United States Patent 11,421,016 (CANCER NEOEPITOPES) - sequence listing, part 25

SEQ ID NO: 1108943 - protein, 9 aa, Homo Sapiens
IGSYVPGPC

SEQ ID NO: 1108944 - protein, 9 aa, Homo Sapiens
MNNGLTNQI

SEQ ID NO: 1108945 - protein, 9 aa, Homo Sapiens
REMAPFLRY

SEQ ID NO: 1108946 - protein, 9 aa, Homo Sapiens
VSQLQTSIG

SEQ ID NO: 1108947 - protein, 9 aa, Homo Sapiens
PPFDDIVDT

SEQ ID NO: 1108948 - protein, 9 aa, Homo Sapiens
KIAQLRELM

SEQ ID NO: 1108949 - protein, 9 aa, Homo Sapiens
PREDEEEVM

SEQ ID NO: 1108950 - protein, 9 aa, Homo Sapiens
ECFFNFCGL

SEQ ID NO: 1108951 - protein, 9 aa, Homo Sapiens
HEVPGHPLG

SEQ ID NO: 1108952 - protein, 9 aa, Homo Sapiens
ICSQMQFCQ

SEQ ID NO: 1108953 - protein, 9 aa, Homo Sapiens
ALSTVPAVL

SEQ ID NO: 1108954 - protein, 9 aa, Homo Sapiens
RSPLPPPST

SEQ ID NO: 1108955 - protein, 9 aa, Homo Sapiens
TVPAVLLVL

SEQ ID NO: 1108956 - protein, 9 aa, Homo Sapiens
VEAYMRALE

SEQ ID NO: 1108957 - protein, 9 aa, Homo Sapiens
PQVEMVQNG

SEQ ID NO: 1108958 - protein, 9 aa, Homo Sapiens
ELITTVEER

SEQ ID NO: 1108959 - protein, 9 aa, Homo Sapiens
ETHSSTSDS

SEQ ID NO: 1108960 - protein, 9 aa, Homo Sapiens
CSQMQFCQP

SEQ ID NO: 1108961 - protein, 9 aa, Homo Sapiens
WMTAIYDAD

SEQ ID NO: 1108962 - protein, 9 aa, Homo Sapiens
DQEDHCSEE

SEQ ID NO: 1108963 - protein, 9 aa, Homo Sapiens
QVAVARVPL

SEQ ID NO: 1108964 - protein, 9 aa, Homo Sapiens
RWNYRFFYA

SEQ ID NO: 1108965 - protein, 9 aa, Homo Sapiens
LFGGGSWGS

SEQ ID NO: 1108966 - protein, 9 aa, Homo Sapiens
PDELITTVE

SEQ ID NO: 1108967 - protein, 9 aa, Homo Sapiens
ALLYLEMQK

SEQ ID NO: 1108968 - protein, 9 aa, Homo Sapiens
RHSVVVPCE

SEQ ID NO: 1108969 - protein, 9 aa, Homo Sapiens
MSMSMAACP

SEQ ID NO: 1108970 - protein, 9 aa, Homo Sapiens
EMPEYENLP

SEQ ID NO: 1108971 - protein, 9 aa, Homo Sapiens
NHNDGLGNA

SEQ ID NO: 1108972 - protein, 9 aa, Homo Sapiens
WYSHLTRHK

SEQ ID NO: 1108973 - protein, 9 aa, Homo Sapiens
DMDVLYIVS

SEQ ID NO: 1108974 - protein, 9 aa, Homo Sapiens
LLLTRMAFC

SEQ ID NO: 1108975 - protein, 9 aa, Homo Sapiens
IVTDGRVRK

SEQ ID NO: 1108976 - protein, 9 aa, Homo Sapiens
LLEACCTDG

SEQ ID NO: 1108977 - protein, 9 aa, Homo Sapiens
FELVGQEAI

SEQ ID NO: 1108978 - protein, 9 aa, Homo Sapiens
TMHLAQTPF

SEQ ID NO: 1108979 - protein, 9 aa, Homo Sapiens
ASKHFEESK

SEQ ID NO: 1108980 - protein, 9 aa, Homo Sapiens
RRVSIWDPR

SEQ ID NO: 1108981 - protein, 9 aa, Homo Sapiens
KSNPDELIT

SEQ ID NO: 1108982 - protein, 9 aa, Homo Sapiens
SPEKPHFQA

SEQ ID NO: 1108983 - protein, 9 aa, Homo Sapiens
GAGKHGEMS

SEQ ID NO: 1108984 - protein, 9 aa, Homo Sapiens
KKYLEQSCP

SEQ ID NO: 1108985 - protein, 9 aa, Homo Sapiens
EEMPEYENL

SEQ ID NO: 1108986 - protein, 9 aa, Homo Sapiens
SPVQSGLLG

SEQ ID NO: 1108987 - protein, 9 aa, Homo Sapiens
SGMNGHVTC

SEQ ID NO: 1108988 - protein, 9 aa, Homo Sapiens
AHLFQNGSL

SEQ ID NO: 1108989 - protein, 9 aa, Homo Sapiens
EVKEKPSSK

SEQ ID NO: 1108990 - protein, 9 aa, Homo Sapiens
CADITSTVS

SEQ ID NO: 1108991 - protein, 9 aa, Homo Sapiens
WQVSLPELE

SEQ ID NO: 1108992 - protein, 9 aa, Homo Sapiens
PLLSIFSQV

SEQ ID NO: 1108993 - protein, 9 aa, Homo Sapiens
DTFTLDYRY

SEQ ID NO: 1108994 - protein, 9 aa, Homo Sapiens
ILIRCTMLN

SEQ ID NO: 1108995 - protein, 9 aa, Homo Sapiens
DHCSEEKSK

SEQ ID NO: 1108996 - protein, 9 aa, Homo Sapiens
ATSSVKPQH

SEQ ID NO: 1108997 - protein, 9 aa, Homo Sapiens
AYIETPFMK

SEQ ID NO: 1108998 - protein, 9 aa, Homo Sapiens
ERERERESL

SEQ ID NO: 1108999 - protein, 9 aa, Homo Sapiens
LNELTCICM

SEQ ID NO: 1109000 - protein, 9 aa, Homo Sapiens
AHMEASLTY

SEQ ID NO: 1109001 - protein, 9 aa, Homo Sapiens
ARRRRQSYS

SEQ ID NO: 1109002 - protein, 9 aa, Homo Sapiens
LPTAVTNGF

SEQ ID NO: 1109003 - protein, 9 aa, Homo Sapiens
TNGFNSTND

SEQ ID NO: 1109004 - protein, 9 aa, Homo Sapiens
EACCTDGHR

SEQ ID NO: 1109005 - protein, 9 aa, Homo Sapiens
SEEAVEAYM

SEQ ID NO: 1109006 - protein, 9 aa, Homo Sapiens
ACCTDGHRM

SEQ ID NO: 1109007 - protein, 9 aa, Homo Sapiens
KWYSHLTRH

SEQ ID NO: 1109008 - protein, 9 aa, Homo Sapiens
RDSGMNGHV

SEQ ID NO: 1109009 - protein, 9 aa, Homo Sapiens
LGGDMGQQM

SEQ ID NO: 1109010 - protein, 9 aa, Homo Sapiens
MDLRVYGPA

SEQ ID NO: 1109011 - protein, 9 aa, Homo Sapiens
HWEEGVTHP

SEQ ID NO: 1109012 - protein, 9 aa, Homo Sapiens
YLEMQKGGL

SEQ ID NO: 1109013 - protein, 9 aa, Homo Sapiens
NEFIITQHH

SEQ ID NO: 1109014 - protein, 9 aa, Homo Sapiens
LTDLHPSVR

SEQ ID NO: 1109015 - protein, 9 aa, Homo Sapiens
GSPASASQV

SEQ ID NO: 1109016 - protein, 9 aa, Homo Sapiens
MRALEIQPG

SEQ ID NO: 1109017 - protein, 9 aa, Homo Sapiens
LEVKHTREM

SEQ ID NO: 1109018 - protein, 9 aa, Homo Sapiens
ATAANLSRA

SEQ ID NO: 1109019 - protein, 9 aa, Homo Sapiens
TCHAETSSG

SEQ ID NO: 1109020 - protein, 9 aa, Homo Sapiens
AAMDLELQN

SEQ ID NO: 1109021 - protein, 9 aa, Homo Sapiens
GTCHAETSS

SEQ ID NO: 1109022 - protein, 9 aa, Homo Sapiens
LRYQERSLI

SEQ ID NO: 1109023 - protein, 9 aa, Homo Sapiens
WEPRKLLTQ

SEQ ID NO: 1109024 - protein, 9 aa, Homo Sapiens
SGRRALSTV

SEQ ID NO: 1109025 - protein, 9 aa, Homo Sapiens
GSYVPGPCS

SEQ ID NO: 1109026 - protein, 9 aa, Homo Sapiens
FGRVAEDTF

SEQ ID NO: 1109027 - protein, 9 aa, Homo Sapiens
PELEDRLQC

SEQ ID NO: 1109028 - protein, 9 aa, Homo Sapiens
RRQSYSPMR

SEQ ID NO: 1109029 - protein, 9 aa, Homo Sapiens
ISDQEDHCS

SEQ ID NO: 1109030 - protein, 9 aa, Homo Sapiens
GWLAQKAFE

SEQ ID NO: 1109031 - protein, 9 aa, Homo Sapiens
YEPHSPGGY

SEQ ID NO: 1109032 - protein, 9 aa, Homo Sapiens
QDYKDICSQ

SEQ ID NO: 1109033 - protein, 9 aa, Homo Sapiens
EETPFSWLI

SEQ ID NO: 1109034 - protein, 9 aa, Homo Sapiens
AQCRGRFVC

SEQ ID NO: 1109035 - protein, 9 aa, Homo Sapiens
PTCFLGLLA

SEQ ID NO: 1109036 - protein, 9 aa, Homo Sapiens
TDGRVRKLV

SEQ ID NO: 1109037 - protein, 9 aa, Homo Sapiens
GPLPPPRPS

SEQ ID NO: 1109038 - protein, 9 aa, Homo Sapiens
PTSPAYEPH

SEQ ID NO: 1109039 - protein, 9 aa, Homo Sapiens
WNYRFFYAF

SEQ ID NO: 1109040 - protein, 9 aa, Homo Sapiens
QHHLLHTIK

SEQ ID NO: 1109041 - protein, 9 aa, Homo Sapiens
NWPEDMDVL

SEQ ID NO: 1109042 - protein, 9 aa, Homo Sapiens
VPGPCSRSP

SEQ ID NO: 1109043 - protein, 9 aa, Homo Sapiens
CGICDENRA

SEQ ID NO: 1109044 - protein, 9 aa, Homo Sapiens
VVPCEPPEV

SEQ ID NO: 1109045 - protein, 9 aa, Homo Sapiens
QGTSTKNSE

SEQ ID NO: 1109046 - protein, 9 aa, Homo Sapiens
QVVHVGGEE

SEQ ID NO: 1109047 - protein, 9 aa, Homo Sapiens
DEDEDYYKQ

SEQ ID NO: 1109048 - protein, 9 aa, Homo Sapiens
EGGRRVSIW

SEQ ID NO: 1109049 - protein, 9 aa, Homo Sapiens
RYQERSLIP

SEQ ID NO: 1109050 - protein, 9 aa, Homo Sapiens
YVSQLQTSI

SEQ ID NO: 1109051 - protein, 9 aa, Homo Sapiens
GLLGMQNLK

SEQ ID NO: 1109052 - protein, 9 aa, Homo Sapiens
VKLIDRNNN

SEQ ID NO: 1109053 - protein, 9 aa, Homo Sapiens
WAEGGRRVS

SEQ ID NO: 1109054 - protein, 9 aa, Homo Sapiens
LQGTSTKNS

SEQ ID NO: 1109055 - protein, 9 aa, Homo Sapiens
YRGFSAPYE

SEQ ID NO: 1109056 - protein, 9 aa, Homo Sapiens
QPFIQDDYY

SEQ ID NO: 1109057 - protein, 9 aa, Homo Sapiens
TLLLTRMAF

SEQ ID NO: 1109058 - protein, 9 aa, Homo Sapiens
HLFAWTSAT

SEQ ID NO: 1109059 - protein, 9 aa, Homo Sapiens
KGRQLQGCL

SEQ ID NO: 1109060 - protein, 9 aa, Homo Sapiens
GGLFGGGSW

SEQ ID NO: 1109061 - protein, 9 aa, Homo Sapiens
YKDICSQMQ

SEQ ID NO: 1109062 - protein, 9 aa, Homo Sapiens
LEKLVAHME

SEQ ID NO: 1109063 - protein, 9 aa, Homo Sapiens
ACLAYTLAC

SEQ ID NO: 1109064 - protein, 9 aa, Homo Sapiens
DGRPQVVHV

SEQ ID NO: 1109065 - protein, 9 aa, Homo Sapiens
AQKSRNGDK

SEQ ID NO: 1109066 - protein, 9 aa, Homo Sapiens
LAYTLACVY

SEQ ID NO: 1109067 - protein, 9 aa, Homo Sapiens
LSIFSQVPG

SEQ ID NO: 1109068 - protein, 9 aa, Homo Sapiens
MVATKIVEL

SEQ ID NO: 1109069 - protein, 9 aa, Homo Sapiens
VGNCVGRWN

SEQ ID NO: 1109070 - protein, 9 aa, Homo Sapiens
RQLQGCLGA

SEQ ID NO: 1109071 - protein, 9 aa, Homo Sapiens
QKRLTKGEA

SEQ ID NO: 1109072 - protein, 9 aa, Homo Sapiens
MAPFLRYQE

SEQ ID NO: 1109073 - protein, 9 aa, Homo Sapiens
KAYIYRVIQ

SEQ ID NO: 1109074 - protein, 9 aa, Homo Sapiens
HSVVVPCEP

SEQ ID NO: 1109075 - protein, 9 aa, Homo Sapiens
LLQGTSTKN

SEQ ID NO: 1109076 - protein, 9 aa, Homo Sapiens
SAPSWMTAI

SEQ ID NO: 1109077 - protein, 9 aa, Homo Sapiens
QNIAEKFSQ

SEQ ID NO: 1109078 - protein, 9 aa, Homo Sapiens
EDEDYYKQR

SEQ ID NO: 1109079 - protein, 9 aa, Homo Sapiens
RAAADLECF

SEQ ID NO: 1109080 - protein, 9 aa, Homo Sapiens
HPLGGDMGQ

SEQ ID NO: 1109081 - protein, 9 aa, Homo Sapiens
AAADLECFF

SEQ ID NO: 1109082 - protein, 9 aa, Homo Sapiens
APSWMTAIY

SEQ ID NO: 1109083 - protein, 9 aa, Homo Sapiens
PKGLLEVWE

SEQ ID NO: 1109084 - protein, 9 aa, Homo Sapiens
AEGSPQKRL

SEQ ID NO: 1109085 - protein, 9 aa, Homo Sapiens
IQTLVDVIT

SEQ ID NO: 1109086 - protein, 9 aa, Homo Sapiens
FRSYVDTAL

SEQ ID NO: 1109087 - protein, 9 aa, Homo Sapiens
AVLAFPDDM

SEQ ID NO: 1109088 - protein, 9 aa, Homo Sapiens
NSFWNVSTQ

SEQ ID NO: 1109089 - protein, 9 aa, Homo Sapiens
SDRDSGMNG

SEQ ID NO: 1109090 - protein, 9 aa, Homo Sapiens
ECGKAFKWY

SEQ ID NO: 1109091 - protein, 9 aa, Homo Sapiens
EKPSSKREH

SEQ ID NO: 1109092 - protein, 9 aa, Homo Sapiens
SATSSVKPQ

SEQ ID NO: 1109093 - protein, 9 aa, Homo Sapiens
RAQKSRNGD

SEQ ID NO: 1109094 - protein, 9 aa, Homo Sapiens
LSVTSNSSF

SEQ ID NO: 1109095 - protein, 9 aa, Homo Sapiens
GEMSMSMAA

SEQ ID NO: 1109096 - protein, 9 aa, Homo Sapiens
LLKLEVKHT

SEQ ID NO: 1109097 - protein, 9 aa, Homo Sapiens
NYIRVLLLG

SEQ ID NO: 1109098 - protein, 9 aa, Homo Sapiens
ITTVEERKS

SEQ ID NO: 1109099 - protein, 9 aa, Homo Sapiens
RALSTVPAV

SEQ ID NO: 1109100 - protein, 9 aa, Homo Sapiens
VITKRKGHI

SEQ ID NO: 1109101 - protein, 9 aa, Homo Sapiens
LALLTDLHP

SEQ ID NO: 1109102 - protein, 9 aa, Homo Sapiens
SHLEQKSKR

SEQ ID NO: 1109103 - protein, 9 aa, Homo Sapiens
KHFEESKEI

SEQ ID NO: 1109104 - protein, 9 aa, Homo Sapiens
EVPGHPLGG

SEQ ID NO: 1109105 - protein, 9 aa, Homo Sapiens
WGSRDWRCL

SEQ ID NO: 1109106 - protein, 9 aa, Homo Sapiens
IFSQVPGSE

SEQ ID NO: 1109107 - protein, 9 aa, Homo Sapiens
AKYVKIRYD

SEQ ID NO: 1109108 - protein, 9 aa, Homo Sapiens
SDISKQAAD

SEQ ID NO: 1109109 - protein, 9 aa, Homo Sapiens
SQLQTSIGV

SEQ ID NO: 1109110 - protein, 9 aa, Homo Sapiens
LSTVPAVLL

SEQ ID NO: 1109111 - protein, 9 aa, Homo Sapiens
GCSHVCSRT

SEQ ID NO: 1109112 - protein, 9 aa, Homo Sapiens
DGPPLAPVA

SEQ ID NO: 1109113 - protein, 9 aa, Homo Sapiens
DITTLNSFW

SEQ ID NO: 1109114 - protein, 9 aa, Homo Sapiens
HSPGGYTPQ

SEQ ID NO: 1109115 - protein, 9 aa, Homo Sapiens
NIKPLLSIF

SEQ ID NO: 1109116 - protein, 9 aa, Homo Sapiens
VWKWITKKP

SEQ ID NO: 1109117 - protein, 9 aa, Homo Sapiens
VDMAIAEET

SEQ ID NO: 1109118 - protein, 9 aa, Homo Sapiens
ESLGGAGKH

SEQ ID NO: 1109119 - protein, 9 aa, Homo Sapiens
QSYSPMRKR

SEQ ID NO: 1109120 - protein, 9 aa, Homo Sapiens
SSKQKKYLE

SEQ ID NO: 1109121 - protein, 9 aa, Homo Sapiens
SKMAQCRGR

SEQ ID NO: 1109122 - protein, 9 aa, Homo Sapiens
GMNGHVTCS

SEQ ID NO: 1109123 - protein, 9 aa, Homo Sapiens
DISDQEDHC

SEQ ID NO: 1109124 - protein, 9 aa, Homo Sapiens
YAKLKKSKI

SEQ ID NO: 1109125 - protein, 9 aa, Homo Sapiens
TLEKLVAHM

SEQ ID NO: 1109126 - protein, 9 aa, Homo Sapiens
AFKWYSHLT

SEQ ID NO: 1109127 - protein, 9 aa, Homo Sapiens
KALALLTDL

SEQ ID NO: 1109128 - protein, 9 aa, Homo Sapiens
GFCTLVCPL

SEQ ID NO: 1109129 - protein, 9 aa, Homo Sapiens
HCSEEKSKE

SEQ ID NO: 1109130 - protein, 9 aa, Homo Sapiens
SNPDELITT

SEQ ID NO: 1109131 - protein, 9 aa, Homo Sapiens
TTLNSFWNV

SEQ ID NO: 1109132 - protein, 9 aa, Homo Sapiens
LSNWPEDMD

SEQ ID NO: 1109133 - protein, 9 aa, Homo Sapiens
EKLVAHMEA

SEQ ID NO: 1109134 - protein, 9 aa, Homo Sapiens
TSHLQMKFP

SEQ ID NO: 1109135 - protein, 9 aa, Homo Sapiens
PPPTPPPCG

SEQ ID NO: 1109136 - protein, 9 aa, Homo Sapiens
CAATLGGGG

SEQ ID NO: 1109137 - protein, 9 aa, Homo Sapiens
IRFDQLHWE

SEQ ID NO: 1109138 - protein, 9 aa, Homo Sapiens
QNYIRVLLL

SEQ ID NO: 1109139 - protein, 9 aa, Homo Sapiens
DTNDSDVEE

SEQ ID NO: 1109140 - protein, 9 aa, Homo Sapiens
GFSAPYEGS

SEQ ID NO: 1109141 - protein, 9 aa, Homo Sapiens
VKHTREMLH

SEQ ID NO: 1109142 - protein, 9 aa, Homo Sapiens
EWDITTLNS

SEQ ID NO: 1109143 - protein, 9 aa, Homo Sapiens
NNGLTNQIN

SEQ ID NO: 1109144 - protein, 9 aa, Homo Sapiens
IDRNNNAPS

SEQ ID NO: 1109145 - protein, 9 aa, Homo Sapiens
VKEKPSSKR

SEQ ID NO: 1109146 - protein, 9 aa, Homo Sapiens
LSTDVGFCT

SEQ ID NO: 1109147 - protein, 9 aa, Homo Sapiens
PPTPPPCGA

SEQ ID NO: 1109148 - protein, 9 aa, Homo Sapiens
LAFPDDMDL

SEQ ID NO: 1109149 - protein, 9 aa, Homo Sapiens
LCGICDENR

SEQ ID NO: 1109150 - protein, 9 aa, Homo Sapiens
GISGSDISK

SEQ ID NO: 1109151 - protein, 9 aa, Homo Sapiens
SLGGAGKHG

SEQ ID NO: 1109152 - protein, 9 aa, Homo Sapiens
GLFGGGSWG

SEQ ID NO: 1109153 - protein, 9 aa, Homo Sapiens
PYECEIRDQ

SEQ ID NO: 1109154 - protein, 9 aa, Homo Sapiens
IRYDFTARN

SEQ ID NO: 1109155 - protein, 9 aa, Homo Sapiens
ALALLTDLH

SEQ ID NO: 1109156 - protein, 9 aa, Homo Sapiens
PGDCASHLC

SEQ ID NO: 1109157 - protein, 9 aa, Homo Sapiens
DLECFFNFC

SEQ ID NO: 1109158 - protein, 9 aa, Homo Sapiens
DIKENKDGK

SEQ ID NO: 1109159 - protein, 9 aa, Homo Sapiens
KGWKWKDKD

SEQ ID NO: 1109160 - protein, 9 aa, Homo Sapiens
FALLYLEMQ

SEQ ID NO: 1109161 - protein, 9 aa, Homo Sapiens
TALFTQSCI

SEQ ID NO: 1109162 - protein, 9 aa, Homo Sapiens
KGLLEVWEA

SEQ ID NO: 1109163 - protein, 9 aa, Homo Sapiens
DGLLLLGTC

SEQ ID NO: 1109164 - protein, 9 aa, Homo Sapiens
GRLGLGGQI

SEQ ID NO: 1109165 - protein, 9 aa, Homo Sapiens
GTCAATLGG

SEQ ID NO: 1109166 - protein, 9 aa, Homo Sapiens
RSRQSGTCH

SEQ ID NO: 1109167 - protein, 9 aa, Homo Sapiens
LVDVITKRK

SEQ ID NO: 1109168 - protein, 9 aa, Homo Sapiens
GGWAEGGRR

SEQ ID NO: 1109169 - protein, 9 aa, Homo Sapiens
PDTMLPTCF

SEQ ID NO: 1109170 - protein, 9 aa, Homo Sapiens
PVAAVPGPP

SEQ ID NO: 1109171 - protein, 9 aa, Homo Sapiens
LTCICMVGI

SEQ ID NO: 1109172 - protein, 9 aa, Homo Sapiens
FKCFLINKV

SEQ ID NO: 1109173 - protein, 9 aa, Homo Sapiens
PGYPALLWA

SEQ ID NO: 1109174 - protein, 9 aa, Homo Sapiens
PEIMNNGLT

SEQ ID NO: 1109175 - protein, 9 aa, Homo Sapiens
FSAPSWMTA

SEQ ID NO: 1109176 - protein, 9 aa, Homo Sapiens
AYWEPRKLL

SEQ ID NO: 1109177 - protein, 9 aa, Homo Sapiens
ADLECFFNF

SEQ ID NO: 1109178 - protein, 9 aa, Homo Sapiens
RRRQSYSPM

SEQ ID NO: 1109179 - protein, 9 aa, Homo Sapiens
DYAPCRSQD

SEQ ID NO: 1109180 - protein, 9 aa, Homo Sapiens
DDIVDTNDS

SEQ ID NO: 1109181 - protein, 9 aa, Homo Sapiens
YIYRVIQTT

SEQ ID NO: 1109182 - protein, 9 aa, Homo Sapiens
IGGIDGRLG

SEQ ID NO: 1109183 - protein, 9 aa, Homo Sapiens
VVVPCEPPE

SEQ ID NO: 1109184 - protein, 9 aa, Homo Sapiens
IQTTGYLLF

SEQ ID NO: 1109185 - protein, 9 aa, Homo Sapiens
GSPQKRLTK

SEQ ID NO: 1109186 - protein, 9 aa, Homo Sapiens
YEIVTDGRV

SEQ ID NO: 1109187 - protein, 9 aa, Homo Sapiens
TLNSFWNVS

SEQ ID NO: 1109188 - protein, 9 aa, Homo Sapiens
SPLPPPSTS

SEQ ID NO: 1109189 - protein, 9 aa, Homo Sapiens
RFDQLHWEY

SEQ ID NO: 1109190 - protein, 9 aa, Homo Sapiens
YPALLWAKA

SEQ ID NO: 1109191 - protein, 9 aa, Homo Sapiens
EMSMSMAAC

SEQ ID NO: 1109192 - protein, 9 aa, Homo Sapiens
KTVDYAPCR

SEQ ID NO: 1109193 - protein, 9 aa, Homo Sapiens
VGRWNYRFF

SEQ ID NO: 1109194 - protein, 9 aa, Homo Sapiens
MPEYENLPF

SEQ ID NO: 1109195 - protein, 9 aa, Homo Sapiens
CHAETSSGG

SEQ ID NO: 1109196 - protein, 9 aa, Homo Sapiens
MMCSEDKVQ

SEQ ID NO: 1109197 - protein, 9 aa, Homo Sapiens
KRADIKENK

SEQ ID NO: 1109198 - protein, 9 aa, Homo Sapiens
LGDSLMAGN

SEQ ID NO: 1109199 - protein, 9 aa, Homo Sapiens
GLVGNSDLS

SEQ ID NO: 1109200 - protein, 9 aa, Homo Sapiens
STDVGFCTL

SEQ ID NO: 1109201 - protein, 9 aa, Homo Sapiens
IRHYEEMPE

SEQ ID NO: 1109202 - protein, 9 aa, Homo Sapiens
YIRVLLLGG

SEQ ID NO: 1109203 - protein, 9 aa, Homo Sapiens
KNIKPLLSI

SEQ ID NO: 1109204 - protein, 9 aa, Homo Sapiens
RPQVVHVGG

SEQ ID NO: 1109205 - protein, 9 aa, Homo Sapiens
LHLPGSRGS

SEQ ID NO: 1109206 - protein, 9 aa, Homo Sapiens
EAITCQKNN

SEQ ID NO: 1109207 - protein, 9 aa, Homo Sapiens
TCAATLGGG

SEQ ID NO: 1109208 - protein, 9 aa, Homo Sapiens
QGCLGAKKH

SEQ ID NO: 1109209 - protein, 9 aa, Homo Sapiens
LPPPSTSHL

SEQ ID NO: 1109210 - protein, 9 aa, Homo Sapiens
LVGQEAITC

SEQ ID NO: 1109211 - protein, 9 aa, Homo Sapiens
PLGGDMGQQ

SEQ ID NO: 1109212 - protein, 9 aa, Homo Sapiens
ITTLNSFWN

SEQ ID NO: 1109213 - protein, 9 aa, Homo Sapiens
DVLLEACCT

SEQ ID NO: 1109214 - protein, 9 aa, Homo Sapiens
KYVKIRYDF

SEQ ID NO: 1109215 - protein, 9 aa, Homo Sapiens
TDGHRMATH

SEQ ID NO: 1109216 - protein, 9 aa, Homo Sapiens
SHVCSRTPV

SEQ ID NO: 1109217 - protein, 9 aa, Homo Sapiens
KMAQCRGRF

SEQ ID NO: 1109218 - protein, 9 aa, Homo Sapiens
EIVTDGRVR

SEQ ID NO: 1109219 - protein, 9 aa, Homo Sapiens
LPEIMNNGL

SEQ ID NO: 1109220 - protein, 9 aa, Homo Sapiens
GDSLMAGNG

SEQ ID NO: 1109221 - protein, 9 aa, Homo Sapiens
SDQEDHCSE

SEQ ID NO: 1109222 - protein, 9 aa, Homo Sapiens
PSPRPPVPP

SEQ ID NO: 1109223 - protein, 9 aa, Homo Sapiens
TMEQIKVDM

SEQ ID NO: 1109224 - protein, 9 aa, Homo Sapiens
LQNIAEKFS

SEQ ID NO: 1109225 - protein, 9 aa, Homo Sapiens
TSIGVQAEA

SEQ ID NO: 1109226 - protein, 9 aa, Homo Sapiens
GWAEGGRRV

SEQ ID NO: 1109227 - protein, 9 aa, Homo Sapiens
DIANVLSHL

SEQ ID NO: 1109228 - protein, 9 aa, Homo Sapiens
QNGSLLVGE

SEQ ID NO: 1109229 - protein, 9 aa, Homo Sapiens
FIQDDYYYH

SEQ ID NO: 1109230 - protein, 9 aa, Homo Sapiens
SEDKVQKAT

SEQ ID NO: 1109231 - protein, 9 aa, Homo Sapiens
GWKWKDKDI

SEQ ID NO: 1109232 - protein, 9 aa, Homo Sapiens
AYTLACVYG

SEQ ID NO: 1109233 - protein, 9 aa, Homo Sapiens
RVSIWDPRR

SEQ ID NO: 1109234 - protein, 9 aa, Homo Sapiens
IITQHHLLH

SEQ ID NO: 1109235 - protein, 9 aa, Homo Sapiens
LMAGNGAGS

SEQ ID NO: 1109236 - protein, 9 aa, Homo Sapiens
LQGEDFQSS

SEQ ID NO: 1109237 - protein, 9 aa, Homo Sapiens
QCRGRFVCP

SEQ ID NO: 1109238 - protein, 9 aa, Homo Sapiens
LIRCTMLNP

SEQ ID NO: 1109239 - protein, 9 aa, Homo Sapiens
EKIAQLREL

SEQ ID NO: 1109240 - protein, 9 aa, Homo Sapiens
RSYVDTALF

SEQ ID NO: 1109241 - protein, 9 aa, Homo Sapiens
TFFQGNHND

SEQ ID NO: 1109242 - protein, 9 aa, Homo Sapiens
MAQCRGRFV

SEQ ID NO: 1109243 - protein, 9 aa, Homo Sapiens
FFQGNHNDG

SEQ ID NO: 1109244 - protein, 9 aa, Homo Sapiens
IRLTFFQGN

SEQ ID NO: 1109245 - protein, 9 aa, Homo Sapiens
RYRDDEDED

SEQ ID NO: 1109246 - protein, 9 aa, Homo Sapiens
VYDEKAKEK

SEQ ID NO: 1109247 - protein, 9 aa, Homo Sapiens
MCSEDKVQK

SEQ ID NO: 1109248 - protein, 9 aa, Homo Sapiens
SEATAANLS

SEQ ID NO: 1109249 - protein, 9 aa, Homo Sapiens
SVTSNSSFA

SEQ ID NO: 1109250 - protein, 9 aa, Homo Sapiens
VAGDMVATK

SEQ ID NO: 1109251 - protein, 9 aa, Homo Sapiens
ICDENRAND

SEQ ID NO: 1109252 - protein, 9 aa, Homo Sapiens
PTLEKLVAH

SEQ ID NO: 1109253 - protein, 9 aa, Homo Sapiens
PEKPHFQAL

SEQ ID NO: 1109254 - protein, 9 aa, Homo Sapiens
LPELEDRLQ

SEQ ID NO: 1109255 - protein, 9 aa, Homo Sapiens
KKAEGSPQK

SEQ ID NO: 1109256 - protein, 9 aa, Homo Sapiens
EEENGEVYQ

SEQ ID NO: 1109257 - protein, 9 aa, Homo Sapiens
DISKQAADM

SEQ ID NO: 1109258 - protein, 9 aa, Homo Sapiens
LKGVWKWIT

SEQ ID NO: 1109259 - protein, 9 aa, Homo Sapiens
VIQTTGYLL

SEQ ID NO: 1109260 - protein, 9 aa, Homo Sapiens
KVQKATGKR

SEQ ID NO: 1109261 - protein, 9 aa, Homo Sapiens
EEGVTHPPK

SEQ ID NO: 1109262 - protein, 9 aa, Homo Sapiens
SLMAGNGAG

SEQ ID NO: 1109263 - protein, 9 aa, Homo Sapiens
CASHLCQNG

SEQ ID NO: 1109264 - protein, 9 aa, Homo Sapiens
LQDGTKTVD

SEQ ID NO: 1109265 - protein, 9 aa, Homo Sapiens
CSEDKVQKA

SEQ ID NO: 1109266 - protein, 9 aa, Homo Sapiens
GEKIAQLRE

SEQ ID NO: 1109267 - protein, 9 aa, Homo Sapiens
KKGYNVYDE

SEQ ID NO: 1109268 - protein, 9 aa, Homo Sapiens
RPSPRPPVP

SEQ ID NO: 1109269 - protein, 9 aa, Homo Sapiens
NCVGRWNYR

SEQ ID NO: 1109270 - protein, 9 aa, Homo Sapiens
QTTGYLLFI

SEQ ID NO: 1109271 - protein, 9 aa, Homo Sapiens
PFDDIVDTN

SEQ ID NO: 1109272 - protein, 9 aa, Homo Sapiens
RQSYSPMRK

SEQ ID NO: 1109273 - protein, 9 aa, Homo Sapiens
CVYGVESDL

SEQ ID NO: 1109274 - protein, 9 aa, Homo Sapiens
MQKGGLRNQ

SEQ ID NO: 1109275 - protein, 9 aa, Homo Sapiens
GCLGAKKHE

SEQ ID NO: 1109276 - protein, 9 aa, Homo Sapiens
GLLLLGTCA

SEQ ID NO: 1109277 - protein, 9 aa, Homo Sapiens
CKHWEEGVT

SEQ ID NO: 1109278 - protein, 9 aa, Homo Sapiens
KYEIVTDGR

SEQ ID NO: 1109279 - protein, 9 aa, Homo Sapiens
CTDGHRMAT

SEQ ID NO: 1109280 - protein, 9 aa, Homo Sapiens
KAEGSPQKR

SEQ ID NO: 1109281 - protein, 9 aa, Homo Sapiens
KSREFIETH

SEQ ID NO: 1109282 - protein, 9 aa, Homo Sapiens
LHWEYCLSP

SEQ ID NO: 1109283 - protein, 9 aa, Homo Sapiens
TPFSWLIAQ

SEQ ID NO: 1109284 - protein, 9 aa, Homo Sapiens
YEEMPEYEN

SEQ ID NO: 1109285 - protein, 9 aa, Homo Sapiens
FQNGSLLVG

SEQ ID NO: 1109286 - protein, 9 aa, Homo Sapiens
PRPSPRPPV

SEQ ID NO: 1109287 - protein, 9 aa, Homo Sapiens
RYLPEIMNN

SEQ ID NO: 1109288 - protein, 9 aa, Homo Sapiens
EENGEVYQA

SEQ ID NO: 1109289 - protein, 9 aa, Homo Sapiens
LELQNIAEK

SEQ ID NO: 1109290 - protein, 9 aa, Homo Sapiens
PDDMDLRVY

SEQ ID NO: 1109291 - protein, 9 aa, Homo Sapiens
SRNGDKEDK

SEQ ID NO: 1109292 - protein, 9 aa, Homo Sapiens
VDYAPCRSQ

SEQ ID NO: 1109293 - protein, 9 aa, Homo Sapiens
CSHVCSRTP

SEQ ID NO: 1109294 - protein, 9 aa, Homo Sapiens
DDYYYHGYV

SEQ ID NO: 1109295 - protein, 9 aa, Homo Sapiens
GGAGKHGEM

SEQ ID NO: 1109296 - protein, 9 aa, Homo Sapiens
CSRSPSLNR

SEQ ID NO: 1109297 - protein, 9 aa, Homo Sapiens
FIQTLVDVI

SEQ ID NO: 1109298 - protein, 9 aa, Homo Sapiens
PLQGEDFQS

SEQ ID NO: 1109299 - protein, 9 aa, Homo Sapiens
YEGSSTLTH

SEQ ID NO: 1109300 - protein, 9 aa, Homo Sapiens
CGKAFKWYS

SEQ ID NO: 1109301 - protein, 9 aa, Homo Sapiens
AADLECFFN

SEQ ID NO: 1109302 - protein, 9 aa, Homo Sapiens
DVTHQADCK

SEQ ID NO: 1109303 - protein, 9 aa, Homo Sapiens
MTAIYDADN

SEQ ID NO: 1109304 - protein, 9 aa, Homo Sapiens
RDGRPQVVH

SEQ ID NO: 1109305 - protein, 9 aa, Homo Sapiens
GKAEHTNTG

SEQ ID NO: 1109306 - protein, 9 aa, Homo Sapiens
WKDKDISQK

SEQ ID NO: 1109307 - protein, 9 aa, Homo Sapiens
MHLAQTPFI

SEQ ID NO: 1109308 - protein, 9 aa, Homo Sapiens
LFVGLVGNS

SEQ ID NO: 1109309 - protein, 9 aa, Homo Sapiens
FLRYQERSL

SEQ ID NO: 1109310 - protein, 9 aa, Homo Sapiens
SPTVPRSLC

SEQ ID NO: 1109311 - protein, 9 aa, Homo Sapiens
QIKVDMAIA

SEQ ID NO: 1109312 - protein, 9 aa, Homo Sapiens
RNNNAPSIG

SEQ ID NO: 1109313 - protein, 9 aa, Homo Sapiens
PSTSHLQMK

SEQ ID NO: 1109314 - protein, 9 aa, Homo Sapiens
ELTCICMVG

SEQ ID NO: 1109315 - protein, 9 aa, Homo Sapiens
ETPFSWLIA

SEQ ID NO: 1109316 - protein, 9 aa, Homo Sapiens
TPFICDCHL

SEQ ID NO: 1109317 - protein, 9 aa, Homo Sapiens
TAGVAGDMV

SEQ ID NO: 1109318 - protein, 9 aa, Homo Sapiens
GRVAEDTFT

SEQ ID NO: 1109319 - protein, 9 aa, Homo Sapiens
GRRVSIWDP

SEQ ID NO: 1109320 - protein, 9 aa, Homo Sapiens
QVEMVQNGS

SEQ ID NO: 1109321 - protein, 9 aa, Homo Sapiens
YRDDEDEDY

SEQ ID NO: 1109322 - protein, 9 aa, Homo Sapiens
CGAHGGQQT

SEQ ID NO: 1109323 - protein, 9 aa, Homo Sapiens
KAEHTNTGT

SEQ ID NO: 1109324 - protein, 9 aa, Homo Sapiens
KFVCKHWEE

SEQ ID NO: 1109325 - protein, 9 aa, Homo Sapiens
LLGTCAATL

SEQ ID NO: 1109326 - protein, 9 aa, Homo Sapiens
EPHSPGGYT

SEQ ID NO: 1109327 - protein, 9 aa, Homo Sapiens
MAKYVKIRY

SEQ ID NO: 1109328 - protein, 9 aa, Homo Sapiens
HLCQNGGSC

SEQ ID NO: 1109329 - protein, 9 aa, Homo Sapiens
GSDISKQAA

SEQ ID NO: 1109330 - protein, 9 aa, Homo Sapiens
RNKYYRKSS

SEQ ID NO: 1109331 - protein, 9 aa, Homo Sapiens
LCQNGGSCE

SEQ ID NO: 1109332 - protein, 9 aa, Homo Sapiens
VKASKHFEE

SEQ ID NO: 1109333 - protein, 9 aa, Homo Sapiens
SLLSVTSNS

SEQ ID NO: 1109334 - protein, 9 aa, Homo Sapiens
RDDEDEDYY

SEQ ID NO: 1109335 - protein, 9 aa, Homo Sapiens
TSPAYEPHS

SEQ ID NO: 1109336 - protein, 9 aa, Homo Sapiens
CPGRPGYPA

SEQ ID NO: 1109337 - protein, 9 aa, Homo Sapiens
MVQNGSSRI

SEQ ID NO: 1109338 - protein, 9 aa, Homo Sapiens
IETHSSTSD

SEQ ID NO: 1109339 - protein, 9 aa, Homo Sapiens
VGQEAITCQ

SEQ ID NO: 1109340 - protein, 9 aa, Homo Sapiens
HGEMSMSMA

SEQ ID NO: 1109341 - protein, 9 aa, Homo Sapiens
RDQDGGMRS

SEQ ID NO: 1109342 - protein, 9 aa, Homo Sapiens
LLARNKYYR

SEQ ID NO: 1109343 - protein, 9 aa, Homo Sapiens
GDMVATKIV

SEQ ID NO: 1109344 - protein, 9 aa, Homo Sapiens
LACVYGVES

SEQ ID NO: 1109345 - protein, 9 aa, Homo Sapiens
SMSMAACPE

SEQ ID NO: 1109346 - protein, 9 aa, Homo Sapiens
NKDGKSRGM

SEQ ID NO: 1109347 - protein, 9 aa, Homo Sapiens
RLTFFQGNH

SEQ ID NO: 1109348 - protein, 9 aa, Homo Sapiens
DRSRQSGTC

SEQ ID NO: 1109349 - protein, 9 aa, Homo Sapiens
AKLKKSKIE

SEQ ID NO: 1109350 - protein, 9 aa, Homo Sapiens
DRDSGMNGH

SEQ ID NO: 1109351 - protein, 9 aa, Homo Sapiens
EGSSTLTHT

SEQ ID NO: 1109352 - protein, 9 aa, Homo Sapiens
SEIKEIEYA

SEQ ID NO: 1109353 - protein, 9 aa, Homo Sapiens
YVKIRYDFT

SEQ ID NO: 1109354 - protein, 9 aa, Homo Sapiens
EEEVMCHGS

SEQ ID NO: 1109355 - protein, 9 aa, Homo Sapiens
DITSTVSIQ

SEQ ID NO: 1109356 - protein, 9 aa, Homo Sapiens
LFTQSCIVH

SEQ ID NO: 1109357 - protein, 9 aa, Homo Sapiens
TAIYDADNG

SEQ ID NO: 1109358 - protein, 9 aa, Homo Sapiens
LLGGDRLFT

SEQ ID NO: 1109359 - protein, 9 aa, Homo Sapiens
RSKMAQCRG

SEQ ID NO: 1109360 - protein, 9 aa, Homo Sapiens
NLSRAPWSL

SEQ ID NO: 1109361 - protein, 9 aa, Homo Sapiens
AQVAVARVP

SEQ ID NO: 1109362 - protein, 9 aa, Homo Sapiens
DKDISQKDM

SEQ ID NO: 1109363 - protein, 9 aa, Homo Sapiens
FYGKAEHTN

SEQ ID NO: 1109364 - protein, 9 aa, Homo Sapiens
EFIITQHHL

SEQ ID NO: 1109365 - protein, 9 aa, Homo Sapiens
CFLINKVDG

SEQ ID NO: 1109366 - protein, 9 aa, Homo Sapiens
KWKDKDISQ

SEQ ID NO: 1109367 - protein, 9 aa, Homo Sapiens
VTHQADCKM

SEQ ID NO: 1109368 - protein, 9 aa, Homo Sapiens
ENRANDFML

SEQ ID NO: 1109369 - protein, 9 aa, Homo Sapiens
WEQQLQQEL

SEQ ID NO: 1109370 - protein, 9 aa, Homo Sapiens
ENIFVKEWQ

SEQ ID NO: 1109371 - protein, 9 aa, Homo Sapiens
TNDSDVEEN

SEQ ID NO: 1109372 - protein, 9 aa, Homo Sapiens
DTALFTQSC

SEQ ID NO: 1109373 - protein, 9 aa, Homo Sapiens
ETPFMKILP

SEQ ID NO: 1109374 - protein, 9 aa, Homo Sapiens
VIDVTHQAD

SEQ ID NO: 1109375 - protein, 9 aa, Homo Sapiens
AQLRELMLE

SEQ ID NO: 1109376 - protein, 9 aa, Homo Sapiens
LLTDLHPSV

SEQ ID NO: 1109377 - protein, 9 aa, Homo Sapiens
EIKEIEYAK

SEQ ID NO: 1109378 - protein, 9 aa, Homo Sapiens
TCFLGLLAF

SEQ ID NO: 1109379 - protein, 9 aa, Homo Sapiens
FKWYSHLTR

SEQ ID NO: 1109380 - protein, 9 aa, Homo Sapiens
DYYYHGYVE

SEQ ID NO: 1109381 - protein, 9 aa, Homo Sapiens
KEIEYAKLK

SEQ ID NO: 1109382 - protein, 9 aa, Homo Sapiens
KIRYDFTAR

SEQ ID NO: 1109383 - protein, 9 aa, Homo Sapiens
NIFVKEWQL

SEQ ID NO: 1109384 - protein, 9 aa, Homo Sapiens
TPFMKILPV

SEQ ID NO: 1109385 - protein, 9 aa, Homo Sapiens
LLLLGTCAA

SEQ ID NO: 1109386 - protein, 9 aa, Homo Sapiens
TLACVYGVE

SEQ ID NO: 1109387 - protein, 9 aa, Homo Sapiens
KKKGYNVYD

SEQ ID NO: 1109388 - protein, 9 aa, Homo Sapiens
SGSEATAAN

SEQ ID NO: 1109389 - protein, 9 aa, Homo Sapiens
GIDGRLGLG

SEQ ID NO: 1109390 - protein, 9 aa, Homo Sapiens
VLAFPDDMD

SEQ ID NO: 1109391 - protein, 9 aa, Homo Sapiens
PQKRLTKGE

SEQ ID NO: 1109392 - protein, 9 aa, Homo Sapiens
SLLVGELYS

SEQ ID NO: 1109393 - protein, 9 aa, Homo Sapiens
RGSPASASQ

SEQ ID NO: 1109394 - protein, 9 aa, Homo Sapiens
MAGNGAGST

SEQ ID NO: 1109395 - protein, 9 aa, Homo Sapiens
SGGLFGGGS

SEQ ID NO: 1109396 - protein, 9 aa, Homo Sapiens
LITTVEERK

SEQ ID NO: 1109397 - protein, 9 aa, Homo Sapiens
PYEGSSTLT

SEQ ID NO: 1109398 - protein, 9 aa, Homo Sapiens
PLPPPSTSH

SEQ ID NO: 1109399 - protein, 9 aa, Homo Sapiens
YLPEIMNNG

SEQ ID NO: 1109400 - protein, 9 aa, Homo Sapiens
QLHWEYCLS

SEQ ID NO: 1109401 - protein, 9 aa, Homo Sapiens
DCASHLCQN

SEQ ID NO: 1109402 - protein, 9 aa, Homo Sapiens
NNAPSIGFV

SEQ ID NO: 1109403 - protein, 9 aa, Homo Sapiens
GDCASHLCQ

SEQ ID NO: 1109404 - protein, 9 aa, Homo Sapiens
PPFKCFLIN

SEQ ID NO: 1109405 - protein, 9 aa, Homo Sapiens
MNGHVTCSL

SEQ ID NO: 1109406 - protein, 9 aa, Homo Sapiens
GPQVEMVQN

SEQ ID NO: 1109407 - protein, 9 aa, Homo Sapiens
AQLLGCSHV

SEQ ID NO: 1109408 - protein, 9 aa, Homo Sapiens
TKTVDYAPC

SEQ ID NO: 1109409 - protein, 9 aa, Homo Sapiens
KSKKYEIVT

SEQ ID NO: 1109410 - protein, 9 aa, Homo Sapiens
TMLPTCFLG

SEQ ID NO: 1109411 - protein, 9 aa, Homo Sapiens
LYLEMQKGG

SEQ ID NO: 1109412 - protein, 9 aa, Homo Sapiens
TLPTAVTNG

SEQ ID NO: 1109413 - protein, 9 aa, Homo Sapiens
QLRELMLEQ

SEQ ID NO: 1109414 - protein, 9 aa, Homo Sapiens
DDMDLRVYG

SEQ ID NO: 1109415 - protein, 9 aa, Homo Sapiens
IDVTHQADC

SEQ ID NO: 1109416 - protein, 9 aa, Homo Sapiens
LLGMQNLKA

SEQ ID NO: 1109417 - protein, 9 aa, Homo Sapiens
KHTREMLHS

SEQ ID NO: 1109418 - protein, 9 aa, Homo Sapiens
DSGMNGHVT

SEQ ID NO: 1109419 - protein, 9 aa, Homo Sapiens
NGDKEDKEP

SEQ ID NO: 1109420 - protein, 9 aa, Homo Sapiens
CEPPEVGSD

SEQ ID NO: 1109421 - protein, 9 aa, Homo Sapiens
LFAWTSATS

SEQ ID NO: 1109422 - protein, 9 aa, Homo Sapiens
RMAFCAQKA

SEQ ID NO: 1109423 - protein, 9 aa, Homo Sapiens
HSGSSKQKK

SEQ ID NO: 1109424 - protein, 9 aa, Homo Sapiens
CLLARNKYY

SEQ ID NO: 1109425 - protein, 9 aa, Homo Sapiens
ISKQAADMI

SEQ ID NO: 1109426 - protein, 9 aa, Homo Sapiens
DICSQMQFC

SEQ ID NO: 1109427 - protein, 9 aa, Homo Sapiens
CCTDGHRMA

SEQ ID NO: 1109428 - protein, 9 aa, Homo Sapiens
LPPPRPSPR

SEQ ID NO: 1109429 - protein, 9 aa, Homo Sapiens
DLDDLFVGL

SEQ ID NO: 1109430 - protein, 9 aa, Homo Sapiens
PPPFKCFLI

SEQ ID NO: 1109431 - protein, 9 aa, Homo Sapiens
EIRDQDGGM

SEQ ID NO: 1109432 - protein, 9 aa, Homo Sapiens
VGSVDPTLW

SEQ ID NO: 1109433 - protein, 9 aa, Homo Sapiens
EDGEKIAQL

SEQ ID NO: 1109434 - protein, 9 aa, Homo Sapiens
RRRRQSYSP

SEQ ID NO: 1109435 - protein, 9 aa, Homo Sapiens
GKAFKWYSH

SEQ ID NO: 1109436 - protein, 9 aa, Homo Sapiens
QGNHNDGLG

SEQ ID NO: 1109437 - protein, 9 aa, Homo Sapiens
MDLELQNIA

SEQ ID NO: 1109438 - protein, 9 aa, Homo Sapiens
LLSIFSQVP

SEQ ID NO: 1109439 - protein, 9 aa, Homo Sapiens
GCLLARNKY

SEQ ID NO: 1109440 - protein, 9 aa, Homo Sapiens
LPTCFLGLL

SEQ ID NO: 1109441 - protein, 9 aa, Homo Sapiens
NPDELITTV

SEQ ID NO: 1109442 - protein, 9 aa, Homo Sapiens
SAPYEGSST

SEQ ID NO: 1109443 - protein, 9 aa, Homo Sapiens
GGGSWGSRD

SEQ ID NO: 1109444 - protein, 9 aa, Homo Sapiens
EHSAYWEPR

SEQ ID NO: 1109445 - protein, 9 aa, Homo Sapiens
KHWEEGVTH

SEQ ID NO: 1109446 - protein, 9 aa, Homo Sapiens
YGKAEHTNT

SEQ ID NO: 1109447 - protein, 9 aa, Homo Sapiens
QEDHCSEEK

SEQ ID NO: 1109448 - protein, 9 aa, Homo Sapiens
VWEALEKVH

SEQ ID NO: 1109449 - protein, 9 aa, Homo Sapiens
IKENKDGKS

SEQ ID NO: 1109450 - protein, 9 aa, Homo Sapiens
GSLLVGELY

SEQ ID NO: 1109451 - protein, 9 aa, Homo Sapiens
PSWMTAIYD

SEQ ID NO: 1109452 - protein, 9 aa, Homo Sapiens
KEWQLHLGV

SEQ ID NO: 1109453 - protein, 9 aa, Homo Sapiens
QMQFCQPDP

SEQ ID NO: 1109454 - protein, 9 aa, Homo Sapiens
RRALSTVPA

SEQ ID NO: 1109455 - protein, 9 aa, Homo Sapiens
GRPGYPALL

SEQ ID NO: 1109456 - protein, 9 aa, Homo Sapiens
ERARRRRQS

SEQ ID NO: 1109457 - protein, 9 aa, Homo Sapiens
ITQHHLLHT

SEQ ID NO: 1109458 - protein, 9 aa, Homo Sapiens
DQLHWEYCL

SEQ ID NO: 1109459 - protein, 9 aa, Homo Sapiens
ELQNIAEKF

SEQ ID NO: 1109460 - protein, 9 aa, Homo Sapiens
MHTLLLTRM

SEQ ID NO: 1109461 - protein, 9 aa, Homo Sapiens
RERESLGGA

SEQ ID NO: 1109462 - protein, 9 aa, Homo Sapiens
FDDIVDTND

SEQ ID NO: 1109463 - protein, 9 aa, Homo Sapiens
GRQLQGCLG

SEQ ID NO: 1109464 - protein, 9 aa, Homo Sapiens
REHSAYWEP

SEQ ID NO: 1109465 - protein, 9 aa, Homo Sapiens
LAPVAAVPG

SEQ ID NO: 1109466 - protein, 9 aa, Homo Sapiens
STVPAVLLV

SEQ ID NO: 1109467 - protein, 9 aa, Homo Sapiens
PTLWEQQLQ

SEQ ID NO: 1109468 - protein, 9 aa, Homo Sapiens
GYPALLWAK

SEQ ID NO: 1109469 - protein, 9 aa, Homo Sapiens
GGRRVSIWD

SEQ ID NO: 1109470 - protein, 9 aa, Homo Sapiens
TRMAFCAQK

SEQ ID NO: 1109471 - protein, 9 aa, Homo Sapiens
TVSDRDSGM

SEQ ID NO: 1109472 - protein, 9 aa, Homo Sapiens
SIFSQVPGS

SEQ ID NO: 1109473 - protein, 9 aa, Homo Sapiens
KWITKKPPT

SEQ ID NO: 1109474 - protein, 9 aa, Homo Sapiens
DTMLPTCFL

SEQ ID NO: 1109475 - protein, 9 aa, Homo Sapiens
SKKYEIVTD

SEQ ID NO: 1109476 - protein, 9 aa, Homo Sapiens
LGCSHVCSR

SEQ ID NO: 1109477 - protein, 9 aa, Homo Sapiens
CTMLNPPNR

SEQ ID NO: 1109478 - protein, 9 aa, Homo Sapiens
LACADITST

SEQ ID NO: 1109479 - protein, 9 aa, Homo Sapiens
KAFKWYSHL

SEQ ID NO: 1109480 - protein, 9 aa, Homo Sapiens
IETPFMKIL

SEQ ID NO: 1109481 - protein, 9 aa, Homo Sapiens
DMDLRVYGP

SEQ ID NO: 1109482 - protein, 9 aa, Homo Sapiens
DPTLWEQQL

SEQ ID NO: 1109483 - protein, 9 aa, Homo Sapiens
FMKILPVNL

SEQ ID NO: 1109484 - protein, 9 aa, Homo Sapiens
ADIKENKDG

SEQ ID NO: 1109485 - protein, 9 aa, Homo Sapiens
MKSNPDELI

SEQ ID NO: 1109486 - protein, 9 aa, Homo Sapiens
KDKDISQKD

SEQ ID NO: 1109487 - protein, 9 aa, Homo Sapiens
QDGGMRSDP

SEQ ID NO: 1109488 - protein, 9 aa, Homo Sapiens
MAFCAQKAI

SEQ ID NO: 1109489 - protein, 9 aa, Homo Sapiens
GRPQVVHVG

SEQ ID NO: 1109490 - protein, 9 aa, Homo Sapiens
SACPGRPGY

SEQ ID NO: 1109491 - protein, 9 aa, Homo Sapiens
EVKHTREML

SEQ ID NO: 1109492 - protein, 9 aa, Homo Sapiens
YQERSLIPS

SEQ ID NO: 1109493 - protein, 9 aa, Homo Sapiens
VYQAREDKS

SEQ ID NO: 1109494 - protein, 9 aa, Homo Sapiens
QTMHLAQTP

SEQ ID NO: 1109495 - protein, 9 aa, Homo Sapiens
LVGNSDLSP

SEQ ID NO: 1109496 - protein, 9 aa, Homo Sapiens
LIDRNNNAP

SEQ ID NO: 1109497 - protein, 9 aa, Homo Sapiens
AMAKYVKIR

SEQ ID NO: 1109498 - protein, 9 aa, Homo Sapiens
EMQKGGLRN

SEQ ID NO: 1109499 - protein, 9 aa, Homo Sapiens
PTPPPCGAH

SEQ ID NO: 1109500 - protein, 9 aa, Homo Sapiens
NNNAPSIGF

SEQ ID NO: 1109501 - protein, 9 aa, Homo Sapiens
NLHLPGSRG

SEQ ID NO: 1109502 - protein, 9 aa, Homo Sapiens
PPPCGAHGG

SEQ ID NO: 1109503 - protein, 9 aa, Homo Sapiens
HLFQNGSLL

SEQ ID NO: 1109504 - protein, 9 aa, Homo Sapiens
PDGPPLAPV

SEQ ID NO: 1109505 - protein, 9 aa, Homo Sapiens
TSNSSFAFH

SEQ ID NO: 1109506 - protein, 9 aa, Homo Sapiens
VQSGLLGMQ

SEQ ID NO: 1109507 - protein, 9 aa, Homo Sapiens
VQNGSSRIL

SEQ ID NO: 1109508 - protein, 9 aa, Homo Sapiens
KPSSKREHQ

SEQ ID NO: 1109509 - protein, 9 aa, Homo Sapiens
DDEDEDYYK

SEQ ID NO: 1109510 - protein, 9 aa, Homo Sapiens
FDQLHWEYC

SEQ ID NO: 1109511 - protein, 9 aa, Homo Sapiens
RVPLLFSGA

SEQ ID NO: 1109512 - protein, 9 aa, Homo Sapiens
FVGLVGNSD

SEQ ID NO: 1109513 - protein, 9 aa, Homo Sapiens
HHLLHTIKD

SEQ ID NO: 1109514 - protein, 9 aa, Homo Sapiens
SPQKRLTKG

SEQ ID NO: 1109515 - protein, 9 aa, Homo Sapiens
CSEEKSKEP

SEQ ID NO: 1109516 - protein, 9 aa, Homo Sapiens
FIETHSSTS

SEQ ID NO: 1109517 - protein, 9 aa, Homo Sapiens
TCICMVGIE

SEQ ID NO: 1109518 - protein, 9 aa, Homo Sapiens
CLAYTLACV

SEQ ID NO: 1109519 - protein, 9 aa, Homo Sapiens
TSTKNSELL

SEQ ID NO: 1109520 - protein, 9 aa, Homo Sapiens
YVDTALFTQ

SEQ ID NO: 1109521 - protein, 9 aa, Homo Sapiens
LGTCAATLG

SEQ ID NO: 1109522 - protein, 9 aa, Homo Sapiens
KYYRKSSVS

SEQ ID NO: 1109523 - protein, 9 aa, Homo Sapiens
QDGTKTVDY

SEQ ID NO: 1109524 - protein, 9 aa, Homo Sapiens
RERERESLG

SEQ ID NO: 1109525 - protein, 9 aa, Homo Sapiens
FSWLIAQAS

SEQ ID NO: 1109526 - protein, 9 aa, Homo Sapiens
KCFLINKVD

SEQ ID NO: 1109527 - protein, 9 aa, Homo Sapiens
SKQKKYLEQ

SEQ ID NO: 1109528 - protein, 9 aa, Homo Sapiens
LNSFWNVST

SEQ ID NO: 1109529 - protein, 9 aa, Homo Sapiens
ACVYGVESD

SEQ ID NO: 1109530 - protein, 9 aa, Homo Sapiens
VPGHPLGGD

SEQ ID NO: 1109531 - protein, 9 aa, Homo Sapiens
PPPRPSPRP

SEQ ID NO: 1109532 - protein, 9 aa, Homo Sapiens
REDEEEVMC

SEQ ID NO: 1109533 - protein, 9 aa, Homo Sapiens
CLSNWPEDM

SEQ ID NO: 1109534 - protein, 9 aa, Homo Sapiens
EDMDVLYIV

SEQ ID NO: 1109535 - protein, 9 aa, Homo Sapiens
TVEGPGWLA

SEQ ID NO: 1109536 - protein, 9 aa, Homo Sapiens
EIEYAKLKK

SEQ ID NO: 1109537 - protein, 9 aa, Homo Sapiens
PLAPVAAVP

SEQ ID NO: 1109538 - protein, 9 aa, Homo Sapiens
EIMNNGLTN

SEQ ID NO: 1109539 - protein, 9 aa, Homo Sapiens
LLEVWEALE

SEQ ID NO: 1109540 - protein, 9 aa, Homo Sapiens
DIVDTNDSD

SEQ ID NO: 1109541 - protein, 9 aa, Homo Sapiens
REFIETHSS

SEQ ID NO: 1109542 - protein, 9 aa, Homo Sapiens
YQAREDKSL

SEQ ID NO: 1109543 - protein, 9 aa, Homo Sapiens
SVVVPCEPP

SEQ ID NO: 1109544 - protein, 9 aa, Homo Sapiens
IGALGDSLM

SEQ ID NO: 1109545 - protein, 9 aa, Homo Sapiens
GGIDGRLGL

SEQ ID NO: 1109546 - protein, 9 aa, Homo Sapiens
MKILPVNLG

SEQ ID NO: 1109547 - protein, 9 aa, Homo Sapiens
AWTSATSSV

SEQ ID NO: 1109548 - protein, 9 aa, Homo Sapiens
KLIDRNNNA

SEQ ID NO: 1109549 - protein, 9 aa, Homo Sapiens
NVLSHLEQK

SEQ ID NO: 1109550 - protein, 9 aa, Homo Sapiens
EVMCHGSKI

SEQ ID NO: 1109551 - protein, 9 aa, Homo Sapiens
TPPPCGAHG

SEQ ID NO: 1109552 - protein, 9 aa, Homo Sapiens
SRGSPASAS

SEQ ID NO: 1109553 - protein, 9 aa, Homo Sapiens
VAEDTFTLD

SEQ ID NO: 1109554 - protein, 9 aa, Homo Sapiens
PHSPGGYTP

SEQ ID NO: 1109555 - protein, 9 aa, Homo Sapiens
PPPSTSHLQ

SEQ ID NO: 1109556 - protein, 9 aa, Homo Sapiens
LLSVTSNSS

SEQ ID NO: 1109557 - protein, 9 aa, Homo Sapiens
VPLLFSGAL

SEQ ID NO: 1109558 - protein, 9 aa, Homo Sapiens
SQMQFCQPD

SEQ ID NO: 1109559 - protein, 9 aa, Homo Sapiens
EDTFTLDYR

SEQ ID NO: 1109560 - protein, 9 aa, Homo Sapiens
SYVPGPCSR

SEQ ID NO: 1109561 - protein, 9 aa, Homo Sapiens
ENIRHYEEM

SEQ ID NO: 1109562 - protein, 9 aa, Homo Sapiens
SWGSRDWRC

SEQ ID NO: 1109563 - protein, 9 aa, Homo Sapiens
SNWPEDMDV

SEQ ID NO: 1109564 - protein, 9 aa, Homo Sapiens
GALGDSLMA

SEQ ID NO: 1109565 - protein, 9 aa, Homo Sapiens
DVIDVTHQA

SEQ ID NO: 1109566 - protein, 9 aa, Homo Sapiens
HLAQTPFIC

SEQ ID NO: 1109567 - protein, 9 aa, Homo Sapiens
ELVGQEAIT

SEQ ID NO: 1109568 - protein, 9 aa, Homo Sapiens
RQSGTCHAE

SEQ ID NO: 1109569 - protein, 9 aa, Homo Sapiens
PEDGEKIAQ

SEQ ID NO: 1109570 - protein, 9 aa, Homo Sapiens
AQTPFICDC

SEQ ID NO: 1109571 - protein, 9 aa, Homo Sapiens
SYVDTALFT

SEQ ID NO: 1109572 - protein, 9 aa, Homo Sapiens
DMAIAEETR

SEQ ID NO: 1109573 - protein, 9 aa, Homo Sapiens
YTLACVYGV

SEQ ID NO: 1109574 - protein, 9 aa, Homo Sapiens
KLEVKHTRE

SEQ ID NO: 1109575 - protein, 9 aa, Homo Sapiens
RNGDKEDKE

SEQ ID NO: 1109576 - protein, 9 aa, Homo Sapiens
AMGISGSDI

SEQ ID NO: 1109577 - protein, 9 aa, Homo Sapiens
EDEEEVMCH

SEQ ID NO: 1109578 - protein, 9 aa, Homo Sapiens
MCHGSKIQM

SEQ ID NO: 1109579 - protein, 9 aa, Homo Sapiens
PPSTSHLQM

SEQ ID NO: 1109580 - protein, 9 aa, Homo Sapiens
ARVPLLFSG

SEQ ID NO: 1109581 - protein, 9 aa, Homo Sapiens
VDPTLWEQQ

SEQ ID NO: 1109582 - protein, 9 aa, Homo Sapiens
GGSWGSRDW

SEQ ID NO: 1109583 - protein, 9 aa, Homo Sapiens
VKEWQLHLG

SEQ ID NO: 1109584 - protein, 9 aa, Homo Sapiens
GVWKWITKK

SEQ ID NO: 1109585 - protein, 9 aa, Homo Sapiens
LKLEVKHTR

SEQ ID NO: 1109586 - protein, 9 aa, Homo Sapiens
VGCVIQSPE

SEQ ID NO: 1109587 - protein, 9 aa, Homo Sapiens
GSRGSPASA

SEQ ID NO: 1109588 - protein, 9 aa, Homo Sapiens
GKTVEGPGW

SEQ ID NO: 1109589 - protein, 9 aa, Homo Sapiens
HVCSRTPVE

SEQ ID NO: 1109590 - protein, 9 aa, Homo Sapiens
MPDTMLPTC

SEQ ID NO: 1109591 - protein, 9 aa, Homo Sapiens
CEIRDQDGG

SEQ ID NO: 1109592 - protein, 9 aa, Homo Sapiens
LVAHMEASL

SEQ ID NO: 1109593 - protein, 9 aa, Homo Sapiens
IKVDMAIAE

SEQ ID NO: 1109594 - protein, 9 aa, Homo Sapiens
EMVQNGSSR

SEQ ID NO: 1109595 - protein, 9 aa, Homo Sapiens
EVWEALEKV

SEQ ID NO: 1109596 - protein, 9 aa, Homo Sapiens
QKGGLRNQW

SEQ ID NO: 1109597 - protein, 9 aa, Homo Sapiens
TLVDVITKR

SEQ ID NO: 1109598 - protein, 9 aa, Homo Sapiens
WITKKPPTV

SEQ ID NO: 1109599 - protein, 9 aa, Homo Sapiens
ANVLSHLEQ

SEQ ID NO: 1109600 - protein, 9 aa, Homo Sapiens
QTLVDVITK

SEQ ID NO: 1109601 - protein, 9 aa, Homo Sapiens
SGSDISKQA

SEQ ID NO: 1109602 - protein, 9 aa, Homo Sapiens
LTRMAFCAQ

SEQ ID NO: 1109603 - protein, 9 aa, Homo Sapiens
AGDMVATKI

SEQ ID NO: 1109604 - protein, 9 aa, Homo Sapiens
VGLVGNSDL

SEQ ID NO: 1109605 - protein, 9 aa, Homo Sapiens
PGHPLGGDM

SEQ ID NO: 1109606 - protein, 9 aa, Homo Sapiens
HFYGKAEHT

SEQ ID NO: 1109607 - protein, 9 aa, Homo Sapiens
CLLQGTSTK

SEQ ID NO: 1109608 - protein, 9 aa, Homo Sapiens
DVITKRKGH

SEQ ID NO: 1109609 - protein, 9 aa, Homo Sapiens
AFPDDMDLR

SEQ ID NO: 1109610 - protein, 9 aa, Homo Sapiens
FSAPYEGSS

SEQ ID NO: 1109611 - protein, 9 aa, Homo Sapiens
AMDLELQNI

SEQ ID NO: 1109612 - protein, 9 aa, Homo Sapiens
VDTNDSDVE

SEQ ID NO: 1109613 - protein, 9 aa, Homo Sapiens
FYVSQLQTS

SEQ ID NO: 1109614 - protein, 9 aa, Homo Sapiens
CVIQSPEKP

SEQ ID NO: 1109615 - protein, 9 aa, Homo Sapiens
IDVIDVTHQ

SEQ ID NO: 1109616 - protein, 9 aa, Homo Sapiens
QSGLLGMQN

SEQ ID NO: 1109617 - protein, 9 aa, Homo Sapiens
PFSWLIAQA

SEQ ID NO: 1109618 - protein, 9 aa, Homo Sapiens
WEEGVTHPP

SEQ ID NO: 1109619 - protein, 9 aa, Homo Sapiens
EMAPFLRYQ

SEQ ID NO: 1109620 - protein, 9 aa, Homo Sapiens
NGLTNQINN

SEQ ID NO: 1109621 - protein, 9 aa, Homo Sapiens
AKFVCKHWE

SEQ ID NO: 1109622 - protein, 9 aa, Homo Sapiens
RESLGGAGK

SEQ ID NO: 1109623 - protein, 9 aa, Homo Sapiens
HSAYWEPRK

SEQ ID NO: 1109624 - protein, 9 aa, Homo Sapiens
AWQVSLPEL

SEQ ID NO: 1109625 - protein, 9 aa, Homo Sapiens
PFIQDDYYY

SEQ ID NO: 1109626 - protein, 9 aa, Homo Sapiens
EVYQAREDK

SEQ ID NO: 1109627 - protein, 9 aa, Homo Sapiens
SKHFEESKE

SEQ ID NO: 1109628 - protein, 9 aa, Homo Sapiens
LQGCLGAKK

SEQ ID NO: 1109629 - protein, 9 aa, Homo Sapiens
PGPCSRSPS

SEQ ID NO: 1109630 - protein, 9 aa, Homo Sapiens
FVTEVKEKP

SEQ ID NO: 1109631 - protein, 9 aa, Homo Sapiens
GCVIQSPEK

SEQ ID NO: 1109632 - protein, 9 aa, Homo Sapiens
VTSNSSFAF

SEQ ID NO: 1109633 - protein, 9 aa, Homo Sapiens
ADITSTVSI

SEQ ID NO: 1109634 - protein, 9 aa, Homo Sapiens
YRVIQTTGY

SEQ ID NO: 1109635 - protein, 9 aa, Homo Sapiens
DQPFIQDDY

SEQ ID NO: 1109636 - protein, 9 aa, Homo Sapiens
HFEESKEIT

SEQ ID NO: 1109637 - protein, 9 aa, Homo Sapiens
DAYIETPFM

SEQ ID NO: 1109638 - protein, 9 aa, Homo Sapiens
EATAANLSR

SEQ ID NO: 1109639 - protein, 9 aa, Homo Sapiens
IYRVIQTTG

SEQ ID NO: 1109640 - protein, 9 aa, Homo Sapiens
FEEETPFSW

SEQ ID NO: 1109641 - protein, 9 aa, Homo Sapiens
ALFTQSCIV

SEQ ID NO: 1109642 - protein, 9 aa, Homo Sapiens
RVAEDTFTL

SEQ ID NO: 1109643 - protein, 9 aa, Homo Sapiens
IAQLRELML

SEQ ID NO: 1109644 - protein, 9 aa, Homo Sapiens
DGREHSAYW

SEQ ID NO: 1109645 - protein, 9 aa, Homo Sapiens
SVDPTLWEQ

SEQ ID NO: 1109646 - protein, 9 aa, Homo Sapiens
RYDFTARNA

SEQ ID NO: 1109647 - protein, 9 aa, Homo Sapiens
QKSRNGDKE

SEQ ID NO: 1109648 - protein, 9 aa, Homo Sapiens
GSSKQKKYL

SEQ ID NO: 1109649 - protein, 9 aa, Homo Sapiens
IQSPEKPHF

SEQ ID NO: 1109650 - protein, 9 aa, Homo Sapiens
AYEPHSPGG

SEQ ID NO: 1109651 - protein, 9 aa, Homo Sapiens
RLGLGGQIV

SEQ ID NO: 1109652 - protein, 9 aa, Homo Sapiens
CPIILIRCT

SEQ ID NO: 1109653 - protein, 9 aa, Homo Sapiens
NGFNSTNDP

SEQ ID NO: 1109654 - protein, 9 aa, Homo Sapiens
TMLNPPNRC

SEQ ID NO: 1109655 - protein, 9 aa, Homo Sapiens
DGTKTVDYA

SEQ ID NO: 1109656 - protein, 9 aa, Homo Sapiens
KLACADITS

SEQ ID NO: 1109657 - protein, 9 aa, Homo Sapiens
KYLEQSCPK

SEQ ID NO: 1109658 - protein, 9 aa, Homo Sapiens
GRYRDDEDE

SEQ ID NO: 1109659 - protein, 9 aa, Homo Sapiens
IDGRLGLGG

SEQ ID NO: 1109660 - protein, 9 aa, Homo Sapiens
ARNKYYRKS

SEQ ID NO: 1109661 - protein, 9 aa, Homo Sapiens
EGSPQKRLT

SEQ ID NO: 1109662 - protein, 9 aa, Homo Sapiens
GREHSAYWE

SEQ ID NO: 1109663 - protein, 9 aa, Homo Sapiens
DGEKIAQLR

SEQ ID NO: 1109664 - protein, 9 aa, Homo Sapiens
DKVQKATGK

SEQ ID NO: 1109665 - protein, 9 aa, Homo Sapiens
AEHTNTGTK

SEQ ID NO: 1109666 - protein, 9 aa, Homo Sapiens
FPDDMDLRV

SEQ ID NO: 1109667 - protein, 9 aa, Homo Sapiens
MVGIEDPVR

SEQ ID NO: 1109668 - protein, 9 aa, Homo Sapiens
NIRHYEEMP

SEQ ID NO: 1109669 - protein, 9 aa, Homo Sapiens
TQHHLLHTI

SEQ ID NO: 1109670 - protein, 9 aa, Homo Sapiens
LGAKKHEFL

SEQ ID NO: 1109671 - protein, 9 aa, Homo Sapiens
SNSSFAFHK

SEQ ID NO: 1109672 - protein, 9 aa, Homo Sapiens
RVLLLGGDR

SEQ ID NO: 1109673 - protein, 9 aa, Homo Sapiens
DQDGGMRSD

SEQ ID NO: 1109674 - protein, 9 aa, Homo Sapiens
QLLGCSHVC

SEQ ID NO: 1109675 - protein, 9 aa, Homo Sapiens
PPLAPVAAV

SEQ ID NO: 1109676 - protein, 9 aa, Homo Sapiens
MEQIKVDMA

SEQ ID NO: 1109677 - protein, 9 aa, Homo Sapiens
TDVGFCTLV

SEQ ID NO: 1109678 - protein, 9 aa, Homo Sapiens
MSMAACPEA

SEQ ID NO: 1109679 - protein, 9 aa, Homo Sapiens
VGRYRDDED

SEQ ID NO: 1109680 - protein, 9 aa, Homo Sapiens
ALLTDLHPS

SEQ ID NO: 1109681 - protein, 9 aa, Homo Sapiens
HSSTSDSNT

SEQ ID NO: 1109682 - protein, 9 aa, Homo Sapiens
VKRADIKEN

SEQ ID NO: 1109683 - protein, 9 aa, Homo Sapiens
TEVKEKPSS

SEQ ID NO: 1109684 - protein, 9 aa, Homo Sapiens
STSHLQMKF

SEQ ID NO: 1109685 - protein, 9 aa, Homo Sapiens
EIDVIDVTH

SEQ ID NO: 1109686 - protein, 9 aa, Homo Sapiens
HTLLLTRMA

SEQ ID NO: 1109687 - protein, 9 aa, Homo Sapiens
PVHFYGKAE

SEQ ID NO: 1109688 - protein, 9 aa, Homo Sapiens
RVIQTTGYL

SEQ ID NO: 1109689 - protein, 9 aa, Homo Sapiens
DMVATKIVE

SEQ ID NO: 1109690 - protein, 9 aa, Homo Sapiens
CDENRANDF

SEQ ID NO: 1109691 - protein, 9 aa, Homo Sapiens
NGSLLVGEL

SEQ ID NO: 1109692 - protein, 9 aa, Homo Sapiens
AFELVGQEA

SEQ ID NO: 1109693 - protein, 9 aa, Homo Sapiens
EEVMCHGSK

SEQ ID NO: 1109694 - protein, 9 aa, Homo Sapiens
PFKCFLINK

SEQ ID NO: 1109695 - protein, 9 aa, Homo Sapiens
GSWGSRDWR

SEQ ID NO: 1109696 - protein, 9 aa, Homo Sapiens
RANDFMLRD

SEQ ID NO: 1109697 - protein, 9 aa, Homo Sapiens
KTVEGPGWL

SEQ ID NO: 1109698 - protein, 9 aa, Homo Sapiens
EFIETHSST

SEQ ID NO: 1109699 - protein, 9 aa, Homo Sapiens
YSHLTRHKV

SEQ ID NO: 1109700 - protein, 9 aa, Homo Sapiens
PAFELVGQE

SEQ ID NO: 1109701 - protein, 9 aa, Homo Sapiens
CLGAKKHEF

SEQ ID NO: 1109702 - protein, 9 aa, Homo Sapiens
EEETPFSWL

SEQ ID NO: 1109703 - protein, 9 aa, Homo Sapiens
GVAGDMVAT

SEQ ID NO: 1109704 - protein, 9 aa, Homo Sapiens
APVAAVPGP

SEQ ID NO: 1109705 - protein, 9 aa, Homo Sapiens
GTKTVDYAP

SEQ ID NO: 1109706 - protein, 9 aa, Homo Sapiens
HVGGEESEV

SEQ ID NO: 1109707 - protein, 9 aa, Homo Sapiens
KTLPTAVTN

SEQ ID NO: 1109708 - protein, 9 aa, Homo Sapiens
FGGGSWGSR

SEQ ID NO: 1109709 - protein, 9 aa, Homo Sapiens
LQTSIGVQA

SEQ ID NO: 1109710 - protein, 9 aa, Homo Sapiens
SGSSKQKKY

SEQ ID NO: 1109711 - protein, 9 aa, Homo Sapiens
VLSHLEQKS

SEQ ID NO: 1109712 - protein, 9 aa, Homo Sapiens
VTNGFNSTN

SEQ ID NO: 1109713 - protein, 9 aa, Homo Sapiens
CMVGIEDPV

SEQ ID NO: 1109714 - protein, 9 aa, Homo Sapiens
LSHLEQKSK

SEQ ID NO: 1109715 - protein, 9 aa, Homo Sapiens
LARNKYYRK

SEQ ID NO: 1109716 - protein, 9 aa, Homo Sapiens
LLGCSHVCS

SEQ ID NO: 1109717 - protein, 9 aa, Homo Sapiens
AVARVPLLF

SEQ ID NO: 1109718 - protein, 9 aa, Homo Sapiens
DRNNNAPSI

SEQ ID NO: 1109719 - protein, 9 aa, Homo Sapiens
ISGSDISKQ

SEQ ID NO: 1109720 - protein, 9 aa, Homo Sapiens
IRCTMLNPP

SEQ ID NO: 1109721 - protein, 9 aa, Homo Sapiens
IKPLLSIFS

SEQ ID NO: 1109722 - protein, 9 aa, Homo Sapiens
PLPPPRPSP

SEQ ID NO: 1109723 - protein, 9 aa, Homo Sapiens
AEGGRRVSI

SEQ ID NO: 1109724 - protein, 9 aa, Homo Sapiens
LDIANVLSH

SEQ ID NO: 1109725 - protein, 9 aa, Homo Sapiens
ITKRKGHIL

SEQ ID NO: 1109726 - protein, 9 aa, Homo Sapiens
APYEGSSTL

SEQ ID NO: 1109727 - protein, 9 aa, Homo Sapiens
YWEPRKLLT

SEQ ID NO: 1109728 - protein, 9 aa, Homo Sapiens
TFTLDYRYP

SEQ ID NO: 1109729 - protein, 9 aa, Homo Sapiens
WLAQKAFEY

SEQ ID NO: 1109730 - protein, 9 aa, Homo Sapiens
SWLIAQASE

SEQ ID NO: 1109731 - protein, 9 aa, Homo Sapiens
LLLGGDRLF

SEQ ID NO: 1109732 - protein, 9 aa, Homo Sapiens
YLSTDVGFC

SEQ ID NO: 1109733 - protein, 9 aa, Homo Sapiens
PCGAHGGQQ

SEQ ID NO: 1109734 - protein, 9 aa, Homo Sapiens
PQVVHVGGE

SEQ ID NO: 1109735 - protein, 9 aa, Homo Sapiens
PQSPLQGED

SEQ ID NO: 1109736 - protein, 9 aa, Homo Sapiens
PGRPGYPAL

SEQ ID NO: 1109737 - protein, 9 aa, Homo Sapiens
SLPELEDRL

SEQ ID NO: 1109738 - protein, 9 aa, Homo Sapiens
TVDYAPCRS

SEQ ID NO: 1109739 - protein, 9 aa, Homo Sapiens
LGMQNLKAD

SEQ ID NO: 1109740 - protein, 9 aa, Homo Sapiens
IGCLLARNK

SEQ ID NO: 1109741 - protein, 9 aa, Homo Sapiens
PCSRSPSLN

SEQ ID NO: 1109742 - protein, 9 aa, Homo Sapiens
MKALALLTD

SEQ ID NO: 1109743 - protein, 9 aa, Homo Sapiens
AVEAYMRAL

SEQ ID NO: 1109744 - protein, 9 aa, Homo Sapiens
VTEVKEKPS

SEQ ID NO: 1109745 - protein, 9 aa, Homo Sapiens
YIETPFMKI

SEQ ID NO: 1109746 - protein, 9 aa, Homo Sapiens
KVDMAIAEE

SEQ ID NO: 1109747 - protein, 9 aa, Homo Sapiens
NIAEKFSQR

SEQ ID NO: 1109748 - protein, 9 aa, Homo Sapiens
HMEASLTYP

SEQ ID NO: 1109749 - protein, 9 aa, Homo Sapiens
GLKGVWKWI

SEQ ID NO: 1109750 - protein, 9 aa, Homo Sapiens
QEAITCQKN

SEQ ID NO: 1109751 - protein, 9 aa, Homo Sapiens
QSGTCHAET

SEQ ID NO: 1109752 - protein, 9 aa, Homo Sapiens
AAQVAVARV

SEQ ID NO: 1109753 - protein, 9 aa, Homo Sapiens
VAVARVPLL

SEQ ID NO: 1109754 - protein, 9 aa, Homo Sapiens
GSGRRALST

SEQ ID NO: 1109755 - protein, 9 aa, Homo Sapiens
WKWITKKPP

SEQ ID NO: 1109756 - protein, 9 aa, Homo Sapiens
KGYNVYDEK

SEQ ID NO: 1109757 - protein, 9 aa, Homo Sapiens
IQTMHLAQT

SEQ ID NO: 1109758 - protein, 9 aa, Homo Sapiens
FVKASKHFE

SEQ ID NO: 1109759 - protein, 9 aa, Homo Sapiens
QKKYLEQSC

SEQ ID NO: 1109760 - protein, 9 aa, Homo Sapiens
WLIAQASEK

SEQ ID NO: 1109761 - protein, 9 aa, Homo Sapiens
ENKDGKSRG

SEQ ID NO: 1109762 - protein, 9 aa, Homo Sapiens
VPCEPPEVG

SEQ ID NO: 1109763 - protein, 9 aa, Homo Sapiens
PPGDCASHL

SEQ ID NO: 1109764 - protein, 9 aa, Homo Sapiens
LFVKASKHF

SEQ ID NO: 1109765 - protein, 9 aa, Homo Sapiens
KDISQKDMY

SEQ ID NO: 1109766 - protein, 9 aa, Homo Sapiens
WDITTLNSF

SEQ ID NO: 1109767 - protein, 9 aa, Homo Sapiens
LLVGELYSY

SEQ ID NO: 1109768 - protein, 9 aa, Homo Sapiens
TVKLIDRNN

SEQ ID NO: 1109769 - protein, 9 aa, Homo Sapiens
HYEEMPEYE

SEQ ID NO: 1109770 - protein, 9 aa, Homo Sapiens
HLPGSRGSP

SEQ ID NO: 1109771 - protein, 9 aa, Homo Sapiens
IMNNGLTNQ

SEQ ID NO: 1109772 - protein, 9 aa, Homo Sapiens
IKEIEYAKL

SEQ ID NO: 1109773 - protein, 9 aa, Homo Sapiens
PTAVTNGFN

SEQ ID NO: 1109774 - protein, 9 aa, Homo Sapiens
GTSTKNSEL

SEQ ID NO: 1109775 - protein, 9 aa, Homo Sapiens
AEDTFTLDY

SEQ ID NO: 1109776 - protein, 9 aa, Homo Sapiens
SPAYEPHSP

SEQ ID NO: 1109777 - protein, 9 aa, Homo Sapiens
KEKPSSKRE

SEQ ID NO: 1109778 - protein, 9 aa, Homo Sapiens
EDKVQKATG

SEQ ID NO: 1109779 - protein, 9 aa, Homo Sapiens
EAVEAYMRA

SEQ ID NO: 1109780 - protein, 9 aa, Homo Sapiens
FLINKVDGS

SEQ ID NO: 1109781 - protein, 9 aa, Homo Sapiens
RERARRRRQ

SEQ ID NO: 1109782 - protein, 9 aa, Homo Sapiens
SRQSGTCHA

SEQ ID NO: 1109783 - protein, 9 aa, Homo Sapiens
YDEKAKEKD

SEQ ID NO: 1109784 - protein, 9 aa, Homo Sapiens
TLWEQQLQQ

SEQ ID NO: 1109785 - protein, 9 aa, Homo Sapiens
SREFIETHS

SEQ ID NO: 1109786 - protein, 9 aa, Homo Sapiens
QFGRVAEDT

SEQ ID NO: 1109787 - protein, 9 aa, Homo Sapiens
LENIFVKEW

SEQ ID NO: 1109788 - protein, 9 aa, Homo Sapiens
ALGDSLMAG

SEQ ID NO: 1109789 - protein, 9 aa, Homo Sapiens
TFSAPSWMT

SEQ ID NO: 1109790 - protein, 9 aa, Homo Sapiens
VDVITKRKG

SEQ ID NO: 1109791 - protein, 9 aa, Homo Sapiens
RGFSAPYEG

SEQ ID NO: 1109792 - protein, 9 aa, Homo Sapiens
EDHCSEEKS

SEQ ID NO: 1109793 - protein, 9 aa, Homo Sapiens
DEEEVMCHG

SEQ ID NO: 1109794 - protein, 9 aa, Homo Sapiens
THSSTSDSN

SEQ ID NO: 1109795 - protein, 9 aa, Homo Sapiens
IHRSKMAQC

SEQ ID NO: 1109796 - protein, 9 aa, Homo Sapiens
ICMVGIEDP

SEQ ID NO: 1109797 - protein, 9 aa, Homo Sapiens
YYYHGYVEG

SEQ ID NO: 1109798 - protein, 9 aa, Homo Sapiens
LPVHFYGKA

SEQ ID NO: 1109799 - protein, 9 aa, Homo Sapiens
FVCKHWEEG

SEQ ID NO: 1109800 - protein, 9 aa, Homo Sapiens
SFWNVSTQP

SEQ ID NO: 1109801 - protein, 9 aa, Homo Sapiens
VAHMEASLT

SEQ ID NO: 1109802 - protein, 9 aa, Homo Sapiens
VAAVPGPPP

SEQ ID NO: 1109803 - protein, 9 aa, Homo Sapiens
PGPQVEMVQ

SEQ ID NO: 1109804 - protein, 9 aa, Homo Sapiens
ACPGRPGYP

SEQ ID NO: 1109805 - protein, 9 aa, Homo Sapiens
GHPLGGDMG

SEQ ID NO: 1109806 - protein, 9 aa, Homo Sapiens
GPPLAPVAA

SEQ ID NO: 1109807 - protein, 9 aa, Homo Sapiens
GQEAITCQK

SEQ ID NO: 1109808 - protein, 9 aa, Homo Sapiens
RCTMLNPPN

SEQ ID NO: 1109809 - protein, 9 aa, Homo Sapiens
PEDMDVLYI

SEQ ID NO: 1109810 - protein, 9 aa, Homo Sapiens
AVTNGFNST

SEQ ID NO: 1109811 - protein, 9 aa, Homo Sapiens
ASHLCQNGG

SEQ ID NO: 1109812 - protein, 9 aa, Homo Sapiens
PSIRCTGEL

SEQ ID NO: 1109813 - protein, 9 aa, Homo Sapiens
VLDVFYTIL

SEQ ID NO: 1109814 - protein, 9 aa, Homo Sapiens
NFTKKTQLL

SEQ ID NO: 1109815 - protein, 9 aa, Homo Sapiens
NYKNWAVTH

SEQ ID NO: 1109816 - protein, 9 aa, Homo Sapiens
WTPSRRCNG

SEQ ID NO: 1109817 - protein, 9 aa, Homo Sapiens
DMVAPALLN

SEQ ID NO: 1109818 - protein, 9 aa, Homo Sapiens
PISRELQRE

SEQ ID NO: 1109819 - protein, 9 aa, Homo Sapiens
HTFSLGPVP

SEQ ID NO: 1109820 - protein, 9 aa, Homo Sapiens
CSYTSGPGS

SEQ ID NO: 1109821 - protein, 9 aa, Homo Sapiens
LFYTPAFFS

SEQ ID NO: 1109822 - protein, 9 aa, Homo Sapiens
ESAECLRLQ

SEQ ID NO: 1109823 - protein, 9 aa, Homo Sapiens
IMLTLSCHI

SEQ ID NO: 1109824 - protein, 9 aa, Homo Sapiens
DGGMLILLP

SEQ ID NO: 1109825 - protein, 9 aa, Homo Sapiens
ASVKRQLGF

SEQ ID NO: 1109826 - protein, 9 aa, Homo Sapiens
CTGELPGSR

SEQ ID NO: 1109827 - protein, 9 aa, Homo Sapiens
RCNGFLLPL

SEQ ID NO: 1109828 - protein, 9 aa, Homo Sapiens
SRITPSSSC

SEQ ID NO: 1109829 - protein, 9 aa, Homo Sapiens
LFCKSTLGY

SEQ ID NO: 1109830 - protein, 9 aa, Homo Sapiens
SQNAGRYLC

SEQ ID NO: 1109831 - protein, 9 aa, Homo Sapiens
LLYMATVPS

SEQ ID NO: 1109832 - protein, 9 aa, Homo Sapiens
AIELAIVGS

SEQ ID NO: 1109833 - protein, 9 aa, Homo Sapiens
QALGTKYFV

SEQ ID NO: 1109834 - protein, 9 aa, Homo Sapiens
LDFPALKKN

SEQ ID NO: 1109835 - protein, 9 aa, Homo Sapiens
TGKVGPKKP

SEQ ID NO: 1109836 - protein, 9 aa, Homo Sapiens
AASNLLFIF

SEQ ID NO: 1109837 - protein, 9 aa, Homo Sapiens
TCFCGKVKH

SEQ ID NO: 1109838 - protein, 9 aa, Homo Sapiens
HSSRIFPSL

SEQ ID NO: 1109839 - protein, 9 aa, Homo Sapiens
AKHPEYQEH

SEQ ID NO: 1109840 - protein, 9 aa, Homo Sapiens
TGKLADVKS

SEQ ID NO: 1109841 - protein, 9 aa, Homo Sapiens
KCAFQAPPS

SEQ ID NO: 1109842 - protein, 9 aa, Homo Sapiens
CYINKDCDL

SEQ ID NO: 1109843 - protein, 9 aa, Homo Sapiens
ARATRPLPL

SEQ ID NO: 1109844 - protein, 9 aa, Homo Sapiens
CLLRRPGEK

SEQ ID NO: 1109845 - protein, 9 aa, Homo Sapiens
DPKEIVKRE

SEQ ID NO: 1109846 - protein, 9 aa, Homo Sapiens
VESSLLVPM

SEQ ID NO: 1109847 - protein, 9 aa, Homo Sapiens
SCSFPHNFV

SEQ ID NO: 1109848 - protein, 9 aa, Homo Sapiens
PLPRTDSHL

SEQ ID NO: 1109849 - protein, 9 aa, Homo Sapiens
NNFGSVARM

SEQ ID NO: 1109850 - protein, 9 aa, Homo Sapiens
TPSSNQLFG

SEQ ID NO: 1109851 - protein, 9 aa, Homo Sapiens
AVKREGRLG

SEQ ID NO: 1109852 - protein, 9 aa, Homo Sapiens
SPATNMSTH

SEQ ID NO: 1109853 - protein, 9 aa, Homo Sapiens
NCPVDKRRW

SEQ ID NO: 1109854 - protein, 9 aa, Homo Sapiens
QDKAWQPPT

SEQ ID NO: 1109855 - protein, 9 aa, Homo Sapiens
YEVRASWLE

SEQ ID NO: 1109856 - protein, 9 aa, Homo Sapiens
VGILIKKPK

SEQ ID NO: 1109857 - protein, 9 aa, Homo Sapiens
NDPKEIVKR

SEQ ID NO: 1109858 - protein, 9 aa, Homo Sapiens
YASLKAVRS

SEQ ID NO: 1109859 - protein, 9 aa, Homo Sapiens
GMLILLPFL

SEQ ID NO: 1109860 - protein, 9 aa, Homo Sapiens
QEHCRQEVQ

SEQ ID NO: 1109861 - protein, 9 aa, Homo Sapiens
PYSLFCKST

SEQ ID NO: 1109862 - protein, 9 aa, Homo Sapiens
KYFVLTPPG

SEQ ID NO: 1109863 - protein, 9 aa, Homo Sapiens
MLILLPFLL

SEQ ID NO: 1109864 - protein, 9 aa, Homo Sapiens
PHHGRLAWR

SEQ ID NO: 1109865 - protein, 9 aa, Homo Sapiens
FETQHRHLL

SEQ ID NO: 1109866 - protein, 9 aa, Homo Sapiens
YKNWAVTHP

SEQ ID NO: 1109867 - protein, 9 aa, Homo Sapiens
LAGGVTAAV

SEQ ID NO: 1109868 - protein, 9 aa, Homo Sapiens
SVKRQLGFG

SEQ ID NO: 1109869 - protein, 9 aa, Homo Sapiens
QKMEIHQLT

SEQ ID NO: 1109870 - protein, 9 aa, Homo Sapiens
PRTDSHLTL

SEQ ID NO: 1109871 - protein, 9 aa, Homo Sapiens
FGSVARMCA

SEQ ID NO: 1109872 - protein, 9 aa, Homo Sapiens
VEYNIFKGV

SEQ ID NO: 1109873 - protein, 9 aa, Homo Sapiens
CKSTLGYTI

SEQ ID NO: 1109874 - protein, 9 aa, Homo Sapiens
GGMLILLPF

SEQ ID NO: 1109875 - protein, 9 aa, Homo Sapiens
TDSHLTLLN

SEQ ID NO: 1109876 - protein, 9 aa, Homo Sapiens
SNHTFSLGP

SEQ ID NO: 1109877 - protein, 9 aa, Homo Sapiens
AKNILLITE

SEQ ID NO: 1109878 - protein, 9 aa, Homo Sapiens
LSPATNMST

SEQ ID NO: 1109879 - protein, 9 aa, Homo Sapiens
PAQDKAWQP

SEQ ID NO: 1109880 - protein, 9 aa, Homo Sapiens
PGMPQNGTH

SEQ ID NO: 1109881 - protein, 9 aa, Homo Sapiens
SSLLVPMGG

SEQ ID NO: 1109882 - protein, 9 aa, Homo Sapiens
DSWLRPDQR

SEQ ID NO: 1109883 - protein, 9 aa, Homo Sapiens
KHPEWSRNE

SEQ ID NO: 1109884 - protein, 9 aa, Homo Sapiens
RPIQALGTK

SEQ ID NO: 1109885 - protein, 9 aa, Homo Sapiens
PTVSALFTG

SEQ ID NO: 1109886 - protein, 9 aa, Homo Sapiens
GKPLCDNVN

SEQ ID NO: 1109887 - protein, 9 aa, Homo Sapiens
ILLPFLLRQ

SEQ ID NO: 1109888 - protein, 9 aa, Homo Sapiens
LFTGPEELK

SEQ ID NO: 1109889 - protein, 9 aa, Homo Sapiens
ADIHRNRGD

SEQ ID NO: 1109890 - protein, 9 aa, Homo Sapiens
TFSLGPVPG

SEQ ID NO: 1109891 - protein, 9 aa, Homo Sapiens
CFADIHRNR

SEQ ID NO: 1109892 - protein, 9 aa, Homo Sapiens
EKIMKLSLP

SEQ ID NO: 1109893 - protein, 9 aa, Homo Sapiens
EALKNRMGH

SEQ ID NO: 1109894 - protein, 9 aa, Homo Sapiens
GTWTICFEG

SEQ ID NO: 1109895 - protein, 9 aa, Homo Sapiens
TYVMEEESA

SEQ ID NO: 1109896 - protein, 9 aa, Homo Sapiens
SFLSSVADV

SEQ ID NO: 1109897 - protein, 9 aa, Homo Sapiens
KALQKMEIH

SEQ ID NO: 1109898 - protein, 9 aa, Homo Sapiens
YEVMERPHH

SEQ ID NO: 1109899 - protein, 9 aa, Homo Sapiens
SSFETQHRH

SEQ ID NO: 1109900 - protein, 9 aa, Homo Sapiens
RCTGELPGS

SEQ ID NO: 1109901 - protein, 9 aa, Homo Sapiens
PGYLSYVNG

SEQ ID NO: 1109902 - protein, 9 aa, Homo Sapiens
EYQEHCRQE

SEQ ID NO: 1109903 - protein, 9 aa, Homo Sapiens
MKNTVLICL

SEQ ID NO: 1109904 - protein, 9 aa, Homo Sapiens
CVILLFYTP

SEQ ID NO: 1109905 - protein, 9 aa, Homo Sapiens
TRAPSSCTS

SEQ ID NO: 1109906 - protein, 9 aa, Homo Sapiens
NLSYLIQHH

SEQ ID NO: 1109907 - protein, 9 aa, Homo Sapiens
KTKQIHKAM

SEQ ID NO: 1109908 - protein, 9 aa, Homo Sapiens
CSKVREELR

SEQ ID NO: 1109909 - protein, 9 aa, Homo Sapiens
PIQALGTKY

SEQ ID NO: 1109910 - protein, 9 aa, Homo Sapiens
SWLRPDQRL

SEQ ID NO: 1109911 - protein, 9 aa, Homo Sapiens
RPHHGRLAW

SEQ ID NO: 1109912 - protein, 9 aa, Homo Sapiens
INKDCDLDI

SEQ ID NO: 1109913 - protein, 9 aa, Homo Sapiens
APSSCTSAT

SEQ ID NO: 1109914 - protein, 9 aa, Homo Sapiens
YQEHCRQEV

SEQ ID NO: 1109915 - protein, 9 aa, Homo Sapiens
NRGDLETAF

SEQ ID NO: 1109916 - protein, 9 aa, Homo Sapiens
GVTPLHNAL

SEQ ID NO: 1109917 - protein, 9 aa, Homo Sapiens
LQKMEIHQL

SEQ ID NO: 1109918 - protein, 9 aa, Homo Sapiens
VQPYVESSL

SEQ ID NO: 1109919 - protein, 9 aa, Homo Sapiens
SRKGAITFT

SEQ ID NO: 1109920 - protein, 9 aa, Homo Sapiens
LTLKSNKYN

SEQ ID NO: 1109921 - protein, 9 aa, Homo Sapiens
DSTRMDSGA

SEQ ID NO: 1109922 - protein, 9 aa, Homo Sapiens
SRASVKRQL

SEQ ID NO: 1109923 - protein, 9 aa, Homo Sapiens
IHKAMLSLL

SEQ ID NO: 1109924 - protein, 9 aa, Homo Sapiens
SENAVLILL

SEQ ID NO: 1109925 - protein, 9 aa, Homo Sapiens
LVLQIDCGS

SEQ ID NO: 1109926 - protein, 9 aa, Homo Sapiens
LITEEDRKT

SEQ ID NO: 1109927 - protein, 9 aa, Homo Sapiens
IPGYLSYVN

SEQ ID NO: 1109928 - protein, 9 aa, Homo Sapiens
LTYVMEEES

SEQ ID NO: 1109929 - protein, 9 aa, Homo Sapiens
QRELYGRRR

SEQ ID NO: 1109930 - protein, 9 aa, Homo Sapiens
EVDIDEILR

SEQ ID NO: 1109931 - protein, 9 aa, Homo Sapiens
DIESPTYTN

SEQ ID NO: 1109932 - protein, 9 aa, Homo Sapiens
HESPSSVLS

SEQ ID NO: 1109933 - protein, 9 aa, Homo Sapiens
DKRRWNRCQ

SEQ ID NO: 1109934 - protein, 9 aa, Homo Sapiens
SVADVVQSI

SEQ ID NO: 1109935 - protein, 9 aa, Homo Sapiens
PGTWTICFE

SEQ ID NO: 1109936 - protein, 9 aa, Homo Sapiens
LADVKSQPS

SEQ ID NO: 1109937 - protein, 9 aa, Homo Sapiens
LKKNKNIDN

SEQ ID NO: 1109938 - protein, 9 aa, Homo Sapiens
EEESAECLR

SEQ ID NO: 1109939 - protein, 9 aa, Homo Sapiens
PTDSWLRPD

SEQ ID NO: 1109940 - protein, 9 aa, Homo Sapiens
VKREGRLGE

SEQ ID NO: 1109941 - protein, 9 aa, Homo Sapiens
IRWWYMLLI

SEQ ID NO: 1109942 - protein, 9 aa, Homo Sapiens
ISQNAGRYL

SEQ ID NO: 1109943 - protein, 9 aa, Homo Sapiens
SFPHNFVLL

SEQ ID NO: 1109944 - protein, 9 aa, Homo Sapiens
KPKEKISIF

SEQ ID NO: 1109945 - protein, 9 aa, Homo Sapiens
KAFSNLSYL

SEQ ID NO: 1109946 - protein, 9 aa, Homo Sapiens
YSQGSHSSR

SEQ ID NO: 1109947 - protein, 9 aa, Homo Sapiens
WILMKNTVL

SEQ ID NO: 1109948 - protein, 9 aa, Homo Sapiens
SWAARATRP

SEQ ID NO: 1109949 - protein, 9 aa, Homo Sapiens
ALGTKYFVL

SEQ ID NO: 1109950 - protein, 9 aa, Homo Sapiens
ALKNRMGHQ

SEQ ID NO: 1109951 - protein, 9 aa, Homo Sapiens
REQQLRHEQ

SEQ ID NO: 1109952 - protein, 9 aa, Homo Sapiens
LKAVRSSDG

SEQ ID NO: 1109953 - protein, 9 aa, Homo Sapiens
ECSKVREEL

SEQ ID NO: 1109954 - protein, 9 aa, Homo Sapiens
TAAVSKTAV

SEQ ID NO: 1109955 - protein, 9 aa, Homo Sapiens
SPTEDKVLD

SEQ ID NO: 1109956 - protein, 9 aa, Homo Sapiens
SIVQLVLML

SEQ ID NO: 1109957 - protein, 9 aa, Homo Sapiens
FSENPYPNP

SEQ ID NO: 1109958 - protein, 9 aa, Homo Sapiens
EKALQKMEI

SEQ ID NO: 1109959 - protein, 9 aa, Homo Sapiens
AVRSSDGDW

SEQ ID NO: 1109960 - protein, 9 aa, Homo Sapiens
TPAQDKAWQ

SEQ ID NO: 1109961 - protein, 9 aa, Homo Sapiens
VTPLHNALS

SEQ ID NO: 1109962 - protein, 9 aa, Homo Sapiens
FCKSTLGYT

SEQ ID NO: 1109963 - protein, 9 aa, Homo Sapiens
NILLITEED

SEQ ID NO: 1109964 - protein, 9 aa, Homo Sapiens
VILLFYTPA

SEQ ID NO: 1109965 - protein, 9 aa, Homo Sapiens
TPLHNALSN

SEQ ID NO: 1109966 - protein, 9 aa, Homo Sapiens
RRWNRCQYC

SEQ ID NO: 1109967 - protein, 9 aa, Homo Sapiens
VSNHTFSLG

SEQ ID NO: 1109968 - protein, 9 aa, Homo Sapiens
LSRTTTPSD

SEQ ID NO: 1109969 - protein, 9 aa, Homo Sapiens
LVVQWLCNH

SEQ ID NO: 1109970 - protein, 9 aa, Homo Sapiens
LRDRPSIRC

SEQ ID NO: 1109971 - protein, 9 aa, Homo Sapiens
LDVADLHRL

SEQ ID NO: 1109972 - protein, 9 aa, Homo Sapiens
IDGLVLQID

SEQ ID NO: 1109973 - protein, 9 aa, Homo Sapiens
CFEGADYES

SEQ ID NO: 1109974 - protein, 9 aa, Homo Sapiens
VREELRLQH

SEQ ID NO: 1109975 - protein, 9 aa, Homo Sapiens
LWILMKNTV

SEQ ID NO: 1109976 - protein, 9 aa, Homo Sapiens
PFAVFRKIL

SEQ ID NO: 1109977 - protein, 9 aa, Homo Sapiens
ALLFAASNL

SEQ ID NO: 1109978 - protein, 9 aa, Homo Sapiens
VLSDSVTTK

SEQ ID NO: 1109979 - protein, 9 aa, Homo Sapiens
VKHPEWSRN

SEQ ID NO: 1109980 - protein, 9 aa, Homo Sapiens
IESPTYTNL

SEQ ID NO: 1109981 - protein, 9 aa, Homo Sapiens
VADLHRLRY

SEQ ID NO: 1109982 - protein, 9 aa, Homo Sapiens
WLELDIEIL

SEQ ID NO: 1109983 - protein, 9 aa, Homo Sapiens
KGAITFTWV

SEQ ID NO: 1109984 - protein, 9 aa, Homo Sapiens
FQAPPSCLR

SEQ ID NO: 1109985 - protein, 9 aa, Homo Sapiens
LFAASNLLF

SEQ ID NO: 1109986 - protein, 9 aa, Homo Sapiens
TRIAWRLCR

SEQ ID NO: 1109987 - protein, 9 aa, Homo Sapiens
NLRQECSKV

SEQ ID NO: 1109988 - protein, 9 aa, Homo Sapiens
WTICFEGAD

SEQ ID NO: 1109989 - protein, 9 aa, Homo Sapiens
RWNRCQYCR

SEQ ID NO: 1109990 - protein, 9 aa, Homo Sapiens
TTPSSNQLF

SEQ ID NO: 1109991 - protein, 9 aa, Homo Sapiens
LPPLPLPRT

SEQ ID NO: 1109992 - protein, 9 aa, Homo Sapiens
PQNGTHYGD

SEQ ID NO: 1109993 - protein, 9 aa, Homo Sapiens
MDSGAYTLT

SEQ ID NO: 1109994 - protein, 9 aa, Homo Sapiens
TEDKVLDVF

SEQ ID NO: 1109995 - protein, 9 aa, Homo Sapiens
SEVYGFSEF

SEQ ID NO: 1109996 - protein, 9 aa, Homo Sapiens
VRSSDGDWA

SEQ ID NO: 1109997 - protein, 9 aa, Homo Sapiens
NLCLLRRPG

SEQ ID NO: 1109998 - protein, 9 aa, Homo Sapiens
PETPELDMV

SEQ ID NO: 1109999 - protein, 9 aa, Homo Sapiens
ELQRELYGR

SEQ ID NO: 1110000 - protein, 9 aa, Homo Sapiens
SCSYTSGPG

SEQ ID NO: 1110001 - protein, 9 aa, Homo Sapiens
KNTVLICLA

SEQ ID NO: 1110002 - protein, 9 aa, Homo Sapiens
LYMATVPSL

SEQ ID NO: 1110003 - protein, 9 aa, Homo Sapiens
MALSRTTTP

SEQ ID NO: 1110004 - protein, 9 aa, Homo Sapiens
GSHVCVILL

SEQ ID NO: 1110005 - protein, 9 aa, Homo Sapiens
VDIRWWYML

SEQ ID NO: 1110006 - protein, 9 aa, Homo Sapiens
CSFPHNFVL

SEQ ID NO: 1110007 - protein, 9 aa, Homo Sapiens
KVKHPEWSR

SEQ ID NO: 1110008 - protein, 9 aa, Homo Sapiens
EPQEVDIDE

SEQ ID NO: 1110009 - protein, 9 aa, Homo Sapiens
SNLLFIFCF

SEQ ID NO: 1110010 - protein, 9 aa, Homo Sapiens
PCYINKDCD

SEQ ID NO: 1110011 - protein, 9 aa, Homo Sapiens
RITPSSSCA

SEQ ID NO: 1110012 - protein, 9 aa, Homo Sapiens
PSSVLSDSV

SEQ ID NO: 1110013 - protein, 9 aa, Homo Sapiens
ICFEGADYE

SEQ ID NO: 1110014 - protein, 9 aa, Homo Sapiens
VFLMALSEN

SEQ ID NO: 1110015 - protein, 9 aa, Homo Sapiens
VTISQNAGR

SEQ ID NO: 1110016 - protein, 9 aa, Homo Sapiens
VQLVLMLPL

SEQ ID NO: 1110017 - protein, 9 aa, Homo Sapiens
LFSENPYPN

SEQ ID NO: 1110018 - protein, 9 aa, Homo Sapiens
EAAKLVVQW

SEQ ID NO: 1110019 - protein, 9 aa, Homo Sapiens
NFGSVARMC

SEQ ID NO: 1110020 - protein, 9 aa, Homo Sapiens
RNRGDLETA

SEQ ID NO: 1110021 - protein, 9 aa, Homo Sapiens
FAVFRKILQ

SEQ ID NO: 1110022 - protein, 9 aa, Homo Sapiens
TPELDMVAP

SEQ ID NO: 1110023 - protein, 9 aa, Homo Sapiens
TQHRHLLHC

SEQ ID NO: 1110024 - protein, 9 aa, Homo Sapiens
TLKSNKYNS

SEQ ID NO: 1110025 - protein, 9 aa, Homo Sapiens
VHDGGMLIL

SEQ ID NO: 1110026 - protein, 9 aa, Homo Sapiens
LSENAVLIL

SEQ ID NO: 1110027 - protein, 9 aa, Homo Sapiens
IYHGGKPLC

SEQ ID NO: 1110028 - protein, 9 aa, Homo Sapiens
PKEKISIFS

SEQ ID NO: 1110029 - protein, 9 aa, Homo Sapiens
QAPPSCLRF

SEQ ID NO: 1110030 - protein, 9 aa, Homo Sapiens
SSNNFTKKT

SEQ ID NO: 1110031 - protein, 9 aa, Homo Sapiens
RHLLHCLEK

SEQ ID NO: 1110032 - protein, 9 aa, Homo Sapiens
NIGIGQSQD

SEQ ID NO: 1110033 - protein, 9 aa, Homo Sapiens
LHRLRYKGI

SEQ ID NO: 1110034 - protein, 9 aa, Homo Sapiens
ALSRTTTPS

SEQ ID NO: 1110035 - protein, 9 aa, Homo Sapiens
VLMLPLPFC

SEQ ID NO: 1110036 - protein, 9 aa, Homo Sapiens
TPSRRCNGF

SEQ ID NO: 1110037 - protein, 9 aa, Homo Sapiens
KDLLAGGVT

SEQ ID NO: 1110038 - protein, 9 aa, Homo Sapiens
CGKVKHPEW

SEQ ID NO: 1110039 - protein, 9 aa, Homo Sapiens
SGTAPTDSW

SEQ ID NO: 1110040 - protein, 9 aa, Homo Sapiens
GHYEVRASW

SEQ ID NO: 1110041 - protein, 9 aa, Homo Sapiens
PSSNQLFGK

SEQ ID NO: 1110042 - protein, 9 aa, Homo Sapiens
LDVFYTILT

SEQ ID NO: 1110043 - protein, 9 aa, Homo Sapiens
SQGSHSSRI

SEQ ID NO: 1110044 - protein, 9 aa, Homo Sapiens
RTGIYHGGK

SEQ ID NO: 1110045 - protein, 9 aa, Homo Sapiens
APTDSWLRP

SEQ ID NO: 1110046 - protein, 9 aa, Homo Sapiens
KPLCDNVNT

SEQ ID NO: 1110047 - protein, 9 aa, Homo Sapiens
RFEAAKLVV

SEQ ID NO: 1110048 - protein, 9 aa, Homo Sapiens
KIMKLSLPE

SEQ ID NO: 1110049 - protein, 9 aa, Homo Sapiens
AKLVVQWLC

SEQ ID NO: 1110050 - protein, 9 aa, Homo Sapiens
KSPCYINKD

SEQ ID NO: 1110051 - protein, 9 aa, Homo Sapiens
FPALKKNKN

SEQ ID NO: 1110052 - protein, 9 aa, Homo Sapiens
RQECSKVRE

SEQ ID NO: 1110053 - protein, 9 aa, Homo Sapiens
ESSLLVPMG

SEQ ID NO: 1110054 - protein, 9 aa, Homo Sapiens
IKKDILERN

SEQ ID NO: 1110055 - protein, 9 aa, Homo Sapiens
RTRAPSSCT

SEQ ID NO: 1110056 - protein, 9 aa, Homo Sapiens
CRRNLDIES

SEQ ID NO: 1110057 - protein, 9 aa, Homo Sapiens
YSLFCKSTL

SEQ ID NO: 1110058 - protein, 9 aa, Homo Sapiens
EGFKANLCL

SEQ ID NO: 1110059 - protein, 9 aa, Homo Sapiens
DVVQSIQVE

SEQ ID NO: 1110060 - protein, 9 aa, Homo Sapiens
ILLFYTPAF

SEQ ID NO: 1110061 - protein, 9 aa, Homo Sapiens
PPYSLFCKS

SEQ ID NO: 1110062 - protein, 9 aa, Homo Sapiens
ETPELDMVA

SEQ ID NO: 1110063 - protein, 9 aa, Homo Sapiens
WFRTRAPSS

SEQ ID NO: 1110064 - protein, 9 aa, Homo Sapiens
RQLGFGQTT

SEQ ID NO: 1110065 - protein, 9 aa, Homo Sapiens
ATNMSTHFR

SEQ ID NO: 1110066 - protein, 9 aa, Homo Sapiens
AGLAVKREG

SEQ ID NO: 1110067 - protein, 9 aa, Homo Sapiens
VGPKKPLPD

SEQ ID NO: 1110068 - protein, 9 aa, Homo Sapiens
EDLNILFSE

SEQ ID NO: 1110069 - protein, 9 aa, Homo Sapiens
CAEPCQSSA

SEQ ID NO: 1110070 - protein, 9 aa, Homo Sapiens
SIRCTGELP

SEQ ID NO: 1110071 - protein, 9 aa, Homo Sapiens
LWLAIELAI

SEQ ID NO: 1110072 - protein, 9 aa, Homo Sapiens
GLAVKREGR

SEQ ID NO: 1110073 - protein, 9 aa, Homo Sapiens
RFSESSRKG

SEQ ID NO: 1110074 - protein, 9 aa, Homo Sapiens
SSRITPSSS

SEQ ID NO: 1110075 - protein, 9 aa, Homo Sapiens
RIAWRLCRE

SEQ ID NO: 1110076 - protein, 9 aa, Homo Sapiens
FLMALSENA

SEQ ID NO: 1110077 - protein, 9 aa, Homo Sapiens
SPGTWTICF

SEQ ID NO: 1110078 - protein, 9 aa, Homo Sapiens
NPPYSLFCK

SEQ ID NO: 1110079 - protein, 9 aa, Homo Sapiens
TTKLTRIAW

SEQ ID NO: 1110080 - protein, 9 aa, Homo Sapiens
FHNTTPSSN

SEQ ID NO: 1110081 - protein, 9 aa, Homo Sapiens
RWWYMLLIF

SEQ ID NO: 1110082 - protein, 9 aa, Homo Sapiens
DLLAGGVTA

SEQ ID NO: 1110083 - protein, 9 aa, Homo Sapiens
HPEWSRNEI

SEQ ID NO: 1110084 - protein, 9 aa, Homo Sapiens
EHCRQEVQE

SEQ ID NO: 1110085 - protein, 9 aa, Homo Sapiens
AAAGLAVKR

SEQ ID NO: 1110086 - protein, 9 aa, Homo Sapiens
LLFYTPAFF

SEQ ID NO: 1110087 - protein, 9 aa, Homo Sapiens
FQIPIEIKK

SEQ ID NO: 1110088 - protein, 9 aa, Homo Sapiens
LLAGGVTAA

SEQ ID NO: 1110089 - protein, 9 aa, Homo Sapiens
MSTHFRGCV

SEQ ID NO: 1110090 - protein, 9 aa, Homo Sapiens
VKTKQIHKA

SEQ ID NO: 1110091 - protein, 9 aa, Homo Sapiens
VAPALLNNP

SEQ ID NO: 1110092 - protein, 9 aa, Homo Sapiens
LSWAARATR

SEQ ID NO: 1110093 - protein, 9 aa, Homo Sapiens
TAACRSTSS

SEQ ID NO: 1110094 - protein, 9 aa, Homo Sapiens
LVNKDSTRM

SEQ ID NO: 1110095 - protein, 9 aa, Homo Sapiens
FPHNFVLLV

SEQ ID NO: 1110096 - protein, 9 aa, Homo Sapiens
WLAIELAIV

SEQ ID NO: 1110097 - protein, 9 aa, Homo Sapiens
SNNFTKKTQ

SEQ ID NO: 1110098 - protein, 9 aa, Homo Sapiens
KNWAVTHPD

SEQ ID NO: 1110099 - protein, 9 aa, Homo Sapiens
KRRWNRCQY

SEQ ID NO: 1110100 - protein, 9 aa, Homo Sapiens
LCAEPCQSS

SEQ ID NO: 1110101 - protein, 9 aa, Homo Sapiens
RIDGLVLQI

SEQ ID NO: 1110102 - protein, 9 aa, Homo Sapiens
CRSTSSRIT

SEQ ID NO: 1110103 - protein, 9 aa, Homo Sapiens
VCVILLFYT

SEQ ID NO: 1110104 - protein, 9 aa, Homo Sapiens
IVKREEKGD

SEQ ID NO: 1110105 - protein, 9 aa, Homo Sapiens
AFQAPPSCL

SEQ ID NO: 1110106 - protein, 9 aa, Homo Sapiens
ETQHRHLLH

SEQ ID NO: 1110107 - protein, 9 aa, Homo Sapiens
ITGKLADVK

SEQ ID NO: 1110108 - protein, 9 aa, Homo Sapiens
KEIVKREEK

SEQ ID NO: 1110109 - protein, 9 aa, Homo Sapiens
SESSRKGAI

SEQ ID NO: 1110110 - protein, 9 aa, Homo Sapiens
TIAIMLTLS

SEQ ID NO: 1110111 - protein, 9 aa, Homo Sapiens
VKSQPSVQF

SEQ ID NO: 1110112 - protein, 9 aa, Homo Sapiens
KVGPKKPLP

SEQ ID NO: 1110113 - protein, 9 aa, Homo Sapiens
VSTIAIMLT

SEQ ID NO: 1110114 - protein, 9 aa, Homo Sapiens
THFRGCVGE

SEQ ID NO: 1110115 - protein, 9 aa, Homo Sapiens
FSESSRKGA

SEQ ID NO: 1110116 - protein, 9 aa, Homo Sapiens
NLDIESPTY

SEQ ID NO: 1110117 - protein, 9 aa, Homo Sapiens
FNNSEVYGF

SEQ ID NO: 1110118 - protein, 9 aa, Homo Sapiens
QIPIEIKKD

SEQ ID NO: 1110119 - protein, 9 aa, Homo Sapiens
CTSATAACR

SEQ ID NO: 1110120 - protein, 9 aa, Homo Sapiens
FLSSVADVV

SEQ ID NO: 1110121 - protein, 9 aa, Homo Sapiens
SSVADVVQS

SEQ ID NO: 1110122 - protein, 9 aa, Homo Sapiens
ATAACRSTS

SEQ ID NO: 1110123 - protein, 9 aa, Homo Sapiens
DFNNSEVYG

SEQ ID NO: 1110124 - protein, 9 aa, Homo Sapiens
LQIDCGSYH

SEQ ID NO: 1110125 - protein, 9 aa, Homo Sapiens
IDFNNSEVY

SEQ ID NO: 1110126 - protein, 9 aa, Homo Sapiens
REEKGDYYL

SEQ ID NO: 1110127 - protein, 9 aa, Homo Sapiens
LPQKPYNNI

SEQ ID NO: 1110128 - protein, 9 aa, Homo Sapiens
TWTICFEGA

SEQ ID NO: 1110129 - protein, 9 aa, Homo Sapiens
ILIKKPKEK

SEQ ID NO: 1110130 - protein, 9 aa, Homo Sapiens
SPCYINKDC

SEQ ID NO: 1110131 - protein, 9 aa, Homo Sapiens
LVLMLPLPF

SEQ ID NO: 1110132 - protein, 9 aa, Homo Sapiens
LAIELAIVG

SEQ ID NO: 1110133 - protein, 9 aa, Homo Sapiens
QECSKVREE

SEQ ID NO: 1110134 - protein, 9 aa, Homo Sapiens
ITNNFGSVA

SEQ ID NO: 1110135 - protein, 9 aa, Homo Sapiens
RTTTPSDSY

SEQ ID NO: 1110136 - protein, 9 aa, Homo Sapiens
CNGFLLPLV

SEQ ID NO: 1110137 - protein, 9 aa, Homo Sapiens
PQKPYNNIG

SEQ ID NO: 1110138 - protein, 9 aa, Homo Sapiens
YHGGKPLCD

SEQ ID NO: 1110139 - protein, 9 aa, Homo Sapiens
RREQQLRHE

SEQ ID NO: 1110140 - protein, 9 aa, Homo Sapiens
GVTAAVSKT

SEQ ID NO: 1110141 - protein, 9 aa, Homo Sapiens
KKPKEKISI

SEQ ID NO: 1110142 - protein, 9 aa, Homo Sapiens
YINKDCDLD

SEQ ID NO: 1110143 - protein, 9 aa, Homo Sapiens
DKAWQPPTA

SEQ ID NO: 1110144 - protein, 9 aa, Homo Sapiens
PTGKVGPKK

SEQ ID NO: 1110145 - protein, 9 aa, Homo Sapiens
ASNLLFIFC

SEQ ID NO: 1110146 - protein, 9 aa, Homo Sapiens
IAIMLTLSC

SEQ ID NO: 1110147 - protein, 9 aa, Homo Sapiens
IHKPTVSAL

SEQ ID NO: 1110148 - protein, 9 aa, Homo Sapiens
VYGFSEFFY

SEQ ID NO: 1110149 - protein, 9 aa, Homo Sapiens
HMALSRTTT

SEQ ID NO: 1110150 - protein, 9 aa, Homo Sapiens
VHSIVQLVL

SEQ ID NO: 1110151 - protein, 9 aa, Homo Sapiens
KDILERNIS

SEQ ID NO: 1110152 - protein, 9 aa, Homo Sapiens
NSEVYGFSE

SEQ ID NO: 1110153 - protein, 9 aa, Homo Sapiens
STSSRITPS

SEQ ID NO: 1110154 - protein, 9 aa, Homo Sapiens
TTPSDSYCA

SEQ ID NO: 1110155 - protein, 9 aa, Homo Sapiens
YVMEEESAE

SEQ ID NO: 1110156 - protein, 9 aa, Homo Sapiens
RAPSSCTSA

SEQ ID NO: 1110157 - protein, 9 aa, Homo Sapiens
VFRKILQFL

SEQ ID NO: 1110158 - protein, 9 aa, Homo Sapiens
WAARATRPL

SEQ ID NO: 1110159 - protein, 9 aa, Homo Sapiens
HYGDSREAG

SEQ ID NO: 1110160 - protein, 9 aa, Homo Sapiens
SHVCVILLF

SEQ ID NO: 1110161 - protein, 9 aa, Homo Sapiens
FRTRAPSSC

SEQ ID NO: 1110162 - protein, 9 aa, Homo Sapiens
EVMERPHHG

SEQ ID NO: 1110163 - protein, 9 aa, Homo Sapiens
GSSFETQHR

SEQ ID NO: 1110164 - protein, 9 aa, Homo Sapiens
IAWRLCREI

SEQ ID NO: 1110165 - protein, 9 aa, Homo Sapiens
ESPSSVLSD

SEQ ID NO: 1110166 - protein, 9 aa, Homo Sapiens
DVADLHRLR

SEQ ID NO: 1110167 - protein, 9 aa, Homo Sapiens
GPRAFSSCS

SEQ ID NO: 1110168 - protein, 9 aa, Homo Sapiens
FKGVECRGA

SEQ ID NO: 1110169 - protein, 9 aa, Homo Sapiens
KKDILERNI

SEQ ID NO: 1110170 - protein, 9 aa, Homo Sapiens
KREEKGDYY

SEQ ID NO: 1110171 - protein, 9 aa, Homo Sapiens
AQDKAWQPP

SEQ ID NO: 1110172 - protein, 9 aa, Homo Sapiens
DGVTPLHNA

SEQ ID NO: 1110173 - protein, 9 aa, Homo Sapiens
EVYGFSEFF

SEQ ID NO: 1110174 - protein, 9 aa, Homo Sapiens
YSGYSQGSH

SEQ ID NO: 1110175 - protein, 9 aa, Homo Sapiens
LVTITNNFG

SEQ ID NO: 1110176 - protein, 9 aa, Homo Sapiens
QHRHLLHCL

SEQ ID NO: 1110177 - protein, 9 aa, Homo Sapiens
PIKGPFAVF

SEQ ID NO: 1110178 - protein, 9 aa, Homo Sapiens
LIKKPKEKI

SEQ ID NO: 1110179 - protein, 9 aa, Homo Sapiens
DVKSQPSVQ

SEQ ID NO: 1110180 - protein, 9 aa, Homo Sapiens
LTRIAWRLC

SEQ ID NO: 1110181 - protein, 9 aa, Homo Sapiens
RDRPSIRCT

SEQ ID NO: 1110182 - protein, 9 aa, Homo Sapiens
LITGKLADV

SEQ ID NO: 1110183 - protein, 9 aa, Homo Sapiens
YNIFKGVEC

SEQ ID NO: 1110184 - protein, 9 aa, Homo Sapiens
EVRASWLEL

SEQ ID NO: 1110185 - protein, 9 aa, Homo Sapiens
AARATRPLP

SEQ ID NO: 1110186 - protein, 9 aa, Homo Sapiens
LAVKREGRL

SEQ ID NO: 1110187 - protein, 9 aa, Homo Sapiens
NNSEVYGFS

SEQ ID NO: 1110188 - protein, 9 aa, Homo Sapiens
ADLHRLRYK

SEQ ID NO: 1110189 - protein, 9 aa, Homo Sapiens
QKPYNNIGI

SEQ ID NO: 1110190 - protein, 9 aa, Homo Sapiens
EDKVLDVFY

SEQ ID NO: 1110191 - protein, 9 aa, Homo Sapiens
PKEIVKREE

SEQ ID NO: 1110192 - protein, 9 aa, Homo Sapiens
RAFSSCSYT

SEQ ID NO: 1110193 - protein, 9 aa, Homo Sapiens
ADVKSQPSV

SEQ ID NO: 1110194 - protein, 9 aa, Homo Sapiens
KGPFAVFRK

SEQ ID NO: 1110195 - protein, 9 aa, Homo Sapiens
KLSLPESLK

SEQ ID NO: 1110196 - protein, 9 aa, Homo Sapiens
TEEDRKTGN

SEQ ID NO: 1110197 - protein, 9 aa, Homo Sapiens
ATRPLPLFL

SEQ ID NO: 1110198 - protein, 9 aa, Homo Sapiens
DKVLDVFYT

SEQ ID NO: 1110199 - protein, 9 aa, Homo Sapiens
DRPSIRCTG

SEQ ID NO: 1110200 - protein, 9 aa, Homo Sapiens
SPTYTNLNR

SEQ ID NO: 1110201 - protein, 9 aa, Homo Sapiens
TKYFVLTPP

SEQ ID NO: 1110202 - protein, 9 aa, Homo Sapiens
LPWDPTGKV

SEQ ID NO: 1110203 - protein, 9 aa, Homo Sapiens
QNGTHYGDS

SEQ ID NO: 1110204 - protein, 9 aa, Homo Sapiens
IFHNTTPSS

SEQ ID NO: 1110205 - protein, 9 aa, Homo Sapiens
NLLFIFCFL

SEQ ID NO: 1110206 - protein, 9 aa, Homo Sapiens
VSALFTGPE

SEQ ID NO: 1110207 - protein, 9 aa, Homo Sapiens
PYNNIGIGQ

SEQ ID NO: 1110208 - protein, 9 aa, Homo Sapiens
FEAAKLVVQ

SEQ ID NO: 1110209 - protein, 9 aa, Homo Sapiens
SCTSATAAC

SEQ ID NO: 1110210 - protein, 9 aa, Homo Sapiens
SNQLFGKEA

SEQ ID NO: 1110211 - protein, 9 aa, Homo Sapiens
HYEVRASWL

SEQ ID NO: 1110212 - protein, 9 aa, Homo Sapiens
GTAPTDSWL

SEQ ID NO: 1110213 - protein, 9 aa, Homo Sapiens
PWDPTGKVG

SEQ ID NO: 1110214 - protein, 9 aa, Homo Sapiens
SRTTTPSDS

SEQ ID NO: 1110215 - protein, 9 aa, Homo Sapiens
VERIDGLVL

SEQ ID NO: 1110216 - protein, 9 aa, Homo Sapiens
AWQPPTAAA

SEQ ID NO: 1110217 - protein, 9 aa, Homo Sapiens
FVTKCAFQA

SEQ ID NO: 1110218 - protein, 9 aa, Homo Sapiens
LDLDFPALK

SEQ ID NO: 1110219 - protein, 9 aa, Homo Sapiens
YVESSLLVP

SEQ ID NO: 1110220 - protein, 9 aa, Homo Sapiens
GGVTAAVSK

SEQ ID NO: 1110221 - protein, 9 aa, Homo Sapiens
SALFTGPEE

SEQ ID NO: 1110222 - protein, 9 aa, Homo Sapiens
FAASNLLFI

SEQ ID NO: 1110223 - protein, 9 aa, Homo Sapiens
LILLPFLLR

SEQ ID NO: 1110224 - protein, 9 aa, Homo Sapiens
ANLCLLRRP

SEQ ID NO: 1110225 - protein, 9 aa, Homo Sapiens
SATAACRST

SEQ ID NO: 1110226 - protein, 9 aa, Homo Sapiens
TRPLPLFLG

SEQ ID NO: 1110227 - protein, 9 aa, Homo Sapiens
LSYVNGTKA

SEQ ID NO: 1110228 - protein, 9 aa, Homo Sapiens
MEIHQLTEE

SEQ ID NO: 1110229 - protein, 9 aa, Homo Sapiens
VRASWLELD

SEQ ID NO: 1110230 - protein, 9 aa, Homo Sapiens
LMALSENAV

SEQ ID NO: 1110231 - protein, 9 aa, Homo Sapiens
TSATAACRS

SEQ ID NO: 1110232 - protein, 9 aa, Homo Sapiens
RHEQEEERR

SEQ ID NO: 1110233 - protein, 9 aa, Homo Sapiens
PPIKGPFAV

SEQ ID NO: 1110234 - protein, 9 aa, Homo Sapiens
LPRTDSHLT

SEQ ID NO: 1110235 - protein, 9 aa, Homo Sapiens
HGGKPLCDN

SEQ ID NO: 1110236 - protein, 9 aa, Homo Sapiens
ESEPQEVDI

SEQ ID NO: 1110237 - protein, 9 aa, Homo Sapiens
IQALGTKYF

SEQ ID NO: 1110238 - protein, 9 aa, Homo Sapiens
GGKPLCDNV

SEQ ID NO: 1110239 - protein, 9 aa, Homo Sapiens
DLHRLRYKG

SEQ ID NO: 1110240 - protein, 9 aa, Homo Sapiens
NKDSTRMDS

SEQ ID NO: 1110241 - protein, 9 aa, Homo Sapiens
AWRLCREIL

SEQ ID NO: 1110242 - protein, 9 aa, Homo Sapiens
GIYHGGKPL

SEQ ID NO: 1110243 - protein, 9 aa, Homo Sapiens
ASLKAVRSS

SEQ ID NO: 1110244 - protein, 9 aa, Homo Sapiens
QPYVESSLL

SEQ ID NO: 1110245 - protein, 9 aa, Homo Sapiens
TKLTRIAWR

SEQ ID NO: 1110246 - protein, 9 aa, Homo Sapiens
KSNKYNSSL

SEQ ID NO: 1110247 - protein, 9 aa, Homo Sapiens
CVDIRWWYM

SEQ ID NO: 1110248 - protein, 9 aa, Homo Sapiens
FTKKTQLLL

SEQ ID NO: 1110249 - protein, 9 aa, Homo Sapiens
HPLLYMATV

SEQ ID NO: 1110250 - protein, 9 aa, Homo Sapiens
KEKISIFSL

SEQ ID NO: 1110251 - protein, 9 aa, Homo Sapiens
SLLVPMGGV

SEQ ID NO: 1110252 - protein, 9 aa, Homo Sapiens
ITPSSSCAH

SEQ ID NO: 1110253 - protein, 9 aa, Homo Sapiens
SSRKGAITF

SEQ ID NO: 1110254 - protein, 9 aa, Homo Sapiens
ILLITEEDR

SEQ ID NO: 1110255 - protein, 9 aa, Homo Sapiens
GILIKKPKE

SEQ ID NO: 1110256 - protein, 9 aa, Homo Sapiens
AACRSTSSR

SEQ ID NO: 1110257 - protein, 9 aa, Homo Sapiens
NKYNSSLVH

SEQ ID NO: 1110258 - protein, 9 aa, Homo Sapiens
DGLVLQIDC

SEQ ID NO: 1110259 - protein, 9 aa, Homo Sapiens
GSHSSRIFP

SEQ ID NO: 1110260 - protein, 9 aa, Homo Sapiens
TCVDIRWWY

SEQ ID NO: 1110261 - protein, 9 aa, Homo Sapiens
LMKNTVLIC

SEQ ID NO: 1110262 - protein, 9 aa, Homo Sapiens
SVLSDSVTT

SEQ ID NO: 1110263 - protein, 9 aa, Homo Sapiens
SLKAVRSSD

SEQ ID NO: 1110264 - protein, 9 aa, Homo Sapiens
ILMKNTVLI

SEQ ID NO: 1110265 - protein, 9 aa, Homo Sapiens
QLRHEQEEE

SEQ ID NO: 1110266 - protein, 9 aa, Homo Sapiens
WYMLLIFSL

SEQ ID NO: 1110267 - protein, 9 aa, Homo Sapiens
EIKKDILER

SEQ ID NO: 1110268 - protein, 9 aa, Homo Sapiens
VNKDSTRMD

SEQ ID NO: 1110269 - protein, 9 aa, Homo Sapiens
AGGVTAAVS

SEQ ID NO: 1110270 - protein, 9 aa, Homo Sapiens
TICFEGADY

SEQ ID NO: 1110271 - protein, 9 aa, Homo Sapiens
REKIMKLSL

SEQ ID NO: 1110272 - protein, 9 aa, Homo Sapiens
HDGGMLILL

SEQ ID NO: 1110273 - protein, 9 aa, Homo Sapiens
SGPRAFSSC

SEQ ID NO: 1110274 - protein, 9 aa, Homo Sapiens
IVQLVLMLP

SEQ ID NO: 1110275 - protein, 9 aa, Homo Sapiens
ERIDGLVLQ

SEQ ID NO: 1110276 - protein, 9 aa, Homo Sapiens
KQIHKAMLS

SEQ ID NO: 1110277 - protein, 9 aa, Homo Sapiens
LQRELYGRR

SEQ ID NO: 1110278 - protein, 9 aa, Homo Sapiens
QLGFGQTTA

SEQ ID NO: 1110279 - protein, 9 aa, Homo Sapiens
LRFSESSRK

SEQ ID NO: 1110280 - protein, 9 aa, Homo Sapiens
WWYMLLIFS

SEQ ID NO: 1110281 - protein, 9 aa, Homo Sapiens
NHTFSLGPV

SEQ ID NO: 1110282 - protein, 9 aa, Homo Sapiens
ASWLELDIE

SEQ ID NO: 1110283 - protein, 9 aa, Homo Sapiens
EQLDVADLH

SEQ ID NO: 1110284 - protein, 9 aa, Homo Sapiens
LDIESPTYT

SEQ ID NO: 1110285 - protein, 9 aa, Homo Sapiens
ESPTYTNLN

SEQ ID NO: 1110286 - protein, 9 aa, Homo Sapiens
AFSNLSYLI

SEQ ID NO: 1110287 - protein, 9 aa, Homo Sapiens
MKLSLPESL

SEQ ID NO: 1110288 - protein, 9 aa, Homo Sapiens
NTTPSSNQL

SEQ ID NO: 1110289 - protein, 9 aa, Homo Sapiens
LSDSVTTKA

SEQ ID NO: 1110290 - protein, 9 aa, Homo Sapiens
MALSENAVL

SEQ ID NO: 1110291 - protein, 9 aa, Homo Sapiens
SEGFKANLC

SEQ ID NO: 1110292 - protein, 9 aa, Homo Sapiens
EESEPQEVD

SEQ ID NO: 1110293 - protein, 9 aa, Homo Sapiens
HCRQEVQEL

SEQ ID NO: 1110294 - protein, 9 aa, Homo Sapiens
PGTLCAEPC

SEQ ID NO: 1110295 - protein, 9 aa, Homo Sapiens
DIRWWYMLL

SEQ ID NO: 1110296 - protein, 9 aa, Homo Sapiens
NWAVTHPDN

SEQ ID NO: 1110297 - protein, 9 aa, Homo Sapiens
VTAAVSKTA

SEQ ID NO: 1110298 - protein, 9 aa, Homo Sapiens
LNVEYNIFK

SEQ ID NO: 1110299 - protein, 9 aa, Homo Sapiens
SPGTLCAEP

SEQ ID NO: 1110300 - protein, 9 aa, Homo Sapiens
SLPESLKAY

SEQ ID NO: 1110301 - protein, 9 aa, Homo Sapiens
ADVVQSIQV

SEQ ID NO: 1110302 - protein, 9 aa, Homo Sapiens
YNSSLVHMI

SEQ ID NO: 1110303 - protein, 9 aa, Homo Sapiens
FALLFAASN

SEQ ID NO: 1110304 - protein, 9 aa, Homo Sapiens
LYEVMERPH

SEQ ID NO: 1110305 - protein, 9 aa, Homo Sapiens
SENPYPNPS

SEQ ID NO: 1110306 - protein, 9 aa, Homo Sapiens
TLVTITNNF

SEQ ID NO: 1110307 - protein, 9 aa, Homo Sapiens
FSLGPVPGA

SEQ ID NO: 1110308 - protein, 9 aa, Homo Sapiens
RTVLWLAIE

SEQ ID NO: 1110309 - protein, 9 aa, Homo Sapiens
TSSRITPSS

SEQ ID NO: 1110310 - protein, 9 aa, Homo Sapiens
SVTISQNAG

SEQ ID NO: 1110311 - protein, 9 aa, Homo Sapiens
CAFQAPPSC

SEQ ID NO: 1110312 - protein, 9 aa, Homo Sapiens
AAAAGLAVK

SEQ ID NO: 1110313 - protein, 9 aa, Homo Sapiens
NTVLICLAL

SEQ ID NO: 1110314 - protein, 9 aa, Homo Sapiens
TNMSTHFRG

SEQ ID NO: 1110315 - protein, 9 aa, Homo Sapiens
PIDFNNSEV

SEQ ID NO: 1110316 - protein, 9 aa, Homo Sapiens
RPSIRCTGE

SEQ ID NO: 1110317 - protein, 9 aa, Homo Sapiens
DLDFPALKK

SEQ ID NO: 1110318 - protein, 9 aa, Homo Sapiens
PEYQEHCRQ

SEQ ID NO: 1110319 - protein, 9 aa, Homo Sapiens
LLFAASNLL

SEQ ID NO: 1110320 - protein, 9 aa, Homo Sapiens
TTCVDIRWW

SEQ ID NO: 1110321 - protein, 9 aa, Homo Sapiens
VDKRRWNRC

SEQ ID NO: 1110322 - protein, 9 aa, Homo Sapiens
LRTWFRTRA

SEQ ID NO: 1110323 - protein, 9 aa, Homo Sapiens
CPVDKRRWN

SEQ ID NO: 1110324 - protein, 9 aa, Homo Sapiens
KLVVQWLCN

SEQ ID NO: 1110325 - protein, 9 aa, Homo Sapiens
NNIGIGQSQ

SEQ ID NO: 1110326 - protein, 9 aa, Homo Sapiens
HPEYQEHCR

SEQ ID NO: 1110327 - protein, 9 aa, Homo Sapiens
VNGTKALAI

SEQ ID NO: 1110328 - protein, 9 aa, Homo Sapiens
VVFLMALSE

SEQ ID NO: 1110329 - protein, 9 aa, Homo Sapiens
GYLSYVNGT

SEQ ID NO: 1110330 - protein, 9 aa, Homo Sapiens
PSSCTSATA

SEQ ID NO: 1110331 - protein, 9 aa, Homo Sapiens
QQLRHEQEE

SEQ ID NO: 1110332 - protein, 9 aa, Homo Sapiens
YVNGTKALA

SEQ ID NO: 1110333 - protein, 9 aa, Homo Sapiens
GTLCAEPCQ

SEQ ID NO: 1110334 - protein, 9 aa, Homo Sapiens
LPLPRTDSH

SEQ ID NO: 1110335 - protein, 9 aa, Homo Sapiens
WDPTGKVGP

SEQ ID NO: 1110336 - protein, 9 aa, Homo Sapiens
KLADVKSQP

SEQ ID NO: 1110337 - protein, 9 aa, Homo Sapiens
VSVTISQNA

SEQ ID NO: 1110338 - protein, 9 aa, Homo Sapiens
RSTSSRITP

SEQ ID NO: 1110339 - protein, 9 aa, Homo Sapiens
LGTKYFVLT

SEQ ID NO: 1110340 - protein, 9 aa, Homo Sapiens
FSNLSYLIQ

SEQ ID NO: 1110341 - protein, 9 aa, Homo Sapiens
QIHKAMLSL

SEQ ID NO: 1110342 - protein, 9 aa, Homo Sapiens
PIVSTIAIM

SEQ ID NO: 1110343 - protein, 9 aa, Homo Sapiens
TVSALFTGP

SEQ ID NO: 1110344 - protein, 9 aa, Homo Sapiens
HVCVILLFY

SEQ ID NO: 1110345 - protein, 9 aa, Homo Sapiens
LKSNKYNSS

SEQ ID NO: 1110346 - protein, 9 aa, Homo Sapiens
GTHYGDSRE

SEQ ID NO: 1110347 - protein, 9 aa, Homo Sapiens
TLCAEPCQS

SEQ ID NO: 1110348 - protein, 9 aa, Homo Sapiens
VVQPYVESS

SEQ ID NO: 1110349 - protein, 9 aa, Homo Sapiens
KYASLKAVR

SEQ ID NO: 1110350 - protein, 9 aa, Homo Sapiens
VVQWLCNHE

SEQ ID NO: 1110351 - protein, 9 aa, Homo Sapiens
FVHSIVQLV

SEQ ID NO: 1110352 - protein, 9 aa, Homo Sapiens
RRCNGFLLP

SEQ ID NO: 1110353 - protein, 9 aa, Homo Sapiens
HNALSNGHV

SEQ ID NO: 1110354 - protein, 9 aa, Homo Sapiens
SSCSYTSGP

SEQ ID NO: 1110355 - protein, 9 aa, Homo Sapiens
YNNIGIGQS

SEQ ID NO: 1110356 - protein, 9 aa, Homo Sapiens
TAPTDSWLR

SEQ ID NO: 1110357 - protein, 9 aa, Homo Sapiens
DVFYTILTP

SEQ ID NO: 1110358 - protein, 9 aa, Homo Sapiens
FCGKVKHPE

SEQ ID NO: 1110359 - protein, 9 aa, Homo Sapiens
SFETQHRHL

SEQ ID NO: 1110360 - protein, 9 aa, Homo Sapiens
SSCTSATAA

SEQ ID NO: 1110361 - protein, 9 aa, Homo Sapiens
VTITNNFGS

SEQ ID NO: 1110362 - protein, 9 aa, Homo Sapiens
ILPQKPYNN

SEQ ID NO: 1110363 - protein, 9 aa, Homo Sapiens
NNFTKKTQL

SEQ ID NO: 1110364 - protein, 9 aa, Homo Sapiens
CAKNILLIT

SEQ ID NO: 1110365 - protein, 9 aa, Homo Sapiens
GKVGPKKPL

SEQ ID NO: 1110366 - protein, 9 aa, Homo Sapiens
KAVRSSDGD

SEQ ID NO: 1110367 - protein, 9 aa, Homo Sapiens
NMSTHFRGC

SEQ ID NO: 1110368 - protein, 9 aa, Homo Sapiens
PELDMVAPA

SEQ ID NO: 1110369 - protein, 9 aa, Homo Sapiens
RRNLDIESP

SEQ ID NO: 1110370 - protein, 9 aa, Homo Sapiens
SNLSYLIQH

SEQ ID NO: 1110371 - protein, 9 aa, Homo Sapiens
HRNRGDLET

SEQ ID NO: 1110372 - protein, 9 aa, Homo Sapiens
VHPLLYMAT

SEQ ID NO: 1110373 - protein, 9 aa, Homo Sapiens
DIHRNRGDL

SEQ ID NO: 1110374 - protein, 9 aa, Homo Sapiens
RMDSGAYTL

SEQ ID NO: 1110375 - protein, 9 aa, Homo Sapiens
NGTHYGDSR

SEQ ID NO: 1110376 - protein, 9 aa, Homo Sapiens
DVSNHTFSL

SEQ ID NO: 1110377 - protein, 9 aa, Homo Sapiens
DPTGKVGPK

SEQ ID NO: 1110378 - protein, 9 aa, Homo Sapiens
QEVDIDEIL

SEQ ID NO: 1110379 - protein, 9 aa, Homo Sapiens
RATRPLPLF

SEQ ID NO: 1110380 - protein, 9 aa, Homo Sapiens
KVREELRLQ

SEQ ID NO: 1110381 - protein, 9 aa, Homo Sapiens
DLNILFSEN

SEQ ID NO: 1110382 - protein, 9 aa, Homo Sapiens
GPSCSFPHN

SEQ ID NO: 1110383 - protein, 9 aa, Homo Sapiens
PLHNALSNG

SEQ ID NO: 1110384 - protein, 9 aa, Homo Sapiens
THYGDSREA

SEQ ID NO: 1110385 - protein, 9 aa, Homo Sapiens
VLWLAIELA

SEQ ID NO: 1110386 - protein, 9 aa, Homo Sapiens
QGSHSSRIF

SEQ ID NO: 1110387 - protein, 9 aa, Homo Sapiens
AIMLTLSCH

SEQ ID NO: 1110388 - protein, 9 aa, Homo Sapiens
SWLELDIEI

SEQ ID NO: 1110389 - protein, 9 aa, Homo Sapiens
HKPTVSALF

SEQ ID NO: 1110390 - protein, 9 aa, Homo Sapiens
PVDKRRWNR

SEQ ID NO: 1110391 - protein, 9 aa, Homo Sapiens
GEESEPQEV

SEQ ID NO: 1110392 - protein, 9 aa, Homo Sapiens
KDSTRMDSG

SEQ ID NO: 1110393 - protein, 9 aa, Homo Sapiens
SKVREELRL

SEQ ID NO: 1110394 - protein, 9 aa, Homo Sapiens
PSRRCNGFL

SEQ ID NO: 1110395 - protein, 9 aa, Homo Sapiens
IHQLTEEDR

SEQ ID NO: 1110396 - protein, 9 aa, Homo Sapiens
MATVPSLGC

SEQ ID NO: 1110397 - protein, 9 aa, Homo Sapiens
KREGRLGEK

SEQ ID NO: 1110398 - protein, 9 aa, Homo Sapiens
KAWQPPTAA

SEQ ID NO: 1110399 - protein, 9 aa, Homo Sapiens
ELDMVAPAL

SEQ ID NO: 1110400 - protein, 9 aa, Homo Sapiens
KLTRIAWRL

SEQ ID NO: 1110401 - protein, 9 aa, Homo Sapiens
IMKLSLPES

SEQ ID NO: 1110402 - protein, 9 aa, Homo Sapiens
GGKSPCYIN

SEQ ID NO: 1110403 - protein, 9 aa, Homo Sapiens
TVLWLAIEL

SEQ ID NO: 1110404 - protein, 9 aa, Homo Sapiens
CFCGKVKHP

SEQ ID NO: 1110405 - protein, 9 aa, Homo Sapiens
VKREEKGDY

SEQ ID NO: 1110406 - protein, 9 aa, Homo Sapiens
WRLCREILR

SEQ ID NO: 1110407 - protein, 9 aa, Homo Sapiens
EYNIFKGVE

SEQ ID NO: 1110408 - protein, 9 aa, Homo Sapiens
VADVVQSIQ

SEQ ID NO: 1110409 - protein, 9 aa, Homo Sapiens
PHNFVLLVQ

SEQ ID NO: 1110410 - protein, 9 aa, Homo Sapiens
WNRCQYCRF

SEQ ID NO: 1110411 - protein, 9 aa, Homo Sapiens
SAECLRLQA

SEQ ID NO: 1110412 - protein, 9 aa, Homo Sapiens
LCFADIHRN

SEQ ID NO: 1110413 - protein, 9 aa, Homo Sapiens
HKAMLSLLL

SEQ ID NO: 1110414 - protein, 9 aa, Homo Sapiens
ATVPSLGCC

SEQ ID NO: 1110415 - protein, 9 aa, Homo Sapiens
SEPQEVDID

SEQ ID NO: 1110416 - protein, 9 aa, Homo Sapiens
LLITEEDRK

SEQ ID NO: 1110417 - protein, 9 aa, Homo Sapiens
RELQRELYG

SEQ ID NO: 1110418 - protein, 9 aa, Homo Sapiens
HEQEEERRE

SEQ ID NO: 1110419 - protein, 9 aa, Homo Sapiens
HQGPSCSFP

SEQ ID NO: 1110420 - protein, 9 aa, Homo Sapiens
THPDNWHGH

SEQ ID NO: 1110421 - protein, 9 aa, Homo Sapiens
GMPQNGTHY

SEQ ID NO: 1110422 - protein, 9 aa, Homo Sapiens
IFKGVECRG

SEQ ID NO: 1110423 - protein, 9 aa, Homo Sapiens
VTKCAFQAP

SEQ ID NO: 1110424 - protein, 9 aa, Homo Sapiens
LREKIMKLS

SEQ ID NO: 1110425 - protein, 9 aa, Homo Sapiens
SRELQRELY

SEQ ID NO: 1110426 - protein, 9 aa, Homo Sapiens
HRHLLHCLE

SEQ ID NO: 1110427 - protein, 9 aa, Homo Sapiens
VDIDEILRL

SEQ ID NO: 1110428 - protein, 9 aa, Homo Sapiens
IVHDGGMLI

SEQ ID NO: 1110429 - protein, 9 aa, Homo Sapiens
YMATVPSLG

SEQ ID NO: 1110430 - protein, 9 aa, Homo Sapiens
EIHQLTEED

SEQ ID NO: 1110431 - protein, 9 aa, Homo Sapiens
WQPPTAAAA

SEQ ID NO: 1110432 - protein, 9 aa, Homo Sapiens
LGFGQTTAK

SEQ ID NO: 1110433 - protein, 9 aa, Homo Sapiens
SSVLSDSVT

SEQ ID NO: 1110434 - protein, 9 aa, Homo Sapiens
SHSSRIFPS

SEQ ID NO: 1110435 - protein, 9 aa, Homo Sapiens
TVLICLALS

SEQ ID NO: 1110436 - protein, 9 aa, Homo Sapiens
ERPHHGRLA

SEQ ID NO: 1110437 - protein, 9 aa, Homo Sapiens
RASWLELDI

SEQ ID NO: 1110438 - protein, 9 aa, Homo Sapiens
IKGPFAVFR

SEQ ID NO: 1110439 - protein, 9 aa, Homo Sapiens
TWFRTRAPS

SEQ ID NO: 1110440 - protein, 9 aa, Homo Sapiens
SPSSVLSDS

SEQ ID NO: 1110441 - protein, 9 aa, Homo Sapiens
TNPPYSLFC

SEQ ID NO: 1110442 - protein, 9 aa, Homo Sapiens
SDSVTTKAT

SEQ ID NO: 1110443 - protein, 9 aa, Homo Sapiens
SLFCKSTLG

SEQ ID NO: 1110444 - protein, 9 aa, Homo Sapiens
RKGAITFTW

SEQ ID NO: 1110445 - protein, 9 aa, Homo Sapiens
ALSWAARAT

SEQ ID NO: 1110446 - protein, 9 aa, Homo Sapiens
RASVKRQLG

SEQ ID NO: 1110447 - protein, 9 aa, Homo Sapiens
NAGRYLCDF

SEQ ID NO: 1110448 - protein, 9 aa, Homo Sapiens
ITEEDRKTG

SEQ ID NO: 1110449 - protein, 9 aa, Homo Sapiens
ALQKMEIHQ

SEQ ID NO: 1110450 - protein, 9 aa, Homo Sapiens
GPFAVFRKI

SEQ ID NO: 1110451 - protein, 9 aa, Homo Sapiens
NVEYNIFKG

SEQ ID NO: 1110452 - protein, 9 aa, Homo Sapiens
VMEEESAEC

SEQ ID NO: 1110453 - protein, 9 aa, Homo Sapiens
KYNSSLVHM

SEQ ID NO: 1110454 - protein, 9 aa, Homo Sapiens
NIFKGVECR

SEQ ID NO: 1110455 - protein, 9 aa, Homo Sapiens
GYSQGSHSS

SEQ ID NO: 1110456 - protein, 9 aa, Homo Sapiens
HRLRYKGIR

SEQ ID NO: 1110457 - protein, 9 aa, Homo Sapiens
MERPHHGRL

SEQ ID NO: 1110458 - protein, 9 aa, Homo Sapiens
HNTTPSSNQ

SEQ ID NO: 1110459 - protein, 9 aa, Homo Sapiens
KGVECRGAP

SEQ ID NO: 1110460 - protein, 9 aa, Homo Sapiens
LRQECSKVR

SEQ ID NO: 1110461 - protein, 9 aa, Homo Sapiens
ESSRKGAIT

SEQ ID NO: 1110462 - protein, 9 aa, Homo Sapiens
MVAPALLNN

SEQ ID NO: 1110463 - protein, 9 aa, Homo Sapiens
QLVLMLPLP

SEQ ID NO: 1110464 - protein, 9 aa, Homo Sapiens
LSYLIQHHI

SEQ ID NO: 1110465 - protein, 9 aa, Homo Sapiens
WAVTHPDNW

SEQ ID NO: 1110466 - protein, 9 aa, Homo Sapiens
GWTPSRRCN

SEQ ID NO: 1110467 - protein, 9 aa, Homo Sapiens
FIPGYLSYV

SEQ ID NO: 1110468 - protein, 9 aa, Homo Sapiens
ASPGTLCAE

SEQ ID NO: 1110469 - protein, 9 aa, Homo Sapiens
YLSYVNGTK

SEQ ID NO: 1110470 - protein, 9 aa, Homo Sapiens
KRQLGFGQT

SEQ ID NO: 1110471 - protein, 9 aa, Homo Sapiens
TGIYHGGKP

SEQ ID NO: 1110472 - protein, 9 aa, Homo Sapiens
KANLCLLRR

SEQ ID NO: 1110473 - protein, 9 aa, Homo Sapiens
NSSLVHMIL

SEQ ID NO: 1110474 - protein, 9 aa, Homo Sapiens
GTKYFVLTP

SEQ ID NO: 1110475 - protein, 9 aa, Homo Sapiens
TVPSLGCCC

SEQ ID NO: 1110476 - protein, 9 aa, Homo Sapiens
EQQLRHEQE

SEQ ID NO: 1110477 - protein, 9 aa, Homo Sapiens
NILFSENPY

SEQ ID NO: 1110478 - protein, 9 aa, Homo Sapiens
STIAIMLTL

SEQ ID NO: 1110479 - protein, 9 aa, Homo Sapiens
AAGLAVKRE

SEQ ID NO: 1110480 - protein, 9 aa, Homo Sapiens
IPIEIKKDI

SEQ ID NO: 1110481 - protein, 9 aa, Homo Sapiens
KHPEYQEHC

SEQ ID NO: 1110482 - protein, 9 aa, Homo Sapiens
FGWTPSRRC

SEQ ID NO: 1110483 - protein, 9 aa, Homo Sapiens
DSVKTKQIH

SEQ ID NO: 1110484 - protein, 9 aa, Homo Sapiens
HPDNWHGHE

SEQ ID NO: 1110485 - protein, 9 aa, Homo Sapiens
PPLPLPRTD

SEQ ID NO: 1110486 - protein, 9 aa, Homo Sapiens
TDSWLRPDQ

SEQ ID NO: 1110487 - protein, 9 aa, Homo Sapiens
PATNMSTHF

SEQ ID NO: 1110488 - protein, 9 aa, Homo Sapiens
EIVKREEKG

SEQ ID NO: 1110489 - protein, 9 aa, Homo Sapiens
TISQNAGRY

SEQ ID NO: 1110490 - protein, 9 aa, Homo Sapiens
MLTLSCHIL

SEQ ID NO: 1110491 - protein, 9 aa, Homo Sapiens
LSLPESLKA

SEQ ID NO: 1110492 - protein, 9 aa, Homo Sapiens
QGPSCSFPH

SEQ ID NO: 1110493 - protein, 9 aa, Homo Sapiens
ALKKNKNID

SEQ ID NO: 1110494 - protein, 9 aa, Homo Sapiens
SNKYNSSLV

SEQ ID NO: 1110495 - protein, 9 aa, Homo Sapiens
ALFTGPEEL

SEQ ID NO: 1110496 - protein, 9 aa, Homo Sapiens
VTASPGTLC

SEQ ID NO: 1110497 - protein, 9 aa, Homo Sapiens
LSSVADVVQ

SEQ ID NO: 1110498 - protein, 9 aa, Homo Sapiens
VDGVTPLHN

SEQ ID NO: 1110499 - protein, 9 aa, Homo Sapiens
QLDVADLHR

SEQ ID NO: 1110500 - protein, 9 aa, Homo Sapiens
PRAFSSCSY

SEQ ID NO: 1110501 - protein, 9 aa, Homo Sapiens
GKAFSNLSY

SEQ ID NO: 1110502 - protein, 9 aa, Homo Sapiens
AVFRKILQF

SEQ ID NO: 1110503 - protein, 9 aa, Homo Sapiens
GLVLQIDCG

SEQ ID NO: 1110504 - protein, 9 aa, Homo Sapiens
IEIKKDILE

SEQ ID NO: 1110505 - protein, 9 aa, Homo Sapiens
LDMVAPALL

SEQ ID NO: 1110506 - protein, 9 aa, Homo Sapiens
VMERPHHGR

SEQ ID NO: 1110507 - protein, 9 aa, Homo Sapiens
DVSVTISQN

SEQ ID NO: 1110508 - protein, 9 aa, Homo Sapiens
APPSCLRFV

SEQ ID NO: 1110509 - protein, 9 aa, Homo Sapiens
RTDSHLTLL

SEQ ID NO: 1110510 - protein, 9 aa, Homo Sapiens
TKCAFQAPP

SEQ ID NO: 1110511 - protein, 9 aa, Homo Sapiens
SSNQLFGKE

SEQ ID NO: 1110512 - protein, 9 aa, Homo Sapiens
LNDVSNHTF

SEQ ID NO: 1110513 - protein, 9 aa, Homo Sapiens
ALWILMKNT

SEQ ID NO: 1110514 - protein, 9 aa, Homo Sapiens
ILFSENPYP

SEQ ID NO: 1110515 - protein, 9 aa, Homo Sapiens
RNLDIESPT

SEQ ID NO: 1110516 - protein, 9 aa, Homo Sapiens
KPYNNIGIG

SEQ ID NO: 1110517 - protein, 9 aa, Homo Sapiens
PRTVLWLAI

SEQ ID NO: 1110518 - protein, 9 aa, Homo Sapiens
STRMDSGAY

SEQ ID NO: 1110519 - protein, 9 aa, Homo Sapiens
VLQIDCGSY

SEQ ID NO: 1110520 - protein, 9 aa, Homo Sapiens
RHMALSRTT

SEQ ID NO: 1110521 - protein, 9 aa, Homo Sapiens
PTEDKVLDV

SEQ ID NO: 1110522 - protein, 9 aa, Homo Sapiens
VTHPDNWHG

SEQ ID NO: 1110523 - protein, 9 aa, Homo Sapiens
NKDCDLDIV

SEQ ID NO: 1110524 - protein, 9 aa, Homo Sapiens
AAKLVVQWL

SEQ ID NO: 1110525 - protein, 9 aa, Homo Sapiens
NDVSNHTFS

SEQ ID NO: 1110526 - protein, 9 aa, Homo Sapiens
TRMDSGAYT

SEQ ID NO: 1110527 - protein, 9 aa, Homo Sapiens
PYVESSLLV

SEQ ID NO: 1110528 - protein, 9 aa, Homo Sapiens
SVKTKQIHK

SEQ ID NO: 1110529 - protein, 9 aa, Homo Sapiens
VVQSIQVEL

SEQ ID NO: 1110530 - protein, 9 aa, Homo Sapiens
STHFRGCVG

SEQ ID NO: 1110531 - protein, 9 aa, Homo Sapiens
WLRPDQRLM

SEQ ID NO: 1110532 - protein, 9 aa, Homo Sapiens
RTWFRTRAP

SEQ ID NO: 1110533 - protein, 9 aa, Homo Sapiens
HHGRLAWRG

SEQ ID NO: 1110534 - protein, 9 aa, Homo Sapiens
TNNFGSVAR

SEQ ID NO: 1110535 - protein, 9 aa, Homo Sapiens
RSSDGDWAV

SEQ ID NO: 1110536 - protein, 9 aa, Homo Sapiens
PLLYMATVP

SEQ ID NO: 1110537 - protein, 9 aa, Homo Sapiens
LEDLNILFS

SEQ ID NO: 1110538 - protein, 9 aa, Homo Sapiens
KPTVSALFT

SEQ ID NO: 1110539 - protein, 9 aa, Homo Sapiens
GKSPCYINK

SEQ ID NO: 1110540 - protein, 9 aa, Homo Sapiens
SRRCNGFLL

SEQ ID NO: 1110541 - protein, 9 aa, Homo Sapiens
FKANLCLLR

SEQ ID NO: 1110542 - protein, 9 aa, Homo Sapiens
ALSENAVLI

SEQ ID NO: 1110543 - protein, 9 aa, Homo Sapiens
LNILFSENP

SEQ ID NO: 1110544 - protein, 9 aa, Homo Sapiens
GKVKHPEWS

SEQ ID NO: 1110545 - protein, 9 aa, Homo Sapiens
GKLADVKSQ

SEQ ID NO: 1110546 - protein, 9 aa, Homo Sapiens
PALKKNKNI

SEQ ID NO: 1110547 - protein, 9 aa, Homo Sapiens
TASPGTLCA

SEQ ID NO: 1110548 - protein, 9 aa, Homo Sapiens
KVLDVFYTI

SEQ ID NO: 1110549 - protein, 9 aa, Homo Sapiens
PSCSFPHNF

SEQ ID NO: 1110550 - protein, 9 aa, Homo Sapiens
RSPGTWTIC

SEQ ID NO: 1110551 - protein, 9 aa, Homo Sapiens
TITNNFGSV

SEQ ID NO: 1110552 - protein, 9 aa, Homo Sapiens
AVTHPDNWH

SEQ ID NO: 1110553 - protein, 9 aa, Homo Sapiens
LHNALSNGH

SEQ ID NO: 1110554 - protein, 9 aa, Homo Sapiens
ACRSTSSRI

SEQ ID NO: 1110555 - protein, 9 aa, Homo Sapiens
DFPALKKNK

SEQ ID NO: 1110556 - protein, 9 aa, Homo Sapiens
IKKPKEKIS

SEQ ID NO: 1110557 - protein, 9 aa, Homo Sapiens
ERREQQLRH

SEQ ID NO: 1110558 - protein, 9 aa, Homo Sapiens
VKRQLGFGQ

SEQ ID NO: 1110559 - protein, 9 aa, Homo Sapiens
TKKTQLLLF

SEQ ID NO: 1110560 - protein, 9 aa, Homo Sapiens
IVSTIAIML

SEQ ID NO: 1110561 - protein, 9 aa, Homo Sapiens
ENAVLILLI

SEQ ID NO: 1110562 - protein, 9 aa, Homo Sapiens
ATPAQDKAW

SEQ ID NO: 1110563 - protein, 9 aa, Homo Sapiens
SYVNGTKAL

SEQ ID NO: 1110564 - protein, 9 aa, Homo Sapiens
KKNKNIDNF

SEQ ID NO: 1110565 - protein, 9 aa, Homo Sapiens
PQEVDIDEI

SEQ ID NO: 1110566 - protein, 9 aa, Homo Sapiens
TKQIHKAML

SEQ ID NO: 1110567 - protein, 9 aa, Homo Sapiens
GFKANLCLL

SEQ ID NO: 1110568 - protein, 9 aa, Homo Sapiens
TTTPSDSYC

SEQ ID NO: 1110569 - protein, 9 aa, Homo Sapiens
MEEESAECL

SEQ ID NO: 1110570 - protein, 9 aa, Homo Sapiens
PLPLPRTDS

SEQ ID NO: 1110571 - protein, 9 aa, Homo Sapiens
MPQNGTHYG

SEQ ID NO: 1110572 - protein, 9 aa, Homo Sapiens
NALSNGHVE

SEQ ID NO: 1110573 - protein, 9 aa, Homo Sapiens
LKPISRELQ

SEQ ID NO: 1110574 - protein, 9 aa, Homo Sapiens
VQWLCNHED

SEQ ID NO: 1110575 - protein, 9 aa, Homo Sapiens
AFSSCSYTS

SEQ ID NO: 1110576 - protein, 9 aa, Homo Sapiens
PIEIKKDIL

SEQ ID NO: 1110577 - protein, 9 aa, Homo Sapiens
IHRNRGDLE

SEQ ID NO: 1110578 - protein, 9 aa, Homo Sapiens
SGYSQGSHS

SEQ ID NO: 1110579 - protein, 9 aa, Homo Sapiens
ISRELQREL

SEQ ID NO: 1110580 - protein, 9 aa, Homo Sapiens
HSIVQLVLM

SEQ ID NO: 1110581 - protein, 9 aa, Homo Sapiens
KMEIHQLTE

SEQ ID NO: 1110582 - protein, 9 aa, Homo Sapiens
KPISRELQR

SEQ ID NO: 1110583 - protein, 9 aa, Homo Sapiens
EESAECLRL

SEQ ID NO: 1110584 - protein, 9 aa, Homo Sapiens
VPRTVLWLA

SEQ ID NO: 1110585 - protein, 9 aa, Homo Sapiens
FADIHRNRG

SEQ ID NO: 1110586 - protein, 9 aa, Homo Sapiens
LCLLRRPGE

SEQ ID NO: 1110587 - protein, 9 aa, Homo Sapiens
FSSCSYTSG

SEQ ID NO: 1110588 - protein, 9 aa, Homo Sapiens
IRCTGELPG

SEQ ID NO: 1110589 - protein, 9 aa, Homo Sapiens
KNILLITEE

SEQ ID NO: 1110590 - protein, 9 aa, Homo Sapiens
LRHEQEEER

SEQ ID NO: 1110591 - protein, 9 aa, Homo Sapiens
QNAGRYLCD

SEQ ID NO: 1110592 - protein, 9 aa, Homo Sapiens
PCYFFSLKT

SEQ ID NO: 1110593 - protein, 9 aa, Homo Sapiens
HQMLSESVT

SEQ ID NO: 1110594 - protein, 9 aa, Homo Sapiens
VVLEERRAG

SEQ ID NO: 1110595 - protein, 9 aa, Homo Sapiens
DLEERTYFF

SEQ ID NO: 1110596 - protein, 9 aa, Homo Sapiens
TARCGNLIV

SEQ ID NO: 1110597 - protein, 9 aa, Homo Sapiens
MNRNNVEMK

SEQ ID NO: 1110598 - protein, 9 aa, Homo Sapiens
GFETLELNE

SEQ ID NO: 1110599 - protein, 9 aa, Homo Sapiens
EFLWDHVCV

SEQ ID NO: 1110600 - protein, 9 aa, Homo Sapiens
AEPTVWTEL

SEQ ID NO: 1110601 - protein, 9 aa, Homo Sapiens
YAGVLPVDV

SEQ ID NO: 1110602 - protein, 9 aa, Homo Sapiens
VIVVNKQTR

SEQ ID NO: 1110603 - protein, 9 aa, Homo Sapiens
ARNNRSQIV

SEQ ID NO: 1110604 - protein, 9 aa, Homo Sapiens
EKWAPAFKY

SEQ ID NO: 1110605 - protein, 9 aa, Homo Sapiens
KRRFKETLR

SEQ ID NO: 1110606 - protein, 9 aa, Homo Sapiens
IESCRFWAA

SEQ ID NO: 1110607 - protein, 9 aa, Homo Sapiens
ELTSVIHSH

SEQ ID NO: 1110608 - protein, 9 aa, Homo Sapiens
DAGAVCPLG

SEQ ID NO: 1110609 - protein, 9 aa, Homo Sapiens
PLLDDSAGK

SEQ ID NO: 1110610 - protein, 9 aa, Homo Sapiens
RSSSISGID

SEQ ID NO: 1110611 - protein, 9 aa, Homo Sapiens
NEIRTLLII

SEQ ID NO: 1110612 - protein, 9 aa, Homo Sapiens
LQPSSASSM

SEQ ID NO: 1110613 - protein, 9 aa, Homo Sapiens
DDLPPKCSA

SEQ ID NO: 1110614 - protein, 9 aa, Homo Sapiens
STITSREMQ

SEQ ID NO: 1110615 - protein, 9 aa, Homo Sapiens
LHMASQGDH

SEQ ID NO: 1110616 - protein, 9 aa, Homo Sapiens
TTVAAFILL

SEQ ID NO: 1110617 - protein, 9 aa, Homo Sapiens
LDRGFRTTW

SEQ ID NO: 1110618 - protein, 9 aa, Homo Sapiens
RSMNLRARN

SEQ ID NO: 1110619 - protein, 9 aa, Homo Sapiens
HPIAFSCSW

SEQ ID NO: 1110620 - protein, 9 aa, Homo Sapiens
LSPLHMASQ

SEQ ID NO: 1110621 - protein, 9 aa, Homo Sapiens
WDHVCVSPQ

SEQ ID NO: 1110622 - protein, 9 aa, Homo Sapiens
RKTVPSVLL

SEQ ID NO: 1110623 - protein, 9 aa, Homo Sapiens
ISIDTVVGA

SEQ ID NO: 1110624 - protein, 9 aa, Homo Sapiens
SSSISGIDM

SEQ ID NO: 1110625 - protein, 9 aa, Homo Sapiens
CWLLAVIDT

SEQ ID NO: 1110626 - protein, 9 aa, Homo Sapiens
TARRDRPIE

SEQ ID NO: 1110627 - protein, 9 aa, Homo Sapiens
VGLWIKMTM

SEQ ID NO: 1110628 - protein, 9 aa, Homo Sapiens
RDSIQPATS

SEQ ID NO: 1110629 - protein, 9 aa, Homo Sapiens
PPTPGDIFE

SEQ ID NO: 1110630 - protein, 9 aa, Homo Sapiens
GNGTVFRGI

SEQ ID NO: 1110631 - protein, 9 aa, Homo Sapiens
PDAMPLPGF

SEQ ID NO: 1110632 - protein, 9 aa, Homo Sapiens
RRAGTTYKV

SEQ ID NO: 1110633 - protein, 9 aa, Homo Sapiens
TDGYRLAEN

SEQ ID NO: 1110634 - protein, 9 aa, Homo Sapiens
PDYIDEKNC

SEQ ID NO: 1110635 - protein, 9 aa, Homo Sapiens
SMEHNLTPT

SEQ ID NO: 1110636 - protein, 9 aa, Homo Sapiens
NKDVMGALR

SEQ ID NO: 1110637 - protein, 9 aa, Homo Sapiens
QIILFLFFP

SEQ ID NO: 1110638 - protein, 9 aa, Homo Sapiens
SKAQQDPTV

SEQ ID NO: 1110639 - protein, 9 aa, Homo Sapiens
PWVNLAIQV

SEQ ID NO: 1110640 - protein, 9 aa, Homo Sapiens
LELKAACKQ

SEQ ID NO: 1110641 - protein, 9 aa, Homo Sapiens
IDPTFISNG

SEQ ID NO: 1110642 - protein, 9 aa, Homo Sapiens
GEPRKLLTH

SEQ ID NO: 1110643 - protein, 9 aa, Homo Sapiens
IYKKEEAHV

SEQ ID NO: 1110644 - protein, 9 aa, Homo Sapiens
PTQEAPPWV

SEQ ID NO: 1110645 - protein, 9 aa, Homo Sapiens
IDEKNCSFC

SEQ ID NO: 1110646 - protein, 9 aa, Homo Sapiens
EYHLQRVDT

SEQ ID NO: 1110647 - protein, 9 aa, Homo Sapiens
ARERQKDHC

SEQ ID NO: 1110648 - protein, 9 aa, Homo Sapiens
SCMADSVIK

SEQ ID NO: 1110649 - protein, 9 aa, Homo Sapiens
ATDETDRHI

SEQ ID NO: 1110650 - protein, 9 aa, Homo Sapiens
KYGPGSCHG

SEQ ID NO: 1110651 - protein, 9 aa, Homo Sapiens
ITGCRTVPV

SEQ ID NO: 1110652 - protein, 9 aa, Homo Sapiens
EHLAVAAMH

SEQ ID NO: 1110653 - protein, 9 aa, Homo Sapiens
PSGIRIERV

SEQ ID NO: 1110654 - protein, 9 aa, Homo Sapiens
ESVKDTCKN

SEQ ID NO: 1110655 - protein, 9 aa, Homo Sapiens
LKQMSAFSV

SEQ ID NO: 1110656 - protein, 9 aa, Homo Sapiens
GNGKAHTRR

SEQ ID NO: 1110657 - protein, 9 aa, Homo Sapiens
MLMWPHPHL

SEQ ID NO: 1110658 - protein, 9 aa, Homo Sapiens
TYHCHMRTH

SEQ ID NO: 1110659 - protein, 9 aa, Homo Sapiens
SKETKDKRV

SEQ ID NO: 1110660 - protein, 9 aa, Homo Sapiens
PYDVGFGNS

SEQ ID NO: 1110661 - protein, 9 aa, Homo Sapiens
KFGSFIWEQ

SEQ ID NO: 1110662 - protein, 9 aa, Homo Sapiens
EEHLLNLHE

SEQ ID NO: 1110663 - protein, 9 aa, Homo Sapiens
FHVAKRRFK

SEQ ID NO: 1110664 - protein, 9 aa, Homo Sapiens
DARFLTRAR

SEQ ID NO: 1110665 - protein, 9 aa, Homo Sapiens
SSASPALSH

SEQ ID NO: 1110666 - protein, 9 aa, Homo Sapiens
LVKAFIDQL

SEQ ID NO: 1110667 - protein, 9 aa, Homo Sapiens
GTDIDFTMR

SEQ ID NO: 1110668 - protein, 9 aa, Homo Sapiens
RAILIFLTT

SEQ ID NO: 1110669 - protein, 9 aa, Homo Sapiens
NEDVFGQIT

SEQ ID NO: 1110670 - protein, 9 aa, Homo Sapiens
SPRSWPGDI

SEQ ID NO: 1110671 - protein, 9 aa, Homo Sapiens
DENREKWAP

SEQ ID NO: 1110672 - protein, 9 aa, Homo Sapiens
RWSPPRRPA

SEQ ID NO: 1110673 - protein, 9 aa, Homo Sapiens
TYEPCIKPL

SEQ ID NO: 1110674 - protein, 9 aa, Homo Sapiens
PPKWGPLPT

SEQ ID NO: 1110675 - protein, 9 aa, Homo Sapiens
RVEDGYFRI

SEQ ID NO: 1110676 - protein, 9 aa, Homo Sapiens
SCEGLNDTK

SEQ ID NO: 1110677 - protein, 9 aa, Homo Sapiens
SIAIRRWHA

SEQ ID NO: 1110678 - protein, 9 aa, Homo Sapiens
VKAFIDQLF

SEQ ID NO: 1110679 - protein, 9 aa, Homo Sapiens
IVVNKQTRD

SEQ ID NO: 1110680 - protein, 9 aa, Homo Sapiens
AMPLPGFGE

SEQ ID NO: 1110681 - protein, 9 aa, Homo Sapiens
NEESKILKK

SEQ ID NO: 1110682 - protein, 9 aa, Homo Sapiens
PIHVCWYRD

SEQ ID NO: 1110683 - protein, 9 aa, Homo Sapiens
HVAKRRFKE

SEQ ID NO: 1110684 - protein, 9 aa, Homo Sapiens
FIIQAKSDQ

SEQ ID NO: 1110685 - protein, 9 aa, Homo Sapiens
NRDSIQPAT

SEQ ID NO: 1110686 - protein, 9 aa, Homo Sapiens
RKQCKDGES

SEQ ID NO: 1110687 - protein, 9 aa, Homo Sapiens
QPSSASSMD

SEQ ID NO: 1110688 - protein, 9 aa, Homo Sapiens
SASPALSHR

SEQ ID NO: 1110689 - protein, 9 aa, Homo Sapiens
ISGGCCGPG

SEQ ID NO: 1110690 - protein, 9 aa, Homo Sapiens
LWIKMTMNS

SEQ ID NO: 1110691 - protein, 9 aa, Homo Sapiens
LKISNEESK

SEQ ID NO: 1110692 - protein, 9 aa, Homo Sapiens
QKEKCKHSH

SEQ ID NO: 1110693 - protein, 9 aa, Homo Sapiens
FSYLLCLIQ

SEQ ID NO: 1110694 - protein, 9 aa, Homo Sapiens
PLDRGFRTT

SEQ ID NO: 1110695 - protein, 9 aa, Homo Sapiens
YGHTQCHLL

SEQ ID NO: 1110696 - protein, 9 aa, Homo Sapiens
TDRHIIREP

SEQ ID NO: 1110697 - protein, 9 aa, Homo Sapiens
EQFIIQAKS

SEQ ID NO: 1110698 - protein, 9 aa, Homo Sapiens
VFCNSSHHP

SEQ ID NO: 1110699 - protein, 9 aa, Homo Sapiens
SEHHDHAIV

SEQ ID NO: 1110700 - protein, 9 aa, Homo Sapiens
ANEHLAVAA

SEQ ID NO: 1110701 - protein, 9 aa, Homo Sapiens
KEIDPSGIR

SEQ ID NO: 1110702 - protein, 9 aa, Homo Sapiens
TRRLLGLDT

SEQ ID NO: 1110703 - protein, 9 aa, Homo Sapiens
LMINQEPRD

SEQ ID NO: 1110704 - protein, 9 aa, Homo Sapiens
RPVENVCDP

SEQ ID NO: 1110705 - protein, 9 aa, Homo Sapiens
CDPVTVHFE

SEQ ID NO: 1110706 - protein, 9 aa, Homo Sapiens
SQVLPLTTE

SEQ ID NO: 1110707 - protein, 9 aa, Homo Sapiens
LPASHPLFG

SEQ ID NO: 1110708 - protein, 9 aa, Homo Sapiens
SYRHQKRWW

SEQ ID NO: 1110709 - protein, 9 aa, Homo Sapiens
IAKGTFAPL

SEQ ID NO: 1110710 - protein, 9 aa, Homo Sapiens
HDVRDKLGA

SEQ ID NO: 1110711 - protein, 9 aa, Homo Sapiens
ICNHLRPFM

SEQ ID NO: 1110712 - protein, 9 aa, Homo Sapiens
IILFLFFPV

SEQ ID NO: 1110713 - protein, 9 aa, Homo Sapiens
YIDEKNCSF

SEQ ID NO: 1110714 - protein, 9 aa, Homo Sapiens
ERIHRISFR

SEQ ID NO: 1110715 - protein, 9 aa, Homo Sapiens
QRRCSQAVA

SEQ ID NO: 1110716 - protein, 9 aa, Homo Sapiens
TDIDFTMRY

SEQ ID NO: 1110717 - protein, 9 aa, Homo Sapiens
KSNMGTCGD

SEQ ID NO: 1110718 - protein, 9 aa, Homo Sapiens
DSSVSKTTL

SEQ ID NO: 1110719 - protein, 9 aa, Homo Sapiens
VFILKNQVK

SEQ ID NO: 1110720 - protein, 9 aa, Homo Sapiens
KLVHVLIDI

SEQ ID NO: 1110721 - protein, 9 aa, Homo Sapiens
VNEDVFGQI

SEQ ID NO: 1110722 - protein, 9 aa, Homo Sapiens
VATFNEIRT

SEQ ID NO: 1110723 - protein, 9 aa, Homo Sapiens
DVFHSISKE

SEQ ID NO: 1110724 - protein, 9 aa, Homo Sapiens
QLGMTKEQL

SEQ ID NO: 1110725 - protein, 9 aa, Homo Sapiens
QMSAFSVFL

SEQ ID NO: 1110726 - protein, 9 aa, Homo Sapiens
ASPALSHRG

SEQ ID NO: 1110727 - protein, 9 aa, Homo Sapiens
HAIVLTRQD

SEQ ID NO: 1110728 - protein, 9 aa, Homo Sapiens
TGELTSVIH

SEQ ID NO: 1110729 - protein, 9 aa, Homo Sapiens
SQGDHVECV

SEQ ID NO: 1110730 - protein, 9 aa, Homo Sapiens
FWDQLSDDL

SEQ ID NO: 1110731 - protein, 9 aa, Homo Sapiens
VLNPIIYTR

SEQ ID NO: 1110732 - protein, 9 aa, Homo Sapiens
SSMSIADSE

SEQ ID NO: 1110733 - protein, 9 aa, Homo Sapiens
QTDLEERTY

SEQ ID NO: 1110734 - protein, 9 aa, Homo Sapiens
GELTSVIHS

SEQ ID NO: 1110735 - protein, 9 aa, Homo Sapiens
GVLPVDVCK

SEQ ID NO: 1110736 - protein, 9 aa, Homo Sapiens
KSGNTGELT

SEQ ID NO: 1110737 - protein, 9 aa, Homo Sapiens
QPRWNTHRH

SEQ ID NO: 1110738 - protein, 9 aa, Homo Sapiens
NTHRHVSNA

SEQ ID NO: 1110739 - protein, 9 aa, Homo Sapiens
YRNINWKLS

SEQ ID NO: 1110740 - protein, 9 aa, Homo Sapiens
GYSLSTGSA

SEQ ID NO: 1110741 - protein, 9 aa, Homo Sapiens
QSSSEVGYN

SEQ ID NO: 1110742 - protein, 9 aa, Homo Sapiens
SKTKFAHQS

SEQ ID NO: 1110743 - protein, 9 aa, Homo Sapiens
VDYMNRNNV

SEQ ID NO: 1110744 - protein, 9 aa, Homo Sapiens
PREPDHAGT

SEQ ID NO: 1110745 - protein, 9 aa, Homo Sapiens
KLMSEMHGF

SEQ ID NO: 1110746 - protein, 9 aa, Homo Sapiens
TSREMQTAV

SEQ ID NO: 1110747 - protein, 9 aa, Homo Sapiens
LPQLLGRSC

SEQ ID NO: 1110748 - protein, 9 aa, Homo Sapiens
YDVGFGNSS

SEQ ID NO: 1110749 - protein, 9 aa, Homo Sapiens
KTVPSVLLV

SEQ ID NO: 1110750 - protein, 9 aa, Homo Sapiens
ECGKASCHK

SEQ ID NO: 1110751 - protein, 9 aa, Homo Sapiens
AEAATAVVE

SEQ ID NO: 1110752 - protein, 9 aa, Homo Sapiens
HVATELGYV

SEQ ID NO: 1110753 - protein, 9 aa, Homo Sapiens
SAADSDTEG

SEQ ID NO: 1110754 - protein, 9 aa, Homo Sapiens
FGISLVKIY

SEQ ID NO: 1110755 - protein, 9 aa, Homo Sapiens
CFKKCLSVG

SEQ ID NO: 1110756 - protein, 9 aa, Homo Sapiens
HQKRWWNAY

SEQ ID NO: 1110757 - protein, 9 aa, Homo Sapiens
CGRAVLTHK

SEQ ID NO: 1110758 - protein, 9 aa, Homo Sapiens
SWIGVFCNS

SEQ ID NO: 1110759 - protein, 9 aa, Homo Sapiens
ASSMDQGKV

SEQ ID NO: 1110760 - protein, 9 aa, Homo Sapiens
KAACKQAEE

SEQ ID NO: 1110761 - protein, 9 aa, Homo Sapiens
QCQYRNINW

SEQ ID NO: 1110762 - protein, 9 aa, Homo Sapiens
VQGRIVRPN

SEQ ID NO: 1110763 - protein, 9 aa, Homo Sapiens
AVAAMHTLW

SEQ ID NO: 1110764 - protein, 9 aa, Homo Sapiens
EAATAVVEN

SEQ ID NO: 1110765 - protein, 9 aa, Homo Sapiens
LLYQEGVSS

SEQ ID NO: 1110766 - protein, 9 aa, Homo Sapiens
NNELQEIRT

SEQ ID NO: 1110767 - protein, 9 aa, Homo Sapiens
FRQYVQECA

SEQ ID NO: 1110768 - protein, 9 aa, Homo Sapiens
TCHAAPCTP

SEQ ID NO: 1110769 - protein, 9 aa, Homo Sapiens
HCYLSTVDW

SEQ ID NO: 1110770 - protein, 9 aa, Homo Sapiens
LTSVIHSHI

SEQ ID NO: 1110771 - protein, 9 aa, Homo Sapiens
FEDMVATKC

SEQ ID NO: 1110772 - protein, 9 aa, Homo Sapiens
LASSTCGQP

SEQ ID NO: 1110773 - protein, 9 aa, Homo Sapiens
ATFNEIRTL

SEQ ID NO: 1110774 - protein, 9 aa, Homo Sapiens
ALSHRGSLG

SEQ ID NO: 1110775 - protein, 9 aa, Homo Sapiens
LGLGDFVFY

SEQ ID NO: 1110776 - protein, 9 aa, Homo Sapiens
HSNANYYFC

SEQ ID NO: 1110777 - protein, 9 aa, Homo Sapiens
TFTVNEDVF

SEQ ID NO: 1110778 - protein, 9 aa, Homo Sapiens
EEHINVYNS

SEQ ID NO: 1110779 - protein, 9 aa, Homo Sapiens
PLGSPPKWG

SEQ ID NO: 1110780 - protein, 9 aa, Homo Sapiens
DVRDKLGAV

SEQ ID NO: 1110781 - protein, 9 aa, Homo Sapiens
HNLTPTTYN

SEQ ID NO: 1110782 - protein, 9 aa, Homo Sapiens
LITTGFPTQ

SEQ ID NO: 1110783 - protein, 9 aa, Homo Sapiens
GLGDFVFYS

SEQ ID NO: 1110784 - protein, 9 aa, Homo Sapiens
KCLSLVAKL

SEQ ID NO: 1110785 - protein, 9 aa, Homo Sapiens
PTEDRSWWQ

SEQ ID NO: 1110786 - protein, 9 aa, Homo Sapiens
FLSDRPSTV

SEQ ID NO: 1110787 - protein, 9 aa, Homo Sapiens
MAVLTIRSA

SEQ ID NO: 1110788 - protein, 9 aa, Homo Sapiens
MSAFSVFLS

SEQ ID NO: 1110789 - protein, 9 aa, Homo Sapiens
ATLAHAQQL

SEQ ID NO: 1110790 - protein, 9 aa, Homo Sapiens
SFEEIMKIS

SEQ ID NO: 1110791 - protein, 9 aa, Homo Sapiens
EHHDHAIVL

SEQ ID NO: 1110792 - protein, 9 aa, Homo Sapiens
VLTIRSATL

SEQ ID NO: 1110793 - protein, 9 aa, Homo Sapiens
IRPVENVCD

SEQ ID NO: 1110794 - protein, 9 aa, Homo Sapiens
GFSYLLCLI

SEQ ID NO: 1110795 - protein, 9 aa, Homo Sapiens
GNTGELTSV

SEQ ID NO: 1110796 - protein, 9 aa, Homo Sapiens
KIIITEPRD

SEQ ID NO: 1110797 - protein, 9 aa, Homo Sapiens
AKSDQEAEE

SEQ ID NO: 1110798 - protein, 9 aa, Homo Sapiens
QEAPPWVNL

SEQ ID NO: 1110799 - protein, 9 aa, Homo Sapiens
HINVYNSWE

SEQ ID NO: 1110800 - protein, 9 aa, Homo Sapiens
CKDGESVKD

SEQ ID NO: 1110801 - protein, 9 aa, Homo Sapiens
TIRSATLAI

SEQ ID NO: 1110802 - protein, 9 aa, Homo Sapiens
LTYSTTGTV

SEQ ID NO: 1110803 - protein, 9 aa, Homo Sapiens
FANVIESCR

SEQ ID NO: 1110804 - protein, 9 aa, Homo Sapiens
TMRYHYRLD

SEQ ID NO: 1110805 - protein, 9 aa, Homo Sapiens
WQGKRGFQV

SEQ ID NO: 1110806 - protein, 9 aa, Homo Sapiens
LDHSNANYY

SEQ ID NO: 1110807 - protein, 9 aa, Homo Sapiens
PGSLATSPY

SEQ ID NO: 1110808 - protein, 9 aa, Homo Sapiens
AGLVMCIQP

SEQ ID NO: 1110809 - protein, 9 aa, Homo Sapiens
GPLPASHPL

SEQ ID NO: 1110810 - protein, 9 aa, Homo Sapiens
KDRHDLGLP

SEQ ID NO: 1110811 - protein, 9 aa, Homo Sapiens
YMLETWRWM

SEQ ID NO: 1110812 - protein, 9 aa, Homo Sapiens
NNVEMKWKY

SEQ ID NO: 1110813 - protein, 9 aa, Homo Sapiens
ICDLGEVRP

SEQ ID NO: 1110814 - protein, 9 aa, Homo Sapiens
IDLNRDSIQ

SEQ ID NO: 1110815 - protein, 9 aa, Homo Sapiens
GTVFRGIPG

SEQ ID NO: 1110816 - protein, 9 aa, Homo Sapiens
RGFRTTWLS

SEQ ID NO: 1110817 - protein, 9 aa, Homo Sapiens
ENCTTVAAF

SEQ ID NO: 1110818 - protein, 9 aa, Homo Sapiens
FGNGKAHTR

SEQ ID NO: 1110819 - protein, 9 aa, Homo Sapiens
SQQKEKCKH

SEQ ID NO: 1110820 - protein, 9 aa, Homo Sapiens
FAKEIDPSG

SEQ ID NO: 1110821 - protein, 9 aa, Homo Sapiens
AQKPEKMHP

SEQ ID NO: 1110822 - protein, 9 aa, Homo Sapiens
PLAECKGPL

SEQ ID NO: 1110823 - protein, 9 aa, Homo Sapiens
CKQAEEALS

SEQ ID NO: 1110824 - protein, 9 aa, Homo Sapiens
PPLDRGFRT

SEQ ID NO: 1110825 - protein, 9 aa, Homo Sapiens
RGCRPMRKT

SEQ ID NO: 1110826 - protein, 9 aa, Homo Sapiens
QETARRDRP

SEQ ID NO: 1110827 - protein, 9 aa, Homo Sapiens
ELKAACKQA

SEQ ID NO: 1110828 - protein, 9 aa, Homo Sapiens
MNLRARNNR

SEQ ID NO: 1110829 - protein, 9 aa, Homo Sapiens
GTVTFDGNK

SEQ ID NO: 1110830 - protein, 9 aa, Homo Sapiens
IQEITGCRT

SEQ ID NO: 1110831 - protein, 9 aa, Homo Sapiens
NVHIDPTFI

SEQ ID NO: 1110832 - protein, 9 aa, Homo Sapiens
NMAVLTIRS

SEQ ID NO: 1110833 - protein, 9 aa, Homo Sapiens
LEYIQEITG

SEQ ID NO: 1110834 - protein, 9 aa, Homo Sapiens
HMASQGDHV

SEQ ID NO: 1110835 - protein, 9 aa, Homo Sapiens
TVATFNEIR

SEQ ID NO: 1110836 - protein, 9 aa, Homo Sapiens
LNFLPSVDS

SEQ ID NO: 1110837 - protein, 9 aa, Homo Sapiens
QGMYYHGQT

SEQ ID NO: 1110838 - protein, 9 aa, Homo Sapiens
SAPIHVCWY

SEQ ID NO: 1110839 - protein, 9 aa, Homo Sapiens
LTSREEEED

SEQ ID NO: 1110840 - protein, 9 aa, Homo Sapiens
THRHVSNAS

SEQ ID NO: 1110841 - protein, 9 aa, Homo Sapiens
QEGVSSFCP

SEQ ID NO: 1110842 - protein, 9 aa, Homo Sapiens
RRNRDMKAA

SEQ ID NO: 1110843 - protein, 9 aa, Homo Sapiens
VMGALRKML

SEQ ID NO: 1110844 - protein, 9 aa, Homo Sapiens
MGALRKMLT

SEQ ID NO: 1110845 - protein, 9 aa, Homo Sapiens
NTVVLEERR

SEQ ID NO: 1110846 - protein, 9 aa, Homo Sapiens
PGGNRKRSS

SEQ ID NO: 1110847 - protein, 9 aa, Homo Sapiens
SHRGSLGEE

SEQ ID NO: 1110848 - protein, 9 aa, Homo Sapiens
GQPATRACD

SEQ ID NO: 1110849 - protein, 9 aa, Homo Sapiens
EHNLTPTTY

SEQ ID NO: 1110850 - protein, 9 aa, Homo Sapiens
PPWVNLAIQ

SEQ ID NO: 1110851 - protein, 9 aa, Homo Sapiens
DNGSWLLGN

SEQ ID NO: 1110852 - protein, 9 aa, Homo Sapiens
HSCERARER

SEQ ID NO: 1110853 - protein, 9 aa, Homo Sapiens
IDPKMSNFS

SEQ ID NO: 1110854 - protein, 9 aa, Homo Sapiens
TDLEERTYF

SEQ ID NO: 1110855 - protein, 9 aa, Homo Sapiens
EGLNDTKDY

SEQ ID NO: 1110856 - protein, 9 aa, Homo Sapiens
VTSTDVAEY

SEQ ID NO: 1110857 - protein, 9 aa, Homo Sapiens
VNFDSSEDT

SEQ ID NO: 1110858 - protein, 9 aa, Homo Sapiens
SAEDDIIDG

SEQ ID NO: 1110859 - protein, 9 aa, Homo Sapiens
QGFSYLLCL

SEQ ID NO: 1110860 - protein, 9 aa, Homo Sapiens
HLRPFMLQQ

SEQ ID NO: 1110861 - protein, 9 aa, Homo Sapiens
CKGPLLDDS

SEQ ID NO: 1110862 - protein, 9 aa, Homo Sapiens
KRMSYRHQK

SEQ ID NO: 1110863 - protein, 9 aa, Homo Sapiens
AAFILLGLS

SEQ ID NO: 1110864 - protein, 9 aa, Homo Sapiens
RARSLGLFF

SEQ ID NO: 1110865 - protein, 9 aa, Homo Sapiens
STSAEDDII

SEQ ID NO: 1110866 - protein, 9 aa, Homo Sapiens
GLHDVRDKL

SEQ ID NO: 1110867 - protein, 9 aa, Homo Sapiens
RHQKRWWNA

SEQ ID NO: 1110868 - protein, 9 aa, Homo Sapiens
MQTAVRLLL

SEQ ID NO: 1110869 - protein, 9 aa, Homo Sapiens
AHVLLKAFQ

SEQ ID NO: 1110870 - protein, 9 aa, Homo Sapiens
EITGCRTVP

SEQ ID NO: 1110871 - protein, 9 aa, Homo Sapiens
SEDTTYLYR

SEQ ID NO: 1110872 - protein, 9 aa, Homo Sapiens
EAPPWVNLA

SEQ ID NO: 1110873 - protein, 9 aa, Homo Sapiens
EAPPLDRGF

SEQ ID NO: 1110874 - protein, 9 aa, Homo Sapiens
DDFAGMCFP

SEQ ID NO: 1110875 - protein, 9 aa, Homo Sapiens
RFKETLRPY

SEQ ID NO: 1110876 - protein, 9 aa, Homo Sapiens
SIADSEAYF

SEQ ID NO: 1110877 - protein, 9 aa, Homo Sapiens
GPGSGGCCN

SEQ ID NO: 1110878 - protein, 9 aa, Homo Sapiens
THDWVQENY

SEQ ID NO: 1110879 - protein, 9 aa, Homo Sapiens
DFAGMCFPE

SEQ ID NO: 1110880 - protein, 9 aa, Homo Sapiens
SQEESPREP

SEQ ID NO: 1110881 - protein, 9 aa, Homo Sapiens
VIESCRFWA

SEQ ID NO: 1110882 - protein, 9 aa, Homo Sapiens
MPLPGFGEE

SEQ ID NO: 1110883 - protein, 9 aa, Homo Sapiens
FDSSEDTTY

SEQ ID NO: 1110884 - protein, 9 aa, Homo Sapiens
IFDENREKW

SEQ ID NO: 1110885 - protein, 9 aa, Homo Sapiens
GATLAHAQQ

SEQ ID NO: 1110886 - protein, 9 aa, Homo Sapiens
ERRAGTTYK

SEQ ID NO: 1110887 - protein, 9 aa, Homo Sapiens
AEYPLVEST

SEQ ID NO: 1110888 - protein, 9 aa, Homo Sapiens
RNNRSQIVL

SEQ ID NO: 1110889 - protein, 9 aa, Homo Sapiens
YIQEITGCR

SEQ ID NO: 1110890 - protein, 9 aa, Homo Sapiens
SLQERLVWL

SEQ ID NO: 1110891 - protein, 9 aa, Homo Sapiens
WEVGRGLQR

SEQ ID NO: 1110892 - protein, 9 aa, Homo Sapiens
NREKWAPAF

SEQ ID NO: 1110893 - protein, 9 aa, Homo Sapiens
KEEAHVLLK

SEQ ID NO: 1110894 - protein, 9 aa, Homo Sapiens
CHPLQYPML

SEQ ID NO: 1110895 - protein, 9 aa, Homo Sapiens
PSTLGGRGR

SEQ ID NO: 1110896 - protein, 9 aa, Homo Sapiens
ASCHKSALI

SEQ ID NO: 1110897 - protein, 9 aa, Homo Sapiens
YHCHMRTHE

SEQ ID NO: 1110898 - protein, 9 aa, Homo Sapiens
EAHVLLKAF

SEQ ID NO: 1110899 - protein, 9 aa, Homo Sapiens
HQPIVEGLC

SEQ ID NO: 1110900 - protein, 9 aa, Homo Sapiens
NGTVFRGIP

SEQ ID NO: 1110901 - protein, 9 aa, Homo Sapiens
NGSAPIHVC

SEQ ID NO: 1110902 - protein, 9 aa, Homo Sapiens
HKTFARYLS

SEQ ID NO: 1110903 - protein, 9 aa, Homo Sapiens
ILIFLTTDG

SEQ ID NO: 1110904 - protein, 9 aa, Homo Sapiens
VKIYFISCL

SEQ ID NO: 1110905 - protein, 9 aa, Homo Sapiens
QFNHEPPEE

SEQ ID NO: 1110906 - protein, 9 aa, Homo Sapiens
AIPEFIITT

SEQ ID NO: 1110907 - protein, 9 aa, Homo Sapiens
TKEQLLELP

SEQ ID NO: 1110908 - protein, 9 aa, Homo Sapiens
LPPKCSAKA

SEQ ID NO: 1110909 - protein, 9 aa, Homo Sapiens
RWHAEKKMY

SEQ ID NO: 1110910 - protein, 9 aa, Homo Sapiens
NQRISAERI

SEQ ID NO: 1110911 - protein, 9 aa, Homo Sapiens
LVMCIQPTS

SEQ ID NO: 1110912 - protein, 9 aa, Homo Sapiens
TTLNLNDFQ

SEQ ID NO: 1110913 - protein, 9 aa, Homo Sapiens
FSVMRSMHK

SEQ ID NO: 1110914 - protein, 9 aa, Homo Sapiens
IVLTRQDFG

SEQ ID NO: 1110915 - protein, 9 aa, Homo Sapiens
AIFLSFYLF

SEQ ID NO: 1110916 - protein, 9 aa, Homo Sapiens
VEDGYFRIG

SEQ ID NO: 1110917 - protein, 9 aa, Homo Sapiens
KWGPLPTEE

SEQ ID NO: 1110918 - protein, 9 aa, Homo Sapiens
RRPSSSQHS

SEQ ID NO: 1110919 - protein, 9 aa, Homo Sapiens
DGYRLAENQ

SEQ ID NO: 1110920 - protein, 9 aa, Homo Sapiens
PQLLGRSCS

SEQ ID NO: 1110921 - protein, 9 aa, Homo Sapiens
PPPLMINQE

SEQ ID NO: 1110922 - protein, 9 aa, Homo Sapiens
CNECGKASC

SEQ ID NO: 1110923 - protein, 9 aa, Homo Sapiens
LDNGSWLLG

SEQ ID NO: 1110924 - protein, 9 aa, Homo Sapiens
IGKTGYTLE

SEQ ID NO: 1110925 - protein, 9 aa, Homo Sapiens
EFEDMVATK

SEQ ID NO: 1110926 - protein, 9 aa, Homo Sapiens
QDNKDPCYF

SEQ ID NO: 1110927 - protein, 9 aa, Homo Sapiens
RRLLGLDTT

SEQ ID NO: 1110928 - protein, 9 aa, Homo Sapiens
PALSHRGSL

SEQ ID NO: 1110929 - protein, 9 aa, Homo Sapiens
PIIYTRRNR

SEQ ID NO: 1110930 - protein, 9 aa, Homo Sapiens
EVQLVLFAI

SEQ ID NO: 1110931 - protein, 9 aa, Homo Sapiens
SGTVTFDGN

SEQ ID NO: 1110932 - protein, 9 aa, Homo Sapiens
AIDSSVSKT

SEQ ID NO: 1110933 - protein, 9 aa, Homo Sapiens
GQRFRRACC

SEQ ID NO: 1110934 - protein, 9 aa, Homo Sapiens
VFASPYFST

SEQ ID NO: 1110935 - protein, 9 aa, Homo Sapiens
HTHLGKLAV

SEQ ID NO: 1110936 - protein, 9 aa, Homo Sapiens
DHPVVSNQF

SEQ ID NO: 1110937 - protein, 9 aa, Homo Sapiens
QKEIRRKFG

SEQ ID NO: 1110938 - protein, 9 aa, Homo Sapiens
FYKCEECGE

SEQ ID NO: 1110939 - protein, 9 aa, Homo Sapiens
LQRKTVPSV

SEQ ID NO: 1110940 - protein, 9 aa, Homo Sapiens
IIQAKSDQE

SEQ ID NO: 1110941 - protein, 9 aa, Homo Sapiens
FDENREKWA

SEQ ID NO: 1110942 - protein, 9 aa, Homo Sapiens
SLIGKTGYT

SEQ ID NO: 1110943 - protein, 9 aa, Homo Sapiens
LDWNSFNSY

SEQ ID NO: 1110944 - protein, 9 aa, Homo Sapiens
IRRSTLSEH

SEQ ID NO: 1110945 - protein, 9 aa, Homo Sapiens
ASCRPGLSP

SEQ ID NO: 1110946 - protein, 9 aa, Homo Sapiens
HTQCHLLPD

SEQ ID NO: 1110947 - protein, 9 aa, Homo Sapiens
REVQLVLFA

SEQ ID NO: 1110948 - protein, 9 aa, Homo Sapiens
PRSWPGDII

SEQ ID NO: 1110949 - protein, 9 aa, Homo Sapiens
CMADSVIKN

SEQ ID NO: 1110950 - protein, 9 aa, Homo Sapiens
RKFGSFIWE

SEQ ID NO: 1110951 - protein, 9 aa, Homo Sapiens
APLAECKGP

SEQ ID NO: 1110952 - protein, 9 aa, Homo Sapiens
PFLSDRPST

SEQ ID NO: 1110953 - protein, 9 aa, Homo Sapiens
PSVLLVQLI

SEQ ID NO: 1110954 - protein, 9 aa, Homo Sapiens
EELRRKLKS

SEQ ID NO: 1110955 - protein, 9 aa, Homo Sapiens
RRGCRPMRK

SEQ ID NO: 1110956 - protein, 9 aa, Homo Sapiens
SSVSKTTLV

SEQ ID NO: 1110957 - protein, 9 aa, Homo Sapiens
DKLGAVNSS

SEQ ID NO: 1110958 - protein, 9 aa, Homo Sapiens
ELSRPGGNR

SEQ ID NO: 1110959 - protein, 9 aa, Homo Sapiens
DVGFGNSSY

SEQ ID NO: 1110960 - protein, 9 aa, Homo Sapiens
KDVMGALRK

SEQ ID NO: 1110961 - protein, 9 aa, Homo Sapiens
VENSVKVQP

SEQ ID NO: 1110962 - protein, 9 aa, Homo Sapiens
ITTGFPTQF

SEQ ID NO: 1110963 - protein, 9 aa, Homo Sapiens
YRQSSTYHC

SEQ ID NO: 1110964 - protein, 9 aa, Homo Sapiens
QHEVELSRP

SEQ ID NO: 1110965 - protein, 9 aa, Homo Sapiens
SLVAKLLKI

SEQ ID NO: 1110966 - protein, 9 aa, Homo Sapiens
NKNSQVLPL

SEQ ID NO: 1110967 - protein, 9 aa, Homo Sapiens
LAVAAMHTL

SEQ ID NO: 1110968 - protein, 9 aa, Homo Sapiens
GPSPRSWPG

SEQ ID NO: 1110969 - protein, 9 aa, Homo Sapiens
IRRKFGSFI

SEQ ID NO: 1110970 - protein, 9 aa, Homo Sapiens
IGFGISLVK

SEQ ID NO: 1110971 - protein, 9 aa, Homo Sapiens
VVNKQTRDY

SEQ ID NO: 1110972 - protein, 9 aa, Homo Sapiens
EDCFFKGDR

SEQ ID NO: 1110973 - protein, 9 aa, Homo Sapiens
YTRRNRDMK

SEQ ID NO: 1110974 - protein, 9 aa, Homo Sapiens
AADSDTEGG

SEQ ID NO: 1110975 - protein, 9 aa, Homo Sapiens
SMHKTFARY

SEQ ID NO: 1110976 - protein, 9 aa, Homo Sapiens
MYLQPSSAS

SEQ ID NO: 1110977 - protein, 9 aa, Homo Sapiens
HKLKISNEE

SEQ ID NO: 1110978 - protein, 9 aa, Homo Sapiens
PVVSNQFLI

SEQ ID NO: 1110979 - protein, 9 aa, Homo Sapiens
EVGYNAMAG

SEQ ID NO: 1110980 - protein, 9 aa, Homo Sapiens
LGAVNSSAA

SEQ ID NO: 1110981 - protein, 9 aa, Homo Sapiens
VTLTSNVFS

SEQ ID NO: 1110982 - protein, 9 aa, Homo Sapiens
CFLNAKRNT

SEQ ID NO: 1110983 - protein, 9 aa, Homo Sapiens
LRPFMLQQL

SEQ ID NO: 1110984 - protein, 9 aa, Homo Sapiens
LSDRPSTVV

SEQ ID NO: 1110985 - protein, 9 aa, Homo Sapiens
LSNGIPIKV

SEQ ID NO: 1110986 - protein, 9 aa, Homo Sapiens
LFFPVIYTL

SEQ ID NO: 1110987 - protein, 9 aa, Homo Sapiens
DTVVGAGEF

SEQ ID NO: 1110988 - protein, 9 aa, Homo Sapiens
EGVPYSVPE

SEQ ID NO: 1110989 - protein, 9 aa, Homo Sapiens
GHLISKAQQ

SEQ ID NO: 1110990 - protein, 9 aa, Homo Sapiens
AVVENSVKV

SEQ ID NO: 1110991 - protein, 9 aa, Homo Sapiens
VPEPVLEGW

SEQ ID NO: 1110992 - protein, 9 aa, Homo Sapiens
VLPLTTEKK

SEQ ID NO: 1110993 - protein, 9 aa, Homo Sapiens
PGSVIAQKP

SEQ ID NO: 1110994 - protein, 9 aa, Homo Sapiens
VFYSVLVGK

SEQ ID NO: 1110995 - protein, 9 aa, Homo Sapiens
RRSTLSEHL

SEQ ID NO: 1110996 - protein, 9 aa, Homo Sapiens
TPHKLQFTF

SEQ ID NO: 1110997 - protein, 9 aa, Homo Sapiens
SNANYYFCN

SEQ ID NO: 1110998 - protein, 9 aa, Homo Sapiens
QKLSQRHKR

SEQ ID NO: 1110999 - protein, 9 aa, Homo Sapiens
CNHLRPFML

SEQ ID NO: 1111000 - protein, 9 aa, Homo Sapiens
EIRRKFGSF

SEQ ID NO: 1111001 - protein, 9 aa, Homo Sapiens
DGESVKDTC

SEQ ID NO: 1111002 - protein, 9 aa, Homo Sapiens
LPQETARRD

SEQ ID NO: 1111003 - protein, 9 aa, Homo Sapiens
QEYHLQRVD

SEQ ID NO: 1111004 - protein, 9 aa, Homo Sapiens
DPCYFFSLK

SEQ ID NO: 1111005 - protein, 9 aa, Homo Sapiens
PHTHLGKLA

SEQ ID NO: 1111006 - protein, 9 aa, Homo Sapiens
SNMGTCGDH

SEQ ID NO: 1111007 - protein, 9 aa, Homo Sapiens
RARERQKDH

SEQ ID NO: 1111008 - protein, 9 aa, Homo Sapiens
ERTYFFPED

SEQ ID NO: 1111009 - protein, 9 aa, Homo Sapiens
VWTELMEQI

SEQ ID NO: 1111010 - protein, 9 aa, Homo Sapiens
KTFSSSPPT

SEQ ID NO: 1111011 - protein, 9 aa, Homo Sapiens
YGAGLVMCI

SEQ ID NO: 1111012 - protein, 9 aa, Homo Sapiens
CCYGHTQCH

SEQ ID NO: 1111013 - protein, 9 aa, Homo Sapiens
SCAGLSQQK

SEQ ID NO: 1111014 - protein, 9 aa, Homo Sapiens
SQVVSMEHN

SEQ ID NO: 1111015 - protein, 9 aa, Homo Sapiens
DADDPIYGN

SEQ ID NO: 1111016 - protein, 9 aa, Homo Sapiens
DPTFISNGP

SEQ ID NO: 1111017 - protein, 9 aa, Homo Sapiens
LHLGNNELQ

SEQ ID NO: 1111018 - protein, 9 aa, Homo Sapiens
QAKSDQEAE

SEQ ID NO: 1111019 - protein, 9 aa, Homo Sapiens
TGHPIAFSC

SEQ ID NO: 1111020 - protein, 9 aa, Homo Sapiens
DGAMIWSKT

SEQ ID NO: 1111021 - protein, 9 aa, Homo Sapiens
NFLPSVDSE

SEQ ID NO: 1111022 - protein, 9 aa, Homo Sapiens
LSDDFAGMC

SEQ ID NO: 1111023 - protein, 9 aa, Homo Sapiens
CGDHDDSFM

SEQ ID NO: 1111024 - protein, 9 aa, Homo Sapiens
DVAEYPLVE

SEQ ID NO: 1111025 - protein, 9 aa, Homo Sapiens
CFFKGDRCK

SEQ ID NO: 1111026 - protein, 9 aa, Homo Sapiens
VTSGTVTFD

SEQ ID NO: 1111027 - protein, 9 aa, Homo Sapiens
SCALELLPD

SEQ ID NO: 1111028 - protein, 9 aa, Homo Sapiens
STGSAADSD

SEQ ID NO: 1111029 - protein, 9 aa, Homo Sapiens
LPGPLPASH

SEQ ID NO: 1111030 - protein, 9 aa, Homo Sapiens
TSCEGLNDT

SEQ ID NO: 1111031 - protein, 9 aa, Homo Sapiens
DEFEDMVAT

SEQ ID NO: 1111032 - protein, 9 aa, Homo Sapiens
ILIKNKNSL

SEQ ID NO: 1111033 - protein, 9 aa, Homo Sapiens
KDKRVEDGY

SEQ ID NO: 1111034 - protein, 9 aa, Homo Sapiens
ALRKMLTVE

SEQ ID NO: 1111035 - protein, 9 aa, Homo Sapiens
APIHVCWYR

SEQ ID NO: 1111036 - protein, 9 aa, Homo Sapiens
DAMPLPGFG

SEQ ID NO: 1111037 - protein, 9 aa, Homo Sapiens
KRVEDGYFR

SEQ ID NO: 1111038 - protein, 9 aa, Homo Sapiens
PTQFNHEPP

SEQ ID NO: 1111039 - protein, 9 aa, Homo Sapiens
GFGNSSYYN

SEQ ID NO: 1111040 - protein, 9 aa, Homo Sapiens
AETPHKLQF

SEQ ID NO: 1111041 - protein, 9 aa, Homo Sapiens
AIYLDTYEP

SEQ ID NO: 1111042 - protein, 9 aa, Homo Sapiens
EPLNVTFIK

SEQ ID NO: 1111043 - protein, 9 aa, Homo Sapiens
LQKEIRRKF

SEQ ID NO: 1111044 - protein, 9 aa, Homo Sapiens
RNTTPVQDC

SEQ ID NO: 1111045 - protein, 9 aa, Homo Sapiens
VDSETVLQT

SEQ ID NO: 1111046 - protein, 9 aa, Homo Sapiens
LSSASCRPG

SEQ ID NO: 1111047 - protein, 9 aa, Homo Sapiens
TQFNHEPPE

SEQ ID NO: 1111048 - protein, 9 aa, Homo Sapiens
KTKFAHQSE

SEQ ID NO: 1111049 - protein, 9 aa, Homo Sapiens
LLIFLVLAL

SEQ ID NO: 1111050 - protein, 9 aa, Homo Sapiens
INGEEEILI

SEQ ID NO: 1111051 - protein, 9 aa, Homo Sapiens
QEIYDSIVN

SEQ ID NO: 1111052 - protein, 9 aa, Homo Sapiens
KSDQEAEEN

SEQ ID NO: 1111053 - protein, 9 aa, Homo Sapiens
VCTCHAAPC

SEQ ID NO: 1111054 - protein, 9 aa, Homo Sapiens
THKRCNKHA

SEQ ID NO: 1111055 - protein, 9 aa, Homo Sapiens
GKTGYTLES

SEQ ID NO: 1111056 - protein, 9 aa, Homo Sapiens
SQEKCLSLV

SEQ ID NO: 1111057 - protein, 9 aa, Homo Sapiens
VMRSMHKTF

SEQ ID NO: 1111058 - protein, 9 aa, Homo Sapiens
PSSSQHSPS

SEQ ID NO: 1111059 - protein, 9 aa, Homo Sapiens
CAGLSQQKE

SEQ ID NO: 1111060 - protein, 9 aa, Homo Sapiens
QSSEEHINV

SEQ ID NO: 1111061 - protein, 9 aa, Homo Sapiens
KLGLGDFVF

SEQ ID NO: 1111062 - protein, 9 aa, Homo Sapiens
LVKIYFISC

SEQ ID NO: 1111063 - protein, 9 aa, Homo Sapiens
RFWAAVYFN

SEQ ID NO: 1111064 - protein, 9 aa, Homo Sapiens
IAIPEFIIT

SEQ ID NO: 1111065 - protein, 9 aa, Homo Sapiens
TTNHRQEAA

SEQ ID NO: 1111066 - protein, 9 aa, Homo Sapiens
NAMAGDFVN

SEQ ID NO: 1111067 - protein, 9 aa, Homo Sapiens
TIAKGTFAP

SEQ ID NO: 1111068 - protein, 9 aa, Homo Sapiens
GVRSRRPSS

SEQ ID NO: 1111069 - protein, 9 aa, Homo Sapiens
RLTWEAGAA

SEQ ID NO: 1111070 - protein, 9 aa, Homo Sapiens
IEKNADHCY

SEQ ID NO: 1111071 - protein, 9 aa, Homo Sapiens
QDPTVTRRY

SEQ ID NO: 1111072 - protein, 9 aa, Homo Sapiens
SMNLRARNN

SEQ ID NO: 1111073 - protein, 9 aa, Homo Sapiens
KEIRRKFGS

SEQ ID NO: 1111074 - protein, 9 aa, Homo Sapiens
EHINVYNSW

SEQ ID NO: 1111075 - protein, 9 aa, Homo Sapiens
TVAAFILLG

SEQ ID NO: 1111076 - protein, 9 aa, Homo Sapiens
EKAEFLWDH

SEQ ID NO: 1111077 - protein, 9 aa, Homo Sapiens
LPSVDSETV

SEQ ID NO: 1111078 - protein, 9 aa, Homo Sapiens
AAPCTPHKA

SEQ ID NO: 1111079 - protein, 9 aa, Homo Sapiens
RPGGNRKRS

SEQ ID NO: 1111080 - protein, 9 aa, Homo Sapiens
ADDPIYGNS

SEQ ID NO: 1111081 - protein, 9 aa, Homo Sapiens
GYNAMAGDF

SEQ ID NO: 1111082 - protein, 9 aa, Homo Sapiens
LSLVAKLLK

SEQ ID NO: 1111083 - protein, 9 aa, Homo Sapiens
CCLVHDFTD

SEQ ID NO: 1111084 - protein, 9 aa, Homo Sapiens
LCLIQHEEN

SEQ ID NO: 1111085 - protein, 9 aa, Homo Sapiens
REKWAPAFK

SEQ ID NO: 1111086 - protein, 9 aa, Homo Sapiens
DPIYGNSAR

SEQ ID NO: 1111087 - protein, 9 aa, Homo Sapiens
VHVLIDINL

SEQ ID NO: 1111088 - protein, 9 aa, Homo Sapiens
LTSNVFSII

SEQ ID NO: 1111089 - protein, 9 aa, Homo Sapiens
CCGPGSGGC

SEQ ID NO: 1111090 - protein, 9 aa, Homo Sapiens
KWAPAFKYF

SEQ ID NO: 1111091 - protein, 9 aa, Homo Sapiens
LFTLQRKPK

SEQ ID NO: 1111092 - protein, 9 aa, Homo Sapiens
EVRPMKCNS

SEQ ID NO: 1111093 - protein, 9 aa, Homo Sapiens
TGTVFASPY

SEQ ID NO: 1111094 - protein, 9 aa, Homo Sapiens
TDVAEYPLV

SEQ ID NO: 1111095 - protein, 9 aa, Homo Sapiens
AHNSNISEY

SEQ ID NO: 1111096 - protein, 9 aa, Homo Sapiens
FTLQRKPKV

SEQ ID NO: 1111097 - protein, 9 aa, Homo Sapiens
FPHTHLGKL

SEQ ID NO: 1111098 - protein, 9 aa, Homo Sapiens
SLIDPKMSN

SEQ ID NO: 1111099 - protein, 9 aa, Homo Sapiens
RNNVEMKWK

SEQ ID NO: 1111100 - protein, 9 aa, Homo Sapiens
GKIFQCTKY

SEQ ID NO: 1111101 - protein, 9 aa, Homo Sapiens
KLSQRHKRQ

SEQ ID NO: 1111102 - protein, 9 aa, Homo Sapiens
LTCEEHLLN

SEQ ID NO: 1111103 - protein, 9 aa, Homo Sapiens
AQQDPTVTR

SEQ ID NO: 1111104 - protein, 9 aa, Homo Sapiens
DLGLPQEEF

SEQ ID NO: 1111105 - protein, 9 aa, Homo Sapiens
FQCTKYVKV

SEQ ID NO: 1111106 - protein, 9 aa, Homo Sapiens
HQPQSHVIL

SEQ ID NO: 1111107 - protein, 9 aa, Homo Sapiens
CDLGEVRPM

SEQ ID NO: 1111108 - protein, 9 aa, Homo Sapiens
SEEHINVYN

SEQ ID NO: 1111109 - protein, 9 aa, Homo Sapiens
RKLLTHDWV

SEQ ID NO: 1111110 - protein, 9 aa, Homo Sapiens
EERRAGTTY

SEQ ID NO: 1111111 - protein, 9 aa, Homo Sapiens
NPIIYTRRN

SEQ ID NO: 1111112 - protein, 9 aa, Homo Sapiens
FMYLQPSSA

SEQ ID NO: 1111113 - protein, 9 aa, Homo Sapiens
EIDPSGIRI

SEQ ID NO: 1111114 - protein, 9 aa, Homo Sapiens
TLSEHLRIH

SEQ ID NO: 1111115 - protein, 9 aa, Homo Sapiens
QPATRACDA

SEQ ID NO: 1111116 - protein, 9 aa, Homo Sapiens
MTTARCGNL

SEQ ID NO: 1111117 - protein, 9 aa, Homo Sapiens
SPREPDHAG

SEQ ID NO: 1111118 - protein, 9 aa, Homo Sapiens
EECGEAFSQ

SEQ ID NO: 1111119 - protein, 9 aa, Homo Sapiens
CTKYVKVFH

SEQ ID NO: 1111120 - protein, 9 aa, Homo Sapiens
FAIFLSFYL

SEQ ID NO: 1111121 - protein, 9 aa, Homo Sapiens
RQYVQECAD

SEQ ID NO: 1111122 - protein, 9 aa, Homo Sapiens
GFIQIQKNT

SEQ ID NO: 1111123 - protein, 9 aa, Homo Sapiens
NRNNVEMKW

SEQ ID NO: 1111124 - protein, 9 aa, Homo Sapiens
PRDAGAVCP

SEQ ID NO: 1111125 - protein, 9 aa, Homo Sapiens
SWPGDIIRT

SEQ ID NO: 1111126 - protein, 9 aa, Homo Sapiens
SPTCGYTHP

SEQ ID NO: 1111127 - protein, 9 aa, Homo Sapiens
LIFLTTDGL

SEQ ID NO: 1111128 - protein, 9 aa, Homo Sapiens
ISLVKIYFI

SEQ ID NO: 1111129 - protein, 9 aa, Homo Sapiens
HCHMRTHEK

SEQ ID NO: 1111130 - protein, 9 aa, Homo Sapiens
VLALFLATV

SEQ ID NO: 1111131 - protein, 9 aa, Homo Sapiens
RLHLSLQER

SEQ ID NO: 1111132 - protein, 9 aa, Homo Sapiens
GPLLDDSAG

SEQ ID NO: 1111133 - protein, 9 aa, Homo Sapiens
FLTRARSLG

SEQ ID NO: 1111134 - protein, 9 aa, Homo Sapiens
KDPCYFFSL

SEQ ID NO: 1111135 - protein, 9 aa, Homo Sapiens
TKDKRVEDG

SEQ ID NO: 1111136 - protein, 9 aa, Homo Sapiens
KASCHKSAL

SEQ ID NO: 1111137 - protein, 9 aa, Homo Sapiens
LQYPMLMSK

SEQ ID NO: 1111138 - protein, 9 aa, Homo Sapiens
TPRLCLSCA

SEQ ID NO: 1111139 - protein, 9 aa, Homo Sapiens
KGSTIVLNE

SEQ ID NO: 1111140 - protein, 9 aa, Homo Sapiens
QLSDDLCYY

SEQ ID NO: 1111141 - protein, 9 aa, Homo Sapiens
QLLRALKFR

SEQ ID NO: 1111142 - protein, 9 aa, Homo Sapiens
CEGLNDTKD

SEQ ID NO: 1111143 - protein, 9 aa, Homo Sapiens
ENMAVLTIR

SEQ ID NO: 1111144 - protein, 9 aa, Homo Sapiens
SDDLCYYHG

SEQ ID NO: 1111145 - protein, 9 aa, Homo Sapiens
IVRPNNNNM

SEQ ID NO: 1111146 - protein, 9 aa, Homo Sapiens
PIVEGLCWL

SEQ ID NO: 1111147 - protein, 9 aa, Homo Sapiens
GLCWLLAVI

SEQ ID NO: 1111148 - protein, 9 aa, Homo Sapiens
VAEYPLVES

SEQ ID NO: 1111149 - protein, 9 aa, Homo Sapiens
NINWKLSAA

SEQ ID NO: 1111150 - protein, 9 aa, Homo Sapiens
YYGAGLVMC

SEQ ID NO: 1111151 - protein, 9 aa, Homo Sapiens
NISIDTVVG

SEQ ID NO: 1111152 - protein, 9 aa, Homo Sapiens
PGFGEELKQ

SEQ ID NO: 1111153 - protein, 9 aa, Homo Sapiens
VILSVSATD

SEQ ID NO: 1111154 - protein, 9 aa, Homo Sapiens
YMNRNNVEM

SEQ ID NO: 1111155 - protein, 9 aa, Homo Sapiens
EDAEPTVWT

SEQ ID NO: 1111156 - protein, 9 aa, Homo Sapiens
YQEGVSSFC

SEQ ID NO: 1111157 - protein, 9 aa, Homo Sapiens
NNRSQIVLF

SEQ ID NO: 1111158 - protein, 9 aa, Homo Sapiens
VQARAILNY

SEQ ID NO: 1111159 - protein, 9 aa, Homo Sapiens
FLADILHLT

SEQ ID NO: 1111160 - protein, 9 aa, Homo Sapiens
WTIHQPQSH

SEQ ID NO: 1111161 - protein, 9 aa, Homo Sapiens
LPTSPGSLA

SEQ ID NO: 1111162 - protein, 9 aa, Homo Sapiens
DSSEDTTYL

SEQ ID NO: 1111163 - protein, 9 aa, Homo Sapiens
RRDRPIEVK

SEQ ID NO: 1111164 - protein, 9 aa, Homo Sapiens
RCKTTEYSK

SEQ ID NO: 1111165 - protein, 9 aa, Homo Sapiens
RNINWKLSA

SEQ ID NO: 1111166 - protein, 9 aa, Homo Sapiens
VFRGIPGDN

SEQ ID NO: 1111167 - protein, 9 aa, Homo Sapiens
RAVLTHKRC

SEQ ID NO: 1111168 - protein, 9 aa, Homo Sapiens
RESTSAEDD

SEQ ID NO: 1111169 - protein, 9 aa, Homo Sapiens
NAIYLDTYE

SEQ ID NO: 1111170 - protein, 9 aa, Homo Sapiens
ADILHLTDL

SEQ ID NO: 1111171 - protein, 9 aa, Homo Sapiens
GGCCGPGSG

SEQ ID NO: 1111172 - protein, 9 aa, Homo Sapiens
MDSSMSIAD

SEQ ID NO: 1111173 - protein, 9 aa, Homo Sapiens
RWNTHRHVS

SEQ ID NO: 1111174 - protein, 9 aa, Homo Sapiens
QVVSMEHNL

SEQ ID NO: 1111175 - protein, 9 aa, Homo Sapiens
ETWRWMVFK

SEQ ID NO: 1111176 - protein, 9 aa, Homo Sapiens
ANVIESCRF

SEQ ID NO: 1111177 - protein, 9 aa, Homo Sapiens
QRVDTAGQD

SEQ ID NO: 1111178 - protein, 9 aa, Homo Sapiens
QEITGCRTV

SEQ ID NO: 1111179 - protein, 9 aa, Homo Sapiens
LTRARSLGL

SEQ ID NO: 1111180 - protein, 9 aa, Homo Sapiens
LFLFFPVIY

SEQ ID NO: 1111181 - protein, 9 aa, Homo Sapiens
PQGMYYHGQ

SEQ ID NO: 1111182 - protein, 9 aa, Homo Sapiens
TYMLETWRW

SEQ ID NO: 1111183 - protein, 9 aa, Homo Sapiens
DNTVVLEER

SEQ ID NO: 1111184 - protein, 9 aa, Homo Sapiens
KLPQETARR

SEQ ID NO: 1111185 - protein, 9 aa, Homo Sapiens
EKLSCMADS

SEQ ID NO: 1111186 - protein, 9 aa, Homo Sapiens
KSIPVPCQT

SEQ ID NO: 1111187 - protein, 9 aa, Homo Sapiens
DEQLHAIDS

SEQ ID NO: 1111188 - protein, 9 aa, Homo Sapiens
NKQTRDYAE

SEQ ID NO: 1111189 - protein, 9 aa, Homo Sapiens
PQSHVILLN

SEQ ID NO: 1111190 - protein, 9 aa, Homo Sapiens
TSPGSLATS

SEQ ID NO: 1111191 - protein, 9 aa, Homo Sapiens
EEIMKISPI

SEQ ID NO: 1111192 - protein, 9 aa, Homo Sapiens
MVKATTIKE

SEQ ID NO: 1111193 - protein, 9 aa, Homo Sapiens
NGIPIKVGL

SEQ ID NO: 1111194 - protein, 9 aa, Homo Sapiens
MRKTAPKAK

SEQ ID NO: 1111195 - protein, 9 aa, Homo Sapiens
TRRNRDMKA

SEQ ID NO: 1111196 - protein, 9 aa, Homo Sapiens
KTLVKAFID

SEQ ID NO: 1111197 - protein, 9 aa, Homo Sapiens
SLSTGSAAD

SEQ ID NO: 1111198 - protein, 9 aa, Homo Sapiens
LRKVLGKGR

SEQ ID NO: 1111199 - protein, 9 aa, Homo Sapiens
SSSEVGYNA

SEQ ID NO: 1111200 - protein, 9 aa, Homo Sapiens
ETSRQRKMS

SEQ ID NO: 1111201 - protein, 9 aa, Homo Sapiens
DFVFYSVLV

SEQ ID NO: 1111202 - protein, 9 aa, Homo Sapiens
GSPPKWGPL

SEQ ID NO: 1111203 - protein, 9 aa, Homo Sapiens
DETDRHIIR

SEQ ID NO: 1111204 - protein, 9 aa, Homo Sapiens
SREMQTAVR

SEQ ID NO: 1111205 - protein, 9 aa, Homo Sapiens
SHVILLNFT

SEQ ID NO: 1111206 - protein, 9 aa, Homo Sapiens
MVATKCLIP

SEQ ID NO: 1111207 - protein, 9 aa, Homo Sapiens
LYNLDHSNA

SEQ ID NO: 1111208 - protein, 9 aa, Homo Sapiens
PPLMINQEP

SEQ ID NO: 1111209 - protein, 9 aa, Homo Sapiens
TGCRTVPVE

SEQ ID NO: 1111210 - protein, 9 aa, Homo Sapiens
TKDYAHIRS

SEQ ID NO: 1111211 - protein, 9 aa, Homo Sapiens
DNKDPCYFF

SEQ ID NO: 1111212 - protein, 9 aa, Homo Sapiens
SRPGGNRKR

SEQ ID NO: 1111213 - protein, 9 aa, Homo Sapiens
LGEVRPMKC

SEQ ID NO: 1111214 - protein, 9 aa, Homo Sapiens
GSAPIHVCW

SEQ ID NO: 1111215 - protein, 9 aa, Homo Sapiens
RLLGLDTTP

SEQ ID NO: 1111216 - protein, 9 aa, Homo Sapiens
AIHDVDHPV

SEQ ID NO: 1111217 - protein, 9 aa, Homo Sapiens
MSEMHGFIQ

SEQ ID NO: 1111218 - protein, 9 aa, Homo Sapiens
VVSNQFLIN

SEQ ID NO: 1111219 - protein, 9 aa, Homo Sapiens
YEPETRDAW

SEQ ID NO: 1111220 - protein, 9 aa, Homo Sapiens
GSCAGLSQQ

SEQ ID NO: 1111221 - protein, 9 aa, Homo Sapiens
EDRSWWQGK

SEQ ID NO: 1111222 - protein, 9 aa, Homo Sapiens
KQTRDYAES

SEQ ID NO: 1111223 - protein, 9 aa, Homo Sapiens
SREEEEDAE

SEQ ID NO: 1111224 - protein, 9 aa, Homo Sapiens
HPLQYPMLM

SEQ ID NO: 1111225 - protein, 9 aa, Homo Sapiens
TCGDHDDSF

SEQ ID NO: 1111226 - protein, 9 aa, Homo Sapiens
FFKGDRCKT

SEQ ID NO: 1111227 - protein, 9 aa, Homo Sapiens
AFSVFLSLR

SEQ ID NO: 1111228 - protein, 9 aa, Homo Sapiens
KFSVMRSMH

SEQ ID NO: 1111229 - protein, 9 aa, Homo Sapiens
GEEGATLAH

SEQ ID NO: 1111230 - protein, 9 aa, Homo Sapiens
GSCHGLDHD

SEQ ID NO: 1111231 - protein, 9 aa, Homo Sapiens
CGQPATRAC

SEQ ID NO: 1111232 - protein, 9 aa, Homo Sapiens
NVFSIIAIR

SEQ ID NO: 1111233 - protein, 9 aa, Homo Sapiens
YGPGSCHGL

SEQ ID NO: 1111234 - protein, 9 aa, Homo Sapiens
SQTDLEERT

SEQ ID NO: 1111235 - protein, 9 aa, Homo Sapiens
HKIIITEPR

SEQ ID NO: 1111236 - protein, 9 aa, Homo Sapiens
IKVGLWIKM

SEQ ID NO: 1111237 - protein, 9 aa, Homo Sapiens
QQDPTVTRR

SEQ ID NO: 1111238 - protein, 9 aa, Homo Sapiens
PKVFEDEEN

SEQ ID NO: 1111239 - protein, 9 aa, Homo Sapiens
PGLSPTSGD

SEQ ID NO: 1111240 - protein, 9 aa, Homo Sapiens
TNISIDTVV

SEQ ID NO: 1111241 - protein, 9 aa, Homo Sapiens
PGEARAILI

SEQ ID NO: 1111242 - protein, 9 aa, Homo Sapiens
NANYYFCNL

SEQ ID NO: 1111243 - protein, 9 aa, Homo Sapiens
GYTHPQFTL

SEQ ID NO: 1111244 - protein, 9 aa, Homo Sapiens
HEKLSCMAD

SEQ ID NO: 1111245 - protein, 9 aa, Homo Sapiens
ATNISIDTV

SEQ ID NO: 1111246 - protein, 9 aa, Homo Sapiens
HLISKAQQD

SEQ ID NO: 1111247 - protein, 9 aa, Homo Sapiens
RHVSNASIS

SEQ ID NO: 1111248 - protein, 9 aa, Homo Sapiens
SSWIGVFCN

SEQ ID NO: 1111249 - protein, 9 aa, Homo Sapiens
FAGMCFPEV

SEQ ID NO: 1111250 - protein, 9 aa, Homo Sapiens
SAERIHRIS

SEQ ID NO: 1111251 - protein, 9 aa, Homo Sapiens
IFQCTKYVK

SEQ ID NO: 1111252 - protein, 9 aa, Homo Sapiens
QRKPKVFED

SEQ ID NO: 1111253 - protein, 9 aa, Homo Sapiens
ECNECGKAS

SEQ ID NO: 1111254 - protein, 9 aa, Homo Sapiens
HRNLMQEIY

SEQ ID NO: 1111255 - protein, 9 aa, Homo Sapiens
NAPEPYDVG

SEQ ID NO: 1111256 - protein, 9 aa, Homo Sapiens
ALLYQEGVS

SEQ ID NO: 1111257 - protein, 9 aa, Homo Sapiens
QLSNGIPIK

SEQ ID NO: 1111258 - protein, 9 aa, Homo Sapiens
FHQMLSESV

SEQ ID NO: 1111259 - protein, 9 aa, Homo Sapiens
KFRQYVQEC

SEQ ID NO: 1111260 - protein, 9 aa, Homo Sapiens
LSCMADSVI

SEQ ID NO: 1111261 - protein, 9 aa, Homo Sapiens
MINQEPRDF

SEQ ID NO: 1111262 - protein, 9 aa, Homo Sapiens
VVCSCTDGY

SEQ ID NO: 1111263 - protein, 9 aa, Homo Sapiens
RQKDHCEQR

SEQ ID NO: 1111264 - protein, 9 aa, Homo Sapiens
LCLSCALEL

SEQ ID NO: 1111265 - protein, 9 aa, Homo Sapiens
MEHNLTPTT

SEQ ID NO: 1111266 - protein, 9 aa, Homo Sapiens
RALLYQEGV

SEQ ID NO: 1111267 - protein, 9 aa, Homo Sapiens
KLQFTFTSE

SEQ ID NO: 1111268 - protein, 9 aa, Homo Sapiens
LQRRCSQAV

SEQ ID NO: 1111269 - protein, 9 aa, Homo Sapiens
PSCNNRHFW

SEQ ID NO: 1111270 - protein, 9 aa, Homo Sapiens
LVAKLLKIN

SEQ ID NO: 1111271 - protein, 9 aa, Homo Sapiens
TAVVENSVK

SEQ ID NO: 1111272 - protein, 9 aa, Homo Sapiens
VDSWADLNY

SEQ ID NO: 1111273 - protein, 9 aa, Homo Sapiens
NGSWLLGNI

SEQ ID NO: 1111274 - protein, 9 aa, Homo Sapiens
DQDNKDPCY

SEQ ID NO: 1111275 - protein, 9 aa, Homo Sapiens
GEEEILIKN

SEQ ID NO: 1111276 - protein, 9 aa, Homo Sapiens
DMVATKCLI

SEQ ID NO: 1111277 - protein, 9 aa, Homo Sapiens
VRPNNNNMP

SEQ ID NO: 1111278 - protein, 9 aa, Homo Sapiens
PEPVLEGWT

SEQ ID NO: 1111279 - protein, 9 aa, Homo Sapiens
GMYYGAGLV

SEQ ID NO: 1111280 - protein, 9 aa, Homo Sapiens
LPFTYMLET

SEQ ID NO: 1111281 - protein, 9 aa, Homo Sapiens
GRIVRPNNN

SEQ ID NO: 1111282 - protein, 9 aa, Homo Sapiens
EQRALLYQE

SEQ ID NO: 1111283 - protein, 9 aa, Homo Sapiens
LRKMLTVEP

SEQ ID NO: 1111284 - protein, 9 aa, Homo Sapiens
LVLFAIFLS

SEQ ID NO: 1111285 - protein, 9 aa, Homo Sapiens
IQAKSDQEA

SEQ ID NO: 1111286 - protein, 9 aa, Homo Sapiens
LPVDVCKLT

SEQ ID NO: 1111287 - protein, 9 aa, Homo Sapiens
PGSGGCCNS

SEQ ID NO: 1111288 - protein, 9 aa, Homo Sapiens
VGNKNSQVL

SEQ ID NO: 1111289 - protein, 9 aa, Homo Sapiens
WPHPHLPTH

SEQ ID NO: 1111290 - protein, 9 aa, Homo Sapiens
FRRACCLVH

SEQ ID NO: 1111291 - protein, 9 aa, Homo Sapiens
CTTVAAFIL

SEQ ID NO: 1111292 - protein, 9 aa, Homo Sapiens
SIDTVVGAG

SEQ ID NO: 1111293 - protein, 9 aa, Homo Sapiens
NSQVLPLTT

SEQ ID NO: 1111294 - protein, 9 aa, Homo Sapiens
SGIRIERVI

SEQ ID NO: 1111295 - protein, 9 aa, Homo Sapiens
NEPVLRFHQ

SEQ ID NO: 1111296 - protein, 9 aa, Homo Sapiens
VVENSVKVQ

SEQ ID NO: 1111297 - protein, 9 aa, Homo Sapiens
AGAVCPLGD

SEQ ID NO: 1111298 - protein, 9 aa, Homo Sapiens
VPYSVPEPV

SEQ ID NO: 1111299 - protein, 9 aa, Homo Sapiens
TSREEEEDA

SEQ ID NO: 1111300 - protein, 9 aa, Homo Sapiens
VVTSTDVAE

SEQ ID NO: 1111301 - protein, 9 aa, Homo Sapiens
TLTSNVFSI

SEQ ID NO: 1111302 - protein, 9 aa, Homo Sapiens
IDPSGIRIE

SEQ ID NO: 1111303 - protein, 9 aa, Homo Sapiens
AECKGPLLD

SEQ ID NO: 1111304 - protein, 9 aa, Homo Sapiens
ERQKDHCEQ

SEQ ID NO: 1111305 - protein, 9 aa, Homo Sapiens
QEESPREPD

SEQ ID NO: 1111306 - protein, 9 aa, Homo Sapiens
KPEKMHPKH

SEQ ID NO: 1111307 - protein, 9 aa, Homo Sapiens
RSTLSEHLR

SEQ ID NO: 1111308 - protein, 9 aa, Homo Sapiens
KAEFLWDHV

SEQ ID NO: 1111309 - protein, 9 aa, Homo Sapiens
GSLATSPYP

SEQ ID NO: 1111310 - protein, 9 aa, Homo Sapiens
SVDSETVLQ

SEQ ID NO: 1111311 - protein, 9 aa, Homo Sapiens
FTASIAIRR

SEQ ID NO: 1111312 - protein, 9 aa, Homo Sapiens
ELQEIRTGA

SEQ ID NO: 1111313 - protein, 9 aa, Homo Sapiens
HSISKEDHR

SEQ ID NO: 1111314 - protein, 9 aa, Homo Sapiens
RFHQMLSES

SEQ ID NO: 1111315 - protein, 9 aa, Homo Sapiens
KNADHCYLS

SEQ ID NO: 1111316 - protein, 9 aa, Homo Sapiens
EVNFDSSED

SEQ ID NO: 1111317 - protein, 9 aa, Homo Sapiens
TEQRALLYQ

SEQ ID NO: 1111318 - protein, 9 aa, Homo Sapiens
DAEPTVWTE

SEQ ID NO: 1111319 - protein, 9 aa, Homo Sapiens
GTFAPLRAI

SEQ ID NO: 1111320 - protein, 9 aa, Homo Sapiens
CYFFSLKTD

SEQ ID NO: 1111321 - protein, 9 aa, Homo Sapiens
DGMKLVQAR

SEQ ID NO: 1111322 - protein, 9 aa, Homo Sapiens
HDWVQENYL

SEQ ID NO: 1111323 - protein, 9 aa, Homo Sapiens
EFIITTLNL

SEQ ID NO: 1111324 - protein, 9 aa, Homo Sapiens
HTPPGSVIL

SEQ ID NO: 1111325 - protein, 9 aa, Homo Sapiens
FAPLRAIQT

SEQ ID NO: 1111326 - protein, 9 aa, Homo Sapiens
PKTLTCEEH

SEQ ID NO: 1111327 - protein, 9 aa, Homo Sapiens
FLYNLDHSN

SEQ ID NO: 1111328 - protein, 9 aa, Homo Sapiens
IVEGLCWLL

SEQ ID NO: 1111329 - protein, 8 aa, Homo Sapiens
SSDRQRSD

SEQ ID NO: 1111330 - protein, 9 aa, Homo Sapiens
SHPLFGRLV

SEQ ID NO: 1111331 - protein, 9 aa, Homo Sapiens
HLSLQERLV

SEQ ID NO: 1111332 - protein, 9 aa, Homo Sapiens
GALRKMLTV

SEQ ID NO: 1111333 - protein, 9 aa, Homo Sapiens
GIPIKVGLW

SEQ ID NO: 1111334 - protein, 9 aa, Homo Sapiens
SPALSHRGS

SEQ ID NO: 1111335 - protein, 9 aa, Homo Sapiens
GHTQCHLLP

SEQ ID NO: 1111336 - protein, 9 aa, Homo Sapiens
MSQVEQELF

SEQ ID NO: 1111337 - protein, 9 aa, Homo Sapiens
PTPGDIFEV

SEQ ID NO: 1111338 - protein, 9 aa, Homo Sapiens
FTMRYHYRL

SEQ ID NO: 1111339 - protein, 9 aa, Homo Sapiens
LIGKTGYTL

SEQ ID NO: 1111340 - protein, 9 aa, Homo Sapiens
GMKLVQARA

SEQ ID NO: 1111341 - protein, 9 aa, Homo Sapiens
MCVPFLADI

SEQ ID NO: 1111342 - protein, 9 aa, Homo Sapiens
SVLLVQLIQ

SEQ ID NO: 1111343 - protein, 9 aa, Homo Sapiens
KLKSIPVPC

SEQ ID NO: 1111344 - protein, 9 aa, Homo Sapiens
NSFNSYEPE

SEQ ID NO: 1111345 - protein, 9 aa, Homo Sapiens
LQIVPVFIQ

SEQ ID NO: 1111346 - protein, 9 aa, Homo Sapiens
LDTYEPCIK

SEQ ID NO: 1111347 - protein, 9 aa, Homo Sapiens
SPPTPGDIF

SEQ ID NO: 1111348 - protein, 9 aa, Homo Sapiens
EYIQEITGC

SEQ ID NO: 1111349 - protein, 9 aa, Homo Sapiens
FETLELNEN

SEQ ID NO: 1111350 - protein, 9 aa, Homo Sapiens
ERARERQKD

SEQ ID NO: 1111351 - protein, 9 aa, Homo Sapiens
HKLQFTFTS

SEQ ID NO: 1111352 - protein, 9 aa, Homo Sapiens
SSPPTPGDI

SEQ ID NO: 1111353 - protein, 9 aa, Homo Sapiens
PSSWIGVFC

SEQ ID NO: 1111354 - protein, 9 aa, Homo Sapiens
PLHMASQGD

SEQ ID NO: 1111355 - protein, 9 aa, Homo Sapiens
ISNEESKIL

SEQ ID NO: 1111356 - protein, 9 aa, Homo Sapiens
TLVKAFIDQ

SEQ ID NO: 1111357 - protein, 9 aa, Homo Sapiens
YSVPEPVLE

SEQ ID NO: 1111358 - protein, 9 aa, Homo Sapiens
DEQLGMTKE

SEQ ID NO: 1111359 - protein, 9 aa, Homo Sapiens
LSHRGSLGE

SEQ ID NO: 1111360 - protein, 9 aa, Homo Sapiens
HLQRVDTAG

SEQ ID NO: 1111361 - protein, 9 aa, Homo Sapiens
NECGKASCH

SEQ ID NO: 1111362 - protein, 9 aa, Homo Sapiens
SLVQGRIVR

SEQ ID NO: 1111363 - protein, 9 aa, Homo Sapiens
AERIHRISF

SEQ ID NO: 1111364 - protein, 9 aa, Homo Sapiens
NVIESCRFW

SEQ ID NO: 1111365 - protein, 9 aa, Homo Sapiens
YNAMAGDFV

SEQ ID NO: 1111366 - protein, 9 aa, Homo Sapiens
KCSAKAFHT

SEQ ID NO: 1111367 - protein, 9 aa, Homo Sapiens
VELSRPGGN

SEQ ID NO: 1111368 - protein, 9 aa, Homo Sapiens
LSQTDLEER

SEQ ID NO: 1111369 - protein, 9 aa, Homo Sapiens
EPTVWTELM

SEQ ID NO: 1111370 - protein, 9 aa, Homo Sapiens
ILFLFFPVI

SEQ ID NO: 1111371 - protein, 9 aa, Homo Sapiens
LEERTYFFP

SEQ ID NO: 1111372 - protein, 9 aa, Homo Sapiens
SCFPHTHLG

SEQ ID NO: 1111373 - protein, 9 aa, Homo Sapiens
EEGATLAHA

SEQ ID NO: 1111374 - protein, 9 aa, Homo Sapiens
CNSSHHPWV

SEQ ID NO: 1111375 - protein, 9 aa, Homo Sapiens
VSMEHNLTP

SEQ ID NO: 1111376 - protein, 9 aa, Homo Sapiens
MKISPIEIG

SEQ ID NO: 1111377 - protein, 9 aa, Homo Sapiens
ESTSAEDDI

SEQ ID NO: 1111378 - protein, 9 aa, Homo Sapiens
LQFTFTSEP

SEQ ID NO: 1111379 - protein, 9 aa, Homo Sapiens
STLSEHLRI

SEQ ID NO: 1111380 - protein, 9 aa, Homo Sapiens
KTLTCEEHL

SEQ ID NO: 1111381 - protein, 9 aa, Homo Sapiens
AATAVVENS

SEQ ID NO: 1111382 - protein, 9 aa, Homo Sapiens
ETDRHIIRE

SEQ ID NO: 1111383 - protein, 9 aa, Homo Sapiens
TPGDIFEVE

SEQ ID NO: 1111384 - protein, 9 aa, Homo Sapiens
SMDSSMSIA

SEQ ID NO: 1111385 - protein, 9 aa, Homo Sapiens
IGVFCNSSH

SEQ ID NO: 1111386 - protein, 9 aa, Homo Sapiens
SSTYHCHMR

SEQ ID NO: 1111387 - protein, 9 aa, Homo Sapiens
ACKQAEEAL

SEQ ID NO: 1111388 - protein, 9 aa, Homo Sapiens
CEEHLLNLH

SEQ ID NO: 1111389 - protein, 9 aa, Homo Sapiens
YTHPQFTLR

SEQ ID NO: 1111390 - protein, 9 aa, Homo Sapiens
SCLKDRHDL

SEQ ID NO: 1111391 - protein, 9 aa, Homo Sapiens
LNENTDYPV

SEQ ID NO: 1111392 - protein, 9 aa, Homo Sapiens
FEEIMKISP

SEQ ID NO: 1111393 - protein, 9 aa, Homo Sapiens
SSASSMDQG

SEQ ID NO: 1111394 - protein, 9 aa, Homo Sapiens
QIVPVFIQD

SEQ ID NO: 1111395 - protein, 9 aa, Homo Sapiens
HRQEAALKL

SEQ ID NO: 1111396 - protein, 9 aa, Homo Sapiens
AICNHLRPF

SEQ ID NO: 1111397 - protein, 9 aa, Homo Sapiens
GHPIAFSCS

SEQ ID NO: 1111398 - protein, 9 aa, Homo Sapiens
ESLIGKTGY

SEQ ID NO: 1111399 - protein, 9 aa, Homo Sapiens
HIIREPLTE

SEQ ID NO: 1111400 - protein, 9 aa, Homo Sapiens
VKLGLGDFV

SEQ ID NO: 1111401 - protein, 9 aa, Homo Sapiens
EDDIIDGFA

SEQ ID NO: 1111402 - protein, 9 aa, Homo Sapiens
SSSPPTPGD

SEQ ID NO: 1111403 - protein, 9 aa, Homo Sapiens
CTPHKALRA

SEQ ID NO: 1111404 - protein, 9 aa, Homo Sapiens
IEQYSARHL

SEQ ID NO: 1111405 - protein, 9 aa, Homo Sapiens
CLVHDFTDA

SEQ ID NO: 1111406 - protein, 9 aa, Homo Sapiens
HIDPTFISN

SEQ ID NO: 1111407 - protein, 9 aa, Homo Sapiens
TTPVQDCPR

SEQ ID NO: 1111408 - protein, 9 aa, Homo Sapiens
VRDKLGAVN

SEQ ID NO: 1111409 - protein, 9 aa, Homo Sapiens
LPLTTEKKE

SEQ ID NO: 1111410 - protein, 9 aa, Homo Sapiens
MHGFIQIQK

SEQ ID NO: 1111411 - protein, 9 aa, Homo Sapiens
SCLPSCNNR

SEQ ID NO: 1111412 - protein, 9 aa, Homo Sapiens
TCGQPATRA

SEQ ID NO: 1111413 - protein, 9 aa, Homo Sapiens
RVDTAGQDE

SEQ ID NO: 1111414 - protein, 9 aa, Homo Sapiens
RKLKSIPVP

SEQ ID NO: 1111415 - protein, 9 aa, Homo Sapiens
RCQQCCFKK

SEQ ID NO: 1111416 - protein, 9 aa, Homo Sapiens
TVPSVLLVQ

SEQ ID NO: 1111417 - protein, 9 aa, Homo Sapiens
EILELKAAC

SEQ ID NO: 1111418 - protein, 9 aa, Homo Sapiens
RGLQRRCSQ

SEQ ID NO: 1111419 - protein, 9 aa, Homo Sapiens
LNATGHPIA

SEQ ID NO: 1111420 - protein, 9 aa, Homo Sapiens
LQRVDTAGQ

SEQ ID NO: 1111421 - protein, 9 aa, Homo Sapiens
GLWIKMTMN

SEQ ID NO: 1111422 - protein, 9 aa, Homo Sapiens
DRPSTVVPR

SEQ ID NO: 1111423 - protein, 9 aa, Homo Sapiens
NGEEEILIK

SEQ ID NO: 1111424 - protein, 9 aa, Homo Sapiens
ELGYVFILK

SEQ ID NO: 1111425 - protein, 9 aa, Homo Sapiens
DIYKGSTIV

SEQ ID NO: 1111426 - protein, 9 aa, Homo Sapiens
SIIAIRLDS

SEQ ID NO: 1111427 - protein, 9 aa, Homo Sapiens
SLEYIQEIT

SEQ ID NO: 1111428 - protein, 9 aa, Homo Sapiens
DCFFKGDRC

SEQ ID NO: 1111429 - protein, 9 aa, Homo Sapiens
RPNNNNMPS

SEQ ID NO: 1111430 - protein, 9 aa, Homo Sapiens
TSAEDDIID

SEQ ID NO: 1111431 - protein, 9 aa, Homo Sapiens
TVWTELMEQ

SEQ ID NO: 1111432 - protein, 9 aa, Homo Sapiens
FSIIAIRLD

SEQ ID NO: 1111433 - protein, 9 aa, Homo Sapiens
SEDAEPTVW

SEQ ID NO: 1111434 - protein, 9 aa, Homo Sapiens
HGLDHDYSR

SEQ ID NO: 1111435 - protein, 9 aa, Homo Sapiens
LELNENTDY

SEQ ID NO: 1111436 - protein, 9 aa, Homo Sapiens
VDVCKLTCR

SEQ ID NO: 1111437 - protein, 9 aa, Homo Sapiens
PGSVILSVS

SEQ ID NO: 1111438 - protein, 9 aa, Homo Sapiens
MYYHGQTEQ

SEQ ID NO: 1111439 - protein, 9 aa, Homo Sapiens
KRDEQLGMT

SEQ ID NO: 1111440 - protein, 9 aa, Homo Sapiens
ESGGLQIVP

SEQ ID NO: 1111441 - protein, 9 aa, Homo Sapiens
TQPRWNTHR

SEQ ID NO: 1111442 - protein, 9 aa, Homo Sapiens
SLVKIYFIS

SEQ ID NO: 1111443 - protein, 9 aa, Homo Sapiens
HHRITYLDN

SEQ ID NO: 1111444 - protein, 9 aa, Homo Sapiens
VLTHKRCNK

SEQ ID NO: 1111445 - protein, 9 aa, Homo Sapiens
FGSFIWEQD

SEQ ID NO: 1111446 - protein, 9 aa, Homo Sapiens
GYVFILKNQ

SEQ ID NO: 1111447 - protein, 9 aa, Homo Sapiens
PTSPGSLAT

SEQ ID NO: 1111448 - protein, 9 aa, Homo Sapiens
SGGCCGPGS

SEQ ID NO: 1111449 - protein, 9 aa, Homo Sapiens
SDRPSTVVP

SEQ ID NO: 1111450 - protein, 9 aa, Homo Sapiens
LLTHDWVQE

SEQ ID NO: 1111451 - protein, 9 aa, Homo Sapiens
SASSMDQGK

SEQ ID NO: 1111452 - protein, 9 aa, Homo Sapiens
RTLLIILTS

SEQ ID NO: 1111453 - protein, 9 aa, Homo Sapiens
SQVEQELFE

SEQ ID NO: 1111454 - protein, 9 aa, Homo Sapiens
TLHLGNNEL

SEQ ID NO: 1111455 - protein, 9 aa, Homo Sapiens
AKRNTTPVQ

SEQ ID NO: 1111456 - protein, 9 aa, Homo Sapiens
VNKQTRDYA

SEQ ID NO: 1111457 - protein, 9 aa, Homo Sapiens
MISITRRLL

SEQ ID NO: 1111458 - protein, 9 aa, Homo Sapiens
LEERRAGTT

SEQ ID NO: 1111459 - protein, 9 aa, Homo Sapiens
PRWNTHRHV

SEQ ID NO: 1111460 - protein, 9 aa, Homo Sapiens
IITTLNLND

SEQ ID NO: 1111461 - protein, 9 aa, Homo Sapiens
AACKQAEEA

SEQ ID NO: 1111462 - protein, 9 aa, Homo Sapiens
FLFFPVIYT

SEQ ID NO: 1111463 - protein, 9 aa, Homo Sapiens
VAKRRFKET

SEQ ID NO: 1111464 - protein, 9 aa, Homo Sapiens
ADSVIKNLQ

SEQ ID NO: 1111465 - protein, 9 aa, Homo Sapiens
CGKASCHKS

SEQ ID NO: 1111466 - protein, 9 aa, Homo Sapiens
EGATLAHAQ

SEQ ID NO: 1111467 - protein, 9 aa, Homo Sapiens
PSVGDVFHS

SEQ ID NO: 1111468 - protein, 9 aa, Homo Sapiens
QTRDYAESV

SEQ ID NO: 1111469 - protein, 9 aa, Homo Sapiens
SAFSVFLSL

SEQ ID NO: 1111470 - protein, 9 aa, Homo Sapiens
NLRARNNRS

SEQ ID NO: 1111471 - protein, 9 aa, Homo Sapiens
MSYRHQKRW

SEQ ID NO: 1111472 - protein, 9 aa, Homo Sapiens
RRESTSAED

SEQ ID NO: 1111473 - protein, 9 aa, Homo Sapiens
HICDLGEVR

SEQ ID NO: 1111474 - protein, 9 aa, Homo Sapiens
RPFMLQQLL

SEQ ID NO: 1111475 - protein, 9 aa, Homo Sapiens
SPGSLATSP

SEQ ID NO: 1111476 - protein, 9 aa, Homo Sapiens
HLGKLAVVV

SEQ ID NO: 1111477 - protein, 9 aa, Homo Sapiens
EKNADHCYL

SEQ ID NO: 1111478 - protein, 9 aa, Homo Sapiens
YLLCLIQHE

SEQ ID NO: 1111479 - protein, 9 aa, Homo Sapiens
RRWHAEKKM

SEQ ID NO: 1111480 - protein, 9 aa, Homo Sapiens
QYSARHLDM

SEQ ID NO: 1111481 - protein, 9 aa, Homo Sapiens
ITSREMQTA

SEQ ID NO: 1111482 - protein, 9 aa, Homo Sapiens
QDPLAGLPM

SEQ ID NO: 1111483 - protein, 9 aa, Homo Sapiens
KISNEESKI

SEQ ID NO: 1111484 - protein, 9 aa, Homo Sapiens
ELNENTDYP

SEQ ID NO: 1111485 - protein, 9 aa, Homo Sapiens
QRKMSQVEQ

SEQ ID NO: 1111486 - protein, 9 aa, Homo Sapiens
PTFISNGPF

SEQ ID NO: 1111487 - protein, 9 aa, Homo Sapiens
IYTRRNRDM

SEQ ID NO: 1111488 - protein, 9 aa, Homo Sapiens
NENTDYPVK

SEQ ID NO: 1111489 - protein, 9 aa, Homo Sapiens
ENSDEPLNV

SEQ ID NO: 1111490 - protein, 9 aa, Homo Sapiens
IADSEAYFS

SEQ ID NO: 1111491 - protein, 9 aa, Homo Sapiens
EVELSRPGG

SEQ ID NO: 1111492 - protein, 9 aa, Homo Sapiens
LSCALELLP

SEQ ID NO: 1111493 - protein, 9 aa, Homo Sapiens
SYEPETRDA

SEQ ID NO: 1111494 - protein, 9 aa, Homo Sapiens
RPGEARAIL

SEQ ID NO: 1111495 - protein, 9 aa, Homo Sapiens
HARWSPPRR

SEQ ID NO: 1111496 - protein, 9 aa, Homo Sapiens
ARRDRPIEV

SEQ ID NO: 1111497 - protein, 9 aa, Homo Sapiens
SPLHMASQG

SEQ ID NO: 1111498 - protein, 9 aa, Homo Sapiens
IRSATLAIV

SEQ ID NO: 1111499 - protein, 9 aa, Homo Sapiens
SASCRPGLS

SEQ ID NO: 1111500 - protein, 9 aa, Homo Sapiens
TATDADDPI

SEQ ID NO: 1111501 - protein, 9 aa, Homo Sapiens
STLGGRGRW

SEQ ID NO: 1111502 - protein, 9 aa, Homo Sapiens
RFRRACCLV

SEQ ID NO: 1111503 - protein, 9 aa, Homo Sapiens
RYHYRLDGG

SEQ ID NO: 1111504 - protein, 9 aa, Homo Sapiens
WDQLSDDLC

SEQ ID NO: 1111505 - protein, 9 aa, Homo Sapiens
AALNATGHP

SEQ ID NO: 1111506 - protein, 9 aa, Homo Sapiens
YLQPSSASS

SEQ ID NO: 1111507 - protein, 9 aa, Homo Sapiens
WEPTQEAPP

SEQ ID NO: 1111508 - protein, 9 aa, Homo Sapiens
SISKEDHRH

SEQ ID NO: 1111509 - protein, 9 aa, Homo Sapiens
TFAPLRAIQ

SEQ ID NO: 1111510 - protein, 9 aa, Homo Sapiens
GKSNMGTCG

SEQ ID NO: 1111511 - protein, 9 aa, Homo Sapiens
SDEPLNVTF

SEQ ID NO: 1111512 - protein, 9 aa, Homo Sapiens
LESGGLQIV

SEQ ID NO: 1111513 - protein, 9 aa, Homo Sapiens
TVVGAGEFG

SEQ ID NO: 1111514 - protein, 9 aa, Homo Sapiens
LISKAQQDP

SEQ ID NO: 1111515 - protein, 9 aa, Homo Sapiens
PEPYDVGFG

SEQ ID NO: 1111516 - protein, 9 aa, Homo Sapiens
RQGFSYLLC

SEQ ID NO: 1111517 - protein, 9 aa, Homo Sapiens
RDYAESVGR

SEQ ID NO: 1111518 - protein, 9 aa, Homo Sapiens
AGLPMPERG

SEQ ID NO: 1111519 - protein, 9 aa, Homo Sapiens
LGRSCSWEA

SEQ ID NO: 1111520 - protein, 9 aa, Homo Sapiens
IDGMKLVQA

SEQ ID NO: 1111521 - protein, 9 aa, Homo Sapiens
WGPLPTEEQ

SEQ ID NO: 1111522 - protein, 9 aa, Homo Sapiens
NELQEIRTG

SEQ ID NO: 1111523 - protein, 9 aa, Homo Sapiens
FLCKLVHVL

SEQ ID NO: 1111524 - protein, 9 aa, Homo Sapiens
GISLVKIYF

SEQ ID NO: 1111525 - protein, 9 aa, Homo Sapiens
VLLVQLIQE

SEQ ID NO: 1111526 - protein, 9 aa, Homo Sapiens
IPEFIITTL

SEQ ID NO: 1111527 - protein, 9 aa, Homo Sapiens
CRFWAAVYF

SEQ ID NO: 1111528 - protein, 9 aa, Homo Sapiens
GMCFPEVAR

SEQ ID NO: 1111529 - protein, 9 aa, Homo Sapiens
RMSYRHQKR

SEQ ID NO: 1111530 - protein, 9 aa, Homo Sapiens
IRIEKNADH

SEQ ID NO: 1111531 - protein, 9 aa, Homo Sapiens
QDKPFLSDR

SEQ ID NO: 1111532 - protein, 9 aa, Homo Sapiens
SETIDLNRD

SEQ ID NO: 1111533 - protein, 9 aa, Homo Sapiens
EPTQEAPPW

SEQ ID NO: 1111534 - protein, 9 aa, Homo Sapiens
VHLSFEEIM

SEQ ID NO: 1111535 - protein, 9 aa, Homo Sapiens
SISGIDMAG

SEQ ID NO: 1111536 - protein, 9 aa, Homo Sapiens
PEFIITTLN

SEQ ID NO: 1111537 - protein, 9 aa, Homo Sapiens
KMSNFSPIQ

SEQ ID NO: 1111538 - protein, 9 aa, Homo Sapiens
ERLVWLQLK

SEQ ID NO: 1111539 - protein, 9 aa, Homo Sapiens
RKVLGKGRC

SEQ ID NO: 1111540 - protein, 9 aa, Homo Sapiens
LTIRSATLA

SEQ ID NO: 1111541 - protein, 9 aa, Homo Sapiens
VTLHLGNNE

SEQ ID NO: 1111542 - protein, 9 aa, Homo Sapiens
FIRPVENVC

SEQ ID NO: 1111543 - protein, 9 aa, Homo Sapiens
EGLCWLLAV

SEQ ID NO: 1111544 - protein, 9 aa, Homo Sapiens
STCGQPATR

SEQ ID NO: 1111545 - protein, 9 aa, Homo Sapiens
DYMNRNNVE

SEQ ID NO: 1111546 - protein, 9 aa, Homo Sapiens
CLSLVAKLL

SEQ ID NO: 1111547 - protein, 9 aa, Homo Sapiens
WSKTKFAHQ

SEQ ID NO: 1111548 - protein, 9 aa, Homo Sapiens
MSNFSPIQE

SEQ ID NO: 1111549 - protein, 9 aa, Homo Sapiens
IAIRRWHAE

SEQ ID NO: 1111550 - protein, 9 aa, Homo Sapiens
SQRHKRQPR

SEQ ID NO: 1111551 - protein, 9 aa, Homo Sapiens
CLKDRHDLG

SEQ ID NO: 1111552 - protein, 9 aa, Homo Sapiens
RQEAALKLY

SEQ ID NO: 1111553 - protein, 9 aa, Homo Sapiens
WQSSEEHIN

SEQ ID NO: 1111554 - protein, 9 aa, Homo Sapiens
PIYGNSARV

SEQ ID NO: 1111555 - protein, 9 aa, Homo Sapiens
ETPHKLQFT

SEQ ID NO: 1111556 - protein, 9 aa, Homo Sapiens
RITYLDNGS

SEQ ID NO: 1111557 - protein, 9 aa, Homo Sapiens
LGNNELQEI

SEQ ID NO: 1111558 - protein, 9 aa, Homo Sapiens
TCGYTHPQF

SEQ ID NO: 1111559 - protein, 9 aa, Homo Sapiens
WEAGAAHNS

SEQ ID NO: 1111560 - protein, 9 aa, Homo Sapiens
SEVGYNAMA

SEQ ID NO: 1111561 - protein, 9 aa, Homo Sapiens
VNQRISAER

SEQ ID NO: 1111562 - protein, 9 aa, Homo Sapiens
PRLCLSCAL

SEQ ID NO: 1111563 - protein, 9 aa, Homo Sapiens
TRARSLGLF

SEQ ID NO: 1111564 - protein, 9 aa, Homo Sapiens
MMKRMSYRH

SEQ ID NO: 1111565 - protein, 9 aa, Homo Sapiens
CHGLDHDYS

SEQ ID NO: 1111566 - protein, 9 aa, Homo Sapiens
AKEIDPSGI

SEQ ID NO: 1111567 - protein, 9 aa, Homo Sapiens
QLVLFAIFL

SEQ ID NO: 1111568 - protein, 9 aa, Homo Sapiens
GNNELQEIR

SEQ ID NO: 1111569 - protein, 9 aa, Homo Sapiens
RSATLAIVL

SEQ ID NO: 1111570 - protein, 9 aa, Homo Sapiens
LNPIIYTRR

SEQ ID NO: 1111571 - protein, 9 aa, Homo Sapiens
KRQPRVIKV

SEQ ID NO: 1111572 - protein, 9 aa, Homo Sapiens
KVVCSCTDG

SEQ ID NO: 1111573 - protein, 9 aa, Homo Sapiens
TYSTTGTVF

SEQ ID NO: 1111574 - protein, 9 aa, Homo Sapiens
PSSASSMDQ

SEQ ID NO: 1111575 - protein, 9 aa, Homo Sapiens
GPGSCHGLD

SEQ ID NO: 1111576 - protein, 9 aa, Homo Sapiens
IKNKNSLYL

SEQ ID NO: 1111577 - protein, 9 aa, Homo Sapiens
KYAGVLPVD

SEQ ID NO: 1111578 - protein, 9 aa, Homo Sapiens
DEPLNVTFI

SEQ ID NO: 1111579 - protein, 9 aa, Homo Sapiens
GLVMCIQPT

SEQ ID NO: 1111580 - protein, 9 aa, Homo Sapiens
PDCPDYIDE

SEQ ID NO: 1111581 - protein, 9 aa, Homo Sapiens
CFPHTHLGK

SEQ ID NO: 1111582 - protein, 9 aa, Homo Sapiens
EEILIKNKN

SEQ ID NO: 1111583 - protein, 9 aa, Homo Sapiens
VEGVPYSVP

SEQ ID NO: 1111584 - protein, 9 aa, Homo Sapiens
QCCFKKCLS

SEQ ID NO: 1111585 - protein, 9 aa, Homo Sapiens
HVILLNFTV

SEQ ID NO: 1111586 - protein, 9 aa, Homo Sapiens
VLTRQDFGP

SEQ ID NO: 1111587 - protein, 9 aa, Homo Sapiens
PYSVPEPVL

SEQ ID NO: 1111588 - protein, 9 aa, Homo Sapiens
KETKDKRVE

SEQ ID NO: 1111589 - protein, 9 aa, Homo Sapiens
LSFEEIMKI

SEQ ID NO: 1111590 - protein, 9 aa, Homo Sapiens
PGPLPASHP

SEQ ID NO: 1111591 - protein, 9 aa, Homo Sapiens
PKYAGVLPV

SEQ ID NO: 1111592 - protein, 9 aa, Homo Sapiens
TSTDVAEYP

SEQ ID NO: 1111593 - protein, 9 aa, Homo Sapiens
NHRQEAALK

SEQ ID NO: 1111594 - protein, 9 aa, Homo Sapiens
MPERGPQSL

SEQ ID NO: 1111595 - protein, 9 aa, Homo Sapiens
KGDRCKTTE

SEQ ID NO: 1111596 - protein, 9 aa, Homo Sapiens
DWQSSEEHI

SEQ ID NO: 1111597 - protein, 9 aa, Homo Sapiens
MHLRIHARW

SEQ ID NO: 1111598 - protein, 9 aa, Homo Sapiens
EPYDVGFGN

SEQ ID NO: 1111599 - protein, 9 aa, Homo Sapiens
KFHVAKRRF

SEQ ID NO: 1111600 - protein, 9 aa, Homo Sapiens
ELFTLQRKP

SEQ ID NO: 1111601 - protein, 9 aa, Homo Sapiens
GCGRAVLTH

SEQ ID NO: 1111602 - protein, 9 aa, Homo Sapiens
ENREKWAPA

SEQ ID NO: 1111603 - protein, 9 aa, Homo Sapiens
CHLLPDKLR

SEQ ID NO: 1111604 - protein, 9 aa, Homo Sapiens
ATGHPIAFS

SEQ ID NO: 1111605 - protein, 9 aa, Homo Sapiens
KPFLSDRPS

SEQ ID NO: 1111606 - protein, 9 aa, Homo Sapiens
SCRFWAAVY

SEQ ID NO: 1111607 - protein, 9 aa, Homo Sapiens
SLPQLLGRS

SEQ ID NO: 1111608 - protein, 9 aa, Homo Sapiens
QARAILNYI

SEQ ID NO: 1111609 - protein, 9 aa, Homo Sapiens
EMQTAVRLL

SEQ ID NO: 1111610 - protein, 9 aa, Homo Sapiens
GRSCSWEAE

SEQ ID NO: 1111611 - protein, 9 aa, Homo Sapiens
LGLPQEEFD

SEQ ID NO: 1111612 - protein, 9 aa, Homo Sapiens
CQYRNINWK

SEQ ID NO: 1111613 - protein, 9 aa, Homo Sapiens
RPMRKTAPK

SEQ ID NO: 1111614 - protein, 9 aa, Homo Sapiens
CSCTDGYRL

SEQ ID NO: 1111615 - protein, 9 aa, Homo Sapiens
QLLGRSCSW

SEQ ID NO: 1111616 - protein, 9 aa, Homo Sapiens
MYYGAGLVM

SEQ ID NO: 1111617 - protein, 9 aa, Homo Sapiens
NSYEPETRD

SEQ ID NO: 1111618 - protein, 9 aa, Homo Sapiens
GKAHTRRRC

SEQ ID NO: 1111619 - protein, 9 aa, Homo Sapiens
DFTMRYHYR

SEQ ID NO: 1111620 - protein, 9 aa, Homo Sapiens
RSTITSREM

SEQ ID NO: 1111621 - protein, 9 aa, Homo Sapiens
NWKLSAAGM

SEQ ID NO: 1111622 - protein, 9 aa, Homo Sapiens
ITRRLLGLD

SEQ ID NO: 1111623 - protein, 9 aa, Homo Sapiens
PEAPPLDRG

SEQ ID NO: 1111624 - protein, 9 aa, Homo Sapiens
VLEERRAGT

SEQ ID NO: 1111625 - protein, 9 aa, Homo Sapiens
RSCSWEAEG

SEQ ID NO: 1111626 - protein, 9 aa, Homo Sapiens
EPVLRFHQM

SEQ ID NO: 1111627 - protein, 9 aa, Homo Sapiens
IAQKPEKMH

SEQ ID NO: 1111628 - protein, 9 aa, Homo Sapiens
PPGSVILSV

SEQ ID NO: 1111629 - protein, 9 aa, Homo Sapiens
TNHRQEAAL

SEQ ID NO: 1111630 - protein, 9 aa, Homo Sapiens
GFRTTWLST

SEQ ID NO: 1111631 - protein, 9 aa, Homo Sapiens
IRRWHAEKK

SEQ ID NO: 1111632 - protein, 9 aa, Homo Sapiens
TTARCGNLI

SEQ ID NO: 1111633 - protein, 9 aa, Homo Sapiens
LGSPPKWGP

SEQ ID NO: 1111634 - protein, 9 aa, Homo Sapiens
TSRQRKMSQ

SEQ ID NO: 1111635 - protein, 9 aa, Homo Sapiens
TKCLIPDGC

SEQ ID NO: 1111636 - protein, 9 aa, Homo Sapiens
HDLGLPQEE

SEQ ID NO: 1111637 - protein, 9 aa, Homo Sapiens
KLLTHDWVQ

SEQ ID NO: 1111638 - protein, 9 aa, Homo Sapiens
LTHKRCNKH

SEQ ID NO: 1111639 - protein, 9 aa, Homo Sapiens
CTDGYRLAE

SEQ ID NO: 1111640 - protein, 9 aa, Homo Sapiens
ADHCYLSTV

SEQ ID NO: 1111641 - protein, 9 aa, Homo Sapiens
LSRPGGNRK

SEQ ID NO: 1111642 - protein, 9 aa, Homo Sapiens
THPQFTLRP

SEQ ID NO: 1111643 - protein, 9 aa, Homo Sapiens
QFIIQAKSD

SEQ ID NO: 1111644 - protein, 9 aa, Homo Sapiens
ASQEESPRE

SEQ ID NO: 1111645 - protein, 9 aa, Homo Sapiens
RRKFGSFIW

SEQ ID NO: 1111646 - protein, 9 aa, Homo Sapiens
FLPSVDSET

SEQ ID NO: 1111647 - protein, 9 aa, Homo Sapiens
SGIDMAGLQ

SEQ ID NO: 1111648 - protein, 9 aa, Homo Sapiens
LGDFVFYSV

SEQ ID NO: 1111649 - protein, 9 aa, Homo Sapiens
VATELGYVF

SEQ ID NO: 1111650 - protein, 9 aa, Homo Sapiens
HDVDHPVVS

SEQ ID NO: 1111651 - protein, 9 aa, Homo Sapiens
GLQRRCSQA

SEQ ID NO: 1111652 - protein, 9 aa, Homo Sapiens
HRANEHLAV

SEQ ID NO: 1111653 - protein, 9 aa, Homo Sapiens
EMHGFIQIQ

SEQ ID NO: 1111654 - protein, 9 aa, Homo Sapiens
TTGFPTQFN

SEQ ID NO: 1111655 - protein, 9 aa, Homo Sapiens
DVMGALRKM

SEQ ID NO: 1111656 - protein, 9 aa, Homo Sapiens
DRGFRTTWL

SEQ ID NO: 1111657 - protein, 9 aa, Homo Sapiens
NADHCYLST

SEQ ID NO: 1111658 - protein, 9 aa, Homo Sapiens
VTFDGNKQH

SEQ ID NO: 1111659 - protein, 9 aa, Homo Sapiens
RTYFFPEDH

SEQ ID NO: 1111660 - protein, 9 aa, Homo Sapiens
VLASSTCGQ

SEQ ID NO: 1111661 - protein, 9 aa, Homo Sapiens
QQKEKCKHS

SEQ ID NO: 1111662 - protein, 9 aa, Homo Sapiens
YNLDHSNAN

SEQ ID NO: 1111663 - protein, 9 aa, Homo Sapiens
NLKQMSAFS

SEQ ID NO: 1111664 - protein, 9 aa, Homo Sapiens
VSPNHTIVT

SEQ ID NO: 1111665 - protein, 9 aa, Homo Sapiens
HHDHAIVLT

SEQ ID NO: 1111666 - protein, 9 aa, Homo Sapiens
MWLTSREEE

SEQ ID NO: 1111667 - protein, 9 aa, Homo Sapiens
NLDHSNANY

SEQ ID NO: 1111668 - protein, 9 aa, Homo Sapiens
PLPGFGEEL

SEQ ID NO: 1111669 - protein, 9 aa, Homo Sapiens
NTTPVQDCP

SEQ ID NO: 1111670 - protein, 9 aa, Homo Sapiens
DPLAGLPMP

SEQ ID NO: 1111671 - protein, 9 aa, Homo Sapiens
PIKVGLWIK

SEQ ID NO: 1111672 - protein, 9 aa, Homo Sapiens
TTGTVFASP

SEQ ID NO: 1111673 - protein, 9 aa, Homo Sapiens
LEHTPPGSV

SEQ ID NO: 1111674 - protein, 9 aa, Homo Sapiens
FLVLALFLA

SEQ ID NO: 1111675 - protein, 9 aa, Homo Sapiens
ACCLVHDFT

SEQ ID NO: 1111676 - protein, 9 aa, Homo Sapiens
DTTYLYRLG

SEQ ID NO: 1111677 - protein, 9 aa, Homo Sapiens
PTCGYTHPQ

SEQ ID NO: 1111678 - protein, 9 aa, Homo Sapiens
NFSPIQESR

SEQ ID NO: 1111679 - protein, 9 aa, Homo Sapiens
DVDHPVVSN

SEQ ID NO: 1111680 - protein, 9 aa, Homo Sapiens
DKPFLSDRP

SEQ ID NO: 1111681 - protein, 9 aa, Homo Sapiens
DLTFTVNED

SEQ ID NO: 1111682 - protein, 9 aa, Homo Sapiens
TVFRGIPGD

SEQ ID NO: 1111683 - protein, 9 aa, Homo Sapiens
VQLVLFAIF

SEQ ID NO: 1111684 - protein, 9 aa, Homo Sapiens
PLNVTFIKK

SEQ ID NO: 1111685 - protein, 9 aa, Homo Sapiens
FPVIYTLTV

SEQ ID NO: 1111686 - protein, 9 aa, Homo Sapiens
RDEQLGMTK

SEQ ID NO: 1111687 - protein, 9 aa, Homo Sapiens
EAFSQLSHL

SEQ ID NO: 1111688 - protein, 9 aa, Homo Sapiens
RSRRPSSSQ

SEQ ID NO: 1111689 - protein, 9 aa, Homo Sapiens
LKAACKQAE

SEQ ID NO: 1111690 - protein, 9 aa, Homo Sapiens
AIRRWHAEK

SEQ ID NO: 1111691 - protein, 9 aa, Homo Sapiens
HIPTDIYKG

SEQ ID NO: 1111692 - protein, 9 aa, Homo Sapiens
PASHPLFGR

SEQ ID NO: 1111693 - protein, 9 aa, Homo Sapiens
TITSREMQT

SEQ ID NO: 1111694 - protein, 9 aa, Homo Sapiens
RKPKVFEDE

SEQ ID NO: 1111695 - protein, 9 aa, Homo Sapiens
IMKISPIEI

SEQ ID NO: 1111696 - protein, 9 aa, Homo Sapiens
RLCLSCALE

SEQ ID NO: 1111697 - protein, 9 aa, Homo Sapiens
PLPASHPLF

SEQ ID NO: 1111698 - protein, 9 aa, Homo Sapiens
IYLDTYEPC

SEQ ID NO: 1111699 - protein, 9 aa, Homo Sapiens
SCPQGMYYH

SEQ ID NO: 1111700 - protein, 9 aa, Homo Sapiens
LAECKGPLL

SEQ ID NO: 1111701 - protein, 9 aa, Homo Sapiens
YVFILKNQV

SEQ ID NO: 1111702 - protein, 9 aa, Homo Sapiens
TYLDNGSWL

SEQ ID NO: 1111703 - protein, 9 aa, Homo Sapiens
GMYYHGQTE

SEQ ID NO: 1111704 - protein, 9 aa, Homo Sapiens
SNFSPIQES

SEQ ID NO: 1111705 - protein, 9 aa, Homo Sapiens
CRPGLSPTS

SEQ ID NO: 1111706 - protein, 9 aa, Homo Sapiens
DRSWWQGKR

SEQ ID NO: 1111707 - protein, 9 aa, Homo Sapiens
ECGEAFSQL

SEQ ID NO: 1111708 - protein, 9 aa, Homo Sapiens
SVGDVFHSI

SEQ ID NO: 1111709 - protein, 9 aa, Homo Sapiens
TGSAADSDT

SEQ ID NO: 1111710 - protein, 9 aa, Homo Sapiens
DSETVLQTG

SEQ ID NO: 1111711 - protein, 9 aa, Homo Sapiens
GSGGCCNSG

SEQ ID NO: 1111712 - protein, 9 aa, Homo Sapiens
MWPHPHLPT

SEQ ID NO: 1111713 - protein, 9 aa, Homo Sapiens
SCRPGLSPT

SEQ ID NO: 1111714 - protein, 9 aa, Homo Sapiens
AEFLWDHVC

SEQ ID NO: 1111715 - protein, 9 aa, Homo Sapiens
VPRDAGAVC

SEQ ID NO: 1111716 - protein, 9 aa, Homo Sapiens
SCTDGYRLA

SEQ ID NO: 1111717 - protein, 9 aa, Homo Sapiens
ALKFRQYVQ

SEQ ID NO: 1111718 - protein, 9 aa, Homo Sapiens
LSQQKEKCK

SEQ ID NO: 1111719 - protein, 9 aa, Homo Sapiens
GAMIWSKTK

SEQ ID NO: 1111720 - protein, 9 aa, Homo Sapiens
HLRIHARWS

SEQ ID NO: 1111721 - protein, 9 aa, Homo Sapiens
GEAFSQLSH

SEQ ID NO: 1111722 - protein, 9 aa, Homo Sapiens
VEGLCWLLA

SEQ ID NO: 1111723 - protein, 9 aa, Homo Sapiens
ETIDLNRDS

SEQ ID NO: 1111724 - protein, 9 aa, Homo Sapiens
SKLMSEMHG

SEQ ID NO: 1111725 - protein, 9 aa, Homo Sapiens
SWPESLIGK

SEQ ID NO: 1111726 - protein, 9 aa, Homo Sapiens
YDSIVNKND

SEQ ID NO: 1111727 - protein, 9 aa, Homo Sapiens
RHLDMLSRI

SEQ ID NO: 1111728 - protein, 9 aa, Homo Sapiens
PSMWLTSRE

SEQ ID NO: 1111729 - protein, 9 aa, Homo Sapiens
DDPIYGNSA

SEQ ID NO: 1111730 - protein, 9 aa, Homo Sapiens
YLDNGSWLL

SEQ ID NO: 1111731 - protein, 9 aa, Homo Sapiens
EHLLNLHEK

SEQ ID NO: 1111732 - protein, 9 aa, Homo Sapiens
SPHICDLGE

SEQ ID NO: 1111733 - protein, 9 aa, Homo Sapiens
CGPGSGGCC

SEQ ID NO: 1111734 - protein, 9 aa, Homo Sapiens
LGYVFILKN

SEQ ID NO: 1111735 - protein, 9 aa, Homo Sapiens
IYGNSARVV

SEQ ID NO: 1111736 - protein, 9 aa, Homo Sapiens
VIEQYSARH

SEQ ID NO: 1111737 - protein, 9 aa, Homo Sapiens
LKDRHDLGL

SEQ ID NO: 1111738 - protein, 9 aa, Homo Sapiens
ESPREPDHA

SEQ ID NO: 1111739 - protein, 9 aa, Homo Sapiens
LSCFPHTHL

SEQ ID NO: 1111740 - protein, 9 aa, Homo Sapiens
ESCRFWAAV

SEQ ID NO: 1111741 - protein, 9 aa, Homo Sapiens
TLELNENTD

SEQ ID NO: 1111742 - protein, 9 aa, Homo Sapiens
MTKEQLLEL

SEQ ID NO: 1111743 - protein, 9 aa, Homo Sapiens
SRSSSISGI

SEQ ID NO: 1111744 - protein, 9 aa, Homo Sapiens
PHICDLGEV

SEQ ID NO: 1111745 - protein, 9 aa, Homo Sapiens
LLGRSCSWE

SEQ ID NO: 1111746 - protein, 9 aa, Homo Sapiens
HLLNLHEKR

SEQ ID NO: 1111747 - protein, 9 aa, Homo Sapiens
TLTCEEHLL

SEQ ID NO: 1111748 - protein, 9 aa, Homo Sapiens
IDMAGLQTS

SEQ ID NO: 1111749 - protein, 9 aa, Homo Sapiens
SVPEPVLEG

SEQ ID NO: 1111750 - protein, 9 aa, Homo Sapiens
PVTPRLCLS

SEQ ID NO: 1111751 - protein, 9 aa, Homo Sapiens
DKLLIFLVL

SEQ ID NO: 1111752 - protein, 9 aa, Homo Sapiens
ASHPLFGRL

SEQ ID NO: 1111753 - protein, 9 aa, Homo Sapiens
HVLIDINLF

SEQ ID NO: 1111754 - protein, 9 aa, Homo Sapiens
GRAVLTHKR

SEQ ID NO: 1111755 - protein, 9 aa, Homo Sapiens
APEPYDVGF

SEQ ID NO: 1111756 - protein, 9 aa, Homo Sapiens
RRKLKSIPV

SEQ ID NO: 1111757 - protein, 9 aa, Homo Sapiens
LMWPHPHLP

SEQ ID NO: 1111758 - protein, 9 aa, Homo Sapiens
WNTHRHVSN

SEQ ID NO: 1111759 - protein, 9 aa, Homo Sapiens
FVFYSVLVG

SEQ ID NO: 1111760 - protein, 9 aa, Homo Sapiens
PVLRFHQML

SEQ ID NO: 1111761 - protein, 9 aa, Homo Sapiens
PFLADILHL

SEQ ID NO: 1111762 - protein, 9 aa, Homo Sapiens
PRHRKTLVK

SEQ ID NO: 1111763 - protein, 9 aa, Homo Sapiens
SPPKWGPLP

SEQ ID NO: 1111764 - protein, 9 aa, Homo Sapiens
PGSCHGLDH

SEQ ID NO: 1111765 - protein, 9 aa, Homo Sapiens
QVLPLTTEK

SEQ ID NO: 1111766 - protein, 9 aa, Homo Sapiens
GVFCNSSHH

SEQ ID NO: 1111767 - protein, 9 aa, Homo Sapiens
RALKFRQYV

SEQ ID NO: 1111768 - protein, 9 aa, Homo Sapiens
PVIYTLTVL

SEQ ID NO: 1111769 - protein, 9 aa, Homo Sapiens
DYMISITRR

SEQ ID NO: 1111770 - protein, 9 aa, Homo Sapiens
TIHQPQSHV

SEQ ID NO: 1111771 - protein, 9 aa, Homo Sapiens
TVNEDVFGQ

SEQ ID NO: 1111772 - protein, 9 aa, Homo Sapiens
NGFGNGKAH

SEQ ID NO: 1111773 - protein, 9 aa, Homo Sapiens
AGMCFPEVA

SEQ ID NO: 1111774 - protein, 9 aa, Homo Sapiens
LGMTKEQLL

SEQ ID NO: 1111775 - protein, 9 aa, Homo Sapiens
QRALLYQEG

SEQ ID NO: 1111776 - protein, 9 aa, Homo Sapiens
HTTNHRQEA

SEQ ID NO: 1111777 - protein, 9 aa, Homo Sapiens
ARFLTRARS

SEQ ID NO: 1111778 - protein, 9 aa, Homo Sapiens
LTWEAGAAH

SEQ ID NO: 1111779 - protein, 9 aa, Homo Sapiens
AEDDIIDGF

SEQ ID NO: 1111780 - protein, 9 aa, Homo Sapiens
SMSIADSEA

SEQ ID NO: 1111781 - protein, 9 aa, Homo Sapiens
HVCWYRDGV

SEQ ID NO: 1111782 - protein, 9 aa, Homo Sapiens
RKTLVKAFI

SEQ ID NO: 1111783 - protein, 9 aa, Homo Sapiens
GEARAILIF

SEQ ID NO: 1111784 - protein, 9 aa, Homo Sapiens
RACCLVHDF

SEQ ID NO: 1111785 - protein, 9 aa, Homo Sapiens
VPSVLLVQL

SEQ ID NO: 1111786 - protein, 9 aa, Homo Sapiens
AANVHIDPT

SEQ ID NO: 1111787 - protein, 9 aa, Homo Sapiens
AHTRRRCRN

SEQ ID NO: 1111788 - protein, 9 aa, Homo Sapiens
QYRNINWKL

SEQ ID NO: 1111789 - protein, 9 aa, Homo Sapiens
GEVRPMKCN

SEQ ID NO: 1111790 - protein, 9 aa, Homo Sapiens
QSWPESLIG

SEQ ID NO: 1111791 - protein, 9 aa, Homo Sapiens
LETWRWMVF

SEQ ID NO: 1111792 - protein, 9 aa, Homo Sapiens
LRARNNRSQ

SEQ ID NO: 1111793 - protein, 9 aa, Homo Sapiens
FHSISKEDH

SEQ ID NO: 1111794 - protein, 9 aa, Homo Sapiens
ANVHIDPTF

SEQ ID NO: 1111795 - protein, 9 aa, Homo Sapiens
SLPTSPGSL

SEQ ID NO: 1111796 - protein, 9 aa, Homo Sapiens
PKCSAKAFH

SEQ ID NO: 1111797 - protein, 9 aa, Homo Sapiens
QLHAIDSSV

SEQ ID NO: 1111798 - protein, 9 aa, Homo Sapiens
YSTTGTVFA

SEQ ID NO: 1111799 - protein, 9 aa, Homo Sapiens
LTFTVNEDV

SEQ ID NO: 1111800 - protein, 9 aa, Homo Sapiens
WNSFNSYEP

SEQ ID NO: 1111801 - protein, 9 aa, Homo Sapiens
NVTFIKKEF

SEQ ID NO: 1111802 - protein, 9 aa, Homo Sapiens
ISVDSWADL

SEQ ID NO: 1111803 - protein, 9 aa, Homo Sapiens
IHDVDHPVV

SEQ ID NO: 1111804 - protein, 9 aa, Homo Sapiens
CFPEVARLC

SEQ ID NO: 1111805 - protein, 9 aa, Homo Sapiens
PPKCSAKAF

SEQ ID NO: 1111806 - protein, 9 aa, Homo Sapiens
LPMPERGPQ

SEQ ID NO: 1111807 - protein, 9 aa, Homo Sapiens
LHTTNHRQE

SEQ ID NO: 1111808 - protein, 9 aa, Homo Sapiens
SWWQGKRGF

SEQ ID NO: 1111809 - protein, 9 aa, Homo Sapiens
LDARFLTRA

SEQ ID NO: 1111810 - protein, 9 aa, Homo Sapiens
WDGAMIWSK

SEQ ID NO: 1111811 - protein, 9 aa, Homo Sapiens
AVLTIRSAT

SEQ ID NO: 1111812 - protein, 9 aa, Homo Sapiens
VAAMHTLWF

SEQ ID NO: 1111813 - protein, 9 aa, Homo Sapiens
GKDSKESTK

SEQ ID NO: 1111814 - protein, 9 aa, Homo Sapiens
LIKNKNSLY

SEQ ID NO: 1111815 - protein, 9 aa, Homo Sapiens
SETVLQTGH

SEQ ID NO: 1111816 - protein, 9 aa, Homo Sapiens
VLRFHQMLS

SEQ ID NO: 1111817 - protein, 9 aa, Homo Sapiens
VSCPQGMYY

SEQ ID NO: 1111818 - protein, 9 aa, Homo Sapiens
KQMSAFSVF

SEQ ID NO: 1111819 - protein, 9 aa, Homo Sapiens
SCHGLDHDY

SEQ ID NO: 1111820 - protein, 9 aa, Homo Sapiens
LEKAEFLWD

SEQ ID NO: 1111821 - protein, 9 aa, Homo Sapiens
DWNSFNSYE

SEQ ID NO: 1111822 - protein, 9 aa, Homo Sapiens
CSAKAFHTE

SEQ ID NO: 1111823 - protein, 9 aa, Homo Sapiens
LQRKPKVFE

SEQ ID NO: 1111824 - protein, 9 aa, Homo Sapiens
LTHDWVQEN

SEQ ID NO: 1111825 - protein, 9 aa, Homo Sapiens
AMIWSKTKF

SEQ ID NO: 1111826 - protein, 9 aa, Homo Sapiens
KEPSMWLTS

SEQ ID NO: 1111827 - protein, 9 aa, Homo Sapiens
GDRCKTTEY

SEQ ID NO: 1111828 - protein, 9 aa, Homo Sapiens
INQEPRDFA

SEQ ID NO: 1111829 - protein, 9 aa, Homo Sapiens
TDKLLIFLV

SEQ ID NO: 1111830 - protein, 9 aa, Homo Sapiens
DSSMSIADS

SEQ ID NO: 1111831 - protein, 9 aa, Homo Sapiens
WSPPRRPAW

SEQ ID NO: 1111832 - protein, 9 aa, Homo Sapiens
VENVCDPVT

SEQ ID NO: 1111833 - protein, 9 aa, Homo Sapiens
ATDADDPIY

SEQ ID NO: 1111834 - protein, 9 aa, Homo Sapiens
GDFVFYSVL

SEQ ID NO: 1111835 - protein, 9 aa, Homo Sapiens
NHLRPFMLQ

SEQ ID NO: 1111836 - protein, 9 aa, Homo Sapiens
CKLVHVLID

SEQ ID NO: 1111837 - protein, 9 aa, Homo Sapiens
VIAQKPEKM

SEQ ID NO: 1111838 - protein, 9 aa, Homo Sapiens
KKEEAHVLL

SEQ ID NO: 1111839 - protein, 9 aa, Homo Sapiens
MCFPEVARL

SEQ ID NO: 1111840 - protein, 9 aa, Homo Sapiens
GMTKEQLLE

SEQ ID NO: 1111841 - protein, 9 aa, Homo Sapiens
MADSVIKNL

SEQ ID NO: 1111842 - protein, 9 aa, Homo Sapiens
QCTKYVKVF

SEQ ID NO: 1111843 - protein, 9 aa, Homo Sapiens
EQLHAIDSS

SEQ ID NO: 1111844 - protein, 9 aa, Homo Sapiens
SDDFAGMCF

SEQ ID NO: 1111845 - protein, 9 aa, Homo Sapiens
NTGELTSVI

SEQ ID NO: 1111846 - protein, 9 aa, Homo Sapiens
VKATTIKEA

SEQ ID NO: 1111847 - protein, 9 aa, Homo Sapiens
ITYLDNGSW

SEQ ID NO: 1111848 - protein, 9 aa, Homo Sapiens
EERTYFFPE

SEQ ID NO: 1111849 - protein, 9 aa, Homo Sapiens
RIHARWSPP

SEQ ID NO: 1111850 - protein, 9 aa, Homo Sapiens
KQCKDGESV

SEQ ID NO: 1111851 - protein, 9 aa, Homo Sapiens
TFNEIRTLL

SEQ ID NO: 1111852 - protein, 9 aa, Homo Sapiens
VFHSISKED

SEQ ID NO: 1111853 - protein, 9 aa, Homo Sapiens
MKRMSYRHQ

SEQ ID NO: 1111854 - protein, 9 aa, Homo Sapiens
HRGSLGEEG

SEQ ID NO: 1111855 - protein, 9 aa, Homo Sapiens
ATELGYVFI

SEQ ID NO: 1111856 - protein, 9 aa, Homo Sapiens
VATKCLIPD

SEQ ID NO: 1111857 - protein, 9 aa, Homo Sapiens
LYQEGVSSF

SEQ ID NO: 1111858 - protein, 9 aa, Homo Sapiens
LPSPTCGYT

SEQ ID NO: 1111859 - protein, 9 aa, Homo Sapiens
APPWVNLAI

SEQ ID NO: 1111860 - protein, 9 aa, Homo Sapiens
LKSIPVPCQ

SEQ ID NO: 1111861 - protein, 9 aa, Homo Sapiens
QQCCFKKCL

SEQ ID NO: 1111862 - protein, 9 aa, Homo Sapiens
IRTLLIILT

SEQ ID NO: 1111863 - protein, 9 aa, Homo Sapiens
IWSKTKFAH

SEQ ID NO: 1111864 - protein, 9 aa, Homo Sapiens
SNGIPIKVG

SEQ ID NO: 1111865 - protein, 9 aa, Homo Sapiens
LDWQSSEEH

SEQ ID NO: 1111866 - protein, 9 aa, Homo Sapiens
YLDTYEPCI

SEQ ID NO: 1111867 - protein, 9 aa, Homo Sapiens
LNRDSIQPA

SEQ ID NO: 1111868 - protein, 9 aa, Homo Sapiens
SNEESKILK

SEQ ID NO: 1111869 - protein, 9 aa, Homo Sapiens
YSLSTGSAA

SEQ ID NO: 1111870 - protein, 9 aa, Homo Sapiens
SSTCGQPAT

SEQ ID NO: 1111871 - protein, 9 aa, Homo Sapiens
AGAAHNSNI

SEQ ID NO: 1111872 - protein, 9 aa, Homo Sapiens
PSVDSETVL

SEQ ID NO: 1111873 - protein, 9 aa, Homo Sapiens
SVILSVSAT

SEQ ID NO: 1111874 - protein, 9 aa, Homo Sapiens
NRCQQCCFK

SEQ ID NO: 1111875 - protein, 9 aa, Homo Sapiens
DRHIIREPL

SEQ ID NO: 1111876 - protein, 9 aa, Homo Sapiens
LPSCNNRHF

SEQ ID NO: 1111877 - protein, 9 aa, Homo Sapiens
LCKLVHVLI

SEQ ID NO: 1111878 - protein, 9 aa, Homo Sapiens
VDHPVVSNQ

SEQ ID NO: 1111879 - protein, 9 aa, Homo Sapiens
QRISAERIH

SEQ ID NO: 1111880 - protein, 9 aa, Homo Sapiens
MHKTFARYL

SEQ ID NO: 1111881 - protein, 9 aa, Homo Sapiens
GQDKPFLSD

SEQ ID NO: 1111882 - protein, 9 aa, Homo Sapiens
GFPTQFNHE

SEQ ID NO: 1111883 - protein, 9 aa, Homo Sapiens
LLRALKFRQ

SEQ ID NO: 1111884 - protein, 9 aa, Homo Sapiens
WLTSREEEE

SEQ ID NO: 1111885 - protein, 9 aa, Homo Sapiens
KNSQVLPLT

SEQ ID NO: 1111886 - protein, 9 aa, Homo Sapiens
EVGRGLQRR

SEQ ID NO: 1111887 - protein, 9 aa, Homo Sapiens
DQLSDDLCY

SEQ ID NO: 1111888 - protein, 9 aa, Homo Sapiens
RIEKNADHC

SEQ ID NO: 1111889 - protein, 9 aa, Homo Sapiens
HPVVSNQFL

SEQ ID NO: 1111890 - protein, 9 aa, Homo Sapiens
ATKCLIPDG

SEQ ID NO: 1111891 - protein, 9 aa, Homo Sapiens
HRHVSNASI

SEQ ID NO: 1111892 - protein, 9 aa, Homo Sapiens
HKRCNKHAY

SEQ ID NO: 1111893 - protein, 9 aa, Homo Sapiens
TVVLEERRA

SEQ ID NO: 1111894 - protein, 9 aa, Homo Sapiens
KLKISNEES

SEQ ID NO: 1111895 - protein, 9 aa, Homo Sapiens
AGLSQQKEK

SEQ ID NO: 1111896 - protein, 9 aa, Homo Sapiens
CTCHAAPCT

SEQ ID NO: 1111897 - protein, 9 aa, Homo Sapiens
YSLPQLLGR

SEQ ID NO: 1111898 - protein, 9 aa, Homo Sapiens
VLFAIFLSF

SEQ ID NO: 1111899 - protein, 9 aa, Homo Sapiens
HLGNNELQE

SEQ ID NO: 1111900 - protein, 9 aa, Homo Sapiens
NMGNGTVFR

SEQ ID NO: 1111901 - protein, 9 aa, Homo Sapiens
GLPMPERGP

SEQ ID NO: 1111902 - protein, 9 aa, Homo Sapiens
ASQGDHVEC

SEQ ID NO: 1111903 - protein, 9 aa, Homo Sapiens
DHCYLSTVD

SEQ ID NO: 1111904 - protein, 9 aa, Homo Sapiens
DSWADLNYF

SEQ ID NO: 1111905 - protein, 9 aa, Homo Sapiens
LIDPKMSNF

SEQ ID NO: 1111906 - protein, 9 aa, Homo Sapiens
QRHKRQPRV

SEQ ID NO: 1111907 - protein, 9 aa, Homo Sapiens
LFAIFLSFY

SEQ ID NO: 1111908 - protein, 9 aa, Homo Sapiens
ILELKAACK

SEQ ID NO: 1111909 - protein, 9 aa, Homo Sapiens
DVFGQITER

SEQ ID NO: 1111910 - protein, 9 aa, Homo Sapiens
SLATSPYPE

SEQ ID NO: 1111911 - protein, 9 aa, Homo Sapiens
GSVIAQKPE

SEQ ID NO: 1111912 - protein, 9 aa, Homo Sapiens
ISITRRLLG

SEQ ID NO: 1111913 - protein, 9 aa, Homo Sapiens
FMLQQLLRR

SEQ ID NO: 1111914 - protein, 9 aa, Homo Sapiens
SWADLNYFL

SEQ ID NO: 1111915 - protein, 9 aa, Homo Sapiens
NEHLAVAAM

SEQ ID NO: 1111916 - protein, 9 aa, Homo Sapiens
TQCHLLPDK

SEQ ID NO: 1111917 - protein, 9 aa, Homo Sapiens
QKPEKMHPK

SEQ ID NO: 1111918 - protein, 9 aa, Homo Sapiens
SCHKSALIV

SEQ ID NO: 1111919 - protein, 9 aa, Homo Sapiens
TDADDPIYG

SEQ ID NO: 1111920 - protein, 9 aa, Homo Sapiens
RLHTTNHRQ

SEQ ID NO: 1111921 - protein, 9 aa, Homo Sapiens
TSGTVTFDG

SEQ ID NO: 1111922 - protein, 9 aa, Homo Sapiens
APPLDRGFR

SEQ ID NO: 1111923 - protein, 9 aa, Homo Sapiens
VLPVDVCKL

SEQ ID NO: 1111924 - protein, 9 aa, Homo Sapiens
ITTLNLNDF

SEQ ID NO: 1111925 - protein, 9 aa, Homo Sapiens
HVLLKAFQI

SEQ ID NO: 1111926 - protein, 9 aa, Homo Sapiens
VAKLLKINS

SEQ ID NO: 1111927 - protein, 9 aa, Homo Sapiens
KGPLLDDSA

SEQ ID NO: 1111928 - protein, 9 aa, Homo Sapiens
LAGLPMPER

SEQ ID NO: 1111929 - protein, 9 aa, Homo Sapiens
DHKLKISNE

SEQ ID NO: 1111930 - protein, 9 aa, Homo Sapiens
LHLSLQERL

SEQ ID NO: 1111931 - protein, 9 aa, Homo Sapiens
PKMSNFSPI

SEQ ID NO: 1111932 - protein, 9 aa, Homo Sapiens
APLRAIQTM

SEQ ID NO: 1111933 - protein, 9 aa, Homo Sapiens
RQSSTYHCH

SEQ ID NO: 1111934 - protein, 9 aa, Homo Sapiens
RSWPGDIIR

SEQ ID NO: 1111935 - protein, 9 aa, Homo Sapiens
RHIIREPLT

SEQ ID NO: 1111936 - protein, 9 aa, Homo Sapiens
PLSVPRDAG

SEQ ID NO: 1111937 - protein, 9 aa, Homo Sapiens
RLVWLQLKD

SEQ ID NO: 1111938 - protein, 9 aa, Homo Sapiens
GLQIVPVFI

SEQ ID NO: 1111939 - protein, 9 aa, Homo Sapiens
KAHTRRRCR

SEQ ID NO: 1111940 - protein, 9 aa, Homo Sapiens
FLDARFLTR

SEQ ID NO: 1111941 - protein, 9 aa, Homo Sapiens
GAVCPLGDK

SEQ ID NO: 1111942 - protein, 9 aa, Homo Sapiens
SGKSNMGTC

SEQ ID NO: 1111943 - protein, 9 aa, Homo Sapiens
TWEAGAAHN

SEQ ID NO: 1111944 - protein, 9 aa, Homo Sapiens
KRNTTPVQD

SEQ ID NO: 1111945 - protein, 9 aa, Homo Sapiens
ASIAIRRWH

SEQ ID NO: 1111946 - protein, 9 aa, Homo Sapiens
FCNSSHHPW

SEQ ID NO: 1111947 - protein, 9 aa, Homo Sapiens
RHRKTLVKA

SEQ ID NO: 1111948 - protein, 9 aa, Homo Sapiens
DIDFTMRYH

SEQ ID NO: 1111949 - protein, 9 aa, Homo Sapiens
EPRKLLTHD

SEQ ID NO: 1111950 - protein, 9 aa, Homo Sapiens
ALNATGHPI

SEQ ID NO: 1111951 - protein, 9 aa, Homo Sapiens
FPTQFNHEP

SEQ ID NO: 1111952 - protein, 9 aa, Homo Sapiens
CVPFLADIL

SEQ ID NO: 1111953 - protein, 9 aa, Homo Sapiens
LKFRQYVQE

SEQ ID NO: 1111954 - protein, 9 aa, Homo Sapiens
GESVKDTCK

SEQ ID NO: 1111955 - protein, 9 aa, Homo Sapiens
DLGEVRPMK

SEQ ID NO: 1111956 - protein, 9 aa, Homo Sapiens
LNAKRNTTP

SEQ ID NO: 1111957 - protein, 9 aa, Homo Sapiens
GCCGPGSGG

SEQ ID NO: 1111958 - protein, 9 aa, Homo Sapiens
NLMQEIYDS

SEQ ID NO: 1111959 - protein, 9 aa, Homo Sapiens
IYDSIVNKN

SEQ ID NO: 1111960 - protein, 9 aa, Homo Sapiens
AKGTFAPLR

SEQ ID NO: 1111961 - protein, 9 aa, Homo Sapiens
EKYGPGSCH

SEQ ID NO: 1111962 - protein, 9 aa, Homo Sapiens
STYHCHMRT

SEQ ID NO: 1111963 - protein, 9 aa, Homo Sapiens
AAALNATGH

SEQ ID NO: 1111964 - protein, 9 aa, Homo Sapiens
QRFRRACCL

SEQ ID NO: 1111965 - protein, 9 aa, Homo Sapiens
ARHLDMLSR

SEQ ID NO: 1111966 - protein, 9 aa, Homo Sapiens
GKASCHKSA

SEQ ID NO: 1111967 - protein, 9 aa, Homo Sapiens
QGKRGFQVG

SEQ ID NO: 1111968 - protein, 9 aa, Homo Sapiens
PLMINQEPR

SEQ ID NO: 1111969 - protein, 9 aa, Homo Sapiens
KCVSCPQGM

SEQ ID NO: 1111970 - protein, 9 aa, Homo Sapiens
MKFHVAKRR

SEQ ID NO: 1111971 - protein, 9 aa, Homo Sapiens
VRSRRPSSS

SEQ ID NO: 1111972 - protein, 9 aa, Homo Sapiens
ASQVVSMEH

SEQ ID NO: 1111973 - protein, 9 aa, Homo Sapiens
NRNRCQQCC

SEQ ID NO: 1111974 - protein, 9 aa, Homo Sapiens
RLNGSAPIH

SEQ ID NO: 1111975 - protein, 9 aa, Homo Sapiens
IDSSVSKTT

SEQ ID NO: 1111976 - protein, 9 aa, Homo Sapiens
QEKCLSLVA

SEQ ID NO: 1111977 - protein, 9 aa, Homo Sapiens
PCCYGHTQC

SEQ ID NO: 1111978 - protein, 9 aa, Homo Sapiens
LRRKLKSIP

SEQ ID NO: 1111979 - protein, 9 aa, Homo Sapiens
RSMHKTFAR

SEQ ID NO: 1111980 - protein, 9 aa, Homo Sapiens
PLQYPMLMS

SEQ ID NO: 1111981 - protein, 9 aa, Homo Sapiens
TLAHAQQLI

SEQ ID NO: 1111982 - protein, 9 aa, Homo Sapiens
IDTVVGAGE

SEQ ID NO: 1111983 - protein, 9 aa, Homo Sapiens
QYPMLMSKK

SEQ ID NO: 1111984 - protein, 9 aa, Homo Sapiens
MSIADSEAY

SEQ ID NO: 1111985 - protein, 9 aa, Homo Sapiens
TQGKIFQCT

SEQ ID NO: 1111986 - protein, 9 aa, Homo Sapiens
APCTPHKAL

SEQ ID NO: 1111987 - protein, 9 aa, Homo Sapiens
HAIDSSVSK

SEQ ID NO: 1111988 - protein, 9 aa, Homo Sapiens
LRALKFRQY

SEQ ID NO: 1111989 - protein, 9 aa, Homo Sapiens
AGVLPVDVC

SEQ ID NO: 1111990 - protein, 9 aa, Homo Sapiens
TVFASPYFS

SEQ ID NO: 1111991 - protein, 9 aa, Homo Sapiens
MGNGTVFRG

SEQ ID NO: 1111992 - protein, 9 aa, Homo Sapiens
TDIYKGSTI

SEQ ID NO: 1111993 - protein, 9 aa, Homo Sapiens
GDVFHSISK

SEQ ID NO: 1111994 - protein, 9 aa, Homo Sapiens
FKGDRCKTT

SEQ ID NO: 1111995 - protein, 9 aa, Homo Sapiens
RQPRVIKVT

SEQ ID NO: 1111996 - protein, 9 aa, Homo Sapiens
STDVAEYPL

SEQ ID NO: 1111997 - protein, 9 aa, Homo Sapiens
WKLSAAGMH

SEQ ID NO: 1111998 - protein, 9 aa, Homo Sapiens
ICHPLQYPM

SEQ ID NO: 1111999 - protein, 9 aa, Homo Sapiens
QSSTYHCHM

SEQ ID NO: 1112000 - protein, 9 aa, Homo Sapiens
FPDCPDYID

SEQ ID NO: 1112001 - protein, 9 aa, Homo Sapiens
YKKEEAHVL

SEQ ID NO: 1112002 - protein, 9 aa, Homo Sapiens
RSMDSSMSI

SEQ ID NO: 1112003 - protein, 9 aa, Homo Sapiens
DTKDYAHIR

SEQ ID NO: 1112004 - protein, 9 aa, Homo Sapiens
GRGLQRRCS

SEQ ID NO: 1112005 - protein, 9 aa, Homo Sapiens
GFGISLVKI

SEQ ID NO: 1112006 - protein, 9 aa, Homo Sapiens
ARAILIFLT

SEQ ID NO: 1112007 - protein, 9 aa, Homo Sapiens
GSAADSDTE

SEQ ID NO: 1112008 - protein, 9 aa, Homo Sapiens
PQETARRDR

SEQ ID NO: 1112009 - protein, 9 aa, Homo Sapiens
RPGLSPTSG

SEQ ID NO: 1112010 - protein, 9 aa, Homo Sapiens
KGKDSKEST

SEQ ID NO: 1112011 - protein, 9 aa, Homo Sapiens
GSVILSVSA

SEQ ID NO: 1112012 - protein, 9 aa, Homo Sapiens
ETARRDRPI

SEQ ID NO: 1112013 - protein, 9 aa, Homo Sapiens
PTVWTELME

SEQ ID NO: 1112014 - protein, 9 aa, Homo Sapiens
IIYTRRNRD

SEQ ID NO: 1112015 - protein, 9 aa, Homo Sapiens
RSWWQGKRG

SEQ ID NO: 1112016 - protein, 9 aa, Homo Sapiens
FFPVIYTLT

SEQ ID NO: 1112017 - protein, 9 aa, Homo Sapiens
MVSPNHTIV

SEQ ID NO: 1112018 - protein, 9 aa, Homo Sapiens
CERARERQK

SEQ ID NO: 1112019 - protein, 9 aa, Homo Sapiens
ECKGPLLDD

SEQ ID NO: 1112020 - protein, 9 aa, Homo Sapiens
WAPAFKYFI

SEQ ID NO: 1112021 - protein, 9 aa, Homo Sapiens
CHMRTHEKI

SEQ ID NO: 1112022 - protein, 9 aa, Homo Sapiens
GNKNSQVLP

SEQ ID NO: 1112023 - protein, 9 aa, Homo Sapiens
NEELRRKLK

SEQ ID NO: 1112024 - protein, 9 aa, Homo Sapiens
LWDHVCVSP

SEQ ID NO: 1112025 - protein, 9 aa, Homo Sapiens
RNLMQEIYD

SEQ ID NO: 1112026 - protein, 9 aa, Homo Sapiens
KIFQCTKYV

SEQ ID NO: 1112027 - protein, 9 aa, Homo Sapiens
SFPPPLMIN

SEQ ID NO: 1112028 - protein, 9 aa, Homo Sapiens
VLLKAFQIK

SEQ ID NO: 1112029 - protein, 9 aa, Homo Sapiens
SEHLRIHTG

SEQ ID NO: 1112030 - protein, 9 aa, Homo Sapiens
VTFIKKEFS

SEQ ID NO: 1112031 - protein, 9 aa, Homo Sapiens
VLGKGRCGE

SEQ ID NO: 1112032 - protein, 9 aa, Homo Sapiens
DRCKTTEYS

SEQ ID NO: 1112033 - protein, 9 aa, Homo Sapiens
NATGHPIAF

SEQ ID NO: 1112034 - protein, 9 aa, Homo Sapiens
SGNTGELTS

SEQ ID NO: 1112035 - protein, 9 aa, Homo Sapiens
EDVFGQITE

SEQ ID NO: 1112036 - protein, 9 aa, Homo Sapiens
EPSMWLTSR

SEQ ID NO: 1112037 - protein, 9 aa, Homo Sapiens
EIMKISPIE

SEQ ID NO: 1112038 - protein, 9 aa, Homo Sapiens
VCSCTDGYR

SEQ ID NO: 1112039 - protein, 9 aa, Homo Sapiens
SDQEAEENS

SEQ ID NO: 1112040 - protein, 9 aa, Homo Sapiens
LNVTFIKKE

SEQ ID NO: 1112041 - protein, 9 aa, Homo Sapiens
TFSSSPPTP

SEQ ID NO: 1112042 - protein, 9 aa, Homo Sapiens
ENFWDQLSD

SEQ ID NO: 1112043 - protein, 9 aa, Homo Sapiens
GLSQQKEKC

SEQ ID NO: 1112044 - protein, 9 aa, Homo Sapiens
SEMHGFIQI

SEQ ID NO: 1112045 - protein, 9 aa, Homo Sapiens
EIYDSIVNK

SEQ ID NO: 1112046 - protein, 9 aa, Homo Sapiens
NQEPRDFAY

SEQ ID NO: 1112047 - protein, 9 aa, Homo Sapiens
INAIYLDTY

SEQ ID NO: 1112048 - protein, 9 aa, Homo Sapiens
PSPRSWPGD

SEQ ID NO: 1112049 - protein, 9 aa, Homo Sapiens
LNDTKDYAH

SEQ ID NO: 1112050 - protein, 9 aa, Homo Sapiens
LSTGSAADS

SEQ ID NO: 1112051 - protein, 9 aa, Homo Sapiens
HGFIQIQKN

SEQ ID NO: 1112052 - protein, 9 aa, Homo Sapiens
RHKRQPRVI

SEQ ID NO: 1112053 - protein, 9 aa, Homo Sapiens
IDFTMRYHY

SEQ ID NO: 1112054 - protein, 9 aa, Homo Sapiens
QPQSHVILL

SEQ ID NO: 1112055 - protein, 9 aa, Homo Sapiens
SSQHSPSLQ

SEQ ID NO: 1112056 - protein, 9 aa, Homo Sapiens
KLGAVNSSA

SEQ ID NO: 1112057 - protein, 9 aa, Homo Sapiens
PCTPHKALR

SEQ ID NO: 1112058 - protein, 9 aa, Homo Sapiens
KENCTTVAA

SEQ ID NO: 1112059 - protein, 9 aa, Homo Sapiens
FIRRSTLSE

SEQ ID NO: 1112060 - protein, 9 aa, Homo Sapiens
TWRWMVFKG

SEQ ID NO: 1112061 - protein, 9 aa, Homo Sapiens
SVPRDAGAV

SEQ ID NO: 1112062 - protein, 9 aa, Homo Sapiens
SSISGIDMA

SEQ ID NO: 1112063 - protein, 9 aa, Homo Sapiens
VPVFIQDAG

SEQ ID NO: 1112064 - protein, 9 aa, Homo Sapiens
GCRPMRKTA

SEQ ID NO: 1112065 - protein, 9 aa, Homo Sapiens
LRFHQMLSE

SEQ ID NO: 1112066 - protein, 9 aa, Homo Sapiens
KAQQDPTVT

SEQ ID NO: 1112067 - protein, 9 aa, Homo Sapiens
LVHVLIDIN

SEQ ID NO: 1112068 - protein, 9 aa, Homo Sapiens
GFPDCPDYI

SEQ ID NO: 1112069 - protein, 9 aa, Homo Sapiens
VVTSGTVTF

SEQ ID NO: 1112070 - protein, 9 aa, Homo Sapiens
DAEAATAVV

SEQ ID NO: 1112071 - protein, 9 aa, Homo Sapiens
SFNSYEPET

SEQ ID NO: 1112072 - protein, 9 aa, Homo Sapiens
AILIFLTTD

SEQ ID NO: 1112073 - protein, 9 aa, Homo Sapiens
SRQRKMSQV

SEQ ID NO: 1112074 - protein, 9 aa, Homo Sapiens
NGQEYHLQR

SEQ ID NO: 1112075 - protein, 9 aa, Homo Sapiens
RRACCLVHD

SEQ ID NO: 1112076 - protein, 9 aa, Homo Sapiens
CEECGEAFS

SEQ ID NO: 1112077 - protein, 9 aa, Homo Sapiens
EAGAAHNSN

SEQ ID NO: 1112078 - protein, 9 aa, Homo Sapiens
VGDVFHSIS

SEQ ID NO: 1112079 - protein, 9 aa, Homo Sapiens
HKRQPRVIK

SEQ ID NO: 1112080 - protein, 9 aa, Homo Sapiens
QSASQEESP

SEQ ID NO: 1112081 - protein, 9 aa, Homo Sapiens
GQEYHLQRV

SEQ ID NO: 1112082 - protein, 9 aa, Homo Sapiens
LHAIDSSVS

SEQ ID NO: 1112083 - protein, 9 aa, Homo Sapiens
VEMKWKYEG

SEQ ID NO: 1112084 - protein, 9 aa, Homo Sapiens
RARNNRSQI

SEQ ID NO: 1112085 - protein, 9 aa, Homo Sapiens
RGIPGDNKQ

SEQ ID NO: 1112086 - protein, 9 aa, Homo Sapiens
SASQEESPR

SEQ ID NO: 1112087 - protein, 9 aa, Homo Sapiens
SARHLDMLS

SEQ ID NO: 1112088 - protein, 9 aa, Homo Sapiens
DTYEPCIKP

SEQ ID NO: 1112089 - protein, 9 aa, Homo Sapiens
RFLTRARSL

SEQ ID NO: 1112090 - protein, 9 aa, Homo Sapiens
RISAERIHR

SEQ ID NO: 1112091 - protein, 9 aa, Homo Sapiens
HEVELSRPG

SEQ ID NO: 1112092 - protein, 9 aa, Homo Sapiens
QTIAKGTFA

SEQ ID NO: 1112093 - protein, 9 aa, Homo Sapiens
SSASCRPGL

SEQ ID NO: 1112094 - protein, 9 aa, Homo Sapiens
SSEVGYNAM

SEQ ID NO: 1112095 - protein, 9 aa, Homo Sapiens
LSEHLRIHT

SEQ ID NO: 1112096 - protein, 9 aa, Homo Sapiens
SSEEHINVY

SEQ ID NO: 1112097 - protein, 9 aa, Homo Sapiens
SITRRLLGL

SEQ ID NO: 1112098 - protein, 9 aa, Homo Sapiens
DSVIKNLQS

SEQ ID NO: 1112099 - protein, 9 aa, Homo Sapiens
NDTKDYAHI

SEQ ID NO: 1112100 - protein, 9 aa, Homo Sapiens
YRHQKRWWN

SEQ ID NO: 1112101 - protein, 9 aa, Homo Sapiens
AAHNSNISE

SEQ ID NO: 1112102 - protein, 9 aa, Homo Sapiens
AVLTHKRCN

SEQ ID NO: 1112103 - protein, 9 aa, Homo Sapiens
WPESLIGKT

SEQ ID NO: 1112104 - protein, 9 aa, Homo Sapiens
IFLVLALFL

SEQ ID NO: 1112105 - protein, 9 aa, Homo Sapiens
DDIIDGFAM

SEQ ID NO: 1112106 - protein, 9 aa, Homo Sapiens
SYLLCLIQH

SEQ ID NO: 1112107 - protein, 9 aa, Homo Sapiens
SNVFSIIAI

SEQ ID NO: 1112108 - protein, 9 aa, Homo Sapiens
VGFGNSSYY

SEQ ID NO: 1112109 - protein, 9 aa, Homo Sapiens
LSLQERLVW

SEQ ID NO: 1112110 - protein, 9 aa, Homo Sapiens
DYIDEKNCS

SEQ ID NO: 1112111 - protein, 9 aa, Homo Sapiens
QPIVEGLCW

SEQ ID NO: 1112112 - protein, 9 aa, Homo Sapiens
WPGDIIRTL

SEQ ID NO: 1112113 - protein, 9 aa, Homo Sapiens
CDMCVPFLA

SEQ ID NO: 1112114 - protein, 9 aa, Homo Sapiens
REMQTAVRL

SEQ ID NO: 1112115 - protein, 9 aa, Homo Sapiens
ETLELNENT

SEQ ID NO: 1112116 - protein, 9 aa, Homo Sapiens
VHIDPTFIS

SEQ ID NO: 1112117 - protein, 9 aa, Homo Sapiens
SSEDTTYLY

SEQ ID NO: 1112118 - protein, 9 aa, Homo Sapiens
VPRHRKTLV

SEQ ID NO: 1112119 - protein, 9 aa, Homo Sapiens
RQRKMSQVE

SEQ ID NO: 1112120 - protein, 9 aa, Homo Sapiens
MRSMHKTFA

SEQ ID NO: 1112121 - protein, 9 aa, Homo Sapiens
TDETDRHII

SEQ ID NO: 1112122 - protein, 9 aa, Homo Sapiens
GLSPTSGDA

SEQ ID NO: 1112123 - protein, 9 aa, Homo Sapiens
STTGTVFAS

SEQ ID NO: 1112124 - protein, 9 aa, Homo Sapiens
CHAAPCTPH

SEQ ID NO: 1112125 - protein, 9 aa, Homo Sapiens
LMQEIYDSI

SEQ ID NO: 1112126 - protein, 9 aa, Homo Sapiens
PHPHLPTHP

SEQ ID NO: 1112127 - protein, 9 aa, Homo Sapiens
LMSEMHGFI

SEQ ID NO: 1112128 - protein, 9 aa, Homo Sapiens
SMWLTSREE

SEQ ID NO: 1112129 - protein, 9 aa, Homo Sapiens
HRKTLVKAF

SEQ ID NO: 1112130 - protein, 9 aa, Homo Sapiens
LADILHLTD

SEQ ID NO: 1112131 - protein, 9 aa, Homo Sapiens
LLPGPLPAS

SEQ ID NO: 1112132 - protein, 9 aa, Homo Sapiens
PVDVCKLTC

SEQ ID NO: 1112133 - protein, 9 aa, Homo Sapiens
VTPRLCLSC

SEQ ID NO: 1112134 - protein, 9 aa, Homo Sapiens
EARAILIFL

SEQ ID NO: 1112135 - protein, 9 aa, Homo Sapiens
FTYMLETWR

SEQ ID NO: 1112136 - protein, 9 aa, Homo Sapiens
EEEILIKNK

SEQ ID NO: 1112137 - protein, 9 aa, Homo Sapiens
QGRIVRPNN

SEQ ID NO: 1112138 - protein, 9 aa, Homo Sapiens
EQLGMTKEQ

SEQ ID NO: 1112139 - protein, 9 aa, Homo Sapiens
TPPGSVILS

SEQ ID NO: 1112140 - protein, 9 aa, Homo Sapiens
TRDYAESVG

SEQ ID NO: 1112141 - protein, 9 aa, Homo Sapiens
ALEKAEFLW

SEQ ID NO: 1112142 - protein, 9 aa, Homo Sapiens
TFISNGPFK

SEQ ID NO: 1112143 - protein, 9 aa, Homo Sapiens
NGKAHTRRR

SEQ ID NO: 1112144 - protein, 9 aa, Homo Sapiens
LQERLVWLQ

SEQ ID NO: 1112145 - protein, 9 aa, Homo Sapiens
PLAGLPMPE

SEQ ID NO: 1112146 - protein, 9 aa, Homo Sapiens
VHIPTDIYK

SEQ ID NO: 1112147 - protein, 9 aa, Homo Sapiens
TGFPTQFNH

SEQ ID NO: 1112148 - protein, 9 aa, Homo Sapiens
HAQQLIQTY

SEQ ID NO: 1112149 - protein, 9 aa, Homo Sapiens
NVCDPVTVH

SEQ ID NO: 1112150 - protein, 9 aa, Homo Sapiens
DLPPKCSAK

SEQ ID NO: 1112151 - protein, 9 aa, Homo Sapiens
CRPMRKTAP

SEQ ID NO: 1112152 - protein, 9 aa, Homo Sapiens
NFDSSEDTT

SEQ ID NO: 1112153 - protein, 9 aa, Homo Sapiens
KLSCMADSV

SEQ ID NO: 1112154 - protein, 9 aa, Homo Sapiens
RERQKDHCE

SEQ ID NO: 1112155 - protein, 9 aa, Homo Sapiens
GVPYSVPEP

SEQ ID NO: 1112156 - protein, 9 aa, Homo Sapiens
EKCLSLVAK

SEQ ID NO: 1112157 - protein, 9 aa, Homo Sapiens
PGFETLELN

SEQ ID NO: 1112158 - protein, 9 aa, Homo Sapiens
GLSPLHMAS

SEQ ID NO: 1112159 - protein, 9 aa, Homo Sapiens
KLVQARAIL

SEQ ID NO: 1112160 - protein, 9 aa, Homo Sapiens
ISGIDMAGL

SEQ ID NO: 1112161 - protein, 9 aa, Homo Sapiens
SVDSWADLN

SEQ ID NO: 1112162 - protein, 9 aa, Homo Sapiens
MLETWRWMV

SEQ ID NO: 1112163 - protein, 9 aa, Homo Sapiens
FGEELKQAK

SEQ ID NO: 1112164 - protein, 9 aa, Homo Sapiens
LPGFGEELK

SEQ ID NO: 1112165 - protein, 9 aa, Homo Sapiens
IPIKVGLWI

SEQ ID NO: 1112166 - protein, 9 aa, Homo Sapiens
LIFLVLALF

SEQ ID NO: 1112167 - protein, 9 aa, Homo Sapiens
SDQDNKDPC

SEQ ID NO: 1112168 - protein, 9 aa, Homo Sapiens
TSVIHSHIK

SEQ ID NO: 1112169 - protein, 9 aa, Homo Sapiens
EEAHVLLKA

SEQ ID NO: 1112170 - protein, 9 aa, Homo Sapiens
IHQPQSHVI

SEQ ID NO: 1112171 - protein, 9 aa, Homo Sapiens
NMGTCGDHD

SEQ ID NO: 1112172 - protein, 9 aa, Homo Sapiens
LCWLLAVID

SEQ ID NO: 1112173 - protein, 9 aa, Homo Sapiens
HAAPCTPHK

SEQ ID NO: 1112174 - protein, 9 aa, Homo Sapiens
SCERARERQ

SEQ ID NO: 1112175 - protein, 9 aa, Homo Sapiens
RHDLGLPQE

SEQ ID NO: 1112176 - protein, 9 aa, Homo Sapiens
GRRGCRPMR

SEQ ID NO: 1112177 - protein, 9 aa, Homo Sapiens
PFTYMLETW

SEQ ID NO: 1112178 - protein, 9 aa, Homo Sapiens
PEKMHPKHQ

SEQ ID NO: 1112179 - protein, 9 aa, Homo Sapiens
SVKDTCKNL

SEQ ID NO: 1112180 - protein, 9 aa, Homo Sapiens
SNLKQMSAF

SEQ ID NO: 1112181 - protein, 9 aa, Homo Sapiens
ISAERIHRI

SEQ ID NO: 1112182 - protein, 9 aa, Homo Sapiens
EIRTLLIIL

SEQ ID NO: 1112183 - protein, 9 aa, Homo Sapiens
EESPREPDH

SEQ ID NO: 1112184 - protein, 9 aa, Homo Sapiens
DCPDYIDEK

SEQ ID NO: 1112185 - protein, 9 aa, Homo Sapiens
AIGFGISLV

SEQ ID NO: 1112186 - protein, 9 aa, Homo Sapiens
DHSNANYYF

SEQ ID NO: 1112187 - protein, 9 aa, Homo Sapiens
KATDETDRH

SEQ ID NO: 1112188 - protein, 9 aa, Homo Sapiens
ANGFGNGKA

SEQ ID NO: 1112189 - protein, 9 aa, Homo Sapiens
ARCGNLIVE

SEQ ID NO: 1112190 - protein, 9 aa, Homo Sapiens
ISKAQQDPT

SEQ ID NO: 1112191 - protein, 9 aa, Homo Sapiens
FNSYEPETR

SEQ ID NO: 1112192 - protein, 9 aa, Homo Sapiens
TSNVFSIIA

SEQ ID NO: 1112193 - protein, 9 aa, Homo Sapiens
DRHDLGLPQ

SEQ ID NO: 1112194 - protein, 9 aa, Homo Sapiens
KVLGKGRCG

SEQ ID NO: 1112195 - protein, 9 aa, Homo Sapiens
PHKLQFTFT

SEQ ID NO: 1112196 - protein, 9 aa, Homo Sapiens
FTVNEDVFG

SEQ ID NO: 1112197 - protein, 9 aa, Homo Sapiens
LVQGRIVRP

SEQ ID NO: 1112198 - protein, 9 aa, Homo Sapiens
FSSSPPTPG

SEQ ID NO: 1112199 - protein, 9 aa, Homo Sapiens
HDHAIVLTR

SEQ ID NO: 1112200 - protein, 9 aa, Homo Sapiens
KLLIFLVLA

SEQ ID NO: 1112201 - protein, 9 aa, Homo Sapiens
CPQGMYYHG

SEQ ID NO: 1112202 - protein, 9 aa, Homo Sapiens
NAKRNTTPV

SEQ ID NO: 1112203 - protein, 9 aa, Homo Sapiens
RDRPIEVKE

SEQ ID NO: 1112204 - protein, 9 aa, Homo Sapiens
MCISVDSWA

SEQ ID NO: 1112205 - protein, 9 aa, Homo Sapiens
THLGKLAVV

SEQ ID NO: 1112206 - protein, 9 aa, Homo Sapiens
RKMLTVEPA

SEQ ID NO: 1112207 - protein, 9 aa, Homo Sapiens
LVQARAILN

SEQ ID NO: 1112208 - protein, 9 aa, Homo Sapiens
CRQGFSYLL

SEQ ID NO: 1112209 - protein, 9 aa, Homo Sapiens
ETKDKRVED

SEQ ID NO: 1112210 - protein, 9 aa, Homo Sapiens
TFDGNKQHF

SEQ ID NO: 1112211 - protein, 9 aa, Homo Sapiens
VFSIIAIRL

SEQ ID NO: 1112212 - protein, 9 aa, Homo Sapiens
LLCLIQHEE

SEQ ID NO: 1112213 - protein, 9 aa, Homo Sapiens
IVPVFIQDA

SEQ ID NO: 1112214 - protein, 9 aa, Homo Sapiens
EINAIYLDT

SEQ ID NO: 1112215 - protein, 9 aa, Homo Sapiens
YKGSTIVLN

SEQ ID NO: 1112216 - protein, 9 aa, Homo Sapiens
LSQRHKRQP

SEQ ID NO: 1112217 - protein, 9 aa, Homo Sapiens
TASIAIRRW

SEQ ID NO: 1112218 - protein, 9 aa, Homo Sapiens
RPSSSQHSP

SEQ ID NO: 1112219 - protein, 9 aa, Homo Sapiens
MQEIYDSIV

SEQ ID NO: 1112220 - protein, 9 aa, Homo Sapiens
FPPPLMINQ

SEQ ID NO: 1112221 - protein, 9 aa, Homo Sapiens
SSSQHSPSL

SEQ ID NO: 1112222 - protein, 9 aa, Homo Sapiens
KPKVFEDEE

SEQ ID NO: 1112223 - protein, 9 aa, Homo Sapiens
AIVLTRQDF

SEQ ID NO: 1112224 - protein, 9 aa, Homo Sapiens
GGLQIVPVF

SEQ ID NO: 1112225 - protein, 9 aa, Homo Sapiens
FLNAKRNTT

SEQ ID NO: 1112226 - protein, 9 aa, Homo Sapiens
AFILLGLSD

SEQ ID NO: 1112227 - protein, 9 aa, Homo Sapiens
TCEEHLLNL

SEQ ID NO: 1112228 - protein, 9 aa, Homo Sapiens
FIITTLNLN

SEQ ID NO: 1112229 - protein, 9 aa, Homo Sapiens
MKLVQARAI

SEQ ID NO: 1112230 - protein, 9 aa, Homo Sapiens
PGDIIRTLC

SEQ ID NO: 1112231 - protein, 9 aa, Homo Sapiens
GIRIERVIG

SEQ ID NO: 1112232 - protein, 9 aa, Homo Sapiens
SGGLQIVPV

SEQ ID NO: 1112233 - protein, 9 aa, Homo Sapiens
GLNDTKDYA

SEQ ID NO: 1112234 - protein, 9 aa, Homo Sapiens
EDTTYLYRL

SEQ ID NO: 1112235 - protein, 9 aa, Homo Sapiens
VGRGLQRRC

SEQ ID NO: 1112236 - protein, 9 aa, Homo Sapiens
ATAVVENSV

SEQ ID NO: 1112237 - protein, 9 aa, Homo Sapiens
KDGESVKDT

SEQ ID NO: 1112238 - protein, 9 aa, Homo Sapiens
YSARHLDML

SEQ ID NO: 1112239 - protein, 9 aa, Homo Sapiens
LNGSAPIHV

SEQ ID NO: 1112240 - protein, 9 aa, Homo Sapiens
GAAHNSNIS

SEQ ID NO: 1112241 - protein, 9 aa, Homo Sapiens
SRRPSSSQH

SEQ ID NO: 1112242 - protein, 9 aa, Homo Sapiens
DVIEQYSAR

SEQ ID NO: 1112243 - protein, 9 aa, Homo Sapiens
HLAVAAMHT

SEQ ID NO: 1112244 - protein, 9 aa, Homo Sapiens
TELGYVFIL

SEQ ID NO: 1112245 - protein, 9 aa, Homo Sapiens
KGTFAPLRA

SEQ ID NO: 1112246 - protein, 9 aa, Homo Sapiens
ALSCFPHTH

SEQ ID NO: 1112247 - protein, 9 aa, Homo Sapiens
PRKLLTHDW

SEQ ID NO: 1112248 - protein, 9 aa, Homo Sapiens
YHLQRVDTA

SEQ ID NO: 1112249 - protein, 9 aa, Homo Sapiens
GFGNGKAHT

SEQ ID NO: 1112250 - protein, 9 aa, Homo Sapiens
EQYSARHLD

SEQ ID NO: 1112251 - protein, 9 aa, Homo Sapiens
HSNLKQMSA

SEQ ID NO: 1112252 - protein, 9 aa, Homo Sapiens
VAAFILLGL

SEQ ID NO: 1112253 - protein, 9 aa, Homo Sapiens
DPSGIRIER

SEQ ID NO: 1112254 - protein, 9 aa, Homo Sapiens
LVVTSGTVT

SEQ ID NO: 1112255 - protein, 9 aa, Homo Sapiens
WIGVFCNSS

SEQ ID NO: 1112256 - protein, 9 aa, Homo Sapiens
PMRKTAPKA

SEQ ID NO: 1112257 - protein, 9 aa, Homo Sapiens
GTVFASPYF

SEQ ID NO: 1112258 - protein, 9 aa, Homo Sapiens
DATNISIDT

SEQ ID NO: 1112259 - protein, 9 aa, Homo Sapiens
ANEPVLRFH

SEQ ID NO: 1112260 - protein, 9 aa, Homo Sapiens
IHVCWYRDG

SEQ ID NO: 1112261 - protein, 9 aa, Homo Sapiens
CLPSCNNRH

SEQ ID NO: 1112262 - protein, 9 aa, Homo Sapiens
CYGHTQCHL

SEQ ID NO: 1112263 - protein, 9 aa, Homo Sapiens
RKMSQVEQE

SEQ ID NO: 1112264 - protein, 9 aa, Homo Sapiens
IHARWSPPR

SEQ ID NO: 1112265 - protein, 9 aa, Homo Sapiens
QCHLLPDKL

SEQ ID NO: 1112266 - protein, 9 aa, Homo Sapiens
CPDYIDEKN

SEQ ID NO: 1112267 - protein, 9 aa, Homo Sapiens
DKRVEDGYF

SEQ ID NO: 1112268 - protein, 9 aa, Homo Sapiens
AKRRFKETL

SEQ ID NO: 1112269 - protein, 9 aa, Homo Sapiens
CCFKKCLSV

SEQ ID NO: 1112270 - protein, 9 aa, Homo Sapiens
LHDVRDKLG

SEQ ID NO: 1112271 - protein, 9 aa, Homo Sapiens
LRIHARWSP

SEQ ID NO: 1112272 - protein, 9 aa, Homo Sapiens
VGYNAMAGD

SEQ ID NO: 1112273 - protein, 9 aa, Homo Sapiens
MGTCGDHDD

SEQ ID NO: 1112274 - protein, 9 aa, Homo Sapiens
PMPERGPQS

SEQ ID NO: 1112275 - protein, 9 aa, Homo Sapiens
INWKLSAAG

SEQ ID NO: 1112276 - protein, 9 aa, Homo Sapiens
CVSCPQGMY

SEQ ID NO: 1112277 - protein, 9 aa, Homo Sapiens
CQQCCFKKC

SEQ ID NO: 1112278 - protein, 9 aa, Homo Sapiens
YMISITRRL

SEQ ID NO: 1112279 - protein, 9 aa, Homo Sapiens
NFWDQLSDD

SEQ ID NO: 1112280 - protein, 9 aa, Homo Sapiens
TIDLNRDSI

SEQ ID NO: 1112281 - protein, 9 aa, Homo Sapiens
LIDINLFVS

SEQ ID NO: 1112282 - protein, 9 aa, Homo Sapiens
CISVDSWAD

SEQ ID NO: 1112283 - protein, 9 aa, Homo Sapiens
CLSCALELL

SEQ ID NO: 1112284 - protein, 9 aa, Homo Sapiens
KVGLWIKMT

SEQ ID NO: 1112285 - protein, 9 aa, Homo Sapiens
DDLCYYHGV

SEQ ID NO: 1112286 - protein, 9 aa, Homo Sapiens
QSHVILLNF

SEQ ID NO: 1112287 - protein, 9 aa, Homo Sapiens
TQEAPPWVN

SEQ ID NO: 1112288 - protein, 9 aa, Homo Sapiens
WTELMEQIP

SEQ ID NO: 1112289 - protein, 9 aa, Homo Sapiens
CGEAFSQLS

SEQ ID NO: 1112290 - protein, 9 aa, Homo Sapiens
VLIDINLFV

SEQ ID NO: 1112291 - protein, 9 aa, Homo Sapiens
GDIIRTLCP

SEQ ID NO: 1112292 - protein, 9 aa, Homo Sapiens
FNEIRTLLI

SEQ ID NO: 1112293 - protein, 9 aa, Homo Sapiens
WWQGKRGFQ

SEQ ID NO: 1112294 - protein, 9 aa, Homo Sapiens
VVSMEHNLT

SEQ ID NO: 1112295 - protein, 9 aa, Homo Sapiens
GTCGDHDDS

SEQ ID NO: 1112296 - protein, 9 aa, Homo Sapiens
SVIAQKPEK

SEQ ID NO: 1112297 - protein, 9 aa, Homo Sapiens
IYKGSTIVL

SEQ ID NO: 1112298 - protein, 9 aa, Homo Sapiens
EILIKNKNS

SEQ ID NO: 1112299 - protein, 9 aa, Homo Sapiens
FLWDHVCVS

SEQ ID NO: 1112300 - protein, 9 aa, Homo Sapiens
NSDEPLNVT

SEQ ID NO: 1112301 - protein, 9 aa, Homo Sapiens
AHAQQLIQT

SEQ ID NO: 1112302 - protein, 9 aa, Homo Sapiens
EDMVATKCL

SEQ ID NO: 1112303 - protein, 9 aa, Homo Sapiens
LGRRGCRPM

SEQ ID NO: 1112304 - protein, 9 aa, Homo Sapiens
KMSQVEQEL

SEQ ID NO: 1112305 - protein, 9 aa, Homo Sapiens
GAGLVMCIQ

SEQ ID NO: 1112306 - protein, 9 aa, Homo Sapiens
RDAGAVCPL

SEQ ID NO: 1112307 - protein, 9 aa, Homo Sapiens
DMCVPFLAD

SEQ ID NO: 1112308 - protein, 9 aa, Homo Sapiens
MASQGDHVE

SEQ ID NO: 1112309 - protein, 9 aa, Homo Sapiens
QEAALKLYK

SEQ ID NO: 1112310 - protein, 9 aa, Homo Sapiens
DLNRDSIQP

SEQ ID NO: 1112311 - protein, 9 aa, Homo Sapiens
TKYVKVFHK

SEQ ID NO: 1112312 - protein, 9 aa, Homo Sapiens
RIHRISFRL

SEQ ID NO: 1112313 - protein, 9 aa, Homo Sapiens
ARWSPPRRP

SEQ ID NO: 1112314 - protein, 9 aa, Homo Sapiens
TEDRSWWQG

SEQ ID NO: 1112315 - protein, 9 aa, Homo Sapiens
FRGIPGDNK

SEQ ID NO: 1112316 - protein, 9 aa, Homo Sapiens
RDKLGAVNS

SEQ ID NO: 1112317 - protein, 9 aa, Homo Sapiens
GFGEELKQA

SEQ ID NO: 1112318 - protein, 9 aa, Homo Sapiens
RRFKETLRP

SEQ ID NO: 1112319 - protein, 9 aa, Homo Sapiens
VPFLADILH

SEQ ID NO: 1112320 - protein, 9 aa, Homo Sapiens
QDHKLKISN

SEQ ID NO: 1112321 - protein, 9 aa, Homo Sapiens
LSDDLCYYH

SEQ ID NO: 1112322 - protein, 9 aa, Homo Sapiens
TLQRKPKVF

SEQ ID NO: 1112323 - protein, 9 aa, Homo Sapiens
HSETIDLNR

SEQ ID NO: 1112324 - protein, 9 aa, Homo Sapiens
GIDMAGLQT

SEQ ID NO: 1112325 - protein, 9 aa, Homo Sapiens
ELRRKLKSI

SEQ ID NO: 1112326 - protein, 9 aa, Homo Sapiens
RNRCQQCCF

SEQ ID NO: 1112327 - protein, 9 aa, Homo Sapiens
LAHAQQLIQ

SEQ ID NO: 1112328 - protein, 9 aa, Homo Sapiens
MIWSKTKFA

SEQ ID NO: 1112329 - protein, 9 aa, Homo Sapiens
GPLGSPPKW

SEQ ID NO: 1112330 - protein, 9 aa, Homo Sapiens
PVENVCDPV

SEQ ID NO: 1112331 - protein, 9 aa, Homo Sapiens
RIVRPNNNN

SEQ ID NO: 1112332 - protein, 9 aa, Homo Sapiens
HLSFEEIMK

SEQ ID NO: 1112333 - protein, 9 aa, Homo Sapiens
ASSTCGQPA

SEQ ID NO: 1112334 - protein, 9 aa, Homo Sapiens
LSVPRDAGA

SEQ ID NO: 1112335 - protein, 9 aa, Homo Sapiens
ARAILNYIA

SEQ ID NO: 1112336 - protein, 9 aa, Homo Sapiens
TVTFDGNKQ

SEQ ID NO: 1112337 - protein, 9 aa, Homo Sapiens
PKWGPLPTE

SEQ ID NO: 1112338 - protein, 9 aa, Homo Sapiens
QERLVWLQL

SEQ ID NO: 1112339 - protein, 9 aa, Homo Sapiens
SWEVGRGLQ

SEQ ID NO: 1112340 - protein, 9 aa, Homo Sapiens
VMCIQPTSH

SEQ ID NO: 1112341 - protein, 9 aa, Homo Sapiens
PESLIGKTG

SEQ ID NO: 1112342 - protein, 9 aa, Homo Sapiens
LVLALFLAT

SEQ ID NO: 1112343 - protein, 9 aa, Homo Sapiens
DPKMSNFSP

SEQ ID NO: 1112344 - protein, 9 aa, Homo Sapiens
PFMLQQLLR

SEQ ID NO: 1112345 - protein, 9 aa, Homo Sapiens
ENVCDPVTV

SEQ ID NO: 1112346 - protein, 9 aa, Homo Sapiens
QGKIFQCTK

SEQ ID NO: 1112347 - protein, 9 aa, Homo Sapiens
VCDPVTVHF

SEQ ID NO: 1112348 - protein, 9 aa, Homo Sapiens
VSLPTSPGS

SEQ ID NO: 1112349 - protein, 9 aa, Homo Sapiens
NKDPCYFFS

SEQ ID NO: 1112350 - protein, 9 aa, Homo Sapiens
NVEMKWKYE

SEQ ID NO: 1112351 - protein, 9 aa, Homo Sapiens
DHAIVLTRQ

SEQ ID NO: 1112352 - protein, 9 aa, Homo Sapiens
QRKTVPSVL

SEQ ID NO: 1112353 - protein, 9 aa, Homo Sapiens
PSPTCGYTH

SEQ ID NO: 1112354 - protein, 9 aa, Homo Sapiens
SVMRSMHKT

SEQ ID NO: 1112355 - protein, 9 aa, Homo Sapiens
CGYTHPQFT

SEQ ID NO: 1112356 - protein, 9 aa, Homo Sapiens
HRITYLDNG

SEQ ID NO: 1112357 - protein, 9 aa, Homo Sapiens
EHTPPGSVI

SEQ ID NO: 1112358 - protein, 9 aa, Homo Sapiens
NKVVCSCTD

SEQ ID NO: 1112359 - protein, 9 aa, Homo Sapiens
NCTTVAAFI

SEQ ID NO: 1112360 - protein, 9 aa, Homo Sapiens
MRYHYRLDG

SEQ ID NO: 1112361 - protein, 9 aa, Homo Sapiens
RANEHLAVA

SEQ ID NO: 1112362 - protein, 9 aa, Homo Sapiens
QCKDGESVK

SEQ ID NO: 1112363 - protein, 9 aa, Homo Sapiens
MNRRCCVLP

SEQ ID NO: 1112364 - protein, 9 aa, Homo Sapiens
KKLEKMMQE

SEQ ID NO: 1112365 - protein, 9 aa, Homo Sapiens
LNSLEFHLD

SEQ ID NO: 1112366 - protein, 9 aa, Homo Sapiens
DDLDFKTGD

SEQ ID NO: 1112367 - protein, 9 aa, Homo Sapiens
DVPSKYKVV

SEQ ID NO: 1112368 - protein, 9 aa, Homo Sapiens
MKGDYYRDL

SEQ ID NO: 1112369 - protein, 9 aa, Homo Sapiens
DAPQRLQWQ

SEQ ID NO: 1112370 - protein, 9 aa, Homo Sapiens
VDSEIEENM

SEQ ID NO: 1112371 - protein, 9 aa, Homo Sapiens
SFFESQSLS

SEQ ID NO: 1112372 - protein, 9 aa, Homo Sapiens
QILSPLLDT

SEQ ID NO: 1112373 - protein, 9 aa, Homo Sapiens
SRSRLWNAQ

SEQ ID NO: 1112374 - protein, 9 aa, Homo Sapiens
LRTYREEKH

SEQ ID NO: 1112375 - protein, 9 aa, Homo Sapiens
DGSKGKEKV

SEQ ID NO: 1112376 - protein, 9 aa, Homo Sapiens
DDFCTLQLS

SEQ ID NO: 1112377 - protein, 9 aa, Homo Sapiens
PRVVYKYHY

SEQ ID NO: 1112378 - protein, 9 aa, Homo Sapiens
VLPLAFPIT

SEQ ID NO: 1112379 - protein, 9 aa, Homo Sapiens
ADSKEQVLP

SEQ ID NO: 1112380 - protein, 9 aa, Homo Sapiens
SSQAFCGPE

SEQ ID NO: 1112381 - protein, 9 aa, Homo Sapiens
PDSSLERSC

SEQ ID NO: 1112382 - protein, 9 aa, Homo Sapiens
RVVYKYHYS

SEQ ID NO: 1112383 - protein, 9 aa, Homo Sapiens
SSAAAANPL

SEQ ID NO: 1112384 - protein, 9 aa, Homo Sapiens
LAFPDDMDL

SEQ ID NO: 1112385 - protein, 9 aa, Homo Sapiens
ISVDSEIEE

SEQ ID NO: 1112386 - protein, 9 aa, Homo Sapiens
APQRLQWQA

SEQ ID NO: 1112387 - protein, 9 aa, Homo Sapiens
QAFCGPESS

SEQ ID NO: 1112388 - protein, 9 aa, Homo Sapiens
YYRDLAEVA

SEQ ID NO: 1112389 - protein, 9 aa, Homo Sapiens
TSSAAAANP

SEQ ID NO: 1112390 - protein, 9 aa, Homo Sapiens
TKEIATSIE

SEQ ID NO: 1112391 - protein, 9 aa, Homo Sapiens
FKTGDAGAS

SEQ ID NO: 1112392 - protein, 9 aa, Homo Sapiens
DFCTLQLSG

SEQ ID NO: 1112393 - protein, 9 aa, Homo Sapiens
GSKGKEKVL

SEQ ID NO: 1112394 - protein, 9 aa, Homo Sapiens
DDMDLRVYG

SEQ ID NO: 1112395 - protein, 9 aa, Homo Sapiens
PPQQQQQQA

SEQ ID NO: 1112396 - protein, 9 aa, Homo Sapiens
LEKMMQEDE

SEQ ID NO: 1112397 - protein, 9 aa, Homo Sapiens
RSRLWNAQE

SEQ ID NO: 1112398 - protein, 9 aa, Homo Sapiens
FCGPESSGS

SEQ ID NO: 1112399 - protein, 9 aa, Homo Sapiens
FYLGQLSNV

SEQ ID NO: 1112400 - protein, 9 aa, Homo Sapiens
YKVVVLYED

SEQ ID NO: 1112401 - protein, 9 aa, Homo Sapiens
PAPSTKPPR

SEQ ID NO: 1112402 - protein, 9 aa, Homo Sapiens
VIAGAFAGI

SEQ ID NO: 1112403 - protein, 9 aa, Homo Sapiens
FFESQSLSK

SEQ ID NO: 1112404 - protein, 9 aa, Homo Sapiens
EQVLPVKGG

SEQ ID NO: 1112405 - protein, 9 aa, Homo Sapiens
AEMKSAVDC

SEQ ID NO: 1112406 - protein, 9 aa, Homo Sapiens
SGARSCQGA

SEQ ID NO: 1112407 - protein, 9 aa, Homo Sapiens
YQGKMFVEE

SEQ ID NO: 1112408 - protein, 9 aa, Homo Sapiens
TLGHKNCSV

SEQ ID NO: 1112409 - protein, 9 aa, Homo Sapiens
KWVKPRDSS

SEQ ID NO: 1112410 - protein, 9 aa, Homo Sapiens
QVLPVKGGF

SEQ ID NO: 1112411 - protein, 9 aa, Homo Sapiens
SILRTYREE

SEQ ID NO: 1112412 - protein, 9 aa, Homo Sapiens
IKKHQMSVE

SEQ ID NO: 1112413 - protein, 9 aa, Homo Sapiens
LDISVDSEI

SEQ ID NO: 1112414 - protein, 9 aa, Homo Sapiens
PSGGDRFYL

SEQ ID NO: 1112415 - protein, 9 aa, Homo Sapiens
SPLLDTILA

SEQ ID NO: 1112416 - protein, 9 aa, Homo Sapiens
IHIKKHQMS

SEQ ID NO: 1112417 - protein, 9 aa, Homo Sapiens
KMFVEESIL

SEQ ID NO: 1112418 - protein, 9 aa, Homo Sapiens
YREEKHAKK

SEQ ID NO: 1112419 - protein, 9 aa, Homo Sapiens
EEKSQVKCD

SEQ ID NO: 1112420 - protein, 9 aa, Homo Sapiens
SSLERSCPR

SEQ ID NO: 1112421 - protein, 9 aa, Homo Sapiens
TGKQIMKSC

SEQ ID NO: 1112422 - protein, 9 aa, Homo Sapiens
QGKDYGKFG

SEQ ID NO: 1112423 - protein, 9 aa, Homo Sapiens
EEFHGNQFQ

SEQ ID NO: 1112424 - protein, 9 aa, Homo Sapiens
MSVEGTNQT

SEQ ID NO: 1112425 - protein, 9 aa, Homo Sapiens
KNRKLKSKW

SEQ ID NO: 1112426 - protein, 9 aa, Homo Sapiens
PLLDTILAE

SEQ ID NO: 1112427 - protein, 9 aa, Homo Sapiens
LSGRPYCGK

SEQ ID NO: 1112428 - protein, 9 aa, Homo Sapiens
RLEEKSQVK

SEQ ID NO: 1112429 - protein, 9 aa, Homo Sapiens
KKHQMSVEG

SEQ ID NO: 1112430 - protein, 9 aa, Homo Sapiens
EKSQVKCDQ

SEQ ID NO: 1112431 - protein, 9 aa, Homo Sapiens
AKAPAMTPV

SEQ ID NO: 1112432 - protein, 9 aa, Homo Sapiens
MFVEESILG

SEQ ID NO: 1112433 - protein, 9 aa, Homo Sapiens
APQTLSAST

SEQ ID NO: 1112434 - protein, 9 aa, Homo Sapiens
HKNCSVGAT

SEQ ID NO: 1112435 - protein, 9 aa, Homo Sapiens
ASRRVSGAR

SEQ ID NO: 1112436 - protein, 9 aa, Homo Sapiens
SCPRRRTRA

SEQ ID NO: 1112437 - protein, 9 aa, Homo Sapiens
QMSVEGTNQ

SEQ ID NO: 1112438 - protein, 9 aa, Homo Sapiens
LEEKSQVKC

SEQ ID NO: 1112439 - protein, 9 aa, Homo Sapiens
IPRVVYKYH

SEQ ID NO: 1112440 - protein, 9 aa, Homo Sapiens
MDLRVYGPA

SEQ ID NO: 1112441 - protein, 9 aa, Homo Sapiens
GAFAGILLF

SEQ ID NO: 1112442 - protein, 9 aa, Homo Sapiens
TPTGKQIMK

SEQ ID NO: 1112443 - protein, 9 aa, Homo Sapiens
SVDSEIEEN

SEQ ID NO: 1112444 - protein, 9 aa, Homo Sapiens
LPVKGGFQA

SEQ ID NO: 1112445 - protein, 9 aa, Homo Sapiens
LDTILAEKT

SEQ ID NO: 1112446 - protein, 9 aa, Homo Sapiens
KLEKMMQED

SEQ ID NO: 1112447 - protein, 9 aa, Homo Sapiens
SSSSSQAFC

SEQ ID NO: 1112448 - protein, 9 aa, Homo Sapiens
DTSSAAAAN

SEQ ID NO: 1112449 - protein, 9 aa, Homo Sapiens
NKKLEKMMQ

SEQ ID NO: 1112450 - protein, 9 aa, Homo Sapiens
PQTLSASTQ

SEQ ID NO: 1112451 - protein, 9 aa, Homo Sapiens
SKEQVLPVK

SEQ ID NO: 1112452 - protein, 9 aa, Homo Sapiens
SLERSCPRR

SEQ ID NO: 1112453 - protein, 9 aa, Homo Sapiens
GKDYGKFGL

SEQ ID NO: 1112454 - protein, 9 aa, Homo Sapiens
PQRLQWQAH

SEQ ID NO: 1112455 - protein, 9 aa, Homo Sapiens
RCAFLKLRR

SEQ ID NO: 1112456 - protein, 9 aa, Homo Sapiens
ILRTYREEK

SEQ ID NO: 1112457 - protein, 9 aa, Homo Sapiens
ERVENRCAF

SEQ ID NO: 1112458 - protein, 9 aa, Homo Sapiens
RFYLGQLSN

SEQ ID NO: 1112459 - protein, 9 aa, Homo Sapiens
FIQGKDYGK

SEQ ID NO: 1112460 - protein, 9 aa, Homo Sapiens
LWNAQEKMV

SEQ ID NO: 1112461 - protein, 9 aa, Homo Sapiens
ECPDDFCTL

SEQ ID NO: 1112462 - protein, 9 aa, Homo Sapiens
GRPYCGKPS

SEQ ID NO: 1112463 - protein, 9 aa, Homo Sapiens
KSQVKCDQY

SEQ ID NO: 1112464 - protein, 9 aa, Homo Sapiens
RRRTRAPTP

SEQ ID NO: 1112465 - protein, 9 aa, Homo Sapiens
NRRCCVLPL

SEQ ID NO: 1112466 - protein, 9 aa, Homo Sapiens
GSTPTGKQI

SEQ ID NO: 1112467 - protein, 9 aa, Homo Sapiens
TYREEKHAK

SEQ ID NO: 1112468 - protein, 9 aa, Homo Sapiens
CECPDDFCT

SEQ ID NO: 1112469 - protein, 9 aa, Homo Sapiens
SSQGPVVTK

SEQ ID NO: 1112470 - protein, 9 aa, Homo Sapiens
PAKAPAMTP

SEQ ID NO: 1112471 - protein, 9 aa, Homo Sapiens
IADSKEQVL

SEQ ID NO: 1112472 - protein, 9 aa, Homo Sapiens
AVLAFPDDM

SEQ ID NO: 1112473 - protein, 9 aa, Homo Sapiens
RIPQEEFHG

SEQ ID NO: 1112474 - protein, 9 aa, Homo Sapiens
DISVDSEIE

SEQ ID NO: 1112475 - protein, 9 aa, Homo Sapiens
GSSSSSQAF

SEQ ID NO: 1112476 - protein, 9 aa, Homo Sapiens
QRLQWQAHL

SEQ ID NO: 1112477 - protein, 9 aa, Homo Sapiens
KVVVLYEDE

SEQ ID NO: 1112478 - protein, 9 aa, Homo Sapiens
MEDAPQRLQ

SEQ ID NO: 1112479 - protein, 9 aa, Homo Sapiens
TVCENYVAD

SEQ ID NO: 1112480 - protein, 9 aa, Homo Sapiens
HQAFSTCSS

SEQ ID NO: 1112481 - protein, 9 aa, Homo Sapiens
EDAPQRLQW

SEQ ID NO: 1112482 - protein, 9 aa, Homo Sapiens
CPRRRTRAP

SEQ ID NO: 1112483 - protein, 9 aa, Homo Sapiens
LKSKWVKPR

SEQ ID NO: 1112484 - protein, 9 aa, Homo Sapiens
KFGLQRLGL

SEQ ID NO: 1112485 - protein, 9 aa, Homo Sapiens
ERSCPRRRT

SEQ ID NO: 1112486 - protein, 9 aa, Homo Sapiens
ASILRTYRE

SEQ ID NO: 1112487 - protein, 9 aa, Homo Sapiens
YHYSPCLKE

SEQ ID NO: 1112488 - protein, 9 aa, Homo Sapiens
RLQWQAHLE

SEQ ID NO: 1112489 - protein, 9 aa, Homo Sapiens
VENRCAFLK

SEQ ID NO: 1112490 - protein, 9 aa, Homo Sapiens
LSKSASKMD

SEQ ID NO: 1112491 - protein, 9 aa, Homo Sapiens
SQAFCGPES

SEQ ID NO: 1112492 - protein, 9 aa, Homo Sapiens
SAVDCNTCA

SEQ ID NO: 1112493 - protein, 9 aa, Homo Sapiens
MRNRRMPAK

SEQ ID NO: 1112494 - protein, 9 aa, Homo Sapiens
KTGDAGASA

SEQ ID NO: 1112495 - protein, 9 aa, Homo Sapiens
VVLYEDEPL

SEQ ID NO: 1112496 - protein, 9 aa, Homo Sapiens
WVKPRDSSE

SEQ ID NO: 1112497 - protein, 9 aa, Homo Sapiens
QGKMFVEES

SEQ ID NO: 1112498 - protein, 9 aa, Homo Sapiens
KNCSVGATN

SEQ ID NO: 1112499 - protein, 9 aa, Homo Sapiens
LEDGSKGKE

SEQ ID NO: 1112500 - protein, 9 aa, Homo Sapiens
VTKEIATSI

SEQ ID NO: 1112501 - protein, 9 aa, Homo Sapiens
ERERVENRC

SEQ ID NO: 1112502 - protein, 9 aa, Homo Sapiens
DSSLERSCP

SEQ ID NO: 1112503 - protein, 9 aa, Homo Sapiens
NRRMPAKAP

SEQ ID NO: 1112504 - protein, 9 aa, Homo Sapiens
KYKVVVLYE

SEQ ID NO: 1112505 - protein, 9 aa, Homo Sapiens
VYVPTVCEN

SEQ ID NO: 1112506 - protein, 9 aa, Homo Sapiens
RCCVLPLAF

SEQ ID NO: 1112507 - protein, 9 aa, Homo Sapiens
DPSGGDRFY

SEQ ID NO: 1112508 - protein, 9 aa, Homo Sapiens
CAFLKLRRQ

SEQ ID NO: 1112509 - protein, 9 aa, Homo Sapiens
VEESILGEL

SEQ ID NO: 1112510 - protein, 9 aa, Homo Sapiens
KEIATSIEP

SEQ ID NO: 1112511 - protein, 9 aa, Homo Sapiens
SLSKSASKM

SEQ ID NO: 1112512 - protein, 9 aa, Homo Sapiens
GDRFYLGQL

SEQ ID NO: 1112513 - protein, 9 aa, Homo Sapiens
KHQMSVEGT

SEQ ID NO: 1112514 - protein, 9 aa, Homo Sapiens
SQVKCDQYW

SEQ ID NO: 1112515 - protein, 9 aa, Homo Sapiens
HYSPCLKEG

SEQ ID NO: 1112516 - protein, 9 aa, Homo Sapiens
QQQQQAATT

SEQ ID NO: 1112517 - protein, 9 aa, Homo Sapiens
YGKFGLQRL

SEQ ID NO: 1112518 - protein, 9 aa, Homo Sapiens
KMKGDYYRD

SEQ ID NO: 1112519 - protein, 9 aa, Homo Sapiens
IIHIKKHQM

SEQ ID NO: 1112520 - protein, 9 aa, Homo Sapiens
GPVVTKEIA

SEQ ID NO: 1112521 - protein, 9 aa, Homo Sapiens
VYKYHYSPC

SEQ ID NO: 1112522 - protein, 9 aa, Homo Sapiens
RMPAKAPAM

SEQ ID NO: 1112523 - protein, 9 aa, Homo Sapiens
MKSAVDCNT

SEQ ID NO: 1112524 - protein, 9 aa, Homo Sapiens
VVTKEIATS

SEQ ID NO: 1112525 - protein, 9 aa, Homo Sapiens
DSKEQVLPV

SEQ ID NO: 1112526 - protein, 9 aa, Homo Sapiens
DASRSRLWN

SEQ ID NO: 1112527 - protein, 9 aa, Homo Sapiens
VLSGRPYCG

SEQ ID NO: 1112528 - protein, 9 aa, Homo Sapiens
MTRLEEKSQ

SEQ ID NO: 1112529 - protein, 9 aa, Homo Sapiens
YLGQLSNVH

SEQ ID NO: 1112530 - protein, 9 aa, Homo Sapiens
RYQGKMFVE

SEQ ID NO: 1112531 - protein, 9 aa, Homo Sapiens
MQEDESNLN

SEQ ID NO: 1112532 - protein, 9 aa, Homo Sapiens
HQMSVEGTN

SEQ ID NO: 1112533 - protein, 9 aa, Homo Sapiens
GFTGSTPTG

SEQ ID NO: 1112534 - protein, 9 aa, Homo Sapiens
SRLWNAQEK

SEQ ID NO: 1112535 - protein, 9 aa, Homo Sapiens
RSCPRRRTR

SEQ ID NO: 1112536 - protein, 9 aa, Homo Sapiens
GDYYRDLAE

SEQ ID NO: 1112537 - protein, 9 aa, Homo Sapiens
RRVSGARSC

SEQ ID NO: 1112538 - protein, 9 aa, Homo Sapiens
AGILLFLIL

SEQ ID NO: 1112539 - protein, 9 aa, Homo Sapiens
SLEDGSKGK

SEQ ID NO: 1112540 - protein, 9 aa, Homo Sapiens
PDDMDLRVY

SEQ ID NO: 1112541 - protein, 9 aa, Homo Sapiens
SSSSQAFCG

SEQ ID NO: 1112542 - protein, 9 aa, Homo Sapiens
SSSQAFCGP

SEQ ID NO: 1112543 - protein, 9 aa, Homo Sapiens
KLKSKWVKP

SEQ ID NO: 1112544 - protein, 9 aa, Homo Sapiens
HRYQGKMFV

SEQ ID NO: 1112545 - protein, 9 aa, Homo Sapiens
SQLNSLEFH

SEQ ID NO: 1112546 - protein, 9 aa, Homo Sapiens
MRLSLEDGS

SEQ ID NO: 1112547 - protein, 9 aa, Homo Sapiens
KAPQTLSAS

SEQ ID NO: 1112548 - protein, 9 aa, Homo Sapiens
LQWQAHLEF

SEQ ID NO: 1112549 - protein, 9 aa, Homo Sapiens
EFHGNQFQK

SEQ ID NO: 1112550 - protein, 9 aa, Homo Sapiens
FESQSLSKS

SEQ ID NO: 1112551 - protein, 9 aa, Homo Sapiens
RDLAEVASG

SEQ ID NO: 1112552 - protein, 9 aa, Homo Sapiens
PSKYKVVVL

SEQ ID NO: 1112553 - protein, 9 aa, Homo Sapiens
PRRRTRAPT

SEQ ID NO: 1112554 - protein, 9 aa, Homo Sapiens
DYGKFGLQR

SEQ ID NO: 1112555 - protein, 9 aa, Homo Sapiens
LDFKTGDAG

SEQ ID NO: 1112556 - protein, 9 aa, Homo Sapiens
PTVCENYVA

SEQ ID NO: 1112557 - protein, 9 aa, Homo Sapiens
SNKKLEKMM

SEQ ID NO: 1112558 - protein, 9 aa, Homo Sapiens
VPTVCENYV

SEQ ID NO: 1112559 - protein, 9 aa, Homo Sapiens
AVDCNTCAG

SEQ ID NO: 1112560 - protein, 9 aa, Homo Sapiens
AGVIAGAFA

SEQ ID NO: 1112561 - protein, 9 aa, Homo Sapiens
KSKWVKPRD

SEQ ID NO: 1112562 - protein, 9 aa, Homo Sapiens
KEQVLPVKG

SEQ ID NO: 1112563 - protein, 9 aa, Homo Sapiens
QVKCDQYWP

SEQ ID NO: 1112564 - protein, 9 aa, Homo Sapiens
QGPVVTKEI

SEQ ID NO: 1112565 - protein, 9 aa, Homo Sapiens
PTGKQIMKS

SEQ ID NO: 1112566 - protein, 9 aa, Homo Sapiens
KPPRAGGPH

SEQ ID NO: 1112567 - protein, 9 aa, Homo Sapiens
PYCGKPSDM

SEQ ID NO: 1112568 - protein, 9 aa, Homo Sapiens
SWHLDKAPQ

SEQ ID NO: 1112569 - protein, 9 aa, Homo Sapiens
QLNSLEFHL

SEQ ID NO: 1112570 - protein, 9 aa, Homo Sapiens
TKPPRAGGP

SEQ ID NO: 1112571 - protein, 9 aa, Homo Sapiens
STKPPRAGG

SEQ ID NO: 1112572 - protein, 9 aa, Homo Sapiens
RRMPAKAPA

SEQ ID NO: 1112573 - protein, 9 aa, Homo Sapiens
VSQLNSLEF

SEQ ID NO: 1112574 - protein, 9 aa, Homo Sapiens
FTGSTPTGK

SEQ ID NO: 1112575 - protein, 9 aa, Homo Sapiens
AAASRRVSG

SEQ ID NO: 1112576 - protein, 9 aa, Homo Sapiens
QWQAHLEFT

SEQ ID NO: 1112577 - protein, 9 aa, Homo Sapiens
SQGPVVTKE

SEQ ID NO: 1112578 - protein, 9 aa, Homo Sapiens
TCECPDDFC

SEQ ID NO: 1112579 - protein, 9 aa, Homo Sapiens
IQGKDYGKF

SEQ ID NO: 1112580 - protein, 9 aa, Homo Sapiens
VLAFPDDMD

SEQ ID NO: 1112581 - protein, 9 aa, Homo Sapiens
LLDTILAEK

SEQ ID NO: 1112582 - protein, 9 aa, Homo Sapiens
ASFFESQSL

SEQ ID NO: 1112583 - protein, 9 aa, Homo Sapiens
IMTLGHKNC

SEQ ID NO: 1112584 - protein, 9 aa, Homo Sapiens
WHLDKAPQT

SEQ ID NO: 1112585 - protein, 9 aa, Homo Sapiens
EMKSAVDCN

SEQ ID NO: 1112586 - protein, 9 aa, Homo Sapiens
DCNTCAGVW

SEQ ID NO: 1112587 - protein, 9 aa, Homo Sapiens
APPAPSTKP

SEQ ID NO: 1112588 - protein, 9 aa, Homo Sapiens
VVYKYHYSP

SEQ ID NO: 1112589 - protein, 9 aa, Homo Sapiens
CGKPSDMWA

SEQ ID NO: 1112590 - protein, 9 aa, Homo Sapiens
VCENYVADI

SEQ ID NO: 1112591 - protein, 9 aa, Homo Sapiens
RRCCVLPLA

SEQ ID NO: 1112592 - protein, 9 aa, Homo Sapiens
YRDLAEVAS

SEQ ID NO: 1112593 - protein, 9 aa, Homo Sapiens
YKYHYSPCL

SEQ ID NO: 1112594 - protein, 9 aa, Homo Sapiens
EDGSKGKEK

SEQ ID NO: 1112595 - protein, 9 aa, Homo Sapiens
RNRRMPAKA

SEQ ID NO: 1112596 - protein, 9 aa, Homo Sapiens
ADDLDFKTG

SEQ ID NO: 1112597 - protein, 9 aa, Homo Sapiens
RAAASRRVS

SEQ ID NO: 1112598 - protein, 9 aa, Homo Sapiens
CNTCAGVWS

SEQ ID NO: 1112599 - protein, 9 aa, Homo Sapiens
RERVENRCA

SEQ ID NO: 1112600 - protein, 9 aa, Homo Sapiens
WNAQEKMVY

SEQ ID NO: 1112601 - protein, 9 aa, Homo Sapiens
PQQQQQQAA

SEQ ID NO: 1112602 - protein, 9 aa, Homo Sapiens
MPAKAPAMT

SEQ ID NO: 1112603 - protein, 9 aa, Homo Sapiens
PQEEFHGNQ

SEQ ID NO: 1112604 - protein, 9 aa, Homo Sapiens
RKLKSKWVK

SEQ ID NO: 1112605 - protein, 9 aa, Homo Sapiens
NRKLKSKWV

SEQ ID NO: 1112606 - protein, 9 aa, Homo Sapiens
HLDKAPQTL

SEQ ID NO: 1112607 - protein, 9 aa, Homo Sapiens
HIKKHQMSV

SEQ ID NO: 1112608 - protein, 9 aa, Homo Sapiens
GKMFVEESI

SEQ ID NO: 1112609 - protein, 9 aa, Homo Sapiens
DMDLRVYGP

SEQ ID NO: 1112610 - protein, 9 aa, Homo Sapiens
TIQILSPLL

SEQ ID NO: 1112611 - protein, 9 aa, Homo Sapiens
GVIAGAFAG

SEQ ID NO: 1112612 - protein, 9 aa, Homo Sapiens
FVEESILGE

SEQ ID NO: 1112613 - protein, 9 aa, Homo Sapiens
QAFSTCSSH

SEQ ID NO: 1112614 - protein, 9 aa, Homo Sapiens
EKMMQEDES

SEQ ID NO: 1112615 - protein, 9 aa, Homo Sapiens
AFCGPESSG

SEQ ID NO: 1112616 - protein, 9 aa, Homo Sapiens
NSLEFHLDT

SEQ ID NO: 1112617 - protein, 9 aa, Homo Sapiens
LERSCPRRR

SEQ ID NO: 1112618 - protein, 9 aa, Homo Sapiens
AGAFAGILL

SEQ ID NO: 1112619 - protein, 9 aa, Homo Sapiens
LGFTGSTPT

SEQ ID NO: 1112620 - protein, 9 aa, Homo Sapiens
QPDSSLERS

SEQ ID NO: 1112621 - protein, 9 aa, Homo Sapiens
STPTGKQIM

SEQ ID NO: 1112622 - protein, 9 aa, Homo Sapiens
DLAEVASGE

SEQ ID NO: 1112623 - protein, 9 aa, Homo Sapiens
DFKTGDAGA

SEQ ID NO: 1112624 - protein, 9 aa, Homo Sapiens
SGRPYCGKP

SEQ ID NO: 1112625 - protein, 9 aa, Homo Sapiens
VSGARSCQG

SEQ ID NO: 1112626 - protein, 9 aa, Homo Sapiens
FRIPQEEFH

SEQ ID NO: 1112627 - protein, 9 aa, Homo Sapiens
RVENRCAFL

SEQ ID NO: 1112628 - protein, 9 aa, Homo Sapiens
RVSGARSCQ

SEQ ID NO: 1112629 - protein, 9 aa, Homo Sapiens
REEKHAKKI

SEQ ID NO: 1112630 - protein, 9 aa, Homo Sapiens
ILDISVDSE

SEQ ID NO: 1112631 - protein, 9 aa, Homo Sapiens
FCTLQLSGS

SEQ ID NO: 1112632 - protein, 9 aa, Homo Sapiens
QSLSKSASK

SEQ ID NO: 1112633 - protein, 9 aa, Homo Sapiens
CPDDFCTLQ

SEQ ID NO: 1112634 - protein, 9 aa, Homo Sapiens
RLILDISVD

SEQ ID NO: 1112635 - protein, 9 aa, Homo Sapiens
QEEFHGNQF

SEQ ID NO: 1112636 - protein, 9 aa, Homo Sapiens
TRLEEKSQV

SEQ ID NO: 1112637 - protein, 9 aa, Homo Sapiens
MTLGHKNCS

SEQ ID NO: 1112638 - protein, 9 aa, Homo Sapiens
PSTKPPRAG

SEQ ID NO: 1112639 - protein, 9 aa, Homo Sapiens
SKWVKPRDS

SEQ ID NO: 1112640 - protein, 9 aa, Homo Sapiens
RPYCGKPSD

SEQ ID NO: 1112641 - protein, 9 aa, Homo Sapiens
KDYGKFGLQ

SEQ ID NO: 1112642 - protein, 9 aa, Homo Sapiens
SVSQLNSLE

SEQ ID NO: 1112643 - protein, 9 aa, Homo Sapiens
AFAGILLFL

SEQ ID NO: 1112644 - protein, 9 aa, Homo Sapiens
AFPDDMDLR

SEQ ID NO: 1112645 - protein, 9 aa, Homo Sapiens
CCVLPLAFP

SEQ ID NO: 1112646 - protein, 9 aa, Homo Sapiens
IAGAFAGIL

SEQ ID NO: 1112647 - protein, 9 aa, Homo Sapiens
GHKNCSVGA

SEQ ID NO: 1112648 - protein, 9 aa, Homo Sapiens
PEVYVPTVC

SEQ ID NO: 1112649 - protein, 9 aa, Homo Sapiens
RRLILDISV

SEQ ID NO: 1112650 - protein, 9 aa, Homo Sapiens
RTYREEKHA

SEQ ID NO: 1112651 - protein, 9 aa, Homo Sapiens
QQQQQQAAT

SEQ ID NO: 1112652 - protein, 9 aa, Homo Sapiens
VPSKYKVVV

SEQ ID NO: 1112653 - protein, 9 aa, Homo Sapiens
PLAFPITFS

SEQ ID NO: 1112654 - protein, 9 aa, Homo Sapiens
PDDFCTLQL

SEQ ID NO: 1112655 - protein, 9 aa, Homo Sapiens
SKYKVVVLY

SEQ ID NO: 1112656 - protein, 9 aa, Homo Sapiens
SKGKEKVLE

SEQ ID NO: 1112657 - protein, 9 aa, Homo Sapiens
ENRCAFLKL

SEQ ID NO: 1112658 - protein, 9 aa, Homo Sapiens
SGGDRFYLG

SEQ ID NO: 1112659 - protein, 9 aa, Homo Sapiens
CVLPLAFPI

SEQ ID NO: 1112660 - protein, 9 aa, Homo Sapiens
LEFHLDTPF

SEQ ID NO: 1112661 - protein, 9 aa, Homo Sapiens
QDASRSRLW

SEQ ID NO: 1112662 - protein, 9 aa, Homo Sapiens
SRRVSGARS

SEQ ID NO: 1112663 - protein, 9 aa, Homo Sapiens
KSAVDCNTC

SEQ ID NO: 1112664 - protein, 9 aa, Homo Sapiens
FPDDMDLRV

SEQ ID NO: 1112665 - protein, 9 aa, Homo Sapiens
KMMQEDESN

SEQ ID NO: 1112666 - protein, 9 aa, Homo Sapiens
QTLSASTQD

SEQ ID NO: 1112667 - protein, 9 aa, Homo Sapiens
PPAPSTKPP

SEQ ID NO: 1112668 - protein, 9 aa, Homo Sapiens
DLDFKTGDA

SEQ ID NO: 1112669 - protein, 9 aa, Homo Sapiens
LSPLLDTIL

SEQ ID NO: 1112670 - protein, 9 aa, Homo Sapiens
LGHKNCSVG

SEQ ID NO: 1112671 - protein, 9 aa, Homo Sapiens
KYHYSPCLK

SEQ ID NO: 1112672 - protein, 9 aa, Homo Sapiens
VDCNTCAGV

SEQ ID NO: 1112673 - protein, 9 aa, Homo Sapiens
FAGILLFLI

SEQ ID NO: 1112674 - protein, 9 aa, Homo Sapiens
IPQEEFHGN

SEQ ID NO: 1112675 - protein, 9 aa, Homo Sapiens
EFHLDTPFS

SEQ ID NO: 1112676 - protein, 9 aa, Homo Sapiens
LPLAFPITF

SEQ ID NO: 1112677 - protein, 9 aa, Homo Sapiens
AAPPAPSTK

SEQ ID NO: 1112678 - protein, 9 aa, Homo Sapiens
SQSLSKSAS

SEQ ID NO: 1112679 - protein, 9 aa, Homo Sapiens
DRFYLGQLS

SEQ ID NO: 1112680 - protein, 9 aa, Homo Sapiens
IQILSPLLD

SEQ ID NO: 1112681 - protein, 9 aa, Homo Sapiens
ESQSLSKSA

SEQ ID NO: 1112682 - protein, 9 aa, Homo Sapiens
MADDLDFKT

SEQ ID NO: 1112683 - protein, 9 aa, Homo Sapiens
RLWNAQEKM

SEQ ID NO: 1112684 - protein, 9 aa, Homo Sapiens
GKFGLQRLG

SEQ ID NO: 1112685 - protein, 9 aa, Homo Sapiens
DVLSGRPYC

SEQ ID NO: 1112686 - protein, 9 aa, Homo Sapiens
NRCAFLKLR

SEQ ID NO: 1112687 - protein, 9 aa, Homo Sapiens
DYYRDLAEV

SEQ ID NO: 1112688 - protein, 9 aa, Homo Sapiens
KGDYYRDLA

SEQ ID NO: 1112689 - protein, 9 aa, Homo Sapiens
PVVTKEIAT

SEQ ID NO: 1112690 - protein, 9 aa, Homo Sapiens
RLSLEDGSK

SEQ ID NO: 1112691 - protein, 9 aa, Homo Sapiens
YCGKPSDMW

SEQ ID NO: 1112692 - protein, 9 aa, Homo Sapiens
TGSTPTGKQ

SEQ ID NO: 1112693 - protein, 9 aa, Homo Sapiens
HGNQFQKAQ

SEQ ID NO: 1112694 - protein, 9 aa, Homo Sapiens
VVVLYEDEP

SEQ ID NO: 1112695 - protein, 9 aa, Homo Sapiens
LASILRTYR

SEQ ID NO: 1112696 - protein, 9 aa, Homo Sapiens
SLEFHLDTP

SEQ ID NO: 1112697 - protein, 9 aa, Homo Sapiens
RMRNRRMPA

SEQ ID NO: 1112698 - protein, 9 aa, Homo Sapiens
LDKAPQTLS

SEQ ID NO: 1112699 - protein, 9 aa, Homo Sapiens
CSVGATNMN

SEQ ID NO: 1112700 - protein, 9 aa, Homo Sapiens
APSTKPPRA

SEQ ID NO: 1112701 - protein, 9 aa, Homo Sapiens
LSLEDGSKG

SEQ ID NO: 1112702 - protein, 9 aa, Homo Sapiens
CTLQLSGST

SEQ ID NO: 1112703 - protein, 9 aa, Homo Sapiens
LILDISVDS

SEQ ID NO: 1112704 - protein, 9 aa, Homo Sapiens
YVPTVCENY

SEQ ID NO: 1112705 - protein, 9 aa, Homo Sapiens
MMQEDESNL

SEQ ID NO: 1112706 - protein, 9 aa, Homo Sapiens
DKAPQTLSA

SEQ ID NO: 1112707 - protein, 9 aa, Homo Sapiens
ILSPLLDTI

SEQ ID NO: 1112708 - protein, 9 aa, Homo Sapiens
VLPVKGGFQ

SEQ ID NO: 1112709 - protein, 9 aa, Homo Sapiens
EVYVPTVCE

SEQ ID NO: 1112710 - protein, 9 aa, Homo Sapiens
ASRSRLWNA

SEQ ID NO: 1112711 - protein, 9 aa, Homo Sapiens
NCSVGATNM

SEQ ID NO: 1112712 - protein, 9 aa, Homo Sapiens
FHGNQFQKA

SEQ ID NO: 1112713 - protein, 9 aa, Homo Sapiens
AASRRVSGA

SEQ ID NO: 1112714 - protein, 9 aa, Homo Sapiens
PQPDSSLER

SEQ ID NO: 1112715 - protein, 9 aa, Homo Sapiens
CENYVADIE

SEQ ID NO: 1112716 - protein, 9 aa, Homo Sapiens
GGDRFYLGQ

SEQ ID NO: 1112717 - protein, 9 aa, Homo Sapiens
TCLLCHCHL

SEQ ID NO: 1112718 - protein, 9 aa, Homo Sapiens
HTGENLYTC

SEQ ID NO: 1112719 - protein, 9 aa, Homo Sapiens
LQNKKKNCS

SEQ ID NO: 1112720 - protein, 9 aa, Homo Sapiens
VTQMEGPVS

SEQ ID NO: 1112721 - protein, 9 aa, Homo Sapiens
KLTYTKVWK

SEQ ID NO: 1112722 - protein, 9 aa, Homo Sapiens
MFEGGGSVA

SEQ ID NO: 1112723 - protein, 9 aa, Homo Sapiens
SSRKTVVQQ

SEQ ID NO: 1112724 - protein, 9 aa, Homo Sapiens
MVQLERSAI

SEQ ID NO: 1112725 - protein, 9 aa, Homo Sapiens
EVVQLNLSW

SEQ ID NO: 1112726 - protein, 9 aa, Homo Sapiens
QWRTKYKTD

SEQ ID NO: 1112727 - protein, 9 aa, Homo Sapiens
GSCRQTGDF

SEQ ID NO: 1112728 - protein, 9 aa, Homo Sapiens
RPLSVYPPA

SEQ ID NO: 1112729 - protein, 9 aa, Homo Sapiens
PPGPPMARL

SEQ ID NO: 1112730 - protein, 9 aa, Homo Sapiens
LRCHVMQVF

SEQ ID NO: 1112731 - protein, 9 aa, Homo Sapiens
FNTALTLLK

SEQ ID NO: 1112732 - protein, 9 aa, Homo Sapiens
GHVNLHLKI

SEQ ID NO: 1112733 - protein, 9 aa, Homo Sapiens
GLADGWCGW

SEQ ID NO: 1112734 - protein, 9 aa, Homo Sapiens
EQKISRVSS

SEQ ID NO: 1112735 - protein, 9 aa, Homo Sapiens
AVSTGHTTP

SEQ ID NO: 1112736 - protein, 9 aa, Homo Sapiens
LPPPQSSPF

SEQ ID NO: 1112737 - protein, 9 aa, Homo Sapiens
ESISARKVL

SEQ ID NO: 1112738 - protein, 9 aa, Homo Sapiens
ANVPLPPPQ

SEQ ID NO: 1112739 - protein, 9 aa, Homo Sapiens
NNQACTIAF

SEQ ID NO: 1112740 - protein, 9 aa, Homo Sapiens
PPPEAPRRH

SEQ ID NO: 1112741 - protein, 9 aa, Homo Sapiens
KNCSFPAFY

SEQ ID NO: 1112742 - protein, 9 aa, Homo Sapiens
CKVSGKPVP

SEQ ID NO: 1112743 - protein, 9 aa, Homo Sapiens
EGGGSVAGS

SEQ ID NO: 1112744 - protein, 9 aa, Homo Sapiens
GCTLRFPGI

SEQ ID NO: 1112745 - protein, 9 aa, Homo Sapiens
CAEAGLDSE

SEQ ID NO: 1112746 - protein, 9 aa, Homo Sapiens
PFLARSWNT

SEQ ID NO: 1112747 - protein, 9 aa, Homo Sapiens
DGWCGWTVA

SEQ ID NO: 1112748 - protein, 9 aa, Homo Sapiens
WKKMMIGSQ

SEQ ID NO: 1112749 - protein, 9 aa, Homo Sapiens
RVLYQNTNI

SEQ ID NO: 1112750 - protein, 9 aa, Homo Sapiens
KISKRSDDW

SEQ ID NO: 1112751 - protein, 9 aa, Homo Sapiens
DRRASQGRG

SEQ ID NO: 1112752 - protein, 9 aa, Homo Sapiens
SQQLKKWAK

SEQ ID NO: 1112753 - protein, 9 aa, Homo Sapiens
IFVTGLLLH

SEQ ID NO: 1112754 - protein, 9 aa, Homo Sapiens
LVFFLYKCF

SEQ ID NO: 1112755 - protein, 9 aa, Homo Sapiens
IAGAHHCQY

SEQ ID NO: 1112756 - protein, 9 aa, Homo Sapiens
EFSSDLADI

SEQ ID NO: 1112757 - protein, 9 aa, Homo Sapiens
APRRHLDFS

SEQ ID NO: 1112758 - protein, 9 aa, Homo Sapiens
LLFGAAATL

SEQ ID NO: 1112759 - protein, 9 aa, Homo Sapiens
PTKCLLTPL

SEQ ID NO: 1112760 - protein, 9 aa, Homo Sapiens
PYQAPQQWE

SEQ ID NO: 1112761 - protein, 9 aa, Homo Sapiens
RIGFVTYNK

SEQ ID NO: 1112762 - protein, 9 aa, Homo Sapiens
EGQPSPEGC

SEQ ID NO: 1112763 - protein, 9 aa, Homo Sapiens
QVKTVQQDE

SEQ ID NO: 1112764 - protein, 9 aa, Homo Sapiens
QETCLLCHC

SEQ ID NO: 1112765 - protein, 9 aa, Homo Sapiens
PVNPAAFRP

SEQ ID NO: 1112766 - protein, 9 aa, Homo Sapiens
ECKVSGKPV

SEQ ID NO: 1112767 - protein, 9 aa, Homo Sapiens
EFECKVSGK

SEQ ID NO: 1112768 - protein, 9 aa, Homo Sapiens
LLLLLSPLD

SEQ ID NO: 1112769 - protein, 9 aa, Homo Sapiens
SIHHGSPRP

SEQ ID NO: 1112770 - protein, 9 aa, Homo Sapiens
FSYVRHLVK

SEQ ID NO: 1112771 - protein, 9 aa, Homo Sapiens
ERMYSKTNT

SEQ ID NO: 1112772 - protein, 9 aa, Homo Sapiens
SEAEQNEED

SEQ ID NO: 1112773 - protein, 9 aa, Homo Sapiens
EKGHQKLEE

SEQ ID NO: 1112774 - protein, 9 aa, Homo Sapiens
SPCVNGGSC

SEQ ID NO: 1112775 - protein, 9 aa, Homo Sapiens
EESAIRIGF

SEQ ID NO: 1112776 - protein, 9 aa, Homo Sapiens
HVNLHLKIS

SEQ ID NO: 1112777 - protein, 9 aa, Homo Sapiens
PFNTALTLL

SEQ ID NO: 1112778 - protein, 9 aa, Homo Sapiens
LFGLLFGAA

SEQ ID NO: 1112779 - protein, 9 aa, Homo Sapiens
FPYSATPLG

SEQ ID NO: 1112780 - protein, 9 aa, Homo Sapiens
NPINRKVRA

SEQ ID NO: 1112781 - protein, 9 aa, Homo Sapiens
QRESSSRKT

SEQ ID NO: 1112782 - protein, 9 aa, Homo Sapiens
PQGSPVEVA

SEQ ID NO: 1112783 - protein, 9 aa, Homo Sapiens
PCCRLTWMS

SEQ ID NO: 1112784 - protein, 9 aa, Homo Sapiens
QHLLFEAWL

SEQ ID NO: 1112785 - protein, 9 aa, Homo Sapiens
HLLFEAWLL

SEQ ID NO: 1112786 - protein, 9 aa, Homo Sapiens
YRIYSQVLF

SEQ ID NO: 1112787 - protein, 9 aa, Homo Sapiens
SGDLCDAQK

SEQ ID NO: 1112788 - protein, 9 aa, Homo Sapiens
ICVARVLYQ

SEQ ID NO: 1112789 - protein, 9 aa, Homo Sapiens
KRCNPCCRL

SEQ ID NO: 1112790 - protein, 9 aa, Homo Sapiens
ADMGVGLAG

SEQ ID NO: 1112791 - protein, 9 aa, Homo Sapiens
PVVVEGAGA

SEQ ID NO: 1112792 - protein, 9 aa, Homo Sapiens
DIEFECKVS

SEQ ID NO: 1112793 - protein, 9 aa, Homo Sapiens
QSKVEQKIS

SEQ ID NO: 1112794 - protein, 9 aa, Homo Sapiens
TVIAGAHHC

SEQ ID NO: 1112795 - protein, 9 aa, Homo Sapiens
YTKVWKMNW

SEQ ID NO: 1112796 - protein, 9 aa, Homo Sapiens
FGAAATLLQ

SEQ ID NO: 1112797 - protein, 9 aa, Homo Sapiens
RSWNTMQWN

SEQ ID NO: 1112798 - protein, 9 aa, Homo Sapiens
FLARSWNTM

SEQ ID NO: 1112799 - protein, 9 aa, Homo Sapiens
WNNKKMAMT

SEQ ID NO: 1112800 - protein, 9 aa, Homo Sapiens
YVQETCLLC

SEQ ID NO: 1112801 - protein, 9 aa, Homo Sapiens
DDGMRENPM

SEQ ID NO: 1112802 - protein, 9 aa, Homo Sapiens
PGPPMARLP

SEQ ID NO: 1112803 - protein, 9 aa, Homo Sapiens
SDDWLGCWG

SEQ ID NO: 1112804 - protein, 9 aa, Homo Sapiens
PYGGSGCCH

SEQ ID NO: 1112805 - protein, 9 aa, Homo Sapiens
MTYFYTDTT

SEQ ID NO: 1112806 - protein, 9 aa, Homo Sapiens
DSEAEQNEE

SEQ ID NO: 1112807 - protein, 9 aa, Homo Sapiens
TESISARKV

SEQ ID NO: 1112808 - protein, 9 aa, Homo Sapiens
VAQWRTKYK

SEQ ID NO: 1112809 - protein, 9 aa, Homo Sapiens
SKVEQKISR

SEQ ID NO: 1112810 - protein, 9 aa, Homo Sapiens
NLVNLSVSD

SEQ ID NO: 1112811 - protein, 9 aa, Homo Sapiens
STESISARK

SEQ ID NO: 1112812 - protein, 9 aa, Homo Sapiens
VMQVFPVGY

SEQ ID NO: 1112813 - protein, 9 aa, Homo Sapiens
QTYMFEGGG

SEQ ID NO: 1112814 - protein, 9 aa, Homo Sapiens
YQAPQQWEG

SEQ ID NO: 1112815 - protein, 9 aa, Homo Sapiens
EVPGVFSRS

SEQ ID NO: 1112816 - protein, 9 aa, Homo Sapiens
RFPGIEKIR

SEQ ID NO: 1112817 - protein, 9 aa, Homo Sapiens
LDVEEDRRA

SEQ ID NO: 1112818 - protein, 9 aa, Homo Sapiens
RKCCDDGMR

SEQ ID NO: 1112819 - protein, 9 aa, Homo Sapiens
CTLRFPGIE

SEQ ID NO: 1112820 - protein, 9 aa, Homo Sapiens
KCCDDGMRE

SEQ ID NO: 1112821 - protein, 9 aa, Homo Sapiens
GGWRARAEC

SEQ ID NO: 1112822 - protein, 9 aa, Homo Sapiens
NLYTCEECG

SEQ ID NO: 1112823 - protein, 9 aa, Homo Sapiens
RSDDWLGCW

SEQ ID NO: 1112824 - protein, 9 aa, Homo Sapiens
ETCLLCHCH

SEQ ID NO: 1112825 - protein, 9 aa, Homo Sapiens
GAVGAPRPY

SEQ ID NO: 1112826 - protein, 9 aa, Homo Sapiens
DLEKGHQKL

SEQ ID NO: 1112827 - protein, 9 aa, Homo Sapiens
TQMEGPVSL

SEQ ID NO: 1112828 - protein, 9 aa, Homo Sapiens
QNKKKNCSF

SEQ ID NO: 1112829 - protein, 9 aa, Homo Sapiens
YVHQNAKNS

SEQ ID NO: 1112830 - protein, 9 aa, Homo Sapiens
PPGVPHDRV

SEQ ID NO: 1112831 - protein, 9 aa, Homo Sapiens
LEAIELELG

SEQ ID NO: 1112832 - protein, 9 aa, Homo Sapiens
LTIIKAKAQ

SEQ ID NO: 1112833 - protein, 9 aa, Homo Sapiens
IIKAKAQWP

SEQ ID NO: 1112834 - protein, 9 aa, Homo Sapiens
FYRKLKFSL

SEQ ID NO: 1112835 - protein, 9 aa, Homo Sapiens
SCIGAPSPG

SEQ ID NO: 1112836 - protein, 9 aa, Homo Sapiens
IAYGTNNVQ

SEQ ID NO: 1112837 - protein, 9 aa, Homo Sapiens
LLLHPHGKR

SEQ ID NO: 1112838 - protein, 9 aa, Homo Sapiens
VTGLLLHKP

SEQ ID NO: 1112839 - protein, 9 aa, Homo Sapiens
DRVDRLLDL

SEQ ID NO: 1112840 - protein, 9 aa, Homo Sapiens
SPVEVATTN

SEQ ID NO: 1112841 - protein, 9 aa, Homo Sapiens
PCVNGGSCR

SEQ ID NO: 1112842 - protein, 9 aa, Homo Sapiens
AATLLQSPV

SEQ ID NO: 1112843 - protein, 9 aa, Homo Sapiens
HQNAKNSWV

SEQ ID NO: 1112844 - protein, 9 aa, Homo Sapiens
WPIEEQGPL

SEQ ID NO: 1112845 - protein, 8 aa, Homo Sapiens
IKRFLEDT

SEQ ID NO: 1112846 - protein, 9 aa, Homo Sapiens
VLYQNTNIV

SEQ ID NO: 1112847 - protein, 9 aa, Homo Sapiens
PEGCLCPCS

SEQ ID NO: 1112848 - protein, 9 aa, Homo Sapiens
NCSFPAFYR

SEQ ID NO: 1112849 - protein, 9 aa, Homo Sapiens
GIFENGIEF

SEQ ID NO: 1112850 - protein, 9 aa, Homo Sapiens
TEILELAGN

SEQ ID NO: 1112851 - protein, 9 aa, Homo Sapiens
EEVPGVFSR

SEQ ID NO: 1112852 - protein, 9 aa, Homo Sapiens
LTYTKVWKM

SEQ ID NO: 1112853 - protein, 9 aa, Homo Sapiens
DGCIVYLDG

SEQ ID NO: 1112854 - protein, 9 aa, Homo Sapiens
SLSEEAFLT

SEQ ID NO: 1112855 - protein, 9 aa, Homo Sapiens
GPVSLSEEA

SEQ ID NO: 1112856 - protein, 9 aa, Homo Sapiens
LAFVLGNWQ

SEQ ID NO: 1112857 - protein, 9 aa, Homo Sapiens
AIELELGEA

SEQ ID NO: 1112858 - protein, 9 aa, Homo Sapiens
RCNPCCRLT

SEQ ID NO: 1112859 - protein, 9 aa, Homo Sapiens
KYTLRCHVM

SEQ ID NO: 1112860 - protein, 9 aa, Homo Sapiens
YGGSGCCHS

SEQ ID NO: 1112861 - protein, 9 aa, Homo Sapiens
VPSEGLYRI

SEQ ID NO: 1112862 - protein, 9 aa, Homo Sapiens
LEYLTTEIL

SEQ ID NO: 1112863 - protein, 9 aa, Homo Sapiens
GVPHDRVDR

SEQ ID NO: 1112864 - protein, 9 aa, Homo Sapiens
YKTDAIQRT

SEQ ID NO: 1112865 - protein, 9 aa, Homo Sapiens
RRASQGRGP

SEQ ID NO: 1112866 - protein, 9 aa, Homo Sapiens
EPEGQPSPE

SEQ ID NO: 1112867 - protein, 8 aa, Homo Sapiens
DDKEYVGF

SEQ ID NO: 1112868 - protein, 9 aa, Homo Sapiens
QKETVGGMT

SEQ ID NO: 1112869 - protein, 9 aa, Homo Sapiens
TKVWKMNWK

SEQ ID NO: 1112870 - protein, 9 aa, Homo Sapiens
HPHGKRCNP

SEQ ID NO: 1112871 - protein, 9 aa, Homo Sapiens
KWAKTRHQK

SEQ ID NO: 1112872 - protein, 9 aa, Homo Sapiens
KISRVSSAQ

SEQ ID NO: 1112873 - protein, 9 aa, Homo Sapiens
LLHKPNTYP

SEQ ID NO: 1112874 - protein, 9 aa, Homo Sapiens
LKKWAKTRH

SEQ ID NO: 1112875 - protein, 9 aa, Homo Sapiens
PSPCVNGGS

SEQ ID NO: 1112876 - protein, 9 aa, Homo Sapiens
VVVEGAGAA

SEQ ID NO: 1112877 - protein, 9 aa, Homo Sapiens
FFLYKCFQG

SEQ ID NO: 1112878 - protein, 9 aa, Homo Sapiens
QPSPEGCLC

SEQ ID NO: 1112879 - protein, 9 aa, Homo Sapiens
KTDAIQRTE

SEQ ID NO: 1112880 - protein, 9 aa, Homo Sapiens
TIIKAKAQW

SEQ ID NO: 1112881 - protein, 9 aa, Homo Sapiens
KKNCSFPAF

SEQ ID NO: 1112882 - protein, 9 aa, Homo Sapiens
RTEEDLEKG

SEQ ID NO: 1112883 - protein, 9 aa, Homo Sapiens
LFGAAATLL

SEQ ID NO: 1112884 - protein, 9 aa, Homo Sapiens
LLHPHGKRC

SEQ ID NO: 1112885 - protein, 9 aa, Homo Sapiens
QYKLTYTKV

SEQ ID NO: 1112886 - protein, 9 aa, Homo Sapiens
VQETCLLCH

SEQ ID NO: 1112887 - protein, 9 aa, Homo Sapiens
CLLCHCHLK

SEQ ID NO: 1112888 - protein, 9 aa, Homo Sapiens
HCQYKLTYT

SEQ ID NO: 1112889 - protein, 9 aa, Homo Sapiens
EPYGGSGCC

SEQ ID NO: 1112890 - protein, 9 aa, Homo Sapiens
CVARVLYQN

SEQ ID NO: 1112891 - protein, 9 aa, Homo Sapiens
CEPYGGSGC

SEQ ID NO: 1112892 - protein, 9 aa, Homo Sapiens
GCAEAGLDS

SEQ ID NO: 1112893 - protein, 9 aa, Homo Sapiens
ETVGGMTYF

SEQ ID NO: 1112894 - protein, 9 aa, Homo Sapiens
HVMQVFPVG

SEQ ID NO: 1112895 - protein, 9 aa, Homo Sapiens
CIVYLDGDR

SEQ ID NO: 1112896 - protein, 9 aa, Homo Sapiens
GMTYFYTDT

SEQ ID NO: 1112897 - protein, 9 aa, Homo Sapiens
RLNNQACTI

SEQ ID NO: 1112898 - protein, 9 aa, Homo Sapiens
NSWVPYEPD

SEQ ID NO: 1112899 - protein, 9 aa, Homo Sapiens
RASTRLTVL

SEQ ID NO: 1112900 - protein, 9 aa, Homo Sapiens
YDKCGHVNL

SEQ ID NO: 1112901 - protein, 9 aa, Homo Sapiens
PRPLSVYPP

SEQ ID NO: 1112902 - protein, 9 aa, Homo Sapiens
YSATPLGTS

SEQ ID NO: 1112903 - protein, 9 aa, Homo Sapiens
PPQSSPFLA

SEQ ID NO: 1112904 - protein, 9 aa, Homo Sapiens
TGENLYTCE

SEQ ID NO: 1112905 - protein, 9 aa, Homo Sapiens
REEVPGVFS

SEQ ID NO: 1112906 - protein, 9 aa, Homo Sapiens
ALPLEREDS

SEQ ID NO: 1112907 - protein, 9 aa, Homo Sapiens
LHPHGKRCN

SEQ ID NO: 1112908 - protein, 9 aa, Homo Sapiens
GAEESAIRI

SEQ ID NO: 1112909 - protein, 9 aa, Homo Sapiens
AAAASVAEQ

SEQ ID NO: 1112910 - protein, 9 aa, Homo Sapiens
PVRLGVYLE

SEQ ID NO: 1112911 - protein, 9 aa, Homo Sapiens
PAFYRKLKF

SEQ ID NO: 1112912 - protein, 9 aa, Homo Sapiens
SPLDSSPLQ

SEQ ID NO: 1112913 - protein, 9 aa, Homo Sapiens
ATSTESISA

SEQ ID NO: 1112914 - protein, 9 aa, Homo Sapiens
IFENGIEFS

SEQ ID NO: 1112915 - protein, 9 aa, Homo Sapiens
SGFTPVVDD

SEQ ID NO: 1112916 - protein, 9 aa, Homo Sapiens
YVRHLVKLV

SEQ ID NO: 1112917 - protein, 9 aa, Homo Sapiens
EKTKGSGFT

SEQ ID NO: 1112918 - protein, 9 aa, Homo Sapiens
IPRAIINPI

SEQ ID NO: 1112919 - protein, 9 aa, Homo Sapiens
LLLHKPNTY

SEQ ID NO: 1112920 - protein, 9 aa, Homo Sapiens
ARAECSACL

SEQ ID NO: 1112921 - protein, 9 aa, Homo Sapiens
CDAQKSIPV

SEQ ID NO: 1112922 - protein, 9 aa, Homo Sapiens
DFEKTKGSG

SEQ ID NO: 1112923 - protein, 9 aa, Homo Sapiens
GVYLEEEDI

SEQ ID NO: 1112924 - protein, 9 aa, Homo Sapiens
EFPVRLGVY

SEQ ID NO: 1112925 - protein, 9 aa, Homo Sapiens
GIEKIRDDK

SEQ ID NO: 1112926 - protein, 9 aa, Homo Sapiens
VSLSEEAFL

SEQ ID NO: 1112927 - protein, 9 aa, Homo Sapiens
VIAGAHHCQ

SEQ ID NO: 1112928 - protein, 9 aa, Homo Sapiens
KNSWVPYEP

SEQ ID NO: 1112929 - protein, 9 aa, Homo Sapiens
NVQPPQHVV

SEQ ID NO: 1112930 - protein, 9 aa, Homo Sapiens
KKTRAPQKT

SEQ ID NO: 1112931 - protein, 9 aa, Homo Sapiens
VEQKISRVS

SEQ ID NO: 1112932 - protein, 9 aa, Homo Sapiens
RPYQAPQQW

SEQ ID NO: 1112933 - protein, 9 aa, Homo Sapiens
NMIKTADMG

SEQ ID NO: 1112934 - protein, 9 aa, Homo Sapiens
AIRIGFVTY

SEQ ID NO: 1112935 - protein, 9 aa, Homo Sapiens
KKMAMTVIA

SEQ ID NO: 1112936 - protein, 9 aa, Homo Sapiens
ATTNDHGKQ

SEQ ID NO: 1112937 - protein, 9 aa, Homo Sapiens
RAPQKTKQG

SEQ ID NO: 1112938 - protein, 9 aa, Homo Sapiens
AFRPAELLA

SEQ ID NO: 1112939 - protein, 9 aa, Homo Sapiens
RCHVMQVFP

SEQ ID NO: 1112940 - protein, 9 aa, Homo Sapiens
RKVRGDGCI

SEQ ID NO: 1112941 - protein, 9 aa, Homo Sapiens
NSCIGAPSP

SEQ ID NO: 1112942 - protein, 9 aa, Homo Sapiens
MMIGPNNSC

SEQ ID NO: 1112943 - protein, 9 aa, Homo Sapiens
LGTSISSLS

SEQ ID NO: 1112944 - protein, 9 aa, Homo Sapiens
ASTRLTVLQ

SEQ ID NO: 1112945 - protein, 9 aa, Homo Sapiens
GSNRSGDLC

SEQ ID NO: 1112946 - protein, 9 aa, Homo Sapiens
SRASTRLTV

SEQ ID NO: 1112947 - protein, 9 aa, Homo Sapiens
KVEQKISRV

SEQ ID NO: 1112948 - protein, 9 aa, Homo Sapiens
AAASVAEQV

SEQ ID NO: 1112949 - protein, 9 aa, Homo Sapiens
WRARAECSA

SEQ ID NO: 1112950 - protein, 9 aa, Homo Sapiens
ENGIEFSSD

SEQ ID NO: 1112951 - protein, 9 aa, Homo Sapiens
VGGMTYFYT

SEQ ID NO: 1112952 - protein, 9 aa, Homo Sapiens
GIEFSSDLA

SEQ ID NO: 1112953 - protein, 9 aa, Homo Sapiens
QQSDEVLTI

SEQ ID NO: 1112954 - protein, 9 aa, Homo Sapiens
ADGWCGWTV

SEQ ID NO: 1112955 - protein, 9 aa, Homo Sapiens
RQRICVARV

SEQ ID NO: 1112956 - protein, 9 aa, Homo Sapiens
QLKKWAKTR

SEQ ID NO: 1112957 - protein, 9 aa, Homo Sapiens
FRPAELLAE

SEQ ID NO: 1112958 - protein, 9 aa, Homo Sapiens
RSLEAIELE

SEQ ID NO: 1112959 - protein, 9 aa, Homo Sapiens
WAKTRHQKG

SEQ ID NO: 1112960 - protein, 9 aa, Homo Sapiens
ALAHYSDKL

SEQ ID NO: 1112961 - protein, 9 aa, Homo Sapiens
GQPSPEGCL

SEQ ID NO: 1112962 - protein, 9 aa, Homo Sapiens
ICRLKLERM

SEQ ID NO: 1112963 - protein, 9 aa, Homo Sapiens
LSWPIEEQG

SEQ ID NO: 1112964 - protein, 9 aa, Homo Sapiens
VGAPRPYQA

SEQ ID NO: 1112965 - protein, 9 aa, Homo Sapiens
GWCGWTVAM

SEQ ID NO: 1112966 - protein, 9 aa, Homo Sapiens
LADGWCGWT

SEQ ID NO: 1112967 - protein, 9 aa, Homo Sapiens
RLGVYLEEE

SEQ ID NO: 1112968 - protein, 9 aa, Homo Sapiens
VPHDRVDRL

SEQ ID NO: 1112969 - protein, 9 aa, Homo Sapiens
HFKISKRSD

SEQ ID NO: 1112970 - protein, 9 aa, Homo Sapiens
SFPAFYRKL

SEQ ID NO: 1112971 - protein, 9 aa, Homo Sapiens
YKLTYTKVW

SEQ ID NO: 1112972 - protein, 9 aa, Homo Sapiens
WRTKYKTDA

SEQ ID NO: 1112973 - protein, 9 aa, Homo Sapiens
SRKTVVQQP

SEQ ID NO: 1112974 - protein, 9 aa, Homo Sapiens
SEGLYRIYS

SEQ ID NO: 1112975 - protein, 9 aa, Homo Sapiens
LDSEAEQNE

SEQ ID NO: 1112976 - protein, 9 aa, Homo Sapiens
NNVQPPQHV

SEQ ID NO: 1112977 - protein, 9 aa, Homo Sapiens
HRGLADGWC

SEQ ID NO: 1112978 - protein, 9 aa, Homo Sapiens
NLSVSDGAS

SEQ ID NO: 1112979 - protein, 9 aa, Homo Sapiens
IMPVVVEGA

SEQ ID NO: 1112980 - protein, 9 aa, Homo Sapiens
AAFRPAELL

SEQ ID NO: 1112981 - protein, 9 aa, Homo Sapiens
FPAFYRKLK

SEQ ID NO: 1112982 - protein, 9 aa, Homo Sapiens
MQVFPVGYL

SEQ ID NO: 1112983 - protein, 9 aa, Homo Sapiens
DQQSKVEQK

SEQ ID NO: 1112984 - protein, 9 aa, Homo Sapiens
RKTVVQQPI

SEQ ID NO: 1112985 - protein, 9 aa, Homo Sapiens
NNSCIGAPS

SEQ ID NO: 1112986 - protein, 9 aa, Homo Sapiens
QLNLSWPIE

SEQ ID NO: 1112987 - protein, 9 aa, Homo Sapiens
VDRLLDLYA

SEQ ID NO: 1112988 - protein, 9 aa, Homo Sapiens
VHQNAKNSW

SEQ ID NO: 1112989 - protein, 9 aa, Homo Sapiens
DLCDAQKSI

SEQ ID NO: 1112990 - protein, 9 aa, Homo Sapiens
KTADMGVGL

SEQ ID NO: 1112991 - protein, 9 aa, Homo Sapiens
FGLLFGAAA

SEQ ID NO: 1112992 - protein, 9 aa, Homo Sapiens
ISKRSDDWL

SEQ ID NO: 1112993 - protein, 9 aa, Homo Sapiens
PVEVATTND

SEQ ID NO: 1112994 - protein, 9 aa, Homo Sapiens
KVWKMNWKK

SEQ ID NO: 1112995 - protein, 9 aa, Homo Sapiens
KRTEEDLEK

SEQ ID NO: 1112996 - protein, 9 aa, Homo Sapiens
GGSVAGSLS

SEQ ID NO: 1112997 - protein, 9 aa, Homo Sapiens
SAVSTGHTT

SEQ ID NO: 1112998 - protein, 9 aa, Homo Sapiens
TIPSAVSTG

SEQ ID NO: 1112999 - protein, 9 aa, Homo Sapiens
RHRAEALPL

SEQ ID NO: 1113000 - protein, 9 aa, Homo Sapiens
NWQTDLLQE

SEQ ID NO: 1113001 - protein, 9 aa, Homo Sapiens
EDRRASQGR

SEQ ID NO: 1113002 - protein, 9 aa, Homo Sapiens
VNLHLKISC

SEQ ID NO: 1113003 - protein, 9 aa, Homo Sapiens
PPEAPRRHL

SEQ ID NO: 1113004 - protein, 9 aa, Homo Sapiens
KRSDDWLGC

SEQ ID NO: 1113005 - protein, 9 aa, Homo Sapiens
FENGIEFSS

SEQ ID NO: 1113006 - protein, 9 aa, Homo Sapiens
SEFPVRLGV

SEQ ID NO: 1113007 - protein, 9 aa, Homo Sapiens
NPAAFRPAE

SEQ ID NO: 1113008 - protein, 9 aa, Homo Sapiens
VQLNLSWPI

SEQ ID NO: 1113009 - protein, 9 aa, Homo Sapiens
WLYVQETCL

SEQ ID NO: 1113010 - protein, 9 aa, Homo Sapiens
RAIINPINR

SEQ ID NO: 1113011 - protein, 9 aa, Homo Sapiens
RARAECSAC

SEQ ID NO: 1113012 - protein, 9 aa, Homo Sapiens
CAPSFSYVR

SEQ ID NO: 1113013 - protein, 9 aa, Homo Sapiens
IRIGFVTYN

SEQ ID NO: 1113014 - protein, 9 aa, Homo Sapiens
AASVAEQVS

SEQ ID NO: 1113015 - protein, 9 aa, Homo Sapiens
PSFSYVRHL

SEQ ID NO: 1113016 - protein, 9 aa, Homo Sapiens
MIGPNNSCI

SEQ ID NO: 1113017 - protein, 9 aa, Homo Sapiens
AEALPLERE

SEQ ID NO: 1113018 - protein, 9 aa, Homo Sapiens
HHGSPRPLS

SEQ ID NO: 1113019 - protein, 9 aa, Homo Sapiens
GPPMARLPP

SEQ ID NO: 1113020 - protein, 9 aa, Homo Sapiens
DSHYIMPVV

SEQ ID NO: 1113021 - protein, 9 aa, Homo Sapiens
GSPVEVATT

SEQ ID NO: 1113022 - protein, 9 aa, Homo Sapiens
AIINPINRK

SEQ ID NO: 1113023 - protein, 9 aa, Homo Sapiens
EGLYRIYSQ

SEQ ID NO: 1113024 - protein, 9 aa, Homo Sapiens
EDLEKGHQK

SEQ ID NO: 1113025 - protein, 9 aa, Homo Sapiens
WCGWTVAMK

SEQ ID NO: 1113026 - protein, 9 aa, Homo Sapiens
EDFEKTKGS

SEQ ID NO: 1113027 - protein, 9 aa, Homo Sapiens
ASVAEQVSA

SEQ ID NO: 1113028 - protein, 9 aa, Homo Sapiens
QSDEVLTII

SEQ ID NO: 1113029 - protein, 9 aa, Homo Sapiens
AAAAAASVA

SEQ ID NO: 1113030 - protein, 9 aa, Homo Sapiens
ARSWNTMQW

SEQ ID NO: 1113031 - protein, 9 aa, Homo Sapiens
YGTNNVQPP

SEQ ID NO: 1113032 - protein, 9 aa, Homo Sapiens
GENLYTCEE

SEQ ID NO: 1113033 - protein, 9 aa, Homo Sapiens
LPLEREDSG

SEQ ID NO: 1113034 - protein, 9 aa, Homo Sapiens
ESSSRKTVV

SEQ ID NO: 1113035 - protein, 9 aa, Homo Sapiens
WQTDLLQEE

SEQ ID NO: 1113036 - protein, 9 aa, Homo Sapiens
VRGDGCIVY

SEQ ID NO: 1113037 - protein, 9 aa, Homo Sapiens
GPVNPAAFR

SEQ ID NO: 1113038 - protein, 9 aa, Homo Sapiens
TADMGVGLA

SEQ ID NO: 1113039 - protein, 9 aa, Homo Sapiens
VALAHYSDK

SEQ ID NO: 1113040 - protein, 9 aa, Homo Sapiens
VVQLNLSWP

SEQ ID NO: 1113041 - protein, 9 aa, Homo Sapiens
TRLTVLQVV

SEQ ID NO: 1113042 - protein, 9 aa, Homo Sapiens
GSPRPLSVY

SEQ ID NO: 1113043 - protein, 9 aa, Homo Sapiens
CGHVNLHLK

SEQ ID NO: 1113044 - protein, 9 aa, Homo Sapiens
SPLQLLLHP

SEQ ID NO: 1113045 - protein, 9 aa, Homo Sapiens
LNNQACTIA

SEQ ID NO: 1113046 - protein, 9 aa, Homo Sapiens
ISRASTRLT

SEQ ID NO: 1113047 - protein, 9 aa, Homo Sapiens
VFFLYKCFQ

SEQ ID NO: 1113048 - protein, 9 aa, Homo Sapiens
MGVGLAGQE

SEQ ID NO: 1113049 - protein, 9 aa, Homo Sapiens
TSIHHGSPR

SEQ ID NO: 1113050 - protein, 9 aa, Homo Sapiens
SPRPLSVYP

SEQ ID NO: 1113051 - protein, 9 aa, Homo Sapiens
CCECEPYGG

SEQ ID NO: 1113052 - protein, 9 aa, Homo Sapiens
FEKTKGSGF

SEQ ID NO: 1113053 - protein, 9 aa, Homo Sapiens
KLERMYSKT

SEQ ID NO: 1113054 - protein, 9 aa, Homo Sapiens
PMARLPPGP

SEQ ID NO: 1113055 - protein, 9 aa, Homo Sapiens
LLSPLDSSP

SEQ ID NO: 1113056 - protein, 9 aa, Homo Sapiens
VNGGSCRQT

SEQ ID NO: 1113057 - protein, 9 aa, Homo Sapiens
LARSWNTMQ

SEQ ID NO: 1113058 - protein, 9 aa, Homo Sapiens
LAPFNTALT

SEQ ID NO: 1113059 - protein, 9 aa, Homo Sapiens
IINPINRKV

SEQ ID NO: 1113060 - protein, 9 aa, Homo Sapiens
YLTTEILEL

SEQ ID NO: 1113061 - protein, 9 aa, Homo Sapiens
TSTESISAR

SEQ ID NO: 1113062 - protein, 9 aa, Homo Sapiens
INRKVRALA

SEQ ID NO: 1113063 - protein, 9 aa, Homo Sapiens
NWKKMMIGS

SEQ ID NO: 1113064 - protein, 9 aa, Homo Sapiens
LSVSDGASN

SEQ ID NO: 1113065 - protein, 9 aa, Homo Sapiens
GAAATLLQS

SEQ ID NO: 1113066 - protein, 9 aa, Homo Sapiens
AFVLGNWQT

SEQ ID NO: 1113067 - protein, 9 aa, Homo Sapiens
VRKVRGDGC

SEQ ID NO: 1113068 - protein, 9 aa, Homo Sapiens
AQWRTKYKT

SEQ ID NO: 1113069 - protein, 9 aa, Homo Sapiens
SRHRAEALP

SEQ ID NO: 1113070 - protein, 9 aa, Homo Sapiens
TVGGMTYFY

SEQ ID NO: 1113071 - protein, 9 aa, Homo Sapiens
CVNGGSCRQ

SEQ ID NO: 1113072 - protein, 9 aa, Homo Sapiens
DSSPLQLLL

SEQ ID NO: 1113073 - protein, 9 aa, Homo Sapiens
KELRKCCDD

SEQ ID NO: 1113074 - protein, 9 aa, Homo Sapiens
RAEALPLER

SEQ ID NO: 1113075 - protein, 9 aa, Homo Sapiens
KTKGSGFTP

SEQ ID NO: 1113076 - protein, 9 aa, Homo Sapiens
EAWLLLLLS

SEQ ID NO: 1113077 - protein, 9 aa, Homo Sapiens
EYLTTEILE

SEQ ID NO: 1113078 - protein, 9 aa, Homo Sapiens
GGGSVAGSL

SEQ ID NO: 1113079 - protein, 9 aa, Homo Sapiens
RSGDLCDAQ

SEQ ID NO: 1113080 - protein, 9 aa, Homo Sapiens
ILQNKKKNC

SEQ ID NO: 1113081 - protein, 9 aa, Homo Sapiens
RTKYKTDAI

SEQ ID NO: 1113082 - protein, 9 aa, Homo Sapiens
LLLLSPLDS

SEQ ID NO: 1113083 - protein, 9 aa, Homo Sapiens
VPGVFSRSV

SEQ ID NO: 1113084 - protein, 9 aa, Homo Sapiens
QNAKNSWVP

SEQ ID NO: 1113085 - protein, 9 aa, Homo Sapiens
LAHYSDKLH

SEQ ID NO: 1113086 - protein, 9 aa, Homo Sapiens
LLLSPLDSS

SEQ ID NO: 1113087 - protein, 9 aa, Homo Sapiens
RRHLDFSPL

SEQ ID NO: 1113088 - protein, 9 aa, Homo Sapiens
PHGKRCNPC

SEQ ID NO: 1113089 - protein, 9 aa, Homo Sapiens
ARKVLPMSI

SEQ ID NO: 1113090 - protein, 9 aa, Homo Sapiens
GPNNSCIGA

SEQ ID NO: 1113091 - protein, 9 aa, Homo Sapiens
FPGIEKIRD

SEQ ID NO: 1113092 - protein, 9 aa, Homo Sapiens
QRICVARVL

SEQ ID NO: 1113093 - protein, 9 aa, Homo Sapiens
PKELRKCCD

SEQ ID NO: 1113094 - protein, 9 aa, Homo Sapiens
ENLYTCEEC

SEQ ID NO: 1113095 - protein, 9 aa, Homo Sapiens
KCGHVNLHL

SEQ ID NO: 1113096 - protein, 9 aa, Homo Sapiens
PLDSSPLQL

SEQ ID NO: 1113097 - protein, 9 aa, Homo Sapiens
GTNNVQPPQ

SEQ ID NO: 1113098 - protein, 9 aa, Homo Sapiens
KMNWKKMMI

SEQ ID NO: 1113099 - protein, 9 aa, Homo Sapiens
PINRKVRAL

SEQ ID NO: 1113100 - protein, 9 aa, Homo Sapiens
TRAPQKTKQ

SEQ ID NO: 1113101 - protein, 9 aa, Homo Sapiens
LREEVPGVF

SEQ ID NO: 1113102 - protein, 9 aa, Homo Sapiens
IELELGEAQ

SEQ ID NO: 1113103 - protein, 9 aa, Homo Sapiens
RASQGRGPV

SEQ ID NO: 1113104 - protein, 9 aa, Homo Sapiens
NNKKMAMTV

SEQ ID NO: 1113105 - protein, 9 aa, Homo Sapiens
SISARKVLP

SEQ ID NO: 1113106 - protein, 9 aa, Homo Sapiens
VSDGASNVE

SEQ ID NO: 1113107 - protein, 9 aa, Homo Sapiens
QQSKVEQKI

SEQ ID NO: 1113108 - protein, 9 aa, Homo Sapiens
WKMNWKKMM

SEQ ID NO: 1113109 - protein, 9 aa, Homo Sapiens
HGSPRPLSV

SEQ ID NO: 1113110 - protein, 9 aa, Homo Sapiens
RHLVKLVLG

SEQ ID NO: 1113111 - protein, 9 aa, Homo Sapiens
AGAHHCQYK

SEQ ID NO: 1113112 - protein, 9 aa, Homo Sapiens
SLSLKTPTK

SEQ ID NO: 1113113 - protein, 9 aa, Homo Sapiens
VNPAAFRPA

SEQ ID NO: 1113114 - protein, 9 aa, Homo Sapiens
VLTIIKAKA

SEQ ID NO: 1113115 - protein, 9 aa, Homo Sapiens
KTRAPQKTK

SEQ ID NO: 1113116 - protein, 9 aa, Homo Sapiens
APRPYQAPQ

SEQ ID NO: 1113117 - protein, 9 aa, Homo Sapiens
IQKETVGGM

SEQ ID NO: 1113118 - protein, 9 aa, Homo Sapiens
SAIRIGFVT

SEQ ID NO: 1113119 - protein, 9 aa, Homo Sapiens
PAAFRPAEL

SEQ ID NO: 1113120 - protein, 9 aa, Homo Sapiens
PLPPPQSSP

SEQ ID NO: 1113121 - protein, 9 aa, Homo Sapiens
QKISRVSSA

SEQ ID NO: 1113122 - protein, 9 aa, Homo Sapiens
AYGTNNVQP

SEQ ID NO: 1113123 - protein, 9 aa, Homo Sapiens
HHCQYKLTY

SEQ ID NO: 1113124 - protein, 9 aa, Homo Sapiens
KYKTDAIQR

SEQ ID NO: 1113125 - protein, 9 aa, Homo Sapiens
PGIEKIRDD

SEQ ID NO: 1113126 - protein, 9 aa, Homo Sapiens
EEDLEKGHQ

SEQ ID NO: 1113127 - protein, 9 aa, Homo Sapiens
NPCCRLTWM

SEQ ID NO: 1113128 - protein, 9 aa, Homo Sapiens
LRFPGIEKI

SEQ ID NO: 1113129 - protein, 9 aa, Homo Sapiens
MPVVVEGAG

SEQ ID NO: 1113130 - protein, 9 aa, Homo Sapiens
KKKNCSFPA

SEQ ID NO: 1113131 - protein, 9 aa, Homo Sapiens
HNLVNLSVS

SEQ ID NO: 1113132 - protein, 9 aa, Homo Sapiens
SDEVLTIIK

SEQ ID NO: 1113133 - protein, 9 aa, Homo Sapiens
HLDFSPLLP

SEQ ID NO: 1113134 - protein, 9 aa, Homo Sapiens
FLAFVLGNW

SEQ ID NO: 1113135 - protein, 9 aa, Homo Sapiens
AVLEYLTTE

SEQ ID NO: 1113136 - protein, 9 aa, Homo Sapiens
LPVTIPSAV

SEQ ID NO: 1113137 - protein, 9 aa, Homo Sapiens
QWNNKKMAM

SEQ ID NO: 1113138 - protein, 9 aa, Homo Sapiens
ESAIRIGFV

SEQ ID NO: 1113139 - protein, 9 aa, Homo Sapiens
QLLLHPHGK

SEQ ID NO: 1113140 - protein, 9 aa, Homo Sapiens
PEGQPSPEG

SEQ ID NO: 1113141 - protein, 9 aa, Homo Sapiens
EAGLDSEAE

SEQ ID NO: 1113142 - protein, 9 aa, Homo Sapiens
GSGFTPVVD

SEQ ID NO: 1113143 - protein, 9 aa, Homo Sapiens
PQRESSSRK

SEQ ID NO: 1113144 - protein, 9 aa, Homo Sapiens
MSQQLKKWA

SEQ ID NO: 1113145 - protein, 9 aa, Homo Sapiens
FECKVSGKP

SEQ ID NO: 1113146 - protein, 9 aa, Homo Sapiens
QPPQHVVGN

SEQ ID NO: 1113147 - protein, 9 aa, Homo Sapiens
IPSAVSTGH

SEQ ID NO: 1113148 - protein, 9 aa, Homo Sapiens
SHYIMPVVV

SEQ ID NO: 1113149 - protein, 9 aa, Homo Sapiens
VARVLYQNT

SEQ ID NO: 1113150 - protein, 9 aa, Homo Sapiens
PRAIINPIN

SEQ ID NO: 1113151 - protein, 9 aa, Homo Sapiens
PSPEGCLCP

SEQ ID NO: 1113152 - protein, 9 aa, Homo Sapiens
VKTVQQDEI

SEQ ID NO: 1113153 - protein, 9 aa, Homo Sapiens
LVNLSVSDG

SEQ ID NO: 1113154 - protein, 9 aa, Homo Sapiens
AAAAASVAE

SEQ ID NO: 1113155 - protein, 9 aa, Homo Sapiens
IGPNNSCIG

SEQ ID NO: 1113156 - protein, 9 aa, Homo Sapiens
GCIVYLDGD

SEQ ID NO: 1113157 - protein, 9 aa, Homo Sapiens
NKKKNCSFP

SEQ ID NO: 1113158 - protein, 9 aa, Homo Sapiens
KTVQQDEIV

SEQ ID NO: 1113159 - protein, 9 aa, Homo Sapiens
CCDDGMREN

SEQ ID NO: 1113160 - protein, 9 aa, Homo Sapiens
SYVRHLVKL

SEQ ID NO: 1113161 - protein, 9 aa, Homo Sapiens
AEAGLDSEA

SEQ ID NO: 1113162 - protein, 9 aa, Homo Sapiens
NQACTIAFL

SEQ ID NO: 1113163 - protein, 9 aa, Homo Sapiens
NLSWPIEEQ

SEQ ID NO: 1113164 - protein, 9 aa, Homo Sapiens
FSSDLADIT

SEQ ID NO: 1113165 - protein, 9 aa, Homo Sapiens
LLLLVFFLY

SEQ ID NO: 1113166 - protein, 9 aa, Homo Sapiens
KETVGGMTY

SEQ ID NO: 1113167 - protein, 9 aa, Homo Sapiens
AMTVIAGAH

SEQ ID NO: 1113168 - protein, 9 aa, Homo Sapiens
YRVALAHYS

SEQ ID NO: 1113169 - protein, 9 aa, Homo Sapiens
LNLSWPIEE

SEQ ID NO: 1113170 - protein, 9 aa, Homo Sapiens
LYVQETCLL

SEQ ID NO: 1113171 - protein, 9 aa, Homo Sapiens
SVAEQVSAA

SEQ ID NO: 1113172 - protein, 9 aa, Homo Sapiens
ECEPYGGSG

SEQ ID NO: 1113173 - protein, 9 aa, Homo Sapiens
FVTGLLLHK

SEQ ID NO: 1113174 - protein, 9 aa, Homo Sapiens
HQVKTVQQD

SEQ ID NO: 1113175 - protein, 9 aa, Homo Sapiens
QISRASTRL

SEQ ID NO: 1113176 - protein, 9 aa, Homo Sapiens
IGFVTYNKV

SEQ ID NO: 1113177 - protein, 9 aa, Homo Sapiens
RKLKFSLQF

SEQ ID NO: 1113178 - protein, 9 aa, Homo Sapiens
EVATTNDHG

SEQ ID NO: 1113179 - protein, 9 aa, Homo Sapiens
CECEPYGGS

SEQ ID NO: 1113180 - protein, 9 aa, Homo Sapiens
SSPFLARSW

SEQ ID NO: 1113181 - protein, 9 aa, Homo Sapiens
PDCCECEPY

SEQ ID NO: 1113182 - protein, 9 aa, Homo Sapiens
VRHLVKLVL

SEQ ID NO: 1113183 - protein, 9 aa, Homo Sapiens
RESSSRKTV

SEQ ID NO: 1113184 - protein, 9 aa, Homo Sapiens
AAVLEYLTT

SEQ ID NO: 1113185 - protein, 9 aa, Homo Sapiens
SWNTMQWNN

SEQ ID NO: 1113186 - protein, 9 aa, Homo Sapiens
AVGAPRPYQ

SEQ ID NO: 1113187 - protein, 9 aa, Homo Sapiens
NGGSCRQTG

SEQ ID NO: 1113188 - protein, 9 aa, Homo Sapiens
IHTGENLYT

SEQ ID NO: 1113189 - protein, 9 aa, Homo Sapiens
SSEFPVRLG

SEQ ID NO: 1113190 - protein, 9 aa, Homo Sapiens
QQDEIVRGD

SEQ ID NO: 1113191 - protein, 9 aa, Homo Sapiens
APFNTALTL

SEQ ID NO: 1113192 - protein, 9 aa, Homo Sapiens
QGSPVEVAT

SEQ ID NO: 1113193 - protein, 9 aa, Homo Sapiens
SLKTPTKCL

SEQ ID NO: 1113194 - protein, 9 aa, Homo Sapiens
LGNWQTDLL

SEQ ID NO: 1113195 - protein, 9 aa, Homo Sapiens
RRYDKCGHV

SEQ ID NO: 1113196 - protein, 9 aa, Homo Sapiens
PPMARLPPG

SEQ ID NO: 1113197 - protein, 9 aa, Homo Sapiens
VVPSEGLYR

SEQ ID NO: 1113198 - protein, 9 aa, Homo Sapiens
SWPIEEQGP

SEQ ID NO: 1113199 - protein, 9 aa, Homo Sapiens
ALHKKTRAP

SEQ ID NO: 1113200 - protein, 9 aa, Homo Sapiens
LRKCCDDGM

SEQ ID NO: 1113201 - protein, 9 aa, Homo Sapiens
MDIEFECKV

SEQ ID NO: 1113202 - protein, 9 aa, Homo Sapiens
FKISKRSDD

SEQ ID NO: 1113203 - protein, 9 aa, Homo Sapiens
VQLERSAIS

SEQ ID NO: 1113204 - protein, 9 aa, Homo Sapiens
AHHCQYKLT

SEQ ID NO: 1113205 - protein, 9 aa, Homo Sapiens
LERMYSKTN

SEQ ID NO: 1113206 - protein, 9 aa, Homo Sapiens
PNNSCIGAP

SEQ ID NO: 1113207 - protein, 9 aa, Homo Sapiens
NKKMAMTVI

SEQ ID NO: 1113208 - protein, 9 aa, Homo Sapiens
MEGPVSLSE

SEQ ID NO: 1113209 - protein, 9 aa, Homo Sapiens
MTVIAGAHH

SEQ ID NO: 1113210 - protein, 9 aa, Homo Sapiens
ELELGEAQV

SEQ ID NO: 1113211 - protein, 9 aa, Homo Sapiens
LYRIYSQVL

SEQ ID NO: 1113212 - protein, 9 aa, Homo Sapiens
YMFEGGGSV

SEQ ID NO: 1113213 - protein, 9 aa, Homo Sapiens
MIKTADMGV

SEQ ID NO: 1113214 - protein, 9 aa, Homo Sapiens
QSSPFLARS

SEQ ID NO: 1113215 - protein, 9 aa, Homo Sapiens
RVALAHYSD

SEQ ID NO: 1113216 - protein, 9 aa, Homo Sapiens
PPPQSSPFL

SEQ ID NO: 1113217 - protein, 9 aa, Homo Sapiens
EVLTIIKAK

SEQ ID NO: 1113218 - protein, 9 aa, Homo Sapiens
NTMQWNNKK

SEQ ID NO: 1113219 - protein, 9 aa, Homo Sapiens
MNWKKMMIG

SEQ ID NO: 1113220 - protein, 9 aa, Homo Sapiens
DKCGHVNLH

SEQ ID NO: 1113221 - protein, 9 aa, Homo Sapiens
IEFSSDLAD

SEQ ID NO: 1113222 - protein, 9 aa, Homo Sapiens
LKLERMYSK

SEQ ID NO: 1113223 - protein, 9 aa, Homo Sapiens
SPEGCLCPC

SEQ ID NO: 1113224 - protein, 9 aa, Homo Sapiens
VRLGVYLEE

SEQ ID NO: 1113225 - protein, 9 aa, Homo Sapiens
RIYSQVLFK

SEQ ID NO: 1113226 - protein, 9 aa, Homo Sapiens
SLEAIELEL

SEQ ID NO: 1113227 - protein, 9 aa, Homo Sapiens
WNTMQWNNK

SEQ ID NO: 1113228 - protein, 9 aa, Homo Sapiens
INMIKTADM

SEQ ID NO: 1113229 - protein, 9 aa, Homo Sapiens
GAPRPYQAP

SEQ ID NO: 1113230 - protein, 9 aa, Homo Sapiens
TEEDLEKGH

SEQ ID NO: 1113231 - protein, 9 aa, Homo Sapiens
DRLNNQACT

SEQ ID NO: 1113232 - protein, 9 aa, Homo Sapiens
IGSQHLLFE

SEQ ID NO: 1113233 - protein, 9 aa, Homo Sapiens
RYDKCGHVN

SEQ ID NO: 1113234 - protein, 9 aa, Homo Sapiens
SSSRKTVVQ

SEQ ID NO: 1113235 - protein, 9 aa, Homo Sapiens
CALHKKTRA

SEQ ID NO: 1113236 - protein, 9 aa, Homo Sapiens
PCALHKKTR

SEQ ID NO: 1113237 - protein, 9 aa, Homo Sapiens
EDRLNNQAC

SEQ ID NO: 1113238 - protein, 9 aa, Homo Sapiens
SDGASNVEL

SEQ ID NO: 1113239 - protein, 9 aa, Homo Sapiens
KCLLTPLPP

SEQ ID NO: 1113240 - protein, 9 aa, Homo Sapiens
KLKFSLQFI

SEQ ID NO: 1113241 - protein, 9 aa, Homo Sapiens
STRLTVLQV

SEQ ID NO: 1113242 - protein, 9 aa, Homo Sapiens
KKMMIGSQH

SEQ ID NO: 1113243 - protein, 9 aa, Homo Sapiens
NAKNSWVPY

SEQ ID NO: 1113244 - protein, 9 aa, Homo Sapiens
EGCLCPCSL

SEQ ID NO: 1113245 - protein, 9 aa, Homo Sapiens
INPINRKVR

SEQ ID NO: 1113246 - protein, 9 aa, Homo Sapiens
GAHHCQYKL

SEQ ID NO: 1113247 - protein, 9 aa, Homo Sapiens
VVEGAGAAE

SEQ ID NO: 1113248 - protein, 9 aa, Homo Sapiens
TGQISRAST

SEQ ID NO: 1113249 - protein, 9 aa, Homo Sapiens
IHHGSPRPL

SEQ ID NO: 1113250 - protein, 9 aa, Homo Sapiens
GLYRIYSQV

SEQ ID NO: 1113251 - protein, 9 aa, Homo Sapiens
MAMTVIAGA

SEQ ID NO: 1113252 - protein, 9 aa, Homo Sapiens
VEVATTNDH

SEQ ID NO: 1113253 - protein, 9 aa, Homo Sapiens
RVDRLLDLY

SEQ ID NO: 1113254 - protein, 9 aa, Homo Sapiens
LKTPTKCLL

SEQ ID NO: 1113255 - protein, 9 aa, Homo Sapiens
HKKTRAPQK

SEQ ID NO: 1113256 - protein, 9 aa, Homo Sapiens
CIGAPSPGP

SEQ ID NO: 1113257 - protein, 9 aa, Homo Sapiens
YYVHQNAKN

SEQ ID NO: 1113258 - protein, 9 aa, Homo Sapiens
AFPYSATPL

SEQ ID NO: 1113259 - protein, 9 aa, Homo Sapiens
SQHLLFEAW

SEQ ID NO: 1113260 - protein, 9 aa, Homo Sapiens
LGVYLEEED

SEQ ID NO: 1113261 - protein, 9 aa, Homo Sapiens
MLDVEEDRR

SEQ ID NO: 1113262 - protein, 9 aa, Homo Sapiens
AGLDSEAEQ

SEQ ID NO: 1113263 - protein, 9 aa, Homo Sapiens
DCCECEPYG

SEQ ID NO: 1113264 - protein, 9 aa, Homo Sapiens
SFSYVRHLV

SEQ ID NO: 1113265 - protein, 9 aa, Homo Sapiens
EAIELELGE

SEQ ID NO: 1113266 - protein, 9 aa, Homo Sapiens
FPVRLGVYL

SEQ ID NO: 1113267 - protein, 9 aa, Homo Sapiens
MARLPPGPP

SEQ ID NO: 1113268 - protein, 9 aa, Homo Sapiens
VATTNDHGK

SEQ ID NO: 1113269 - protein, 9 aa, Homo Sapiens
SNRSGDLCD

SEQ ID NO: 1113270 - protein, 9 aa, Homo Sapiens
PHDRVDRLL

SEQ ID NO: 1113271 - protein, 9 aa, Homo Sapiens
AKNSWVPYE

SEQ ID NO: 1113272 - protein, 9 aa, Homo Sapiens
CSACLETFG

SEQ ID NO: 1113273 - protein, 9 aa, Homo Sapiens
EGPVSLSEE

SEQ ID NO: 1113274 - protein, 9 aa, Homo Sapiens
TGCTLRFPG

SEQ ID NO: 1113275 - protein, 9 aa, Homo Sapiens
VLEYLTTEI

SEQ ID NO: 1113276 - protein, 9 aa, Homo Sapiens
EAPRRHLDF

SEQ ID NO: 1113277 - protein, 9 aa, Homo Sapiens
QQLKKWAKT

SEQ ID NO: 1113278 - protein, 9 aa, Homo Sapiens
RICVARVLY

SEQ ID NO: 1113279 - protein, 9 aa, Homo Sapiens
ACTIAFLLE

SEQ ID NO: 1113280 - protein, 9 aa, Homo Sapiens
QMEGPVSLS

SEQ ID NO: 1113281 - protein, 9 aa, Homo Sapiens
LSPLDSSPL

SEQ ID NO: 1113282 - protein, 9 aa, Homo Sapiens
LQLLLHPHG

SEQ ID NO: 1113283 - protein, 9 aa, Homo Sapiens
SATPLGTSI

SEQ ID NO: 1113284 - protein, 9 aa, Homo Sapiens
AHYSDKLHS

SEQ ID NO: 1113285 - protein, 9 aa, Homo Sapiens
GKRCNPCCR

SEQ ID NO: 1113286 - protein, 9 aa, Homo Sapiens
MQWNNKKMA

SEQ ID NO: 1113287 - protein, 9 aa, Homo Sapiens
PEAPRRHLD

SEQ ID NO: 1113288 - protein, 9 aa, Homo Sapiens
ECSACLETF

SEQ ID NO: 1113289 - protein, 9 aa, Homo Sapiens
KMAMTVIAG

SEQ ID NO: 1113290 - protein, 9 aa, Homo Sapiens
RLKLERMYS

SEQ ID NO: 1113291 - protein, 9 aa, Homo Sapiens
CHVMQVFPV

SEQ ID NO: 1113292 - protein, 9 aa, Homo Sapiens
HKPNTYPKM

SEQ ID NO: 1113293 - protein, 9 aa, Homo Sapiens
LTTEILELA

SEQ ID NO: 1113294 - protein, 9 aa, Homo Sapiens
LLVFFLYKC

SEQ ID NO: 1113295 - protein, 9 aa, Homo Sapiens
LSLKTPTKC

SEQ ID NO: 1113296 - protein, 9 aa, Homo Sapiens
ELGEAQVIL

SEQ ID NO: 1113297 - protein, 9 aa, Homo Sapiens
AECSACLET

SEQ ID NO: 1113298 - protein, 9 aa, Homo Sapiens
VNLSVSDGA

SEQ ID NO: 1113299 - protein, 9 aa, Homo Sapiens
SMDIEFECK

SEQ ID NO: 1113300 - protein, 9 aa, Homo Sapiens
HGKRCNPCC

SEQ ID NO: 1113301 - protein, 9 aa, Homo Sapiens
GLDSEAEQN

SEQ ID NO: 1113302 - protein, 9 aa, Homo Sapiens
EEDRRASQG

SEQ ID NO: 1113303 - protein, 9 aa, Homo Sapiens
TKGSGFTPV

SEQ ID NO: 1113304 - protein, 9 aa, Homo Sapiens
TNNVQPPQH

SEQ ID NO: 1113305 - protein, 9 aa, Homo Sapiens
SSPLQLLLH

SEQ ID NO: 1113306 - protein, 9 aa, Homo Sapiens
DMGVGLAGQ

SEQ ID NO: 1113307 - protein, 9 aa, Homo Sapiens
FEAWLLLLL

SEQ ID NO: 1113308 - protein, 9 aa, Homo Sapiens
DVEEDRRAS

SEQ ID NO: 1113309 - protein, 9 aa, Homo Sapiens
CQYKLTYTK

SEQ ID NO: 1113310 - protein, 9 aa, Homo Sapiens
VWKMNWKKM

SEQ ID NO: 1113311 - protein, 9 aa, Homo Sapiens
TKYKTDAIQ

SEQ ID NO: 1113312 - protein, 9 aa, Homo Sapiens
LELGEAQVI

SEQ ID NO: 1113313 - protein, 9 aa, Homo Sapiens
HYIMPVVVE

SEQ ID NO: 1113314 - protein, 9 aa, Homo Sapiens
KVRGDGCIV

SEQ ID NO: 1113315 - protein, 9 aa, Homo Sapiens
ILLLLVFFL

SEQ ID NO: 1113316 - protein, 9 aa, Homo Sapiens
CGWTVAMKN

SEQ ID NO: 1113317 - protein, 9 aa, Homo Sapiens
PRRHLDFSP

SEQ ID NO: 1113318 - protein, 9 aa, Homo Sapiens
TPTKCLLTP

SEQ ID NO: 1113319 - protein, 9 aa, Homo Sapiens
SKRSDDWLG

SEQ ID NO: 1113320 - protein, 9 aa, Homo Sapiens
HYSDKLHSE

SEQ ID NO: 1113321 - protein, 9 aa, Homo Sapiens
AEESAIRIG

SEQ ID NO: 1113322 - protein, 9 aa, Homo Sapiens
TYMFEGGGS

SEQ ID NO: 1113323 - protein, 9 aa, Homo Sapiens
PVTIPSAVS

SEQ ID NO: 1113324 - protein, 9 aa, Homo Sapiens
RMYSKTNTS

SEQ ID NO: 1113325 - protein, 9 aa, Homo Sapiens
NVPLPPPQS

SEQ ID NO: 1113326 - protein, 9 aa, Homo Sapiens
KYRVALAHY

SEQ ID NO: 1113327 - protein, 9 aa, Homo Sapiens
RAECSACLE

SEQ ID NO: 1113328 - protein, 9 aa, Homo Sapiens
KVSGKPVPT

SEQ ID NO: 1113329 - protein, 9 aa, Homo Sapiens
PLGTSISSL

SEQ ID NO: 1113330 - protein, 9 aa, Homo Sapiens
EALPLERED

SEQ ID NO: 1113331 - protein, 9 aa, Homo Sapiens
LHKKTRAPQ

SEQ ID NO: 1113332 - protein, 9 aa, Homo Sapiens
TLRCHVMQV

SEQ ID NO: 1113333 - protein, 9 aa, Homo Sapiens
VQPPQHVVG

SEQ ID NO: 1113334 - protein, 9 aa, Homo Sapiens
AFYRKLKFS

SEQ ID NO: 1113335 - protein, 9 aa, Homo Sapiens
DEIVRGDVR

SEQ ID NO: 1113336 - protein, 9 aa, Homo Sapiens
TGLLLHKPN

SEQ ID NO: 1113337 - protein, 9 aa, Homo Sapiens
CILLLLVFF

SEQ ID NO: 1113338 - protein, 9 aa, Homo Sapiens
GLLFGAAAT

SEQ ID NO: 1113339 - protein, 9 aa, Homo Sapiens
YRKLKFSLQ

SEQ ID NO: 1113340 - protein, 9 aa, Homo Sapiens
PLQLLLHPH

SEQ ID NO: 1113341 - protein, 9 aa, Homo Sapiens
LLCHCHLKN

SEQ ID NO: 1113342 - protein, 9 aa, Homo Sapiens
WLLLLLSPL

SEQ ID NO: 1113343 - protein, 9 aa, Homo Sapiens
GNWQTDLLQ

SEQ ID NO: 1113344 - protein, 9 aa, Homo Sapiens
CNPCCRLTW

SEQ ID NO: 1113345 - protein, 9 aa, Homo Sapiens
TTEILELAG

SEQ ID NO: 1113346 - protein, 9 aa, Homo Sapiens
SVSDGASNV

SEQ ID NO: 1113347 - protein, 9 aa, Homo Sapiens
VLGNWQTDL

SEQ ID NO: 1113348 - protein, 9 aa, Homo Sapiens
GGMTYFYTD

SEQ ID NO: 1113349 - protein, 9 aa, Homo Sapiens
FEGGGSVAG

SEQ ID NO: 1113350 - protein, 9 aa, Homo Sapiens
ICILLLLVF

SEQ ID NO: 1113351 - protein, 9 aa, Homo Sapiens
TICRLKLER

SEQ ID NO: 1113352 - protein, 9 aa, Homo Sapiens
KTPTKCLLT

SEQ ID NO: 1113353 - protein, 9 aa, Homo Sapiens
TPLGTSISS

SEQ ID NO: 1113354 - protein, 9 aa, Homo Sapiens
MMIGSQHLL

SEQ ID NO: 1113355 - protein, 9 aa, Homo Sapiens
SPFLARSWN

SEQ ID NO: 1113356 - protein, 9 aa, Homo Sapiens
PRPYQAPQQ

SEQ ID NO: 1113357 - protein, 9 aa, Homo Sapiens
LEKGHQKLE

SEQ ID NO: 1113358 - protein, 9 aa, Homo Sapiens
QSRHRAEAL

SEQ ID NO: 1113359 - protein, 9 aa, Homo Sapiens
GSQHLLFEA

SEQ ID NO: 1113360 - protein, 9 aa, Homo Sapiens
VGPVNPAAF

SEQ ID NO: 1113361 - protein, 9 aa, Homo Sapiens
EILQNKKKN

SEQ ID NO: 1113362 - protein, 9 aa, Homo Sapiens
GGSCRQTGD

SEQ ID NO: 1113363 - protein, 9 aa, Homo Sapiens
PSAVSTGHT

SEQ ID NO: 1113364 - protein, 9 aa, Homo Sapiens
NPQRESSSR

SEQ ID NO: 1113365 - protein, 9 aa, Homo Sapiens
VTIPSAVST

SEQ ID NO: 1113366 - protein, 9 aa, Homo Sapiens
FVLGNWQTD

SEQ ID NO: 1113367 - protein, 9 aa, Homo Sapiens
GQISRASTR

SEQ ID NO: 1113368 - protein, 9 aa, Homo Sapiens
GWRARAECS

SEQ ID NO: 1113369 - protein, 9 aa, Homo Sapiens
MIGSQHLLF

SEQ ID NO: 1113370 - protein, 9 aa, Homo Sapiens
CDDGMRENP

SEQ ID NO: 1113371 - protein, 9 aa, Homo Sapiens
GDGCIVYLD

SEQ ID NO: 1113372 - protein, 9 aa, Homo Sapiens
SARKVLPMS

SEQ ID NO: 1113373 - protein, 9 aa, Homo Sapiens
ISARKVLPM

SEQ ID NO: 1113374 - protein, 9 aa, Homo Sapiens
PYSATPLGT

SEQ ID NO: 1113375 - protein, 9 aa, Homo Sapiens
GLLLHKPNT

SEQ ID NO: 1113376 - protein, 9 aa, Homo Sapiens
CSFPAFYRK

SEQ ID NO: 1113377 - protein, 9 aa, Homo Sapiens
PSEGLYRIY

SEQ ID NO: 1113378 - protein, 9 aa, Homo Sapiens
ATPLGTSIS

SEQ ID NO: 1113379 - protein, 9 aa, Homo Sapiens
VQQDEIVRG

SEQ ID NO: 1113380 - protein, 9 aa, Homo Sapiens
SCRQTGDFT

SEQ ID NO: 1113381 - protein, 9 aa, Homo Sapiens
RLPPGPPMA

SEQ ID NO: 1113382 - protein, 9 aa, Homo Sapiens
AAATLLQSP

SEQ ID NO: 1113383 - protein, 9 aa, Homo Sapiens
TLRFPGIEK

SEQ ID NO: 1113384 - protein, 9 aa, Homo Sapiens
TYTKVWKMN

SEQ ID NO: 1113385 - protein, 9 aa, Homo Sapiens
LCDAQKSIP

SEQ ID NO: 1113386 - protein, 9 aa, Homo Sapiens
CTIAFLLEQ

SEQ ID NO: 1113387 - protein, 9 aa, Homo Sapiens
LLLVFFLYK

SEQ ID NO: 1113388 - protein, 9 aa, Homo Sapiens
PVSLSEEAF

SEQ ID NO: 1113389 - protein, 9 aa, Homo Sapiens
TKCLLTPLP

SEQ ID NO: 1113390 - protein, 9 aa, Homo Sapiens
PQSSPFLAR

SEQ ID NO: 1113391 - protein, 9 aa, Homo Sapiens
IEFECKVSG

SEQ ID NO: 1113392 - protein, 9 aa, Homo Sapiens
ARVLYQNTN

SEQ ID NO: 1113393 - protein, 9 aa, Homo Sapiens
VEEDRRASQ

SEQ ID NO: 1113394 - protein, 9 aa, Homo Sapiens
QDEIVRGDV

SEQ ID NO: 1113395 - protein, 9 aa, Homo Sapiens
NGIEFSSDL

SEQ ID NO: 1113396 - protein, 9 aa, Homo Sapiens
LFEAWLLLL

SEQ ID NO: 1113397 - protein, 9 aa, Homo Sapiens
TVQQDEIVR

SEQ ID NO: 1113398 - protein, 9 aa, Homo Sapiens
DKYRVALAH

SEQ ID NO: 1113399 - protein, 9 aa, Homo Sapiens
ARLPPGPPM

SEQ ID NO: 1113400 - protein, 9 aa, Homo Sapiens
KMMIGSQHL

SEQ ID NO: 1113401 - protein, 9 aa, Homo Sapiens
LHKPNTYPK

SEQ ID NO: 1113402 - protein, 9 aa, Homo Sapiens
YIMPVVVEG

SEQ ID NO: 1113403 - protein, 9 aa, Homo Sapiens
LQTYMFEGG

SEQ ID NO: 1113404 - protein, 9 aa, Homo Sapiens
RGDGCIVYL

SEQ ID NO: 1113405 - protein, 9 aa, Homo Sapiens
KKWAKTRHQ

SEQ ID NO: 1113406 - protein, 9 aa, Homo Sapiens
NRSGDLCDA

SEQ ID NO: 1113407 - protein, 9 aa, Homo Sapiens
TMQWNNKKM

SEQ ID NO: 1113408 - protein, 9 aa, Homo Sapiens
QACTIAFLL

SEQ ID NO: 1113409 - protein, 9 aa, Homo Sapiens
APSFSYVRH

SEQ ID NO: 1113410 - protein, 9 aa, Homo Sapiens
KGSGFTPVV

SEQ ID NO: 1113411 - protein, 9 aa, Homo Sapiens
DEVLTIIKA

SEQ ID NO: 1113412 - protein, 9 aa, Homo Sapiens
YTLRCHVMQ

SEQ ID NO: 1113413 - protein, 9 aa, Homo Sapiens
HDRVDRLLD

SEQ ID NO: 1113414 - protein, 9 aa, Homo Sapiens
HRAEALPLE

SEQ ID NO: 1113415 - protein, 9 aa, Homo Sapiens
LKRTEEDLE

SEQ ID NO: 1113416 - protein, 9 aa, Homo Sapiens
GDLCDAQKS

SEQ ID NO: 1113417 - protein, 9 aa, Homo Sapiens
VPLPPPQSS

SEQ ID NO: 1113418 - protein, 9 aa, Homo Sapiens
RGLADGWCG

SEQ ID NO: 1113419 - protein, 9 aa, Homo Sapiens
AWLLLLLSP

SEQ ID NO: 1113420 - protein, 9 aa, Homo Sapiens
CRLKLERMY

SEQ ID NO: 1113421 - protein, 9 aa, Homo Sapiens
PGVPHDRVD

SEQ ID NO: 1113422 - protein, 9 aa, Homo Sapiens
SHFKISKRS

SEQ ID NO: 1113423 - protein, 9 aa, Homo Sapiens
IKTADMGVG

SEQ ID NO: 1113424 - protein, 9 aa, Homo Sapiens
LLFEAWLLL

SEQ ID NO: 1113425 - protein, 9 aa, Homo Sapiens
RHLDFSPLL

SEQ ID NO: 1113426 - protein, 9 aa, Homo Sapiens
ELRKCCDDG

SEQ ID NO: 1113427 - protein, 9 aa, Homo Sapiens
LDSSPLQLL

SEQ ID NO: 1113428 - protein, 9 aa, Homo Sapiens
AAGRLATLL

SEQ ID NO: 1113429 - protein, 9 aa, Homo Sapiens
EQKKKSWDF

SEQ ID NO: 1113430 - protein, 9 aa, Homo Sapiens
SSPSGTMMD

SEQ ID NO: 1113431 - protein, 9 aa, Homo Sapiens
VVKDVATGK

SEQ ID NO: 1113432 - protein, 9 aa, Homo Sapiens
AHLPQRHLQ

SEQ ID NO: 1113433 - protein, 9 aa, Homo Sapiens
FPTLIKKLS

SEQ ID NO: 1113434 - protein, 9 aa, Homo Sapiens
RAKDLSKWS

SEQ ID NO: 1113435 - protein, 9 aa, Homo Sapiens
CKHAESMET

SEQ ID NO: 1113436 - protein, 9 aa, Homo Sapiens
KASPDYLEI

SEQ ID NO: 1113437 - protein, 9 aa, Homo Sapiens
VQLEQDEYA

SEQ ID NO: 1113438 - protein, 9 aa, Homo Sapiens
RSQLEESVG

SEQ ID NO: 1113439 - protein, 9 aa, Homo Sapiens
EEVGEERAG

SEQ ID NO: 1113440 - protein, 9 aa, Homo Sapiens
SDKTAMLTL

SEQ ID NO: 1113441 - protein, 9 aa, Homo Sapiens
VIGVSSALV

SEQ ID NO: 1113442 - protein, 9 aa, Homo Sapiens
GLNTTVPSV

SEQ ID NO: 1113443 - protein, 9 aa, Homo Sapiens
HDFRNQVYS

SEQ ID NO: 1113444 - protein, 9 aa, Homo Sapiens
HTYNNITCA

SEQ ID NO: 1113445 - protein, 9 aa, Homo Sapiens
VVFAVDVKE

SEQ ID NO: 1113446 - protein, 9 aa, Homo Sapiens
GRFSQVSTM

SEQ ID NO: 1113447 - protein, 9 aa, Homo Sapiens
FNWHHGVFV

SEQ ID NO: 1113448 - protein, 9 aa, Homo Sapiens
PSRGWLSTT

SEQ ID NO: 1113449 - protein, 9 aa, Homo Sapiens
TPPPLILWP

SEQ ID NO: 1113450 - protein, 9 aa, Homo Sapiens
LAQHPAPAN

SEQ ID NO: 1113451 - protein, 9 aa, Homo Sapiens
LLLRHERGA

SEQ ID NO: 1113452 - protein, 9 aa, Homo Sapiens
EIKASPDYL

SEQ ID NO: 1113453 - protein, 9 aa, Homo Sapiens
VFWSTADIG

SEQ ID NO: 1113454 - protein, 9 aa, Homo Sapiens
RSLPTEKPP

SEQ ID NO: 1113455 - protein, 9 aa, Homo Sapiens
HMLAFRVSI

SEQ ID NO: 1113456 - protein, 9 aa, Homo Sapiens
SLSQYGGSE

SEQ ID NO: 1113457 - protein, 9 aa, Homo Sapiens
PVGPPKSPC

SEQ ID NO: 1113458 - protein, 9 aa, Homo Sapiens
ATCFLLSPG

SEQ ID NO: 1113459 - protein, 9 aa, Homo Sapiens
HTTYARPEP

SEQ ID NO: 1113460 - protein, 9 aa, Homo Sapiens
AICYIESLQ

SEQ ID NO: 1113461 - protein, 9 aa, Homo Sapiens
NYMYDEDEY

SEQ ID NO: 1113462 - protein, 9 aa, Homo Sapiens
NNTPVRYTV

SEQ ID NO: 1113463 - protein, 9 aa, Homo Sapiens
EKGGGLSRG

SEQ ID NO: 1113464 - protein, 9 aa, Homo Sapiens
AMHKAVLTI

SEQ ID NO: 1113465 - protein, 9 aa, Homo Sapiens
GQWADSHAN

SEQ ID NO: 1113466 - protein, 9 aa, Homo Sapiens
TIHDFRNQV

SEQ ID NO: 1113467 - protein, 9 aa, Homo Sapiens
ESDKTAMLT

SEQ ID NO: 1113468 - protein, 9 aa, Homo Sapiens
SLWAIRVYM

SEQ ID NO: 1113469 - protein, 9 aa, Homo Sapiens
EKMGYNISQ

SEQ ID NO: 1113470 - protein, 9 aa, Homo Sapiens
EEAEPAARA

SEQ ID NO: 1113471 - protein, 9 aa, Homo Sapiens
ARTSCKDDK

SEQ ID NO: 1113472 - protein, 9 aa, Homo Sapiens
DVAGGPGHT

SEQ ID NO: 1113473 - protein, 9 aa, Homo Sapiens
EQDEYAKHI

SEQ ID NO: 1113474 - protein, 9 aa, Homo Sapiens
KTAMLTLIR

SEQ ID NO: 1113475 - protein, 9 aa, Homo Sapiens
EDILSKGQH

SEQ ID NO: 1113476 - protein, 9 aa, Homo Sapiens
ADVYKLDKQ

SEQ ID NO: 1113477 - protein, 9 aa, Homo Sapiens
GRGGHGADA

SEQ ID NO: 1113478 - protein, 9 aa, Homo Sapiens
RLEDYGRYS

SEQ ID NO: 1113479 - protein, 9 aa, Homo Sapiens
RDPLSKITE

SEQ ID NO: 1113480 - protein, 9 aa, Homo Sapiens
GPPGLQVPA

SEQ ID NO: 1113481 - protein, 9 aa, Homo Sapiens
LEEEQKKKS

SEQ ID NO: 1113482 - protein, 9 aa, Homo Sapiens
PYTAQLNLH

SEQ ID NO: 1113483 - protein, 9 aa, Homo Sapiens
IEVVFAVDV

SEQ ID NO: 1113484 - protein, 9 aa, Homo Sapiens
PITAAATKV

SEQ ID NO: 1113485 - protein, 9 aa, Homo Sapiens
PRFQQETGH

SEQ ID NO: 1113486 - protein, 9 aa, Homo Sapiens
CRERRALHQ

SEQ ID NO: 1113487 - protein, 9 aa, Homo Sapiens
KYRQRINQH

SEQ ID NO: 1113488 - protein, 9 aa, Homo Sapiens
HLTMTSTLR

SEQ ID NO: 1113489 - protein, 9 aa, Homo Sapiens
VKEVNPTCH

SEQ ID NO: 1113490 - protein, 9 aa, Homo Sapiens
RTMPVDERD

SEQ ID NO: 1113491 - protein, 9 aa, Homo Sapiens
GTPPPLILW

SEQ ID NO: 1113492 - protein, 9 aa, Homo Sapiens
KLSKAMHKA

SEQ ID NO: 1113493 - protein, 9 aa, Homo Sapiens
RINQHADAV

SEQ ID NO: 1113494 - protein, 9 aa, Homo Sapiens
TEDVGECHN

SEQ ID NO: 1113495 - protein, 9 aa, Homo Sapiens
GLSAGTVIG

SEQ ID NO: 1113496 - protein, 9 aa, Homo Sapiens
RRSRGAGGM

SEQ ID NO: 1113497 - protein, 9 aa, Homo Sapiens
RFQQETGHP

SEQ ID NO: 1113498 - protein, 9 aa, Homo Sapiens
PRSKKKKLG

SEQ ID NO: 1113499 - protein, 9 aa, Homo Sapiens
PTDPTHHPQ

SEQ ID NO: 1113500 - protein, 9 aa, Homo Sapiens
LHLACASDH

SEQ ID NO: 1113501 - protein, 9 aa, Homo Sapiens
GIGAMNAFA

SEQ ID NO: 1113502 - protein, 9 aa, Homo Sapiens
SLKQVQLEQ

SEQ ID NO: 1113503 - protein, 9 aa, Homo Sapiens
LSAGTVIGV

SEQ ID NO: 1113504 - protein, 9 aa, Homo Sapiens
SGSSSSSNG

SEQ ID NO: 1113505 - protein, 9 aa, Homo Sapiens
ERAGGGRGG

SEQ ID NO: 1113506 - protein, 9 aa, Homo Sapiens
TVPSVGVVT

SEQ ID NO: 1113507 - protein, 9 aa, Homo Sapiens
VGVRIVTVT

SEQ ID NO: 1113508 - protein, 9 aa, Homo Sapiens
GTMMDRQML

SEQ ID NO: 1113509 - protein, 9 aa, Homo Sapiens
PLHRRTMPV

SEQ ID NO: 1113510 - protein, 9 aa, Homo Sapiens
AQEGPPGLQ

SEQ ID NO: 1113511 - protein, 9 aa, Homo Sapiens
FLLSPGEKA

SEQ ID NO: 1113512 - protein, 9 aa, Homo Sapiens
AEDVFWSTA

SEQ ID NO: 1113513 - protein, 9 aa, Homo Sapiens
PSGTMMDRQ

SEQ ID NO: 1113514 - protein, 9 aa, Homo Sapiens
VIIITVNYR

SEQ ID NO: 1113515 - protein, 9 aa, Homo Sapiens
ARVVKDVAT

SEQ ID NO: 1113516 - protein, 9 aa, Homo Sapiens
DKAVVQAPR

SEQ ID NO: 1113517 - protein, 9 aa, Homo Sapiens
RALGAIPGP

SEQ ID NO: 1113518 - protein, 9 aa, Homo Sapiens
GGMEETFLR

SEQ ID NO: 1113519 - protein, 9 aa, Homo Sapiens
IVTVTPTML

SEQ ID NO: 1113520 - protein, 9 aa, Homo Sapiens
PPTSYKSSC

SEQ ID NO: 1113521 - protein, 9 aa, Homo Sapiens
PPLHRRTMP

SEQ ID NO: 1113522 - protein, 9 aa, Homo Sapiens
CQPPAHTYN

SEQ ID NO: 1113523 - protein, 9 aa, Homo Sapiens
AAQQWLLCQ

SEQ ID NO: 1113524 - protein, 9 aa, Homo Sapiens
WLLCQQEQI

SEQ ID NO: 1113525 - protein, 9 aa, Homo Sapiens
QHAYNLVDW

SEQ ID NO: 1113526 - protein, 9 aa, Homo Sapiens
RPYTCDIFH

SEQ ID NO: 1113527 - protein, 9 aa, Homo Sapiens
MSGTEASIG

SEQ ID NO: 1113528 - protein, 9 aa, Homo Sapiens
LRNAICYIE

SEQ ID NO: 1113529 - protein, 9 aa, Homo Sapiens
GPGHTTYAR

SEQ ID NO: 1113530 - protein, 9 aa, Homo Sapiens
PPAHTYNNI

SEQ ID NO: 1113531 - protein, 9 aa, Homo Sapiens
AVDVKEVNP

SEQ ID NO: 1113532 - protein, 9 aa, Homo Sapiens
HRPGTPPPL

SEQ ID NO: 1113533 - protein, 9 aa, Homo Sapiens
KQPDVEDIL

SEQ ID NO: 1113534 - protein, 9 aa, Homo Sapiens
AEPAARAAQ

SEQ ID NO: 1113535 - protein, 9 aa, Homo Sapiens
GRYSCEVID

SEQ ID NO: 1113536 - protein, 9 aa, Homo Sapiens
SEEGRFSQV

SEQ ID NO: 1113537 - protein, 9 aa, Homo Sapiens
QLEQDEYAK

SEQ ID NO: 1113538 - protein, 9 aa, Homo Sapiens
TVTPTMLAA

SEQ ID NO: 1113539 - protein, 9 aa, Homo Sapiens
EGPPGLQVP

SEQ ID NO: 1113540 - protein, 9 aa, Homo Sapiens
DSHANTVYG

SEQ ID NO: 1113541 - protein, 9 aa, Homo Sapiens
LGRALAILL

SEQ ID NO: 1113542 - protein, 9 aa, Homo Sapiens
RHEKMGYNI

SEQ ID NO: 1113543 - protein, 9 aa, Homo Sapiens
MGYNISQLT

SEQ ID NO: 1113544 - protein, 9 aa, Homo Sapiens
PRRALGAIP

SEQ ID NO: 1113545 - protein, 9 aa, Homo Sapiens
YEAFNWHHG

SEQ ID NO: 1113546 - protein, 9 aa, Homo Sapiens
QSSEEGRFS

SEQ ID NO: 1113547 - protein, 9 aa, Homo Sapiens
SCKHAESME

SEQ ID NO: 1113548 - protein, 9 aa, Homo Sapiens
TKPRAGRGL

SEQ ID NO: 1113549 - protein, 9 aa, Homo Sapiens
ASAEQDDLQ

SEQ ID NO: 1113550 - protein, 9 aa, Homo Sapiens
ATCHDTIHD

SEQ ID NO: 1113551 - protein, 9 aa, Homo Sapiens
DYGRYSCEV

SEQ ID NO: 1113552 - protein, 9 aa, Homo Sapiens
GSSSSSNGR

SEQ ID NO: 1113553 - protein, 9 aa, Homo Sapiens
ERGALPRRA

SEQ ID NO: 1113554 - protein, 9 aa, Homo Sapiens
AHRTLPHML

SEQ ID NO: 1113555 - protein, 9 aa, Homo Sapiens
WHHGVFVGS

SEQ ID NO: 1113556 - protein, 9 aa, Homo Sapiens
PGVQYNYMY

SEQ ID NO: 1113557 - protein, 9 aa, Homo Sapiens
EVEAVTITQ

SEQ ID NO: 1113558 - protein, 9 aa, Homo Sapiens
VGCMPFFGD

SEQ ID NO: 1113559 - protein, 9 aa, Homo Sapiens
RTSCKDDKA

SEQ ID NO: 1113560 - protein, 9 aa, Homo Sapiens
PTSYKSSCT

SEQ ID NO: 1113561 - protein, 9 aa, Homo Sapiens
VGEERAGGG

SEQ ID NO: 1113562 - protein, 9 aa, Homo Sapiens
YSRLQQCRE

SEQ ID NO: 1113563 - protein, 9 aa, Homo Sapiens
PPGLQVPAA

SEQ ID NO: 1113564 - protein, 9 aa, Homo Sapiens
RRTMPVDER

SEQ ID NO: 1113565 - protein, 9 aa, Homo Sapiens
GPVGPPKSP

SEQ ID NO: 1113566 - protein, 9 aa, Homo Sapiens
SESDKTAML

SEQ ID NO: 1113567 - protein, 9 aa, Homo Sapiens
MRIPVVRVQ

SEQ ID NO: 1113568 - protein, 9 aa, Homo Sapiens
QEIMVQLLW

SEQ ID NO: 1113569 - protein, 9 aa, Homo Sapiens
VGVVTVEST

SEQ ID NO: 1113570 - protein, 9 aa, Homo Sapiens
VAALQLWLR

SEQ ID NO: 1113571 - protein, 9 aa, Homo Sapiens
MLQSLAQHP

SEQ ID NO: 1113572 - protein, 9 aa, Homo Sapiens
GSSPSGTMM

SEQ ID NO: 1113573 - protein, 9 aa, Homo Sapiens
MPFFGDTPE

SEQ ID NO: 1113574 - protein, 9 aa, Homo Sapiens
LFHGMDNNT

SEQ ID NO: 1113575 - protein, 9 aa, Homo Sapiens
EVLKPRKKC

SEQ ID NO: 1113576 - protein, 9 aa, Homo Sapiens
GHGADAHLP

SEQ ID NO: 1113577 - protein, 9 aa, Homo Sapiens
KATCFLLSP

SEQ ID NO: 1113578 - protein, 9 aa, Homo Sapiens
TEASIGVLV

SEQ ID NO: 1113579 - protein, 9 aa, Homo Sapiens
LPHMLAFRV

SEQ ID NO: 1113580 - protein, 9 aa, Homo Sapiens
GVQYNYMYD

SEQ ID NO: 1113581 - protein, 9 aa, Homo Sapiens
NGILADEMS

SEQ ID NO: 1113582 - protein, 9 aa, Homo Sapiens
SDARVVKDV

SEQ ID NO: 1113583 - protein, 9 aa, Homo Sapiens
QEEGQRQGE

SEQ ID NO: 1113584 - protein, 9 aa, Homo Sapiens
STADIGWIT

SEQ ID NO: 1113585 - protein, 9 aa, Homo Sapiens
APEKETKAL

SEQ ID NO: 1113586 - protein, 9 aa, Homo Sapiens
DSYSRLQQC

SEQ ID NO: 1113587 - protein, 9 aa, Homo Sapiens
AALRSLPTE

SEQ ID NO: 1113588 - protein, 9 aa, Homo Sapiens
LPRRALGAI

SEQ ID NO: 1113589 - protein, 9 aa, Homo Sapiens
QDKVCHNEE

SEQ ID NO: 1113590 - protein, 9 aa, Homo Sapiens
LACASDHVK

SEQ ID NO: 1113591 - protein, 9 aa, Homo Sapiens
LATLLLRHE

SEQ ID NO: 1113592 - protein, 9 aa, Homo Sapiens
HPDTAPPLS

SEQ ID NO: 1113593 - protein, 9 aa, Homo Sapiens
SNLFHGMDN

SEQ ID NO: 1113594 - protein, 9 aa, Homo Sapiens
AIPGPTDPT

SEQ ID NO: 1113595 - protein, 9 aa, Homo Sapiens
EKEIKASPD

SEQ ID NO: 1113596 - protein, 9 aa, Homo Sapiens
RSKKKKLGA

SEQ ID NO: 1113597 - protein, 9 aa, Homo Sapiens
VRVQALPTP

SEQ ID NO: 1113598 - protein, 9 aa, Homo Sapiens
HAEDVFWST

SEQ ID NO: 1113599 - protein, 9 aa, Homo Sapiens
VATGKSKGY

SEQ ID NO: 1113600 - protein, 9 aa, Homo Sapiens
LSNGIQFSR

SEQ ID NO: 1113601 - protein, 9 aa, Homo Sapiens
SSQSSEEGR

SEQ ID NO: 1113602 - protein, 9 aa, Homo Sapiens
KDKEGKDFY

SEQ ID NO: 1113603 - protein, 9 aa, Homo Sapiens
PTTPDSCPR

SEQ ID NO: 1113604 - protein, 9 aa, Homo Sapiens
QNRRAAGQG

SEQ ID NO: 1113605 - protein, 9 aa, Homo Sapiens
PSVGVVTVE

SEQ ID NO: 1113606 - protein, 9 aa, Homo Sapiens
CGKAFPYTA

SEQ ID NO: 1113607 - protein, 9 aa, Homo Sapiens
VAGGPGHTT

SEQ ID NO: 1113608 - protein, 9 aa, Homo Sapiens
DLQEDRSHS

SEQ ID NO: 1113609 - protein, 9 aa, Homo Sapiens
KNADVYKLD

SEQ ID NO: 1113610 - protein, 9 aa, Homo Sapiens
GGGLSRGAA

SEQ ID NO: 1113611 - protein, 9 aa, Homo Sapiens
NLFHGMDNN

SEQ ID NO: 1113612 - protein, 9 aa, Homo Sapiens
KVGVRIVTV

SEQ ID NO: 1113613 - protein, 9 aa, Homo Sapiens
AAAQQWLLC

SEQ ID NO: 1113614 - protein, 9 aa, Homo Sapiens
ITLNWMLKS

SEQ ID NO: 1113615 - protein, 9 aa, Homo Sapiens
DCSSSSSSS

SEQ ID NO: 1113616 - protein, 9 aa, Homo Sapiens
PAHTYNNIT

SEQ ID NO: 1113617 - protein, 9 aa, Homo Sapiens
QQWLLCQQE

SEQ ID NO: 1113618 - protein, 9 aa, Homo Sapiens
LSKAMHKAV

SEQ ID NO: 1113619 - protein, 9 aa, Homo Sapiens
QVSLSQYGG

SEQ ID NO: 1113620 - protein, 9 aa, Homo Sapiens
RHLQGAAGR

SEQ ID NO: 1113621 - protein, 9 aa, Homo Sapiens
QDDLQEDRS

SEQ ID NO: 1113622 - protein, 9 aa, Homo Sapiens
QGPVGPPKS

SEQ ID NO: 1113623 - protein, 9 aa, Homo Sapiens
AVAALQLWL

SEQ ID NO: 1113624 - protein, 9 aa, Homo Sapiens
GLQVPAAAE

SEQ ID NO: 1113625 - protein, 9 aa, Homo Sapiens
PTMLAAAQQ

SEQ ID NO: 1113626 - protein, 9 aa, Homo Sapiens
LQGAAGRLA

SEQ ID NO: 1113627 - protein, 9 aa, Homo Sapiens
YLLQHAYNL

SEQ ID NO: 1113628 - protein, 9 aa, Homo Sapiens
EAVKGPVLA

SEQ ID NO: 1113629 - protein, 9 aa, Homo Sapiens
RAGGGRGGH

SEQ ID NO: 1113630 - protein, 9 aa, Homo Sapiens
QAKQPDVED

SEQ ID NO: 1113631 - protein, 9 aa, Homo Sapiens
AKATCFLLS

SEQ ID NO: 1113632 - protein, 9 aa, Homo Sapiens
HPAPANTNR

SEQ ID NO: 1113633 - protein, 9 aa, Homo Sapiens
YEFLVGCMP

SEQ ID NO: 1113634 - protein, 9 aa, Homo Sapiens
RIPVVRVQA

SEQ ID NO: 1113635 - protein, 9 aa, Homo Sapiens
LVYEAFNWH

SEQ ID NO: 1113636 - protein, 9 aa, Homo Sapiens
RKEKGGGLS

SEQ ID NO: 1113637 - protein, 9 aa, Homo Sapiens
SCEVIDGLE

SEQ ID NO: 1113638 - protein, 9 aa, Homo Sapiens
EDVFWSTAD

SEQ ID NO: 1113639 - protein, 9 aa, Homo Sapiens
LWLRAAGLG

SEQ ID NO: 1113640 - protein, 9 aa, Homo Sapiens
GWLSTTPAH

SEQ ID NO: 1113641 - protein, 9 aa, Homo Sapiens
QWLLCQQEQ

SEQ ID NO: 1113642 - protein, 9 aa, Homo Sapiens
DNVLWTMLR

SEQ ID NO: 1113643 - protein, 9 aa, Homo Sapiens
EAKATCFLL

SEQ ID NO: 1113644 - protein, 9 aa, Homo Sapiens
VDVKEVNPT

SEQ ID NO: 1113645 - protein, 9 aa, Homo Sapiens
KGGGLSRGA

SEQ ID NO: 1113646 - protein, 9 aa, Homo Sapiens
SNGIQFSRI

SEQ ID NO: 1113647 - protein, 9 aa, Homo Sapiens
QKKKSWDFG

SEQ ID NO: 1113648 - protein, 9 aa, Homo Sapiens
KDDKAVVQA

SEQ ID NO: 1113649 - protein, 9 aa, Homo Sapiens
TTTIITLNW

SEQ ID NO: 1113650 - protein, 9 aa, Homo Sapiens
PPLILWPQA

SEQ ID NO: 1113651 - protein, 9 aa, Homo Sapiens
DGASAEQDD

SEQ ID NO: 1113652 - protein, 9 aa, Homo Sapiens
VEVEAVTIT

SEQ ID NO: 1113653 - protein, 9 aa, Homo Sapiens
ELEEEQKKK

SEQ ID NO: 1113654 - protein, 9 aa, Homo Sapiens
PDSCPRLRA

SEQ ID NO: 1113655 - protein, 9 aa, Homo Sapiens
QEQGQVCCS

SEQ ID NO: 1113656 - protein, 9 aa, Homo Sapiens
HAESMETEG

SEQ ID NO: 1113657 - protein, 9 aa, Homo Sapiens
EEQVSLSQY

SEQ ID NO: 1113658 - protein, 9 aa, Homo Sapiens
VPSVGVVTV

SEQ ID NO: 1113659 - protein, 9 aa, Homo Sapiens
VKDVATGKS

SEQ ID NO: 1113660 - protein, 9 aa, Homo Sapiens
SGQEQGQVC

SEQ ID NO: 1113661 - protein, 9 aa, Homo Sapiens
ILADEMSLG

SEQ ID NO: 1113662 - protein, 9 aa, Homo Sapiens
SRGWLSTTP

SEQ ID NO: 1113663 - protein, 9 aa, Homo Sapiens
SATCHDTIH

SEQ ID NO: 1113664 - protein, 9 aa, Homo Sapiens
KAVVQAPRH

SEQ ID NO: 1113665 - protein, 9 aa, Homo Sapiens
GRALAILLS

SEQ ID NO: 1113666 - protein, 9 aa, Homo Sapiens
VFAVDVKEV

SEQ ID NO: 1113667 - protein, 9 aa, Homo Sapiens
DNNTPVRYT

SEQ ID NO: 1113668 - protein, 9 aa, Homo Sapiens
RHERGALPR

SEQ ID NO: 1113669 - protein, 9 aa, Homo Sapiens
PKSPCACSS

SEQ ID NO: 1113670 - protein, 9 aa, Homo Sapiens
TMMDRQMLP

SEQ ID NO: 1113671 - protein, 9 aa, Homo Sapiens
PEKETKALS

SEQ ID NO: 1113672 - protein, 9 aa, Homo Sapiens
DHVKVVTLL

SEQ ID NO: 1113673 - protein, 9 aa, Homo Sapiens
AGGMEETFL

SEQ ID NO: 1113674 - protein, 9 aa, Homo Sapiens
YNLVDWYPW

SEQ ID NO: 1113675 - protein, 9 aa, Homo Sapiens
DGEEEEEVL

SEQ ID NO: 1113676 - protein, 9 aa, Homo Sapiens
PLKLSKAMH

SEQ ID NO: 1113677 - protein, 9 aa, Homo Sapiens
QRAKDLSKW

SEQ ID NO: 1113678 - protein, 9 aa, Homo Sapiens
HDTIHDFRN

SEQ ID NO: 1113679 - protein, 9 aa, Homo Sapiens
PAPPLHRRT

SEQ ID NO: 1113680 - protein, 9 aa, Homo Sapiens
YMYDEDEYM

SEQ ID NO: 1113681 - protein, 9 aa, Homo Sapiens
NKDKEGKDF

SEQ ID NO: 1113682 - protein, 9 aa, Homo Sapiens
REKEIKASP

SEQ ID NO: 1113683 - protein, 9 aa, Homo Sapiens
EAFNWHHGV

SEQ ID NO: 1113684 - protein, 9 aa, Homo Sapiens
REKELEEEQ

SEQ ID NO: 1113685 - protein, 9 aa, Homo Sapiens
QSKTGILTL

SEQ ID NO: 1113686 - protein, 9 aa, Homo Sapiens
RYSCEVIDG

SEQ ID NO: 1113687 - protein, 9 aa, Homo Sapiens
WTMLRRFAR

SEQ ID NO: 1113688 - protein, 9 aa, Homo Sapiens
PFVEEAEPA

SEQ ID NO: 1113689 - protein, 9 aa, Homo Sapiens
IKKLSAEPT

SEQ ID NO: 1113690 - protein, 9 aa, Homo Sapiens
KKYGFSLWA

SEQ ID NO: 1113691 - protein, 9 aa, Homo Sapiens
CQQEQIQAL

SEQ ID NO: 1113692 - protein, 9 aa, Homo Sapiens
KYFLLVLAD

SEQ ID NO: 1113693 - protein, 9 aa, Homo Sapiens
NGIQFSRIS

SEQ ID NO: 1113694 - protein, 9 aa, Homo Sapiens
PLSKITEQE

SEQ ID NO: 1113695 - protein, 9 aa, Homo Sapiens
MEETFLRVR

SEQ ID NO: 1113696 - protein, 9 aa, Homo Sapiens
QHLTMTSTL

SEQ ID NO: 1113697 - protein, 9 aa, Homo Sapiens
VQYNYMYDE

SEQ ID NO: 1113698 - protein, 9 aa, Homo Sapiens
LPSRGWLST

SEQ ID NO: 1113699 - protein, 9 aa, Homo Sapiens
CFLLSPGEK

SEQ ID NO: 1113700 - protein, 9 aa, Homo Sapiens
IKAMRALGM

SEQ ID NO: 1113701 - protein, 9 aa, Homo Sapiens
LVGCMPFFG

SEQ ID NO: 1113702 - protein, 9 aa, Homo Sapiens
KQVQLEQDE

SEQ ID NO: 1113703 - protein, 9 aa, Homo Sapiens
RGALPRRAL

SEQ ID NO: 1113704 - protein, 9 aa, Homo Sapiens
KMRIPVVRV

SEQ ID NO: 1113705 - protein, 9 aa, Homo Sapiens
PDTAPPLSI

SEQ ID NO: 1113706 - protein, 9 aa, Homo Sapiens
TITQEPRHI

SEQ ID NO: 1113707 - protein, 9 aa, Homo Sapiens
TEKPPAPEA

SEQ ID NO: 1113708 - protein, 9 aa, Homo Sapiens
LWAIRVYMG

SEQ ID NO: 1113709 - protein, 9 aa, Homo Sapiens
PPKSPCACS

SEQ ID NO: 1113710 - protein, 9 aa, Homo Sapiens
DLSKWSFSS

SEQ ID NO: 1113711 - protein, 9 aa, Homo Sapiens
WSTADIGWI

SEQ ID NO: 1113712 - protein, 9 aa, Homo Sapiens
HLPQRHLQG

SEQ ID NO: 1113713 - protein, 9 aa, Homo Sapiens
YRQRINQHA

SEQ ID NO: 1113714 - protein, 9 aa, Homo Sapiens
GALPRRALG

SEQ ID NO: 1113715 - protein, 9 aa, Homo Sapiens
CMPFFGDTP

SEQ ID NO: 1113716 - protein, 9 aa, Homo Sapiens
AQSKTGILT

SEQ ID NO: 1113717 - protein, 9 aa, Homo Sapiens
SLGKTIQTI

SEQ ID NO: 1113718 - protein, 9 aa, Homo Sapiens
TCFLLSPGE

SEQ ID NO: 1113719 - protein, 9 aa, Homo Sapiens
LYEFLVGCM

SEQ ID NO: 1113720 - protein, 9 aa, Homo Sapiens
WSFSSQRPG

SEQ ID NO: 1113721 - protein, 9 aa, Homo Sapiens
PGTPPPLIL

SEQ ID NO: 1113722 - protein, 9 aa, Homo Sapiens
LTMTSTLRR

SEQ ID NO: 1113723 - protein, 9 aa, Homo Sapiens
EQVSLSQYG

SEQ ID NO: 1113724 - protein, 9 aa, Homo Sapiens
GPPKSPCAC

SEQ ID NO: 1113725 - protein, 9 aa, Homo Sapiens
GGLSRGAAP

SEQ ID NO: 1113726 - protein, 9 aa, Homo Sapiens
FHKAFRRQD

SEQ ID NO: 1113727 - protein, 9 aa, Homo Sapiens
HLACASDHV

SEQ ID NO: 1113728 - protein, 9 aa, Homo Sapiens
TIITLNWML

SEQ ID NO: 1113729 - protein, 9 aa, Homo Sapiens
ALGAIPGPT

SEQ ID NO: 1113730 - protein, 9 aa, Homo Sapiens
AAATKVPTP

SEQ ID NO: 1113731 - protein, 9 aa, Homo Sapiens
AATKVPTPP

SEQ ID NO: 1113732 - protein, 9 aa, Homo Sapiens
EYTEDVGEC

SEQ ID NO: 1113733 - protein, 9 aa, Homo Sapiens
HPQNRRAAG

SEQ ID NO: 1113734 - protein, 9 aa, Homo Sapiens
DQQEEGQRQ

SEQ ID NO: 1113735 - protein, 9 aa, Homo Sapiens
LLCQQEQIQ

SEQ ID NO: 1113736 - protein, 9 aa, Homo Sapiens
QLDAGAQHL

SEQ ID NO: 1113737 - protein, 9 aa, Homo Sapiens
WTPPTSYKS

SEQ ID NO: 1113738 - protein, 9 aa, Homo Sapiens
SRHEKMGYN

SEQ ID NO: 1113739 - protein, 9 aa, Homo Sapiens
VTITQEPRH

SEQ ID NO: 1113740 - protein, 9 aa, Homo Sapiens
DKEGKDFYS

SEQ ID NO: 1113741 - protein, 9 aa, Homo Sapiens
VKNADVYKL

SEQ ID NO: 1113742 - protein, 9 aa, Homo Sapiens
NVLWTMLRR

SEQ ID NO: 1113743 - protein, 9 aa, Homo Sapiens
RPGTPPPLI

SEQ ID NO: 1113744 - protein, 9 aa, Homo Sapiens
QLWLRAAGL

SEQ ID NO: 1113745 - protein, 9 aa, Homo Sapiens
SGTMMDRQM

SEQ ID NO: 1113746 - protein, 9 aa, Homo Sapiens
KYGFSLWAI

SEQ ID NO: 1113747 - protein, 9 aa, Homo Sapiens
DKTAMLTLI

SEQ ID NO: 1113748 - protein, 9 aa, Homo Sapiens
NFLNAIKAM

SEQ ID NO: 1113749 - protein, 9 aa, Homo Sapiens
ATKVPTPPG

SEQ ID NO: 1113750 - protein, 9 aa, Homo Sapiens
EEQKKKSWD

SEQ ID NO: 1113751 - protein, 9 aa, Homo Sapiens
GKDFYSITG

SEQ ID NO: 1113752 - protein, 9 aa, Homo Sapiens
AGAQHLTMT

SEQ ID NO: 1113753 - protein, 9 aa, Homo Sapiens
AKQPDVEDI

SEQ ID NO: 1113754 - protein, 9 aa, Homo Sapiens
AFPYTAQLN

SEQ ID NO: 1113755 - protein, 9 aa, Homo Sapiens
ILRNAICYI

SEQ ID NO: 1113756 - protein, 9 aa, Homo Sapiens
DSCPRLRAA

SEQ ID NO: 1113757 - protein, 9 aa, Homo Sapiens
PGLQVPAAA

SEQ ID NO: 1113758 - protein, 9 aa, Homo Sapiens
YGRYSCEVI

SEQ ID NO: 1113759 - protein, 9 aa, Homo Sapiens
SKTGILTLK

SEQ ID NO: 1113760 - protein, 9 aa, Homo Sapiens
RDRAEAEAP

SEQ ID NO: 1113761 - protein, 9 aa, Homo Sapiens
QVCCSADQQ

SEQ ID NO: 1113762 - protein, 9 aa, Homo Sapiens
RIKEEQVSL

SEQ ID NO: 1113763 - protein, 9 aa, Homo Sapiens
LTVGTPATL

SEQ ID NO: 1113764 - protein, 9 aa, Homo Sapiens
PGREKEIKA

SEQ ID NO: 1113765 - protein, 9 aa, Homo Sapiens
RNAICYIES

SEQ ID NO: 1113766 - protein, 9 aa, Homo Sapiens
TKVPTPPGV

SEQ ID NO: 1113767 - protein, 9 aa, Homo Sapiens
PGDTTTIIT

SEQ ID NO: 1113768 - protein, 9 aa, Homo Sapiens
FHGMDNNTP

SEQ ID NO: 1113769 - protein, 9 aa, Homo Sapiens
HEYTEDVGE

SEQ ID NO: 1113770 - protein, 9 aa, Homo Sapiens
AQHRLREPQ

SEQ ID NO: 1113771 - protein, 9 aa, Homo Sapiens
APGHPDTAP

SEQ ID NO: 1113772 - protein, 9 aa, Homo Sapiens
YTAQLNLHQ

SEQ ID NO: 1113773 - protein, 9 aa, Homo Sapiens
VQLLWTVNR

SEQ ID NO: 1113774 - protein, 9 aa, Homo Sapiens
QQETGHPSL

SEQ ID NO: 1113775 - protein, 9 aa, Homo Sapiens
MDRQMLPPV

SEQ ID NO: 1113776 - protein, 9 aa, Homo Sapiens
ALHLACASD

SEQ ID NO: 1113777 - protein, 9 aa, Homo Sapiens
IITLNWMLK

SEQ ID NO: 1113778 - protein, 9 aa, Homo Sapiens
AMSGTEASI

SEQ ID NO: 1113779 - protein, 9 aa, Homo Sapiens
LWTMLRRFA

SEQ ID NO: 1113780 - protein, 9 aa, Homo Sapiens
DVATGKSKG

SEQ ID NO: 1113781 - protein, 9 aa, Homo Sapiens
FPRPRFQQE

SEQ ID NO: 1113782 - protein, 9 aa, Homo Sapiens
YEVLKPRKK

SEQ ID NO: 1113783 - protein, 9 aa, Homo Sapiens
YGFSLWAIR

SEQ ID NO: 1113784 - protein, 9 aa, Homo Sapiens
VPAAAEEVG

SEQ ID NO: 1113785 - protein, 9 aa, Homo Sapiens
MSLGKTIQT

SEQ ID NO: 1113786 - protein, 9 aa, Homo Sapiens
FDFPTLIKK

SEQ ID NO: 1113787 - protein, 9 aa, Homo Sapiens
HRRTMPVDE

SEQ ID NO: 1113788 - protein, 9 aa, Homo Sapiens
AAEEVGEER

SEQ ID NO: 1113789 - protein, 9 aa, Homo Sapiens
RVLSNGIQF

SEQ ID NO: 1113790 - protein, 9 aa, Homo Sapiens
KEGKDFYSI

SEQ ID NO: 1113791 - protein, 9 aa, Homo Sapiens
DEMSLGKTI

SEQ ID NO: 1113792 - protein, 9 aa, Homo Sapiens
HGMDNNTPV

SEQ ID NO: 1113793 - protein, 9 aa, Homo Sapiens
SLAQHPAPA

SEQ ID NO: 1113794 - protein, 9 aa, Homo Sapiens
TLIKKLSAE

SEQ ID NO: 1113795 - protein, 9 aa, Homo Sapiens
QCRERRALH

SEQ ID NO: 1113796 - protein, 9 aa, Homo Sapiens
EIMVQLLWT

SEQ ID NO: 1113797 - protein, 9 aa, Homo Sapiens
GAIPGPTDP

SEQ ID NO: 1113798 - protein, 9 aa, Homo Sapiens
LSPGEKALG

SEQ ID NO: 1113799 - protein, 9 aa, Homo Sapiens
PLCSGQEQG

SEQ ID NO: 1113800 - protein, 9 aa, Homo Sapiens
GYNISQLTD

SEQ ID NO: 1113801 - protein, 9 aa, Homo Sapiens
AVKNADVYK

SEQ ID NO: 1113802 - protein, 9 aa, Homo Sapiens
HKYFLLVLA

SEQ ID NO: 1113803 - protein, 9 aa, Homo Sapiens
AGRLATLLL

SEQ ID NO: 1113804 - protein, 9 aa, Homo Sapiens
MMDRQMLPP

SEQ ID NO: 1113805 - protein, 9 aa, Homo Sapiens
ESFMSQIGW

SEQ ID NO: 1113806 - protein, 9 aa, Homo Sapiens
FLVGCMPFF

SEQ ID NO: 1113807 - protein, 9 aa, Homo Sapiens
IGAMNAFAP

SEQ ID NO: 1113808 - protein, 9 aa, Homo Sapiens
MYDEDEYMI

SEQ ID NO: 1113809 - protein, 9 aa, Homo Sapiens
HTDPRSQLE

SEQ ID NO: 1113810 - protein, 9 aa, Homo Sapiens
YTEDVGECH

SEQ ID NO: 1113811 - protein, 9 aa, Homo Sapiens
DCQPPAHTY

SEQ ID NO: 1113812 - protein, 9 aa, Homo Sapiens
DEAQSKTGI

SEQ ID NO: 1113813 - protein, 9 aa, Homo Sapiens
SYGNVIIIT

SEQ ID NO: 1113814 - protein, 9 aa, Homo Sapiens
RFSQVSTMA

SEQ ID NO: 1113815 - protein, 9 aa, Homo Sapiens
EFLVGCMPF

SEQ ID NO: 1113816 - protein, 9 aa, Homo Sapiens
HAYNLVDWY

SEQ ID NO: 1113817 - protein, 9 aa, Homo Sapiens
KKKNFLNAI

SEQ ID NO: 1113818 - protein, 9 aa, Homo Sapiens
LILWPQAAP

SEQ ID NO: 1113819 - protein, 9 aa, Homo Sapiens
LAQHLAQHR

SEQ ID NO: 1113820 - protein, 9 aa, Homo Sapiens
ASIGVLVDK

SEQ ID NO: 1113821 - protein, 9 aa, Homo Sapiens
KWSFSSQRP

SEQ ID NO: 1113822 - protein, 9 aa, Homo Sapiens
PCAPGHPDT

SEQ ID NO: 1113823 - protein, 9 aa, Homo Sapiens
VEEAEPAAR

SEQ ID NO: 1113824 - protein, 9 aa, Homo Sapiens
FAVDVKEVN

SEQ ID NO: 1113825 - protein, 9 aa, Homo Sapiens
ACASDHVKV

SEQ ID NO: 1113826 - protein, 9 aa, Homo Sapiens
HHGVFVGSA

SEQ ID NO: 1113827 - protein, 9 aa, Homo Sapiens
LSESDKTAM

SEQ ID NO: 1113828 - protein, 9 aa, Homo Sapiens
LQLWLRAAG

SEQ ID NO: 1113829 - protein, 9 aa, Homo Sapiens
AHTYNNITC

SEQ ID NO: 1113830 - protein, 9 aa, Homo Sapiens
HERGALPRR

SEQ ID NO: 1113831 - protein, 9 aa, Homo Sapiens
TPPTSYKSS

SEQ ID NO: 1113832 - protein, 9 aa, Homo Sapiens
ATLLLRHER

SEQ ID NO: 1113833 - protein, 9 aa, Homo Sapiens
ITAAATKVP

SEQ ID NO: 1113834 - protein, 9 aa, Homo Sapiens
QVPAAAEEV

SEQ ID NO: 1113835 - protein, 9 aa, Homo Sapiens
TAMLTLIRE

SEQ ID NO: 1113836 - protein, 9 aa, Homo Sapiens
FMSQIGWNR

SEQ ID NO: 1113837 - protein, 9 aa, Homo Sapiens
AQGPVGPPK

SEQ ID NO: 1113838 - protein, 9 aa, Homo Sapiens
GAAGRLATL

SEQ ID NO: 1113839 - protein, 9 aa, Homo Sapiens
TMLAAAQQW

SEQ ID NO: 1113840 - protein, 9 aa, Homo Sapiens
LIKKLSAEP

SEQ ID NO: 1113841 - protein, 9 aa, Homo Sapiens
SADQQEEGQ

SEQ ID NO: 1113842 - protein, 9 aa, Homo Sapiens
VTKNIHESF

SEQ ID NO: 1113843 - protein, 9 aa, Homo Sapiens
PRPRFQQET

SEQ ID NO: 1113844 - protein, 9 aa, Homo Sapiens
GPVLAAPAR

SEQ ID NO: 1113845 - protein, 9 aa, Homo Sapiens
KPRAGRGLT

SEQ ID NO: 1113846 - protein, 9 aa, Homo Sapiens
KPRKKCKKK

SEQ ID NO: 1113847 - protein, 9 aa, Homo Sapiens
RLGRALAIL

SEQ ID NO: 1113848 - protein, 9 aa, Homo Sapiens
TVYEVLKPR

SEQ ID NO: 1113849 - protein, 9 aa, Homo Sapiens
DAVKNADVY

SEQ ID NO: 1113850 - protein, 9 aa, Homo Sapiens
ASLPSRGWL

SEQ ID NO: 1113851 - protein, 9 aa, Homo Sapiens
GGHGADAHL

SEQ ID NO: 1113852 - protein, 9 aa, Homo Sapiens
EEGRFSQVS

SEQ ID NO: 1113853 - protein, 9 aa, Homo Sapiens
QWADSHANT

SEQ ID NO: 1113854 - protein, 9 aa, Homo Sapiens
PRVLSNGIQ

SEQ ID NO: 1113855 - protein, 9 aa, Homo Sapiens
QPPAHTYNN

SEQ ID NO: 1113856 - protein, 9 aa, Homo Sapiens
PVVRVQALP

SEQ ID NO: 1113857 - protein, 9 aa, Homo Sapiens
APPLHRRTM

SEQ ID NO: 1113858 - protein, 9 aa, Homo Sapiens
CCSADQQEE

SEQ ID NO: 1113859 - protein, 9 aa, Homo Sapiens
INQHADAVH

SEQ ID NO: 1113860 - protein, 9 aa, Homo Sapiens
TPRSKKKKL

SEQ ID NO: 1113861 - protein, 9 aa, Homo Sapiens
GGRGGHGAD

SEQ ID NO: 1113862 - protein, 9 aa, Homo Sapiens
TSCKDDKAV

SEQ ID NO: 1113863 - protein, 9 aa, Homo Sapiens
PRSQLEESV

SEQ ID NO: 1113864 - protein, 9 aa, Homo Sapiens
DDLQEDRSH

SEQ ID NO: 1113865 - protein, 9 aa, Homo Sapiens
VEAVTITQE

SEQ ID NO: 1113866 - protein, 9 aa, Homo Sapiens
GTVVWTPPT

SEQ ID NO: 1113867 - protein, 9 aa, Homo Sapiens
KNFLNAIKA

SEQ ID NO: 1113868 - protein, 9 aa, Homo Sapiens
LAAAQQWLL

SEQ ID NO: 1113869 - protein, 9 aa, Homo Sapiens
GQRKEKGGG

SEQ ID NO: 1113870 - protein, 9 aa, Homo Sapiens
RAEAEAPEK

SEQ ID NO: 1113871 - protein, 9 aa, Homo Sapiens
GCMPFFGDT

SEQ ID NO: 1113872 - protein, 9 aa, Homo Sapiens
YGNVIIITV

SEQ ID NO: 1113873 - protein, 9 aa, Homo Sapiens
IYAMSGTEA

SEQ ID NO: 1113874 - protein, 9 aa, Homo Sapiens
PGHTTYARP

SEQ ID NO: 1113875 - protein, 9 aa, Homo Sapiens
ATLKKIRHY

SEQ ID NO: 1113876 - protein, 9 aa, Homo Sapiens
VYKLDKQHT

SEQ ID NO: 1113877 - protein, 9 aa, Homo Sapiens
GDDCQPPAH

SEQ ID NO: 1113878 - protein, 9 aa, Homo Sapiens
WLRAAGLGR

SEQ ID NO: 1113879 - protein, 9 aa, Homo Sapiens
VEDILSKGQ

SEQ ID NO: 1113880 - protein, 9 aa, Homo Sapiens
PAARAAQEG

SEQ ID NO: 1113881 - protein, 9 aa, Homo Sapiens
RLQQCRERR

SEQ ID NO: 1113882 - protein, 9 aa, Homo Sapiens
TLKKIRHYK

SEQ ID NO: 1113883 - protein, 9 aa, Homo Sapiens
PQRHLQGAA

SEQ ID NO: 1113884 - protein, 9 aa, Homo Sapiens
EEEQKKKSW

SEQ ID NO: 1113885 - protein, 9 aa, Homo Sapiens
THHPQNRRA

SEQ ID NO: 1113886 - protein, 9 aa, Homo Sapiens
LDAGAQHLT

SEQ ID NO: 1113887 - protein, 9 aa, Homo Sapiens
AAAEEVGEE

SEQ ID NO: 1113888 - protein, 9 aa, Homo Sapiens
ADAHLPQRH

SEQ ID NO: 1113889 - protein, 9 aa, Homo Sapiens
DAGAQHLTM

SEQ ID NO: 1113890 - protein, 9 aa, Homo Sapiens
HGADAHLPQ

SEQ ID NO: 1113891 - protein, 9 aa, Homo Sapiens
GMEETFLRV

SEQ ID NO: 1113892 - protein, 9 aa, Homo Sapiens
LAILLSLAL

SEQ ID NO: 1113893 - protein, 9 aa, Homo Sapiens
RAGRGLTVG

SEQ ID NO: 1113894 - protein, 9 aa, Homo Sapiens
KHAESMETE

SEQ ID NO: 1113895 - protein, 9 aa, Homo Sapiens
AQHLTMTST

SEQ ID NO: 1113896 - protein, 9 aa, Homo Sapiens
SFMSQIGWN

SEQ ID NO: 1113897 - protein, 9 aa, Homo Sapiens
PSPITAAAT

SEQ ID NO: 1113898 - protein, 9 aa, Homo Sapiens
PGPTDPTHH

SEQ ID NO: 1113899 - protein, 9 aa, Homo Sapiens
KDVATGKSK

SEQ ID NO: 1113900 - protein, 9 aa, Homo Sapiens
VRIVTVTPT

SEQ ID NO: 1113901 - protein, 9 aa, Homo Sapiens
VWTPPTSYK

SEQ ID NO: 1113902 - protein, 9 aa, Homo Sapiens
KVEVEAVTI

SEQ ID NO: 1113903 - protein, 9 aa, Homo Sapiens
GDEAQSKTG

SEQ ID NO: 1113904 - protein, 9 aa, Homo Sapiens
RHYKANKDV

SEQ ID NO: 1113905 - protein, 9 aa, Homo Sapiens
SRLQQCRER

SEQ ID NO: 1113906 - protein, 9 aa, Homo Sapiens
GQEQGQVCC

SEQ ID NO: 1113907 - protein, 9 aa, Homo Sapiens
ICYIESLQE

SEQ ID NO: 1113908 - protein, 9 aa, Homo Sapiens
KEKGGGLSR

SEQ ID NO: 1113909 - protein, 9 aa, Homo Sapiens
DRAEAEAPE

SEQ ID NO: 1113910 - protein, 9 aa, Homo Sapiens
MVQLLWTVN

SEQ ID NO: 1113911 - protein, 9 aa, Homo Sapiens
RPRFQQETG

SEQ ID NO: 1113912 - protein, 9 aa, Homo Sapiens
GVRIVTVTP

SEQ ID NO: 1113913 - protein, 9 aa, Homo Sapiens
SAEQDDLQE

SEQ ID NO: 1113914 - protein, 9 aa, Homo Sapiens
QEGPPGLQV

SEQ ID NO: 1113915 - protein, 9 aa, Homo Sapiens
KEEQVSLSQ

SEQ ID NO: 1113916 - protein, 9 aa, Homo Sapiens
LLSPGEKAL

SEQ ID NO: 1113917 - protein, 9 aa, Homo Sapiens
PTHHPQNRR

SEQ ID NO: 1113918 - protein, 9 aa, Homo Sapiens
DIFHKAFRR

SEQ ID NO: 1113919 - protein, 9 aa, Homo Sapiens
LNTTVPSVG

SEQ ID NO: 1113920 - protein, 9 aa, Homo Sapiens
SLPSRGWLS

SEQ ID NO: 1113921 - protein, 9 aa, Homo Sapiens
AQHPAPANT

SEQ ID NO: 1113922 - protein, 9 aa, Homo Sapiens
TCHDTIHDF

SEQ ID NO: 1113923 - protein, 9 aa, Homo Sapiens
AQQWLLCQQ

SEQ ID NO: 1113924 - protein, 9 aa, Homo Sapiens
DDKAVVQAP

SEQ ID NO: 1113925 - protein, 9 aa, Homo Sapiens
VSLSQYGGS

SEQ ID NO: 1113926 - protein, 9 aa, Homo Sapiens
APAPTYGIG

SEQ ID NO: 1113927 - protein, 9 aa, Homo Sapiens
AGRGLTVGT

SEQ ID NO: 1113928 - protein, 9 aa, Homo Sapiens
AIKAMRALG

SEQ ID NO: 1113929 - protein, 9 aa, Homo Sapiens
DDCQPPAHT

SEQ ID NO: 1113930 - protein, 9 aa, Homo Sapiens
DNGHKYFLL

SEQ ID NO: 1113931 - protein, 9 aa, Homo Sapiens
SFDFPTLIK

SEQ ID NO: 1113932 - protein, 9 aa, Homo Sapiens
LHRRTMPVD

SEQ ID NO: 1113933 - protein, 9 aa, Homo Sapiens
PRAGRGLTV

SEQ ID NO: 1113934 - protein, 9 aa, Homo Sapiens
FWSTADIGW

SEQ ID NO: 1113935 - protein, 9 aa, Homo Sapiens
PVLAAPARR

SEQ ID NO: 1113936 - protein, 9 aa, Homo Sapiens
KTGILTLKY

SEQ ID NO: 1113937 - protein, 9 aa, Homo Sapiens
DARLGRALA

SEQ ID NO: 1113938 - protein, 9 aa, Homo Sapiens
FPYTAQLNL

SEQ ID NO: 1113939 - protein, 9 aa, Homo Sapiens
SLPTEKPPA

SEQ ID NO: 1113940 - protein, 9 aa, Homo Sapiens
GHTTYARPE

SEQ ID NO: 1113941 - protein, 9 aa, Homo Sapiens
FHAEDVFWS

SEQ ID NO: 1113942 - protein, 9 aa, Homo Sapiens
HESFMSQIG

SEQ ID NO: 1113943 - protein, 9 aa, Homo Sapiens
ISTRDPLSK

SEQ ID NO: 1113944 - protein, 9 aa, Homo Sapiens
LKKIRHYKA

SEQ ID NO: 1113945 - protein, 9 aa, Homo Sapiens
LSQYGGSEL

SEQ ID NO: 1113946 - protein, 9 aa, Homo Sapiens
PDVEDILSK

SEQ ID NO: 1113947 - protein, 9 aa, Homo Sapiens
FLLVLADPY

SEQ ID NO: 1113948 - protein, 9 aa, Homo Sapiens
APLKLSKAM

SEQ ID NO: 1113949 - protein, 9 aa, Homo Sapiens
QQEEGQRQG

SEQ ID NO: 1113950 - protein, 9 aa, Homo Sapiens
IKEEQVSLS

SEQ ID NO: 1113951 - protein, 9 aa, Homo Sapiens
TLNWMLKSP

SEQ ID NO: 1113952 - protein, 9 aa, Homo Sapiens
NAICYIESL

SEQ ID NO: 1113953 - protein, 9 aa, Homo Sapiens
CSADQQEEG

SEQ ID NO: 1113954 - protein, 9 aa, Homo Sapiens
KSPCACSSV

SEQ ID NO: 1113955 - protein, 9 aa, Homo Sapiens
LADEMSLGK

SEQ ID NO: 1113956 - protein, 9 aa, Homo Sapiens
LCSGQEQGQ

SEQ ID NO: 1113957 - protein, 9 aa, Homo Sapiens
DVEDILSKG

SEQ ID NO: 1113958 - protein, 9 aa, Homo Sapiens
QPFPRPRFQ

SEQ ID NO: 1113959 - protein, 9 aa, Homo Sapiens
LPTEKPPAP

SEQ ID NO: 1113960 - protein, 9 aa, Homo Sapiens
SNKDKEGKD

SEQ ID NO: 1113961 - protein, 9 aa, Homo Sapiens
MHKAVLTID

SEQ ID NO: 1113962 - protein, 9 aa, Homo Sapiens
LKQVQLEQD

SEQ ID NO: 1113963 - protein, 9 aa, Homo Sapiens
METEGNGED

SEQ ID NO: 1113964 - protein, 9 aa, Homo Sapiens
EERAGGGRG

SEQ ID NO: 1113965 - protein, 9 aa, Homo Sapiens
TAAATKVPT

SEQ ID NO: 1113966 - protein, 9 aa, Homo Sapiens
LLWTVNRTV

SEQ ID NO: 1113967 - protein, 9 aa, Homo Sapiens
VLWTMLRRF

SEQ ID NO: 1113968 - protein, 9 aa, Homo Sapiens
LRSLPTEKP

SEQ ID NO: 1113969 - protein, 9 aa, Homo Sapiens
DTIHDFRNQ

SEQ ID NO: 1113970 - protein, 9 aa, Homo Sapiens
QKMRIPVVR

SEQ ID NO: 1113971 - protein, 9 aa, Homo Sapiens
LSKITEQEK

SEQ ID NO: 1113972 - protein, 9 aa, Homo Sapiens
VYEVLKPRK

SEQ ID NO: 1113973 - protein, 9 aa, Homo Sapiens
EEGQRQGEG

SEQ ID NO: 1113974 - protein, 9 aa, Homo Sapiens
QHLAQHRLR

SEQ ID NO: 1113975 - protein, 9 aa, Homo Sapiens
LRHERGALP

SEQ ID NO: 1113976 - protein, 9 aa, Homo Sapiens
PFPRPRFQQ

SEQ ID NO: 1113977 - protein, 9 aa, Homo Sapiens
GFSLWAIRV

SEQ ID NO: 1113978 - protein, 9 aa, Homo Sapiens
PLILWPQAA

SEQ ID NO: 1113979 - protein, 9 aa, Homo Sapiens
TSYKSSCTM

SEQ ID NO: 1113980 - protein, 9 aa, Homo Sapiens
DVKEVNPTC

SEQ ID NO: 1113981 - protein, 9 aa, Homo Sapiens
RRALGAIPG

SEQ ID NO: 1113982 - protein, 9 aa, Homo Sapiens
TVIGVSSAL

SEQ ID NO: 1113983 - protein, 9 aa, Homo Sapiens
GASAEQDDL

SEQ ID NO: 1113984 - protein, 9 aa, Homo Sapiens
IIITVNYRL

SEQ ID NO: 1113985 - protein, 9 aa, Homo Sapiens
VGPPKSPCA

SEQ ID NO: 1113986 - protein, 9 aa, Homo Sapiens
VSRHEKMGY

SEQ ID NO: 1113987 - protein, 9 aa, Homo Sapiens
LAQHRLREP

SEQ ID NO: 1113988 - protein, 9 aa, Homo Sapiens
LCQQEQIQA

SEQ ID NO: 1113989 - protein, 9 aa, Homo Sapiens
PYTCDIFHK

SEQ ID NO: 1113990 - protein, 9 aa, Homo Sapiens
AEAVKGPVL

SEQ ID NO: 1113991 - protein, 9 aa, Homo Sapiens
AALQLWLRA

SEQ ID NO: 1113992 - protein, 9 aa, Homo Sapiens
LEQDEYAKH

SEQ ID NO: 1113993 - protein, 9 aa, Homo Sapiens
ATSLDNVLW

SEQ ID NO: 1113994 - protein, 9 aa, Homo Sapiens
EILRNAICY

SEQ ID NO: 1113995 - protein, 9 aa, Homo Sapiens
VPLKHEYTE

SEQ ID NO: 1113996 - protein, 9 aa, Homo Sapiens
SSEEGRFSQ

SEQ ID NO: 1113997 - protein, 9 aa, Homo Sapiens
KKNFLNAIK

SEQ ID NO: 1113998 - protein, 9 aa, Homo Sapiens
AKDLSKWSF

SEQ ID NO: 1113999 - protein, 9 aa, Homo Sapiens
EMSLGKTIQ

SEQ ID NO: 1114000 - protein, 9 aa, Homo Sapiens
QGAAGRLAT

SEQ ID NO: 1114001 - protein, 9 aa, Homo Sapiens
LQSLAQHPA

SEQ ID NO: 1114002 - protein, 9 aa, Homo Sapiens
GMDNNTPVR

SEQ ID NO: 1114003 - protein, 9 aa, Homo Sapiens
ISCKHAESM

SEQ ID NO: 1114004 - protein, 9 aa, Homo Sapiens
YTCDIFHKA

SEQ ID NO: 1114005 - protein, 9 aa, Homo Sapiens
PPPLILWPQ

SEQ ID NO: 1114006 - protein, 9 aa, Homo Sapiens
NLVDWYPWG

SEQ ID NO: 1114007 - protein, 9 aa, Homo Sapiens
GPTTPDSCP

SEQ ID NO: 1114008 - protein, 9 aa, Homo Sapiens
ASDHVKVVT

SEQ ID NO: 1114009 - protein, 9 aa, Homo Sapiens
LEEEEEVPD

SEQ ID NO: 1114010 - protein, 9 aa, Homo Sapiens
RVGLSAGTV

SEQ ID NO: 1114011 - protein, 9 aa, Homo Sapiens
AESMETEGN

SEQ ID NO: 1114012 - protein, 9 aa, Homo Sapiens
EKVEVEAVT

SEQ ID NO: 1114013 - protein, 9 aa, Homo Sapiens
LSKWSFSSQ

SEQ ID NO: 1114014 - protein, 9 aa, Homo Sapiens
YAQDKVCHN

SEQ ID NO: 1114015 - protein, 9 aa, Homo Sapiens
MASLPSRGW

SEQ ID NO: 1114016 - protein, 9 aa, Homo Sapiens
PQNRRAAGQ

SEQ ID NO: 1114017 - protein, 9 aa, Homo Sapiens
GKKYGFSLW

SEQ ID NO: 1114018 - protein, 9 aa, Homo Sapiens
RPFVEEAEP

SEQ ID NO: 1114019 - protein, 9 aa, Homo Sapiens
QGQVCCSAD

SEQ ID NO: 1114020 - protein, 9 aa, Homo Sapiens
GAQHLTMTS

SEQ ID NO: 1114021 - protein, 9 aa, Homo Sapiens
GTEASIGVL

SEQ ID NO: 1114022 - protein, 9 aa, Homo Sapiens
EPGVQYNYM

SEQ ID NO: 1114023 - protein, 9 aa, Homo Sapiens
VLSNGIQFS

SEQ ID NO: 1114024 - protein, 9 aa, Homo Sapiens
AGTVIGVSS

SEQ ID NO: 1114025 - protein, 9 aa, Homo Sapiens
HANTVYGLG

SEQ ID NO: 1114026 - protein, 9 aa, Homo Sapiens
ELEEEEEVP

SEQ ID NO: 1114027 - protein, 9 aa, Homo Sapiens
QRINQHADA

SEQ ID NO: 1114028 - protein, 9 aa, Homo Sapiens
FQQETGHPS

SEQ ID NO: 1114029 - protein, 9 aa, Homo Sapiens
DKVCHNEEQ

SEQ ID NO: 1114030 - protein, 9 aa, Homo Sapiens
QRHLQGAAG

SEQ ID NO: 1114031 - protein, 9 aa, Homo Sapiens
AEQDDLQED

SEQ ID NO: 1114032 - protein, 9 aa, Homo Sapiens
HNEEQLLSQ

SEQ ID NO: 1114033 - protein, 9 aa, Homo Sapiens
RGWLSTTPA

SEQ ID NO: 1114034 - protein, 9 aa, Homo Sapiens
ERPYTCDIF

SEQ ID NO: 1114035 - protein, 9 aa, Homo Sapiens
CKDDKAVVQ

SEQ ID NO: 1114036 - protein, 9 aa, Homo Sapiens
FGQWADSHA

SEQ ID NO: 1114037 - protein, 9 aa, Homo Sapiens
KAFPYTAQL

SEQ ID NO: 1114038 - protein, 9 aa, Homo Sapiens
DFPTLIKKL

SEQ ID NO: 1114039 - protein, 9 aa, Homo Sapiens
LNAIKAMRA

SEQ ID NO: 1114040 - protein, 9 aa, Homo Sapiens
DILSKGQHL

SEQ ID NO: 1114041 - protein, 9 aa, Homo Sapiens
LLVLADPYM

SEQ ID NO: 1114042 - protein, 9 aa, Homo Sapiens
LVLADPYMP

SEQ ID NO: 1114043 - protein, 9 aa, Homo Sapiens
LDNVLWTML

SEQ ID NO: 1114044 - protein, 9 aa, Homo Sapiens
SCPRLRAAA

SEQ ID NO: 1114045 - protein, 9 aa, Homo Sapiens
FTVYEVLKP

SEQ ID NO: 1114046 - protein, 9 aa, Homo Sapiens
DPTHHPQNR

SEQ ID NO: 1114047 - protein, 9 aa, Homo Sapiens
SQSSEEGRF

SEQ ID NO: 1114048 - protein, 9 aa, Homo Sapiens
GRGLTVGTP

SEQ ID NO: 1114049 - protein, 9 aa, Homo Sapiens
LQHAYNLVD

SEQ ID NO: 1114050 - protein, 9 aa, Homo Sapiens
RQRINQHAD

SEQ ID NO: 1114051 - protein, 9 aa, Homo Sapiens
LVDWYPWGQ

SEQ ID NO: 1114052 - protein, 9 aa, Homo Sapiens
PTLIKKLSA

SEQ ID NO: 1114053 - protein, 9 aa, Homo Sapiens
VCHNEEQLL

SEQ ID NO: 1114054 - protein, 9 aa, Homo Sapiens
KFGQWADSH

SEQ ID NO: 1114055 - protein, 9 aa, Homo Sapiens
ADEMSLGKT

SEQ ID NO: 1114056 - protein, 9 aa, Homo Sapiens
LWTVNRTVI

SEQ ID NO: 1114057 - protein, 9 aa, Homo Sapiens
ALPRRALGA

SEQ ID NO: 1114058 - protein, 9 aa, Homo Sapiens
ADSHANTVY

SEQ ID NO: 1114059 - protein, 9 aa, Homo Sapiens
SYSRLQQCR

SEQ ID NO: 1114060 - protein, 9 aa, Homo Sapiens
FSKYRQRIN

SEQ ID NO: 1114061 - protein, 9 aa, Homo Sapiens
DTTTIITLN

SEQ ID NO: 1114062 - protein, 9 aa, Homo Sapiens
AVKGPVLAA

SEQ ID NO: 1114063 - protein, 9 aa, Homo Sapiens
TMPVDERDL

SEQ ID NO: 1114064 - protein, 9 aa, Homo Sapiens
KGPVLAAPA

SEQ ID NO: 1114065 - protein, 9 aa, Homo Sapiens
VLLAQHLAQ

SEQ ID NO: 1114066 - protein, 9 aa, Homo Sapiens
YGIGAMNAF

SEQ ID NO: 1114067 - protein, 9 aa, Homo Sapiens
EQDDLQEDR

SEQ ID NO: 1114068 - protein, 9 aa, Homo Sapiens
AAVAALQLW

SEQ ID NO: 1114069 - protein, 9 aa, Homo Sapiens
KEIKASPDY

SEQ ID NO: 1114070 - protein, 9 aa, Homo Sapiens
LEESVGLRA

SEQ ID NO: 1114071 - protein, 9 aa, Homo Sapiens
SAALRSLPT

SEQ ID NO: 1114072 - protein, 9 aa, Homo Sapiens
QQCRERRAL

SEQ ID NO: 1114073 - protein, 9 aa, Homo Sapiens
VLKPRKKCK

SEQ ID NO: 1114074 - protein, 9 aa, Homo Sapiens
SKAMHKAVL

SEQ ID NO: 1114075 - protein, 9 aa, Homo Sapiens
SAGTVIGVS

SEQ ID NO: 1114076 - protein, 9 aa, Homo Sapiens
ALRSLPTEK

SEQ ID NO: 1114077 - protein, 9 aa, Homo Sapiens
VVWTPPTSY

SEQ ID NO: 1114078 - protein, 9 aa, Homo Sapiens
KNIHESFMS

SEQ ID NO: 1114079 - protein, 9 aa, Homo Sapiens
SHANTVYGL

SEQ ID NO: 1114080 - protein, 9 aa, Homo Sapiens
CASDHVKVV

SEQ ID NO: 1114081 - protein, 9 aa, Homo Sapiens
QPDVEDILS

SEQ ID NO: 1114082 - protein, 9 aa, Homo Sapiens
LLQHAYNLV

SEQ ID NO: 1114083 - protein, 9 aa, Homo Sapiens
PLKHEYTED

SEQ ID NO: 1114084 - protein, 9 aa, Homo Sapiens
TDPTHHPQN

SEQ ID NO: 1114085 - protein, 9 aa, Homo Sapiens
SLDNVLWTM

SEQ ID NO: 1114086 - protein, 9 aa, Homo Sapiens
DTAPPLSIS

SEQ ID NO: 1114087 - protein, 9 aa, Homo Sapiens
EPAARAAQE

SEQ ID NO: 1114088 - protein, 9 aa, Homo Sapiens
IQFSRISPD

SEQ ID NO: 1114089 - protein, 9 aa, Homo Sapiens
TTIITLNWM

SEQ ID NO: 1114090 - protein, 9 aa, Homo Sapiens
CHNEEQLLS

SEQ ID NO: 1114091 - protein, 9 aa, Homo Sapiens
GGGRGGHGA

SEQ ID NO: 1114092 - protein, 9 aa, Homo Sapiens
GDTTTIITL

SEQ ID NO: 1114093 - protein, 9 aa, Homo Sapiens
SPSGTMMDR

SEQ ID NO: 1114094 - protein, 9 aa, Homo Sapiens
EAPEKETKA

SEQ ID NO: 1114095 - protein, 9 aa, Homo Sapiens
KKLSAEPTE

SEQ ID NO: 1114096 - protein, 9 aa, Homo Sapiens
SMETEGNGE

SEQ ID NO: 1114097 - protein, 9 aa, Homo Sapiens
SCKDDKAVV

SEQ ID NO: 1114098 - protein, 9 aa, Homo Sapiens
ALQLWLRAA

SEQ ID NO: 1114099 - protein, 9 aa, Homo Sapiens
VTPTMLAAA

SEQ ID NO: 1114100 - protein, 9 aa, Homo Sapiens
GIQFSRISP

SEQ ID NO: 1114101 - protein, 9 aa, Homo Sapiens
LKHEYTEDV

SEQ ID NO: 1114102 - protein, 9 aa, Homo Sapiens
LLAQHLAQH

SEQ ID NO: 1114103 - protein, 9 aa, Homo Sapiens
QYNYMYDED

SEQ ID NO: 1114104 - protein, 9 aa, Homo Sapiens
VKGPVLAAP

SEQ ID NO: 1114105 - protein, 9 aa, Homo Sapiens
QQKMRIPVV

SEQ ID NO: 1114106 - protein, 9 aa, Homo Sapiens
NAIKAMRAL

SEQ ID NO: 1114107 - protein, 9 aa, Homo Sapiens
EAQSKTGIL

SEQ ID NO: 1114108 - protein, 9 aa, Homo Sapiens
NTTVPSVGV

SEQ ID NO: 1114109 - protein, 9 aa, Homo Sapiens
KHEYTEDVG

SEQ ID NO: 1114110 - protein, 9 aa, Homo Sapiens
LQQCRERRA

SEQ ID NO: 1114111 - protein, 9 aa, Homo Sapiens
ADQQEEGQR

SEQ ID NO: 1114112 - protein, 9 aa, Homo Sapiens
WLSTTPAHS

SEQ ID NO: 1114113 - protein, 9 aa, Homo Sapiens
YNISQLTDK

SEQ ID NO: 1114114 - protein, 9 aa, Homo Sapiens
KAMHKAVLT

SEQ ID NO: 1114115 - protein, 9 aa, Homo Sapiens
KDLSKWSFS

SEQ ID NO: 1114116 - protein, 9 aa, Homo Sapiens
LLRHERGAL

SEQ ID NO: 1114117 - protein, 9 aa, Homo Sapiens
MLAAAQQWL

SEQ ID NO: 1114118 - protein, 9 aa, Homo Sapiens
GAGGMEETF

SEQ ID NO: 1114119 - protein, 9 aa, Homo Sapiens
KVCHNEEQL

SEQ ID NO: 1114120 - protein, 9 aa, Homo Sapiens
HHPQNRRAA

SEQ ID NO: 1114121 - protein, 9 aa, Homo Sapiens
IPVVRVQAL

SEQ ID NO: 1114122 - protein, 9 aa, Homo Sapiens
SQLEESVGL

SEQ ID NO: 1114123 - protein, 9 aa, Homo Sapiens
EDYGRYSCE

SEQ ID NO: 1114124 - protein, 9 aa, Homo Sapiens
GTVIGVSSA

SEQ ID NO: 1114125 - protein, 9 aa, Homo Sapiens
WTVNRTVIT

SEQ ID NO: 1114126 - protein, 9 aa, Homo Sapiens
TVVWTPPTS

SEQ ID NO: 1114127 - protein, 9 aa, Homo Sapiens
YAMSGTEAS

SEQ ID NO: 1114128 - protein, 9 aa, Homo Sapiens
IMVQLLWTV

SEQ ID NO: 1114129 - protein, 9 aa, Homo Sapiens
RLATLLLRH

SEQ ID NO: 1114130 - protein, 9 aa, Homo Sapiens
TRDPLSKIT

SEQ ID NO: 1114131 - protein, 9 aa, Homo Sapiens
LPQRHLQGA

SEQ ID NO: 1114132 - protein, 9 aa, Homo Sapiens
MLTLIREEI

SEQ ID NO: 1114133 - protein, 9 aa, Homo Sapiens
AVTITQEPR

SEQ ID NO: 1114134 - protein, 9 aa, Homo Sapiens
GQVCCSADQ

SEQ ID NO: 1114135 - protein, 9 aa, Homo Sapiens
DPLSKITEQ

SEQ ID NO: 1114136 - protein, 9 aa, Homo Sapiens
QFTVYEVLK

SEQ ID NO: 1114137 - protein, 9 aa, Homo Sapiens
VTVTPTMLA

SEQ ID NO: 1114138 - protein, 9 aa, Homo Sapiens
GHPDTAPPL

SEQ ID NO: 1114139 - protein, 9 aa, Homo Sapiens
RSRGAGGME

SEQ ID NO: 1114140 - protein, 9 aa, Homo Sapiens
WADSHANTV

SEQ ID NO: 1114141 - protein, 9 aa, Homo Sapiens
IHESFMSQI

SEQ ID NO: 1114142 - protein, 9 aa, Homo Sapiens
DPRSQLEES

SEQ ID NO: 1114143 - protein, 9 aa, Homo Sapiens
SKKKKLGAG

SEQ ID NO: 1114144 - protein, 9 aa, Homo Sapiens
VYEAFNWHH

SEQ ID NO: 1114145 - protein, 9 aa, Homo Sapiens
NADVYKLDK

SEQ ID NO: 1114146 - protein, 9 aa, Homo Sapiens
LKLSKAMHK

SEQ ID NO: 1114147 - protein, 9 aa, Homo Sapiens
QHPAPANTN

SEQ ID NO: 1114148 - protein, 9 aa, Homo Sapiens
CAPGHPDTA

SEQ ID NO: 1114149 - protein, 9 aa, Homo Sapiens
AEEVGEERA

SEQ ID NO: 1114150 - protein, 9 aa, Homo Sapiens
MDNNTPVRY

SEQ ID NO: 1114151 - protein, 9 aa, Homo Sapiens
SPITAAATK

SEQ ID NO: 1114152 - protein, 9 aa, Homo Sapiens
TDPRSQLEE

SEQ ID NO: 1114153 - protein, 9 aa, Homo Sapiens
IPGPTDPTH

SEQ ID NO: 1114154 - protein, 9 aa, Homo Sapiens
AGGPGHTTY

SEQ ID NO: 1114155 - protein, 9 aa, Homo Sapiens
ARAAQEGPP

SEQ ID NO: 1114156 - protein, 9 aa, Homo Sapiens
TPRVLSNGI

SEQ ID NO: 1114157 - protein, 9 aa, Homo Sapiens
LAPAPTYGI

SEQ ID NO: 1114158 - protein, 9 aa, Homo Sapiens
GRLATLLLR

SEQ ID NO: 1114159 - protein, 9 aa, Homo Sapiens
EDVAGGPGH

SEQ ID NO: 1114160 - protein, 9 aa, Homo Sapiens
APTYGIGAM

SEQ ID NO: 1114161 - protein, 9 aa, Homo Sapiens
PAAAEEVGE

SEQ ID NO: 1114162 - protein, 9 aa, Homo Sapiens
APGREKEIK

SEQ ID NO: 1114163 - protein, 9 aa, Homo Sapiens
VPLCSGQEQ

SEQ ID NO: 1114164 - protein, 9 aa, Homo Sapiens
YAHRTLPHM

SEQ ID NO: 1114165 - protein, 9 aa, Homo Sapiens
PGHPDTAPP

SEQ ID NO: 1114166 - protein, 9 aa, Homo Sapiens
LYAQDKVCH

SEQ ID NO: 1114167 - protein, 9 aa, Homo Sapiens
QVQLEQDEY

SEQ ID NO: 1114168 - protein, 9 aa, Homo Sapiens
PHMLAFRVS

SEQ ID NO: 1114169 - protein, 9 aa, Homo Sapiens
TTVPSVGVV

SEQ ID NO: 1114170 - protein, 9 aa, Homo Sapiens
ADARLGRAL

SEQ ID NO: 1114171 - protein, 9 aa, Homo Sapiens
LAAPARRRL

SEQ ID NO: 1114172 - protein, 9 aa, Homo Sapiens
IITVNYRLG

SEQ ID NO: 1114173 - protein, 9 aa, Homo Sapiens
ECGKAFPYT

SEQ ID NO: 1114174 - protein, 9 aa, Homo Sapiens
AFNWHHGVF

SEQ ID NO: 1114175 - protein, 9 aa, Homo Sapiens
HLAQHRLRE

SEQ ID NO: 1114176 - protein, 9 aa, Homo Sapiens
HYKANKDVM

SEQ ID NO: 1114177 - protein, 9 aa, Homo Sapiens
EVGEERAGG

SEQ ID NO: 1114178 - protein, 9 aa, Homo Sapiens
FSLWAIRVY

SEQ ID NO: 1114179 - protein, 9 aa, Homo Sapiens
MLAFRVSIA

SEQ ID NO: 1114180 - protein, 9 aa, Homo Sapiens
DAHLPQRHL

SEQ ID NO: 1114181 - protein, 9 aa, Homo Sapiens
TYGIGAMNA

SEQ ID NO: 1114182 - protein, 9 aa, Homo Sapiens
GEEEEEVLA

SEQ ID NO: 1114183 - protein, 9 aa, Homo Sapiens
RVVKDVATG

SEQ ID NO: 1114184 - protein, 9 aa, Homo Sapiens
LASYGNVII

SEQ ID NO: 1114185 - protein, 9 aa, Homo Sapiens
EAEPAARAA

SEQ ID NO: 1114186 - protein, 9 aa, Homo Sapiens
AEAPEKETK

SEQ ID NO: 1114187 - protein, 9 aa, Homo Sapiens
DVFWSTADI

SEQ ID NO: 1114188 - protein, 9 aa, Homo Sapiens
NIHESFMSQ

SEQ ID NO: 1114189 - protein, 9 aa, Homo Sapiens
TLLLRHERG

SEQ ID NO: 1114190 - protein, 9 aa, Homo Sapiens
RIVTVTPTM

SEQ ID NO: 1114191 - protein, 9 aa, Homo Sapiens
TPTMLAAAQ

SEQ ID NO: 1114192 - protein, 9 aa, Homo Sapiens
GADAHLPQR

SEQ ID NO: 1114193 - protein, 9 aa, Homo Sapiens
KKIRHYKAN

SEQ ID NO: 1114194 - protein, 9 aa, Homo Sapiens
QRKEKGGGL

SEQ ID NO: 1114195 - protein, 9 aa, Homo Sapiens
EQGQVCCSA

SEQ ID NO: 1114196 - protein, 9 aa, Homo Sapiens
AGGGRGGHG

SEQ ID NO: 1114197 - protein, 9 aa, Homo Sapiens
DFYSITGQG

SEQ ID NO: 1114198 - protein, 9 aa, Homo Sapiens
SVGVVTVES

SEQ ID NO: 1114199 - protein, 9 aa, Homo Sapiens
RGAGGMEET

SEQ ID NO: 1114200 - protein, 9 aa, Homo Sapiens
MGPTTPDSC

SEQ ID NO: 1114201 - protein, 9 aa, Homo Sapiens
TGILTLKYP

SEQ ID NO: 1114202 - protein, 9 aa, Homo Sapiens
AARAAQEGP

SEQ ID NO: 1114203 - protein, 9 aa, Homo Sapiens
LGAIPGPTD

SEQ ID NO: 1114204 - protein, 9 aa, Homo Sapiens
LQVPAAAEE

SEQ ID NO: 1114205 - protein, 9 aa, Homo Sapiens
CHDTIHDFR

SEQ ID NO: 1114206 - protein, 9 aa, Homo Sapiens
EAVTITQEP

SEQ ID NO: 1114207 - protein, 9 aa, Homo Sapiens
RTLPHMLAF

SEQ ID NO: 1114208 - protein, 9 aa, Homo Sapiens
VGLSAGTVI

SEQ ID NO: 1114209 - protein, 9 aa, Homo Sapiens
STRDPLSKI

SEQ ID NO: 1114210 - protein, 9 aa, Homo Sapiens
ALAILLSLA

SEQ ID NO: 1114211 - protein, 9 aa, Homo Sapiens
VVRVQALPT

SEQ ID NO: 1114212 - protein, 9 aa, Homo Sapiens
VGDEAQSKT

SEQ ID NO: 1114213 - protein, 9 aa, Homo Sapiens
EASIGVLVD

SEQ ID NO: 1114214 - protein, 9 aa, Homo Sapiens
GKAFPYTAQ

SEQ ID NO: 1114215 - protein, 9 aa, Homo Sapiens
IKASPDYLE

SEQ ID NO: 1114216 - protein, 9 aa, Homo Sapiens
HHTDPRSQL

SEQ ID NO: 1114217 - protein, 9 aa, Homo Sapiens
NWHHGVFVG

SEQ ID NO: 1114218 - protein, 9 aa, Homo Sapiens
TTPDSCPRL

SEQ ID NO: 1114219 - protein, 9 aa, Homo Sapiens
AAQEGPPGL

SEQ ID NO: 1114220 - protein, 9 aa, Homo Sapiens
IHDFRNQVY

SEQ ID NO: 1114221 - protein, 9 aa, Homo Sapiens
GREKEIKAS

SEQ ID NO: 1114222 - protein, 9 aa, Homo Sapiens
NQHADAVHL

SEQ ID NO: 1114223 - protein, 9 aa, Homo Sapiens
SKITEQEKD

SEQ ID NO: 1114224 - protein, 9 aa, Homo Sapiens
AQHLAQHRL

SEQ ID NO: 1114225 - protein, 9 aa, Homo Sapiens
VLAAPARRR

SEQ ID NO: 1114226 - protein, 9 aa, Homo Sapiens
IRHYKANKD

SEQ ID NO: 1114227 - protein, 9 aa, Homo Sapiens
RECGKAFPY

SEQ ID NO: 1114228 - protein, 9 aa, Homo Sapiens
AMLTLIREE

SEQ ID NO: 1114229 - protein, 9 aa, Homo Sapiens
TKNIHESFM

SEQ ID NO: 1114230 - protein, 9 aa, Homo Sapiens
KVPLKHEYT

SEQ ID NO: 1114231 - protein, 9 aa, Homo Sapiens
KMGYNISQL

SEQ ID NO: 1114232 - protein, 9 aa, Homo Sapiens
EMLQSLAQH

SEQ ID NO: 1114233 - protein, 9 aa, Homo Sapiens
CPRLRAAAC

SEQ ID NO: 1114234 - protein, 9 aa, Homo Sapiens
HLQGAAGRL

SEQ ID NO: 1114235 - protein, 9 aa, Homo Sapiens
YSCEVIDGL

SEQ ID NO: 1114236 - protein, 9 aa, Homo Sapiens
DVYKLDKQH

SEQ ID NO: 1114237 - protein, 9 aa, Homo Sapiens
TAPPLSISD

SEQ ID NO: 1114238 - protein, 9 aa, Homo Sapiens
QSLAQHPAP

SEQ ID NO: 1114239 - protein, 9 aa, Homo Sapiens
KELEEEQKK

SEQ ID NO: 1114240 - protein, 9 aa, Homo Sapiens
PTEKPPAPE

SEQ ID NO: 1114241 - protein, 9 aa, Homo Sapiens
TCDIFHKAF

SEQ ID NO: 1114242 - protein, 9 aa, Homo Sapiens
TSLDNVLWT

SEQ ID NO: 1114243 - protein, 9 aa, Homo Sapiens
DARVVKDVA

SEQ ID NO: 1114244 - protein, 9 aa, Homo Sapiens
QLLWTVNRT

SEQ ID NO: 1114245 - protein, 9 aa, Homo Sapiens
EVVFAVDVK

SEQ ID NO: 1114246 - protein, 9 aa, Homo Sapiens
SRGAGGMEE

SEQ ID NO: 1114247 - protein, 9 aa, Homo Sapiens
AQDKVCHNE

SEQ ID NO: 1114248 - protein, 9 aa, Homo Sapiens
GILADEMSL

SEQ ID NO: 1114249 - protein, 9 aa, Homo Sapiens
EAEAPEKET

SEQ ID NO: 1114250 - protein, 9 aa, Homo Sapiens
EGRFSQVST

SEQ ID NO: 1114251 - protein, 9 aa, Homo Sapiens
RGGHGADAH

SEQ ID NO: 1114252 - protein, 9 aa, Homo Sapiens
EGKDFYSIT

SEQ ID NO: 1114253 - protein, 9 aa, Homo Sapiens
FVEEAEPAA

SEQ ID NO: 1114254 - protein, 9 aa, Homo Sapiens
LKPRKKCKK

SEQ ID NO: 1114255 - protein, 9 aa, Homo Sapiens
RAAQEGPPG

SEQ ID NO: 1114256 - protein, 9 aa, Homo Sapiens
HRTLPHMLA

SEQ ID NO: 1114257 - protein, 9 aa, Homo Sapiens
GLTVGTPAT

SEQ ID NO: 1114258 - protein, 9 aa, Homo Sapiens
YFLLVLADP

SEQ ID NO: 1114259 - protein, 9 aa, Homo Sapiens
QLEESVGLR

SEQ ID NO: 1114260 - protein, 9 aa, Homo Sapiens
CDIFHKAFR

SEQ ID NO: 1114261 - protein, 9 aa, Homo Sapiens
TLPHMLAFR

SEQ ID NO: 1114262 - protein, 9 aa, Homo Sapiens
TPDSCPRLR

SEQ ID NO: 1114263 - protein, 9 aa, Homo Sapiens
EDGEEEEEV

SEQ ID NO: 1114264 - protein, 9 aa, Homo Sapiens
GEERAGGGR

SEQ ID NO: 1114265 - protein, 9 aa, Homo Sapiens
RALAILLSL

SEQ ID NO: 1114266 - protein, 9 aa, Homo Sapiens
WAIRVYMGD

SEQ ID NO: 1114267 - protein, 9 aa, Homo Sapiens
NGHKYFLLV

SEQ ID NO: 1114268 - protein, 9 aa, Homo Sapiens
VATLKKIRH

SEQ ID NO: 1114269 - protein, 9 aa, Homo Sapiens
IFHKAFRRQ

SEQ ID NO: 1114270 - protein, 9 aa, Homo Sapiens
KGQRKEKGG

SEQ ID NO: 1114271 - protein, 9 aa, Homo Sapiens
NVIIITVNY

SEQ ID NO: 1114272 - protein, 9 aa, Homo Sapiens
GGPGHTTYA

SEQ ID NO: 1114273 - protein, 9 aa, Homo Sapiens
KIRHYKANK

SEQ ID NO: 1114274 - protein, 9 aa, Homo Sapiens
QHRLREPQL

SEQ ID NO: 1114275 - protein, 9 aa, Homo Sapiens
PAPTYGIGA

SEQ ID NO: 1114276 - protein, 9 aa, Homo Sapiens
CSGQEQGQV

SEQ ID NO: 1114277 - protein, 9 aa, Homo Sapiens
VEILRNAIC

SEQ ID NO: 1114278 - protein, 9 aa, Homo Sapiens
SKYRQRINQ

SEQ ID NO: 1114279 - protein, 9 aa, Homo Sapiens
KDFYSITGQ

SEQ ID NO: 1114280 - protein, 9 aa, Homo Sapiens
KITEQEKDF

SEQ ID NO: 1114281 - protein, 9 aa, Homo Sapiens
GPTDPTHHP

SEQ ID NO: 1114282 - protein, 9 aa, Homo Sapiens
VCCSADQQE

SEQ ID NO: 1114283 - protein, 9 aa, Homo Sapiens
GHKYFLLVL

SEQ ID NO: 1114284 - protein, 9 aa, Homo Sapiens
CYIESLQEL

SEQ ID NO: 1114285 - protein, 9 aa, Homo Sapiens
YNYMYDEDE

SEQ ID NO: 1114286 - protein, 9 aa, Homo Sapiens
VDAVKNADV

SEQ ID NO: 1114287 - protein, 9 aa, Homo Sapiens
QDEYAKHIK

SEQ ID NO: 1114288 - protein, 9 aa, Homo Sapiens
SKWSFSSQR

SEQ ID NO: 1114289 - protein, 9 aa, Homo Sapiens
FLNAIKAMR

SEQ ID NO: 1114290 - protein, 9 aa, Homo Sapiens
LEDYGRYSC

SEQ ID NO: 1114291 - protein, 9 aa, Homo Sapiens
RGLTVGTPA

SEQ ID NO: 1114292 - protein, 9 aa, Homo Sapiens
ESMETEGNG

SEQ ID NO: 1114293 - protein, 9 aa, Homo Sapiens
EKELEEEQK

SEQ ID NO: 1114294 - protein, 9 aa, Homo Sapiens
ARLGRALAI

SEQ ID NO: 1114295 - protein, 9 aa, Homo Sapiens
GNVIIITVN

SEQ ID NO: 1114296 - protein, 9 aa, Homo Sapiens
SGTEASIGV

SEQ ID NO: 1114297 - protein, 9 aa, Homo Sapiens
AYNLVDWYP

SEQ ID NO: 1114298 - protein, 9 aa, Homo Sapiens
PTYGIGAMN

SEQ ID NO: 1114299 - protein, 9 aa, Homo Sapiens
SDHVKVVTL

SEQ ID NO: 1114300 - protein, 9 aa, Homo Sapiens
HEKMGYNIS

SEQ ID NO: 1114301 - protein, 9 aa, Homo Sapiens
ASYGNVIII

SEQ ID NO: 1114302 - protein, 9 aa, Homo Sapiens
TNRIAGKII

SEQ ID NO: 1114303 - protein, 9 aa, Homo Sapiens
QYPDWPAKD

SEQ ID NO: 1114304 - protein, 9 aa, Homo Sapiens
IIEVISNAL

SEQ ID NO: 1114305 - protein, 9 aa, Homo Sapiens
SGRWKPPAV

SEQ ID NO: 1114306 - protein, 9 aa, Homo Sapiens
PKQTIHEEG

SEQ ID NO: 1114307 - protein, 9 aa, Homo Sapiens
KTNRIAGKI

SEQ ID NO: 1114308 - protein, 9 aa, Homo Sapiens
RKRWHRWQG

SEQ ID NO: 1114309 - protein, 9 aa, Homo Sapiens
SLKARGALA

SEQ ID NO: 1114310 - protein, 9 aa, Homo Sapiens
DFSCVGKKP

SEQ ID NO: 1114311 - protein, 9 aa, Homo Sapiens
NRPKFSGLQ

SEQ ID NO: 1114312 - protein, 9 aa, Homo Sapiens
VLCRTHLKE

SEQ ID NO: 1114313 - protein, 9 aa, Homo Sapiens
QLQLHSLAH

SEQ ID NO: 1114314 - protein, 9 aa, Homo Sapiens
LPMLTGCPF

SEQ ID NO: 1114315 - protein, 9 aa, Homo Sapiens
STSITRFAF

SEQ ID NO: 1114316 - protein, 9 aa, Homo Sapiens
CATTTCPGP

SEQ ID NO: 1114317 - protein, 9 aa, Homo Sapiens
RVTIMCDKF

SEQ ID NO: 1114318 - protein, 9 aa, Homo Sapiens
LKVPIIRQV

SEQ ID NO: 1114319 - protein, 9 aa, Homo Sapiens
GCGPWFWIP

SEQ ID NO: 1114320 - protein, 9 aa, Homo Sapiens
LLPPEGPLK

SEQ ID NO: 1114321 - protein, 9 aa, Homo Sapiens
CLVDAHMLD

SEQ ID NO: 1114322 - protein, 9 aa, Homo Sapiens
SYYSPYDQR

SEQ ID NO: 1114323 - protein, 9 aa, Homo Sapiens
TARKGPPNP

SEQ ID NO: 1114324 - protein, 9 aa, Homo Sapiens
SLGTVEWTQ

SEQ ID NO: 1114325 - protein, 9 aa, Homo Sapiens
TLTHPSMET

SEQ ID NO: 1114326 - protein, 9 aa, Homo Sapiens
CFSPLWLMT

SEQ ID NO: 1114327 - protein, 9 aa, Homo Sapiens
HSSLISGRL

SEQ ID NO: 1114328 - protein, 9 aa, Homo Sapiens
SYSNLPQVQ

SEQ ID NO: 1114329 - protein, 9 aa, Homo Sapiens
KALWEMALT

SEQ ID NO: 1114330 - protein, 9 aa, Homo Sapiens
VKWHLTIMM

SEQ ID NO: 1114331 - protein, 9 aa, Homo Sapiens
PSRVLKSLW

SEQ ID NO: 1114332 - protein, 9 aa, Homo Sapiens
EKRQLIVVK

SEQ ID NO: 1114333 - protein, 9 aa, Homo Sapiens
QKDALECCL

SEQ ID NO: 1114334 - protein, 9 aa, Homo Sapiens
EAVSVDYHV

SEQ ID NO: 1114335 - protein, 9 aa, Homo Sapiens
DSRQSVMSG

SEQ ID NO: 1114336 - protein, 9 aa, Homo Sapiens
MLQREKEAG

SEQ ID NO: 1114337 - protein, 9 aa, Homo Sapiens
RTVQWPPGE

SEQ ID NO: 1114338 - protein, 9 aa, Homo Sapiens
RIDSFHSRN

SEQ ID NO: 1114339 - protein, 9 aa, Homo Sapiens
TLYSQIKDV

SEQ ID NO: 1114340 - protein, 9 aa, Homo Sapiens
CGFSLSAVY

SEQ ID NO: 1114341 - protein, 9 aa, Homo Sapiens
AVLGASRRT

SEQ ID NO: 1114342 - protein, 9 aa, Homo Sapiens
IYKLYEVQT

SEQ ID NO: 1114343 - protein, 9 aa, Homo Sapiens
IYDDCIGTV

SEQ ID NO: 1114344 - protein, 9 aa, Homo Sapiens
PSPGPRLAP

SEQ ID NO: 1114345 - protein, 9 aa, Homo Sapiens
WGMDWILAL

SEQ ID NO: 1114346 - protein, 9 aa, Homo Sapiens
KVYLETYDC

SEQ ID NO: 1114347 - protein, 9 aa, Homo Sapiens
RRLMSVDMI

SEQ ID NO: 1114348 - protein, 9 aa, Homo Sapiens
AVYRRPPTS

SEQ ID NO: 1114349 - protein, 9 aa, Homo Sapiens
VINRLVVDV

SEQ ID NO: 1114350 - protein, 9 aa, Homo Sapiens
LDYYLYDQQ

SEQ ID NO: 1114351 - protein, 9 aa, Homo Sapiens
SLWWYPAVR

SEQ ID NO: 1114352 - protein, 9 aa, Homo Sapiens
VTQLDQRLT

SEQ ID NO: 1114353 - protein, 9 aa, Homo Sapiens
STKSIVIGP

SEQ ID NO: 1114354 - protein, 9 aa, Homo Sapiens
IPEAMFSDL

SEQ ID NO: 1114355 - protein, 9 aa, Homo Sapiens
FRHQRTHTG

SEQ ID NO: 1114356 - protein, 9 aa, Homo Sapiens
APLRVLSFN

SEQ ID NO: 1114357 - protein, 9 aa, Homo Sapiens
RILRLRRHL

SEQ ID NO: 1114358 - protein, 9 aa, Homo Sapiens
TKATKFEGD

SEQ ID NO: 1114359 - protein, 9 aa, Homo Sapiens
SQLWRWKPA

SEQ ID NO: 1114360 - protein, 9 aa, Homo Sapiens
LQERGGVAT

SEQ ID NO: 1114361 - protein, 9 aa, Homo Sapiens
GGPLPPRRP

SEQ ID NO: 1114362 - protein, 9 aa, Homo Sapiens
LQDLVHVHP

SEQ ID NO: 1114363 - protein, 9 aa, Homo Sapiens
RFRRRCWHR

SEQ ID NO: 1114364 - protein, 9 aa, Homo Sapiens
QHAELAILL

SEQ ID NO: 1114365 - protein, 9 aa, Homo Sapiens
DSSSSNEDE

SEQ ID NO: 1114366 - protein, 9 aa, Homo Sapiens
PPQQQQHIF

SEQ ID NO: 1114367 - protein, 9 aa, Homo Sapiens
TEEDKTAVV

SEQ ID NO: 1114368 - protein, 9 aa, Homo Sapiens
PAVPAAACP

SEQ ID NO: 1114369 - protein, 9 aa, Homo Sapiens
SFTVPNIDN

SEQ ID NO: 1114370 - protein, 9 aa, Homo Sapiens
PSWCPPGTT

SEQ ID NO: 1114371 - protein, 9 aa, Homo Sapiens
AFPSRSLSS

SEQ ID NO: 1114372 - protein, 9 aa, Homo Sapiens
AVGVIVDLT

SEQ ID NO: 1114373 - protein, 9 aa, Homo Sapiens
AVAWMRTHA

SEQ ID NO: 1114374 - protein, 9 aa, Homo Sapiens
LPEPSCRPR

SEQ ID NO: 1114375 - protein, 9 aa, Homo Sapiens
SLPGPCASL

SEQ ID NO: 1114376 - protein, 9 aa, Homo Sapiens
NTAALSLSR

SEQ ID NO: 1114377 - protein, 9 aa, Homo Sapiens
KKNQEKIAG

SEQ ID NO: 1114378 - protein, 9 aa, Homo Sapiens
QFVPVLSTP

SEQ ID NO: 1114379 - protein, 9 aa, Homo Sapiens
RPLAQSPPH

SEQ ID NO: 1114380 - protein, 9 aa, Homo Sapiens
RMLPFSRFL

SEQ ID NO: 1114381 - protein, 9 aa, Homo Sapiens
QHIEQLSRF

SEQ ID NO: 1114382 - protein, 9 aa, Homo Sapiens
ADTTSVGFC

SEQ ID NO: 1114383 - protein, 9 aa, Homo Sapiens
QCECRPKKR

SEQ ID NO: 1114384 - protein, 9 aa, Homo Sapiens
RRAALSPAV

SEQ ID NO: 1114385 - protein, 9 aa, Homo Sapiens
PGYSAQLVL

SEQ ID NO: 1114386 - protein, 9 aa, Homo Sapiens
VTPGHFCPL

SEQ ID NO: 1114387 - protein, 9 aa, Homo Sapiens
ADSRLHIIF

SEQ ID NO: 1114388 - protein, 9 aa, Homo Sapiens
PGHGAAGDT

SEQ ID NO: 1114389 - protein, 9 aa, Homo Sapiens
WWYPAVRVI

SEQ ID NO: 1114390 - protein, 9 aa, Homo Sapiens
KKKRWSRSR

SEQ ID NO: 1114391 - protein, 9 aa, Homo Sapiens
KKCDKKTLF

SEQ ID NO: 1114392 - protein, 9 aa, Homo Sapiens
LCQYKCSDE

SEQ ID NO: 1114393 - protein, 9 aa, Homo Sapiens
RRRSQGVSS

SEQ ID NO: 1114394 - protein, 9 aa, Homo Sapiens
CCWGFWGWC

SEQ ID NO: 1114395 - protein, 9 aa, Homo Sapiens
QQKSSLSNN

SEQ ID NO: 1114396 - protein, 9 aa, Homo Sapiens
IQAPKTVDT

SEQ ID NO: 1114397 - protein, 9 aa, Homo Sapiens
AAPSSVPRD

SEQ ID NO: 1114398 - protein, 9 aa, Homo Sapiens
LHDTGKFTN

SEQ ID NO: 1114399 - protein, 9 aa, Homo Sapiens
HGRRRRTDS

SEQ ID NO: 1114400 - protein, 9 aa, Homo Sapiens
EMNRHSNEW

SEQ ID NO: 1114401 - protein, 9 aa, Homo Sapiens
RPLSSWTHP

SEQ ID NO: 1114402 - protein, 9 aa, Homo Sapiens
MLVKNEINP

SEQ ID NO: 1114403 - protein, 9 aa, Homo Sapiens
ADSTGVVAN

SEQ ID NO: 1114404 - protein, 9 aa, Homo Sapiens
ISRSWTGTL

SEQ ID NO: 1114405 - protein, 9 aa, Homo Sapiens
LTMVYAFCT

SEQ ID NO: 1114406 - protein, 9 aa, Homo Sapiens
RKYKVLSVL

SEQ ID NO: 1114407 - protein, 9 aa, Homo Sapiens
GFCRNVSFI

SEQ ID NO: 1114408 - protein, 9 aa, Homo Sapiens
CEMFDKASL

SEQ ID NO: 1114409 - protein, 9 aa, Homo Sapiens
PINNLCFVG

SEQ ID NO: 1114410 - protein, 9 aa, Homo Sapiens
YACEACQNF

SEQ ID NO: 1114411 - protein, 9 aa, Homo Sapiens
CLLAVTSLS

SEQ ID NO: 1114412 - protein, 9 aa, Homo Sapiens
AEMNRHSNE

SEQ ID NO: 1114413 - protein, 9 aa, Homo Sapiens
ASQQRQQRQ

SEQ ID NO: 1114414 - protein, 9 aa, Homo Sapiens
PHPHSHSHS

SEQ ID NO: 1114415 - protein, 9 aa, Homo Sapiens
MSVLSLNIT

SEQ ID NO: 1114416 - protein, 9 aa, Homo Sapiens
DDGANHSQD

SEQ ID NO: 1114417 - protein, 9 aa, Homo Sapiens
LALLALATL

SEQ ID NO: 1114418 - protein, 9 aa, Homo Sapiens
LAPVTRLRT

SEQ ID NO: 1114419 - protein, 9 aa, Homo Sapiens
RPLRLPGGD

SEQ ID NO: 1114420 - protein, 9 aa, Homo Sapiens
LMIQKAVIQ

SEQ ID NO: 1114421 - protein, 9 aa, Homo Sapiens
KLWCMLKPG

SEQ ID NO: 1114422 - protein, 9 aa, Homo Sapiens
GLPRAPASQ

SEQ ID NO: 1114423 - protein, 9 aa, Homo Sapiens
TATKKDMLP

SEQ ID NO: 1114424 - protein, 9 aa, Homo Sapiens
AIETDVMNQ

SEQ ID NO: 1114425 - protein, 9 aa, Homo Sapiens
GRRDTPGGR

SEQ ID NO: 1114426 - protein, 9 aa, Homo Sapiens
TDKFTLLED

SEQ ID NO: 1114427 - protein, 9 aa, Homo Sapiens
VVKFVDTDK

SEQ ID NO: 1114428 - protein, 9 aa, Homo Sapiens
WHEPQPRPR

SEQ ID NO: 1114429 - protein, 9 aa, Homo Sapiens
PNLTFDAIT

SEQ ID NO: 1114430 - protein, 9 aa, Homo Sapiens
KTGLGILQQ

SEQ ID NO: 1114431 - protein, 9 aa, Homo Sapiens
THRGEQPPD

SEQ ID NO: 1114432 - protein, 9 aa, Homo Sapiens
EKAPWKTQI

SEQ ID NO: 1114433 - protein, 9 aa, Homo Sapiens
FALELGCAC

SEQ ID NO: 1114434 - protein, 9 aa, Homo Sapiens
LTRSVESWG

SEQ ID NO: 1114435 - protein, 9 aa, Homo Sapiens
NDFHMSELS

SEQ ID NO: 1114436 - protein, 9 aa, Homo Sapiens
CNIIPVLSD

SEQ ID NO: 1114437 - protein, 9 aa, Homo Sapiens
MWSFCFSPL

SEQ ID NO: 1114438 - protein, 9 aa, Homo Sapiens
FSIMNSWLR

SEQ ID NO: 1114439 - protein, 9 aa, Homo Sapiens
MASIWLSYT

SEQ ID NO: 1114440 - protein, 9 aa, Homo Sapiens
GRGTESCEG

SEQ ID NO: 1114441 - protein, 9 aa, Homo Sapiens
RLTTVSGGT

SEQ ID NO: 1114442 - protein, 9 aa, Homo Sapiens
TLEDSRQGS

SEQ ID NO: 1114443 - protein, 9 aa, Homo Sapiens
VVLLVIHSC

SEQ ID NO: 1114444 - protein, 9 aa, Homo Sapiens
GWGAPVPHR

SEQ ID NO: 1114445 - protein, 9 aa, Homo Sapiens
QLDSLVLIN

SEQ ID NO: 1114446 - protein, 9 aa, Homo Sapiens
HIMFDKDMT

SEQ ID NO: 1114447 - protein, 9 aa, Homo Sapiens
SKMNIPFCI

SEQ ID NO: 1114448 - protein, 9 aa, Homo Sapiens
LYTLNLLFW

SEQ ID NO: 1114449 - protein, 9 aa, Homo Sapiens
KVVTSPKSA

SEQ ID NO: 1114450 - protein, 9 aa, Homo Sapiens
LTSRAPPMM

SEQ ID NO: 1114451 - protein, 9 aa, Homo Sapiens
AACPMTACS

SEQ ID NO: 1114452 - protein, 9 aa, Homo Sapiens
YKIHYRKAS

SEQ ID NO: 1114453 - protein, 9 aa, Homo Sapiens
LKPTPHRRY

SEQ ID NO: 1114454 - protein, 9 aa, Homo Sapiens
PQQSGGARG

SEQ ID NO: 1114455 - protein, 9 aa, Homo Sapiens
QRSAFAPCC

SEQ ID NO: 1114456 - protein, 9 aa, Homo Sapiens
VELLRDAEP

SEQ ID NO: 1114457 - protein, 9 aa, Homo Sapiens
KILEVFVMG

SEQ ID NO: 1114458 - protein, 9 aa, Homo Sapiens
VDGMGHFGR

SEQ ID NO: 1114459 - protein, 9 aa, Homo Sapiens
RLTIHIDEE

SEQ ID NO: 1114460 - protein, 9 aa, Homo Sapiens
KDGRSNMRM

SEQ ID NO: 1114461 - protein, 9 aa, Homo Sapiens
LHSCDPPSS

SEQ ID NO: 1114462 - protein, 9 aa, Homo Sapiens
GGSGHCPHE

SEQ ID NO: 1114463 - protein, 9 aa, Homo Sapiens
YHAASAGLA

SEQ ID NO: 1114464 - protein, 9 aa, Homo Sapiens
ALCQKGERV

SEQ ID NO: 1114465 - protein, 9 aa, Homo Sapiens
TKCVKKSKQ

SEQ ID NO: 1114466 - protein, 9 aa, Homo Sapiens
VLKSLWKEW

SEQ ID NO: 1114467 - protein, 9 aa, Homo Sapiens
AVLARSDTA

SEQ ID NO: 1114468 - protein, 9 aa, Homo Sapiens
AFSTSITRF

SEQ ID NO: 1114469 - protein, 9 aa, Homo Sapiens
SCPAGAGPP

SEQ ID NO: 1114470 - protein, 9 aa, Homo Sapiens
SVRSNIQVT

SEQ ID NO: 1114471 - protein, 9 aa, Homo Sapiens
ELLGCYPEE

SEQ ID NO: 1114472 - protein, 9 aa, Homo Sapiens
ASTAVAPAS

SEQ ID NO: 1114473 - protein, 9 aa, Homo Sapiens
EERMLSAVP

SEQ ID NO: 1114474 - protein, 9 aa, Homo Sapiens
FGPRSKMGK

SEQ ID NO: 1114475 - protein, 9 aa, Homo Sapiens
AYQAAPLLL

SEQ ID NO: 1114476 - protein, 9 aa, Homo Sapiens
VTSGASGGT

SEQ ID NO: 1114477 - protein, 9 aa, Homo Sapiens
DYSLMNSRL

SEQ ID NO: 1114478 - protein, 9 aa, Homo Sapiens
SKKEMLPRH

SEQ ID NO: 1114479 - protein, 9 aa, Homo Sapiens
PVFLGRALT

SEQ ID NO: 1114480 - protein, 9 aa, Homo Sapiens
SPGPRLAPT

SEQ ID NO: 1114481 - protein, 9 aa, Homo Sapiens
WTQDSEGSF

SEQ ID NO: 1114482 - protein, 9 aa, Homo Sapiens
NPYKWLTVY

SEQ ID NO: 1114483 - protein, 9 aa, Homo Sapiens
EGLLKRSRC

SEQ ID NO: 1114484 - protein, 9 aa, Homo Sapiens
EITLSESVN

SEQ ID NO: 1114485 - protein, 9 aa, Homo Sapiens
AHPVKFLWK

SEQ ID NO: 1114486 - protein, 9 aa, Homo Sapiens
GRAWAPQTK

SEQ ID NO: 1114487 - protein, 9 aa, Homo Sapiens
LTPGLSKDA

SEQ ID NO: 1114488 - protein, 9 aa, Homo Sapiens
VSTFLFLLS

SEQ ID NO: 1114489 - protein, 9 aa, Homo Sapiens
PLRLHSPTP

SEQ ID NO: 1114490 - protein, 9 aa, Homo Sapiens
TPTEQPLEL

SEQ ID NO: 1114491 - protein, 9 aa, Homo Sapiens
LMAPVGSVM

SEQ ID NO: 1114492 - protein, 9 aa, Homo Sapiens
CPRAPEVPR

SEQ ID NO: 1114493 - protein, 9 aa, Homo Sapiens
RRLQEELKR

SEQ ID NO: 1114494 - protein, 9 aa, Homo Sapiens
SDDRNTSCH

SEQ ID NO: 1114495 - protein, 9 aa, Homo Sapiens
LPPAAGLPV

SEQ ID NO: 1114496 - protein, 9 aa, Homo Sapiens
TTAVTTTAA

SEQ ID NO: 1114497 - protein, 9 aa, Homo Sapiens
HQSWLPSPW

SEQ ID NO: 1114498 - protein, 9 aa, Homo Sapiens
SSDVHRFSV

SEQ ID NO: 1114499 - protein, 9 aa, Homo Sapiens
WLALAAVEC

SEQ ID NO: 1114500 - protein, 9 aa, Homo Sapiens
LIGFGRCFQ

SEQ ID NO: 1114501 - protein, 9 aa, Homo Sapiens
TVNPAEKTP

SEQ ID NO: 1114502 - protein, 9 aa, Homo Sapiens
VVVKDPDMK

SEQ ID NO: 1114503 - protein, 9 aa, Homo Sapiens
TNSDNEVLL

SEQ ID NO: 1114504 - protein, 9 aa, Homo Sapiens
PVLEAGSFP

SEQ ID NO: 1114505 - protein, 9 aa, Homo Sapiens
EKQKRQRGS

SEQ ID NO: 1114506 - protein, 9 aa, Homo Sapiens
SGLMSLGNS

SEQ ID NO: 1114507 - protein, 9 aa, Homo Sapiens
QLLSRAAAQ

SEQ ID NO: 1114508 - protein, 9 aa, Homo Sapiens
EFDNMVKVQ

SEQ ID NO: 1114509 - protein, 9 aa, Homo Sapiens
PATMRCNLH

SEQ ID NO: 1114510 - protein, 9 aa, Homo Sapiens
VYALLYKCD

SEQ ID NO: 1114511 - protein, 9 aa, Homo Sapiens
LFSFLIFLI

SEQ ID NO: 1114512 - protein, 9 aa, Homo Sapiens
LSHLTDGSN

SEQ ID NO: 1114513 - protein, 9 aa, Homo Sapiens
PVMAWTSRM

SEQ ID NO: 1114514 - protein, 9 aa, Homo Sapiens
RGRAGAPAE

SEQ ID NO: 1114515 - protein, 9 aa, Homo Sapiens
LMNSRLSVV

SEQ ID NO: 1114516 - protein, 9 aa, Homo Sapiens
DATKSLGPL

SEQ ID NO: 1114517 - protein, 9 aa, Homo Sapiens
EPVPDAPSP

SEQ ID NO: 1114518 - protein, 9 aa, Homo Sapiens
LCVKATVCP

SEQ ID NO: 1114519 - protein, 9 aa, Homo Sapiens
ADIYPFAIT

SEQ ID NO: 1114520 - protein, 9 aa, Homo Sapiens
PPPKMPPPR

SEQ ID NO: 1114521 - protein, 9 aa, Homo Sapiens
RPTSSQTRT

SEQ ID NO: 1114522 - protein, 9 aa, Homo Sapiens
VRIQSSGKN

SEQ ID NO: 1114523 - protein, 9 aa, Homo Sapiens
DTYKDSFIS

SEQ ID NO: 1114524 - protein, 9 aa, Homo Sapiens
PHPLCGLGF

SEQ ID NO: 1114525 - protein, 9 aa, Homo Sapiens
ACDPNLTFD

SEQ ID NO: 1114526 - protein, 9 aa, Homo Sapiens
AGTPLPWAN

SEQ ID NO: 1114527 - protein, 9 aa, Homo Sapiens
QRRRSLALP

SEQ ID NO: 1114528 - protein, 9 aa, Homo Sapiens
SVQVFSFCW

SEQ ID NO: 1114529 - protein, 9 aa, Homo Sapiens
MGIQLKKGA

SEQ ID NO: 1114530 - protein, 9 aa, Homo Sapiens
QVVLPCQAC

SEQ ID NO: 1114531 - protein, 9 aa, Homo Sapiens
HGPVKLGGH

SEQ ID NO: 1114532 - protein, 9 aa, Homo Sapiens
HPRWSHWTP

SEQ ID NO: 1114533 - protein, 9 aa, Homo Sapiens
DASIHVTFT

SEQ ID NO: 1114534 - protein, 9 aa, Homo Sapiens
EELKRVRGE

SEQ ID NO: 1114535 - protein, 9 aa, Homo Sapiens
VLDPPFWLR

SEQ ID NO: 1114536 - protein, 9 aa, Homo Sapiens
QVVAVPILC

SEQ ID NO: 1114537 - protein, 9 aa, Homo Sapiens
VHAAGHVHG

SEQ ID NO: 1114538 - protein, 9 aa, Homo Sapiens
PFHIMFDKD

SEQ ID NO: 1114539 - protein, 9 aa, Homo Sapiens
GRTPTTRLM

SEQ ID NO: 1114540 - protein, 9 aa, Homo Sapiens
AAAAVGPNR

SEQ ID NO: 1114541 - protein, 9 aa, Homo Sapiens
PACSGTWCL

SEQ ID NO: 1114542 - protein, 9 aa, Homo Sapiens
GTAPSAVPS

SEQ ID NO: 1114543 - protein, 9 aa, Homo Sapiens
DLCADQPRI

SEQ ID NO: 1114544 - protein, 9 aa, Homo Sapiens
PNSPQGAFY

SEQ ID NO: 1114545 - protein, 9 aa, Homo Sapiens
ARMTTLNEE

SEQ ID NO: 1114546 - protein, 9 aa, Homo Sapiens
LKKYSSCLK

SEQ ID NO: 1114547 - protein, 9 aa, Homo Sapiens
ALKVQQKCL

SEQ ID NO: 1114548 - protein, 9 aa, Homo Sapiens
GANICLLLD

SEQ ID NO: 1114549 - protein, 9 aa, Homo Sapiens
MVGVDVATD

SEQ ID NO: 1114550 - protein, 9 aa, Homo Sapiens
RDWRGPSWR

SEQ ID NO: 1114551 - protein, 9 aa, Homo Sapiens
LEKHGLSDI

SEQ ID NO: 1114552 - protein, 9 aa, Homo Sapiens
TELRQAPRT

SEQ ID NO: 1114553 - protein, 9 aa, Homo Sapiens
GKSDPYTKV

SEQ ID NO: 1114554 - protein, 9 aa, Homo Sapiens
ILETWTLLR

SEQ ID NO: 1114555 - protein, 9 aa, Homo Sapiens
HEEVVQVLL

SEQ ID NO: 1114556 - protein, 9 aa, Homo Sapiens
RPCASCPGP

SEQ ID NO: 1114557 - protein, 9 aa, Homo Sapiens
AEGGLHVQL

SEQ ID NO: 1114558 - protein, 9 aa, Homo Sapiens
GSSRRCLLP

SEQ ID NO: 1114559 - protein, 9 aa, Homo Sapiens
GLVVCKQNV

SEQ ID NO: 1114560 - protein, 9 aa, Homo Sapiens
STFYIYLTA

SEQ ID NO: 1114561 - protein, 9 aa, Homo Sapiens
PQLPSAPTC

SEQ ID NO: 1114562 - protein, 9 aa, Homo Sapiens
HNQLPSLRR

SEQ ID NO: 1114563 - protein, 9 aa, Homo Sapiens
ARTRSRRTR

SEQ ID NO: 1114564 - protein, 9 aa, Homo Sapiens
EVSVSYSDP

SEQ ID NO: 1114565 - protein, 9 aa, Homo Sapiens
DPLPPPGLA

SEQ ID NO: 1114566 - protein, 9 aa, Homo Sapiens
SAAATTAAA

SEQ ID NO: 1114567 - protein, 9 aa, Homo Sapiens
LEAQLDVNL

SEQ ID NO: 1114568 - protein, 9 aa, Homo Sapiens
WDVEEVPEQ

SEQ ID NO: 1114569 - protein, 9 aa, Homo Sapiens
VHIVHVGQV

SEQ ID NO: 1114570 - protein, 9 aa, Homo Sapiens
PPTAPRHHQ

SEQ ID NO: 1114571 - protein, 9 aa, Homo Sapiens
LSTIVAGST

SEQ ID NO: 1114572 - protein, 9 aa, Homo Sapiens
LDRYWAITV

SEQ ID NO: 1114573 - protein, 9 aa, Homo Sapiens
EEFLKVKAR

SEQ ID NO: 1114574 - protein, 9 aa, Homo Sapiens
SGTMSTTLC

SEQ ID NO: 1114575 - protein, 9 aa, Homo Sapiens
TASTATTRT

SEQ ID NO: 1114576 - protein, 9 aa, Homo Sapiens
TKSLGIHGR

SEQ ID NO: 1114577 - protein, 9 aa, Homo Sapiens
MSYDHVLFL

SEQ ID NO: 1114578 - protein, 9 aa, Homo Sapiens
AVPQQVQCI

SEQ ID NO: 1114579 - protein, 9 aa, Homo Sapiens
PDMGGAITF

SEQ ID NO: 1114580 - protein, 9 aa, Homo Sapiens
STGDITPLP

SEQ ID NO: 1114581 - protein, 9 aa, Homo Sapiens
SLSKKERKV

SEQ ID NO: 1114582 - protein, 9 aa, Homo Sapiens
CCLQALSLR

SEQ ID NO: 1114583 - protein, 9 aa, Homo Sapiens
TYFEYLMFI

SEQ ID NO: 1114584 - protein, 9 aa, Homo Sapiens
KLSKDPHFS

SEQ ID NO: 1114585 - protein, 9 aa, Homo Sapiens
PAEGRRDTP

SEQ ID NO: 1114586 - protein, 9 aa, Homo Sapiens
IDARKNSMI

SEQ ID NO: 1114587 - protein, 9 aa, Homo Sapiens
KMAVEFGNH

SEQ ID NO: 1114588 - protein, 9 aa, Homo Sapiens
EVIDLDPQL

SEQ ID NO: 1114589 - protein, 9 aa, Homo Sapiens
PAHAHQLVE

SEQ ID NO: 1114590 - protein, 9 aa, Homo Sapiens
ILLSGAKVA

SEQ ID NO: 1114591 - protein, 9 aa, Homo Sapiens
PMLTGCPFR

SEQ ID NO: 1114592 - protein, 9 aa, Homo Sapiens
GHLQDLLLG

SEQ ID NO: 1114593 - protein, 9 aa, Homo Sapiens
HHGEKPYEC

SEQ ID NO: 1114594 - protein, 9 aa, Homo Sapiens
EKGDQLFNQ

SEQ ID NO: 1114595 - protein, 9 aa, Homo Sapiens
LAGHGASLQ

SEQ ID NO: 1114596 - protein, 9 aa, Homo Sapiens
DALFNELTA

SEQ ID NO: 1114597 - protein, 9 aa, Homo Sapiens
CSPLFPWKL

SEQ ID NO: 1114598 - protein, 9 aa, Homo Sapiens
MECLVDAHM

SEQ ID NO: 1114599 - protein, 9 aa, Homo Sapiens
VKEFSRGKT

SEQ ID NO: 1114600 - protein, 9 aa, Homo Sapiens
VSHIRTTML

SEQ ID NO: 1114601 - protein, 9 aa, Homo Sapiens
GGIRWTLTR

SEQ ID NO: 1114602 - protein, 9 aa, Homo Sapiens
TFPQEFIIC

SEQ ID NO: 1114603 - protein, 9 aa, Homo Sapiens
STVIMDKPQ

SEQ ID NO: 1114604 - protein, 9 aa, Homo Sapiens
EELSNVLVA

SEQ ID NO: 1114605 - protein, 9 aa, Homo Sapiens
SWRVRKIGD

SEQ ID NO: 1114606 - protein, 9 aa, Homo Sapiens
SLPHSRSSS

SEQ ID NO: 1114607 - protein, 9 aa, Homo Sapiens
LAVQPHLLD

SEQ ID NO: 1114608 - protein, 9 aa, Homo Sapiens
WWGGDPQYQ

SEQ ID NO: 1114609 - protein, 9 aa, Homo Sapiens
GFDKTQSET

SEQ ID NO: 1114610 - protein, 9 aa, Homo Sapiens
FLDTPIAEV

SEQ ID NO: 1114611 - protein, 9 aa, Homo Sapiens
APELGADPE

SEQ ID NO: 1114612 - protein, 9 aa, Homo Sapiens
NIPVNKSPM

SEQ ID NO: 1114613 - protein, 9 aa, Homo Sapiens
GKKPEQLTL

SEQ ID NO: 1114614 - protein, 9 aa, Homo Sapiens
KYGKIEDMA

SEQ ID NO: 1114615 - protein, 9 aa, Homo Sapiens
IDKRMSHQN

SEQ ID NO: 1114616 - protein, 9 aa, Homo Sapiens
PGLYVFLNV

SEQ ID NO: 1114617 - protein, 9 aa, Homo Sapiens
LDVARLQSR

SEQ ID NO: 1114618 - protein, 9 aa, Homo Sapiens
LRRLGSEVG

SEQ ID NO: 1114619 - protein, 9 aa, Homo Sapiens
YFMCNNPEK

SEQ ID NO: 1114620 - protein, 9 aa, Homo Sapiens
FALVLYGQN

SEQ ID NO: 1114621 - protein, 9 aa, Homo Sapiens
QTSLLRILT

SEQ ID NO: 1114622 - protein, 9 aa, Homo Sapiens
SQQAETRPE

SEQ ID NO: 1114623 - protein, 9 aa, Homo Sapiens
MLLDTDYDN

SEQ ID NO: 1114624 - protein, 9 aa, Homo Sapiens
PLFPSTDDS

SEQ ID NO: 1114625 - protein, 9 aa, Homo Sapiens
IRENNSPAL

SEQ ID NO: 1114626 - protein, 9 aa, Homo Sapiens
FGKAVQDLS

SEQ ID NO: 1114627 - protein, 9 aa, Homo Sapiens
LMNVPLFKH

SEQ ID NO: 1114628 - protein, 9 aa, Homo Sapiens
SVRLKRCRR

SEQ ID NO: 1114629 - protein, 9 aa, Homo Sapiens
CQRGPTHTR

SEQ ID NO: 1114630 - protein, 9 aa, Homo Sapiens
GGGVCGPRV

SEQ ID NO: 1114631 - protein, 9 aa, Homo Sapiens
LSRFQKKMK

SEQ ID NO: 1114632 - protein, 9 aa, Homo Sapiens
EPGTPSKAP

SEQ ID NO: 1114633 - protein, 9 aa, Homo Sapiens
ETTTSSSRF

SEQ ID NO: 1114634 - protein, 9 aa, Homo Sapiens
CGTSQLAEG

SEQ ID NO: 1114635 - protein, 9 aa, Homo Sapiens
FKDLGFFGQ

SEQ ID NO: 1114636 - protein, 9 aa, Homo Sapiens
EGQYLHPGE

SEQ ID NO: 1114637 - protein, 9 aa, Homo Sapiens
QHGILPIWQ

SEQ ID NO: 1114638 - protein, 9 aa, Homo Sapiens
TLDSALVFK

SEQ ID NO: 1114639 - protein, 9 aa, Homo Sapiens
SGSSATDPI

SEQ ID NO: 1114640 - protein, 9 aa, Homo Sapiens
PNATLILVI

SEQ ID NO: 1114641 - protein, 9 aa, Homo Sapiens
KLPIVNDYD

SEQ ID NO: 1114642 - protein, 9 aa, Homo Sapiens
TDWEVFQIG

SEQ ID NO: 1114643 - protein, 9 aa, Homo Sapiens
EKEAGHFKT

SEQ ID NO: 1114644 - protein, 9 aa, Homo Sapiens
GSHVTANMV

SEQ ID NO: 1114645 - protein, 9 aa, Homo Sapiens
CDSGFTGTC

SEQ ID NO: 1114646 - protein, 9 aa, Homo Sapiens
GTHRIKCRV

SEQ ID NO: 1114647 - protein, 9 aa, Homo Sapiens
HPSTIAPST

SEQ ID NO: 1114648 - protein, 9 aa, Homo Sapiens
PAAAAAGAP

SEQ ID NO: 1114649 - protein, 9 aa, Homo Sapiens
VHRRARRVR

SEQ ID NO: 1114650 - protein, 9 aa, Homo Sapiens
RELLRAKLI

SEQ ID NO: 1114651 - protein, 9 aa, Homo Sapiens
PSTCSGWGR

SEQ ID NO: 1114652 - protein, 9 aa, Homo Sapiens
RRRRRRKKK

SEQ ID NO: 1114653 - protein, 9 aa, Homo Sapiens
PSWNPKEHL

SEQ ID NO: 1114654 - protein, 9 aa, Homo Sapiens
FNKIRLDQM

SEQ ID NO: 1114655 - protein, 9 aa, Homo Sapiens
LNRSGRWKP

SEQ ID NO: 1114656 - protein, 9 aa, Homo Sapiens
WFVQSVIAR

SEQ ID NO: 1114657 - protein, 9 aa, Homo Sapiens
LHIDMYAMG

SEQ ID NO: 1114658 - protein, 9 aa, Homo Sapiens
YTTLISPVC

SEQ ID NO: 1114659 - protein, 9 aa, Homo Sapiens
LCSVTDYHA

SEQ ID NO: 1114660 - protein, 9 aa, Homo Sapiens
KNTAALSLS

SEQ ID NO: 1114661 - protein, 9 aa, Homo Sapiens
VEGVSSALR

SEQ ID NO: 1114662 - protein, 9 aa, Homo Sapiens
APVPVATQN

SEQ ID NO: 1114663 - protein, 9 aa, Homo Sapiens
IVFQINHAL

SEQ ID NO: 1114664 - protein, 9 aa, Homo Sapiens
SATRAGWGT

SEQ ID NO: 1114665 - protein, 9 aa, Homo Sapiens
VGWIITISL

SEQ ID NO: 1114666 - protein, 9 aa, Homo Sapiens
GASTSSVTA

SEQ ID NO: 1114667 - protein, 9 aa, Homo Sapiens
KQMFSVFGE

SEQ ID NO: 1114668 - protein, 9 aa, Homo Sapiens
TVLTLAPLG

SEQ ID NO: 1114669 - protein, 9 aa, Homo Sapiens
MAPKRPPKL

SEQ ID NO: 1114670 - protein, 9 aa, Homo Sapiens
FPPAAPCRR

SEQ ID NO: 1114671 - protein, 9 aa, Homo Sapiens
IYTLSGTIR

SEQ ID NO: 1114672 - protein, 9 aa, Homo Sapiens
IKRSLLEMV

SEQ ID NO: 1114673 - protein, 9 aa, Homo Sapiens
VIAERNKKQ

SEQ ID NO: 1114674 - protein, 9 aa, Homo Sapiens
RRTDSMSSE

SEQ ID NO: 1114675 - protein, 9 aa, Homo Sapiens
GTATPSSGR

SEQ ID NO: 1114676 - protein, 9 aa, Homo Sapiens
RWHRWQGHH

SEQ ID NO: 1114677 - protein, 9 aa, Homo Sapiens
GRRNKHQGG

SEQ ID NO: 1114678 - protein, 9 aa, Homo Sapiens
EPGEVVKQT

SEQ ID NO: 1114679 - protein, 9 aa, Homo Sapiens
YQQEVKIYF

SEQ ID NO: 1114680 - protein, 9 aa, Homo Sapiens
IELGWRDSE

SEQ ID NO: 1114681 - protein, 9 aa, Homo Sapiens
LVTAQGEKN

SEQ ID NO: 1114682 - protein, 9 aa, Homo Sapiens
HIPEPGLRS

SEQ ID NO: 1114683 - protein, 9 aa, Homo Sapiens
SPLRPEAPC

SEQ ID NO: 1114684 - protein, 9 aa, Homo Sapiens
DAMLENYRN

SEQ ID NO: 1114685 - protein, 9 aa, Homo Sapiens
VEYRAISFS

SEQ ID NO: 1114686 - protein, 9 aa, Homo Sapiens
SPSEAVQWS

SEQ ID NO: 1114687 - protein, 9 aa, Homo Sapiens
SCSGASASW

SEQ ID NO: 1114688 - protein, 9 aa, Homo Sapiens
VNHWITTTM

SEQ ID NO: 1114689 - protein, 9 aa, Homo Sapiens
EERQPLLGA

SEQ ID NO: 1114690 - protein, 9 aa, Homo Sapiens
ISWHSDYED

SEQ ID NO: 1114691 - protein, 9 aa, Homo Sapiens
LITKELHRS

SEQ ID NO: 1114692 - protein, 9 aa, Homo Sapiens
LSAGPLGLL

SEQ ID NO: 1114693 - protein, 9 aa, Homo Sapiens
QGLFPPLHS

SEQ ID NO: 1114694 - protein, 9 aa, Homo Sapiens
GEENTLMRD

SEQ ID NO: 1114695 - protein, 9 aa, Homo Sapiens
SVDGASPCC

SEQ ID NO: 1114696 - protein, 9 aa, Homo Sapiens
SGGVVDNNH

SEQ ID NO: 1114697 - protein, 9 aa, Homo Sapiens
VTVQFQYSS

SEQ ID NO: 1114698 - protein, 9 aa, Homo Sapiens
GRWRSGGPR

SEQ ID NO: 1114699 - protein, 9 aa, Homo Sapiens
SVYGPLWSI

SEQ ID NO: 1114700 - protein, 9 aa, Homo Sapiens
KIHIPEPGL

SEQ ID NO: 1114701 - protein, 9 aa, Homo Sapiens
EKAIETDVM

SEQ ID NO: 1114702 - protein, 9 aa, Homo Sapiens
LPDYLGLSN

SEQ ID NO: 1114703 - protein, 9 aa, Homo Sapiens
LQQEDTPGC

SEQ ID NO: 1114704 - protein, 9 aa, Homo Sapiens
ATTAAGASG

SEQ ID NO: 1114705 - protein, 9 aa, Homo Sapiens
TQLDQRLTL

SEQ ID NO: 1114706 - protein, 9 aa, Homo Sapiens
TIPDVHGRS

SEQ ID NO: 1114707 - protein, 9 aa, Homo Sapiens
EASVSPPRS

SEQ ID NO: 1114708 - protein, 9 aa, Homo Sapiens
AALDSGPEA

SEQ ID NO: 1114709 - protein, 9 aa, Homo Sapiens
GAGLGCVAE

SEQ ID NO: 1114710 - protein, 9 aa, Homo Sapiens
SAAAASPRA

SEQ ID NO: 1114711 - protein, 9 aa, Homo Sapiens
LVRDNSLAP

SEQ ID NO: 1114712 - protein, 9 aa, Homo Sapiens
IKVSDDLIE

SEQ ID NO: 1114713 - protein, 9 aa, Homo Sapiens
KMAFCSATV

SEQ ID NO: 1114714 - protein, 9 aa, Homo Sapiens
STPPASATR

SEQ ID NO: 1114715 - protein, 9 aa, Homo Sapiens
QREKCLTIL

SEQ ID NO: 1114716 - protein, 9 aa, Homo Sapiens
QCVTTMTHG

SEQ ID NO: 1114717 - protein, 9 aa, Homo Sapiens
QAVDGWVEE

SEQ ID NO: 1114718 - protein, 9 aa, Homo Sapiens
TRRDSWPTR

SEQ ID NO: 1114719 - protein, 9 aa, Homo Sapiens
TFTLVTRGT

SEQ ID NO: 1114720 - protein, 9 aa, Homo Sapiens
HPTCILGQR

SEQ ID NO: 1114721 - protein, 9 aa, Homo Sapiens
SIRFALEVS

SEQ ID NO: 1114722 - protein, 9 aa, Homo Sapiens
KHCFDPDPP

SEQ ID NO: 1114723 - protein, 9 aa, Homo Sapiens
AEEREHTLH

SEQ ID NO: 1114724 - protein, 9 aa, Homo Sapiens
LSSRRRRCL

SEQ ID NO: 1114725 - protein, 9 aa, Homo Sapiens
CDRDDSLVC

SEQ ID NO: 1114726 - protein, 9 aa, Homo Sapiens
GRSQDCDQV

SEQ ID NO: 1114727 - protein, 9 aa, Homo Sapiens
EYLMFILIL

SEQ ID NO: 1114728 - protein, 9 aa, Homo Sapiens
PGLPAMGGA

SEQ ID NO: 1114729 - protein, 9 aa, Homo Sapiens
LPTDVIVFS

SEQ ID NO: 1114730 - protein, 9 aa, Homo Sapiens
HGPGPCIGE

SEQ ID NO: 1114731 - protein, 9 aa, Homo Sapiens
AEKTECKIA

SEQ ID NO: 1114732 - protein, 9 aa, Homo Sapiens
TLLCPVGGA

SEQ ID NO: 1114733 - protein, 9 aa, Homo Sapiens
YIRHQRIHT

SEQ ID NO: 1114734 - protein, 9 aa, Homo Sapiens
NKCHFRAKG

SEQ ID NO: 1114735 - protein, 9 aa, Homo Sapiens
DTCKSDAGN

SEQ ID NO: 1114736 - protein, 9 aa, Homo Sapiens
NLHKCIALR

SEQ ID NO: 1114737 - protein, 9 aa, Homo Sapiens
VILARTQTT

SEQ ID NO: 1114738 - protein, 9 aa, Homo Sapiens
TGCELRCKV

SEQ ID NO: 1114739 - protein, 9 aa, Homo Sapiens
EGGNVEKDP

SEQ ID NO: 1114740 - protein, 9 aa, Homo Sapiens
KAVEESHVE

SEQ ID NO: 1114741 - protein, 9 aa, Homo Sapiens
DWKVMSGGG

SEQ ID NO: 1114742 - protein, 9 aa, Homo Sapiens
VHAVYRRPP

SEQ ID NO: 1114743 - protein, 9 aa, Homo Sapiens
ERQPRSPLR

SEQ ID NO: 1114744 - protein, 9 aa, Homo Sapiens
LLGKNKMNM

SEQ ID NO: 1114745 - protein, 9 aa, Homo Sapiens
TLGLTAALS

SEQ ID NO: 1114746 - protein, 9 aa, Homo Sapiens
PMGHPPTSG

SEQ ID NO: 1114747 - protein, 9 aa, Homo Sapiens
GQGPGHHQR

SEQ ID NO: 1114748 - protein, 9 aa, Homo Sapiens
VTANMVDPG

SEQ ID NO: 1114749 - protein, 9 aa, Homo Sapiens
ILDSPMYWG

SEQ ID NO: 1114750 - protein, 9 aa, Homo Sapiens
SCLSISGWF

SEQ ID NO: 1114751 - protein, 9 aa, Homo Sapiens
TLAPAQARH

SEQ ID NO: 1114752 - protein, 9 aa, Homo Sapiens
LCRETGELV

SEQ ID NO: 1114753 - protein, 9 aa, Homo Sapiens
VRYLDVKKP

SEQ ID NO: 1114754 - protein, 9 aa, Homo Sapiens
SLKIVQMSI

SEQ ID NO: 1114755 - protein, 9 aa, Homo Sapiens
LSSVSTGDI

SEQ ID NO: 1114756 - protein, 9 aa, Homo Sapiens
APLHGVPQS

SEQ ID NO: 1114757 - protein, 9 aa, Homo Sapiens
PPGSPTPTP

SEQ ID NO: 1114758 - protein, 9 aa, Homo Sapiens
KKERRCNSI

SEQ ID NO: 1114759 - protein, 9 aa, Homo Sapiens
ISTGCPLLA

SEQ ID NO: 1114760 - protein, 9 aa, Homo Sapiens
MGSYTCAAE

SEQ ID NO: 1114761 - protein, 9 aa, Homo Sapiens
EAKKLPKEA

SEQ ID NO: 1114762 - protein, 9 aa, Homo Sapiens
PGPTESPTT

SEQ ID NO: 1114763 - protein, 9 aa, Homo Sapiens
PRLVCCPGP

SEQ ID NO: 1114764 - protein, 9 aa, Homo Sapiens
TEKRQLIVV

SEQ ID NO: 1114765 - protein, 9 aa, Homo Sapiens
ITVTGTPAN

SEQ ID NO: 1114766 - protein, 9 aa, Homo Sapiens
MSLGPLRSL

SEQ ID NO: 1114767 - protein, 9 aa, Homo Sapiens
RHIRQDGPW

SEQ ID NO: 1114768 - protein, 9 aa, Homo Sapiens
FTVSALHDD

SEQ ID NO: 1114769 - protein, 9 aa, Homo Sapiens
DTDEETMSG

SEQ ID NO: 1114770 - protein, 9 aa, Homo Sapiens
TWRTSRTRE

SEQ ID NO: 1114771 - protein, 9 aa, Homo Sapiens
MNIPFCIGN

SEQ ID NO: 1114772 - protein, 9 aa, Homo Sapiens
MLEYRKHLN

SEQ ID NO: 1114773 - protein, 9 aa, Homo Sapiens
KWLTVYKPE

SEQ ID NO: 1114774 - protein, 9 aa, Homo Sapiens
QNEFVGSMW

SEQ ID NO: 1114775 - protein, 9 aa, Homo Sapiens
QVHQKLLQL

SEQ ID NO: 1114776 - protein, 9 aa, Homo Sapiens
KNQNAAPAT

SEQ ID NO: 1114777 - protein, 9 aa, Homo Sapiens
SFCWFVHDF

SEQ ID NO: 1114778 - protein, 9 aa, Homo Sapiens
DVMLENINH

SEQ ID NO: 1114779 - protein, 9 aa, Homo Sapiens
IGQGLVGMT

SEQ ID NO: 1114780 - protein, 9 aa, Homo Sapiens
TRNRALQPL

SEQ ID NO: 1114781 - protein, 9 aa, Homo Sapiens
HKDRESLSS

SEQ ID NO: 1114782 - protein, 9 aa, Homo Sapiens
RILTSQRPI

SEQ ID NO: 1114783 - protein, 9 aa, Homo Sapiens
LYLRTSGEP

SEQ ID NO: 1114784 - protein, 9 aa, Homo Sapiens
SLAYTFETK

SEQ ID NO: 1114785 - protein, 9 aa, Homo Sapiens
APPPPPRTC

SEQ ID NO: 1114786 - protein, 9 aa, Homo Sapiens
DLSKNCRLP

SEQ ID NO: 1114787 - protein, 9 aa, Homo Sapiens
LLDKPGKSC

SEQ ID NO: 1114788 - protein, 9 aa, Homo Sapiens
PRGRGCTGL

SEQ ID NO: 1114789 - protein, 9 aa, Homo Sapiens
LPCQACQVG

SEQ ID NO: 1114790 - protein, 9 aa, Homo Sapiens
ASARSPTSS

SEQ ID NO: 1114791 - protein, 9 aa, Homo Sapiens
PRHHPRLRA

SEQ ID NO: 1114792 - protein, 9 aa, Homo Sapiens
PTSAPTQAK

SEQ ID NO: 1114793 - protein, 9 aa, Homo Sapiens
VLKILEVFV

SEQ ID NO: 1114794 - protein, 9 aa, Homo Sapiens
RPVAPFPAT

SEQ ID NO: 1114795 - protein, 9 aa, Homo Sapiens
REHPVALEA

SEQ ID NO: 1114796 - protein, 9 aa, Homo Sapiens
MRPSLAPER

SEQ ID NO: 1114797 - protein, 9 aa, Homo Sapiens
LQAGPVAAV

SEQ ID NO: 1114798 - protein, 9 aa, Homo Sapiens
RGGDAFPGG

SEQ ID NO: 1114799 - protein, 9 aa, Homo Sapiens
LLRALGTRS

SEQ ID NO: 1114800 - protein, 9 aa, Homo Sapiens
LQTKPSGLE

SEQ ID NO: 1114801 - protein, 9 aa, Homo Sapiens
RVHSKHSSS

SEQ ID NO: 1114802 - protein, 9 aa, Homo Sapiens
FQKKMKVSQ

SEQ ID NO: 1114803 - protein, 9 aa, Homo Sapiens
SQTCVAPDY

SEQ ID NO: 1114804 - protein, 9 aa, Homo Sapiens
AARLETYPD

SEQ ID NO: 1114805 - protein, 9 aa, Homo Sapiens
SWWGGDPQY

SEQ ID NO: 1114806 - protein, 9 aa, Homo Sapiens
LWSRLSLLA

SEQ ID NO: 1114807 - protein, 9 aa, Homo Sapiens
SWLPSPWVL

SEQ ID NO: 1114808 - protein, 9 aa, Homo Sapiens
LPHGMSPAL

SEQ ID NO: 1114809 - protein, 9 aa, Homo Sapiens
SAAALDSGP

SEQ ID NO: 1114810 - protein, 9 aa, Homo Sapiens
LPTCSTDSS

SEQ ID NO: 1114811 - protein, 9 aa, Homo Sapiens
YDDFTPFNE

SEQ ID NO: 1114812 - protein, 9 aa, Homo Sapiens
HVIQQGAFL

SEQ ID NO: 1114813 - protein, 9 aa, Homo Sapiens
HCYPDTLQS

SEQ ID NO: 1114814 - protein, 9 aa, Homo Sapiens
AATSRGMWN

SEQ ID NO: 1114815 - protein, 9 aa, Homo Sapiens
LKDSQIVDI

SEQ ID NO: 1114816 - protein, 9 aa, Homo Sapiens
AGTLSDDLG

SEQ ID NO: 1114817 - protein, 9 aa, Homo Sapiens
RQSCSPSPR

SEQ ID NO: 1114818 - protein, 9 aa, Homo Sapiens
GSSERQITV

SEQ ID NO: 1114819 - protein, 9 aa, Homo Sapiens
TDSEALHYD

SEQ ID NO: 1114820 - protein, 9 aa, Homo Sapiens
SQLASHLMS

SEQ ID NO: 1114821 - protein, 9 aa, Homo Sapiens
GGRTGRFAF

SEQ ID NO: 1114822 - protein, 9 aa, Homo Sapiens
REESIPKKS

SEQ ID NO: 1114823 - protein, 9 aa, Homo Sapiens
DPGVVDKAL

SEQ ID NO: 1114824 - protein, 9 aa, Homo Sapiens
STSGVFPAS

SEQ ID NO: 1114825 - protein, 9 aa, Homo Sapiens
ESEALNIRG

SEQ ID NO: 1114826 - protein, 9 aa, Homo Sapiens
NPAEKTPLE

SEQ ID NO: 1114827 - protein, 9 aa, Homo Sapiens
CFKLDLSLN

SEQ ID NO: 1114828 - protein, 9 aa, Homo Sapiens
TCISMTTIS

SEQ ID NO: 1114829 - protein, 9 aa, Homo Sapiens
VLQKAVEES

SEQ ID NO: 1114830 - protein, 9 aa, Homo Sapiens
ANTKKRHTP

SEQ ID NO: 1114831 - protein, 9 aa, Homo Sapiens
RPSWCPPGT

SEQ ID NO: 1114832 - protein, 9 aa, Homo Sapiens
QRLRICHSS

SEQ ID NO: 1114833 - protein, 9 aa, Homo Sapiens
DGHIVNVTV

SEQ ID NO: 1114834 - protein, 9 aa, Homo Sapiens
LPGAMNARG

SEQ ID NO: 1114835 - protein, 9 aa, Homo Sapiens
RPMERDLPP

SEQ ID NO: 1114836 - protein, 9 aa, Homo Sapiens
VIQALRKME

SEQ ID NO: 1114837 - protein, 9 aa, Homo Sapiens
GRKHPPVGS

SEQ ID NO: 1114838 - protein, 9 aa, Homo Sapiens
TWKRVHSKH

SEQ ID NO: 1114839 - protein, 9 aa, Homo Sapiens
MDDVTAVLV

SEQ ID NO: 1114840 - protein, 9 aa, Homo Sapiens
SIHMGFVSG

SEQ ID NO: 1114841 - protein, 9 aa, Homo Sapiens
LIHLGLGLL

SEQ ID NO: 1114842 - protein, 9 aa, Homo Sapiens
PQEISKVMA

SEQ ID NO: 1114843 - protein, 9 aa, Homo Sapiens
APVKWGGNC

SEQ ID NO: 1114844 - protein, 9 aa, Homo Sapiens
HDAPAGPAH

SEQ ID NO: 1114845 - protein, 9 aa, Homo Sapiens
SVPSLVFTC

SEQ ID NO: 1114846 - protein, 9 aa, Homo Sapiens
VPLITSYQP

SEQ ID NO: 1114847 - protein, 9 aa, Homo Sapiens
RRSHWMKAQ

SEQ ID NO: 1114848 - protein, 9 aa, Homo Sapiens
KRTQRIPIP

SEQ ID NO: 1114849 - protein, 9 aa, Homo Sapiens
AQVQTIQIL

SEQ ID NO: 1114850 - protein, 9 aa, Homo Sapiens
SRRRHSDKN

SEQ ID NO: 1114851 - protein, 9 aa, Homo Sapiens
RPHLGPPLP

SEQ ID NO: 1114852 - protein, 9 aa, Homo Sapiens
DLTQVEASG

SEQ ID NO: 1114853 - protein, 9 aa, Homo Sapiens
LRGLTLGGG

SEQ ID NO: 1114854 - protein, 9 aa, Homo Sapiens
QQRRRSLAL

SEQ ID NO: 1114855 - protein, 9 aa, Homo Sapiens
NGGQQSLYC

SEQ ID NO: 1114856 - protein, 9 aa, Homo Sapiens
KLPVLLALT

SEQ ID NO: 1114857 - protein, 9 aa, Homo Sapiens
RQPNKPRVC

SEQ ID NO: 1114858 - protein, 9 aa, Homo Sapiens
EINVLKKSR

SEQ ID NO: 1114859 - protein, 9 aa, Homo Sapiens
TIMMSSCGI

SEQ ID NO: 1114860 - protein, 9 aa, Homo Sapiens
QPLELRLLS

SEQ ID NO: 1114861 - protein, 9 aa, Homo Sapiens
LEYRKHLNS

SEQ ID NO: 1114862 - protein, 9 aa, Homo Sapiens
VPQNMVPLE

SEQ ID NO: 1114863 - protein, 9 aa, Homo Sapiens
PLLYADLDV

SEQ ID NO: 1114864 - protein, 9 aa, Homo Sapiens
LQVLKKILR

SEQ ID NO: 1114865 - protein, 9 aa, Homo Sapiens
EPADGDDGP

SEQ ID NO: 1114866 - protein, 9 aa, Homo Sapiens
LRILTSFTL

SEQ ID NO: 1114867 - protein, 9 aa, Homo Sapiens
GRACVLPGG

SEQ ID NO: 1114868 - protein, 9 aa, Homo Sapiens
SLRLSGTPR

SEQ ID NO: 1114869 - protein, 9 aa, Homo Sapiens
AILPLLNRP

SEQ ID NO: 1114870 - protein, 9 aa, Homo Sapiens
PTAPRHHQA

SEQ ID NO: 1114871 - protein, 9 aa, Homo Sapiens
AFHLDFEFS

SEQ ID NO: 1114872 - protein, 9 aa, Homo Sapiens
VELSLGCEE

SEQ ID NO: 1114873 - protein, 9 aa, Homo Sapiens
SPAQYTTLI

SEQ ID NO: 1114874 - protein, 9 aa, Homo Sapiens
GEEEGEGER

SEQ ID NO: 1114875 - protein, 9 aa, Homo Sapiens
SSLQTKPSG

SEQ ID NO: 1114876 - protein, 9 aa, Homo Sapiens
LPTLSLRRR

SEQ ID NO: 1114877 - protein, 9 aa, Homo Sapiens
HAPIKDKVF

SEQ ID NO: 1114878 - protein, 9 aa, Homo Sapiens
DITPLPVTS

SEQ ID NO: 1114879 - protein, 9 aa, Homo Sapiens
TLDVYKLIH

SEQ ID NO: 1114880 - protein, 9 aa, Homo Sapiens
RVKKLKRQS

SEQ ID NO: 1114881 - protein, 9 aa, Homo Sapiens
CSIEICTAD

SEQ ID NO: 1114882 - protein, 9 aa, Homo Sapiens
EELQLKPQL

SEQ ID NO: 1114883 - protein, 9 aa, Homo Sapiens
PPSLHPSQQ

SEQ ID NO: 1114884 - protein, 9 aa, Homo Sapiens
QDQDVIKNQ

SEQ ID NO: 1114885 - protein, 9 aa, Homo Sapiens
DIQEEALAT

SEQ ID NO: 1114886 - protein, 9 aa, Homo Sapiens
TNDSYQMTQ

SEQ ID NO: 1114887 - protein, 9 aa, Homo Sapiens
LKMEKESSL

SEQ ID NO: 1114888 - protein, 9 aa, Homo Sapiens
LVEGLQEAS

SEQ ID NO: 1114889 - protein, 9 aa, Homo Sapiens
YAAVNCLTT

SEQ ID NO: 1114890 - protein, 9 aa, Homo Sapiens
GAGRAPLHG

SEQ ID NO: 1114891 - protein, 9 aa, Homo Sapiens
SPEEKLRDD

SEQ ID NO: 1114892 - protein, 9 aa, Homo Sapiens
RWCPTSRSI

SEQ ID NO: 1114893 - protein, 9 aa, Homo Sapiens
CPVCQVPIR

SEQ ID NO: 1114894 - protein, 9 aa, Homo Sapiens
LLKEVVKDT

SEQ ID NO: 1114895 - protein, 9 aa, Homo Sapiens
IDASLRKYF

SEQ ID NO: 1114896 - protein, 9 aa, Homo Sapiens
GHPPQARRR

SEQ ID NO: 1114897 - protein, 9 aa, Homo Sapiens
LLNMCQDVC

SEQ ID NO: 1114898 - protein, 9 aa, Homo Sapiens
IGHILSNPE

SEQ ID NO: 1114899 - protein, 9 aa, Homo Sapiens
EKLGSDLPG

SEQ ID NO: 1114900 - protein, 9 aa, Homo Sapiens
LPPTPLSSH

SEQ ID NO: 1114901 - protein, 9 aa, Homo Sapiens
SETVKMACP

SEQ ID NO: 1114902 - protein, 9 aa, Homo Sapiens
NSTDDADAD

SEQ ID NO: 1114903 - protein, 9 aa, Homo Sapiens
FAVVITDGC

SEQ ID NO: 1114904 - protein, 9 aa, Homo Sapiens
KHPPVGSGS

SEQ ID NO: 1114905 - protein, 9 aa, Homo Sapiens
EYKWMASSW

SEQ ID NO: 1114906 - protein, 9 aa, Homo Sapiens
GRGAGAQPH

SEQ ID NO: 1114907 - protein, 9 aa, Homo Sapiens
NSFLTVNDN

SEQ ID NO: 1114908 - protein, 9 aa, Homo Sapiens
KSAILPLLN

SEQ ID NO: 1114909 - protein, 9 aa, Homo Sapiens
VHLVSQAYG

SEQ ID NO: 1114910 - protein, 9 aa, Homo Sapiens
GCVYWLISG

SEQ ID NO: 1114911 - protein, 9 aa, Homo Sapiens
DLGGSERSH

SEQ ID NO: 1114912 - protein, 9 aa, Homo Sapiens
EAPPPPPRT

SEQ ID NO: 1114913 - protein, 9 aa, Homo Sapiens
ETPRGPLVL

SEQ ID NO: 1114914 - protein, 9 aa, Homo Sapiens
PGAGQGPGQ

SEQ ID NO: 1114915 - protein, 9 aa, Homo Sapiens
VARMTTLNE

SEQ ID NO: 1114916 - protein, 9 aa, Homo Sapiens
WSPSAWCSS

SEQ ID NO: 1114917 - protein, 9 aa, Homo Sapiens
ANPQLLCQN

SEQ ID NO: 1114918 - protein, 9 aa, Homo Sapiens
EMNYVHRGL

SEQ ID NO: 1114919 - protein, 9 aa, Homo Sapiens
FILAGLTDY

SEQ ID NO: 1114920 - protein, 9 aa, Homo Sapiens
AQYTTLISP

SEQ ID NO: 1114921 - protein, 9 aa, Homo Sapiens
QWAPHSAGL

SEQ ID NO: 1114922 - protein, 9 aa, Homo Sapiens
FKVLKSLYE

SEQ ID NO: 1114923 - protein, 9 aa, Homo Sapiens
KLMFDFQMN

SEQ ID NO: 1114924 - protein, 9 aa, Homo Sapiens
LTPKAGKIR

SEQ ID NO: 1114925 - protein, 9 aa, Homo Sapiens
KKKFSCPIC

SEQ ID NO: 1114926 - protein, 9 aa, Homo Sapiens
RLMPKFLNS

SEQ ID NO: 1114927 - protein, 9 aa, Homo Sapiens
VDKIHERKC

SEQ ID NO: 1114928 - protein, 9 aa, Homo Sapiens
GHEEREAAR

SEQ ID NO: 1114929 - protein, 9 aa, Homo Sapiens
ALLDQRLRL

SEQ ID NO: 1114930 - protein, 9 aa, Homo Sapiens
RNTRSSVET

SEQ ID NO: 1114931 - protein, 9 aa, Homo Sapiens
RSNQVAFQH

SEQ ID NO: 1114932 - protein, 9 aa, Homo Sapiens
IMQLLMKGS

SEQ ID NO: 1114933 - protein, 9 aa, Homo Sapiens
PRPPTRPSS

SEQ ID NO: 1114934 - protein, 9 aa, Homo Sapiens
LIMFIVIHV

SEQ ID NO: 1114935 - protein, 9 aa, Homo Sapiens
PGNDVATPA

SEQ ID NO: 1114936 - protein, 9 aa, Homo Sapiens
IPDDRDNCR

SEQ ID NO: 1114937 - protein, 9 aa, Homo Sapiens
SHGYGSRCC

SEQ ID NO: 1114938 - protein, 9 aa, Homo Sapiens
SALSFPAPL

SEQ ID NO: 1114939 - protein, 9 aa, Homo Sapiens
QDKTHGGAV

SEQ ID NO: 1114940 - protein, 9 aa, Homo Sapiens
EMPSSHFLA

SEQ ID NO: 1114941 - protein, 9 aa, Homo Sapiens
LISVDGASP

SEQ ID NO: 1114942 - protein, 9 aa, Homo Sapiens
AQGEKNSPF

SEQ ID NO: 1114943 - protein, 9 aa, Homo Sapiens
HPETLAHTA

SEQ ID NO: 1114944 - protein, 9 aa, Homo Sapiens
GRCITSQLG

SEQ ID NO: 1114945 - protein, 9 aa, Homo Sapiens
GPGTAEGPA

SEQ ID NO: 1114946 - protein, 9 aa, Homo Sapiens
FQSDIEGRV

SEQ ID NO: 1114947 - protein, 9 aa, Homo Sapiens
EPSERRRFF

SEQ ID NO: 1114948 - protein, 9 aa, Homo Sapiens
PSVRSNIQV

SEQ ID NO: 1114949 - protein, 9 aa, Homo Sapiens
TISFDRCKI

SEQ ID NO: 1114950 - protein, 9 aa, Homo Sapiens
SPTSLCRGR

SEQ ID NO: 1114951 - protein, 9 aa, Homo Sapiens
LAVAVRSDH

SEQ ID NO: 1114952 - protein, 9 aa, Homo Sapiens
CGADVAAAT

SEQ ID NO: 1114953 - protein, 9 aa, Homo Sapiens
LVDAHMLDH

SEQ ID NO: 1114954 - protein, 9 aa, Homo Sapiens
SGPAGLPRA

SEQ ID NO: 1114955 - protein, 9 aa, Homo Sapiens
RFTTIARPT

SEQ ID NO: 1114956 - protein, 9 aa, Homo Sapiens
PTSGSTPGS

SEQ ID NO: 1114957 - protein, 9 aa, Homo Sapiens
SKKCKPRFH

SEQ ID NO: 1114958 - protein, 9 aa, Homo Sapiens
AFSNMDNML

SEQ ID NO: 1114959 - protein, 9 aa, Homo Sapiens
FQSQWDVDD

SEQ ID NO: 1114960 - protein, 9 aa, Homo Sapiens
LPWSISRSW

SEQ ID NO: 1114961 - protein, 9 aa, Homo Sapiens
EKLTEVREE

SEQ ID NO: 1114962 - protein, 9 aa, Homo Sapiens
VMPDSSSSW

SEQ ID NO: 1114963 - protein, 9 aa, Homo Sapiens
MVNTTDYHG

SEQ ID NO: 1114964 - protein, 9 aa, Homo Sapiens
IMEHGGPPS

SEQ ID NO: 1114965 - protein, 9 aa, Homo Sapiens
SCVPTAARP

SEQ ID NO: 1114966 - protein, 9 aa, Homo Sapiens
EWGLVVCKQ

SEQ ID NO: 1114967 - protein, 9 aa, Homo Sapiens
IGNNCNFVP

SEQ ID NO: 1114968 - protein, 9 aa, Homo Sapiens
LPVFGQHGI

SEQ ID NO: 1114969 - protein, 9 aa, Homo Sapiens
PSSVPRDRQ

SEQ ID NO: 1114970 - protein, 9 aa, Homo Sapiens
ISVKDHRTS

SEQ ID NO: 1114971 - protein, 9 aa, Homo Sapiens
NRFMGMLPP

SEQ ID NO: 1114972 - protein, 9 aa, Homo Sapiens
TINRNHMGR

SEQ ID NO: 1114973 - protein, 9 aa, Homo Sapiens
FQINHALLN

SEQ ID NO: 1114974 - protein, 9 aa, Homo Sapiens
RGYRERGGL

SEQ ID NO: 1114975 - protein, 9 aa, Homo Sapiens
VKDPDMKHK

SEQ ID NO: 1114976 - protein, 9 aa, Homo Sapiens
TPKKRKTGV

SEQ ID NO: 1114977 - protein, 9 aa, Homo Sapiens
RDPQDGCND

SEQ ID NO: 1114978 - protein, 9 aa, Homo Sapiens
RPAAGRASG

SEQ ID NO: 1114979 - protein, 9 aa, Homo Sapiens
RSSSPPSTS

SEQ ID NO: 1114980 - protein, 9 aa, Homo Sapiens
CHLSTKGFP

SEQ ID NO: 1114981 - protein, 9 aa, Homo Sapiens
WRRTGASTP

SEQ ID NO: 1114982 - protein, 9 aa, Homo Sapiens
QSPFFATAR

SEQ ID NO: 1114983 - protein, 9 aa, Homo Sapiens
HRRHRHHGH

SEQ ID NO: 1114984 - protein, 9 aa, Homo Sapiens
VDNKKTHPC

SEQ ID NO: 1114985 - protein, 9 aa, Homo Sapiens
VPEQQVTVA

SEQ ID NO: 1114986 - protein, 9 aa, Homo Sapiens
YDCTIPPME

SEQ ID NO: 1114987 - protein, 9 aa, Homo Sapiens
LTDADHGWA

SEQ ID NO: 1114988 - protein, 9 aa, Homo Sapiens
IGLQPLQRK

SEQ ID NO: 1114989 - protein, 9 aa, Homo Sapiens
PDGQEGFSQ

SEQ ID NO: 1114990 - protein, 9 aa, Homo Sapiens
IGFGRCFQK

SEQ ID NO: 1114991 - protein, 9 aa, Homo Sapiens
IVLLLGTVI

SEQ ID NO: 1114992 - protein, 9 aa, Homo Sapiens
MHRIGELSG

SEQ ID NO: 1114993 - protein, 9 aa, Homo Sapiens
VSATAGACS

SEQ ID NO: 1114994 - protein, 9 aa, Homo Sapiens
STAAQKVVT

SEQ ID NO: 1114995 - protein, 9 aa, Homo Sapiens
KAEQRARHR

SEQ ID NO: 1114996 - protein, 9 aa, Homo Sapiens
YATPLGYGA

SEQ ID NO: 1114997 - protein, 9 aa, Homo Sapiens
GLKNEEMDL

SEQ ID NO: 1114998 - protein, 9 aa, Homo Sapiens
SPGFFLSRA

SEQ ID NO: 1114999 - protein, 9 aa, Homo Sapiens
DLRVITSHA

SEQ ID NO: 1115000 - protein, 9 aa, Homo Sapiens
HIVTELYFA

SEQ ID NO: 1115001 - protein, 9 aa, Homo Sapiens
KKNHRWHWS

SEQ ID NO: 1115002 - protein, 9 aa, Homo Sapiens
PARPEVSIF

SEQ ID NO: 1115003 - protein, 9 aa, Homo Sapiens
TRGTLHTTL

SEQ ID NO: 1115004 - protein, 9 aa, Homo Sapiens
CKAGLAPIF

SEQ ID NO: 1115005 - protein, 9 aa, Homo Sapiens
IFNGGSDLI

SEQ ID NO: 1115006 - protein, 9 aa, Homo Sapiens
VFSGLICMA

SEQ ID NO: 1115007 - protein, 9 aa, Homo Sapiens
AGGARGRDR

SEQ ID NO: 1115008 - protein, 9 aa, Homo Sapiens
KVMYRCLWP

SEQ ID NO: 1115009 - protein, 9 aa, Homo Sapiens
LLLALPILA

SEQ ID NO: 1115010 - protein, 9 aa, Homo Sapiens
LFLRCPKPT

SEQ ID NO: 1115011 - protein, 9 aa, Homo Sapiens
LMYPSPAAL

SEQ ID NO: 1115012 - protein, 9 aa, Homo Sapiens
TGTLEDSRQ

SEQ ID NO: 1115013 - protein, 9 aa, Homo Sapiens
GPQLAAMLN

SEQ ID NO: 1115014 - protein, 9 aa, Homo Sapiens
LLTEMGKRK

SEQ ID NO: 1115015 - protein, 9 aa, Homo Sapiens
RRYHQITIP

SEQ ID NO: 1115016 - protein, 9 aa, Homo Sapiens
TVHQVWVKF

SEQ ID NO: 1115017 - protein, 9 aa, Homo Sapiens
NAHTMRRAF

SEQ ID NO: 1115018 - protein, 9 aa, Homo Sapiens
GLHTGKVRT

SEQ ID NO: 1115019 - protein, 9 aa, Homo Sapiens
VTGAGATCW

SEQ ID NO: 1115020 - protein, 9 aa, Homo Sapiens
QPPQRPPLQ

SEQ ID NO: 1115021 - protein, 9 aa, Homo Sapiens
TVGPSGTSR

SEQ ID NO: 1115022 - protein, 9 aa, Homo Sapiens
YSAPNVVAN

SEQ ID NO: 1115023 - protein, 9 aa, Homo Sapiens
VPPIKKIPR

SEQ ID NO: 1115024 - protein, 9 aa, Homo Sapiens
LRERRQQHK

SEQ ID NO: 1115025 - protein, 9 aa, Homo Sapiens
RKECNFSDL

SEQ ID NO: 1115026 - protein, 9 aa, Homo Sapiens
AAPATRIEK

SEQ ID NO: 1115027 - protein, 9 aa, Homo Sapiens
LVGISAMNL

SEQ ID NO: 1115028 - protein, 9 aa, Homo Sapiens
VRSGTPSVW

SEQ ID NO: 1115029 - protein, 9 aa, Homo Sapiens
SEPGQGPEI

SEQ ID NO: 1115030 - protein, 9 aa, Homo Sapiens
AKFCIFSSP

SEQ ID NO: 1115031 - protein, 9 aa, Homo Sapiens
WWTALIAWD

SEQ ID NO: 1115032 - protein, 9 aa, Homo Sapiens
HGRLVIVGH

SEQ ID NO: 1115033 - protein, 9 aa, Homo Sapiens
PGRHICEGL

SEQ ID NO: 1115034 - protein, 9 aa, Homo Sapiens
PWSISRSWT

SEQ ID NO: 1115035 - protein, 9 aa, Homo Sapiens
FPRKPCSAC

SEQ ID NO: 1115036 - protein, 9 aa, Homo Sapiens
EREPQAFEN

SEQ ID NO: 1115037 - protein, 9 aa, Homo Sapiens
CIMVSEIQA

SEQ ID NO: 1115038 - protein, 9 aa, Homo Sapiens
AAPPPLPSL

SEQ ID NO: 1115039 - protein, 9 aa, Homo Sapiens
LFNQKKEQK

SEQ ID NO: 1115040 - protein, 9 aa, Homo Sapiens
AVLMYPSPA

SEQ ID NO: 1115041 - protein, 9 aa, Homo Sapiens
HRFGASLYG

SEQ ID NO: 1115042 - protein, 9 aa, Homo Sapiens
ADMYSSVAD

SEQ ID NO: 1115043 - protein, 9 aa, Homo Sapiens
EKMVAVALQ

SEQ ID NO: 1115044 - protein, 9 aa, Homo Sapiens
RGPQPGRRP

SEQ ID NO: 1115045 - protein, 9 aa, Homo Sapiens
QENGKQLLY

SEQ ID NO: 1115046 - protein, 9 aa, Homo Sapiens
LSIADMYSS

SEQ ID NO: 1115047 - protein, 9 aa, Homo Sapiens
GRWQGPQVS

SEQ ID NO: 1115048 - protein, 9 aa, Homo Sapiens
TPNGNLADE

SEQ ID NO: 1115049 - protein, 9 aa, Homo Sapiens
DSTAAQKVV

SEQ ID NO: 1115050 - protein, 9 aa, Homo Sapiens
VLIPPLRPS

SEQ ID NO: 1115051 - protein, 9 aa, Homo Sapiens
TGIDTSETS

SEQ ID NO: 1115052 - protein, 9 aa, Homo Sapiens
VFRFPTYRG

SEQ ID NO: 1115053 - protein, 9 aa, Homo Sapiens
AKEDGKANT

SEQ ID NO: 1115054 - protein, 9 aa, Homo Sapiens
PDQGLCDLL

SEQ ID NO: 1115055 - protein, 9 aa, Homo Sapiens
PKGTASQSE

SEQ ID NO: 1115056 - protein, 9 aa, Homo Sapiens
LAADQLLTG

SEQ ID NO: 1115057 - protein, 9 aa, Homo Sapiens
LPFPPWKAR

SEQ ID NO: 1115058 - protein, 9 aa, Homo Sapiens
LCQQLLDEV

SEQ ID NO: 1115059 - protein, 9 aa, Homo Sapiens
GSWWPRMKS

SEQ ID NO: 1115060 - protein, 9 aa, Homo Sapiens
VVTGAGATC

SEQ ID NO: 1115061 - protein, 9 aa, Homo Sapiens
LEISTQLCK

SEQ ID NO: 1115062 - protein, 9 aa, Homo Sapiens
QQNQNRMWW

SEQ ID NO: 1115063 - protein, 9 aa, Homo Sapiens
IFRKECNFS

SEQ ID NO: 1115064 - protein, 9 aa, Homo Sapiens
QNDTYDVPR

SEQ ID NO: 1115065 - protein, 9 aa, Homo Sapiens
TMCYGQTGA

SEQ ID NO: 1115066 - protein, 9 aa, Homo Sapiens
DLLQDELAL

SEQ ID NO: 1115067 - protein, 9 aa, Homo Sapiens
IEGEREPQA

SEQ ID NO: 1115068 - protein, 9 aa, Homo Sapiens
LWTDNCLLL

SEQ ID NO: 1115069 - protein, 9 aa, Homo Sapiens
AAPKVPEAT

SEQ ID NO: 1115070 - protein, 9 aa, Homo Sapiens
PRPPRSQPS

SEQ ID NO: 1115071 - protein, 9 aa, Homo Sapiens
PRPPPHTHP

SEQ ID NO: 1115072 - protein, 9 aa, Homo Sapiens
EAREDTAEP

SEQ ID NO: 1115073 - protein, 9 aa, Homo Sapiens
AKHLSQCKT

SEQ ID NO: 1115074 - protein, 9 aa, Homo Sapiens
AGSAACLFQ

SEQ ID NO: 1115075 - protein, 9 aa, Homo Sapiens
FSMAKLPHG

SEQ ID NO: 1115076 - protein, 9 aa, Homo Sapiens
PRVGGLPKK

SEQ ID NO: 1115077 - protein, 9 aa, Homo Sapiens
AGSESIGRS

SEQ ID NO: 1115078 - protein, 9 aa, Homo Sapiens
EKLGAPRPT

SEQ ID NO: 1115079 - protein, 9 aa, Homo Sapiens
YEVHFKKDH

SEQ ID NO: 1115080 - protein, 9 aa, Homo Sapiens
GVDVATDFS

SEQ ID NO: 1115081 - protein, 9 aa, Homo Sapiens
IGSSRRCLL

SEQ ID NO: 1115082 - protein, 9 aa, Homo Sapiens
GCGPRGRGC

SEQ ID NO: 1115083 - protein, 9 aa, Homo Sapiens
KLIQQPRYP

SEQ ID NO: 1115084 - protein, 9 aa, Homo Sapiens
IEKNNYRKT

SEQ ID NO: 1115085 - protein, 9 aa, Homo Sapiens
KLPVFGQHG

SEQ ID NO: 1115086 - protein, 9 aa, Homo Sapiens
SSTRNKPSE

SEQ ID NO: 1115087 - protein, 9 aa, Homo Sapiens
HLEVFPPVF

SEQ ID NO: 1115088 - protein, 9 aa, Homo Sapiens
PEDSPPRGR

SEQ ID NO: 1115089 - protein, 9 aa, Homo Sapiens
AFRELDTNG

SEQ ID NO: 1115090 - protein, 9 aa, Homo Sapiens
CRCKGWRGR

SEQ ID NO: 1115091 - protein, 9 aa, Homo Sapiens
AYTQKLSVP

SEQ ID NO: 1115092 - protein, 9 aa, Homo Sapiens
SAEPSTRWS

SEQ ID NO: 1115093 - protein, 9 aa, Homo Sapiens
SCRHSVQSI

SEQ ID NO: 1115094 - protein, 9 aa, Homo Sapiens
QNWPPLEGP

SEQ ID NO: 1115095 - protein, 9 aa, Homo Sapiens
KRKPMNTND

SEQ ID NO: 1115096 - protein, 9 aa, Homo Sapiens
STMKISLST

SEQ ID NO: 1115097 - protein, 9 aa, Homo Sapiens
GSYTCAAEN

SEQ ID NO: 1115098 - protein, 9 aa, Homo Sapiens
SRRLEVEAG

SEQ ID NO: 1115099 - protein, 9 aa, Homo Sapiens
SQPSLHLRG

SEQ ID NO: 1115100 - protein, 9 aa, Homo Sapiens
GGSERSHGV

SEQ ID NO: 1115101 - protein, 9 aa, Homo Sapiens
AQSPAGPAG

SEQ ID NO: 1115102 - protein, 9 aa, Homo Sapiens
LSQPPPQAP

SEQ ID NO: 1115103 - protein, 9 aa, Homo Sapiens
NRSGRWKPP

SEQ ID NO: 1115104 - protein, 9 aa, Homo Sapiens
TTAAAIMAT

SEQ ID NO: 1115105 - protein, 9 aa, Homo Sapiens
KLEFCTRLL

SEQ ID NO: 1115106 - protein, 9 aa, Homo Sapiens
PDMKSYLWE

SEQ ID NO: 1115107 - protein, 9 aa, Homo Sapiens
LRSETTAAA

SEQ ID NO: 1115108 - protein, 9 aa, Homo Sapiens
GRCVDGITS

SEQ ID NO: 1115109 - protein, 9 aa, Homo Sapiens
SMTLPAPTA

SEQ ID NO: 1115110 - protein, 9 aa, Homo Sapiens
QVVIVEEAQ

SEQ ID NO: 1115111 - protein, 9 aa, Homo Sapiens
TQQLAWPDT

SEQ ID NO: 1115112 - protein, 9 aa, Homo Sapiens
GSVTHQSSM

SEQ ID NO: 1115113 - protein, 9 aa, Homo Sapiens
FAPSPNEEG

SEQ ID NO: 1115114 - protein, 9 aa, Homo Sapiens
APHIRAENH

SEQ ID NO: 1115115 - protein, 9 aa, Homo Sapiens
KLVDITDIR

SEQ ID NO: 1115116 - protein, 9 aa, Homo Sapiens
INKRIEHSI

SEQ ID NO: 1115117 - protein, 9 aa, Homo Sapiens
NDDLVTFGI

SEQ ID NO: 1115118 - protein, 9 aa, Homo Sapiens
PTPQKFLDT

SEQ ID NO: 1115119 - protein, 9 aa, Homo Sapiens
QCKTHTCQV

SEQ ID NO: 1115120 - protein, 9 aa, Homo Sapiens
PCTASTATT

SEQ ID NO: 1115121 - protein, 9 aa, Homo Sapiens
DATRFPIIA

SEQ ID NO: 1115122 - protein, 9 aa, Homo Sapiens
KARPGTSPG

SEQ ID NO: 1115123 - protein, 9 aa, Homo Sapiens
SSQVPVQTR

SEQ ID NO: 1115124 - protein, 9 aa, Homo Sapiens
VGSQNDTYD

SEQ ID NO: 1115125 - protein, 9 aa, Homo Sapiens
KQSPSWRSE

SEQ ID NO: 1115126 - protein, 9 aa, Homo Sapiens
RAPPMMGAG

SEQ ID NO: 1115127 - protein, 9 aa, Homo Sapiens
RPPPLSLPT

SEQ ID NO: 1115128 - protein, 9 aa, Homo Sapiens
GLRLRPPWC

SEQ ID NO: 1115129 - protein, 9 aa, Homo Sapiens
TSGVFPASV

SEQ ID NO: 1115130 - protein, 9 aa, Homo Sapiens
TGPRCPGSA

SEQ ID NO: 1115131 - protein, 9 aa, Homo Sapiens
EVWRGCRGT

SEQ ID NO: 1115132 - protein, 9 aa, Homo Sapiens
RHVVMNSRE

SEQ ID NO: 1115133 - protein, 9 aa, Homo Sapiens
VWPPYSYSA

SEQ ID NO: 1115134 - protein, 9 aa, Homo Sapiens
LSEIPCCNC

SEQ ID NO: 1115135 - protein, 9 aa, Homo Sapiens
PARQPSRPT

SEQ ID NO: 1115136 - protein, 9 aa, Homo Sapiens
VKNLSHLDT

SEQ ID NO: 1115137 - protein, 9 aa, Homo Sapiens
FKKCVSKNT

SEQ ID NO: 1115138 - protein, 9 aa, Homo Sapiens
LGVHGEGEG

SEQ ID NO: 1115139 - protein, 9 aa, Homo Sapiens
LRFWEFVYQ

SEQ ID NO: 1115140 - protein, 9 aa, Homo Sapiens
TNATGLHKL

SEQ ID NO: 1115141 - protein, 9 aa, Homo Sapiens
LQPLQRKGP

SEQ ID NO: 1115142 - protein, 9 aa, Homo Sapiens
AANGAYAKQ

SEQ ID NO: 1115143 - protein, 9 aa, Homo Sapiens
QRKALYGLE

SEQ ID NO: 1115144 - protein, 9 aa, Homo Sapiens
DVDDNEDES

SEQ ID NO: 1115145 - protein, 9 aa, Homo Sapiens
LLLLPHSRG

SEQ ID NO: 1115146 - protein, 9 aa, Homo Sapiens
NLGLGEAVW

SEQ ID NO: 1115147 - protein, 9 aa, Homo Sapiens
EDDSSQEVI

SEQ ID NO: 1115148 - protein, 9 aa, Homo Sapiens
LVVFLYMWS

SEQ ID NO: 1115149 - protein, 9 aa, Homo Sapiens
LIVHYSFLS

SEQ ID NO: 1115150 - protein, 9 aa, Homo Sapiens
QLVEQAWPW

SEQ ID NO: 1115151 - protein, 9 aa, Homo Sapiens
LFYVASDDE

SEQ ID NO: 1115152 - protein, 9 aa, Homo Sapiens
FGPLVGISA

SEQ ID NO: 1115153 - protein, 9 aa, Homo Sapiens
VVSGPRVSQ

SEQ ID NO: 1115154 - protein, 9 aa, Homo Sapiens
AHRPSLALL

SEQ ID NO: 1115155 - protein, 9 aa, Homo Sapiens
RPGQRASPG

SEQ ID NO: 1115156 - protein, 9 aa, Homo Sapiens
SHPETLAHT

SEQ ID NO: 1115157 - protein, 9 aa, Homo Sapiens
LVAMRKAAA

SEQ ID NO: 1115158 - protein, 9 aa, Homo Sapiens
ILTLFSLKV

SEQ ID NO: 1115159 - protein, 9 aa, Homo Sapiens
AWAVESLDS

SEQ ID NO: 1115160 - protein, 9 aa, Homo Sapiens
RLMAPVGSV

SEQ ID NO: 1115161 - protein, 9 aa, Homo Sapiens
CDIDAMIYT

SEQ ID NO: 1115162 - protein, 9 aa, Homo Sapiens
LSFPAPLPG

SEQ ID NO: 1115163 - protein, 9 aa, Homo Sapiens
TPGLSKDAY

SEQ ID NO: 1115164 - protein, 9 aa, Homo Sapiens
ITTFNIQGL

SEQ ID NO: 1115165 - protein, 9 aa, Homo Sapiens
SCRGLQTDG

SEQ ID NO: 1115166 - protein, 9 aa, Homo Sapiens
HHHFQHHAK

SEQ ID NO: 1115167 - protein, 9 aa, Homo Sapiens
IADATKSLG

SEQ ID NO: 1115168 - protein, 9 aa, Homo Sapiens
LKADSESAS

SEQ ID NO: 1115169 - protein, 9 aa, Homo Sapiens
SPYDQREFT

SEQ ID NO: 1115170 - protein, 9 aa, Homo Sapiens
LDDVLHRYA

SEQ ID NO: 1115171 - protein, 9 aa, Homo Sapiens
EHHRDREPD

SEQ ID NO: 1115172 - protein, 9 aa, Homo Sapiens
SKKGNFQRT

SEQ ID NO: 1115173 - protein, 9 aa, Homo Sapiens
LEKIILYRS

SEQ ID NO: 1115174 - protein, 9 aa, Homo Sapiens
GLLTLLWGT

SEQ ID NO: 1115175 - protein, 9 aa, Homo Sapiens
SAADVTTHF

SEQ ID NO: 1115176 - protein, 9 aa, Homo Sapiens
DERGWWKAI

SEQ ID NO: 1115177 - protein, 9 aa, Homo Sapiens
SPTLTPKAG

SEQ ID NO: 1115178 - protein, 9 aa, Homo Sapiens
IAKFEHLQT

SEQ ID NO: 1115179 - protein, 9 aa, Homo Sapiens
SPKNSNIAG

SEQ ID NO: 1115180 - protein, 9 aa, Homo Sapiens
VGGTLDTER

SEQ ID NO: 1115181 - protein, 9 aa, Homo Sapiens
EGRKKGLCH

SEQ ID NO: 1115182 - protein, 9 aa, Homo Sapiens
LNGEATFGR

SEQ ID NO: 1115183 - protein, 9 aa, Homo Sapiens
VGSVMSCSL

SEQ ID NO: 1115184 - protein, 9 aa, Homo Sapiens
TDAGSTHIS

SEQ ID NO: 1115185 - protein, 9 aa, Homo Sapiens
YNLQTLPPK

SEQ ID NO: 1115186 - protein, 9 aa, Homo Sapiens
AMEQVNKRD

SEQ ID NO: 1115187 - protein, 9 aa, Homo Sapiens
AVMSANAAV

SEQ ID NO: 1115188 - protein, 9 aa, Homo Sapiens
YHEVLSRTH

SEQ ID NO: 1115189 - protein, 9 aa, Homo Sapiens
KDTICSGVT

SEQ ID NO: 1115190 - protein, 9 aa, Homo Sapiens
VALPGEPRR

SEQ ID NO: 1115191 - protein, 9 aa, Homo Sapiens
GPVLFMVYG

SEQ ID NO: 1115192 - protein, 9 aa, Homo Sapiens
YDDDEDDGA

SEQ ID NO: 1115193 - protein, 9 aa, Homo Sapiens
KRVDLLQDE

SEQ ID NO: 1115194 - protein, 9 aa, Homo Sapiens
HMGFVSGLK

SEQ ID NO: 1115195 - protein, 9 aa, Homo Sapiens
AKPMCSTCG

SEQ ID NO: 1115196 - protein, 9 aa, Homo Sapiens
KIILYRSKL

SEQ ID NO: 1115197 - protein, 9 aa, Homo Sapiens
SGFSGSLGT

SEQ ID NO: 1115198 - protein, 9 aa, Homo Sapiens
KEDRPKVQA

SEQ ID NO: 1115199 - protein, 9 aa, Homo Sapiens
RGSGGEQLC

SEQ ID NO: 1115200 - protein, 9 aa, Homo Sapiens
GSRPAAGRA

SEQ ID NO: 1115201 - protein, 9 aa, Homo Sapiens
LENVIRDVV

SEQ ID NO: 1115202 - protein, 9 aa, Homo Sapiens
IVLTFSIVF

SEQ ID NO: 1115203 - protein, 9 aa, Homo Sapiens
EKNPPLRFN

SEQ ID NO: 1115204 - protein, 9 aa, Homo Sapiens
DTSNSLLVP

SEQ ID NO: 1115205 - protein, 9 aa, Homo Sapiens
GLNHVNHFY

SEQ ID NO: 1115206 - protein, 9 aa, Homo Sapiens
MLYSRQGST

SEQ ID NO: 1115207 - protein, 9 aa, Homo Sapiens
STQARSPSS

SEQ ID NO: 1115208 - protein, 9 aa, Homo Sapiens
RSHWSPLTA

SEQ ID NO: 1115209 - protein, 9 aa, Homo Sapiens
TTLSQAQLI

SEQ ID NO: 1115210 - protein, 9 aa, Homo Sapiens
NEETFLKKN

SEQ ID NO: 1115211 - protein, 9 aa, Homo Sapiens
IPDGDQVLC

SEQ ID NO: 1115212 - protein, 9 aa, Homo Sapiens
ALDCIFGVE

SEQ ID NO: 1115213 - protein, 9 aa, Homo Sapiens
QDKEKEQEK

SEQ ID NO: 1115214 - protein, 9 aa, Homo Sapiens
RKGAQLGGG

SEQ ID NO: 1115215 - protein, 9 aa, Homo Sapiens
GVLDNSEGK

SEQ ID NO: 1115216 - protein, 9 aa, Homo Sapiens
PDGIDPTEL

SEQ ID NO: 1115217 - protein, 9 aa, Homo Sapiens
EEEDLDGIL

SEQ ID NO: 1115218 - protein, 9 aa, Homo Sapiens
MLCEFFGVR

SEQ ID NO: 1115219 - protein, 9 aa, Homo Sapiens
GPTGPRCPG

SEQ ID NO: 1115220 - protein, 9 aa, Homo Sapiens
MYTIGYSIS

SEQ ID NO: 1115221 - protein, 9 aa, Homo Sapiens
KTMRPSLAP

SEQ ID NO: 1115222 - protein, 9 aa, Homo Sapiens
CTTFTRHSL

SEQ ID NO: 1115223 - protein, 9 aa, Homo Sapiens
LEVVEGVLI

SEQ ID NO: 1115224 - protein, 9 aa, Homo Sapiens
LLQPAYRDS

SEQ ID NO: 1115225 - protein, 9 aa, Homo Sapiens
PWLGGQLPV

SEQ ID NO: 1115226 - protein, 9 aa, Homo Sapiens
RSTCGRRTR

SEQ ID NO: 1115227 - protein, 9 aa, Homo Sapiens
TEETGKSHL

SEQ ID NO: 1115228 - protein, 9 aa, Homo Sapiens
QLHGKVGQC

SEQ ID NO: 1115229 - protein, 9 aa, Homo Sapiens
FPDEEKPQA

SEQ ID NO: 1115230 - protein, 9 aa, Homo Sapiens
STITLCLHY

SEQ ID NO: 1115231 - protein, 9 aa, Homo Sapiens
ELGGLEASS

SEQ ID NO: 1115232 - protein, 9 aa, Homo Sapiens
GPPAALHTM

SEQ ID NO: 1115233 - protein, 9 aa, Homo Sapiens
KLEMVKAVQ

SEQ ID NO: 1115234 - protein, 9 aa, Homo Sapiens
LGGLGQVFA

SEQ ID NO: 1115235 - protein, 9 aa, Homo Sapiens
CAGSSTRPK

SEQ ID NO: 1115236 - protein, 9 aa, Homo Sapiens
DLMSWMAKG

SEQ ID NO: 1115237 - protein, 9 aa, Homo Sapiens
RPCRMRLYQ

SEQ ID NO: 1115238 - protein, 9 aa, Homo Sapiens
SVKMLLLSA

SEQ ID NO: 1115239 - protein, 9 aa, Homo Sapiens
PAGRIRSGG

SEQ ID NO: 1115240 - protein, 9 aa, Homo Sapiens
LIEGPAFSL

SEQ ID NO: 1115241 - protein, 9 aa, Homo Sapiens
LLMSWKQML

SEQ ID NO: 1115242 - protein, 9 aa, Homo Sapiens
PQPRVGGLP

SEQ ID NO: 1115243 - protein, 9 aa, Homo Sapiens
IKLTPGLSK

SEQ ID NO: 1115244 - protein, 9 aa, Homo Sapiens
EAKKHSNPY

SEQ ID NO: 1115245 - protein, 9 aa, Homo Sapiens
MYLATVMGN

SEQ ID NO: 1115246 - protein, 9 aa, Homo Sapiens
RSRSICPCP

SEQ ID NO: 1115247 - protein, 9 aa, Homo Sapiens
YHYGVSASE

SEQ ID NO: 1115248 - protein, 9 aa, Homo Sapiens
GQVPTLLES

SEQ ID NO: 1115249 - protein, 9 aa, Homo Sapiens
ATDPISVPG

SEQ ID NO: 1115250 - protein, 9 aa, Homo Sapiens
DIWTEMIIT

SEQ ID NO: 1115251 - protein, 9 aa, Homo Sapiens
KNHYEESSR

SEQ ID NO: 1115252 - protein, 9 aa, Homo Sapiens
VCSRQIYFM

SEQ ID NO: 1115253 - protein, 9 aa, Homo Sapiens
GRLQTIDLL

SEQ ID NO: 1115254 - protein, 9 aa, Homo Sapiens
RWERPGAGS

SEQ ID NO: 1115255 - protein, 9 aa, Homo Sapiens
CNAKDVAVS

SEQ ID NO: 1115256 - protein, 9 aa, Homo Sapiens
STGCPLLAS

SEQ ID NO: 1115257 - protein, 9 aa, Homo Sapiens
SYSKQNREK

SEQ ID NO: 1115258 - protein, 9 aa, Homo Sapiens
VTTMTHGVQ

SEQ ID NO: 1115259 - protein, 9 aa, Homo Sapiens
QVYFTEEPE

SEQ ID NO: 1115260 - protein, 9 aa, Homo Sapiens
VPSSDQGLY

SEQ ID NO: 1115261 - protein, 9 aa, Homo Sapiens
KVAQCLLDK

SEQ ID NO: 1115262 - protein, 9 aa, Homo Sapiens
QTKGKGGRE

SEQ ID NO: 1115263 - protein, 9 aa, Homo Sapiens
VMAQSLSQC

SEQ ID NO: 1115264 - protein, 9 aa, Homo Sapiens
PWSERVPRL

SEQ ID NO: 1115265 - protein, 9 aa, Homo Sapiens
TMVYAFCTL

SEQ ID NO: 1115266 - protein, 9 aa, Homo Sapiens
SERVPRLLA

SEQ ID NO: 1115267 - protein, 9 aa, Homo Sapiens
GWLFIQLHH

SEQ ID NO: 1115268 - protein, 9 aa, Homo Sapiens
EFGTRMITI

SEQ ID NO: 1115269 - protein, 9 aa, Homo Sapiens
SSWKNRKEE

SEQ ID NO: 1115270 - protein, 9 aa, Homo Sapiens
GATCGLLYS

SEQ ID NO: 1115271 - protein, 9 aa, Homo Sapiens
EDKKIQDQD

SEQ ID NO: 1115272 - protein, 9 aa, Homo Sapiens
CGTTGQLTQ

SEQ ID NO: 1115273 - protein, 9 aa, Homo Sapiens
EEFEQKNQH

SEQ ID NO: 1115274 - protein, 9 aa, Homo Sapiens
ESYRGTLLN

SEQ ID NO: 1115275 - protein, 9 aa, Homo Sapiens
RTVAGTGAR

SEQ ID NO: 1115276 - protein, 9 aa, Homo Sapiens
MVKSALEPP

SEQ ID NO: 1115277 - protein, 9 aa, Homo Sapiens
AITFKTGKV

SEQ ID NO: 1115278 - protein, 9 aa, Homo Sapiens
FGFSIVVGE

SEQ ID NO: 1115279 - protein, 9 aa, Homo Sapiens
GRRTGQLPV

SEQ ID NO: 1115280 - protein, 9 aa, Homo Sapiens
RLRPPWCAT

SEQ ID NO: 1115281 - protein, 9 aa, Homo Sapiens
PFYLMYITT

SEQ ID NO: 1115282 - protein, 9 aa, Homo Sapiens
TAAARHLRS

SEQ ID NO: 1115283 - protein, 9 aa, Homo Sapiens
VPDVLRWLD

SEQ ID NO: 1115284 - protein, 9 aa, Homo Sapiens
PRRRRPPAL

SEQ ID NO: 1115285 - protein, 9 aa, Homo Sapiens
FTSWVSLVS

SEQ ID NO: 1115286 - protein, 9 aa, Homo Sapiens
ITEWRSLAR

SEQ ID NO: 1115287 - protein, 9 aa, Homo Sapiens
RTTKSWSCC

SEQ ID NO: 1115288 - protein, 9 aa, Homo Sapiens
CPRAATLGI

SEQ ID NO: 1115289 - protein, 9 aa, Homo Sapiens
RESPPNPGC

SEQ ID NO: 1115290 - protein, 9 aa, Homo Sapiens
TDDILRGEL

SEQ ID NO: 1115291 - protein, 9 aa, Homo Sapiens
QDSWWLPMG

SEQ ID NO: 1115292 - protein, 9 aa, Homo Sapiens
VREDNRHVA

SEQ ID NO: 1115293 - protein, 9 aa, Homo Sapiens
RLGEYSLLP

SEQ ID NO: 1115294 - protein, 9 aa, Homo Sapiens
YEVMEKLPV

SEQ ID NO: 1115295 - protein, 9 aa, Homo Sapiens
PPTCAACRP

SEQ ID NO: 1115296 - protein, 9 aa, Homo Sapiens
GFWLMLCEF

SEQ ID NO: 1115297 - protein, 9 aa, Homo Sapiens
HHGRVLFRP

SEQ ID NO: 1115298 - protein, 9 aa, Homo Sapiens
ALVLYGQNK

SEQ ID NO: 1115299 - protein, 9 aa, Homo Sapiens
GLGHIEGSS

SEQ ID NO: 1115300 - protein, 9 aa, Homo Sapiens
SRDVLLNMC

SEQ ID NO: 1115301 - protein, 9 aa, Homo Sapiens
FDATKGRKF

SEQ ID NO: 1115302 - protein, 9 aa, Homo Sapiens
ALLGVQEGV

SEQ ID NO: 1115303 - protein, 9 aa, Homo Sapiens
ATIINLLRF

SEQ ID NO: 1115304 - protein, 9 aa, Homo Sapiens
MSSGFSGSL

SEQ ID NO: 1115305 - protein, 9 aa, Homo Sapiens
QNDVKRLER

SEQ ID NO: 1115306 - protein, 9 aa, Homo Sapiens
AEWIPLARK

SEQ ID NO: 1115307 - protein, 9 aa, Homo Sapiens
ISLPVPLPP

SEQ ID NO: 1115308 - protein, 9 aa, Homo Sapiens
LRDLLHFLL

SEQ ID NO: 1115309 - protein, 9 aa, Homo Sapiens
CEACQNFFR

SEQ ID NO: 1115310 - protein, 9 aa, Homo Sapiens
VARMCLHAS

SEQ ID NO: 1115311 - protein, 9 aa, Homo Sapiens
DPQELLDSP

SEQ ID NO: 1115312 - protein, 9 aa, Homo Sapiens
YRAGVVCCL

SEQ ID NO: 1115313 - protein, 9 aa, Homo Sapiens
LNHVNHFYC

SEQ ID NO: 1115314 - protein, 9 aa, Homo Sapiens
QEAYCQHLL

SEQ ID NO: 1115315 - protein, 9 aa, Homo Sapiens
GCVAELGGH

SEQ ID NO: 1115316 - protein, 9 aa, Homo Sapiens
VQLRQLLVS

SEQ ID NO: 1115317 - protein, 9 aa, Homo Sapiens
TSRARRTNG

SEQ ID NO: 1115318 - protein, 9 aa, Homo Sapiens
EKKTNQRFD

SEQ ID NO: 1115319 - protein, 9 aa, Homo Sapiens
AYVEDPEGL

SEQ ID NO: 1115320 - protein, 9 aa, Homo Sapiens
GNSKIVQAF

SEQ ID NO: 1115321 - protein, 9 aa, Homo Sapiens
ALPSSTYAP

SEQ ID NO: 1115322 - protein, 9 aa, Homo Sapiens
GIQLKKGAG

SEQ ID NO: 1115323 - protein, 9 aa, Homo Sapiens
CTCIPPVKL

SEQ ID NO: 1115324 - protein, 9 aa, Homo Sapiens
VVTGDEEEE

SEQ ID NO: 1115325 - protein, 9 aa, Homo Sapiens
LRAKLDGAR

SEQ ID NO: 1115326 - protein, 9 aa, Homo Sapiens
PCPVHRPAC

SEQ ID NO: 1115327 - protein, 9 aa, Homo Sapiens
CPLLEGSAE

SEQ ID NO: 1115328 - protein, 9 aa, Homo Sapiens
VLGDPAIHQ

SEQ ID NO: 1115329 - protein, 9 aa, Homo Sapiens
FWSLCCTVI

SEQ ID NO: 1115330 - protein, 9 aa, Homo Sapiens
AVRLAVLNG

SEQ ID NO: 1115331 - protein, 9 aa, Homo Sapiens
VKKAICTGP

SEQ ID NO: 1115332 - protein, 9 aa, Homo Sapiens
APHVLGLAV

SEQ ID NO: 1115333 - protein, 9 aa, Homo Sapiens
RREGVKSEN

SEQ ID NO: 1115334 - protein, 9 aa, Homo Sapiens
APPQTRTAQ

SEQ ID NO: 1115335 - protein, 9 aa, Homo Sapiens
FPPWKARWC

SEQ ID NO: 1115336 - protein, 9 aa, Homo Sapiens
ALLQQSFLA

SEQ ID NO: 1115337 - protein, 9 aa, Homo Sapiens
TIHSFSGLV

SEQ ID NO: 1115338 - protein, 9 aa, Homo Sapiens
DSPQECSTF

SEQ ID NO: 1115339 - protein, 9 aa, Homo Sapiens
QKKKIRKQQ

SEQ ID NO: 1115340 - protein, 9 aa, Homo Sapiens
PSTHTVITT

SEQ ID NO: 1115341 - protein, 9 aa, Homo Sapiens
WNLHKCIAL

SEQ ID NO: 1115342 - protein, 9 aa, Homo Sapiens
RTSAPRITA

SEQ ID NO: 1115343 - protein, 9 aa, Homo Sapiens
WYSVLEKGS

SEQ ID NO: 1115344 - protein, 9 aa, Homo Sapiens
AVQEVADGG

SEQ ID NO: 1115345 - protein, 9 aa, Homo Sapiens
LYLQDMWTT

SEQ ID NO: 1115346 - protein, 9 aa, Homo Sapiens
PLSSMAVSP

SEQ ID NO: 1115347 - protein, 9 aa, Homo Sapiens
QENGIYSVT

SEQ ID NO: 1115348 - protein, 9 aa, Homo Sapiens
MASKPRQIL

SEQ ID NO: 1115349 - protein, 9 aa, Homo Sapiens
LPPATGSYG

SEQ ID NO: 1115350 - protein, 9 aa, Homo Sapiens
GGKRSRCRP

SEQ ID NO: 1115351 - protein, 9 aa, Homo Sapiens
QAFSMPHDG

SEQ ID NO: 1115352 - protein, 9 aa, Homo Sapiens
IMLNYNTNS

SEQ ID NO: 1115353 - protein, 9 aa, Homo Sapiens
NMKKSLCQH

SEQ ID NO: 1115354 - protein, 9 aa, Homo Sapiens
PNGHCIGTL

SEQ ID NO: 1115355 - protein, 9 aa, Homo Sapiens
LPPRRPPPA

SEQ ID NO: 1115356 - protein, 9 aa, Homo Sapiens
NTMAEKFSD

SEQ ID NO: 1115357 - protein, 9 aa, Homo Sapiens
RTPRGSPSP

SEQ ID NO: 1115358 - protein, 9 aa, Homo Sapiens
SSVVTDSIH

SEQ ID NO: 1115359 - protein, 9 aa, Homo Sapiens
NQRLQSPHT

SEQ ID NO: 1115360 - protein, 9 aa, Homo Sapiens
SLVEIEFIS

SEQ ID NO: 1115361 - protein, 9 aa, Homo Sapiens
RDVAWLGEF

SEQ ID NO: 1115362 - protein, 9 aa, Homo Sapiens
PVFLVFAKL

SEQ ID NO: 1115363 - protein, 9 aa, Homo Sapiens
ATEREYIQC

SEQ ID NO: 1115364 - protein, 9 aa, Homo Sapiens
DGQEGFSQR

SEQ ID NO: 1115365 - protein, 9 aa, Homo Sapiens
WGTTQLPVV

SEQ ID NO: 1115366 - protein, 9 aa, Homo Sapiens
YTLSGTIRS

SEQ ID NO: 1115367 - protein, 9 aa, Homo Sapiens
QNIEENKGR

SEQ ID NO: 1115368 - protein, 9 aa, Homo Sapiens
TTTSSPRRS

SEQ ID NO: 1115369 - protein, 9 aa, Homo Sapiens
TLSTIVAGS

SEQ ID NO: 1115370 - protein, 9 aa, Homo Sapiens
SHKDAVLGC

SEQ ID NO: 1115371 - protein, 9 aa, Homo Sapiens
SPTPSAPPQ

SEQ ID NO: 1115372 - protein, 9 aa, Homo Sapiens
EVDVISLKQ

SEQ ID NO: 1115373 - protein, 9 aa, Homo Sapiens
RCHPIASWL

SEQ ID NO: 1115374 - protein, 9 aa, Homo Sapiens
FLVYEFINR

SEQ ID NO: 1115375 - protein, 9 aa, Homo Sapiens
SRGPQPGRR

SEQ ID NO: 1115376 - protein, 9 aa, Homo Sapiens
QRVTLSGIY

SEQ ID NO: 1115377 - protein, 9 aa, Homo Sapiens
MENLRQCVD

SEQ ID NO: 1115378 - protein, 9 aa, Homo Sapiens
FQGSYSFDD

SEQ ID NO: 1115379 - protein, 9 aa, Homo Sapiens
RPPGPSPAS

SEQ ID NO: 1115380 - protein, 9 aa, Homo Sapiens
PSSSNNLSC

SEQ ID NO: 1115381 - protein, 9 aa, Homo Sapiens
VPAVWLLDV

SEQ ID NO: 1115382 - protein, 9 aa, Homo Sapiens
ELDDGMDSN

SEQ ID NO: 1115383 - protein, 9 aa, Homo Sapiens
PSRGTATPS

SEQ ID NO: 1115384 - protein, 9 aa, Homo Sapiens
VSDTIYDSK

SEQ ID NO: 1115385 - protein, 9 aa, Homo Sapiens
VAVGLRNGI

SEQ ID NO: 1115386 - protein, 9 aa, Homo Sapiens
SRPLSSWTH

SEQ ID NO: 1115387 - protein, 9 aa, Homo Sapiens
CKKDAPHSE

SEQ ID NO: 1115388 - protein, 9 aa, Homo Sapiens
GALHPRTQG

SEQ ID NO: 1115389 - protein, 9 aa, Homo Sapiens
FQPRTRLLP

SEQ ID NO: 1115390 - protein, 9 aa, Homo Sapiens
QQELEEQTC

SEQ ID NO: 1115391 - protein, 9 aa, Homo Sapiens
SLPENPLFI

SEQ ID NO: 1115392 - protein, 9 aa, Homo Sapiens
LEKRVKMVS

SEQ ID NO: 1115393 - protein, 9 aa, Homo Sapiens
FEESGEFKL

SEQ ID NO: 1115394 - protein, 9 aa, Homo Sapiens
ETVSMKKTI

SEQ ID NO: 1115395 - protein, 9 aa, Homo Sapiens
DDEILTLCA

SEQ ID NO: 1115396 - protein, 9 aa, Homo Sapiens
MGSGPRGVL

SEQ ID NO: 1115397 - protein, 9 aa, Homo Sapiens
NIPFCIGNA

SEQ ID NO: 1115398 - protein, 9 aa, Homo Sapiens
AQLLTDRAF

SEQ ID NO: 1115399 - protein, 9 aa, Homo Sapiens
TDNAYVQIR

SEQ ID NO: 1115400 - protein, 9 aa, Homo Sapiens
GHGAARSSS

SEQ ID NO: 1115401 - protein, 9 aa, Homo Sapiens
EDGDIKHIS

SEQ ID NO: 1115402 - protein, 9 aa, Homo Sapiens
LLALDSEAG

SEQ ID NO: 1115403 - protein, 9 aa, Homo Sapiens
CRGENHGEL

SEQ ID NO: 1115404 - protein, 9 aa, Homo Sapiens
RIPRGSYAE

SEQ ID NO: 1115405 - protein, 9 aa, Homo Sapiens
KDSLGTVEW

SEQ ID NO: 1115406 - protein, 9 aa, Homo Sapiens
VPQCLIVRL

SEQ ID NO: 1115407 - protein, 9 aa, Homo Sapiens
WQKYNVRSM

SEQ ID NO: 1115408 - protein, 9 aa, Homo Sapiens
PRARGEELT

SEQ ID NO: 1115409 - protein, 9 aa, Homo Sapiens
ARPAAAAAG

SEQ ID NO: 1115410 - protein, 9 aa, Homo Sapiens
ACLVIIHQR

SEQ ID NO: 1115411 - protein, 9 aa, Homo Sapiens
FHVSKISQA

SEQ ID NO: 1115412 - protein, 9 aa, Homo Sapiens
TMLYSRQGS

SEQ ID NO: 1115413 - protein, 9 aa, Homo Sapiens
ADIACLCVI

SEQ ID NO: 1115414 - protein, 9 aa, Homo Sapiens
KGEECGKAF

SEQ ID NO: 1115415 - protein, 9 aa, Homo Sapiens
EDEEHYAEQ

SEQ ID NO: 1115416 - protein, 9 aa, Homo Sapiens
VLGINVADK

SEQ ID NO: 1115417 - protein, 9 aa, Homo Sapiens
PPHPARTLA

SEQ ID NO: 1115418 - protein, 9 aa, Homo Sapiens
APHSAGLSP

SEQ ID NO: 1115419 - protein, 9 aa, Homo Sapiens
TQRPRAGGP

SEQ ID NO: 1115420 - protein, 9 aa, Homo Sapiens
DSWWLPMGS

SEQ ID NO: 1115421 - protein, 9 aa, Homo Sapiens
DASQPSWNP

SEQ ID NO: 1115422 - protein, 9 aa, Homo Sapiens
ENKMKNACH

SEQ ID NO: 1115423 - protein, 9 aa, Homo Sapiens
QAEQRVLLL

SEQ ID NO: 1115424 - protein, 9 aa, Homo Sapiens
IEVKYFPFG

SEQ ID NO: 1115425 - protein, 9 aa, Homo Sapiens
VLEVGSLTL

SEQ ID NO: 1115426 - protein, 9 aa, Homo Sapiens
VNNNNHTEA

SEQ ID NO: 1115427 - protein, 9 aa, Homo Sapiens
THFGDTFPP

SEQ ID NO: 1115428 - protein, 9 aa, Homo Sapiens
FLSFLSFFV

SEQ ID NO: 1115429 - protein, 9 aa, Homo Sapiens
KLPGYASHQ

SEQ ID NO: 1115430 - protein, 9 aa, Homo Sapiens
LHPSQQAET

SEQ ID NO: 1115431 - protein, 9 aa, Homo Sapiens
HSISLAGWL

SEQ ID NO: 1115432 - protein, 9 aa, Homo Sapiens
DPTARIPRP

SEQ ID NO: 1115433 - protein, 9 aa, Homo Sapiens
CFIILTLNS

SEQ ID NO: 1115434 - protein, 9 aa, Homo Sapiens
TQGHWHRLS

SEQ ID NO: 1115435 - protein, 9 aa, Homo Sapiens
VLVIQKAVH

SEQ ID NO: 1115436 - protein, 9 aa, Homo Sapiens
GTILTKKRW

SEQ ID NO: 1115437 - protein, 9 aa, Homo Sapiens
HWQCGCVDD

SEQ ID NO: 1115438 - protein, 9 aa, Homo Sapiens
FSIEKNNYR

SEQ ID NO: 1115439 - protein, 9 aa, Homo Sapiens
TLYRKMLDP

SEQ ID NO: 1115440 - protein, 9 aa, Homo Sapiens
AVGNAKTTH

SEQ ID NO: 1115441 - protein, 9 aa, Homo Sapiens
CCQCQEQEV

SEQ ID NO: 1115442 - protein, 9 aa, Homo Sapiens
RACWERQLK

SEQ ID NO: 1115443 - protein, 9 aa, Homo Sapiens
WHVQRSLVP

SEQ ID NO: 1115444 - protein, 9 aa, Homo Sapiens
RSSRCASRR

SEQ ID NO: 1115445 - protein, 9 aa, Homo Sapiens
QPPLHQPPP

SEQ ID NO: 1115446 - protein, 9 aa, Homo Sapiens
SVSNDAGSA

SEQ ID NO: 1115447 - protein, 9 aa, Homo Sapiens
KKERKVTLM

SEQ ID NO: 1115448 - protein, 9 aa, Homo Sapiens
LQLKADSES

SEQ ID NO: 1115449 - protein, 9 aa, Homo Sapiens
PHAWAPSWA

SEQ ID NO: 1115450 - protein, 9 aa, Homo Sapiens
WFEHSAKQR

SEQ ID NO: 1115451 - protein, 9 aa, Homo Sapiens
IKWSPSCHA

SEQ ID NO: 1115452 - protein, 9 aa, Homo Sapiens
HNRQLLCGA

SEQ ID NO: 1115453 - protein, 9 aa, Homo Sapiens
EHLVSTRFN

SEQ ID NO: 1115454 - protein, 9 aa, Homo Sapiens
PLLVLGWPA

SEQ ID NO: 1115455 - protein, 9 aa, Homo Sapiens
FNQKKEQKP

SEQ ID NO: 1115456 - protein, 9 aa, Homo Sapiens
TTSSQMWWR

SEQ ID NO: 1115457 - protein, 9 aa, Homo Sapiens
TGTLTTNCM

SEQ ID NO: 1115458 - protein, 9 aa, Homo Sapiens
SCCGKFTTE

SEQ ID NO: 1115459 - protein, 9 aa, Homo Sapiens
CAVPMPWGP

SEQ ID NO: 1115460 - protein, 9 aa, Homo Sapiens
DISDQETGT

SEQ ID NO: 1115461 - protein, 9 aa, Homo Sapiens
WGLVVCKQN

SEQ ID NO: 1115462 - protein, 9 aa, Homo Sapiens
QSYHAPIKD

SEQ ID NO: 1115463 - protein, 9 aa, Homo Sapiens
VGILSRHLQ

SEQ ID NO: 1115464 - protein, 9 aa, Homo Sapiens
RCRIPDRPY

SEQ ID NO: 1115465 - protein, 9 aa, Homo Sapiens
SRTGSCPNM

SEQ ID NO: 1115466 - protein, 9 aa, Homo Sapiens
SIGKNGRTR

SEQ ID NO: 1115467 - protein, 9 aa, Homo Sapiens
CPSAAGGGP

SEQ ID NO: 1115468 - protein, 9 aa, Homo Sapiens
FDGSALTAY

SEQ ID NO: 1115469 - protein, 9 aa, Homo Sapiens
YVSEDLRAL

SEQ ID NO: 1115470 - protein, 9 aa, Homo Sapiens
TYPICKQPV

SEQ ID NO: 1115471 - protein, 9 aa, Homo Sapiens
GPSPARSAA

SEQ ID NO: 1115472 - protein, 9 aa, Homo Sapiens
LQGHSVYGP

SEQ ID NO: 1115473 - protein, 9 aa, Homo Sapiens
RIKVMILEL

SEQ ID NO: 1115474 - protein, 9 aa, Homo Sapiens
LKKILRSFM

SEQ ID NO: 1115475 - protein, 9 aa, Homo Sapiens
GEFKLFMKR

SEQ ID NO: 1115476 - protein, 9 aa, Homo Sapiens
SLKDVEASL

SEQ ID NO: 1115477 - protein, 9 aa, Homo Sapiens
KPVPPWDCG

SEQ ID NO: 1115478 - protein, 9 aa, Homo Sapiens
VEGVLIDVL

SEQ ID NO: 1115479 - protein, 9 aa, Homo Sapiens
HTIDASLRK

SEQ ID NO: 1115480 - protein, 9 aa, Homo Sapiens
MKLAQKEHH

SEQ ID NO: 1115481 - protein, 9 aa, Homo Sapiens
GAVLDPSLA

SEQ ID NO: 1115482 - protein, 9 aa, Homo Sapiens
GNVYIKFRR

SEQ ID NO: 1115483 - protein, 9 aa, Homo Sapiens
LLISQLLMG

SEQ ID NO: 1115484 - protein, 9 aa, Homo Sapiens
MPNVSWTGN

SEQ ID NO: 1115485 - protein, 9 aa, Homo Sapiens
PEIGHILSN

SEQ ID NO: 1115486 - protein, 9 aa, Homo Sapiens
VTNNSNRYS

SEQ ID NO: 1115487 - protein, 9 aa, Homo Sapiens
WQRQASDLA

SEQ ID NO: 1115488 - protein, 9 aa, Homo Sapiens
FSYKLKMAC

SEQ ID NO: 1115489 - protein, 9 aa, Homo Sapiens
EDKKNGIWE

SEQ ID NO: 1115490 - protein, 9 aa, Homo Sapiens
LELEHYDAA

SEQ ID NO: 1115491 - protein, 9 aa, Homo Sapiens
PAVPIRAAT

SEQ ID NO: 1115492 - protein, 9 aa, Homo Sapiens
RQQRQEAWL

SEQ ID NO: 1115493 - protein, 9 aa, Homo Sapiens
LMFDFQMNS

SEQ ID NO: 1115494 - protein, 9 aa, Homo Sapiens
YLSLARSVK

SEQ ID NO: 1115495 - protein, 9 aa, Homo Sapiens
LPSLRTRRP

SEQ ID NO: 1115496 - protein, 9 aa, Homo Sapiens
TSNVNHKHG

SEQ ID NO: 1115497 - protein, 9 aa, Homo Sapiens
GLQMQESVF

SEQ ID NO: 1115498 - protein, 9 aa, Homo Sapiens
WANVIKNPQ

SEQ ID NO: 1115499 - protein, 9 aa, Homo Sapiens
ISKEHVLKL

SEQ ID NO: 1115500 - protein, 9 aa, Homo Sapiens
SAPRCPAKG

SEQ ID NO: 1115501 - protein, 9 aa, Homo Sapiens
QTFATIRMS

SEQ ID NO: 1115502 - protein, 9 aa, Homo Sapiens
SGSLFYVAS

SEQ ID NO: 1115503 - protein, 9 aa, Homo Sapiens
AAIFVYAAT

SEQ ID NO: 1115504 - protein, 9 aa, Homo Sapiens
LCVTVWVPW

SEQ ID NO: 1115505 - protein, 9 aa, Homo Sapiens
LERPYPEQF

SEQ ID NO: 1115506 - protein, 9 aa, Homo Sapiens
PPASTSSPQ

SEQ ID NO: 1115507 - protein, 9 aa, Homo Sapiens
NPSVVLSTK

SEQ ID NO: 1115508 - protein, 9 aa, Homo Sapiens
CPPRSRKPS

SEQ ID NO: 1115509 - protein, 9 aa, Homo Sapiens
TGVAFKAEG

SEQ ID NO: 1115510 - protein, 9 aa, Homo Sapiens
QGQMVPPLP

SEQ ID NO: 1115511 - protein, 9 aa, Homo Sapiens
RVFSILKKT

SEQ ID NO: 1115512 - protein, 9 aa, Homo Sapiens
RQEAWLSSA

SEQ ID NO: 1115513 - protein, 9 aa, Homo Sapiens
IVPTDGKRA

SEQ ID NO: 1115514 - protein, 9 aa, Homo Sapiens
ICQLVWTAP

SEQ ID NO: 1115515 - protein, 9 aa, Homo Sapiens
NFDNTFEMH

SEQ ID NO: 1115516 - protein, 9 aa, Homo Sapiens
HYVVVIEYS

SEQ ID NO: 1115517 - protein, 9 aa, Homo Sapiens
FARCQEMGA

SEQ ID NO: 1115518 - protein, 9 aa, Homo Sapiens
KVPIIRQVI

SEQ ID NO: 1115519 - protein, 9 aa, Homo Sapiens
AGRILFDII

SEQ ID NO: 1115520 - protein, 9 aa, Homo Sapiens
AALFPSEGV

SEQ ID NO: 1115521 - protein, 9 aa, Homo Sapiens
RTRACTPAS

SEQ ID NO: 1115522 - protein, 9 aa, Homo Sapiens
NMMVDGKPV

SEQ ID NO: 1115523 - protein, 9 aa, Homo Sapiens
SVLLFVTVR

SEQ ID NO: 1115524 - protein, 9 aa, Homo Sapiens
LPSLRRTVE

SEQ ID NO: 1115525 - protein, 9 aa, Homo Sapiens
RSGRNASAS

SEQ ID NO: 1115526 - protein, 9 aa, Homo Sapiens
KESEALNIR

SEQ ID NO: 1115527 - protein, 9 aa, Homo Sapiens
APSSVPRDR

SEQ ID NO: 1115528 - protein, 9 aa, Homo Sapiens
SCLTWASPL

SEQ ID NO: 1115529 - protein, 9 aa, Homo Sapiens
AGAQPHLSV

SEQ ID NO: 1115530 - protein, 9 aa, Homo Sapiens
QLHEEVVDS

SEQ ID NO: 1115531 - protein, 9 aa, Homo Sapiens
DPWTGAGRR

SEQ ID NO: 1115532 - protein, 9 aa, Homo Sapiens
YEGEADLRG

SEQ ID NO: 1115533 - protein, 9 aa, Homo Sapiens
LLEGPDYSV

SEQ ID NO: 1115534 - protein, 9 aa, Homo Sapiens
SSSLLPPRP

SEQ ID NO: 1115535 - protein, 9 aa, Homo Sapiens
VEALKLCQQ

SEQ ID NO: 1115536 - protein, 9 aa, Homo Sapiens
QLRLPRSRK

SEQ ID NO: 1115537 - protein, 9 aa, Homo Sapiens
VMEEVLKWG

SEQ ID NO: 1115538 - protein, 9 aa, Homo Sapiens
KVDLCADQP

SEQ ID NO: 1115539 - protein, 9 aa, Homo Sapiens
SPARSAAAA

SEQ ID NO: 1115540 - protein, 9 aa, Homo Sapiens
QSIRYPHNR

SEQ ID NO: 1115541 - protein, 9 aa, Homo Sapiens
DSNYLNLFI

SEQ ID NO: 1115542 - protein, 9 aa, Homo Sapiens
DYDHFSEDV

SEQ ID NO: 1115543 - protein, 9 aa, Homo Sapiens
SPSRPATPG

SEQ ID NO: 1115544 - protein, 9 aa, Homo Sapiens
ATIRMSSDA

SEQ ID NO: 1115545 - protein, 9 aa, Homo Sapiens
PGPSRREPS

SEQ ID NO: 1115546 - protein, 9 aa, Homo Sapiens
LDPESIFRD

SEQ ID NO: 1115547 - protein, 9 aa, Homo Sapiens
LGVRSQRKD

SEQ ID NO: 1115548 - protein, 9 aa, Homo Sapiens
ELERERVQF

SEQ ID NO: 1115549 - protein, 9 aa, Homo Sapiens
KVSKKRLPK

SEQ ID NO: 1115550 - protein, 9 aa, Homo Sapiens
CPKNVPKRV

SEQ ID NO: 1115551 - protein, 9 aa, Homo Sapiens
ASSRKRNKP

SEQ ID NO: 1115552 - protein, 9 aa, Homo Sapiens
EGGLRLRPP

SEQ ID NO: 1115553 - protein, 9 aa, Homo Sapiens
LHSAEQDTD

SEQ ID NO: 1115554 - protein, 9 aa, Homo Sapiens
QGAFYSLQP

SEQ ID NO: 1115555 - protein, 9 aa, Homo Sapiens
VQGQAAAGG

SEQ ID NO: 1115556 - protein, 9 aa, Homo Sapiens
AQDENATYT

SEQ ID NO: 1115557 - protein, 9 aa, Homo Sapiens
VFYVTSFPV

SEQ ID NO: 1115558 - protein, 9 aa, Homo Sapiens
PLGYGAAFS

SEQ ID NO: 1115559 - protein, 9 aa, Homo Sapiens
GLRSMVSPV

SEQ ID NO: 1115560 - protein, 9 aa, Homo Sapiens
AVKTKFKQH

SEQ ID NO: 1115561 - protein, 9 aa, Homo Sapiens
GPRCPGSAG

SEQ ID NO: 1115562 - protein, 9 aa, Homo Sapiens
EETKESMTC

SEQ ID NO: 1115563 - protein, 9 aa, Homo Sapiens
PGGPRHHPR

SEQ ID NO: 1115564 - protein, 9 aa, Homo Sapiens
LSISRPTSR

SEQ ID NO: 1115565 - protein, 9 aa, Homo Sapiens
KGDQLFNQK

SEQ ID NO: 1115566 - protein, 9 aa, Homo Sapiens
IKQCESCSP

SEQ ID NO: 1115567 - protein, 9 aa, Homo Sapiens
SIMLRLEDM

SEQ ID NO: 1115568 - protein, 9 aa, Homo Sapiens
VVDGNFLCV

SEQ ID NO: 1115569 - protein, 9 aa, Homo Sapiens
QEDKKIKTE

SEQ ID NO: 1115570 - protein, 9 aa, Homo Sapiens
DTVTLPAAP

SEQ ID NO: 1115571 - protein, 9 aa, Homo Sapiens
RGPAPASRA

SEQ ID NO: 1115572 - protein, 9 aa, Homo Sapiens
AARHLRSPS

SEQ ID NO: 1115573 - protein, 9 aa, Homo Sapiens
NYAWVPIRS

SEQ ID NO: 1115574 - protein, 9 aa, Homo Sapiens
DRIKEAVWA

SEQ ID NO: 1115575 - protein, 9 aa, Homo Sapiens
SRARGPAPA

SEQ ID NO: 1115576 - protein, 9 aa, Homo Sapiens
ASTQARSPS

SEQ ID NO: 1115577 - protein, 9 aa, Homo Sapiens
ECKQCGEAF

SEQ ID NO: 1115578 - protein, 9 aa, Homo Sapiens
FQKILDMRG

SEQ ID NO: 1115579 - protein, 9 aa, Homo Sapiens
FVASPGRRD

SEQ ID NO: 1115580 - protein, 9 aa, Homo Sapiens
KLPVHVYRT

SEQ ID NO: 1115581 - protein, 9 aa, Homo Sapiens
VWYPATVLA

SEQ ID NO: 1115582 - protein, 9 aa, Homo Sapiens
EGLKNEEMD

SEQ ID NO: 1115583 - protein, 9 aa, Homo Sapiens
PLWLPLPPT

SEQ ID NO: 1115584 - protein, 9 aa, Homo Sapiens
VFGKAVQDL

SEQ ID NO: 1115585 - protein, 9 aa, Homo Sapiens
LSKNCRLPE

SEQ ID NO: 1115586 - protein, 9 aa, Homo Sapiens
THTVSTAVN

SEQ ID NO: 1115587 - protein, 9 aa, Homo Sapiens
LMPKFLNST

SEQ ID NO: 1115588 - protein, 9 aa, Homo Sapiens
GRNSSMGLQ

SEQ ID NO: 1115589 - protein, 9 aa, Homo Sapiens
PDCGHPLLW

SEQ ID NO: 1115590 - protein, 9 aa, Homo Sapiens
GPQYSAQPL

SEQ ID NO: 1115591 - protein, 9 aa, Homo Sapiens
EHCVQRALE

SEQ ID NO: 1115592 - protein, 9 aa, Homo Sapiens
GTGGESIHG

SEQ ID NO: 1115593 - protein, 9 aa, Homo Sapiens
TSFGYVILE

SEQ ID NO: 1115594 - protein, 9 aa, Homo Sapiens
HDAMPRVPD

SEQ ID NO: 1115595 - protein, 9 aa, Homo Sapiens
NFRSPTPPY

SEQ ID NO: 1115596 - protein, 9 aa, Homo Sapiens
DVGGQRCRD

SEQ ID NO: 1115597 - protein, 9 aa, Homo Sapiens
QLLHILEAH

SEQ ID NO: 1115598 - protein, 9 aa, Homo Sapiens
DQACDTMDT

SEQ ID NO: 1115599 - protein, 9 aa, Homo Sapiens
KKQSQQFLG

SEQ ID NO: 1115600 - protein, 9 aa, Homo Sapiens
SVCYNDCFF

SEQ ID NO: 1115601 - protein, 9 aa, Homo Sapiens
PYLGSDDVV

SEQ ID NO: 1115602 - protein, 9 aa, Homo Sapiens
LCQCDKKRG

SEQ ID NO: 1115603 - protein, 9 aa, Homo Sapiens
PAVPHTARP

SEQ ID NO: 1115604 - protein, 9 aa, Homo Sapiens
FQEKHPFDF

SEQ ID NO: 1115605 - protein, 9 aa, Homo Sapiens
HLSPEEKLR

SEQ ID NO: 1115606 - protein, 9 aa, Homo Sapiens
VIRRERAGQ

SEQ ID NO: 1115607 - protein, 9 aa, Homo Sapiens
MRWPTGTQD

SEQ ID NO: 1115608 - protein, 9 aa, Homo Sapiens
LLAADQLLT

SEQ ID NO: 1115609 - protein, 9 aa, Homo Sapiens
GRPPTCAAC

SEQ ID NO: 1115610 - protein, 9 aa, Homo Sapiens
CLNDSNDDS

SEQ ID NO: 1115611 - protein, 9 aa, Homo Sapiens
ESLQVKIPV

SEQ ID NO: 1115612 - protein, 9 aa, Homo Sapiens
SHAGKGLMH

SEQ ID NO: 1115613 - protein, 9 aa, Homo Sapiens
AFSNLCKLE

SEQ ID NO: 1115614 - protein, 9 aa, Homo Sapiens
RERVQFRVA

SEQ ID NO: 1115615 - protein, 9 aa, Homo Sapiens
ASVLPPATG

SEQ ID NO: 1115616 - protein, 9 aa, Homo Sapiens
VGSGSPRRR

SEQ ID NO: 1115617 - protein, 9 aa, Homo Sapiens
SEPVQAVAS

SEQ ID NO: 1115618 - protein, 9 aa, Homo Sapiens
TPSHTMMLK

SEQ ID NO: 1115619 - protein, 9 aa, Homo Sapiens
EQMAAESQG

SEQ ID NO: 1115620 - protein, 9 aa, Homo Sapiens
EESGGVVDN

SEQ ID NO: 1115621 - protein, 9 aa, Homo Sapiens
GLLVVSHNG

SEQ ID NO: 1115622 - protein, 9 aa, Homo Sapiens
LPDVGGGDR

SEQ ID NO: 1115623 - protein, 9 aa, Homo Sapiens
TVLGNGALI

SEQ ID NO: 1115624 - protein, 9 aa, Homo Sapiens
FVPVLSTPR

SEQ ID NO: 1115625 - protein, 9 aa, Homo Sapiens
PGRGRKHSS

SEQ ID NO: 1115626 - protein, 9 aa, Homo Sapiens
GVDQKELSV

SEQ ID NO: 1115627 - protein, 9 aa, Homo Sapiens
GLKPPGRGR

SEQ ID NO: 1115628 - protein, 9 aa, Homo Sapiens
PTSHDNKDT

SEQ ID NO: 1115629 - protein, 9 aa, Homo Sapiens
VEMLVENEG

SEQ ID NO: 1115630 - protein, 9 aa, Homo Sapiens
DTWNFCDIG

SEQ ID NO: 1115631 - protein, 9 aa, Homo Sapiens
GPASVAPAT

SEQ ID NO: 1115632 - protein, 9 aa, Homo Sapiens
TELRQHEVT

SEQ ID NO: 1115633 - protein, 9 aa, Homo Sapiens
RLTRSVESW

SEQ ID NO: 1115634 - protein, 9 aa, Homo Sapiens
SLHDAMPRV

SEQ ID NO: 1115635 - protein, 9 aa, Homo Sapiens
REVDFDTFL

SEQ ID NO: 1115636 - protein, 9 aa, Homo Sapiens
ADLSEIPCC

SEQ ID NO: 1115637 - protein, 9 aa, Homo Sapiens
MRGGDAFPG

SEQ ID NO: 1115638 - protein, 9 aa, Homo Sapiens
PGCILPFLA

SEQ ID NO: 1115639 - protein, 9 aa, Homo Sapiens
QPVTRGRRT

SEQ ID NO: 1115640 - protein, 9 aa, Homo Sapiens
AATTAAAGG

SEQ ID NO: 1115641 - protein, 9 aa, Homo Sapiens
RTLGTTGGT

SEQ ID NO: 1115642 - protein, 9 aa, Homo Sapiens
FKFNIMVVG

SEQ ID NO: 1115643 - protein, 9 aa, Homo Sapiens
DQPGVQFPL

SEQ ID NO: 1115644 - protein, 9 aa, Homo Sapiens
LSLLGAKVG

SEQ ID NO: 1115645 - protein, 9 aa, Homo Sapiens
ENLFLRCPK

SEQ ID NO: 1115646 - protein, 9 aa, Homo Sapiens
EETMDSETV

SEQ ID NO: 1115647 - protein, 9 aa, Homo Sapiens
KNVFFLVST

SEQ ID NO: 1115648 - protein, 9 aa, Homo Sapiens
ATAQIQRPI

SEQ ID NO: 1115649 - protein, 9 aa, Homo Sapiens
YGITPEPRP

SEQ ID NO: 1115650 - protein, 9 aa, Homo Sapiens
EREHTLHRC

SEQ ID NO: 1115651 - protein, 9 aa, Homo Sapiens
GWCLGSAWS

SEQ ID NO: 1115652 - protein, 9 aa, Homo Sapiens
KKRQRESEC

SEQ ID NO: 1115653 - protein, 9 aa, Homo Sapiens
PVVILARTQ

SEQ ID NO: 1115654 - protein, 9 aa, Homo Sapiens
APSTVCPCQ

SEQ ID NO: 1115655 - protein, 9 aa, Homo Sapiens
TMKISLSTV

SEQ ID NO: 1115656 - protein, 9 aa, Homo Sapiens
NYCLHEQYP

SEQ ID NO: 1115657 - protein, 9 aa, Homo Sapiens
WKITFTVAQ

SEQ ID NO: 1115658 - protein, 9 aa, Homo Sapiens
TRLLPATSR

SEQ ID NO: 1115659 - protein, 9 aa, Homo Sapiens
QRLTLMAEV

SEQ ID NO: 1115660 - protein, 9 aa, Homo Sapiens
QERGGVATP

SEQ ID NO: 1115661 - protein, 9 aa, Homo Sapiens
GGSDRTPRG

SEQ ID NO: 1115662 - protein, 9 aa, Homo Sapiens
GRETGDPTE

SEQ ID NO: 1115663 - protein, 9 aa, Homo Sapiens
TICSGVTGA

SEQ ID NO: 1115664 - protein, 9 aa, Homo Sapiens
TEARKTGPF

SEQ ID NO: 1115665 - protein, 9 aa, Homo Sapiens
QDMWTTVID

SEQ ID NO: 1115666 - protein, 9 aa, Homo Sapiens
AAGVLEGGL

SEQ ID NO: 1115667 - protein, 9 aa, Homo Sapiens
LQRSQSDPI

SEQ ID NO: 1115668 - protein, 9 aa, Homo Sapiens
HPKNLLDSS

SEQ ID NO: 1115669 - protein, 9 aa, Homo Sapiens
SGGFFVAAI

SEQ ID NO: 1115670 - protein, 9 aa, Homo Sapiens
VELSRKVTE

SEQ ID NO: 1115671 - protein, 9 aa, Homo Sapiens
KILKLKYIK

SEQ ID NO: 1115672 - protein, 9 aa, Homo Sapiens
GAHRPSLAL

SEQ ID NO: 1115673 - protein, 9 aa, Homo Sapiens
VVDNNHCQM

SEQ ID NO: 1115674 - protein, 9 aa, Homo Sapiens
LTVPELTQM

SEQ ID NO: 1115675 - protein, 9 aa, Homo Sapiens
AIHQSLKAQ

SEQ ID NO: 1115676 - protein, 9 aa, Homo Sapiens
APSLSPGLP

SEQ ID NO: 1115677 - protein, 9 aa, Homo Sapiens
VLFLIDPLT

SEQ ID NO: 1115678 - protein, 9 aa, Homo Sapiens
SCSASVSFT

SEQ ID NO: 1115679 - protein, 9 aa, Homo Sapiens
DCYYNLGCL

SEQ ID NO: 1115680 - protein, 9 aa, Homo Sapiens
YHLYHGLRA

SEQ ID NO: 1115681 - protein, 9 aa, Homo Sapiens
GLHPNYLNP

SEQ ID NO: 1115682 - protein, 9 aa, Homo Sapiens
IHRVLRYVN

SEQ ID NO: 1115683 - protein, 9 aa, Homo Sapiens
PPSGDMMSS

SEQ ID NO: 1115684 - protein, 9 aa, Homo Sapiens
RSALISLVS

SEQ ID NO: 1115685 - protein, 9 aa, Homo Sapiens
SSATTPPTP

SEQ ID NO: 1115686 - protein, 9 aa, Homo Sapiens
SAHPSRPCR

SEQ ID NO: 1115687 - protein, 9 aa, Homo Sapiens
LDVGLNSLQ

SEQ ID NO: 1115688 - protein, 9 aa, Homo Sapiens
GNEKIYENE

SEQ ID NO: 1115689 - protein, 9 aa, Homo Sapiens
VLLTMSIDR

SEQ ID NO: 1115690 - protein, 9 aa, Homo Sapiens
PYKWLTVYK

SEQ ID NO: 1115691 - protein, 9 aa, Homo Sapiens
GGPVNETLK

SEQ ID NO: 1115692 - protein, 9 aa, Homo Sapiens
DGLLFRHIL

SEQ ID NO: 1115693 - protein, 9 aa, Homo Sapiens
CSQGPPVQP

SEQ ID NO: 1115694 - protein, 9 aa, Homo Sapiens
AVSPQPRAF

SEQ ID NO: 1115695 - protein, 9 aa, Homo Sapiens
VVKLEAIFG

SEQ ID NO: 1115696 - protein, 9 aa, Homo Sapiens
VDAAIRTVI

SEQ ID NO: 1115697 - protein, 9 aa, Homo Sapiens
TGQTRGRRC

SEQ ID NO: 1115698 - protein, 9 aa, Homo Sapiens
RIFLVLRGV

SEQ ID NO: 1115699 - protein, 9 aa, Homo Sapiens
DTGKFTNGQ

SEQ ID NO: 1115700 - protein, 9 aa, Homo Sapiens
PTQAKSPSP

SEQ ID NO: 1115701 - protein, 9 aa, Homo Sapiens
VHNIYVWDV

SEQ ID NO: 1115702 - protein, 9 aa, Homo Sapiens
SPDSSTPKR

SEQ ID NO: 1115703 - protein, 9 aa, Homo Sapiens
EMKWSRKAE

SEQ ID NO: 1115704 - protein, 9 aa, Homo Sapiens
QREPPEVHI

SEQ ID NO: 1115705 - protein, 9 aa, Homo Sapiens
GTGVCGWRD

SEQ ID NO: 1115706 - protein, 9 aa, Homo Sapiens
MKRIAFQLT

SEQ ID NO: 1115707 - protein, 9 aa, Homo Sapiens
DMKTGLSWS

SEQ ID NO: 1115708 - protein, 9 aa, Homo Sapiens
LLLPTDVIV

SEQ ID NO: 1115709 - protein, 9 aa, Homo Sapiens
WMASSWKGS

SEQ ID NO: 1115710 - protein, 9 aa, Homo Sapiens
CEELAESGL

SEQ ID NO: 1115711 - protein, 9 aa, Homo Sapiens
ERLVEWDVE

SEQ ID NO: 1115712 - protein, 9 aa, Homo Sapiens
LKGPSEYVA

SEQ ID NO: 1115713 - protein, 9 aa, Homo Sapiens
AVIVGHLMG

SEQ ID NO: 1115714 - protein, 9 aa, Homo Sapiens
SVTSGASGG

SEQ ID NO: 1115715 - protein, 9 aa, Homo Sapiens
SCGRPHAHP

SEQ ID NO: 1115716 - protein, 9 aa, Homo Sapiens
LITRNSYEC

SEQ ID NO: 1115717 - protein, 9 aa, Homo Sapiens
DEFRKKCDK

SEQ ID NO: 1115718 - protein, 9 aa, Homo Sapiens
SGTPSVWSP

SEQ ID NO: 1115719 - protein, 9 aa, Homo Sapiens
GPVAAEAVT

SEQ ID NO: 1115720 - protein, 9 aa, Homo Sapiens
LHLEVVEGV

SEQ ID NO: 1115721 - protein, 9 aa, Homo Sapiens
LYGSYPPAR

SEQ ID NO: 1115722 - protein, 9 aa, Homo Sapiens
AETCTDLLS

SEQ ID NO: 1115723 - protein, 9 aa, Homo Sapiens
PRNSGRSEV

SEQ ID NO: 1115724 - protein, 9 aa, Homo Sapiens
CCLPGLTHP

SEQ ID NO: 1115725 - protein, 9 aa, Homo Sapiens
DAAIRTVII

SEQ ID NO: 1115726 - protein, 9 aa, Homo Sapiens
DTVQIPCPS

SEQ ID NO: 1115727 - protein, 9 aa, Homo Sapiens
LPEDFIWVG

SEQ ID NO: 1115728 - protein, 9 aa, Homo Sapiens
LFLALLTSV

SEQ ID NO: 1115729 - protein, 9 aa, Homo Sapiens
GEESGGVVD

SEQ ID NO: 1115730 - protein, 9 aa, Homo Sapiens
LHPQSRGLD

SEQ ID NO: 1115731 - protein, 9 aa, Homo Sapiens
GCRCTACPP

SEQ ID NO: 1115732 - protein, 9 aa, Homo Sapiens
CGALRRWKE

SEQ ID NO: 1115733 - protein, 9 aa, Homo Sapiens
FDGTYYGDN

SEQ ID NO: 1115734 - protein, 9 aa, Homo Sapiens
PLIIQRLTI

SEQ ID NO: 1115735 - protein, 9 aa, Homo Sapiens
EGAYIPPQV

SEQ ID NO: 1115736 - protein, 9 aa, Homo Sapiens
GWVEEWYND

SEQ ID NO: 1115737 - protein, 9 aa, Homo Sapiens
GSDRVAKTG

SEQ ID NO: 1115738 - protein, 9 aa, Homo Sapiens
MSPTDALVW

SEQ ID NO: 1115739 - protein, 9 aa, Homo Sapiens
QSPLIFIFA

SEQ ID NO: 1115740 - protein, 9 aa, Homo Sapiens
THNDNSSRF

SEQ ID NO: 1115741 - protein, 9 aa, Homo Sapiens
IAKVIVIPN

SEQ ID NO: 1115742 - protein, 9 aa, Homo Sapiens
KRMCKQKRR

SEQ ID NO: 1115743 - protein, 9 aa, Homo Sapiens
KKHCFDPDP

SEQ ID NO: 1115744 - protein, 9 aa, Homo Sapiens
PFVASLFRH

SEQ ID NO: 1115745 - protein, 9 aa, Homo Sapiens
CNFSDLKEK

SEQ ID NO: 1115746 - protein, 9 aa, Homo Sapiens
TLDHWSSRY

SEQ ID NO: 1115747 - protein, 9 aa, Homo Sapiens
MLHLESWLQ

SEQ ID NO: 1115748 - protein, 9 aa, Homo Sapiens
EKERQLMCM

SEQ ID NO: 1115749 - protein, 9 aa, Homo Sapiens
NGDPVKKAI

SEQ ID NO: 1115750 - protein, 9 aa, Homo Sapiens
WPMSSPWPS

SEQ ID NO: 1115751 - protein, 9 aa, Homo Sapiens
AGTTFTLVT

SEQ ID NO: 1115752 - protein, 9 aa, Homo Sapiens
GGDPQYQYM

SEQ ID NO: 1115753 - protein, 9 aa, Homo Sapiens
GYKIHYRKA

SEQ ID NO: 1115754 - protein, 9 aa, Homo Sapiens
KKLKCGILW

SEQ ID NO: 1115755 - protein, 9 aa, Homo Sapiens
QIWWKKAMS

SEQ ID NO: 1115756 - protein, 9 aa, Homo Sapiens
RNYAWVPIR

SEQ ID NO: 1115757 - protein, 9 aa, Homo Sapiens
LSPGPPGSL

SEQ ID NO: 1115758 - protein, 9 aa, Homo Sapiens
MRKEAEARK

SEQ ID NO: 1115759 - protein, 9 aa, Homo Sapiens
LSSSPTSLC

SEQ ID NO: 1115760 - protein, 9 aa, Homo Sapiens
GCRGTTLPS

SEQ ID NO: 1115761 - protein, 9 aa, Homo Sapiens
SQIVALNFQ

SEQ ID NO: 1115762 - protein, 9 aa, Homo Sapiens
YKTRNRALQ

SEQ ID NO: 1115763 - protein, 9 aa, Homo Sapiens
LSWTPAPRY

SEQ ID NO: 1115764 - protein, 9 aa, Homo Sapiens
DFTHHNGTG

SEQ ID NO: 1115765 - protein, 9 aa, Homo Sapiens
HHIQESVLR

SEQ ID NO: 1115766 - protein, 9 aa, Homo Sapiens
ISCSGASAS

SEQ ID NO: 1115767 - protein, 9 aa, Homo Sapiens
PHFNADSGY

SEQ ID NO: 1115768 - protein, 9 aa, Homo Sapiens
NKKERRCNS

SEQ ID NO: 1115769 - protein, 9 aa, Homo Sapiens
DMHLELKDL

SEQ ID NO: 1115770 - protein, 9 aa, Homo Sapiens
IFISLPRSM

SEQ ID NO: 1115771 - protein, 9 aa, Homo Sapiens
AAVAASSVV

SEQ ID NO: 1115772 - protein, 9 aa, Homo Sapiens
METLVLNNN

SEQ ID NO: 1115773 - protein, 9 aa, Homo Sapiens
VAGRTTQSL

SEQ ID NO: 1115774 - protein, 9 aa, Homo Sapiens
RDTFHLLRE

SEQ ID NO: 1115775 - protein, 9 aa, Homo Sapiens
NPEIGHILS

SEQ ID NO: 1115776 - protein, 9 aa, Homo Sapiens
GASPHCEAI

SEQ ID NO: 1115777 - protein, 9 aa, Homo Sapiens
QCQCIFCIL

SEQ ID NO: 1115778 - protein, 9 aa, Homo Sapiens
QDTCREASV

SEQ ID NO: 1115779 - protein, 9 aa, Homo Sapiens
RRCNIIPVL

SEQ ID NO: 1115780 - protein, 9 aa, Homo Sapiens
PEIRALCNV

SEQ ID NO: 1115781 - protein, 9 aa, Homo Sapiens
EPSSGMLPP

SEQ ID NO: 1115782 - protein, 9 aa, Homo Sapiens
PVLWELCCR

SEQ ID NO: 1115783 - protein, 9 aa, Homo Sapiens
QQRPPWRTS

SEQ ID NO: 1115784 - protein, 9 aa, Homo Sapiens
PRLECICTV

SEQ ID NO: 1115785 - protein, 9 aa, Homo Sapiens
FVNVSQRKQ

SEQ ID NO: 1115786 - protein, 9 aa, Homo Sapiens
DGTDPFFLY

SEQ ID NO: 1115787 - protein, 9 aa, Homo Sapiens
QPPKARDLP

SEQ ID NO: 1115788 - protein, 9 aa, Homo Sapiens
QEVDAHRER

SEQ ID NO: 1115789 - protein, 9 aa, Homo Sapiens
CITECVRTA

SEQ ID NO: 1115790 - protein, 9 aa, Homo Sapiens
PVHESPTGI

SEQ ID NO: 1115791 - protein, 9 aa, Homo Sapiens
FLPTLLHRA

SEQ ID NO: 1115792 - protein, 9 aa, Homo Sapiens
PHHDLGPLP

SEQ ID NO: 1115793 - protein, 9 aa, Homo Sapiens
TQLQRQTTE

SEQ ID NO: 1115794 - protein, 9 aa, Homo Sapiens
CSSGSGEQG

SEQ ID NO: 1115795 - protein, 9 aa, Homo Sapiens
RPTSSHGGL

SEQ ID NO: 1115796 - protein, 9 aa, Homo Sapiens
AHCNLHLPC

SEQ ID NO: 1115797 - protein, 9 aa, Homo Sapiens
RFHDIWTEM

SEQ ID NO: 1115798 - protein, 9 aa, Homo Sapiens
HSKPCGFDS

SEQ ID NO: 1115799 - protein, 9 aa, Homo Sapiens
AIDTGCRHI

SEQ ID NO: 1115800 - protein, 9 aa, Homo Sapiens
LVHIWKLSR

SEQ ID NO: 1115801 - protein, 9 aa, Homo Sapiens
YLLVTYHIN

SEQ ID NO: 1115802 - protein, 9 aa, Homo Sapiens
PWKLPGPRR

SEQ ID NO: 1115803 - protein, 9 aa, Homo Sapiens
PSWRSECRL

SEQ ID NO: 1115804 - protein, 9 aa, Homo Sapiens
KRSLATVDS

SEQ ID NO: 1115805 - protein, 9 aa, Homo Sapiens
CPTQENFNS

SEQ ID NO: 1115806 - protein, 9 aa, Homo Sapiens
RRRGEAGGL

SEQ ID NO: 1115807 - protein, 9 aa, Homo Sapiens
RARRTNGAS

SEQ ID NO: 1115808 - protein, 9 aa, Homo Sapiens
CENNSPSNL

SEQ ID NO: 1115809 - protein, 9 aa, Homo Sapiens
TPKADIYPF

SEQ ID NO: 1115810 - protein, 9 aa, Homo Sapiens
QRATRHGPY

SEQ ID NO: 1115811 - protein, 9 aa, Homo Sapiens
KPASCRALP

SEQ ID NO: 1115812 - protein, 9 aa, Homo Sapiens
SAAPVRCSR

SEQ ID NO: 1115813 - protein, 9 aa, Homo Sapiens
PHLSVSAQN

SEQ ID NO: 1115814 - protein, 9 aa, Homo Sapiens
FLRPSKRPS

SEQ ID NO: 1115815 - protein, 9 aa, Homo Sapiens
PLPSERLAH

SEQ ID NO: 1115816 - protein, 9 aa, Homo Sapiens
QDPYDLMGA

SEQ ID NO: 1115817 - protein, 9 aa, Homo Sapiens
RGNYARLNM

SEQ ID NO: 1115818 - protein, 9 aa, Homo Sapiens
GLGKDLTQV

SEQ ID NO: 1115819 - protein, 9 aa, Homo Sapiens
ETSPHQAVC

SEQ ID NO: 1115820 - protein, 9 aa, Homo Sapiens
GRAPLHGVP

SEQ ID NO: 1115821 - protein, 9 aa, Homo Sapiens
KHQLRHPLH

SEQ ID NO: 1115822 - protein, 9 aa, Homo Sapiens
GPGHGAAGD

SEQ ID NO: 1115823 - protein, 9 aa, Homo Sapiens
ATVNMDGAT

SEQ ID NO: 1115824 - protein, 9 aa, Homo Sapiens
LERERVQFR

SEQ ID NO: 1115825 - protein, 9 aa, Homo Sapiens
VTATLWGKM

SEQ ID NO: 1115826 - protein, 9 aa, Homo Sapiens
LTSLSDCFI

SEQ ID NO: 1115827 - protein, 9 aa, Homo Sapiens
PSLSEEEKL

SEQ ID NO: 1115828 - protein, 9 aa, Homo Sapiens
DEAKKHSNP

SEQ ID NO: 1115829 - protein, 9 aa, Homo Sapiens
VLQGLFPPL

SEQ ID NO: 1115830 - protein, 9 aa, Homo Sapiens
HQPEMAAMR

SEQ ID NO: 1115831 - protein, 9 aa, Homo Sapiens
VLRLSCPYH

SEQ ID NO: 1115832 - protein, 9 aa, Homo Sapiens
TTILSGSLS

SEQ ID NO: 1115833 - protein, 9 aa, Homo Sapiens
LMTIIVLLL

SEQ ID NO: 1115834 - protein, 9 aa, Homo Sapiens
LLYVIRTCV

SEQ ID NO: 1115835 - protein, 9 aa, Homo Sapiens
TEIPPLSSS

SEQ ID NO: 1115836 - protein, 9 aa, Homo Sapiens
TCCHRTPWL

SEQ ID NO: 1115837 - protein, 9 aa, Homo Sapiens
DLWTDNCLL

SEQ ID NO: 1115838 - protein, 9 aa, Homo Sapiens
AESEEVPDV

SEQ ID NO: 1115839 - protein, 9 aa, Homo Sapiens
KKSRRRTKK

SEQ ID NO: 1115840 - protein, 9 aa, Homo Sapiens
PGQRDDLIV

SEQ ID NO: 1115841 - protein, 9 aa, Homo Sapiens
RSGSRSEIS

SEQ ID NO: 1115842 - protein, 9 aa, Homo Sapiens
CELRPHGGL

SEQ ID NO: 1115843 - protein, 9 aa, Homo Sapiens
GVLTSKPYA

SEQ ID NO: 1115844 - protein, 9 aa, Homo Sapiens
PPTGMTRAS

SEQ ID NO: 1115845 - protein, 9 aa, Homo Sapiens
ISAGCCLCP

SEQ ID NO: 1115846 - protein, 9 aa, Homo Sapiens
ICTVVQLRQ

SEQ ID NO: 1115847 - protein, 9 aa, Homo Sapiens
CVDDFGFSI

SEQ ID NO: 1115848 - protein, 9 aa, Homo Sapiens
LTGRPSYPG

SEQ ID NO: 1115849 - protein, 9 aa, Homo Sapiens
GAPRVNLGL

SEQ ID NO: 1115850 - protein, 9 aa, Homo Sapiens
ASPGPQRRV

SEQ ID NO: 1115851 - protein, 9 aa, Homo Sapiens
NVYIKFRRE

SEQ ID NO: 1115852 - protein, 9 aa, Homo Sapiens
MTTSTTAKK

SEQ ID NO: 1115853 - protein, 9 aa, Homo Sapiens
HHPRLRAAG

SEQ ID NO: 1115854 - protein, 9 aa, Homo Sapiens
NSIKKGEIP

SEQ ID NO: 1115855 - protein, 9 aa, Homo Sapiens
QARSPSSAA

SEQ ID NO: 1115856 - protein, 9 aa, Homo Sapiens
PKGQRIFLV

SEQ ID NO: 1115857 - protein, 9 aa, Homo Sapiens
VKSKSPSSA

SEQ ID NO: 1115858 - protein, 9 aa, Homo Sapiens
QGPLPHGAA

SEQ ID NO: 1115859 - protein, 9 aa, Homo Sapiens
NEENVNRVN

SEQ ID NO: 1115860 - protein, 9 aa, Homo Sapiens
SPHICQRGP

SEQ ID NO: 1115861 - protein, 9 aa, Homo Sapiens
QVMAQSLSQ

SEQ ID NO: 1115862 - protein, 9 aa, Homo Sapiens
LVEWDVEEV

SEQ ID NO: 1115863 - protein, 9 aa, Homo Sapiens
PHLRKFSSS

SEQ ID NO: 1115864 - protein, 9 aa, Homo Sapiens
RPRSAASLP

SEQ ID NO: 1115865 - protein, 9 aa, Homo Sapiens
EAIKAFFQK

SEQ ID NO: 1115866 - protein, 9 aa, Homo Sapiens
QALPPARGP

SEQ ID NO: 1115867 - protein, 9 aa, Homo Sapiens
CGRRDRGVS

SEQ ID NO: 1115868 - protein, 9 aa, Homo Sapiens
STCVDPYLF

SEQ ID NO: 1115869 - protein, 9 aa, Homo Sapiens
GNAPPNTMA

SEQ ID NO: 1115870 - protein, 9 aa, Homo Sapiens
LSPLHGDSG

SEQ ID NO: 1115871 - protein, 9 aa, Homo Sapiens
GGVVLHSPG

SEQ ID NO: 1115872 - protein, 9 aa, Homo Sapiens
VSWGSLLMA

SEQ ID NO: 1115873 - protein, 9 aa, Homo Sapiens
WPSFEAAPR

SEQ ID NO: 1115874 - protein, 9 aa, Homo Sapiens
LEVGSLTLH

SEQ ID NO: 1115875 - protein, 9 aa, Homo Sapiens
DTSHRMTHR

SEQ ID NO: 1115876 - protein, 9 aa, Homo Sapiens
CPHAFYQVH

SEQ ID NO: 1115877 - protein, 9 aa, Homo Sapiens
LGGLEASSD

SEQ ID NO: 1115878 - protein, 9 aa, Homo Sapiens
CREASVSPP

SEQ ID NO: 1115879 - protein, 9 aa, Homo Sapiens
CPVLGPQPH

SEQ ID NO: 1115880 - protein, 9 aa, Homo Sapiens
VLNRPPRFL

SEQ ID NO: 1115881 - protein, 9 aa, Homo Sapiens
PTSWAALPP

SEQ ID NO: 1115882 - protein, 9 aa, Homo Sapiens
FPCGPWGAG

SEQ ID NO: 1115883 - protein, 9 aa, Homo Sapiens
FPLKSTFHI

SEQ ID NO: 1115884 - protein, 9 aa, Homo Sapiens
KEFTRRRRP

SEQ ID NO: 1115885 - protein, 9 aa, Homo Sapiens
EKKLGSPAP

SEQ ID NO: 1115886 - protein, 9 aa, Homo Sapiens
KIHRESFFY

SEQ ID NO: 1115887 - protein, 9 aa, Homo Sapiens
TPNTTLISL

SEQ ID NO: 1115888 - protein, 9 aa, Homo Sapiens
GHWRRCGGP

SEQ ID NO: 1115889 - protein, 9 aa, Homo Sapiens
CSSSVRHRG

SEQ ID NO: 1115890 - protein, 9 aa, Homo Sapiens
ILHVLSDDH

SEQ ID NO: 1115891 - protein, 9 aa, Homo Sapiens
LMERKTATV

SEQ ID NO: 1115892 - protein, 9 aa, Homo Sapiens
LTKDGRSNM

SEQ ID NO: 1115893 - protein, 9 aa, Homo Sapiens
SAAYQLYYG

SEQ ID NO: 1115894 - protein, 9 aa, Homo Sapiens
RSQSDPILG

SEQ ID NO: 1115895 - protein, 9 aa, Homo Sapiens
TLDGTRCQP

SEQ ID NO: 1115896 - protein, 9 aa, Homo Sapiens
DRVGPLAVW

SEQ ID NO: 1115897 - protein, 9 aa, Homo Sapiens
CWMPYHLST

SEQ ID NO: 1115898 - protein, 9 aa, Homo Sapiens
MYEQLRDIT

SEQ ID NO: 1115899 - protein, 9 aa, Homo Sapiens
NKYLEKKTN

SEQ ID NO: 1115900 - protein, 9 aa, Homo Sapiens
LYTEGSTNG

SEQ ID NO: 1115901 - protein, 9 aa, Homo Sapiens
NLNRHIRGN

SEQ ID NO: 1115902 - protein, 9 aa, Homo Sapiens
LACSRNSLP

SEQ ID NO: 1115903 - protein, 9 aa, Homo Sapiens
PMHAAGLGM

SEQ ID NO: 1115904 - protein, 9 aa, Homo Sapiens
STGVVANLS

SEQ ID NO: 1115905 - protein, 9 aa, Homo Sapiens
LPDDRSLIV

SEQ ID NO: 1115906 - protein, 9 aa, Homo Sapiens
ARPPQLRRP

SEQ ID NO: 1115907 - protein, 9 aa, Homo Sapiens
EQSGGKTSL

SEQ ID NO: 1115908 - protein, 9 aa, Homo Sapiens
FTYDHSYPE

SEQ ID NO: 1115909 - protein, 9 aa, Homo Sapiens
MTTISRATW

SEQ ID NO: 1115910 - protein, 9 aa, Homo Sapiens
LARLKEHRQ

SEQ ID NO: 1115911 - protein, 9 aa, Homo Sapiens
FECPVCFDF

SEQ ID NO: 1115912 - protein, 9 aa, Homo Sapiens
PPPLRGPQT

SEQ ID NO: 1115913 - protein, 9 aa, Homo Sapiens
LYALQTFDY

SEQ ID NO: 1115914 - protein, 9 aa, Homo Sapiens
GSTTLHTVE

SEQ ID NO: 1115915 - protein, 9 aa, Homo Sapiens
NVRVTRNLR

SEQ ID NO: 1115916 - protein, 9 aa, Homo Sapiens
PLLSRPRSA

SEQ ID NO: 1115917 - protein, 9 aa, Homo Sapiens
RARGEELTG

SEQ ID NO: 1115918 - protein, 9 aa, Homo Sapiens
CVSKNTFFV

SEQ ID NO: 1115919 - protein, 9 aa, Homo Sapiens
KLGAVENAT

SEQ ID NO: 1115920 - protein, 9 aa, Homo Sapiens
LGNSKIVQA

SEQ ID NO: 1115921 - protein, 9 aa, Homo Sapiens
GNMGIRPFQ

SEQ ID NO: 1115922 - protein, 9 aa, Homo Sapiens
RKIAVPANR

SEQ ID NO: 1115923 - protein, 9 aa, Homo Sapiens
LPNSVLGHI

SEQ ID NO: 1115924 - protein, 9 aa, Homo Sapiens
PSTDDSLYY

SEQ ID NO: 1115925 - protein, 9 aa, Homo Sapiens
IGMYMLHLE

SEQ ID NO: 1115926 - protein, 9 aa, Homo Sapiens
RAALSPAVP

SEQ ID NO: 1115927 - protein, 9 aa, Homo Sapiens
TGDQAAKDN

SEQ ID NO: 1115928 - protein, 9 aa, Homo Sapiens
QDPVICSLV

SEQ ID NO: 1115929 - protein, 9 aa, Homo Sapiens
LSTNFLCLD

SEQ ID NO: 1115930 - protein, 9 aa, Homo Sapiens
TSGEPWDTE

SEQ ID NO: 1115931 - protein, 9 aa, Homo Sapiens
TTPTPGSAA

SEQ ID NO: 1115932 - protein, 9 aa, Homo Sapiens
IRLVYSNGK

SEQ ID NO: 1115933 - protein, 9 aa, Homo Sapiens
NKNLVLQSI

SEQ ID NO: 1115934 - protein, 9 aa, Homo Sapiens
ARAWMRLGA

SEQ ID NO: 1115935 - protein, 9 aa, Homo Sapiens
GNSGNSWNK

SEQ ID NO: 1115936 - protein, 9 aa, Homo Sapiens
IKRLNKVPV

SEQ ID NO: 1115937 - protein, 9 aa, Homo Sapiens
SQVTVHIVH

SEQ ID NO: 1115938 - protein, 9 aa, Homo Sapiens
PQCPSPWPQ

SEQ ID NO: 1115939 - protein, 9 aa, Homo Sapiens
AQCLLDKDL

SEQ ID NO: 1115940 - protein, 9 aa, Homo Sapiens
NNYRKTAEW

SEQ ID NO: 1115941 - protein, 9 aa, Homo Sapiens
KNLIWQVFL

SEQ ID NO: 1115942 - protein, 9 aa, Homo Sapiens
NEFLVYEFI

SEQ ID NO: 1115943 - protein, 9 aa, Homo Sapiens
YDQSMRDAS

SEQ ID NO: 1115944 - protein, 9 aa, Homo Sapiens
LILQQYQRL

SEQ ID NO: 1115945 - protein, 9 aa, Homo Sapiens
ELCCRTGSW

SEQ ID NO: 1115946 - protein, 9 aa, Homo Sapiens
PPALGRQQV

SEQ ID NO: 1115947 - protein, 9 aa, Homo Sapiens
ILPYWRRTA

SEQ ID NO: 1115948 - protein, 9 aa, Homo Sapiens
KNGRKFPCG

SEQ ID NO: 1115949 - protein, 9 aa, Homo Sapiens
RAMDALARR

SEQ ID NO: 1115950 - protein, 9 aa, Homo Sapiens
HGILPIWQV

SEQ ID NO: 1115951 - protein, 9 aa, Homo Sapiens
WDDRGEGLL

SEQ ID NO: 1115952 - protein, 9 aa, Homo Sapiens
QNLAARPPG

SEQ ID NO: 1115953 - protein, 9 aa, Homo Sapiens
QQRQQRQEA

SEQ ID NO: 1115954 - protein, 9 aa, Homo Sapiens
STLQINVCL

SEQ ID NO: 1115955 - protein, 9 aa, Homo Sapiens
ILRPTGTGP

SEQ ID NO: 1115956 - protein, 9 aa, Homo Sapiens
PSSPPPLCR

SEQ ID NO: 1115957 - protein, 9 aa, Homo Sapiens
TLFQTMSQA

SEQ ID NO: 1115958 - protein, 9 aa, Homo Sapiens
FPTSVQESS

SEQ ID NO: 1115959 - protein, 9 aa, Homo Sapiens
HSLVMCLRL

SEQ ID NO: 1115960 - protein, 9 aa, Homo Sapiens
QNPNMTVAQ

SEQ ID NO: 1115961 - protein, 9 aa, Homo Sapiens
IQWYICGFS

SEQ ID NO: 1115962 - protein, 9 aa, Homo Sapiens
SQCSNLIAH

SEQ ID NO: 1115963 - protein, 9 aa, Homo Sapiens
VSKKRLPKL

SEQ ID NO: 1115964 - protein, 9 aa, Homo Sapiens
CWGFWGWCL

SEQ ID NO: 1115965 - protein, 9 aa, Homo Sapiens
PTFDYLQSI

SEQ ID NO: 1115966 - protein, 9 aa, Homo Sapiens
SSSPADTTS

SEQ ID NO: 1115967 - protein, 9 aa, Homo Sapiens
HTKPDRDNH

SEQ ID NO: 1115968 - protein, 9 aa, Homo Sapiens
EKAMREQEE

SEQ ID NO: 1115969 - protein, 9 aa, Homo Sapiens
LCPSEAGVP

SEQ ID NO: 1115970 - protein, 9 aa, Homo Sapiens
ARHNETGSI

SEQ ID NO: 1115971 - protein, 9 aa, Homo Sapiens
MLRLEDMSP

SEQ ID NO: 1115972 - protein, 9 aa, Homo Sapiens
YWLQLLYSN

SEQ ID NO: 1115973 - protein, 9 aa, Homo Sapiens
CWCRLKTQR

SEQ ID NO: 1115974 - protein, 9 aa, Homo Sapiens
VLGCRKNKS

SEQ ID NO: 1115975 - protein, 9 aa, Homo Sapiens
VYQGPEEEG

SEQ ID NO: 1115976 - protein, 9 aa, Homo Sapiens
HYHYGWSFA

SEQ ID NO: 1115977 - protein, 9 aa, Homo Sapiens
SELMAQQYH

SEQ ID NO: 1115978 - protein, 9 aa, Homo Sapiens
LIHKSASSR

SEQ ID NO: 1115979 - protein, 9 aa, Homo Sapiens
DHFSEDVYT

SEQ ID NO: 1115980 - protein, 9 aa, Homo Sapiens
EPPCLHDES

SEQ ID NO: 1115981 - protein, 9 aa, Homo Sapiens
YTQPSDISS

SEQ ID NO: 1115982 - protein, 9 aa, Homo Sapiens
TIVAGSTVG

SEQ ID NO: 1115983 - protein, 9 aa, Homo Sapiens
PRTRESPPN

SEQ ID NO: 1115984 - protein, 9 aa, Homo Sapiens
RTRHQKGLG

SEQ ID NO: 1115985 - protein, 9 aa, Homo Sapiens
PPALGPISC

SEQ ID NO: 1115986 - protein, 9 aa, Homo Sapiens
GAGEDGKRL

SEQ ID NO: 1115987 - protein, 9 aa, Homo Sapiens
GHGAAGDTP

SEQ ID NO: 1115988 - protein, 9 aa, Homo Sapiens
PSAFAKSQP

SEQ ID NO: 1115989 - protein, 9 aa, Homo Sapiens
ICLLTAFAQ

SEQ ID NO: 1115990 - protein, 9 aa, Homo Sapiens
EQKMLKKEG

SEQ ID NO: 1115991 - protein, 9 aa, Homo Sapiens
LASTLESSS

SEQ ID NO: 1115992 - protein, 9 aa, Homo Sapiens
TDGNSEGEF

SEQ ID NO: 1115993 - protein, 9 aa, Homo Sapiens
MFSFVKYRD

SEQ ID NO: 1115994 - protein, 9 aa, Homo Sapiens
NGRKVRGGC

SEQ ID NO: 1115995 - protein, 9 aa, Homo Sapiens
YEFINRQKR

SEQ ID NO: 1115996 - protein, 9 aa, Homo Sapiens
PSLASSCTP

SEQ ID NO: 1115997 - protein, 9 aa, Homo Sapiens
ERGVSIHRQ

SEQ ID NO: 1115998 - protein, 9 aa, Homo Sapiens
HCLHPQSRG

SEQ ID NO: 1115999 - protein, 9 aa, Homo Sapiens
YSTCMSQTV

SEQ ID NO: 1116000 - protein, 9 aa, Homo Sapiens
AMLRKDKDG

SEQ ID NO: 1116001 - protein, 9 aa, Homo Sapiens
EGPSKLPGY

SEQ ID NO: 1116002 - protein, 9 aa, Homo Sapiens
LRKGGNLVN

SEQ ID NO: 1116003 - protein, 9 aa, Homo Sapiens
EIPSELQGI

SEQ ID NO: 1116004 - protein, 9 aa, Homo Sapiens
QSPPHPRTP

SEQ ID NO: 1116005 - protein, 9 aa, Homo Sapiens
TAHRGLSLL

SEQ ID NO: 1116006 - protein, 9 aa, Homo Sapiens
GSSTLSQVA

SEQ ID NO: 1116007 - protein, 9 aa, Homo Sapiens
KKPEQLTLP

SEQ ID NO: 1116008 - protein, 9 aa, Homo Sapiens
MLAGFLTGA

SEQ ID NO: 1116009 - protein, 9 aa, Homo Sapiens
DAYFVFENT

SEQ ID NO: 1116010 - protein, 9 aa, Homo Sapiens
PCVPSVIRI

SEQ ID NO: 1116011 - protein, 9 aa, Homo Sapiens
QSGGKTSLI

SEQ ID NO: 1116012 - protein, 9 aa, Homo Sapiens
DYIRHQRIH

SEQ ID NO: 1116013 - protein, 9 aa, Homo Sapiens
ANNTMGRDP

SEQ ID NO: 1116014 - protein, 9 aa, Homo Sapiens
MEPERHLSG

SEQ ID NO: 1116015 - protein, 9 aa, Homo Sapiens
ETLAHTASP

SEQ ID NO: 1116016 - protein, 9 aa, Homo Sapiens
LWPHQGPCQ

SEQ ID NO: 1116017 - protein, 9 aa, Homo Sapiens
MRVVRTVGQ

SEQ ID NO: 1116018 - protein, 9 aa, Homo Sapiens
AVRALEKHV

SEQ ID NO: 1116019 - protein, 9 aa, Homo Sapiens
ILFMIVLTF

SEQ ID NO: 1116020 - protein, 9 aa, Homo Sapiens
PSVTIHSFS

SEQ ID NO: 1116021 - protein, 9 aa, Homo Sapiens
DPECDFTEF

SEQ ID NO: 1116022 - protein, 9 aa, Homo Sapiens
VALLQAGPV

SEQ ID NO: 1116023 - protein, 9 aa, Homo Sapiens
HGEKFEDEN

SEQ ID NO: 1116024 - protein, 9 aa, Homo Sapiens
TCSQTRPLW

SEQ ID NO: 1116025 - protein, 9 aa, Homo Sapiens
ILVIITAVY

SEQ ID NO: 1116026 - protein, 9 aa, Homo Sapiens
PIRIYYYIS

SEQ ID NO: 1116027 - protein, 9 aa, Homo Sapiens
ATKSLGPLH

SEQ ID NO: 1116028 - protein, 9 aa, Homo Sapiens
FIYLPLMAV

SEQ ID NO: 1116029 - protein, 9 aa, Homo Sapiens
LQGCRCTAC

SEQ ID NO: 1116030 - protein, 9 aa, Homo Sapiens
RRRCLRLLT

SEQ ID NO: 1116031 - protein, 9 aa, Homo Sapiens
DGMDSNQNS

SEQ ID NO: 1116032 - protein, 9 aa, Homo Sapiens
LLGHLQDLL

SEQ ID NO: 1116033 - protein, 9 aa, Homo Sapiens
PQLQNAHTM

SEQ ID NO: 1116034 - protein, 9 aa, Homo Sapiens
RKRRRSSSL

SEQ ID NO: 1116035 - protein, 9 aa, Homo Sapiens
RKLGDPQSS

SEQ ID NO: 1116036 - protein, 9 aa, Homo Sapiens
KLLHVLTLM

SEQ ID NO: 1116037 - protein, 9 aa, Homo Sapiens
YKCHKCGKV

SEQ ID NO: 1116038 - protein, 9 aa, Homo Sapiens
RHQTDKSEV

SEQ ID NO: 1116039 - protein, 9 aa, Homo Sapiens
KVPVRSSMG

SEQ ID NO: 1116040 - protein, 9 aa, Homo Sapiens
TDDLTPQLE

SEQ ID NO: 1116041 - protein, 9 aa, Homo Sapiens
PCPQYIRKS

SEQ ID NO: 1116042 - protein, 9 aa, Homo Sapiens
HLAVAFLAQ

SEQ ID NO: 1116043 - protein, 9 aa, Homo Sapiens
STSSPQGSS

SEQ ID NO: 1116044 - protein, 9 aa, Homo Sapiens
CVDRVFHAI

SEQ ID NO: 1116045 - protein, 9 aa, Homo Sapiens
PVPSGMNSP

SEQ ID NO: 1116046 - protein, 9 aa, Homo Sapiens
TSFPEVVAS

SEQ ID NO: 1116047 - protein, 9 aa, Homo Sapiens
RLCWSVGRP

SEQ ID NO: 1116048 - protein, 9 aa, Homo Sapiens
TREAGIITT

SEQ ID NO: 1116049 - protein, 9 aa, Homo Sapiens
PLLAMAPRP

SEQ ID NO: 1116050 - protein, 9 aa, Homo Sapiens
EPYEKVVVR

SEQ ID NO: 1116051 - protein, 9 aa, Homo Sapiens
DCIFGVEEM

SEQ ID NO: 1116052 - protein, 9 aa, Homo Sapiens
RLKHNPPIF

SEQ ID NO: 1116053 - protein, 9 aa, Homo Sapiens
TTFTLVTRG

SEQ ID NO: 1116054 - protein, 9 aa, Homo Sapiens
LLDSSLDNT

SEQ ID NO: 1116055 - protein, 9 aa, Homo Sapiens
CSFCIDLWL

SEQ ID NO: 1116056 - protein, 9 aa, Homo Sapiens
MARYILKTD

SEQ ID NO: 1116057 - protein, 9 aa, Homo Sapiens
FGEVELSRK

SEQ ID NO: 1116058 - protein, 9 aa, Homo Sapiens
LSSMAVSPD

SEQ ID NO: 1116059 - protein, 9 aa, Homo Sapiens
NPDGIDPTE

SEQ ID NO: 1116060 - protein, 9 aa, Homo Sapiens
RERGPPSHC

SEQ ID NO: 1116061 - protein, 9 aa, Homo Sapiens
PDQPHPCPQ

SEQ ID NO: 1116062 - protein, 9 aa, Homo Sapiens
IHYRKASRK

SEQ ID NO: 1116063 - protein, 9 aa, Homo Sapiens
SRTRETLES

SEQ ID NO: 1116064 - protein, 9 aa, Homo Sapiens
PGMSEIYRK

SEQ ID NO: 1116065 - protein, 9 aa, Homo Sapiens
SERLAHQQG

SEQ ID NO: 1116066 - protein, 9 aa, Homo Sapiens
MTCQSRSSY

SEQ ID NO: 1116067 - protein, 9 aa, Homo Sapiens
HVGQGPLLL

SEQ ID NO: 1116068 - protein, 9 aa, Homo Sapiens
VPGSMPNVS

SEQ ID NO: 1116069 - protein, 9 aa, Homo Sapiens
TQMSAGNVF

SEQ ID NO: 1116070 - protein, 9 aa, Homo Sapiens
RLPCLLRFL

SEQ ID NO: 1116071 - protein, 9 aa, Homo Sapiens
NHPKNLLDS

SEQ ID NO: 1116072 - protein, 9 aa, Homo Sapiens
AGFVSQIRG

SEQ ID NO: 1116073 - protein, 9 aa, Homo Sapiens
VLSSQDKTH

SEQ ID NO: 1116074 - protein, 9 aa, Homo Sapiens
KWSSCLTWA

SEQ ID NO: 1116075 - protein, 9 aa, Homo Sapiens
GAMTIGETL

SEQ ID NO: 1116076 - protein, 9 aa, Homo Sapiens
RPLLPHKSG

SEQ ID NO: 1116077 - protein, 9 aa, Homo Sapiens
GTLGVGDKF

SEQ ID NO: 1116078 - protein, 9 aa, Homo Sapiens
LTSQRPISF

SEQ ID NO: 1116079 - protein, 9 aa, Homo Sapiens
AISFSGCIM

SEQ ID NO: 1116080 - protein, 9 aa, Homo Sapiens
LQMTTNRRW

SEQ ID NO: 1116081 - protein, 9 aa, Homo Sapiens
KRGELFLVK

SEQ ID NO: 1116082 - protein, 9 aa, Homo Sapiens
YLVCVARWL

SEQ ID NO: 1116083 - protein, 9 aa, Homo Sapiens
FSDPGVVDK

SEQ ID NO: 1116084 - protein, 9 aa, Homo Sapiens
RTSTTRAIV

SEQ ID NO: 1116085 - protein, 9 aa, Homo Sapiens
FPPAQNLAA

SEQ ID NO: 1116086 - protein, 9 aa, Homo Sapiens
PAASAPCWA

SEQ ID NO: 1116087 - protein, 9 aa, Homo Sapiens
PVGGEALVP

SEQ ID NO: 1116088 - protein, 9 aa, Homo Sapiens
KMLINLMVL

SEQ ID NO: 1116089 - protein, 9 aa, Homo Sapiens
SEVELLAFT

SEQ ID NO: 1116090 - protein, 9 aa, Homo Sapiens
ISGGDPTGW

SEQ ID NO: 1116091 - protein, 9 aa, Homo Sapiens
TDVPDQGLC

SEQ ID NO: 1116092 - protein, 9 aa, Homo Sapiens
LVSKGALVQ

SEQ ID NO: 1116093 - protein, 9 aa, Homo Sapiens
QGPEIQEVL

SEQ ID NO: 1116094 - protein, 9 aa, Homo Sapiens
RGRVNNITS

SEQ ID NO: 1116095 - protein, 9 aa, Homo Sapiens
KDVKKRAVA

SEQ ID NO: 1116096 - protein, 9 aa, Homo Sapiens
GGGHVQLLS

SEQ ID NO: 1116097 - protein, 9 aa, Homo Sapiens
TDTVRVLSS

SEQ ID NO: 1116098 - protein, 9 aa, Homo Sapiens
SKCITECVR

SEQ ID NO: 1116099 - protein, 9 aa, Homo Sapiens
RSPTASSCL

SEQ ID NO: 1116100 - protein, 9 aa, Homo Sapiens
EFLVYEFIN

SEQ ID NO: 1116101 - protein, 9 aa, Homo Sapiens
PFIDEPTSS

SEQ ID NO: 1116102 - protein, 9 aa, Homo Sapiens
KLLGNFLCL

SEQ ID NO: 1116103 - protein, 9 aa, Homo Sapiens
WARPARTRG

SEQ ID NO: 1116104 - protein, 9 aa, Homo Sapiens
FKRSPFLTQ

SEQ ID NO: 1116105 - protein, 9 aa, Homo Sapiens
LKILTTKNL

SEQ ID NO: 1116106 - protein, 9 aa, Homo Sapiens
MAEKFSDLL

SEQ ID NO: 1116107 - protein, 9 aa, Homo Sapiens
PRTRLLPAT

SEQ ID NO: 1116108 - protein, 9 aa, Homo Sapiens
GRHLRELSG

SEQ ID NO: 1116109 - protein, 9 aa, Homo Sapiens
DPSGPPGLP

SEQ ID NO: 1116110 - protein, 9 aa, Homo Sapiens
RVKDCVLMV

SEQ ID NO: 1116111 - protein, 9 aa, Homo Sapiens
GLRTHTGSN

SEQ ID NO: 1116112 - protein, 9 aa, Homo Sapiens
IFCYGVTVI

SEQ ID NO: 1116113 - protein, 9 aa, Homo Sapiens
ESLISVDGA

SEQ ID NO: 1116114 - protein, 9 aa, Homo Sapiens
WMRLGAPVL

SEQ ID NO: 1116115 - protein, 9 aa, Homo Sapiens
TSVAVHCSD

SEQ ID NO: 1116116 - protein, 9 aa, Homo Sapiens
QLSLELNTV

SEQ ID NO: 1116117 - protein, 9 aa, Homo Sapiens
VLKQGPLPH

SEQ ID NO: 1116118 - protein, 9 aa, Homo Sapiens
RVAVLGASR

SEQ ID NO: 1116119 - protein, 9 aa, Homo Sapiens
KLYEKRLVQ

SEQ ID NO: 1116120 - protein, 9 aa, Homo Sapiens
CCTLRSGTG

SEQ ID NO: 1116121 - protein, 9 aa, Homo Sapiens
HSTALANQA

SEQ ID NO: 1116122 - protein, 9 aa, Homo Sapiens
RRPRAGCPH

SEQ ID NO: 1116123 - protein, 9 aa, Homo Sapiens
KMLLSGIMG

SEQ ID NO: 1116124 - protein, 9 aa, Homo Sapiens
PLARKWHLL

SEQ ID NO: 1116125 - protein, 9 aa, Homo Sapiens
RGIPRSTCG

SEQ ID NO: 1116126 - protein, 9 aa, Homo Sapiens
DKSQEGFQF

SEQ ID NO: 1116127 - protein, 9 aa, Homo Sapiens
LVDVNVYLT

SEQ ID NO: 1116128 - protein, 9 aa, Homo Sapiens
CLDHILFPL

SEQ ID NO: 1116129 - protein, 9 aa, Homo Sapiens
GHLGALECA

SEQ ID NO: 1116130 - protein, 9 aa, Homo Sapiens
FASLVPTDS

SEQ ID NO: 1116131 - protein, 9 aa, Homo Sapiens
CEGTAGVCR

SEQ ID NO: 1116132 - protein, 9 aa, Homo Sapiens
MRWCPTSRS

SEQ ID NO: 1116133 - protein, 9 aa, Homo Sapiens
SQNDVKRLE

SEQ ID NO: 1116134 - protein, 9 aa, Homo Sapiens
AMAPRPRAG

SEQ ID NO: 1116135 - protein, 9 aa, Homo Sapiens
RDAFLHIDM

SEQ ID NO: 1116136 - protein, 9 aa, Homo Sapiens
VLLNAGEEV

SEQ ID NO: 1116137 - protein, 9 aa, Homo Sapiens
VVSSCQLRH

SEQ ID NO: 1116138 - protein, 9 aa, Homo Sapiens
ACPSSPIPR

SEQ ID NO: 1116139 - protein, 9 aa, Homo Sapiens
PDCYYNLGC

SEQ ID NO: 1116140 - protein, 9 aa, Homo Sapiens
GSTVAYCYY

SEQ ID NO: 1116141 - protein, 9 aa, Homo Sapiens
FAGCVYWLI

SEQ ID NO: 1116142 - protein, 9 aa, Homo Sapiens
QVQKQSPSW

SEQ ID NO: 1116143 - protein, 9 aa, Homo Sapiens
PPAAAGCSW

SEQ ID NO: 1116144 - protein, 9 aa, Homo Sapiens
IFACLVIIH

SEQ ID NO: 1116145 - protein, 9 aa, Homo Sapiens
LTKCVKKSK

SEQ ID NO: 1116146 - protein, 9 aa, Homo Sapiens
HCFDPDPPA

SEQ ID NO: 1116147 - protein, 9 aa, Homo Sapiens
TVLVYPTDA

SEQ ID NO: 1116148 - protein, 9 aa, Homo Sapiens
SEDLRALGI

SEQ ID NO: 1116149 - protein, 9 aa, Homo Sapiens
CFSVRNVFK

SEQ ID NO: 1116150 - protein, 9 aa, Homo Sapiens
DCKWSSCLT

SEQ ID NO: 1116151 - protein, 9 aa, Homo Sapiens
SKAVESPTA

SEQ ID NO: 1116152 - protein, 9 aa, Homo Sapiens
TVMSFDHYT

SEQ ID NO: 1116153 - protein, 9 aa, Homo Sapiens
EAVQWSNHR

SEQ ID NO: 1116154 - protein, 9 aa, Homo Sapiens
ATESPLTDK

SEQ ID NO: 1116155 - protein, 9 aa, Homo Sapiens
ACEACQNFF

SEQ ID NO: 1116156 - protein, 9 aa, Homo Sapiens
AEVDVISLK

SEQ ID NO: 1116157 - protein, 9 aa, Homo Sapiens
PRATTKTLP

SEQ ID NO: 1116158 - protein, 9 aa, Homo Sapiens
GQPWQQCPL

SEQ ID NO: 1116159 - protein, 9 aa, Homo Sapiens
PGAVELSRC

SEQ ID NO: 1116160 - protein, 9 aa, Homo Sapiens
FSINDHFYN

SEQ ID NO: 1116161 - protein, 9 aa, Homo Sapiens
PWTAAARHL

SEQ ID NO: 1116162 - protein, 9 aa, Homo Sapiens
IKKGVSWST

SEQ ID NO: 1116163 - protein, 9 aa, Homo Sapiens
FTRHSLKAR

SEQ ID NO: 1116164 - protein, 9 aa, Homo Sapiens
KDLTYFLPF

SEQ ID NO: 1116165 - protein, 9 aa, Homo Sapiens
AVALGAGGQ

SEQ ID NO: 1116166 - protein, 9 aa, Homo Sapiens
SNMEFVCMK

SEQ ID NO: 1116167 - protein, 9 aa, Homo Sapiens
VVDGMGHFG

SEQ ID NO: 1116168 - protein, 9 aa, Homo Sapiens
YPICKQPVH

SEQ ID NO: 1116169 - protein, 9 aa, Homo Sapiens
QAGRETGDP

SEQ ID NO: 1116170 - protein, 9 aa, Homo Sapiens
AESARHFHT

SEQ ID NO: 1116171 - protein, 9 aa, Homo Sapiens
QPQPTGEKG

SEQ ID NO: 1116172 - protein, 9 aa, Homo Sapiens
VVNRPRPPT

SEQ ID NO: 1116173 - protein, 9 aa, Homo Sapiens
LWARPSPGP

SEQ ID NO: 1116174 - protein, 9 aa, Homo Sapiens
SQCVSLSFS

SEQ ID NO: 1116175 - protein, 9 aa, Homo Sapiens
PDFLRGTPD

SEQ ID NO: 1116176 - protein, 9 aa, Homo Sapiens
MMEKLGAPR

SEQ ID NO: 1116177 - protein, 9 aa, Homo Sapiens
NRGVLRSLA

SEQ ID NO: 1116178 - protein, 9 aa, Homo Sapiens
TQLQKQKLM

SEQ ID NO: 1116179 - protein, 9 aa, Homo Sapiens
GFPEPPCLH

SEQ ID NO: 1116180 - protein, 9 aa, Homo Sapiens
NNPVPLRPK

SEQ ID NO: 1116181 - protein, 9 aa, Homo Sapiens
LWTPVLLQG

SEQ ID NO: 1116182 - protein, 9 aa, Homo Sapiens
EKRLVQLLV

SEQ ID NO: 1116183 - protein, 9 aa, Homo Sapiens
TCPGPSWHP

SEQ ID NO: 1116184 - protein, 9 aa, Homo Sapiens
SDILIPTCC

SEQ ID NO: 1116185 - protein, 9 aa, Homo Sapiens
KRGASSSTS

SEQ ID NO: 1116186 - protein, 9 aa, Homo Sapiens
SPGDQRAGK

SEQ ID NO: 1116187 - protein, 9 aa, Homo Sapiens
NTTLISLPV

SEQ ID NO: 1116188 - protein, 9 aa, Homo Sapiens
LQPTNRRSK

SEQ ID NO: 1116189 - protein, 9 aa, Homo Sapiens
QEKLQVTLG

SEQ ID NO: 1116190 - protein, 9 aa, Homo Sapiens
WAQGGPRPP

SEQ ID NO: 1116191 - protein, 9 aa, Homo Sapiens
SNLCKLERL

SEQ ID NO: 1116192 - protein, 9 aa, Homo Sapiens
GYAKIYKPL

SEQ ID NO: 1116193 - protein, 9 aa, Homo Sapiens
DAINTSCDI

SEQ ID NO: 1116194 - protein, 9 aa, Homo Sapiens
SAGTVAASL

SEQ ID NO: 1116195 - protein, 9 aa, Homo Sapiens
VYSNGKDDE

SEQ ID NO: 1116196 - protein, 9 aa, Homo Sapiens
FYTPWCPHC

SEQ ID NO: 1116197 - protein, 9 aa, Homo Sapiens
FRRIAWIKK

SEQ ID NO: 1116198 - protein, 9 aa, Homo Sapiens
WGKSHSIPK

SEQ ID NO: 1116199 - protein, 9 aa, Homo Sapiens
FDNMVKVQD

SEQ ID NO: 1116200 - protein, 9 aa, Homo Sapiens
SSEADQVGL

SEQ ID NO: 1116201 - protein, 9 aa, Homo Sapiens
QQVFERLVE

SEQ ID NO: 1116202 - protein, 9 aa, Homo Sapiens
DREGWESQD

SEQ ID NO: 1116203 - protein, 9 aa, Homo Sapiens
EERGHRDVT

SEQ ID NO: 1116204 - protein, 9 aa, Homo Sapiens
ELRDAINTS

SEQ ID NO: 1116205 - protein, 9 aa, Homo Sapiens
EMLTHSIML

SEQ ID NO: 1116206 - protein, 9 aa, Homo Sapiens
VGHYVVVIE

SEQ ID NO: 1116207 - protein, 9 aa, Homo Sapiens
ICPVGVLTS

SEQ ID NO: 1116208 - protein, 9 aa, Homo Sapiens
CFPQAFFCM

SEQ ID NO: 1116209 - protein, 9 aa, Homo Sapiens
CGLRGQSGT

SEQ ID NO: 1116210 - protein, 9 aa, Homo Sapiens
RLHCSMFFS

SEQ ID NO: 1116211 - protein, 9 aa, Homo Sapiens
KFSILPSSR

SEQ ID NO: 1116212 - protein, 9 aa, Homo Sapiens
EQYFHYHYG

SEQ ID NO: 1116213 - protein, 9 aa, Homo Sapiens
FTTKSLLGT

SEQ ID NO: 1116214 - protein, 9 aa, Homo Sapiens
QAPRTTAFC

SEQ ID NO: 1116215 - protein, 9 aa, Homo Sapiens
GPRRAWRAL

SEQ ID NO: 1116216 - protein, 9 aa, Homo Sapiens
TDYCSGSST

SEQ ID NO: 1116217 - protein, 9 aa, Homo Sapiens
ITSRDATRF

SEQ ID NO: 1116218 - protein, 9 aa, Homo Sapiens
WCPQSASRE

SEQ ID NO: 1116219 - protein, 9 aa, Homo Sapiens
HSCQQPIGT

SEQ ID NO: 1116220 - protein, 9 aa, Homo Sapiens
VGFSVKEDL

SEQ ID NO: 1116221 - protein, 9 aa, Homo Sapiens
ESFETIFGP

SEQ ID NO: 1116222 - protein, 9 aa, Homo Sapiens
KPFRLHCSM

SEQ ID NO: 1116223 - protein, 9 aa, Homo Sapiens
QWPRVNGCQ

SEQ ID NO: 1116224 - protein, 9 aa, Homo Sapiens
VACLAAISD

SEQ ID NO: 1116225 - protein, 9 aa, Homo Sapiens
LSNPEIMRQ

SEQ ID NO: 1116226 - protein, 9 aa, Homo Sapiens
SLEMPSSHF

SEQ ID NO: 1116227 - protein, 9 aa, Homo Sapiens
LGYQLCSHH

SEQ ID NO: 1116228 - protein, 9 aa, Homo Sapiens
APGSTRIPF

SEQ ID NO: 1116229 - protein, 9 aa, Homo Sapiens
EVSIFQDFS

SEQ ID NO: 1116230 - protein, 9 aa, Homo Sapiens
SAPWSERVP

SEQ ID NO: 1116231 - protein, 9 aa, Homo Sapiens
RGPQTHCER

SEQ ID NO: 1116232 - protein, 9 aa, Homo Sapiens
TTAKKPAVT

SEQ ID NO: 1116233 - protein, 9 aa, Homo Sapiens
YSQIKDVKK

SEQ ID NO: 1116234 - protein, 9 aa, Homo Sapiens
ERMEQFTVR

SEQ ID NO: 1116235 - protein, 9 aa, Homo Sapiens
SDTFSQGIQ

SEQ ID NO: 1116236 - protein, 9 aa, Homo Sapiens
IEGPAFSLR

SEQ ID NO: 1116237 - protein, 9 aa, Homo Sapiens
HLHLHAPQL

SEQ ID NO: 1116238 - protein, 9 aa, Homo Sapiens
SRAAVSTPP

SEQ ID NO: 1116239 - protein, 9 aa, Homo Sapiens
AGIMGQFDH

SEQ ID NO: 1116240 - protein, 9 aa, Homo Sapiens
YRKHLNSHL

SEQ ID NO: 1116241 - protein, 9 aa, Homo Sapiens
AVISTVEWG

SEQ ID NO: 1116242 - protein, 9 aa, Homo Sapiens
ADGLDLLQL

SEQ ID NO: 1116243 - protein, 9 aa, Homo Sapiens
KYLEKKTNQ

SEQ ID NO: 1116244 - protein, 9 aa, Homo Sapiens
KMKNACHFP

SEQ ID NO: 1116245 - protein, 9 aa, Homo Sapiens
HEPQPRPRP

SEQ ID NO: 1116246 - protein, 9 aa, Homo Sapiens
VKLRRFNAG

SEQ ID NO: 1116247 - protein, 9 aa, Homo Sapiens
GLHGSLLLK

SEQ ID NO: 1116248 - protein, 9 aa, Homo Sapiens
RERAARRVL

SEQ ID NO: 1116249 - protein, 9 aa, Homo Sapiens
ELVQCFLCC

SEQ ID NO: 1116250 - protein, 9 aa, Homo Sapiens
TTKSLLGTW

SEQ ID NO: 1116251 - protein, 9 aa, Homo Sapiens
HPVKFLWKL

SEQ ID NO: 1116252 - protein, 9 aa, Homo Sapiens
MFIGDCAKL

SEQ ID NO: 1116253 - protein, 9 aa, Homo Sapiens
RTPRASRAP

SEQ ID NO: 1116254 - protein, 9 aa, Homo Sapiens
QTLEKHGLS

SEQ ID NO: 1116255 - protein, 9 aa, Homo Sapiens
SCFKLDLSL

SEQ ID NO: 1116256 - protein, 9 aa, Homo Sapiens
RPNVCHLST

SEQ ID NO: 1116257 - protein, 9 aa, Homo Sapiens
DVGYGRSVS

SEQ ID NO: 1116258 - protein, 9 aa, Homo Sapiens
SKLQATNAH

SEQ ID NO: 1116259 - protein, 9 aa, Homo Sapiens
SYHAPIKDK

SEQ ID NO: 1116260 - protein, 9 aa, Homo Sapiens
SVKSRDKKM

SEQ ID NO: 1116261 - protein, 9 aa, Homo Sapiens
PVHVYRTSF

SEQ ID NO: 1116262 - protein, 9 aa, Homo Sapiens
SGCSRSLAK

SEQ ID NO: 1116263 - protein, 9 aa, Homo Sapiens
ETGSDPQHN

SEQ ID NO: 1116264 - protein, 9 aa, Homo Sapiens
RMSKNTAAL

SEQ ID NO: 1116265 - protein, 9 aa, Homo Sapiens
HPVSQMQHA

SEQ ID NO: 1116266 - protein, 9 aa, Homo Sapiens
NMHGNETVG

SEQ ID NO: 1116267 - protein, 9 aa, Homo Sapiens
KVTELRQAP

SEQ ID NO: 1116268 - protein, 9 aa, Homo Sapiens
SLRILTSQR

SEQ ID NO: 1116269 - protein, 9 aa, Homo Sapiens
FTGTCCHEN

SEQ ID NO: 1116270 - protein, 9 aa, Homo Sapiens
GRVCTLSTA

SEQ ID NO: 1116271 - protein, 9 aa, Homo Sapiens
AALPPSLWA

SEQ ID NO: 1116272 - protein, 9 aa, Homo Sapiens
HRVTIMCDK

SEQ ID NO: 1116273 - protein, 9 aa, Homo Sapiens
LDRDQGRAP

SEQ ID NO: 1116274 - protein, 9 aa, Homo Sapiens
AETGSSTDS

SEQ ID NO: 1116275 - protein, 9 aa, Homo Sapiens
AVVITDGCH

SEQ ID NO: 1116276 - protein, 9 aa, Homo Sapiens
RTSARRRTW

SEQ ID NO: 1116277 - protein, 9 aa, Homo Sapiens
PRWRTFTTT

SEQ ID NO: 1116278 - protein, 9 aa, Homo Sapiens
APHSFFPYE

SEQ ID NO: 1116279 - protein, 9 aa, Homo Sapiens
SKELQQRRR

SEQ ID NO: 1116280 - protein, 9 aa, Homo Sapiens
QERGDHDLN

SEQ ID NO: 1116281 - protein, 9 aa, Homo Sapiens
THMCLAKNP

SEQ ID NO: 1116282 - protein, 9 aa, Homo Sapiens
APKTVDTIK

SEQ ID NO: 1116283 - protein, 9 aa, Homo Sapiens
RPWRRTGRG

SEQ ID NO: 1116284 - protein, 9 aa, Homo Sapiens
RIAFQLTPY

SEQ ID NO: 1116285 - protein, 9 aa, Homo Sapiens
RNHYRKYLC

SEQ ID NO: 1116286 - protein, 9 aa, Homo Sapiens
ASSSPHICQ

SEQ ID NO: 1116287 - protein, 9 aa, Homo Sapiens
SYALSNKNL

SEQ ID NO: 1116288 - protein, 9 aa, Homo Sapiens
SLCGTKSQS

SEQ ID NO: 1116289 - protein, 9 aa, Homo Sapiens
ATRAGLGES

SEQ ID NO: 1116290 - protein, 9 aa, Homo Sapiens
KDGLGMIVQ

SEQ ID NO: 1116291 - protein, 9 aa, Homo Sapiens
ATPALPTQQ

SEQ ID NO: 1116292 - protein, 9 aa, Homo Sapiens
VIHNVCEQK

SEQ ID NO: 1116293 - protein, 9 aa, Homo Sapiens
TRSELKQMF

SEQ ID NO: 1116294 - protein, 9 aa, Homo Sapiens
PSVGIDAHT

SEQ ID NO: 1116295 - protein, 9 aa, Homo Sapiens
NPSKPGHKT

SEQ ID NO: 1116296 - protein, 9 aa, Homo Sapiens
YQAAPLLLR

SEQ ID NO: 1116297 - protein, 9 aa, Homo Sapiens
LPLLRQPLI

SEQ ID NO: 1116298 - protein, 9 aa, Homo Sapiens
TLLVLQGAL

SEQ ID NO: 1116299 - protein, 9 aa, Homo Sapiens
ELRFHELEA

SEQ ID NO: 1116300 - protein, 9 aa, Homo Sapiens
KNPPLRFNL

SEQ ID NO: 1116301 - protein, 9 aa, Homo Sapiens
AWLSQDSST

SEQ ID NO: 1116302 - protein, 9 aa, Homo Sapiens
RTPTRRKRR

SEQ ID NO: 1116303 - protein, 9 aa, Homo Sapiens
QGHHSLRVP

SEQ ID NO: 1116304 - protein, 9 aa, Homo Sapiens
FICVVMAIF

SEQ ID NO: 1116305 - protein, 9 aa, Homo Sapiens
PTLPPGNSF

SEQ ID NO: 1116306 - protein, 9 aa, Homo Sapiens
KGNFQRTTC

SEQ ID NO: 1116307 - protein, 9 aa, Homo Sapiens
KIIQNKKLV

SEQ ID NO: 1116308 - protein, 9 aa, Homo Sapiens
RAWMRLGAP

SEQ ID NO: 1116309 - protein, 9 aa, Homo Sapiens
PVGSVMSCS

SEQ ID NO: 1116310 - protein, 9 aa, Homo Sapiens
ICEEFKEKC

SEQ ID NO: 1116311 - protein, 9 aa, Homo Sapiens
PFPSTSTLC

SEQ ID NO: 1116312 - protein, 9 aa, Homo Sapiens
TLQCNPRLD

SEQ ID NO: 1116313 - protein, 9 aa, Homo Sapiens
MVNLDGSYW

SEQ ID NO: 1116314 - protein, 9 aa, Homo Sapiens
DDDKKGCCR

SEQ ID NO: 1116315 - protein, 9 aa, Homo Sapiens
SVLLTMSID

SEQ ID NO: 1116316 - protein, 9 aa, Homo Sapiens
QEVILSSEV

SEQ ID NO: 1116317 - protein, 9 aa, Homo Sapiens
QNFRSPTPP

SEQ ID NO: 1116318 - protein, 9 aa, Homo Sapiens
LAGWLTQMY

SEQ ID NO: 1116319 - protein, 9 aa, Homo Sapiens
SPKAGIGGA

SEQ ID NO: 1116320 - protein, 9 aa, Homo Sapiens
LGAPRSQGA

SEQ ID NO: 1116321 - protein, 9 aa, Homo Sapiens
QTDRERERV

SEQ ID NO: 1116322 - protein, 9 aa, Homo Sapiens
FLSMIMYSL

SEQ ID NO: 1116323 - protein, 9 aa, Homo Sapiens
LQPAPGSTR

SEQ ID NO: 1116324 - protein, 9 aa, Homo Sapiens
ENATYTQLY

SEQ ID NO: 1116325 - protein, 9 aa, Homo Sapiens
SCEVLEILL

SEQ ID NO: 1116326 - protein, 9 aa, Homo Sapiens
LENKMKNAC

SEQ ID NO: 1116327 - protein, 9 aa, Homo Sapiens
YTVCDLAPR

SEQ ID NO: 1116328 - protein, 9 aa, Homo Sapiens
SLEKRVKMV

SEQ ID NO: 1116329 - protein, 9 aa, Homo Sapiens
TTHFDEVFW

SEQ ID NO: 1116330 - protein, 9 aa, Homo Sapiens
GRGRKHSSP

SEQ ID NO: 1116331 - protein, 9 aa, Homo Sapiens
ALPLPSRRA

SEQ ID NO: 1116332 - protein, 9 aa, Homo Sapiens
TDYHAIVSS

SEQ ID NO: 1116333 - protein, 9 aa, Homo Sapiens
YRRLVEGLQ

SEQ ID NO: 1116334 - protein, 9 aa, Homo Sapiens
PTLMMSNGC

SEQ ID NO: 1116335 - protein, 9 aa, Homo Sapiens
NMLQKAHLV

SEQ ID NO: 1116336 - protein, 9 aa, Homo Sapiens
AGLLSAAYQ

SEQ ID NO: 1116337 - protein, 9 aa, Homo Sapiens
DGTDGEGEG

SEQ ID NO: 1116338 - protein, 9 aa, Homo Sapiens
GSGSGLRAS

SEQ ID NO: 1116339 - protein, 9 aa, Homo Sapiens
KVKARAFRC

SEQ ID NO: 1116340 - protein, 9 aa, Homo Sapiens
PLTATWAPR

SEQ ID NO: 1116341 - protein, 9 aa, Homo Sapiens
LVKWKGWPQ

SEQ ID NO: 1116342 - protein, 9 aa, Homo Sapiens
YSSDSTNGT

SEQ ID NO: 1116343 - protein, 9 aa, Homo Sapiens
SPLWLPLPP

SEQ ID NO: 1116344 - protein, 9 aa, Homo Sapiens
TQKDLTTKI

SEQ ID NO: 1116345 - protein, 9 aa, Homo Sapiens
HVGMALHTP

SEQ ID NO: 1116346 - protein, 9 aa, Homo Sapiens
VYGPLWSIP

SEQ ID NO: 1116347 - protein, 9 aa, Homo Sapiens
LLFEHMQRA

SEQ ID NO: 1116348 - protein, 9 aa, Homo Sapiens
VAPDAFGIV

SEQ ID NO: 1116349 - protein, 9 aa, Homo Sapiens
PEVSIFQDF

SEQ ID NO: 1116350 - protein, 9 aa, Homo Sapiens
RSKDESTDK

SEQ ID NO: 1116351 - protein, 9 aa, Homo Sapiens
VGDGMSQVT

SEQ ID NO: 1116352 - protein, 9 aa, Homo Sapiens
IGWVATFEE

SEQ ID NO: 1116353 - protein, 9 aa, Homo Sapiens
FLAQESLQL

SEQ ID NO: 1116354 - protein, 9 aa, Homo Sapiens
GEGGPAEGR

SEQ ID NO: 1116355 - protein, 9 aa, Homo Sapiens
HPYCDVLIG

SEQ ID NO: 1116356 - protein, 9 aa, Homo Sapiens
TQFNKGPRT

SEQ ID NO: 1116357 - protein, 9 aa, Homo Sapiens
RLRELLRAK

SEQ ID NO: 1116358 - protein, 9 aa, Homo Sapiens
SRGRDADAS

SEQ ID NO: 1116359 - protein, 9 aa, Homo Sapiens
SAASLPQLS

SEQ ID NO: 1116360 - protein, 9 aa, Homo Sapiens
TTAIDTENI

SEQ ID NO: 1116361 - protein, 9 aa, Homo Sapiens
RRSGRRRCG

SEQ ID NO: 1116362 - protein, 9 aa, Homo Sapiens
HNMEALLIS

SEQ ID NO: 1116363 - protein, 9 aa, Homo Sapiens
FTSAHPSRP

SEQ ID NO: 1116364 - protein, 9 aa, Homo Sapiens
TSLDDVLHR

SEQ ID NO: 1116365 - protein, 9 aa, Homo Sapiens
QGALFGRGA

SEQ ID NO: 1116366 - protein, 9 aa, Homo Sapiens
SVVHMMTQS

SEQ ID NO: 1116367 - protein, 9 aa, Homo Sapiens
IDAVKPGVQ

SEQ ID NO: 1116368 - protein, 9 aa, Homo Sapiens
DDRSLIVGG

SEQ ID NO: 1116369 - protein, 9 aa, Homo Sapiens
GEITDDLDV

SEQ ID NO: 1116370 - protein, 9 aa, Homo Sapiens
APLPVAVSR

SEQ ID NO: 1116371 - protein, 9 aa, Homo Sapiens
GGRVKMWKR

SEQ ID NO: 1116372 - protein, 9 aa, Homo Sapiens
EQLRDITID

SEQ ID NO: 1116373 - protein, 9 aa, Homo Sapiens
SYGATEQGT

SEQ ID NO: 1116374 - protein, 9 aa, Homo Sapiens
TESHKAKGK

SEQ ID NO: 1116375 - protein, 9 aa, Homo Sapiens
PANHTKLKG

SEQ ID NO: 1116376 - protein, 9 aa, Homo Sapiens
AKYRPRAAC

SEQ ID NO: 1116377 - protein, 9 aa, Homo Sapiens
TEYIEKFAN

SEQ ID NO: 1116378 - protein, 9 aa, Homo Sapiens
GLDLLQLPE

SEQ ID NO: 1116379 - protein, 9 aa, Homo Sapiens
GVVANLSPA

SEQ ID NO: 1116380 - protein, 9 aa, Homo Sapiens
LHKNSQQLW

SEQ ID NO: 1116381 - protein, 9 aa, Homo Sapiens
GERSSTKGC

SEQ ID NO: 1116382 - protein, 9 aa, Homo Sapiens
GAGISTAVS

SEQ ID NO: 1116383 - protein, 9 aa, Homo Sapiens
SLYIEEIHS

SEQ ID NO: 1116384 - protein, 9 aa, Homo Sapiens
LWWYPAVRV

SEQ ID NO: 1116385 - protein, 9 aa, Homo Sapiens
RVGPLAVWI

SEQ ID NO: 1116386 - protein, 9 aa, Homo Sapiens
GATGPMGMC

SEQ ID NO: 1116387 - protein, 9 aa, Homo Sapiens
IPKKSYALS

SEQ ID NO: 1116388 - protein, 9 aa, Homo Sapiens
TVVWGSAMP

SEQ ID NO: 1116389 - protein, 9 aa, Homo Sapiens
SWGSLLMAR

SEQ ID NO: 1116390 - protein, 9 aa, Homo Sapiens
GSSYDGGSD

SEQ ID NO: 1116391 - protein, 9 aa, Homo Sapiens
RAVISTVEW

SEQ ID NO: 1116392 - protein, 9 aa, Homo Sapiens
CTLSTAGQY

SEQ ID NO: 1116393 - protein, 9 aa, Homo Sapiens
INNHVFCSF

SEQ ID NO: 1116394 - protein, 9 aa, Homo Sapiens
MTAAATRGI

SEQ ID NO: 1116395 - protein, 9 aa, Homo Sapiens
VGQCLDVGL

SEQ ID NO: 1116396 - protein, 9 aa, Homo Sapiens
CASTGSSTA

SEQ ID NO: 1116397 - protein, 9 aa, Homo Sapiens
LLQQSFLAA

SEQ ID NO: 1116398 - protein, 9 aa, Homo Sapiens
KDPEELRSY

SEQ ID NO: 1116399 - protein, 9 aa, Homo Sapiens
STGELGTID

SEQ ID NO: 1116400 - protein, 9 aa, Homo Sapiens
TDDADADGP

SEQ ID NO: 1116401 - protein, 9 aa, Homo Sapiens
ATRFPIIAS

SEQ ID NO: 1116402 - protein, 9 aa, Homo Sapiens
PVAVASSLS

SEQ ID NO: 1116403 - protein, 9 aa, Homo Sapiens
TLREEEEKK

SEQ ID NO: 1116404 - protein, 9 aa, Homo Sapiens
RDCSENIEV

SEQ ID NO: 1116405 - protein, 9 aa, Homo Sapiens
EQISANITT

SEQ ID NO: 1116406 - protein, 9 aa, Homo Sapiens
LRKLLHVLT

SEQ ID NO: 1116407 - protein, 9 aa, Homo Sapiens
FVPCYNFTR

SEQ ID NO: 1116408 - protein, 9 aa, Homo Sapiens
TCNHLRITA

SEQ ID NO: 1116409 - protein, 9 aa, Homo Sapiens
EVAEAPPGC

SEQ ID NO: 1116410 - protein, 9 aa, Homo Sapiens
DFLLLQSVD

SEQ ID NO: 1116411 - protein, 9 aa, Homo Sapiens
TFMILRETP

SEQ ID NO: 1116412 - protein, 9 aa, Homo Sapiens
AANGPRGSG

SEQ ID NO: 1116413 - protein, 9 aa, Homo Sapiens
SLLCFQPRT

SEQ ID NO: 1116414 - protein, 9 aa, Homo Sapiens
SYWVTLITE

SEQ ID NO: 1116415 - protein, 9 aa, Homo Sapiens
QKGSHPDAI

SEQ ID NO: 1116416 - protein, 9 aa, Homo Sapiens
PLPVAVSRG

SEQ ID NO: 1116417 - protein, 9 aa, Homo Sapiens
EPQAFENIE

SEQ ID NO: 1116418 - protein, 9 aa, Homo Sapiens
ELKPVEAVK

SEQ ID NO: 1116419 - protein, 9 aa, Homo Sapiens
ECRTFMPPG

SEQ ID NO: 1116420 - protein, 9 aa, Homo Sapiens
DEPAGWKEM

SEQ ID NO: 1116421 - protein, 9 aa, Homo Sapiens
SQCVTTMTH

SEQ ID NO: 1116422 - protein, 9 aa, Homo Sapiens
PLAPLLPLP

SEQ ID NO: 1116423 - protein, 9 aa, Homo Sapiens
EASGRGRWQ

SEQ ID NO: 1116424 - protein, 9 aa, Homo Sapiens
GVAEGSVQY

SEQ ID NO: 1116425 - protein, 9 aa, Homo Sapiens
ALEELQSQH

SEQ ID NO: 1116426 - protein, 9 aa, Homo Sapiens
AVTFGLFLH

SEQ ID NO: 1116427 - protein, 9 aa, Homo Sapiens
ESIPKKSYA

SEQ ID NO: 1116428 - protein, 9 aa, Homo Sapiens
LDDIKLYQK

SEQ ID NO: 1116429 - protein, 9 aa, Homo Sapiens
GRDRAGVQP

SEQ ID NO: 1116430 - protein, 9 aa, Homo Sapiens
SHSWSLSPL

SEQ ID NO: 1116431 - protein, 9 aa, Homo Sapiens
RSNCAENIH

SEQ ID NO: 1116432 - protein, 9 aa, Homo Sapiens
FDQGCLALA

SEQ ID NO: 1116433 - protein, 9 aa, Homo Sapiens
TYLRKIPHF

SEQ ID NO: 1116434 - protein, 9 aa, Homo Sapiens
TVANTTMSL

SEQ ID NO: 1116435 - protein, 9 aa, Homo Sapiens
TAAATRGIS

SEQ ID NO: 1116436 - protein, 9 aa, Homo Sapiens
QLYMRRAAL

SEQ ID NO: 1116437 - protein, 9 aa, Homo Sapiens
ISLSVRLKR

SEQ ID NO: 1116438 - protein, 9 aa, Homo Sapiens
CTIPPMEKA

SEQ ID NO: 1116439 - protein, 9 aa, Homo Sapiens
IRTCVNTSD

SEQ ID NO: 1116440 - protein, 9 aa, Homo Sapiens
QSRGLDSLA

SEQ ID NO: 1116441 - protein, 9 aa, Homo Sapiens
ISTCGPTGP

SEQ ID NO: 1116442 - protein, 9 aa, Homo Sapiens
HDKNRFMGM

SEQ ID NO: 1116443 - protein, 9 aa, Homo Sapiens
AHGASGGEG

SEQ ID NO: 1116444 - protein, 9 aa, Homo Sapiens
SETAGAWQY

SEQ ID NO: 1116445 - protein, 9 aa, Homo Sapiens
HRWHWSSGS

SEQ ID NO: 1116446 - protein, 9 aa, Homo Sapiens
GISAQPSSG

SEQ ID NO: 1116447 - protein, 9 aa, Homo Sapiens
PPPPLPPWP

SEQ ID NO: 1116448 - protein, 9 aa, Homo Sapiens
HDFSINFNE

SEQ ID NO: 1116449 - protein, 9 aa, Homo Sapiens
LTLVFKRSP

SEQ ID NO: 1116450 - protein, 9 aa, Homo Sapiens
TMKMAAMIF

SEQ ID NO: 1116451 - protein, 9 aa, Homo Sapiens
LAHIWQEEE

SEQ ID NO: 1116452 - protein, 9 aa, Homo Sapiens
MLRVTNPYN

SEQ ID NO: 1116453 - protein, 9 aa, Homo Sapiens
SPPWRALAS

SEQ ID NO: 1116454 - protein, 9 aa, Homo Sapiens
PVSQMQHAS

SEQ ID NO: 1116455 - protein, 9 aa, Homo Sapiens
GQRIFLVLR

SEQ ID NO: 1116456 - protein, 9 aa, Homo Sapiens
DCDSKELQQ

SEQ ID NO: 1116457 - protein, 9 aa, Homo Sapiens
STRPIAGTQ

SEQ ID NO: 1116458 - protein, 9 aa, Homo Sapiens
RRTLGTTGG

SEQ ID NO: 1116459 - protein, 9 aa, Homo Sapiens
AAPPLPDRP

SEQ ID NO: 1116460 - protein, 9 aa, Homo Sapiens
NPTIFEERH

SEQ ID NO: 1116461 - protein, 9 aa, Homo Sapiens
VIAASPAPT

SEQ ID NO: 1116462 - protein, 9 aa, Homo Sapiens
ERAPRTPRA

SEQ ID NO: 1116463 - protein, 9 aa, Homo Sapiens
THPSTIAPS

SEQ ID NO: 1116464 - protein, 9 aa, Homo Sapiens
QARHSVVFS

SEQ ID NO: 1116465 - protein, 9 aa, Homo Sapiens
SRGTLEKMQ

SEQ ID NO: 1116466 - protein, 9 aa, Homo Sapiens
GTIDSAFGQ

SEQ ID NO: 1116467 - protein, 9 aa, Homo Sapiens
TASSWGRKS

SEQ ID NO: 1116468 - protein, 9 aa, Homo Sapiens
RKVTLTRGA

SEQ ID NO: 1116469 - protein, 9 aa, Homo Sapiens
CLLCWMPYH

SEQ ID NO: 1116470 - protein, 9 aa, Homo Sapiens
LLVIHSCQC

SEQ ID NO: 1116471 - protein, 9 aa, Homo Sapiens
QTIDLLDWC

SEQ ID NO: 1116472 - protein, 9 aa, Homo Sapiens
EWSSGCYWI

SEQ ID NO: 1116473 - protein, 9 aa, Homo Sapiens
SEVCGGTWP

SEQ ID NO: 1116474 - protein, 9 aa, Homo Sapiens
HSEGMKVYN

SEQ ID NO: 1116475 - protein, 9 aa, Homo Sapiens
SLQCQSLAL

SEQ ID NO: 1116476 - protein, 9 aa, Homo Sapiens
GTLEKMQKD

SEQ ID NO: 1116477 - protein, 9 aa, Homo Sapiens
DETFGPNIP

SEQ ID NO: 1116478 - protein, 9 aa, Homo Sapiens
LWPLRPPPL

SEQ ID NO: 1116479 - protein, 9 aa, Homo Sapiens
QMLSSQPPL

SEQ ID NO: 1116480 - protein, 9 aa, Homo Sapiens
AGSKTAGPH

SEQ ID NO: 1116481 - protein, 9 aa, Homo Sapiens
YPQSPFPPT

SEQ ID NO: 1116482 - protein, 9 aa, Homo Sapiens
TFGFLALPG

SEQ ID NO: 1116483 - protein, 9 aa, Homo Sapiens
QHEVTICNY

SEQ ID NO: 1116484 - protein, 9 aa, Homo Sapiens
DFSQSTSTS

SEQ ID NO: 1116485 - protein, 9 aa, Homo Sapiens
LGLGLLQSP

SEQ ID NO: 1116486 - protein, 9 aa, Homo Sapiens
GTWPCPQCL

SEQ ID NO: 1116487 - protein, 9 aa, Homo Sapiens
RCHRRRRRC

SEQ ID NO: 1116488 - protein, 9 aa, Homo Sapiens
VEWDVEEVP

SEQ ID NO: 1116489 - protein, 9 aa, Homo Sapiens
KVAWKKTAK

SEQ ID NO: 1116490 - protein, 9 aa, Homo Sapiens
NPQLLCQNP

SEQ ID NO: 1116491 - protein, 9 aa, Homo Sapiens
IVMAAYPAS

SEQ ID NO: 1116492 - protein, 9 aa, Homo Sapiens
IESCKLYDG

SEQ ID NO: 1116493 - protein, 9 aa, Homo Sapiens
IGKNGRTRT

SEQ ID NO: 1116494 - protein, 9 aa, Homo Sapiens
AQALEELQS

SEQ ID NO: 1116495 - protein, 9 aa, Homo Sapiens
LHRCPPARW

SEQ ID NO: 1116496 - protein, 9 aa, Homo Sapiens
HLGDGKKMD

SEQ ID NO: 1116497 - protein, 9 aa, Homo Sapiens
KLFVKVYEV

SEQ ID NO: 1116498 - protein, 9 aa, Homo Sapiens
DILCLSGDI

SEQ ID NO: 1116499 - protein, 9 aa, Homo Sapiens
LSASGLRQW

SEQ ID NO: 1116500 - protein, 9 aa, Homo Sapiens
SLDALCPTR

SEQ ID NO: 1116501 - protein, 9 aa, Homo Sapiens
EEFVRQYKS

SEQ ID NO: 1116502 - protein, 9 aa, Homo Sapiens
AGVVCCLPG

SEQ ID NO: 1116503 - protein, 9 aa, Homo Sapiens
LWNNLCQIV

SEQ ID NO: 1116504 - protein, 9 aa, Homo Sapiens
MTAMWLSAS

SEQ ID NO: 1116505 - protein, 9 aa, Homo Sapiens
EALGEAEHI

SEQ ID NO: 1116506 - protein, 9 aa, Homo Sapiens
ELPGQVAGA

SEQ ID NO: 1116507 - protein, 9 aa, Homo Sapiens
QLIYLYLFH

SEQ ID NO: 1116508 - protein, 9 aa, Homo Sapiens
FIYSYILGL

SEQ ID NO: 1116509 - protein, 9 aa, Homo Sapiens
VHANDDLKE

SEQ ID NO: 1116510 - protein, 9 aa, Homo Sapiens
FDALVFFFD

SEQ ID NO: 1116511 - protein, 9 aa, Homo Sapiens
RARDALCHQ

SEQ ID NO: 1116512 - protein, 9 aa, Homo Sapiens
GMGHFGRSL

SEQ ID NO: 1116513 - protein, 9 aa, Homo Sapiens
ALVACVGSG

SEQ ID NO: 1116514 - protein, 9 aa, Homo Sapiens
LCQNPEKLA

SEQ ID NO: 1116515 - protein, 9 aa, Homo Sapiens
QGMPAFSFS

SEQ ID NO: 1116516 - protein, 9 aa, Homo Sapiens
VYIAVIAKE

SEQ ID NO: 1116517 - protein, 9 aa, Homo Sapiens
EAGIMGQFD

SEQ ID NO: 1116518 - protein, 9 aa, Homo Sapiens
RHILGVFSK

SEQ ID NO: 1116519 - protein, 9 aa, Homo Sapiens
ITYASIALA

SEQ ID NO: 1116520 - protein, 9 aa, Homo Sapiens
PHCGLRGQS

SEQ ID NO: 1116521 - protein, 9 aa, Homo Sapiens
PPLHWKEFV

SEQ ID NO: 1116522 - protein, 9 aa, Homo Sapiens
GLGPHVVTN

SEQ ID NO: 1116523 - protein, 9 aa, Homo Sapiens
FGLISVRLN

SEQ ID NO: 1116524 - protein, 9 aa, Homo Sapiens
CFQSSAVMA

SEQ ID NO: 1116525 - protein, 9 aa, Homo Sapiens
AFSLRNSLP

SEQ ID NO: 1116526 - protein, 9 aa, Homo Sapiens
KRMSKNTAA

SEQ ID NO: 1116527 - protein, 9 aa, Homo Sapiens
TVSTAVNVF

SEQ ID NO: 1116528 - protein, 9 aa, Homo Sapiens
ENRNGNSGN

SEQ ID NO: 1116529 - protein, 9 aa, Homo Sapiens
RTAPPTPVP

SEQ ID NO: 1116530 - protein, 9 aa, Homo Sapiens
RAGWGTSAS

SEQ ID NO: 1116531 - protein, 9 aa, Homo Sapiens
EPSSEPMHT

SEQ ID NO: 1116532 - protein, 9 aa, Homo Sapiens
LQGVPGKTS

SEQ ID NO: 1116533 - protein, 9 aa, Homo Sapiens
ETGDPTEKQ

SEQ ID NO: 1116534 - protein, 9 aa, Homo Sapiens
HGAAGDTPS

SEQ ID NO: 1116535 - protein, 9 aa, Homo Sapiens
ATSLATAAD

SEQ ID NO: 1116536 - protein, 9 aa, Homo Sapiens
LTKKRWEET

SEQ ID NO: 1116537 - protein, 9 aa, Homo Sapiens
AAKPSARSP

SEQ ID NO: 1116538 - protein, 9 aa, Homo Sapiens
HGTEKLIEA

SEQ ID NO: 1116539 - protein, 9 aa, Homo Sapiens
MTAAQEGTC

SEQ ID NO: 1116540 - protein, 9 aa, Homo Sapiens
ARGRWWLSS

SEQ ID NO: 1116541 - protein, 9 aa, Homo Sapiens
GSAQPQAMA

SEQ ID NO: 1116542 - protein, 9 aa, Homo Sapiens
LAPGGGVAY

SEQ ID NO: 1116543 - protein, 9 aa, Homo Sapiens
RTRPSTSTR

SEQ ID NO: 1116544 - protein, 9 aa, Homo Sapiens
SRTGKLFPV

SEQ ID NO: 1116545 - protein, 9 aa, Homo Sapiens
DRERERVRA

SEQ ID NO: 1116546 - protein, 9 aa, Homo Sapiens
GRILHQPEM

SEQ ID NO: 1116547 - protein, 9 aa, Homo Sapiens
APSGAPSPP

SEQ ID NO: 1116548 - protein, 9 aa, Homo Sapiens
YHGVEADNL

SEQ ID NO: 1116549 - protein, 9 aa, Homo Sapiens
PVARTLPKV

SEQ ID NO: 1116550 - protein, 9 aa, Homo Sapiens
PECDFTEFC

SEQ ID NO: 1116551 - protein, 9 aa, Homo Sapiens
MMMMMMMMI

SEQ ID NO: 1116552 - protein, 9 aa, Homo Sapiens
TGSSTDSEA

SEQ ID NO: 1116553 - protein, 9 aa, Homo Sapiens
TRRIRGSRQ

SEQ ID NO: 1116554 - protein, 9 aa, Homo Sapiens
LASHLMSCK

SEQ ID NO: 1116555 - protein, 9 aa, Homo Sapiens
CTCIAKNTK

SEQ ID NO: 1116556 - protein, 9 aa, Homo Sapiens
RTPLFPLLS

SEQ ID NO: 1116557 - protein, 9 aa, Homo Sapiens
LSLGCEELQ

SEQ ID NO: 1116558 - protein, 9 aa, Homo Sapiens
LFVVNRPWL

SEQ ID NO: 1116559 - protein, 9 aa, Homo Sapiens
AISREPDIL

SEQ ID NO: 1116560 - protein, 9 aa, Homo Sapiens
IGLKDSQIV

SEQ ID NO: 1116561 - protein, 9 aa, Homo Sapiens
FSRDVLLNM

SEQ ID NO: 1116562 - protein, 9 aa, Homo Sapiens
FLPYFIYSY

SEQ ID NO: 1116563 - protein, 9 aa, Homo Sapiens
VQWRITSCA

SEQ ID NO: 1116564 - protein, 9 aa, Homo Sapiens
LHPPHLVPK

SEQ ID NO: 1116565 - protein, 9 aa, Homo Sapiens
TRLTVLWED

SEQ ID NO: 1116566 - protein, 9 aa, Homo Sapiens
MLRKDKDGA

SEQ ID NO: 1116567 - protein, 9 aa, Homo Sapiens
QALRNHYRK

SEQ ID NO: 1116568 - protein, 9 aa, Homo Sapiens
AQAESEVGW

SEQ ID NO: 1116569 - protein, 9 aa, Homo Sapiens
WCPDGSHLG

SEQ ID NO: 1116570 - protein, 9 aa, Homo Sapiens
FAEWIPLAR

SEQ ID NO: 1116571 - protein, 9 aa, Homo Sapiens
RLVYSNGKD

SEQ ID NO: 1116572 - protein, 9 aa, Homo Sapiens
AQAEVGRAA

SEQ ID NO: 1116573 - protein, 9 aa, Homo Sapiens
REDFKQKVE

SEQ ID NO: 1116574 - protein, 9 aa, Homo Sapiens
IGNAVEHVF

SEQ ID NO: 1116575 - protein, 9 aa, Homo Sapiens
KWPNDISVD

SEQ ID NO: 1116576 - protein, 9 aa, Homo Sapiens
RPTQRPRAG

SEQ ID NO: 1116577 - protein, 9 aa, Homo Sapiens
GQHKLLCRE

SEQ ID NO: 1116578 - protein, 9 aa, Homo Sapiens
DSTLLVLQG

SEQ ID NO: 1116579 - protein, 9 aa, Homo Sapiens
TAQSPAGPA

SEQ ID NO: 1116580 - protein, 9 aa, Homo Sapiens
HQLVDHAGR

SEQ ID NO: 1116581 - protein, 9 aa, Homo Sapiens
MAKLPHGMS

SEQ ID NO: 1116582 - protein, 9 aa, Homo Sapiens
CEERGVHVE

SEQ ID NO: 1116583 - protein, 9 aa, Homo Sapiens
LSLPILRPT

SEQ ID NO: 1116584 - protein, 9 aa, Homo Sapiens
PLVGISAMN

SEQ ID NO: 1116585 - protein, 9 aa, Homo Sapiens
YAPPNSYAQ

SEQ ID NO: 1116586 - protein, 9 aa, Homo Sapiens
DTIRGHLGP

SEQ ID NO: 1116587 - protein, 9 aa, Homo Sapiens
GSVQYKKWY

SEQ ID NO: 1116588 - protein, 9 aa, Homo Sapiens
TRNSYECEM

SEQ ID NO: 1116589 - protein, 9 aa, Homo Sapiens
KKKGESQEG

SEQ ID NO: 1116590 - protein, 9 aa, Homo Sapiens
SDTGYILFL

SEQ ID NO: 1116591 - protein, 9 aa, Homo Sapiens
AELDHEDDF

SEQ ID NO: 1116592 - protein, 9 aa, Homo Sapiens
LKTKSIIFQ

SEQ ID NO: 1116593 - protein, 9 aa, Homo Sapiens
HWRAMVGGL

SEQ ID NO: 1116594 - protein, 9 aa, Homo Sapiens
VTPTAFSEY

SEQ ID NO: 1116595 - protein, 9 aa, Homo Sapiens
AGGGSPAAV

SEQ ID NO: 1116596 - protein, 9 aa, Homo Sapiens
HLRELSGSG

SEQ ID NO: 1116597 - protein, 9 aa, Homo Sapiens
GLLLHAPSL

SEQ ID NO: 1116598 - protein, 9 aa, Homo Sapiens
LHKTEKAIN

SEQ ID NO: 1116599 - protein, 9 aa, Homo Sapiens
IEVTCKSAS

SEQ ID NO: 1116600 - protein, 9 aa, Homo Sapiens
RKHPPVGSG

SEQ ID NO: 1116601 - protein, 9 aa, Homo Sapiens
CCGAGVGVL

SEQ ID NO: 1116602 - protein, 9 aa, Homo Sapiens
SDCFIGSSD

SEQ ID NO: 1116603 - protein, 9 aa, Homo Sapiens
QHSPNVCAV

SEQ ID NO: 1116604 - protein, 9 aa, Homo Sapiens
GSGPGVESM

SEQ ID NO: 1116605 - protein, 9 aa, Homo Sapiens
RQLSLRING

SEQ ID NO: 1116606 - protein, 9 aa, Homo Sapiens
AWDPSPSHL

SEQ ID NO: 1116607 - protein, 9 aa, Homo Sapiens
GHGVHHGGN

SEQ ID NO: 1116608 - protein, 9 aa, Homo Sapiens
LVQRNTRSS

SEQ ID NO: 1116609 - protein, 9 aa, Homo Sapiens
LLEILWTLS

SEQ ID NO: 1116610 - protein, 9 aa, Homo Sapiens
KDHRTSQNH

SEQ ID NO: 1116611 - protein, 9 aa, Homo Sapiens
QFRWNQKGE

SEQ ID NO: 1116612 - protein, 9 aa, Homo Sapiens
GNLSRGVSP

SEQ ID NO: 1116613 - protein, 9 aa, Homo Sapiens
FLTALKSRK

SEQ ID NO: 1116614 - protein, 9 aa, Homo Sapiens
TLESGGASR

SEQ ID NO: 1116615 - protein, 9 aa, Homo Sapiens
LPVSRCENN

SEQ ID NO: 1116616 - protein, 9 aa, Homo Sapiens
SEPKCDFHF

SEQ ID NO: 1116617 - protein, 9 aa, Homo Sapiens
VIYQQIVQT

SEQ ID NO: 1116618 - protein, 9 aa, Homo Sapiens
CKLHVNRAT

SEQ ID NO: 1116619 - protein, 9 aa, Homo Sapiens
VTAEFDLTL

SEQ ID NO: 1116620 - protein, 9 aa, Homo Sapiens
LMSPNRGVL

SEQ ID NO: 1116621 - protein, 9 aa, Homo Sapiens
KTSRILNLQ

SEQ ID NO: 1116622 - protein, 9 aa, Homo Sapiens
VISNALSKS

SEQ ID NO: 1116623 - protein, 9 aa, Homo Sapiens
PNRELVCRS

SEQ ID NO: 1116624 - protein, 9 aa, Homo Sapiens
YDGKFAIFI

SEQ ID NO: 1116625 - protein, 9 aa, Homo Sapiens
QSVMSGRSP

SEQ ID NO: 1116626 - protein, 9 aa, Homo Sapiens
GPEDKAEQR

SEQ ID NO: 1116627 - protein, 9 aa, Homo Sapiens
KWNLHKCIA

SEQ ID NO: 1116628 - protein, 9 aa, Homo Sapiens
QSLERVLET

SEQ ID NO: 1116629 - protein, 9 aa, Homo Sapiens
DNKDTCKSD

SEQ ID NO: 1116630 - protein, 9 aa, Homo Sapiens
TVIHLALKE

SEQ ID NO: 1116631 - protein, 9 aa, Homo Sapiens
RSSVETLHA

SEQ ID NO: 1116632 - protein, 9 aa, Homo Sapiens
AFFKGVWSN

SEQ ID NO: 1116633 - protein, 9 aa, Homo Sapiens
KARLLWQYD

SEQ ID NO: 1116634 - protein, 9 aa, Homo Sapiens
TQVEASGRG

SEQ ID NO: 1116635 - protein, 9 aa, Homo Sapiens
VPELRIGRL

SEQ ID NO: 1116636 - protein, 9 aa, Homo Sapiens
SPADTTSVG

SEQ ID NO: 1116637 - protein, 9 aa, Homo Sapiens
VPEESPLLG

SEQ ID NO: 1116638 - protein, 9 aa, Homo Sapiens
LEDGTLEIH

SEQ ID NO: 1116639 - protein, 9 aa, Homo Sapiens
IDLPLAKTG

SEQ ID NO: 1116640 - protein, 9 aa, Homo Sapiens
LDNVFSPQA

SEQ ID NO: 1116641 - protein, 9 aa, Homo Sapiens
HRDKVPGGE

SEQ ID NO: 1116642 - protein, 9 aa, Homo Sapiens
PLASQEGAQ

SEQ ID NO: 1116643 - protein, 9 aa, Homo Sapiens
TEQGWSCPW

SEQ ID NO: 1116644 - protein, 9 aa, Homo Sapiens
PLDHCYVRP

SEQ ID NO: 1116645 - protein, 9 aa, Homo Sapiens
YECMVRGKH

SEQ ID NO: 1116646 - protein, 9 aa, Homo Sapiens
PDPSPVSTA

SEQ ID NO: 1116647 - protein, 9 aa, Homo Sapiens
VNPAEKTPL

SEQ ID NO: 1116648 - protein, 9 aa, Homo Sapiens
VTFESLQVK

SEQ ID NO: 1116649 - protein, 9 aa, Homo Sapiens
RELDTNGDG

SEQ ID NO: 1116650 - protein, 9 aa, Homo Sapiens
CSPPRLCVK

SEQ ID NO: 1116651 - protein, 9 aa, Homo Sapiens
RRPRPRQPT

SEQ ID NO: 1116652 - protein, 9 aa, Homo Sapiens
LPEHQTRLR

SEQ ID NO: 1116653 - protein, 9 aa, Homo Sapiens
LGALGRRQL

SEQ ID NO: 1116654 - protein, 9 aa, Homo Sapiens
ILVISMDNA

SEQ ID NO: 1116655 - protein, 9 aa, Homo Sapiens
ILLLCGQPQ

SEQ ID NO: 1116656 - protein, 9 aa, Homo Sapiens
YKRENKEIR

SEQ ID NO: 1116657 - protein, 9 aa, Homo Sapiens
FLHHKDRES

SEQ ID NO: 1116658 - protein, 9 aa, Homo Sapiens
AAKESQASI

SEQ ID NO: 1116659 - protein, 9 aa, Homo Sapiens
TVRLCRRSR

SEQ ID NO: 1116660 - protein, 9 aa, Homo Sapiens
RSCLERWDK

SEQ ID NO: 1116661 - protein, 9 aa, Homo Sapiens
ATTPPTPHL

SEQ ID NO: 1116662 - protein, 9 aa, Homo Sapiens
SSSCRSHGY

SEQ ID NO: 1116663 - protein, 9 aa, Homo Sapiens
CLSYIAEIK

SEQ ID NO: 1116664 - protein, 9 aa, Homo Sapiens
PPVQPALTP

SEQ ID NO: 1116665 - protein, 9 aa, Homo Sapiens
TARVNGLMK

SEQ ID NO: 1116666 - protein, 9 aa, Homo Sapiens
RPDVGRHLR

SEQ ID NO: 1116667 - protein, 9 aa, Homo Sapiens
YPDTLQSPF

SEQ ID NO: 1116668 - protein, 9 aa, Homo Sapiens
YTISCVTQS

SEQ ID NO: 1116669 - protein, 9 aa, Homo Sapiens
TLMRDLKPF

SEQ ID NO: 1116670 - protein, 9 aa, Homo Sapiens
AAEGFDAKE

SEQ ID NO: 1116671 - protein, 9 aa, Homo Sapiens
IPQRPGRKH

SEQ ID NO: 1116672 - protein, 9 aa, Homo Sapiens
PQTHCERRN

SEQ ID NO: 1116673 - protein, 9 aa, Homo Sapiens
VSSSSSLRR

SEQ ID NO: 1116674 - protein, 9 aa, Homo Sapiens
APLDHCYVR

SEQ ID NO: 1116675 - protein, 9 aa, Homo Sapiens
LCSLCTTGL

SEQ ID NO: 1116676 - protein, 9 aa, Homo Sapiens
HKMIHTGEN

SEQ ID NO: 1116677 - protein, 9 aa, Homo Sapiens
CANTFGSYI

SEQ ID NO: 1116678 - protein, 9 aa, Homo Sapiens
PGGHQEDQL

SEQ ID NO: 1116679 - protein, 9 aa, Homo Sapiens
NILTVNRPV

SEQ ID NO: 1116680 - protein, 9 aa, Homo Sapiens
KNQEKIAGS

SEQ ID NO: 1116681 - protein, 9 aa, Homo Sapiens
ESEVGWPEE

SEQ ID NO: 1116682 - protein, 9 aa, Homo Sapiens
NISESLHIF

SEQ ID NO: 1116683 - protein, 9 aa, Homo Sapiens
TCNHRKKEV

SEQ ID NO: 1116684 - protein, 9 aa, Homo Sapiens
TSCHHGLVA

SEQ ID NO: 1116685 - protein, 9 aa, Homo Sapiens
MLENINHLV

SEQ ID NO: 1116686 - protein, 9 aa, Homo Sapiens
LASIGKNGR

SEQ ID NO: 1116687 - protein, 9 aa, Homo Sapiens
NFPPAQNLA

SEQ ID NO: 1116688 - protein, 9 aa, Homo Sapiens
RSVSSSSSL

SEQ ID NO: 1116689 - protein, 9 aa, Homo Sapiens
FIRTVKSVG

SEQ ID NO: 1116690 - protein, 9 aa, Homo Sapiens
CIHTGCELR

SEQ ID NO: 1116691 - protein, 9 aa, Homo Sapiens
RPCLSGPVA

SEQ ID NO: 1116692 - protein, 9 aa, Homo Sapiens
RKWSGASPH

SEQ ID NO: 1116693 - protein, 9 aa, Homo Sapiens
MHCLTTPML

SEQ ID NO: 1116694 - protein, 9 aa, Homo Sapiens
VCPAVERVS

SEQ ID NO: 1116695 - protein, 9 aa, Homo Sapiens
RCGSRRRSV

SEQ ID NO: 1116696 - protein, 9 aa, Homo Sapiens
EAWGQKANE

SEQ ID NO: 1116697 - protein, 9 aa, Homo Sapiens
TGCPLLASQ

SEQ ID NO: 1116698 - protein, 9 aa, Homo Sapiens
SSLGVEIKT

SEQ ID NO: 1116699 - protein, 9 aa, Homo Sapiens
FPDLYKSLT

SEQ ID NO: 1116700 - protein, 9 aa, Homo Sapiens
GPPRASPRT

SEQ ID NO: 1116701 - protein, 9 aa, Homo Sapiens
VTEMAPKRP

SEQ ID NO: 1116702 - protein, 9 aa, Homo Sapiens
TCPSPQEIS

SEQ ID NO: 1116703 - protein, 9 aa, Homo Sapiens
TMVRALGRF

SEQ ID NO: 1116704 - protein, 9 aa, Homo Sapiens
LKRSRCPPR

SEQ ID NO: 1116705 - protein, 9 aa, Homo Sapiens
YGKAVSSQP

SEQ ID NO: 1116706 - protein, 9 aa, Homo Sapiens
QNIMDFGKN

SEQ ID NO: 1116707 - protein, 9 aa, Homo Sapiens
LHSCFQTKV

SEQ ID NO: 1116708 - protein, 9 aa, Homo Sapiens
SIGRSGAVD

SEQ ID NO: 1116709 - protein, 9 aa, Homo Sapiens
LAHVFIGIN

SEQ ID NO: 1116710 - protein, 9 aa, Homo Sapiens
TFLKAQLVC

SEQ ID NO: 1116711 - protein, 9 aa, Homo Sapiens
YPESEGISF

SEQ ID NO: 1116712 - protein, 9 aa, Homo Sapiens
HTLVMFYTP

SEQ ID NO: 1116713 - protein, 9 aa, Homo Sapiens
GFSDPGVWG

SEQ ID NO: 1116714 - protein, 9 aa, Homo Sapiens
GMGRPPPQP

SEQ ID NO: 1116715 - protein, 9 aa, Homo Sapiens
MPPLLHPQW

SEQ ID NO: 1116716 - protein, 9 aa, Homo Sapiens
AVFEQDLEK

SEQ ID NO: 1116717 - protein, 9 aa, Homo Sapiens
GSSGSGRAR

SEQ ID NO: 1116718 - protein, 9 aa, Homo Sapiens
GKQTPVART

SEQ ID NO: 1116719 - protein, 9 aa, Homo Sapiens
PVEAVKYSD

SEQ ID NO: 1116720 - protein, 9 aa, Homo Sapiens
DMKHKIRKI

SEQ ID NO: 1116721 - protein, 9 aa, Homo Sapiens
WGAVAGTAS

SEQ ID NO: 1116722 - protein, 9 aa, Homo Sapiens
NLFGLISVR

SEQ ID NO: 1116723 - protein, 9 aa, Homo Sapiens
GSVGALTGR

SEQ ID NO: 1116724 - protein, 9 aa, Homo Sapiens
SELERRFKQ

SEQ ID NO: 1116725 - protein, 9 aa, Homo Sapiens
QWTQTCPPK

SEQ ID NO: 1116726 - protein, 9 aa, Homo Sapiens
RLHAVHMKE

SEQ ID NO: 1116727 - protein, 9 aa, Homo Sapiens
RGSYAEVKP

SEQ ID NO: 1116728 - protein, 9 aa, Homo Sapiens
NKNQSALIE

SEQ ID NO: 1116729 - protein, 9 aa, Homo Sapiens
YMINVVTLN

SEQ ID NO: 1116730 - protein, 9 aa, Homo Sapiens
AYLPEDFIW

SEQ ID NO: 1116731 - protein, 9 aa, Homo Sapiens
LPGWIYTLS

SEQ ID NO: 1116732 - protein, 9 aa, Homo Sapiens
PHSRSSSPP

SEQ ID NO: 1116733 - protein, 9 aa, Homo Sapiens
SGFARPPQL

SEQ ID NO: 1116734 - protein, 9 aa, Homo Sapiens
ASPAPTSSP

SEQ ID NO: 1116735 - protein, 9 aa, Homo Sapiens
SVAIPSVTG

SEQ ID NO: 1116736 - protein, 9 aa, Homo Sapiens
DAPSHSPPA

SEQ ID NO: 1116737 - protein, 9 aa, Homo Sapiens
SINHFFVTP

SEQ ID NO: 1116738 - protein, 9 aa, Homo Sapiens
SWSLQTLPT

SEQ ID NO: 1116739 - protein, 9 aa, Homo Sapiens
PAAPRPHSR

SEQ ID NO: 1116740 - protein, 9 aa, Homo Sapiens
GGFFVAAIE

SEQ ID NO: 1116741 - protein, 9 aa, Homo Sapiens
DQRDFRPAQ

SEQ ID NO: 1116742 - protein, 9 aa, Homo Sapiens
YSKQNREKR

SEQ ID NO: 1116743 - protein, 9 aa, Homo Sapiens
QMKFYFRFT

SEQ ID NO: 1116744 - protein, 9 aa, Homo Sapiens
APPTPVPRS

SEQ ID NO: 1116745 - protein, 9 aa, Homo Sapiens
RDRCSAGKR

SEQ ID NO: 1116746 - protein, 9 aa, Homo Sapiens
RHPVKVYPN

SEQ ID NO: 1116747 - protein, 9 aa, Homo Sapiens
WFCYFNASQ

SEQ ID NO: 1116748 - protein, 9 aa, Homo Sapiens
GLVGLFRAG

SEQ ID NO: 1116749 - protein, 9 aa, Homo Sapiens
EDKTAVVKL

SEQ ID NO: 1116750 - protein, 9 aa, Homo Sapiens
NASQTCVAP

SEQ ID NO: 1116751 - protein, 9 aa, Homo Sapiens
PALLVLLLQ

SEQ ID NO: 1116752 - protein, 9 aa, Homo Sapiens
QGPSPPLFQ

SEQ ID NO: 1116753 - protein, 9 aa, Homo Sapiens
TDDEAADDT

SEQ ID NO: 1116754 - protein, 9 aa, Homo Sapiens
TVAGTGARA

SEQ ID NO: 1116755 - protein, 9 aa, Homo Sapiens
LGWPVKAPT

SEQ ID NO: 1116756 - protein, 9 aa, Homo Sapiens
RKWHLLSEL

SEQ ID NO: 1116757 - protein, 9 aa, Homo Sapiens
LYHGLRASL

SEQ ID NO: 1116758 - protein, 9 aa, Homo Sapiens
QRERNPKIG

SEQ ID NO: 1116759 - protein, 9 aa, Homo Sapiens
CASCSAPVL

SEQ ID NO: 1116760 - protein, 9 aa, Homo Sapiens
GQPRQLPRD

SEQ ID NO: 1116761 - protein, 9 aa, Homo Sapiens
HAPSLSPGL

SEQ ID NO: 1116762 - protein, 9 aa, Homo Sapiens
EPESLISVD

SEQ ID NO: 1116763 - protein, 9 aa, Homo Sapiens
GRNTLGPQY

SEQ ID NO: 1116764 - protein, 9 aa, Homo Sapiens
PHAYYTLSY

SEQ ID NO: 1116765 - protein, 9 aa, Homo Sapiens
VGEDEEQNQ

SEQ ID NO: 1116766 - protein, 9 aa, Homo Sapiens
VDVATDFSQ

SEQ ID NO: 1116767 - protein, 9 aa, Homo Sapiens
VPTTYAGKL

SEQ ID NO: 1116768 - protein, 9 aa, Homo Sapiens
RGAPLRSCI

SEQ ID NO: 1116769 - protein, 9 aa, Homo Sapiens
GKGHFAEVY

SEQ ID NO: 1116770 - protein, 9 aa, Homo Sapiens
LPRPGSHLR

SEQ ID NO: 1116771 - protein, 9 aa, Homo Sapiens
QGAVACLAA

SEQ ID NO: 1116772 - protein, 9 aa, Homo Sapiens
RRTPTRRKR

SEQ ID NO: 1116773 - protein, 9 aa, Homo Sapiens
LDLDHTQHQ

SEQ ID NO: 1116774 - protein, 9 aa, Homo Sapiens
VFLVVANNE

SEQ ID NO: 1116775 - protein, 9 aa, Homo Sapiens
GAEGRGTES

SEQ ID NO: 1116776 - protein, 9 aa, Homo Sapiens
AVLGCRKNK

SEQ ID NO: 1116777 - protein, 9 aa, Homo Sapiens
PGGPGTAEG

SEQ ID NO: 1116778 - protein, 9 aa, Homo Sapiens
TAAGPAAPR

SEQ ID NO: 1116779 - protein, 9 aa, Homo Sapiens
QGFIPDGDQ

SEQ ID NO: 1116780 - protein, 9 aa, Homo Sapiens
SLFRHYTMV

SEQ ID NO: 1116781 - protein, 9 aa, Homo Sapiens
RPSTTRRDS

SEQ ID NO: 1116782 - protein, 9 aa, Homo Sapiens
LSATESPLT

SEQ ID NO: 1116783 - protein, 9 aa, Homo Sapiens
TSGLGKNPH

SEQ ID NO: 1116784 - protein, 9 aa, Homo Sapiens
PTVCGVLDL

SEQ ID NO: 1116785 - protein, 9 aa, Homo Sapiens
IAVGPARIS

SEQ ID NO: 1116786 - protein, 9 aa, Homo Sapiens
VCVFRERAA

SEQ ID NO: 1116787 - protein, 9 aa, Homo Sapiens
AQAGLAHVF

SEQ ID NO: 1116788 - protein, 9 aa, Homo Sapiens
RRIGATTPP

SEQ ID NO: 1116789 - protein, 9 aa, Homo Sapiens
ECICTVVQL

SEQ ID NO: 1116790 - protein, 9 aa, Homo Sapiens
RSCRHSVQS

SEQ ID NO: 1116791 - protein, 9 aa, Homo Sapiens
RMTPTCPLE

SEQ ID NO: 1116792 - protein, 9 aa, Homo Sapiens
QPGVQFPLF

SEQ ID NO: 1116793 - protein, 9 aa, Homo Sapiens
SEEGNHDKN

SEQ ID NO: 1116794 - protein, 9 aa, Homo Sapiens
SSPTFPKGI

SEQ ID NO: 1116795 - protein, 9 aa, Homo Sapiens
PIPRCVAGA

SEQ ID NO: 1116796 - protein, 9 aa, Homo Sapiens
SLSVRLKRC

SEQ ID NO: 1116797 - protein, 9 aa, Homo Sapiens
CNAHYLKQS

SEQ ID NO: 1116798 - protein, 9 aa, Homo Sapiens
YFPFGQQNC

SEQ ID NO: 1116799 - protein, 9 aa, Homo Sapiens
VCTRTQQGM

SEQ ID NO: 1116800 - protein, 9 aa, Homo Sapiens
TELYFAGQV

SEQ ID NO: 1116801 - protein, 9 aa, Homo Sapiens
GSWYCLTSP

SEQ ID NO: 1116802 - protein, 9 aa, Homo Sapiens
SRDQKLPVF

SEQ ID NO: 1116803 - protein, 9 aa, Homo Sapiens
RDHKYCCDA

SEQ ID NO: 1116804 - protein, 9 aa, Homo Sapiens
GSMLSAAIF

SEQ ID NO: 1116805 - protein, 9 aa, Homo Sapiens
FGHTSTLIK

SEQ ID NO: 1116806 - protein, 9 aa, Homo Sapiens
LGRVLLPDG

SEQ ID NO: 1116807 - protein, 9 aa, Homo Sapiens
RRTPCVPSV

SEQ ID NO: 1116808 - protein, 9 aa, Homo Sapiens
FKIRKIPDC

SEQ ID NO: 1116809 - protein, 9 aa, Homo Sapiens
TWRRTGAST

SEQ ID NO: 1116810 - protein, 9 aa, Homo Sapiens
PPPRHPWPP

SEQ ID NO: 1116811 - protein, 9 aa, Homo Sapiens
PRILLLCGQ

SEQ ID NO: 1116812 - protein, 9 aa, Homo Sapiens
KVMSGGGPS

SEQ ID NO: 1116813 - protein, 9 aa, Homo Sapiens
VIHVGMALH

SEQ ID NO: 1116814 - protein, 9 aa, Homo Sapiens
RRIHLKLRN

SEQ ID NO: 1116815 - protein, 9 aa, Homo Sapiens
VQDLSRISD

SEQ ID NO: 1116816 - protein, 9 aa, Homo Sapiens
ACSRNSLPP

SEQ ID NO: 1116817 - protein, 9 aa, Homo Sapiens
GQVLHASCD

SEQ ID NO: 1116818 - protein, 9 aa, Homo Sapiens
SEAKGKDLF

SEQ ID NO: 1116819 - protein, 9 aa, Homo Sapiens
AFGHTSTLI

SEQ ID NO: 1116820 - protein, 9 aa, Homo Sapiens
LEFSRLRFW

SEQ ID NO: 1116821 - protein, 9 aa, Homo Sapiens
LKYATEKRQ

SEQ ID NO: 1116822 - protein, 9 aa, Homo Sapiens
HKNREAFQT

SEQ ID NO: 1116823 - protein, 9 aa, Homo Sapiens
PLDSNLSED

SEQ ID NO: 1116824 - protein, 9 aa, Homo Sapiens
KHQKSGRVL

SEQ ID NO: 1116825 - protein, 9 aa, Homo Sapiens
PTHPLCTVA

SEQ ID NO: 1116826 - protein, 9 aa, Homo Sapiens
HRIKCRVHP

SEQ ID NO: 1116827 - protein, 9 aa, Homo Sapiens
NMVDPGVVN

SEQ ID NO: 1116828 - protein, 9 aa, Homo Sapiens
SAKSESSAL

SEQ ID NO: 1116829 - protein, 9 aa, Homo Sapiens
GREPCAAPC

SEQ ID NO: 1116830 - protein, 9 aa, Homo Sapiens
LWLREGPSK

SEQ ID NO: 1116831 - protein, 9 aa, Homo Sapiens
NLSEDEDLQ

SEQ ID NO: 1116832 - protein, 9 aa, Homo Sapiens
PKVQADVEK

SEQ ID NO: 1116833 - protein, 9 aa, Homo Sapiens
DELQRLQNS

SEQ ID NO: 1116834 - protein, 9 aa, Homo Sapiens
SLMKMDDAT

SEQ ID NO: 1116835 - protein, 9 aa, Homo Sapiens
YFPRKPCSA

SEQ ID NO: 1116836 - protein, 9 aa, Homo Sapiens
STRRCPSPS

SEQ ID NO: 1116837 - protein, 9 aa, Homo Sapiens
EPEIKICLK

SEQ ID NO: 1116838 - protein, 9 aa, Homo Sapiens
GTVEWTQDS

SEQ ID NO: 1116839 - protein, 9 aa, Homo Sapiens
HENVEAAQT

SEQ ID NO: 1116840 - protein, 9 aa, Homo Sapiens
PEKVQAMAL

SEQ ID NO: 1116841 - protein, 9 aa, Homo Sapiens
NCLPPLPRR

SEQ ID NO: 1116842 - protein, 9 aa, Homo Sapiens
SGPTHASGN

SEQ ID NO: 1116843 - protein, 9 aa, Homo Sapiens
HYQAWVAEQ

SEQ ID NO: 1116844 - protein, 9 aa, Homo Sapiens
RLYYTVKLR

SEQ ID NO: 1116845 - protein, 9 aa, Homo Sapiens
LDWQVYFTE

SEQ ID NO: 1116846 - protein, 9 aa, Homo Sapiens
DVRQVIKLD

SEQ ID NO: 1116847 - protein, 9 aa, Homo Sapiens
TQGSRPAAG

SEQ ID NO: 1116848 - protein, 9 aa, Homo Sapiens
SRQRVVMCC

SEQ ID NO: 1116849 - protein, 9 aa, Homo Sapiens
TAKKPAVTT

SEQ ID NO: 1116850 - protein, 9 aa, Homo Sapiens
VRNHRIFEK

SEQ ID NO: 1116851 - protein, 9 aa, Homo Sapiens
ASVAPATLP

SEQ ID NO: 1116852 - protein, 9 aa, Homo Sapiens
SSRSRCAYA

SEQ ID NO: 1116853 - protein, 9 aa, Homo Sapiens
MMVDGKPVN

SEQ ID NO: 1116854 - protein, 9 aa, Homo Sapiens
WVRRPGRHI

SEQ ID NO: 1116855 - protein, 9 aa, Homo Sapiens
MKTPTVCGV

SEQ ID NO: 1116856 - protein, 9 aa, Homo Sapiens
DCTIPPMEK

SEQ ID NO: 1116857 - protein, 9 aa, Homo Sapiens
HKDIVSSSM

SEQ ID NO: 1116858 - protein, 9 aa, Homo Sapiens
AIKHKLCRR

SEQ ID NO: 1116859 - protein, 9 aa, Homo Sapiens
FNESDLCIS

SEQ ID NO: 1116860 - protein, 9 aa, Homo Sapiens
RRRTKKTSS

SEQ ID NO: 1116861 - protein, 9 aa, Homo Sapiens
HSHVEARED

SEQ ID NO: 1116862 - protein, 9 aa, Homo Sapiens
SRYEYLSHM

SEQ ID NO: 1116863 - protein, 9 aa, Homo Sapiens
SPFPPTPMD

SEQ ID NO: 1116864 - protein, 9 aa, Homo Sapiens
HHRDLRSAL

SEQ ID NO: 1116865 - protein, 9 aa, Homo Sapiens
CLGSAWSLS

SEQ ID NO: 1116866 - protein, 9 aa, Homo Sapiens
STSSSLEPT

SEQ ID NO: 1116867 - protein, 9 aa, Homo Sapiens
GTPLPWANS

SEQ ID NO: 1116868 - protein, 9 aa, Homo Sapiens
KTTLPGLFV

SEQ ID NO: 1116869 - protein, 9 aa, Homo Sapiens
PASPSAPTS

SEQ ID NO: 1116870 - protein, 9 aa, Homo Sapiens
TANVASRMD

SEQ ID NO: 1116871 - protein, 9 aa, Homo Sapiens
SSATQFRWN

SEQ ID NO: 1116872 - protein, 9 aa, Homo Sapiens
KTFTMSMKR

SEQ ID NO: 1116873 - protein, 9 aa, Homo Sapiens
QSSAPGSRD

SEQ ID NO: 1116874 - protein, 9 aa, Homo Sapiens
RAAVSTPPA

SEQ ID NO: 1116875 - protein, 9 aa, Homo Sapiens
VGPLGFTGP

SEQ ID NO: 1116876 - protein, 9 aa, Homo Sapiens
NPEKNQRLQ

SEQ ID NO: 1116877 - protein, 9 aa, Homo Sapiens
SQMPPLPQT

SEQ ID NO: 1116878 - protein, 9 aa, Homo Sapiens
RGPSWRVRK

SEQ ID NO: 1116879 - protein, 9 aa, Homo Sapiens
YSKVTPPEE

SEQ ID NO: 1116880 - protein, 9 aa, Homo Sapiens
DHLGLILFS

SEQ ID NO: 1116881 - protein, 9 aa, Homo Sapiens
LIIGGGVAG

SEQ ID NO: 1116882 - protein, 9 aa, Homo Sapiens
NARDAKEKC

SEQ ID NO: 1116883 - protein, 9 aa, Homo Sapiens
QGLCDLLWS

SEQ ID NO: 1116884 - protein, 9 aa, Homo Sapiens
VDGSSQPDT

SEQ ID NO: 1116885 - protein, 9 aa, Homo Sapiens
QPFCGNNFE

SEQ ID NO: 1116886 - protein, 9 aa, Homo Sapiens
RTQGHWHRL

SEQ ID NO: 1116887 - protein, 9 aa, Homo Sapiens
PEAPLEGTP

SEQ ID NO: 1116888 - protein, 9 aa, Homo Sapiens
MSRRRHSDK

SEQ ID NO: 1116889 - protein, 9 aa, Homo Sapiens
LKMLCFLSM

SEQ ID NO: 1116890 - protein, 9 aa, Homo Sapiens
AVQPLKKMS

SEQ ID NO: 1116891 - protein, 9 aa, Homo Sapiens
PELTQMFDA

SEQ ID NO: 1116892 - protein, 9 aa, Homo Sapiens
KTESHKAKG

SEQ ID NO: 1116893 - protein, 9 aa, Homo Sapiens
ERLPDVGGG

SEQ ID NO: 1116894 - protein, 9 aa, Homo Sapiens
RTRGTLHTT

SEQ ID NO: 1116895 - protein, 9 aa, Homo Sapiens
SVVSGPRVS

SEQ ID NO: 1116896 - protein, 9 aa, Homo Sapiens
HLHTHYVIA

SEQ ID NO: 1116897 - protein, 9 aa, Homo Sapiens
GPLGFTGPP

SEQ ID NO: 1116898 - protein, 9 aa, Homo Sapiens
SLTQMSAGN

SEQ ID NO: 1116899 - protein, 9 aa, Homo Sapiens
LPHKSGSLS

SEQ ID NO: 1116900 - protein, 9 aa, Homo Sapiens
YNNREHIFS

SEQ ID NO: 1116901 - protein, 9 aa, Homo Sapiens
DADHGWAFS

SEQ ID NO: 1116902 - protein, 9 aa, Homo Sapiens
VPRCAMAPE

SEQ ID NO: 1116903 - protein, 9 aa, Homo Sapiens
GISTAVSIP

SEQ ID NO: 1116904 - protein, 9 aa, Homo Sapiens
CVPTAARPS

SEQ ID NO: 1116905 - protein, 9 aa, Homo Sapiens
TTPRWRTFT

SEQ ID NO: 1116906 - protein, 9 aa, Homo Sapiens
SAGGPCPSA

SEQ ID NO: 1116907 - protein, 9 aa, Homo Sapiens
YCNAHYLKQ

SEQ ID NO: 1116908 - protein, 9 aa, Homo Sapiens
NDVQSIKKT

SEQ ID NO: 1116909 - protein, 9 aa, Homo Sapiens
ARPARTRGA

SEQ ID NO: 1116910 - protein, 9 aa, Homo Sapiens
GAPLDNSTD

SEQ ID NO: 1116911 - protein, 9 aa, Homo Sapiens
AGHEPICDP

SEQ ID NO: 1116912 - protein, 9 aa, Homo Sapiens
VHTIPLRSS

SEQ ID NO: 1116913 - protein, 9 aa, Homo Sapiens
RHFHTFRSA

SEQ ID NO: 1116914 - protein, 9 aa, Homo Sapiens
YEDDSSQEV

SEQ ID NO: 1116915 - protein, 9 aa, Homo Sapiens
YYTVKLRRF

SEQ ID NO: 1116916 - protein, 9 aa, Homo Sapiens
KNPQVVPAA

SEQ ID NO: 1116917 - protein, 9 aa, Homo Sapiens
PLKGPWRTT

SEQ ID NO: 1116918 - protein, 9 aa, Homo Sapiens
SGASGGTAS

SEQ ID NO: 1116919 - protein, 9 aa, Homo Sapiens
SAQGPEEGD

SEQ ID NO: 1116920 - protein, 9 aa, Homo Sapiens
PADRFKTNR

SEQ ID NO: 1116921 - protein, 9 aa, Homo Sapiens
DGRSVRLWS

SEQ ID NO: 1116922 - protein, 9 aa, Homo Sapiens
SPRSFTDTI

SEQ ID NO: 1116923 - protein, 9 aa, Homo Sapiens
LSEEQIQKK

SEQ ID NO: 1116924 - protein, 9 aa, Homo Sapiens
FHLFSLHVL

SEQ ID NO: 1116925 - protein, 9 aa, Homo Sapiens
SVEHRDNLV

SEQ ID NO: 1116926 - protein, 9 aa, Homo Sapiens
PPYLPVTVA

SEQ ID NO: 1116927 - protein, 9 aa, Homo Sapiens
FDPSRHRDY

SEQ ID NO: 1116928 - protein, 9 aa, Homo Sapiens
LLGNFLCLS

SEQ ID NO: 1116929 - protein, 9 aa, Homo Sapiens
KTSVEEMFA

SEQ ID NO: 1116930 - protein, 9 aa, Homo Sapiens
GLMTAAATR

SEQ ID NO: 1116931 - protein, 9 aa, Homo Sapiens
SCPSPWWRS

SEQ ID NO: 1116932 - protein, 9 aa, Homo Sapiens
NRATCYFTM

SEQ ID NO: 1116933 - protein, 9 aa, Homo Sapiens
DSLLYVIRT

SEQ ID NO: 1116934 - protein, 9 aa, Homo Sapiens
RVQRERNPK

SEQ ID NO: 1116935 - protein, 9 aa, Homo Sapiens
WLISGGWCS

SEQ ID NO: 1116936 - protein, 9 aa, Homo Sapiens
VAAQPGQQQ

SEQ ID NO: 1116937 - protein, 9 aa, Homo Sapiens
SASPVPSGM

SEQ ID NO: 1116938 - protein, 9 aa, Homo Sapiens
YTEMALPFS

SEQ ID NO: 1116939 - protein, 9 aa, Homo Sapiens
GRLDLGVHG

SEQ ID NO: 1116940 - protein, 9 aa, Homo Sapiens
EQLGGCWPM

SEQ ID NO: 1116941 - protein, 9 aa, Homo Sapiens
CQVPRTDAH

SEQ ID NO: 1116942 - protein, 9 aa, Homo Sapiens
TNVELSLGC

SEQ ID NO: 1116943 - protein, 9 aa, Homo Sapiens
KKNPSMKSF

SEQ ID NO: 1116944 - protein, 9 aa, Homo Sapiens
DRAFQGATV

SEQ ID NO: 1116945 - protein, 9 aa, Homo Sapiens
DGEGEGASE

SEQ ID NO: 1116946 - protein, 9 aa, Homo Sapiens
AVSVPDSLL

SEQ ID NO: 1116947 - protein, 9 aa, Homo Sapiens
CAKLVRDAF

SEQ ID NO: 1116948 - protein, 9 aa, Homo Sapiens
YTVANEAML

SEQ ID NO: 1116949 - protein, 9 aa, Homo Sapiens
AHRERPLRL

SEQ ID NO: 1116950 - protein, 9 aa, Homo Sapiens
HSVYGPLWS

SEQ ID NO: 1116951 - protein, 9 aa, Homo Sapiens
GGSGGGSTR

SEQ ID NO: 1116952 - protein, 9 aa, Homo Sapiens
NELYEPIWQ

SEQ ID NO: 1116953 - protein, 9 aa, Homo Sapiens
TIRMSSDAF

SEQ ID NO: 1116954 - protein, 9 aa, Homo Sapiens
VVEYRAISF

SEQ ID NO: 1116955 - protein, 9 aa, Homo Sapiens
QVLKVCVNH

SEQ ID NO: 1116956 - protein, 9 aa, Homo Sapiens
QQAETRPER

SEQ ID NO: 1116957 - protein, 9 aa, Homo Sapiens
SWKNRKEES

SEQ ID NO: 1116958 - protein, 9 aa, Homo Sapiens
KAFSPDLTE

SEQ ID NO: 1116959 - protein, 9 aa, Homo Sapiens
RAAGVRMGC

SEQ ID NO: 1116960 - protein, 9 aa, Homo Sapiens
SEWGLVVCK

SEQ ID NO: 1116961 - protein, 9 aa, Homo Sapiens
LTDKKAPGS

SEQ ID NO: 1116962 - protein, 9 aa, Homo Sapiens
TSFTLQPGG

SEQ ID NO: 1116963 - protein, 9 aa, Homo Sapiens
SKQQGVPQV

SEQ ID NO: 1116964 - protein, 9 aa, Homo Sapiens
TLLWGTWCS

SEQ ID NO: 1116965 - protein, 9 aa, Homo Sapiens
RVFKELPVN

SEQ ID NO: 1116966 - protein, 9 aa, Homo Sapiens
IPLARKWHL

SEQ ID NO: 1116967 - protein, 9 aa, Homo Sapiens
SQVAMCTPP

SEQ ID NO: 1116968 - protein, 9 aa, Homo Sapiens
EWHTAFVNI

SEQ ID NO: 1116969 - protein, 9 aa, Homo Sapiens
LLERGYRHP

SEQ ID NO: 1116970 - protein, 9 aa, Homo Sapiens
FDYSLMNSR

SEQ ID NO: 1116971 - protein, 9 aa, Homo Sapiens
VLVRFVVED

SEQ ID NO: 1116972 - protein, 9 aa, Homo Sapiens
IVGHGHEAE

SEQ ID NO: 1116973 - protein, 9 aa, Homo Sapiens
KSIVIGPLD

SEQ ID NO: 1116974 - protein, 9 aa, Homo Sapiens
VFICVVMAI

SEQ ID NO: 1116975 - protein, 9 aa, Homo Sapiens
GVPPLVLNS

SEQ ID NO: 1116976 - protein, 9 aa, Homo Sapiens
PLWLMTAMW

SEQ ID NO: 1116977 - protein, 9 aa, Homo Sapiens
EVFCSSPQE

SEQ ID NO: 1116978 - protein, 9 aa, Homo Sapiens
HRSHSKSPK

SEQ ID NO: 1116979 - protein, 9 aa, Homo Sapiens
RGSLAIFCW

SEQ ID NO: 1116980 - protein, 9 aa, Homo Sapiens
WSTFLKAQL

SEQ ID NO: 1116981 - protein, 9 aa, Homo Sapiens
KTLLGRCIT

SEQ ID NO: 1116982 - protein, 9 aa, Homo Sapiens
FLSGEPTEE

SEQ ID NO: 1116983 - protein, 9 aa, Homo Sapiens
QSVEVPGNH

SEQ ID NO: 1116984 - protein, 9 aa, Homo Sapiens
QPAPKLEPS

SEQ ID NO: 1116985 - protein, 9 aa, Homo Sapiens
TMTTRTSLP

SEQ ID NO: 1116986 - protein, 9 aa, Homo Sapiens
YAAPKVPEA

SEQ ID NO: 1116987 - protein, 9 aa, Homo Sapiens
ETKRKLRKE

SEQ ID NO: 1116988 - protein, 9 aa, Homo Sapiens
LQNIMAQED

SEQ ID NO: 1116989 - protein, 9 aa, Homo Sapiens
AASAPCWAP

SEQ ID NO: 1116990 - protein, 9 aa, Homo Sapiens
FIILTLNSI

SEQ ID NO: 1116991 - protein, 9 aa, Homo Sapiens
GAISRIHLN

SEQ ID NO: 1116992 - protein, 9 aa, Homo Sapiens
QQQQQEEVE

SEQ ID NO: 1116993 - protein, 9 aa, Homo Sapiens
LPGSSATVQ

SEQ ID NO: 1116994 - protein, 9 aa, Homo Sapiens
PALTCARAW

SEQ ID NO: 1116995 - protein, 9 aa, Homo Sapiens
PDLLLGKNK

SEQ ID NO: 1116996 - protein, 9 aa, Homo Sapiens
SFIPHEVKL

SEQ ID NO: 1116997 - protein, 9 aa, Homo Sapiens
CAGAEGRGT

SEQ ID NO: 1116998 - protein, 9 aa, Homo Sapiens
ETAFVFVIT

SEQ ID NO: 1116999 - protein, 9 aa, Homo Sapiens
TIPHACDPN

SEQ ID NO: 1117000 - protein, 9 aa, Homo Sapiens
QRDKHLRTT

SEQ ID NO: 1117001 - protein, 9 aa, Homo Sapiens
QHLRPAGTL

SEQ ID NO: 1117002 - protein, 9 aa, Homo Sapiens
GDLKDQKQK

SEQ ID NO: 1117003 - protein, 9 aa, Homo Sapiens
RALRRLRGG

SEQ ID NO: 1117004 - protein, 9 aa, Homo Sapiens
VTALKGRIT

SEQ ID NO: 1117005 - protein, 9 aa, Homo Sapiens
PSQQAETRP

SEQ ID NO: 1117006 - protein, 9 aa, Homo Sapiens
GAPPSRNSG

SEQ ID NO: 1117007 - protein, 9 aa, Homo Sapiens
FSRSRTFLD

SEQ ID NO: 1117008 - protein, 9 aa, Homo Sapiens
RHGWNPRDC

SEQ ID NO: 1117009 - protein, 9 aa, Homo Sapiens
SERRYHQIT

SEQ ID NO: 1117010 - protein, 9 aa, Homo Sapiens
RVIGMPHLC

SEQ ID NO: 1117011 - protein, 9 aa, Homo Sapiens
SRGQAQDTS

SEQ ID NO: 1117012 - protein, 9 aa, Homo Sapiens
MLSSQPPLT

SEQ ID NO: 1117013 - protein, 9 aa, Homo Sapiens
QSSFCLRDE

SEQ ID NO: 1117014 - protein, 9 aa, Homo Sapiens
QNTLAAPMG

SEQ ID NO: 1117015 - protein, 9 aa, Homo Sapiens
VEAGGSHVG

SEQ ID NO: 1117016 - protein, 9 aa, Homo Sapiens
SCDAPQHAH

SEQ ID NO: 1117017 - protein, 9 aa, Homo Sapiens
WNHHHFQHH

SEQ ID NO: 1117018 - protein, 9 aa, Homo Sapiens
AYRDSIRAP

SEQ ID NO: 1117019 - protein, 9 aa, Homo Sapiens
KPKNRTVAG

SEQ ID NO: 1117020 - protein, 9 aa, Homo Sapiens
LTGSWEWQR

SEQ ID NO: 1117021 - protein, 9 aa, Homo Sapiens
GARSHQGAL

SEQ ID NO: 1117022 - protein, 9 aa, Homo Sapiens
TIKLTPGLS

SEQ ID NO: 1117023 - protein, 9 aa, Homo Sapiens
MVYSGGRYD

SEQ ID NO: 1117024 - protein, 9 aa, Homo Sapiens
MWTHGWPMS

SEQ ID NO: 1117025 - protein, 9 aa, Homo Sapiens
LTSGGECLM

SEQ ID NO: 1117026 - protein, 9 aa, Homo Sapiens
VATTPGILP

SEQ ID NO: 1117027 - protein, 9 aa, Homo Sapiens
NHHHFQHHA

SEQ ID NO: 1117028 - protein, 9 aa, Homo Sapiens
LLEVSLRND

SEQ ID NO: 1117029 - protein, 9 aa, Homo Sapiens
QLEISTQLC

SEQ ID NO: 1117030 - protein, 9 aa, Homo Sapiens
LFSPFAGCV

SEQ ID NO: 1117031 - protein, 9 aa, Homo Sapiens
LPESYFINN

SEQ ID NO: 1117032 - protein, 9 aa, Homo Sapiens
VVHNIYVWD

SEQ ID NO: 1117033 - protein, 9 aa, Homo Sapiens
QLPVSPSCP

SEQ ID NO: 1117034 - protein, 9 aa, Homo Sapiens
WKHCETLGV

SEQ ID NO: 1117035 - protein, 9 aa, Homo Sapiens
DCSIEICTA

SEQ ID NO: 1117036 - protein, 9 aa, Homo Sapiens
LTVLGVRSQ

SEQ ID NO: 1117037 - protein, 9 aa, Homo Sapiens
AHLIHSINP

SEQ ID NO: 1117038 - protein, 9 aa, Homo Sapiens
MTVPAHRSI

SEQ ID NO: 1117039 - protein, 9 aa, Homo Sapiens
LSSHGSDSE

SEQ ID NO: 1117040 - protein, 9 aa, Homo Sapiens
NHRIFEKDS

SEQ ID NO: 1117041 - protein, 9 aa, Homo Sapiens
ILAGLTDYP

SEQ ID NO: 1117042 - protein, 9 aa, Homo Sapiens
FCRYCNELR

SEQ ID NO: 1117043 - protein, 9 aa, Homo Sapiens
WYMGYDAFL

SEQ ID NO: 1117044 - protein, 9 aa, Homo Sapiens
VTIDGRSYI

SEQ ID NO: 1117045 - protein, 9 aa, Homo Sapiens
RTHAGSTMP

SEQ ID NO: 1117046 - protein, 9 aa, Homo Sapiens
QPPDQWCPD

SEQ ID NO: 1117047 - protein, 9 aa, Homo Sapiens
LGLFLNSTF

SEQ ID NO: 1117048 - protein, 9 aa, Homo Sapiens
DPIEAPPPS

SEQ ID NO: 1117049 - protein, 9 aa, Homo Sapiens
EDLDGILRK

SEQ ID NO: 1117050 - protein, 9 aa, Homo Sapiens
KQPVIVPMH

SEQ ID NO: 1117051 - protein, 9 aa, Homo Sapiens
VLLIFIYLP

SEQ ID NO: 1117052 - protein, 9 aa, Homo Sapiens
LTNVELSLG

SEQ ID NO: 1117053 - protein, 9 aa, Homo Sapiens
DKVIIITRD

SEQ ID NO: 1117054 - protein, 9 aa, Homo Sapiens
GQRATRHGP

SEQ ID NO: 1117055 - protein, 9 aa, Homo Sapiens
NIDARKNSM

SEQ ID NO: 1117056 - protein, 9 aa, Homo Sapiens
PAVPRATTK

SEQ ID NO: 1117057 - protein, 9 aa, Homo Sapiens
YEDTIRLYE

SEQ ID NO: 1117058 - protein, 9 aa, Homo Sapiens
HAEREKYVQ

SEQ ID NO: 1117059 - protein, 9 aa, Homo Sapiens
ICHSCQQPI

SEQ ID NO: 1117060 - protein, 9 aa, Homo Sapiens
DIETVHGSV

SEQ ID NO: 1117061 - protein, 9 aa, Homo Sapiens
KKNYCTKPQ

SEQ ID NO: 1117062 - protein, 9 aa, Homo Sapiens
QAWLALAAV

SEQ ID NO: 1117063 - protein, 9 aa, Homo Sapiens
HGEGEGPGK

SEQ ID NO: 1117064 - protein, 9 aa, Homo Sapiens
RLSIQERRR

SEQ ID NO: 1117065 - protein, 9 aa, Homo Sapiens
EGVLIDVLH

SEQ ID NO: 1117066 - protein, 9 aa, Homo Sapiens
LNHRTEMKE

SEQ ID NO: 1117067 - protein, 9 aa, Homo Sapiens
VGGAEGIDR

SEQ ID NO: 1117068 - protein, 9 aa, Homo Sapiens
KGRVGGHWK

SEQ ID NO: 1117069 - protein, 9 aa, Homo Sapiens
DVATPACIG

SEQ ID NO: 1117070 - protein, 9 aa, Homo Sapiens
RCENNSPSN

SEQ ID NO: 1117071 - protein, 9 aa, Homo Sapiens
RWKPATPSP

SEQ ID NO: 1117072 - protein, 9 aa, Homo Sapiens
ITNELLQIE

SEQ ID NO: 1117073 - protein, 9 aa, Homo Sapiens
EPRPLAQSP

SEQ ID NO: 1117074 - protein, 9 aa, Homo Sapiens
ANFLCLWMA

SEQ ID NO: 1117075 - protein, 9 aa, Homo Sapiens
TAVTMGFGD

SEQ ID NO: 1117076 - protein, 9 aa, Homo Sapiens
SGISAQPSS

SEQ ID NO: 1117077 - protein, 9 aa, Homo Sapiens
WIISIYVGR

SEQ ID NO: 1117078 - protein, 9 aa, Homo Sapiens
LRCKLATFY

SEQ ID NO: 1117079 - protein, 9 aa, Homo Sapiens
PQCLIVRLQ

SEQ ID NO: 1117080 - protein, 9 aa, Homo Sapiens
GDLMHFCWL

SEQ ID NO: 1117081 - protein, 9 aa, Homo Sapiens
WSGCSRSLA

SEQ ID NO: 1117082 - protein, 9 aa, Homo Sapiens
AKGPKGGEG

SEQ ID NO: 1117083 - protein, 9 aa, Homo Sapiens
FSLTHVMGK

SEQ ID NO: 1117084 - protein, 9 aa, Homo Sapiens
PTVDKIHER

SEQ ID NO: 1117085 - protein, 9 aa, Homo Sapiens
QCSNLIAHN

SEQ ID NO: 1117086 - protein, 9 aa, Homo Sapiens
GGPRAKKPC

SEQ ID NO: 1117087 - protein, 9 aa, Homo Sapiens
HSSSDFFYS

SEQ ID NO: 1117088 - protein, 9 aa, Homo Sapiens
EAQENGIYS

SEQ ID NO: 1117089 - protein, 9 aa, Homo Sapiens
ERVPEIISF

SEQ ID NO: 1117090 - protein, 9 aa, Homo Sapiens
TKSPAALKV

SEQ ID NO: 1117091 - protein, 9 aa, Homo Sapiens
SEAGVPGSA

SEQ ID NO: 1117092 - protein, 9 aa, Homo Sapiens
IQEPGPLRE

SEQ ID NO: 1117093 - protein, 9 aa, Homo Sapiens
SRTRALMEC

SEQ ID NO: 1117094 - protein, 9 aa, Homo Sapiens
HLRELCLRE

SEQ ID NO: 1117095 - protein, 9 aa, Homo Sapiens
LEDEEHYAE

SEQ ID NO: 1117096 - protein, 9 aa, Homo Sapiens
PQRDKHLRT

SEQ ID NO: 1117097 - protein, 9 aa, Homo Sapiens
QQQQQQSQQ

SEQ ID NO: 1117098 - protein, 9 aa, Homo Sapiens
RLHVAAMQM

SEQ ID NO: 1117099 - protein, 9 aa, Homo Sapiens
QKKMKVSQS

SEQ ID NO: 1117100 - protein, 9 aa, Homo Sapiens
KPGVQYREL

SEQ ID NO: 1117101 - protein, 9 aa, Homo Sapiens
QQSLERVLE

SEQ ID NO: 1117102 - protein, 9 aa, Homo Sapiens
LPDLQPQRN

SEQ ID NO: 1117103 - protein, 9 aa, Homo Sapiens
GTTQLPVVE

SEQ ID NO: 1117104 - protein, 9 aa, Homo Sapiens
PNVCHLSTK

SEQ ID NO: 1117105 - protein, 9 aa, Homo Sapiens
ESGPCCCWG

SEQ ID NO: 1117106 - protein, 9 aa, Homo Sapiens
AQTYVMRYF

SEQ ID NO: 1117107 - protein, 9 aa, Homo Sapiens
FWRPPSPSV

SEQ ID NO: 1117108 - protein, 9 aa, Homo Sapiens
EYTAFPSRR

SEQ ID NO: 1117109 - protein, 9 aa, Homo Sapiens
LQQARGRVN

SEQ ID NO: 1117110 - protein, 9 aa, Homo Sapiens
LVYSNGKDD

SEQ ID NO: 1117111 - protein, 9 aa, Homo Sapiens
GPCASLLST

SEQ ID NO: 1117112 - protein, 9 aa, Homo Sapiens
PIKHKKELT

SEQ ID NO: 1117113 - protein, 9 aa, Homo Sapiens
CENIITYDD

SEQ ID NO: 1117114 - protein, 9 aa, Homo Sapiens
HHQRRAGRH

SEQ ID NO: 1117115 - protein, 9 aa, Homo Sapiens
ADISTVIMD

SEQ ID NO: 1117116 - protein, 9 aa, Homo Sapiens
GVEADNLPT

SEQ ID NO: 1117117 - protein, 9 aa, Homo Sapiens
SRGARGAKV

SEQ ID NO: 1117118 - protein, 9 aa, Homo Sapiens
MQSLYIEEI

SEQ ID NO: 1117119 - protein, 9 aa, Homo Sapiens
TRISVLVPG

SEQ ID NO: 1117120 - protein, 9 aa, Homo Sapiens
ASRGMAGPL

SEQ ID NO: 1117121 - protein, 9 aa, Homo Sapiens
SIAKYNIIT

SEQ ID NO: 1117122 - protein, 9 aa, Homo Sapiens
TPPIGPSCV

SEQ ID NO: 1117123 - protein, 9 aa, Homo Sapiens
KYTFNKIRL

SEQ ID NO: 1117124 - protein, 9 aa, Homo Sapiens
FISLPRSMD

SEQ ID NO: 1117125 - protein, 9 aa, Homo Sapiens
EENDTDEET

SEQ ID NO: 1117126 - protein, 9 aa, Homo Sapiens
YDEETKRKL

SEQ ID NO: 1117127 - protein, 9 aa, Homo Sapiens
CSKVKSSKS

SEQ ID NO: 1117128 - protein, 9 aa, Homo Sapiens
SPDMGGAIT

SEQ ID NO: 1117129 - protein, 9 aa, Homo Sapiens
ATNVEKHYE

SEQ ID NO: 1117130 - protein, 9 aa, Homo Sapiens
VPDQGLCDL

SEQ ID NO: 1117131 - protein, 9 aa, Homo Sapiens
VQLLSRAAA

SEQ ID NO: 1117132 - protein, 9 aa, Homo Sapiens
LPLLNRPCK

SEQ ID NO: 1117133 - protein, 9 aa, Homo Sapiens
LILSEKLFD

SEQ ID NO: 1117134 - protein, 9 aa, Homo Sapiens
ERGPPSHCQ

SEQ ID NO: 1117135 - protein, 9 aa, Homo Sapiens
NSTDHIEQE

SEQ ID NO: 1117136 - protein, 9 aa, Homo Sapiens
HMVCRTTLS

SEQ ID NO: 1117137 - protein, 9 aa, Homo Sapiens
EEWYNDSVE

SEQ ID NO: 1117138 - protein, 9 aa, Homo Sapiens
VPTLLLLAV

SEQ ID NO: 1117139 - protein, 9 aa, Homo Sapiens
KLPHGMSPA

SEQ ID NO: 1117140 - protein, 9 aa, Homo Sapiens
ALAQAIAVQ

SEQ ID NO: 1117141 - protein, 9 aa, Homo Sapiens
TGTRREAPA

SEQ ID NO: 1117142 - protein, 9 aa, Homo Sapiens
ITDGCHDPR

SEQ ID NO: 1117143 - protein, 9 aa, Homo Sapiens
NLVVVEGVH

SEQ ID NO: 1117144 - protein, 9 aa, Homo Sapiens
APPNSYAQH

SEQ ID NO: 1117145 - protein, 9 aa, Homo Sapiens
VKGFYCVEC

SEQ ID NO: 1117146 - protein, 9 aa, Homo Sapiens
SSSPAPRGR

SEQ ID NO: 1117147 - protein, 9 aa, Homo Sapiens
AFVTFDDHE

SEQ ID NO: 1117148 - protein, 9 aa, Homo Sapiens
PAAYAESAR

SEQ ID NO: 1117149 - protein, 9 aa, Homo Sapiens
AAAAASTSS

SEQ ID NO: 1117150 - protein, 9 aa, Homo Sapiens
GIWEVMPRT

SEQ ID NO: 1117151 - protein, 9 aa, Homo Sapiens
TPVVTVPPQ

SEQ ID NO: 1117152 - protein, 9 aa, Homo Sapiens
GRMLKLESY

SEQ ID NO: 1117153 - protein, 9 aa, Homo Sapiens
LPLPPLPAP

SEQ ID NO: 1117154 - protein, 9 aa, Homo Sapiens
AVKKKFMAD

SEQ ID NO: 1117155 - protein, 9 aa, Homo Sapiens
HTVPEPEGS

SEQ ID NO: 1117156 - protein, 9 aa, Homo Sapiens
KVAFHLDFE

SEQ ID NO: 1117157 - protein, 9 aa, Homo Sapiens
EGVKSENKQ

SEQ ID NO: 1117158 - protein, 9 aa, Homo Sapiens
CTPGKPTLV

SEQ ID NO: 1117159 - protein, 9 aa, Homo Sapiens
KVCPVCQVP

SEQ ID NO: 1117160 - protein, 9 aa, Homo Sapiens
LRPWARPAR

SEQ ID NO: 1117161 - protein, 9 aa, Homo Sapiens
GCEQDIDDC

SEQ ID NO: 1117162 - protein, 9 aa, Homo Sapiens
SASKSVLEL

SEQ ID NO: 1117163 - protein, 9 aa, Homo Sapiens
TKHARQHTE

SEQ ID NO: 1117164 - protein, 9 aa, Homo Sapiens
LQVASSRTG

SEQ ID NO: 1117165 - protein, 9 aa, Homo Sapiens
IVRSSPTWL

SEQ ID NO: 1117166 - protein, 9 aa, Homo Sapiens
GTASQSENL

SEQ ID NO: 1117167 - protein, 9 aa, Homo Sapiens
PEDKAEQRA

SEQ ID NO: 1117168 - protein, 9 aa, Homo Sapiens
PSAPAMGTG

SEQ ID NO: 1117169 - protein, 9 aa, Homo Sapiens
LSRTSWRTL

SEQ ID NO: 1117170 - protein, 9 aa, Homo Sapiens
VFGQHGILP

SEQ ID NO: 1117171 - protein, 9 aa, Homo Sapiens
QYIRKSPKG

SEQ ID NO: 1117172 - protein, 9 aa, Homo Sapiens
QIVQTYLTV

SEQ ID NO: 1117173 - protein, 9 aa, Homo Sapiens
FTEFCNGTS

SEQ ID NO: 1117174 - protein, 9 aa, Homo Sapiens
LTIIESEMG

SEQ ID NO: 1117175 - protein, 9 aa, Homo Sapiens
VTVRLCRRS

SEQ ID NO: 1117176 - protein, 9 aa, Homo Sapiens
TDKKAPGSE

SEQ ID NO: 1117177 - protein, 9 aa, Homo Sapiens
TKLKGPSEY

SEQ ID NO: 1117178 - protein, 9 aa, Homo Sapiens
TVDDDYSRA

SEQ ID NO: 1117179 - protein, 9 aa, Homo Sapiens
PPRTCCHRT

SEQ ID NO: 1117180 - protein, 9 aa, Homo Sapiens
GQEEPPLMD

SEQ ID NO: 1117181 - protein, 9 aa, Homo Sapiens
QKQRLERTL

SEQ ID NO: 1117182 - protein, 9 aa, Homo Sapiens
LWGTTQLPV

SEQ ID NO: 1117183 - protein, 9 aa, Homo Sapiens
GLEGDLQHA

SEQ ID NO: 1117184 - protein, 9 aa, Homo Sapiens
EGPGKHGAQ

SEQ ID NO: 1117185 - protein, 9 aa, Homo Sapiens
AAPSPGRNS

SEQ ID NO: 1117186 - protein, 9 aa, Homo Sapiens
PHTRLSPGP

SEQ ID NO: 1117187 - protein, 9 aa, Homo Sapiens
APQMYTYPV

SEQ ID NO: 1117188 - protein, 9 aa, Homo Sapiens
QLDASIHVT

SEQ ID NO: 1117189 - protein, 9 aa, Homo Sapiens
AGYCRCVLT

SEQ ID NO: 1117190 - protein, 9 aa, Homo Sapiens
GTTRQQRSS

SEQ ID NO: 1117191 - protein, 9 aa, Homo Sapiens
GHKHEHDQG

SEQ ID NO: 1117192 - protein, 9 aa, Homo Sapiens
VQGPILHVL

SEQ ID NO: 1117193 - protein, 9 aa, Homo Sapiens
LTIGVEFGT

SEQ ID NO: 1117194 - protein, 9 aa, Homo Sapiens
SLRGNSKTA

SEQ ID NO: 1117195 - protein, 9 aa, Homo Sapiens
EEDMFASQH

SEQ ID NO: 1117196 - protein, 9 aa, Homo Sapiens
SYVHVQPCF

SEQ ID NO: 1117197 - protein, 9 aa, Homo Sapiens
GSRQRTQEP

SEQ ID NO: 1117198 - protein, 9 aa, Homo Sapiens
LLLTGETVY

SEQ ID NO: 1117199 - protein, 9 aa, Homo Sapiens
FTKSVEVQG

SEQ ID NO: 1117200 - protein, 9 aa, Homo Sapiens
CPQCLRRRS

SEQ ID NO: 1117201 - protein, 9 aa, Homo Sapiens
TVHHRFHHG

SEQ ID NO: 1117202 - protein, 9 aa, Homo Sapiens
LYIEEIHSV

SEQ ID NO: 1117203 - protein, 9 aa, Homo Sapiens
CPSEAGVPG

SEQ ID NO: 1117204 - protein, 9 aa, Homo Sapiens
INVVTLNNL

SEQ ID NO: 1117205 - protein, 9 aa, Homo Sapiens
TTVSGGTTS

SEQ ID NO: 1117206 - protein, 9 aa, Homo Sapiens
TPTCVSCWK

SEQ ID NO: 1117207 - protein, 9 aa, Homo Sapiens
ELTQMFDAK

SEQ ID NO: 1117208 - protein, 9 aa, Homo Sapiens
SALATQCSS

SEQ ID NO: 1117209 - protein, 9 aa, Homo Sapiens
KPHACRECG

SEQ ID NO: 1117210 - protein, 9 aa, Homo Sapiens
PEQQVTVAT

SEQ ID NO: 1117211 - protein, 9 aa, Homo Sapiens
VREHLRELC

SEQ ID NO: 1117212 - protein, 9 aa, Homo Sapiens
EGCFIKVLT

SEQ ID NO: 1117213 - protein, 9 aa, Homo Sapiens
GSSATDPIS

SEQ ID NO: 1117214 - protein, 9 aa, Homo Sapiens
MGKRKRKRR

SEQ ID NO: 1117215 - protein, 9 aa, Homo Sapiens
DGATLFQCV

SEQ ID NO: 1117216 - protein, 9 aa, Homo Sapiens
YDIWGNTAN

SEQ ID NO: 1117217 - protein, 9 aa, Homo Sapiens
LRLHSPTPN

SEQ ID NO: 1117218 - protein, 9 aa, Homo Sapiens
GHGVWVGAQ

SEQ ID NO: 1117219 - protein, 9 aa, Homo Sapiens
ASSFSSLGV

SEQ ID NO: 1117220 - protein, 9 aa, Homo Sapiens
YEVQTVIKT

SEQ ID NO: 1117221 - protein, 9 aa, Homo Sapiens
TYGQTGSGK

SEQ ID NO: 1117222 - protein, 9 aa, Homo Sapiens
MSTTLCTGL

SEQ ID NO: 1117223 - protein, 9 aa, Homo Sapiens
SMETRAHCN

SEQ ID NO: 1117224 - protein, 9 aa, Homo Sapiens
KVRAAGVRM

SEQ ID NO: 1117225 - protein, 9 aa, Homo Sapiens
FMIVLTFSI

SEQ ID NO: 1117226 - protein, 9 aa, Homo Sapiens
ALVFKKGKI

SEQ ID NO: 1117227 - protein, 9 aa, Homo Sapiens
PSARSPTWC

SEQ ID NO: 1117228 - protein, 9 aa, Homo Sapiens
KKGLRKSET

SEQ ID NO: 1117229 - protein, 9 aa, Homo Sapiens
KNHFMVAQS

SEQ ID NO: 1117230 - protein, 9 aa, Homo Sapiens
QQLLDEVLD

SEQ ID NO: 1117231 - protein, 9 aa, Homo Sapiens
AEQGPSSQL

SEQ ID NO: 1117232 - protein, 9 aa, Homo Sapiens
DFGPNLPNH

SEQ ID NO: 1117233 - protein, 9 aa, Homo Sapiens
FERLLGPSM

SEQ ID NO: 1117234 - protein, 9 aa, Homo Sapiens
WVLFGSDDC

SEQ ID NO: 1117235 - protein, 9 aa, Homo Sapiens
NSLPPTSWA

SEQ ID NO: 1117236 - protein, 9 aa, Homo Sapiens
KASRMSTAS

SEQ ID NO: 1117237 - protein, 9 aa, Homo Sapiens
DKPLHIIGD

SEQ ID NO: 1117238 - protein, 9 aa, Homo Sapiens
ANGPNAGEL

SEQ ID NO: 1117239 - protein, 9 aa, Homo Sapiens
CTDGINTAL

SEQ ID NO: 1117240 - protein, 9 aa, Homo Sapiens
EGPEDKAEQ

SEQ ID NO: 1117241 - protein, 9 aa, Homo Sapiens
LPRPRLHQL

SEQ ID NO: 1117242 - protein, 9 aa, Homo Sapiens
SDNTVSKRA

SEQ ID NO: 1117243 - protein, 9 aa, Homo Sapiens
APLCEDVVL

SEQ ID NO: 1117244 - protein, 9 aa, Homo Sapiens
RHRHHGHKH

SEQ ID NO: 1117245 - protein, 9 aa, Homo Sapiens
NGNLADECD

SEQ ID NO: 1117246 - protein, 9 aa, Homo Sapiens
TSTIFSSVG

SEQ ID NO: 1117247 - protein, 9 aa, Homo Sapiens
GEADLRGEP

SEQ ID NO: 1117248 - protein, 9 aa, Homo Sapiens
STLTTRLHR

SEQ ID NO: 1117249 - protein, 9 aa, Homo Sapiens
QFLIENGLL

SEQ ID NO: 1117250 - protein, 9 aa, Homo Sapiens
APCRRGAPS

SEQ ID NO: 1117251 - protein, 9 aa, Homo Sapiens
LYHSLVMCL

SEQ ID NO: 1117252 - protein, 9 aa, Homo Sapiens
PWGTGTRRE

SEQ ID NO: 1117253 - protein, 9 aa, Homo Sapiens
IERKFSPWI

SEQ ID NO: 1117254 - protein, 9 aa, Homo Sapiens
GASASWPPA

SEQ ID NO: 1117255 - protein, 9 aa, Homo Sapiens
SCLEENERP

SEQ ID NO: 1117256 - protein, 9 aa, Homo Sapiens
TVKLRRFNA

SEQ ID NO: 1117257 - protein, 9 aa, Homo Sapiens
RAGLGESSV

SEQ ID NO: 1117258 - protein, 9 aa, Homo Sapiens
VEKRKHTIE

SEQ ID NO: 1117259 - protein, 9 aa, Homo Sapiens
KQGQWGPPR

SEQ ID NO: 1117260 - protein, 9 aa, Homo Sapiens
TATENALFL

SEQ ID NO: 1117261 - protein, 9 aa, Homo Sapiens
GKKMDLDGM

SEQ ID NO: 1117262 - protein, 9 aa, Homo Sapiens
ERPDVGRHL

SEQ ID NO: 1117263 - protein, 9 aa, Homo Sapiens
QNPEKLALK

SEQ ID NO: 1117264 - protein, 9 aa, Homo Sapiens
NNSLSNLTP

SEQ ID NO: 1117265 - protein, 9 aa, Homo Sapiens
FVFVITAAG

SEQ ID NO: 1117266 - protein, 9 aa, Homo Sapiens
PKKIKEVYF

SEQ ID NO: 1117267 - protein, 9 aa, Homo Sapiens
KRAIVVFHC

SEQ ID NO: 1117268 - protein, 9 aa, Homo Sapiens
LRLRLEKKE

SEQ ID NO: 1117269 - protein, 9 aa, Homo Sapiens
LHGTYQNPN

SEQ ID NO: 1117270 - protein, 9 aa, Homo Sapiens
FGLDTRWHE

SEQ ID NO: 1117271 - protein, 9 aa, Homo Sapiens
VQADVEKCQ

SEQ ID NO: 1117272 - protein, 9 aa, Homo Sapiens
TGGESIHGE

SEQ ID NO: 1117273 - protein, 9 aa, Homo Sapiens
QLIMPLSEV

SEQ ID NO: 1117274 - protein, 9 aa, Homo Sapiens
QAPLPVAVS

SEQ ID NO: 1117275 - protein, 9 aa, Homo Sapiens
EEFFDYSLM

SEQ ID NO: 1117276 - protein, 9 aa, Homo Sapiens
PCGECFPQA

SEQ ID NO: 1117277 - protein, 9 aa, Homo Sapiens
DRVPGLGPR

SEQ ID NO: 1117278 - protein, 9 aa, Homo Sapiens
VFERLVEWD

SEQ ID NO: 1117279 - protein, 9 aa, Homo Sapiens
TVQLQLHSL

SEQ ID NO: 1117280 - protein, 9 aa, Homo Sapiens
KQRSAFAPC

SEQ ID NO: 1117281 - protein, 9 aa, Homo Sapiens
SQNHSKCIT

SEQ ID NO: 1117282 - protein, 9 aa, Homo Sapiens
KAGAQLRNG

SEQ ID NO: 1117283 - protein, 9 aa, Homo Sapiens
PPAFSGRIL

SEQ ID NO: 1117284 - protein, 9 aa, Homo Sapiens
NLPTFDLSV

SEQ ID NO: 1117285 - protein, 9 aa, Homo Sapiens
LLSGIMGAV

SEQ ID NO: 1117286 - protein, 9 aa, Homo Sapiens
FEEFASVIN

SEQ ID NO: 1117287 - protein, 9 aa, Homo Sapiens
QGAVWKEGG

SEQ ID NO: 1117288 - protein, 9 aa, Homo Sapiens
WTHTAACVL

SEQ ID NO: 1117289 - protein, 9 aa, Homo Sapiens
PPLAPLLPL

SEQ ID NO: 1117290 - protein, 9 aa, Homo Sapiens
ALCIHTGCE

SEQ ID NO: 1117291 - protein, 9 aa, Homo Sapiens
AVGPARISM

SEQ ID NO: 1117292 - protein, 9 aa, Homo Sapiens
SYDGGSDVQ

SEQ ID NO: 1117293 - protein, 9 aa, Homo Sapiens
DFLREAGIM

SEQ ID NO: 1117294 - protein, 9 aa, Homo Sapiens
NVMKALQHK

SEQ ID NO: 1117295 - protein, 9 aa, Homo Sapiens
RRKAQIPQL

SEQ ID NO: 1117296 - protein, 9 aa, Homo Sapiens
GPLPHGAAR

SEQ ID NO: 1117297 - protein, 9 aa, Homo Sapiens
PTSSPATSA

SEQ ID NO: 1117298 - protein, 9 aa, Homo Sapiens
PEAPPPPPR

SEQ ID NO: 1117299 - protein, 9 aa, Homo Sapiens
ANAQNPSLF

SEQ ID NO: 1117300 - protein, 9 aa, Homo Sapiens
YVHVQPCFI

SEQ ID NO: 1117301 - protein, 9 aa, Homo Sapiens
EDIDSQVDG

SEQ ID NO: 1117302 - protein, 9 aa, Homo Sapiens
LLLLLPPPT

SEQ ID NO: 1117303 - protein, 9 aa, Homo Sapiens
KKFIAGFWT

SEQ ID NO: 1117304 - protein, 9 aa, Homo Sapiens
CGPTGPRCP

SEQ ID NO: 1117305 - protein, 9 aa, Homo Sapiens
SGPSGPSFA

SEQ ID NO: 1117306 - protein, 9 aa, Homo Sapiens
TSLWVVTSK

SEQ ID NO: 1117307 - protein, 9 aa, Homo Sapiens
WGVRHPHIV

SEQ ID NO: 1117308 - protein, 9 aa, Homo Sapiens
SFSGLVGLF

SEQ ID NO: 1117309 - protein, 9 aa, Homo Sapiens
KLQATNAHD

SEQ ID NO: 1117310 - protein, 9 aa, Homo Sapiens
SFISNNEWC

SEQ ID NO: 1117311 - protein, 9 aa, Homo Sapiens
VTRGRRTGQ

SEQ ID NO: 1117312 - protein, 9 aa, Homo Sapiens
ARRTNGASQ

SEQ ID NO: 1117313 - protein, 9 aa, Homo Sapiens
LGSEVGRRR

SEQ ID NO: 1117314 - protein, 9 aa, Homo Sapiens
AAPPRSSRS

SEQ ID NO: 1117315 - protein, 9 aa, Homo Sapiens
HAELAILLP

SEQ ID NO: 1117316 - protein, 9 aa, Homo Sapiens
ALHGEVSSS

SEQ ID NO: 1117317 - protein, 9 aa, Homo Sapiens
VGHSIRFED

SEQ ID NO: 1117318 - protein, 9 aa, Homo Sapiens
TRATLINTT

SEQ ID NO: 1117319 - protein, 9 aa, Homo Sapiens
YSSKAEKRP

SEQ ID NO: 1117320 - protein, 9 aa, Homo Sapiens
GKRLKTGQK

SEQ ID NO: 1117321 - protein, 9 aa, Homo Sapiens
FPMNPPKYG

SEQ ID NO: 1117322 - protein, 9 aa, Homo Sapiens
PTSSLAFLT

SEQ ID NO: 1117323 - protein, 9 aa, Homo Sapiens
MHYLDIVRE

SEQ ID NO: 1117324 - protein, 9 aa, Homo Sapiens
PTERGFQTS

SEQ ID NO: 1117325 - protein, 9 aa, Homo Sapiens
MERDLPPPG

SEQ ID NO: 1117326 - protein, 9 aa, Homo Sapiens
VTPPEEPPT

SEQ ID NO: 1117327 - protein, 9 aa, Homo Sapiens
APLRLHSPT

SEQ ID NO: 1117328 - protein, 9 aa, Homo Sapiens
PQLSPTPSA

SEQ ID NO: 1117329 - protein, 9 aa, Homo Sapiens
KEPFPPAAP

SEQ ID NO: 1117330 - protein, 9 aa, Homo Sapiens
IELLDMGKT

SEQ ID NO: 1117331 - protein, 9 aa, Homo Sapiens
RNQTLDGTR

SEQ ID NO: 1117332 - protein, 9 aa, Homo Sapiens
KMEKESSLI

SEQ ID NO: 1117333 - protein, 9 aa, Homo Sapiens
EAKYRPRAA

SEQ ID NO: 1117334 - protein, 9 aa, Homo Sapiens
PDLQPQRNF

SEQ ID NO: 1117335 - protein, 9 aa, Homo Sapiens
HYRTHTGKK

SEQ ID NO: 1117336 - protein, 9 aa, Homo Sapiens
YEAIKHKLC

SEQ ID NO: 1117337 - protein, 9 aa, Homo Sapiens
MLHIQVQAP

SEQ ID NO: 1117338 - protein, 9 aa, Homo Sapiens
PGACRPACT

SEQ ID NO: 1117339 - protein, 9 aa, Homo Sapiens
TYDVPRGVQ

SEQ ID NO: 1117340 - protein, 9 aa, Homo Sapiens
LEMLRVTNP

SEQ ID NO: 1117341 - protein, 9 aa, Homo Sapiens
QGTYRAGVV

SEQ ID NO: 1117342 - protein, 9 aa, Homo Sapiens
RRAPGGGAW

SEQ ID NO: 1117343 - protein, 9 aa, Homo Sapiens
KQQGVPQVS

SEQ ID NO: 1117344 - protein, 9 aa, Homo Sapiens
PRMASTSGS

SEQ ID NO: 1117345 - protein, 9 aa, Homo Sapiens
GWAQGGPRP

SEQ ID NO: 1117346 - protein, 9 aa, Homo Sapiens
DKEKEQEKD

SEQ ID NO: 1117347 - protein, 9 aa, Homo Sapiens
KSCLSISGW

SEQ ID NO: 1117348 - protein, 9 aa, Homo Sapiens
ASHLMSCKK

SEQ ID NO: 1117349 - protein, 9 aa, Homo Sapiens
PYLPVTVAN

SEQ ID NO: 1117350 - protein, 9 aa, Homo Sapiens
LVVAAIPEG

SEQ ID NO: 1117351 - protein, 9 aa, Homo Sapiens
RNHWSDMLA

SEQ ID NO: 1117352 - protein, 9 aa, Homo Sapiens
ERVWVHEKR

SEQ ID NO: 1117353 - protein, 9 aa, Homo Sapiens
VGIVDIFLS

SEQ ID NO: 1117354 - protein, 9 aa, Homo Sapiens
ACTCRACRT

SEQ ID NO: 1117355 - protein, 9 aa, Homo Sapiens
KPVEAVKYS

SEQ ID NO: 1117356 - protein, 9 aa, Homo Sapiens
GIGCEQDID

SEQ ID NO: 1117357 - protein, 9 aa, Homo Sapiens
GDIKHISTK

SEQ ID NO: 1117358 - protein, 9 aa, Homo Sapiens
TLHTTLARE

SEQ ID NO: 1117359 - protein, 9 aa, Homo Sapiens
EKNQRLQSP

SEQ ID NO: 1117360 - protein, 9 aa, Homo Sapiens
LYCEIGVTL

SEQ ID NO: 1117361 - protein, 9 aa, Homo Sapiens
HHLETRPTQ

SEQ ID NO: 1117362 - protein, 9 aa, Homo Sapiens
GGPCPSAAG

SEQ ID NO: 1117363 - protein, 9 aa, Homo Sapiens
RCIAFNGSV

SEQ ID NO: 1117364 - protein, 9 aa, Homo Sapiens
PSRREPSRA

SEQ ID NO: 1117365 - protein, 9 aa, Homo Sapiens
EKQVLQLER

SEQ ID NO: 1117366 - protein, 9 aa, Homo Sapiens
LHTTLARET

SEQ ID NO: 1117367 - protein, 9 aa, Homo Sapiens
GCISVKDHR

SEQ ID NO: 1117368 - protein, 9 aa, Homo Sapiens
QLLHTQLLS

SEQ ID NO: 1117369 - protein, 9 aa, Homo Sapiens
VLARSDTAQ

SEQ ID NO: 1117370 - protein, 9 aa, Homo Sapiens
ASTPSSGAS

SEQ ID NO: 1117371 - protein, 9 aa, Homo Sapiens
QSASREDLI

SEQ ID NO: 1117372 - protein, 9 aa, Homo Sapiens
CAEGPGGHQ

SEQ ID NO: 1117373 - protein, 9 aa, Homo Sapiens
MHVAAKESQ

SEQ ID NO: 1117374 - protein, 9 aa, Homo Sapiens
DYPAPRAVI

SEQ ID NO: 1117375 - protein, 9 aa, Homo Sapiens
KNCRLPEIK

SEQ ID NO: 1117376 - protein, 9 aa, Homo Sapiens
DLEYAHTFM

SEQ ID NO: 1117377 - protein, 9 aa, Homo Sapiens
TGRCIAFNG

SEQ ID NO: 1117378 - protein, 9 aa, Homo Sapiens
AIPAVARMT

SEQ ID NO: 1117379 - protein, 9 aa, Homo Sapiens
TTQGMKHSS

SEQ ID NO: 1117380 - protein, 9 aa, Homo Sapiens
NEKIYENED

SEQ ID NO: 1117381 - protein, 9 aa, Homo Sapiens
DWCKTQPPK

SEQ ID NO: 1117382 - protein, 9 aa, Homo Sapiens
PESIFRDDG

SEQ ID NO: 1117383 - protein, 9 aa, Homo Sapiens
PRYPRRIVR

SEQ ID NO: 1117384 - protein, 9 aa, Homo Sapiens
VAVPILCLF

SEQ ID NO: 1117385 - protein, 9 aa, Homo Sapiens
SVTKMHRFY

SEQ ID NO: 1117386 - protein, 9 aa, Homo Sapiens
YPHNRTLNN

SEQ ID NO: 1117387 - protein, 9 aa, Homo Sapiens
TRFAFSTRL

SEQ ID NO: 1117388 - protein, 9 aa, Homo Sapiens
RAALSACSS

SEQ ID NO: 1117389 - protein, 9 aa, Homo Sapiens
VRQYLQERR

SEQ ID NO: 1117390 - protein, 9 aa, Homo Sapiens
CLLLDASCH

SEQ ID NO: 1117391 - protein, 9 aa, Homo Sapiens
ALLWSPLLF

SEQ ID NO: 1117392 - protein, 9 aa, Homo Sapiens
RSGRRRCGS

SEQ ID NO: 1117393 - protein, 9 aa, Homo Sapiens
TVFIGKNSV

SEQ ID NO: 1117394 - protein, 9 aa, Homo Sapiens
GRRRRRRKK

SEQ ID NO: 1117395 - protein, 9 aa, Homo Sapiens
TTREAGIIT

SEQ ID NO: 1117396 - protein, 9 aa, Homo Sapiens
ILTELTTAV

SEQ ID NO: 1117397 - protein, 9 aa, Homo Sapiens
CHWNGKKML

SEQ ID NO: 1117398 - protein, 9 aa, Homo Sapiens
TIRSGRAIP

SEQ ID NO: 1117399 - protein, 9 aa, Homo Sapiens
PIIENAPEE

SEQ ID NO: 1117400 - protein, 9 aa, Homo Sapiens
PPVGSGSPR

SEQ ID NO: 1117401 - protein, 9 aa, Homo Sapiens
LRTHTGSNI

SEQ ID NO: 1117402 - protein, 9 aa, Homo Sapiens
CVTVWVPWL

SEQ ID NO: 1117403 - protein, 9 aa, Homo Sapiens
KQGMSVLSL

SEQ ID NO: 1117404 - protein, 9 aa, Homo Sapiens
DACESLTRV

SEQ ID NO: 1117405 - protein, 9 aa, Homo Sapiens
CRTTLSGQQ

SEQ ID NO: 1117406 - protein, 9 aa, Homo Sapiens
STCRCGWGG

SEQ ID NO: 1117407 - protein, 9 aa, Homo Sapiens
HPARTLARP

SEQ ID NO: 1117408 - protein, 9 aa, Homo Sapiens
RRRSSSLLP

SEQ ID NO: 1117409 - protein, 9 aa, Homo Sapiens
NRAGRWRSG

SEQ ID NO: 1117410 - protein, 9 aa, Homo Sapiens
SVESWGTQC

SEQ ID NO: 1117411 - protein, 9 aa, Homo Sapiens
SCSEQPALT

SEQ ID NO: 1117412 - protein, 9 aa, Homo Sapiens
LPDCRLAAL

SEQ ID NO: 1117413 - protein, 9 aa, Homo Sapiens
ERQVEEMKT

SEQ ID NO: 1117414 - protein, 9 aa, Homo Sapiens
CGQPQAQAE

SEQ ID NO: 1117415 - protein, 9 aa, Homo Sapiens
GRGAAVGAG

SEQ ID NO: 1117416 - protein, 9 aa, Homo Sapiens
LKQGPLPHG

SEQ ID NO: 1117417 - protein, 9 aa, Homo Sapiens
KKLYPKGVF

SEQ ID NO: 1117418 - protein, 9 aa, Homo Sapiens
GSPRSFTDT

SEQ ID NO: 1117419 - protein, 9 aa, Homo Sapiens
SRLSSRSPT

SEQ ID NO: 1117420 - protein, 9 aa, Homo Sapiens
ASNSTIERK

SEQ ID NO: 1117421 - protein, 9 aa, Homo Sapiens
SRDKKMVGD

SEQ ID NO: 1117422 - protein, 9 aa, Homo Sapiens
NDHGDGGIY

SEQ ID NO: 1117423 - protein, 9 aa, Homo Sapiens
GVSSCPSPW

SEQ ID NO: 1117424 - protein, 9 aa, Homo Sapiens
SLTDCFLKT

SEQ ID NO: 1117425 - protein, 9 aa, Homo Sapiens
LSCRLVNWP

SEQ ID NO: 1117426 - protein, 9 aa, Homo Sapiens
IHFFLIEKN

SEQ ID NO: 1117427 - protein, 9 aa, Homo Sapiens
CESGPCCCW

SEQ ID NO: 1117428 - protein, 9 aa, Homo Sapiens
DIGEESSVV

SEQ ID NO: 1117429 - protein, 9 aa, Homo Sapiens
CNHLRITAD

SEQ ID NO: 1117430 - protein, 9 aa, Homo Sapiens
NGIWEVMPR

SEQ ID NO: 1117431 - protein, 9 aa, Homo Sapiens
QVREHPVAL

SEQ ID NO: 1117432 - protein, 9 aa, Homo Sapiens
MREKEHEMN

SEQ ID NO: 1117433 - protein, 9 aa, Homo Sapiens
FAMFGFLLM

SEQ ID NO: 1117434 - protein, 9 aa, Homo Sapiens
QRRGRNSSM

SEQ ID NO: 1117435 - protein, 9 aa, Homo Sapiens
KNVSVKDIQ

SEQ ID NO: 1117436 - protein, 9 aa, Homo Sapiens
LLNRPCKAG

SEQ ID NO: 1117437 - protein, 9 aa, Homo Sapiens
EAFGNAHTN

SEQ ID NO: 1117438 - protein, 9 aa, Homo Sapiens
RILIHLHPR

SEQ ID NO: 1117439 - protein, 9 aa, Homo Sapiens
QRGHLHPPG

SEQ ID NO: 1117440 - protein, 9 aa, Homo Sapiens
MALTSIRCL

SEQ ID NO: 1117441 - protein, 9 aa, Homo Sapiens
FRFTSHGSP

SEQ ID NO: 1117442 - protein, 9 aa, Homo Sapiens
WPFLKLLGN

SEQ ID NO: 1117443 - protein, 9 aa, Homo Sapiens
KKIKEVYFE

SEQ ID NO: 1117444 - protein, 9 aa, Homo Sapiens
LVSLQDLVH

SEQ ID NO: 1117445 - protein, 9 aa, Homo Sapiens
GSQIVALNF

SEQ ID NO: 1117446 - protein, 9 aa, Homo Sapiens
ALSLSRTRA

SEQ ID NO: 1117447 - protein, 9 aa, Homo Sapiens
LLGVQEGVD

SEQ ID NO: 1117448 - protein, 9 aa, Homo Sapiens
TLSWAARSL

SEQ ID NO: 1117449 - protein, 9 aa, Homo Sapiens
TCKSASVMA

SEQ ID NO: 1117450 - protein, 9 aa, Homo Sapiens
WVEEWYNDS

SEQ ID NO: 1117451 - protein, 9 aa, Homo Sapiens
LAVSSIKWS

SEQ ID NO: 1117452 - protein, 9 aa, Homo Sapiens
EEEAKKLYP

SEQ ID NO: 1117453 - protein, 9 aa, Homo Sapiens
SMSGLTSGG

SEQ ID NO: 1117454 - protein, 9 aa, Homo Sapiens
VPLRPKALS

SEQ ID NO: 1117455 - protein, 9 aa, Homo Sapiens
RDADQCCEV

SEQ ID NO: 1117456 - protein, 9 aa, Homo Sapiens
SRCLIGSWK

SEQ ID NO: 1117457 - protein, 9 aa, Homo Sapiens
FFVKSWNTE

SEQ ID NO: 1117458 - protein, 9 aa, Homo Sapiens
MGSLSPTPM

SEQ ID NO: 1117459 - protein, 9 aa, Homo Sapiens
VLSLSQASH

SEQ ID NO: 1117460 - protein, 9 aa, Homo Sapiens
SPPAAGRSP

SEQ ID NO: 1117461 - protein, 9 aa, Homo Sapiens
LLTNVELSL

SEQ ID NO: 1117462 - protein, 9 aa, Homo Sapiens
NQHYNTLLA

SEQ ID NO: 1117463 - protein, 9 aa, Homo Sapiens
AVESLDSPP

SEQ ID NO: 1117464 - protein, 9 aa, Homo Sapiens
SKIVFSVCN

SEQ ID NO: 1117465 - protein, 9 aa, Homo Sapiens
KFCNNHVSI

SEQ ID NO: 1117466 - protein, 9 aa, Homo Sapiens
LLFVTVRLC

SEQ ID NO: 1117467 - protein, 9 aa, Homo Sapiens
LSPAVPIRA

SEQ ID NO: 1117468 - protein, 9 aa, Homo Sapiens
FSTFMDNYI

SEQ ID NO: 1117469 - protein, 9 aa, Homo Sapiens
LEILFSNGK

SEQ ID NO: 1117470 - protein, 9 aa, Homo Sapiens
GPVAAVLFN

SEQ ID NO: 1117471 - protein, 9 aa, Homo Sapiens
SSLAHIWQE

SEQ ID NO: 1117472 - protein, 9 aa, Homo Sapiens
QETGTFKLD

SEQ ID NO: 1117473 - protein, 9 aa, Homo Sapiens
GLNLAPVTR

SEQ ID NO: 1117474 - protein, 9 aa, Homo Sapiens
LRPGARGEA

SEQ ID NO: 1117475 - protein, 9 aa, Homo Sapiens
LRAQSLKTL

SEQ ID NO: 1117476 - protein, 9 aa, Homo Sapiens
TSCFKLDLS

SEQ ID NO: 1117477 - protein, 9 aa, Homo Sapiens
CAMAPETTL

SEQ ID NO: 1117478 - protein, 9 aa, Homo Sapiens
RMSHQNTFW

SEQ ID NO: 1117479 - protein, 9 aa, Homo Sapiens
IWWSVAGLI

SEQ ID NO: 1117480 - protein, 9 aa, Homo Sapiens
PVTPPAWLV

SEQ ID NO: 1117481 - protein, 9 aa, Homo Sapiens
VLPESYFIN

SEQ ID NO: 1117482 - protein, 9 aa, Homo Sapiens
CKGATCGLL

SEQ ID NO: 1117483 - protein, 9 aa, Homo Sapiens
LFNFPPAQN

SEQ ID NO: 1117484 - protein, 9 aa, Homo Sapiens
WKRTQQRPP

SEQ ID NO: 1117485 - protein, 9 aa, Homo Sapiens
LECCLDPSM

SEQ ID NO: 1117486 - protein, 9 aa, Homo Sapiens
ALVCLGTQT

SEQ ID NO: 1117487 - protein, 9 aa, Homo Sapiens
NYRKTAEWL

SEQ ID NO: 1117488 - protein, 9 aa, Homo Sapiens
CSTDSSSCC

SEQ ID NO: 1117489 - protein, 9 aa, Homo Sapiens
TILEALEER

SEQ ID NO: 1117490 - protein, 9 aa, Homo Sapiens
IQHHDTHSE

SEQ ID NO: 1117491 - protein, 9 aa, Homo Sapiens
PYFRNKLFV

SEQ ID NO: 1117492 - protein, 9 aa, Homo Sapiens
VAYNLGAPP

SEQ ID NO: 1117493 - protein, 9 aa, Homo Sapiens
AESEVGWPE

SEQ ID NO: 1117494 - protein, 9 aa, Homo Sapiens
ERVRARVRA

SEQ ID NO: 1117495 - protein, 9 aa, Homo Sapiens
LLMDAGACY

SEQ ID NO: 1117496 - protein, 9 aa, Homo Sapiens
DGGWYGKAK

SEQ ID NO: 1117497 - protein, 9 aa, Homo Sapiens
GSPAAVCSG

SEQ ID NO: 1117498 - protein, 9 aa, Homo Sapiens
RELERERVQ

SEQ ID NO: 1117499 - protein, 9 aa, Homo Sapiens
KGLTQKDLT

SEQ ID NO: 1117500 - protein, 9 aa, Homo Sapiens
DTCREASVS

SEQ ID NO: 1117501 - protein, 9 aa, Homo Sapiens
RRRRRRSKQ

SEQ ID NO: 1117502 - protein, 9 aa, Homo Sapiens
GLTLGGGLP

SEQ ID NO: 1117503 - protein, 9 aa, Homo Sapiens
LSSRSPTRP

SEQ ID NO: 1117504 - protein, 9 aa, Homo Sapiens
EFRKKCDKK

SEQ ID NO: 1117505 - protein, 9 aa, Homo Sapiens
SSMAVSPDP

SEQ ID NO: 1117506 - protein, 9 aa, Homo Sapiens
TAYEDVLVV

SEQ ID NO: 1117507 - protein, 9 aa, Homo Sapiens
HAAGLGMLE

SEQ ID NO: 1117508 - protein, 9 aa, Homo Sapiens
KSKRALERQ

SEQ ID NO: 1117509 - protein, 9 aa, Homo Sapiens
RCRWAGARG

SEQ ID NO: 1117510 - protein, 9 aa, Homo Sapiens
AKSESSALL

SEQ ID NO: 1117511 - protein, 9 aa, Homo Sapiens
ESIGRSGAV

SEQ ID NO: 1117512 - protein, 9 aa, Homo Sapiens
CMSQTVQRM

SEQ ID NO: 1117513 - protein, 9 aa, Homo Sapiens
SVPRARGEE

SEQ ID NO: 1117514 - protein, 9 aa, Homo Sapiens
ESYFINNLR

SEQ ID NO: 1117515 - protein, 9 aa, Homo Sapiens
YALVCLGTQ

SEQ ID NO: 1117516 - protein, 9 aa, Homo Sapiens
SPQPRAFLG

SEQ ID NO: 1117517 - protein, 9 aa, Homo Sapiens
VNLGLGEAV

SEQ ID NO: 1117518 - protein, 9 aa, Homo Sapiens
TSPTGSVTH

SEQ ID NO: 1117519 - protein, 9 aa, Homo Sapiens
PHPRPAPEP

SEQ ID NO: 1117520 - protein, 9 aa, Homo Sapiens
RGAARDAPG

SEQ ID NO: 1117521 - protein, 9 aa, Homo Sapiens
GSEDEEYYS

SEQ ID NO: 1117522 - protein, 9 aa, Homo Sapiens
SAPTAAKPS

SEQ ID NO: 1117523 - protein, 9 aa, Homo Sapiens
RNPKIGLQP

SEQ ID NO: 1117524 - protein, 9 aa, Homo Sapiens
TAQIVPKRI

SEQ ID NO: 1117525 - protein, 9 aa, Homo Sapiens
MTRREKIKR

SEQ ID NO: 1117526 - protein, 9 aa, Homo Sapiens
ALQPLWESV

SEQ ID NO: 1117527 - protein, 9 aa, Homo Sapiens
ENNKAQASH

SEQ ID NO: 1117528 - protein, 9 aa, Homo Sapiens
TPPASATRA

SEQ ID NO: 1117529 - protein, 9 aa, Homo Sapiens
VVEGVLIDV

SEQ ID NO: 1117530 - protein, 9 aa, Homo Sapiens
QASWSPSAW

SEQ ID NO: 1117531 - protein, 9 aa, Homo Sapiens
NHTEAYNNL

SEQ ID NO: 1117532 - protein, 9 aa, Homo Sapiens
MILRETPIF

SEQ ID NO: 1117533 - protein, 9 aa, Homo Sapiens
PLKPPDGQE

SEQ ID NO: 1117534 - protein, 9 aa, Homo Sapiens
RRKRKRRRS

SEQ ID NO: 1117535 - protein, 9 aa, Homo Sapiens
AQAIAVQAG

SEQ ID NO: 1117536 - protein, 9 aa, Homo Sapiens
VNISLSGIE

SEQ ID NO: 1117537 - protein, 9 aa, Homo Sapiens
SGTAPSAVP

SEQ ID NO: 1117538 - protein, 9 aa, Homo Sapiens
PGLLLHAPS

SEQ ID NO: 1117539 - protein, 9 aa, Homo Sapiens
LQRELDESL

SEQ ID NO: 1117540 - protein, 9 aa, Homo Sapiens
SSRCASRRP

SEQ ID NO: 1117541 - protein, 9 aa, Homo Sapiens
LDLLQLPEP

SEQ ID NO: 1117542 - protein, 9 aa, Homo Sapiens
PGPTAAGPA

SEQ ID NO: 1117543 - protein, 9 aa, Homo Sapiens
PTLKFFLNG

SEQ ID NO: 1117544 - protein, 9 aa, Homo Sapiens
GPDYSVDVE

SEQ ID NO: 1117545 - protein, 9 aa, Homo Sapiens
VLCYTSTIF

SEQ ID NO: 1117546 - protein, 9 aa, Homo Sapiens
DKKRGASSS

SEQ ID NO: 1117547 - protein, 9 aa, Homo Sapiens
YTPWCPHCK

SEQ ID NO: 1117548 - protein, 9 aa, Homo Sapiens
PLGSQCVSL

SEQ ID NO: 1117549 - protein, 9 aa, Homo Sapiens
ERVKKLKRQ

SEQ ID NO: 1117550 - protein, 9 aa, Homo Sapiens
SPWLPAVPH

SEQ ID NO: 1117551 - protein, 9 aa, Homo Sapiens
TALALASTL

SEQ ID NO: 1117552 - protein, 9 aa, Homo Sapiens
GRCFQKYGI

SEQ ID NO: 1117553 - protein, 9 aa, Homo Sapiens
SRTASTRSA

SEQ ID NO: 1117554 - protein, 9 aa, Homo Sapiens
SVTDYHAIV

SEQ ID NO: 1117555 - protein, 9 aa, Homo Sapiens
SLDDVLHRY

SEQ ID NO: 1117556 - protein, 9 aa, Homo Sapiens
LAITSWGAG

SEQ ID NO: 1117557 - protein, 9 aa, Homo Sapiens
EPWDTERNL

SEQ ID NO: 1117558 - protein, 9 aa, Homo Sapiens
SLPAAHHLP

SEQ ID NO: 1117559 - protein, 9 aa, Homo Sapiens
STSFGSGPG

SEQ ID NO: 1117560 - protein, 9 aa, Homo Sapiens
PRCPRPCPG

SEQ ID NO: 1117561 - protein, 9 aa, Homo Sapiens
FWGWCLGSA

SEQ ID NO: 1117562 - protein, 9 aa, Homo Sapiens
FLNSTFPSM

SEQ ID NO: 1117563 - protein, 9 aa, Homo Sapiens
KRALERQVE

SEQ ID NO: 1117564 - protein, 9 aa, Homo Sapiens
DSISKEHVL

SEQ ID NO: 1117565 - protein, 9 aa, Homo Sapiens
QQLKKRART

SEQ ID NO: 1117566 - protein, 9 aa, Homo Sapiens
PGYERMEQF

SEQ ID NO: 1117567 - protein, 9 aa, Homo Sapiens
SRPTSSHGG

SEQ ID NO: 1117568 - protein, 9 aa, Homo Sapiens
LENLFLRCP

SEQ ID NO: 1117569 - protein, 9 aa, Homo Sapiens
GMANIHAIQ

SEQ ID NO: 1117570 - protein, 9 aa, Homo Sapiens
AAAGCSWTC

SEQ ID NO: 1117571 - protein, 9 aa, Homo Sapiens
SPDLTEEMN

SEQ ID NO: 1117572 - protein, 9 aa, Homo Sapiens
LHTQLLSPS

SEQ ID NO: 1117573 - protein, 9 aa, Homo Sapiens
QWLSEDDND

SEQ ID NO: 1117574 - protein, 9 aa, Homo Sapiens
LDLPGKDYC

SEQ ID NO: 1117575 - protein, 9 aa, Homo Sapiens
LNRHIRGNM

SEQ ID NO: 1117576 - protein, 9 aa, Homo Sapiens
AVNCLTTVQ

SEQ ID NO: 1117577 - protein, 9 aa, Homo Sapiens
QQEEVEEVE

SEQ ID NO: 1117578 - protein, 9 aa, Homo Sapiens
HVYQGPEEE

SEQ ID NO: 1117579 - protein, 9 aa, Homo Sapiens
KPLKQNQIV

SEQ ID NO: 1117580 - protein, 9 aa, Homo Sapiens
CRKNKSTKA

SEQ ID NO: 1117581 - protein, 9 aa, Homo Sapiens
AIAHLIHSI

SEQ ID NO: 1117582 - protein, 9 aa, Homo Sapiens
QNREKRKQN

SEQ ID NO: 1117583 - protein, 9 aa, Homo Sapiens
FAHQSWLPS

SEQ ID NO: 1117584 - protein, 9 aa, Homo Sapiens
ARLVATPAL

SEQ ID NO: 1117585 - protein, 9 aa, Homo Sapiens
LNPERCQHY

SEQ ID NO: 1117586 - protein, 9 aa, Homo Sapiens
KCDFHFVYR

SEQ ID NO: 1117587 - protein, 9 aa, Homo Sapiens
IGDHGPTLK

SEQ ID NO: 1117588 - protein, 9 aa, Homo Sapiens
NSQKSIVGH

SEQ ID NO: 1117589 - protein, 9 aa, Homo Sapiens
SPPLFQAGT

SEQ ID NO: 1117590 - protein, 9 aa, Homo Sapiens
TLLGALGRR

SEQ ID NO: 1117591 - protein, 9 aa, Homo Sapiens
PAVPPVLLS

SEQ ID NO: 1117592 - protein, 9 aa, Homo Sapiens
TIEQSSQAY

SEQ ID NO: 1117593 - protein, 9 aa, Homo Sapiens
GNASLLQKV

SEQ ID NO: 1117594 - protein, 9 aa, Homo Sapiens
KFPLQEEIS

SEQ ID NO: 1117595 - protein, 9 aa, Homo Sapiens
PGRNSVACS

SEQ ID NO: 1117596 - protein, 9 aa, Homo Sapiens
GQGPGQRPA

SEQ ID NO: 1117597 - protein, 9 aa, Homo Sapiens
LEKKTNQRF

SEQ ID NO: 1117598 - protein, 9 aa, Homo Sapiens
ATSASTQAR

SEQ ID NO: 1117599 - protein, 9 aa, Homo Sapiens
HSHSHSTTR

SEQ ID NO: 1117600 - protein, 9 aa, Homo Sapiens
TADLSEIPC

SEQ ID NO: 1117601 - protein, 9 aa, Homo Sapiens
YLLNVSVAD

SEQ ID NO: 1117602 - protein, 9 aa, Homo Sapiens
YGRGENFLC

SEQ ID NO: 1117603 - protein, 9 aa, Homo Sapiens
LQLQEDVDP

SEQ ID NO: 1117604 - protein, 9 aa, Homo Sapiens
DQASFAVNK

SEQ ID NO: 1117605 - protein, 9 aa, Homo Sapiens
TVAGATAQI

SEQ ID NO: 1117606 - protein, 9 aa, Homo Sapiens
FLKRNNMSA

SEQ ID NO: 1117607 - protein, 9 aa, Homo Sapiens
SRFLRPSKR

SEQ ID NO: 1117608 - protein, 9 aa, Homo Sapiens
PQAEGENDG

SEQ ID NO: 1117609 - protein, 9 aa, Homo Sapiens
PKVPAVPRA

SEQ ID NO: 1117610 - protein, 9 aa, Homo Sapiens
PDSSSSWKN

SEQ ID NO: 1117611 - protein, 9 aa, Homo Sapiens
KRHPVKVYP

SEQ ID NO: 1117612 - protein, 9 aa, Homo Sapiens
LEEEQRKAL

SEQ ID NO: 1117613 - protein, 9 aa, Homo Sapiens
STATRAPSP

SEQ ID NO: 1117614 - protein, 9 aa, Homo Sapiens
GRKVRGGCP

SEQ ID NO: 1117615 - protein, 9 aa, Homo Sapiens
PATGKSTST

SEQ ID NO: 1117616 - protein, 9 aa, Homo Sapiens
TMLQKRLKR

SEQ ID NO: 1117617 - protein, 9 aa, Homo Sapiens
RYWAITVPI

SEQ ID NO: 1117618 - protein, 9 aa, Homo Sapiens
GHTLTAHRG

SEQ ID NO: 1117619 - protein, 9 aa, Homo Sapiens
GLLSAAYQL

SEQ ID NO: 1117620 - protein, 9 aa, Homo Sapiens
DQCCEVKQI

SEQ ID NO: 1117621 - protein, 9 aa, Homo Sapiens
QGRGVYKGI

SEQ ID NO: 1117622 - protein, 9 aa, Homo Sapiens
MHYNMGGIP

SEQ ID NO: 1117623 - protein, 9 aa, Homo Sapiens
AAGALVYDI

SEQ ID NO: 1117624 - protein, 9 aa, Homo Sapiens
LTDTVRVLS

SEQ ID NO: 1117625 - protein, 9 aa, Homo Sapiens
AQCMGPNRE

SEQ ID NO: 1117626 - protein, 9 aa, Homo Sapiens
RNSVACSAR

SEQ ID NO: 1117627 - protein, 9 aa, Homo Sapiens
YCRLDACES

SEQ ID NO: 1117628 - protein, 9 aa, Homo Sapiens
HFSIEKNNY

SEQ ID NO: 1117629 - protein, 9 aa, Homo Sapiens
GGFRAWHTP

SEQ ID NO: 1117630 - protein, 9 aa, Homo Sapiens
LEGPDYSVD

SEQ ID NO: 1117631 - protein, 9 aa, Homo Sapiens
PTSFIIDSS

SEQ ID NO: 1117632 - protein, 9 aa, Homo Sapiens
NWNIDRSGF

SEQ ID NO: 1117633 - protein, 9 aa, Homo Sapiens
VSSVLERFL

SEQ ID NO: 1117634 - protein, 9 aa, Homo Sapiens
ARHLRSPSC

SEQ ID NO: 1117635 - protein, 9 aa, Homo Sapiens
ELDVARLQS

SEQ ID NO: 1117636 - protein, 9 aa, Homo Sapiens
SWGTMVRAL

SEQ ID NO: 1117637 - protein, 9 aa, Homo Sapiens
HRLWVSRLL

SEQ ID NO: 1117638 - protein, 9 aa, Homo Sapiens
QLKKGAGAA

SEQ ID NO: 1117639 - protein, 9 aa, Homo Sapiens
GIILGHFVI

SEQ ID NO: 1117640 - protein, 9 aa, Homo Sapiens
SVGLHTGKV

SEQ ID NO: 1117641 - protein, 9 aa, Homo Sapiens
HKCIALRMV

SEQ ID NO: 1117642 - protein, 9 aa, Homo Sapiens
FISNNEWCY

SEQ ID NO: 1117643 - protein, 9 aa, Homo Sapiens
CKLERLDIS

SEQ ID NO: 1117644 - protein, 9 aa, Homo Sapiens
MTVHLPFIE

SEQ ID NO: 1117645 - protein, 9 aa, Homo Sapiens
CINPNDKKA

SEQ ID NO: 1117646 - protein, 9 aa, Homo Sapiens
NKSALETKA

SEQ ID NO: 1117647 - protein, 9 aa, Homo Sapiens
KSTFHILCK

SEQ ID NO: 1117648 - protein, 9 aa, Homo Sapiens
ASANWWNHH

SEQ ID NO: 1117649 - protein, 9 aa, Homo Sapiens
KPPDGQEGF

SEQ ID NO: 1117650 - protein, 9 aa, Homo Sapiens
IATDPEEAG

SEQ ID NO: 1117651 - protein, 9 aa, Homo Sapiens
WNIKQCESC

SEQ ID NO: 1117652 - protein, 9 aa, Homo Sapiens
RDLGTVAGA

SEQ ID NO: 1117653 - protein, 9 aa, Homo Sapiens
TIKMRKEAE

SEQ ID NO: 1117654 - protein, 9 aa, Homo Sapiens
FNILYCEIG

SEQ ID NO: 1117655 - protein, 9 aa, Homo Sapiens
KAVESPTAT

SEQ ID NO: 1117656 - protein, 9 aa, Homo Sapiens
TRLRTTWEK

SEQ ID NO: 1117657 - protein, 9 aa, Homo Sapiens
VGHLMGRRR

SEQ ID NO: 1117658 - protein, 9 aa, Homo Sapiens
NPSQAKLQR

SEQ ID NO: 1117659 - protein, 9 aa, Homo Sapiens
TKESMTCSG

SEQ ID NO: 1117660 - protein, 9 aa, Homo Sapiens
AHYLKQSFT

SEQ ID NO: 1117661 - protein, 9 aa, Homo Sapiens
QHKMLAIFW

SEQ ID NO: 1117662 - protein, 9 aa, Homo Sapiens
EAEARKVVL

SEQ ID NO: 1117663 - protein, 9 aa, Homo Sapiens
RAMVGGLTA

SEQ ID NO: 1117664 - protein, 9 aa, Homo Sapiens
SYMERIRGS

SEQ ID NO: 1117665 - protein, 9 aa, Homo Sapiens
NGLLKNTCE

SEQ ID NO: 1117666 - protein, 9 aa, Homo Sapiens
SMELDETDE

SEQ ID NO: 1117667 - protein, 9 aa, Homo Sapiens
GLEASSDEE

SEQ ID NO: 1117668 - protein, 9 aa, Homo Sapiens
VHWRAMVGG

SEQ ID NO: 1117669 - protein, 9 aa, Homo Sapiens
GTSITSVTL

SEQ ID NO: 1117670 - protein, 9 aa, Homo Sapiens
TIQILTCQK

SEQ ID NO: 1117671 - protein, 9 aa, Homo Sapiens
FEPPMPPPA

SEQ ID NO: 1117672 - protein, 9 aa, Homo Sapiens
SSPDSYQRF

SEQ ID NO: 1117673 - protein, 9 aa, Homo Sapiens
KSDPYALVC

SEQ ID NO: 1117674 - protein, 9 aa, Homo Sapiens
QNQIVDRVS

SEQ ID NO: 1117675 - protein, 9 aa, Homo Sapiens
KRCRRRPRA

SEQ ID NO: 1117676 - protein, 9 aa, Homo Sapiens
MQMSSFEKQ

SEQ ID NO: 1117677 - protein, 9 aa, Homo Sapiens
LQALSLRIL

SEQ ID NO: 1117678 - protein, 9 aa, Homo Sapiens
METRGCGTS

SEQ ID NO: 1117679 - protein, 9 aa, Homo Sapiens
RRPRTSHIS

SEQ ID NO: 1117680 - protein, 9 aa, Homo Sapiens
ATPSSGRHP

SEQ ID NO: 1117681 - protein, 9 aa, Homo Sapiens
PPTKKRGKS

SEQ ID NO: 1117682 - protein, 9 aa, Homo Sapiens
PSLPAGGSC

SEQ ID NO: 1117683 - protein, 9 aa, Homo Sapiens
QPLHKEIAL

SEQ ID NO: 1117684 - protein, 9 aa, Homo Sapiens
TIPLRSSWV

SEQ ID NO: 1117685 - protein, 9 aa, Homo Sapiens
TRAHCNSSN

SEQ ID NO: 1117686 - protein, 9 aa, Homo Sapiens
RHRFSINDH

SEQ ID NO: 1117687 - protein, 9 aa, Homo Sapiens
LVIIHWNAR

SEQ ID NO: 1117688 - protein, 9 aa, Homo Sapiens
SPTDALVWA

SEQ ID NO: 1117689 - protein, 9 aa, Homo Sapiens
RLVEGLQEA

SEQ ID NO: 1117690 - protein, 9 aa, Homo Sapiens
WSLCCTVII

SEQ ID NO: 1117691 - protein, 9 aa, Homo Sapiens
TSAAGCSIQ

SEQ ID NO: 1117692 - protein, 9 aa, Homo Sapiens
KPGAQETES

SEQ ID NO: 1117693 - protein, 9 aa, Homo Sapiens
MGGPSTCSG

SEQ ID NO: 1117694 - protein, 9 aa, Homo Sapiens
PTHTRLSLQ

SEQ ID NO: 1117695 - protein, 9 aa, Homo Sapiens
QASDSDSST

SEQ ID NO: 1117696 - protein, 9 aa, Homo Sapiens
EEFASVINS

SEQ ID NO: 1117697 - protein, 9 aa, Homo Sapiens
SLSPGLPGN

SEQ ID NO: 1117698 - protein, 9 aa, Homo Sapiens
TLILVIGAF

SEQ ID NO: 1117699 - protein, 9 aa, Homo Sapiens
ERGHRDVTG

SEQ ID NO: 1117700 - protein, 9 aa, Homo Sapiens
YQNVEDDAE

SEQ ID NO: 1117701 - protein, 9 aa, Homo Sapiens
WCVNCFSCS

SEQ ID NO: 1117702 - protein, 9 aa, Homo Sapiens
ATTRTRSPR

SEQ ID NO: 1117703 - protein, 9 aa, Homo Sapiens
AACLEPYTV

SEQ ID NO: 1117704 - protein, 9 aa, Homo Sapiens
LWHVQRSLV

SEQ ID NO: 1117705 - protein, 9 aa, Homo Sapiens
TSPLHALGA

SEQ ID NO: 1117706 - protein, 9 aa, Homo Sapiens
AALAVSSIK

SEQ ID NO: 1117707 - protein, 9 aa, Homo Sapiens
GKRLQPLWH

SEQ ID NO: 1117708 - protein, 9 aa, Homo Sapiens
SERQPRSPL

SEQ ID NO: 1117709 - protein, 9 aa, Homo Sapiens
SSSEEVSVS

SEQ ID NO: 1117710 - protein, 9 aa, Homo Sapiens
ISDERGWWK

SEQ ID NO: 1117711 - protein, 9 aa, Homo Sapiens
GRLGEYSLL

SEQ ID NO: 1117712 - protein, 9 aa, Homo Sapiens
PPPAWGPSP

SEQ ID NO: 1117713 - protein, 9 aa, Homo Sapiens
SAAPMAEEE

SEQ ID NO: 1117714 - protein, 9 aa, Homo Sapiens
KLPKEAVVL

SEQ ID NO: 1117715 - protein, 9 aa, Homo Sapiens
VTNPYNDLV

SEQ ID NO: 1117716 - protein, 9 aa, Homo Sapiens
GSGSGGSDS

SEQ ID NO: 1117717 - protein, 9 aa, Homo Sapiens
DLSPVKDLT

SEQ ID NO: 1117718 - protein, 9 aa, Homo Sapiens
DAYTQKLSV

SEQ ID NO: 1117719 - protein, 9 aa, Homo Sapiens
WTGTAGCCA

SEQ ID NO: 1117720 - protein, 9 aa, Homo Sapiens
EIIRHISAP

SEQ ID NO: 1117721 - protein, 9 aa, Homo Sapiens
QCCCCCGAG

SEQ ID NO: 1117722 - protein, 9 aa, Homo Sapiens
CCAPQAPHP

SEQ ID NO: 1117723 - protein, 9 aa, Homo Sapiens
GTPFVLLML

SEQ ID NO: 1117724 - protein, 9 aa, Homo Sapiens
QWSGCSRSL

SEQ ID NO: 1117725 - protein, 9 aa, Homo Sapiens
KKIYDSQPN

SEQ ID NO: 1117726 - protein, 9 aa, Homo Sapiens
IMHLTLQLD

SEQ ID NO: 1117727 - protein, 9 aa, Homo Sapiens
QQQVFERLV

SEQ ID NO: 1117728 - protein, 9 aa, Homo Sapiens
PAHRSIPNV

SEQ ID NO: 1117729 - protein, 9 aa, Homo Sapiens
AGKDPPAAP

SEQ ID NO: 1117730 - protein, 9 aa, Homo Sapiens
GSRSEISMG

SEQ ID NO: 1117731 - protein, 9 aa, Homo Sapiens
FCWFVHDFS

SEQ ID NO: 1117732 - protein, 9 aa, Homo Sapiens
PPKKFSILP

SEQ ID NO: 1117733 - protein, 9 aa, Homo Sapiens
ELEEQTCRA

SEQ ID NO: 1117734 - protein, 9 aa, Homo Sapiens
SLAAWDAPC

SEQ ID NO: 1117735 - protein, 9 aa, Homo Sapiens
AGAGGQAGA

SEQ ID NO: 1117736 - protein, 9 aa, Homo Sapiens
KVLRTRYNQ

SEQ ID NO: 1117737 - protein, 9 aa, Homo Sapiens
DGKWLSING

SEQ ID NO: 1117738 - protein, 9 aa, Homo Sapiens
KLLPDDRSL

SEQ ID NO: 1117739 - protein, 9 aa, Homo Sapiens
GCRPRSRTG

SEQ ID NO: 1117740 - protein, 9 aa, Homo Sapiens
CVLPGGTLE

SEQ ID NO: 1117741 - protein, 9 aa, Homo Sapiens
VEHAELILQ

SEQ ID NO: 1117742 - protein, 9 aa, Homo Sapiens
SGPVGPGGP

SEQ ID NO: 1117743 - protein, 9 aa, Homo Sapiens
GVEDIDSQV

SEQ ID NO: 1117744 - protein, 9 aa, Homo Sapiens
ATRPLARIL

SEQ ID NO: 1117745 - protein, 9 aa, Homo Sapiens
LALPILASR

SEQ ID NO: 1117746 - protein, 9 aa, Homo Sapiens
PVKMSTKNS

SEQ ID NO: 1117747 - protein, 9 aa, Homo Sapiens
GSWEWQRQA

SEQ ID NO: 1117748 - protein, 9 aa, Homo Sapiens
MQRQNFRSP

SEQ ID NO: 1117749 - protein, 9 aa, Homo Sapiens
CGAGVGVLR

SEQ ID NO: 1117750 - protein, 9 aa, Homo Sapiens
LVLQGALGL

SEQ ID NO: 1117751 - protein, 9 aa, Homo Sapiens
HQPPPPALQ

SEQ ID NO: 1117752 - protein, 9 aa, Homo Sapiens
STRASGPTP

SEQ ID NO: 1117753 - protein, 9 aa, Homo Sapiens
CCAQGRKPG

SEQ ID NO: 1117754 - protein, 9 aa, Homo Sapiens
ALSPAVPIR

SEQ ID NO: 1117755 - protein, 9 aa, Homo Sapiens
VLGHIWKLS

SEQ ID NO: 1117756 - protein, 9 aa, Homo Sapiens
TDVFRFPTY

SEQ ID NO: 1117757 - protein, 9 aa, Homo Sapiens
PFPPWKARW

SEQ ID NO: 1117758 - protein, 9 aa, Homo Sapiens
WLSSGTSPT

SEQ ID NO: 1117759 - protein, 9 aa, Homo Sapiens
SHDGSHQDM

SEQ ID NO: 1117760 - protein, 9 aa, Homo Sapiens
TGASTPARS

SEQ ID NO: 1117761 - protein, 9 aa, Homo Sapiens
KKELTMFSY

SEQ ID NO: 1117762 - protein, 9 aa, Homo Sapiens
IETVHGSVH

SEQ ID NO: 1117763 - protein, 9 aa, Homo Sapiens
LPDLGVRPL

SEQ ID NO: 1117764 - protein, 9 aa, Homo Sapiens
RHIRGNMGI

SEQ ID NO: 1117765 - protein, 9 aa, Homo Sapiens
RGQMAPPVL

SEQ ID NO: 1117766 - protein, 9 aa, Homo Sapiens
IESIMFHWK

SEQ ID NO: 1117767 - protein, 9 aa, Homo Sapiens
WPWRTRPVC

SEQ ID NO: 1117768 - protein, 9 aa, Homo Sapiens
TYIYPNIAM

SEQ ID NO: 1117769 - protein, 9 aa, Homo Sapiens
QQSFFVVVA

SEQ ID NO: 1117770 - protein, 9 aa, Homo Sapiens
RESLSSCQS

SEQ ID NO: 1117771 - protein, 9 aa, Homo Sapiens
LLSTVIRTL

SEQ ID NO: 1117772 - protein, 9 aa, Homo Sapiens
LDHCYVRPN

SEQ ID NO: 1117773 - protein, 9 aa, Homo Sapiens
WNGKKMLSL

SEQ ID NO: 1117774 - protein, 9 aa, Homo Sapiens
HRATAEQQE

SEQ ID NO: 1117775 - protein, 9 aa, Homo Sapiens
QPVLEAGSF

SEQ ID NO: 1117776 - protein, 9 aa, Homo Sapiens
KQWLVHSCW

SEQ ID NO: 1117777 - protein, 9 aa, Homo Sapiens
LVGQGFIPD

SEQ ID NO: 1117778 - protein, 9 aa, Homo Sapiens
PDRADISNC

SEQ ID NO: 1117779 - protein, 9 aa, Homo Sapiens
VEASGRGRW

SEQ ID NO: 1117780 - protein, 9 aa, Homo Sapiens
ATMSNQQPQ

SEQ ID NO: 1117781 - protein, 9 aa, Homo Sapiens
LHVNRATCY

SEQ ID NO: 1117782 - protein, 9 aa, Homo Sapiens
YKWMASSWK

SEQ ID NO: 1117783 - protein, 9 aa, Homo Sapiens
SAPNVVANT

SEQ ID NO: 1117784 - protein, 9 aa, Homo Sapiens
RSQHRPARR

SEQ ID NO: 1117785 - protein, 9 aa, Homo Sapiens
FLAERKVSP

SEQ ID NO: 1117786 - protein, 9 aa, Homo Sapiens
FPSTDDSLY

SEQ ID NO: 1117787 - protein, 9 aa, Homo Sapiens
SLVGQGFIP

SEQ ID NO: 1117788 - protein, 9 aa, Homo Sapiens
KESQASICQ

SEQ ID NO: 1117789 - protein, 9 aa, Homo Sapiens
RPPGPSRRE

SEQ ID NO: 1117790 - protein, 9 aa, Homo Sapiens
HTIEEAKAQ

SEQ ID NO: 1117791 - protein, 9 aa, Homo Sapiens
NIMDFGKNV

SEQ ID NO: 1117792 - protein, 9 aa, Homo Sapiens
LDPVFLVFA

SEQ ID NO: 1117793 - protein, 9 aa, Homo Sapiens
VISLYATGR

SEQ ID NO: 1117794 - protein, 9 aa, Homo Sapiens
QVPTLLESE

SEQ ID NO: 1117795 - protein, 9 aa, Homo Sapiens
EEISPSTVE

SEQ ID NO: 1117796 - protein, 9 aa, Homo Sapiens
QKKQLALKH

SEQ ID NO: 1117797 - protein, 9 aa, Homo Sapiens
WLPLTDIQI

SEQ ID NO: 1117798 - protein, 9 aa, Homo Sapiens
GMLPPPSSP

SEQ ID NO: 1117799 - protein, 9 aa, Homo Sapiens
IKHTQKKYI

SEQ ID NO: 1117800 - protein, 9 aa, Homo Sapiens
GTGERALPL

SEQ ID NO: 1117801 - protein, 9 aa, Homo Sapiens
AVECLGRPR

SEQ ID NO: 1117802 - protein, 9 aa, Homo Sapiens
GEELNHRTE

SEQ ID NO: 1117803 - protein, 9 aa, Homo Sapiens
TRTQQGMPA

SEQ ID NO: 1117804 - protein, 9 aa, Homo Sapiens
PHDVHHLIH

SEQ ID NO: 1117805 - protein, 9 aa, Homo Sapiens
SRHQTDKSE

SEQ ID NO: 1117806 - protein, 9 aa, Homo Sapiens
SRASWRSPT

SEQ ID NO: 1117807 - protein, 9 aa, Homo Sapiens
FFVKIFFQE

SEQ ID NO: 1117808 - protein, 9 aa, Homo Sapiens
NVNVVYAPW

SEQ ID NO: 1117809 - protein, 9 aa, Homo Sapiens
ERLLAPLIQ

SEQ ID NO: 1117810 - protein, 9 aa, Homo Sapiens
PGKHGAQKM

SEQ ID NO: 1117811 - protein, 9 aa, Homo Sapiens
HGLVTVRVP

SEQ ID NO: 1117812 - protein, 9 aa, Homo Sapiens
KGEYAFPAK

SEQ ID NO: 1117813 - protein, 9 aa, Homo Sapiens
KHSNPYVKT

SEQ ID NO: 1117814 - protein, 9 aa, Homo Sapiens
FVDGLTQKD

SEQ ID NO: 1117815 - protein, 9 aa, Homo Sapiens
SVLLKRSLK

SEQ ID NO: 1117816 - protein, 9 aa, Homo Sapiens
PGLRSMVSP

SEQ ID NO: 1117817 - protein, 9 aa, Homo Sapiens
HRFSINDHF

SEQ ID NO: 1117818 - protein, 9 aa, Homo Sapiens
PLCGLGFCP

SEQ ID NO: 1117819 - protein, 9 aa, Homo Sapiens
TYFLPFPPW

SEQ ID NO: 1117820 - protein, 9 aa, Homo Sapiens
TLEKSYIEC

SEQ ID NO: 1117821 - protein, 9 aa, Homo Sapiens
GWQQSWEIV

SEQ ID NO: 1117822 - protein, 9 aa, Homo Sapiens
ETVKMACPR

SEQ ID NO: 1117823 - protein, 9 aa, Homo Sapiens
SEVGWPEEE

SEQ ID NO: 1117824 - protein, 9 aa, Homo Sapiens
SFNGVRKYP

SEQ ID NO: 1117825 - protein, 9 aa, Homo Sapiens
SHPKGTASQ

SEQ ID NO: 1117826 - protein, 9 aa, Homo Sapiens
DLNLSVVAM

SEQ ID NO: 1117827 - protein, 9 aa, Homo Sapiens
LQPMKTVVW

SEQ ID NO: 1117828 - protein, 9 aa, Homo Sapiens
EMLKKVVRL

SEQ ID NO: 1117829 - protein, 9 aa, Homo Sapiens
VYCHMRKEG

SEQ ID NO: 1117830 - protein, 9 aa, Homo Sapiens
PLRLCWSVG

SEQ ID NO: 1117831 - protein, 9 aa, Homo Sapiens
GCPHTQGSR

SEQ ID NO: 1117832 - protein, 9 aa, Homo Sapiens
SRNIPEDNA

SEQ ID NO: 1117833 - protein, 9 aa, Homo Sapiens
VPPLVLNSP

SEQ ID NO: 1117834 - protein, 9 aa, Homo Sapiens
STLSQVAMC

SEQ ID NO: 1117835 - protein, 9 aa, Homo Sapiens
SERMEVVSH

SEQ ID NO: 1117836 - protein, 9 aa, Homo Sapiens
GSPHPQLQE

SEQ ID NO: 1117837 - protein, 9 aa, Homo Sapiens
RAGGTRLTT

SEQ ID NO: 1117838 - protein, 9 aa, Homo Sapiens
AAYAESARH

SEQ ID NO: 1117839 - protein, 9 aa, Homo Sapiens
PVLLGCWDQ

SEQ ID NO: 1117840 - protein, 9 aa, Homo Sapiens
RCASRRPLR

SEQ ID NO: 1117841 - protein, 9 aa, Homo Sapiens
TWGQSLDNL

SEQ ID NO: 1117842 - protein, 9 aa, Homo Sapiens
PGLHGSLLL

SEQ ID NO: 1117843 - protein, 9 aa, Homo Sapiens
QLQHAELAI

SEQ ID NO: 1117844 - protein, 9 aa, Homo Sapiens
PCPMLEHCN

SEQ ID NO: 1117845 - protein, 9 aa, Homo Sapiens
SSSSWKNRK

SEQ ID NO: 1117846 - protein, 9 aa, Homo Sapiens
LCPFRDVPS

SEQ ID NO: 1117847 - protein, 9 aa, Homo Sapiens
NRDTPPSKR

SEQ ID NO: 1117848 - protein, 9 aa, Homo Sapiens
SSSNEDENE

SEQ ID NO: 1117849 - protein, 9 aa, Homo Sapiens
CDALFNELT

SEQ ID NO: 1117850 - protein, 9 aa, Homo Sapiens
SFFSSKQVG

SEQ ID NO: 1117851 - protein, 9 aa, Homo Sapiens
LREAGIMGQ

SEQ ID NO: 1117852 - protein, 9 aa, Homo Sapiens
TLICQVFQI

SEQ ID NO: 1117853 - protein, 9 aa, Homo Sapiens
PCIGEESGG

SEQ ID NO: 1117854 - protein, 9 aa, Homo Sapiens
DITDIRKYK

SEQ ID NO: 1117855 - protein, 9 aa, Homo Sapiens
LTQPSPASA

SEQ ID NO: 1117856 - protein, 9 aa, Homo Sapiens
VNYSHLAKR

SEQ ID NO: 1117857 - protein, 9 aa, Homo Sapiens
SDSDSEPDS

SEQ ID NO: 1117858 - protein, 9 aa, Homo Sapiens
KLKRQSLKN

SEQ ID NO: 1117859 - protein, 9 aa, Homo Sapiens
TTAAGIPDL

SEQ ID NO: 1117860 - protein, 9 aa, Homo Sapiens
VSGAPTRGA

SEQ ID NO: 1117861 - protein, 9 aa, Homo Sapiens
EDVKWPNDI

SEQ ID NO: 1117862 - protein, 9 aa, Homo Sapiens
SETPRGPLV

SEQ ID NO: 1117863 - protein, 9 aa, Homo Sapiens
KAQLVCSVP

SEQ ID NO: 1117864 - protein, 9 aa, Homo Sapiens
QRGPTHTRL

SEQ ID NO: 1117865 - protein, 9 aa, Homo Sapiens
PGTSPGDQR

SEQ ID NO: 1117866 - protein, 9 aa, Homo Sapiens
REVQWALGA

SEQ ID NO: 1117867 - protein, 9 aa, Homo Sapiens
DSSSEKREK

SEQ ID NO: 1117868 - protein, 9 aa, Homo Sapiens
LHRLITAYQ

SEQ ID NO: 1117869 - protein, 9 aa, Homo Sapiens
VGLLPTLSL

SEQ ID NO: 1117870 - protein, 9 aa, Homo Sapiens
SGEKPHACR

SEQ ID NO: 1117871 - protein, 9 aa, Homo Sapiens
STLKEQFQS

SEQ ID NO: 1117872 - protein, 9 aa, Homo Sapiens
GVGLRRFPR

SEQ ID NO: 1117873 - protein, 9 aa, Homo Sapiens
HSVLETSAV

SEQ ID NO: 1117874 - protein, 9 aa, Homo Sapiens
RPAPEPTER

SEQ ID NO: 1117875 - protein, 9 aa, Homo Sapiens
EQKWTMFIT

SEQ ID NO: 1117876 - protein, 9 aa, Homo Sapiens
IVAPRGITP

SEQ ID NO: 1117877 - protein, 9 aa, Homo Sapiens
VPPAKILII

SEQ ID NO: 1117878 - protein, 9 aa, Homo Sapiens
EGLGHIEGS

SEQ ID NO: 1117879 - protein, 9 aa, Homo Sapiens
NNYIKIRDI

SEQ ID NO: 1117880 - protein, 9 aa, Homo Sapiens
LRRRCLRLL

SEQ ID NO: 1117881 - protein, 9 aa, Homo Sapiens
CASSRKRNK

SEQ ID NO: 1117882 - protein, 9 aa, Homo Sapiens
KSFEELQLK

SEQ ID NO: 1117883 - protein, 9 aa, Homo Sapiens
HALRILIHL

SEQ ID NO: 1117884 - protein, 9 aa, Homo Sapiens
TVAALWSGD

SEQ ID NO: 1117885 - protein, 9 aa, Homo Sapiens
TCSGWGRWT

SEQ ID NO: 1117886 - protein, 9 aa, Homo Sapiens
IQDAYTQKL

SEQ ID NO: 1117887 - protein, 9 aa, Homo Sapiens
KILDMRGLK

SEQ ID NO: 1117888 - protein, 9 aa, Homo Sapiens
GTTMCYGQT

SEQ ID NO: 1117889 - protein, 9 aa, Homo Sapiens
TNPYNDLVK

SEQ ID NO: 1117890 - protein, 9 aa, Homo Sapiens
HGDLRGRQC

SEQ ID NO: 1117891 - protein, 9 aa, Homo Sapiens
KSSEDVCKH

SEQ ID NO: 1117892 - protein, 9 aa, Homo Sapiens
SWAALPPSL

SEQ ID NO: 1117893 - protein, 9 aa, Homo Sapiens
EEPQRDKHL

SEQ ID NO: 1117894 - protein, 9 aa, Homo Sapiens
QGIQTRFSQ

SEQ ID NO: 1117895 - protein, 9 aa, Homo Sapiens
HGIAPDVVL

SEQ ID NO: 1117896 - protein, 9 aa, Homo Sapiens
HHHGGAGGF

SEQ ID NO: 1117897 - protein, 9 aa, Homo Sapiens
VLKENNAIP

SEQ ID NO: 1117898 - protein, 9 aa, Homo Sapiens
GIGLGVIIN

SEQ ID NO: 1117899 - protein, 9 aa, Homo Sapiens
TIDNICRCL

SEQ ID NO: 1117900 - protein, 9 aa, Homo Sapiens
TCAAENMVG

SEQ ID NO: 1117901 - protein, 9 aa, Homo Sapiens
PEDNKTKEL

SEQ ID NO: 1117902 - protein, 9 aa, Homo Sapiens
SQADSPCCS

SEQ ID NO: 1117903 - protein, 9 aa, Homo Sapiens
AALSACSSY

SEQ ID NO: 1117904 - protein, 9 aa, Homo Sapiens
LRPWKTSCT

SEQ ID NO: 1117905 - protein, 9 aa, Homo Sapiens
EELCPMGSC

SEQ ID NO: 1117906 - protein, 9 aa, Homo Sapiens
WAPAPGSPR

SEQ ID NO: 1117907 - protein, 9 aa, Homo Sapiens
PLLWTMTIK

SEQ ID NO: 1117908 - protein, 9 aa, Homo Sapiens
TTCPPTSCP

SEQ ID NO: 1117909 - protein, 9 aa, Homo Sapiens
FRNEMLKKV

SEQ ID NO: 1117910 - protein, 9 aa, Homo Sapiens
GSTHNRSAM

SEQ ID NO: 1117911 - protein, 9 aa, Homo Sapiens
MEDNKQIAL

SEQ ID NO: 1117912 - protein, 9 aa, Homo Sapiens
RAFGWARVT

SEQ ID NO: 1117913 - protein, 9 aa, Homo Sapiens
GLPAVLMVI

SEQ ID NO: 1117914 - protein, 9 aa, Homo Sapiens
TGEVWRGCR

SEQ ID NO: 1117915 - protein, 9 aa, Homo Sapiens
MNLMTVTGN

SEQ ID NO: 1117916 - protein, 9 aa, Homo Sapiens
LTWASPLAS

SEQ ID NO: 1117917 - protein, 9 aa, Homo Sapiens
YGSTGIRDM

SEQ ID NO: 1117918 - protein, 9 aa, Homo Sapiens
QGLVAAYSG

SEQ ID NO: 1117919 - protein, 9 aa, Homo Sapiens
VAASSVVRL

SEQ ID NO: 1117920 - protein, 9 aa, Homo Sapiens
CSLCTTGLL

SEQ ID NO: 1117921 - protein, 9 aa, Homo Sapiens
DRPSPPQGL

SEQ ID NO: 1117922 - protein, 9 aa, Homo Sapiens
SRVCGADVA

SEQ ID NO: 1117923 - protein, 9 aa, Homo Sapiens
HFCGTCNHL

SEQ ID NO: 1117924 - protein, 9 aa, Homo Sapiens
KMLSLTHLF

SEQ ID NO: 1117925 - protein, 9 aa, Homo Sapiens
AATRGISTC

SEQ ID NO: 1117926 - protein, 9 aa, Homo Sapiens
YIKIRDIPS

SEQ ID NO: 1117927 - protein, 9 aa, Homo Sapiens
SNEDENEAE

SEQ ID NO: 1117928 - protein, 9 aa, Homo Sapiens
NIEEVLPHW

SEQ ID NO: 1117929 - protein, 9 aa, Homo Sapiens
KAKFCIFSS

SEQ ID NO: 1117930 - protein, 9 aa, Homo Sapiens
RYIRQGLCW

SEQ ID NO: 1117931 - protein, 9 aa, Homo Sapiens
GAFSEKVSA

SEQ ID NO: 1117932 - protein, 9 aa, Homo Sapiens
SIHVIQQGA

SEQ ID NO: 1117933 - protein, 9 aa, Homo Sapiens
KIPRLLVSR

SEQ ID NO: 1117934 - protein, 9 aa, Homo Sapiens
NTEENDTDE

SEQ ID NO: 1117935 - protein, 9 aa, Homo Sapiens
PRAGCPHTQ

SEQ ID NO: 1117936 - protein, 9 aa, Homo Sapiens
SFSRSRACW

SEQ ID NO: 1117937 - protein, 9 aa, Homo Sapiens
WHSHDTDNA

SEQ ID NO: 1117938 - protein, 9 aa, Homo Sapiens
PPPLSLPTR

SEQ ID NO: 1117939 - protein, 9 aa, Homo Sapiens
LRRPRPSLR

SEQ ID NO: 1117940 - protein, 9 aa, Homo Sapiens
ENGLLKNTC

SEQ ID NO: 1117941 - protein, 9 aa, Homo Sapiens
PQSYHAPIK

SEQ ID NO: 1117942 - protein, 9 aa, Homo Sapiens
QRTTRATLI

SEQ ID NO: 1117943 - protein, 9 aa, Homo Sapiens
GMTCQSRSS

SEQ ID NO: 1117944 - protein, 9 aa, Homo Sapiens
LSEGELGAP

SEQ ID NO: 1117945 - protein, 9 aa, Homo Sapiens
KKKFMADLK

SEQ ID NO: 1117946 - protein, 9 aa, Homo Sapiens
MRRRDTPRR

SEQ ID NO: 1117947 - protein, 9 aa, Homo Sapiens
EDEEEEEAE

SEQ ID NO: 1117948 - protein, 9 aa, Homo Sapiens
GVVDNNHCQ

SEQ ID NO: 1117949 - protein, 9 aa, Homo Sapiens
KLGGRVKMW

SEQ ID NO: 1117950 - protein, 9 aa, Homo Sapiens
SFGSGPGVE

SEQ ID NO: 1117951 - protein, 9 aa, Homo Sapiens
LPYFIYSYI

SEQ ID NO: 1117952 - protein, 9 aa, Homo Sapiens
VIDLDPQLR

SEQ ID NO: 1117953 - protein, 9 aa, Homo Sapiens
CQPRMKPAS

SEQ ID NO: 1117954 - protein, 9 aa, Homo Sapiens
RTLEGCISV

SEQ ID NO: 1117955 - protein, 9 aa, Homo Sapiens
LGAHFIAQD

SEQ ID NO: 1117956 - protein, 9 aa, Homo Sapiens
AEHINGPRD

SEQ ID NO: 1117957 - protein, 9 aa, Homo Sapiens
ESIHGEKFE

SEQ ID NO: 1117958 - protein, 9 aa, Homo Sapiens
SHWPFLKLL

SEQ ID NO: 1117959 - protein, 9 aa, Homo Sapiens
QHLLSYDSL

SEQ ID NO: 1117960 - protein, 9 aa, Homo Sapiens
LIPCIMVSE

SEQ ID NO: 1117961 - protein, 9 aa, Homo Sapiens
EALCQKGER

SEQ ID NO: 1117962 - protein, 9 aa, Homo Sapiens
MMSSCGILT

SEQ ID NO: 1117963 - protein, 9 aa, Homo Sapiens
DMGKMLGER

SEQ ID NO: 1117964 - protein, 9 aa, Homo Sapiens
YYNMANGTV

SEQ ID NO: 1117965 - protein, 9 aa, Homo Sapiens
HREDVPRQQ

SEQ ID NO: 1117966 - protein, 9 aa, Homo Sapiens
DDTSELEEP

SEQ ID NO: 1117967 - protein, 9 aa, Homo Sapiens
VSVGLQGKL

SEQ ID NO: 1117968 - protein, 9 aa, Homo Sapiens
CGGSEAKGK

SEQ ID NO: 1117969 - protein, 9 aa, Homo Sapiens
RELSILWGV

SEQ ID NO: 1117970 - protein, 9 aa, Homo Sapiens
LYPVLCSLC

SEQ ID NO: 1117971 - protein, 9 aa, Homo Sapiens
LMIEYSEPW

SEQ ID NO: 1117972 - protein, 9 aa, Homo Sapiens
PLSKELWQK

SEQ ID NO: 1117973 - protein, 9 aa, Homo Sapiens
IQKGSHPDA

SEQ ID NO: 1117974 - protein, 9 aa, Homo Sapiens
MITIAVKYK

SEQ ID NO: 1117975 - protein, 9 aa, Homo Sapiens
DSQVDGSSQ

SEQ ID NO: 1117976 - protein, 9 aa, Homo Sapiens
KDVGSKDKV

SEQ ID NO: 1117977 - protein, 9 aa, Homo Sapiens
ILTADRSGD

SEQ ID NO: 1117978 - protein, 9 aa, Homo Sapiens
PSGDMMSSG

SEQ ID NO: 1117979 - protein, 9 aa, Homo Sapiens
RGTESCEGD

SEQ ID NO: 1117980 - protein, 9 aa, Homo Sapiens
FRNVTVQIA

SEQ ID NO: 1117981 - protein, 9 aa, Homo Sapiens
LAAIKVMVV

SEQ ID NO: 1117982 - protein, 9 aa, Homo Sapiens
LYVFLNVIV

SEQ ID NO: 1117983 - protein, 9 aa, Homo Sapiens
VVLSTKSPA

SEQ ID NO: 1117984 - protein, 9 aa, Homo Sapiens
PKGIAGSVV

SEQ ID NO: 1117985 - protein, 9 aa, Homo Sapiens
NSIGFLLDQ

SEQ ID NO: 1117986 - protein, 9 aa, Homo Sapiens
GLGQVFATQ

SEQ ID NO: 1117987 - protein, 9 aa, Homo Sapiens
EGEYTAFPS

SEQ ID NO: 1117988 - protein, 9 aa, Homo Sapiens
DKDLDRIFL

SEQ ID NO: 1117989 - protein, 9 aa, Homo Sapiens
LTEAIKAFF

SEQ ID NO: 1117990 - protein, 9 aa, Homo Sapiens
ADPAPSPSR

SEQ ID NO: 1117991 - protein, 9 aa, Homo Sapiens
INGILLSGA

SEQ ID NO: 1117992 - protein, 9 aa, Homo Sapiens
KVFGKAVQD

SEQ ID NO: 1117993 - protein, 9 aa, Homo Sapiens
QGPVMAWTS

SEQ ID NO: 1117994 - protein, 9 aa, Homo Sapiens
QGSKASKEF

SEQ ID NO: 1117995 - protein, 9 aa, Homo Sapiens
QRPGRKHPP

SEQ ID NO: 1117996 - protein, 9 aa, Homo Sapiens
TLLHRATAE

SEQ ID NO: 1117997 - protein, 9 aa, Homo Sapiens
CFVDSGAPQ

SEQ ID NO: 1117998 - protein, 9 aa, Homo Sapiens
PVFLRRSRQ

SEQ ID NO: 1117999 - protein, 9 aa, Homo Sapiens
LTPPHPART

SEQ ID NO: 1118000 - protein, 9 aa, Homo Sapiens
AAIWRRIGA

SEQ ID NO: 1118001 - protein, 9 aa, Homo Sapiens
QFEQKWTMF

SEQ ID NO: 1118002 - protein, 9 aa, Homo Sapiens
YDHVLFLID

SEQ ID NO: 1118003 - protein, 9 aa, Homo Sapiens
TSSSLEPTP

SEQ ID NO: 1118004 - protein, 9 aa, Homo Sapiens
FSLRNFEVG

SEQ ID NO: 1118005 - protein, 9 aa, Homo Sapiens
PLPLSYVPD

SEQ ID NO: 1118006 - protein, 9 aa, Homo Sapiens
GLQEASAAR

SEQ ID NO: 1118007 - protein, 9 aa, Homo Sapiens
EQMRWPTGT

SEQ ID NO: 1118008 - protein, 9 aa, Homo Sapiens
WLTVYKPEV

SEQ ID NO: 1118009 - protein, 9 aa, Homo Sapiens
QLQDAEQQL

SEQ ID NO: 1118010 - protein, 9 aa, Homo Sapiens
SSVNQSDSQ

SEQ ID NO: 1118011 - protein, 9 aa, Homo Sapiens
QETITNLER

SEQ ID NO: 1118012 - protein, 9 aa, Homo Sapiens
GNYARLNMK

SEQ ID NO: 1118013 - protein, 9 aa, Homo Sapiens
CTTGLLTLL

SEQ ID NO: 1118014 - protein, 9 aa, Homo Sapiens
LVGGEITDD

SEQ ID NO: 1118015 - protein, 9 aa, Homo Sapiens
KMNGDGTVQ

SEQ ID NO: 1118016 - protein, 9 aa, Homo Sapiens
INVPVEAVS

SEQ ID NO: 1118017 - protein, 9 aa, Homo Sapiens
FEHLQTVTN

SEQ ID NO: 1118018 - protein, 9 aa, Homo Sapiens
YKLKMACKE

SEQ ID NO: 1118019 - protein, 9 aa, Homo Sapiens
LPGPRRPKQ

SEQ ID NO: 1118020 - protein, 9 aa, Homo Sapiens
HAFFCEERG

SEQ ID NO: 1118021 - protein, 9 aa, Homo Sapiens
IDDMELTLT

SEQ ID NO: 1118022 - protein, 9 aa, Homo Sapiens
PSCTDEAEE

SEQ ID NO: 1118023 - protein, 9 aa, Homo Sapiens
GHHQRRAGR

SEQ ID NO: 1118024 - protein, 9 aa, Homo Sapiens
SVYYSVIPP

SEQ ID NO: 1118025 - protein, 9 aa, Homo Sapiens
EEKAMREQE

SEQ ID NO: 1118026 - protein, 9 aa, Homo Sapiens
QNHSKCITE

SEQ ID NO: 1118027 - protein, 9 aa, Homo Sapiens
VPVESSSPM

SEQ ID NO: 1118028 - protein, 9 aa, Homo Sapiens
IDPTELEDF

SEQ ID NO: 1118029 - protein, 9 aa, Homo Sapiens
KQTYAAPKV

SEQ ID NO: 1118030 - protein, 9 aa, Homo Sapiens
PLFKHKSTV

SEQ ID NO: 1118031 - protein, 9 aa, Homo Sapiens
DGPPTTRCT

SEQ ID NO: 1118032 - protein, 9 aa, Homo Sapiens
LGHLQDLLL

SEQ ID NO: 1118033 - protein, 9 aa, Homo Sapiens
VCSGRLLGA

SEQ ID NO: 1118034 - protein, 9 aa, Homo Sapiens
LILVYPIIF

SEQ ID NO: 1118035 - protein, 9 aa, Homo Sapiens
GHTSTLIKH

SEQ ID NO: 1118036 - protein, 9 aa, Homo Sapiens
TVPEHSATS

SEQ ID NO: 1118037 - protein, 9 aa, Homo Sapiens
LSLQCQSLA

SEQ ID NO: 1118038 - protein, 9 aa, Homo Sapiens
EDSQLASHL

SEQ ID NO: 1118039 - protein, 9 aa, Homo Sapiens
PVGPGGPGG

SEQ ID NO: 1118040 - protein, 9 aa, Homo Sapiens
PGVMVYSGG

SEQ ID NO: 1118041 - protein, 9 aa, Homo Sapiens
RGLGPGLLL

SEQ ID NO: 1118042 - protein, 9 aa, Homo Sapiens
SYGESSLAH

SEQ ID NO: 1118043 - protein, 9 aa, Homo Sapiens
SPHPQLQEL

SEQ ID NO: 1118044 - protein, 9 aa, Homo Sapiens
SEVYRQLEL

SEQ ID NO: 1118045 - protein, 9 aa, Homo Sapiens
FKHKSTVQV

SEQ ID NO: 1118046 - protein, 9 aa, Homo Sapiens
GGSDVQSYS

SEQ ID NO: 1118047 - protein, 9 aa, Homo Sapiens
IHLGLGLLQ

SEQ ID NO: 1118048 - protein, 9 aa, Homo Sapiens
VAQAKLTGG

SEQ ID NO: 1118049 - protein, 9 aa, Homo Sapiens
PPDRPPGPP

SEQ ID NO: 1118050 - protein, 9 aa, Homo Sapiens
PPPLPPWPA

SEQ ID NO: 1118051 - protein, 9 aa, Homo Sapiens
VACSARWKG

SEQ ID NO: 1118052 - protein, 9 aa, Homo Sapiens
RSGTPSVWS

SEQ ID NO: 1118053 - protein, 9 aa, Homo Sapiens
LQEASAARE

SEQ ID NO: 1118054 - protein, 9 aa, Homo Sapiens
TKNLLSYWH

SEQ ID NO: 1118055 - protein, 9 aa, Homo Sapiens
RWDDRGEGL

SEQ ID NO: 1118056 - protein, 9 aa, Homo Sapiens
VAFLPPMHC

SEQ ID NO: 1118057 - protein, 9 aa, Homo Sapiens
KARSDAAPG

SEQ ID NO: 1118058 - protein, 9 aa, Homo Sapiens
FSPFAGCVY

SEQ ID NO: 1118059 - protein, 9 aa, Homo Sapiens
FVIPKKANS

SEQ ID NO: 1118060 - protein, 9 aa, Homo Sapiens
PVTRLRTTW

SEQ ID NO: 1118061 - protein, 9 aa, Homo Sapiens
ENMSAGYHL

SEQ ID NO: 1118062 - protein, 9 aa, Homo Sapiens
SSRPSNQCH

SEQ ID NO: 1118063 - protein, 9 aa, Homo Sapiens
IMYSLPLTY

SEQ ID NO: 1118064 - protein, 9 aa, Homo Sapiens
YVKIFISLP

SEQ ID NO: 1118065 - protein, 9 aa, Homo Sapiens
SLCTTGLLT

SEQ ID NO: 1118066 - protein, 9 aa, Homo Sapiens
GGESIHGEK

SEQ ID NO: 1118067 - protein, 9 aa, Homo Sapiens
PHLQINCSR

SEQ ID NO: 1118068 - protein, 9 aa, Homo Sapiens
DITVYHELV

SEQ ID NO: 1118069 - protein, 9 aa, Homo Sapiens
DSLAGRGLP

SEQ ID NO: 1118070 - protein, 9 aa, Homo Sapiens
PVELEQVHQ

SEQ ID NO: 1118071 - protein, 9 aa, Homo Sapiens
SDMAVLSVR

SEQ ID NO: 1118072 - protein, 9 aa, Homo Sapiens
NQEKIAGSL

SEQ ID NO: 1118073 - protein, 9 aa, Homo Sapiens
LGRPRPCGG

SEQ ID NO: 1118074 - protein, 9 aa, Homo Sapiens
STRSAVMSA

SEQ ID NO: 1118075 - protein, 9 aa, Homo Sapiens
QVLEMVGQI

SEQ ID NO: 1118076 - protein, 9 aa, Homo Sapiens
DHGWAFSPA

SEQ ID NO: 1118077 - protein, 9 aa, Homo Sapiens
SPAAVCSGR

SEQ ID NO: 1118078 - protein, 9 aa, Homo Sapiens
ERRYHQITI

SEQ ID NO: 1118079 - protein, 9 aa, Homo Sapiens
PRNQTLDGT

SEQ ID NO: 1118080 - protein, 9 aa, Homo Sapiens
RSKMNIPFC

SEQ ID NO: 1118081 - protein, 9 aa, Homo Sapiens
LMCMINQLT

SEQ ID NO: 1118082 - protein, 9 aa, Homo Sapiens
RHTVSWGSL

SEQ ID NO: 1118083 - protein, 9 aa, Homo Sapiens
DNSDEENCV

SEQ ID NO: 1118084 - protein, 9 aa, Homo Sapiens
ETVHGSVHV

SEQ ID NO: 1118085 - protein, 9 aa, Homo Sapiens
NKTKSEKLA

SEQ ID NO: 1118086 - protein, 9 aa, Homo Sapiens
CRGLQTDGV

SEQ ID NO: 1118087 - protein, 9 aa, Homo Sapiens
SLRMTPTCP

SEQ ID NO: 1118088 - protein, 9 aa, Homo Sapiens
VLEAFGNAH

SEQ ID NO: 1118089 - protein, 9 aa, Homo Sapiens
AEFTTTEGT

SEQ ID NO: 1118090 - protein, 9 aa, Homo Sapiens
RPEQLPQHA

SEQ ID NO: 1118091 - protein, 9 aa, Homo Sapiens
EDLLYLRTS

SEQ ID NO: 1118092 - protein, 9 aa, Homo Sapiens
RRLVEGLQE

SEQ ID NO: 1118093 - protein, 9 aa, Homo Sapiens
AAMQGTGIQ

SEQ ID NO: 1118094 - protein, 9 aa, Homo Sapiens
TKSSEDVCK

SEQ ID NO: 1118095 - protein, 9 aa, Homo Sapiens
LCFSVRNVF

SEQ ID NO: 1118096 - protein, 9 aa, Homo Sapiens
GHLWKRQMA

SEQ ID NO: 1118097 - protein, 9 aa, Homo Sapiens
DLDHTQHQF

SEQ ID NO: 1118098 - protein, 9 aa, Homo Sapiens
GADVEPDLH

SEQ ID NO: 1118099 - protein, 9 aa, Homo Sapiens
EAFRSASHL

SEQ ID NO: 1118100 - protein, 9 aa, Homo Sapiens
TATPSSGRH

SEQ ID NO: 1118101 - protein, 9 aa, Homo Sapiens
PLSSSPTSL

SEQ ID NO: 1118102 - protein, 9 aa, Homo Sapiens
SSFCLRDET

SEQ ID NO: 1118103 - protein, 9 aa, Homo Sapiens
RRLHSGENL

SEQ ID NO: 1118104 - protein, 9 aa, Homo Sapiens
FRQDGDEAV

SEQ ID NO: 1118105 - protein, 9 aa, Homo Sapiens
PLPHGAARP

SEQ ID NO: 1118106 - protein, 9 aa, Homo Sapiens
SRTFLDRVY

SEQ ID NO: 1118107 - protein, 9 aa, Homo Sapiens
SIQERRRPK

SEQ ID NO: 1118108 - protein, 9 aa, Homo Sapiens
VGNTYGRTA

SEQ ID NO: 1118109 - protein, 9 aa, Homo Sapiens
GAAMQGTGI

SEQ ID NO: 1118110 - protein, 9 aa, Homo Sapiens
IDAIHEVET

SEQ ID NO: 1118111 - protein, 9 aa, Homo Sapiens
YCSGSSTLA

SEQ ID NO: 1118112 - protein, 9 aa, Homo Sapiens
IRMSSDAFG

SEQ ID NO: 1118113 - protein, 9 aa, Homo Sapiens
LGRLLAPGR

SEQ ID NO: 1118114 - protein, 9 aa, Homo Sapiens
VLHASCDAP

SEQ ID NO: 1118115 - protein, 9 aa, Homo Sapiens
RSLGNMYHL

SEQ ID NO: 1118116 - protein, 9 aa, Homo Sapiens
PAVREDNRH

SEQ ID NO: 1118117 - protein, 9 aa, Homo Sapiens
EKREKDQRD

SEQ ID NO: 1118118 - protein, 9 aa, Homo Sapiens
TAAVLDLIC

SEQ ID NO: 1118119 - protein, 9 aa, Homo Sapiens
KATDELQRL

SEQ ID NO: 1118120 - protein, 9 aa, Homo Sapiens
AQDKYPAAH

SEQ ID NO: 1118121 - protein, 9 aa, Homo Sapiens
GLVTVRVPL

SEQ ID NO: 1118122 - protein, 9 aa, Homo Sapiens
EGVSSALRF

SEQ ID NO: 1118123 - protein, 9 aa, Homo Sapiens
VKMLLLSAL

SEQ ID NO: 1118124 - protein, 9 aa, Homo Sapiens
NADIACLCV

SEQ ID NO: 1118125 - protein, 9 aa, Homo Sapiens
CVILVGEMQ

SEQ ID NO: 1118126 - protein, 9 aa, Homo Sapiens
TSRDSRSFF

SEQ ID NO: 1118127 - protein, 9 aa, Homo Sapiens
HSYPVIPVP

SEQ ID NO: 1118128 - protein, 9 aa, Homo Sapiens
PCCVPTTYA

SEQ ID NO: 1118129 - protein, 9 aa, Homo Sapiens
GDYQATPEA

SEQ ID NO: 1118130 - protein, 9 aa, Homo Sapiens
ASSHAPRSL

SEQ ID NO: 1118131 - protein, 9 aa, Homo Sapiens
QCGRRDRGV

SEQ ID NO: 1118132 - protein, 9 aa, Homo Sapiens
AVQDLSRIS

SEQ ID NO: 1118133 - protein, 9 aa, Homo Sapiens
QIYFMACTV

SEQ ID NO: 1118134 - protein, 9 aa, Homo Sapiens
AVITGHDHE

SEQ ID NO: 1118135 - protein, 9 aa, Homo Sapiens
VPDAPSPTQ

SEQ ID NO: 1118136 - protein, 9 aa, Homo Sapiens
SAHPHPWLR

SEQ ID NO: 1118137 - protein, 9 aa, Homo Sapiens
KHRGEGEHK

SEQ ID NO: 1118138 - protein, 9 aa, Homo Sapiens
RRFPRVGFH

SEQ ID NO: 1118139 - protein, 9 aa, Homo Sapiens
AIVKAMYYL

SEQ ID NO: 1118140 - protein, 9 aa, Homo Sapiens
LVWYMGYDA

SEQ ID NO: 1118141 - protein, 9 aa, Homo Sapiens
CHFPAILSL

SEQ ID NO: 1118142 - protein, 9 aa, Homo Sapiens
GDSSELRPV

SEQ ID NO: 1118143 - protein, 9 aa, Homo Sapiens
TITSRDATR

SEQ ID NO: 1118144 - protein, 9 aa, Homo Sapiens
EEDVCENII

SEQ ID NO: 1118145 - protein, 9 aa, Homo Sapiens
ERLKHNPPI

SEQ ID NO: 1118146 - protein, 9 aa, Homo Sapiens
WPAKDMFDH

SEQ ID NO: 1118147 - protein, 9 aa, Homo Sapiens
LTFLQYPHF

SEQ ID NO: 1118148 - protein, 9 aa, Homo Sapiens
RDREPDTSN

SEQ ID NO: 1118149 - protein, 9 aa, Homo Sapiens
AHTIQTAFR

SEQ ID NO: 1118150 - protein, 9 aa, Homo Sapiens
RVTLSGIYQ

SEQ ID NO: 1118151 - protein, 9 aa, Homo Sapiens
PVLPAGRIR

SEQ ID NO: 1118152 - protein, 9 aa, Homo Sapiens
AEALCQKGE

SEQ ID NO: 1118153 - protein, 9 aa, Homo Sapiens
KPKRGSSFS

SEQ ID NO: 1118154 - protein, 9 aa, Homo Sapiens
RDDLIVSIL

SEQ ID NO: 1118155 - protein, 9 aa, Homo Sapiens
LPPRAPHPP

SEQ ID NO: 1118156 - protein, 9 aa, Homo Sapiens
VQCFLCCSA

SEQ ID NO: 1118157 - protein, 9 aa, Homo Sapiens
PLLLAADQL

SEQ ID NO: 1118158 - protein, 9 aa, Homo Sapiens
GPLVGISAM

SEQ ID NO: 1118159 - protein, 9 aa, Homo Sapiens
NACHFPAIL

SEQ ID NO: 1118160 - protein, 9 aa, Homo Sapiens
RKRRRGSDG

SEQ ID NO: 1118161 - protein, 9 aa, Homo Sapiens
REGWESQDA

SEQ ID NO: 1118162 - protein, 9 aa, Homo Sapiens
LRCPTEPLG

SEQ ID NO: 1118163 - protein, 9 aa, Homo Sapiens
GSLLLTNVP

SEQ ID NO: 1118164 - protein, 9 aa, Homo Sapiens
GTCCHENID

SEQ ID NO: 1118165 - protein, 9 aa, Homo Sapiens
SHFLAERKV

SEQ ID NO: 1118166 - protein, 9 aa, Homo Sapiens
PFADTFKKC

SEQ ID NO: 1118167 - protein, 9 aa, Homo Sapiens
QAMANSQGE

SEQ ID NO: 1118168 - protein, 9 aa, Homo Sapiens
GCCAKPCPG

SEQ ID NO: 1118169 - protein, 9 aa, Homo Sapiens
ADLRHPRRR

SEQ ID NO: 1118170 - protein, 9 aa, Homo Sapiens
TIWWSVAGL

SEQ ID NO: 1118171 - protein, 9 aa, Homo Sapiens
QIPFPRCSR

SEQ ID NO: 1118172 - protein, 9 aa, Homo Sapiens
TYGRTAGQL

SEQ ID NO: 1118173 - protein, 9 aa, Homo Sapiens
STFMPYEIK

SEQ ID NO: 1118174 - protein, 9 aa, Homo Sapiens
YLWGMDWIL

SEQ ID NO: 1118175 - protein, 9 aa, Homo Sapiens
ISVSLVVAA

SEQ ID NO: 1118176 - protein, 9 aa, Homo Sapiens
HGWPMSSPW

SEQ ID NO: 1118177 - protein, 9 aa, Homo Sapiens
KQQLEEEQR

SEQ ID NO: 1118178 - protein, 9 aa, Homo Sapiens
SPHQAVCLT

SEQ ID NO: 1118179 - protein, 9 aa, Homo Sapiens
YKVDSPKNS

SEQ ID NO: 1118180 - protein, 9 aa, Homo Sapiens
KMARIFTHH

SEQ ID NO: 1118181 - protein, 9 aa, Homo Sapiens
QSTELRPQH

SEQ ID NO: 1118182 - protein, 9 aa, Homo Sapiens
TWAPRRTPM

SEQ ID NO: 1118183 - protein, 9 aa, Homo Sapiens
LNLSVVAMA

SEQ ID NO: 1118184 - protein, 9 aa, Homo Sapiens
KVLASHKCL

SEQ ID NO: 1118185 - protein, 9 aa, Homo Sapiens
LTGKILTLL

SEQ ID NO: 1118186 - protein, 9 aa, Homo Sapiens
MQNESFTEE

SEQ ID NO: 1118187 - protein, 9 aa, Homo Sapiens
QIVDILSTS

SEQ ID NO: 1118188 - protein, 9 aa, Homo Sapiens
RVRNLTYMM

SEQ ID NO: 1118189 - protein, 9 aa, Homo Sapiens
TLGSNVTLQ

SEQ ID NO: 1118190 - protein, 9 aa, Homo Sapiens
RKVRGGCPW

SEQ ID NO: 1118191 - protein, 9 aa, Homo Sapiens
TSSQMWWRR

SEQ ID NO: 1118192 - protein, 9 aa, Homo Sapiens
PMNPPKYGK

SEQ ID NO: 1118193 - protein, 9 aa, Homo Sapiens
QCNPRLDFH

SEQ ID NO: 1118194 - protein, 9 aa, Homo Sapiens
IFHILLLHQ

SEQ ID NO: 1118195 - protein, 9 aa, Homo Sapiens
LCQTLAITS

SEQ ID NO: 1118196 - protein, 9 aa, Homo Sapiens
WLPMGSLSP

SEQ ID NO: 1118197 - protein, 9 aa, Homo Sapiens
AMITIAVKY

SEQ ID NO: 1118198 - protein, 9 aa, Homo Sapiens
AGAEGRGTE

SEQ ID NO: 1118199 - protein, 9 aa, Homo Sapiens
VHRLWVSRL

SEQ ID NO: 1118200 - protein, 9 aa, Homo Sapiens
SRCPPRSRK

SEQ ID NO: 1118201 - protein, 9 aa, Homo Sapiens
CGGPQGAFS

SEQ ID NO: 1118202 - protein, 9 aa, Homo Sapiens
RKEDRPKVQ

SEQ ID NO: 1118203 - protein, 9 aa, Homo Sapiens
PKRSKKSHK

SEQ ID NO: 1118204 - protein, 9 aa, Homo Sapiens
PCLVEGTAV

SEQ ID NO: 1118205 - protein, 9 aa, Homo Sapiens
LPLIHPRPP

SEQ ID NO: 1118206 - protein, 9 aa, Homo Sapiens
SGLVGLFRA

SEQ ID NO: 1118207 - protein, 9 aa, Homo Sapiens
LMHFCWLMA

SEQ ID NO: 1118208 - protein, 9 aa, Homo Sapiens
FGQEVYCHM

SEQ ID NO: 1118209 - protein, 9 aa, Homo Sapiens
HKHPVPAKR

SEQ ID NO: 1118210 - protein, 9 aa, Homo Sapiens
EGLTSRAPP

SEQ ID NO: 1118211 - protein, 9 aa, Homo Sapiens
VLAPGGGVA

SEQ ID NO: 1118212 - protein, 9 aa, Homo Sapiens
EAVKYSDVE

SEQ ID NO: 1118213 - protein, 9 aa, Homo Sapiens
KTLPQPGAE

SEQ ID NO: 1118214 - protein, 9 aa, Homo Sapiens
VITFTDVSE

SEQ ID NO: 1118215 - protein, 9 aa, Homo Sapiens
SWPTRRSTM

SEQ ID NO: 1118216 - protein, 9 aa, Homo Sapiens
RNLASIGKN

SEQ ID NO: 1118217 - protein, 9 aa, Homo Sapiens
RTQDLKTKS

SEQ ID NO: 1118218 - protein, 9 aa, Homo Sapiens
TDFSQSTST

SEQ ID NO: 1118219 - protein, 9 aa, Homo Sapiens
LAAVLCDCY

SEQ ID NO: 1118220 - protein, 9 aa, Homo Sapiens
AAVQLMAEA

SEQ ID NO: 1118221 - protein, 9 aa, Homo Sapiens
AGASRSGRN

SEQ ID NO: 1118222 - protein, 9 aa, Homo Sapiens
VKSENKQRK

SEQ ID NO: 1118223 - protein, 9 aa, Homo Sapiens
CCHRTPWLC

SEQ ID NO: 1118224 - protein, 9 aa, Homo Sapiens
QVSQQGRGV

SEQ ID NO: 1118225 - protein, 9 aa, Homo Sapiens
RVLDPPFWL

SEQ ID NO: 1118226 - protein, 9 aa, Homo Sapiens
HTEPVVLLV

SEQ ID NO: 1118227 - protein, 9 aa, Homo Sapiens
RVLKSLWKE

SEQ ID NO: 1118228 - protein, 9 aa, Homo Sapiens
QNESFTEEL

SEQ ID NO: 1118229 - protein, 9 aa, Homo Sapiens
APAESHLLN

SEQ ID NO: 1118230 - protein, 9 aa, Homo Sapiens
QRMYSIMDE

SEQ ID NO: 1118231 - protein, 9 aa, Homo Sapiens
CLRTGQTRG

SEQ ID NO: 1118232 - protein, 9 aa, Homo Sapiens
TMRCNLHRC

SEQ ID NO: 1118233 - protein, 9 aa, Homo Sapiens
NDVATPACI

SEQ ID NO: 1118234 - protein, 9 aa, Homo Sapiens
HQPKVAQCL

SEQ ID NO: 1118235 - protein, 9 aa, Homo Sapiens
PPADPAPSP

SEQ ID NO: 1118236 - protein, 9 aa, Homo Sapiens
APFPATARG

SEQ ID NO: 1118237 - protein, 9 aa, Homo Sapiens
ILNLQVLKK

SEQ ID NO: 1118238 - protein, 9 aa, Homo Sapiens
CHLLLPPDC

SEQ ID NO: 1118239 - protein, 9 aa, Homo Sapiens
DHSVCYNDC

SEQ ID NO: 1118240 - protein, 9 aa, Homo Sapiens
APLRSCIPS

SEQ ID NO: 1118241 - protein, 9 aa, Homo Sapiens
LKEVVKDTT

SEQ ID NO: 1118242 - protein, 9 aa, Homo Sapiens
PRGFPEPPC

SEQ ID NO: 1118243 - protein, 9 aa, Homo Sapiens
VSNPSKPGH

SEQ ID NO: 1118244 - protein, 9 aa, Homo Sapiens
VSLQETSVS

SEQ ID NO: 1118245 - protein, 9 aa, Homo Sapiens
EEVVDSGLV

SEQ ID NO: 1118246 - protein, 9 aa, Homo Sapiens
PPVFALELG

SEQ ID NO: 1118247 - protein, 9 aa, Homo Sapiens
LGFSASGLV

SEQ ID NO: 1118248 - protein, 9 aa, Homo Sapiens
FVTFDDHET

SEQ ID NO: 1118249 - protein, 9 aa, Homo Sapiens
EVHKRAIRI

SEQ ID NO: 1118250 - protein, 9 aa, Homo Sapiens
KLQVTLGEL

SEQ ID NO: 1118251 - protein, 9 aa, Homo Sapiens
RQDGDEAVG

SEQ ID NO: 1118252 - protein, 9 aa, Homo Sapiens
EGSEDEEYY

SEQ ID NO: 1118253 - protein, 9 aa, Homo Sapiens
GRSSHRHRT

SEQ ID NO: 1118254 - protein, 9 aa, Homo Sapiens
DFLRGTPDR

SEQ ID NO: 1118255 - protein, 9 aa, Homo Sapiens
QVVPAALLL

SEQ ID NO: 1118256 - protein, 9 aa, Homo Sapiens
PFHKSCLEE

SEQ ID NO: 1118257 - protein, 9 aa, Homo Sapiens
GPQPGRRPP

SEQ ID NO: 1118258 - protein, 9 aa, Homo Sapiens
AKVRQYLQE

SEQ ID NO: 1118259 - protein, 9 aa, Homo Sapiens
LSPGACRPA

SEQ ID NO: 1118260 - protein, 9 aa, Homo Sapiens
KNQRLQSPH

SEQ ID NO: 1118261 - protein, 9 aa, Homo Sapiens
LEFVEDAFH

SEQ ID NO: 1118262 - protein, 9 aa, Homo Sapiens
NRRWIHVIC

SEQ ID NO: 1118263 - protein, 9 aa, Homo Sapiens
CHIHACQAS

SEQ ID NO: 1118264 - protein, 9 aa, Homo Sapiens
VQTIQILTC

SEQ ID NO: 1118265 - protein, 9 aa, Homo Sapiens
ETTHRDKVP

SEQ ID NO: 1118266 - protein, 9 aa, Homo Sapiens
FGPNIPKQF

SEQ ID NO: 1118267 - protein, 9 aa, Homo Sapiens
PISAGCCLC

SEQ ID NO: 1118268 - protein, 9 aa, Homo Sapiens
YIFCLHYGT

SEQ ID NO: 1118269 - protein, 9 aa, Homo Sapiens
FFALGRAPV

SEQ ID NO: 1118270 - protein, 9 aa, Homo Sapiens
FLEHRKMRK

SEQ ID NO: 1118271 - protein, 9 aa, Homo Sapiens
CQHLLSYDS

SEQ ID NO: 1118272 - protein, 9 aa, Homo Sapiens
NVVTLNNLL

SEQ ID NO: 1118273 - protein, 9 aa, Homo Sapiens
AVKKPSFCT

SEQ ID NO: 1118274 - protein, 9 aa, Homo Sapiens
HTEAYNNLA

SEQ ID NO: 1118275 - protein, 9 aa, Homo Sapiens
PQRRVRPGR

SEQ ID NO: 1118276 - protein, 9 aa, Homo Sapiens
TSSVTASCA

SEQ ID NO: 1118277 - protein, 9 aa, Homo Sapiens
PPKMPPPRS

SEQ ID NO: 1118278 - protein, 9 aa, Homo Sapiens
ESCSPNVRF

SEQ ID NO: 1118279 - protein, 9 aa, Homo Sapiens
PCPSAAGGG

SEQ ID NO: 1118280 - protein, 9 aa, Homo Sapiens
NRSSEGTKE

SEQ ID NO: 1118281 - protein, 9 aa, Homo Sapiens
GLAVLAVHL

SEQ ID NO: 1118282 - protein, 9 aa, Homo Sapiens
SQDKTLTHP

SEQ ID NO: 1118283 - protein, 9 aa, Homo Sapiens
CQHYSVSFS

SEQ ID NO: 1118284 - protein, 9 aa, Homo Sapiens
DNLPTFDLS

SEQ ID NO: 1118285 - protein, 9 aa, Homo Sapiens
STDSSSCCQ

SEQ ID NO: 1118286 - protein, 9 aa, Homo Sapiens
YVMCRTPLA

SEQ ID NO: 1118287 - protein, 9 aa, Homo Sapiens
RASWRSPTA

SEQ ID NO: 1118288 - protein, 9 aa, Homo Sapiens
RDAFRELDT

SEQ ID NO: 1118289 - protein, 9 aa, Homo Sapiens
TSGGECLMS

SEQ ID NO: 1118290 - protein, 9 aa, Homo Sapiens
RKKKRRRKR

SEQ ID NO: 1118291 - protein, 9 aa, Homo Sapiens
GSLKKTSRI

SEQ ID NO: 1118292 - protein, 9 aa, Homo Sapiens
DQAKAAVIV

SEQ ID NO: 1118293 - protein, 9 aa, Homo Sapiens
DTVDGQRTL

SEQ ID NO: 1118294 - protein, 9 aa, Homo Sapiens
VTPISVSGE

SEQ ID NO: 1118295 - protein, 9 aa, Homo Sapiens
TCGLLYSRT

SEQ ID NO: 1118296 - protein, 9 aa, Homo Sapiens
RVHVTSNLS

SEQ ID NO: 1118297 - protein, 9 aa, Homo Sapiens
LPVRRDASR

SEQ ID NO: 1118298 - protein, 9 aa, Homo Sapiens
CSASVSFTY

SEQ ID NO: 1118299 - protein, 9 aa, Homo Sapiens
FRELDTNGD

SEQ ID NO: 1118300 - protein, 9 aa, Homo Sapiens
RPPTCAACR

SEQ ID NO: 1118301 - protein, 9 aa, Homo Sapiens
SPTGIDTSE

SEQ ID NO: 1118302 - protein, 9 aa, Homo Sapiens
DPDDDNDGI

SEQ ID NO: 1118303 - protein, 9 aa, Homo Sapiens
AAGGEAVVA

SEQ ID NO: 1118304 - protein, 9 aa, Homo Sapiens
CPWAGPRAP

SEQ ID NO: 1118305 - protein, 9 aa, Homo Sapiens
EPERHLSGA

SEQ ID NO: 1118306 - protein, 9 aa, Homo Sapiens
VVVIRRERA

SEQ ID NO: 1118307 - protein, 9 aa, Homo Sapiens
TAGACSKVK

SEQ ID NO: 1118308 - protein, 9 aa, Homo Sapiens
KGRGDVALP

SEQ ID NO: 1118309 - protein, 9 aa, Homo Sapiens
QGFRRKAQI

SEQ ID NO: 1118310 - protein, 9 aa, Homo Sapiens
RFQSIICKK

SEQ ID NO: 1118311 - protein, 9 aa, Homo Sapiens
GVRKYPLLF

SEQ ID NO: 1118312 - protein, 9 aa, Homo Sapiens
QETGTALAA

SEQ ID NO: 1118313 - protein, 9 aa, Homo Sapiens
DKGDALVAG

SEQ ID NO: 1118314 - protein, 9 aa, Homo Sapiens
PGVAGAAPP

SEQ ID NO: 1118315 - protein, 9 aa, Homo Sapiens
RGLKHPLFP

SEQ ID NO: 1118316 - protein, 9 aa, Homo Sapiens
DNNDNEPKF

SEQ ID NO: 1118317 - protein, 9 aa, Homo Sapiens
MGETSCSEQ

SEQ ID NO: 1118318 - protein, 9 aa, Homo Sapiens
LLKDSLRGN

SEQ ID NO: 1118319 - protein, 9 aa, Homo Sapiens
VDFDTFLRH

SEQ ID NO: 1118320 - protein, 9 aa, Homo Sapiens
VASPDQQQV

SEQ ID NO: 1118321 - protein, 9 aa, Homo Sapiens
LKPRGLFEV

SEQ ID NO: 1118322 - protein, 9 aa, Homo Sapiens
QLAAIKVMV

SEQ ID NO: 1118323 - protein, 9 aa, Homo Sapiens
EICLLTAFA

SEQ ID NO: 1118324 - protein, 9 aa, Homo Sapiens
EFCNGTSSN

SEQ ID NO: 1118325 - protein, 9 aa, Homo Sapiens
AVPIRAATL

SEQ ID NO: 1118326 - protein, 9 aa, Homo Sapiens
FQFQCSLDS

SEQ ID NO: 1118327 - protein, 9 aa, Homo Sapiens
HSVVFSATA

SEQ ID NO: 1118328 - protein, 9 aa, Homo Sapiens
HWTPYTFSL

SEQ ID NO: 1118329 - protein, 9 aa, Homo Sapiens
KEPEPAGVT

SEQ ID NO: 1118330 - protein, 9 aa, Homo Sapiens
LWEDQIPRG

SEQ ID NO: 1118331 - protein, 9 aa, Homo Sapiens
ASLTLVFKR

SEQ ID NO: 1118332 - protein, 9 aa, Homo Sapiens
PTLSLRRRC

SEQ ID NO: 1118333 - protein, 9 aa, Homo Sapiens
GDALKNVMK

SEQ ID NO: 1118334 - protein, 9 aa, Homo Sapiens
TTAWAALGS

SEQ ID NO: 1118335 - protein, 9 aa, Homo Sapiens
CPAGAGPPT

SEQ ID NO: 1118336 - protein, 9 aa, Homo Sapiens
ATPVSRTTV

SEQ ID NO: 1118337 - protein, 9 aa, Homo Sapiens
HASFSEGAY

SEQ ID NO: 1118338 - protein, 9 aa, Homo Sapiens
VIEKHGPPS

SEQ ID NO: 1118339 - protein, 9 aa, Homo Sapiens
VEAKKLPKE

SEQ ID NO: 1118340 - protein, 9 aa, Homo Sapiens
SLCCTVIIK

SEQ ID NO: 1118341 - protein, 9 aa, Homo Sapiens
DIDDMELTL

SEQ ID NO: 1118342 - protein, 9 aa, Homo Sapiens
RPLLPGVST

SEQ ID NO: 1118343 - protein, 9 aa, Homo Sapiens
WARVTLVTA

SEQ ID NO: 1118344 - protein, 9 aa, Homo Sapiens
STNFLCLDH

SEQ ID NO: 1118345 - protein, 9 aa, Homo Sapiens
EKQYRGIID

SEQ ID NO: 1118346 - protein, 9 aa, Homo Sapiens
RQQLAQLHS

SEQ ID NO: 1118347 - protein, 9 aa, Homo Sapiens
HHVTPGHFC

SEQ ID NO: 1118348 - protein, 9 aa, Homo Sapiens
RNFCLLFDY

SEQ ID NO: 1118349 - protein, 9 aa, Homo Sapiens
RYILKTDDD

SEQ ID NO: 1118350 - protein, 9 aa, Homo Sapiens
IYKPLHELI

SEQ ID NO: 1118351 - protein, 9 aa, Homo Sapiens
GVQGAQGLV

SEQ ID NO: 1118352 - protein, 9 aa, Homo Sapiens
GRFYPVYSA

SEQ ID NO: 1118353 - protein, 9 aa, Homo Sapiens
DLLDWCTKY

SEQ ID NO: 1118354 - protein, 9 aa, Homo Sapiens
ARLGLIPCI

SEQ ID NO: 1118355 - protein, 9 aa, Homo Sapiens
PVLLASVLP

SEQ ID NO: 1118356 - protein, 9 aa, Homo Sapiens
KSKEEAIIV

SEQ ID NO: 1118357 - protein, 9 aa, Homo Sapiens
SRKLTKAEK

SEQ ID NO: 1118358 - protein, 9 aa, Homo Sapiens
AGEDGKRLQ

SEQ ID NO: 1118359 - protein, 9 aa, Homo Sapiens
SLLRILTSF

SEQ ID NO: 1118360 - protein, 9 aa, Homo Sapiens
SYTCAAENM

SEQ ID NO: 1118361 - protein, 9 aa, Homo Sapiens
GFDSIHRGA

SEQ ID NO: 1118362 - protein, 9 aa, Homo Sapiens
ALLSYESTD

SEQ ID NO: 1118363 - protein, 9 aa, Homo Sapiens
SLGNSRHGH

SEQ ID NO: 1118364 - protein, 9 aa, Homo Sapiens
MERVKKLKR

SEQ ID NO: 1118365 - protein, 9 aa, Homo Sapiens
SLLAPKTTL

SEQ ID NO: 1118366 - protein, 9 aa, Homo Sapiens
PATPAEVAT

SEQ ID NO: 1118367 - protein, 9 aa, Homo Sapiens
VLEGGLGPH

SEQ ID NO: 1118368 - protein, 9 aa, Homo Sapiens
PKSESMVYS

SEQ ID NO: 1118369 - protein, 9 aa, Homo Sapiens
AAPRPHSRG

SEQ ID NO: 1118370 - protein, 9 aa, Homo Sapiens
RLKLPVLLA

SEQ ID NO: 1118371 - protein, 9 aa, Homo Sapiens
RGSSQILTP

SEQ ID NO: 1118372 - protein, 9 aa, Homo Sapiens
WSSGCYWID

SEQ ID NO: 1118373 - protein, 9 aa, Homo Sapiens
KAIETDVMN

SEQ ID NO: 1118374 - protein, 9 aa, Homo Sapiens
NSKLPVHVY

SEQ ID NO: 1118375 - protein, 9 aa, Homo Sapiens
LYGLPRPGS

SEQ ID NO: 1118376 - protein, 9 aa, Homo Sapiens
FRWNQKGEE

SEQ ID NO: 1118377 - protein, 9 aa, Homo Sapiens
RQIYFMACT

SEQ ID NO: 1118378 - protein, 9 aa, Homo Sapiens
PPIGPSCVP

SEQ ID NO: 1118379 - protein, 9 aa, Homo Sapiens
NHVFCSFCI

SEQ ID NO: 1118380 - protein, 9 aa, Homo Sapiens
EVTFESLQV

SEQ ID NO: 1118381 - protein, 9 aa, Homo Sapiens
PGTPSKAPW

SEQ ID NO: 1118382 - protein, 9 aa, Homo Sapiens
FGQHGILPI

SEQ ID NO: 1118383 - protein, 9 aa, Homo Sapiens
SDSQEDKKI

SEQ ID NO: 1118384 - protein, 9 aa, Homo Sapiens
PGHHGADVE

SEQ ID NO: 1118385 - protein, 9 aa, Homo Sapiens
KKTKKKRKF

SEQ ID NO: 1118386 - protein, 9 aa, Homo Sapiens
TCKSDAGNL

SEQ ID NO: 1118387 - protein, 9 aa, Homo Sapiens
AAVPKRMKG

SEQ ID NO: 1118388 - protein, 9 aa, Homo Sapiens
VDITDIRKY

SEQ ID NO: 1118389 - protein, 9 aa, Homo Sapiens
CVAGASRSG

SEQ ID NO: 1118390 - protein, 9 aa, Homo Sapiens
VPQSPRTKS

SEQ ID NO: 1118391 - protein, 9 aa, Homo Sapiens
DGSYWVTLI

SEQ ID NO: 1118392 - protein, 9 aa, Homo Sapiens
VKYKRENKE

SEQ ID NO: 1118393 - protein, 9 aa, Homo Sapiens
HLHAPQLLP

SEQ ID NO: 1118394 - protein, 9 aa, Homo Sapiens
YILKTDDDV

SEQ ID NO: 1118395 - protein, 9 aa, Homo Sapiens
ELWGIRWTS

SEQ ID NO: 1118396 - protein, 9 aa, Homo Sapiens
AQENGIYSV

SEQ ID NO: 1118397 - protein, 9 aa, Homo Sapiens
GPVEGRVAR

SEQ ID NO: 1118398 - protein, 9 aa, Homo Sapiens
NEEDMFASQ

SEQ ID NO: 1118399 - protein, 9 aa, Homo Sapiens
EYPSLISID

SEQ ID NO: 1118400 - protein, 9 aa, Homo Sapiens
PLWSIPEEF

SEQ ID NO: 1118401 - protein, 9 aa, Homo Sapiens
DRLLCPHAF

SEQ ID NO: 1118402 - protein, 9 aa, Homo Sapiens
QYRGIIDCV

SEQ ID NO: 1118403 - protein, 9 aa, Homo Sapiens
TLKFFLNGN

SEQ ID NO: 1118404 - protein, 9 aa, Homo Sapiens
QAAKDNYGL

SEQ ID NO: 1118405 - protein, 9 aa, Homo Sapiens
HRKMRKSLE

SEQ ID NO: 1118406 - protein, 9 aa, Homo Sapiens
ATLAPAQAR

SEQ ID NO: 1118407 - protein, 9 aa, Homo Sapiens
AIYQKVCHR

SEQ ID NO: 1118408 - protein, 9 aa, Homo Sapiens
ASAVQETQL

SEQ ID NO: 1118409 - protein, 9 aa, Homo Sapiens
AYPNTGPRR

SEQ ID NO: 1118410 - protein, 9 aa, Homo Sapiens
ASSPSPNWA

SEQ ID NO: 1118411 - protein, 9 aa, Homo Sapiens
QSDIEGRVV

SEQ ID NO: 1118412 - protein, 9 aa, Homo Sapiens
EVEAGAAKV

SEQ ID NO: 1118413 - protein, 9 aa, Homo Sapiens
KDIQRGNVC

SEQ ID NO: 1118414 - protein, 9 aa, Homo Sapiens
ERKKRQRES

SEQ ID NO: 1118415 - protein, 9 aa, Homo Sapiens
SESELDVAR

SEQ ID NO: 1118416 - protein, 9 aa, Homo Sapiens
ASRYDRANT

SEQ ID NO: 1118417 - protein, 9 aa, Homo Sapiens
GALATGSSR

SEQ ID NO: 1118418 - protein, 9 aa, Homo Sapiens
ALDVDCMTS

SEQ ID NO: 1118419 - protein, 9 aa, Homo Sapiens
TVNRPVVIL

SEQ ID NO: 1118420 - protein, 9 aa, Homo Sapiens
CCLFSPFAG

SEQ ID NO: 1118421 - protein, 9 aa, Homo Sapiens
SSPADTTSV

SEQ ID NO: 1118422 - protein, 9 aa, Homo Sapiens
RCKGWRGRL

SEQ ID NO: 1118423 - protein, 9 aa, Homo Sapiens
AGCPHTQGS

SEQ ID NO: 1118424 - protein, 9 aa, Homo Sapiens
NKVPVRSSM

SEQ ID NO: 1118425 - protein, 9 aa, Homo Sapiens
KLQRQASPS

SEQ ID NO: 1118426 - protein, 9 aa, Homo Sapiens
HLRVHPGAQ

SEQ ID NO: 1118427 - protein, 9 aa, Homo Sapiens
PSFDTILYY

SEQ ID NO: 1118428 - protein, 9 aa, Homo Sapiens
TCRALELEQ

SEQ ID NO: 1118429 - protein, 9 aa, Homo Sapiens
KRCMSVGQQ

SEQ ID NO: 1118430 - protein, 9 aa, Homo Sapiens
ACESGPCCC

SEQ ID NO: 1118431 - protein, 9 aa, Homo Sapiens
QGLPDPSGP

SEQ ID NO: 1118432 - protein, 9 aa, Homo Sapiens
TRPPGPSRR

SEQ ID NO: 1118433 - protein, 9 aa, Homo Sapiens
CLPLGATSS

SEQ ID NO: 1118434 - protein, 9 aa, Homo Sapiens
HVVKRKPPV

SEQ ID NO: 1118435 - protein, 9 aa, Homo Sapiens
PFTATENAL

SEQ ID NO: 1118436 - protein, 9 aa, Homo Sapiens
HVTLDSALV

SEQ ID NO: 1118437 - protein, 9 aa, Homo Sapiens
EMQNESFTE

SEQ ID NO: 1118438 - protein, 9 aa, Homo Sapiens
RKAFSACGF

SEQ ID NO: 1118439 - protein, 9 aa, Homo Sapiens
AGPRCHRRR

SEQ ID NO: 1118440 - protein, 9 aa, Homo Sapiens
FPATARGPG

SEQ ID NO: 1118441 - protein, 9 aa, Homo Sapiens
SSEETAPAV

SEQ ID NO: 1118442 - protein, 9 aa, Homo Sapiens
LLCGALRRW

SEQ ID NO: 1118443 - protein, 9 aa, Homo Sapiens
SIEICTADC

SEQ ID NO: 1118444 - protein, 9 aa, Homo Sapiens
PAAAGCSWT

SEQ ID NO: 1118445 - protein, 9 aa, Homo Sapiens
LWKRSLLLL

SEQ ID NO: 1118446 - protein, 9 aa, Homo Sapiens
ERERAQAEV

SEQ ID NO: 1118447 - protein, 9 aa, Homo Sapiens
CLCPHPPAA

SEQ ID NO: 1118448 - protein, 9 aa, Homo Sapiens
IQASQWPRV

SEQ ID NO: 1118449 - protein, 9 aa, Homo Sapiens
TLGILSLRS

SEQ ID NO: 1118450 - protein, 9 aa, Homo Sapiens
LSGLKGKKI

SEQ ID NO: 1118451 - protein, 9 aa, Homo Sapiens
KPGHKTNQL

SEQ ID NO: 1118452 - protein, 9 aa, Homo Sapiens
EHKRSMVDS

SEQ ID NO: 1118453 - protein, 9 aa, Homo Sapiens
NPEDDLLPW

SEQ ID NO: 1118454 - protein, 9 aa, Homo Sapiens
LCSPVARLT

SEQ ID NO: 1118455 - protein, 9 aa, Homo Sapiens
TILTKKRWE

SEQ ID NO: 1118456 - protein, 9 aa, Homo Sapiens
NRLAVDSNT

SEQ ID NO: 1118457 - protein, 9 aa, Homo Sapiens
SPPQGLVAA

SEQ ID NO: 1118458 - protein, 9 aa, Homo Sapiens
TFGTSITSV

SEQ ID NO: 1118459 - protein, 9 aa, Homo Sapiens
DPGHWGADA

SEQ ID NO: 1118460 - protein, 9 aa, Homo Sapiens
IQKKQLALK

SEQ ID NO: 1118461 - protein, 9 aa, Homo Sapiens
PGGSRPGWK

SEQ ID NO: 1118462 - protein, 9 aa, Homo Sapiens
KGGEGAECG

SEQ ID NO: 1118463 - protein, 9 aa, Homo Sapiens
SSRDQKLPV

SEQ ID NO: 1118464 - protein, 9 aa, Homo Sapiens
FTRELAVRL

SEQ ID NO: 1118465 - protein, 9 aa, Homo Sapiens
DRDRDQERE

SEQ ID NO: 1118466 - protein, 9 aa, Homo Sapiens
LRSERQPRP

SEQ ID NO: 1118467 - protein, 9 aa, Homo Sapiens
AATVLTLAP

SEQ ID NO: 1118468 - protein, 9 aa, Homo Sapiens
LPGLFVKTM

SEQ ID NO: 1118469 - protein, 9 aa, Homo Sapiens
VCVARWLDR

SEQ ID NO: 1118470 - protein, 9 aa, Homo Sapiens
QRDSLKIVQ

SEQ ID NO: 1118471 - protein, 9 aa, Homo Sapiens
KGPVLLGFP

SEQ ID NO: 1118472 - protein, 9 aa, Homo Sapiens
ITSCAMLTW

SEQ ID NO: 1118473 - protein, 9 aa, Homo Sapiens
TTLSGQQDR

SEQ ID NO: 1118474 - protein, 9 aa, Homo Sapiens
QHHDTHSEG

SEQ ID NO: 1118475 - protein, 9 aa, Homo Sapiens
HLPPAAGLP

SEQ ID NO: 1118476 - protein, 9 aa, Homo Sapiens
IHPFIFALC

SEQ ID NO: 1118477 - protein, 9 aa, Homo Sapiens
AWVAEQYEG

SEQ ID NO: 1118478 - protein, 9 aa, Homo Sapiens
PLGLLLPAV

SEQ ID NO: 1118479 - protein, 9 aa, Homo Sapiens
YLLRSEPKC

SEQ ID NO: 1118480 - protein, 9 aa, Homo Sapiens
LYMRRAALA

SEQ ID NO: 1118481 - protein, 9 aa, Homo Sapiens
TQCSSPSCS

SEQ ID NO: 1118482 - protein, 9 aa, Homo Sapiens
YDETYPLSL

SEQ ID NO: 1118483 - protein, 9 aa, Homo Sapiens
RPKVQADVE

SEQ ID NO: 1118484 - protein, 9 aa, Homo Sapiens
RKNKSTKAT

SEQ ID NO: 1118485 - protein, 9 aa, Homo Sapiens
LSAITNRSD

SEQ ID NO: 1118486 - protein, 9 aa, Homo Sapiens
TGPRRRPYA

SEQ ID NO: 1118487 - protein, 9 aa, Homo Sapiens
INYYEGQYI

SEQ ID NO: 1118488 - protein, 9 aa, Homo Sapiens
NELLQIEPE

SEQ ID NO: 1118489 - protein, 9 aa, Homo Sapiens
EDGCGFCHE

SEQ ID NO: 1118490 - protein, 9 aa, Homo Sapiens
PEPARETPT

SEQ ID NO: 1118491 - protein, 9 aa, Homo Sapiens
APAYVASRP

SEQ ID NO: 1118492 - protein, 9 aa, Homo Sapiens
LPTMHYNMG

SEQ ID NO: 1118493 - protein, 9 aa, Homo Sapiens
TALIAWDPS

SEQ ID NO: 1118494 - protein, 9 aa, Homo Sapiens
TGSYGATEQ

SEQ ID NO: 1118495 - protein, 9 aa, Homo Sapiens
SMASLRSPI

SEQ ID NO: 1118496 - protein, 9 aa, Homo Sapiens
SPFQLVRDN

SEQ ID NO: 1118497 - protein, 9 aa, Homo Sapiens
LTTAWAALG

SEQ ID NO: 1118498 - protein, 9 aa, Homo Sapiens
ACLNDSNDD

SEQ ID NO: 1118499 - protein, 9 aa, Homo Sapiens
YSSSSGGGS

SEQ ID NO: 1118500 - protein, 9 aa, Homo Sapiens
TQCRRCMRW

SEQ ID NO: 1118501 - protein, 9 aa, Homo Sapiens
QLLSPSGLF

SEQ ID NO: 1118502 - protein, 9 aa, Homo Sapiens
EGEREPQAF

SEQ ID NO: 1118503 - protein, 9 aa, Homo Sapiens
GPLASQEGA

SEQ ID NO: 1118504 - protein, 9 aa, Homo Sapiens
SQLPTSFII

SEQ ID NO: 1118505 - protein, 9 aa, Homo Sapiens
SQIRGQEKS

SEQ ID NO: 1118506 - protein, 9 aa, Homo Sapiens
MFPSLETHL

SEQ ID NO: 1118507 - protein, 9 aa, Homo Sapiens
TADDFPVFL

SEQ ID NO: 1118508 - protein, 9 aa, Homo Sapiens
LLSETSCLR

SEQ ID NO: 1118509 - protein, 9 aa, Homo Sapiens
PEPRPLAQS

SEQ ID NO: 1118510 - protein, 9 aa, Homo Sapiens
SPQECSTFS

SEQ ID NO: 1118511 - protein, 9 aa, Homo Sapiens
DLYFPRKPC

SEQ ID NO: 1118512 - protein, 9 aa, Homo Sapiens
KDMGKMLGE

SEQ ID NO: 1118513 - protein, 9 aa, Homo Sapiens
APATRIEKK

SEQ ID NO: 1118514 - protein, 9 aa, Homo Sapiens
LPILASRAY

SEQ ID NO: 1118515 - protein, 9 aa, Homo Sapiens
VQLNEEKSS

SEQ ID NO: 1118516 - protein, 9 aa, Homo Sapiens
RVHSEALLH

SEQ ID NO: 1118517 - protein, 9 aa, Homo Sapiens
EMAPKRPPK

SEQ ID NO: 1118518 - protein, 9 aa, Homo Sapiens
DYDELVAII

SEQ ID NO: 1118519 - protein, 9 aa, Homo Sapiens
AWFCYFNAS

SEQ ID NO: 1118520 - protein, 9 aa, Homo Sapiens
ALCFAMFGF

SEQ ID NO: 1118521 - protein, 9 aa, Homo Sapiens
GPRVLDPPF

SEQ ID NO: 1118522 - protein, 9 aa, Homo Sapiens
DNDVAAIHC

SEQ ID NO: 1118523 - protein, 9 aa, Homo Sapiens
EPVLTATAT

SEQ ID NO: 1118524 - protein, 9 aa, Homo Sapiens
ATAAEHRVP

SEQ ID NO: 1118525 - protein, 9 aa, Homo Sapiens
LFTAMAYDR

SEQ ID NO: 1118526 - protein, 9 aa, Homo Sapiens
TPVLLQGHS

SEQ ID NO: 1118527 - protein, 9 aa, Homo Sapiens
PALVLAHVP

SEQ ID NO: 1118528 - protein, 9 aa, Homo Sapiens
FIQDAYTQK

SEQ ID NO: 1118529 - protein, 9 aa, Homo Sapiens
LSYVPDAPD

SEQ ID NO: 1118530 - protein, 9 aa, Homo Sapiens
STKHCSIFP

SEQ ID NO: 1118531 - protein, 9 aa, Homo Sapiens
STLTMESAK

SEQ ID NO: 1118532 - protein, 9 aa, Homo Sapiens
GIHSKYVRA

SEQ ID NO: 1118533 - protein, 9 aa, Homo Sapiens
NPTSSLAFL

SEQ ID NO: 1118534 - protein, 9 aa, Homo Sapiens
IVRAAHGPR

SEQ ID NO: 1118535 - protein, 9 aa, Homo Sapiens
TPHGQIAGF

SEQ ID NO: 1118536 - protein, 9 aa, Homo Sapiens
QEFTPPSGD

SEQ ID NO: 1118537 - protein, 9 aa, Homo Sapiens
VGLAKMAFC

SEQ ID NO: 1118538 - protein, 9 aa, Homo Sapiens
NSQQLWEVT

SEQ ID NO: 1118539 - protein, 9 aa, Homo Sapiens
YLMTIIVLL

SEQ ID NO: 1118540 - protein, 9 aa, Homo Sapiens
VENEGPQSG

SEQ ID NO: 1118541 - protein, 9 aa, Homo Sapiens
MRKSLETPI

SEQ ID NO: 1118542 - protein, 9 aa, Homo Sapiens
LTPNTTLIS

SEQ ID NO: 1118543 - protein, 9 aa, Homo Sapiens
YPAPRAVIT

SEQ ID NO: 1118544 - protein, 9 aa, Homo Sapiens
ASIAARLET

SEQ ID NO: 1118545 - protein, 9 aa, Homo Sapiens
PGGGVAYNL

SEQ ID NO: 1118546 - protein, 9 aa, Homo Sapiens
SLAHIWQEE

SEQ ID NO: 1118547 - protein, 9 aa, Homo Sapiens
ESNLSPSEA

SEQ ID NO: 1118548 - protein, 9 aa, Homo Sapiens
REPLTDADH

SEQ ID NO: 1118549 - protein, 9 aa, Homo Sapiens
SSTPKRSRA

SEQ ID NO: 1118550 - protein, 9 aa, Homo Sapiens
SPAHAHQLV

SEQ ID NO: 1118551 - protein, 9 aa, Homo Sapiens
FYLMYITTV

SEQ ID NO: 1118552 - protein, 9 aa, Homo Sapiens
FSLQFILHP

SEQ ID NO: 1118553 - protein, 9 aa, Homo Sapiens
KKTFTMSMK

SEQ ID NO: 1118554 - protein, 9 aa, Homo Sapiens
RSHGYGSRC

SEQ ID NO: 1118555 - protein, 9 aa, Homo Sapiens
GFDGRWYTN

SEQ ID NO: 1118556 - protein, 9 aa, Homo Sapiens
EVPPSPTTP

SEQ ID NO: 1118557 - protein, 9 aa, Homo Sapiens
FLSRFQKKM

SEQ ID NO: 1118558 - protein, 9 aa, Homo Sapiens
VRFPPEASD

SEQ ID NO: 1118559 - protein, 9 aa, Homo Sapiens
SQRSHCRPS

SEQ ID NO: 1118560 - protein, 9 aa, Homo Sapiens
HNVYSRDSN

SEQ ID NO: 1118561 - protein, 9 aa, Homo Sapiens
KQCGEAFRS

SEQ ID NO: 1118562 - protein, 9 aa, Homo Sapiens
SPYEVPPSP

SEQ ID NO: 1118563 - protein, 9 aa, Homo Sapiens
LHHKDRESL

SEQ ID NO: 1118564 - protein, 9 aa, Homo Sapiens
ASLVPTDSH

SEQ ID NO: 1118565 - protein, 9 aa, Homo Sapiens
SLVQLKIMD

SEQ ID NO: 1118566 - protein, 9 aa, Homo Sapiens
VGLQGKLGP

SEQ ID NO: 1118567 - protein, 9 aa, Homo Sapiens
DVHVGLGRL

SEQ ID NO: 1118568 - protein, 9 aa, Homo Sapiens
SRDSNYLNL

SEQ ID NO: 1118569 - protein, 9 aa, Homo Sapiens
STCSGWGRW

SEQ ID NO: 1118570 - protein, 9 aa, Homo Sapiens
EGVQGIPLI

SEQ ID NO: 1118571 - protein, 9 aa, Homo Sapiens
NNLCQIVMA

SEQ ID NO: 1118572 - protein, 9 aa, Homo Sapiens
VHPHDVHHL

SEQ ID NO: 1118573 - protein, 9 aa, Homo Sapiens
PERVWVHEK

SEQ ID NO: 1118574 - protein, 9 aa, Homo Sapiens
YDVISVHGT

SEQ ID NO: 1118575 - protein, 9 aa, Homo Sapiens
DDDRMVKSA

SEQ ID NO: 1118576 - protein, 9 aa, Homo Sapiens
EDVCKHGML

SEQ ID NO: 1118577 - protein, 9 aa, Homo Sapiens
CNELRSLEC

SEQ ID NO: 1118578 - protein, 9 aa, Homo Sapiens
AVDLFGRVC

SEQ ID NO: 1118579 - protein, 9 aa, Homo Sapiens
LMRRLWGTT

SEQ ID NO: 1118580 - protein, 9 aa, Homo Sapiens
GRDSPQECS

SEQ ID NO: 1118581 - protein, 9 aa, Homo Sapiens
LDFHPRSSS

SEQ ID NO: 1118582 - protein, 9 aa, Homo Sapiens
SPWWRSQNW

SEQ ID NO: 1118583 - protein, 9 aa, Homo Sapiens
DPDVTNNSN

SEQ ID NO: 1118584 - protein, 9 aa, Homo Sapiens
IHTGCELRC

SEQ ID NO: 1118585 - protein, 9 aa, Homo Sapiens
EQISKERAN

SEQ ID NO: 1118586 - protein, 9 aa, Homo Sapiens
PSPSRGTAT

SEQ ID NO: 1118587 - protein, 9 aa, Homo Sapiens
AFFHNQLPS

SEQ ID NO: 1118588 - protein, 9 aa, Homo Sapiens
MRDASVLAA

SEQ ID NO: 1118589 - protein, 9 aa, Homo Sapiens
HVSRGDVHV

SEQ ID NO: 1118590 - protein, 9 aa, Homo Sapiens
NYARLNMKQ

SEQ ID NO: 1118591 - protein, 9 aa, Homo Sapiens
SISLPLPDR

SEQ ID NO: 1118592 - protein, 9 aa, Homo Sapiens
VHRGLAARN

SEQ ID NO: 1118593 - protein, 9 aa, Homo Sapiens
ERKVTLMIN

SEQ ID NO: 1118594 - protein, 9 aa, Homo Sapiens
RGSSGSGRA

SEQ ID NO: 1118595 - protein, 9 aa, Homo Sapiens
GAPPSQRLR

SEQ ID NO: 1118596 - protein, 9 aa, Homo Sapiens
CGECGKGFA

SEQ ID NO: 1118597 - protein, 9 aa, Homo Sapiens
AARPSATNP

SEQ ID NO: 1118598 - protein, 9 aa, Homo Sapiens
CADTRISVL

SEQ ID NO: 1118599 - protein, 9 aa, Homo Sapiens
KPCPGTATM

SEQ ID NO: 1118600 - protein, 9 aa, Homo Sapiens
RLERTLDAT

SEQ ID NO: 1118601 - protein, 9 aa, Homo Sapiens
FNFDNTFEM

SEQ ID NO: 1118602 - protein, 9 aa, Homo Sapiens
GGSGNMSAG

SEQ ID NO: 1118603 - protein, 9 aa, Homo Sapiens
PKSQDQDVI

SEQ ID NO: 1118604 - protein, 9 aa, Homo Sapiens
SVLPPATGS

SEQ ID NO: 1118605 - protein, 9 aa, Homo Sapiens
HGLSDIKVE

SEQ ID NO: 1118606 - protein, 9 aa, Homo Sapiens
DVGSKDKVG

SEQ ID NO: 1118607 - protein, 9 aa, Homo Sapiens
TLLLLAVAL

SEQ ID NO: 1118608 - protein, 9 aa, Homo Sapiens
GSIKRSCSA

SEQ ID NO: 1118609 - protein, 9 aa, Homo Sapiens
GGRHPSWPW

SEQ ID NO: 1118610 - protein, 9 aa, Homo Sapiens
EHTLHRCQQ

SEQ ID NO: 1118611 - protein, 9 aa, Homo Sapiens
HLQEMAQKA

SEQ ID NO: 1118612 - protein, 9 aa, Homo Sapiens
SIGADLLTG

SEQ ID NO: 1118613 - protein, 9 aa, Homo Sapiens
HRAALSACS

SEQ ID NO: 1118614 - protein, 9 aa, Homo Sapiens
VSYLHSNTG

SEQ ID NO: 1118615 - protein, 9 aa, Homo Sapiens
VQRRQAEIS

SEQ ID NO: 1118616 - protein, 9 aa, Homo Sapiens
EVDVQALRA

SEQ ID NO: 1118617 - protein, 9 aa, Homo Sapiens
SVSFTYSLS

SEQ ID NO: 1118618 - protein, 9 aa, Homo Sapiens
PFSHPLFTM

SEQ ID NO: 1118619 - protein, 9 aa, Homo Sapiens
SSGSGRARG

SEQ ID NO: 1118620 - protein, 9 aa, Homo Sapiens
VLLHDGIKT

SEQ ID NO: 1118621 - protein, 9 aa, Homo Sapiens
VHHRFHHGE

SEQ ID NO: 1118622 - protein, 9 aa, Homo Sapiens
RARGPAPAS

SEQ ID NO: 1118623 - protein, 9 aa, Homo Sapiens
THASGNLSR

SEQ ID NO: 1118624 - protein, 9 aa, Homo Sapiens
PLQMENALV

SEQ ID NO: 1118625 - protein, 9 aa, Homo Sapiens
HEHTKPDRD

SEQ ID NO: 1118626 - protein, 9 aa, Homo Sapiens
DLAREVADK

SEQ ID NO: 1118627 - protein, 9 aa, Homo Sapiens
DGVIRELAV

SEQ ID NO: 1118628 - protein, 9 aa, Homo Sapiens
TTYAVRLAV

SEQ ID NO: 1118629 - protein, 9 aa, Homo Sapiens
SVCTRTQQG

SEQ ID NO: 1118630 - protein, 9 aa, Homo Sapiens
LRSYMERIR

SEQ ID NO: 1118631 - protein, 9 aa, Homo Sapiens
ENNKEGSFQ

SEQ ID NO: 1118632 - protein, 9 aa, Homo Sapiens
GPGVADYLT

SEQ ID NO: 1118633 - protein, 9 aa, Homo Sapiens
ELQQRRRSL

SEQ ID NO: 1118634 - protein, 9 aa, Homo Sapiens
LALKHQLRH

SEQ ID NO: 1118635 - protein, 9 aa, Homo Sapiens
KKVRLSPVK

SEQ ID NO: 1118636 - protein, 9 aa, Homo Sapiens
SVKQVITFT

SEQ ID NO: 1118637 - protein, 9 aa, Homo Sapiens
GLGPGLLLL

SEQ ID NO: 1118638 - protein, 9 aa, Homo Sapiens
LLWWFWSLC

SEQ ID NO: 1118639 - protein, 9 aa, Homo Sapiens
RGSGSHCPR

SEQ ID NO: 1118640 - protein, 9 aa, Homo Sapiens
IQLDDAVHA

SEQ ID NO: 1118641 - protein, 9 aa, Homo Sapiens
VTKMHRFYH

SEQ ID NO: 1118642 - protein, 9 aa, Homo Sapiens
RTRALMECL

SEQ ID NO: 1118643 - protein, 9 aa, Homo Sapiens
AGVQFGEVE

SEQ ID NO: 1118644 - protein, 9 aa, Homo Sapiens
MNYVHRGLA

SEQ ID NO: 1118645 - protein, 9 aa, Homo Sapiens
EVELVSQED

SEQ ID NO: 1118646 - protein, 9 aa, Homo Sapiens
LEVSGLRSV

SEQ ID NO: 1118647 - protein, 9 aa, Homo Sapiens
NPWSYSKQN

SEQ ID NO: 1118648 - protein, 9 aa, Homo Sapiens
YLRKIPHFN

SEQ ID NO: 1118649 - protein, 9 aa, Homo Sapiens
EAEQGRVHA

SEQ ID NO: 1118650 - protein, 9 aa, Homo Sapiens
SFLIKYKQK

SEQ ID NO: 1118651 - protein, 9 aa, Homo Sapiens
DDAETKKVL

SEQ ID NO: 1118652 - protein, 9 aa, Homo Sapiens
PWPSFEAAP

SEQ ID NO: 1118653 - protein, 9 aa, Homo Sapiens
KLCQAMQPV

SEQ ID NO: 1118654 - protein, 9 aa, Homo Sapiens
KRRRSSSLL

SEQ ID NO: 1118655 - protein, 9 aa, Homo Sapiens
SLKKTSRIL

SEQ ID NO: 1118656 - protein, 9 aa, Homo Sapiens
VEWTQDSEG

SEQ ID NO: 1118657 - protein, 9 aa, Homo Sapiens
RMERVKKLK

SEQ ID NO: 1118658 - protein, 9 aa, Homo Sapiens
HITKSGTRV

SEQ ID NO: 1118659 - protein, 9 aa, Homo Sapiens
NALVACVGS

SEQ ID NO: 1118660 - protein, 9 aa, Homo Sapiens
EETSPHQAV

SEQ ID NO: 1118661 - protein, 9 aa, Homo Sapiens
KTFPFHIMF

SEQ ID NO: 1118662 - protein, 9 aa, Homo Sapiens
GFSDEDSTW

SEQ ID NO: 1118663 - protein, 9 aa, Homo Sapiens
TFGPNIPKQ

SEQ ID NO: 1118664 - protein, 9 aa, Homo Sapiens
GSLLLKRSD

SEQ ID NO: 1118665 - protein, 9 aa, Homo Sapiens
IGDICSLYT

SEQ ID NO: 1118666 - protein, 9 aa, Homo Sapiens
VLAMQRTVL

SEQ ID NO: 1118667 - protein, 9 aa, Homo Sapiens
VLFCEMVER

SEQ ID NO: 1118668 - protein, 9 aa, Homo Sapiens
PILRPTGTG

SEQ ID NO: 1118669 - protein, 9 aa, Homo Sapiens
KLATFYRLA

SEQ ID NO: 1118670 - protein, 9 aa, Homo Sapiens
GQVQALRNH

SEQ ID NO: 1118671 - protein, 9 aa, Homo Sapiens
DTNFWVLLH

SEQ ID NO: 1118672 - protein, 9 aa, Homo Sapiens
SRGAISRIH

SEQ ID NO: 1118673 - protein, 9 aa, Homo Sapiens
MTACSILAR

SEQ ID NO: 1118674 - protein, 9 aa, Homo Sapiens
IIHQRQLDR

SEQ ID NO: 1118675 - protein, 9 aa, Homo Sapiens
HSQYYVAQQ

SEQ ID NO: 1118676 - protein, 9 aa, Homo Sapiens
ELLPPEGPL

SEQ ID NO: 1118677 - protein, 9 aa, Homo Sapiens
KKRHPVKVY

SEQ ID NO: 1118678 - protein, 9 aa, Homo Sapiens
PAPSSCWPV

SEQ ID NO: 1118679 - protein, 9 aa, Homo Sapiens
RGLAARNIL

SEQ ID NO: 1118680 - protein, 9 aa, Homo Sapiens
LQERFSLLS

SEQ ID NO: 1118681 - protein, 9 aa, Homo Sapiens
SRKENRSSE

SEQ ID NO: 1118682 - protein, 9 aa, Homo Sapiens
TAIAKFEHL

SEQ ID NO: 1118683 - protein, 9 aa, Homo Sapiens
YSNLPQVQP

SEQ ID NO: 1118684 - protein, 9 aa, Homo Sapiens
MNKNRQRVR

SEQ ID NO: 1118685 - protein, 9 aa, Homo Sapiens
TLESSSHTP

SEQ ID NO: 1118686 - protein, 9 aa, Homo Sapiens
NGTSDCSLP

SEQ ID NO: 1118687 - protein, 9 aa, Homo Sapiens
DLICEGLYP

SEQ ID NO: 1118688 - protein, 9 aa, Homo Sapiens
AILSQGPRK

SEQ ID NO: 1118689 - protein, 9 aa, Homo Sapiens
EEGDVCITE

SEQ ID NO: 1118690 - protein, 9 aa, Homo Sapiens
HQAWIGAGR

SEQ ID NO: 1118691 - protein, 9 aa, Homo Sapiens
WALGAILYK

SEQ ID NO: 1118692 - protein, 9 aa, Homo Sapiens
FKKILKLKY

SEQ ID NO: 1118693 - protein, 9 aa, Homo Sapiens
ASGTAGSTS

SEQ ID NO: 1118694 - protein, 9 aa, Homo Sapiens
PRPRAGPRC

SEQ ID NO: 1118695 - protein, 9 aa, Homo Sapiens
EGEFFGNCF

SEQ ID NO: 1118696 - protein, 9 aa, Homo Sapiens
AVPPQPVTH

SEQ ID NO: 1118697 - protein, 9 aa, Homo Sapiens
AQKQRLERT

SEQ ID NO: 1118698 - protein, 9 aa, Homo Sapiens
RPPPQPAAV

SEQ ID NO: 1118699 - protein, 9 aa, Homo Sapiens
SARFVPCYN

SEQ ID NO: 1118700 - protein, 9 aa, Homo Sapiens
YQATPEARF

SEQ ID NO: 1118701 - protein, 9 aa, Homo Sapiens
RCHIDNLHF

SEQ ID NO: 1118702 - protein, 9 aa, Homo Sapiens
ECGKIFNMK

SEQ ID NO: 1118703 - protein, 9 aa, Homo Sapiens
LFDFQSDIE

SEQ ID NO: 1118704 - protein, 9 aa, Homo Sapiens
DTQELLPPE

SEQ ID NO: 1118705 - protein, 9 aa, Homo Sapiens
KMSNGRLGH

SEQ ID NO: 1118706 - protein, 9 aa, Homo Sapiens
PCSSPACRS

SEQ ID NO: 1118707 - protein, 9 aa, Homo Sapiens
SQMWWRRQH

SEQ ID NO: 1118708 - protein, 9 aa, Homo Sapiens
GPDGGGSGS

SEQ ID NO: 1118709 - protein, 9 aa, Homo Sapiens
VLKIKKLKE

SEQ ID NO: 1118710 - protein, 9 aa, Homo Sapiens
LGRCITSQL

SEQ ID NO: 1118711 - protein, 9 aa, Homo Sapiens
SHCRPSRKN

SEQ ID NO: 1118712 - protein, 9 aa, Homo Sapiens
LRQPLIMQP

SEQ ID NO: 1118713 - protein, 9 aa, Homo Sapiens
AGAANVSSE

SEQ ID NO: 1118714 - protein, 9 aa, Homo Sapiens
KYAIGDLKD

SEQ ID NO: 1118715 - protein, 9 aa, Homo Sapiens
GFNESDLCI

SEQ ID NO: 1118716 - protein, 9 aa, Homo Sapiens
FKQKVEECT

SEQ ID NO: 1118717 - protein, 9 aa, Homo Sapiens
RLECICTVV

SEQ ID NO: 1118718 - protein, 9 aa, Homo Sapiens
RFEVKRWNA

SEQ ID NO: 1118719 - protein, 9 aa, Homo Sapiens
PLPWANSSP

SEQ ID NO: 1118720 - protein, 9 aa, Homo Sapiens
QVSLVEIEF

SEQ ID NO: 1118721 - protein, 9 aa, Homo Sapiens
KKFGPLVGI

SEQ ID NO: 1118722 - protein, 9 aa, Homo Sapiens
GFFLSRAPP

SEQ ID NO: 1118723 - protein, 9 aa, Homo Sapiens
TVQASRLKT

SEQ ID NO: 1118724 - protein, 9 aa, Homo Sapiens
TDLLQERFS

SEQ ID NO: 1118725 - protein, 9 aa, Homo Sapiens
FAKCVKGRT

SEQ ID NO: 1118726 - protein, 9 aa, Homo Sapiens
HSLGNSKIV

SEQ ID NO: 1118727 - protein, 9 aa, Homo Sapiens
MGIIATNVE

SEQ ID NO: 1118728 - protein, 9 aa, Homo Sapiens
ECDFTEFCN

SEQ ID NO: 1118729 - protein, 9 aa, Homo Sapiens
VCMKGPQGK

SEQ ID NO: 1118730 - protein, 9 aa, Homo Sapiens
AQGGPRPPG

SEQ ID NO: 1118731 - protein, 9 aa, Homo Sapiens
CDFHFVYRP

SEQ ID NO: 1118732 - protein, 9 aa, Homo Sapiens
GPVMAWTSR

SEQ ID NO: 1118733 - protein, 9 aa, Homo Sapiens
QEGAQYPPP

SEQ ID NO: 1118734 - protein, 9 aa, Homo Sapiens
SGRILHQPE

SEQ ID NO: 1118735 - protein, 9 aa, Homo Sapiens
GPTPVPTAT

SEQ ID NO: 1118736 - protein, 9 aa, Homo Sapiens
EGTPFVLLM

SEQ ID NO: 1118737 - protein, 9 aa, Homo Sapiens
LVHVHPHDV

SEQ ID NO: 1118738 - protein, 9 aa, Homo Sapiens
SVDDAAILL

SEQ ID NO: 1118739 - protein, 9 aa, Homo Sapiens
KSIIFQWLI

SEQ ID NO: 1118740 - protein, 9 aa, Homo Sapiens
PSPSRARGP

SEQ ID NO: 1118741 - protein, 9 aa, Homo Sapiens
EEMEIAKKG

SEQ ID NO: 1118742 - protein, 9 aa, Homo Sapiens
SCKGEKLPE

SEQ ID NO: 1118743 - protein, 9 aa, Homo Sapiens
GMMVRGPLP

SEQ ID NO: 1118744 - protein, 9 aa, Homo Sapiens
PLPDRPWGT

SEQ ID NO: 1118745 - protein, 9 aa, Homo Sapiens
LTQTRKTYP

SEQ ID NO: 1118746 - protein, 9 aa, Homo Sapiens
IGDPSKQNL

SEQ ID NO: 1118747 - protein, 9 aa, Homo Sapiens
SSKHWGDDC

SEQ ID NO: 1118748 - protein, 9 aa, Homo Sapiens
PTVAFLPPM

SEQ ID NO: 1118749 - protein, 9 aa, Homo Sapiens
AFTYDHSYP

SEQ ID NO: 1118750 - protein, 9 aa, Homo Sapiens
VAPATLPCR

SEQ ID NO: 1118751 - protein, 9 aa, Homo Sapiens
CCCCGAGVG

SEQ ID NO: 1118752 - protein, 9 aa, Homo Sapiens
INRVAMENQ

SEQ ID NO: 1118753 - protein, 9 aa, Homo Sapiens
SAILPLLNR

SEQ ID NO: 1118754 - protein, 9 aa, Homo Sapiens
CHRCDHAPN

SEQ ID NO: 1118755 - protein, 9 aa, Homo Sapiens
RKENRSSEG

SEQ ID NO: 1118756 - protein, 9 aa, Homo Sapiens
SAGLSPGAC

SEQ ID NO: 1118757 - protein, 9 aa, Homo Sapiens
QAQVSELER

SEQ ID NO: 1118758 - protein, 9 aa, Homo Sapiens
DGAALREDL

SEQ ID NO: 1118759 - protein, 9 aa, Homo Sapiens
VVTLNNLLL

SEQ ID NO: 1118760 - protein, 9 aa, Homo Sapiens
SWSTVRYMI

SEQ ID NO: 1118761 - protein, 9 aa, Homo Sapiens
AQGGSAAPG

SEQ ID NO: 1118762 - protein, 9 aa, Homo Sapiens
LLWGCHLHL

SEQ ID NO: 1118763 - protein, 9 aa, Homo Sapiens
PSRASWRSP

SEQ ID NO: 1118764 - protein, 9 aa, Homo Sapiens
IHKHILHTG

SEQ ID NO: 1118765 - protein, 9 aa, Homo Sapiens
RSRRTRGRA

SEQ ID NO: 1118766 - protein, 9 aa, Homo Sapiens
VKAVQLRVA

SEQ ID NO: 1118767 - protein, 9 aa, Homo Sapiens
VWLHARLIP

SEQ ID NO: 1118768 - protein, 9 aa, Homo Sapiens
FRTEDGGWY

SEQ ID NO: 1118769 - protein, 9 aa, Homo Sapiens
ELSRKVTEL

SEQ ID NO: 1118770 - protein, 9 aa, Homo Sapiens
VLQGALGLY

SEQ ID NO: 1118771 - protein, 9 aa, Homo Sapiens
YPFAITLWQ

SEQ ID NO: 1118772 - protein, 9 aa, Homo Sapiens
KGPDSPDSP

SEQ ID NO: 1118773 - protein, 9 aa, Homo Sapiens
RKSEIAVGP

SEQ ID NO: 1118774 - protein, 9 aa, Homo Sapiens
RRTGRGLRQ

SEQ ID NO: 1118775 - protein, 9 aa, Homo Sapiens
SEEHLGRAV

SEQ ID NO: 1118776 - protein, 9 aa, Homo Sapiens
FSQPRNQTL

SEQ ID NO: 1118777 - protein, 9 aa, Homo Sapiens
GDWKVMSGG

SEQ ID NO: 1118778 - protein, 9 aa, Homo Sapiens
LLYEFCTCI

SEQ ID NO: 1118779 - protein, 9 aa, Homo Sapiens
AVNVFELTG

SEQ ID NO: 1118780 - protein, 9 aa, Homo Sapiens
SKGIDCSGG

SEQ ID NO: 1118781 - protein, 9 aa, Homo Sapiens
DVVFWWTAL

SEQ ID NO: 1118782 - protein, 9 aa, Homo Sapiens
AMQRTVLPG

SEQ ID NO: 1118783 - protein, 9 aa, Homo Sapiens
QYFHYHYGW

SEQ ID NO: 1118784 - protein, 9 aa, Homo Sapiens
DVEGVSSAL

SEQ ID NO: 1118785 - protein, 9 aa, Homo Sapiens
LRFNLILMM

SEQ ID NO: 1118786 - protein, 9 aa, Homo Sapiens
PWPSALATQ

SEQ ID NO: 1118787 - protein, 9 aa, Homo Sapiens
LATCSMMVV

SEQ ID NO: 1118788 - protein, 9 aa, Homo Sapiens
EDEKMVAVA

SEQ ID NO: 1118789 - protein, 9 aa, Homo Sapiens
TQLLSPSGL

SEQ ID NO: 1118790 - protein, 9 aa, Homo Sapiens
EKKKQLSHP

SEQ ID NO: 1118791 - protein, 9 aa, Homo Sapiens
EENRNGNSG

SEQ ID NO: 1118792 - protein, 9 aa, Homo Sapiens
GSQVTVHIV

SEQ ID NO: 1118793 - protein, 9 aa, Homo Sapiens
VNTLVPHEM

SEQ ID NO: 1118794 - protein, 9 aa, Homo Sapiens
YPAAHLRQE

SEQ ID NO: 1118795 - protein, 9 aa, Homo Sapiens
TNNGIHYWL

SEQ ID NO: 1118796 - protein, 9 aa, Homo Sapiens
AKKGEYAFP

SEQ ID NO: 1118797 - protein, 9 aa, Homo Sapiens
KPGMHYLDI

SEQ ID NO: 1118798 - protein, 9 aa, Homo Sapiens
QLRQLLVSL

SEQ ID NO: 1118799 - protein, 9 aa, Homo Sapiens
DASVPRARG

SEQ ID NO: 1118800 - protein, 9 aa, Homo Sapiens
RLVVDGMGH

SEQ ID NO: 1118801 - protein, 9 aa, Homo Sapiens
IYSPQRQKE

SEQ ID NO: 1118802 - protein, 9 aa, Homo Sapiens
EEDEFNDVQ

SEQ ID NO: 1118803 - protein, 9 aa, Homo Sapiens
GNVWMTHEM

SEQ ID NO: 1118804 - protein, 9 aa, Homo Sapiens
PLHWKEFVR

SEQ ID NO: 1118805 - protein, 9 aa, Homo Sapiens
GLGKPLMLP

SEQ ID NO: 1118806 - protein, 9 aa, Homo Sapiens
PARSPTSAP

SEQ ID NO: 1118807 - protein, 9 aa, Homo Sapiens
VWRGCRGTT

SEQ ID NO: 1118808 - protein, 9 aa, Homo Sapiens
AEKERQLMC

SEQ ID NO: 1118809 - protein, 9 aa, Homo Sapiens
TTTTSSPRR

SEQ ID NO: 1118810 - protein, 9 aa, Homo Sapiens
KKVLRTRYN

SEQ ID NO: 1118811 - protein, 9 aa, Homo Sapiens
HEHGQRQQL

SEQ ID NO: 1118812 - protein, 9 aa, Homo Sapiens
GRKHSSPMG

SEQ ID NO: 1118813 - protein, 9 aa, Homo Sapiens
TTLISPVCL

SEQ ID NO: 1118814 - protein, 9 aa, Homo Sapiens
VATFEEGLG

SEQ ID NO: 1118815 - protein, 9 aa, Homo Sapiens
LVSDSALYL

SEQ ID NO: 1118816 - protein, 9 aa, Homo Sapiens
SPASPSAPT

SEQ ID NO: 1118817 - protein, 9 aa, Homo Sapiens
TSPSSRPGV

SEQ ID NO: 1118818 - protein, 9 aa, Homo Sapiens
SGGECLMST

SEQ ID NO: 1118819 - protein, 9 aa, Homo Sapiens
PRAAAPASV

SEQ ID NO: 1118820 - protein, 9 aa, Homo Sapiens
AARKDSDSP

SEQ ID NO: 1118821 - protein, 9 aa, Homo Sapiens
ECLQDRCEQ

SEQ ID NO: 1118822 - protein, 9 aa, Homo Sapiens
MEKIVNSFL

SEQ ID NO: 1118823 - protein, 9 aa, Homo Sapiens
TAQIVADIR

SEQ ID NO: 1118824 - protein, 9 aa, Homo Sapiens
NNMSAPDGP

SEQ ID NO: 1118825 - protein, 9 aa, Homo Sapiens
PGVQFPLFF

SEQ ID NO: 1118826 - protein, 9 aa, Homo Sapiens
EESSVVWQD

SEQ ID NO: 1118827 - protein, 9 aa, Homo Sapiens
ESNLIEQEQ

SEQ ID NO: 1118828 - protein, 9 aa, Homo Sapiens
SPSSRPGVL

SEQ ID NO: 1118829 - protein, 9 aa, Homo Sapiens
PGHCYHLYH

SEQ ID NO: 1118830 - protein, 9 aa, Homo Sapiens
HQGALMDSQ

SEQ ID NO: 1118831 - protein, 9 aa, Homo Sapiens
LAGPRHRFL

SEQ ID NO: 1118832 - protein, 9 aa, Homo Sapiens
TRMLLQKAE

SEQ ID NO: 1118833 - protein, 9 aa, Homo Sapiens
AAEESCTLI

SEQ ID NO: 1118834 - protein, 9 aa, Homo Sapiens
ENHFLFFVK

SEQ ID NO: 1118835 - protein, 9 aa, Homo Sapiens
RDAGVPTLG

SEQ ID NO: 1118836 - protein, 9 aa, Homo Sapiens
RSCGRVHHT

SEQ ID NO: 1118837 - protein, 9 aa, Homo Sapiens
CSSPACRSC

SEQ ID NO: 1118838 - protein, 9 aa, Homo Sapiens
HQPTVDKIH

SEQ ID NO: 1118839 - protein, 9 aa, Homo Sapiens
AVWKEGGER

SEQ ID NO: 1118840 - protein, 9 aa, Homo Sapiens
SALRFGKRV

SEQ ID NO: 1118841 - protein, 9 aa, Homo Sapiens
QQGRGVYKG

SEQ ID NO: 1118842 - protein, 9 aa, Homo Sapiens
ARLKEHRQE

SEQ ID NO: 1118843 - protein, 9 aa, Homo Sapiens
ALASEKAIE

SEQ ID NO: 1118844 - protein, 9 aa, Homo Sapiens
GYPNEEDMF

SEQ ID NO: 1118845 - protein, 9 aa, Homo Sapiens
LEGEFKISY

SEQ ID NO: 1118846 - protein, 9 aa, Homo Sapiens
EQQQQRRED

SEQ ID NO: 1118847 - protein, 9 aa, Homo Sapiens
KSSTRNKPS

SEQ ID NO: 1118848 - protein, 9 aa, Homo Sapiens
TKELHRSYV

SEQ ID NO: 1118849 - protein, 9 aa, Homo Sapiens
SQIKDVKKR

SEQ ID NO: 1118850 - protein, 9 aa, Homo Sapiens
GDMGSYTCA

SEQ ID NO: 1118851 - protein, 9 aa, Homo Sapiens
CISMTTISR

SEQ ID NO: 1118852 - protein, 9 aa, Homo Sapiens
AGAPPPGCW

SEQ ID NO: 1118853 - protein, 9 aa, Homo Sapiens
LTRPRLLPL

SEQ ID NO: 1118854 - protein, 9 aa, Homo Sapiens
RSFMKLYHS

SEQ ID NO: 1118855 - protein, 9 aa, Homo Sapiens
PWPPSFSAP

SEQ ID NO: 1118856 - protein, 9 aa, Homo Sapiens
LWAQEYLWG

SEQ ID NO: 1118857 - protein, 9 aa, Homo Sapiens
CELRCKVFP

SEQ ID NO: 1118858 - protein, 9 aa, Homo Sapiens
VKFPSLSRS

SEQ ID NO: 1118859 - protein, 9 aa, Homo Sapiens
DFICLDYSH

SEQ ID NO: 1118860 - protein, 9 aa, Homo Sapiens
FWSIPLVPL

SEQ ID NO: 1118861 - protein, 9 aa, Homo Sapiens
PGSMPNVSW

SEQ ID NO: 1118862 - protein, 9 aa, Homo Sapiens
LASTRPSGP

SEQ ID NO: 1118863 - protein, 9 aa, Homo Sapiens
NKQIALRID

SEQ ID NO: 1118864 - protein, 9 aa, Homo Sapiens
RLHSGENLT

SEQ ID NO: 1118865 - protein, 9 aa, Homo Sapiens
RILLDTHFE

SEQ ID NO: 1118866 - protein, 9 aa, Homo Sapiens
NTDACQYEC

SEQ ID NO: 1118867 - protein, 9 aa, Homo Sapiens
TSGTSFFSS

SEQ ID NO: 1118868 - protein, 9 aa, Homo Sapiens
RLWGTTQLP

SEQ ID NO: 1118869 - protein, 9 aa, Homo Sapiens
GCFIKVLTI

SEQ ID NO: 1118870 - protein, 9 aa, Homo Sapiens
HALGALPPC

SEQ ID NO: 1118871 - protein, 9 aa, Homo Sapiens
IPRSTCGRR

SEQ ID NO: 1118872 - protein, 9 aa, Homo Sapiens
KATTKLSML

SEQ ID NO: 1118873 - protein, 9 aa, Homo Sapiens
EKIHRESFF

SEQ ID NO: 1118874 - protein, 9 aa, Homo Sapiens
LACVLWKKK

SEQ ID NO: 1118875 - protein, 9 aa, Homo Sapiens
RRRAALSPA

SEQ ID NO: 1118876 - protein, 9 aa, Homo Sapiens
NVYLTIAIC

SEQ ID NO: 1118877 - protein, 9 aa, Homo Sapiens
LLNAGEEVT

SEQ ID NO: 1118878 - protein, 9 aa, Homo Sapiens
KITFTVAQN

SEQ ID NO: 1118879 - protein, 9 aa, Homo Sapiens
GPGRSISTG

SEQ ID NO: 1118880 - protein, 9 aa, Homo Sapiens
PDPQELLDS

SEQ ID NO: 1118881 - protein, 9 aa, Homo Sapiens
HGAARPLGE

SEQ ID NO: 1118882 - protein, 9 aa, Homo Sapiens
RPRLLPLIH

SEQ ID NO: 1118883 - protein, 9 aa, Homo Sapiens
EAEHINGPR

SEQ ID NO: 1118884 - protein, 9 aa, Homo Sapiens
EDGTLEIHS

SEQ ID NO: 1118885 - protein, 9 aa, Homo Sapiens
AQKTGLGIL

SEQ ID NO: 1118886 - protein, 9 aa, Homo Sapiens
DDFKMCVSL

SEQ ID NO: 1118887 - protein, 9 aa, Homo Sapiens
RNLLRLQSL

SEQ ID NO: 1118888 - protein, 9 aa, Homo Sapiens
ARGPQPVTR

SEQ ID NO: 1118889 - protein, 9 aa, Homo Sapiens
PDLHLEVVE

SEQ ID NO: 1118890 - protein, 9 aa, Homo Sapiens
CGPRVVERH

SEQ ID NO: 1118891 - protein, 9 aa, Homo Sapiens
LRDSAQGVT

SEQ ID NO: 1118892 - protein, 9 aa, Homo Sapiens
WHRWQGHHS

SEQ ID NO: 1118893 - protein, 9 aa, Homo Sapiens
FSHSSSLTR

SEQ ID NO: 1118894 - protein, 9 aa, Homo Sapiens
PLSRRLEVE

SEQ ID NO: 1118895 - protein, 9 aa, Homo Sapiens
CHLHLHAPQ

SEQ ID NO: 1118896 - protein, 9 aa, Homo Sapiens
SAEQDTDDE

SEQ ID NO: 1118897 - protein, 9 aa, Homo Sapiens
MGPNRELVC

SEQ ID NO: 1118898 - protein, 9 aa, Homo Sapiens
QSWGAVAGT

SEQ ID NO: 1118899 - protein, 9 aa, Homo Sapiens
LYLLLTGET

SEQ ID NO: 1118900 - protein, 9 aa, Homo Sapiens
KSQGGRILL

SEQ ID NO: 1118901 - protein, 9 aa, Homo Sapiens
QIGERPEII

SEQ ID NO: 1118902 - protein, 9 aa, Homo Sapiens
GSSAWRPPR

SEQ ID NO: 1118903 - protein, 9 aa, Homo Sapiens
HYLDIVREV

SEQ ID NO: 1118904 - protein, 9 aa, Homo Sapiens
CPQCDALFN

SEQ ID NO: 1118905 - protein, 9 aa, Homo Sapiens
LQHAELAIL

SEQ ID NO: 1118906 - protein, 9 aa, Homo Sapiens
GPSGLASLG

SEQ ID NO: 1118907 - protein, 9 aa, Homo Sapiens
KNHPKNLLD

SEQ ID NO: 1118908 - protein, 9 aa, Homo Sapiens
KQNREKRKQ

SEQ ID NO: 1118909 - protein, 9 aa, Homo Sapiens
LSMYLATVM

SEQ ID NO: 1118910 - protein, 9 aa, Homo Sapiens
LQKRLKRTL

SEQ ID NO: 1118911 - protein, 9 aa, Homo Sapiens
HCQMSGTSG

SEQ ID NO: 1118912 - protein, 9 aa, Homo Sapiens
PPGGRAWAP

SEQ ID NO: 1118913 - protein, 9 aa, Homo Sapiens
SPDPSPVST

SEQ ID NO: 1118914 - protein, 9 aa, Homo Sapiens
VAGASRSGR

SEQ ID NO: 1118915 - protein, 9 aa, Homo Sapiens
DHVSLVDMI

SEQ ID NO: 1118916 - protein, 9 aa, Homo Sapiens
GILRKRLKD

SEQ ID NO: 1118917 - protein, 9 aa, Homo Sapiens
FLSAPPHAE

SEQ ID NO: 1118918 - protein, 9 aa, Homo Sapiens
ARIPRPNVC

SEQ ID NO: 1118919 - protein, 9 aa, Homo Sapiens
PKYGKIEDM

SEQ ID NO: 1118920 - protein, 9 aa, Homo Sapiens
RVLLPDGGI

SEQ ID NO: 1118921 - protein, 9 aa, Homo Sapiens
ESARHFHTF

SEQ ID NO: 1118922 - protein, 9 aa, Homo Sapiens
ATFIDFPVY

SEQ ID NO: 1118923 - protein, 9 aa, Homo Sapiens
PLYTIVDFT

SEQ ID NO: 1118924 - protein, 9 aa, Homo Sapiens
VVTYTEHAK

SEQ ID NO: 1118925 - protein, 9 aa, Homo Sapiens
TDFGFAKCV

SEQ ID NO: 1118926 - protein, 9 aa, Homo Sapiens
VLDRHTDTT

SEQ ID NO: 1118927 - protein, 9 aa, Homo Sapiens
WGEGFAQRE

SEQ ID NO: 1118928 - protein, 9 aa, Homo Sapiens
SGLQKELTI

SEQ ID NO: 1118929 - protein, 9 aa, Homo Sapiens
EALLDQRLR

SEQ ID NO: 1118930 - protein, 9 aa, Homo Sapiens
CTCISMTTI

SEQ ID NO: 1118931 - protein, 9 aa, Homo Sapiens
AAVGAGAGL

SEQ ID NO: 1118932 - protein, 9 aa, Homo Sapiens
FLSALDVDC

SEQ ID NO: 1118933 - protein, 9 aa, Homo Sapiens
VPLPPSAPP

SEQ ID NO: 1118934 - protein, 9 aa, Homo Sapiens
VTRLRTTWE

SEQ ID NO: 1118935 - protein, 9 aa, Homo Sapiens
AESQGLSRK

SEQ ID NO: 1118936 - protein, 9 aa, Homo Sapiens
SDACWALSH

SEQ ID NO: 1118937 - protein, 9 aa, Homo Sapiens
TQTFSATMS

SEQ ID NO: 1118938 - protein, 9 aa, Homo Sapiens
ETGKSHLLS

SEQ ID NO: 1118939 - protein, 9 aa, Homo Sapiens
KTIKTVQAS

SEQ ID NO: 1118940 - protein, 9 aa, Homo Sapiens
GKTSVAVHC

SEQ ID NO: 1118941 - protein, 9 aa, Homo Sapiens
TPGSAAATP

SEQ ID NO: 1118942 - protein, 9 aa, Homo Sapiens
ISMTTISRA

SEQ ID NO: 1118943 - protein, 9 aa, Homo Sapiens
ASCEVLEIL

SEQ ID NO: 1118944 - protein, 9 aa, Homo Sapiens
CDVPRLSLP

SEQ ID NO: 1118945 - protein, 9 aa, Homo Sapiens
SMSPTLTPK

SEQ ID NO: 1118946 - protein, 9 aa, Homo Sapiens
WLSQDSSTW

SEQ ID NO: 1118947 - protein, 9 aa, Homo Sapiens
RMTHRLQKA

SEQ ID NO: 1118948 - protein, 9 aa, Homo Sapiens
QLSLRINGL

SEQ ID NO: 1118949 - protein, 9 aa, Homo Sapiens
LCQDTPTCV

SEQ ID NO: 1118950 - protein, 9 aa, Homo Sapiens
SATDPISVP

SEQ ID NO: 1118951 - protein, 9 aa, Homo Sapiens
RDNMLNLEV

SEQ ID NO: 1118952 - protein, 9 aa, Homo Sapiens
VGPNRCDTI

SEQ ID NO: 1118953 - protein, 9 aa, Homo Sapiens
FSNMDNMLQ

SEQ ID NO: 1118954 - protein, 9 aa, Homo Sapiens
PFAGCVYWL

SEQ ID NO: 1118955 - protein, 9 aa, Homo Sapiens
NTAEEKKLG

SEQ ID NO: 1118956 - protein, 9 aa, Homo Sapiens
LERFLQELT

SEQ ID NO: 1118957 - protein, 9 aa, Homo Sapiens
ERSLKDVEA

SEQ ID NO: 1118958 - protein, 9 aa, Homo Sapiens
NIAMEQVNK

SEQ ID NO: 1118959 - protein, 9 aa, Homo Sapiens
DYCIHLVEG

SEQ ID NO: 1118960 - protein, 9 aa, Homo Sapiens
CFDFVLPPI

SEQ ID NO: 1118961 - protein, 9 aa, Homo Sapiens
KGLRKSETP

SEQ ID NO: 1118962 - protein, 9 aa, Homo Sapiens
QLLIILTAD

SEQ ID NO: 1118963 - protein, 9 aa, Homo Sapiens
VLYGQNKKY

SEQ ID NO: 1118964 - protein, 9 aa, Homo Sapiens
KVQELQRSN

SEQ ID NO: 1118965 - protein, 9 aa, Homo Sapiens
VAFHLDFEF

SEQ ID NO: 1118966 - protein, 9 aa, Homo Sapiens
RKRQKQASD

SEQ ID NO: 1118967 - protein, 9 aa, Homo Sapiens
KEVGEALLY

SEQ ID NO: 1118968 - protein, 9 aa, Homo Sapiens
QSVIARCLV

SEQ ID NO: 1118969 - protein, 9 aa, Homo Sapiens
NGVEMLVEN

SEQ ID NO: 1118970 - protein, 9 aa, Homo Sapiens
TNNSNRYSI

SEQ ID NO: 1118971 - protein, 9 aa, Homo Sapiens
RKYAIGDLK

SEQ ID NO: 1118972 - protein, 9 aa, Homo Sapiens
GVCTDCASR

SEQ ID NO: 1118973 - protein, 9 aa, Homo Sapiens
PVLFMVYGN

SEQ ID NO: 1118974 - protein, 9 aa, Homo Sapiens
VVPVPPLPA

SEQ ID NO: 1118975 - protein, 9 aa, Homo Sapiens
QDFKTDLCF

SEQ ID NO: 1118976 - protein, 9 aa, Homo Sapiens
RVQFRVASL

SEQ ID NO: 1118977 - protein, 9 aa, Homo Sapiens
CQNPTIFEE

SEQ ID NO: 1118978 - protein, 9 aa, Homo Sapiens
ERHGLGKDL

SEQ ID NO: 1118979 - protein, 9 aa, Homo Sapiens
LKKKKQLVQ

SEQ ID NO: 1118980 - protein, 9 aa, Homo Sapiens
PRPMGIIAT

SEQ ID NO: 1118981 - protein, 9 aa, Homo Sapiens
LDSTNGTGV

SEQ ID NO: 1118982 - protein, 9 aa, Homo Sapiens
LSLRSETTA

SEQ ID NO: 1118983 - protein, 9 aa, Homo Sapiens
PDLETMDIW

SEQ ID NO: 1118984 - protein, 9 aa, Homo Sapiens
ERPYPEQFW

SEQ ID NO: 1118985 - protein, 9 aa, Homo Sapiens
PLTIMKRKP

SEQ ID NO: 1118986 - protein, 9 aa, Homo Sapiens
AILVIITAV

SEQ ID NO: 1118987 - protein, 9 aa, Homo Sapiens
HQNTFWYGI

SEQ ID NO: 1118988 - protein, 9 aa, Homo Sapiens
TFRDHKRVH

SEQ ID NO: 1118989 - protein, 9 aa, Homo Sapiens
GVQFGEVEL

SEQ ID NO: 1118990 - protein, 9 aa, Homo Sapiens
VLDVGGNCH

SEQ ID NO: 1118991 - protein, 9 aa, Homo Sapiens
AERLQLCPQ

SEQ ID NO: 1118992 - protein, 9 aa, Homo Sapiens
CSPVARLTW

SEQ ID NO: 1118993 - protein, 9 aa, Homo Sapiens
RQHTEFHPS

SEQ ID NO: 1118994 - protein, 9 aa, Homo Sapiens
WKIRDSNRS

SEQ ID NO: 1118995 - protein, 9 aa, Homo Sapiens
TAIAYGAMT

SEQ ID NO: 1118996 - protein, 9 aa, Homo Sapiens
VHVNLLFLE

SEQ ID NO: 1118997 - protein, 9 aa, Homo Sapiens
LKQSMTMNL

SEQ ID NO: 1118998 - protein, 9 aa, Homo Sapiens
TVIMDKPQK

SEQ ID NO: 1118999 - protein, 9 aa, Homo Sapiens
SLFGDVSSD

SEQ ID NO: 1119000 - protein, 9 aa, Homo Sapiens
NLYRDAMLE

SEQ ID NO: 1119001 - protein, 9 aa, Homo Sapiens
SDPILGSPF

SEQ ID NO: 1119002 - protein, 9 aa, Homo Sapiens
ASPPSMRCV

SEQ ID NO: 1119003 - protein, 9 aa, Homo Sapiens
GGQVAVGLR

SEQ ID NO: 1119004 - protein, 9 aa, Homo Sapiens
LVTVRVPLQ

SEQ ID NO: 1119005 - protein, 9 aa, Homo Sapiens
TSAVLLKEI

SEQ ID NO: 1119006 - protein, 9 aa, Homo Sapiens
GHFCPLRTL

SEQ ID NO: 1119007 - protein, 9 aa, Homo Sapiens
IRGNMGIRP

SEQ ID NO: 1119008 - protein, 9 aa, Homo Sapiens
PTVDDDYSR

SEQ ID NO: 1119009 - protein, 9 aa, Homo Sapiens
SPGPSGLAS

SEQ ID NO: 1119010 - protein, 9 aa, Homo Sapiens
LIPAPVLLL

SEQ ID NO: 1119011 - protein, 9 aa, Homo Sapiens
GPLKTEQGG

SEQ ID NO: 1119012 - protein, 9 aa, Homo Sapiens
YPRRIVRSS

SEQ ID NO: 1119013 - protein, 9 aa, Homo Sapiens
TSIIVERMY

SEQ ID NO: 1119014 - protein, 9 aa, Homo Sapiens
DGDIKHIST

SEQ ID NO: 1119015 - protein, 9 aa, Homo Sapiens
RGTSIAFST

SEQ ID NO: 1119016 - protein, 9 aa, Homo Sapiens
NPSMKSFIF

SEQ ID NO: 1119017 - protein, 9 aa, Homo Sapiens
LSEEEKLKL

SEQ ID NO: 1119018 - protein, 9 aa, Homo Sapiens
HRFYHIEYF

SEQ ID NO: 1119019 - protein, 9 aa, Homo Sapiens
RGSMSARVT

SEQ ID NO: 1119020 - protein, 9 aa, Homo Sapiens
NFLCLSTNF

SEQ ID NO: 1119021 - protein, 9 aa, Homo Sapiens
TRAQAAPST

SEQ ID NO: 1119022 - protein, 9 aa, Homo Sapiens
GMERGQGRI

SEQ ID NO: 1119023 - protein, 9 aa, Homo Sapiens
ISITPVWLH

SEQ ID NO: 1119024 - protein, 9 aa, Homo Sapiens
MDLDGMLTV

SEQ ID NO: 1119025 - protein, 9 aa, Homo Sapiens
FLVIRYVKW

SEQ ID NO: 1119026 - protein, 9 aa, Homo Sapiens
NGIKGGLGE

SEQ ID NO: 1119027 - protein, 9 aa, Homo Sapiens
PPDGQEGFS

SEQ ID NO: 1119028 - protein, 9 aa, Homo Sapiens
PQGPPENQV

SEQ ID NO: 1119029 - protein, 9 aa, Homo Sapiens
ASPAQYTTL

SEQ ID NO: 1119030 - protein, 9 aa, Homo Sapiens
MLTGCPFRP

SEQ ID NO: 1119031 - protein, 9 aa, Homo Sapiens
SVKEAAVLV

SEQ ID NO: 1119032 - protein, 9 aa, Homo Sapiens
FHRILLDTH

SEQ ID NO: 1119033 - protein, 9 aa, Homo Sapiens
RTDSMSSES

SEQ ID NO: 1119034 - protein, 9 aa, Homo Sapiens
YSMELDETD

SEQ ID NO: 1119035 - protein, 9 aa, Homo Sapiens
CPTATAACP

SEQ ID NO: 1119036 - protein, 9 aa, Homo Sapiens
LGCYPEEDN

SEQ ID NO: 1119037 - protein, 9 aa, Homo Sapiens
LCADQPRIV

SEQ ID NO: 1119038 - protein, 9 aa, Homo Sapiens
VSPQPRAFL

SEQ ID NO: 1119039 - protein, 9 aa, Homo Sapiens
QLFYMINVV

SEQ ID NO: 1119040 - protein, 9 aa, Homo Sapiens
GPSPASLLT

SEQ ID NO: 1119041 - protein, 9 aa, Homo Sapiens
EPMHTISDG

SEQ ID NO: 1119042 - protein, 9 aa, Homo Sapiens
AFARHGRSL

SEQ ID NO: 1119043 - protein, 9 aa, Homo Sapiens
IITTKMGGP

SEQ ID NO: 1119044 - protein, 9 aa, Homo Sapiens
PLTMGAICP

SEQ ID NO: 1119045 - protein, 9 aa, Homo Sapiens
LSSSRDQKL

SEQ ID NO: 1119046 - protein, 9 aa, Homo Sapiens
HFGRSLKVG

SEQ ID NO: 1119047 - protein, 9 aa, Homo Sapiens
SLLLTNVPS

SEQ ID NO: 1119048 - protein, 9 aa, Homo Sapiens
HVTANMVDP

SEQ ID NO: 1119049 - protein, 9 aa, Homo Sapiens
STSSVTASC

SEQ ID NO: 1119050 - protein, 9 aa, Homo Sapiens
HRCQQEGQE

SEQ ID NO: 1119051 - protein, 9 aa, Homo Sapiens
LEETSPHQA

SEQ ID NO: 1119052 - protein, 9 aa, Homo Sapiens
VGMRRLCRR

SEQ ID NO: 1119053 - protein, 9 aa, Homo Sapiens
PQQVQCIQE

SEQ ID NO: 1119054 - protein, 9 aa, Homo Sapiens
FPFLIAVMF

SEQ ID NO: 1119055 - protein, 9 aa, Homo Sapiens
VLPPATGSY

SEQ ID NO: 1119056 - protein, 9 aa, Homo Sapiens
TAEGPAARA

SEQ ID NO: 1119057 - protein, 9 aa, Homo Sapiens
DRPKPPRPL

SEQ ID NO: 1119058 - protein, 9 aa, Homo Sapiens
GAGAGLGCV

SEQ ID NO: 1119059 - protein, 9 aa, Homo Sapiens
VAVATDLSP

SEQ ID NO: 1119060 - protein, 9 aa, Homo Sapiens
LVYPIIFVM

SEQ ID NO: 1119061 - protein, 9 aa, Homo Sapiens
GYEWVNSPE

SEQ ID NO: 1119062 - protein, 9 aa, Homo Sapiens
HWRRCGGPR

SEQ ID NO: 1119063 - protein, 9 aa, Homo Sapiens
VCNVTISFD

SEQ ID NO: 1119064 - protein, 9 aa, Homo Sapiens
NDAQDITVY

SEQ ID NO: 1119065 - protein, 9 aa, Homo Sapiens
SKRPSWYNI

SEQ ID NO: 1119066 - protein, 9 aa, Homo Sapiens
ACNMMKKKN

SEQ ID NO: 1119067 - protein, 9 aa, Homo Sapiens
KDLTTKINE

SEQ ID NO: 1119068 - protein, 9 aa, Homo Sapiens
RLYPGAADP

SEQ ID NO: 1119069 - protein, 9 aa, Homo Sapiens
TLHRCQQEG

SEQ ID NO: 1119070 - protein, 9 aa, Homo Sapiens
PAALLLRSS

SEQ ID NO: 1119071 - protein, 9 aa, Homo Sapiens
LGLILFSML

SEQ ID NO: 1119072 - protein, 9 aa, Homo Sapiens
VSVKDIQRG

SEQ ID NO: 1119073 - protein, 9 aa, Homo Sapiens
LLRSFRITT

SEQ ID NO: 1119074 - protein, 9 aa, Homo Sapiens
SYGGPSPQG

SEQ ID NO: 1119075 - protein, 9 aa, Homo Sapiens
TWKLLVKQV

SEQ ID NO: 1119076 - protein, 9 aa, Homo Sapiens
CHKCGKVFS

SEQ ID NO: 1119077 - protein, 9 aa, Homo Sapiens
LVFYISVGV

SEQ ID NO: 1119078 - protein, 9 aa, Homo Sapiens
ISVRLNMLP

SEQ ID NO: 1119079 - protein, 9 aa, Homo Sapiens
VTRNYAWVP

SEQ ID NO: 1119080 - protein, 9 aa, Homo Sapiens
PSPAPSAGR

SEQ ID NO: 1119081 - protein, 9 aa, Homo Sapiens
GQDLGMAGS

SEQ ID NO: 1119082 - protein, 9 aa, Homo Sapiens
HVTFTKDNR

SEQ ID NO: 1119083 - protein, 9 aa, Homo Sapiens
SKRCMSVGQ

SEQ ID NO: 1119084 - protein, 9 aa, Homo Sapiens
KSEASSSPL

SEQ ID NO: 1119085 - protein, 9 aa, Homo Sapiens
VAGHTLTAH

SEQ ID NO: 1119086 - protein, 9 aa, Homo Sapiens
PYECMVRGK

SEQ ID NO: 1119087 - protein, 9 aa, Homo Sapiens
DDAYSQCVT

SEQ ID NO: 1119088 - protein, 9 aa, Homo Sapiens
GRRDPQDGC

SEQ ID NO: 1119089 - protein, 9 aa, Homo Sapiens
ILQERGDHD

SEQ ID NO: 1119090 - protein, 9 aa, Homo Sapiens
STVHQVWVK

SEQ ID NO: 1119091 - protein, 9 aa, Homo Sapiens
NVLVAMRKA

SEQ ID NO: 1119092 - protein, 9 aa, Homo Sapiens
LTAFQKKGP

SEQ ID NO: 1119093 - protein, 9 aa, Homo Sapiens
GLCPGQAWL

SEQ ID NO: 1119094 - protein, 9 aa, Homo Sapiens
DNAGKERAA

SEQ ID NO: 1119095 - protein, 9 aa, Homo Sapiens
VLSNGLLLI

SEQ ID NO: 1119096 - protein, 9 aa, Homo Sapiens
QAMRVVRTV

SEQ ID NO: 1119097 - protein, 9 aa, Homo Sapiens
FREVKESEN

SEQ ID NO: 1119098 - protein, 9 aa, Homo Sapiens
PVQAVASPD

SEQ ID NO: 1119099 - protein, 9 aa, Homo Sapiens
RDADASPAP

SEQ ID NO: 1119100 - protein, 9 aa, Homo Sapiens
TDIRKYKVL

SEQ ID NO: 1119101 - protein, 9 aa, Homo Sapiens
THPTCILGQ

SEQ ID NO: 1119102 - protein, 9 aa, Homo Sapiens
MHLTLQLDS

SEQ ID NO: 1119103 - protein, 9 aa, Homo Sapiens
VECTSAMMQ

SEQ ID NO: 1119104 - protein, 9 aa, Homo Sapiens
LTMSIDRAL

SEQ ID NO: 1119105 - protein, 9 aa, Homo Sapiens
LRPELGPQL

SEQ ID NO: 1119106 - protein, 9 aa, Homo Sapiens
HPLHPPHLV

SEQ ID NO: 1119107 - protein, 9 aa, Homo Sapiens
GLQPLQRKG

SEQ ID NO: 1119108 - protein, 9 aa, Homo Sapiens
THGWPMSSP

SEQ ID NO: 1119109 - protein, 9 aa, Homo Sapiens
DVVVYDQSM

SEQ ID NO: 1119110 - protein, 9 aa, Homo Sapiens
RGKHFTGRS

SEQ ID NO: 1119111 - protein, 9 aa, Homo Sapiens
KNPKNHYEE

SEQ ID NO: 1119112 - protein, 9 aa, Homo Sapiens
IPCIMVSEI

SEQ ID NO: 1119113 - protein, 9 aa, Homo Sapiens
PTSSVAGRT

SEQ ID NO: 1119114 - protein, 9 aa, Homo Sapiens
DLRHPRRRL

SEQ ID NO: 1119115 - protein, 9 aa, Homo Sapiens
TMKSVMCKM

SEQ ID NO: 1119116 - protein, 9 aa, Homo Sapiens
SIAARLETY

SEQ ID NO: 1119117 - protein, 9 aa, Homo Sapiens
VSKGAMVNT

SEQ ID NO: 1119118 - protein, 9 aa, Homo Sapiens
KIGDTKRTT

SEQ ID NO: 1119119 - protein, 9 aa, Homo Sapiens
LEQLGGCWP

SEQ ID NO: 1119120 - protein, 9 aa, Homo Sapiens
KPYICSKCG

SEQ ID NO: 1119121 - protein, 9 aa, Homo Sapiens
SHLHKTEKA

SEQ ID NO: 1119122 - protein, 9 aa, Homo Sapiens
ILEAHAHNE

SEQ ID NO: 1119123 - protein, 9 aa, Homo Sapiens
PMHCPTATA

SEQ ID NO: 1119124 - protein, 9 aa, Homo Sapiens
GLTGNTAII

SEQ ID NO: 1119125 - protein, 9 aa, Homo Sapiens
FLIEKNLIW

SEQ ID NO: 1119126 - protein, 9 aa, Homo Sapiens
WPANRDTPP

SEQ ID NO: 1119127 - protein, 9 aa, Homo Sapiens
VNVYLTIAI

SEQ ID NO: 1119128 - protein, 9 aa, Homo Sapiens
YMWSFCFSP

SEQ ID NO: 1119129 - protein, 9 aa, Homo Sapiens
GHHGADVEP

SEQ ID NO: 1119130 - protein, 9 aa, Homo Sapiens
SKAARTGLH

SEQ ID NO: 1119131 - protein, 9 aa, Homo Sapiens
CRACIGRRW

SEQ ID NO: 1119132 - protein, 9 aa, Homo Sapiens
WNPKEHLSS

SEQ ID NO: 1119133 - protein, 9 aa, Homo Sapiens
DYYLYDQQR

SEQ ID NO: 1119134 - protein, 9 aa, Homo Sapiens
FLMAEKNFN

SEQ ID NO: 1119135 - protein, 9 aa, Homo Sapiens
DDGDWQACG

SEQ ID NO: 1119136 - protein, 9 aa, Homo Sapiens
RFWANVIKN

SEQ ID NO: 1119137 - protein, 9 aa, Homo Sapiens
REPPEVHIA

SEQ ID NO: 1119138 - protein, 9 aa, Homo Sapiens
AREVADKGD

SEQ ID NO: 1119139 - protein, 9 aa, Homo Sapiens
GKHGAQKMS

SEQ ID NO: 1119140 - protein, 9 aa, Homo Sapiens
DYPCSLVGI

SEQ ID NO: 1119141 - protein, 9 aa, Homo Sapiens
GLCDLLWSD

SEQ ID NO: 1119142 - protein, 9 aa, Homo Sapiens
SQGALFGRG

SEQ ID NO: 1119143 - protein, 9 aa, Homo Sapiens
KEARGRMLI

SEQ ID NO: 1119144 - protein, 9 aa, Homo Sapiens
LKEHRQESL

SEQ ID NO: 1119145 - protein, 9 aa, Homo Sapiens
STVDQQKSS

SEQ ID NO: 1119146 - protein, 9 aa, Homo Sapiens
IITEVRIYV

SEQ ID NO: 1119147 - protein, 9 aa, Homo Sapiens
EHRVPPFPS

SEQ ID NO: 1119148 - protein, 9 aa, Homo Sapiens
ACPPCPVHR

SEQ ID NO: 1119149 - protein, 9 aa, Homo Sapiens
CEHLRRCNI

SEQ ID NO: 1119150 - protein, 9 aa, Homo Sapiens
PLLGDQLVG

SEQ ID NO: 1119151 - protein, 9 aa, Homo Sapiens
AARSSLGAR

SEQ ID NO: 1119152 - protein, 9 aa, Homo Sapiens
AAPNMNSEP

SEQ ID NO: 1119153 - protein, 9 aa, Homo Sapiens
CSSPSCSAW

SEQ ID NO: 1119154 - protein, 9 aa, Homo Sapiens
RRDRCSAGK

SEQ ID NO: 1119155 - protein, 9 aa, Homo Sapiens
SPRTCGASI

SEQ ID NO: 1119156 - protein, 9 aa, Homo Sapiens
VRSQRKDCK

SEQ ID NO: 1119157 - protein, 9 aa, Homo Sapiens
SFKFPLQEE

SEQ ID NO: 1119158 - protein, 9 aa, Homo Sapiens
VGLHTGKVR

SEQ ID NO: 1119159 - protein, 9 aa, Homo Sapiens
GVSTGRCIA

SEQ ID NO: 1119160 - protein, 9 aa, Homo Sapiens
DTIRLYEMI

SEQ ID NO: 1119161 - protein, 9 aa, Homo Sapiens
VRFEEFASV

SEQ ID NO: 1119162 - protein, 9 aa, Homo Sapiens
PGGAAGGGS

SEQ ID NO: 1119163 - protein, 9 aa, Homo Sapiens
DGPASSTSG

SEQ ID NO: 1119164 - protein, 9 aa, Homo Sapiens
CAACRPGPT

SEQ ID NO: 1119165 - protein, 9 aa, Homo Sapiens
PPSTRHGVE

SEQ ID NO: 1119166 - protein, 9 aa, Homo Sapiens
STRIPFRVG

SEQ ID NO: 1119167 - protein, 9 aa, Homo Sapiens
EVNLKKYSS

SEQ ID NO: 1119168 - protein, 9 aa, Homo Sapiens
TGTLSWAAR

SEQ ID NO: 1119169 - protein, 9 aa, Homo Sapiens
PQAFENIED

SEQ ID NO: 1119170 - protein, 9 aa, Homo Sapiens
TNRRWIHVI

SEQ ID NO: 1119171 - protein, 9 aa, Homo Sapiens
VSTRGASKA

SEQ ID NO: 1119172 - protein, 9 aa, Homo Sapiens
DHVAFCVTS

SEQ ID NO: 1119173 - protein, 9 aa, Homo Sapiens
QATNAHDAL

SEQ ID NO: 1119174 - protein, 9 aa, Homo Sapiens
TSSHGGLRL

SEQ ID NO: 1119175 - protein, 9 aa, Homo Sapiens
ELRQHEVTI

SEQ ID NO: 1119176 - protein, 9 aa, Homo Sapiens
GPRAPPQTR

SEQ ID NO: 1119177 - protein, 9 aa, Homo Sapiens
QGRKPGAQE

SEQ ID NO: 1119178 - protein, 9 aa, Homo Sapiens
ERLVEEALE

SEQ ID NO: 1119179 - protein, 9 aa, Homo Sapiens
KYGGNLIGN

SEQ ID NO: 1119180 - protein, 9 aa, Homo Sapiens
TRAVAHSIV

SEQ ID NO: 1119181 - protein, 9 aa, Homo Sapiens
LWPGVKGPD

SEQ ID NO: 1119182 - protein, 9 aa, Homo Sapiens
LVFLASTRP

SEQ ID NO: 1119183 - protein, 9 aa, Homo Sapiens
PTQENFNSQ

SEQ ID NO: 1119184 - protein, 9 aa, Homo Sapiens
WRTRACTPA

SEQ ID NO: 1119185 - protein, 9 aa, Homo Sapiens
VSQGYHQRT

SEQ ID NO: 1119186 - protein, 9 aa, Homo Sapiens
AGTVAASLV

SEQ ID NO: 1119187 - protein, 9 aa, Homo Sapiens
RMCLHASGS

SEQ ID NO: 1119188 - protein, 9 aa, Homo Sapiens
LAAAAVGPN

SEQ ID NO: 1119189 - protein, 9 aa, Homo Sapiens
TVAEKEEWH

SEQ ID NO: 1119190 - protein, 9 aa, Homo Sapiens
CRPKKRTVL

SEQ ID NO: 1119191 - protein, 9 aa, Homo Sapiens
PKFLNSTNS

SEQ ID NO: 1119192 - protein, 9 aa, Homo Sapiens
CAENIHKHI

SEQ ID NO: 1119193 - protein, 9 aa, Homo Sapiens
TISLLVGIL

SEQ ID NO: 1119194 - protein, 9 aa, Homo Sapiens
EVILSSEVS

SEQ ID NO: 1119195 - protein, 9 aa, Homo Sapiens
PPPRTCCHR

SEQ ID NO: 1119196 - protein, 9 aa, Homo Sapiens
ACFTWRTSR

SEQ ID NO: 1119197 - protein, 9 aa, Homo Sapiens
LFLEARMQA

SEQ ID NO: 1119198 - protein, 9 aa, Homo Sapiens
RSHQGALMD

SEQ ID NO: 1119199 - protein, 9 aa, Homo Sapiens
HVLFLIDPL

SEQ ID NO: 1119200 - protein, 9 aa, Homo Sapiens
WERTTFTRA

SEQ ID NO: 1119201 - protein, 9 aa, Homo Sapiens
GQWGPPRAR

SEQ ID NO: 1119202 - protein, 9 aa, Homo Sapiens
NPIAPTKKS

SEQ ID NO: 1119203 - protein, 9 aa, Homo Sapiens
SGDQAKAAV

SEQ ID NO: 1119204 - protein, 9 aa, Homo Sapiens
DRMVKSALE

SEQ ID NO: 1119205 - protein, 9 aa, Homo Sapiens
NAWHNVRVT

SEQ ID NO: 1119206 - protein, 9 aa, Homo Sapiens
LEILLSRGY

SEQ ID NO: 1119207 - protein, 9 aa, Homo Sapiens
DNRHVALAT

SEQ ID NO: 1119208 - protein, 9 aa, Homo Sapiens
QHKRLVRLY

SEQ ID NO: 1119209 - protein, 9 aa, Homo Sapiens
NHADTIRSG

SEQ ID NO: 1119210 - protein, 9 aa, Homo Sapiens
TTAFPDSAT

SEQ ID NO: 1119211 - protein, 9 aa, Homo Sapiens
GILLSGAKV

SEQ ID NO: 1119212 - protein, 9 aa, Homo Sapiens
AFYSLQPPT

SEQ ID NO: 1119213 - protein, 9 aa, Homo Sapiens
EELQEQLYM

SEQ ID NO: 1119214 - protein, 9 aa, Homo Sapiens
GVQPPLPSE

SEQ ID NO: 1119215 - protein, 9 aa, Homo Sapiens
GTSRTRGTL

SEQ ID NO: 1119216 - protein, 9 aa, Homo Sapiens
TIFHILLLH

SEQ ID NO: 1119217 - protein, 9 aa, Homo Sapiens
ENIDARKNS

SEQ ID NO: 1119218 - protein, 9 aa, Homo Sapiens
GGTRLTTVS

SEQ ID NO: 1119219 - protein, 9 aa, Homo Sapiens
VKAMYYLKE

SEQ ID NO: 1119220 - protein, 9 aa, Homo Sapiens
GVVLHSPGA

SEQ ID NO: 1119221 - protein, 9 aa, Homo Sapiens
HPQWAPHSA

SEQ ID NO: 1119222 - protein, 9 aa, Homo Sapiens
LDKVNYSHL

SEQ ID NO: 1119223 - protein, 9 aa, Homo Sapiens
LHPRTQGHW

SEQ ID NO: 1119224 - protein, 9 aa, Homo Sapiens
TLPQPGAEQ

SEQ ID NO: 1119225 - protein, 9 aa, Homo Sapiens
ICSGVTGAV

SEQ ID NO: 1119226 - protein, 9 aa, Homo Sapiens
HEKLGSDLP

SEQ ID NO: 1119227 - protein, 9 aa, Homo Sapiens
LLALATLCI

SEQ ID NO: 1119228 - protein, 9 aa, Homo Sapiens
TGMSVYYSV

SEQ ID NO: 1119229 - protein, 9 aa, Homo Sapiens
KFLSKKGNF

SEQ ID NO: 1119230 - protein, 9 aa, Homo Sapiens
EQLKEYLFY

SEQ ID NO: 1119231 - protein, 9 aa, Homo Sapiens
PTGWFAIQT

SEQ ID NO: 1119232 - protein, 9 aa, Homo Sapiens
VIPSKPIQF

SEQ ID NO: 1119233 - protein, 9 aa, Homo Sapiens
IFIFAYLIF

SEQ ID NO: 1119234 - protein, 9 aa, Homo Sapiens
KCDLFEQFR

SEQ ID NO: 1119235 - protein, 9 aa, Homo Sapiens
ILCKTSLFL

SEQ ID NO: 1119236 - protein, 9 aa, Homo Sapiens
DVEEVPEQQ

SEQ ID NO: 1119237 - protein, 9 aa, Homo Sapiens
MYSLRERKA

SEQ ID NO: 1119238 - protein, 9 aa, Homo Sapiens
NMDNMLQKA

SEQ ID NO: 1119239 - protein, 9 aa, Homo Sapiens
PQLLIILTA

SEQ ID NO: 1119240 - protein, 9 aa, Homo Sapiens
PPGSLRLSC

SEQ ID NO: 1119241 - protein, 9 aa, Homo Sapiens
DLLPWKIRD

SEQ ID NO: 1119242 - protein, 9 aa, Homo Sapiens
STRNKPSEG

SEQ ID NO: 1119243 - protein, 9 aa, Homo Sapiens
PQFVPVLST

SEQ ID NO: 1119244 - protein, 9 aa, Homo Sapiens
KYAELRDAI

SEQ ID NO: 1119245 - protein, 9 aa, Homo Sapiens
VYPSIDEAW

SEQ ID NO: 1119246 - protein, 9 aa, Homo Sapiens
SIVSLCPGV

SEQ ID NO: 1119247 - protein, 9 aa, Homo Sapiens
SRHSPSPLS

SEQ ID NO: 1119248 - protein, 9 aa, Homo Sapiens
PLKKRILCG

SEQ ID NO: 1119249 - protein, 9 aa, Homo Sapiens
QAQAGMERG

SEQ ID NO: 1119250 - protein, 9 aa, Homo Sapiens
GVLRSLAAW

SEQ ID NO: 1119251 - protein, 9 aa, Homo Sapiens
GECLMSTMK

SEQ ID NO: 1119252 - protein, 9 aa, Homo Sapiens
PWGFSDPGV

SEQ ID NO: 1119253 - protein, 9 aa, Homo Sapiens
QLPEPSCRP

SEQ ID NO: 1119254 - protein, 9 aa, Homo Sapiens
LIMMYRTHC

SEQ ID NO: 1119255 - protein, 9 aa, Homo Sapiens
HRCPPARWV

SEQ ID NO: 1119256 - protein, 9 aa, Homo Sapiens
ACNCVFRDA

SEQ ID NO: 1119257 - protein, 9 aa, Homo Sapiens
TCSAHRGRT

SEQ ID NO: 1119258 - protein, 9 aa, Homo Sapiens
EEGNHDKNH

SEQ ID NO: 1119259 - protein, 9 aa, Homo Sapiens
SYALFIREN

SEQ ID NO: 1119260 - protein, 9 aa, Homo Sapiens
LSYIAEIKL

SEQ ID NO: 1119261 - protein, 9 aa, Homo Sapiens
PVCQVPIRK

SEQ ID NO: 1119262 - protein, 9 aa, Homo Sapiens
NGVRKYPLL

SEQ ID NO: 1119263 - protein, 9 aa, Homo Sapiens
LDSFLKSAR

SEQ ID NO: 1119264 - protein, 9 aa, Homo Sapiens
PFMAPGKSR

SEQ ID NO: 1119265 - protein, 9 aa, Homo Sapiens
DWHSHDTDN

SEQ ID NO: 1119266 - protein, 9 aa, Homo Sapiens
NASASRPTS

SEQ ID NO: 1119267 - protein, 9 aa, Homo Sapiens
GKDPPAAPP

SEQ ID NO: 1119268 - protein, 9 aa, Homo Sapiens
PTTPRWRTF

SEQ ID NO: 1119269 - protein, 9 aa, Homo Sapiens
GIWNTWYGE

SEQ ID NO: 1119270 - protein, 9 aa, Homo Sapiens
RRDPQDGCN

SEQ ID NO: 1119271 - protein, 9 aa, Homo Sapiens
RGGTTCPPT

SEQ ID NO: 1119272 - protein, 9 aa, Homo Sapiens
STSERELDL

SEQ ID NO: 1119273 - protein, 9 aa, Homo Sapiens
SSRGRNFWQ

SEQ ID NO: 1119274 - protein, 9 aa, Homo Sapiens
VDVLDREGW

SEQ ID NO: 1119275 - protein, 9 aa, Homo Sapiens
ELNHRTEMK

SEQ ID NO: 1119276 - protein, 9 aa, Homo Sapiens
QLQMRLGCR

SEQ ID NO: 1119277 - protein, 9 aa, Homo Sapiens
LWELCCRTG

SEQ ID NO: 1119278 - protein, 9 aa, Homo Sapiens
HHRDREPDT

SEQ ID NO: 1119279 - protein, 9 aa, Homo Sapiens
SGTSRTRGT

SEQ ID NO: 1119280 - protein, 9 aa, Homo Sapiens
LVINRLVVD

SEQ ID NO: 1119281 - protein, 9 aa, Homo Sapiens
DSPPRGRSQ

SEQ ID NO: 1119282 - protein, 9 aa, Homo Sapiens
YSRDSNYLN

SEQ ID NO: 1119283 - protein, 9 aa, Homo Sapiens
ADQSGPLAA

SEQ ID NO: 1119284 - protein, 9 aa, Homo Sapiens
IKVAWKKTA

SEQ ID NO: 1119285 - protein, 9 aa, Homo Sapiens
NMEALLISQ

SEQ ID NO: 1119286 - protein, 9 aa, Homo Sapiens
PSTFYIYLT

SEQ ID NO: 1119287 - protein, 9 aa, Homo Sapiens
SMPTTGMSV

SEQ ID NO: 1119288 - protein, 9 aa, Homo Sapiens
MDNMLQKAH

SEQ ID NO: 1119289 - protein, 9 aa, Homo Sapiens
SRLRGRQHS

SEQ ID NO: 1119290 - protein, 9 aa, Homo Sapiens
FQSVEVPGN

SEQ ID NO: 1119291 - protein, 9 aa, Homo Sapiens
LWVVTSKKD

SEQ ID NO: 1119292 - protein, 9 aa, Homo Sapiens
SNLIEQEQL

SEQ ID NO: 1119293 - protein, 9 aa, Homo Sapiens
ERQPLLGAG

SEQ ID NO: 1119294 - protein, 9 aa, Homo Sapiens
TPVPRSLRL

SEQ ID NO: 1119295 - protein, 9 aa, Homo Sapiens
VTASCASTG

SEQ ID NO: 1119296 - protein, 9 aa, Homo Sapiens
EEPFPSTST

SEQ ID NO: 1119297 - protein, 9 aa, Homo Sapiens
VKFVDTDKE

SEQ ID NO: 1119298 - protein, 9 aa, Homo Sapiens
KDDEFRKKC

SEQ ID NO: 1119299 - protein, 9 aa, Homo Sapiens
CDTMDTVDI

SEQ ID NO: 1119300 - protein, 9 aa, Homo Sapiens
LLSALGHTA

SEQ ID NO: 1119301 - protein, 9 aa, Homo Sapiens
HLRPAGTLP

SEQ ID NO: 1119302 - protein, 9 aa, Homo Sapiens
SDSQSSNPC

SEQ ID NO: 1119303 - protein, 9 aa, Homo Sapiens
VDVDCLPLP

SEQ ID NO: 1119304 - protein, 9 aa, Homo Sapiens
TGVSYTLEK

SEQ ID NO: 1119305 - protein, 9 aa, Homo Sapiens
QRLTCSPQQ

SEQ ID NO: 1119306 - protein, 9 aa, Homo Sapiens
GVEAFFMNL

SEQ ID NO: 1119307 - protein, 9 aa, Homo Sapiens
IQQSLERVL

SEQ ID NO: 1119308 - protein, 9 aa, Homo Sapiens
MSSSYETYD

SEQ ID NO: 1119309 - protein, 9 aa, Homo Sapiens
GPRGSGGEQ

SEQ ID NO: 1119310 - protein, 9 aa, Homo Sapiens
LHIQVQAPP

SEQ ID NO: 1119311 - protein, 9 aa, Homo Sapiens
ISFSFAFPK

SEQ ID NO: 1119312 - protein, 9 aa, Homo Sapiens
GQRSASTKH

SEQ ID NO: 1119313 - protein, 9 aa, Homo Sapiens
SYTISCVTQ

SEQ ID NO: 1119314 - protein, 9 aa, Homo Sapiens
YRHPVLLLH

SEQ ID NO: 1119315 - protein, 9 aa, Homo Sapiens
GLGMIVQSI

SEQ ID NO: 1119316 - protein, 9 aa, Homo Sapiens
SSVPGAALQ

SEQ ID NO: 1119317 - protein, 9 aa, Homo Sapiens
HIRIDDSTS

SEQ ID NO: 1119318 - protein, 9 aa, Homo Sapiens
SPGPPTSLP

SEQ ID NO: 1119319 - protein, 9 aa, Homo Sapiens
VRAAHGPRT

SEQ ID NO: 1119320 - protein, 9 aa, Homo Sapiens
MWTTVIDMK

SEQ ID NO: 1119321 - protein, 9 aa, Homo Sapiens
RCNSINRNF

SEQ ID NO: 1119322 - protein, 9 aa, Homo Sapiens
PRVCPTSRQ

SEQ ID NO: 1119323 - protein, 9 aa, Homo Sapiens
CTSAMMQAL

SEQ ID NO: 1119324 - protein, 9 aa, Homo Sapiens
LRPHGGLKL

SEQ ID NO: 1119325 - protein, 9 aa, Homo Sapiens
DAQDITVYH

SEQ ID NO: 1119326 - protein, 9 aa, Homo Sapiens
EIRAKFEEY

SEQ ID NO: 1119327 - protein, 9 aa, Homo Sapiens
SFMKLYHSL

SEQ ID NO: 1119328 - protein, 9 aa, Homo Sapiens
KCLMDRSRE

SEQ ID NO: 1119329 - protein, 9 aa, Homo Sapiens
RRWERPGAG

SEQ ID NO: 1119330 - protein, 9 aa, Homo Sapiens
FEHCVQRAL

SEQ ID NO: 1119331 - protein, 9 aa, Homo Sapiens
LLKNQWFAR

SEQ ID NO: 1119332 - protein, 9 aa, Homo Sapiens
ALSACSSYF

SEQ ID NO: 1119333 - protein, 9 aa, Homo Sapiens
GQPQAQAEQ

SEQ ID NO: 1119334 - protein, 9 aa, Homo Sapiens
LNQIMKRMC

SEQ ID NO: 1119335 - protein, 9 aa, Homo Sapiens
LLCPHAFYQ

SEQ ID NO: 1119336 - protein, 9 aa, Homo Sapiens
EEVPDVLRW

SEQ ID NO: 1119337 - protein, 9 aa, Homo Sapiens
AGQSHSKPC

SEQ ID NO: 1119338 - protein, 9 aa, Homo Sapiens
SNQCHNSIQ

SEQ ID NO: 1119339 - protein, 9 aa, Homo Sapiens
GPKSESMVY

SEQ ID NO: 1119340 - protein, 9 aa, Homo Sapiens
VCFIILTLN

SEQ ID NO: 1119341 - protein, 9 aa, Homo Sapiens
LCTLQPRGW

SEQ ID NO: 1119342 - protein, 9 aa, Homo Sapiens
PCVEADDAM

SEQ ID NO: 1119343 - protein, 9 aa, Homo Sapiens
AACLDRDQG

SEQ ID NO: 1119344 - protein, 9 aa, Homo Sapiens
GPGPNQHNM

SEQ ID NO: 1119345 - protein, 9 aa, Homo Sapiens
STSSPASCC

SEQ ID NO: 1119346 - protein, 9 aa, Homo Sapiens
TWMRRRDTP

SEQ ID NO: 1119347 - protein, 9 aa, Homo Sapiens
GHLLSAITN

SEQ ID NO: 1119348 - protein, 9 aa, Homo Sapiens
GIDAHTESN

SEQ ID NO: 1119349 - protein, 9 aa, Homo Sapiens
SGTIMMSSC

SEQ ID NO: 1119350 - protein, 9 aa, Homo Sapiens
RKQTKVLWP

SEQ ID NO: 1119351 - protein, 9 aa, Homo Sapiens
DPDPPAGNS

SEQ ID NO: 1119352 - protein, 9 aa, Homo Sapiens
RTCKLRKEQ

SEQ ID NO: 1119353 - protein, 9 aa, Homo Sapiens
KAFFKGVWS

SEQ ID NO: 1119354 - protein, 9 aa, Homo Sapiens
DVALPGEPR

SEQ ID NO: 1119355 - protein, 9 aa, Homo Sapiens
PDDFKMCVS

SEQ ID NO: 1119356 - protein, 9 aa, Homo Sapiens
PLPAPRPTH

SEQ ID NO: 1119357 - protein, 9 aa, Homo Sapiens
VSLCGLCLA

SEQ ID NO: 1119358 - protein, 9 aa, Homo Sapiens
VSPSLLKIF

SEQ ID NO: 1119359 - protein, 9 aa, Homo Sapiens
SMVIKVDLC

SEQ ID NO: 1119360 - protein, 9 aa, Homo Sapiens
CSHHVTHTV

SEQ ID NO: 1119361 - protein, 9 aa, Homo Sapiens
QWPPGEPGR

SEQ ID NO: 1119362 - protein, 9 aa, Homo Sapiens
GAVELSRCH

SEQ ID NO: 1119363 - protein, 9 aa, Homo Sapiens
EGSVQYKKW

SEQ ID NO: 1119364 - protein, 9 aa, Homo Sapiens
ARDAPGLGV

SEQ ID NO: 1119365 - protein, 9 aa, Homo Sapiens
AWGPSPAPL

SEQ ID NO: 1119366 - protein, 9 aa, Homo Sapiens
PHIIMHLTL

SEQ ID NO: 1119367 - protein, 9 aa, Homo Sapiens
MRRLCRRRT

SEQ ID NO: 1119368 - protein, 9 aa, Homo Sapiens
HLPWSISRS

SEQ ID NO: 1119369 - protein, 9 aa, Homo Sapiens
GTESCEGDS

SEQ ID NO: 1119370 - protein, 9 aa, Homo Sapiens
ARSTVVSTA

SEQ ID NO: 1119371 - protein, 9 aa, Homo Sapiens
SKEPESLIS

SEQ ID NO: 1119372 - protein, 9 aa, Homo Sapiens
LLQERFSLL

SEQ ID NO: 1119373 - protein, 9 aa, Homo Sapiens
VIIHWNARI

SEQ ID NO: 1119374 - protein, 9 aa, Homo Sapiens
GRLTGLTNI

SEQ ID NO: 1119375 - protein, 9 aa, Homo Sapiens
NVKPPRCCP

SEQ ID NO: 1119376 - protein, 9 aa, Homo Sapiens
DKTLTHPSM

SEQ ID NO: 1119377 - protein, 9 aa, Homo Sapiens
LGLSNCETG

SEQ ID NO: 1119378 - protein, 9 aa, Homo Sapiens
SLSPLHGDS

SEQ ID NO: 1119379 - protein, 9 aa, Homo Sapiens
MTPTCPLEK

SEQ ID NO: 1119380 - protein, 9 aa, Homo Sapiens
RRSGSRSEI

SEQ ID NO: 1119381 - protein, 9 aa, Homo Sapiens
RSCIPSTLM

SEQ ID NO: 1119382 - protein, 9 aa, Homo Sapiens
SSPEELHRT

SEQ ID NO: 1119383 - protein, 9 aa, Homo Sapiens
HVNRATCYF

SEQ ID NO: 1119384 - protein, 9 aa, Homo Sapiens
ANCLSMSGL

SEQ ID NO: 1119385 - protein, 9 aa, Homo Sapiens
DPDLETMDI

SEQ ID NO: 1119386 - protein, 9 aa, Homo Sapiens
GQELEKCDI

SEQ ID NO: 1119387 - protein, 9 aa, Homo Sapiens
ALVPAAVLL

SEQ ID NO: 1119388 - protein, 9 aa, Homo Sapiens
LHGVPQSPR

SEQ ID NO: 1119389 - protein, 9 aa, Homo Sapiens
RPKFSGLQK

SEQ ID NO: 1119390 - protein, 9 aa, Homo Sapiens
ELFSVFEGV

SEQ ID NO: 1119391 - protein, 9 aa, Homo Sapiens
AEDSVLLKR

SEQ ID NO: 1119392 - protein, 9 aa, Homo Sapiens
RRPQWTQTC

SEQ ID NO: 1119393 - protein, 9 aa, Homo Sapiens
SQKKSKQQG

SEQ ID NO: 1119394 - protein, 9 aa, Homo Sapiens
SGGTTSSSG

SEQ ID NO: 1119395 - protein, 9 aa, Homo Sapiens
PNEEGSEDE

SEQ ID NO: 1119396 - protein, 9 aa, Homo Sapiens
ADASVPRAR

SEQ ID NO: 1119397 - protein, 9 aa, Homo Sapiens
TCWPSVVTC

SEQ ID NO: 1119398 - protein, 9 aa, Homo Sapiens
QNAHTMRRA

SEQ ID NO: 1119399 - protein, 9 aa, Homo Sapiens
DSLVLINKI

SEQ ID NO: 1119400 - protein, 9 aa, Homo Sapiens
AVRSDHVSL

SEQ ID NO: 1119401 - protein, 9 aa, Homo Sapiens
DDHHLEVFP

SEQ ID NO: 1119402 - protein, 9 aa, Homo Sapiens
GNAMCKLYT

SEQ ID NO: 1119403 - protein, 9 aa, Homo Sapiens
LYEVQTVIK

SEQ ID NO: 1119404 - protein, 9 aa, Homo Sapiens
RTSLPPTGM

SEQ ID NO: 1119405 - protein, 9 aa, Homo Sapiens
GGLHVQLPG

SEQ ID NO: 1119406 - protein, 9 aa, Homo Sapiens
SVFGPARIR

SEQ ID NO: 1119407 - protein, 9 aa, Homo Sapiens
LDTRWHEPQ

SEQ ID NO: 1119408 - protein, 9 aa, Homo Sapiens
LQATGGDEP

SEQ ID NO: 1119409 - protein, 9 aa, Homo Sapiens
AGLPRAPAS

SEQ ID NO: 1119410 - protein, 9 aa, Homo Sapiens
SCPWAGPRA

SEQ ID NO: 1119411 - protein, 9 aa, Homo Sapiens
VLGYEWVNS

SEQ ID NO: 1119412 - protein, 9 aa, Homo Sapiens
FGFGSRTFM

SEQ ID NO: 1119413 - protein, 9 aa, Homo Sapiens
WNPRDCSEN

SEQ ID NO: 1119414 - protein, 9 aa, Homo Sapiens
NETVGRELL

SEQ ID NO: 1119415 - protein, 9 aa, Homo Sapiens
HGQIAGFIG

SEQ ID NO: 1119416 - protein, 9 aa, Homo Sapiens
FHNMEALLI

SEQ ID NO: 1119417 - protein, 9 aa, Homo Sapiens
EEIMKAFKL

SEQ ID NO: 1119418 - protein, 9 aa, Homo Sapiens
TRPRLLPLI

SEQ ID NO: 1119419 - protein, 9 aa, Homo Sapiens
AVPANRYTP

SEQ ID NO: 1119420 - protein, 9 aa, Homo Sapiens
RLLAPLIQK

SEQ ID NO: 1119421 - protein, 9 aa, Homo Sapiens
RSRSPRCPR

SEQ ID NO: 1119422 - protein, 9 aa, Homo Sapiens
TLWLGPASV

SEQ ID NO: 1119423 - protein, 9 aa, Homo Sapiens
TRPRLLPLT

SEQ ID NO: 1119424 - protein, 9 aa, Homo Sapiens
LQVTIDGRS

SEQ ID NO: 1119425 - protein, 9 aa, Homo Sapiens
IHACQASGG

SEQ ID NO: 1119426 - protein, 9 aa, Homo Sapiens
YTYPVSNSV

SEQ ID NO: 1119427 - protein, 9 aa, Homo Sapiens
PFCGNNFED

SEQ ID NO: 1119428 - protein, 9 aa, Homo Sapiens
GFIPDGDQV

SEQ ID NO: 1119429 - protein, 9 aa, Homo Sapiens
TPRWRTFTT

SEQ ID NO: 1119430 - protein, 9 aa, Homo Sapiens
QNRRMKWKN

SEQ ID NO: 1119431 - protein, 9 aa, Homo Sapiens
AIAGNASLL

SEQ ID NO: 1119432 - protein, 9 aa, Homo Sapiens
VCSDFLKAN

SEQ ID NO: 1119433 - protein, 9 aa, Homo Sapiens
PTCCFSASP

SEQ ID NO: 1119434 - protein, 9 aa, Homo Sapiens
IRCINPNDK

SEQ ID NO: 1119435 - protein, 9 aa, Homo Sapiens
DYLGLSNCE

SEQ ID NO: 1119436 - protein, 9 aa, Homo Sapiens
AIDTENIRF

SEQ ID NO: 1119437 - protein, 9 aa, Homo Sapiens
ERMEVVSHR

SEQ ID NO: 1119438 - protein, 9 aa, Homo Sapiens
LLQNEFVGS

SEQ ID NO: 1119439 - protein, 9 aa, Homo Sapiens
PKVPEATLG

SEQ ID NO: 1119440 - protein, 9 aa, Homo Sapiens
RVNGCQDTQ

SEQ ID NO: 1119441 - protein, 9 aa, Homo Sapiens
TTHNDNSSR

SEQ ID NO: 1119442 - protein, 9 aa, Homo Sapiens
NVNRVNKAF

SEQ ID NO: 1119443 - protein, 9 aa, Homo Sapiens
SSGTDGGGG

SEQ ID NO: 1119444 - protein, 9 aa, Homo Sapiens
SQQGRGVYK

SEQ ID NO: 1119445 - protein, 9 aa, Homo Sapiens
SKAKAESAA

SEQ ID NO: 1119446 - protein, 9 aa, Homo Sapiens
CIALRMVLM

SEQ ID NO: 1119447 - protein, 9 aa, Homo Sapiens
SGQEDKKIK

SEQ ID NO: 1119448 - protein, 9 aa, Homo Sapiens
LPRELSILW

SEQ ID NO: 1119449 - protein, 9 aa, Homo Sapiens
GWNIKQCES

SEQ ID NO: 1119450 - protein, 9 aa, Homo Sapiens
GGPRILLLC

SEQ ID NO: 1119451 - protein, 9 aa, Homo Sapiens
FSFSQPRNQ

SEQ ID NO: 1119452 - protein, 9 aa, Homo Sapiens
ISAKSESSA

SEQ ID NO: 1119453 - protein, 9 aa, Homo Sapiens
GLPRPGSHL

SEQ ID NO: 1119454 - protein, 9 aa, Homo Sapiens
ELIEGEREP

SEQ ID NO: 1119455 - protein, 9 aa, Homo Sapiens
LCWMPYHLS

SEQ ID NO: 1119456 - protein, 9 aa, Homo Sapiens
QGMSVLSLN

SEQ ID NO: 1119457 - protein, 9 aa, Homo Sapiens
KGVSWSTVR

SEQ ID NO: 1119458 - protein, 9 aa, Homo Sapiens
FTRFACFTW

SEQ ID NO: 1119459 - protein, 9 aa, Homo Sapiens
LLTNVPSSD

SEQ ID NO: 1119460 - protein, 9 aa, Homo Sapiens
FGRVCTLST

SEQ ID NO: 1119461 - protein, 9 aa, Homo Sapiens
GLGGMSGDQ

SEQ ID NO: 1119462 - protein, 9 aa, Homo Sapiens
EVFMLHIQV

SEQ ID NO: 1119463 - protein, 9 aa, Homo Sapiens
KKNQLLPVL

SEQ ID NO: 1119464 - protein, 9 aa, Homo Sapiens
MAQALEELQ

SEQ ID NO: 1119465 - protein, 9 aa, Homo Sapiens
EAIKKNYCT

SEQ ID NO: 1119466 - protein, 9 aa, Homo Sapiens
VAQQAGTRP

SEQ ID NO: 1119467 - protein, 9 aa, Homo Sapiens
NELTAREHL

SEQ ID NO: 1119468 - protein, 9 aa, Homo Sapiens
KKSLILFPP

SEQ ID NO: 1119469 - protein, 9 aa, Homo Sapiens
LVQCFLCCS

SEQ ID NO: 1119470 - protein, 9 aa, Homo Sapiens
HPATRPLAR

SEQ ID NO: 1119471 - protein, 9 aa, Homo Sapiens
VPPLHWKEF

SEQ ID NO: 1119472 - protein, 9 aa, Homo Sapiens
RRGFAEGRR

SEQ ID NO: 1119473 - protein, 9 aa, Homo Sapiens
SSTDSEALH

SEQ ID NO: 1119474 - protein, 9 aa, Homo Sapiens
DVNEALRKV

SEQ ID NO: 1119475 - protein, 9 aa, Homo Sapiens
ADRPPTPIY

SEQ ID NO: 1119476 - protein, 9 aa, Homo Sapiens
KCHKCGKVF

SEQ ID NO: 1119477 - protein, 9 aa, Homo Sapiens
GEREPQAFE

SEQ ID NO: 1119478 - protein, 9 aa, Homo Sapiens
AKMAFCSAT

SEQ ID NO: 1119479 - protein, 9 aa, Homo Sapiens
WTMFITQLP

SEQ ID NO: 1119480 - protein, 9 aa, Homo Sapiens
SAAAMGGGS

SEQ ID NO: 1119481 - protein, 9 aa, Homo Sapiens
LVISMDNAL

SEQ ID NO: 1119482 - protein, 9 aa, Homo Sapiens
SLELNTVSN

SEQ ID NO: 1119483 - protein, 9 aa, Homo Sapiens
HQRLHTSER

SEQ ID NO: 1119484 - protein, 9 aa, Homo Sapiens
SAAATPPRA

SEQ ID NO: 1119485 - protein, 9 aa, Homo Sapiens
CATSAAATT

SEQ ID NO: 1119486 - protein, 9 aa, Homo Sapiens
MRKRMSKNT

SEQ ID NO: 1119487 - protein, 9 aa, Homo Sapiens
TATLWGKML

SEQ ID NO: 1119488 - protein, 9 aa, Homo Sapiens
ALDSGPEAG

SEQ ID NO: 1119489 - protein, 9 aa, Homo Sapiens
TSCAMLTWS

SEQ ID NO: 1119490 - protein, 9 aa, Homo Sapiens
DSFISNNEW

SEQ ID NO: 1119491 - protein, 9 aa, Homo Sapiens
TPQKFLDTS

SEQ ID NO: 1119492 - protein, 9 aa, Homo Sapiens
PYTKVSIGL

SEQ ID NO: 1119493 - protein, 9 aa, Homo Sapiens
DAPLDHCYV

SEQ ID NO: 1119494 - protein, 9 aa, Homo Sapiens
AGGADPPNP

SEQ ID NO: 1119495 - protein, 9 aa, Homo Sapiens
AENIHKHIL

SEQ ID NO: 1119496 - protein, 9 aa, Homo Sapiens
IRSQSLHVV

SEQ ID NO: 1119497 - protein, 9 aa, Homo Sapiens
TEAAYALLL

SEQ ID NO: 1119498 - protein, 9 aa, Homo Sapiens
THFDEVFWF

SEQ ID NO: 1119499 - protein, 9 aa, Homo Sapiens
DEAAEDADT

SEQ ID NO: 1119500 - protein, 9 aa, Homo Sapiens
EELSLEGNS

SEQ ID NO: 1119501 - protein, 9 aa, Homo Sapiens
QWEEEWTLL

SEQ ID NO: 1119502 - protein, 9 aa, Homo Sapiens
PGPYATPLG

SEQ ID NO: 1119503 - protein, 9 aa, Homo Sapiens
NKCVPNNNE

SEQ ID NO: 1119504 - protein, 9 aa, Homo Sapiens
FCADTRISV

SEQ ID NO: 1119505 - protein, 9 aa, Homo Sapiens
SPSHPVSQM

SEQ ID NO: 1119506 - protein, 9 aa, Homo Sapiens
EKLALKEDL

SEQ ID NO: 1119507 - protein, 9 aa, Homo Sapiens
EVQTVIKTA

SEQ ID NO: 1119508 - protein, 9 aa, Homo Sapiens
DIAQRLRIC

SEQ ID NO: 1119509 - protein, 9 aa, Homo Sapiens
CSLLTQPSP

SEQ ID NO: 1119510 - protein, 9 aa, Homo Sapiens
WQYFMCNNP

SEQ ID NO: 1119511 - protein, 9 aa, Homo Sapiens
KVVVRIQSS

SEQ ID NO: 1119512 - protein, 9 aa, Homo Sapiens
GSALTAYED

SEQ ID NO: 1119513 - protein, 9 aa, Homo Sapiens
QSPPERDWP

SEQ ID NO: 1119514 - protein, 9 aa, Homo Sapiens
DGIINPSTF

SEQ ID NO: 1119515 - protein, 9 aa, Homo Sapiens
GRPHLGPPL

SEQ ID NO: 1119516 - protein, 9 aa, Homo Sapiens
YPDWPAKDM

SEQ ID NO: 1119517 - protein, 9 aa, Homo Sapiens
RHPWPPQAS

SEQ ID NO: 1119518 - protein, 9 aa, Homo Sapiens
ELSTVHQVW

SEQ ID NO: 1119519 - protein, 9 aa, Homo Sapiens
HSIPKFKIR

SEQ ID NO: 1119520 - protein, 9 aa, Homo Sapiens
LIIDRDFDP

SEQ ID NO: 1119521 - protein, 9 aa, Homo Sapiens
LLTSVPSLV

SEQ ID NO: 1119522 - protein, 9 aa, Homo Sapiens
FLENVIRDV

SEQ ID NO: 1119523 - protein, 9 aa, Homo Sapiens
MCCSFSPEP

SEQ ID NO: 1119524 - protein, 9 aa, Homo Sapiens
LGVPELRIG

SEQ ID NO: 1119525 - protein, 9 aa, Homo Sapiens
CQRPQTGSS

SEQ ID NO: 1119526 - protein, 9 aa, Homo Sapiens
LSEQQQQRR

SEQ ID NO: 1119527 - protein, 9 aa, Homo Sapiens
ESSVLLTMS

SEQ ID NO: 1119528 - protein, 9 aa, Homo Sapiens
YSQPLHKEI

SEQ ID NO: 1119529 - protein, 9 aa, Homo Sapiens
MHCPTATAA

SEQ ID NO: 1119530 - protein, 9 aa, Homo Sapiens
GICQLVWTA

SEQ ID NO: 1119531 - protein, 9 aa, Homo Sapiens
ARPTKLGSN

SEQ ID NO: 1119532 - protein, 9 aa, Homo Sapiens
SEPMHTISD

SEQ ID NO: 1119533 - protein, 9 aa, Homo Sapiens
YAELDHEDD

SEQ ID NO: 1119534 - protein, 9 aa, Homo Sapiens
QEQDIETVH

SEQ ID NO: 1119535 - protein, 9 aa, Homo Sapiens
LFPSTDDSL

SEQ ID NO: 1119536 - protein, 9 aa, Homo Sapiens
PLCPPPSPL

SEQ ID NO: 1119537 - protein, 9 aa, Homo Sapiens
ITNRSDLGP

SEQ ID NO: 1119538 - protein, 9 aa, Homo Sapiens
TWTLLRSFR

SEQ ID NO: 1119539 - protein, 9 aa, Homo Sapiens
SSSEETAPA

SEQ ID NO: 1119540 - protein, 9 aa, Homo Sapiens
LIGNAVEHV

SEQ ID NO: 1119541 - protein, 9 aa, Homo Sapiens
LPCFYTPAT

SEQ ID NO: 1119542 - protein, 9 aa, Homo Sapiens
QYYEVMEKL

SEQ ID NO: 1119543 - protein, 9 aa, Homo Sapiens
YRPPLAPLL

SEQ ID NO: 1119544 - protein, 9 aa, Homo Sapiens
GPKGGEGAE

SEQ ID NO: 1119545 - protein, 9 aa, Homo Sapiens
GLHDPKKNH

SEQ ID NO: 1119546 - protein, 9 aa, Homo Sapiens
TAFSEYPSL

SEQ ID NO: 1119547 - protein, 9 aa, Homo Sapiens
VTELRQAPR

SEQ ID NO: 1119548 - protein, 9 aa, Homo Sapiens
MCMINQLTS

SEQ ID NO: 1119549 - protein, 9 aa, Homo Sapiens
RVCGADVAA

SEQ ID NO: 1119550 - protein, 9 aa, Homo Sapiens
NPLASAVQE

SEQ ID NO: 1119551 - protein, 9 aa, Homo Sapiens
SAIVSKRHH

SEQ ID NO: 1119552 - protein, 9 aa, Homo Sapiens
RHLQEALAA

SEQ ID NO: 1119553 - protein, 9 aa, Homo Sapiens
VSGAYDGKK

SEQ ID NO: 1119554 - protein, 9 aa, Homo Sapiens
RIQVLSNGL

SEQ ID NO: 1119555 - protein, 9 aa, Homo Sapiens
ETSAVLLKE

SEQ ID NO: 1119556 - protein, 9 aa, Homo Sapiens
LLFLPDYLG

SEQ ID NO: 1119557 - protein, 9 aa, Homo Sapiens
SQWPRVNGC

SEQ ID NO: 1119558 - protein, 9 aa, Homo Sapiens
ALATADDFP

SEQ ID NO: 1119559 - protein, 9 aa, Homo Sapiens
PGTSPGWWS

SEQ ID NO: 1119560 - protein, 9 aa, Homo Sapiens
VEADNLPTF

SEQ ID NO: 1119561 - protein, 9 aa, Homo Sapiens
KREKDQRDS

SEQ ID NO: 1119562 - protein, 9 aa, Homo Sapiens
GGCPAEDGR

SEQ ID NO: 1119563 - protein, 9 aa, Homo Sapiens
SSQDKTLTH

SEQ ID NO: 1119564 - protein, 9 aa, Homo Sapiens
QERERERDR

SEQ ID NO: 1119565 - protein, 9 aa, Homo Sapiens
ILQLMYSCK

SEQ ID NO: 1119566 - protein, 9 aa, Homo Sapiens
SPVPSGMNS

SEQ ID NO: 1119567 - protein, 9 aa, Homo Sapiens
EKPAHNYLA

SEQ ID NO: 1119568 - protein, 9 aa, Homo Sapiens
PALRARGGT

SEQ ID NO: 1119569 - protein, 9 aa, Homo Sapiens
AKQSWGAVA

SEQ ID NO: 1119570 - protein, 9 aa, Homo Sapiens
VVNVKPTNT

SEQ ID NO: 1119571 - protein, 9 aa, Homo Sapiens
LGFTQRKES

SEQ ID NO: 1119572 - protein, 9 aa, Homo Sapiens
YTEGGEAQE

SEQ ID NO: 1119573 - protein, 9 aa, Homo Sapiens
SIIKKTSDI

SEQ ID NO: 1119574 - protein, 9 aa, Homo Sapiens
SCVGKKPEQ

SEQ ID NO: 1119575 - protein, 9 aa, Homo Sapiens
PRPPALLQP

SEQ ID NO: 1119576 - protein, 9 aa, Homo Sapiens
QSYSERMEV

SEQ ID NO: 1119577 - protein, 9 aa, Homo Sapiens
LCEQNEEVS

SEQ ID NO: 1119578 - protein, 9 aa, Homo Sapiens
GGELRAGDP

SEQ ID NO: 1119579 - protein, 9 aa, Homo Sapiens
RRGRRGHEE

SEQ ID NO: 1119580 - protein, 9 aa, Homo Sapiens
YLDVKKPIK

SEQ ID NO: 1119581 - protein, 9 aa, Homo Sapiens
ALRDSAQGV

SEQ ID NO: 1119582 - protein, 9 aa, Homo Sapiens
EDRPKVQAD

SEQ ID NO: 1119583 - protein, 9 aa, Homo Sapiens
PQHNFKQWP

SEQ ID NO: 1119584 - protein, 9 aa, Homo Sapiens
KWSGASPHC

SEQ ID NO: 1119585 - protein, 9 aa, Homo Sapiens
KVMVVTGDE

SEQ ID NO: 1119586 - protein, 9 aa, Homo Sapiens
HAVRVHVTS

SEQ ID NO: 1119587 - protein, 9 aa, Homo Sapiens
GSYWVTLIT

SEQ ID NO: 1119588 - protein, 9 aa, Homo Sapiens
GLPYHTIDA

SEQ ID NO: 1119589 - protein, 9 aa, Homo Sapiens
LEPPLLVLG

SEQ ID NO: 1119590 - protein, 9 aa, Homo Sapiens
LVPLISLMI

SEQ ID NO: 1119591 - protein, 9 aa, Homo Sapiens
RAQMGPKKN

SEQ ID NO: 1119592 - protein, 9 aa, Homo Sapiens
PPTSCPSWS

SEQ ID NO: 1119593 - protein, 9 aa, Homo Sapiens
HTRSSDLEA

SEQ ID NO: 1119594 - protein, 9 aa, Homo Sapiens
SRKRSLATV

SEQ ID NO: 1119595 - protein, 9 aa, Homo Sapiens
TNGASQTTD

SEQ ID NO: 1119596 - protein, 9 aa, Homo Sapiens
LLKRSLKNI

SEQ ID NO: 1119597 - protein, 9 aa, Homo Sapiens
LVGTDATMC

SEQ ID NO: 1119598 - protein, 9 aa, Homo Sapiens
FSRHSPSPL

SEQ ID NO: 1119599 - protein, 9 aa, Homo Sapiens
MATPVSRTT

SEQ ID NO: 1119600 - protein, 9 aa, Homo Sapiens
KDFRFSYKL

SEQ ID NO: 1119601 - protein, 9 aa, Homo Sapiens
AGVPGSASH

SEQ ID NO: 1119602 - protein, 9 aa, Homo Sapiens
SLIGNAVEH

SEQ ID NO: 1119603 - protein, 9 aa, Homo Sapiens
KYSSCLKDI

SEQ ID NO: 1119604 - protein, 9 aa, Homo Sapiens
TRALMECLA

SEQ ID NO: 1119605 - protein, 9 aa, Homo Sapiens
YFKEILPPD

SEQ ID NO: 1119606 - protein, 9 aa, Homo Sapiens
THPSMETTR

SEQ ID NO: 1119607 - protein, 9 aa, Homo Sapiens
YMVEKNYPQ

SEQ ID NO: 1119608 - protein, 9 aa, Homo Sapiens
AVVAAAATE

SEQ ID NO: 1119609 - protein, 9 aa, Homo Sapiens
CKTQPPKQT

SEQ ID NO: 1119610 - protein, 9 aa, Homo Sapiens
GANGSSAWR

SEQ ID NO: 1119611 - protein, 9 aa, Homo Sapiens
AVAGESMEG

SEQ ID NO: 1119612 - protein, 9 aa, Homo Sapiens
SGAHALNSW

SEQ ID NO: 1119613 - protein, 9 aa, Homo Sapiens
SERQITVTG

SEQ ID NO: 1119614 - protein, 9 aa, Homo Sapiens
RGVLRSLAA

SEQ ID NO: 1119615 - protein, 9 aa, Homo Sapiens
CQNPEKLAL

SEQ ID NO: 1119616 - protein, 9 aa, Homo Sapiens
RVRDSDGDR

SEQ ID NO: 1119617 - protein, 9 aa, Homo Sapiens
EASVALLEV

SEQ ID NO: 1119618 - protein, 9 aa, Homo Sapiens
GGMSGDQAK

SEQ ID NO: 1119619 - protein, 9 aa, Homo Sapiens
HALNSWTQE

SEQ ID NO: 1119620 - protein, 9 aa, Homo Sapiens
DMESNGKHI

SEQ ID NO: 1119621 - protein, 9 aa, Homo Sapiens
TRGTSRARR

SEQ ID NO: 1119622 - protein, 9 aa, Homo Sapiens
CCTNATGLH

SEQ ID NO: 1119623 - protein, 9 aa, Homo Sapiens
FAYLIFALG

SEQ ID NO: 1119624 - protein, 9 aa, Homo Sapiens
GLRIPRWLP

SEQ ID NO: 1119625 - protein, 9 aa, Homo Sapiens
TSITSVTLR

SEQ ID NO: 1119626 - protein, 9 aa, Homo Sapiens
DDPGHWGAD

SEQ ID NO: 1119627 - protein, 9 aa, Homo Sapiens
KIAVPANRY

SEQ ID NO: 1119628 - protein, 9 aa, Homo Sapiens
LSESDAPTR

SEQ ID NO: 1119629 - protein, 9 aa, Homo Sapiens
QGPPENQVS

SEQ ID NO: 1119630 - protein, 9 aa, Homo Sapiens
RRRRCLALF

SEQ ID NO: 1119631 - protein, 9 aa, Homo Sapiens
HEEREAARR

SEQ ID NO: 1119632 - protein, 9 aa, Homo Sapiens
PVLLALTAR

SEQ ID NO: 1119633 - protein, 9 aa, Homo Sapiens
STSSYEAQI

SEQ ID NO: 1119634 - protein, 9 aa, Homo Sapiens
HVMGKTKPE

SEQ ID NO: 1119635 - protein, 9 aa, Homo Sapiens
LGDGKKMDL

SEQ ID NO: 1119636 - protein, 9 aa, Homo Sapiens
LDCIFGVEE

SEQ ID NO: 1119637 - protein, 9 aa, Homo Sapiens
TRLQEMELR

SEQ ID NO: 1119638 - protein, 9 aa, Homo Sapiens
DDFGFSIVV

SEQ ID NO: 1119639 - protein, 9 aa, Homo Sapiens
CIGTLSVYG

SEQ ID NO: 1119640 - protein, 9 aa, Homo Sapiens
LTATDTTIL

SEQ ID NO: 1119641 - protein, 9 aa, Homo Sapiens
GSEAKGKDL

SEQ ID NO: 1119642 - protein, 9 aa, Homo Sapiens
SLAGRGLPS

SEQ ID NO: 1119643 - protein, 9 aa, Homo Sapiens
REDVPRQQR

SEQ ID NO: 1119644 - protein, 9 aa, Homo Sapiens
EAGIITTKM

SEQ ID NO: 1119645 - protein, 9 aa, Homo Sapiens
TLPPTTTPA

SEQ ID NO: 1119646 - protein, 9 aa, Homo Sapiens
HTIQTAFRQ

SEQ ID NO: 1119647 - protein, 9 aa, Homo Sapiens
KGASTPSSG

SEQ ID NO: 1119648 - protein, 9 aa, Homo Sapiens
STPHHPFQG

SEQ ID NO: 1119649 - protein, 9 aa, Homo Sapiens
APPPGTGVC

SEQ ID NO: 1119650 - protein, 9 aa, Homo Sapiens
NLTPNTTLI

SEQ ID NO: 1119651 - protein, 9 aa, Homo Sapiens
QGLVQGQAA

SEQ ID NO: 1119652 - protein, 9 aa, Homo Sapiens
IPHFNADSG

SEQ ID NO: 1119653 - protein, 9 aa, Homo Sapiens
KTAKRKIKE

SEQ ID NO: 1119654 - protein, 9 aa, Homo Sapiens
LLLPHSRGG

SEQ ID NO: 1119655 - protein, 9 aa, Homo Sapiens
RIERQAMYT

SEQ ID NO: 1119656 - protein, 9 aa, Homo Sapiens
AIAQDTDQN

SEQ ID NO: 1119657 - protein, 9 aa, Homo Sapiens
RCWRGCCSA

SEQ ID NO: 1119658 - protein, 9 aa, Homo Sapiens
RYSQPLHKE

SEQ ID NO: 1119659 - protein, 9 aa, Homo Sapiens
PQPSAAPAA

SEQ ID NO: 1119660 - protein, 9 aa, Homo Sapiens
VSAAATTAA

SEQ ID NO: 1119661 - protein, 9 aa, Homo Sapiens
TTRRRVPHP

SEQ ID NO: 1119662 - protein, 9 aa, Homo Sapiens
LRLCWSVGR

SEQ ID NO: 1119663 - protein, 9 aa, Homo Sapiens
TLSDDLGKT

SEQ ID NO: 1119664 - protein, 9 aa, Homo Sapiens
AWYALHGEV

SEQ ID NO: 1119665 - protein, 9 aa, Homo Sapiens
RAIVVFHCE

SEQ ID NO: 1119666 - protein, 9 aa, Homo Sapiens
YFEYLMFIL

SEQ ID NO: 1119667 - protein, 9 aa, Homo Sapiens
IPSKPIQFD

SEQ ID NO: 1119668 - protein, 9 aa, Homo Sapiens
RTFMGQGAG

SEQ ID NO: 1119669 - protein, 9 aa, Homo Sapiens
ISTFGTSIT

SEQ ID NO: 1119670 - protein, 9 aa, Homo Sapiens
KEPESLISV

SEQ ID NO: 1119671 - protein, 9 aa, Homo Sapiens
GSPRRRPCA

SEQ ID NO: 1119672 - protein, 9 aa, Homo Sapiens
CGTCNHLRI

SEQ ID NO: 1119673 - protein, 9 aa, Homo Sapiens
HTSSGSIKR

SEQ ID NO: 1119674 - protein, 9 aa, Homo Sapiens
LCQAMQPVY

SEQ ID NO: 1119675 - protein, 9 aa, Homo Sapiens
SVSLVVAAI

SEQ ID NO: 1119676 - protein, 9 aa, Homo Sapiens
KGAQKSLEL

SEQ ID NO: 1119677 - protein, 9 aa, Homo Sapiens
GRGVYKGIV

SEQ ID NO: 1119678 - protein, 9 aa, Homo Sapiens
GLPDPSGPP

SEQ ID NO: 1119679 - protein, 8 aa, Homo Sapiens
ASEVPYAS

SEQ ID NO: 1119680 - protein, 9 aa, Homo Sapiens
QELATVLLQ

SEQ ID NO: 1119681 - protein, 9 aa, Homo Sapiens
LLLQRESRP

SEQ ID NO: 1119682 - protein, 9 aa, Homo Sapiens
TGPAHPTRG

SEQ ID NO: 1119683 - protein, 9 aa, Homo Sapiens
TGRSPCPKG

SEQ ID NO: 1119684 - protein, 9 aa, Homo Sapiens
TQPSPASAC

SEQ ID NO: 1119685 - protein, 9 aa, Homo Sapiens
IFARRAIST

SEQ ID NO: 1119686 - protein, 9 aa, Homo Sapiens
VPPFPSHLA

SEQ ID NO: 1119687 - protein, 9 aa, Homo Sapiens
AGLAHVFIG

SEQ ID NO: 1119688 - protein, 9 aa, Homo Sapiens
EAISASTRR

SEQ ID NO: 1119689 - protein, 9 aa, Homo Sapiens
GEGASEEED

SEQ ID NO: 1119690 - protein, 9 aa, Homo Sapiens
VQAFPSKMH

SEQ ID NO: 1119691 - protein, 9 aa, Homo Sapiens
FGSRTFMGQ

SEQ ID NO: 1119692 - protein, 9 aa, Homo Sapiens
RPPQLRRPR

SEQ ID NO: 1119693 - protein, 9 aa, Homo Sapiens
FLVKETGLF

SEQ ID NO: 1119694 - protein, 9 aa, Homo Sapiens
TGRFAFQLP

SEQ ID NO: 1119695 - protein, 9 aa, Homo Sapiens
QYHGVEADN

SEQ ID NO: 1119696 - protein, 9 aa, Homo Sapiens
VWVHEKRVR

SEQ ID NO: 1119697 - protein, 9 aa, Homo Sapiens
TSQLGATFF

SEQ ID NO: 1119698 - protein, 9 aa, Homo Sapiens
RIPIPVINV

SEQ ID NO: 1119699 - protein, 9 aa, Homo Sapiens
GPRLAPTQT

SEQ ID NO: 1119700 - protein, 9 aa, Homo Sapiens
PAPEPTERG

SEQ ID NO: 1119701 - protein, 9 aa, Homo Sapiens
MSTMKISLS

SEQ ID NO: 1119702 - protein, 9 aa, Homo Sapiens
PMPWGPLPM

SEQ ID NO: 1119703 - protein, 9 aa, Homo Sapiens
TLSGTIRSH

SEQ ID NO: 1119704 - protein, 9 aa, Homo Sapiens
SLLNFLSEG

SEQ ID NO: 1119705 - protein, 9 aa, Homo Sapiens
VALGAGGQC

SEQ ID NO: 1119706 - protein, 9 aa, Homo Sapiens
FPPLIPLLG

SEQ ID NO: 1119707 - protein, 9 aa, Homo Sapiens
YECSVSNDA

SEQ ID NO: 1119708 - protein, 9 aa, Homo Sapiens
TIKEIATDP

SEQ ID NO: 1119709 - protein, 9 aa, Homo Sapiens
GSAEGAGQR

SEQ ID NO: 1119710 - protein, 9 aa, Homo Sapiens
LRGRQHSPN

SEQ ID NO: 1119711 - protein, 9 aa, Homo Sapiens
RTKSLGIHG

SEQ ID NO: 1119712 - protein, 9 aa, Homo Sapiens
FPSLETHLK

SEQ ID NO: 1119713 - protein, 9 aa, Homo Sapiens
VAVLGASRR

SEQ ID NO: 1119714 - protein, 9 aa, Homo Sapiens
CNSINRNFV

SEQ ID NO: 1119715 - protein, 9 aa, Homo Sapiens
AAAVGPNRC

SEQ ID NO: 1119716 - protein, 9 aa, Homo Sapiens
EGTVFFGTY

SEQ ID NO: 1119717 - protein, 9 aa, Homo Sapiens
HSNEWKTVM

SEQ ID NO: 1119718 - protein, 9 aa, Homo Sapiens
QAARKDSDS

SEQ ID NO: 1119719 - protein, 9 aa, Homo Sapiens
ENEEKEQDA

SEQ ID NO: 1119720 - protein, 9 aa, Homo Sapiens
VSVADGKFT

SEQ ID NO: 1119721 - protein, 9 aa, Homo Sapiens
IRIDDSTSS

SEQ ID NO: 1119722 - protein, 9 aa, Homo Sapiens
QCFLCCSAS

SEQ ID NO: 1119723 - protein, 9 aa, Homo Sapiens
SLLPTYLLV

SEQ ID NO: 1119724 - protein, 9 aa, Homo Sapiens
SNVAPPAFS

SEQ ID NO: 1119725 - protein, 9 aa, Homo Sapiens
TSSPATSAS

SEQ ID NO: 1119726 - protein, 9 aa, Homo Sapiens
PQPAAVHGL

SEQ ID NO: 1119727 - protein, 9 aa, Homo Sapiens
RCRRRPRAG

SEQ ID NO: 1119728 - protein, 9 aa, Homo Sapiens
EMETSQFPD

SEQ ID NO: 1119729 - protein, 9 aa, Homo Sapiens
SYPEGFVYK

SEQ ID NO: 1119730 - protein, 9 aa, Homo Sapiens
TTNRRWIHV

SEQ ID NO: 1119731 - protein, 9 aa, Homo Sapiens
TSCADIADL

SEQ ID NO: 1119732 - protein, 9 aa, Homo Sapiens
ISAEKQYRG

SEQ ID NO: 1119733 - protein, 9 aa, Homo Sapiens
VAGLIHYSF

SEQ ID NO: 1119734 - protein, 9 aa, Homo Sapiens
CILVNTLVP

SEQ ID NO: 1119735 - protein, 9 aa, Homo Sapiens
DAIFARRAI

SEQ ID NO: 1119736 - protein, 9 aa, Homo Sapiens
ICKSQARHV

SEQ ID NO: 1119737 - protein, 9 aa, Homo Sapiens
WKVMSGGGP

SEQ ID NO: 1119738 - protein, 9 aa, Homo Sapiens
CSARWKGPR

SEQ ID NO: 1119739 - protein, 9 aa, Homo Sapiens
QMETLVLNN

SEQ ID NO: 1119740 - protein, 9 aa, Homo Sapiens
NGLPSTMQR

SEQ ID NO: 1119741 - protein, 9 aa, Homo Sapiens
EYCFEVFDL

SEQ ID NO: 1119742 - protein, 9 aa, Homo Sapiens
ILIIGGGVA

SEQ ID NO: 1119743 - protein, 9 aa, Homo Sapiens
LLAHAFFCE

SEQ ID NO: 1119744 - protein, 9 aa, Homo Sapiens
SGQHCSGSQ

SEQ ID NO: 1119745 - protein, 9 aa, Homo Sapiens
ACSARWKGP

SEQ ID NO: 1119746 - protein, 9 aa, Homo Sapiens
LRQFLGLFY

SEQ ID NO: 1119747 - protein, 9 aa, Homo Sapiens
MHDDIEVLK

SEQ ID NO: 1119748 - protein, 9 aa, Homo Sapiens
FHILCKTSL

SEQ ID NO: 1119749 - protein, 9 aa, Homo Sapiens
VIHHKVLSL

SEQ ID NO: 1119750 - protein, 9 aa, Homo Sapiens
RQHSPNVCA

SEQ ID NO: 1119751 - protein, 9 aa, Homo Sapiens
ASLSTSSSL

SEQ ID NO: 1119752 - protein, 9 aa, Homo Sapiens
GTLMMAFRN

SEQ ID NO: 1119753 - protein, 9 aa, Homo Sapiens
HTLHRCQQE

SEQ ID NO: 1119754 - protein, 9 aa, Homo Sapiens
DACWALSHL

SEQ ID NO: 1119755 - protein, 9 aa, Homo Sapiens
RLEQLGGCW

SEQ ID NO: 1119756 - protein, 9 aa, Homo Sapiens
FPRCSRRLS

SEQ ID NO: 1119757 - protein, 9 aa, Homo Sapiens
NSCRGLQTD

SEQ ID NO: 1119758 - protein, 9 aa, Homo Sapiens
PTLLESELY

SEQ ID NO: 1119759 - protein, 9 aa, Homo Sapiens
RSLLEMVLE

SEQ ID NO: 1119760 - protein, 9 aa, Homo Sapiens
QCHVQRLWF

SEQ ID NO: 1119761 - protein, 9 aa, Homo Sapiens
ECRVIGMPH

SEQ ID NO: 1119762 - protein, 9 aa, Homo Sapiens
GVHGEGEGP

SEQ ID NO: 1119763 - protein, 9 aa, Homo Sapiens
AAGVRMGCV

SEQ ID NO: 1119764 - protein, 9 aa, Homo Sapiens
PRCCPCSSP

SEQ ID NO: 1119765 - protein, 9 aa, Homo Sapiens
YVLRRILHR

SEQ ID NO: 1119766 - protein, 9 aa, Homo Sapiens
ARCQEMGAR

SEQ ID NO: 1119767 - protein, 9 aa, Homo Sapiens
WAPAPPTRC

SEQ ID NO: 1119768 - protein, 9 aa, Homo Sapiens
PKNHYEESS

SEQ ID NO: 1119769 - protein, 9 aa, Homo Sapiens
PAHISPAIL

SEQ ID NO: 1119770 - protein, 9 aa, Homo Sapiens
LSPDVQRVD

SEQ ID NO: 1119771 - protein, 9 aa, Homo Sapiens
PNGNLADEC

SEQ ID NO: 1119772 - protein, 9 aa, Homo Sapiens
EETFLKKNL

SEQ ID NO: 1119773 - protein, 9 aa, Homo Sapiens
SLPDCRLAA

SEQ ID NO: 1119774 - protein, 9 aa, Homo Sapiens
SSPTARATS

SEQ ID NO: 1119775 - protein, 9 aa, Homo Sapiens
ESQGLSRKK

SEQ ID NO: 1119776 - protein, 9 aa, Homo Sapiens
NFGPGFVNV

SEQ ID NO: 1119777 - protein, 9 aa, Homo Sapiens
LRLPRSRKT

SEQ ID NO: 1119778 - protein, 9 aa, Homo Sapiens
FHDIWTEMI

SEQ ID NO: 1119779 - protein, 9 aa, Homo Sapiens
SAMVGEDVS

SEQ ID NO: 1119780 - protein, 9 aa, Homo Sapiens
TAASARSPT

SEQ ID NO: 1119781 - protein, 9 aa, Homo Sapiens
GPQGPPENQ

SEQ ID NO: 1119782 - protein, 9 aa, Homo Sapiens
SHQGALMDS

SEQ ID NO: 1119783 - protein, 9 aa, Homo Sapiens
EKPGQLNID

SEQ ID NO: 1119784 - protein, 9 aa, Homo Sapiens
SKKERKVTL

SEQ ID NO: 1119785 - protein, 9 aa, Homo Sapiens
TFTTTSRLS

SEQ ID NO: 1119786 - protein, 9 aa, Homo Sapiens
AQYPPPAAA

SEQ ID NO: 1119787 - protein, 9 aa, Homo Sapiens
KCLRCLLYT

SEQ ID NO: 1119788 - protein, 9 aa, Homo Sapiens
KLMNARDAK

SEQ ID NO: 1119789 - protein, 9 aa, Homo Sapiens
LVQGQAAAG

SEQ ID NO: 1119790 - protein, 9 aa, Homo Sapiens
DTESFETIF

SEQ ID NO: 1119791 - protein, 9 aa, Homo Sapiens
KRKRQKQAS

SEQ ID NO: 1119792 - protein, 9 aa, Homo Sapiens
KFKIRKIPD

SEQ ID NO: 1119793 - protein, 9 aa, Homo Sapiens
YTTLYRKML

SEQ ID NO: 1119794 - protein, 9 aa, Homo Sapiens
TNELLQIEP

SEQ ID NO: 1119795 - protein, 9 aa, Homo Sapiens
WWLSSGTSP

SEQ ID NO: 1119796 - protein, 9 aa, Homo Sapiens
SAHPVKFLW

SEQ ID NO: 1119797 - protein, 9 aa, Homo Sapiens
GLHSVMDDD

SEQ ID NO: 1119798 - protein, 9 aa, Homo Sapiens
CRPACTCIS

SEQ ID NO: 1119799 - protein, 9 aa, Homo Sapiens
LPLTDIQIV

SEQ ID NO: 1119800 - protein, 9 aa, Homo Sapiens
TAAASRTAS

SEQ ID NO: 1119801 - protein, 9 aa, Homo Sapiens
APWKTQIQY

SEQ ID NO: 1119802 - protein, 9 aa, Homo Sapiens
SSAASPPAA

SEQ ID NO: 1119803 - protein, 9 aa, Homo Sapiens
NKAVQPLKK

SEQ ID NO: 1119804 - protein, 9 aa, Homo Sapiens
RCLLPTTGL

SEQ ID NO: 1119805 - protein, 9 aa, Homo Sapiens
RLTYNHFHQ

SEQ ID NO: 1119806 - protein, 9 aa, Homo Sapiens
KRSPFLTQY

SEQ ID NO: 1119807 - protein, 9 aa, Homo Sapiens
PNFQDSIHM

SEQ ID NO: 1119808 - protein, 9 aa, Homo Sapiens
GSGSTREEQ

SEQ ID NO: 1119809 - protein, 9 aa, Homo Sapiens
SRSICPCPQ

SEQ ID NO: 1119810 - protein, 9 aa, Homo Sapiens
SIPLVPLIS

SEQ ID NO: 1119811 - protein, 9 aa, Homo Sapiens
AKLPHGMSP

SEQ ID NO: 1119812 - protein, 9 aa, Homo Sapiens
VKKPFGPRS

SEQ ID NO: 1119813 - protein, 9 aa, Homo Sapiens
RRGQPPKAR

SEQ ID NO: 1119814 - protein, 9 aa, Homo Sapiens
ILRSFMKLY

SEQ ID NO: 1119815 - protein, 9 aa, Homo Sapiens
ASCRALPGW

SEQ ID NO: 1119816 - protein, 9 aa, Homo Sapiens
RQCSSGSGE

SEQ ID NO: 1119817 - protein, 9 aa, Homo Sapiens
TAFAQMAQA

SEQ ID NO: 1119818 - protein, 9 aa, Homo Sapiens
MLGADLRHP

SEQ ID NO: 1119819 - protein, 9 aa, Homo Sapiens
MERKTATVE

SEQ ID NO: 1119820 - protein, 9 aa, Homo Sapiens
NGASQTTDA

SEQ ID NO: 1119821 - protein, 9 aa, Homo Sapiens
CWFYVYHSE

SEQ ID NO: 1119822 - protein, 9 aa, Homo Sapiens
LGPKEEVVC

SEQ ID NO: 1119823 - protein, 9 aa, Homo Sapiens
TLVMFYTPW

SEQ ID NO: 1119824 - protein, 9 aa, Homo Sapiens
KIRLDQMEE

SEQ ID NO: 1119825 - protein, 9 aa, Homo Sapiens
WPVLLPGHL

SEQ ID NO: 1119826 - protein, 9 aa, Homo Sapiens
DTEREVKTR

SEQ ID NO: 1119827 - protein, 9 aa, Homo Sapiens
QDTPTCVSC

SEQ ID NO: 1119828 - protein, 9 aa, Homo Sapiens
SSVDYCIHL

SEQ ID NO: 1119829 - protein, 9 aa, Homo Sapiens
QCSLDSTNG

SEQ ID NO: 1119830 - protein, 9 aa, Homo Sapiens
RDATRFPII

SEQ ID NO: 1119831 - protein, 9 aa, Homo Sapiens
PGKMPVYAE

SEQ ID NO: 1119832 - protein, 9 aa, Homo Sapiens
HTVSTAVNV

SEQ ID NO: 1119833 - protein, 9 aa, Homo Sapiens
ARDAKEKCP

SEQ ID NO: 1119834 - protein, 9 aa, Homo Sapiens
CWALSHLTD

SEQ ID NO: 1119835 - protein, 9 aa, Homo Sapiens
VYAHAGAML

SEQ ID NO: 1119836 - protein, 9 aa, Homo Sapiens
AGGSQGALF

SEQ ID NO: 1119837 - protein, 9 aa, Homo Sapiens
AFIDLPLAK

SEQ ID NO: 1119838 - protein, 9 aa, Homo Sapiens
LRQDHVAFC

SEQ ID NO: 1119839 - protein, 9 aa, Homo Sapiens
PQRPGRKHP

SEQ ID NO: 1119840 - protein, 9 aa, Homo Sapiens
DACQYECKN

SEQ ID NO: 1119841 - protein, 9 aa, Homo Sapiens
RLPRSRKTF

SEQ ID NO: 1119842 - protein, 9 aa, Homo Sapiens
QEEALATSP

SEQ ID NO: 1119843 - protein, 9 aa, Homo Sapiens
GGLGGSCQH

SEQ ID NO: 1119844 - protein, 9 aa, Homo Sapiens
LPGKDYCFP

SEQ ID NO: 1119845 - protein, 9 aa, Homo Sapiens
VGCDVPRLS

SEQ ID NO: 1119846 - protein, 9 aa, Homo Sapiens
QFLMAEKNF

SEQ ID NO: 1119847 - protein, 9 aa, Homo Sapiens
YSPFRSDPA

SEQ ID NO: 1119848 - protein, 9 aa, Homo Sapiens
SVGRPHLGP

SEQ ID NO: 1119849 - protein, 9 aa, Homo Sapiens
EVIAYFLER

SEQ ID NO: 1119850 - protein, 9 aa, Homo Sapiens
RMAKPKNRT

SEQ ID NO: 1119851 - protein, 9 aa, Homo Sapiens
PQRNFCLLF

SEQ ID NO: 1119852 - protein, 9 aa, Homo Sapiens
MYYQVVKAD

SEQ ID NO: 1119853 - protein, 9 aa, Homo Sapiens
GRSSAKKGG

SEQ ID NO: 1119854 - protein, 9 aa, Homo Sapiens
PLHIIGDPY

SEQ ID NO: 1119855 - protein, 9 aa, Homo Sapiens
RDRDRDQER

SEQ ID NO: 1119856 - protein, 9 aa, Homo Sapiens
RDLELEHYD

SEQ ID NO: 1119857 - protein, 9 aa, Homo Sapiens
ARLAMAEAL

SEQ ID NO: 1119858 - protein, 9 aa, Homo Sapiens
LDDAVHAND

SEQ ID NO: 1119859 - protein, 9 aa, Homo Sapiens
VGNPGAAMQ

SEQ ID NO: 1119860 - protein, 9 aa, Homo Sapiens
GAADGLDLL

SEQ ID NO: 1119861 - protein, 9 aa, Homo Sapiens
KRMKGPAQA

SEQ ID NO: 1119862 - protein, 9 aa, Homo Sapiens
GPLGRDSPQ

SEQ ID NO: 1119863 - protein, 9 aa, Homo Sapiens
RSRCPPRSR

SEQ ID NO: 1119864 - protein, 9 aa, Homo Sapiens
VLSFHSSAT

SEQ ID NO: 1119865 - protein, 9 aa, Homo Sapiens
GIMGAVVTW

SEQ ID NO: 1119866 - protein, 9 aa, Homo Sapiens
NNHVSIAKY

SEQ ID NO: 1119867 - protein, 9 aa, Homo Sapiens
ELRELCYGC

SEQ ID NO: 1119868 - protein, 9 aa, Homo Sapiens
GPWRTTPRP

SEQ ID NO: 1119869 - protein, 9 aa, Homo Sapiens
EVELSRKVT

SEQ ID NO: 1119870 - protein, 9 aa, Homo Sapiens
QERLLADGK

SEQ ID NO: 1119871 - protein, 9 aa, Homo Sapiens
RCQETITNL

SEQ ID NO: 1119872 - protein, 9 aa, Homo Sapiens
HAARCVCDR

SEQ ID NO: 1119873 - protein, 9 aa, Homo Sapiens
REYIQCLGY

SEQ ID NO: 1119874 - protein, 9 aa, Homo Sapiens
SRAPPMMGA

SEQ ID NO: 1119875 - protein, 9 aa, Homo Sapiens
AHAVRVHVT

SEQ ID NO: 1119876 - protein, 9 aa, Homo Sapiens
VLHRYASFR

SEQ ID NO: 1119877 - protein, 9 aa, Homo Sapiens
WIYTLSGTI

SEQ ID NO: 1119878 - protein, 9 aa, Homo Sapiens
FILILLNTI

SEQ ID NO: 1119879 - protein, 9 aa, Homo Sapiens
VAFLAQESL

SEQ ID NO: 1119880 - protein, 9 aa, Homo Sapiens
VESGKTSVA

SEQ ID NO: 1119881 - protein, 9 aa, Homo Sapiens
FCFSPLWLM

SEQ ID NO: 1119882 - protein, 9 aa, Homo Sapiens
DVLDREGWE

SEQ ID NO: 1119883 - protein, 9 aa, Homo Sapiens
LSQLLYEFC

SEQ ID NO: 1119884 - protein, 9 aa, Homo Sapiens
SRDSPASPS

SEQ ID NO: 1119885 - protein, 9 aa, Homo Sapiens
KRERPERYS

SEQ ID NO: 1119886 - protein, 9 aa, Homo Sapiens
TSSYEAQIT

SEQ ID NO: 1119887 - protein, 9 aa, Homo Sapiens
QRDDLIVSI

SEQ ID NO: 1119888 - protein, 9 aa, Homo Sapiens
AQVDMVRTA

SEQ ID NO: 1119889 - protein, 9 aa, Homo Sapiens
RIQASQWPR

SEQ ID NO: 1119890 - protein, 9 aa, Homo Sapiens
VQACRGENH

SEQ ID NO: 1119891 - protein, 9 aa, Homo Sapiens
QSQHDEQVR

SEQ ID NO: 1119892 - protein, 9 aa, Homo Sapiens
FHSSATGPK

SEQ ID NO: 1119893 - protein, 9 aa, Homo Sapiens
FLEARMQAA

SEQ ID NO: 1119894 - protein, 9 aa, Homo Sapiens
HELVQCFLC

SEQ ID NO: 1119895 - protein, 9 aa, Homo Sapiens
LLPPASTSS

SEQ ID NO: 1119896 - protein, 9 aa, Homo Sapiens
LGGGQGGQD

SEQ ID NO: 1119897 - protein, 9 aa, Homo Sapiens
ASRPFREAG

SEQ ID NO: 1119898 - protein, 9 aa, Homo Sapiens
GLGCVAELG

SEQ ID NO: 1119899 - protein, 9 aa, Homo Sapiens
IRAENHDML

SEQ ID NO: 1119900 - protein, 9 aa, Homo Sapiens
ASCPAGAGP

SEQ ID NO: 1119901 - protein, 9 aa, Homo Sapiens
MSAGNVFTT

SEQ ID NO: 1119902 - protein, 9 aa, Homo Sapiens
QCLIVRLQV

SEQ ID NO: 1119903 - protein, 9 aa, Homo Sapiens
PLPAGPPPG

SEQ ID NO: 1119904 - protein, 9 aa, Homo Sapiens
FRKKCDKKT

SEQ ID NO: 1119905 - protein, 9 aa, Homo Sapiens
FAAPSPTSE

SEQ ID NO: 1119906 - protein, 9 aa, Homo Sapiens
GCWTGTAGC

SEQ ID NO: 1119907 - protein, 9 aa, Homo Sapiens
GGTTIGEVT

SEQ ID NO: 1119908 - protein, 9 aa, Homo Sapiens
RMAKNPQVV

SEQ ID NO: 1119909 - protein, 9 aa, Homo Sapiens
PCPLLEGSA

SEQ ID NO: 1119910 - protein, 9 aa, Homo Sapiens
WAPRRGPLG

SEQ ID NO: 1119911 - protein, 9 aa, Homo Sapiens
ISPSILYVH

SEQ ID NO: 1119912 - protein, 9 aa, Homo Sapiens
ILQQYQRLT

SEQ ID NO: 1119913 - protein, 9 aa, Homo Sapiens
IKLYQKDFL

SEQ ID NO: 1119914 - protein, 9 aa, Homo Sapiens
HIANITQSR

SEQ ID NO: 1119915 - protein, 9 aa, Homo Sapiens
MRMEHIADK

SEQ ID NO: 1119916 - protein, 9 aa, Homo Sapiens
RYLDDGGLE

SEQ ID NO: 1119917 - protein, 9 aa, Homo Sapiens
GIITTKMGG

SEQ ID NO: 1119918 - protein, 9 aa, Homo Sapiens
SPNSPQGAF

SEQ ID NO: 1119919 - protein, 9 aa, Homo Sapiens
QQQEEVEEV

SEQ ID NO: 1119920 - protein, 9 aa, Homo Sapiens
GKHITKSGT

SEQ ID NO: 1119921 - protein, 9 aa, Homo Sapiens
LQPPQALPP

SEQ ID NO: 1119922 - protein, 9 aa, Homo Sapiens
LDHTQHQFG

SEQ ID NO: 1119923 - protein, 9 aa, Homo Sapiens
LNDSNDDSP

SEQ ID NO: 1119924 - protein, 9 aa, Homo Sapiens
MDNGWAGGG

SEQ ID NO: 1119925 - protein, 9 aa, Homo Sapiens
KSMAGAANV

SEQ ID NO: 1119926 - protein, 9 aa, Homo Sapiens
SSPACRSCR

SEQ ID NO: 1119927 - protein, 9 aa, Homo Sapiens
IALATSKAL

SEQ ID NO: 1119928 - protein, 9 aa, Homo Sapiens
SIDAHAEER

SEQ ID NO: 1119929 - protein, 9 aa, Homo Sapiens
SGSIKRSCS

SEQ ID NO: 1119930 - protein, 9 aa, Homo Sapiens
LPLFIIVRA

SEQ ID NO: 1119931 - protein, 9 aa, Homo Sapiens
PYEVPPSPT

SEQ ID NO: 1119932 - protein, 9 aa, Homo Sapiens
LWGIRWTSS

SEQ ID NO: 1119933 - protein, 9 aa, Homo Sapiens
NKLFVKVYE

SEQ ID NO: 1119934 - protein, 9 aa, Homo Sapiens
REPSRASWR

SEQ ID NO: 1119935 - protein, 9 aa, Homo Sapiens
CLAPLRLHS

SEQ ID NO: 1119936 - protein, 9 aa, Homo Sapiens
SGAVPGPCL

SEQ ID NO: 1119937 - protein, 9 aa, Homo Sapiens
TAVAPASSF

SEQ ID NO: 1119938 - protein, 9 aa, Homo Sapiens
QGKMQREKC

SEQ ID NO: 1119939 - protein, 9 aa, Homo Sapiens
FRMVLQKAV

SEQ ID NO: 1119940 - protein, 9 aa, Homo Sapiens
SGASTDAGS

SEQ ID NO: 1119941 - protein, 9 aa, Homo Sapiens
GPRDLGIHV

SEQ ID NO: 1119942 - protein, 9 aa, Homo Sapiens
PWRSRSICP

SEQ ID NO: 1119943 - protein, 9 aa, Homo Sapiens
IEQMRWPTG

SEQ ID NO: 1119944 - protein, 9 aa, Homo Sapiens
VLSFNIECA

SEQ ID NO: 1119945 - protein, 9 aa, Homo Sapiens
IDKAFQEKH

SEQ ID NO: 1119946 - protein, 9 aa, Homo Sapiens
LDHWSSRYE

SEQ ID NO: 1119947 - protein, 9 aa, Homo Sapiens
TMPPLLHPQ

SEQ ID NO: 1119948 - protein, 9 aa, Homo Sapiens
HYAEQLKEY

SEQ ID NO: 1119949 - protein, 9 aa, Homo Sapiens
SLASCSRGA

SEQ ID NO: 1119950 - protein, 9 aa, Homo Sapiens
LRPEAPCST

SEQ ID NO: 1119951 - protein, 9 aa, Homo Sapiens
VEGLQEASA

SEQ ID NO: 1119952 - protein, 9 aa, Homo Sapiens
KADIYPFAI

SEQ ID NO: 1119953 - protein, 9 aa, Homo Sapiens
CRKLRARRK

SEQ ID NO: 1119954 - protein, 9 aa, Homo Sapiens
FQRTTCHSI

SEQ ID NO: 1119955 - protein, 9 aa, Homo Sapiens
LGDPQSSSQ

SEQ ID NO: 1119956 - protein, 9 aa, Homo Sapiens
KKLQRQASP

SEQ ID NO: 1119957 - protein, 9 aa, Homo Sapiens
YRCLWPNCG

SEQ ID NO: 1119958 - protein, 9 aa, Homo Sapiens
SATQASMTL

SEQ ID NO: 1119959 - protein, 9 aa, Homo Sapiens
QPAPGSTRI

SEQ ID NO: 1119960 - protein, 9 aa, Homo Sapiens
IQNSFQYLR

SEQ ID NO: 1119961 - protein, 9 aa, Homo Sapiens
SASEGCKGF

SEQ ID NO: 1119962 - protein, 9 aa, Homo Sapiens
AAAGVQFGE

SEQ ID NO: 1119963 - protein, 9 aa, Homo Sapiens
ESNGKHITK

SEQ ID NO: 1119964 - protein, 9 aa, Homo Sapiens
WRRIGATTP

SEQ ID NO: 1119965 - protein, 9 aa, Homo Sapiens
ASGSLFYVA

SEQ ID NO: 1119966 - protein, 9 aa, Homo Sapiens
DEWTMASPL

SEQ ID NO: 1119967 - protein, 9 aa, Homo Sapiens
LRRHLPPAA

SEQ ID NO: 1119968 - protein, 9 aa, Homo Sapiens
IVTFGATIT

SEQ ID NO: 1119969 - protein, 9 aa, Homo Sapiens
TSSPRRSPA

SEQ ID NO: 1119970 - protein, 9 aa, Homo Sapiens
RKLCFSVRN

SEQ ID NO: 1119971 - protein, 9 aa, Homo Sapiens
YATVIHNVC

SEQ ID NO: 1119972 - protein, 9 aa, Homo Sapiens
STFGTSITS

SEQ ID NO: 1119973 - protein, 9 aa, Homo Sapiens
CSLDSTNGT

SEQ ID NO: 1119974 - protein, 9 aa, Homo Sapiens
NFPINNLCF

SEQ ID NO: 1119975 - protein, 9 aa, Homo Sapiens
TIAICAVSS

SEQ ID NO: 1119976 - protein, 9 aa, Homo Sapiens
EEGKPKKTE

SEQ ID NO: 1119977 - protein, 9 aa, Homo Sapiens
GHAARCVCD

SEQ ID NO: 1119978 - protein, 9 aa, Homo Sapiens
NNHCQMSGT

SEQ ID NO: 1119979 - protein, 9 aa, Homo Sapiens
QSVGSQNDT

SEQ ID NO: 1119980 - protein, 9 aa, Homo Sapiens
FFGNCFIQI

SEQ ID NO: 1119981 - protein, 9 aa, Homo Sapiens
PVLFSIMNS

SEQ ID NO: 1119982 - protein, 9 aa, Homo Sapiens
SFAYGLAVK

SEQ ID NO: 1119983 - protein, 9 aa, Homo Sapiens
GKMLINLMV

SEQ ID NO: 1119984 - protein, 9 aa, Homo Sapiens
SPATSVEES

SEQ ID NO: 1119985 - protein, 9 aa, Homo Sapiens
VSDSALYLC

SEQ ID NO: 1119986 - protein, 9 aa, Homo Sapiens
TKLGSNGQS

SEQ ID NO: 1119987 - protein, 9 aa, Homo Sapiens
FLHIDMYAM

SEQ ID NO: 1119988 - protein, 9 aa, Homo Sapiens
VSTGRCIAF

SEQ ID NO: 1119989 - protein, 9 aa, Homo Sapiens
AEAVTFGLF

SEQ ID NO: 1119990 - protein, 9 aa, Homo Sapiens
LDVYKLIHK

SEQ ID NO: 1119991 - protein, 9 aa, Homo Sapiens
GWNPRDCSE

SEQ ID NO: 1119992 - protein, 9 aa, Homo Sapiens
SQLLIIDRD

SEQ ID NO: 1119993 - protein, 9 aa, Homo Sapiens
PAVERVSTL

SEQ ID NO: 1119994 - protein, 9 aa, Homo Sapiens
PETVCNVTI

SEQ ID NO: 1119995 - protein, 9 aa, Homo Sapiens
VRVLSSMAD

SEQ ID NO: 1119996 - protein, 9 aa, Homo Sapiens
TANRDILAR

SEQ ID NO: 1119997 - protein, 9 aa, Homo Sapiens
YKWDHRAIS

SEQ ID NO: 1119998 - protein, 9 aa, Homo Sapiens
QELEEQTCR

SEQ ID NO: 1119999 - protein, 9 aa, Homo Sapiens
SDFSNKKAK

SEQ ID NO: 1120000 - protein, 9 aa, Homo Sapiens
PAKDMFDHP

SEQ ID NO: 1120001 - protein, 9 aa, Homo Sapiens
GSYGATEQG

SEQ ID NO: 1120002 - protein, 9 aa, Homo Sapiens
VIIITRDRG

SEQ ID NO: 1120003 - protein, 9 aa, Homo Sapiens
EDDPGHWGA

SEQ ID NO: 1120004 - protein, 9 aa, Homo Sapiens
QALTQSNQL

SEQ ID NO: 1120005 - protein, 9 aa, Homo Sapiens
HVTPGHFCP

SEQ ID NO: 1120006 - protein, 9 aa, Homo Sapiens
LGADLRHPR

SEQ ID NO: 1120007 - protein, 9 aa, Homo Sapiens
SLSKLVHAD

SEQ ID NO: 1120008 - protein, 9 aa, Homo Sapiens
APDAFGIVA

SEQ ID NO: 1120009 - protein, 9 aa, Homo Sapiens
SEQQSFFVV

SEQ ID NO: 1120010 - protein, 9 aa, Homo Sapiens
TVTYNSNIF

SEQ ID NO: 1120011 - protein, 9 aa, Homo Sapiens
GDITPLPVT

SEQ ID NO: 1120012 - protein, 9 aa, Homo Sapiens
ENEFLVYEF

SEQ ID NO: 1120013 - protein, 9 aa, Homo Sapiens
LAVLNGKGL

SEQ ID NO: 1120014 - protein, 9 aa, Homo Sapiens
GAPELGADP

SEQ ID NO: 1120015 - protein, 9 aa, Homo Sapiens
KVLQWDYQK

SEQ ID NO: 1120016 - protein, 9 aa, Homo Sapiens
DCGLWGPFE

SEQ ID NO: 1120017 - protein, 9 aa, Homo Sapiens
NLNKLIQQP

SEQ ID NO: 1120018 - protein, 9 aa, Homo Sapiens
QDLSRISDE

SEQ ID NO: 1120019 - protein, 9 aa, Homo Sapiens
AVCPIQRVV

SEQ ID NO: 1120020 - protein, 9 aa, Homo Sapiens
YEEDEFNDV

SEQ ID NO: 1120021 - protein, 9 aa, Homo Sapiens
LELFDLDEM

SEQ ID NO: 1120022 - protein, 9 aa, Homo Sapiens
TQARGSGSH

SEQ ID NO: 1120023 - protein, 9 aa, Homo Sapiens
TPWLCKPVP

SEQ ID NO: 1120024 - protein, 9 aa, Homo Sapiens
VHPPEDVQP

SEQ ID NO: 1120025 - protein, 9 aa, Homo Sapiens
RRALRFVSS

SEQ ID NO: 1120026 - protein, 9 aa, Homo Sapiens
MGNLLIILS

SEQ ID NO: 1120027 - protein, 9 aa, Homo Sapiens
LRHPRRRLS

SEQ ID NO: 1120028 - protein, 9 aa, Homo Sapiens
LWVWMPLTI

SEQ ID NO: 1120029 - protein, 9 aa, Homo Sapiens
RLDFHPRSS

SEQ ID NO: 1120030 - protein, 9 aa, Homo Sapiens
TVLGVRSQR

SEQ ID NO: 1120031 - protein, 9 aa, Homo Sapiens
VKMSTKNST

SEQ ID NO: 1120032 - protein, 9 aa, Homo Sapiens
AAREVIAYF

SEQ ID NO: 1120033 - protein, 9 aa, Homo Sapiens
EVFPPVFAL

SEQ ID NO: 1120034 - protein, 9 aa, Homo Sapiens
LERSPCPGW

SEQ ID NO: 1120035 - protein, 9 aa, Homo Sapiens
RERDRDRDQ

SEQ ID NO: 1120036 - protein, 9 aa, Homo Sapiens
RSKAKAESA

SEQ ID NO: 1120037 - protein, 9 aa, Homo Sapiens
EIKRLNKVP

SEQ ID NO: 1120038 - protein, 9 aa, Homo Sapiens
PTPVPRSLR

SEQ ID NO: 1120039 - protein, 9 aa, Homo Sapiens
PVLCSLCTT

SEQ ID NO: 1120040 - protein, 9 aa, Homo Sapiens
LGRVFYVTS

SEQ ID NO: 1120041 - protein, 9 aa, Homo Sapiens
CLITRSQEE

SEQ ID NO: 1120042 - protein, 9 aa, Homo Sapiens
VPPQPVTHL

SEQ ID NO: 1120043 - protein, 9 aa, Homo Sapiens
DFSNKKAKR

SEQ ID NO: 1120044 - protein, 9 aa, Homo Sapiens
SWTCSQTRP

SEQ ID NO: 1120045 - protein, 9 aa, Homo Sapiens
PNKPRVCPT

SEQ ID NO: 1120046 - protein, 9 aa, Homo Sapiens
ESPTTRRGT

SEQ ID NO: 1120047 - protein, 9 aa, Homo Sapiens
TFHLLREEK

SEQ ID NO: 1120048 - protein, 9 aa, Homo Sapiens
TAAAIMATP

SEQ ID NO: 1120049 - protein, 9 aa, Homo Sapiens
PKFKIRKIP

SEQ ID NO: 1120050 - protein, 9 aa, Homo Sapiens
GDGTDGEGE

SEQ ID NO: 1120051 - protein, 9 aa, Homo Sapiens
TYRAGVVCC

SEQ ID NO: 1120052 - protein, 9 aa, Homo Sapiens
NHDKNHPKN

SEQ ID NO: 1120053 - protein, 9 aa, Homo Sapiens
RSSMYRGLW

SEQ ID NO: 1120054 - protein, 9 aa, Homo Sapiens
GPSWRVRKI

SEQ ID NO: 1120055 - protein, 9 aa, Homo Sapiens
IFRDDGDWQ

SEQ ID NO: 1120056 - protein, 9 aa, Homo Sapiens
SPGRNSVAC

SEQ ID NO: 1120057 - protein, 9 aa, Homo Sapiens
HDPKKNHRW

SEQ ID NO: 1120058 - protein, 9 aa, Homo Sapiens
LERTLDATE

SEQ ID NO: 1120059 - protein, 9 aa, Homo Sapiens
PHLHPAPPC

SEQ ID NO: 1120060 - protein, 9 aa, Homo Sapiens
DGGGSGSGL

SEQ ID NO: 1120061 - protein, 9 aa, Homo Sapiens
TQAEGQHKM

SEQ ID NO: 1120062 - protein, 9 aa, Homo Sapiens
WLQLLYSNG

SEQ ID NO: 1120063 - protein, 9 aa, Homo Sapiens
QKKSKQQGV

SEQ ID NO: 1120064 - protein, 9 aa, Homo Sapiens
YQEADQRDF

SEQ ID NO: 1120065 - protein, 9 aa, Homo Sapiens
LPWANSSPT

SEQ ID NO: 1120066 - protein, 9 aa, Homo Sapiens
YLFHNDIRV

SEQ ID NO: 1120067 - protein, 9 aa, Homo Sapiens
FTWRTSRTR

SEQ ID NO: 1120068 - protein, 9 aa, Homo Sapiens
MPPGSPTPT

SEQ ID NO: 1120069 - protein, 9 aa, Homo Sapiens
MVEKNYPQI

SEQ ID NO: 1120070 - protein, 9 aa, Homo Sapiens
ELSAIVSKR

SEQ ID NO: 1120071 - protein, 9 aa, Homo Sapiens
CGVGLRRFP

SEQ ID NO: 1120072 - protein, 9 aa, Homo Sapiens
QHGELGRPL

SEQ ID NO: 1120073 - protein, 9 aa, Homo Sapiens
TRGAPAPPA

SEQ ID NO: 1120074 - protein, 9 aa, Homo Sapiens
LGGEGDGTG

SEQ ID NO: 1120075 - protein, 9 aa, Homo Sapiens
KWHLTIMMD

SEQ ID NO: 1120076 - protein, 9 aa, Homo Sapiens
AGSGNTTHR

SEQ ID NO: 1120077 - protein, 9 aa, Homo Sapiens
FIKKHEEGC

SEQ ID NO: 1120078 - protein, 9 aa, Homo Sapiens
LIFIYLPLM

SEQ ID NO: 1120079 - protein, 9 aa, Homo Sapiens
FASRDKQVL

SEQ ID NO: 1120080 - protein, 9 aa, Homo Sapiens
SIPEEFFDY

SEQ ID NO: 1120081 - protein, 9 aa, Homo Sapiens
IAGFWTIFH

SEQ ID NO: 1120082 - protein, 9 aa, Homo Sapiens
HGGAVAAQP

SEQ ID NO: 1120083 - protein, 9 aa, Homo Sapiens
FLRHPRWSH

SEQ ID NO: 1120084 - protein, 9 aa, Homo Sapiens
CPRFRQCAN

SEQ ID NO: 1120085 - protein, 9 aa, Homo Sapiens
RTGASTPAR

SEQ ID NO: 1120086 - protein, 9 aa, Homo Sapiens
ASACATSAA

SEQ ID NO: 1120087 - protein, 9 aa, Homo Sapiens
EEEVLIPPL

SEQ ID NO: 1120088 - protein, 9 aa, Homo Sapiens
SCSAPVLLG

SEQ ID NO: 1120089 - protein, 9 aa, Homo Sapiens
QGPVGPLGF

SEQ ID NO: 1120090 - protein, 9 aa, Homo Sapiens
QCRRCMRWC

SEQ ID NO: 1120091 - protein, 9 aa, Homo Sapiens
SVTHQSSMS

SEQ ID NO: 1120092 - protein, 9 aa, Homo Sapiens
VIAYFLERN

SEQ ID NO: 1120093 - protein, 9 aa, Homo Sapiens
YTRHECRQM

SEQ ID NO: 1120094 - protein, 9 aa, Homo Sapiens
LTLLWGTWC

SEQ ID NO: 1120095 - protein, 9 aa, Homo Sapiens
METTRRRVP

SEQ ID NO: 1120096 - protein, 9 aa, Homo Sapiens
GLPRKSVTT

SEQ ID NO: 1120097 - protein, 9 aa, Homo Sapiens
ALKLCQQLL

SEQ ID NO: 1120098 - protein, 9 aa, Homo Sapiens
VPKLQRRQF

SEQ ID NO: 1120099 - protein, 9 aa, Homo Sapiens
HLPPAEGGL

SEQ ID NO: 1120100 - protein, 9 aa, Homo Sapiens
HVQRSLVPR

SEQ ID NO: 1120101 - protein, 9 aa, Homo Sapiens
LGESWMRPC

SEQ ID NO: 1120102 - protein, 9 aa, Homo Sapiens
EADLRGEPR

SEQ ID NO: 1120103 - protein, 9 aa, Homo Sapiens
DYRAWKVQL

SEQ ID NO: 1120104 - protein, 9 aa, Homo Sapiens
EGLQEASAA

SEQ ID NO: 1120105 - protein, 9 aa, Homo Sapiens
TRGASKASR

SEQ ID NO: 1120106 - protein, 9 aa, Homo Sapiens
APTCQENLP

SEQ ID NO: 1120107 - protein, 9 aa, Homo Sapiens
QVFATQPVL

SEQ ID NO: 1120108 - protein, 9 aa, Homo Sapiens
CQSRSSYMD

SEQ ID NO: 1120109 - protein, 9 aa, Homo Sapiens
MSTASHSFM

SEQ ID NO: 1120110 - protein, 9 aa, Homo Sapiens
AADQSGPLA

SEQ ID NO: 1120111 - protein, 9 aa, Homo Sapiens
AATGTAAAT

SEQ ID NO: 1120112 - protein, 9 aa, Homo Sapiens
TFDDHETVD

SEQ ID NO: 1120113 - protein, 9 aa, Homo Sapiens
VRARVRAPC

SEQ ID NO: 1120114 - protein, 9 aa, Homo Sapiens
TAAGLGPPA

SEQ ID NO: 1120115 - protein, 9 aa, Homo Sapiens
EGGEAQENG

SEQ ID NO: 1120116 - protein, 9 aa, Homo Sapiens
LMAEKNFNT

SEQ ID NO: 1120117 - protein, 9 aa, Homo Sapiens
SDNEVLLQE

SEQ ID NO: 1120118 - protein, 9 aa, Homo Sapiens
KPQLSGKML

SEQ ID NO: 1120119 - protein, 9 aa, Homo Sapiens
CMSVGQQTW

SEQ ID NO: 1120120 - protein, 9 aa, Homo Sapiens
PSQAAAAEA

SEQ ID NO: 1120121 - protein, 9 aa, Homo Sapiens
VSSEGISLA

SEQ ID NO: 1120122 - protein, 9 aa, Homo Sapiens
SCGSPGWWA

SEQ ID NO: 1120123 - protein, 9 aa, Homo Sapiens
TLCASSRKR

SEQ ID NO: 1120124 - protein, 9 aa, Homo Sapiens
FPLQEEISK

SEQ ID NO: 1120125 - protein, 9 aa, Homo Sapiens
RDSAQGVTF

SEQ ID NO: 1120126 - protein, 9 aa, Homo Sapiens
YVHKEKRTQ

SEQ ID NO: 1120127 - protein, 9 aa, Homo Sapiens
TSTATRAPS

SEQ ID NO: 1120128 - protein, 9 aa, Homo Sapiens
TTTPALQPP

SEQ ID NO: 1120129 - protein, 9 aa, Homo Sapiens
PAPAAEGFD

SEQ ID NO: 1120130 - protein, 9 aa, Homo Sapiens
PHASFSEGA

SEQ ID NO: 1120131 - protein, 9 aa, Homo Sapiens
NYITGYDVK

SEQ ID NO: 1120132 - protein, 9 aa, Homo Sapiens
RPVVILART

SEQ ID NO: 1120133 - protein, 9 aa, Homo Sapiens
GKDGHIVNV

SEQ ID NO: 1120134 - protein, 9 aa, Homo Sapiens
CKRRLENID

SEQ ID NO: 1120135 - protein, 9 aa, Homo Sapiens
LNSIKKGEI

SEQ ID NO: 1120136 - protein, 9 aa, Homo Sapiens
PGWIYTLSG

SEQ ID NO: 1120137 - protein, 9 aa, Homo Sapiens
MVLQKAVEE

SEQ ID NO: 1120138 - protein, 9 aa, Homo Sapiens
SSRFFVKIF

SEQ ID NO: 1120139 - protein, 9 aa, Homo Sapiens
VMVVTGDEE

SEQ ID NO: 1120140 - protein, 9 aa, Homo Sapiens
VVNRPWLFS

SEQ ID NO: 1120141 - protein, 9 aa, Homo Sapiens
VAEKEEWHT

SEQ ID NO: 1120142 - protein, 9 aa, Homo Sapiens
RAPHPPPAA

SEQ ID NO: 1120143 - protein, 9 aa, Homo Sapiens
HAGEKPYHC

SEQ ID NO: 1120144 - protein, 9 aa, Homo Sapiens
VECAGRHRL

SEQ ID NO: 1120145 - protein, 9 aa, Homo Sapiens
MCVSLAVSR

SEQ ID NO: 1120146 - protein, 9 aa, Homo Sapiens
LLASREDFK

SEQ ID NO: 1120147 - protein, 9 aa, Homo Sapiens
TIINLLRFV

SEQ ID NO: 1120148 - protein, 9 aa, Homo Sapiens
RTRETLESG

SEQ ID NO: 1120149 - protein, 9 aa, Homo Sapiens
LLPTYLLVT

SEQ ID NO: 1120150 - protein, 9 aa, Homo Sapiens
TASCASTGS

SEQ ID NO: 1120151 - protein, 9 aa, Homo Sapiens
HPSPRCARS

SEQ ID NO: 1120152 - protein, 9 aa, Homo Sapiens
GGSHVGAAD

SEQ ID NO: 1120153 - protein, 9 aa, Homo Sapiens
MAFRNVTVQ

SEQ ID NO: 1120154 - protein, 9 aa, Homo Sapiens
PDCRLAALP

SEQ ID NO: 1120155 - protein, 9 aa, Homo Sapiens
TSLFLHHKD

SEQ ID NO: 1120156 - protein, 9 aa, Homo Sapiens
MQREKCLTI

SEQ ID NO: 1120157 - protein, 9 aa, Homo Sapiens
KNAVLMYPS

SEQ ID NO: 1120158 - protein, 9 aa, Homo Sapiens
AFSPDLTEE

SEQ ID NO: 1120159 - protein, 9 aa, Homo Sapiens
TFSLAPGYS

SEQ ID NO: 1120160 - protein, 9 aa, Homo Sapiens
RGAKVSRNT

SEQ ID NO: 1120161 - protein, 9 aa, Homo Sapiens
QEKSTKSIV

SEQ ID NO: 1120162 - protein, 9 aa, Homo Sapiens
YGPDFGPNL

SEQ ID NO: 1120163 - protein, 9 aa, Homo Sapiens
RQILGLRIP

SEQ ID NO: 1120164 - protein, 9 aa, Homo Sapiens
PAMGGAWPR

SEQ ID NO: 1120165 - protein, 9 aa, Homo Sapiens
SEIPCCNCK

SEQ ID NO: 1120166 - protein, 9 aa, Homo Sapiens
CRLPEIKLP

SEQ ID NO: 1120167 - protein, 9 aa, Homo Sapiens
SSSWKNRKE

SEQ ID NO: 1120168 - protein, 9 aa, Homo Sapiens
SEDDEDVGT

SEQ ID NO: 1120169 - protein, 9 aa, Homo Sapiens
LQIWWKKAM

SEQ ID NO: 1120170 - protein, 9 aa, Homo Sapiens
TATSAGRAC

SEQ ID NO: 1120171 - protein, 9 aa, Homo Sapiens
VFPAREWLF

SEQ ID NO: 1120172 - protein, 9 aa, Homo Sapiens
RERNPKIGL

SEQ ID NO: 1120173 - protein, 9 aa, Homo Sapiens
QQTFGKKWH

SEQ ID NO: 1120174 - protein, 9 aa, Homo Sapiens
GVTPISVSG

SEQ ID NO: 1120175 - protein, 9 aa, Homo Sapiens
DEAKRLHAV

SEQ ID NO: 1120176 - protein, 9 aa, Homo Sapiens
MFILILLNT

SEQ ID NO: 1120177 - protein, 9 aa, Homo Sapiens
GGEQSWWGG

SEQ ID NO: 1120178 - protein, 9 aa, Homo Sapiens
EVLVQSFSG

SEQ ID NO: 1120179 - protein, 9 aa, Homo Sapiens
SANMMVDGK

SEQ ID NO: 1120180 - protein, 9 aa, Homo Sapiens
LIYLCRFCS

SEQ ID NO: 1120181 - protein, 9 aa, Homo Sapiens
SLLGAKVGV

SEQ ID NO: 1120182 - protein, 9 aa, Homo Sapiens
QKDLMSWMA

SEQ ID NO: 1120183 - protein, 9 aa, Homo Sapiens
DILRGELQR

SEQ ID NO: 1120184 - protein, 9 aa, Homo Sapiens
VVEKCGCAQ

SEQ ID NO: 1120185 - protein, 9 aa, Homo Sapiens
KPGQLNIDI

SEQ ID NO: 1120186 - protein, 9 aa, Homo Sapiens
RVDLLQDEL

SEQ ID NO: 1120187 - protein, 9 aa, Homo Sapiens
GHFKTWEEQ

SEQ ID NO: 1120188 - protein, 9 aa, Homo Sapiens
YDGGSDVQS

SEQ ID NO: 1120189 - protein, 9 aa, Homo Sapiens
GGPSTCSGW

SEQ ID NO: 1120190 - protein, 9 aa, Homo Sapiens
HGNETVGRE

SEQ ID NO: 1120191 - protein, 9 aa, Homo Sapiens
HPLLWGCHL

SEQ ID NO: 1120192 - protein, 9 aa, Homo Sapiens
KVAARLAMA

SEQ ID NO: 1120193 - protein, 9 aa, Homo Sapiens
GGFNGGCEQ

SEQ ID NO: 1120194 - protein, 9 aa, Homo Sapiens
KKLMNARDA

SEQ ID NO: 1120195 - protein, 9 aa, Homo Sapiens
VLSCRSPSG

SEQ ID NO: 1120196 - protein, 9 aa, Homo Sapiens
MTGLGKQVL

SEQ ID NO: 1120197 - protein, 9 aa, Homo Sapiens
EDGQIGERP

SEQ ID NO: 1120198 - protein, 9 aa, Homo Sapiens
TPVARTLPK

SEQ ID NO: 1120199 - protein, 9 aa, Homo Sapiens
MECLAPLRL

SEQ ID NO: 1120200 - protein, 9 aa, Homo Sapiens
LRAGDPWTG

SEQ ID NO: 1120201 - protein, 9 aa, Homo Sapiens
PNIRHSSSD

SEQ ID NO: 1120202 - protein, 9 aa, Homo Sapiens
NFQRDAFLH

SEQ ID NO: 1120203 - protein, 9 aa, Homo Sapiens
PLPPSAPPP

SEQ ID NO: 1120204 - protein, 9 aa, Homo Sapiens
EGEDDTDDL

SEQ ID NO: 1120205 - protein, 9 aa, Homo Sapiens
GVPQVSLVE

SEQ ID NO: 1120206 - protein, 9 aa, Homo Sapiens
TSQKDVWCP

SEQ ID NO: 1120207 - protein, 9 aa, Homo Sapiens
RAPPVRDPT

SEQ ID NO: 1120208 - protein, 9 aa, Homo Sapiens
VKKSCGVAH

SEQ ID NO: 1120209 - protein, 9 aa, Homo Sapiens
FRLKLPVLL

SEQ ID NO: 1120210 - protein, 9 aa, Homo Sapiens
TDELQRLQN

SEQ ID NO: 1120211 - protein, 9 aa, Homo Sapiens
SGRPPTCAA

SEQ ID NO: 1120212 - protein, 9 aa, Homo Sapiens
VHAGILSRN

SEQ ID NO: 1120213 - protein, 9 aa, Homo Sapiens
RMEQFTVRV

SEQ ID NO: 1120214 - protein, 9 aa, Homo Sapiens
EKAKWLGVQ

SEQ ID NO: 1120215 - protein, 9 aa, Homo Sapiens
KCHNSDAVR

SEQ ID NO: 1120216 - protein, 9 aa, Homo Sapiens
KEMLPRHPC

SEQ ID NO: 1120217 - protein, 9 aa, Homo Sapiens
LVIQKAVHT

SEQ ID NO: 1120218 - protein, 9 aa, Homo Sapiens
GCGCGRAPA

SEQ ID NO: 1120219 - protein, 9 aa, Homo Sapiens
SPSTVELSG

SEQ ID NO: 1120220 - protein, 9 aa, Homo Sapiens
EKTRPMSER

SEQ ID NO: 1120221 - protein, 9 aa, Homo Sapiens
QKANELYEP

SEQ ID NO: 1120222 - protein, 9 aa, Homo Sapiens
GVHYQAWVA

SEQ ID NO: 1120223 - protein, 9 aa, Homo Sapiens
QDLAPPLLP

SEQ ID NO: 1120224 - protein, 9 aa, Homo Sapiens
AELRDAINT

SEQ ID NO: 1120225 - protein, 9 aa, Homo Sapiens
AWKVQLPEP

SEQ ID NO: 1120226 - protein, 9 aa, Homo Sapiens
PQAVDGWVE

SEQ ID NO: 1120227 - protein, 9 aa, Homo Sapiens
KARGALATG

SEQ ID NO: 1120228 - protein, 9 aa, Homo Sapiens
LLQLLSFAL

SEQ ID NO: 1120229 - protein, 9 aa, Homo Sapiens
GPLAVWISG

SEQ ID NO: 1120230 - protein, 9 aa, Homo Sapiens
ILPGKMPVY

SEQ ID NO: 1120231 - protein, 9 aa, Homo Sapiens
VLVEHAELI

SEQ ID NO: 1120232 - protein, 9 aa, Homo Sapiens
WVPHPLTVL

SEQ ID NO: 1120233 - protein, 9 aa, Homo Sapiens
PTPIYQVLG

SEQ ID NO: 1120234 - protein, 9 aa, Homo Sapiens
VGTDATMCC

SEQ ID NO: 1120235 - protein, 9 aa, Homo Sapiens
ILDDFYTAT

SEQ ID NO: 1120236 - protein, 9 aa, Homo Sapiens
FHILLLHQQ

SEQ ID NO: 1120237 - protein, 9 aa, Homo Sapiens
VAEGSVQYK

SEQ ID NO: 1120238 - protein, 9 aa, Homo Sapiens
PIKFLIKYQ

SEQ ID NO: 1120239 - protein, 9 aa, Homo Sapiens
VHHLIHLGL

SEQ ID NO: 1120240 - protein, 9 aa, Homo Sapiens
AGASGWSAS

SEQ ID NO: 1120241 - protein, 9 aa, Homo Sapiens
RLLGASSVD

SEQ ID NO: 1120242 - protein, 9 aa, Homo Sapiens
MSGTSGKGF

SEQ ID NO: 1120243 - protein, 9 aa, Homo Sapiens
RQMASKPRQ

SEQ ID NO: 1120244 - protein, 9 aa, Homo Sapiens
ETGELVPHW

SEQ ID NO: 1120245 - protein, 9 aa, Homo Sapiens
ALTPPHPAR

SEQ ID NO: 1120246 - protein, 9 aa, Homo Sapiens
ILEKNPPLR

SEQ ID NO: 1120247 - protein, 9 aa, Homo Sapiens
RLLWKRSLL

SEQ ID NO: 1120248 - protein, 9 aa, Homo Sapiens
SAVQETQLI

SEQ ID NO: 1120249 - protein, 9 aa, Homo Sapiens
HIRAENHDM

SEQ ID NO: 1120250 - protein, 9 aa, Homo Sapiens
TPGTCLKPT

SEQ ID NO: 1120251 - protein, 9 aa, Homo Sapiens
APRITAAAS

SEQ ID NO: 1120252 - protein, 9 aa, Homo Sapiens
CLSGPVAVA

SEQ ID NO: 1120253 - protein, 9 aa, Homo Sapiens
KRDIDDMEL

SEQ ID NO: 1120254 - protein, 9 aa, Homo Sapiens
MAKHLSQCK

SEQ ID NO: 1120255 - protein, 9 aa, Homo Sapiens
LRTRRPWTA

SEQ ID NO: 1120256 - protein, 9 aa, Homo Sapiens
CNSLCGTKS

SEQ ID NO: 1120257 - protein, 9 aa, Homo Sapiens
DLGVHGEGE

SEQ ID NO: 1120258 - protein, 9 aa, Homo Sapiens
PLPPRAPHP

SEQ ID NO: 1120259 - protein, 9 aa, Homo Sapiens
KQRNGCHPY

SEQ ID NO: 1120260 - protein, 9 aa, Homo Sapiens
RANNTMGRD

SEQ ID NO: 1120261 - protein, 9 aa, Homo Sapiens
GCYPEEDNE

SEQ ID NO: 1120262 - protein, 9 aa, Homo Sapiens
TYPVSNSVP

SEQ ID NO: 1120263 - protein, 9 aa, Homo Sapiens
HFGDTFPPA

SEQ ID NO: 1120264 - protein, 9 aa, Homo Sapiens
VNEALRKVM

SEQ ID NO: 1120265 - protein, 9 aa, Homo Sapiens
QMFIGDCAK

SEQ ID NO: 1120266 - protein, 9 aa, Homo Sapiens
QCANTFGSY

SEQ ID NO: 1120267 - protein, 9 aa, Homo Sapiens
AGGSCMKGA

SEQ ID NO: 1120268 - protein, 9 aa, Homo Sapiens
MSPTLTPKA

SEQ ID NO: 1120269 - protein, 9 aa, Homo Sapiens
EHIFSLPIT

SEQ ID NO: 1120270 - protein, 9 aa, Homo Sapiens
THVMGKTKP

SEQ ID NO: 1120271 - protein, 9 aa, Homo Sapiens
RPCKAGAQL

SEQ ID NO: 1120272 - protein, 9 aa, Homo Sapiens
SFPAPLPGR

SEQ ID NO: 1120273 - protein, 9 aa, Homo Sapiens
KMANFSFGG

SEQ ID NO: 1120274 - protein, 9 aa, Homo Sapiens
HARLIPFPG

SEQ ID NO: 1120275 - protein, 9 aa, Homo Sapiens
TAAEHRVPP

SEQ ID NO: 1120276 - protein, 9 aa, Homo Sapiens
ARAVIVGHL

SEQ ID NO: 1120277 - protein, 9 aa, Homo Sapiens
ILGHFVIPK

SEQ ID NO: 1120278 - protein, 9 aa, Homo Sapiens
VEWGAGRGR

SEQ ID NO: 1120279 - protein, 9 aa, Homo Sapiens
RPRLPRHCL

SEQ ID NO: 1120280 - protein, 9 aa, Homo Sapiens
RQDHVAFCV

SEQ ID NO: 1120281 - protein, 9 aa, Homo Sapiens
KNQWFARCQ

SEQ ID NO: 1120282 - protein, 9 aa, Homo Sapiens
DSSELRPVD

SEQ ID NO: 1120283 - protein, 9 aa, Homo Sapiens
ITLSNPLNC

SEQ ID NO: 1120284 - protein, 9 aa, Homo Sapiens
EHEINGVAK

SEQ ID NO: 1120285 - protein, 9 aa, Homo Sapiens
TLLSALAVA

SEQ ID NO: 1120286 - protein, 9 aa, Homo Sapiens
TLIMMYRTH

SEQ ID NO: 1120287 - protein, 9 aa, Homo Sapiens
SSINTTISD

SEQ ID NO: 1120288 - protein, 9 aa, Homo Sapiens
VGVIVDLTV

SEQ ID NO: 1120289 - protein, 9 aa, Homo Sapiens
QAFCTHPDE

SEQ ID NO: 1120290 - protein, 9 aa, Homo Sapiens
ASQTTDAIF

SEQ ID NO: 1120291 - protein, 9 aa, Homo Sapiens
LRHKHPVPA

SEQ ID NO: 1120292 - protein, 9 aa, Homo Sapiens
DFKQKVEEC

SEQ ID NO: 1120293 - protein, 9 aa, Homo Sapiens
TDYVSYTES

SEQ ID NO: 1120294 - protein, 9 aa, Homo Sapiens
SYRVIQHHD

SEQ ID NO: 1120295 - protein, 9 aa, Homo Sapiens
EGEGPGKHG

SEQ ID NO: 1120296 - protein, 9 aa, Homo Sapiens
FTVIPSKPI

SEQ ID NO: 1120297 - protein, 9 aa, Homo Sapiens
VVIEYSTEA

SEQ ID NO: 1120298 - protein, 9 aa, Homo Sapiens
SPDSKGAQK

SEQ ID NO: 1120299 - protein, 9 aa, Homo Sapiens
LGAGGQCCC

SEQ ID NO: 1120300 - protein, 9 aa, Homo Sapiens
VAVAGESME

SEQ ID NO: 1120301 - protein, 9 aa, Homo Sapiens
YTETHARHQ

SEQ ID NO: 1120302 - protein, 9 aa, Homo Sapiens
WPWTRCLRM

SEQ ID NO: 1120303 - protein, 9 aa, Homo Sapiens
GEEPQRDKH

SEQ ID NO: 1120304 - protein, 9 aa, Homo Sapiens
STCMSQTVQ

SEQ ID NO: 1120305 - protein, 9 aa, Homo Sapiens
MVKVQDEKR

SEQ ID NO: 1120306 - protein, 9 aa, Homo Sapiens
RELAVRALH

SEQ ID NO: 1120307 - protein, 9 aa, Homo Sapiens
WANSSPTST

SEQ ID NO: 1120308 - protein, 9 aa, Homo Sapiens
GRDPSPRAG

SEQ ID NO: 1120309 - protein, 9 aa, Homo Sapiens
EKNLIWQVF

SEQ ID NO: 1120310 - protein, 9 aa, Homo Sapiens
YLTIAICAV

SEQ ID NO: 1120311 - protein, 9 aa, Homo Sapiens
ELEHYDAAF

SEQ ID NO: 1120312 - protein, 9 aa, Homo Sapiens
MAPVGSVMS

SEQ ID NO: 1120313 - protein, 9 aa, Homo Sapiens
LGPGPGPTV

SEQ ID NO: 1120314 - protein, 9 aa, Homo Sapiens
KILKQSMTM

SEQ ID NO: 1120315 - protein, 9 aa, Homo Sapiens
EKKVRLSPV

SEQ ID NO: 1120316 - protein, 9 aa, Homo Sapiens
PGKTSLKAS

SEQ ID NO: 1120317 - protein, 9 aa, Homo Sapiens
SKQNREKRK

SEQ ID NO: 1120318 - protein, 9 aa, Homo Sapiens
AATTAAGAS

SEQ ID NO: 1120319 - protein, 9 aa, Homo Sapiens
TLRCPAVPA

SEQ ID NO: 1120320 - protein, 9 aa, Homo Sapiens
FAMTMYYQV

SEQ ID NO: 1120321 - protein, 9 aa, Homo Sapiens
QLPGGPGHG

SEQ ID NO: 1120322 - protein, 9 aa, Homo Sapiens
NRPPRFLQV

SEQ ID NO: 1120323 - protein, 9 aa, Homo Sapiens
SPVLGKLEM

SEQ ID NO: 1120324 - protein, 9 aa, Homo Sapiens
KLGSNGQSP

SEQ ID NO: 1120325 - protein, 9 aa, Homo Sapiens
RNKHQGGWT

SEQ ID NO: 1120326 - protein, 9 aa, Homo Sapiens
VGLASTVRS

SEQ ID NO: 1120327 - protein, 9 aa, Homo Sapiens
EVGWPEEEE

SEQ ID NO: 1120328 - protein, 9 aa, Homo Sapiens
RKRMSKNTA

SEQ ID NO: 1120329 - protein, 9 aa, Homo Sapiens
SMAKLPHGM

SEQ ID NO: 1120330 - protein, 9 aa, Homo Sapiens
TLINTTTIT

SEQ ID NO: 1120331 - protein, 9 aa, Homo Sapiens
RDLPPPGGP

SEQ ID NO: 1120332 - protein, 9 aa, Homo Sapiens
IMPLSEVCE

SEQ ID NO: 1120333 - protein, 9 aa, Homo Sapiens
CGSQIVALN

SEQ ID NO: 1120334 - protein, 9 aa, Homo Sapiens
GASTPARSP

SEQ ID NO: 1120335 - protein, 9 aa, Homo Sapiens
AGSFPTCGP

SEQ ID NO: 1120336 - protein, 9 aa, Homo Sapiens
KTITDYVSY

SEQ ID NO: 1120337 - protein, 9 aa, Homo Sapiens
AAISHRSEF

SEQ ID NO: 1120338 - protein, 9 aa, Homo Sapiens
KKNGIWEVM

SEQ ID NO: 1120339 - protein, 9 aa, Homo Sapiens
DMRGLKRSE

SEQ ID NO: 1120340 - protein, 9 aa, Homo Sapiens
EFLTALKSR

SEQ ID NO: 1120341 - protein, 9 aa, Homo Sapiens
AQSLKTLRN

SEQ ID NO: 1120342 - protein, 9 aa, Homo Sapiens
REESQNEET

SEQ ID NO: 1120343 - protein, 9 aa, Homo Sapiens
FLIGLLKVP

SEQ ID NO: 1120344 - protein, 9 aa, Homo Sapiens
GARARTEQG

SEQ ID NO: 1120345 - protein, 9 aa, Homo Sapiens
HIQVQAPPP

SEQ ID NO: 1120346 - protein, 9 aa, Homo Sapiens
LVGNVYIKF

SEQ ID NO: 1120347 - protein, 9 aa, Homo Sapiens
SISRPTSRA

SEQ ID NO: 1120348 - protein, 9 aa, Homo Sapiens
SLGHSRQGS

SEQ ID NO: 1120349 - protein, 9 aa, Homo Sapiens
SLTGYRIYR

SEQ ID NO: 1120350 - protein, 9 aa, Homo Sapiens
LSVQVFSFC

SEQ ID NO: 1120351 - protein, 9 aa, Homo Sapiens
PRGVLSLLL

SEQ ID NO: 1120352 - protein, 9 aa, Homo Sapiens
NSIGADLLT

SEQ ID NO: 1120353 - protein, 9 aa, Homo Sapiens
LSGEPTEEA

SEQ ID NO: 1120354 - protein, 9 aa, Homo Sapiens
PYLKKKGES

SEQ ID NO: 1120355 - protein, 9 aa, Homo Sapiens
RWTEEEMEI

SEQ ID NO: 1120356 - protein, 9 aa, Homo Sapiens
IDVLHLVHQ

SEQ ID NO: 1120357 - protein, 9 aa, Homo Sapiens
CDPPSSMGT

SEQ ID NO: 1120358 - protein, 9 aa, Homo Sapiens
TWASPLASV

SEQ ID NO: 1120359 - protein, 9 aa, Homo Sapiens
PHPWLRLRP

SEQ ID NO: 1120360 - protein, 9 aa, Homo Sapiens
VEPDLHLEV

SEQ ID NO: 1120361 - protein, 9 aa, Homo Sapiens
ATAGACSKV

SEQ ID NO: 1120362 - protein, 9 aa, Homo Sapiens
PACRSCRCL

SEQ ID NO: 1120363 - protein, 9 aa, Homo Sapiens
KTQPPKQTI

SEQ ID NO: 1120364 - protein, 9 aa, Homo Sapiens
SQAMRVVRT

SEQ ID NO: 1120365 - protein, 9 aa, Homo Sapiens
RRTVRLRHR

SEQ ID NO: 1120366 - protein, 9 aa, Homo Sapiens
GANFLCLWM

SEQ ID NO: 1120367 - protein, 9 aa, Homo Sapiens
PGPSPASLL

SEQ ID NO: 1120368 - protein, 9 aa, Homo Sapiens
ILRRLVSYW

SEQ ID NO: 1120369 - protein, 9 aa, Homo Sapiens
RKRCNRFVK

SEQ ID NO: 1120370 - protein, 9 aa, Homo Sapiens
GVAAVVRGL

SEQ ID NO: 1120371 - protein, 9 aa, Homo Sapiens
HDKNHPKNL

SEQ ID NO: 1120372 - protein, 9 aa, Homo Sapiens
EPGQGPEIQ

SEQ ID NO: 1120373 - protein, 9 aa, Homo Sapiens
PLPMLTGCP

SEQ ID NO: 1120374 - protein, 9 aa, Homo Sapiens
NSDEENCVL

SEQ ID NO: 1120375 - protein, 9 aa, Homo Sapiens
NLSLAQVKI

SEQ ID NO: 1120376 - protein, 9 aa, Homo Sapiens
RGDVHVGLG

SEQ ID NO: 1120377 - protein, 9 aa, Homo Sapiens
HLETRPTQR

SEQ ID NO: 1120378 - protein, 9 aa, Homo Sapiens
PEAMFSDLH

SEQ ID NO: 1120379 - protein, 9 aa, Homo Sapiens
TVDKIHERK

SEQ ID NO: 1120380 - protein, 9 aa, Homo Sapiens
SVAGLIHYS

SEQ ID NO: 1120381 - protein, 9 aa, Homo Sapiens
LRDITIDNI

SEQ ID NO: 1120382 - protein, 9 aa, Homo Sapiens
GEDEEQNQE

SEQ ID NO: 1120383 - protein, 9 aa, Homo Sapiens
QCDALFNEL

SEQ ID NO: 1120384 - protein, 9 aa, Homo Sapiens
NVHGINFDS

SEQ ID NO: 1120385 - protein, 9 aa, Homo Sapiens
QCPSPWPQA

SEQ ID NO: 1120386 - protein, 9 aa, Homo Sapiens
GNQVVIVEE

SEQ ID NO: 1120387 - protein, 9 aa, Homo Sapiens
DDFQFNASE

SEQ ID NO: 1120388 - protein, 9 aa, Homo Sapiens
KQHLSCRLV

SEQ ID NO: 1120389 - protein, 9 aa, Homo Sapiens
WWLIGAESV

SEQ ID NO: 1120390 - protein, 9 aa, Homo Sapiens
VMHVAAKES

SEQ ID NO: 1120391 - protein, 9 aa, Homo Sapiens
VSVCDCEGT

SEQ ID NO: 1120392 - protein, 9 aa, Homo Sapiens
KGLCHLLLP

SEQ ID NO: 1120393 - protein, 9 aa, Homo Sapiens
SAHRGRTGV

SEQ ID NO: 1120394 - protein, 9 aa, Homo Sapiens
LRLRTKLEK

SEQ ID NO: 1120395 - protein, 9 aa, Homo Sapiens
VATKLYKGV

SEQ ID NO: 1120396 - protein, 9 aa, Homo Sapiens
VTLVTAPQD

SEQ ID NO: 1120397 - protein, 9 aa, Homo Sapiens
QGITPHGQI

SEQ ID NO: 1120398 - protein, 9 aa, Homo Sapiens
DGCGFCHEI

SEQ ID NO: 1120399 - protein, 9 aa, Homo Sapiens
IPRCVAGAS

SEQ ID NO: 1120400 - protein, 9 aa, Homo Sapiens
QITVTGTPA

SEQ ID NO: 1120401 - protein, 9 aa, Homo Sapiens
SALHDDMDQ

SEQ ID NO: 1120402 - protein, 9 aa, Homo Sapiens
RSPELEILC

SEQ ID NO: 1120403 - protein, 9 aa, Homo Sapiens
VCGNQSIRY

SEQ ID NO: 1120404 - protein, 9 aa, Homo Sapiens
WSYSKQNRE

SEQ ID NO: 1120405 - protein, 9 aa, Homo Sapiens
GRSHWSPLT

SEQ ID NO: 1120406 - protein, 9 aa, Homo Sapiens
TSSPTARAT

SEQ ID NO: 1120407 - protein, 9 aa, Homo Sapiens
LSFNIECAG

SEQ ID NO: 1120408 - protein, 9 aa, Homo Sapiens
EEEGEGERL

SEQ ID NO: 1120409 - protein, 9 aa, Homo Sapiens
SSWAESPEK

SEQ ID NO: 1120410 - protein, 9 aa, Homo Sapiens
MNSTSDDDS

SEQ ID NO: 1120411 - protein, 9 aa, Homo Sapiens
EQVHQKLLQ

SEQ ID NO: 1120412 - protein, 9 aa, Homo Sapiens
AASPPAAGR

SEQ ID NO: 1120413 - protein, 9 aa, Homo Sapiens
FLERNACLL

SEQ ID NO: 1120414 - protein, 9 aa, Homo Sapiens
HLQEALAAK

SEQ ID NO: 1120415 - protein, 9 aa, Homo Sapiens
QQEDTPGCR

SEQ ID NO: 1120416 - protein, 9 aa, Homo Sapiens
RRLGSEVGR

SEQ ID NO: 1120417 - protein, 9 aa, Homo Sapiens
MTRSELKQM

SEQ ID NO: 1120418 - protein, 9 aa, Homo Sapiens
TRTSLPPTG

SEQ ID NO: 1120419 - protein, 9 aa, Homo Sapiens
GGGPSWRTR

SEQ ID NO: 1120420 - protein, 9 aa, Homo Sapiens
RARRARWDL

SEQ ID NO: 1120421 - protein, 9 aa, Homo Sapiens
TRLHRLITA

SEQ ID NO: 1120422 - protein, 9 aa, Homo Sapiens
QKSIVGHSP

SEQ ID NO: 1120423 - protein, 9 aa, Homo Sapiens
NSNRYSIDR

SEQ ID NO: 1120424 - protein, 9 aa, Homo Sapiens
GQKANELYE

SEQ ID NO: 1120425 - protein, 9 aa, Homo Sapiens
MIRFQYRIL

SEQ ID NO: 1120426 - protein, 9 aa, Homo Sapiens
HCYHLYHGL

SEQ ID NO: 1120427 - protein, 9 aa, Homo Sapiens
VSSLALESK

SEQ ID NO: 1120428 - protein, 9 aa, Homo Sapiens
WRTTPRPRV

SEQ ID NO: 1120429 - protein, 9 aa, Homo Sapiens
RVFYVTSFP

SEQ ID NO: 1120430 - protein, 9 aa, Homo Sapiens
TFPFHIMFD

SEQ ID NO: 1120431 - protein, 9 aa, Homo Sapiens
VNKTKSEKL

SEQ ID NO: 1120432 - protein, 9 aa, Homo Sapiens
RYDGPQQAL

SEQ ID NO: 1120433 - protein, 9 aa, Homo Sapiens
AGGPLPPRR

SEQ ID NO: 1120434 - protein, 9 aa, Homo Sapiens
ELCLREFPC

SEQ ID NO: 1120435 - protein, 9 aa, Homo Sapiens
TMDSETVKM

SEQ ID NO: 1120436 - protein, 9 aa, Homo Sapiens
PGYTQPSDI

SEQ ID NO: 1120437 - protein, 9 aa, Homo Sapiens
PERCQHYSV

SEQ ID NO: 1120438 - protein, 9 aa, Homo Sapiens
TNVYIDPLK

SEQ ID NO: 1120439 - protein, 9 aa, Homo Sapiens
KSAKNLLTS

SEQ ID NO: 1120440 - protein, 9 aa, Homo Sapiens
VIKLDCTDM

SEQ ID NO: 1120441 - protein, 9 aa, Homo Sapiens
LPTLLHRAT

SEQ ID NO: 1120442 - protein, 9 aa, Homo Sapiens
PYTVCDLAP

SEQ ID NO: 1120443 - protein, 9 aa, Homo Sapiens
QGSTETIEE

SEQ ID NO: 1120444 - protein, 9 aa, Homo Sapiens
KILRSFMKL

SEQ ID NO: 1120445 - protein, 9 aa, Homo Sapiens
TGKSTSTSC

SEQ ID NO: 1120446 - protein, 9 aa, Homo Sapiens
LWWFWSLCC

SEQ ID NO: 1120447 - protein, 9 aa, Homo Sapiens
PIPPDAQTP

SEQ ID NO: 1120448 - protein, 9 aa, Homo Sapiens
RRCGSRRRS

SEQ ID NO: 1120449 - protein, 9 aa, Homo Sapiens
ERLLLQERL

SEQ ID NO: 1120450 - protein, 9 aa, Homo Sapiens
ITRNSYECE

SEQ ID NO: 1120451 - protein, 9 aa, Homo Sapiens
QWYICGFSL

SEQ ID NO: 1120452 - protein, 9 aa, Homo Sapiens
TAYTKLVLD

SEQ ID NO: 1120453 - protein, 9 aa, Homo Sapiens
CCSDFSNKK

SEQ ID NO: 1120454 - protein, 9 aa, Homo Sapiens
FRPAGGVVL

SEQ ID NO: 1120455 - protein, 9 aa, Homo Sapiens
KGPKGGEGA

SEQ ID NO: 1120456 - protein, 9 aa, Homo Sapiens
SHSSSLTRH

SEQ ID NO: 1120457 - protein, 9 aa, Homo Sapiens
SEKLHFSVD

SEQ ID NO: 1120458 - protein, 9 aa, Homo Sapiens
LCHHEKIFH

SEQ ID NO: 1120459 - protein, 9 aa, Homo Sapiens
VLKKILRSF

SEQ ID NO: 1120460 - protein, 9 aa, Homo Sapiens
AARGGENLI

SEQ ID NO: 1120461 - protein, 9 aa, Homo Sapiens
LSEEKSCLS

SEQ ID NO: 1120462 - protein, 9 aa, Homo Sapiens
FQKKGPRKR

SEQ ID NO: 1120463 - protein, 9 aa, Homo Sapiens
RRTNGASQT

SEQ ID NO: 1120464 - protein, 9 aa, Homo Sapiens
VVKDPDMKH

SEQ ID NO: 1120465 - protein, 9 aa, Homo Sapiens
RMASTSGSP

SEQ ID NO: 1120466 - protein, 9 aa, Homo Sapiens
LPAPRPTHP

SEQ ID NO: 1120467 - protein, 9 aa, Homo Sapiens
GYVLRRILH

SEQ ID NO: 1120468 - protein, 9 aa, Homo Sapiens
SQPSMTSPF

SEQ ID NO: 1120469 - protein, 9 aa, Homo Sapiens
LKDVEASLQ

SEQ ID NO: 1120470 - protein, 9 aa, Homo Sapiens
RCRLFEYDQ

SEQ ID NO: 1120471 - protein, 9 aa, Homo Sapiens
GNDTVQIPC

SEQ ID NO: 1120472 - protein, 9 aa, Homo Sapiens
RLQAGDAPQ

SEQ ID NO: 1120473 - protein, 9 aa, Homo Sapiens
LEVEAGPAG

SEQ ID NO: 1120474 - protein, 9 aa, Homo Sapiens
PVKFPSLSR

SEQ ID NO: 1120475 - protein, 9 aa, Homo Sapiens
EAFFMNLTR

SEQ ID NO: 1120476 - protein, 9 aa, Homo Sapiens
VEEVPEQQV

SEQ ID NO: 1120477 - protein, 9 aa, Homo Sapiens
CDAPHSFFP

SEQ ID NO: 1120478 - protein, 9 aa, Homo Sapiens
GQRDDLIVS

SEQ ID NO: 1120479 - protein, 9 aa, Homo Sapiens
VIERRGPDL

SEQ ID NO: 1120480 - protein, 9 aa, Homo Sapiens
SLPVPLPPS

SEQ ID NO: 1120481 - protein, 9 aa, Homo Sapiens
FDSIHRGAE

SEQ ID NO: 1120482 - protein, 9 aa, Homo Sapiens
NASCPAGAG

SEQ ID NO: 1120483 - protein, 9 aa, Homo Sapiens
RLCRGKMAT

SEQ ID NO: 1120484 - protein, 9 aa, Homo Sapiens
GANHSQDDH

SEQ ID NO: 1120485 - protein, 9 aa, Homo Sapiens
MLPPKPEKS

SEQ ID NO: 1120486 - protein, 9 aa, Homo Sapiens
VRKYPLLFN

SEQ ID NO: 1120487 - protein, 9 aa, Homo Sapiens
PVLSTPRDA

SEQ ID NO: 1120488 - protein, 9 aa, Homo Sapiens
TIDLLDWCT

SEQ ID NO: 1120489 - protein, 9 aa, Homo Sapiens
LNKVPVRSS

SEQ ID NO: 1120490 - protein, 9 aa, Homo Sapiens
ILLPKELVQ

SEQ ID NO: 1120491 - protein, 9 aa, Homo Sapiens
TPRPATGKS

SEQ ID NO: 1120492 - protein, 9 aa, Homo Sapiens
CWRGCCSAS

SEQ ID NO: 1120493 - protein, 9 aa, Homo Sapiens
VTLQLGPED

SEQ ID NO: 1120494 - protein, 9 aa, Homo Sapiens
GWWALQASW

SEQ ID NO: 1120495 - protein, 9 aa, Homo Sapiens
SATAGACSK

SEQ ID NO: 1120496 - protein, 9 aa, Homo Sapiens
PRSPLRSER

SEQ ID NO: 1120497 - protein, 9 aa, Homo Sapiens
RSDLLGIHW

SEQ ID NO: 1120498 - protein, 9 aa, Homo Sapiens
RCHIHACQA

SEQ ID NO: 1120499 - protein, 9 aa, Homo Sapiens
SRSIVSLCP

SEQ ID NO: 1120500 - protein, 9 aa, Homo Sapiens
PPCPVHRPA

SEQ ID NO: 1120501 - protein, 9 aa, Homo Sapiens
QVIKLDCTD

SEQ ID NO: 1120502 - protein, 9 aa, Homo Sapiens
DLFRHQRTH

SEQ ID NO: 1120503 - protein, 9 aa, Homo Sapiens
IRLTDGTDP

SEQ ID NO: 1120504 - protein, 9 aa, Homo Sapiens
CRALPGWIY

SEQ ID NO: 1120505 - protein, 9 aa, Homo Sapiens
AQAFFHNQL

SEQ ID NO: 1120506 - protein, 9 aa, Homo Sapiens
FGTSITSVT

SEQ ID NO: 1120507 - protein, 9 aa, Homo Sapiens
WEQVGVYEE

SEQ ID NO: 1120508 - protein, 9 aa, Homo Sapiens
PRTSHISAL

SEQ ID NO: 1120509 - protein, 9 aa, Homo Sapiens
ETRAHCNSS

SEQ ID NO: 1120510 - protein, 9 aa, Homo Sapiens
DNKKTHPCT

SEQ ID NO: 1120511 - protein, 9 aa, Homo Sapiens
DKGSSLEPQ

SEQ ID NO: 1120512 - protein, 9 aa, Homo Sapiens
QACQVGLLP

SEQ ID NO: 1120513 - protein, 9 aa, Homo Sapiens
HPCTMLLPQ

SEQ ID NO: 1120514 - protein, 9 aa, Homo Sapiens
RTRTLKITT

SEQ ID NO: 1120515 - protein, 9 aa, Homo Sapiens
EAPLAAPRS

SEQ ID NO: 1120516 - protein, 9 aa, Homo Sapiens
GLSKDAYSE

SEQ ID NO: 1120517 - protein, 9 aa, Homo Sapiens
NYIKIRDIP

SEQ ID NO: 1120518 - protein, 9 aa, Homo Sapiens
RWLCRKLRA

SEQ ID NO: 1120519 - protein, 9 aa, Homo Sapiens
PQMYTYPVS

SEQ ID NO: 1120520 - protein, 9 aa, Homo Sapiens
LKKKQEPPC

SEQ ID NO: 1120521 - protein, 9 aa, Homo Sapiens
QGVSSCPSP

SEQ ID NO: 1120522 - protein, 9 aa, Homo Sapiens
VQKVSVKSL

SEQ ID NO: 1120523 - protein, 9 aa, Homo Sapiens
HLVVGRVVE

SEQ ID NO: 1120524 - protein, 9 aa, Homo Sapiens
TDIQIVQKE

SEQ ID NO: 1120525 - protein, 9 aa, Homo Sapiens
IFDGSALTA

SEQ ID NO: 1120526 - protein, 9 aa, Homo Sapiens
GSDPQHNFK

SEQ ID NO: 1120527 - protein, 9 aa, Homo Sapiens
SARHFHTFR

SEQ ID NO: 1120528 - protein, 9 aa, Homo Sapiens
TREEFITAV

SEQ ID NO: 1120529 - protein, 9 aa, Homo Sapiens
SMDDMFLSA

SEQ ID NO: 1120530 - protein, 9 aa, Homo Sapiens
STREYVMCR

SEQ ID NO: 1120531 - protein, 9 aa, Homo Sapiens
EVYCHMRKE

SEQ ID NO: 1120532 - protein, 9 aa, Homo Sapiens
PLGNAHACS

SEQ ID NO: 1120533 - protein, 9 aa, Homo Sapiens
PLKTEQGGL

SEQ ID NO: 1120534 - protein, 9 aa, Homo Sapiens
EEGEGERLV

SEQ ID NO: 1120535 - protein, 9 aa, Homo Sapiens
TENALFLWL

SEQ ID NO: 1120536 - protein, 9 aa, Homo Sapiens
LPLEETSPH

SEQ ID NO: 1120537 - protein, 9 aa, Homo Sapiens
NNAIPQSPR

SEQ ID NO: 1120538 - protein, 9 aa, Homo Sapiens
GPPFPLLQI

SEQ ID NO: 1120539 - protein, 9 aa, Homo Sapiens
PLVFSFIWP

SEQ ID NO: 1120540 - protein, 9 aa, Homo Sapiens
KHLRTTITP

SEQ ID NO: 1120541 - protein, 9 aa, Homo Sapiens
GWPVKAPTS

SEQ ID NO: 1120542 - protein, 9 aa, Homo Sapiens
VIGAFTLLL

SEQ ID NO: 1120543 - protein, 9 aa, Homo Sapiens
WWRRQHLPW

SEQ ID NO: 1120544 - protein, 9 aa, Homo Sapiens
QEVAEAPPG

SEQ ID NO: 1120545 - protein, 9 aa, Homo Sapiens
CSGWGRWTP

SEQ ID NO: 1120546 - protein, 9 aa, Homo Sapiens
MVGGLTAGA

SEQ ID NO: 1120547 - protein, 9 aa, Homo Sapiens
SVMSGRSPL

SEQ ID NO: 1120548 - protein, 9 aa, Homo Sapiens
KHGLSDIKV

SEQ ID NO: 1120549 - protein, 9 aa, Homo Sapiens
LERIPIPVI

SEQ ID NO: 1120550 - protein, 9 aa, Homo Sapiens
IWQVFLKMI

SEQ ID NO: 1120551 - protein, 9 aa, Homo Sapiens
PENQVSVGL

SEQ ID NO: 1120552 - protein, 9 aa, Homo Sapiens
IAEIKLPKK

SEQ ID NO: 1120553 - protein, 9 aa, Homo Sapiens
ASLLPKEDP

SEQ ID NO: 1120554 - protein, 9 aa, Homo Sapiens
GGAAGGGSP

SEQ ID NO: 1120555 - protein, 9 aa, Homo Sapiens
PPGTGVCGW

SEQ ID NO: 1120556 - protein, 9 aa, Homo Sapiens
MYMLHLESW

SEQ ID NO: 1120557 - protein, 9 aa, Homo Sapiens
DFHNMEALL

SEQ ID NO: 1120558 - protein, 9 aa, Homo Sapiens
APAGPAHQP

SEQ ID NO: 1120559 - protein, 9 aa, Homo Sapiens
GTGPAHPTR

SEQ ID NO: 1120560 - protein, 9 aa, Homo Sapiens
LSSGTSPTW

SEQ ID NO: 1120561 - protein, 9 aa, Homo Sapiens
TPDMSFFKM

SEQ ID NO: 1120562 - protein, 9 aa, Homo Sapiens
IEGSSWLPE

SEQ ID NO: 1120563 - protein, 9 aa, Homo Sapiens
RFFERVTSG

SEQ ID NO: 1120564 - protein, 9 aa, Homo Sapiens
YPCLAPVKW

SEQ ID NO: 1120565 - protein, 9 aa, Homo Sapiens
SFEAAPRRR

SEQ ID NO: 1120566 - protein, 9 aa, Homo Sapiens
PMKTVVWGS

SEQ ID NO: 1120567 - protein, 9 aa, Homo Sapiens
HLDMRPFKS

SEQ ID NO: 1120568 - protein, 9 aa, Homo Sapiens
ARGPGGAAG

SEQ ID NO: 1120569 - protein, 9 aa, Homo Sapiens
VLFSQAQVS

SEQ ID NO: 1120570 - protein, 9 aa, Homo Sapiens
PLRVPEGAI

SEQ ID NO: 1120571 - protein, 9 aa, Homo Sapiens
NVYSRDSNY

SEQ ID NO: 1120572 - protein, 9 aa, Homo Sapiens
KELSVSPSL

SEQ ID NO: 1120573 - protein, 9 aa, Homo Sapiens
NEMLKKVVR

SEQ ID NO: 1120574 - protein, 9 aa, Homo Sapiens
YTHMVCRTT

SEQ ID NO: 1120575 - protein, 9 aa, Homo Sapiens
YVLGDPAIH

SEQ ID NO: 1120576 - protein, 9 aa, Homo Sapiens
LTLPISQQK

SEQ ID NO: 1120577 - protein, 9 aa, Homo Sapiens
VQLPEPSCR

SEQ ID NO: 1120578 - protein, 9 aa, Homo Sapiens
VYLTIAICA

SEQ ID NO: 1120579 - protein, 9 aa, Homo Sapiens
ESKPFPRYG

SEQ ID NO: 1120580 - protein, 9 aa, Homo Sapiens
PFPCPPACN

SEQ ID NO: 1120581 - protein, 9 aa, Homo Sapiens
KAFSACGFY

SEQ ID NO: 1120582 - protein, 9 aa, Homo Sapiens
RCPPRSRKP

SEQ ID NO: 1120583 - protein, 9 aa, Homo Sapiens
LTDRAFQGA

SEQ ID NO: 1120584 - protein, 9 aa, Homo Sapiens
IGQLETVCF

SEQ ID NO: 1120585 - protein, 9 aa, Homo Sapiens
RSQNWPPLE

SEQ ID NO: 1120586 - protein, 9 aa, Homo Sapiens
MEIAKKGLV

SEQ ID NO: 1120587 - protein, 9 aa, Homo Sapiens
TRRRRPSCT

SEQ ID NO: 1120588 - protein, 9 aa, Homo Sapiens
QCLGYVIDN

SEQ ID NO: 1120589 - protein, 9 aa, Homo Sapiens
YSLSVISCF

SEQ ID NO: 1120590 - protein, 9 aa, Homo Sapiens
LMKGSRQRT

SEQ ID NO: 1120591 - protein, 9 aa, Homo Sapiens
PMAVLGYEW

SEQ ID NO: 1120592 - protein, 9 aa, Homo Sapiens
PGKVHKYIV

SEQ ID NO: 1120593 - protein, 9 aa, Homo Sapiens
WAITVPIDY

SEQ ID NO: 1120594 - protein, 9 aa, Homo Sapiens
LPPSKITLL

SEQ ID NO: 1120595 - protein, 9 aa, Homo Sapiens
VLEAGSFPT

SEQ ID NO: 1120596 - protein, 9 aa, Homo Sapiens
EVSFFIANT

SEQ ID NO: 1120597 - protein, 9 aa, Homo Sapiens
ATLFQTMSQ

SEQ ID NO: 1120598 - protein, 9 aa, Homo Sapiens
FEVGEDEEQ

SEQ ID NO: 1120599 - protein, 9 aa, Homo Sapiens
QPPVVLQGL

SEQ ID NO: 1120600 - protein, 9 aa, Homo Sapiens
CTNQEIRAK

SEQ ID NO: 1120601 - protein, 9 aa, Homo Sapiens
GERLVEEAL

SEQ ID NO: 1120602 - protein, 9 aa, Homo Sapiens
ARPEVSIFQ

SEQ ID NO: 1120603 - protein, 9 aa, Homo Sapiens
LSAPPHAEV

SEQ ID NO: 1120604 - protein, 9 aa, Homo Sapiens
SDQPYQREA

SEQ ID NO: 1120605 - protein, 9 aa, Homo Sapiens
TQPSDISSV

SEQ ID NO: 1120606 - protein, 9 aa, Homo Sapiens
NNITSVLGR

SEQ ID NO: 1120607 - protein, 9 aa, Homo Sapiens
TLPISQQKP

SEQ ID NO: 1120608 - protein, 9 aa, Homo Sapiens
HNMTNSSMN

SEQ ID NO: 1120609 - protein, 9 aa, Homo Sapiens
PPKGAGRAR

SEQ ID NO: 1120610 - protein, 9 aa, Homo Sapiens
GELVPHWQD

SEQ ID NO: 1120611 - protein, 9 aa, Homo Sapiens
GVVILPLLG

SEQ ID NO: 1120612 - protein, 9 aa, Homo Sapiens
KVVTVRSRS

SEQ ID NO: 1120613 - protein, 9 aa, Homo Sapiens
DALCPTRKE

SEQ ID NO: 1120614 - protein, 9 aa, Homo Sapiens
ILTLLGPLQ

SEQ ID NO: 1120615 - protein, 9 aa, Homo Sapiens
ASIWLSYTI

SEQ ID NO: 1120616 - protein, 9 aa, Homo Sapiens
RVSQGYHQR

SEQ ID NO: 1120617 - protein, 9 aa, Homo Sapiens
NSEGKILVR

SEQ ID NO: 1120618 - protein, 9 aa, Homo Sapiens
QRPPLRAGL

SEQ ID NO: 1120619 - protein, 9 aa, Homo Sapiens
KSYLWERYR

SEQ ID NO: 1120620 - protein, 9 aa, Homo Sapiens
SINKNLVLQ

SEQ ID NO: 1120621 - protein, 9 aa, Homo Sapiens
NTRSSVETL

SEQ ID NO: 1120622 - protein, 9 aa, Homo Sapiens
TLYGLPRPG

SEQ ID NO: 1120623 - protein, 9 aa, Homo Sapiens
AIIVEDEDE

SEQ ID NO: 1120624 - protein, 9 aa, Homo Sapiens
PVFALELGC

SEQ ID NO: 1120625 - protein, 9 aa, Homo Sapiens
ISPSQTLIC

SEQ ID NO: 1120626 - protein, 9 aa, Homo Sapiens
LCYEGEADL

SEQ ID NO: 1120627 - protein, 9 aa, Homo Sapiens
PTRCVWQQP

SEQ ID NO: 1120628 - protein, 9 aa, Homo Sapiens
SDDHHGLVF

SEQ ID NO: 1120629 - protein, 9 aa, Homo Sapiens
SVSTGDITP

SEQ ID NO: 1120630 - protein, 9 aa, Homo Sapiens
TRYCHGCGV

SEQ ID NO: 1120631 - protein, 9 aa, Homo Sapiens
SDRVAKTGV

SEQ ID NO: 1120632 - protein, 9 aa, Homo Sapiens
VPGCFLQDF

SEQ ID NO: 1120633 - protein, 9 aa, Homo Sapiens
DMELTLTKV

SEQ ID NO: 1120634 - protein, 9 aa, Homo Sapiens
SVGIDAHTE

SEQ ID NO: 1120635 - protein, 9 aa, Homo Sapiens
HEINGVAKS

SEQ ID NO: 1120636 - protein, 9 aa, Homo Sapiens
FSFLEKIIL

SEQ ID NO: 1120637 - protein, 9 aa, Homo Sapiens
ARGRMLIRT

SEQ ID NO: 1120638 - protein, 9 aa, Homo Sapiens
WAFICELRP

SEQ ID NO: 1120639 - protein, 9 aa, Homo Sapiens
GPSPQGQHK

SEQ ID NO: 1120640 - protein, 9 aa, Homo Sapiens
EIFLFTAMA

SEQ ID NO: 1120641 - protein, 9 aa, Homo Sapiens
ALGAILYKT

SEQ ID NO: 1120642 - protein, 9 aa, Homo Sapiens
VCWKTITDY

SEQ ID NO: 1120643 - protein, 9 aa, Homo Sapiens
GDPAIHQSL

SEQ ID NO: 1120644 - protein, 9 aa, Homo Sapiens
AAVNCLTTV

SEQ ID NO: 1120645 - protein, 9 aa, Homo Sapiens
DTFLRHPRW

SEQ ID NO: 1120646 - protein, 9 aa, Homo Sapiens
MCLRLRTKL

SEQ ID NO: 1120647 - protein, 9 aa, Homo Sapiens
QTKEGHIKA

SEQ ID NO: 1120648 - protein, 9 aa, Homo Sapiens
VNGTHVNVP

SEQ ID NO: 1120649 - protein, 9 aa, Homo Sapiens
YLHSCDPPS

SEQ ID NO: 1120650 - protein, 9 aa, Homo Sapiens
GWPANRDTP

SEQ ID NO: 1120651 - protein, 9 aa, Homo Sapiens
QDLLHKMAR

SEQ ID NO: 1120652 - protein, 9 aa, Homo Sapiens
TTAAAGGGG

SEQ ID NO: 1120653 - protein, 9 aa, Homo Sapiens
GAPRSQGAP

SEQ ID NO: 1120654 - protein, 9 aa, Homo Sapiens
RRLGNDGSM

SEQ ID NO: 1120655 - protein, 9 aa, Homo Sapiens
VGGQVAVGL

SEQ ID NO: 1120656 - protein, 9 aa, Homo Sapiens
KTGVAFKAE

SEQ ID NO: 1120657 - protein, 9 aa, Homo Sapiens
MYPSPAALG

SEQ ID NO: 1120658 - protein, 9 aa, Homo Sapiens
KFSSSQVPV

SEQ ID NO: 1120659 - protein, 9 aa, Homo Sapiens
PKYVKIFIS

SEQ ID NO: 1120660 - protein, 9 aa, Homo Sapiens
PAQTPTLVP

SEQ ID NO: 1120661 - protein, 9 aa, Homo Sapiens
VQKQSPSWR

SEQ ID NO: 1120662 - protein, 9 aa, Homo Sapiens
HAGKGLMHH

SEQ ID NO: 1120663 - protein, 9 aa, Homo Sapiens
RCNIIPVLS

SEQ ID NO: 1120664 - protein, 9 aa, Homo Sapiens
STTSSQMWW

SEQ ID NO: 1120665 - protein, 9 aa, Homo Sapiens
GQHKMDRKA

SEQ ID NO: 1120666 - protein, 9 aa, Homo Sapiens
GDPPLLPPP

SEQ ID NO: 1120667 - protein, 9 aa, Homo Sapiens
AGTLPAPSS

SEQ ID NO: 1120668 - protein, 9 aa, Homo Sapiens
PWAGPRAPP

SEQ ID NO: 1120669 - protein, 9 aa, Homo Sapiens
RHRVVQSTL

SEQ ID NO: 1120670 - protein, 9 aa, Homo Sapiens
QSDPILGSP

SEQ ID NO: 1120671 - protein, 9 aa, Homo Sapiens
LRLRPPWCA

SEQ ID NO: 1120672 - protein, 9 aa, Homo Sapiens
PTARIPRPN

SEQ ID NO: 1120673 - protein, 9 aa, Homo Sapiens
WLTQTRKTY

SEQ ID NO: 1120674 - protein, 9 aa, Homo Sapiens
GWSCPWAGP

SEQ ID NO: 1120675 - protein, 9 aa, Homo Sapiens
MLSQNDVKR

SEQ ID NO: 1120676 - protein, 9 aa, Homo Sapiens
LCPVLGPQP

SEQ ID NO: 1120677 - protein, 9 aa, Homo Sapiens
RESQFLMAE

SEQ ID NO: 1120678 - protein, 9 aa, Homo Sapiens
QRRCTLKNR

SEQ ID NO: 1120679 - protein, 9 aa, Homo Sapiens
SAAASELEP

SEQ ID NO: 1120680 - protein, 9 aa, Homo Sapiens
QEISKVMAS

SEQ ID NO: 1120681 - protein, 9 aa, Homo Sapiens
SVWSPLQLL

SEQ ID NO: 1120682 - protein, 9 aa, Homo Sapiens
EEKKKQLSH

SEQ ID NO: 1120683 - protein, 9 aa, Homo Sapiens
WRPPSPSVS

SEQ ID NO: 1120684 - protein, 9 aa, Homo Sapiens
IGKKFQNRI

SEQ ID NO: 1120685 - protein, 9 aa, Homo Sapiens
IHRHKISFS

SEQ ID NO: 1120686 - protein, 9 aa, Homo Sapiens
MLKATLIPG

SEQ ID NO: 1120687 - protein, 9 aa, Homo Sapiens
RAPRTPRAS

SEQ ID NO: 1120688 - protein, 9 aa, Homo Sapiens
PRTPRASRA

SEQ ID NO: 1120689 - protein, 9 aa, Homo Sapiens
PAAHHLPPA

SEQ ID NO: 1120690 - protein, 9 aa, Homo Sapiens
VHEKLGSDL

SEQ ID NO: 1120691 - protein, 9 aa, Homo Sapiens
RASGPTPVP

SEQ ID NO: 1120692 - protein, 9 aa, Homo Sapiens
GSKFPAHRS

SEQ ID NO: 1120693 - protein, 9 aa, Homo Sapiens
CVSRGAISR

SEQ ID NO: 1120694 - protein, 9 aa, Homo Sapiens
GPSCVPTAA

SEQ ID NO: 1120695 - protein, 9 aa, Homo Sapiens
AKTWVKKLQ

SEQ ID NO: 1120696 - protein, 9 aa, Homo Sapiens
DVIKNQQPA

SEQ ID NO: 1120697 - protein, 9 aa, Homo Sapiens
FFDYSLMNS

SEQ ID NO: 1120698 - protein, 9 aa, Homo Sapiens
QKDQLEYHI

SEQ ID NO: 1120699 - protein, 9 aa, Homo Sapiens
HTWYTETHA

SEQ ID NO: 1120700 - protein, 9 aa, Homo Sapiens
CRCTACPPC

SEQ ID NO: 1120701 - protein, 9 aa, Homo Sapiens
LYFRGLKHP

SEQ ID NO: 1120702 - protein, 9 aa, Homo Sapiens
ASRTASTRS

SEQ ID NO: 1120703 - protein, 9 aa, Homo Sapiens
MGRPPPQPA

SEQ ID NO: 1120704 - protein, 9 aa, Homo Sapiens
PVVEPPPSS

SEQ ID NO: 1120705 - protein, 9 aa, Homo Sapiens
SYLWERYRE

SEQ ID NO: 1120706 - protein, 9 aa, Homo Sapiens
FLQDFEKSK

SEQ ID NO: 1120707 - protein, 9 aa, Homo Sapiens
ASTQFSTSL

SEQ ID NO: 1120708 - protein, 9 aa, Homo Sapiens
TVVGLTMVY

SEQ ID NO: 1120709 - protein, 9 aa, Homo Sapiens
IEYSEPWMG

SEQ ID NO: 1120710 - protein, 9 aa, Homo Sapiens
FQPGRMHRI

SEQ ID NO: 1120711 - protein, 9 aa, Homo Sapiens
QPRNQTLDG

SEQ ID NO: 1120712 - protein, 9 aa, Homo Sapiens
FILERIPIP

SEQ ID NO: 1120713 - protein, 9 aa, Homo Sapiens
AAHTYVSED

SEQ ID NO: 1120714 - protein, 9 aa, Homo Sapiens
ALLLFVGLT

SEQ ID NO: 1120715 - protein, 9 aa, Homo Sapiens
SGPRGVLSL

SEQ ID NO: 1120716 - protein, 9 aa, Homo Sapiens
TWCRTGAST

SEQ ID NO: 1120717 - protein, 9 aa, Homo Sapiens
TRTSAPRIT

SEQ ID NO: 1120718 - protein, 9 aa, Homo Sapiens
PAAVHGLCH

SEQ ID NO: 1120719 - protein, 9 aa, Homo Sapiens
TVSALHDDM

SEQ ID NO: 1120720 - protein, 9 aa, Homo Sapiens
TTPPTPHLA

SEQ ID NO: 1120721 - protein, 9 aa, Homo Sapiens
IGGGVAGLA

SEQ ID NO: 1120722 - protein, 9 aa, Homo Sapiens
TISCVTQST

SEQ ID NO: 1120723 - protein, 9 aa, Homo Sapiens
SAEGAGQRE

SEQ ID NO: 1120724 - protein, 9 aa, Homo Sapiens
YGRTAGQLL

SEQ ID NO: 1120725 - protein, 9 aa, Homo Sapiens
GTLHTTLAR

SEQ ID NO: 1120726 - protein, 9 aa, Homo Sapiens
CCRTGSWWP

SEQ ID NO: 1120727 - protein, 9 aa, Homo Sapiens
DMYSSVADQ

SEQ ID NO: 1120728 - protein, 9 aa, Homo Sapiens
GSGGGSTRD

SEQ ID NO: 1120729 - protein, 9 aa, Homo Sapiens
TTCPGPSWH

SEQ ID NO: 1120730 - protein, 9 aa, Homo Sapiens
ASWRSPTAS

SEQ ID NO: 1120731 - protein, 9 aa, Homo Sapiens
VSQRKQYEE

SEQ ID NO: 1120732 - protein, 9 aa, Homo Sapiens
RYNQTELGS

SEQ ID NO: 1120733 - protein, 9 aa, Homo Sapiens
ILLFLALLT

SEQ ID NO: 1120734 - protein, 9 aa, Homo Sapiens
KCCQCQEQE

SEQ ID NO: 1120735 - protein, 9 aa, Homo Sapiens
PTESPTTRR

SEQ ID NO: 1120736 - protein, 9 aa, Homo Sapiens
CLHDESLPP

SEQ ID NO: 1120737 - protein, 9 aa, Homo Sapiens
AFFQKSGAS

SEQ ID NO: 1120738 - protein, 9 aa, Homo Sapiens
PWLPLQIEV

SEQ ID NO: 1120739 - protein, 9 aa, Homo Sapiens
ETLALVGGE

SEQ ID NO: 1120740 - protein, 9 aa, Homo Sapiens
DFEESGEFK

SEQ ID NO: 1120741 - protein, 9 aa, Homo Sapiens
MAAASLAYS

SEQ ID NO: 1120742 - protein, 9 aa, Homo Sapiens
GNLADECDD

SEQ ID NO: 1120743 - protein, 9 aa, Homo Sapiens
QQSNAGVAQ

SEQ ID NO: 1120744 - protein, 9 aa, Homo Sapiens
QDTIRGHLG

SEQ ID NO: 1120745 - protein, 9 aa, Homo Sapiens
SRSWTGTLS

SEQ ID NO: 1120746 - protein, 9 aa, Homo Sapiens
TRLAVSTRG

SEQ ID NO: 1120747 - protein, 9 aa, Homo Sapiens
FFRREDRGC

SEQ ID NO: 1120748 - protein, 9 aa, Homo Sapiens
GPCIGEESG

SEQ ID NO: 1120749 - protein, 9 aa, Homo Sapiens
VLCHHLATG

SEQ ID NO: 1120750 - protein, 9 aa, Homo Sapiens
DGHGRLVIV

SEQ ID NO: 1120751 - protein, 9 aa, Homo Sapiens
EVEAGPAGE

SEQ ID NO: 1120752 - protein, 9 aa, Homo Sapiens
QFIPPYVLR

SEQ ID NO: 1120753 - protein, 9 aa, Homo Sapiens
WSRLSLLAP

SEQ ID NO: 1120754 - protein, 9 aa, Homo Sapiens
VHKYIVRYK

SEQ ID NO: 1120755 - protein, 9 aa, Homo Sapiens
RTTPRPRVP

SEQ ID NO: 1120756 - protein, 9 aa, Homo Sapiens
TGSWEWQRQ

SEQ ID NO: 1120757 - protein, 9 aa, Homo Sapiens
EFFDYSLMN

SEQ ID NO: 1120758 - protein, 9 aa, Homo Sapiens
LSRAAAQLT

SEQ ID NO: 1120759 - protein, 9 aa, Homo Sapiens
IERVKDCVL

SEQ ID NO: 1120760 - protein, 9 aa, Homo Sapiens
IITFPFLIA

SEQ ID NO: 1120761 - protein, 9 aa, Homo Sapiens
KFSGLQKEL

SEQ ID NO: 1120762 - protein, 9 aa, Homo Sapiens
RMSTASHSF

SEQ ID NO: 1120763 - protein, 9 aa, Homo Sapiens
KLEKALSAL

SEQ ID NO: 1120764 - protein, 9 aa, Homo Sapiens
HLLDILSEH

SEQ ID NO: 1120765 - protein, 9 aa, Homo Sapiens
GPNQHNMTN

SEQ ID NO: 1120766 - protein, 9 aa, Homo Sapiens
CCCWGFWGW

SEQ ID NO: 1120767 - protein, 9 aa, Homo Sapiens
QVTLGELRR

SEQ ID NO: 1120768 - protein, 9 aa, Homo Sapiens
GAICPLLYA

SEQ ID NO: 1120769 - protein, 9 aa, Homo Sapiens
RPWARPART

SEQ ID NO: 1120770 - protein, 9 aa, Homo Sapiens
LIVVKIESI

SEQ ID NO: 1120771 - protein, 9 aa, Homo Sapiens
GGAPGAPPP

SEQ ID NO: 1120772 - protein, 9 aa, Homo Sapiens
QMTAVTMGF

SEQ ID NO: 1120773 - protein, 9 aa, Homo Sapiens
RNASCPAGA

SEQ ID NO: 1120774 - protein, 9 aa, Homo Sapiens
AHGQDLGMA

SEQ ID NO: 1120775 - protein, 9 aa, Homo Sapiens
AMDALARRI

SEQ ID NO: 1120776 - protein, 9 aa, Homo Sapiens
VFFGTYFLF

SEQ ID NO: 1120777 - protein, 9 aa, Homo Sapiens
HCIGTLSVY

SEQ ID NO: 1120778 - protein, 9 aa, Homo Sapiens
VEKNYPQIP

SEQ ID NO: 1120779 - protein, 9 aa, Homo Sapiens
IPPYVLRFR

SEQ ID NO: 1120780 - protein, 9 aa, Homo Sapiens
SLYSVAVWP

SEQ ID NO: 1120781 - protein, 9 aa, Homo Sapiens
TNAKKILLE

SEQ ID NO: 1120782 - protein, 9 aa, Homo Sapiens
LCFQPRTRL

SEQ ID NO: 1120783 - protein, 9 aa, Homo Sapiens
PRHGRSRSS

SEQ ID NO: 1120784 - protein, 9 aa, Homo Sapiens
EQLPQHALV

SEQ ID NO: 1120785 - protein, 9 aa, Homo Sapiens
VVFLYMWSF

SEQ ID NO: 1120786 - protein, 9 aa, Homo Sapiens
SYIVDAGFG

SEQ ID NO: 1120787 - protein, 9 aa, Homo Sapiens
IKKIPRLLV

SEQ ID NO: 1120788 - protein, 9 aa, Homo Sapiens
LLPLTRPRL

SEQ ID NO: 1120789 - protein, 9 aa, Homo Sapiens
LDTLVGKGH

SEQ ID NO: 1120790 - protein, 9 aa, Homo Sapiens
AGYPNEEDM

SEQ ID NO: 1120791 - protein, 9 aa, Homo Sapiens
KATVCPAVE

SEQ ID NO: 1120792 - protein, 9 aa, Homo Sapiens
LPAAHHLPP

SEQ ID NO: 1120793 - protein, 9 aa, Homo Sapiens
LILQHITQN

SEQ ID NO: 1120794 - protein, 9 aa, Homo Sapiens
CAKPCPGTA

SEQ ID NO: 1120795 - protein, 9 aa, Homo Sapiens
TNLAALFPS

SEQ ID NO: 1120796 - protein, 9 aa, Homo Sapiens
QPLPQCPSP

SEQ ID NO: 1120797 - protein, 9 aa, Homo Sapiens
YKDSFISNN

SEQ ID NO: 1120798 - protein, 9 aa, Homo Sapiens
HISALIAAR

SEQ ID NO: 1120799 - protein, 9 aa, Homo Sapiens
IGEESGGVV

SEQ ID NO: 1120800 - protein, 9 aa, Homo Sapiens
QNIMAQEDT

SEQ ID NO: 1120801 - protein, 9 aa, Homo Sapiens
PSAKGHSHP

SEQ ID NO: 1120802 - protein, 9 aa, Homo Sapiens
GATCWCRLK

SEQ ID NO: 1120803 - protein, 9 aa, Homo Sapiens
DKARLLWQY

SEQ ID NO: 1120804 - protein, 9 aa, Homo Sapiens
SALGHTAVH

SEQ ID NO: 1120805 - protein, 9 aa, Homo Sapiens
LVFAKLYIR

SEQ ID NO: 1120806 - protein, 9 aa, Homo Sapiens
PPTPHLASG

SEQ ID NO: 1120807 - protein, 9 aa, Homo Sapiens
QQIASTTHT

SEQ ID NO: 1120808 - protein, 9 aa, Homo Sapiens
EELENSNKK

SEQ ID NO: 1120809 - protein, 9 aa, Homo Sapiens
SQLLYEFCT

SEQ ID NO: 1120810 - protein, 9 aa, Homo Sapiens
LENGTSDCS

SEQ ID NO: 1120811 - protein, 9 aa, Homo Sapiens
ARFVPCYNF

SEQ ID NO: 1120812 - protein, 9 aa, Homo Sapiens
CCAGSSTRP

SEQ ID NO: 1120813 - protein, 9 aa, Homo Sapiens
GTMRDNMLN

SEQ ID NO: 1120814 - protein, 9 aa, Homo Sapiens
ACHLIYSPQ

SEQ ID NO: 1120815 - protein, 9 aa, Homo Sapiens
RGFAEGRRR

SEQ ID NO: 1120816 - protein, 9 aa, Homo Sapiens
RAHGQDLGM

SEQ ID NO: 1120817 - protein, 9 aa, Homo Sapiens
TLEKKGSAA

SEQ ID NO: 1120818 - protein, 9 aa, Homo Sapiens
HLLSYDSLS

SEQ ID NO: 1120819 - protein, 9 aa, Homo Sapiens
SHHVTHTVQ

SEQ ID NO: 1120820 - protein, 9 aa, Homo Sapiens
NCVLVTEHP

SEQ ID NO: 1120821 - protein, 9 aa, Homo Sapiens
DIVFQLQRI

SEQ ID NO: 1120822 - protein, 9 aa, Homo Sapiens
QQVMAQSLS

SEQ ID NO: 1120823 - protein, 9 aa, Homo Sapiens
PFCIGNAKG

SEQ ID NO: 1120824 - protein, 9 aa, Homo Sapiens
SLEPQQHFN

SEQ ID NO: 1120825 - protein, 9 aa, Homo Sapiens
HLCSTGRKT

SEQ ID NO: 1120826 - protein, 9 aa, Homo Sapiens
NIVASDHRS

SEQ ID NO: 1120827 - protein, 9 aa, Homo Sapiens
GEHPEASGS

SEQ ID NO: 1120828 - protein, 9 aa, Homo Sapiens
AEKFSDLLQ

SEQ ID NO: 1120829 - protein, 9 aa, Homo Sapiens
APSPSAFAK

SEQ ID NO: 1120830 - protein, 9 aa, Homo Sapiens
QLGVQYELK

SEQ ID NO: 1120831 - protein, 9 aa, Homo Sapiens
AMCKLYTGL

SEQ ID NO: 1120832 - protein, 9 aa, Homo Sapiens
TFSATMSNQ

SEQ ID NO: 1120833 - protein, 9 aa, Homo Sapiens
GCTPYEVHF

SEQ ID NO: 1120834 - protein, 9 aa, Homo Sapiens
LPAVACRFH

SEQ ID NO: 1120835 - protein, 9 aa, Homo Sapiens
LSLRINGLP

SEQ ID NO: 1120836 - protein, 9 aa, Homo Sapiens
LGTSTSFGS

SEQ ID NO: 1120837 - protein, 9 aa, Homo Sapiens
WICGSQIVA

SEQ ID NO: 1120838 - protein, 9 aa, Homo Sapiens
CRPMERDLP

SEQ ID NO: 1120839 - protein, 9 aa, Homo Sapiens
KKPLVRSLA

SEQ ID NO: 1120840 - protein, 9 aa, Homo Sapiens
DCFIGSSDV

SEQ ID NO: 1120841 - protein, 9 aa, Homo Sapiens
VIKCDMSVL

SEQ ID NO: 1120842 - protein, 9 aa, Homo Sapiens
LEAHAHNEI

SEQ ID NO: 1120843 - protein, 9 aa, Homo Sapiens
HGCRAEGGP

SEQ ID NO: 1120844 - protein, 9 aa, Homo Sapiens
ITQNLFIIE

SEQ ID NO: 1120845 - protein, 9 aa, Homo Sapiens
DRPNGLHPN

SEQ ID NO: 1120846 - protein, 9 aa, Homo Sapiens
NSLRVCRPQ

SEQ ID NO: 1120847 - protein, 9 aa, Homo Sapiens
WKTSCTTFT

SEQ ID NO: 1120848 - protein, 9 aa, Homo Sapiens
ALEPKVTAE

SEQ ID NO: 1120849 - protein, 9 aa, Homo Sapiens
NLIWQVFLK

SEQ ID NO: 1120850 - protein, 9 aa, Homo Sapiens
TPEIRALCN

SEQ ID NO: 1120851 - protein, 9 aa, Homo Sapiens
MTAVTMGFG

SEQ ID NO: 1120852 - protein, 9 aa, Homo Sapiens
GTAEGPAAR

SEQ ID NO: 1120853 - protein, 9 aa, Homo Sapiens
FSPPKKFSI

SEQ ID NO: 1120854 - protein, 9 aa, Homo Sapiens
PQYIRKSPK

SEQ ID NO: 1120855 - protein, 9 aa, Homo Sapiens
LPGHLWKRQ

SEQ ID NO: 1120856 - protein, 9 aa, Homo Sapiens
VSTLTMESA

SEQ ID NO: 1120857 - protein, 9 aa, Homo Sapiens
SVRRAGRRP

SEQ ID NO: 1120858 - protein, 9 aa, Homo Sapiens
TMMLKDGQE

SEQ ID NO: 1120859 - protein, 9 aa, Homo Sapiens
STCTNYNTP

SEQ ID NO: 1120860 - protein, 9 aa, Homo Sapiens
GLGKQVLAG

SEQ ID NO: 1120861 - protein, 9 aa, Homo Sapiens
APPLPDRPW

SEQ ID NO: 1120862 - protein, 9 aa, Homo Sapiens
DRVYSPFRS

SEQ ID NO: 1120863 - protein, 9 aa, Homo Sapiens
EAYTTKGLC

SEQ ID NO: 1120864 - protein, 9 aa, Homo Sapiens
RGLDAISKK

SEQ ID NO: 1120865 - protein, 9 aa, Homo Sapiens
TGENPYKCE

SEQ ID NO: 1120866 - protein, 9 aa, Homo Sapiens
QNLLLWRAN

SEQ ID NO: 1120867 - protein, 9 aa, Homo Sapiens
RPATPGPGA

SEQ ID NO: 1120868 - protein, 9 aa, Homo Sapiens
RASRAPRTL

SEQ ID NO: 1120869 - protein, 9 aa, Homo Sapiens
PTGAHRPSL

SEQ ID NO: 1120870 - protein, 9 aa, Homo Sapiens
ASSRTGKLF

SEQ ID NO: 1120871 - protein, 9 aa, Homo Sapiens
TKGCNRGPD

SEQ ID NO: 1120872 - protein, 9 aa, Homo Sapiens
PPPSTAATT

SEQ ID NO: 1120873 - protein, 9 aa, Homo Sapiens
RDDGKDGGM

SEQ ID NO: 1120874 - protein, 9 aa, Homo Sapiens
ISKAVESPT

SEQ ID NO: 1120875 - protein, 9 aa, Homo Sapiens
VFQINHALL

SEQ ID NO: 1120876 - protein, 9 aa, Homo Sapiens
SSFSRSRAC

SEQ ID NO: 1120877 - protein, 9 aa, Homo Sapiens
NAHTNRNHN

SEQ ID NO: 1120878 - protein, 9 aa, Homo Sapiens
DGQRTLEKK

SEQ ID NO: 1120879 - protein, 9 aa, Homo Sapiens
LCFLSMIMY

SEQ ID NO: 1120880 - protein, 9 aa, Homo Sapiens
HLASPPPRQ

SEQ ID NO: 1120881 - protein, 9 aa, Homo Sapiens
GDEHKRSMV

SEQ ID NO: 1120882 - protein, 9 aa, Homo Sapiens
MRVREVEAV

SEQ ID NO: 1120883 - protein, 9 aa, Homo Sapiens
DSTVDQQKS

SEQ ID NO: 1120884 - protein, 9 aa, Homo Sapiens
VDTIKRPSP

SEQ ID NO: 1120885 - protein, 9 aa, Homo Sapiens
VPKRIRKAA

SEQ ID NO: 1120886 - protein, 9 aa, Homo Sapiens
KTDLCFQSS

SEQ ID NO: 1120887 - protein, 9 aa, Homo Sapiens
REELSNVLV

SEQ ID NO: 1120888 - protein, 9 aa, Homo Sapiens
REEPSSGML

SEQ ID NO: 1120889 - protein, 9 aa, Homo Sapiens
GPRHHPRLR

SEQ ID NO: 1120890 - protein, 9 aa, Homo Sapiens
TTTSRLSSR

SEQ ID NO: 1120891 - protein, 9 aa, Homo Sapiens
VAQPWPSFE

SEQ ID NO: 1120892 - protein, 9 aa, Homo Sapiens
PPDQWCPDG

SEQ ID NO: 1120893 - protein, 9 aa, Homo Sapiens
CTLQPRGWQ

SEQ ID NO: 1120894 - protein, 9 aa, Homo Sapiens
DCGGSEAKG

SEQ ID NO: 1120895 - protein, 9 aa, Homo Sapiens
GLWVWMPLT

SEQ ID NO: 1120896 - protein, 9 aa, Homo Sapiens
NGHIANRLA

SEQ ID NO: 1120897 - protein, 9 aa, Homo Sapiens
SHLSPEEKL

SEQ ID NO: 1120898 - protein, 9 aa, Homo Sapiens
FQHGELGRP

SEQ ID NO: 1120899 - protein, 9 aa, Homo Sapiens
GIPPALGPI

SEQ ID NO: 1120900 - protein, 9 aa, Homo Sapiens
DEIHRVLRY

SEQ ID NO: 1120901 - protein, 9 aa, Homo Sapiens
KKGQHIEQL

SEQ ID NO: 1120902 - protein, 9 aa, Homo Sapiens
KTTYKADQI

SEQ ID NO: 1120903 - protein, 9 aa, Homo Sapiens
LDGILRKRL

SEQ ID NO: 1120904 - protein, 9 aa, Homo Sapiens
VLHIGSTHN

SEQ ID NO: 1120905 - protein, 9 aa, Homo Sapiens
AHAFFCEER

SEQ ID NO: 1120906 - protein, 9 aa, Homo Sapiens
VDECLQDRC

SEQ ID NO: 1120907 - protein, 9 aa, Homo Sapiens
MTHRLQKAH

SEQ ID NO: 1120908 - protein, 9 aa, Homo Sapiens
SHDFSINFN

SEQ ID NO: 1120909 - protein, 9 aa, Homo Sapiens
TRLSPGPPG

SEQ ID NO: 1120910 - protein, 9 aa, Homo Sapiens
ALGHTAVHQ

SEQ ID NO: 1120911 - protein, 9 aa, Homo Sapiens
ASPRTCGAS

SEQ ID NO: 1120912 - protein, 9 aa, Homo Sapiens
VRKIGDWKV

SEQ ID NO: 1120913 - protein, 9 aa, Homo Sapiens
CGPWGAGGN

SEQ ID NO: 1120914 - protein, 9 aa, Homo Sapiens
VIMDKPQKA

SEQ ID NO: 1120915 - protein, 9 aa, Homo Sapiens
GSGFLSIAD

SEQ ID NO: 1120916 - protein, 9 aa, Homo Sapiens
RAPVSLERS

SEQ ID NO: 1120917 - protein, 9 aa, Homo Sapiens
LLIVHYSFL

SEQ ID NO: 1120918 - protein, 9 aa, Homo Sapiens
EHLRKGGNL

SEQ ID NO: 1120919 - protein, 9 aa, Homo Sapiens
EESPLLGAE

SEQ ID NO: 1120920 - protein, 9 aa, Homo Sapiens
QVLKKILRS

SEQ ID NO: 1120921 - protein, 9 aa, Homo Sapiens
KSLSKLVHA

SEQ ID NO: 1120922 - protein, 9 aa, Homo Sapiens
SILFMIVLT

SEQ ID NO: 1120923 - protein, 9 aa, Homo Sapiens
QQSAPWRSR

SEQ ID NO: 1120924 - protein, 9 aa, Homo Sapiens
SLGFSASGL

SEQ ID NO: 1120925 - protein, 9 aa, Homo Sapiens
YHPSKKCKP

SEQ ID NO: 1120926 - protein, 9 aa, Homo Sapiens
DGTYYGDNR

SEQ ID NO: 1120927 - protein, 9 aa, Homo Sapiens
NMSAGYHLG

SEQ ID NO: 1120928 - protein, 9 aa, Homo Sapiens
EAYCQHLLS

SEQ ID NO: 1120929 - protein, 9 aa, Homo Sapiens
SEASTRPIA

SEQ ID NO: 1120930 - protein, 9 aa, Homo Sapiens
TVRLRHRLP

SEQ ID NO: 1120931 - protein, 9 aa, Homo Sapiens
KRVKMVSQS

SEQ ID NO: 1120932 - protein, 9 aa, Homo Sapiens
ALHIVTELY

SEQ ID NO: 1120933 - protein, 9 aa, Homo Sapiens
QLPTSFIID

SEQ ID NO: 1120934 - protein, 9 aa, Homo Sapiens
AKKHSNPYV

SEQ ID NO: 1120935 - protein, 9 aa, Homo Sapiens
QRAGKDPPA

SEQ ID NO: 1120936 - protein, 9 aa, Homo Sapiens
KGPAQAKLL

SEQ ID NO: 1120937 - protein, 9 aa, Homo Sapiens
FGNPSLDEG

SEQ ID NO: 1120938 - protein, 9 aa, Homo Sapiens
PPTTTPALQ

SEQ ID NO: 1120939 - protein, 9 aa, Homo Sapiens
DATKGRKFY

SEQ ID NO: 1120940 - protein, 9 aa, Homo Sapiens
IQVTVTATA

SEQ ID NO: 1120941 - protein, 9 aa, Homo Sapiens
CKEKLHDMD

SEQ ID NO: 1120942 - protein, 9 aa, Homo Sapiens
RHQRIHAGE

SEQ ID NO: 1120943 - protein, 9 aa, Homo Sapiens
FYPVYSAPN

SEQ ID NO: 1120944 - protein, 9 aa, Homo Sapiens
QYIGWPANR

SEQ ID NO: 1120945 - protein, 9 aa, Homo Sapiens
YEKVVVRIQ

SEQ ID NO: 1120946 - protein, 9 aa, Homo Sapiens
AIPSVTGHP

SEQ ID NO: 1120947 - protein, 9 aa, Homo Sapiens
VAPFPATAR

SEQ ID NO: 1120948 - protein, 9 aa, Homo Sapiens
PPCEVQVLC

SEQ ID NO: 1120949 - protein, 9 aa, Homo Sapiens
RLRHRLPCR

SEQ ID NO: 1120950 - protein, 9 aa, Homo Sapiens
PPATPPPRH

SEQ ID NO: 1120951 - protein, 9 aa, Homo Sapiens
PSLHLRGQG

SEQ ID NO: 1120952 - protein, 9 aa, Homo Sapiens
VVEAGGSHV

SEQ ID NO: 1120953 - protein, 9 aa, Homo Sapiens
QAMYTRHEC

SEQ ID NO: 1120954 - protein, 9 aa, Homo Sapiens
QQRSSGHRN

SEQ ID NO: 1120955 - protein, 9 aa, Homo Sapiens
PQTPPGAVL

SEQ ID NO: 1120956 - protein, 9 aa, Homo Sapiens
HHSAWLTIL

SEQ ID NO: 1120957 - protein, 9 aa, Homo Sapiens
VFLGEQSGG

SEQ ID NO: 1120958 - protein, 9 aa, Homo Sapiens
VHNENQHLV

SEQ ID NO: 1120959 - protein, 9 aa, Homo Sapiens
NRTVQRRQA

SEQ ID NO: 1120960 - protein, 9 aa, Homo Sapiens
HIRPSHKDA

SEQ ID NO: 1120961 - protein, 9 aa, Homo Sapiens
VRRPGRHIC

SEQ ID NO: 1120962 - protein, 9 aa, Homo Sapiens
KILARHNET

SEQ ID NO: 1120963 - protein, 9 aa, Homo Sapiens
VVTATLWGK

SEQ ID NO: 1120964 - protein, 9 aa, Homo Sapiens
KTQLHLQEM

SEQ ID NO: 1120965 - protein, 9 aa, Homo Sapiens
SDGDYLNPP

SEQ ID NO: 1120966 - protein, 9 aa, Homo Sapiens
RPEAPCSTS

SEQ ID NO: 1120967 - protein, 9 aa, Homo Sapiens
LDSPPQPRA

SEQ ID NO: 1120968 - protein, 9 aa, Homo Sapiens
ASPPALQGC

SEQ ID NO: 1120969 - protein, 9 aa, Homo Sapiens
ALLEVSLRN

SEQ ID NO: 1120970 - protein, 9 aa, Homo Sapiens
ALFTSLASG

SEQ ID NO: 1120971 - protein, 9 aa, Homo Sapiens
QTLAITSWG

SEQ ID NO: 1120972 - protein, 9 aa, Homo Sapiens
VQFQYSSDS

SEQ ID NO: 1120973 - protein, 9 aa, Homo Sapiens
LLHFLLIYL

SEQ ID NO: 1120974 - protein, 9 aa, Homo Sapiens
PHISSPDEA

SEQ ID NO: 1120975 - protein, 9 aa, Homo Sapiens
TADCGGHGV

SEQ ID NO: 1120976 - protein, 9 aa, Homo Sapiens
QTHQKLKES

SEQ ID NO: 1120977 - protein, 9 aa, Homo Sapiens
ELKQMFSVF

SEQ ID NO: 1120978 - protein, 9 aa, Homo Sapiens
LPLTRPRLL

SEQ ID NO: 1120979 - protein, 9 aa, Homo Sapiens
YAESARHFH

SEQ ID NO: 1120980 - protein, 9 aa, Homo Sapiens
SCDTYKDSF

SEQ ID NO: 1120981 - protein, 9 aa, Homo Sapiens
AAQEGTCTC

SEQ ID NO: 1120982 - protein, 9 aa, Homo Sapiens
RPCTASTAT

SEQ ID NO: 1120983 - protein, 9 aa, Homo Sapiens
PRFRQCANT

SEQ ID NO: 1120984 - protein, 9 aa, Homo Sapiens
TCWCRLKTQ

SEQ ID NO: 1120985 - protein, 9 aa, Homo Sapiens
DVARLQSRA

SEQ ID NO: 1120986 - protein, 9 aa, Homo Sapiens
TTLQKMGKN

SEQ ID NO: 1120987 - protein, 9 aa, Homo Sapiens
EFAIFRKEC

SEQ ID NO: 1120988 - protein, 9 aa, Homo Sapiens
ECTSAMMQA

SEQ ID NO: 1120989 - protein, 9 aa, Homo Sapiens
IIENAPEEK

SEQ ID NO: 1120990 - protein, 9 aa, Homo Sapiens
WDTERNLRP

SEQ ID NO: 1120991 - protein, 9 aa, Homo Sapiens
PPRPTVAFL

SEQ ID NO: 1120992 - protein, 9 aa, Homo Sapiens
VLLNLRERY

SEQ ID NO: 1120993 - protein, 9 aa, Homo Sapiens
QGPGQRPAR

SEQ ID NO: 1120994 - protein, 9 aa, Homo Sapiens
GFHFAAISH

SEQ ID NO: 1120995 - protein, 9 aa, Homo Sapiens
NPRLDFHPR

SEQ ID NO: 1120996 - protein, 9 aa, Homo Sapiens
GELRAGDPW

SEQ ID NO: 1120997 - protein, 9 aa, Homo Sapiens
IGLLKVPII

SEQ ID NO: 1120998 - protein, 9 aa, Homo Sapiens
ASEGCKGFF

SEQ ID NO: 1120999 - protein, 9 aa, Homo Sapiens
WYICGFSLS

SEQ ID NO: 1121000 - protein, 9 aa, Homo Sapiens
SIWNQWLSC

SEQ ID NO: 1121001 - protein, 9 aa, Homo Sapiens
YSLPLTYSN

SEQ ID NO: 1121002 - protein, 9 aa, Homo Sapiens
CKSQARHVG

SEQ ID NO: 1121003 - protein, 9 aa, Homo Sapiens
SDVQSYSIE

SEQ ID NO: 1121004 - protein, 9 aa, Homo Sapiens
AGAPAESHL

SEQ ID NO: 1121005 - protein, 9 aa, Homo Sapiens
EGERLVEEA

SEQ ID NO: 1121006 - protein, 9 aa, Homo Sapiens
DQVLITEHS

SEQ ID NO: 1121007 - protein, 9 aa, Homo Sapiens
AMREQEERR

SEQ ID NO: 1121008 - protein, 9 aa, Homo Sapiens
DPYTKVSIG

SEQ ID NO: 1121009 - protein, 9 aa, Homo Sapiens
VSKRASRPT

SEQ ID NO: 1121010 - protein, 9 aa, Homo Sapiens
SKCGKGFPR

SEQ ID NO: 1121011 - protein, 9 aa, Homo Sapiens
RFLNMEELI

SEQ ID NO: 1121012 - protein, 9 aa, Homo Sapiens
GGAAKQGFS

SEQ ID NO: 1121013 - protein, 9 aa, Homo Sapiens
YEFCTCIPP

SEQ ID NO: 1121014 - protein, 9 aa, Homo Sapiens
PLLASQWGT

SEQ ID NO: 1121015 - protein, 9 aa, Homo Sapiens
LSEGVNKLK

SEQ ID NO: 1121016 - protein, 9 aa, Homo Sapiens
TEIFLFTAM

SEQ ID NO: 1121017 - protein, 9 aa, Homo Sapiens
CNVTISFDR

SEQ ID NO: 1121018 - protein, 9 aa, Homo Sapiens
GDLNLSVVA

SEQ ID NO: 1121019 - protein, 9 aa, Homo Sapiens
RMKSQPSQD

SEQ ID NO: 1121020 - protein, 9 aa, Homo Sapiens
PHPPPAAAG

SEQ ID NO: 1121021 - protein, 9 aa, Homo Sapiens
FEVELVSQE

SEQ ID NO: 1121022 - protein, 9 aa, Homo Sapiens
AGRWRSGGP

SEQ ID NO: 1121023 - protein, 9 aa, Homo Sapiens
NRTSGLGKN

SEQ ID NO: 1121024 - protein, 9 aa, Homo Sapiens
TLCIAGQAG

SEQ ID NO: 1121025 - protein, 9 aa, Homo Sapiens
SQGITPHGQ

SEQ ID NO: 1121026 - protein, 9 aa, Homo Sapiens
PTLTPKAGK

SEQ ID NO: 1121027 - protein, 9 aa, Homo Sapiens
VKLGGHPLQ

SEQ ID NO: 1121028 - protein, 9 aa, Homo Sapiens
HNETGSILP

SEQ ID NO: 1121029 - protein, 9 aa, Homo Sapiens
AKSRARYGD

SEQ ID NO: 1121030 - protein, 9 aa, Homo Sapiens
APRSAEPGC

SEQ ID NO: 1121031 - protein, 9 aa, Homo Sapiens
GSLLVGQPK

SEQ ID NO: 1121032 - protein, 9 aa, Homo Sapiens
GKRKAFSAC

SEQ ID NO: 1121033 - protein, 9 aa, Homo Sapiens
FKAFSPDLT

SEQ ID NO: 1121034 - protein, 9 aa, Homo Sapiens
PQCLQLQED

SEQ ID NO: 1121035 - protein, 9 aa, Homo Sapiens
HNDNSSRFG

SEQ ID NO: 1121036 - protein, 9 aa, Homo Sapiens
SSVITSPLH

SEQ ID NO: 1121037 - protein, 9 aa, Homo Sapiens
PDEAAEDAD

SEQ ID NO: 1121038 - protein, 9 aa, Homo Sapiens
AAGPAAPRP

SEQ ID NO: 1121039 - protein, 9 aa, Homo Sapiens
KLSMIRFQY

SEQ ID NO: 1121040 - protein, 9 aa, Homo Sapiens
ERFVHNENQ

SEQ ID NO: 1121041 - protein, 9 aa, Homo Sapiens
LLKTWLPGG

SEQ ID NO: 1121042 - protein, 9 aa, Homo Sapiens
ESIMFHWKK

SEQ ID NO: 1121043 - protein, 9 aa, Homo Sapiens
NYLALRDAG

SEQ ID NO: 1121044 - protein, 9 aa, Homo Sapiens
KWTMFITQL

SEQ ID NO: 1121045 - protein, 9 aa, Homo Sapiens
TGTKDTICS

SEQ ID NO: 1121046 - protein, 9 aa, Homo Sapiens
GAARSPLPP

SEQ ID NO: 1121047 - protein, 9 aa, Homo Sapiens
LRVRPRVSG

SEQ ID NO: 1121048 - protein, 9 aa, Homo Sapiens
SEDAQQPAK

SEQ ID NO: 1121049 - protein, 9 aa, Homo Sapiens
ADVVFWWTA

SEQ ID NO: 1121050 - protein, 9 aa, Homo Sapiens
VVLEHLRPS

SEQ ID NO: 1121051 - protein, 9 aa, Homo Sapiens
EQIQKKKIR

SEQ ID NO: 1121052 - protein, 9 aa, Homo Sapiens
AVKYKRENK

SEQ ID NO: 1121053 - protein, 9 aa, Homo Sapiens
AFIKKHEEG

SEQ ID NO: 1121054 - protein, 9 aa, Homo Sapiens
IDLLKEPGK

SEQ ID NO: 1121055 - protein, 9 aa, Homo Sapiens
GVYKGIVLS

SEQ ID NO: 1121056 - protein, 9 aa, Homo Sapiens
LRAAGGARG

SEQ ID NO: 1121057 - protein, 9 aa, Homo Sapiens
CKSASVMAA

SEQ ID NO: 1121058 - protein, 9 aa, Homo Sapiens
LNLAPVTRL

SEQ ID NO: 1121059 - protein, 9 aa, Homo Sapiens
EGENDGGHD

SEQ ID NO: 1121060 - protein, 9 aa, Homo Sapiens
NRLVVDVDC

SEQ ID NO: 1121061 - protein, 9 aa, Homo Sapiens
LATVDSPPH

SEQ ID NO: 1121062 - protein, 9 aa, Homo Sapiens
KLMMSSTNN

SEQ ID NO: 1121063 - protein, 9 aa, Homo Sapiens
ISMDNALHA

SEQ ID NO: 1121064 - protein, 9 aa, Homo Sapiens
ICLKYYHGI

SEQ ID NO: 1121065 - protein, 9 aa, Homo Sapiens
SGSGRARGT

SEQ ID NO: 1121066 - protein, 9 aa, Homo Sapiens
DDAMCRCAY

SEQ ID NO: 1121067 - protein, 9 aa, Homo Sapiens
RGTGPAHPT

SEQ ID NO: 1121068 - protein, 9 aa, Homo Sapiens
DLRGRQCSS

SEQ ID NO: 1121069 - protein, 9 aa, Homo Sapiens
LAPKTTLPG

SEQ ID NO: 1121070 - protein, 9 aa, Homo Sapiens
GAAGGGSPA

SEQ ID NO: 1121071 - protein, 9 aa, Homo Sapiens
TQAKSPSPA

SEQ ID NO: 1121072 - protein, 9 aa, Homo Sapiens
AQGRKPGAQ

SEQ ID NO: 1121073 - protein, 9 aa, Homo Sapiens
ILCLKQYVE

SEQ ID NO: 1121074 - protein, 9 aa, Homo Sapiens
AQKVVTSPK

SEQ ID NO: 1121075 - protein, 9 aa, Homo Sapiens
RHLRELSGS

SEQ ID NO: 1121076 - protein, 9 aa, Homo Sapiens
ASDRPSSAR

SEQ ID NO: 1121077 - protein, 9 aa, Homo Sapiens
MASTSGSPH

SEQ ID NO: 1121078 - protein, 9 aa, Homo Sapiens
TPKKKRSAF

SEQ ID NO: 1121079 - protein, 9 aa, Homo Sapiens
FNASQTCVA

SEQ ID NO: 1121080 - protein, 9 aa, Homo Sapiens
GDCAKLVRD

SEQ ID NO: 1121081 - protein, 9 aa, Homo Sapiens
LQSALDCIF

SEQ ID NO: 1121082 - protein, 9 aa, Homo Sapiens
LYLMTIIVL

SEQ ID NO: 1121083 - protein, 9 aa, Homo Sapiens
RSDPAKIGR

SEQ ID NO: 1121084 - protein, 9 aa, Homo Sapiens
PSSGRHPAT

SEQ ID NO: 1121085 - protein, 9 aa, Homo Sapiens
LCYGFVLDH

SEQ ID NO: 1121086 - protein, 9 aa, Homo Sapiens
DRRGGPGQA

SEQ ID NO: 1121087 - protein, 9 aa, Homo Sapiens
TLTAHRGLS

SEQ ID NO: 1121088 - protein, 9 aa, Homo Sapiens
TPLVFSFIW

SEQ ID NO: 1121089 - protein, 9 aa, Homo Sapiens
AGLPVEALK

SEQ ID NO: 1121090 - protein, 9 aa, Homo Sapiens
RRGEAGGLG

SEQ ID NO: 1121091 - protein, 9 aa, Homo Sapiens
LYHVSQSPF

SEQ ID NO: 1121092 - protein, 9 aa, Homo Sapiens
LFTSLASGT

SEQ ID NO: 1121093 - protein, 9 aa, Homo Sapiens
PSVTGHPLY

SEQ ID NO: 1121094 - protein, 9 aa, Homo Sapiens
ASLPQLSPT

SEQ ID NO: 1121095 - protein, 9 aa, Homo Sapiens
AGGPCPSAA

SEQ ID NO: 1121096 - protein, 9 aa, Homo Sapiens
ATQCSSPSC

SEQ ID NO: 1121097 - protein, 9 aa, Homo Sapiens
ISPKEEISP

SEQ ID NO: 1121098 - protein, 9 aa, Homo Sapiens
KCLCTGRAC

SEQ ID NO: 1121099 - protein, 9 aa, Homo Sapiens
IRTRPQAST

SEQ ID NO: 1121100 - protein, 9 aa, Homo Sapiens
SDCSLPENP

SEQ ID NO: 1121101 - protein, 9 aa, Homo Sapiens
LEGDLQHAL

SEQ ID NO: 1121102 - protein, 9 aa, Homo Sapiens
ALVGTDATM

SEQ ID NO: 1121103 - protein, 9 aa, Homo Sapiens
KNNYRKTAE

SEQ ID NO: 1121104 - protein, 9 aa, Homo Sapiens
ALAVECAGR

SEQ ID NO: 1121105 - protein, 9 aa, Homo Sapiens
SLSPTPMWW

SEQ ID NO: 1121106 - protein, 9 aa, Homo Sapiens
TPRNKVAQA

SEQ ID NO: 1121107 - protein, 9 aa, Homo Sapiens
FSDEDSTWE

SEQ ID NO: 1121108 - protein, 9 aa, Homo Sapiens
LRRSVSPYP

SEQ ID NO: 1121109 - protein, 9 aa, Homo Sapiens
LHLDMRPFK

SEQ ID NO: 1121110 - protein, 9 aa, Homo Sapiens
RLKEHRQES

SEQ ID NO: 1121111 - protein, 9 aa, Homo Sapiens
MDGATLFQC

SEQ ID NO: 1121112 - protein, 9 aa, Homo Sapiens
TRSVESWGT

SEQ ID NO: 1121113 - protein, 9 aa, Homo Sapiens
YPVLCSLCT

SEQ ID NO: 1121114 - protein, 9 aa, Homo Sapiens
SLPRSMDFE

SEQ ID NO: 1121115 - protein, 9 aa, Homo Sapiens
EQFQSVEVP

SEQ ID NO: 1121116 - protein, 9 aa, Homo Sapiens
RNGCHPYCD

SEQ ID NO: 1121117 - protein, 9 aa, Homo Sapiens
SGEFKLFMK

SEQ ID NO: 1121118 - protein, 9 aa, Homo Sapiens
GSSRGTSIT

SEQ ID NO: 1121119 - protein, 9 aa, Homo Sapiens
AGSQVTVHI

SEQ ID NO: 1121120 - protein, 9 aa, Homo Sapiens
LAHAFFCEE

SEQ ID NO: 1121121 - protein, 9 aa, Homo Sapiens
LISPVCLAS

SEQ ID NO: 1121122 - protein, 9 aa, Homo Sapiens
TSPPGAPPS

SEQ ID NO: 1121123 - protein, 9 aa, Homo Sapiens
LGLVLAMQR

SEQ ID NO: 1121124 - protein, 9 aa, Homo Sapiens
ELVQGPILH

SEQ ID NO: 1121125 - protein, 9 aa, Homo Sapiens
KQLFYMINV

SEQ ID NO: 1121126 - protein, 9 aa, Homo Sapiens
EIRCHIDNL

SEQ ID NO: 1121127 - protein, 9 aa, Homo Sapiens
NDFSEQRAG

SEQ ID NO: 1121128 - protein, 9 aa, Homo Sapiens
NTTDYHGAT

SEQ ID NO: 1121129 - protein, 9 aa, Homo Sapiens
SAKGHSHPG

SEQ ID NO: 1121130 - protein, 9 aa, Homo Sapiens
GDFQSQWDV

SEQ ID NO: 1121131 - protein, 9 aa, Homo Sapiens
KKGEIPSEL

SEQ ID NO: 1121132 - protein, 9 aa, Homo Sapiens
SIPKFKIRK

SEQ ID NO: 1121133 - protein, 9 aa, Homo Sapiens
SISLAGWLT

SEQ ID NO: 1121134 - protein, 9 aa, Homo Sapiens
GTVAGATAQ

SEQ ID NO: 1121135 - protein, 9 aa, Homo Sapiens
PMARYILKT

SEQ ID NO: 1121136 - protein, 9 aa, Homo Sapiens
HTSERPYKC

SEQ ID NO: 1121137 - protein, 9 aa, Homo Sapiens
LIKVSDDLI

SEQ ID NO: 1121138 - protein, 9 aa, Homo Sapiens
DRNRPSFDT

SEQ ID NO: 1121139 - protein, 9 aa, Homo Sapiens
KVKVVYVAC

SEQ ID NO: 1121140 - protein, 9 aa, Homo Sapiens
ASSPECGFA

SEQ ID NO: 1121141 - protein, 9 aa, Homo Sapiens
YVYHSEGMK

SEQ ID NO: 1121142 - protein, 9 aa, Homo Sapiens
IWWKKAMST

SEQ ID NO: 1121143 - protein, 9 aa, Homo Sapiens
EASSSPLWL

SEQ ID NO: 1121144 - protein, 9 aa, Homo Sapiens
GHCIGTLSV

SEQ ID NO: 1121145 - protein, 9 aa, Homo Sapiens
LGVQEGVDE

SEQ ID NO: 1121146 - protein, 9 aa, Homo Sapiens
EVAVHWRAM

SEQ ID NO: 1121147 - protein, 9 aa, Homo Sapiens
NEETKESMT

SEQ ID NO: 1121148 - protein, 9 aa, Homo Sapiens
KLKVKSKQY

SEQ ID NO: 1121149 - protein, 9 aa, Homo Sapiens
TRTAPPTPV

SEQ ID NO: 1121150 - protein, 9 aa, Homo Sapiens
GDDVPEIPP

SEQ ID NO: 1121151 - protein, 9 aa, Homo Sapiens
AIAKFEHLQ

SEQ ID NO: 1121152 - protein, 9 aa, Homo Sapiens
SRGTSITLS

SEQ ID NO: 1121153 - protein, 9 aa, Homo Sapiens
VWMPLTILW

SEQ ID NO: 1121154 - protein, 9 aa, Homo Sapiens
AVYGQNVIH

SEQ ID NO: 1121155 - protein, 9 aa, Homo Sapiens
RVDGEKGTY

SEQ ID NO: 1121156 - protein, 9 aa, Homo Sapiens
RRRKRKRRR

SEQ ID NO: 1121157 - protein, 9 aa, Homo Sapiens
CRRCMRWCP

SEQ ID NO: 1121158 - protein, 9 aa, Homo Sapiens
SAPPPSAPA

SEQ ID NO: 1121159 - protein, 9 aa, Homo Sapiens
ALEDAGYCR

SEQ ID NO: 1121160 - protein, 9 aa, Homo Sapiens
LKEGIPAPD

SEQ ID NO: 1121161 - protein, 9 aa, Homo Sapiens
DTDDLTPQL

SEQ ID NO: 1121162 - protein, 9 aa, Homo Sapiens
ILYCEIGVT

SEQ ID NO: 1121163 - protein, 9 aa, Homo Sapiens
RPPSPSVSP

SEQ ID NO: 1121164 - protein, 9 aa, Homo Sapiens
AVKYSDVEL

SEQ ID NO: 1121165 - protein, 9 aa, Homo Sapiens
TQEVDAHRE

SEQ ID NO: 1121166 - protein, 9 aa, Homo Sapiens
WQVFLKMIL

SEQ ID NO: 1121167 - protein, 9 aa, Homo Sapiens
SSEPMHTIS

SEQ ID NO: 1121168 - protein, 9 aa, Homo Sapiens
PSRIPRGSY

SEQ ID NO: 1121169 - protein, 9 aa, Homo Sapiens
VHCKGATCG

SEQ ID NO: 1121170 - protein, 9 aa, Homo Sapiens
WEKNRQRGH

SEQ ID NO: 1121171 - protein, 9 aa, Homo Sapiens
QDHVAFCVT

SEQ ID NO: 1121172 - protein, 9 aa, Homo Sapiens
ATLRCPAVP

SEQ ID NO: 1121173 - protein, 9 aa, Homo Sapiens
DKTAVVKLE

SEQ ID NO: 1121174 - protein, 9 aa, Homo Sapiens
YDNVNKLNV

SEQ ID NO: 1121175 - protein, 9 aa, Homo Sapiens
CVNPPGLLL

SEQ ID NO: 1121176 - protein, 9 aa, Homo Sapiens
FGIVAMAAG

SEQ ID NO: 1121177 - protein, 9 aa, Homo Sapiens
SSPEVLEVG

SEQ ID NO: 1121178 - protein, 9 aa, Homo Sapiens
TKSWSCCGK

SEQ ID NO: 1121179 - protein, 9 aa, Homo Sapiens
AKQNGYVPF

SEQ ID NO: 1121180 - protein, 9 aa, Homo Sapiens
APERLHARR

SEQ ID NO: 1121181 - protein, 9 aa, Homo Sapiens
EAAPRRRAP

SEQ ID NO: 1121182 - protein, 9 aa, Homo Sapiens
NRHIRGNMG

SEQ ID NO: 1121183 - protein, 9 aa, Homo Sapiens
ILTKKRWEE

SEQ ID NO: 1121184 - protein, 9 aa, Homo Sapiens
THMVCRTTL

SEQ ID NO: 1121185 - protein, 9 aa, Homo Sapiens
SVLDASELG

SEQ ID NO: 1121186 - protein, 9 aa, Homo Sapiens
FCLHYGTQL

SEQ ID NO: 1121187 - protein, 9 aa, Homo Sapiens
LQQVSTALM

SEQ ID NO: 1121188 - protein, 9 aa, Homo Sapiens
GRSRSSSSI

SEQ ID NO: 1121189 - protein, 9 aa, Homo Sapiens
SGTSPTWAR

SEQ ID NO: 1121190 - protein, 9 aa, Homo Sapiens
FDHSDLIYL

SEQ ID NO: 1121191 - protein, 9 aa, Homo Sapiens
YTFETKADL

SEQ ID NO: 1121192 - protein, 9 aa, Homo Sapiens
GDAPSHSPP

SEQ ID NO: 1121193 - protein, 9 aa, Homo Sapiens
AVSSIKWSP

SEQ ID NO: 1121194 - protein, 9 aa, Homo Sapiens
PEASGSGEG

SEQ ID NO: 1121195 - protein, 9 aa, Homo Sapiens
PVQPALTPR

SEQ ID NO: 1121196 - protein, 9 aa, Homo Sapiens
ESGGVVDNN

SEQ ID NO: 1121197 - protein, 9 aa, Homo Sapiens
LEPYTVCDL

SEQ ID NO: 1121198 - protein, 9 aa, Homo Sapiens
GKVHKYIVR

SEQ ID NO: 1121199 - protein, 9 aa, Homo Sapiens
AHVFIGIND

SEQ ID NO: 1121200 - protein, 9 aa, Homo Sapiens
QDWHSHDTD

SEQ ID NO: 1121201 - protein, 9 aa, Homo Sapiens
HNGEKSQAV

SEQ ID NO: 1121202 - protein, 9 aa, Homo Sapiens
VFSATASTC

SEQ ID NO: 1121203 - protein, 9 aa, Homo Sapiens
LGRDSPQEC

SEQ ID NO: 1121204 - protein, 9 aa, Homo Sapiens
LTMDDVTAV

SEQ ID NO: 1121205 - protein, 9 aa, Homo Sapiens
RQLLGHLQD

SEQ ID NO: 1121206 - protein, 9 aa, Homo Sapiens
TEVHKRAIR

SEQ ID NO: 1121207 - protein, 9 aa, Homo Sapiens
DVQALRAKL

SEQ ID NO: 1121208 - protein, 9 aa, Homo Sapiens
SFTDTITYR

SEQ ID NO: 1121209 - protein, 9 aa, Homo Sapiens
EFAAISSRH

SEQ ID NO: 1121210 - protein, 9 aa, Homo Sapiens
ARTEQGWSC

SEQ ID NO: 1121211 - protein, 9 aa, Homo Sapiens
LALTFLQYP

SEQ ID NO: 1121212 - protein, 9 aa, Homo Sapiens
APGYSAQLV

SEQ ID NO: 1121213 - protein, 9 aa, Homo Sapiens
GSGRARGTS

SEQ ID NO: 1121214 - protein, 9 aa, Homo Sapiens
TKVSIGLQH

SEQ ID NO: 1121215 - protein, 9 aa, Homo Sapiens
APPAVGGRE

SEQ ID NO: 1121216 - protein, 9 aa, Homo Sapiens
RPAGTLPAP

SEQ ID NO: 1121217 - protein, 9 aa, Homo Sapiens
CNLHRCPPA

SEQ ID NO: 1121218 - protein, 9 aa, Homo Sapiens
PVKDLTYFL

SEQ ID NO: 1121219 - protein, 9 aa, Homo Sapiens
GRRGHEERE

SEQ ID NO: 1121220 - protein, 9 aa, Homo Sapiens
KKMDLDGML

SEQ ID NO: 1121221 - protein, 9 aa, Homo Sapiens
RGEWTELRQ

SEQ ID NO: 1121222 - protein, 9 aa, Homo Sapiens
ERKAHAYKE

SEQ ID NO: 1121223 - protein, 9 aa, Homo Sapiens
TTLISLPVP

SEQ ID NO: 1121224 - protein, 9 aa, Homo Sapiens
PALCPLTRW

SEQ ID NO: 1121225 - protein, 9 aa, Homo Sapiens
QLFYTNVYI

SEQ ID NO: 1121226 - protein, 9 aa, Homo Sapiens
SSAPRCPAK

SEQ ID NO: 1121227 - protein, 9 aa, Homo Sapiens
ATGVSYTLE

SEQ ID NO: 1121228 - protein, 9 aa, Homo Sapiens
AVGPNRCDT

SEQ ID NO: 1121229 - protein, 9 aa, Homo Sapiens
KRQMASKPR

SEQ ID NO: 1121230 - protein, 9 aa, Homo Sapiens
DDWDHKLCR

SEQ ID NO: 1121231 - protein, 9 aa, Homo Sapiens
WSLSPLHGD

SEQ ID NO: 1121232 - protein, 9 aa, Homo Sapiens
MLPQKFWGL

SEQ ID NO: 1121233 - protein, 9 aa, Homo Sapiens
VSVSYSDPP

SEQ ID NO: 1121234 - protein, 9 aa, Homo Sapiens
ILNFLRNGE

SEQ ID NO: 1121235 - protein, 9 aa, Homo Sapiens
SGLRTHTGS

SEQ ID NO: 1121236 - protein, 9 aa, Homo Sapiens
GQRCRDGAL

SEQ ID NO: 1121237 - protein, 9 aa, Homo Sapiens
HGVCTDCAS

SEQ ID NO: 1121238 - protein, 9 aa, Homo Sapiens
QLGPLGRDS

SEQ ID NO: 1121239 - protein, 9 aa, Homo Sapiens
TCTCIAKNT

SEQ ID NO: 1121240 - protein, 9 aa, Homo Sapiens
NTLFTRFAC

SEQ ID NO: 1121241 - protein, 9 aa, Homo Sapiens
TRWHEPQPR

SEQ ID NO: 1121242 - protein, 9 aa, Homo Sapiens
NQWFARCQE

SEQ ID NO: 1121243 - protein, 9 aa, Homo Sapiens
TPNTWTSPS

SEQ ID NO: 1121244 - protein, 9 aa, Homo Sapiens
TPGSGPSPA

SEQ ID NO: 1121245 - protein, 9 aa, Homo Sapiens
KTHPCTMLL

SEQ ID NO: 1121246 - protein, 9 aa, Homo Sapiens
QEAVYGQNV

SEQ ID NO: 1121247 - protein, 9 aa, Homo Sapiens
PAWYALHGE

SEQ ID NO: 1121248 - protein, 9 aa, Homo Sapiens
AVGGELRAG

SEQ ID NO: 1121249 - protein, 9 aa, Homo Sapiens
PPLRPHHDL

SEQ ID NO: 1121250 - protein, 9 aa, Homo Sapiens
GLCPVLGPQ

SEQ ID NO: 1121251 - protein, 9 aa, Homo Sapiens
LAGSESIGR

SEQ ID NO: 1121252 - protein, 9 aa, Homo Sapiens
QRITQGFCV

SEQ ID NO: 1121253 - protein, 9 aa, Homo Sapiens
HSKAQKTGL

SEQ ID NO: 1121254 - protein, 9 aa, Homo Sapiens
HRHALRILI

SEQ ID NO: 1121255 - protein, 9 aa, Homo Sapiens
FKGVWSNVL

SEQ ID NO: 1121256 - protein, 9 aa, Homo Sapiens
VCRTTLSGQ

SEQ ID NO: 1121257 - protein, 9 aa, Homo Sapiens
LSMIRFQYR

SEQ ID NO: 1121258 - protein, 9 aa, Homo Sapiens
RKYGKSMYY

SEQ ID NO: 1121259 - protein, 9 aa, Homo Sapiens
PEELHRTAL

SEQ ID NO: 1121260 - protein, 9 aa, Homo Sapiens
MPGVAGAAP

SEQ ID NO: 1121261 - protein, 9 aa, Homo Sapiens
TDGCHDPRD

SEQ ID NO: 1121262 - protein, 9 aa, Homo Sapiens
AMLACLGMA

SEQ ID NO: 1121263 - protein, 9 aa, Homo Sapiens
NQLPSLRRT

SEQ ID NO: 1121264 - protein, 9 aa, Homo Sapiens
QGQAAAGGS

SEQ ID NO: 1121265 - protein, 9 aa, Homo Sapiens
KASKVPGGS

SEQ ID NO: 1121266 - protein, 9 aa, Homo Sapiens
LHDMDFYKA

SEQ ID NO: 1121267 - protein, 9 aa, Homo Sapiens
PPQAPLPVA

SEQ ID NO: 1121268 - protein, 9 aa, Homo Sapiens
GMSGDQAKA

SEQ ID NO: 1121269 - protein, 9 aa, Homo Sapiens
SSSIRTVQW

SEQ ID NO: 1121270 - protein, 9 aa, Homo Sapiens
ENLNKLIQQ

SEQ ID NO: 1121271 - protein, 9 aa, Homo Sapiens
GGYAKIYKP

SEQ ID NO: 1121272 - protein, 9 aa, Homo Sapiens
PSSEPMHTI

SEQ ID NO: 1121273 - protein, 9 aa, Homo Sapiens
PHKSGSLSE

SEQ ID NO: 1121274 - protein, 9 aa, Homo Sapiens
INVKKMSQL

SEQ ID NO: 1121275 - protein, 9 aa, Homo Sapiens
RHSLKARGA

SEQ ID NO: 1121276 - protein, 9 aa, Homo Sapiens
ECLMSTMKI

SEQ ID NO: 1121277 - protein, 9 aa, Homo Sapiens
ILTSFTLQP

SEQ ID NO: 1121278 - protein, 9 aa, Homo Sapiens
DTAKCGIHG

SEQ ID NO: 1121279 - protein, 9 aa, Homo Sapiens
MASPLPCAW

SEQ ID NO: 1121280 - protein, 9 aa, Homo Sapiens
GGSEAKGKD

SEQ ID NO: 1121281 - protein, 9 aa, Homo Sapiens
IRTVQWPPG

SEQ ID NO: 1121282 - protein, 9 aa, Homo Sapiens
THPLCTVAS

SEQ ID NO: 1121283 - protein, 9 aa, Homo Sapiens
EVPPIKKIP

SEQ ID NO: 1121284 - protein, 9 aa, Homo Sapiens
GNFLCVWGG

SEQ ID NO: 1121285 - protein, 9 aa, Homo Sapiens
GFRHDRSPE

SEQ ID NO: 1121286 - protein, 9 aa, Homo Sapiens
QAKSPSPAT

SEQ ID NO: 1121287 - protein, 9 aa, Homo Sapiens
FTYSLSVIS

SEQ ID NO: 1121288 - protein, 9 aa, Homo Sapiens
SNGRLGHGL

SEQ ID NO: 1121289 - protein, 9 aa, Homo Sapiens
LRLRRHLPP

SEQ ID NO: 1121290 - protein, 9 aa, Homo Sapiens
KYVPLITSY

SEQ ID NO: 1121291 - protein, 9 aa, Homo Sapiens
ASKEFTRRR

SEQ ID NO: 1121292 - protein, 9 aa, Homo Sapiens
EALGKYHEV

SEQ ID NO: 1121293 - protein, 9 aa, Homo Sapiens
VVLPCQACQ

SEQ ID NO: 1121294 - protein, 9 aa, Homo Sapiens
GKSHLLSNH

SEQ ID NO: 1121295 - protein, 9 aa, Homo Sapiens
LPEVGGQVA

SEQ ID NO: 1121296 - protein, 9 aa, Homo Sapiens
YEGFGMYRE

SEQ ID NO: 1121297 - protein, 9 aa, Homo Sapiens
RLQVQLHEE

SEQ ID NO: 1121298 - protein, 9 aa, Homo Sapiens
LQHALAQAI

SEQ ID NO: 1121299 - protein, 9 aa, Homo Sapiens
KAVIQALRK

SEQ ID NO: 1121300 - protein, 9 aa, Homo Sapiens
HLDFEFSKS

SEQ ID NO: 1121301 - protein, 9 aa, Homo Sapiens
TRLYPGAAD

SEQ ID NO: 1121302 - protein, 9 aa, Homo Sapiens
LLDQRLRLQ

SEQ ID NO: 1121303 - protein, 9 aa, Homo Sapiens
PELGADPEE

SEQ ID NO: 1121304 - protein, 9 aa, Homo Sapiens
STGTRRIRG

SEQ ID NO: 1121305 - protein, 9 aa, Homo Sapiens
PETHLGRLL

SEQ ID NO: 1121306 - protein, 9 aa, Homo Sapiens
SYNEFGLLI

SEQ ID NO: 1121307 - protein, 9 aa, Homo Sapiens
NVSTFLFLL

SEQ ID NO: 1121308 - protein, 9 aa, Homo Sapiens
PAVLMVIPN

SEQ ID NO: 1121309 - protein, 9 aa, Homo Sapiens
RLTIHHLKK

SEQ ID NO: 1121310 - protein, 9 aa, Homo Sapiens
WEFVYQEAA

SEQ ID NO: 1121311 - protein, 9 aa, Homo Sapiens
AAGCSWTCS

SEQ ID NO: 1121312 - protein, 9 aa, Homo Sapiens
GKKIFLVAA

SEQ ID NO: 1121313 - protein, 9 aa, Homo Sapiens
EEEDVCENI

SEQ ID NO: 1121314 - protein, 9 aa, Homo Sapiens
GMCGFKGDR

SEQ ID NO: 1121315 - protein, 9 aa, Homo Sapiens
FKPDCVNIE

SEQ ID NO: 1121316 - protein, 9 aa, Homo Sapiens
GSDSDSEPD

SEQ ID NO: 1121317 - protein, 9 aa, Homo Sapiens
PTTEVHKRA

SEQ ID NO: 1121318 - protein, 9 aa, Homo Sapiens
VYEFINRQK

SEQ ID NO: 1121319 - protein, 9 aa, Homo Sapiens
KLTEVREEL

SEQ ID NO: 1121320 - protein, 9 aa, Homo Sapiens
SPWPSALAT

SEQ ID NO: 1121321 - protein, 9 aa, Homo Sapiens
LGPEDTGKA

SEQ ID NO: 1121322 - protein, 9 aa, Homo Sapiens
RLPGGDPIS

SEQ ID NO: 1121323 - protein, 9 aa, Homo Sapiens
LCQKGERVL

SEQ ID NO: 1121324 - protein, 9 aa, Homo Sapiens
SSSEKREKD

SEQ ID NO: 1121325 - protein, 9 aa, Homo Sapiens
FLYMWSFCF

SEQ ID NO: 1121326 - protein, 9 aa, Homo Sapiens
NGKQLLYGR

SEQ ID NO: 1121327 - protein, 9 aa, Homo Sapiens
GAVPGPCLV

SEQ ID NO: 1121328 - protein, 9 aa, Homo Sapiens
EDLMKMVWP

SEQ ID NO: 1121329 - protein, 9 aa, Homo Sapiens
QSLKNLSWK

SEQ ID NO: 1121330 - protein, 9 aa, Homo Sapiens
VCLGTQTFC

SEQ ID NO: 1121331 - protein, 9 aa, Homo Sapiens
PHPLTVLGV

SEQ ID NO: 1121332 - protein, 9 aa, Homo Sapiens
SQCGRRDRG

SEQ ID NO: 1121333 - protein, 9 aa, Homo Sapiens
AQGLVQGQA

SEQ ID NO: 1121334 - protein, 9 aa, Homo Sapiens
PGLGGEGDG

SEQ ID NO: 1121335 - protein, 9 aa, Homo Sapiens
NLHRCPPAR

SEQ ID NO: 1121336 - protein, 9 aa, Homo Sapiens
TVASPPRRW

SEQ ID NO: 1121337 - protein, 9 aa, Homo Sapiens
MLEGKMYIT

SEQ ID NO: 1121338 - protein, 9 aa, Homo Sapiens
SKDESTDKA

SEQ ID NO: 1121339 - protein, 9 aa, Homo Sapiens
AKKNLYYLR

SEQ ID NO: 1121340 - protein, 9 aa, Homo Sapiens
LQQNCMEKI

SEQ ID NO: 1121341 - protein, 9 aa, Homo Sapiens
GRARGTSIA

SEQ ID NO: 1121342 - protein, 9 aa, Homo Sapiens
DDDFQFNAS

SEQ ID NO: 1121343 - protein, 9 aa, Homo Sapiens
PAPPCGPRL

SEQ ID NO: 1121344 - protein, 9 aa, Homo Sapiens
EKVKKEGSG

SEQ ID NO: 1121345 - protein, 9 aa, Homo Sapiens
YLYDQQRME

SEQ ID NO: 1121346 - protein, 9 aa, Homo Sapiens
RRRPCASCP

SEQ ID NO: 1121347 - protein, 9 aa, Homo Sapiens
QFPLFFLFL

SEQ ID NO: 1121348 - protein, 9 aa, Homo Sapiens
PEPGYERME

SEQ ID NO: 1121349 - protein, 9 aa, Homo Sapiens
KLDLSLNFG

SEQ ID NO: 1121350 - protein, 9 aa, Homo Sapiens
CRLLYPVLC

SEQ ID NO: 1121351 - protein, 9 aa, Homo Sapiens
PQHAHQLQH

SEQ ID NO: 1121352 - protein, 9 aa, Homo Sapiens
GFGSHHHSQ

SEQ ID NO: 1121353 - protein, 9 aa, Homo Sapiens
ALSPALGPL

SEQ ID NO: 1121354 - protein, 9 aa, Homo Sapiens
LTILEALEE

SEQ ID NO: 1121355 - protein, 9 aa, Homo Sapiens
GDVALPGEP

SEQ ID NO: 1121356 - protein, 9 aa, Homo Sapiens
CSRFTTIAR

SEQ ID NO: 1121357 - protein, 9 aa, Homo Sapiens
AQAGMERGQ

SEQ ID NO: 1121358 - protein, 9 aa, Homo Sapiens
GEDVSSLAL

SEQ ID NO: 1121359 - protein, 9 aa, Homo Sapiens
PRFLQVCDW

SEQ ID NO: 1121360 - protein, 9 aa, Homo Sapiens
YGAGAYRLL

SEQ ID NO: 1121361 - protein, 9 aa, Homo Sapiens
SDDLGKTMD

SEQ ID NO: 1121362 - protein, 9 aa, Homo Sapiens
DYVLLKEVV

SEQ ID NO: 1121363 - protein, 9 aa, Homo Sapiens
GGARGRDRA

SEQ ID NO: 1121364 - protein, 9 aa, Homo Sapiens
ERHILGVFS

SEQ ID NO: 1121365 - protein, 9 aa, Homo Sapiens
GKIEDMAMM

SEQ ID NO: 1121366 - protein, 9 aa, Homo Sapiens
TDEETMSGE

SEQ ID NO: 1121367 - protein, 9 aa, Homo Sapiens
SELQAFARH

SEQ ID NO: 1121368 - protein, 9 aa, Homo Sapiens
AAPRSTPKD

SEQ ID NO: 1121369 - protein, 9 aa, Homo Sapiens
KRRDQAAAF

SEQ ID NO: 1121370 - protein, 9 aa, Homo Sapiens
RPSCTDEAE

SEQ ID NO: 1121371 - protein, 9 aa, Homo Sapiens
VVASADLKE

SEQ ID NO: 1121372 - protein, 9 aa, Homo Sapiens
KKMLSLTHL

SEQ ID NO: 1121373 - protein, 9 aa, Homo Sapiens
ELPEHQTRL

SEQ ID NO: 1121374 - protein, 9 aa, Homo Sapiens
PTLVPDPCP

SEQ ID NO: 1121375 - protein, 9 aa, Homo Sapiens
AVDNKKTHP

SEQ ID NO: 1121376 - protein, 9 aa, Homo Sapiens
KHCETLGVK

SEQ ID NO: 1121377 - protein, 9 aa, Homo Sapiens
FRKIKHQKS

SEQ ID NO: 1121378 - protein, 9 aa, Homo Sapiens
GRVHAVYRR

SEQ ID NO: 1121379 - protein, 9 aa, Homo Sapiens
LSPVKDLTY

SEQ ID NO: 1121380 - protein, 9 aa, Homo Sapiens
RPPALLQPP

SEQ ID NO: 1121381 - protein, 9 aa, Homo Sapiens
KKKRRRKRK

SEQ ID NO: 1121382 - protein, 9 aa, Homo Sapiens
IQPTWKLLV

SEQ ID NO: 1121383 - protein, 9 aa, Homo Sapiens
LLYLRTSGE

SEQ ID NO: 1121384 - protein, 9 aa, Homo Sapiens
SELQAGRET

SEQ ID NO: 1121385 - protein, 9 aa, Homo Sapiens
WTLSIWNQW

SEQ ID NO: 1121386 - protein, 9 aa, Homo Sapiens
FAAISHRSE

SEQ ID NO: 1121387 - protein, 9 aa, Homo Sapiens
ISCFWSIPL

SEQ ID NO: 1121388 - protein, 9 aa, Homo Sapiens
QGMRGGDAF

SEQ ID NO: 1121389 - protein, 9 aa, Homo Sapiens
QLQRIVSTM

SEQ ID NO: 1121390 - protein, 9 aa, Homo Sapiens
FSRGRDADA

SEQ ID NO: 1121391 - protein, 9 aa, Homo Sapiens
LPPSAPPPS

SEQ ID NO: 1121392 - protein, 9 aa, Homo Sapiens
PVKKSCGVA

SEQ ID NO: 1121393 - protein, 9 aa, Homo Sapiens
SAEMTGLGK

SEQ ID NO: 1121394 - protein, 9 aa, Homo Sapiens
PTPGRPARP

SEQ ID NO: 1121395 - protein, 9 aa, Homo Sapiens
MMSSHLHKT

SEQ ID NO: 1121396 - protein, 9 aa, Homo Sapiens
QITDHGLRG

SEQ ID NO: 1121397 - protein, 9 aa, Homo Sapiens
GITPEPRPL

SEQ ID NO: 1121398 - protein, 9 aa, Homo Sapiens
SVSPSLLKI

SEQ ID NO: 1121399 - protein, 9 aa, Homo Sapiens
DQWCPDGSH

SEQ ID NO: 1121400 - protein, 9 aa, Homo Sapiens
RTVRLRHRL

SEQ ID NO: 1121401 - protein, 9 aa, Homo Sapiens
RSCQVPRTD

SEQ ID NO: 1121402 - protein, 9 aa, Homo Sapiens
LTLQCNPRL

SEQ ID NO: 1121403 - protein, 9 aa, Homo Sapiens
KCGRAFISP

SEQ ID NO: 1121404 - protein, 9 aa, Homo Sapiens
TVTGTPANI

SEQ ID NO: 1121405 - protein, 9 aa, Homo Sapiens
INHLVSLGY

SEQ ID NO: 1121406 - protein, 9 aa, Homo Sapiens
YSGTMSTTL

SEQ ID NO: 1121407 - protein, 9 aa, Homo Sapiens
RGIIDCVVR

SEQ ID NO: 1121408 - protein, 9 aa, Homo Sapiens
QLVWTAPPA

SEQ ID NO: 1121409 - protein, 9 aa, Homo Sapiens
ALHPRTQGH

SEQ ID NO: 1121410 - protein, 9 aa, Homo Sapiens
QVITFTDVS

SEQ ID NO: 1121411 - protein, 9 aa, Homo Sapiens
TLARPRLPR

SEQ ID NO: 1121412 - protein, 9 aa, Homo Sapiens
GVGVLRPSS

SEQ ID NO: 1121413 - protein, 9 aa, Homo Sapiens
TEEALGEAE

SEQ ID NO: 1121414 - protein, 9 aa, Homo Sapiens
SKEEAIIVE

SEQ ID NO: 1121415 - protein, 9 aa, Homo Sapiens
ETVYEEMKY

SEQ ID NO: 1121416 - protein, 9 aa, Homo Sapiens
SFFIANTKD

SEQ ID NO: 1121417 - protein, 9 aa, Homo Sapiens
MANIHAIQN

SEQ ID NO: 1121418 - protein, 9 aa, Homo Sapiens
VMPRTLEGC

SEQ ID NO: 1121419 - protein, 9 aa, Homo Sapiens
IFQHLQNIM

SEQ ID NO: 1121420 - protein, 9 aa, Homo Sapiens
ERLAHQQGL

SEQ ID NO: 1121421 - protein, 9 aa, Homo Sapiens
CQNFFRNKY

SEQ ID NO: 1121422 - protein, 9 aa, Homo Sapiens
STRPSGPPF

SEQ ID NO: 1121423 - protein, 9 aa, Homo Sapiens
TNSVDVLDR

SEQ ID NO: 1121424 - protein, 9 aa, Homo Sapiens
LKWKHCETL

SEQ ID NO: 1121425 - protein, 9 aa, Homo Sapiens
CPEHLLQPW

SEQ ID NO: 1121426 - protein, 9 aa, Homo Sapiens
RPPKGAGRA

SEQ ID NO: 1121427 - protein, 9 aa, Homo Sapiens
TCGIHSKYV

SEQ ID NO: 1121428 - protein, 9 aa, Homo Sapiens
RSSSLDALC

SEQ ID NO: 1121429 - protein, 9 aa, Homo Sapiens
RGPGGAAGG

SEQ ID NO: 1121430 - protein, 9 aa, Homo Sapiens
TEMAPKRPP

SEQ ID NO: 1121431 - protein, 9 aa, Homo Sapiens
CPVKNVFFL

SEQ ID NO: 1121432 - protein, 9 aa, Homo Sapiens
HIIMHLTLQ

SEQ ID NO: 1121433 - protein, 9 aa, Homo Sapiens
WWPRMKSQP

SEQ ID NO: 1121434 - protein, 9 aa, Homo Sapiens
RNTSYDGVF

SEQ ID NO: 1121435 - protein, 9 aa, Homo Sapiens
MENSHPPTT

SEQ ID NO: 1121436 - protein, 9 aa, Homo Sapiens
KGESQEGKQ

SEQ ID NO: 1121437 - protein, 9 aa, Homo Sapiens
LHSLAHNLS

SEQ ID NO: 1121438 - protein, 9 aa, Homo Sapiens
ATENALFLW

SEQ ID NO: 1121439 - protein, 9 aa, Homo Sapiens
LALWPPPLR

SEQ ID NO: 1121440 - protein, 9 aa, Homo Sapiens
QLCSPVARL

SEQ ID NO: 1121441 - protein, 9 aa, Homo Sapiens
MKCLGKRRD

SEQ ID NO: 1121442 - protein, 9 aa, Homo Sapiens
PLQSALQGP

SEQ ID NO: 1121443 - protein, 9 aa, Homo Sapiens
SKEPEPAGV

SEQ ID NO: 1121444 - protein, 9 aa, Homo Sapiens
PRTRPAPYG

SEQ ID NO: 1121445 - protein, 9 aa, Homo Sapiens
ASRALFTSL

SEQ ID NO: 1121446 - protein, 9 aa, Homo Sapiens
SSWKGSSRT

SEQ ID NO: 1121447 - protein, 9 aa, Homo Sapiens
HLRGQGGKQ

SEQ ID NO: 1121448 - protein, 9 aa, Homo Sapiens
GFWTIFHIL

SEQ ID NO: 1121449 - protein, 9 aa, Homo Sapiens
PVAAVLFNF

SEQ ID NO: 1121450 - protein, 9 aa, Homo Sapiens
GRSYIVDAG

SEQ ID NO: 1121451 - protein, 9 aa, Homo Sapiens
GEVHRVTIM

SEQ ID NO: 1121452 - protein, 9 aa, Homo Sapiens
GKKYTQKDQ

SEQ ID NO: 1121453 - protein, 9 aa, Homo Sapiens
NLSVVAMAL

SEQ ID NO: 1121454 - protein, 9 aa, Homo Sapiens
DTLQSPFGD

SEQ ID NO: 1121455 - protein, 9 aa, Homo Sapiens
QIHASPRKS

SEQ ID NO: 1121456 - protein, 9 aa, Homo Sapiens
AHLVVGRVV

SEQ ID NO: 1121457 - protein, 9 aa, Homo Sapiens
QAIAVQAGD

SEQ ID NO: 1121458 - protein, 9 aa, Homo Sapiens
GRSVSSSSS

SEQ ID NO: 1121459 - protein, 9 aa, Homo Sapiens
PSFEAAPRR

SEQ ID NO: 1121460 - protein, 9 aa, Homo Sapiens
QRPIQVQTG

SEQ ID NO: 1121461 - protein, 9 aa, Homo Sapiens
LDGSYWVTL

SEQ ID NO: 1121462 - protein, 9 aa, Homo Sapiens
DAQCLFLMS

SEQ ID NO: 1121463 - protein, 9 aa, Homo Sapiens
PPEVHIANI

SEQ ID NO: 1121464 - protein, 9 aa, Homo Sapiens
SASREDLIQ

SEQ ID NO: 1121465 - protein, 9 aa, Homo Sapiens
RPRSMRSPT

SEQ ID NO: 1121466 - protein, 9 aa, Homo Sapiens
KLQRELDES

SEQ ID NO: 1121467 - protein, 9 aa, Homo Sapiens
DKNDGGQPH

SEQ ID NO: 1121468 - protein, 9 aa, Homo Sapiens
GIVVADAEA

SEQ ID NO: 1121469 - protein, 9 aa, Homo Sapiens
VILQERGDH

SEQ ID NO: 1121470 - protein, 9 aa, Homo Sapiens
SSMYRGLWL

SEQ ID NO: 1121471 - protein, 9 aa, Homo Sapiens
DSPSEEPFP

SEQ ID NO: 1121472 - protein, 9 aa, Homo Sapiens
RTLPKVPAV

SEQ ID NO: 1121473 - protein, 9 aa, Homo Sapiens
VGQVLHASC

SEQ ID NO: 1121474 - protein, 9 aa, Homo Sapiens
DQPYQREAP

SEQ ID NO: 1121475 - protein, 9 aa, Homo Sapiens
DCPKRPEQL

SEQ ID NO: 1121476 - protein, 9 aa, Homo Sapiens
KPSPVLGKL

SEQ ID NO: 1121477 - protein, 9 aa, Homo Sapiens
TVPGGPGTA

SEQ ID NO: 1121478 - protein, 9 aa, Homo Sapiens
DQAQDIQQS

SEQ ID NO: 1121479 - protein, 9 aa, Homo Sapiens
AVEGLTSRA

SEQ ID NO: 1121480 - protein, 9 aa, Homo Sapiens
LLLTDPIEQ

SEQ ID NO: 1121481 - protein, 9 aa, Homo Sapiens
GGNLIGNNC

SEQ ID NO: 1121482 - protein, 9 aa, Homo Sapiens
YGGDSEGGR

SEQ ID NO: 1121483 - protein, 9 aa, Homo Sapiens
PLPPLPDLG

SEQ ID NO: 1121484 - protein, 9 aa, Homo Sapiens
IELDHTSLE

SEQ ID NO: 1121485 - protein, 9 aa, Homo Sapiens
QYECKNTFG

SEQ ID NO: 1121486 - protein, 9 aa, Homo Sapiens
EFVGSMWRQ

SEQ ID NO: 1121487 - protein, 9 aa, Homo Sapiens
VHHGGNEAW

SEQ ID NO: 1121488 - protein, 9 aa, Homo Sapiens
GQSNDHGDG

SEQ ID NO: 1121489 - protein, 9 aa, Homo Sapiens
AGVAQPASG

SEQ ID NO: 1121490 - protein, 9 aa, Homo Sapiens
FTISVSLVV

SEQ ID NO: 1121491 - protein, 9 aa, Homo Sapiens
HLLYRIRKD

SEQ ID NO: 1121492 - protein, 9 aa, Homo Sapiens
TQACSHGAG

SEQ ID NO: 1121493 - protein, 9 aa, Homo Sapiens
GSGPSPAPS

SEQ ID NO: 1121494 - protein, 9 aa, Homo Sapiens
NKEGSFQRR

SEQ ID NO: 1121495 - protein, 9 aa, Homo Sapiens
KNVPKRVQR

SEQ ID NO: 1121496 - protein, 9 aa, Homo Sapiens
LMMSNGCWG

SEQ ID NO: 1121497 - protein, 9 aa, Homo Sapiens
GDQAKAAVI

SEQ ID NO: 1121498 - protein, 9 aa, Homo Sapiens
RGGQRGQEP

SEQ ID NO: 1121499 - protein, 9 aa, Homo Sapiens
PRDCSENIE

SEQ ID NO: 1121500 - protein, 9 aa, Homo Sapiens
RELDLLDST

SEQ ID NO: 1121501 - protein, 9 aa, Homo Sapiens
AAESQGLSR

SEQ ID NO: 1121502 - protein, 9 aa, Homo Sapiens
FPRAMDALA

SEQ ID NO: 1121503 - protein, 9 aa, Homo Sapiens
IVPKRIRKA

SEQ ID NO: 1121504 - protein, 9 aa, Homo Sapiens
KCVSKNTFF

SEQ ID NO: 1121505 - protein, 9 aa, Homo Sapiens
EVATTPGIL

SEQ ID NO: 1121506 - protein, 9 aa, Homo Sapiens
GTPRPSADL

SEQ ID NO: 1121507 - protein, 9 aa, Homo Sapiens
PGSGPSPAP

SEQ ID NO: 1121508 - protein, 9 aa, Homo Sapiens
KRSRCRPHA

SEQ ID NO: 1121509 - protein, 9 aa, Homo Sapiens
WDCGGSEAK

SEQ ID NO: 1121510 - protein, 9 aa, Homo Sapiens
TSYSSEDYT

SEQ ID NO: 1121511 - protein, 9 aa, Homo Sapiens
KRGSSFSRS

SEQ ID NO: 1121512 - protein, 9 aa, Homo Sapiens
GTSPTWART

SEQ ID NO: 1121513 - protein, 9 aa, Homo Sapiens
VAAMQMSSF

SEQ ID NO: 1121514 - protein, 9 aa, Homo Sapiens
AAQKVVTSP

SEQ ID NO: 1121515 - protein, 9 aa, Homo Sapiens
IFCILCLKQ

SEQ ID NO: 1121516 - protein, 9 aa, Homo Sapiens
MAEALTNLV

SEQ ID NO: 1121517 - protein, 9 aa, Homo Sapiens
PWWRSQNWP

SEQ ID NO: 1121518 - protein, 9 aa, Homo Sapiens
PGLCPECSC

SEQ ID NO: 1121519 - protein, 9 aa, Homo Sapiens
DLRGEPRIQ

SEQ ID NO: 1121520 - protein, 9 aa, Homo Sapiens
LDLSLNFGR

SEQ ID NO: 1121521 - protein, 9 aa, Homo Sapiens
MGSCVCGSV

SEQ ID NO: 1121522 - protein, 9 aa, Homo Sapiens
GGFDGTYYG

SEQ ID NO: 1121523 - protein, 9 aa, Homo Sapiens
EAPPGCILP

SEQ ID NO: 1121524 - protein, 9 aa, Homo Sapiens
IGQVPTLLE

SEQ ID NO: 1121525 - protein, 9 aa, Homo Sapiens
SPILVHRSA

SEQ ID NO: 1121526 - protein, 9 aa, Homo Sapiens
QRLHTSERP

SEQ ID NO: 1121527 - protein, 9 aa, Homo Sapiens
LVRYIRQGL

SEQ ID NO: 1121528 - protein, 9 aa, Homo Sapiens
PLPDLGVRP

SEQ ID NO: 1121529 - protein, 9 aa, Homo Sapiens
NRSGTWKRV

SEQ ID NO: 1121530 - protein, 9 aa, Homo Sapiens
RCLIGSWKM

SEQ ID NO: 1121531 - protein, 9 aa, Homo Sapiens
GVQQISLEG

SEQ ID NO: 1121532 - protein, 9 aa, Homo Sapiens
RRSVSPYPS

SEQ ID NO: 1121533 - protein, 9 aa, Homo Sapiens
IPLEPTPAG

SEQ ID NO: 1121534 - protein, 9 aa, Homo Sapiens
ERINSTDHI

SEQ ID NO: 1121535 - protein, 9 aa, Homo Sapiens
QDTAKILEN

SEQ ID NO: 1121536 - protein, 9 aa, Homo Sapiens
LGAARSPLP

SEQ ID NO: 1121537 - protein, 9 aa, Homo Sapiens
CTACPPCPV

SEQ ID NO: 1121538 - protein, 9 aa, Homo Sapiens
LLTAFAQMA

SEQ ID NO: 1121539 - protein, 9 aa, Homo Sapiens
CRKIFNGGS

SEQ ID NO: 1121540 - protein, 9 aa, Homo Sapiens
VVYVACNAK

SEQ ID NO: 1121541 - protein, 9 aa, Homo Sapiens
HEKKKKRWS

SEQ ID NO: 1121542 - protein, 9 aa, Homo Sapiens
DLMHFCWLM

SEQ ID NO: 1121543 - protein, 9 aa, Homo Sapiens
SGTSFFSSK

SEQ ID NO: 1121544 - protein, 9 aa, Homo Sapiens
SLLSLYSVA

SEQ ID NO: 1121545 - protein, 9 aa, Homo Sapiens
TRGLCPGQA

SEQ ID NO: 1121546 - protein, 9 aa, Homo Sapiens
LPHTRLSPG

SEQ ID NO: 1121547 - protein, 9 aa, Homo Sapiens
ENALFLWLI

SEQ ID NO: 1121548 - protein, 9 aa, Homo Sapiens
RCTLKNRGY

SEQ ID NO: 1121549 - protein, 9 aa, Homo Sapiens
LQLLSFALC

SEQ ID NO: 1121550 - protein, 9 aa, Homo Sapiens
LLSAAYQLY

SEQ ID NO: 1121551 - protein, 9 aa, Homo Sapiens
YLQSILDDF

SEQ ID NO: 1121552 - protein, 9 aa, Homo Sapiens
REVKESENV

SEQ ID NO: 1121553 - protein, 9 aa, Homo Sapiens
RAPEVPRCA

SEQ ID NO: 1121554 - protein, 9 aa, Homo Sapiens
DAMIRKADV

SEQ ID NO: 1121555 - protein, 9 aa, Homo Sapiens
YPTDANADR

SEQ ID NO: 1121556 - protein, 9 aa, Homo Sapiens
DWDHKLCRV

SEQ ID NO: 1121557 - protein, 9 aa, Homo Sapiens
FPVFLRRSR

SEQ ID NO: 1121558 - protein, 9 aa, Homo Sapiens
KSKRSLIDR

SEQ ID NO: 1121559 - protein, 9 aa, Homo Sapiens
AGLSPGACR

SEQ ID NO: 1121560 - protein, 9 aa, Homo Sapiens
FERLVEWDV

SEQ ID NO: 1121561 - protein, 9 aa, Homo Sapiens
FGLFLHLDM

SEQ ID NO: 1121562 - protein, 9 aa, Homo Sapiens
SSSTSRDSR

SEQ ID NO: 1121563 - protein, 9 aa, Homo Sapiens
VGSLTLHSV

SEQ ID NO: 1121564 - protein, 9 aa, Homo Sapiens
GVGLDEVVS

SEQ ID NO: 1121565 - protein, 9 aa, Homo Sapiens
SLTDTVRVL

SEQ ID NO: 1121566 - protein, 9 aa, Homo Sapiens
QRRQAEISN

SEQ ID NO: 1121567 - protein, 9 aa, Homo Sapiens
LAEGGGVCG

SEQ ID NO: 1121568 - protein, 9 aa, Homo Sapiens
TLLNDFHMS

SEQ ID NO: 1121569 - protein, 9 aa, Homo Sapiens
VALEDAGYC

SEQ ID NO: 1121570 - protein, 9 aa, Homo Sapiens
KRLVRLYAV

SEQ ID NO: 1121571 - protein, 9 aa, Homo Sapiens
DEVKAGKRM

SEQ ID NO: 1121572 - protein, 9 aa, Homo Sapiens
AVFPGAPGE

SEQ ID NO: 1121573 - protein, 9 aa, Homo Sapiens
SWGEGFAQR

SEQ ID NO: 1121574 - protein, 9 aa, Homo Sapiens
SLSRPWEKN

SEQ ID NO: 1121575 - protein, 9 aa, Homo Sapiens
QQLKSPFQL

SEQ ID NO: 1121576 - protein, 9 aa, Homo Sapiens
LECHKCKCL

SEQ ID NO: 1121577 - protein, 9 aa, Homo Sapiens
FNKGPRTGC

SEQ ID NO: 1121578 - protein, 9 aa, Homo Sapiens
HTVSWGSLL

SEQ ID NO: 1121579 - protein, 9 aa, Homo Sapiens
AVTLAVQPH

SEQ ID NO: 1121580 - protein, 9 aa, Homo Sapiens
GDQAAKDNY

SEQ ID NO: 1121581 - protein, 9 aa, Homo Sapiens
CAAGCHPAV

SEQ ID NO: 1121582 - protein, 9 aa, Homo Sapiens
RQLIVVKIE

SEQ ID NO: 1121583 - protein, 9 aa, Homo Sapiens
WGGDPQYQY

SEQ ID NO: 1121584 - protein, 9 aa, Homo Sapiens
EVVKQTDVV

SEQ ID NO: 1121585 - protein, 9 aa, Homo Sapiens
RERLRELLR

SEQ ID NO: 1121586 - protein, 9 aa, Homo Sapiens
PVLLPGHLW

SEQ ID NO: 1121587 - protein, 9 aa, Homo Sapiens
KSLGIHGRK

SEQ ID NO: 1121588 - protein, 9 aa, Homo Sapiens
KRSAFPSRS

SEQ ID NO: 1121589 - protein, 9 aa, Homo Sapiens
TKPFSPKII

SEQ ID NO: 1121590 - protein, 9 aa, Homo Sapiens
VSNTSTFMP

SEQ ID NO: 1121591 - protein, 9 aa, Homo Sapiens
SVGFSVKED

SEQ ID NO: 1121592 - protein, 9 aa, Homo Sapiens
RPPSLHPSQ

SEQ ID NO: 1121593 - protein, 9 aa, Homo Sapiens
SRLHIIFGG

SEQ ID NO: 1121594 - protein, 9 aa, Homo Sapiens
MGYQNVEDD

SEQ ID NO: 1121595 - protein, 9 aa, Homo Sapiens
VCYNDCFFY

SEQ ID NO: 1121596 - protein, 9 aa, Homo Sapiens
MRDLKPFRI

SEQ ID NO: 1121597 - protein, 9 aa, Homo Sapiens
MSEIYRKDL

SEQ ID NO: 1121598 - protein, 9 aa, Homo Sapiens
QLSAGPLGL

SEQ ID NO: 1121599 - protein, 9 aa, Homo Sapiens
TSACPSSPI

SEQ ID NO: 1121600 - protein, 9 aa, Homo Sapiens
LAHTASPHP

SEQ ID NO: 1121601 - protein, 9 aa, Homo Sapiens
GEVELSRKV

SEQ ID NO: 1121602 - protein, 9 aa, Homo Sapiens
KAHQPESYL

SEQ ID NO: 1121603 - protein, 9 aa, Homo Sapiens
AAGHVHGIA

SEQ ID NO: 1121604 - protein, 9 aa, Homo Sapiens
ASCSAPVLL

SEQ ID NO: 1121605 - protein, 9 aa, Homo Sapiens
HVNLLFLEA

SEQ ID NO: 1121606 - protein, 9 aa, Homo Sapiens
LLDEVLDRF

SEQ ID NO: 1121607 - protein, 9 aa, Homo Sapiens
RRDQAAAFL

SEQ ID NO: 1121608 - protein, 9 aa, Homo Sapiens
SLVGIWNTW

SEQ ID NO: 1121609 - protein, 9 aa, Homo Sapiens
LVEHAELIL

SEQ ID NO: 1121610 - protein, 9 aa, Homo Sapiens
AYPARPEVS

SEQ ID NO: 1121611 - protein, 9 aa, Homo Sapiens
GLGFSFLEK

SEQ ID NO: 1121612 - protein, 9 aa, Homo Sapiens
VVFSATAST

SEQ ID NO: 1121613 - protein, 9 aa, Homo Sapiens
RTGQLPVSP

SEQ ID NO: 1121614 - protein, 9 aa, Homo Sapiens
ACQVGLLPT

SEQ ID NO: 1121615 - protein, 9 aa, Homo Sapiens
SCQVPRTDA

SEQ ID NO: 1121616 - protein, 9 aa, Homo Sapiens
TPRASRAPR

SEQ ID NO: 1121617 - protein, 9 aa, Homo Sapiens
PPGAVLDPS

SEQ ID NO: 1121618 - protein, 9 aa, Homo Sapiens
DFDPVSTVL

SEQ ID NO: 1121619 - protein, 9 aa, Homo Sapiens
SPRHRVVQS

SEQ ID NO: 1121620 - protein, 9 aa, Homo Sapiens
HRIDNTTVT

SEQ ID NO: 1121621 - protein, 9 aa, Homo Sapiens
GDNVIESKA

SEQ ID NO: 1121622 - protein, 9 aa, Homo Sapiens
VADFLQNIM

SEQ ID NO: 1121623 - protein, 9 aa, Homo Sapiens
GGAFIDLPL

SEQ ID NO: 1121624 - protein, 9 aa, Homo Sapiens
LMPPPGLRP

SEQ ID NO: 1121625 - protein, 9 aa, Homo Sapiens
WLMSPNRGV

SEQ ID NO: 1121626 - protein, 9 aa, Homo Sapiens
RTEQGWSCP

SEQ ID NO: 1121627 - protein, 9 aa, Homo Sapiens
LCEDVVLQD

SEQ ID NO: 1121628 - protein, 9 aa, Homo Sapiens
IVGTGSNTC

SEQ ID NO: 1121629 - protein, 9 aa, Homo Sapiens
AENHDMLMM

SEQ ID NO: 1121630 - protein, 9 aa, Homo Sapiens
YHLILLSET

SEQ ID NO: 1121631 - protein, 9 aa, Homo Sapiens
NWTHTAACV

SEQ ID NO: 1121632 - protein, 9 aa, Homo Sapiens
CRLFEYDQG

SEQ ID NO: 1121633 - protein, 9 aa, Homo Sapiens
TRPSSPPPL

SEQ ID NO: 1121634 - protein, 9 aa, Homo Sapiens
SDDTSELEE

SEQ ID NO: 1121635 - protein, 9 aa, Homo Sapiens
STSRDSRSF

SEQ ID NO: 1121636 - protein, 9 aa, Homo Sapiens
NQSTPKKRK

SEQ ID NO: 1121637 - protein, 9 aa, Homo Sapiens
GKVIDEIHR

SEQ ID NO: 1121638 - protein, 9 aa, Homo Sapiens
RFGKRVALG

SEQ ID NO: 1121639 - protein, 9 aa, Homo Sapiens
LGPLKTEQG

SEQ ID NO: 1121640 - protein, 9 aa, Homo Sapiens
LRSLAAWDA

SEQ ID NO: 1121641 - protein, 9 aa, Homo Sapiens
RAPELVLVR

SEQ ID NO: 1121642 - protein, 9 aa, Homo Sapiens
ASPRKSTLE

SEQ ID NO: 1121643 - protein, 9 aa, Homo Sapiens
HSGENLTSV

SEQ ID NO: 1121644 - protein, 9 aa, Homo Sapiens
IQDQDQELA

SEQ ID NO: 1121645 - protein, 9 aa, Homo Sapiens
GSANSLRVC

SEQ ID NO: 1121646 - protein, 9 aa, Homo Sapiens
PRDLIPRLQ

SEQ ID NO: 1121647 - protein, 9 aa, Homo Sapiens
LAVDSNTSS

SEQ ID NO: 1121648 - protein, 9 aa, Homo Sapiens
RSLPAVACR

SEQ ID NO: 1121649 - protein, 9 aa, Homo Sapiens
AAVSSSEET

SEQ ID NO: 1121650 - protein, 9 aa, Homo Sapiens
HRRARRVRD

SEQ ID NO: 1121651 - protein, 9 aa, Homo Sapiens
ASLGLFLNS

SEQ ID NO: 1121652 - protein, 9 aa, Homo Sapiens
GKSHSIPKF

SEQ ID NO: 1121653 - protein, 9 aa, Homo Sapiens
LKSLVSKGA

SEQ ID NO: 1121654 - protein, 9 aa, Homo Sapiens
SLPQLSPTP

SEQ ID NO: 1121655 - protein, 9 aa, Homo Sapiens
LKIKKLKEQ

SEQ ID NO: 1121656 - protein, 9 aa, Homo Sapiens
ADELLFRRI

SEQ ID NO: 1121657 - protein, 9 aa, Homo Sapiens
SGTWKRVHS

SEQ ID NO: 1121658 - protein, 9 aa, Homo Sapiens
TSRSIVSLC

SEQ ID NO: 1121659 - protein, 9 aa, Homo Sapiens
WRRSGRRSG

SEQ ID NO: 1121660 - protein, 9 aa, Homo Sapiens
LETRPTQRP

SEQ ID NO: 1121661 - protein, 9 aa, Homo Sapiens
QQQHIFEPP

SEQ ID NO: 1121662 - protein, 9 aa, Homo Sapiens
LALCFAMFG

SEQ ID NO: 1121663 - protein, 9 aa, Homo Sapiens
YSLMNSRLS

SEQ ID NO: 1121664 - protein, 9 aa, Homo Sapiens
KSASVMAAT

SEQ ID NO: 1121665 - protein, 9 aa, Homo Sapiens
CIEKQVLQL

SEQ ID NO: 1121666 - protein, 9 aa, Homo Sapiens
YLSIVRAAH

SEQ ID NO: 1121667 - protein, 9 aa, Homo Sapiens
SKPIQFDPG

SEQ ID NO: 1121668 - protein, 9 aa, Homo Sapiens
PLEETSPHQ

SEQ ID NO: 1121669 - protein, 9 aa, Homo Sapiens
FEEEEEEGD

SEQ ID NO: 1121670 - protein, 9 aa, Homo Sapiens
FPLFFLFLG

SEQ ID NO: 1121671 - protein, 9 aa, Homo Sapiens
PFLAKAGLP

SEQ ID NO: 1121672 - protein, 9 aa, Homo Sapiens
LGTWIISIY

SEQ ID NO: 1121673 - protein, 9 aa, Homo Sapiens
KKGLCHLLL

SEQ ID NO: 1121674 - protein, 9 aa, Homo Sapiens
AVPKRMKGP

SEQ ID NO: 1121675 - protein, 9 aa, Homo Sapiens
GYGRSVSSS

SEQ ID NO: 1121676 - protein, 9 aa, Homo Sapiens
PYGITPEPR

SEQ ID NO: 1121677 - protein, 9 aa, Homo Sapiens
APTPPAPPT

SEQ ID NO: 1121678 - protein, 9 aa, Homo Sapiens
LGHIWKLSD

SEQ ID NO: 1121679 - protein, 9 aa, Homo Sapiens
LPFTIKLLL

SEQ ID NO: 1121680 - protein, 9 aa, Homo Sapiens
PRVNLGLGE

SEQ ID NO: 1121681 - protein, 9 aa, Homo Sapiens
QEPPCTRLH

SEQ ID NO: 1121682 - protein, 9 aa, Homo Sapiens
DFPVFLRRS

SEQ ID NO: 1121683 - protein, 9 aa, Homo Sapiens
SALLSYEST

SEQ ID NO: 1121684 - protein, 9 aa, Homo Sapiens
AWLAEAGLP

SEQ ID NO: 1121685 - protein, 9 aa, Homo Sapiens
GSQLLQKKC

SEQ ID NO: 1121686 - protein, 9 aa, Homo Sapiens
TLPPSKITL

SEQ ID NO: 1121687 - protein, 9 aa, Homo Sapiens
AARAKVAGP

SEQ ID NO: 1121688 - protein, 9 aa, Homo Sapiens
RRRHSDKND

SEQ ID NO: 1121689 - protein, 9 aa, Homo Sapiens
GVLRPSSPP

SEQ ID NO: 1121690 - protein, 9 aa, Homo Sapiens
LPRKSHDNV

SEQ ID NO: 1121691 - protein, 9 aa, Homo Sapiens
STQFSTSLW

SEQ ID NO: 1121692 - protein, 9 aa, Homo Sapiens
LIVSILSEV

SEQ ID NO: 1121693 - protein, 9 aa, Homo Sapiens
SLMIQKAVI

SEQ ID NO: 1121694 - protein, 9 aa, Homo Sapiens
QKKGPRKRS

SEQ ID NO: 1121695 - protein, 9 aa, Homo Sapiens
RGSRQRVVM

SEQ ID NO: 1121696 - protein, 9 aa, Homo Sapiens
GVQWRITSC

SEQ ID NO: 1121697 - protein, 9 aa, Homo Sapiens
TKRTTKSWS

SEQ ID NO: 1121698 - protein, 9 aa, Homo Sapiens
TILDIEKIH

SEQ ID NO: 1121699 - protein, 9 aa, Homo Sapiens
RRCGGPRIL

SEQ ID NO: 1121700 - protein, 9 aa, Homo Sapiens
HTGCELRCK

SEQ ID NO: 1121701 - protein, 9 aa, Homo Sapiens
PDAPSPTQE

SEQ ID NO: 1121702 - protein, 9 aa, Homo Sapiens
VARTLPKVP

SEQ ID NO: 1121703 - protein, 9 aa, Homo Sapiens
RDVVTYTEH

SEQ ID NO: 1121704 - protein, 9 aa, Homo Sapiens
RPVCCPRAP

SEQ ID NO: 1121705 - protein, 9 aa, Homo Sapiens
TRSPRRPRP

SEQ ID NO: 1121706 - protein, 9 aa, Homo Sapiens
TPHIIMHLT

SEQ ID NO: 1121707 - protein, 9 aa, Homo Sapiens
ARPSPGPRL

SEQ ID NO: 1121708 - protein, 9 aa, Homo Sapiens
PVFPPLIPL

SEQ ID NO: 1121709 - protein, 9 aa, Homo Sapiens
RITREEFIT

SEQ ID NO: 1121710 - protein, 9 aa, Homo Sapiens
APHLKETLS

SEQ ID NO: 1121711 - protein, 9 aa, Homo Sapiens
ILSNPEIMR

SEQ ID NO: 1121712 - protein, 9 aa, Homo Sapiens
GSILAPLYQ

SEQ ID NO: 1121713 - protein, 9 aa, Homo Sapiens
FPPEASDYL

SEQ ID NO: 1121714 - protein, 9 aa, Homo Sapiens
TARATSGTA

SEQ ID NO: 1121715 - protein, 9 aa, Homo Sapiens
LYLKKKQEP

SEQ ID NO: 1121716 - protein, 9 aa, Homo Sapiens
SSSTQHKML

SEQ ID NO: 1121717 - protein, 9 aa, Homo Sapiens
AYALLLYDE

SEQ ID NO: 1121718 - protein, 9 aa, Homo Sapiens
DVLIGFGRC

SEQ ID NO: 1121719 - protein, 9 aa, Homo Sapiens
VQSTLEQTQ

SEQ ID NO: 1121720 - protein, 9 aa, Homo Sapiens
IICKKDAPH

SEQ ID NO: 1121721 - protein, 9 aa, Homo Sapiens
DKSLSKLVH

SEQ ID NO: 1121722 - protein, 9 aa, Homo Sapiens
CFIKVLTII

SEQ ID NO: 1121723 - protein, 9 aa, Homo Sapiens
PARDPPRPT

SEQ ID NO: 1121724 - protein, 9 aa, Homo Sapiens
MCGKKYTQK

SEQ ID NO: 1121725 - protein, 9 aa, Homo Sapiens
KTYPICKQP

SEQ ID NO: 1121726 - protein, 9 aa, Homo Sapiens
LLQATDDIL

SEQ ID NO: 1121727 - protein, 9 aa, Homo Sapiens
DQLVGGQVG

SEQ ID NO: 1121728 - protein, 9 aa, Homo Sapiens
QRLTIHHLK

SEQ ID NO: 1121729 - protein, 9 aa, Homo Sapiens
NGEKLEFCT

SEQ ID NO: 1121730 - protein, 9 aa, Homo Sapiens
ERGWWKAIS

SEQ ID NO: 1121731 - protein, 9 aa, Homo Sapiens
QKTEAFTKS

SEQ ID NO: 1121732 - protein, 9 aa, Homo Sapiens
QVTEMAPKR

SEQ ID NO: 1121733 - protein, 9 aa, Homo Sapiens
QDFEKSKKY

SEQ ID NO: 1121734 - protein, 9 aa, Homo Sapiens
NSTFPSMLA

SEQ ID NO: 1121735 - protein, 9 aa, Homo Sapiens
VADGKFTTV

SEQ ID NO: 1121736 - protein, 9 aa, Homo Sapiens
MNPPKYGKI

SEQ ID NO: 1121737 - protein, 9 aa, Homo Sapiens
TGTFKLDKR

SEQ ID NO: 1121738 - protein, 9 aa, Homo Sapiens
YHSLVMCLR

SEQ ID NO: 1121739 - protein, 9 aa, Homo Sapiens
ALLYYGCRR

SEQ ID NO: 1121740 - protein, 9 aa, Homo Sapiens
CYTSTIFSS

SEQ ID NO: 1121741 - protein, 9 aa, Homo Sapiens
ESRPVAPFP

SEQ ID NO: 1121742 - protein, 9 aa, Homo Sapiens
TGGFDGTYY

SEQ ID NO: 1121743 - protein, 9 aa, Homo Sapiens
LCISIRQLQ

SEQ ID NO: 1121744 - protein, 9 aa, Homo Sapiens
IDGEKEHTN

SEQ ID NO: 1121745 - protein, 9 aa, Homo Sapiens
RPGRPSLAS

SEQ ID NO: 1121746 - protein, 9 aa, Homo Sapiens
LVDLAGSES

SEQ ID NO: 1121747 - protein, 9 aa, Homo Sapiens
VSQQGRGVY

SEQ ID NO: 1121748 - protein, 9 aa, Homo Sapiens
FLGEQSGGK

SEQ ID NO: 1121749 - protein, 9 aa, Homo Sapiens
ITFKTGKVG

SEQ ID NO: 1121750 - protein, 9 aa, Homo Sapiens
LQPLWESVD

SEQ ID NO: 1121751 - protein, 9 aa, Homo Sapiens
AFLAQESLQ

SEQ ID NO: 1121752 - protein, 9 aa, Homo Sapiens
RIETIKARM

SEQ ID NO: 1121753 - protein, 9 aa, Homo Sapiens
VATAPVPAG

SEQ ID NO: 1121754 - protein, 9 aa, Homo Sapiens
RQRVVMCCT

SEQ ID NO: 1121755 - protein, 9 aa, Homo Sapiens
RPWLFSLLW

SEQ ID NO: 1121756 - protein, 9 aa, Homo Sapiens
WTAAARHLR

SEQ ID NO: 1121757 - protein, 9 aa, Homo Sapiens
DDQLFYTNV

SEQ ID NO: 1121758 - protein, 9 aa, Homo Sapiens
RNLPGEPGT

SEQ ID NO: 1121759 - protein, 9 aa, Homo Sapiens
TRLMAPVGS

SEQ ID NO: 1121760 - protein, 9 aa, Homo Sapiens
VKKLQRQAS

SEQ ID NO: 1121761 - protein, 9 aa, Homo Sapiens
PKNLVACPD

SEQ ID NO: 1121762 - protein, 9 aa, Homo Sapiens
GGLGEVAQG

SEQ ID NO: 1121763 - protein, 9 aa, Homo Sapiens
FRNKLFVKV

SEQ ID NO: 1121764 - protein, 9 aa, Homo Sapiens
VGIITQETL

SEQ ID NO: 1121765 - protein, 9 aa, Homo Sapiens
GCCLCPHPP

SEQ ID NO: 1121766 - protein, 9 aa, Homo Sapiens
RCRDGALHE

SEQ ID NO: 1121767 - protein, 9 aa, Homo Sapiens
QRLLERPYP

SEQ ID NO: 1121768 - protein, 9 aa, Homo Sapiens
LSKNFFDFL

SEQ ID NO: 1121769 - protein, 9 aa, Homo Sapiens
RNKPSEGKA

SEQ ID NO: 1121770 - protein, 9 aa, Homo Sapiens
DAVKPGVQY

SEQ ID NO: 1121771 - protein, 9 aa, Homo Sapiens
AARCVCDRD

SEQ ID NO: 1121772 - protein, 9 aa, Homo Sapiens
LPFVASLFR

SEQ ID NO: 1121773 - protein, 9 aa, Homo Sapiens
SDQACDTMD

SEQ ID NO: 1121774 - protein, 9 aa, Homo Sapiens
SKLVHADGD

SEQ ID NO: 1121775 - protein, 9 aa, Homo Sapiens
HHHSQNYCY

SEQ ID NO: 1121776 - protein, 9 aa, Homo Sapiens
ESWMRPCSE

SEQ ID NO: 1121777 - protein, 9 aa, Homo Sapiens
LRKIPHFNA

SEQ ID NO: 1121778 - protein, 9 aa, Homo Sapiens
SNSKKIYDS

SEQ ID NO: 1121779 - protein, 9 aa, Homo Sapiens
VTFSGPSGP

SEQ ID NO: 1121780 - protein, 9 aa, Homo Sapiens
VVVILPGKM

SEQ ID NO: 1121781 - protein, 9 aa, Homo Sapiens
RPSNQCHNS

SEQ ID NO: 1121782 - protein, 9 aa, Homo Sapiens
SLSTSSSLE

SEQ ID NO: 1121783 - protein, 9 aa, Homo Sapiens
VSRCENNSP

SEQ ID NO: 1121784 - protein, 9 aa, Homo Sapiens
GATLFQCVA

SEQ ID NO: 1121785 - protein, 9 aa, Homo Sapiens
PALGPISCS

SEQ ID NO: 1121786 - protein, 9 aa, Homo Sapiens
DLRALGIPF

SEQ ID NO: 1121787 - protein, 9 aa, Homo Sapiens
HGNDTVQIP

SEQ ID NO: 1121788 - protein, 9 aa, Homo Sapiens
TEIGTTAAG

SEQ ID NO: 1121789 - protein, 9 aa, Homo Sapiens
GDPWTGAGR

SEQ ID NO: 1121790 - protein, 9 aa, Homo Sapiens
YVVGWIITI

SEQ ID NO: 1121791 - protein, 9 aa, Homo Sapiens
DPIMLNVGG

SEQ ID NO: 1121792 - protein, 9 aa, Homo Sapiens
SHSKSPKRS

SEQ ID NO: 1121793 - protein, 9 aa, Homo Sapiens
NQPERVWVH

SEQ ID NO: 1121794 - protein, 9 aa, Homo Sapiens
GASTPSSGA

SEQ ID NO: 1121795 - protein, 9 aa, Homo Sapiens
QQSFLAAAH

SEQ ID NO: 1121796 - protein, 9 aa, Homo Sapiens
PWTGAGRRA

SEQ ID NO: 1121797 - protein, 9 aa, Homo Sapiens
SGPRVSQGY

SEQ ID NO: 1121798 - protein, 9 aa, Homo Sapiens
NKGLEILFS

SEQ ID NO: 1121799 - protein, 9 aa, Homo Sapiens
PQWMLKATL

SEQ ID NO: 1121800 - protein, 9 aa, Homo Sapiens
FFREVKESE

SEQ ID NO: 1121801 - protein, 9 aa, Homo Sapiens
IAARGLCSA

SEQ ID NO: 1121802 - protein, 9 aa, Homo Sapiens
MLTLYWVGM

SEQ ID NO: 1121803 - protein, 9 aa, Homo Sapiens
AAYQAAPLL

SEQ ID NO: 1121804 - protein, 9 aa, Homo Sapiens
LVRHQRIHA

SEQ ID NO: 1121805 - protein, 9 aa, Homo Sapiens
ASAPWSERV

SEQ ID NO: 1121806 - protein, 9 aa, Homo Sapiens
SKILARHNE

SEQ ID NO: 1121807 - protein, 9 aa, Homo Sapiens
GCRHIDGAY

SEQ ID NO: 1121808 - protein, 9 aa, Homo Sapiens
GKAVQDLSR

SEQ ID NO: 1121809 - protein, 9 aa, Homo Sapiens
APCPLLEGS

SEQ ID NO: 1121810 - protein, 9 aa, Homo Sapiens
RILLQRNLL

SEQ ID NO: 1121811 - protein, 9 aa, Homo Sapiens
MCPENAVDC

SEQ ID NO: 1121812 - protein, 9 aa, Homo Sapiens
PMRRAQSSF

SEQ ID NO: 1121813 - protein, 9 aa, Homo Sapiens
ATGGDEPAG

SEQ ID NO: 1121814 - protein, 9 aa, Homo Sapiens
ELWQKYNVR

SEQ ID NO: 1121815 - protein, 9 aa, Homo Sapiens
LEPKVTAEF

SEQ ID NO: 1121816 - protein, 9 aa, Homo Sapiens
KKYTQKDQL

SEQ ID NO: 1121817 - protein, 9 aa, Homo Sapiens
GSRGGAVAA

SEQ ID NO: 1121818 - protein, 9 aa, Homo Sapiens
CMMNWTHTA

SEQ ID NO: 1121819 - protein, 9 aa, Homo Sapiens
LLLGKNKMN

SEQ ID NO: 1121820 - protein, 9 aa, Homo Sapiens
SAAGGGPGG

SEQ ID NO: 1121821 - protein, 9 aa, Homo Sapiens
SLDPESIFR

SEQ ID NO: 1121822 - protein, 9 aa, Homo Sapiens
KQAFSMPHD

SEQ ID NO: 1121823 - protein, 9 aa, Homo Sapiens
NIPPVGLLV

SEQ ID NO: 1121824 - protein, 9 aa, Homo Sapiens
CMKGPQGKG

SEQ ID NO: 1121825 - protein, 9 aa, Homo Sapiens
GLGAAPLPP

SEQ ID NO: 1121826 - protein, 9 aa, Homo Sapiens
LGHGLVTVR

SEQ ID NO: 1121827 - protein, 9 aa, Homo Sapiens
EIGNQVVIV

SEQ ID NO: 1121828 - protein, 9 aa, Homo Sapiens
LVFKRSPFL

SEQ ID NO: 1121829 - protein, 9 aa, Homo Sapiens
GSGISAQPS

SEQ ID NO: 1121830 - protein, 9 aa, Homo Sapiens
KFKPDCVNI

SEQ ID NO: 1121831 - protein, 9 aa, Homo Sapiens
FAADIGHRN

SEQ ID NO: 1121832 - protein, 9 aa, Homo Sapiens
VFLYMWSFC

SEQ ID NO: 1121833 - protein, 9 aa, Homo Sapiens
LCVWGGYVS

SEQ ID NO: 1121834 - protein, 9 aa, Homo Sapiens
LLSHWPFLK

SEQ ID NO: 1121835 - protein, 9 aa, Homo Sapiens
HISSPDEAA

SEQ ID NO: 1121836 - protein, 9 aa, Homo Sapiens
AKGVQKIPV

SEQ ID NO: 1121837 - protein, 9 aa, Homo Sapiens
GKGYHIHNQ

SEQ ID NO: 1121838 - protein, 9 aa, Homo Sapiens
GLTKCVKKS

SEQ ID NO: 1121839 - protein, 9 aa, Homo Sapiens
RYLDVKKPI

SEQ ID NO: 1121840 - protein, 9 aa, Homo Sapiens
ALTQSNQLI

SEQ ID NO: 1121841 - protein, 9 aa, Homo Sapiens
MLPFSRFLN

SEQ ID NO: 1121842 - protein, 9 aa, Homo Sapiens
LFSITPEVV

SEQ ID NO: 1121843 - protein, 9 aa, Homo Sapiens
VNKNQSALI

SEQ ID NO: 1121844 - protein, 9 aa, Homo Sapiens
DMFASQHHR

SEQ ID NO: 1121845 - protein, 9 aa, Homo Sapiens
KTFKCTQCG

SEQ ID NO: 1121846 - protein, 9 aa, Homo Sapiens
PGGGCCAKP

SEQ ID NO: 1121847 - protein, 9 aa, Homo Sapiens
GGAITFKTG

SEQ ID NO: 1121848 - protein, 9 aa, Homo Sapiens
AVARAVIVG

SEQ ID NO: 1121849 - protein, 9 aa, Homo Sapiens
MNARGIPRS

SEQ ID NO: 1121850 - protein, 9 aa, Homo Sapiens
EGSSWLPER

SEQ ID NO: 1121851 - protein, 9 aa, Homo Sapiens
RSSDLEAQL

SEQ ID NO: 1121852 - protein, 9 aa, Homo Sapiens
PLPASPGPP

SEQ ID NO: 1121853 - protein, 9 aa, Homo Sapiens
QKTQLHLQE

SEQ ID NO: 1121854 - protein, 9 aa, Homo Sapiens
LETEGSKFP

SEQ ID NO: 1121855 - protein, 9 aa, Homo Sapiens
ERGDHDLNG

SEQ ID NO: 1121856 - protein, 9 aa, Homo Sapiens
DTDQNYDYA

SEQ ID NO: 1121857 - protein, 9 aa, Homo Sapiens
PRPWSPEDP

SEQ ID NO: 1121858 - protein, 9 aa, Homo Sapiens
HPPVGSGSP

SEQ ID NO: 1121859 - protein, 9 aa, Homo Sapiens
CDKKRGASS

SEQ ID NO: 1121860 - protein, 9 aa, Homo Sapiens
SQLGSLKRD

SEQ ID NO: 1121861 - protein, 9 aa, Homo Sapiens
KRSLLLLPH

SEQ ID NO: 1121862 - protein, 9 aa, Homo Sapiens
AAAGGSQGA

SEQ ID NO: 1121863 - protein, 9 aa, Homo Sapiens
ENIHKHILH

SEQ ID NO: 1121864 - protein, 9 aa, Homo Sapiens
VLSLACTHT

SEQ ID NO: 1121865 - protein, 9 aa, Homo Sapiens
RSAAAASPR

SEQ ID NO: 1121866 - protein, 9 aa, Homo Sapiens
GVGNPGAAM

SEQ ID NO: 1121867 - protein, 9 aa, Homo Sapiens
MKGPAQAKL

SEQ ID NO: 1121868 - protein, 9 aa, Homo Sapiens
DKNRFMGML

SEQ ID NO: 1121869 - protein, 9 aa, Homo Sapiens
VSASEGCKG

SEQ ID NO: 1121870 - protein, 9 aa, Homo Sapiens
VDVQALRAK

SEQ ID NO: 1121871 - protein, 9 aa, Homo Sapiens
SPPERDWPQ

SEQ ID NO: 1121872 - protein, 9 aa, Homo Sapiens
GNTYGRTAG

SEQ ID NO: 1121873 - protein, 9 aa, Homo Sapiens
HSSATGPKS

SEQ ID NO: 1121874 - protein, 9 aa, Homo Sapiens
SSGTSPTWA

SEQ ID NO: 1121875 - protein, 9 aa, Homo Sapiens
WTALIAWDP

SEQ ID NO: 1121876 - protein, 9 aa, Homo Sapiens
TERGSTEGG

SEQ ID NO: 1121877 - protein, 9 aa, Homo Sapiens
FCEMVERAL

SEQ ID NO: 1121878 - protein, 9 aa, Homo Sapiens
YRKDLLARN

SEQ ID NO: 1121879 - protein, 9 aa, Homo Sapiens
RRRLQEELK

SEQ ID NO: 1121880 - protein, 9 aa, Homo Sapiens
STGSSTASA

SEQ ID NO: 1121881 - protein, 9 aa, Homo Sapiens
LGTIDSAFG

SEQ ID NO: 1121882 - protein, 9 aa, Homo Sapiens
DNNHCQMSG

SEQ ID NO: 1121883 - protein, 9 aa, Homo Sapiens
AVLYLKKKQ

SEQ ID NO: 1121884 - protein, 9 aa, Homo Sapiens
LALKEDLLY

SEQ ID NO: 1121885 - protein, 9 aa, Homo Sapiens
TTSPPTSAP

SEQ ID NO: 1121886 - protein, 9 aa, Homo Sapiens
PCGPWGAGG

SEQ ID NO: 1121887 - protein, 9 aa, Homo Sapiens
FIVSLAYTF

SEQ ID NO: 1121888 - protein, 9 aa, Homo Sapiens
QRNFCLLFD

SEQ ID NO: 1121889 - protein, 9 aa, Homo Sapiens
ARYGDGQQD

SEQ ID NO: 1121890 - protein, 9 aa, Homo Sapiens
AADVTTHFD

SEQ ID NO: 1121891 - protein, 9 aa, Homo Sapiens
YGTSIIVER

SEQ ID NO: 1121892 - protein, 9 aa, Homo Sapiens
GPLPASPGP

SEQ ID NO: 1121893 - protein, 9 aa, Homo Sapiens
LCGVGLRRF

SEQ ID NO: 1121894 - protein, 9 aa, Homo Sapiens
ELQEQLYMR

SEQ ID NO: 1121895 - protein, 9 aa, Homo Sapiens
WAPSWACTC

SEQ ID NO: 1121896 - protein, 9 aa, Homo Sapiens
RSYIVDAGF

SEQ ID NO: 1121897 - protein, 9 aa, Homo Sapiens
YEWVNSPEE

SEQ ID NO: 1121898 - protein, 9 aa, Homo Sapiens
PPSAPAMGT

SEQ ID NO: 1121899 - protein, 9 aa, Homo Sapiens
TVLTYGQTG

SEQ ID NO: 1121900 - protein, 9 aa, Homo Sapiens
GSSWLPERH

SEQ ID NO: 1121901 - protein, 9 aa, Homo Sapiens
SDPGVWGPR

SEQ ID NO: 1121902 - protein, 9 aa, Homo Sapiens
QRREDEDDY

SEQ ID NO: 1121903 - protein, 9 aa, Homo Sapiens
KTKYAFSLR

SEQ ID NO: 1121904 - protein, 9 aa, Homo Sapiens
RHGRSLPRF

SEQ ID NO: 1121905 - protein, 9 aa, Homo Sapiens
NPGYVGIGC

SEQ ID NO: 1121906 - protein, 9 aa, Homo Sapiens
LKPPDGQEG

SEQ ID NO: 1121907 - protein, 9 aa, Homo Sapiens
HLDTLKKAR

SEQ ID NO: 1121908 - protein, 9 aa, Homo Sapiens
TAATTAAGA

SEQ ID NO: 1121909 - protein, 9 aa, Homo Sapiens
AVLAVHLGE

SEQ ID NO: 1121910 - protein, 9 aa, Homo Sapiens
GMTGLPRKS

SEQ ID NO: 1121911 - protein, 9 aa, Homo Sapiens
NSGRSEVPP

SEQ ID NO: 1121912 - protein, 9 aa, Homo Sapiens
HLWKRQMAS

SEQ ID NO: 1121913 - protein, 9 aa, Homo Sapiens
FLTAASTQF

SEQ ID NO: 1121914 - protein, 9 aa, Homo Sapiens
PKKPPQPRV

SEQ ID NO: 1121915 - protein, 9 aa, Homo Sapiens
AELATVQSL

SEQ ID NO: 1121916 - protein, 9 aa, Homo Sapiens
EEGSEDEEY

SEQ ID NO: 1121917 - protein, 9 aa, Homo Sapiens
WGRKSAILP

SEQ ID NO: 1121918 - protein, 9 aa, Homo Sapiens
ACTPASGPS

SEQ ID NO: 1121919 - protein, 9 aa, Homo Sapiens
LCSTGRKTM

SEQ ID NO: 1121920 - protein, 9 aa, Homo Sapiens
YTQSYSERM

SEQ ID NO: 1121921 - protein, 9 aa, Homo Sapiens
MNVQWSGCS

SEQ ID NO: 1121922 - protein, 9 aa, Homo Sapiens
DGSHLGQPR

SEQ ID NO: 1121923 - protein, 9 aa, Homo Sapiens
SPLWLMTAM

SEQ ID NO: 1121924 - protein, 9 aa, Homo Sapiens
GSSTLACSR

SEQ ID NO: 1121925 - protein, 9 aa, Homo Sapiens
SPSCSAWTV

SEQ ID NO: 1121926 - protein, 9 aa, Homo Sapiens
VTLSGIYQF

SEQ ID NO: 1121927 - protein, 9 aa, Homo Sapiens
CLTTVQERK

SEQ ID NO: 1121928 - protein, 9 aa, Homo Sapiens
DFQFNASEQ

SEQ ID NO: 1121929 - protein, 9 aa, Homo Sapiens
TLVPDPCPP

SEQ ID NO: 1121930 - protein, 9 aa, Homo Sapiens
RQCANTFGS

SEQ ID NO: 1121931 - protein, 9 aa, Homo Sapiens
TTTGTFPQE

SEQ ID NO: 1121932 - protein, 9 aa, Homo Sapiens
ANGPRGSGG

SEQ ID NO: 1121933 - protein, 9 aa, Homo Sapiens
CRGTTLPSR

SEQ ID NO: 1121934 - protein, 9 aa, Homo Sapiens
GKKQSPLIF

SEQ ID NO: 1121935 - protein, 9 aa, Homo Sapiens
NSLNEVIHT

SEQ ID NO: 1121936 - protein, 9 aa, Homo Sapiens
AGALHPRTQ

SEQ ID NO: 1121937 - protein, 9 aa, Homo Sapiens
KTPSHTMML

SEQ ID NO: 1121938 - protein, 9 aa, Homo Sapiens
SWLTDPIPL

SEQ ID NO: 1121939 - protein, 9 aa, Homo Sapiens
QTGSSSLPT

SEQ ID NO: 1121940 - protein, 9 aa, Homo Sapiens
DPGPLRVPE

SEQ ID NO: 1121941 - protein, 9 aa, Homo Sapiens
GKPKKTEAP

SEQ ID NO: 1121942 - protein, 9 aa, Homo Sapiens
PLTRPRLLP

SEQ ID NO: 1121943 - protein, 9 aa, Homo Sapiens
RGHLHPPGT

SEQ ID NO: 1121944 - protein, 9 aa, Homo Sapiens
SSGCYWIDP

SEQ ID NO: 1121945 - protein, 9 aa, Homo Sapiens
AYADEAKKH

SEQ ID NO: 1121946 - protein, 9 aa, Homo Sapiens
KKQSPLIFI

SEQ ID NO: 1121947 - protein, 9 aa, Homo Sapiens
HLSPHLNQI

SEQ ID NO: 1121948 - protein, 9 aa, Homo Sapiens
TCQSRSSYM

SEQ ID NO: 1121949 - protein, 9 aa, Homo Sapiens
NTVFSPDGH

SEQ ID NO: 1121950 - protein, 9 aa, Homo Sapiens
HSNPYVKTY

SEQ ID NO: 1121951 - protein, 9 aa, Homo Sapiens
SHDNKDTCK

SEQ ID NO: 1121952 - protein, 9 aa, Homo Sapiens
HCETLGVKT

SEQ ID NO: 1121953 - protein, 9 aa, Homo Sapiens
VFLVFAKLY

SEQ ID NO: 1121954 - protein, 9 aa, Homo Sapiens
ARAKTWVKK

SEQ ID NO: 1121955 - protein, 9 aa, Homo Sapiens
DCRLAALPP

SEQ ID NO: 1121956 - protein, 9 aa, Homo Sapiens
TIRGHLGPS

SEQ ID NO: 1121957 - protein, 9 aa, Homo Sapiens
STPKKRKTG

SEQ ID NO: 1121958 - protein, 9 aa, Homo Sapiens
EFVCMKGPQ

SEQ ID NO: 1121959 - protein, 9 aa, Homo Sapiens
HEMESLTAT

SEQ ID NO: 1121960 - protein, 9 aa, Homo Sapiens
RTLKQTGHV

SEQ ID NO: 1121961 - protein, 9 aa, Homo Sapiens
VPHTARPPL

SEQ ID NO: 1121962 - protein, 9 aa, Homo Sapiens
EADQRDFRP

SEQ ID NO: 1121963 - protein, 9 aa, Homo Sapiens
TPMDSHRSS

SEQ ID NO: 1121964 - protein, 9 aa, Homo Sapiens
PVFGQHGIL

SEQ ID NO: 1121965 - protein, 9 aa, Homo Sapiens
KELHRSYVR

SEQ ID NO: 1121966 - protein, 9 aa, Homo Sapiens
CYYLLPGLS

SEQ ID NO: 1121967 - protein, 9 aa, Homo Sapiens
TAGSTSQLP

SEQ ID NO: 1121968 - protein, 9 aa, Homo Sapiens
IHLHTHYVI

SEQ ID NO: 1121969 - protein, 9 aa, Homo Sapiens
NGKVFDATK

SEQ ID NO: 1121970 - protein, 9 aa, Homo Sapiens
AFFCEERGV

SEQ ID NO: 1121971 - protein, 9 aa, Homo Sapiens
QLCGVGLRR

SEQ ID NO: 1121972 - protein, 9 aa, Homo Sapiens
MRRAQSSFC

SEQ ID NO: 1121973 - protein, 9 aa, Homo Sapiens
NFWVLLHDG

SEQ ID NO: 1121974 - protein, 9 aa, Homo Sapiens
ESPILVHRS

SEQ ID NO: 1121975 - protein, 9 aa, Homo Sapiens
KQSMTMNLA

SEQ ID NO: 1121976 - protein, 9 aa, Homo Sapiens
AGPGPPPLS

SEQ ID NO: 1121977 - protein, 9 aa, Homo Sapiens
PRMMRPGQG

SEQ ID NO: 1121978 - protein, 9 aa, Homo Sapiens
DSSLSFQCH

SEQ ID NO: 1121979 - protein, 9 aa, Homo Sapiens
SIRWDDRGE

SEQ ID NO: 1121980 - protein, 9 aa, Homo Sapiens
PVCCPRAPE

SEQ ID NO: 1121981 - protein, 9 aa, Homo Sapiens
DEKMVAVAL

SEQ ID NO: 1121982 - protein, 9 aa, Homo Sapiens
GPTHTRLSL

SEQ ID NO: 1121983 - protein, 9 aa, Homo Sapiens
PPLLVLGWP

SEQ ID NO: 1121984 - protein, 9 aa, Homo Sapiens
FSVGLHTGK

SEQ ID NO: 1121985 - protein, 9 aa, Homo Sapiens
AAISREPDI

SEQ ID NO: 1121986 - protein, 9 aa, Homo Sapiens
VFDATKGRK

SEQ ID NO: 1121987 - protein, 9 aa, Homo Sapiens
SPKATANRD

SEQ ID NO: 1121988 - protein, 9 aa, Homo Sapiens
FVSQIRGQE

SEQ ID NO: 1121989 - protein, 9 aa, Homo Sapiens
IKFRREEDA

SEQ ID NO: 1121990 - protein, 9 aa, Homo Sapiens
GHFVIPKKA

SEQ ID NO: 1121991 - protein, 9 aa, Homo Sapiens
WLFIQLHHS

SEQ ID NO: 1121992 - protein, 9 aa, Homo Sapiens
VYRQLELVI

SEQ ID NO: 1121993 - protein, 9 aa, Homo Sapiens
MLLVFICVV

SEQ ID NO: 1121994 - protein, 9 aa, Homo Sapiens
HARQHTEFH

SEQ ID NO: 1121995 - protein, 9 aa, Homo Sapiens
QACGQGTAC

SEQ ID NO: 1121996 - protein, 9 aa, Homo Sapiens
TARPPLRPH

SEQ ID NO: 1121997 - protein, 9 aa, Homo Sapiens
PQAQAEQRV

SEQ ID NO: 1121998 - protein, 9 aa, Homo Sapiens
ICDPETEEN

SEQ ID NO: 1121999 - protein, 9 aa, Homo Sapiens
IPVLFSIMN

SEQ ID NO: 1122000 - protein, 9 aa, Homo Sapiens
QCMGPNREL

SEQ ID NO: 1122001 - protein, 9 aa, Homo Sapiens
DTILYYYQS

SEQ ID NO: 1122002 - protein, 9 aa, Homo Sapiens
LGLAVLAVH

SEQ ID NO: 1122003 - protein, 9 aa, Homo Sapiens
TLKRPSLSE

SEQ ID NO: 1122004 - protein, 9 aa, Homo Sapiens
LLAGFVSQI

SEQ ID NO: 1122005 - protein, 9 aa, Homo Sapiens
RAAAPASVA

SEQ ID NO: 1122006 - protein, 9 aa, Homo Sapiens
YILFLVATH

SEQ ID NO: 1122007 - protein, 9 aa, Homo Sapiens
PESVKNGFD

SEQ ID NO: 1122008 - protein, 9 aa, Homo Sapiens
EVYRQLELV

SEQ ID NO: 1122009 - protein, 9 aa, Homo Sapiens
FMGMLPPDR

SEQ ID NO: 1122010 - protein, 9 aa, Homo Sapiens
NTFEMHDDI

SEQ ID NO: 1122011 - protein, 9 aa, Homo Sapiens
SGARGWAQG

SEQ ID NO: 1122012 - protein, 9 aa, Homo Sapiens
QAAGRGGTT

SEQ ID NO: 1122013 - protein, 9 aa, Homo Sapiens
YKLIHKSAS

SEQ ID NO: 1122014 - protein, 9 aa, Homo Sapiens
ELEIGQVPT

SEQ ID NO: 1122015 - protein, 9 aa, Homo Sapiens
AKLEYMEEE

SEQ ID NO: 1122016 - protein, 9 aa, Homo Sapiens
EAVCAAISR

SEQ ID NO: 1122017 - protein, 9 aa, Homo Sapiens
EELVPVAEL

SEQ ID NO: 1122018 - protein, 9 aa, Homo Sapiens
SSPQEENLT

SEQ ID NO: 1122019 - protein, 9 aa, Homo Sapiens
SRAAAQLTY

SEQ ID NO: 1122020 - protein, 9 aa, Homo Sapiens
HVGQVLHAS

SEQ ID NO: 1122021 - protein, 9 aa, Homo Sapiens
NDNKLKSMS

SEQ ID NO: 1122022 - protein, 9 aa, Homo Sapiens
EMWLSKGLA

SEQ ID NO: 1122023 - protein, 9 aa, Homo Sapiens
VGGREPCAA

SEQ ID NO: 1122024 - protein, 9 aa, Homo Sapiens
QVQGKFQKA

SEQ ID NO: 1122025 - protein, 9 aa, Homo Sapiens
MCLAKNPIG

SEQ ID NO: 1122026 - protein, 9 aa, Homo Sapiens
IYQQIVQTY

SEQ ID NO: 1122027 - protein, 9 aa, Homo Sapiens
PSPSVSPAS

SEQ ID NO: 1122028 - protein, 9 aa, Homo Sapiens
SDIEGRVVE

SEQ ID NO: 1122029 - protein, 9 aa, Homo Sapiens
PTPGSAAAT

SEQ ID NO: 1122030 - protein, 9 aa, Homo Sapiens
SSKKEMLPR

SEQ ID NO: 1122031 - protein, 9 aa, Homo Sapiens
VAAEAVTFG

SEQ ID NO: 1122032 - protein, 9 aa, Homo Sapiens
ATWAPRRTP

SEQ ID NO: 1122033 - protein, 9 aa, Homo Sapiens
FARRAISTF

SEQ ID NO: 1122034 - protein, 9 aa, Homo Sapiens
ISREPDILV

SEQ ID NO: 1122035 - protein, 9 aa, Homo Sapiens
ERERLRELL

SEQ ID NO: 1122036 - protein, 9 aa, Homo Sapiens
TSTLVFYIS

SEQ ID NO: 1122037 - protein, 9 aa, Homo Sapiens
QRNTRSSVE

SEQ ID NO: 1122038 - protein, 9 aa, Homo Sapiens
CHLLAIAGN

SEQ ID NO: 1122039 - protein, 9 aa, Homo Sapiens
VTISQQLSL

SEQ ID NO: 1122040 - protein, 9 aa, Homo Sapiens
TSRTRETLE

SEQ ID NO: 1122041 - protein, 9 aa, Homo Sapiens
ADQVGLAST

SEQ ID NO: 1122042 - protein, 9 aa, Homo Sapiens
GITSFSCAC

SEQ ID NO: 1122043 - protein, 9 aa, Homo Sapiens
SGTSLACLN

SEQ ID NO: 1122044 - protein, 9 aa, Homo Sapiens
RFAFSTRLA

SEQ ID NO: 1122045 - protein, 9 aa, Homo Sapiens
LACLGMATG

SEQ ID NO: 1122046 - protein, 9 aa, Homo Sapiens
IVIGPLDFR

SEQ ID NO: 1122047 - protein, 9 aa, Homo Sapiens
CLTSPPGAP

SEQ ID NO: 1122048 - protein, 9 aa, Homo Sapiens
SQLLMGFLS

SEQ ID NO: 1122049 - protein, 9 aa, Homo Sapiens
RWHEPQPRP

SEQ ID NO: 1122050 - protein, 9 aa, Homo Sapiens
KVHTIPLRS

SEQ ID NO: 1122051 - protein, 9 aa, Homo Sapiens
WCLDYGAHR

SEQ ID NO: 1122052 - protein, 9 aa, Homo Sapiens
SFEELQLKP

SEQ ID NO: 1122053 - protein, 9 aa, Homo Sapiens
SALFIWPQH

SEQ ID NO: 1122054 - protein, 9 aa, Homo Sapiens
LAQAIAVQA

SEQ ID NO: 1122055 - protein, 9 aa, Homo Sapiens
RHHPSNKED

SEQ ID NO: 1122056 - protein, 9 aa, Homo Sapiens
HLTKHARQH

SEQ ID NO: 1122057 - protein, 9 aa, Homo Sapiens
RWWLSSGTS

SEQ ID NO: 1122058 - protein, 9 aa, Homo Sapiens
LVIGAFTLL

SEQ ID NO: 1122059 - protein, 9 aa, Homo Sapiens
AAASEDAQQ

SEQ ID NO: 1122060 - protein, 9 aa, Homo Sapiens
WRIGGGTPL

SEQ ID NO: 1122061 - protein, 9 aa, Homo Sapiens
GKAKYTTQG

SEQ ID NO: 1122062 - protein, 9 aa, Homo Sapiens
HVYRTSFYS

SEQ ID NO: 1122063 - protein, 9 aa, Homo Sapiens
AQKMSNGRL

SEQ ID NO: 1122064 - protein, 9 aa, Homo Sapiens
EASGSGEGS

SEQ ID NO: 1122065 - protein, 9 aa, Homo Sapiens
IRPSHKDAV

SEQ ID NO: 1122066 - protein, 9 aa, Homo Sapiens
GVLGVATIS

SEQ ID NO: 1122067 - protein, 9 aa, Homo Sapiens
LLPWKIRDS

SEQ ID NO: 1122068 - protein, 9 aa, Homo Sapiens
SGGFNGGCE

SEQ ID NO: 1122069 - protein, 9 aa, Homo Sapiens
LRGSVRRAG

SEQ ID NO: 1122070 - protein, 9 aa, Homo Sapiens
ARLQSRATP

SEQ ID NO: 1122071 - protein, 9 aa, Homo Sapiens
KGDDVPEIP

SEQ ID NO: 1122072 - protein, 9 aa, Homo Sapiens
LPLPDRADI

SEQ ID NO: 1122073 - protein, 9 aa, Homo Sapiens
NLFLRCPKP

SEQ ID NO: 1122074 - protein, 9 aa, Homo Sapiens
SFVQKVSVK

SEQ ID NO: 1122075 - protein, 9 aa, Homo Sapiens
GGSTRDGSA

SEQ ID NO: 1122076 - protein, 9 aa, Homo Sapiens
PLSLQCQSL

SEQ ID NO: 1122077 - protein, 9 aa, Homo Sapiens
VDLCADQPR

SEQ ID NO: 1122078 - protein, 9 aa, Homo Sapiens
PSTVCPCQN

SEQ ID NO: 1122079 - protein, 9 aa, Homo Sapiens
AANVSSEGI

SEQ ID NO: 1122080 - protein, 9 aa, Homo Sapiens
CQCQEQEVC

SEQ ID NO: 1122081 - protein, 9 aa, Homo Sapiens
LPQSYHAPI

SEQ ID NO: 1122082 - protein, 9 aa, Homo Sapiens
SYIAEIKLP

SEQ ID NO: 1122083 - protein, 9 aa, Homo Sapiens
ERAQAEVGR

SEQ ID NO: 1122084 - protein, 9 aa, Homo Sapiens
GSEALLDQR

SEQ ID NO: 1122085 - protein, 9 aa, Homo Sapiens
DTAQIVPKR

SEQ ID NO: 1122086 - protein, 9 aa, Homo Sapiens
SAVVAPATG

SEQ ID NO: 1122087 - protein, 9 aa, Homo Sapiens
LGQPRQLPR

SEQ ID NO: 1122088 - protein, 9 aa, Homo Sapiens
IPCCNCKAT

SEQ ID NO: 1122089 - protein, 9 aa, Homo Sapiens
LKLLGNFLC

SEQ ID NO: 1122090 - protein, 9 aa, Homo Sapiens
CENTDACQY

SEQ ID NO: 1122091 - protein, 9 aa, Homo Sapiens
PVGSGSPRR

SEQ ID NO: 1122092 - protein, 9 aa, Homo Sapiens
QQLNGNDVE

SEQ ID NO: 1122093 - protein, 9 aa, Homo Sapiens
AVVDGNFLC

SEQ ID NO: 1122094 - protein, 9 aa, Homo Sapiens
VLRSLAAWD

SEQ ID NO: 1122095 - protein, 9 aa, Homo Sapiens
EMCASLYVG

SEQ ID NO: 1122096 - protein, 9 aa, Homo Sapiens
MSKRCMSVG

SEQ ID NO: 1122097 - protein, 9 aa, Homo Sapiens
PFPRCSRRL

SEQ ID NO: 1122098 - protein, 9 aa, Homo Sapiens
EETKRKLRK

SEQ ID NO: 1122099 - protein, 9 aa, Homo Sapiens
APPSQRLRR

SEQ ID NO: 1122100 - protein, 9 aa, Homo Sapiens
KVSRNTLFT

SEQ ID NO: 1122101 - protein, 9 aa, Homo Sapiens
ELTDEYFFD

SEQ ID NO: 1122102 - protein, 9 aa, Homo Sapiens
HPRPPPHTH

SEQ ID NO: 1122103 - protein, 9 aa, Homo Sapiens
RALGTRSLL

SEQ ID NO: 1122104 - protein, 9 aa, Homo Sapiens
PGGPGHGAA

SEQ ID NO: 1122105 - protein, 9 aa, Homo Sapiens
GPPILGRGA

SEQ ID NO: 1122106 - protein, 9 aa, Homo Sapiens
GFCLTLRSS

SEQ ID NO: 1122107 - protein, 9 aa, Homo Sapiens
AHRSIPNVT

SEQ ID NO: 1122108 - protein, 9 aa, Homo Sapiens
ERSGQHCSG

SEQ ID NO: 1122109 - protein, 9 aa, Homo Sapiens
SSSNNLSCG

SEQ ID NO: 1122110 - protein, 9 aa, Homo Sapiens
CKAGAQLRN

SEQ ID NO: 1122111 - protein, 9 aa, Homo Sapiens
THTRLSLQG

SEQ ID NO: 1122112 - protein, 9 aa, Homo Sapiens
LTYMMTRRE

SEQ ID NO: 1122113 - protein, 9 aa, Homo Sapiens
YLLYLQDMW

SEQ ID NO: 1122114 - protein, 9 aa, Homo Sapiens
SRLSVVHMM

SEQ ID NO: 1122115 - protein, 9 aa, Homo Sapiens
THTGKKKFS

SEQ ID NO: 1122116 - protein, 9 aa, Homo Sapiens
AVHANDDLK

SEQ ID NO: 1122117 - protein, 9 aa, Homo Sapiens
FVKVYEVRS

SEQ ID NO: 1122118 - protein, 9 aa, Homo Sapiens
MDERKLREL

SEQ ID NO: 1122119 - protein, 9 aa, Homo Sapiens
LSLSRTRAL

SEQ ID NO: 1122120 - protein, 9 aa, Homo Sapiens
TKFKQHTIR

SEQ ID NO: 1122121 - protein, 9 aa, Homo Sapiens
LQMRLGCRT

SEQ ID NO: 1122122 - protein, 9 aa, Homo Sapiens
MGFLSGEPT

SEQ ID NO: 1122123 - protein, 9 aa, Homo Sapiens
REAPQVSSL

SEQ ID NO: 1122124 - protein, 9 aa, Homo Sapiens
HQQAGRILF

SEQ ID NO: 1122125 - protein, 9 aa, Homo Sapiens
WNIDRSGFT

SEQ ID NO: 1122126 - protein, 9 aa, Homo Sapiens
ERMLSAVPQ

SEQ ID NO: 1122127 - protein, 9 aa, Homo Sapiens
MLTVIGQGL

SEQ ID NO: 1122128 - protein, 9 aa, Homo Sapiens
VSHDFSINF

SEQ ID NO: 1122129 - protein, 9 aa, Homo Sapiens
KGEAKYRPR

SEQ ID NO: 1122130 - protein, 9 aa, Homo Sapiens
FSASGLVIS

SEQ ID NO: 1122131 - protein, 9 aa, Homo Sapiens
GRTGRFAFQ

SEQ ID NO: 1122132 - protein, 9 aa, Homo Sapiens
MPPPANPQL

SEQ ID NO: 1122133 - protein, 9 aa, Homo Sapiens
ESLPGAMNA

SEQ ID NO: 1122134 - protein, 9 aa, Homo Sapiens
LLYLQDMWT

SEQ ID NO: 1122135 - protein, 9 aa, Homo Sapiens
SYSWAGAVD

SEQ ID NO: 1122136 - protein, 9 aa, Homo Sapiens
RLQSPHTPL

SEQ ID NO: 1122137 - protein, 9 aa, Homo Sapiens
DLGMAGSCL

SEQ ID NO: 1122138 - protein, 9 aa, Homo Sapiens
MGGGSGNMS

SEQ ID NO: 1122139 - protein, 9 aa, Homo Sapiens
ATRSKDEST

SEQ ID NO: 1122140 - protein, 9 aa, Homo Sapiens
GSAAATPPR

SEQ ID NO: 1122141 - protein, 9 aa, Homo Sapiens
PALTPRPAT

SEQ ID NO: 1122142 - protein, 9 aa, Homo Sapiens
MSAGGPCPS

SEQ ID NO: 1122143 - protein, 9 aa, Homo Sapiens
ITAATRAGL

SEQ ID NO: 1122144 - protein, 9 aa, Homo Sapiens
CHRRRRRCC

SEQ ID NO: 1122145 - protein, 9 aa, Homo Sapiens
FISVKEAAV

SEQ ID NO: 1122146 - protein, 9 aa, Homo Sapiens
PQTGSSSLP

SEQ ID NO: 1122147 - protein, 9 aa, Homo Sapiens
PVTGSPRSF

SEQ ID NO: 1122148 - protein, 9 aa, Homo Sapiens
QMAPPVLPA

SEQ ID NO: 1122149 - protein, 9 aa, Homo Sapiens
ELGTIDSAF

SEQ ID NO: 1122150 - protein, 9 aa, Homo Sapiens
YTFNKIRLD

SEQ ID NO: 1122151 - protein, 9 aa, Homo Sapiens
TCHTPALPG

SEQ ID NO: 1122152 - protein, 9 aa, Homo Sapiens
NCMTVVQAY

SEQ ID NO: 1122153 - protein, 9 aa, Homo Sapiens
PEQLTLPIS

SEQ ID NO: 1122154 - protein, 9 aa, Homo Sapiens
HDSTLLVLQ

SEQ ID NO: 1122155 - protein, 9 aa, Homo Sapiens
FLIILGPVL

SEQ ID NO: 1122156 - protein, 9 aa, Homo Sapiens
HTAELWGIR

SEQ ID NO: 1122157 - protein, 9 aa, Homo Sapiens
LHLVHQLHG

SEQ ID NO: 1122158 - protein, 9 aa, Homo Sapiens
RLHSPTPNT

SEQ ID NO: 1122159 - protein, 9 aa, Homo Sapiens
TFGATDWEV

SEQ ID NO: 1122160 - protein, 9 aa, Homo Sapiens
PFIEIRIVE

SEQ ID NO: 1122161 - protein, 9 aa, Homo Sapiens
ADVTTHFDE

SEQ ID NO: 1122162 - protein, 9 aa, Homo Sapiens
NYPQIPDHL

SEQ ID NO: 1122163 - protein, 9 aa, Homo Sapiens
SSPPPLCRK

SEQ ID NO: 1122164 - protein, 9 aa, Homo Sapiens
GKNGRTRTL

SEQ ID NO: 1122165 - protein, 9 aa, Homo Sapiens
QVFERLVEW

SEQ ID NO: 1122166 - protein, 9 aa, Homo Sapiens
VNKGLEILF

SEQ ID NO: 1122167 - protein, 9 aa, Homo Sapiens
EICTADCGG

SEQ ID NO: 1122168 - protein, 9 aa, Homo Sapiens
NPKIGLQPL

SEQ ID NO: 1122169 - protein, 9 aa, Homo Sapiens
HEAETLALV

SEQ ID NO: 1122170 - protein, 9 aa, Homo Sapiens
AASLVRRGG

SEQ ID NO: 1122171 - protein, 9 aa, Homo Sapiens
IRSHRPCLS

SEQ ID NO: 1122172 - protein, 9 aa, Homo Sapiens
CRHSVQSIK

SEQ ID NO: 1122173 - protein, 9 aa, Homo Sapiens
PIKKNPSMK

SEQ ID NO: 1122174 - protein, 9 aa, Homo Sapiens
LQYIGWPAN

SEQ ID NO: 1122175 - protein, 9 aa, Homo Sapiens
AISASTRRQ

SEQ ID NO: 1122176 - protein, 9 aa, Homo Sapiens
DNSAGVNEK

SEQ ID NO: 1122177 - protein, 9 aa, Homo Sapiens
PPEVPGLHG

SEQ ID NO: 1122178 - protein, 9 aa, Homo Sapiens
ANGAYAKQK

SEQ ID NO: 1122179 - protein, 9 aa, Homo Sapiens
RLGAEALCQ

SEQ ID NO: 1122180 - protein, 9 aa, Homo Sapiens
INECKRRLE

SEQ ID NO: 1122181 - protein, 9 aa, Homo Sapiens
GTSGKGFVA

SEQ ID NO: 1122182 - protein, 9 aa, Homo Sapiens
LEMPSSHFL

SEQ ID NO: 1122183 - protein, 9 aa, Homo Sapiens
RAHCNSSNK

SEQ ID NO: 1122184 - protein, 9 aa, Homo Sapiens
DQGLCDLLW

SEQ ID NO: 1122185 - protein, 9 aa, Homo Sapiens
KILIIGGGV

SEQ ID NO: 1122186 - protein, 9 aa, Homo Sapiens
PDGGITAIV

SEQ ID NO: 1122187 - protein, 9 aa, Homo Sapiens
FTASCEVLE

SEQ ID NO: 1122188 - protein, 9 aa, Homo Sapiens
NHLRITADG

SEQ ID NO: 1122189 - protein, 9 aa, Homo Sapiens
EEVSVSYSD

SEQ ID NO: 1122190 - protein, 9 aa, Homo Sapiens
NPHASFSEG

SEQ ID NO: 1122191 - protein, 9 aa, Homo Sapiens
YLETYDCQM

SEQ ID NO: 1122192 - protein, 9 aa, Homo Sapiens
KRFHDIWTE

SEQ ID NO: 1122193 - protein, 9 aa, Homo Sapiens
GCHDPRDDD

SEQ ID NO: 1122194 - protein, 9 aa, Homo Sapiens
LKLPVLLAL

SEQ ID NO: 1122195 - protein, 9 aa, Homo Sapiens
IDEPTSSSI

SEQ ID NO: 1122196 - protein, 9 aa, Homo Sapiens
SSRRCLLPT

SEQ ID NO: 1122197 - protein, 9 aa, Homo Sapiens
KVISSYVHV

SEQ ID NO: 1122198 - protein, 9 aa, Homo Sapiens
DNSEGKILV

SEQ ID NO: 1122199 - protein, 9 aa, Homo Sapiens
ASRAPRTLL

SEQ ID NO: 1122200 - protein, 9 aa, Homo Sapiens
VVDSGLVHQ

SEQ ID NO: 1122201 - protein, 9 aa, Homo Sapiens
GTGTRREAP

SEQ ID NO: 1122202 - protein, 9 aa, Homo Sapiens
TGLHICDLL

SEQ ID NO: 1122203 - protein, 9 aa, Homo Sapiens
NTTHRCLLE

SEQ ID NO: 1122204 - protein, 9 aa, Homo Sapiens
SELLIGRLG

SEQ ID NO: 1122205 - protein, 9 aa, Homo Sapiens
FLAAAHMSE

SEQ ID NO: 1122206 - protein, 9 aa, Homo Sapiens
KTLRGLAVG

SEQ ID NO: 1122207 - protein, 9 aa, Homo Sapiens
AAPCRRGAP

SEQ ID NO: 1122208 - protein, 9 aa, Homo Sapiens
SEGVNKLKI

SEQ ID NO: 1122209 - protein, 9 aa, Homo Sapiens
SLSSCQSMM

SEQ ID NO: 1122210 - protein, 9 aa, Homo Sapiens
EMVERALDF

SEQ ID NO: 1122211 - protein, 9 aa, Homo Sapiens
LAKQSWGAV

SEQ ID NO: 1122212 - protein, 9 aa, Homo Sapiens
RSPLRSERQ

SEQ ID NO: 1122213 - protein, 9 aa, Homo Sapiens
HTPLVFSFI

SEQ ID NO: 1122214 - protein, 9 aa, Homo Sapiens
YRLEALKIC

SEQ ID NO: 1122215 - protein, 9 aa, Homo Sapiens
NAHYLKQSF

SEQ ID NO: 1122216 - protein, 9 aa, Homo Sapiens
LPPTPGRPA

SEQ ID NO: 1122217 - protein, 9 aa, Homo Sapiens
KIKKLKEQM

SEQ ID NO: 1122218 - protein, 9 aa, Homo Sapiens
WCLGSAWSL

SEQ ID NO: 1122219 - protein, 9 aa, Homo Sapiens
AFAQMAQAR

SEQ ID NO: 1122220 - protein, 9 aa, Homo Sapiens
CQGGDFTHH

SEQ ID NO: 1122221 - protein, 9 aa, Homo Sapiens
CQACQVGLL

SEQ ID NO: 1122222 - protein, 9 aa, Homo Sapiens
AITVPIDYV

SEQ ID NO: 1122223 - protein, 9 aa, Homo Sapiens
ALFGRGAAR

SEQ ID NO: 1122224 - protein, 9 aa, Homo Sapiens
LLTMSIDRA

SEQ ID NO: 1122225 - protein, 9 aa, Homo Sapiens
MNEENVNRV

SEQ ID NO: 1122226 - protein, 9 aa, Homo Sapiens
DDGMDSNQN

SEQ ID NO: 1122227 - protein, 9 aa, Homo Sapiens
KKGCCRLLT

SEQ ID NO: 1122228 - protein, 9 aa, Homo Sapiens
GKRRDQAAA

SEQ ID NO: 1122229 - protein, 9 aa, Homo Sapiens
ELQRSNQVA

SEQ ID NO: 1122230 - protein, 9 aa, Homo Sapiens
ATESVSTFL

SEQ ID NO: 1122231 - protein, 9 aa, Homo Sapiens
RAGGLGPEA

SEQ ID NO: 1122232 - protein, 9 aa, Homo Sapiens
ATSVEESLP

SEQ ID NO: 1122233 - protein, 9 aa, Homo Sapiens
TTLARETSL

SEQ ID NO: 1122234 - protein, 9 aa, Homo Sapiens
KCGKGFPRK

SEQ ID NO: 1122235 - protein, 9 aa, Homo Sapiens
SLERSPCPG

SEQ ID NO: 1122236 - protein, 9 aa, Homo Sapiens
HLKTLRLPC

SEQ ID NO: 1122237 - protein, 9 aa, Homo Sapiens
STSGPVGRP

SEQ ID NO: 1122238 - protein, 9 aa, Homo Sapiens
LRTLRCPTE

SEQ ID NO: 1122239 - protein, 9 aa, Homo Sapiens
SEGCKGFFR

SEQ ID NO: 1122240 - protein, 9 aa, Homo Sapiens
GAWLLGPLK

SEQ ID NO: 1122241 - protein, 9 aa, Homo Sapiens
LSLLAPKTT

SEQ ID NO: 1122242 - protein, 9 aa, Homo Sapiens
SVRHRGAPL

SEQ ID NO: 1122243 - protein, 9 aa, Homo Sapiens
PCYNFTRGD

SEQ ID NO: 1122244 - protein, 9 aa, Homo Sapiens
CCCGAGVGV

SEQ ID NO: 1122245 - protein, 9 aa, Homo Sapiens
LAVTSLSVL

SEQ ID NO: 1122246 - protein, 9 aa, Homo Sapiens
RFYPVYSAP

SEQ ID NO: 1122247 - protein, 9 aa, Homo Sapiens
TRPGLQMQE

SEQ ID NO: 1122248 - protein, 9 aa, Homo Sapiens
STDEVKAGK

SEQ ID NO: 1122249 - protein, 9 aa, Homo Sapiens
HVRSCQVPR

SEQ ID NO: 1122250 - protein, 9 aa, Homo Sapiens
VMCRTPLAS

SEQ ID NO: 1122251 - protein, 9 aa, Homo Sapiens
TSGARLGAA

SEQ ID NO: 1122252 - protein, 9 aa, Homo Sapiens
CGRAFISPS

SEQ ID NO: 1122253 - protein, 9 aa, Homo Sapiens
NHSKCITEC

SEQ ID NO: 1122254 - protein, 9 aa, Homo Sapiens
WVWMPLTIL

SEQ ID NO: 1122255 - protein, 9 aa, Homo Sapiens
LEYFSPAFY

SEQ ID NO: 1122256 - protein, 9 aa, Homo Sapiens
IGVTAVTFN

SEQ ID NO: 1122257 - protein, 9 aa, Homo Sapiens
PADGDDGPV

SEQ ID NO: 1122258 - protein, 9 aa, Homo Sapiens
APEPTERGF

SEQ ID NO: 1122259 - protein, 9 aa, Homo Sapiens
ETSSINTTI

SEQ ID NO: 1122260 - protein, 9 aa, Homo Sapiens
TIGYSISFG

SEQ ID NO: 1122261 - protein, 9 aa, Homo Sapiens
LDSEAGVPA

SEQ ID NO: 1122262 - protein, 9 aa, Homo Sapiens
RHLRSPSCP

SEQ ID NO: 1122263 - protein, 9 aa, Homo Sapiens
ACTPGKPTL

SEQ ID NO: 1122264 - protein, 9 aa, Homo Sapiens
EKLKRDVES

SEQ ID NO: 1122265 - protein, 9 aa, Homo Sapiens
GRHTVSWGS

SEQ ID NO: 1122266 - protein, 9 aa, Homo Sapiens
PLRFWANVI

SEQ ID NO: 1122267 - protein, 9 aa, Homo Sapiens
RAGKLEVDS

SEQ ID NO: 1122268 - protein, 9 aa, Homo Sapiens
EDTSHRMTH

SEQ ID NO: 1122269 - protein, 9 aa, Homo Sapiens
PQLRRPRPS

SEQ ID NO: 1122270 - protein, 9 aa, Homo Sapiens
EVAQGGSAA

SEQ ID NO: 1122271 - protein, 9 aa, Homo Sapiens
ATVLADNKP

SEQ ID NO: 1122272 - protein, 9 aa, Homo Sapiens
KGRLTGLTN

SEQ ID NO: 1122273 - protein, 9 aa, Homo Sapiens
GTKSQSEKH

SEQ ID NO: 1122274 - protein, 9 aa, Homo Sapiens
EHSATSSVV

SEQ ID NO: 1122275 - protein, 9 aa, Homo Sapiens
HMMTQSSSG

SEQ ID NO: 1122276 - protein, 9 aa, Homo Sapiens
YNDSVEHRD

SEQ ID NO: 1122277 - protein, 9 aa, Homo Sapiens
ECSVSNDAG

SEQ ID NO: 1122278 - protein, 9 aa, Homo Sapiens
SLQVKIPVA

SEQ ID NO: 1122279 - protein, 9 aa, Homo Sapiens
LVHQGDVGG

SEQ ID NO: 1122280 - protein, 9 aa, Homo Sapiens
GTVAASLVR

SEQ ID NO: 1122281 - protein, 9 aa, Homo Sapiens
GRHICEGLR

SEQ ID NO: 1122282 - protein, 9 aa, Homo Sapiens
TPTCPLEKS

SEQ ID NO: 1122283 - protein, 9 aa, Homo Sapiens
ITDYVSYTE

SEQ ID NO: 1122284 - protein, 9 aa, Homo Sapiens
ARSDAAPGG

SEQ ID NO: 1122285 - protein, 9 aa, Homo Sapiens
GMLTVIGQG

SEQ ID NO: 1122286 - protein, 9 aa, Homo Sapiens
SGGVQGAQG

SEQ ID NO: 1122287 - protein, 9 aa, Homo Sapiens
QEQLNCFRG

SEQ ID NO: 1122288 - protein, 9 aa, Homo Sapiens
DRAGPAPQG

SEQ ID NO: 1122289 - protein, 9 aa, Homo Sapiens
VYSLGRVFW

SEQ ID NO: 1122290 - protein, 9 aa, Homo Sapiens
LPGPCASLL

SEQ ID NO: 1122291 - protein, 9 aa, Homo Sapiens
RELCYGCGP

SEQ ID NO: 1122292 - protein, 9 aa, Homo Sapiens
ASTRSAVMS

SEQ ID NO: 1122293 - protein, 9 aa, Homo Sapiens
LHVQLPGGP

SEQ ID NO: 1122294 - protein, 9 aa, Homo Sapiens
QSTCTNYNT

SEQ ID NO: 1122295 - protein, 9 aa, Homo Sapiens
GIEGVQGIP

SEQ ID NO: 1122296 - protein, 9 aa, Homo Sapiens
SRPSNQCHN

SEQ ID NO: 1122297 - protein, 9 aa, Homo Sapiens
LFYLSLARS

SEQ ID NO: 1122298 - protein, 9 aa, Homo Sapiens
KEVVKDTTN

SEQ ID NO: 1122299 - protein, 9 aa, Homo Sapiens
SEALHYDYI

SEQ ID NO: 1122300 - protein, 9 aa, Homo Sapiens
HGVHHGGNE

SEQ ID NO: 1122301 - protein, 9 aa, Homo Sapiens
GCVDAARYA

SEQ ID NO: 1122302 - protein, 9 aa, Homo Sapiens
IRLKVCPVC

SEQ ID NO: 1122303 - protein, 9 aa, Homo Sapiens
LHVLIEYFH

SEQ ID NO: 1122304 - protein, 9 aa, Homo Sapiens
SRSFFTSAH

SEQ ID NO: 1122305 - protein, 9 aa, Homo Sapiens
ALQTFDYEQ

SEQ ID NO: 1122306 - protein, 9 aa, Homo Sapiens
QAPSQVWTA

SEQ ID NO: 1122307 - protein, 9 aa, Homo Sapiens
PGSAAATPP

SEQ ID NO: 1122308 - protein, 9 aa, Homo Sapiens
VPIIENAPE

SEQ ID NO: 1122309 - protein, 9 aa, Homo Sapiens
HFAEVYKAK

SEQ ID NO: 1122310 - protein, 9 aa, Homo Sapiens
DGITSFSCA

SEQ ID NO: 1122311 - protein, 9 aa, Homo Sapiens
KDALECCLD

SEQ ID NO: 1122312 - protein, 9 aa, Homo Sapiens
DWKNHFMVA

SEQ ID NO: 1122313 - protein, 9 aa, Homo Sapiens
RVVEAGGSH

SEQ ID NO: 1122314 - protein, 9 aa, Homo Sapiens
GTMVRALGR

SEQ ID NO: 1122315 - protein, 9 aa, Homo Sapiens
WAQEYLWGM

SEQ ID NO: 1122316 - protein, 9 aa, Homo Sapiens
RSPSCPRRP

SEQ ID NO: 1122317 - protein, 9 aa, Homo Sapiens
RPPWCATAA

SEQ ID NO: 1122318 - protein, 9 aa, Homo Sapiens
AGPAGTGRS

SEQ ID NO: 1122319 - protein, 9 aa, Homo Sapiens
PSGCSLKIL

SEQ ID NO: 1122320 - protein, 9 aa, Homo Sapiens
CPVHESPTG

SEQ ID NO: 1122321 - protein, 9 aa, Homo Sapiens
SELSLQPMA

SEQ ID NO: 1122322 - protein, 9 aa, Homo Sapiens
AVTTTAATG

SEQ ID NO: 1122323 - protein, 9 aa, Homo Sapiens
FIANTKDSV

SEQ ID NO: 1122324 - protein, 9 aa, Homo Sapiens
SPSQTLICK

SEQ ID NO: 1122325 - protein, 9 aa, Homo Sapiens
SGWGRWTPK

SEQ ID NO: 1122326 - protein, 9 aa, Homo Sapiens
WLLDVGIIT

SEQ ID NO: 1122327 - protein, 9 aa, Homo Sapiens
GCHLHLHAP

SEQ ID NO: 1122328 - protein, 9 aa, Homo Sapiens
ASPPPRQCL

SEQ ID NO: 1122329 - protein, 9 aa, Homo Sapiens
LVGDGMSQV

SEQ ID NO: 1122330 - protein, 9 aa, Homo Sapiens
AGAAKVKKE

SEQ ID NO: 1122331 - protein, 9 aa, Homo Sapiens
HCPRAATLG

SEQ ID NO: 1122332 - protein, 9 aa, Homo Sapiens
QGAFSEKVS

SEQ ID NO: 1122333 - protein, 9 aa, Homo Sapiens
KEPLKKRIL

SEQ ID NO: 1122334 - protein, 9 aa, Homo Sapiens
TGEVRCHIH

SEQ ID NO: 1122335 - protein, 9 aa, Homo Sapiens
WDVDDNEDE

SEQ ID NO: 1122336 - protein, 9 aa, Homo Sapiens
GQPNVLCYT

SEQ ID NO: 1122337 - protein, 9 aa, Homo Sapiens
QFLAKQGQW

SEQ ID NO: 1122338 - protein, 9 aa, Homo Sapiens
PGTGVCGWR

SEQ ID NO: 1122339 - protein, 9 aa, Homo Sapiens
CLPPTTASG

SEQ ID NO: 1122340 - protein, 9 aa, Homo Sapiens
LAALVYKCL

SEQ ID NO: 1122341 - protein, 9 aa, Homo Sapiens
PRGKDGHIV

SEQ ID NO: 1122342 - protein, 9 aa, Homo Sapiens
PHSRGPQPG

SEQ ID NO: 1122343 - protein, 9 aa, Homo Sapiens
NQSDSQSSN

SEQ ID NO: 1122344 - protein, 9 aa, Homo Sapiens
RISRSIYLG

SEQ ID NO: 1122345 - protein, 9 aa, Homo Sapiens
AIAYGAMTI

SEQ ID NO: 1122346 - protein, 9 aa, Homo Sapiens
FTIVLSFHS

SEQ ID NO: 1122347 - protein, 9 aa, Homo Sapiens
GQYNISWHS

SEQ ID NO: 1122348 - protein, 9 aa, Homo Sapiens
SIHGEKFED

SEQ ID NO: 1122349 - protein, 9 aa, Homo Sapiens
GEYTAFPSR

SEQ ID NO: 1122350 - protein, 9 aa, Homo Sapiens
LMDNGWAGG

SEQ ID NO: 1122351 - protein, 9 aa, Homo Sapiens
ASACVNPPG

SEQ ID NO: 1122352 - protein, 9 aa, Homo Sapiens
DPKCCFFGA

SEQ ID NO: 1122353 - protein, 9 aa, Homo Sapiens
MLRGLGPGL

SEQ ID NO: 1122354 - protein, 9 aa, Homo Sapiens
SLDDIKLYQ

SEQ ID NO: 1122355 - protein, 9 aa, Homo Sapiens
RWPTGTQDS

SEQ ID NO: 1122356 - protein, 9 aa, Homo Sapiens
GPQVSQQGR

SEQ ID NO: 1122357 - protein, 9 aa, Homo Sapiens
PNQHNMTNS

SEQ ID NO: 1122358 - protein, 9 aa, Homo Sapiens
RSPTRPPGP

SEQ ID NO: 1122359 - protein, 9 aa, Homo Sapiens
AIHEVETLP

SEQ ID NO: 1122360 - protein, 9 aa, Homo Sapiens
LPALCPLTR

SEQ ID NO: 1122361 - protein, 9 aa, Homo Sapiens
ASGNLSRGV

SEQ ID NO: 1122362 - protein, 9 aa, Homo Sapiens
HPSNKEDEG

SEQ ID NO: 1122363 - protein, 9 aa, Homo Sapiens
NANPAHGND

SEQ ID NO: 1122364 - protein, 9 aa, Homo Sapiens
GVHGPGPCI

SEQ ID NO: 1122365 - protein, 9 aa, Homo Sapiens
WPEEGYCQA

SEQ ID NO: 1122366 - protein, 9 aa, Homo Sapiens
THTGEKTFK

SEQ ID NO: 1122367 - protein, 9 aa, Homo Sapiens
GSRDSPASP

SEQ ID NO: 1122368 - protein, 9 aa, Homo Sapiens
CGLNHVNHF

SEQ ID NO: 1122369 - protein, 9 aa, Homo Sapiens
QPRTRLLPA

SEQ ID NO: 1122370 - protein, 9 aa, Homo Sapiens
CTNYNTPLW

SEQ ID NO: 1122371 - protein, 9 aa, Homo Sapiens
LASHKCLMD

SEQ ID NO: 1122372 - protein, 9 aa, Homo Sapiens
GPEAGHWRR

SEQ ID NO: 1122373 - protein, 9 aa, Homo Sapiens
LPPAEGGLH

SEQ ID NO: 1122374 - protein, 9 aa, Homo Sapiens
IEQETGTFK

SEQ ID NO: 1122375 - protein, 9 aa, Homo Sapiens
WELCCRTGS

SEQ ID NO: 1122376 - protein, 9 aa, Homo Sapiens
TASTCRCGW

SEQ ID NO: 1122377 - protein, 9 aa, Homo Sapiens
AKAGLPASI

SEQ ID NO: 1122378 - protein, 9 aa, Homo Sapiens
ERLASSRPL

SEQ ID NO: 1122379 - protein, 9 aa, Homo Sapiens
SPCCSDFSN

SEQ ID NO: 1122380 - protein, 9 aa, Homo Sapiens
TRRGTPGTC

SEQ ID NO: 1122381 - protein, 9 aa, Homo Sapiens
GKKRHPVKV

SEQ ID NO: 1122382 - protein, 9 aa, Homo Sapiens
CRTSLASSS

SEQ ID NO: 1122383 - protein, 9 aa, Homo Sapiens
NGTHVNVPF

SEQ ID NO: 1122384 - protein, 9 aa, Homo Sapiens
KPTNTRPQS

SEQ ID NO: 1122385 - protein, 9 aa, Homo Sapiens
FSYPIWQKM

SEQ ID NO: 1122386 - protein, 9 aa, Homo Sapiens
NICLLLDAS

SEQ ID NO: 1122387 - protein, 9 aa, Homo Sapiens
IPTIGGNTP

SEQ ID NO: 1122388 - protein, 9 aa, Homo Sapiens
LPCLLRFLS

SEQ ID NO: 1122389 - protein, 9 aa, Homo Sapiens
LPSLPAGGS

SEQ ID NO: 1122390 - protein, 9 aa, Homo Sapiens
DIQQSLERV

SEQ ID NO: 1122391 - protein, 9 aa, Homo Sapiens
MDFYKARME

SEQ ID NO: 1122392 - protein, 9 aa, Homo Sapiens
SQLDSLVLI

SEQ ID NO: 1122393 - protein, 9 aa, Homo Sapiens
TDPLNEQWE

SEQ ID NO: 1122394 - protein, 9 aa, Homo Sapiens
IQTKEGHIK

SEQ ID NO: 1122395 - protein, 9 aa, Homo Sapiens
STRDGSALR

SEQ ID NO: 1122396 - protein, 9 aa, Homo Sapiens
STIITEVRI

SEQ ID NO: 1122397 - protein, 9 aa, Homo Sapiens
SMPNVSWTG

SEQ ID NO: 1122398 - protein, 9 aa, Homo Sapiens
QGVLGHHTY

SEQ ID NO: 1122399 - protein, 9 aa, Homo Sapiens
DEVVSELLI

SEQ ID NO: 1122400 - protein, 9 aa, Homo Sapiens
DPPAGNSSP

SEQ ID NO: 1122401 - protein, 9 aa, Homo Sapiens
PICDPETEE

SEQ ID NO: 1122402 - protein, 9 aa, Homo Sapiens
PAGPAHQPG

SEQ ID NO: 1122403 - protein, 9 aa, Homo Sapiens
WLLWTPVLL

SEQ ID NO: 1122404 - protein, 9 aa, Homo Sapiens
VNLFVVNRP

SEQ ID NO: 1122405 - protein, 9 aa, Homo Sapiens
LALAAVECL

SEQ ID NO: 1122406 - protein, 9 aa, Homo Sapiens
TLTRMLLQK

SEQ ID NO: 1122407 - protein, 9 aa, Homo Sapiens
ISTVIMDKP

SEQ ID NO: 1122408 - protein, 9 aa, Homo Sapiens
KPRQILGLR

SEQ ID NO: 1122409 - protein, 9 aa, Homo Sapiens
CCLCPHPPA

SEQ ID NO: 1122410 - protein, 9 aa, Homo Sapiens
YFRGLKHPL

SEQ ID NO: 1122411 - protein, 9 aa, Homo Sapiens
EGGWVRRPG

SEQ ID NO: 1122412 - protein, 9 aa, Homo Sapiens
HPVALEAEL

SEQ ID NO: 1122413 - protein, 9 aa, Homo Sapiens
KPTTENSVY

SEQ ID NO: 1122414 - protein, 9 aa, Homo Sapiens
NEGCFIKVL

SEQ ID NO: 1122415 - protein, 9 aa, Homo Sapiens
WGCHLHLHA

SEQ ID NO: 1122416 - protein, 9 aa, Homo Sapiens
LKRQSLKNL

SEQ ID NO: 1122417 - protein, 9 aa, Homo Sapiens
KIFNGGSDL

SEQ ID NO: 1122418 - protein, 9 aa, Homo Sapiens
VQMSILGKR

SEQ ID NO: 1122419 - protein, 9 aa, Homo Sapiens
SGLGWPVKA

SEQ ID NO: 1122420 - protein, 9 aa, Homo Sapiens
NLSPSEAVQ

SEQ ID NO: 1122421 - protein, 9 aa, Homo Sapiens
LLHDGIKTS

SEQ ID NO: 1122422 - protein, 9 aa, Homo Sapiens
LTGRSPCPK

SEQ ID NO: 1122423 - protein, 9 aa, Homo Sapiens
EIACRQRRR

SEQ ID NO: 1122424 - protein, 9 aa, Homo Sapiens
HPLYTIVDF

SEQ ID NO: 1122425 - protein, 9 aa, Homo Sapiens
KPYECMVRG

SEQ ID NO: 1122426 - protein, 9 aa, Homo Sapiens
PCCLQALSL

SEQ ID NO: 1122427 - protein, 9 aa, Homo Sapiens
EKVNKGLEI

SEQ ID NO: 1122428 - protein, 9 aa, Homo Sapiens
YIRTGDGRI

SEQ ID NO: 1122429 - protein, 9 aa, Homo Sapiens
RSLLLLPHS

SEQ ID NO: 1122430 - protein, 9 aa, Homo Sapiens
DILKCHNSD

SEQ ID NO: 1122431 - protein, 9 aa, Homo Sapiens
RTLARPRLP

SEQ ID NO: 1122432 - protein, 9 aa, Homo Sapiens
QLLDEVLDR

SEQ ID NO: 1122433 - protein, 9 aa, Homo Sapiens
VRCHIHACQ

SEQ ID NO: 1122434 - protein, 9 aa, Homo Sapiens
GEALVPAAV

SEQ ID NO: 1122435 - protein, 9 aa, Homo Sapiens
SPSGLFRPS

SEQ ID NO: 1122436 - protein, 9 aa, Homo Sapiens
YPSLISIDL

SEQ ID NO: 1122437 - protein, 9 aa, Homo Sapiens
GGRCQSPAH

SEQ ID NO: 1122438 - protein, 9 aa, Homo Sapiens
RTGKLFPVC

SEQ ID NO: 1122439 - protein, 9 aa, Homo Sapiens
LRQCVDRVF

SEQ ID NO: 1122440 - protein, 9 aa, Homo Sapiens
FYSSRASIS

SEQ ID NO: 1122441 - protein, 9 aa, Homo Sapiens
GAGGNWGAA

SEQ ID NO: 1122442 - protein, 9 aa, Homo Sapiens
LGPSMEIMK

SEQ ID NO: 1122443 - protein, 9 aa, Homo Sapiens
LKDSTSSYE

SEQ ID NO: 1122444 - protein, 9 aa, Homo Sapiens
WRSCGRVHH

SEQ ID NO: 1122445 - protein, 9 aa, Homo Sapiens
TLISLPVPL

SEQ ID NO: 1122446 - protein, 9 aa, Homo Sapiens
TFLDRVYSP

SEQ ID NO: 1122447 - protein, 9 aa, Homo Sapiens
GAPSPPPPP

SEQ ID NO: 1122448 - protein, 9 aa, Homo Sapiens
PPKSQDQDV

SEQ ID NO: 1122449 - protein, 9 aa, Homo Sapiens
EGLLMEEEG

SEQ ID NO: 1122450 - protein, 9 aa, Homo Sapiens
GTAAATSLA

SEQ ID NO: 1122451 - protein, 9 aa, Homo Sapiens
TVLADNKPV

SEQ ID NO: 1122452 - protein, 9 aa, Homo Sapiens
HVTHTVQKV

SEQ ID NO: 1122453 - protein, 9 aa, Homo Sapiens
CNNHVSIAK

SEQ ID NO: 1122454 - protein, 9 aa, Homo Sapiens
SSSLDALCP

SEQ ID NO: 1122455 - protein, 9 aa, Homo Sapiens
ISKKAKAST

SEQ ID NO: 1122456 - protein, 9 aa, Homo Sapiens
FRGLKHPLF

SEQ ID NO: 1122457 - protein, 9 aa, Homo Sapiens
PQWAMGIPL

SEQ ID NO: 1122458 - protein, 9 aa, Homo Sapiens
APVGGEALV

SEQ ID NO: 1122459 - protein, 9 aa, Homo Sapiens
CFHFKWFEH

SEQ ID NO: 1122460 - protein, 9 aa, Homo Sapiens
WPSALPSQG

SEQ ID NO: 1122461 - protein, 9 aa, Homo Sapiens
VMPCPMLEH

SEQ ID NO: 1122462 - protein, 9 aa, Homo Sapiens
SLRSPDQPH

SEQ ID NO: 1122463 - protein, 9 aa, Homo Sapiens
KTPTVCGVL

SEQ ID NO: 1122464 - protein, 9 aa, Homo Sapiens
LGTTGGTAP

SEQ ID NO: 1122465 - protein, 9 aa, Homo Sapiens
EEGLGHIEG

SEQ ID NO: 1122466 - protein, 9 aa, Homo Sapiens
VKLEAIFGA

SEQ ID NO: 1122467 - protein, 9 aa, Homo Sapiens
AGVGVLRPS

SEQ ID NO: 1122468 - protein, 9 aa, Homo Sapiens
ETGERERLR

SEQ ID NO: 1122469 - protein, 9 aa, Homo Sapiens
TGTCCHENI

SEQ ID NO: 1122470 - protein, 9 aa, Homo Sapiens
AEIKLPKKR

SEQ ID NO: 1122471 - protein, 9 aa, Homo Sapiens
SALRDLWTD

SEQ ID NO: 1122472 - protein, 9 aa, Homo Sapiens
SFLTVNDNL

SEQ ID NO: 1122473 - protein, 9 aa, Homo Sapiens
ALLISQLLM

SEQ ID NO: 1122474 - protein, 9 aa, Homo Sapiens
GIPRSTCGR

SEQ ID NO: 1122475 - protein, 9 aa, Homo Sapiens
QPSRPTGRT

SEQ ID NO: 1122476 - protein, 9 aa, Homo Sapiens
SSLGARART

SEQ ID NO: 1122477 - protein, 9 aa, Homo Sapiens
RMSYSWAGA

SEQ ID NO: 1122478 - protein, 9 aa, Homo Sapiens
SGGSGHCPH

SEQ ID NO: 1122479 - protein, 9 aa, Homo Sapiens
GTTASSPEC

SEQ ID NO: 1122480 - protein, 9 aa, Homo Sapiens
GHVHGIAPD

SEQ ID NO: 1122481 - protein, 9 aa, Homo Sapiens
RDSRSFFTS

SEQ ID NO: 1122482 - protein, 9 aa, Homo Sapiens
PEVLEVGSL

SEQ ID NO: 1122483 - protein, 9 aa, Homo Sapiens
GSYGESSLA

SEQ ID NO: 1122484 - protein, 9 aa, Homo Sapiens
AAPLLLRIL

SEQ ID NO: 1122485 - protein, 9 aa, Homo Sapiens
SGGSDSDSE

SEQ ID NO: 1122486 - protein, 9 aa, Homo Sapiens
TAPPAASWP

SEQ ID NO: 1122487 - protein, 9 aa, Homo Sapiens
PSLETHLKQ

SEQ ID NO: 1122488 - protein, 9 aa, Homo Sapiens
APASSFSSL

SEQ ID NO: 1122489 - protein, 9 aa, Homo Sapiens
THYVIAKVI

SEQ ID NO: 1122490 - protein, 9 aa, Homo Sapiens
MVLDSPCWL

SEQ ID NO: 1122491 - protein, 9 aa, Homo Sapiens
SPWLGGQLP

SEQ ID NO: 1122492 - protein, 9 aa, Homo Sapiens
LILQQNCME

SEQ ID NO: 1122493 - protein, 9 aa, Homo Sapiens
DHLVGNVYI

SEQ ID NO: 1122494 - protein, 9 aa, Homo Sapiens
ESMVYSRCG

SEQ ID NO: 1122495 - protein, 9 aa, Homo Sapiens
MMKKEKESE

SEQ ID NO: 1122496 - protein, 9 aa, Homo Sapiens
RGERLPDVG

SEQ ID NO: 1122497 - protein, 9 aa, Homo Sapiens
LRQAPRTTA

SEQ ID NO: 1122498 - protein, 9 aa, Homo Sapiens
ENHADTIRS

SEQ ID NO: 1122499 - protein, 9 aa, Homo Sapiens
ATGSSRGTS

SEQ ID NO: 1122500 - protein, 9 aa, Homo Sapiens
RHGLGKDLT

SEQ ID NO: 1122501 - protein, 9 aa, Homo Sapiens
LKRSLWVDV

SEQ ID NO: 1122502 - protein, 9 aa, Homo Sapiens
CLGSAEGAG

SEQ ID NO: 1122503 - protein, 9 aa, Homo Sapiens
SIVGQSNDH

SEQ ID NO: 1122504 - protein, 9 aa, Homo Sapiens
GYPWGFSDP

SEQ ID NO: 1122505 - protein, 9 aa, Homo Sapiens
RHRLPCRLL

SEQ ID NO: 1122506 - protein, 9 aa, Homo Sapiens
SSSVNQSDS

SEQ ID NO: 1122507 - protein, 9 aa, Homo Sapiens
GMKHSSQKH

SEQ ID NO: 1122508 - protein, 9 aa, Homo Sapiens
RWQGHHSLR

SEQ ID NO: 1122509 - protein, 9 aa, Homo Sapiens
YVRAMYPTK

SEQ ID NO: 1122510 - protein, 9 aa, Homo Sapiens
SLYCRSGRN

SEQ ID NO: 1122511 - protein, 9 aa, Homo Sapiens
KAHKAELAA

SEQ ID NO: 1122512 - protein, 9 aa, Homo Sapiens
DRRRSCRHS

SEQ ID NO: 1122513 - protein, 9 aa, Homo Sapiens
SCFQTKVVE

SEQ ID NO: 1122514 - protein, 9 aa, Homo Sapiens
LAEAGLPVE

SEQ ID NO: 1122515 - protein, 9 aa, Homo Sapiens
HPAPPCGPR

SEQ ID NO: 1122516 - protein, 9 aa, Homo Sapiens
SVSHIRTTM

SEQ ID NO: 1122517 - protein, 9 aa, Homo Sapiens
TVPIDYVNK

SEQ ID NO: 1122518 - protein, 9 aa, Homo Sapiens
CQYKCSDES

SEQ ID NO: 1122519 - protein, 9 aa, Homo Sapiens
PHGMSPALH

SEQ ID NO: 1122520 - protein, 9 aa, Homo Sapiens
PTMPSQLDS

SEQ ID NO: 1122521 - protein, 9 aa, Homo Sapiens
STKSLDGSM

SEQ ID NO: 1122522 - protein, 9 aa, Homo Sapiens
QRSSGHRND

SEQ ID NO: 1122523 - protein, 9 aa, Homo Sapiens
LECICTVVQ

SEQ ID NO: 1122524 - protein, 9 aa, Homo Sapiens
CPSPSRARG

SEQ ID NO: 1122525 - protein, 9 aa, Homo Sapiens
RHRLCRGKM

SEQ ID NO: 1122526 - protein, 9 aa, Homo Sapiens
FINIKKGQQ

SEQ ID NO: 1122527 - protein, 9 aa, Homo Sapiens
LCASSRKRN

SEQ ID NO: 1122528 - protein, 9 aa, Homo Sapiens
SLCPGVRSL

SEQ ID NO: 1122529 - protein, 9 aa, Homo Sapiens
WRALASSKG

SEQ ID NO: 1122530 - protein, 9 aa, Homo Sapiens
SGSDILIPT

SEQ ID NO: 1122531 - protein, 9 aa, Homo Sapiens
RSHSKSPKR

SEQ ID NO: 1122532 - protein, 9 aa, Homo Sapiens
GPPENQVSV

SEQ ID NO: 1122533 - protein, 9 aa, Homo Sapiens
IYQKVCHRM

SEQ ID NO: 1122534 - protein, 9 aa, Homo Sapiens
LLQSVDQLA

SEQ ID NO: 1122535 - protein, 9 aa, Homo Sapiens
LMSWMAKGV

SEQ ID NO: 1122536 - protein, 9 aa, Homo Sapiens
TMDDVTAVL

SEQ ID NO: 1122537 - protein, 9 aa, Homo Sapiens
PGGRCQSPA

SEQ ID NO: 1122538 - protein, 9 aa, Homo Sapiens
IHKLDKVNY

SEQ ID NO: 1122539 - protein, 9 aa, Homo Sapiens
KINIMNEEN

SEQ ID NO: 1122540 - protein, 9 aa, Homo Sapiens
QLDRPLLPH

SEQ ID NO: 1122541 - protein, 9 aa, Homo Sapiens
VYMRNIVHL

SEQ ID NO: 1122542 - protein, 9 aa, Homo Sapiens
SSSRFFVKI

SEQ ID NO: 1122543 - protein, 9 aa, Homo Sapiens
LRPQHSEPA

SEQ ID NO: 1122544 - protein, 9 aa, Homo Sapiens
KPTPHRRYF

SEQ ID NO: 1122545 - protein, 9 aa, Homo Sapiens
GDGQQDLAT

SEQ ID NO: 1122546 - protein, 9 aa, Homo Sapiens
VQHIRIDDS

SEQ ID NO: 1122547 - protein, 9 aa, Homo Sapiens
AASARSPTS

SEQ ID NO: 1122548 - protein, 9 aa, Homo Sapiens
IVGHLMGRR

SEQ ID NO: 1122549 - protein, 9 aa, Homo Sapiens
GDPQSSSQV

SEQ ID NO: 1122550 - protein, 9 aa, Homo Sapiens
ASESPGPSG

SEQ ID NO: 1122551 - protein, 9 aa, Homo Sapiens
AQKEHHIQE

SEQ ID NO: 1122552 - protein, 9 aa, Homo Sapiens
CAAENMVGK

SEQ ID NO: 1122553 - protein, 9 aa, Homo Sapiens
VARLQSRAT

SEQ ID NO: 1122554 - protein, 9 aa, Homo Sapiens
PVYNANINL

SEQ ID NO: 1122555 - protein, 9 aa, Homo Sapiens
TSTLTTRLH

SEQ ID NO: 1122556 - protein, 9 aa, Homo Sapiens
MNGDGTVQS

SEQ ID NO: 1122557 - protein, 9 aa, Homo Sapiens
HCTACSPPR

SEQ ID NO: 1122558 - protein, 9 aa, Homo Sapiens
RDLKPFRIL

SEQ ID NO: 1122559 - protein, 9 aa, Homo Sapiens
VPMHAAGLG

SEQ ID NO: 1122560 - protein, 9 aa, Homo Sapiens
DIACLCVIL

SEQ ID NO: 1122561 - protein, 9 aa, Homo Sapiens
YPNIAMGFP

SEQ ID NO: 1122562 - protein, 9 aa, Homo Sapiens
IGKNSVTKV

SEQ ID NO: 1122563 - protein, 9 aa, Homo Sapiens
WPPQASLLC

SEQ ID NO: 1122564 - protein, 9 aa, Homo Sapiens
ANSSPTSTP

SEQ ID NO: 1122565 - protein, 9 aa, Homo Sapiens
IIFGGTKVV

SEQ ID NO: 1122566 - protein, 9 aa, Homo Sapiens
LLLAVALLA

SEQ ID NO: 1122567 - protein, 9 aa, Homo Sapiens
HDNVQLVSG

SEQ ID NO: 1122568 - protein, 9 aa, Homo Sapiens
VSILSEVAP

SEQ ID NO: 1122569 - protein, 9 aa, Homo Sapiens
FIRENNSPA

SEQ ID NO: 1122570 - protein, 9 aa, Homo Sapiens
TAANGAYAK

SEQ ID NO: 1122571 - protein, 9 aa, Homo Sapiens
KRRGPRTAI

SEQ ID NO: 1122572 - protein, 9 aa, Homo Sapiens
DEAWWLSNV

SEQ ID NO: 1122573 - protein, 9 aa, Homo Sapiens
PERKTSAVQ

SEQ ID NO: 1122574 - protein, 9 aa, Homo Sapiens
GQQNCTLKF

SEQ ID NO: 1122575 - protein, 9 aa, Homo Sapiens
VNPDWLRSC

SEQ ID NO: 1122576 - protein, 9 aa, Homo Sapiens
THQGFCLTL

SEQ ID NO: 1122577 - protein, 9 aa, Homo Sapiens
LRGGQRGQE

SEQ ID NO: 1122578 - protein, 9 aa, Homo Sapiens
IRSGRAIPI

SEQ ID NO: 1122579 - protein, 9 aa, Homo Sapiens
PLLPGVSTT

SEQ ID NO: 1122580 - protein, 9 aa, Homo Sapiens
EQYPDWPAK

SEQ ID NO: 1122581 - protein, 9 aa, Homo Sapiens
ELRPHGGLK

SEQ ID NO: 1122582 - protein, 9 aa, Homo Sapiens
LFVGLTYLG

SEQ ID NO: 1122583 - protein, 9 aa, Homo Sapiens
GFAKCVKGR

SEQ ID NO: 1122584 - protein, 9 aa, Homo Sapiens
YQMTQERMT

SEQ ID NO: 1122585 - protein, 9 aa, Homo Sapiens
ACSHGAGPA

SEQ ID NO: 1122586 - protein, 9 aa, Homo Sapiens
AHMRVLSKA

SEQ ID NO: 1122587 - protein, 9 aa, Homo Sapiens
RFIRGLDAI

SEQ ID NO: 1122588 - protein, 9 aa, Homo Sapiens
PQGAFSEKV

SEQ ID NO: 1122589 - protein, 9 aa, Homo Sapiens
QWAMGIPLE

SEQ ID NO: 1122590 - protein, 9 aa, Homo Sapiens
RCAMAPETT

SEQ ID NO: 1122591 - protein, 9 aa, Homo Sapiens
FILHPGHAL

SEQ ID NO: 1122592 - protein, 9 aa, Homo Sapiens
DDFTPFNES

SEQ ID NO: 1122593 - protein, 9 aa, Homo Sapiens
YRGLWLMSP

SEQ ID NO: 1122594 - protein, 9 aa, Homo Sapiens
VLRGVLGST

SEQ ID NO: 1122595 - protein, 9 aa, Homo Sapiens
LVVVEGVHG

SEQ ID NO: 1122596 - protein, 9 aa, Homo Sapiens
QVPRTDAHT

SEQ ID NO: 1122597 - protein, 9 aa, Homo Sapiens
FDANEPADG

SEQ ID NO: 1122598 - protein, 9 aa, Homo Sapiens
SRREPSRAS

SEQ ID NO: 1122599 - protein, 9 aa, Homo Sapiens
AIILVILRA

SEQ ID NO: 1122600 - protein, 9 aa, Homo Sapiens
DVVLRLSCP

SEQ ID NO: 1122601 - protein, 9 aa, Homo Sapiens
RPARQPTPA

SEQ ID NO: 1122602 - protein, 9 aa, Homo Sapiens
GEKLPEDLT

SEQ ID NO: 1122603 - protein, 9 aa, Homo Sapiens
LCLRVRPRV

SEQ ID NO: 1122604 - protein, 9 aa, Homo Sapiens
GLGWPVKAP

SEQ ID NO: 1122605 - protein, 9 aa, Homo Sapiens
PGPNQHNMT

SEQ ID NO: 1122606 - protein, 9 aa, Homo Sapiens
KFRPTLPPG

SEQ ID NO: 1122607 - protein, 9 aa, Homo Sapiens
HEVLSRTHN

SEQ ID NO: 1122608 - protein, 9 aa, Homo Sapiens
HFDEVFWFG

SEQ ID NO: 1122609 - protein, 9 aa, Homo Sapiens
HKSASSREL

SEQ ID NO: 1122610 - protein, 9 aa, Homo Sapiens
GLFLHLDMR

SEQ ID NO: 1122611 - protein, 9 aa, Homo Sapiens
PHTQGSRPA

SEQ ID NO: 1122612 - protein, 9 aa, Homo Sapiens
RTGSWWPRM

SEQ ID NO: 1122613 - protein, 9 aa, Homo Sapiens
EDLSKNCRL

SEQ ID NO: 1122614 - protein, 9 aa, Homo Sapiens
RAPGGGAWL

SEQ ID NO: 1122615 - protein, 9 aa, Homo Sapiens
AACPLCSVT

SEQ ID NO: 1122616 - protein, 9 aa, Homo Sapiens
KTKFKQHTI

SEQ ID NO: 1122617 - protein, 9 aa, Homo Sapiens
YLEKKTNQR

SEQ ID NO: 1122618 - protein, 9 aa, Homo Sapiens
SRSLGNMYH

SEQ ID NO: 1122619 - protein, 9 aa, Homo Sapiens
LEGTPFVLL

SEQ ID NO: 1122620 - protein, 9 aa, Homo Sapiens
KECLGDLRS

SEQ ID NO: 1122621 - protein, 9 aa, Homo Sapiens
TTKMGGPST

SEQ ID NO: 1122622 - protein, 9 aa, Homo Sapiens
LDIFRRGFR

SEQ ID NO: 1122623 - protein, 9 aa, Homo Sapiens
EKLQVTLGE

SEQ ID NO: 1122624 - protein, 9 aa, Homo Sapiens
DDHHGLVFG

SEQ ID NO: 1122625 - protein, 9 aa, Homo Sapiens
EKTFKCTQC

SEQ ID NO: 1122626 - protein, 9 aa, Homo Sapiens
QGVTFEDVA

SEQ ID NO: 1122627 - protein, 9 aa, Homo Sapiens
TLPKVPAVP

SEQ ID NO: 1122628 - protein, 9 aa, Homo Sapiens
SWHSDYEDP

SEQ ID NO: 1122629 - protein, 9 aa, Homo Sapiens
VPVEAVSVD

SEQ ID NO: 1122630 - protein, 9 aa, Homo Sapiens
RSEWGLVVC

SEQ ID NO: 1122631 - protein, 9 aa, Homo Sapiens
QAMKMGDNV

SEQ ID NO: 1122632 - protein, 9 aa, Homo Sapiens
IETDVMNQE

SEQ ID NO: 1122633 - protein, 9 aa, Homo Sapiens
ARPGEIACR

SEQ ID NO: 1122634 - protein, 9 aa, Homo Sapiens
MSQWWHVGA

SEQ ID NO: 1122635 - protein, 9 aa, Homo Sapiens
GSAWSLSTG

SEQ ID NO: 1122636 - protein, 9 aa, Homo Sapiens
PSQRSHCRP

SEQ ID NO: 1122637 - protein, 9 aa, Homo Sapiens
HCEAISCKK

SEQ ID NO: 1122638 - protein, 9 aa, Homo Sapiens
GRQCSSGSG

SEQ ID NO: 1122639 - protein, 9 aa, Homo Sapiens
KMVHELMQV

SEQ ID NO: 1122640 - protein, 9 aa, Homo Sapiens
RALWEDVAS

SEQ ID NO: 1122641 - protein, 9 aa, Homo Sapiens
DDEFRKKCD

SEQ ID NO: 1122642 - protein, 9 aa, Homo Sapiens
LMCPENAVD

SEQ ID NO: 1122643 - protein, 9 aa, Homo Sapiens
FTPGFWLML

SEQ ID NO: 1122644 - protein, 9 aa, Homo Sapiens
KKCRKLGDP

SEQ ID NO: 1122645 - protein, 9 aa, Homo Sapiens
ECRPKKRTV

SEQ ID NO: 1122646 - protein, 9 aa, Homo Sapiens
EQGWSCPWA

SEQ ID NO: 1122647 - protein, 9 aa, Homo Sapiens
KLRLPNIRH

SEQ ID NO: 1122648 - protein, 9 aa, Homo Sapiens
LPCRRHCPR

SEQ ID NO: 1122649 - protein, 9 aa, Homo Sapiens
QALEELQSQ

SEQ ID NO: 1122650 - protein, 9 aa, Homo Sapiens
KKRWEETIF

SEQ ID NO: 1122651 - protein, 9 aa, Homo Sapiens
RVNGLMKRE

SEQ ID NO: 1122652 - protein, 9 aa, Homo Sapiens
MAPPVLPAG

SEQ ID NO: 1122653 - protein, 9 aa, Homo Sapiens
SGSTREEQE

SEQ ID NO: 1122654 - protein, 9 aa, Homo Sapiens
PMNTNDLEE

SEQ ID NO: 1122655 - protein, 9 aa, Homo Sapiens
GPWGAGGNW

SEQ ID NO: 1122656 - protein, 9 aa, Homo Sapiens
TKSVEVQGE

SEQ ID NO: 1122657 - protein, 9 aa, Homo Sapiens
ASGCAVPMP

SEQ ID NO: 1122658 - protein, 9 aa, Homo Sapiens
GARGRWWLS

SEQ ID NO: 1122659 - protein, 9 aa, Homo Sapiens
DLLFSITPE

SEQ ID NO: 1122660 - protein, 9 aa, Homo Sapiens
CAGALHPRT

SEQ ID NO: 1122661 - protein, 9 aa, Homo Sapiens
TTDAIFARR

SEQ ID NO: 1122662 - protein, 9 aa, Homo Sapiens
SGGSNGATY

SEQ ID NO: 1122663 - protein, 9 aa, Homo Sapiens
GVATISCRN

SEQ ID NO: 1122664 - protein, 9 aa, Homo Sapiens
SKYVPLITS

SEQ ID NO: 1122665 - protein, 9 aa, Homo Sapiens
IIMCCTNAT

SEQ ID NO: 1122666 - protein, 9 aa, Homo Sapiens
IHSFSGLVG

SEQ ID NO: 1122667 - protein, 9 aa, Homo Sapiens
YYNLGCLYA

SEQ ID NO: 1122668 - protein, 9 aa, Homo Sapiens
TLVLNNNAL

SEQ ID NO: 1122669 - protein, 9 aa, Homo Sapiens
PLRSCIPST

SEQ ID NO: 1122670 - protein, 9 aa, Homo Sapiens
ETMDSETVK

SEQ ID NO: 1122671 - protein, 9 aa, Homo Sapiens
IACIAWFTR

SEQ ID NO: 1122672 - protein, 9 aa, Homo Sapiens
MGKMLGERR

SEQ ID NO: 1122673 - protein, 9 aa, Homo Sapiens
IKKLKEQMR

SEQ ID NO: 1122674 - protein, 9 aa, Homo Sapiens
ASRAAVSTP

SEQ ID NO: 1122675 - protein, 9 aa, Homo Sapiens
PRSFTDTIT

SEQ ID NO: 1122676 - protein, 9 aa, Homo Sapiens
RASSFDPSR

SEQ ID NO: 1122677 - protein, 9 aa, Homo Sapiens
REQPCGECF

SEQ ID NO: 1122678 - protein, 9 aa, Homo Sapiens
PAAPNMNSE

SEQ ID NO: 1122679 - protein, 9 aa, Homo Sapiens
AELWGIRWT

SEQ ID NO: 1122680 - protein, 9 aa, Homo Sapiens
QCDKKRGAS

SEQ ID NO: 1122681 - protein, 9 aa, Homo Sapiens
MKELLEGPD

SEQ ID NO: 1122682 - protein, 9 aa, Homo Sapiens
EAVYGQNVI

SEQ ID NO: 1122683 - protein, 9 aa, Homo Sapiens
TPPTPHLAS

SEQ ID NO: 1122684 - protein, 9 aa, Homo Sapiens
KQNGYVPFY

SEQ ID NO: 1122685 - protein, 9 aa, Homo Sapiens
RPPCCVPTT

SEQ ID NO: 1122686 - protein, 9 aa, Homo Sapiens
IVQLKQRRC

SEQ ID NO: 1122687 - protein, 9 aa, Homo Sapiens
NKKQLPYYY

SEQ ID NO: 1122688 - protein, 9 aa, Homo Sapiens
RHCPRCPAP

SEQ ID NO: 1122689 - protein, 9 aa, Homo Sapiens
TENIRFVFH

SEQ ID NO: 1122690 - protein, 9 aa, Homo Sapiens
YKGIVLSSQ

SEQ ID NO: 1122691 - protein, 9 aa, Homo Sapiens
PTMTTRTSL

SEQ ID NO: 1122692 - protein, 9 aa, Homo Sapiens
PATPPPRHP

SEQ ID NO: 1122693 - protein, 9 aa, Homo Sapiens
REEVSFFIA

SEQ ID NO: 1122694 - protein, 9 aa, Homo Sapiens
PRRPPPAWG

SEQ ID NO: 1122695 - protein, 9 aa, Homo Sapiens
HSPNVCAVQ

SEQ ID NO: 1122696 - protein, 9 aa, Homo Sapiens
SGCAVPMPW

SEQ ID NO: 1122697 - protein, 9 aa, Homo Sapiens
RDWCKTQPP

SEQ ID NO: 1122698 - protein, 9 aa, Homo Sapiens
SINDHFYNH

SEQ ID NO: 1122699 - protein, 9 aa, Homo Sapiens
RGEQPPDQW

SEQ ID NO: 1122700 - protein, 9 aa, Homo Sapiens
RSQCGRRDR

SEQ ID NO: 1122701 - protein, 9 aa, Homo Sapiens
IAERNKKQL

SEQ ID NO: 1122702 - protein, 9 aa, Homo Sapiens
CCPCSSPAC

SEQ ID NO: 1122703 - protein, 9 aa, Homo Sapiens
FPCPPACNC

SEQ ID NO: 1122704 - protein, 9 aa, Homo Sapiens
IVFSVCNTG

SEQ ID NO: 1122705 - protein, 9 aa, Homo Sapiens
TSTSFGSGP

SEQ ID NO: 1122706 - protein, 9 aa, Homo Sapiens
CSKYGGNLI

SEQ ID NO: 1122707 - protein, 9 aa, Homo Sapiens
IVPMHAAGL

SEQ ID NO: 1122708 - protein, 9 aa, Homo Sapiens
QLTNLQMTA

SEQ ID NO: 1122709 - protein, 9 aa, Homo Sapiens
KAINGILLS

SEQ ID NO: 1122710 - protein, 9 aa, Homo Sapiens
GPPNPGVGP

SEQ ID NO: 1122711 - protein, 9 aa, Homo Sapiens
TWRRPGPKE

SEQ ID NO: 1122712 - protein, 9 aa, Homo Sapiens
FVLPPILQC

SEQ ID NO: 1122713 - protein, 9 aa, Homo Sapiens
KVTNSDNEV

SEQ ID NO: 1122714 - protein, 9 aa, Homo Sapiens
LASPPPRQC

SEQ ID NO: 1122715 - protein, 9 aa, Homo Sapiens
IQRNLRTLK

SEQ ID NO: 1122716 - protein, 9 aa, Homo Sapiens
NLSSPDSYQ

SEQ ID NO: 1122717 - protein, 9 aa, Homo Sapiens
MNVPLFKHK

SEQ ID NO: 1122718 - protein, 9 aa, Homo Sapiens
FKDVLIGFG

SEQ ID NO: 1122719 - protein, 9 aa, Homo Sapiens
PIPVLPTMH

SEQ ID NO: 1122720 - protein, 9 aa, Homo Sapiens
WHTAFVNIT

SEQ ID NO: 1122721 - protein, 9 aa, Homo Sapiens
WYPATVLAD

SEQ ID NO: 1122722 - protein, 9 aa, Homo Sapiens
LIVGTGSNT

SEQ ID NO: 1122723 - protein, 9 aa, Homo Sapiens
AWCSSAAPV

SEQ ID NO: 1122724 - protein, 9 aa, Homo Sapiens
NITNELLQI

SEQ ID NO: 1122725 - protein, 9 aa, Homo Sapiens
VKEAAVLVE

SEQ ID NO: 1122726 - protein, 9 aa, Homo Sapiens
VHVYRTSFY

SEQ ID NO: 1122727 - protein, 9 aa, Homo Sapiens
ITFTVAQNE

SEQ ID NO: 1122728 - protein, 9 aa, Homo Sapiens
EGAGQREED

SEQ ID NO: 1122729 - protein, 9 aa, Homo Sapiens
GSGGEQLCG

SEQ ID NO: 1122730 - protein, 9 aa, Homo Sapiens
STRFNQMRE

SEQ ID NO: 1122731 - protein, 9 aa, Homo Sapiens
LVACPDLRR

SEQ ID NO: 1122732 - protein, 9 aa, Homo Sapiens
GSDRTPRGS

SEQ ID NO: 1122733 - protein, 9 aa, Homo Sapiens
SSCGSPGWW

SEQ ID NO: 1122734 - protein, 9 aa, Homo Sapiens
DLFDFQSDI

SEQ ID NO: 1122735 - protein, 9 aa, Homo Sapiens
NADALHVRG

SEQ ID NO: 1122736 - protein, 9 aa, Homo Sapiens
VMAIFSALS

SEQ ID NO: 1122737 - protein, 9 aa, Homo Sapiens
PLSISRPTS

SEQ ID NO: 1122738 - protein, 9 aa, Homo Sapiens
IVIHVGMAL

SEQ ID NO: 1122739 - protein, 9 aa, Homo Sapiens
HRPSLALLR

SEQ ID NO: 1122740 - protein, 9 aa, Homo Sapiens
REITVATGV

SEQ ID NO: 1122741 - protein, 9 aa, Homo Sapiens
PTMHYNMGG

SEQ ID NO: 1122742 - protein, 9 aa, Homo Sapiens
AAMRLMPKF

SEQ ID NO: 1122743 - protein, 9 aa, Homo Sapiens
LTELTTAVT

SEQ ID NO: 1122744 - protein, 9 aa, Homo Sapiens
ILHPGHALF

SEQ ID NO: 1122745 - protein, 9 aa, Homo Sapiens
ILDIEKIHR

SEQ ID NO: 1122746 - protein, 9 aa, Homo Sapiens
KKEKESEAL

SEQ ID NO: 1122747 - protein, 9 aa, Homo Sapiens
GVQYELKDS

SEQ ID NO: 1122748 - protein, 9 aa, Homo Sapiens
SVEEMFAST

SEQ ID NO: 1122749 - protein, 9 aa, Homo Sapiens
VAALSVGFS

SEQ ID NO: 1122750 - protein, 9 aa, Homo Sapiens
WASPQESSS

SEQ ID NO: 1122751 - protein, 9 aa, Homo Sapiens
NAMCKLYTG

SEQ ID NO: 1122752 - protein, 9 aa, Homo Sapiens
GGKQTPVAR

SEQ ID NO: 1122753 - protein, 9 aa, Homo Sapiens
EKGDDVPEI

SEQ ID NO: 1122754 - protein, 9 aa, Homo Sapiens
LLPPPTLLG

SEQ ID NO: 1122755 - protein, 9 aa, Homo Sapiens
QHQFGHTKV

SEQ ID NO: 1122756 - protein, 9 aa, Homo Sapiens
LRSSMYRGL

SEQ ID NO: 1122757 - protein, 9 aa, Homo Sapiens
GDVCITEAL

SEQ ID NO: 1122758 - protein, 9 aa, Homo Sapiens
PRELSILWG

SEQ ID NO: 1122759 - protein, 9 aa, Homo Sapiens
RCPAVPAAA

SEQ ID NO: 1122760 - protein, 9 aa, Homo Sapiens
EPTSSSIDL

SEQ ID NO: 1122761 - protein, 9 aa, Homo Sapiens
STIVAGSTV

SEQ ID NO: 1122762 - protein, 9 aa, Homo Sapiens
PQPTGEKGT

SEQ ID NO: 1122763 - protein, 9 aa, Homo Sapiens
GKRAIVVFH

SEQ ID NO: 1122764 - protein, 9 aa, Homo Sapiens
SRHLQEALA

SEQ ID NO: 1122765 - protein, 9 aa, Homo Sapiens
PFGQQNCTL

SEQ ID NO: 1122766 - protein, 9 aa, Homo Sapiens
IPLLGDQLV

SEQ ID NO: 1122767 - protein, 9 aa, Homo Sapiens
AGRNTLGPQ

SEQ ID NO: 1122768 - protein, 9 aa, Homo Sapiens
GLLEFVEDA

SEQ ID NO: 1122769 - protein, 9 aa, Homo Sapiens
LLEKCCQCQ

SEQ ID NO: 1122770 - protein, 9 aa, Homo Sapiens
RDGALHEHG

SEQ ID NO: 1122771 - protein, 9 aa, Homo Sapiens
TSLASGTSR

SEQ ID NO: 1122772 - protein, 9 aa, Homo Sapiens
LVVDVDCLP

SEQ ID NO: 1122773 - protein, 9 aa, Homo Sapiens
RGAHGASGG

SEQ ID NO: 1122774 - protein, 9 aa, Homo Sapiens
SWGAVAGTA

SEQ ID NO: 1122775 - protein, 9 aa, Homo Sapiens
VCGPRVVER

SEQ ID NO: 1122776 - protein, 9 aa, Homo Sapiens
PLFPWKLPG

SEQ ID NO: 1122777 - protein, 9 aa, Homo Sapiens
VCKHGMLME

SEQ ID NO: 1122778 - protein, 9 aa, Homo Sapiens
IEICTADCG

SEQ ID NO: 1122779 - protein, 9 aa, Homo Sapiens
AEKVNKGLE

SEQ ID NO: 1122780 - protein, 9 aa, Homo Sapiens
TLGELRRKQ

SEQ ID NO: 1122781 - protein, 9 aa, Homo Sapiens
LERQVEEMK

SEQ ID NO: 1122782 - protein, 9 aa, Homo Sapiens
SSRGTSITL

SEQ ID NO: 1122783 - protein, 9 aa, Homo Sapiens
ILRGELQRL

SEQ ID NO: 1122784 - protein, 9 aa, Homo Sapiens
CFICHSCQQ

SEQ ID NO: 1122785 - protein, 9 aa, Homo Sapiens
SRQIYFMAC

SEQ ID NO: 1122786 - protein, 9 aa, Homo Sapiens
QVCFGRHVV

SEQ ID NO: 1122787 - protein, 9 aa, Homo Sapiens
ASRCLIGSW

SEQ ID NO: 1122788 - protein, 9 aa, Homo Sapiens
SLRQDHVAF

SEQ ID NO: 1122789 - protein, 9 aa, Homo Sapiens
VLNNNALSA

SEQ ID NO: 1122790 - protein, 9 aa, Homo Sapiens
RNNPVPLRP

SEQ ID NO: 1122791 - protein, 9 aa, Homo Sapiens
GGDPISAGC

SEQ ID NO: 1122792 - protein, 9 aa, Homo Sapiens
FPFGQQNCT

SEQ ID NO: 1122793 - protein, 9 aa, Homo Sapiens
TLPPQQQQH

SEQ ID NO: 1122794 - protein, 9 aa, Homo Sapiens
VAGESMEGL

SEQ ID NO: 1122795 - protein, 9 aa, Homo Sapiens
GPGPPPLSS

SEQ ID NO: 1122796 - protein, 9 aa, Homo Sapiens
PEASDYLHI

SEQ ID NO: 1122797 - protein, 9 aa, Homo Sapiens
VYWLISGGW

SEQ ID NO: 1122798 - protein, 9 aa, Homo Sapiens
TQALTQSNQ

SEQ ID NO: 1122799 - protein, 9 aa, Homo Sapiens
HVHPHDVHH

SEQ ID NO: 1122800 - protein, 9 aa, Homo Sapiens
KSPFQLVRD

SEQ ID NO: 1122801 - protein, 9 aa, Homo Sapiens
ILKKYMLSQ

SEQ ID NO: 1122802 - protein, 9 aa, Homo Sapiens
FCTHPDEPL

SEQ ID NO: 1122803 - protein, 9 aa, Homo Sapiens
EHYDAAFAQ

SEQ ID NO: 1122804 - protein, 9 aa, Homo Sapiens
SEMNYVHRG

SEQ ID NO: 1122805 - protein, 9 aa, Homo Sapiens
WGAPVPHRS

SEQ ID NO: 1122806 - protein, 9 aa, Homo Sapiens
PPEDSPPRG

SEQ ID NO: 1122807 - protein, 9 aa, Homo Sapiens
QAEGSLKKT

SEQ ID NO: 1122808 - protein, 9 aa, Homo Sapiens
YTKVSIGLQ

SEQ ID NO: 1122809 - protein, 9 aa, Homo Sapiens
GRWKPPAVN

SEQ ID NO: 1122810 - protein, 9 aa, Homo Sapiens
VSGGTTSSS

SEQ ID NO: 1122811 - protein, 9 aa, Homo Sapiens
TRPTQRPRA

SEQ ID NO: 1122812 - protein, 9 aa, Homo Sapiens
GAPPPGTGV

SEQ ID NO: 1122813 - protein, 9 aa, Homo Sapiens
KLRNRTPAA

SEQ ID NO: 1122814 - protein, 9 aa, Homo Sapiens
GSQCVSLSF

SEQ ID NO: 1122815 - protein, 9 aa, Homo Sapiens
SRAAGTTFT

SEQ ID NO: 1122816 - protein, 9 aa, Homo Sapiens
LGVIINGLS

SEQ ID NO: 1122817 - protein, 9 aa, Homo Sapiens
QYKCSDESK

SEQ ID NO: 1122818 - protein, 9 aa, Homo Sapiens
SSSGELNCY

SEQ ID NO: 1122819 - protein, 9 aa, Homo Sapiens
GAGPAHPTR

SEQ ID NO: 1122820 - protein, 9 aa, Homo Sapiens
LRAWPRQRS

SEQ ID NO: 1122821 - protein, 9 aa, Homo Sapiens
ALGKYHEVL

SEQ ID NO: 1122822 - protein, 9 aa, Homo Sapiens
RDSLKIVQM

SEQ ID NO: 1122823 - protein, 9 aa, Homo Sapiens
ANPAHGNDT

SEQ ID NO: 1122824 - protein, 9 aa, Homo Sapiens
LLFLEARMQ

SEQ ID NO: 1122825 - protein, 9 aa, Homo Sapiens
SQAQLIMPL

SEQ ID NO: 1122826 - protein, 9 aa, Homo Sapiens
EGSAEMTGL

SEQ ID NO: 1122827 - protein, 9 aa, Homo Sapiens
YQGPEEEGD

SEQ ID NO: 1122828 - protein, 9 aa, Homo Sapiens
PLGDTPQPS

SEQ ID NO: 1122829 - protein, 9 aa, Homo Sapiens
IPPDAQTPD

SEQ ID NO: 1122830 - protein, 9 aa, Homo Sapiens
FVDSGAPQP

SEQ ID NO: 1122831 - protein, 9 aa, Homo Sapiens
SGIRLYYTV

SEQ ID NO: 1122832 - protein, 9 aa, Homo Sapiens
VGEALLYYG

SEQ ID NO: 1122833 - protein, 9 aa, Homo Sapiens
ASGPSPARS

SEQ ID NO: 1122834 - protein, 9 aa, Homo Sapiens
VMGNLLIIL

SEQ ID NO: 1122835 - protein, 9 aa, Homo Sapiens
NKDVNEALR

SEQ ID NO: 1122836 - protein, 9 aa, Homo Sapiens
RRWPPRTPL

SEQ ID NO: 1122837 - protein, 9 aa, Homo Sapiens
AQTEYIEKF

SEQ ID NO: 1122838 - protein, 9 aa, Homo Sapiens
CQLCSPVAR

SEQ ID NO: 1122839 - protein, 9 aa, Homo Sapiens
SSINHFFVT

SEQ ID NO: 1122840 - protein, 9 aa, Homo Sapiens
YFHYHYGWS

SEQ ID NO: 1122841 - protein, 9 aa, Homo Sapiens
ASTPARSPT

SEQ ID NO: 1122842 - protein, 9 aa, Homo Sapiens
ETLSKNFFD

SEQ ID NO: 1122843 - protein, 9 aa, Homo Sapiens
QDENATYTQ

SEQ ID NO: 1122844 - protein, 9 aa, Homo Sapiens
HPPTTTTSS

SEQ ID NO: 1122845 - protein, 9 aa, Homo Sapiens
YRGTLLNDF

SEQ ID NO: 1122846 - protein, 9 aa, Homo Sapiens
SELHQVLTK

SEQ ID NO: 1122847 - protein, 9 aa, Homo Sapiens
ENVPPLHWK

SEQ ID NO: 1122848 - protein, 9 aa, Homo Sapiens
ELYFAGQVE

SEQ ID NO: 1122849 - protein, 9 aa, Homo Sapiens
RATSGTAPS

SEQ ID NO: 1122850 - protein, 9 aa, Homo Sapiens
RCQSPAHAH

SEQ ID NO: 1122851 - protein, 9 aa, Homo Sapiens
SLPIRIYYY

SEQ ID NO: 1122852 - protein, 9 aa, Homo Sapiens
LSIWNQWLS

SEQ ID NO: 1122853 - protein, 9 aa, Homo Sapiens
CHNSDAVRH

SEQ ID NO: 1122854 - protein, 9 aa, Homo Sapiens
FQRDAFLHI

SEQ ID NO: 1122855 - protein, 9 aa, Homo Sapiens
LCPHAFYQV

SEQ ID NO: 1122856 - protein, 9 aa, Homo Sapiens
NALKKKKQL

SEQ ID NO: 1122857 - protein, 9 aa, Homo Sapiens
KLKMACKED

SEQ ID NO: 1122858 - protein, 9 aa, Homo Sapiens
PAPRYPLKY

SEQ ID NO: 1122859 - protein, 9 aa, Homo Sapiens
EPPLMDNGW

SEQ ID NO: 1122860 - protein, 9 aa, Homo Sapiens
EKDVTGADA

SEQ ID NO: 1122861 - protein, 9 aa, Homo Sapiens
DKERKKMVH

SEQ ID NO: 1122862 - protein, 9 aa, Homo Sapiens
EETKPFSPK

SEQ ID NO: 1122863 - protein, 9 aa, Homo Sapiens
ATNPTWRRT

SEQ ID NO: 1122864 - protein, 9 aa, Homo Sapiens
YVECTSAMM

SEQ ID NO: 1122865 - protein, 9 aa, Homo Sapiens
GYSSKALKP

SEQ ID NO: 1122866 - protein, 9 aa, Homo Sapiens
TGSWWPRMK

SEQ ID NO: 1122867 - protein, 9 aa, Homo Sapiens
SRAEVTLID

SEQ ID NO: 1122868 - protein, 9 aa, Homo Sapiens
FSAFIKKHE

SEQ ID NO: 1122869 - protein, 9 aa, Homo Sapiens
TKQWLVHSC

SEQ ID NO: 1122870 - protein, 9 aa, Homo Sapiens
KTCPSPQEI

SEQ ID NO: 1122871 - protein, 9 aa, Homo Sapiens
RRPCTASTA

SEQ ID NO: 1122872 - protein, 9 aa, Homo Sapiens
HKTNQLQYM

SEQ ID NO: 1122873 - protein, 9 aa, Homo Sapiens
AGGQAGASG

SEQ ID NO: 1122874 - protein, 9 aa, Homo Sapiens
VCQVPIRKN

SEQ ID NO: 1122875 - protein, 9 aa, Homo Sapiens
LTQSNQLIN

SEQ ID NO: 1122876 - protein, 9 aa, Homo Sapiens
DHAGRQPHR

SEQ ID NO: 1122877 - protein, 9 aa, Homo Sapiens
LKSLWKEWH

SEQ ID NO: 1122878 - protein, 9 aa, Homo Sapiens
SMTCSGVKM

SEQ ID NO: 1122879 - protein, 9 aa, Homo Sapiens
LFNELTARE

SEQ ID NO: 1122880 - protein, 9 aa, Homo Sapiens
TAATLRCPA

SEQ ID NO: 1122881 - protein, 9 aa, Homo Sapiens
SDAEKLEQA

SEQ ID NO: 1122882 - protein, 9 aa, Homo Sapiens
PISFVDGLT

SEQ ID NO: 1122883 - protein, 9 aa, Homo Sapiens
DTITYRDSR

SEQ ID NO: 1122884 - protein, 9 aa, Homo Sapiens
KKKKGKKIP

SEQ ID NO: 1122885 - protein, 9 aa, Homo Sapiens
KARWCIHAL

SEQ ID NO: 1122886 - protein, 9 aa, Homo Sapiens
IHMGFVSGL

SEQ ID NO: 1122887 - protein, 9 aa, Homo Sapiens
FLVFAKLYI

SEQ ID NO: 1122888 - protein, 9 aa, Homo Sapiens
VHKEKRTQR

SEQ ID NO: 1122889 - protein, 9 aa, Homo Sapiens
GWVPLLLVL

SEQ ID NO: 1122890 - protein, 9 aa, Homo Sapiens
SPPRGRSQD

SEQ ID NO: 1122891 - protein, 9 aa, Homo Sapiens
TTRATLINT

SEQ ID NO: 1122892 - protein, 9 aa, Homo Sapiens
ALHVRGLCL

SEQ ID NO: 1122893 - protein, 9 aa, Homo Sapiens
KYQQEVKIY

SEQ ID NO: 1122894 - protein, 9 aa, Homo Sapiens
VFPPVFALE

SEQ ID NO: 1122895 - protein, 9 aa, Homo Sapiens
YSAQPLTLP

SEQ ID NO: 1122896 - protein, 9 aa, Homo Sapiens
MGNHAEREK

SEQ ID NO: 1122897 - protein, 9 aa, Homo Sapiens
EHLGRAVFP

SEQ ID NO: 1122898 - protein, 9 aa, Homo Sapiens
LADECDDDQ

SEQ ID NO: 1122899 - protein, 9 aa, Homo Sapiens
AHPGPTAAG

SEQ ID NO: 1122900 - protein, 9 aa, Homo Sapiens
AELAKKQKF

SEQ ID NO: 1122901 - protein, 9 aa, Homo Sapiens
LVEIEFISV

SEQ ID NO: 1122902 - protein, 9 aa, Homo Sapiens
DTFSQGIQT

SEQ ID NO: 1122903 - protein, 9 aa, Homo Sapiens
SSPLWLPLP

SEQ ID NO: 1122904 - protein, 9 aa, Homo Sapiens
GQRTLEKKG

SEQ ID NO: 1122905 - protein, 9 aa, Homo Sapiens
GESWMRPCS

SEQ ID NO: 1122906 - protein, 9 aa, Homo Sapiens
GKPLMLPPK

SEQ ID NO: 1122907 - protein, 9 aa, Homo Sapiens
SQSEKHRIA

SEQ ID NO: 1122908 - protein, 9 aa, Homo Sapiens
VTAVLVIDN

SEQ ID NO: 1122909 - protein, 9 aa, Homo Sapiens
GIPLEPTPA

SEQ ID NO: 1122910 - protein, 9 aa, Homo Sapiens
LKVLQWDYQ

SEQ ID NO: 1122911 - protein, 9 aa, Homo Sapiens
ERKKFGPLV

SEQ ID NO: 1122912 - protein, 9 aa, Homo Sapiens
EATRYCHGC

SEQ ID NO: 1122913 - protein, 9 aa, Homo Sapiens
PTCAACRPG

SEQ ID NO: 1122914 - protein, 9 aa, Homo Sapiens
APHISSPDE

SEQ ID NO: 1122915 - protein, 9 aa, Homo Sapiens
KKQLVQKAI

SEQ ID NO: 1122916 - protein, 9 aa, Homo Sapiens
RIGRLMNRS

SEQ ID NO: 1122917 - protein, 9 aa, Homo Sapiens
GPAHQPGNP

SEQ ID NO: 1122918 - protein, 9 aa, Homo Sapiens
LVIEKHGPP

SEQ ID NO: 1122919 - protein, 9 aa, Homo Sapiens
DVISVHGTE

SEQ ID NO: 1122920 - protein, 9 aa, Homo Sapiens
TRPKDNPLA

SEQ ID NO: 1122921 - protein, 9 aa, Homo Sapiens
GSMPNVSWT

SEQ ID NO: 1122922 - protein, 9 aa, Homo Sapiens
QLQKQKLMN

SEQ ID NO: 1122923 - protein, 9 aa, Homo Sapiens
PAPGSPRLC

SEQ ID NO: 1122924 - protein, 9 aa, Homo Sapiens
PPPGGPRHH

SEQ ID NO: 1122925 - protein, 9 aa, Homo Sapiens
WAESPEKDV

SEQ ID NO: 1122926 - protein, 9 aa, Homo Sapiens
DEEVPAFLK

SEQ ID NO: 1122927 - protein, 9 aa, Homo Sapiens
TEQGGLWHV

SEQ ID NO: 1122928 - protein, 9 aa, Homo Sapiens
KKAINGILL

SEQ ID NO: 1122929 - protein, 9 aa, Homo Sapiens
VFRAESEEV

SEQ ID NO: 1122930 - protein, 9 aa, Homo Sapiens
LQRRQFLAK

SEQ ID NO: 1122931 - protein, 9 aa, Homo Sapiens
PKLEPSFSE

SEQ ID NO: 1122932 - protein, 9 aa, Homo Sapiens
SEKAIETDV

SEQ ID NO: 1122933 - protein, 9 aa, Homo Sapiens
AWPWRTRPV

SEQ ID NO: 1122934 - protein, 9 aa, Homo Sapiens
ANELYEPIW

SEQ ID NO: 1122935 - protein, 9 aa, Homo Sapiens
PPSLWALPG

SEQ ID NO: 1122936 - protein, 9 aa, Homo Sapiens
HPQSRGLDS

SEQ ID NO: 1122937 - protein, 9 aa, Homo Sapiens
CSMMVVHNI

SEQ ID NO: 1122938 - protein, 9 aa, Homo Sapiens
RPSTRAWRR

SEQ ID NO: 1122939 - protein, 9 aa, Homo Sapiens
RELPGLQVQ

SEQ ID NO: 1122940 - protein, 9 aa, Homo Sapiens
KTAVVKLEA

SEQ ID NO: 1122941 - protein, 9 aa, Homo Sapiens
PRDRRPRTS

SEQ ID NO: 1122942 - protein, 9 aa, Homo Sapiens
SDTIYDSKA

SEQ ID NO: 1122943 - protein, 9 aa, Homo Sapiens
GYILFLVAT

SEQ ID NO: 1122944 - protein, 9 aa, Homo Sapiens
GQVFATQPV

SEQ ID NO: 1122945 - protein, 9 aa, Homo Sapiens
VTIWWSVAG

SEQ ID NO: 1122946 - protein, 9 aa, Homo Sapiens
QKAVEESHV

SEQ ID NO: 1122947 - protein, 9 aa, Homo Sapiens
NVSVKDIQR

SEQ ID NO: 1122948 - protein, 9 aa, Homo Sapiens
KIFNVSTFL

SEQ ID NO: 1122949 - protein, 9 aa, Homo Sapiens
RDPSPRAGC

SEQ ID NO: 1122950 - protein, 9 aa, Homo Sapiens
WLFAVFERP

SEQ ID NO: 1122951 - protein, 9 aa, Homo Sapiens
VCCPRAPEV

SEQ ID NO: 1122952 - protein, 9 aa, Homo Sapiens
SLVRRGGQR

SEQ ID NO: 1122953 - protein, 9 aa, Homo Sapiens
STPGSGPSP

SEQ ID NO: 1122954 - protein, 9 aa, Homo Sapiens
NNLYLLLTG

SEQ ID NO: 1122955 - protein, 9 aa, Homo Sapiens
YSWAGAVDN

SEQ ID NO: 1122956 - protein, 9 aa, Homo Sapiens
KDLTQVEAS

SEQ ID NO: 1122957 - protein, 9 aa, Homo Sapiens
GEPGTPSKA

SEQ ID NO: 1122958 - protein, 9 aa, Homo Sapiens
ECRKIFNGG

SEQ ID NO: 1122959 - protein, 9 aa, Homo Sapiens
GQTRGRRCW

SEQ ID NO: 1122960 - protein, 9 aa, Homo Sapiens
DLAGSESIG

SEQ ID NO: 1122961 - protein, 9 aa, Homo Sapiens
LVEAKKLPK

SEQ ID NO: 1122962 - protein, 9 aa, Homo Sapiens
DLLHKMARI

SEQ ID NO: 1122963 - protein, 9 aa, Homo Sapiens
RVRPRVSGA

SEQ ID NO: 1122964 - protein, 9 aa, Homo Sapiens
VADYLTAGT

SEQ ID NO: 1122965 - protein, 9 aa, Homo Sapiens
IRKSEIAVG

SEQ ID NO: 1122966 - protein, 9 aa, Homo Sapiens
ESFGAWCRY

SEQ ID NO: 1122967 - protein, 9 aa, Homo Sapiens
LDPVLCTLQ

SEQ ID NO: 1122968 - protein, 9 aa, Homo Sapiens
ENTAEEKKL

SEQ ID NO: 1122969 - protein, 9 aa, Homo Sapiens
VQAFCTHPD

SEQ ID NO: 1122970 - protein, 9 aa, Homo Sapiens
NRKRRRGSD

SEQ ID NO: 1122971 - protein, 9 aa, Homo Sapiens
KKMVGDVTG

SEQ ID NO: 1122972 - protein, 9 aa, Homo Sapiens
APVRCSRPS

SEQ ID NO: 1122973 - protein, 9 aa, Homo Sapiens
RAPRTLLQT

SEQ ID NO: 1122974 - protein, 9 aa, Homo Sapiens
LWGPFEESP

SEQ ID NO: 1122975 - protein, 9 aa, Homo Sapiens
KVQQKCLMK

SEQ ID NO: 1122976 - protein, 9 aa, Homo Sapiens
WHRRLAPNK

SEQ ID NO: 1122977 - protein, 9 aa, Homo Sapiens
VEGVHGPGP

SEQ ID NO: 1122978 - protein, 9 aa, Homo Sapiens
GAQATSELH

SEQ ID NO: 1122979 - protein, 9 aa, Homo Sapiens
TPPAVPPVL

SEQ ID NO: 1122980 - protein, 9 aa, Homo Sapiens
ETGDPPLLP

SEQ ID NO: 1122981 - protein, 9 aa, Homo Sapiens
LCLSGDIVP

SEQ ID NO: 1122982 - protein, 9 aa, Homo Sapiens
PTRRKRRRS

SEQ ID NO: 1122983 - protein, 9 aa, Homo Sapiens
PYCKASLST

SEQ ID NO: 1122984 - protein, 9 aa, Homo Sapiens
LRPHHDLGP

SEQ ID NO: 1122985 - protein, 9 aa, Homo Sapiens
SLGPDNSNI

SEQ ID NO: 1122986 - protein, 9 aa, Homo Sapiens
DSSINHFFV

SEQ ID NO: 1122987 - protein, 9 aa, Homo Sapiens
SPDSYQRFG

SEQ ID NO: 1122988 - protein, 9 aa, Homo Sapiens
KGVQKIPVL

SEQ ID NO: 1122989 - protein, 9 aa, Homo Sapiens
APGVQGQMV

SEQ ID NO: 1122990 - protein, 9 aa, Homo Sapiens
LYGRGENFL

SEQ ID NO: 1122991 - protein, 9 aa, Homo Sapiens
LKRDVESLV

SEQ ID NO: 1122992 - protein, 9 aa, Homo Sapiens
VDVDLLIGS

SEQ ID NO: 1122993 - protein, 9 aa, Homo Sapiens
LAPGRGAAV

SEQ ID NO: 1122994 - protein, 9 aa, Homo Sapiens
HGWNPRDCS

SEQ ID NO: 1122995 - protein, 9 aa, Homo Sapiens
VGLLVVSHN

SEQ ID NO: 1122996 - protein, 9 aa, Homo Sapiens
PTELEDFKL

SEQ ID NO: 1122997 - protein, 9 aa, Homo Sapiens
QDLWENTEF

SEQ ID NO: 1122998 - protein, 9 aa, Homo Sapiens
KTKSSEDVC

SEQ ID NO: 1122999 - protein, 9 aa, Homo Sapiens
TFYSFFSPS

SEQ ID NO: 1123000 - protein, 9 aa, Homo Sapiens
QSPFPPTPM

SEQ ID NO: 1123001 - protein, 9 aa, Homo Sapiens
PPQLRRPRP

SEQ ID NO: 1123002 - protein, 9 aa, Homo Sapiens
VANEAMLLD

SEQ ID NO: 1123003 - protein, 9 aa, Homo Sapiens
LFLHLDMRP

SEQ ID NO: 1123004 - protein, 9 aa, Homo Sapiens
TQHQFGHTK

SEQ ID NO: 1123005 - protein, 9 aa, Homo Sapiens
TFMGQGAGR

SEQ ID NO: 1123006 - protein, 9 aa, Homo Sapiens
LAELDDGMD

SEQ ID NO: 1123007 - protein, 9 aa, Homo Sapiens
LLLRSSMYR

SEQ ID NO: 1123008 - protein, 9 aa, Homo Sapiens
KLRKEDEEE

SEQ ID NO: 1123009 - protein, 9 aa, Homo Sapiens
PWLCKPVPP

SEQ ID NO: 1123010 - protein, 9 aa, Homo Sapiens
LVPHWQDHI

SEQ ID NO: 1123011 - protein, 9 aa, Homo Sapiens
HSTLLSVLD

SEQ ID NO: 1123012 - protein, 9 aa, Homo Sapiens
QYLHPGEDE

SEQ ID NO: 1123013 - protein, 9 aa, Homo Sapiens
DIREEKAPW

SEQ ID NO: 1123014 - protein, 9 aa, Homo Sapiens
KHPFDFDFF

SEQ ID NO: 1123015 - protein, 9 aa, Homo Sapiens
LGTTDLLQE

SEQ ID NO: 1123016 - protein, 9 aa, Homo Sapiens
SVCNTGSRA

SEQ ID NO: 1123017 - protein, 9 aa, Homo Sapiens
ISDQETGTA

SEQ ID NO: 1123018 - protein, 9 aa, Homo Sapiens
TFGLDTRWH

SEQ ID NO: 1123019 - protein, 9 aa, Homo Sapiens
LEGNSFLTV

SEQ ID NO: 1123020 - protein, 9 aa, Homo Sapiens
DLLKEPGKN

SEQ ID NO: 1123021 - protein, 9 aa, Homo Sapiens
TKLVLDRHT

SEQ ID NO: 1123022 - protein, 9 aa, Homo Sapiens
LLPKELVQG

SEQ ID NO: 1123023 - protein, 9 aa, Homo Sapiens
IKVMILELL

SEQ ID NO: 1123024 - protein, 9 aa, Homo Sapiens
AFAPCCAPQ

SEQ ID NO: 1123025 - protein, 9 aa, Homo Sapiens
LRGLGPGLL

SEQ ID NO: 1123026 - protein, 9 aa, Homo Sapiens
CARSPSLCS

SEQ ID NO: 1123027 - protein, 9 aa, Homo Sapiens
LPAGGSCMK

SEQ ID NO: 1123028 - protein, 9 aa, Homo Sapiens
CGVLDLDRP

SEQ ID NO: 1123029 - protein, 9 aa, Homo Sapiens
KEGHIKAFS

SEQ ID NO: 1123030 - protein, 9 aa, Homo Sapiens
KGATCGLLY

SEQ ID NO: 1123031 - protein, 9 aa, Homo Sapiens
PCQACQVGL

SEQ ID NO: 1123032 - protein, 9 aa, Homo Sapiens
SGLRSVVAN

SEQ ID NO: 1123033 - protein, 9 aa, Homo Sapiens
DSKGAQKSL

SEQ ID NO: 1123034 - protein, 9 aa, Homo Sapiens
KGPSEYVAN

SEQ ID NO: 1123035 - protein, 9 aa, Homo Sapiens
SGFTGTCCH

SEQ ID NO: 1123036 - protein, 9 aa, Homo Sapiens
GAAKVKKER

SEQ ID NO: 1123037 - protein, 9 aa, Homo Sapiens
PVLPTMHYN

SEQ ID NO: 1123038 - protein, 9 aa, Homo Sapiens
DFGFSIVVG

SEQ ID NO: 1123039 - protein, 9 aa, Homo Sapiens
PSFSAPCCW

SEQ ID NO: 1123040 - protein, 9 aa, Homo Sapiens
PCCCWGFWG

SEQ ID NO: 1123041 - protein, 9 aa, Homo Sapiens
PRTAIKAKQ

SEQ ID NO: 1123042 - protein, 9 aa, Homo Sapiens
LPPLPRRDS

SEQ ID NO: 1123043 - protein, 9 aa, Homo Sapiens
LSQNDVKRL

SEQ ID NO: 1123044 - protein, 9 aa, Homo Sapiens
RATRHGPYP

SEQ ID NO: 1123045 - protein, 9 aa, Homo Sapiens
NQWLSCPSS

SEQ ID NO: 1123046 - protein, 9 aa, Homo Sapiens
SETIVSALT

SEQ ID NO: 1123047 - protein, 9 aa, Homo Sapiens
ALLQAGPVA

SEQ ID NO: 1123048 - protein, 9 aa, Homo Sapiens
VVEGVHGPG

SEQ ID NO: 1123049 - protein, 9 aa, Homo Sapiens
PASGPSPAR

SEQ ID NO: 1123050 - protein, 9 aa, Homo Sapiens
HQGPCQRPQ

SEQ ID NO: 1123051 - protein, 9 aa, Homo Sapiens
HRSIPNVTK

SEQ ID NO: 1123052 - protein, 9 aa, Homo Sapiens
SPLLGAEDS

SEQ ID NO: 1123053 - protein, 9 aa, Homo Sapiens
DMGSYTCAA

SEQ ID NO: 1123054 - protein, 9 aa, Homo Sapiens
QTLILVVIG

SEQ ID NO: 1123055 - protein, 9 aa, Homo Sapiens
GSHQDMAHS

SEQ ID NO: 1123056 - protein, 9 aa, Homo Sapiens
PPAAPPLPD

SEQ ID NO: 1123057 - protein, 9 aa, Homo Sapiens
GAERWNKKG

SEQ ID NO: 1123058 - protein, 9 aa, Homo Sapiens
GAGGQCCCC

SEQ ID NO: 1123059 - protein, 9 aa, Homo Sapiens
WQYDNEKKW

SEQ ID NO: 1123060 - protein, 9 aa, Homo Sapiens
VVSNTSTFM

SEQ ID NO: 1123061 - protein, 9 aa, Homo Sapiens
SLPAVACRF

SEQ ID NO: 1123062 - protein, 9 aa, Homo Sapiens
GNSLTERGS

SEQ ID NO: 1123063 - protein, 9 aa, Homo Sapiens
LSYTISCVT

SEQ ID NO: 1123064 - protein, 9 aa, Homo Sapiens
GFSIVVGEL

SEQ ID NO: 1123065 - protein, 9 aa, Homo Sapiens
RITAAASRT

SEQ ID NO: 1123066 - protein, 9 aa, Homo Sapiens
RSYNEFGLL

SEQ ID NO: 1123067 - protein, 9 aa, Homo Sapiens
DKAFQEKHP

SEQ ID NO: 1123068 - protein, 9 aa, Homo Sapiens
TQLCKKQND

SEQ ID NO: 1123069 - protein, 9 aa, Homo Sapiens
KRKKWRHRT

SEQ ID NO: 1123070 - protein, 9 aa, Homo Sapiens
EKEHTNAKK

SEQ ID NO: 1123071 - protein, 9 aa, Homo Sapiens
YQAWVAEQY

SEQ ID NO: 1123072 - protein, 9 aa, Homo Sapiens
FLGVTLGLT

SEQ ID NO: 1123073 - protein, 9 aa, Homo Sapiens
GLIPCIMVS

SEQ ID NO: 1123074 - protein, 9 aa, Homo Sapiens
GELNCYDLV

SEQ ID NO: 1123075 - protein, 9 aa, Homo Sapiens
GGQVGHGVW

SEQ ID NO: 1123076 - protein, 9 aa, Homo Sapiens
LQSLLSLYS

SEQ ID NO: 1123077 - protein, 9 aa, Homo Sapiens
HCNSSNKSY

SEQ ID NO: 1123078 - protein, 9 aa, Homo Sapiens
CQALGSARG

SEQ ID NO: 1123079 - protein, 9 aa, Homo Sapiens
KAKWLGVQW

SEQ ID NO: 1123080 - protein, 9 aa, Homo Sapiens
SALIAARGL

SEQ ID NO: 1123081 - protein, 9 aa, Homo Sapiens
PCPGICQLV

SEQ ID NO: 1123082 - protein, 9 aa, Homo Sapiens
SEEKAMREQ

SEQ ID NO: 1123083 - protein, 9 aa, Homo Sapiens
TFGIFCYGV

SEQ ID NO: 1123084 - protein, 9 aa, Homo Sapiens
GEFKISYEW

SEQ ID NO: 1123085 - protein, 9 aa, Homo Sapiens
SSVSGARGW

SEQ ID NO: 1123086 - protein, 9 aa, Homo Sapiens
PPGRGRKHS

SEQ ID NO: 1123087 - protein, 9 aa, Homo Sapiens
GRLEQLGGC

SEQ ID NO: 1123088 - protein, 9 aa, Homo Sapiens
SFHSSATGP

SEQ ID NO: 1123089 - protein, 9 aa, Homo Sapiens
EQNEEVSPQ

SEQ ID NO: 1123090 - protein, 9 aa, Homo Sapiens
SERLTRSVE

SEQ ID NO: 1123091 - protein, 9 aa, Homo Sapiens
DSNLSEDED

SEQ ID NO: 1123092 - protein, 9 aa, Homo Sapiens
LALHLRVHP

SEQ ID NO: 1123093 - protein, 9 aa, Homo Sapiens
SEKREKDQR

SEQ ID NO: 1123094 - protein, 9 aa, Homo Sapiens
NVNKLNVSL

SEQ ID NO: 1123095 - protein, 9 aa, Homo Sapiens
YNVPEESPL

SEQ ID NO: 1123096 - protein, 9 aa, Homo Sapiens
KERQLMCMI

SEQ ID NO: 1123097 - protein, 9 aa, Homo Sapiens
EDNKTKELT

SEQ ID NO: 1123098 - protein, 9 aa, Homo Sapiens
LMSVDMILI

SEQ ID NO: 1123099 - protein, 9 aa, Homo Sapiens
GSSLEPQQH

SEQ ID NO: 1123100 - protein, 9 aa, Homo Sapiens
LDGTRCQPR

SEQ ID NO: 1123101 - protein, 9 aa, Homo Sapiens
VTNLPTPQK

SEQ ID NO: 1123102 - protein, 9 aa, Homo Sapiens
RRRSKQKDK

SEQ ID NO: 1123103 - protein, 9 aa, Homo Sapiens
WHEHTKPDR

SEQ ID NO: 1123104 - protein, 9 aa, Homo Sapiens
AQLVCSVPG

SEQ ID NO: 1123105 - protein, 9 aa, Homo Sapiens
LSWAARSLS

SEQ ID NO: 1123106 - protein, 9 aa, Homo Sapiens
HRELLAGFC

SEQ ID NO: 1123107 - protein, 9 aa, Homo Sapiens
RPSLALLRG

SEQ ID NO: 1123108 - protein, 9 aa, Homo Sapiens
GQLQDAEQQ

SEQ ID NO: 1123109 - protein, 9 aa, Homo Sapiens
VQALRAKLD

SEQ ID NO: 1123110 - protein, 9 aa, Homo Sapiens
IQKAVIQAL

SEQ ID NO: 1123111 - protein, 9 aa, Homo Sapiens
QLITCHTPA

SEQ ID NO: 1123112 - protein, 9 aa, Homo Sapiens
GGIGSSRRC

SEQ ID NO: 1123113 - protein, 9 aa, Homo Sapiens
WGTWCSSSV

SEQ ID NO: 1123114 - protein, 9 aa, Homo Sapiens
MCRCAYGYY

SEQ ID NO: 1123115 - protein, 9 aa, Homo Sapiens
RPLSRRLEV

SEQ ID NO: 1123116 - protein, 9 aa, Homo Sapiens
SQNEETKPF

SEQ ID NO: 1123117 - protein, 9 aa, Homo Sapiens
NEEVSPQLF

SEQ ID NO: 1123118 - protein, 9 aa, Homo Sapiens
QLSPTPSAP

SEQ ID NO: 1123119 - protein, 9 aa, Homo Sapiens
FVASLFRHY

SEQ ID NO: 1123120 - protein, 9 aa, Homo Sapiens
FSVKPLKQN

SEQ ID NO: 1123121 - protein, 9 aa, Homo Sapiens
FFLIEKNLI

SEQ ID NO: 1123122 - protein, 9 aa, Homo Sapiens
QNQNRMWWQ

SEQ ID NO: 1123123 - protein, 9 aa, Homo Sapiens
VREHPVALE

SEQ ID NO: 1123124 - protein, 9 aa, Homo Sapiens
GDWKITFTV

SEQ ID NO: 1123125 - protein, 9 aa, Homo Sapiens
VENVPPLHW

SEQ ID NO: 1123126 - protein, 9 aa, Homo Sapiens
HTLTAHRGL

SEQ ID NO: 1123127 - protein, 9 aa, Homo Sapiens
TGNTAIILV

SEQ ID NO: 1123128 - protein, 9 aa, Homo Sapiens
VLFSIMNSW

SEQ ID NO: 1123129 - protein, 9 aa, Homo Sapiens
RNKDVNEAL

SEQ ID NO: 1123130 - protein, 9 aa, Homo Sapiens
VTGYLRTAT

SEQ ID NO: 1123131 - protein, 9 aa, Homo Sapiens
PPLFQAGTS

SEQ ID NO: 1123132 - protein, 9 aa, Homo Sapiens
PAHGNDTVQ

SEQ ID NO: 1123133 - protein, 9 aa, Homo Sapiens
SIHRGAERW

SEQ ID NO: 1123134 - protein, 9 aa, Homo Sapiens
HRLCRGKMA

SEQ ID NO: 1123135 - protein, 9 aa, Homo Sapiens
ASIRRTKRT

SEQ ID NO: 1123136 - protein, 9 aa, Homo Sapiens
KMGDNVIES

SEQ ID NO: 1123137 - protein, 9 aa, Homo Sapiens
ETGSSTDSE

SEQ ID NO: 1123138 - protein, 9 aa, Homo Sapiens
NCRLPEIKL

SEQ ID NO: 1123139 - protein, 9 aa, Homo Sapiens
PWTRCLRMR

SEQ ID NO: 1123140 - protein, 9 aa, Homo Sapiens
SNNSLSNLT

SEQ ID NO: 1123141 - protein, 9 aa, Homo Sapiens
DAQTPDMSF

SEQ ID NO: 1123142 - protein, 9 aa, Homo Sapiens
IAVPANRYT

SEQ ID NO: 1123143 - protein, 9 aa, Homo Sapiens
KTNNGIHYW

SEQ ID NO: 1123144 - protein, 9 aa, Homo Sapiens
WVAEKTECK

SEQ ID NO: 1123145 - protein, 9 aa, Homo Sapiens
PPPPPADPA

SEQ ID NO: 1123146 - protein, 9 aa, Homo Sapiens
FIRGLDAIS

SEQ ID NO: 1123147 - protein, 9 aa, Homo Sapiens
LLDMGKTTH

SEQ ID NO: 1123148 - protein, 9 aa, Homo Sapiens
YLAGLLSAA

SEQ ID NO: 1123149 - protein, 9 aa, Homo Sapiens
HGVPQSPRT

SEQ ID NO: 1123150 - protein, 9 aa, Homo Sapiens
TLARETSLA

SEQ ID NO: 1123151 - protein, 9 aa, Homo Sapiens
PPPQPAAVH

SEQ ID NO: 1123152 - protein, 9 aa, Homo Sapiens
PRAGHDAPA

SEQ ID NO: 1123153 - protein, 9 aa, Homo Sapiens
PGQGPEIQE

SEQ ID NO: 1123154 - protein, 9 aa, Homo Sapiens
ELERVAKSS

SEQ ID NO: 1123155 - protein, 9 aa, Homo Sapiens
LLIILTADR

SEQ ID NO: 1123156 - protein, 9 aa, Homo Sapiens
GLLLIKHVV

SEQ ID NO: 1123157 - protein, 9 aa, Homo Sapiens
KNITNELLQ

SEQ ID NO: 1123158 - protein, 9 aa, Homo Sapiens
LANAQNPSL

SEQ ID NO: 1123159 - protein, 9 aa, Homo Sapiens
SAWLTILEA

SEQ ID NO: 1123160 - protein, 9 aa, Homo Sapiens
GQGGKQTPV

SEQ ID NO: 1123161 - protein, 9 aa, Homo Sapiens
GSPDSKGAQ

SEQ ID NO: 1123162 - protein, 9 aa, Homo Sapiens
SVQYKKWYF

SEQ ID NO: 1123163 - protein, 9 aa, Homo Sapiens
VPEIISFAE

SEQ ID NO: 1123164 - protein, 9 aa, Homo Sapiens
CVDGITSFS

SEQ ID NO: 1123165 - protein, 9 aa, Homo Sapiens
LVACVGSGL

SEQ ID NO: 1123166 - protein, 9 aa, Homo Sapiens
PPPIPQRPG

SEQ ID NO: 1123167 - protein, 9 aa, Homo Sapiens
TLPSRGSRG

SEQ ID NO: 1123168 - protein, 9 aa, Homo Sapiens
DDLVTFGIF

SEQ ID NO: 1123169 - protein, 9 aa, Homo Sapiens
FLAKQGQWG

SEQ ID NO: 1123170 - protein, 9 aa, Homo Sapiens
QPSMTSPFK

SEQ ID NO: 1123171 - protein, 9 aa, Homo Sapiens
EGEFKISYE

SEQ ID NO: 1123172 - protein, 9 aa, Homo Sapiens
KRQLIVVKI

SEQ ID NO: 1123173 - protein, 9 aa, Homo Sapiens
TEEEMEIAK

SEQ ID NO: 1123174 - protein, 9 aa, Homo Sapiens
ARMCLHASG

SEQ ID NO: 1123175 - protein, 9 aa, Homo Sapiens
PPANPQLLC

SEQ ID NO: 1123176 - protein, 9 aa, Homo Sapiens
KVILRDLLH

SEQ ID NO: 1123177 - protein, 9 aa, Homo Sapiens
SPSRARGPA

SEQ ID NO: 1123178 - protein, 9 aa, Homo Sapiens
IAHRLNIAM

SEQ ID NO: 1123179 - protein, 9 aa, Homo Sapiens
KLDKVNYSH

SEQ ID NO: 1123180 - protein, 9 aa, Homo Sapiens
SFTYSLSVI

SEQ ID NO: 1123181 - protein, 9 aa, Homo Sapiens
HPTRGPRRR

SEQ ID NO: 1123182 - protein, 9 aa, Homo Sapiens
SAGVNEKVS

SEQ ID NO: 1123183 - protein, 9 aa, Homo Sapiens
RELAVRLAA

SEQ ID NO: 1123184 - protein, 9 aa, Homo Sapiens
QVDMVRTAY

SEQ ID NO: 1123185 - protein, 9 aa, Homo Sapiens
RGRRGHEER

SEQ ID NO: 1123186 - protein, 9 aa, Homo Sapiens
LIEQEQLNC

SEQ ID NO: 1123187 - protein, 9 aa, Homo Sapiens
TGKVRTARA

SEQ ID NO: 1123188 - protein, 9 aa, Homo Sapiens
AGRGGTTCP

SEQ ID NO: 1123189 - protein, 9 aa, Homo Sapiens
ASKSVLELT

SEQ ID NO: 1123190 - protein, 9 aa, Homo Sapiens
PPRRPPPAW

SEQ ID NO: 1123191 - protein, 9 aa, Homo Sapiens
DKAEQRARH

SEQ ID NO: 1123192 - protein, 9 aa, Homo Sapiens
RTMLQKRLK

SEQ ID NO: 1123193 - protein, 9 aa, Homo Sapiens
ILGPVLFMV

SEQ ID NO: 1123194 - protein, 9 aa, Homo Sapiens
WHLLSEHSG

SEQ ID NO: 1123195 - protein, 9 aa, Homo Sapiens
NKQRNGCHP

SEQ ID NO: 1123196 - protein, 9 aa, Homo Sapiens
GGSDSDSEP

SEQ ID NO: 1123197 - protein, 9 aa, Homo Sapiens
PAGGSCMKG

SEQ ID NO: 1123198 - protein, 9 aa, Homo Sapiens
KLYEVQTVI

SEQ ID NO: 1123199 - protein, 9 aa, Homo Sapiens
TFWTTTGTF

SEQ ID NO: 1123200 - protein, 9 aa, Homo Sapiens
SKISQADSP

SEQ ID NO: 1123201 - protein, 9 aa, Homo Sapiens
VHQLHGKVG

SEQ ID NO: 1123202 - protein, 9 aa, Homo Sapiens
DGGSDVQSY

SEQ ID NO: 1123203 - protein, 9 aa, Homo Sapiens
NVPEESPLL

SEQ ID NO: 1123204 - protein, 9 aa, Homo Sapiens
SDESKPFPR

SEQ ID NO: 1123205 - protein, 9 aa, Homo Sapiens
LAVALLAVS

SEQ ID NO: 1123206 - protein, 9 aa, Homo Sapiens
SSTSERELD

SEQ ID NO: 1123207 - protein, 9 aa, Homo Sapiens
SSSSCGSPG

SEQ ID NO: 1123208 - protein, 9 aa, Homo Sapiens
QGPGHHQRR

SEQ ID NO: 1123209 - protein, 9 aa, Homo Sapiens
YLMQKHTSS

SEQ ID NO: 1123210 - protein, 9 aa, Homo Sapiens
SPDEAAEDA

SEQ ID NO: 1123211 - protein, 9 aa, Homo Sapiens
LTDGTDPFF

SEQ ID NO: 1123212 - protein, 9 aa, Homo Sapiens
FIKVLTIIE

SEQ ID NO: 1123213 - protein, 9 aa, Homo Sapiens
FLSIADMYS

SEQ ID NO: 1123214 - protein, 9 aa, Homo Sapiens
GARGWAQGG

SEQ ID NO: 1123215 - protein, 9 aa, Homo Sapiens
WIKHTQKKY

SEQ ID NO: 1123216 - protein, 9 aa, Homo Sapiens
KPRGLFEVL

SEQ ID NO: 1123217 - protein, 9 aa, Homo Sapiens
MPWGPLPML

SEQ ID NO: 1123218 - protein, 9 aa, Homo Sapiens
SRVISSSPA

SEQ ID NO: 1123219 - protein, 9 aa, Homo Sapiens
ISVHGTEKL

SEQ ID NO: 1123220 - protein, 9 aa, Homo Sapiens
RPHAHPGPT

SEQ ID NO: 1123221 - protein, 9 aa, Homo Sapiens
PKRPEQLPQ

SEQ ID NO: 1123222 - protein, 9 aa, Homo Sapiens
SESVNAKES

SEQ ID NO: 1123223 - protein, 9 aa, Homo Sapiens
VRAMYPTKT

SEQ ID NO: 1123224 - protein, 9 aa, Homo Sapiens
DVISLKQGK

SEQ ID NO: 1123225 - protein, 9 aa, Homo Sapiens
PASCRALPG

SEQ ID NO: 1123226 - protein, 9 aa, Homo Sapiens
RPSLSEEEK

SEQ ID NO: 1123227 - protein, 9 aa, Homo Sapiens
ESVKNGFDS

SEQ ID NO: 1123228 - protein, 9 aa, Homo Sapiens
QAVASPDQQ

SEQ ID NO: 1123229 - protein, 9 aa, Homo Sapiens
IANPFAADI

SEQ ID NO: 1123230 - protein, 9 aa, Homo Sapiens
AVELSRCHP

SEQ ID NO: 1123231 - protein, 9 aa, Homo Sapiens
VTLRPWKTS

SEQ ID NO: 1123232 - protein, 9 aa, Homo Sapiens
LLSFALCGS

SEQ ID NO: 1123233 - protein, 9 aa, Homo Sapiens
PWPPQASLL

SEQ ID NO: 1123234 - protein, 9 aa, Homo Sapiens
KTCEKPGQL

SEQ ID NO: 1123235 - protein, 9 aa, Homo Sapiens
LMVIPNAWG

SEQ ID NO: 1123236 - protein, 9 aa, Homo Sapiens
EPPTAPRHH

SEQ ID NO: 1123237 - protein, 9 aa, Homo Sapiens
TQWIVTFGA

SEQ ID NO: 1123238 - protein, 9 aa, Homo Sapiens
DDRNTSCHH

SEQ ID NO: 1123239 - protein, 9 aa, Homo Sapiens
PVKQTCSQT

SEQ ID NO: 1123240 - protein, 9 aa, Homo Sapiens
LGPGLLLLA

SEQ ID NO: 1123241 - protein, 9 aa, Homo Sapiens
DGSLHVEPK

SEQ ID NO: 1123242 - protein, 9 aa, Homo Sapiens
DILIPTCCF

SEQ ID NO: 1123243 - protein, 9 aa, Homo Sapiens
TFTRHSLKA

SEQ ID NO: 1123244 - protein, 9 aa, Homo Sapiens
KELTMFSYP

SEQ ID NO: 1123245 - protein, 9 aa, Homo Sapiens
QGLVGMTPR

SEQ ID NO: 1123246 - protein, 9 aa, Homo Sapiens
PHLKETLSK

SEQ ID NO: 1123247 - protein, 9 aa, Homo Sapiens
PSPPPPPAD

SEQ ID NO: 1123248 - protein, 9 aa, Homo Sapiens
GFGMYREKD

SEQ ID NO: 1123249 - protein, 9 aa, Homo Sapiens
GLSPDVQRV

SEQ ID NO: 1123250 - protein, 9 aa, Homo Sapiens
WGTQCRRCM

SEQ ID NO: 1123251 - protein, 9 aa, Homo Sapiens
DAMCRCAYG

SEQ ID NO: 1123252 - protein, 9 aa, Homo Sapiens
QSSGSSATD

SEQ ID NO: 1123253 - protein, 9 aa, Homo Sapiens
HNQTYRRFP

SEQ ID NO: 1123254 - protein, 9 aa, Homo Sapiens
MLCFLSMIM

SEQ ID NO: 1123255 - protein, 9 aa, Homo Sapiens
MHRFYHIEY

SEQ ID NO: 1123256 - protein, 9 aa, Homo Sapiens
QPSAAPAAP

SEQ ID NO: 1123257 - protein, 9 aa, Homo Sapiens
HLKETLSKN

SEQ ID NO: 1123258 - protein, 9 aa, Homo Sapiens
PHLLDILSE

SEQ ID NO: 1123259 - protein, 9 aa, Homo Sapiens
VGDKFKRPI

SEQ ID NO: 1123260 - protein, 9 aa, Homo Sapiens
FGRHVVMNS

SEQ ID NO: 1123261 - protein, 9 aa, Homo Sapiens
FSTSITRFA

SEQ ID NO: 1123262 - protein, 9 aa, Homo Sapiens
MTMYYQVVK

SEQ ID NO: 1123263 - protein, 9 aa, Homo Sapiens
HIQESVLRK

SEQ ID NO: 1123264 - protein, 9 aa, Homo Sapiens
EIHSVQLRD

SEQ ID NO: 1123265 - protein, 9 aa, Homo Sapiens
LLIGRLGEY

SEQ ID NO: 1123266 - protein, 9 aa, Homo Sapiens
GGHPLQMEN

SEQ ID NO: 1123267 - protein, 9 aa, Homo Sapiens
TLAAPMGHP

SEQ ID NO: 1123268 - protein, 9 aa, Homo Sapiens
LPIPPNGHC

SEQ ID NO: 1123269 - protein, 9 aa, Homo Sapiens
RYFRKHTGA

SEQ ID NO: 1123270 - protein, 9 aa, Homo Sapiens
SDELTRYFR

SEQ ID NO: 1123271 - protein, 9 aa, Homo Sapiens
NRIAGKIIP

SEQ ID NO: 1123272 - protein, 9 aa, Homo Sapiens
TKKRGKSQG

SEQ ID NO: 1123273 - protein, 9 aa, Homo Sapiens
SAPPQGFRT

SEQ ID NO: 1123274 - protein, 9 aa, Homo Sapiens
GITYASIAL

SEQ ID NO: 1123275 - protein, 9 aa, Homo Sapiens
REKALCPTQ

SEQ ID NO: 1123276 - protein, 9 aa, Homo Sapiens
RPPRFLQVC

SEQ ID NO: 1123277 - protein, 9 aa, Homo Sapiens
GDMMSSGFS

SEQ ID NO: 1123278 - protein, 9 aa, Homo Sapiens
KKLKEQMRR

SEQ ID NO: 1123279 - protein, 9 aa, Homo Sapiens
VTLMINLYH

SEQ ID NO: 1123280 - protein, 9 aa, Homo Sapiens
MVDSLDIES

SEQ ID NO: 1123281 - protein, 9 aa, Homo Sapiens
GASKASRAG

SEQ ID NO: 1123282 - protein, 9 aa, Homo Sapiens
SDLEAQLDV

SEQ ID NO: 1123283 - protein, 9 aa, Homo Sapiens
YSLRERKAH

SEQ ID NO: 1123284 - protein, 9 aa, Homo Sapiens
LSLRILTSQ

SEQ ID NO: 1123285 - protein, 9 aa, Homo Sapiens
DSLGTVEWT

SEQ ID NO: 1123286 - protein, 9 aa, Homo Sapiens
STDAGSTHI

SEQ ID NO: 1123287 - protein, 9 aa, Homo Sapiens
QQQSQQPYP

SEQ ID NO: 1123288 - protein, 9 aa, Homo Sapiens
ALLLLMDAG

SEQ ID NO: 1123289 - protein, 9 aa, Homo Sapiens
WSIPLVPLI

SEQ ID NO: 1123290 - protein, 9 aa, Homo Sapiens
SGVLDNSEG

SEQ ID NO: 1123291 - protein, 9 aa, Homo Sapiens
EENVNRVNK

SEQ ID NO: 1123292 - protein, 9 aa, Homo Sapiens
FLKAQLVCS

SEQ ID NO: 1123293 - protein, 9 aa, Homo Sapiens
SVRLNMLPL

SEQ ID NO: 1123294 - protein, 9 aa, Homo Sapiens
MTTDCPEHL

SEQ ID NO: 1123295 - protein, 9 aa, Homo Sapiens
APSQVWTAA

SEQ ID NO: 1123296 - protein, 9 aa, Homo Sapiens
HPLGSQCVS

SEQ ID NO: 1123297 - protein, 9 aa, Homo Sapiens
PVPVATQNP

SEQ ID NO: 1123298 - protein, 9 aa, Homo Sapiens
PRRSPALRA

SEQ ID NO: 1123299 - protein, 9 aa, Homo Sapiens
LDAMIRKAD

SEQ ID NO: 1123300 - protein, 9 aa, Homo Sapiens
GGENLIPCQ

SEQ ID NO: 1123301 - protein, 9 aa, Homo Sapiens
TVNPYKWLT

SEQ ID NO: 1123302 - protein, 9 aa, Homo Sapiens
VTRRCTAVS

SEQ ID NO: 1123303 - protein, 9 aa, Homo Sapiens
SKRLSIQER

SEQ ID NO: 1123304 - protein, 9 aa, Homo Sapiens
VSDSGAHAL

SEQ ID NO: 1123305 - protein, 9 aa, Homo Sapiens
CLHPQSRGL

SEQ ID NO: 1123306 - protein, 9 aa, Homo Sapiens
MVHELMQVV

SEQ ID NO: 1123307 - protein, 9 aa, Homo Sapiens
WHNVRVTRN

SEQ ID NO: 1123308 - protein, 9 aa, Homo Sapiens
LIFIFAYLI

SEQ ID NO: 1123309 - protein, 9 aa, Homo Sapiens
GAVAGTASC

SEQ ID NO: 1123310 - protein, 9 aa, Homo Sapiens
PTAVSPQPR

SEQ ID NO: 1123311 - protein, 9 aa, Homo Sapiens
ALGRSSHRH

SEQ ID NO: 1123312 - protein, 9 aa, Homo Sapiens
SQHNRQLLC

SEQ ID NO: 1123313 - protein, 9 aa, Homo Sapiens
GGDAFPGGS

SEQ ID NO: 1123314 - protein, 9 aa, Homo Sapiens
VHYQAWVAE

SEQ ID NO: 1123315 - protein, 9 aa, Homo Sapiens
KLRVISDER

SEQ ID NO: 1123316 - protein, 9 aa, Homo Sapiens
ECDSSSSNE

SEQ ID NO: 1123317 - protein, 9 aa, Homo Sapiens
FKLDKRLDR

SEQ ID NO: 1123318 - protein, 9 aa, Homo Sapiens
SPVPPPPPI

SEQ ID NO: 1123319 - protein, 9 aa, Homo Sapiens
PNMTVAQDW

SEQ ID NO: 1123320 - protein, 9 aa, Homo Sapiens
VPAVPRATT

SEQ ID NO: 1123321 - protein, 9 aa, Homo Sapiens
VFDNYSANM

SEQ ID NO: 1123322 - protein, 9 aa, Homo Sapiens
GNLAGRNTL

SEQ ID NO: 1123323 - protein, 9 aa, Homo Sapiens
SRPCRMRLY

SEQ ID NO: 1123324 - protein, 9 aa, Homo Sapiens
MHTISDGIV

SEQ ID NO: 1123325 - protein, 9 aa, Homo Sapiens
GKGFVASPG

SEQ ID NO: 1123326 - protein, 9 aa, Homo Sapiens
CHLLDLPGK

SEQ ID NO: 1123327 - protein, 9 aa, Homo Sapiens
LVHRSAGVG

SEQ ID NO: 1123328 - protein, 9 aa, Homo Sapiens
SGAALANAQ

SEQ ID NO: 1123329 - protein, 9 aa, Homo Sapiens
CLRVRPRVS

SEQ ID NO: 1123330 - protein, 9 aa, Homo Sapiens
SNKEDEGLA

SEQ ID NO: 1123331 - protein, 9 aa, Homo Sapiens
PAPSPWLPA

SEQ ID NO: 1123332 - protein, 9 aa, Homo Sapiens
SGRNASASR

SEQ ID NO: 1123333 - protein, 9 aa, Homo Sapiens
MASLELSRS

SEQ ID NO: 1123334 - protein, 9 aa, Homo Sapiens
WMAKGVQKI

SEQ ID NO: 1123335 - protein, 9 aa, Homo Sapiens
EGNHDKNHP

SEQ ID NO: 1123336 - protein, 9 aa, Homo Sapiens
ALSALFIWP

SEQ ID NO: 1123337 - protein, 9 aa, Homo Sapiens
GHGCVDAAR

SEQ ID NO: 1123338 - protein, 9 aa, Homo Sapiens
VLIGFGRCF

SEQ ID NO: 1123339 - protein, 9 aa, Homo Sapiens
TTTTMGETS

SEQ ID NO: 1123340 - protein, 9 aa, Homo Sapiens
DYGAHRCRI

SEQ ID NO: 1123341 - protein, 9 aa, Homo Sapiens
TSNTEENDT

SEQ ID NO: 1123342 - protein, 9 aa, Homo Sapiens
YVQAFCTHP

SEQ ID NO: 1123343 - protein, 9 aa, Homo Sapiens
QIVMAAYPA

SEQ ID NO: 1123344 - protein, 9 aa, Homo Sapiens
LPGKMPVYA

SEQ ID NO: 1123345 - protein, 9 aa, Homo Sapiens
SQLITCHTP

SEQ ID NO: 1123346 - protein, 9 aa, Homo Sapiens
SSPPSVTIH

SEQ ID NO: 1123347 - protein, 9 aa, Homo Sapiens
TKKLSINNY

SEQ ID NO: 1123348 - protein, 9 aa, Homo Sapiens
NSNIAGTVV

SEQ ID NO: 1123349 - protein, 9 aa, Homo Sapiens
VLLLQRESR

SEQ ID NO: 1123350 - protein, 9 aa, Homo Sapiens
RFFRREDRG

SEQ ID NO: 1123351 - protein, 9 aa, Homo Sapiens
RDNLVVVEG

SEQ ID NO: 1123352 - protein, 9 aa, Homo Sapiens
LRRCNIIPV

SEQ ID NO: 1123353 - protein, 9 aa, Homo Sapiens
LFPSEGVSI

SEQ ID NO: 1123354 - protein, 9 aa, Homo Sapiens
IMATPVSRT

SEQ ID NO: 1123355 - protein, 9 aa, Homo Sapiens
RLKLRLTYN

SEQ ID NO: 1123356 - protein, 9 aa, Homo Sapiens
PAAEGFDAK

SEQ ID NO: 1123357 - protein, 9 aa, Homo Sapiens
FSQGIQTRF

SEQ ID NO: 1123358 - protein, 9 aa, Homo Sapiens
ETARVNGLM

SEQ ID NO: 1123359 - protein, 9 aa, Homo Sapiens
TIFSTAHWG

SEQ ID NO: 1123360 - protein, 9 aa, Homo Sapiens
IIAILSQGP

SEQ ID NO: 1123361 - protein, 9 aa, Homo Sapiens
HKMHNYFML

SEQ ID NO: 1123362 - protein, 9 aa, Homo Sapiens
TIFGPKSQR

SEQ ID NO: 1123363 - protein, 9 aa, Homo Sapiens
PCLAPVKWG

SEQ ID NO: 1123364 - protein, 9 aa, Homo Sapiens
MQGPGPNQH

SEQ ID NO: 1123365 - protein, 9 aa, Homo Sapiens
GQNVIHHKV

SEQ ID NO: 1123366 - protein, 9 aa, Homo Sapiens
MKRMCKQKR

SEQ ID NO: 1123367 - protein, 9 aa, Homo Sapiens
TECKIAELL

SEQ ID NO: 1123368 - protein, 9 aa, Homo Sapiens
ARSPSSAAS

SEQ ID NO: 1123369 - protein, 9 aa, Homo Sapiens
AHQSWLPSP

SEQ ID NO: 1123370 - protein, 9 aa, Homo Sapiens
AFGWARVTL

SEQ ID NO: 1123371 - protein, 9 aa, Homo Sapiens
IHTDLQSKF

SEQ ID NO: 1123372 - protein, 9 aa, Homo Sapiens
YQNPNMTVA

SEQ ID NO: 1123373 - protein, 9 aa, Homo Sapiens
DGKKMDLDG

SEQ ID NO: 1123374 - protein, 9 aa, Homo Sapiens
IHNVCEQKM

SEQ ID NO: 1123375 - protein, 9 aa, Homo Sapiens
SPPGQVGFG

SEQ ID NO: 1123376 - protein, 9 aa, Homo Sapiens
STHTVITTH

SEQ ID NO: 1123377 - protein, 9 aa, Homo Sapiens
QTCSAHRGR

SEQ ID NO: 1123378 - protein, 9 aa, Homo Sapiens
QHLSCRLVN

SEQ ID NO: 1123379 - protein, 9 aa, Homo Sapiens
QKAVHTAEK

SEQ ID NO: 1123380 - protein, 9 aa, Homo Sapiens
TLSQAQLIM

SEQ ID NO: 1123381 - protein, 9 aa, Homo Sapiens
TLDTEREVK

SEQ ID NO: 1123382 - protein, 9 aa, Homo Sapiens
KKQLALKHQ

SEQ ID NO: 1123383 - protein, 9 aa, Homo Sapiens
QLASHLMSC

SEQ ID NO: 1123384 - protein, 9 aa, Homo Sapiens
VEKFLSKKG

SEQ ID NO: 1123385 - protein, 9 aa, Homo Sapiens
LWGCHLHLH

SEQ ID NO: 1123386 - protein, 9 aa, Homo Sapiens
DAPSPSAFA

SEQ ID NO: 1123387 - protein, 9 aa, Homo Sapiens
AVHCSDGWD

SEQ ID NO: 1123388 - protein, 9 aa, Homo Sapiens
VLMVIPNAW

SEQ ID NO: 1123389 - protein, 9 aa, Homo Sapiens
CTVASPPRR

SEQ ID NO: 1123390 - protein, 9 aa, Homo Sapiens
GTVIHLALK

SEQ ID NO: 1123391 - protein, 9 aa, Homo Sapiens
VLVVAAAVV

SEQ ID NO: 1123392 - protein, 9 aa, Homo Sapiens
FALCGSKVL

SEQ ID NO: 1123393 - protein, 9 aa, Homo Sapiens
IGFCRNVSF

SEQ ID NO: 1123394 - protein, 9 aa, Homo Sapiens
MTIGETLVL

SEQ ID NO: 1123395 - protein, 9 aa, Homo Sapiens
IGLWLTTAW

SEQ ID NO: 1123396 - protein, 9 aa, Homo Sapiens
LGAAPLPPR

SEQ ID NO: 1123397 - protein, 9 aa, Homo Sapiens
LSELQAFAR

SEQ ID NO: 1123398 - protein, 9 aa, Homo Sapiens
TSHDNKDTC

SEQ ID NO: 1123399 - protein, 9 aa, Homo Sapiens
IGFWHEHTK

SEQ ID NO: 1123400 - protein, 9 aa, Homo Sapiens
TIDGRSYIV

SEQ ID NO: 1123401 - protein, 9 aa, Homo Sapiens
LEAFGNAHT

SEQ ID NO: 1123402 - protein, 9 aa, Homo Sapiens
RRPPALRAW

SEQ ID NO: 1123403 - protein, 9 aa, Homo Sapiens
WGKMLINLM

SEQ ID NO: 1123404 - protein, 9 aa, Homo Sapiens
GQKDLMSWM

SEQ ID NO: 1123405 - protein, 9 aa, Homo Sapiens
PILGRGACE

SEQ ID NO: 1123406 - protein, 9 aa, Homo Sapiens
FRSDPAKIG

SEQ ID NO: 1123407 - protein, 9 aa, Homo Sapiens
RKIPQCLQL

SEQ ID NO: 1123408 - protein, 9 aa, Homo Sapiens
ALRILIHLH

SEQ ID NO: 1123409 - protein, 9 aa, Homo Sapiens
KSSQRHSIS

SEQ ID NO: 1123410 - protein, 9 aa, Homo Sapiens
VFDRANMHN

SEQ ID NO: 1123411 - protein, 9 aa, Homo Sapiens
RATAEQQER

SEQ ID NO: 1123412 - protein, 9 aa, Homo Sapiens
ALSFPAPLP

SEQ ID NO: 1123413 - protein, 9 aa, Homo Sapiens
LMTAAATRG

SEQ ID NO: 1123414 - protein, 9 aa, Homo Sapiens
VLLVIHSCQ

SEQ ID NO: 1123415 - protein, 9 aa, Homo Sapiens
VSGLGWPVK

SEQ ID NO: 1123416 - protein, 9 aa, Homo Sapiens
SHDTDNAYV

SEQ ID NO: 1123417 - protein, 9 aa, Homo Sapiens
LVLRGVLGS

SEQ ID NO: 1123418 - protein, 9 aa, Homo Sapiens
MKVLEFWPR

SEQ ID NO: 1123419 - protein, 9 aa, Homo Sapiens
MPNLSLAQV

SEQ ID NO: 1123420 - protein, 9 aa, Homo Sapiens
LKKTFTMSM

SEQ ID NO: 1123421 - protein, 9 aa, Homo Sapiens
QDLDVGLNS

SEQ ID NO: 1123422 - protein, 9 aa, Homo Sapiens
GSTRIPFRV

SEQ ID NO: 1123423 - protein, 9 aa, Homo Sapiens
EEASKDNSA

SEQ ID NO: 1123424 - protein, 9 aa, Homo Sapiens
LDHILFPLK

SEQ ID NO: 1123425 - protein, 9 aa, Homo Sapiens
RYRLEALKI

SEQ ID NO: 1123426 - protein, 9 aa, Homo Sapiens
VTHQSSMSQ

SEQ ID NO: 1123427 - protein, 9 aa, Homo Sapiens
LLTLLWGTW

SEQ ID NO: 1123428 - protein, 9 aa, Homo Sapiens
RFIVSLAYT

SEQ ID NO: 1123429 - protein, 9 aa, Homo Sapiens
FRAKGIHSA

SEQ ID NO: 1123430 - protein, 9 aa, Homo Sapiens
TAELWGIRW

SEQ ID NO: 1123431 - protein, 9 aa, Homo Sapiens
LTSETVSMK

SEQ ID NO: 1123432 - protein, 9 aa, Homo Sapiens
PDRETRASI

SEQ ID NO: 1123433 - protein, 9 aa, Homo Sapiens
VGLFRAGKL

SEQ ID NO: 1123434 - protein, 9 aa, Homo Sapiens
SEEKSCLSI

SEQ ID NO: 1123435 - protein, 9 aa, Homo Sapiens
GKCFSQCSN

SEQ ID NO: 1123436 - protein, 9 aa, Homo Sapiens
NCLTTVQER

SEQ ID NO: 1123437 - protein, 9 aa, Homo Sapiens
QLRRPRPSL

SEQ ID NO: 1123438 - protein, 9 aa, Homo Sapiens
YVFLVVANN

SEQ ID NO: 1123439 - protein, 9 aa, Homo Sapiens
EDEGLANGS

SEQ ID NO: 1123440 - protein, 9 aa, Homo Sapiens
VSETEVALQ

SEQ ID NO: 1123441 - protein, 9 aa, Homo Sapiens
GHGQCHVQR

SEQ ID NO: 1123442 - protein, 9 aa, Homo Sapiens
PSGMNSPAP

SEQ ID NO: 1123443 - protein, 9 aa, Homo Sapiens
ARRATESPW

SEQ ID NO: 1123444 - protein, 9 aa, Homo Sapiens
TPRDLGTVA

SEQ ID NO: 1123445 - protein, 9 aa, Homo Sapiens
REGPSKLPG

SEQ ID NO: 1123446 - protein, 9 aa, Homo Sapiens
GLFRAGKLE

SEQ ID NO: 1123447 - protein, 9 aa, Homo Sapiens
SPDPEPSVC

SEQ ID NO: 1123448 - protein, 9 aa, Homo Sapiens
HQLQHAELA

SEQ ID NO: 1123449 - protein, 9 aa, Homo Sapiens
TQELLPPEG

SEQ ID NO: 1123450 - protein, 9 aa, Homo Sapiens
SLQEFTPPS

SEQ ID NO: 1123451 - protein, 9 aa, Homo Sapiens
PHDMQRNVA

SEQ ID NO: 1123452 - protein, 9 aa, Homo Sapiens
PPEEPPTAP

SEQ ID NO: 1123453 - protein, 9 aa, Homo Sapiens
ISRPTSRAR

SEQ ID NO: 1123454 - protein, 9 aa, Homo Sapiens
DRYWAITVP

SEQ ID NO: 1123455 - protein, 9 aa, Homo Sapiens
HPPHLVPKL

SEQ ID NO: 1123456 - protein, 9 aa, Homo Sapiens
WRSAPVPVA

SEQ ID NO: 1123457 - protein, 9 aa, Homo Sapiens
RGCRGTTLP

SEQ ID NO: 1123458 - protein, 9 aa, Homo Sapiens
TFHLFSLHV

SEQ ID NO: 1123459 - protein, 9 aa, Homo Sapiens
LQEELKRVR

SEQ ID NO: 1123460 - protein, 9 aa, Homo Sapiens
QVKIPVADI

SEQ ID NO: 1123461 - protein, 9 aa, Homo Sapiens
DRPPGPPRA

SEQ ID NO: 1123462 - protein, 9 aa, Homo Sapiens
PLTGSWEWQ

SEQ ID NO: 1123463 - protein, 9 aa, Homo Sapiens
TVCNVTISF

SEQ ID NO: 1123464 - protein, 9 aa, Homo Sapiens
QPGRHTVSW

SEQ ID NO: 1123465 - protein, 9 aa, Homo Sapiens
AVERVSTLT

SEQ ID NO: 1123466 - protein, 9 aa, Homo Sapiens
QQQQEEVEE

SEQ ID NO: 1123467 - protein, 9 aa, Homo Sapiens
AKVAGPGPP

SEQ ID NO: 1123468 - protein, 9 aa, Homo Sapiens
FLRCPKPTL

SEQ ID NO: 1123469 - protein, 9 aa, Homo Sapiens
APGGGAWLL

SEQ ID NO: 1123470 - protein, 9 aa, Homo Sapiens
GPGKHGAQK

SEQ ID NO: 1123471 - protein, 9 aa, Homo Sapiens
APRTLLQTR

SEQ ID NO: 1123472 - protein, 9 aa, Homo Sapiens
KYLELGFTQ

SEQ ID NO: 1123473 - protein, 9 aa, Homo Sapiens
DKKLSRPFQ

SEQ ID NO: 1123474 - protein, 9 aa, Homo Sapiens
VIEQETGTF

SEQ ID NO: 1123475 - protein, 9 aa, Homo Sapiens
LTFAMTMYY

SEQ ID NO: 1123476 - protein, 9 aa, Homo Sapiens
HLIHLGLGL

SEQ ID NO: 1123477 - protein, 9 aa, Homo Sapiens
KAQASHSEE

SEQ ID NO: 1123478 - protein, 9 aa, Homo Sapiens
RPEVLQDLW

SEQ ID NO: 1123479 - protein, 9 aa, Homo Sapiens
RRARRVRDS

SEQ ID NO: 1123480 - protein, 9 aa, Homo Sapiens
LVIRLTDGT

SEQ ID NO: 1123481 - protein, 9 aa, Homo Sapiens
FLCLSTNFL

SEQ ID NO: 1123482 - protein, 9 aa, Homo Sapiens
RNVHGINFD

SEQ ID NO: 1123483 - protein, 9 aa, Homo Sapiens
AALANAQNP

SEQ ID NO: 1123484 - protein, 9 aa, Homo Sapiens
RLTCSPQQK

SEQ ID NO: 1123485 - protein, 9 aa, Homo Sapiens
QRAGQSHSK

SEQ ID NO: 1123486 - protein, 9 aa, Homo Sapiens
QHKMDRKAL

SEQ ID NO: 1123487 - protein, 9 aa, Homo Sapiens
KRSRAQRPQ

SEQ ID NO: 1123488 - protein, 9 aa, Homo Sapiens
AATPTEQPL

SEQ ID NO: 1123489 - protein, 9 aa, Homo Sapiens
LEDAVRALE

SEQ ID NO: 1123490 - protein, 9 aa, Homo Sapiens
TIYIFCLHY

SEQ ID NO: 1123491 - protein, 9 aa, Homo Sapiens
STSGSPHPQ

SEQ ID NO: 1123492 - protein, 9 aa, Homo Sapiens
PLVEKNKWM

SEQ ID NO: 1123493 - protein, 9 aa, Homo Sapiens
VSTSSPEEL

SEQ ID NO: 1123494 - protein, 9 aa, Homo Sapiens
EGGPPRPTV

SEQ ID NO: 1123495 - protein, 9 aa, Homo Sapiens
VSFILPNLL

SEQ ID NO: 1123496 - protein, 9 aa, Homo Sapiens
SSGSSATDP

SEQ ID NO: 1123497 - protein, 9 aa, Homo Sapiens
RRLRGGQRG

SEQ ID NO: 1123498 - protein, 9 aa, Homo Sapiens
PKNRTVAGT

SEQ ID NO: 1123499 - protein, 9 aa, Homo Sapiens
QDNNDNEPK

SEQ ID NO: 1123500 - protein, 9 aa, Homo Sapiens
LLHPQWAPH

SEQ ID NO: 1123501 - protein, 9 aa, Homo Sapiens
ISPRVMEEV

SEQ ID NO: 1123502 - protein, 9 aa, Homo Sapiens
LETSAVLLK

SEQ ID NO: 1123503 - protein, 9 aa, Homo Sapiens
KEAISASTR

SEQ ID NO: 1123504 - protein, 9 aa, Homo Sapiens
DRGEGLLID

SEQ ID NO: 1123505 - protein, 9 aa, Homo Sapiens
SKKLTHMCL

SEQ ID NO: 1123506 - protein, 9 aa, Homo Sapiens
LALLWWFWS

SEQ ID NO: 1123507 - protein, 9 aa, Homo Sapiens
GVHHGGNEA

SEQ ID NO: 1123508 - protein, 9 aa, Homo Sapiens
EDLRALGIP

SEQ ID NO: 1123509 - protein, 9 aa, Homo Sapiens
AEGSVQYKK

SEQ ID NO: 1123510 - protein, 9 aa, Homo Sapiens
TPASGPSPA

SEQ ID NO: 1123511 - protein, 9 aa, Homo Sapiens
KHITKLKPR

SEQ ID NO: 1123512 - protein, 9 aa, Homo Sapiens
TTKSWSCCG

SEQ ID NO: 1123513 - protein, 9 aa, Homo Sapiens
TSQLPTSFI

SEQ ID NO: 1123514 - protein, 9 aa, Homo Sapiens
PRAPPQTRT

SEQ ID NO: 1123515 - protein, 9 aa, Homo Sapiens
WNTLLCPVG

SEQ ID NO: 1123516 - protein, 9 aa, Homo Sapiens
LRDAINTSC

SEQ ID NO: 1123517 - protein, 9 aa, Homo Sapiens
SQQKPSPVL

SEQ ID NO: 1123518 - protein, 9 aa, Homo Sapiens
ALATQCSSP

SEQ ID NO: 1123519 - protein, 9 aa, Homo Sapiens
SCRSHGYGS

SEQ ID NO: 1123520 - protein, 9 aa, Homo Sapiens
ERERVRARV

SEQ ID NO: 1123521 - protein, 9 aa, Homo Sapiens
RPQTGSSSL

SEQ ID NO: 1123522 - protein, 9 aa, Homo Sapiens
PPAEGGLHV

SEQ ID NO: 1123523 - protein, 9 aa, Homo Sapiens
HKRLVRLYA

SEQ ID NO: 1123524 - protein, 9 aa, Homo Sapiens
RPPGAPPSQ

SEQ ID NO: 1123525 - protein, 9 aa, Homo Sapiens
GTLSWAARS

SEQ ID NO: 1123526 - protein, 9 aa, Homo Sapiens
EPPPPLPPW

SEQ ID NO: 1123527 - protein, 9 aa, Homo Sapiens
KEDGKANTK

SEQ ID NO: 1123528 - protein, 9 aa, Homo Sapiens
RSAFAPCCA

SEQ ID NO: 1123529 - protein, 9 aa, Homo Sapiens
RFTSHGSPF

SEQ ID NO: 1123530 - protein, 9 aa, Homo Sapiens
QCIFCILCL

SEQ ID NO: 1123531 - protein, 9 aa, Homo Sapiens
TVRSGTPSV

SEQ ID NO: 1123532 - protein, 9 aa, Homo Sapiens
SSSPLWLPL

SEQ ID NO: 1123533 - protein, 9 aa, Homo Sapiens
SVEVPGNHC

SEQ ID NO: 1123534 - protein, 9 aa, Homo Sapiens
GSDGRSVRL

SEQ ID NO: 1123535 - protein, 9 aa, Homo Sapiens
LDSTLASMF

SEQ ID NO: 1123536 - protein, 9 aa, Homo Sapiens
TRVNPFSLW

SEQ ID NO: 1123537 - protein, 9 aa, Homo Sapiens
HRDVTGYLR

SEQ ID NO: 1123538 - protein, 9 aa, Homo Sapiens
GDPQYQYMP

SEQ ID NO: 1123539 - protein, 9 aa, Homo Sapiens
QCVSLSFSV

SEQ ID NO: 1123540 - protein, 9 aa, Homo Sapiens
IIDSSLSFQ

SEQ ID NO: 1123541 - protein, 9 aa, Homo Sapiens
TILKKYMLS

SEQ ID NO: 1123542 - protein, 9 aa, Homo Sapiens
QYYVAQQAG

SEQ ID NO: 1123543 - protein, 9 aa, Homo Sapiens
LVVKFVDTD

SEQ ID NO: 1123544 - protein, 9 aa, Homo Sapiens
GCLYADLNR

SEQ ID NO: 1123545 - protein, 9 aa, Homo Sapiens
SPTWCRTGA

SEQ ID NO: 1123546 - protein, 9 aa, Homo Sapiens
AERNKKQLP

SEQ ID NO: 1123547 - protein, 9 aa, Homo Sapiens
IDLFDFQSD

SEQ ID NO: 1123548 - protein, 9 aa, Homo Sapiens
PLPQCPSPW

SEQ ID NO: 1123549 - protein, 9 aa, Homo Sapiens
QKRREGVKS

SEQ ID NO: 1123550 - protein, 9 aa, Homo Sapiens
AEGLKMEKE

SEQ ID NO: 1123551 - protein, 9 aa, Homo Sapiens
EEKSSLGVE

SEQ ID NO: 1123552 - protein, 9 aa, Homo Sapiens
SSMETRAHC

SEQ ID NO: 1123553 - protein, 9 aa, Homo Sapiens
KYQIYQDDT

SEQ ID NO: 1123554 - protein, 9 aa, Homo Sapiens
ALRLRLEKK

SEQ ID NO: 1123555 - protein, 9 aa, Homo Sapiens
KEEATKKLK

SEQ ID NO: 1123556 - protein, 9 aa, Homo Sapiens
PQEENLTRK

SEQ ID NO: 1123557 - protein, 9 aa, Homo Sapiens
KGSHPDAIL

SEQ ID NO: 1123558 - protein, 9 aa, Homo Sapiens
LSGTPRPSA

SEQ ID NO: 1123559 - protein, 9 aa, Homo Sapiens
ASLRSPITS

SEQ ID NO: 1123560 - protein, 9 aa, Homo Sapiens
VDRIKEAVW

SEQ ID NO: 1123561 - protein, 9 aa, Homo Sapiens
ADSSDAGSS

SEQ ID NO: 1123562 - protein, 9 aa, Homo Sapiens
KECEDSQLA

SEQ ID NO: 1123563 - protein, 9 aa, Homo Sapiens
ETYPDWFFF

SEQ ID NO: 1123564 - protein, 9 aa, Homo Sapiens
DDAEGLLME

SEQ ID NO: 1123565 - protein, 9 aa, Homo Sapiens
KKDAPHSEG

SEQ ID NO: 1123566 - protein, 9 aa, Homo Sapiens
MEQAQTYVM

SEQ ID NO: 1123567 - protein, 9 aa, Homo Sapiens
PEWSSGCYW

SEQ ID NO: 1123568 - protein, 9 aa, Homo Sapiens
AEERFFERV

SEQ ID NO: 1123569 - protein, 9 aa, Homo Sapiens
VFKVLKSLY

SEQ ID NO: 1123570 - protein, 9 aa, Homo Sapiens
ATLILVIGA

SEQ ID NO: 1123571 - protein, 9 aa, Homo Sapiens
CLHEQYPLA

SEQ ID NO: 1123572 - protein, 9 aa, Homo Sapiens
LQAILKDST

SEQ ID NO: 1123573 - protein, 9 aa, Homo Sapiens
QPAYRDSIR

SEQ ID NO: 1123574 - protein, 9 aa, Homo Sapiens
RTRRPWTAA

SEQ ID NO: 1123575 - protein, 9 aa, Homo Sapiens
MSILGKRLK

SEQ ID NO: 1123576 - protein, 9 aa, Homo Sapiens
FCWFYVYHS

SEQ ID NO: 1123577 - protein, 9 aa, Homo Sapiens
MWWQILLFL

SEQ ID NO: 1123578 - protein, 9 aa, Homo Sapiens
RRRAWLTAL

SEQ ID NO: 1123579 - protein, 9 aa, Homo Sapiens
AHAGAMLEG

SEQ ID NO: 1123580 - protein, 9 aa, Homo Sapiens
ESAHPVKFL

SEQ ID NO: 1123581 - protein, 9 aa, Homo Sapiens
TVLLQSALD

SEQ ID NO: 1123582 - protein, 9 aa, Homo Sapiens
MAVNMLTHQ

SEQ ID NO: 1123583 - protein, 9 aa, Homo Sapiens
AQLGGGQGG

SEQ ID NO: 1123584 - protein, 9 aa, Homo Sapiens
EDFIWVGQL

SEQ ID NO: 1123585 - protein, 9 aa, Homo Sapiens
GRRDRGVSG

SEQ ID NO: 1123586 - protein, 9 aa, Homo Sapiens
LFSLTHVMG

SEQ ID NO: 1123587 - protein, 9 aa, Homo Sapiens
ANGSSAWRP

SEQ ID NO: 1123588 - protein, 9 aa, Homo Sapiens
GSSPGPPTS

SEQ ID NO: 1123589 - protein, 9 aa, Homo Sapiens
DNMVKVQDE

SEQ ID NO: 1123590 - protein, 9 aa, Homo Sapiens
SNIQVTVTA

SEQ ID NO: 1123591 - protein, 9 aa, Homo Sapiens
AWAPQTKGK

SEQ ID NO: 1123592 - protein, 9 aa, Homo Sapiens
PPLSSSLRM

SEQ ID NO: 1123593 - protein, 9 aa, Homo Sapiens
GWYGKAKSI

SEQ ID NO: 1123594 - protein, 9 aa, Homo Sapiens
KWVLIGSLL

SEQ ID NO: 1123595 - protein, 9 aa, Homo Sapiens
PMWTHGWPM

SEQ ID NO: 1123596 - protein, 9 aa, Homo Sapiens
QLVGIGPRA

SEQ ID NO: 1123597 - protein, 9 aa, Homo Sapiens
SEGAYIPPQ

SEQ ID NO: 1123598 - protein, 9 aa, Homo Sapiens
QRNVAVLRE

SEQ ID NO: 1123599 - protein, 9 aa, Homo Sapiens
SYLHSNTGQ

SEQ ID NO: 1123600 - protein, 9 aa, Homo Sapiens
YKEPLKKRI

SEQ ID NO: 1123601 - protein, 9 aa, Homo Sapiens
GGTLDTERE

SEQ ID NO: 1123602 - protein, 9 aa, Homo Sapiens
KEDLLYLRT

SEQ ID NO: 1123603 - protein, 9 aa, Homo Sapiens
RACRTSLAS

SEQ ID NO: 1123604 - protein, 9 aa, Homo Sapiens
IGILTLFSL

SEQ ID NO: 1123605 - protein, 9 aa, Homo Sapiens
PLRSLPCPL

SEQ ID NO: 1123606 - protein, 9 aa, Homo Sapiens
ACQASGGCP

SEQ ID NO: 1123607 - protein, 9 aa, Homo Sapiens
VARLTWRRP

SEQ ID NO: 1123608 - protein, 9 aa, Homo Sapiens
AVLVVAAAV

SEQ ID NO: 1123609 - protein, 9 aa, Homo Sapiens
MHFCWLMAV

SEQ ID NO: 1123610 - protein, 9 aa, Homo Sapiens
LELGCACFK

SEQ ID NO: 1123611 - protein, 9 aa, Homo Sapiens
LPTQQLAWP

SEQ ID NO: 1123612 - protein, 9 aa, Homo Sapiens
EPLTDADHG

SEQ ID NO: 1123613 - protein, 9 aa, Homo Sapiens
LVTSGTSFF

SEQ ID NO: 1123614 - protein, 9 aa, Homo Sapiens
MAGDWKITF

SEQ ID NO: 1123615 - protein, 9 aa, Homo Sapiens
NQIVDRVSY

SEQ ID NO: 1123616 - protein, 9 aa, Homo Sapiens
LPMGSLSPT

SEQ ID NO: 1123617 - protein, 9 aa, Homo Sapiens
TKRKLRKED

SEQ ID NO: 1123618 - protein, 9 aa, Homo Sapiens
ANTFGSYIC

SEQ ID NO: 1123619 - protein, 9 aa, Homo Sapiens
TGDITPLPV

SEQ ID NO: 1123620 - protein, 9 aa, Homo Sapiens
LMPNLSLAQ

SEQ ID NO: 1123621 - protein, 9 aa, Homo Sapiens
LFRHILNFL

SEQ ID NO: 1123622 - protein, 9 aa, Homo Sapiens
SQWWHVGAD

SEQ ID NO: 1123623 - protein, 9 aa, Homo Sapiens
TGTTRQQRS

SEQ ID NO: 1123624 - protein, 9 aa, Homo Sapiens
ASTLESSSH

SEQ ID NO: 1123625 - protein, 9 aa, Homo Sapiens
NAGELPGQV

SEQ ID NO: 1123626 - protein, 9 aa, Homo Sapiens
EGGGVCGPR

SEQ ID NO: 1123627 - protein, 9 aa, Homo Sapiens
RSDHVSLVD

SEQ ID NO: 1123628 - protein, 9 aa, Homo Sapiens
RRRQSSAPG

SEQ ID NO: 1123629 - protein, 9 aa, Homo Sapiens
ALRAKLDGA

SEQ ID NO: 1123630 - protein, 9 aa, Homo Sapiens
HSGVLDNSE

SEQ ID NO: 1123631 - protein, 9 aa, Homo Sapiens
EVHFKKDHS

SEQ ID NO: 1123632 - protein, 9 aa, Homo Sapiens
WRGPSWRVR

SEQ ID NO: 1123633 - protein, 9 aa, Homo Sapiens
GTVFFGTYF

SEQ ID NO: 1123634 - protein, 9 aa, Homo Sapiens
EMPLLTSTI

SEQ ID NO: 1123635 - protein, 9 aa, Homo Sapiens
QISANITTF

SEQ ID NO: 1123636 - protein, 9 aa, Homo Sapiens
SQVLWCARL

SEQ ID NO: 1123637 - protein, 9 aa, Homo Sapiens
TRRCPSPSR

SEQ ID NO: 1123638 - protein, 9 aa, Homo Sapiens
GRGRWQGPQ

SEQ ID NO: 1123639 - protein, 9 aa, Homo Sapiens
PRTLLQTRQ

SEQ ID NO: 1123640 - protein, 9 aa, Homo Sapiens
MEKLGAPRP

SEQ ID NO: 1123641 - protein, 9 aa, Homo Sapiens
TMGETSCSE

SEQ ID NO: 1123642 - protein, 9 aa, Homo Sapiens
RLLSLYRPP

SEQ ID NO: 1123643 - protein, 9 aa, Homo Sapiens
FLCLWMALC

SEQ ID NO: 1123644 - protein, 9 aa, Homo Sapiens
RRSPALRAR

SEQ ID NO: 1123645 - protein, 9 aa, Homo Sapiens
VQAMALLLY

SEQ ID NO: 1123646 - protein, 9 aa, Homo Sapiens
GCACFKLGG

SEQ ID NO: 1123647 - protein, 9 aa, Homo Sapiens
LLPDDRSLI

SEQ ID NO: 1123648 - protein, 9 aa, Homo Sapiens
SCWPVLLPG

SEQ ID NO: 1123649 - protein, 9 aa, Homo Sapiens
PKIGLQPLQ

SEQ ID NO: 1123650 - protein, 9 aa, Homo Sapiens
PVEGRVARG

SEQ ID NO: 1123651 - protein, 9 aa, Homo Sapiens
NILYCEIGV

SEQ ID NO: 1123652 - protein, 9 aa, Homo Sapiens
PDSPSEEPF

SEQ ID NO: 1123653 - protein, 9 aa, Homo Sapiens
HPAVGGGGQ

SEQ ID NO: 1123654 - protein, 9 aa, Homo Sapiens
EWRSLARDE

SEQ ID NO: 1123655 - protein, 9 aa, Homo Sapiens
DGKVISSYV

SEQ ID NO: 1123656 - protein, 9 aa, Homo Sapiens
SALIEGKNK

SEQ ID NO: 1123657 - protein, 9 aa, Homo Sapiens
TWVKKLQRQ

SEQ ID NO: 1123658 - protein, 9 aa, Homo Sapiens
GTFKLDKRL

SEQ ID NO: 1123659 - protein, 9 aa, Homo Sapiens
TMRVREVEA

SEQ ID NO: 1123660 - protein, 9 aa, Homo Sapiens
AGHFKTWEE

SEQ ID NO: 1123661 - protein, 9 aa, Homo Sapiens
GLKMEKESS

SEQ ID NO: 1123662 - protein, 9 aa, Homo Sapiens
KGIAGSVVQ

SEQ ID NO: 1123663 - protein, 9 aa, Homo Sapiens
PIGPSCVPT

SEQ ID NO: 1123664 - protein, 9 aa, Homo Sapiens
CWPSVVTCV

SEQ ID NO: 1123665 - protein, 9 aa, Homo Sapiens
RSLAAWDAP

SEQ ID NO: 1123666 - protein, 9 aa, Homo Sapiens
FTKDDGILS

SEQ ID NO: 1123667 - protein, 9 aa, Homo Sapiens
NVFSPQASQ

SEQ ID NO: 1123668 - protein, 9 aa, Homo Sapiens
DSNINGHVY

SEQ ID NO: 1123669 - protein, 9 aa, Homo Sapiens
HKTSVEEMF

SEQ ID NO: 1123670 - protein, 9 aa, Homo Sapiens
PPNTMAEKF

SEQ ID NO: 1123671 - protein, 9 aa, Homo Sapiens
NETPKKKRS

SEQ ID NO: 1123672 - protein, 9 aa, Homo Sapiens
PPPPPTKKR

SEQ ID NO: 1123673 - protein, 9 aa, Homo Sapiens
PRKPCSACL

SEQ ID NO: 1123674 - protein, 9 aa, Homo Sapiens
TKLWCMLKP

SEQ ID NO: 1123675 - protein, 9 aa, Homo Sapiens
HWSSRYEYL

SEQ ID NO: 1123676 - protein, 9 aa, Homo Sapiens
EFTTTEGTT

SEQ ID NO: 1123677 - protein, 9 aa, Homo Sapiens
LTAPRVKLM

SEQ ID NO: 1123678 - protein, 9 aa, Homo Sapiens
LQADSRLHI

SEQ ID NO: 1123679 - protein, 9 aa, Homo Sapiens
QDGDEAVGG

SEQ ID NO: 1123680 - protein, 9 aa, Homo Sapiens
PHRSLQAAD

SEQ ID NO: 1123681 - protein, 9 aa, Homo Sapiens
EPVQAVASP

SEQ ID NO: 1123682 - protein, 9 aa, Homo Sapiens
PCFQDVHAM

SEQ ID NO: 1123683 - protein, 9 aa, Homo Sapiens
MIGQKTFYS

SEQ ID NO: 1123684 - protein, 9 aa, Homo Sapiens
GNEETKESM

SEQ ID NO: 1123685 - protein, 9 aa, Homo Sapiens
FSINFNEDN

SEQ ID NO: 1123686 - protein, 9 aa, Homo Sapiens
IGDWKVMSG

SEQ ID NO: 1123687 - protein, 9 aa, Homo Sapiens
AGPPTAASG

SEQ ID NO: 1123688 - protein, 9 aa, Homo Sapiens
LDVGGNCHR

SEQ ID NO: 1123689 - protein, 9 aa, Homo Sapiens
PLQRKGPLP

SEQ ID NO: 1123690 - protein, 9 aa, Homo Sapiens
LEYAAVNCL

SEQ ID NO: 1123691 - protein, 9 aa, Homo Sapiens
VDTLIMMYR

SEQ ID NO: 1123692 - protein, 9 aa, Homo Sapiens
SGCKHDLLM

SEQ ID NO: 1123693 - protein, 9 aa, Homo Sapiens
LLPTDVIVF

SEQ ID NO: 1123694 - protein, 9 aa, Homo Sapiens
VITSPLHAL

SEQ ID NO: 1123695 - protein, 9 aa, Homo Sapiens
DLQHALAQA

SEQ ID NO: 1123696 - protein, 9 aa, Homo Sapiens
SATTPPTPH

SEQ ID NO: 1123697 - protein, 9 aa, Homo Sapiens
APGSRDSPA

SEQ ID NO: 1123698 - protein, 9 aa, Homo Sapiens
ILTSQRPIS

SEQ ID NO: 1123699 - protein, 9 aa, Homo Sapiens
KMVAVALQP

SEQ ID NO: 1123700 - protein, 9 aa, Homo Sapiens
KELWQKYNV

SEQ ID NO: 1123701 - protein, 9 aa, Homo Sapiens
LILVISMDN

SEQ ID NO: 1123702 - protein, 9 aa, Homo Sapiens
PFIRTVKSV

SEQ ID NO: 1123703 - protein, 9 aa, Homo Sapiens
PAAPSPGRN

SEQ ID NO: 1123704 - protein, 9 aa, Homo Sapiens
TACSPPRLC

SEQ ID NO: 1123705 - protein, 9 aa, Homo Sapiens
TRRRVPHPT

SEQ ID NO: 1123706 - protein, 9 aa, Homo Sapiens
FGGIGSSRR

SEQ ID NO: 1123707 - protein, 9 aa, Homo Sapiens
EWQRQASDL

SEQ ID NO: 1123708 - protein, 9 aa, Homo Sapiens
QSLYIEEIH

SEQ ID NO: 1123709 - protein, 9 aa, Homo Sapiens
KPMCSTCGK

SEQ ID NO: 1123710 - protein, 9 aa, Homo Sapiens
LFGDVSSDV

SEQ ID NO: 1123711 - protein, 9 aa, Homo Sapiens
WGADAAEAA

SEQ ID NO: 1123712 - protein, 9 aa, Homo Sapiens
EDQAQDIQQ

SEQ ID NO: 1123713 - protein, 9 aa, Homo Sapiens
TIHIDEELR

SEQ ID NO: 1123714 - protein, 9 aa, Homo Sapiens
PACNCVFRD

SEQ ID NO: 1123715 - protein, 9 aa, Homo Sapiens
VRIYVANGD

SEQ ID NO: 1123716 - protein, 9 aa, Homo Sapiens
ALANAQNPS

SEQ ID NO: 1123717 - protein, 9 aa, Homo Sapiens
RITTREAGI

SEQ ID NO: 1123718 - protein, 9 aa, Homo Sapiens
MSSCGILTN

SEQ ID NO: 1123719 - protein, 9 aa, Homo Sapiens
MWWRRQHLP

SEQ ID NO: 1123720 - protein, 9 aa, Homo Sapiens
NQCHNSIQG

SEQ ID NO: 1123721 - protein, 9 aa, Homo Sapiens
PDVAALSVG

SEQ ID NO: 1123722 - protein, 9 aa, Homo Sapiens
FYSLQPPTD

SEQ ID NO: 1123723 - protein, 9 aa, Homo Sapiens
RASMEFLQQ

SEQ ID NO: 1123724 - protein, 9 aa, Homo Sapiens
RLRERRQQH

SEQ ID NO: 1123725 - protein, 9 aa, Homo Sapiens
SSAAPMAEE

SEQ ID NO: 1123726 - protein, 9 aa, Homo Sapiens
KKGAGAAGA

SEQ ID NO: 1123727 - protein, 9 aa, Homo Sapiens
HIGSTHNRS

SEQ ID NO: 1123728 - protein, 9 aa, Homo Sapiens
QPTGAHRPS

SEQ ID NO: 1123729 - protein, 9 aa, Homo Sapiens
GPTVDDDYS

SEQ ID NO: 1123730 - protein, 9 aa, Homo Sapiens
YTLSYCALI

SEQ ID NO: 1123731 - protein, 9 aa, Homo Sapiens
MAVPPQPVT

SEQ ID NO: 1123732 - protein, 9 aa, Homo Sapiens
LWCARLTSS

SEQ ID NO: 1123733 - protein, 9 aa, Homo Sapiens
LLVFICVVM

SEQ ID NO: 1123734 - protein, 9 aa, Homo Sapiens
MVWPPYSYS

SEQ ID NO: 1123735 - protein, 9 aa, Homo Sapiens
KPVGKKRHP

SEQ ID NO: 1123736 - protein, 9 aa, Homo Sapiens
SAKPVTPPA

SEQ ID NO: 1123737 - protein, 9 aa, Homo Sapiens
AAFEKGDDV

SEQ ID NO: 1123738 - protein, 9 aa, Homo Sapiens
IEGVQGIPL

SEQ ID NO: 1123739 - protein, 9 aa, Homo Sapiens
GAARDAPGL

SEQ ID NO: 1123740 - protein, 9 aa, Homo Sapiens
GPTNVLLIV

SEQ ID NO: 1123741 - protein, 9 aa, Homo Sapiens
ITSQLGATF

SEQ ID NO: 1123742 - protein, 9 aa, Homo Sapiens
KCKCLCTGR

SEQ ID NO: 1123743 - protein, 9 aa, Homo Sapiens
CHSCQQPIG

SEQ ID NO: 1123744 - protein, 9 aa, Homo Sapiens
KPVTPPAWL

SEQ ID NO: 1123745 - protein, 9 aa, Homo Sapiens
YIRCINPND

SEQ ID NO: 1123746 - protein, 9 aa, Homo Sapiens
YFRNKLFVK

SEQ ID NO: 1123747 - protein, 9 aa, Homo Sapiens
EVVSPLQSA

SEQ ID NO: 1123748 - protein, 9 aa, Homo Sapiens
SRRRSVRPS

SEQ ID NO: 1123749 - protein, 9 aa, Homo Sapiens
ISNARVFKE

SEQ ID NO: 1123750 - protein, 9 aa, Homo Sapiens
NVSSEGISL

SEQ ID NO: 1123751 - protein, 9 aa, Homo Sapiens
SAPPHAEVT

SEQ ID NO: 1123752 - protein, 9 aa, Homo Sapiens
KRGKSQGGR

SEQ ID NO: 1123753 - protein, 9 aa, Homo Sapiens
PASLLTRPR

SEQ ID NO: 1123754 - protein, 9 aa, Homo Sapiens
LKATLIPGL

SEQ ID NO: 1123755 - protein, 9 aa, Homo Sapiens
VVYDQSMRD

SEQ ID NO: 1123756 - protein, 9 aa, Homo Sapiens
LTPPAVPPV

SEQ ID NO: 1123757 - protein, 9 aa, Homo Sapiens
ISSPDEAAE

SEQ ID NO: 1123758 - protein, 9 aa, Homo Sapiens
HGLRGLTLG

SEQ ID NO: 1123759 - protein, 9 aa, Homo Sapiens
TELRPQHSE

SEQ ID NO: 1123760 - protein, 9 aa, Homo Sapiens
VAAQDPVIC

SEQ ID NO: 1123761 - protein, 9 aa, Homo Sapiens
PTSSSIDLQ

SEQ ID NO: 1123762 - protein, 9 aa, Homo Sapiens
YGRSVSSSS

SEQ ID NO: 1123763 - protein, 9 aa, Homo Sapiens
RNIGVTAVT

SEQ ID NO: 1123764 - protein, 9 aa, Homo Sapiens
KKWRHRTIF

SEQ ID NO: 1123765 - protein, 9 aa, Homo Sapiens
QVQALRNHY

SEQ ID NO: 1123766 - protein, 9 aa, Homo Sapiens
EREKYVQED

SEQ ID NO: 1123767 - protein, 9 aa, Homo Sapiens
QGCGCGRAP

SEQ ID NO: 1123768 - protein, 9 aa, Homo Sapiens
GALVQTKGT

SEQ ID NO: 1123769 - protein, 9 aa, Homo Sapiens
TASYYSPYD

SEQ ID NO: 1123770 - protein, 9 aa, Homo Sapiens
GEATFGRAL

SEQ ID NO: 1123771 - protein, 9 aa, Homo Sapiens
AICTGPNDT

SEQ ID NO: 1123772 - protein, 9 aa, Homo Sapiens
PRDHLGLIL

SEQ ID NO: 1123773 - protein, 9 aa, Homo Sapiens
THARVLGSP

SEQ ID NO: 1123774 - protein, 9 aa, Homo Sapiens
DLTPQLEED

SEQ ID NO: 1123775 - protein, 9 aa, Homo Sapiens
RPWPPSFSA

SEQ ID NO: 1123776 - protein, 9 aa, Homo Sapiens
LAPLIQKKQ

SEQ ID NO: 1123777 - protein, 9 aa, Homo Sapiens
PSWRVRKIG

SEQ ID NO: 1123778 - protein, 9 aa, Homo Sapiens
GRWTSFGYV

SEQ ID NO: 1123779 - protein, 9 aa, Homo Sapiens
LAETCTDLL

SEQ ID NO: 1123780 - protein, 9 aa, Homo Sapiens
QLLMKGSRQ

SEQ ID NO: 1123781 - protein, 9 aa, Homo Sapiens
EPAAARGAS

SEQ ID NO: 1123782 - protein, 9 aa, Homo Sapiens
VLWEDQIPR

SEQ ID NO: 1123783 - protein, 9 aa, Homo Sapiens
KQSWGAVAG

SEQ ID NO: 1123784 - protein, 9 aa, Homo Sapiens
QCHNSIQGK

SEQ ID NO: 1123785 - protein, 9 aa, Homo Sapiens
SGPSFAYGL

SEQ ID NO: 1123786 - protein, 9 aa, Homo Sapiens
RTSLASSSS

SEQ ID NO: 1123787 - protein, 9 aa, Homo Sapiens
YDRANTVFS

SEQ ID NO: 1123788 - protein, 9 aa, Homo Sapiens
TYKDSFISN

SEQ ID NO: 1123789 - protein, 9 aa, Homo Sapiens
ASIGKNGRT

SEQ ID NO: 1123790 - protein, 9 aa, Homo Sapiens
FQFVKGFGG

SEQ ID NO: 1123791 - protein, 9 aa, Homo Sapiens
TRSRRTRGR

SEQ ID NO: 1123792 - protein, 9 aa, Homo Sapiens
NNEGGKRSR

SEQ ID NO: 1123793 - protein, 9 aa, Homo Sapiens
FVGSMWRQR

SEQ ID NO: 1123794 - protein, 9 aa, Homo Sapiens
NVSWTGNLR

SEQ ID NO: 1123795 - protein, 9 aa, Homo Sapiens
ELTRYFRKH

SEQ ID NO: 1123796 - protein, 9 aa, Homo Sapiens
LVDFFIQDA

SEQ ID NO: 1123797 - protein, 9 aa, Homo Sapiens
DTAQIVADI

SEQ ID NO: 1123798 - protein, 9 aa, Homo Sapiens
FITQLPDIQ

SEQ ID NO: 1123799 - protein, 9 aa, Homo Sapiens
ATLIPGLWR

SEQ ID NO: 1123800 - protein, 9 aa, Homo Sapiens
YPATVLADN

SEQ ID NO: 1123801 - protein, 9 aa, Homo Sapiens
MAKPKNRTV

SEQ ID NO: 1123802 - protein, 9 aa, Homo Sapiens
GHHTYGALL

SEQ ID NO: 1123803 - protein, 9 aa, Homo Sapiens
PRGSYAEVK

SEQ ID NO: 1123804 - protein, 9 aa, Homo Sapiens
KEQDANKGE

SEQ ID NO: 1123805 - protein, 9 aa, Homo Sapiens
RGDHDLNGL

SEQ ID NO: 1123806 - protein, 9 aa, Homo Sapiens
RLGNDGSMD

SEQ ID NO: 1123807 - protein, 9 aa, Homo Sapiens
PVLGPQPHF

SEQ ID NO: 1123808 - protein, 9 aa, Homo Sapiens
ASSWKGSSR

SEQ ID NO: 1123809 - protein, 9 aa, Homo Sapiens
EHLRELCLR

SEQ ID NO: 1123810 - protein, 9 aa, Homo Sapiens
RAGRMGGRH

SEQ ID NO: 1123811 - protein, 9 aa, Homo Sapiens
HVQRLWFQS

SEQ ID NO: 1123812 - protein, 9 aa, Homo Sapiens
YEGQYILTL

SEQ ID NO: 1123813 - protein, 9 aa, Homo Sapiens
KMATQACSH

SEQ ID NO: 1123814 - protein, 9 aa, Homo Sapiens
QSIIHGGAI

SEQ ID NO: 1123815 - protein, 9 aa, Homo Sapiens
GIRWTLTRM

SEQ ID NO: 1123816 - protein, 9 aa, Homo Sapiens
TGCRHIDGA

SEQ ID NO: 1123817 - protein, 9 aa, Homo Sapiens
RLWVEPRLE

SEQ ID NO: 1123818 - protein, 9 aa, Homo Sapiens
LPQKFWGLT

SEQ ID NO: 1123819 - protein, 9 aa, Homo Sapiens
VGTGSNTCY

SEQ ID NO: 1123820 - protein, 9 aa, Homo Sapiens
DHQPKVAQC

SEQ ID NO: 1123821 - protein, 9 aa, Homo Sapiens
ADASPAPLV

SEQ ID NO: 1123822 - protein, 9 aa, Homo Sapiens
PLNEQWEEE

SEQ ID NO: 1123823 - protein, 9 aa, Homo Sapiens
DRSPELEIL

SEQ ID NO: 1123824 - protein, 9 aa, Homo Sapiens
GTTGQLTQE

SEQ ID NO: 1123825 - protein, 9 aa, Homo Sapiens
RASPRTCGA

SEQ ID NO: 1123826 - protein, 9 aa, Homo Sapiens
IRRERAGQT

SEQ ID NO: 1123827 - protein, 9 aa, Homo Sapiens
DFKMCVSLA

SEQ ID NO: 1123828 - protein, 9 aa, Homo Sapiens
WIITISLLV

SEQ ID NO: 1123829 - protein, 9 aa, Homo Sapiens
SKASKEFTR

SEQ ID NO: 1123830 - protein, 9 aa, Homo Sapiens
TSWRTLLRT

SEQ ID NO: 1123831 - protein, 9 aa, Homo Sapiens
VATPALPTQ

SEQ ID NO: 1123832 - protein, 9 aa, Homo Sapiens
EWIPLARKW

SEQ ID NO: 1123833 - protein, 9 aa, Homo Sapiens
AWRPPRYLL

SEQ ID NO: 1123834 - protein, 9 aa, Homo Sapiens
ELNPERCQH

SEQ ID NO: 1123835 - protein, 9 aa, Homo Sapiens
NNVNVVYAP

SEQ ID NO: 1123836 - protein, 9 aa, Homo Sapiens
RGTATPSSG

SEQ ID NO: 1123837 - protein, 9 aa, Homo Sapiens
TAVSPQPRA

SEQ ID NO: 1123838 - protein, 9 aa, Homo Sapiens
FCRACIGRR

SEQ ID NO: 1123839 - protein, 9 aa, Homo Sapiens
QHNMTNSSM

SEQ ID NO: 1123840 - protein, 9 aa, Homo Sapiens
TWTSPSSRP

SEQ ID NO: 1123841 - protein, 9 aa, Homo Sapiens
VDDAAILLQ

SEQ ID NO: 1123842 - protein, 9 aa, Homo Sapiens
GDSGVGLDE

SEQ ID NO: 1123843 - protein, 9 aa, Homo Sapiens
IQILTCQKT

SEQ ID NO: 1123844 - protein, 9 aa, Homo Sapiens
ILLQRNLLR

SEQ ID NO: 1123845 - protein, 9 aa, Homo Sapiens
SKKFIAGFW

SEQ ID NO: 1123846 - protein, 9 aa, Homo Sapiens
RPTSGARLG

SEQ ID NO: 1123847 - protein, 9 aa, Homo Sapiens
ILVIGAFTL

SEQ ID NO: 1123848 - protein, 9 aa, Homo Sapiens
KMWKRRWFI

SEQ ID NO: 1123849 - protein, 9 aa, Homo Sapiens
KQTCSQTAW

SEQ ID NO: 1123850 - protein, 9 aa, Homo Sapiens
TSRTRGTLH

SEQ ID NO: 1123851 - protein, 9 aa, Homo Sapiens
CSKSHPKGT

SEQ ID NO: 1123852 - protein, 9 aa, Homo Sapiens
LSINNYRFQ

SEQ ID NO: 1123853 - protein, 9 aa, Homo Sapiens
LYQRMYSIM

SEQ ID NO: 1123854 - protein, 9 aa, Homo Sapiens
RGAPAPPAR

SEQ ID NO: 1123855 - protein, 9 aa, Homo Sapiens
LYVIRTCVN

SEQ ID NO: 1123856 - protein, 9 aa, Homo Sapiens
TAATRAGLG

SEQ ID NO: 1123857 - protein, 9 aa, Homo Sapiens
TDHGLRGLT

SEQ ID NO: 1123858 - protein, 9 aa, Homo Sapiens
LQAGRETGD

SEQ ID NO: 1123859 - protein, 9 aa, Homo Sapiens
LKNCDLYFP

SEQ ID NO: 1123860 - protein, 9 aa, Homo Sapiens
ITAVKAVGV

SEQ ID NO: 1123861 - protein, 9 aa, Homo Sapiens
RPVDTKAEE

SEQ ID NO: 1123862 - protein, 9 aa, Homo Sapiens
AAPVGGEAL

SEQ ID NO: 1123863 - protein, 9 aa, Homo Sapiens
ASGGCPAED

SEQ ID NO: 1123864 - protein, 9 aa, Homo Sapiens
AAVVVVVVS

SEQ ID NO: 1123865 - protein, 9 aa, Homo Sapiens
GAQKSLELI

SEQ ID NO: 1123866 - protein, 9 aa, Homo Sapiens
RCPGSAGRH

SEQ ID NO: 1123867 - protein, 9 aa, Homo Sapiens
DCSGGFNGG

SEQ ID NO: 1123868 - protein, 9 aa, Homo Sapiens
SRGMAGPLD

SEQ ID NO: 1123869 - protein, 9 aa, Homo Sapiens
TNLVRYIRQ

SEQ ID NO: 1123870 - protein, 9 aa, Homo Sapiens
QEMELRFHE

SEQ ID NO: 1123871 - protein, 9 aa, Homo Sapiens
ELSRCHPIA

SEQ ID NO: 1123872 - protein, 9 aa, Homo Sapiens
QERKYAIGD

SEQ ID NO: 1123873 - protein, 9 aa, Homo Sapiens
QSWWGGDPQ

SEQ ID NO: 1123874 - protein, 9 aa, Homo Sapiens
GFWGWCLGS

SEQ ID NO: 1123875 - protein, 9 aa, Homo Sapiens
SKVTPPEEP

SEQ ID NO: 1123876 - protein, 9 aa, Homo Sapiens
VELVSQEDG

SEQ ID NO: 1123877 - protein, 9 aa, Homo Sapiens
APATLPCRR

SEQ ID NO: 1123878 - protein, 9 aa, Homo Sapiens
NSVLVIQKA

SEQ ID NO: 1123879 - protein, 9 aa, Homo Sapiens
LLVLLHELQ

SEQ ID NO: 1123880 - protein, 9 aa, Homo Sapiens
NLTYSVCHC

SEQ ID NO: 1123881 - protein, 9 aa, Homo Sapiens
SPSWRSECR

SEQ ID NO: 1123882 - protein, 9 aa, Homo Sapiens
QSLYCRSGR

SEQ ID NO: 1123883 - protein, 9 aa, Homo Sapiens
SGPTPVPTA

SEQ ID NO: 1123884 - protein, 9 aa, Homo Sapiens
GMAGDWKIT

SEQ ID NO: 1123885 - protein, 9 aa, Homo Sapiens
PRCSRRLSK

SEQ ID NO: 1123886 - protein, 9 aa, Homo Sapiens
TLLSVLDST

SEQ ID NO: 1123887 - protein, 9 aa, Homo Sapiens
AGKLEVDSL

SEQ ID NO: 1123888 - protein, 9 aa, Homo Sapiens
IPGVTPATI

SEQ ID NO: 1123889 - protein, 9 aa, Homo Sapiens
SNTCYMEEM

SEQ ID NO: 1123890 - protein, 9 aa, Homo Sapiens
EQQLEFLNE

SEQ ID NO: 1123891 - protein, 9 aa, Homo Sapiens
KSPKRSKKS

SEQ ID NO: 1123892 - protein, 9 aa, Homo Sapiens
DDLFKDLGF

SEQ ID NO: 1123893 - protein, 9 aa, Homo Sapiens
CGPWFWIPL

SEQ ID NO: 1123894 - protein, 9 aa, Homo Sapiens
GRRRCGSRR

SEQ ID NO: 1123895 - protein, 9 aa, Homo Sapiens
MGMCGFKGD

SEQ ID NO: 1123896 - protein, 9 aa, Homo Sapiens
RRLCQDTPT

SEQ ID NO: 1123897 - protein, 9 aa, Homo Sapiens
PTAASGRPP

SEQ ID NO: 1123898 - protein, 9 aa, Homo Sapiens
LFSLHVLIE

SEQ ID NO: 1123899 - protein, 9 aa, Homo Sapiens
INLYHLSPH

SEQ ID NO: 1123900 - protein, 9 aa, Homo Sapiens
KLHVNRATC

SEQ ID NO: 1123901 - protein, 9 aa, Homo Sapiens
DTRISVLVP

SEQ ID NO: 1123902 - protein, 9 aa, Homo Sapiens
LSPSEAVQW

SEQ ID NO: 1123903 - protein, 9 aa, Homo Sapiens
VRKAKFCIF

SEQ ID NO: 1123904 - protein, 9 aa, Homo Sapiens
RIRSTRSGG

SEQ ID NO: 1123905 - protein, 9 aa, Homo Sapiens
WVEPRLERL

SEQ ID NO: 1123906 - protein, 9 aa, Homo Sapiens
TSELSLQPM

SEQ ID NO: 1123907 - protein, 9 aa, Homo Sapiens
RSHGVTVAL

SEQ ID NO: 1123908 - protein, 9 aa, Homo Sapiens
EIPCCNCKA

SEQ ID NO: 1123909 - protein, 9 aa, Homo Sapiens
VTSPKSALK

SEQ ID NO: 1123910 - protein, 9 aa, Homo Sapiens
TPAVGGELR

SEQ ID NO: 1123911 - protein, 9 aa, Homo Sapiens
CMKGASTPS

SEQ ID NO: 1123912 - protein, 9 aa, Homo Sapiens
TTKINEKPQ

SEQ ID NO: 1123913 - protein, 9 aa, Homo Sapiens
MSDPIMLNV

SEQ ID NO: 1123914 - protein, 9 aa, Homo Sapiens
HPRLRAAGG

SEQ ID NO: 1123915 - protein, 9 aa, Homo Sapiens
RGCGTSQLA

SEQ ID NO: 1123916 - protein, 9 aa, Homo Sapiens
AAGCCCRCK

SEQ ID NO: 1123917 - protein, 9 aa, Homo Sapiens
YKCSDESKP

SEQ ID NO: 1123918 - protein, 9 aa, Homo Sapiens
TKLEKALSA

SEQ ID NO: 1123919 - protein, 9 aa, Homo Sapiens
CSVTDYHAI

SEQ ID NO: 1123920 - protein, 9 aa, Homo Sapiens
WTLTRMLLQ

SEQ ID NO: 1123921 - protein, 9 aa, Homo Sapiens
WLMTAMWLS

SEQ ID NO: 1123922 - protein, 9 aa, Homo Sapiens
PDVGRHLRE

SEQ ID NO: 1123923 - protein, 9 aa, Homo Sapiens
CHPSSVSGA

SEQ ID NO: 1123924 - protein, 9 aa, Homo Sapiens
FDTFLRHPR

SEQ ID NO: 1123925 - protein, 9 aa, Homo Sapiens
RTQLQKQKL

SEQ ID NO: 1123926 - protein, 9 aa, Homo Sapiens
RGHEEREAA

SEQ ID NO: 1123927 - protein, 9 aa, Homo Sapiens
AVCSGRLLG

SEQ ID NO: 1123928 - protein, 9 aa, Homo Sapiens
GGLPAVLMV

SEQ ID NO: 1123929 - protein, 9 aa, Homo Sapiens
HGLGKDLTQ

SEQ ID NO: 1123930 - protein, 9 aa, Homo Sapiens
VPRSLRLSG

SEQ ID NO: 1123931 - protein, 9 aa, Homo Sapiens
EPFPSTSTL

SEQ ID NO: 1123932 - protein, 9 aa, Homo Sapiens
RWPPRTPLF

SEQ ID NO: 1123933 - protein, 9 aa, Homo Sapiens
IPPDRPPGP

SEQ ID NO: 1123934 - protein, 9 aa, Homo Sapiens
AGCCAMASS

SEQ ID NO: 1123935 - protein, 9 aa, Homo Sapiens
RPGWKRTQQ

SEQ ID NO: 1123936 - protein, 9 aa, Homo Sapiens
SVTLQLGPE

SEQ ID NO: 1123937 - protein, 9 aa, Homo Sapiens
QLRDITIDN

SEQ ID NO: 1123938 - protein, 9 aa, Homo Sapiens
WRALLYPRP

SEQ ID NO: 1123939 - protein, 9 aa, Homo Sapiens
VHVGLGRLL

SEQ ID NO: 1123940 - protein, 9 aa, Homo Sapiens
EWGAGRGRP

SEQ ID NO: 1123941 - protein, 9 aa, Homo Sapiens
YVIDKSAKN

SEQ ID NO: 1123942 - protein, 9 aa, Homo Sapiens
WTEMIITKA

SEQ ID NO: 1123943 - protein, 9 aa, Homo Sapiens
SAIQLRNYK

SEQ ID NO: 1123944 - protein, 9 aa, Homo Sapiens
SGHCPHEGP

SEQ ID NO: 1123945 - protein, 9 aa, Homo Sapiens
PKNLLDSSL

SEQ ID NO: 1123946 - protein, 9 aa, Homo Sapiens
TADILHAGV

SEQ ID NO: 1123947 - protein, 9 aa, Homo Sapiens
LHTGKVRTA

SEQ ID NO: 1123948 - protein, 9 aa, Homo Sapiens
LMECLAPLR

SEQ ID NO: 1123949 - protein, 9 aa, Homo Sapiens
TNLERWVKR

SEQ ID NO: 1123950 - protein, 9 aa, Homo Sapiens
KGGNLVNKP

SEQ ID NO: 1123951 - protein, 9 aa, Homo Sapiens
PYATPLGYG

SEQ ID NO: 1123952 - protein, 9 aa, Homo Sapiens
CVIERRGPD

SEQ ID NO: 1123953 - protein, 9 aa, Homo Sapiens
LHSPTPNTW

SEQ ID NO: 1123954 - protein, 9 aa, Homo Sapiens
VSKILARHN

SEQ ID NO: 1123955 - protein, 9 aa, Homo Sapiens
KDSQIVDIL

SEQ ID NO: 1123956 - protein, 9 aa, Homo Sapiens
LNCTHLGIT

SEQ ID NO: 1123957 - protein, 9 aa, Homo Sapiens
TRESPPNPG

SEQ ID NO: 1123958 - protein, 9 aa, Homo Sapiens
HDDMDQKER

SEQ ID NO: 1123959 - protein, 9 aa, Homo Sapiens
RRRSGRRRC

SEQ ID NO: 1123960 - protein, 9 aa, Homo Sapiens
RLSRTSWRT

SEQ ID NO: 1123961 - protein, 9 aa, Homo Sapiens
PRRRAPGGG

SEQ ID NO: 1123962 - protein, 9 aa, Homo Sapiens
PESYLPIGC

SEQ ID NO: 1123963 - protein, 9 aa, Homo Sapiens
ATGTAAATS

SEQ ID NO: 1123964 - protein, 9 aa, Homo Sapiens
DHFYNHKTS

SEQ ID NO: 1123965 - protein, 9 aa, Homo Sapiens
ELLDMGKTT

SEQ ID NO: 1123966 - protein, 9 aa, Homo Sapiens
PWQFRCIEK

SEQ ID NO: 1123967 - protein, 9 aa, Homo Sapiens
IKHKKELTM

SEQ ID NO: 1123968 - protein, 9 aa, Homo Sapiens
KKKNQNKKH

SEQ ID NO: 1123969 - protein, 9 aa, Homo Sapiens
LEKMQKDQE

SEQ ID NO: 1123970 - protein, 9 aa, Homo Sapiens
ATMRCNLHR

SEQ ID NO: 1123971 - protein, 9 aa, Homo Sapiens
CGIWVLFGS

SEQ ID NO: 1123972 - protein, 9 aa, Homo Sapiens
LQVKIPVAD

SEQ ID NO: 1123973 - protein, 9 aa, Homo Sapiens
IDRDFDPVS

SEQ ID NO: 1123974 - protein, 9 aa, Homo Sapiens
DHLTKHARQ

SEQ ID NO: 1123975 - protein, 9 aa, Homo Sapiens
HYLKQSFTT

SEQ ID NO: 1123976 - protein, 9 aa, Homo Sapiens
SCSPNVRFL

SEQ ID NO: 1123977 - protein, 9 aa, Homo Sapiens
VAAAVVVVV

SEQ ID NO: 1123978 - protein, 9 aa, Homo Sapiens
GMRGGDAFP

SEQ ID NO: 1123979 - protein, 9 aa, Homo Sapiens
SPVKMSTKN

SEQ ID NO: 1123980 - protein, 9 aa, Homo Sapiens
WPCPQCLRR

SEQ ID NO: 1123981 - protein, 9 aa, Homo Sapiens
KKGESQEGK

SEQ ID NO: 1123982 - protein, 9 aa, Homo Sapiens
VNQVVAVPI

SEQ ID NO: 1123983 - protein, 9 aa, Homo Sapiens
YCEIGVTLK

SEQ ID NO: 1123984 - protein, 9 aa, Homo Sapiens
LFVKVYEVR

SEQ ID NO: 1123985 - protein, 9 aa, Homo Sapiens
EEPPLMDNG

SEQ ID NO: 1123986 - protein, 9 aa, Homo Sapiens
KRRRGSDGV

SEQ ID NO: 1123987 - protein, 9 aa, Homo Sapiens
IGYSISFGS

SEQ ID NO: 1123988 - protein, 9 aa, Homo Sapiens
KEQFQSVEV

SEQ ID NO: 1123989 - protein, 9 aa, Homo Sapiens
GRSISTGCP

SEQ ID NO: 1123990 - protein, 9 aa, Homo Sapiens
VKMWKRRWF

SEQ ID NO: 1123991 - protein, 9 aa, Homo Sapiens
PQPRAFLGL

SEQ ID NO: 1123992 - protein, 9 aa, Homo Sapiens
RLKRCRRRP

SEQ ID NO: 1123993 - protein, 9 aa, Homo Sapiens
PYFIYSYIL

SEQ ID NO: 1123994 - protein, 9 aa, Homo Sapiens
SHTMMLKDG

SEQ ID NO: 1123995 - protein, 9 aa, Homo Sapiens
SRSPPTLMM

SEQ ID NO: 1123996 - protein, 9 aa, Homo Sapiens
QTPDMSFFK

SEQ ID NO: 1123997 - protein, 9 aa, Homo Sapiens
ALPGGRCQS

SEQ ID NO: 1123998 - protein, 9 aa, Homo Sapiens
KRSRCPPRS

SEQ ID NO: 1123999 - protein, 9 aa, Homo Sapiens
GVRGSTWMR

SEQ ID NO: 1124000 - protein, 9 aa, Homo Sapiens
VKIESIMFH

SEQ ID NO: 1124001 - protein, 9 aa, Homo Sapiens
LVQMFIGDC

SEQ ID NO: 1124002 - protein, 9 aa, Homo Sapiens
DLLYLRTSG

SEQ ID NO: 1124003 - protein, 9 aa, Homo Sapiens
KVHKYIVRY

SEQ ID NO: 1124004 - protein, 9 aa, Homo Sapiens
NVHRHALRI

SEQ ID NO: 1124005 - protein, 9 aa, Homo Sapiens
ITSVTLRPW

SEQ ID NO: 1124006 - protein, 9 aa, Homo Sapiens
DEGLANGSA

SEQ ID NO: 1124007 - protein, 9 aa, Homo Sapiens
ERRQQHKNR

SEQ ID NO: 1124008 - protein, 9 aa, Homo Sapiens
WLQVRRLMS

SEQ ID NO: 1124009 - protein, 9 aa, Homo Sapiens
DGEKEHTNA

SEQ ID NO: 1124010 - protein, 9 aa, Homo Sapiens
SERPYKCNE

SEQ ID NO: 1124011 - protein, 9 aa, Homo Sapiens
SFRITTREA

SEQ ID NO: 1124012 - protein, 9 aa, Homo Sapiens
KVSYLHSNT

SEQ ID NO: 1124013 - protein, 9 aa, Homo Sapiens
PRCAMAPET

SEQ ID NO: 1124014 - protein, 9 aa, Homo Sapiens
QEKDRSKEI

SEQ ID NO: 1124015 - protein, 9 aa, Homo Sapiens
AFSMPHDGS

SEQ ID NO: 1124016 - protein, 9 aa, Homo Sapiens
TNTEFRYLD

SEQ ID NO: 1124017 - protein, 9 aa, Homo Sapiens
YPAASAPCW

SEQ ID NO: 1124018 - protein, 9 aa, Homo Sapiens
LWKRQMASK

SEQ ID NO: 1124019 - protein, 9 aa, Homo Sapiens
TGLTNISNM

SEQ ID NO: 1124020 - protein, 9 aa, Homo Sapiens
PPRSSRSRC

SEQ ID NO: 1124021 - protein, 9 aa, Homo Sapiens
KIPVLFSIM

SEQ ID NO: 1124022 - protein, 9 aa, Homo Sapiens
TLLRTNLTP

SEQ ID NO: 1124023 - protein, 9 aa, Homo Sapiens
TALKGRITA

SEQ ID NO: 1124024 - protein, 9 aa, Homo Sapiens
AVLRELDNK

SEQ ID NO: 1124025 - protein, 9 aa, Homo Sapiens
CARAWMRLG

SEQ ID NO: 1124026 - protein, 9 aa, Homo Sapiens
YTIGYSISF

SEQ ID NO: 1124027 - protein, 9 aa, Homo Sapiens
SAASPPAAG

SEQ ID NO: 1124028 - protein, 9 aa, Homo Sapiens
RASPGPQRR

SEQ ID NO: 1124029 - protein, 9 aa, Homo Sapiens
VFVMGLKKP

SEQ ID NO: 1124030 - protein, 9 aa, Homo Sapiens
GILRPPSTR

SEQ ID NO: 1124031 - protein, 9 aa, Homo Sapiens
RQLLCGALR

SEQ ID NO: 1124032 - protein, 9 aa, Homo Sapiens
IPHEVKLSI

SEQ ID NO: 1124033 - protein, 9 aa, Homo Sapiens
RFAELLALD

SEQ ID NO: 1124034 - protein, 9 aa, Homo Sapiens
HSCWTKALM

SEQ ID NO: 1124035 - protein, 9 aa, Homo Sapiens
YDAPSPSAF

SEQ ID NO: 1124036 - protein, 9 aa, Homo Sapiens
GCLVTKVVA

SEQ ID NO: 1124037 - protein, 9 aa, Homo Sapiens
PMDSHRSSQ

SEQ ID NO: 1124038 - protein, 9 aa, Homo Sapiens
QRRQFLAKQ

SEQ ID NO: 1124039 - protein, 9 aa, Homo Sapiens
VLEYAAVNC

SEQ ID NO: 1124040 - protein, 9 aa, Homo Sapiens
EIIDEKTGV

SEQ ID NO: 1124041 - protein, 9 aa, Homo Sapiens
MMSSGFSGS

SEQ ID NO: 1124042 - protein, 9 aa, Homo Sapiens
PPLPDRPWG

SEQ ID NO: 1124043 - protein, 9 aa, Homo Sapiens
TLAVQPHLL

SEQ ID NO: 1124044 - protein, 9 aa, Homo Sapiens
EGVHGPGPC

SEQ ID NO: 1124045 - protein, 9 aa, Homo Sapiens
SGQRSASTK

SEQ ID NO: 1124046 - protein, 9 aa, Homo Sapiens
GALFGRGAA

SEQ ID NO: 1124047 - protein, 9 aa, Homo Sapiens
SLLPPASTS

SEQ ID NO: 1124048 - protein, 9 aa, Homo Sapiens
AEGPAARAK

SEQ ID NO: 1124049 - protein, 9 aa, Homo Sapiens
KWSPSCHAH

SEQ ID NO: 1124050 - protein, 9 aa, Homo Sapiens
HTYVSEDLR

SEQ ID NO: 1124051 - protein, 9 aa, Homo Sapiens
WLSYTISCV

SEQ ID NO: 1124052 - protein, 9 aa, Homo Sapiens
NEQISKERA

SEQ ID NO: 1124053 - protein, 9 aa, Homo Sapiens
DRTPRGSPS

SEQ ID NO: 1124054 - protein, 9 aa, Homo Sapiens
GGWYGKAKS

SEQ ID NO: 1124055 - protein, 9 aa, Homo Sapiens
LSLRRRCLR

SEQ ID NO: 1124056 - protein, 9 aa, Homo Sapiens
GRAVFPGAP

SEQ ID NO: 1124057 - protein, 9 aa, Homo Sapiens
GVMVYSGGR

SEQ ID NO: 1124058 - protein, 9 aa, Homo Sapiens
KAYCHPQGS

SEQ ID NO: 1124059 - protein, 9 aa, Homo Sapiens
FLIAVMFGD

SEQ ID NO: 1124060 - protein, 9 aa, Homo Sapiens
NLCKLERLD

SEQ ID NO: 1124061 - protein, 9 aa, Homo Sapiens
VAVALQPPA

SEQ ID NO: 1124062 - protein, 9 aa, Homo Sapiens
EKARETLQA

SEQ ID NO: 1124063 - protein, 9 aa, Homo Sapiens
PCEVQVLCH

SEQ ID NO: 1124064 - protein, 9 aa, Homo Sapiens
TGSDGRSVR

SEQ ID NO: 1124065 - protein, 9 aa, Homo Sapiens
GINVADKKL

SEQ ID NO: 1124066 - protein, 9 aa, Homo Sapiens
NLQLAKRVD

SEQ ID NO: 1124067 - protein, 9 aa, Homo Sapiens
PRDSRLSWL

SEQ ID NO: 1124068 - protein, 9 aa, Homo Sapiens
MLYNNREHI

SEQ ID NO: 1124069 - protein, 9 aa, Homo Sapiens
LNELTMDDV

SEQ ID NO: 1124070 - protein, 9 aa, Homo Sapiens
MALPFSLAE

SEQ ID NO: 1124071 - protein, 9 aa, Homo Sapiens
QLCSHHVTH

SEQ ID NO: 1124072 - protein, 9 aa, Homo Sapiens
LHVQAAQFA

SEQ ID NO: 1124073 - protein, 9 aa, Homo Sapiens
HPSKKCKPR

SEQ ID NO: 1124074 - protein, 9 aa, Homo Sapiens
RDRAGVQPP

SEQ ID NO: 1124075 - protein, 9 aa, Homo Sapiens
GGADPPNPA

SEQ ID NO: 1124076 - protein, 9 aa, Homo Sapiens
FCAAGCHPA

SEQ ID NO: 1124077 - protein, 9 aa, Homo Sapiens
PEEGDVCIT

SEQ ID NO: 1124078 - protein, 9 aa, Homo Sapiens
TAIILVILR

SEQ ID NO: 1124079 - protein, 9 aa, Homo Sapiens
LSLYSVAVW

SEQ ID NO: 1124080 - protein, 9 aa, Homo Sapiens
GENLNISCH

SEQ ID NO: 1124081 - protein, 9 aa, Homo Sapiens
EDAGYCRCV

SEQ ID NO: 1124082 - protein, 9 aa, Homo Sapiens
LSPSGLFRP

SEQ ID NO: 1124083 - protein, 9 aa, Homo Sapiens
RESRPVAPF

SEQ ID NO: 1124084 - protein, 9 aa, Homo Sapiens
PAPYGITPE

SEQ ID NO: 1124085 - protein, 9 aa, Homo Sapiens
RSSHRHRTG

SEQ ID NO: 1124086 - protein, 9 aa, Homo Sapiens
VTTQAEGQH

SEQ ID NO: 1124087 - protein, 9 aa, Homo Sapiens
EDYTDQRIT

SEQ ID NO: 1124088 - protein, 9 aa, Homo Sapiens
CYPDTLQSP

SEQ ID NO: 1124089 - protein, 9 aa, Homo Sapiens
VSPPRSEAQ

SEQ ID NO: 1124090 - protein, 9 aa, Homo Sapiens
TLLEILWTL

SEQ ID NO: 1124091 - protein, 9 aa, Homo Sapiens
ALAELSTVH

SEQ ID NO: 1124092 - protein, 9 aa, Homo Sapiens
MDAGACYAA

SEQ ID NO: 1124093 - protein, 9 aa, Homo Sapiens
LMVKPGMHY

SEQ ID NO: 1124094 - protein, 9 aa, Homo Sapiens
NRRMKWKND

SEQ ID NO: 1124095 - protein, 9 aa, Homo Sapiens
WACTCRACR

SEQ ID NO: 1124096 - protein, 9 aa, Homo Sapiens
LGIHVFDAN

SEQ ID NO: 1124097 - protein, 9 aa, Homo Sapiens
STAHWGSAL

SEQ ID NO: 1124098 - protein, 9 aa, Homo Sapiens
DTGYILFLV

SEQ ID NO: 1124099 - protein, 9 aa, Homo Sapiens
SGWVPLLLV

SEQ ID NO: 1124100 - protein, 9 aa, Homo Sapiens
VLLKRSLKN

SEQ ID NO: 1124101 - protein, 9 aa, Homo Sapiens
APGGSWYCL

SEQ ID NO: 1124102 - protein, 9 aa, Homo Sapiens
PISVKQVIT

SEQ ID NO: 1124103 - protein, 9 aa, Homo Sapiens
PNAGELPGQ

SEQ ID NO: 1124104 - protein, 9 aa, Homo Sapiens
AYTLYWPEE

SEQ ID NO: 1124105 - protein, 9 aa, Homo Sapiens
RRVLSLSQA

SEQ ID NO: 1124106 - protein, 9 aa, Homo Sapiens
IVGQSNDHG

SEQ ID NO: 1124107 - protein, 9 aa, Homo Sapiens
PNYHPSKKC

SEQ ID NO: 1124108 - protein, 9 aa, Homo Sapiens
SSSLTSEPG

SEQ ID NO: 1124109 - protein, 9 aa, Homo Sapiens
SVHGTEKLI

SEQ ID NO: 1124110 - protein, 9 aa, Homo Sapiens
GLDRRRSCR

SEQ ID NO: 1124111 - protein, 9 aa, Homo Sapiens
CSAWTVSTG

SEQ ID NO: 1124112 - protein, 9 aa, Homo Sapiens
KNQSALIEG

SEQ ID NO: 1124113 - protein, 9 aa, Homo Sapiens
RLVEEALEK

SEQ ID NO: 1124114 - protein, 9 aa, Homo Sapiens
VQWPPGEPG

SEQ ID NO: 1124115 - protein, 9 aa, Homo Sapiens
QDTDQNYDY

SEQ ID NO: 1124116 - protein, 9 aa, Homo Sapiens
IMFDKDMTI

SEQ ID NO: 1124117 - protein, 9 aa, Homo Sapiens
MLMVKPGMH

SEQ ID NO: 1124118 - protein, 9 aa, Homo Sapiens
ASGAPNDFS

SEQ ID NO: 1124119 - protein, 9 aa, Homo Sapiens
SNTSTFMPY

SEQ ID NO: 1124120 - protein, 9 aa, Homo Sapiens
DGQQDLATP

SEQ ID NO: 1124121 - protein, 9 aa, Homo Sapiens
RLRGRQHSP

SEQ ID NO: 1124122 - protein, 9 aa, Homo Sapiens
VVWGSAMPV

SEQ ID NO: 1124123 - protein, 9 aa, Homo Sapiens
EAGGSHVGA

SEQ ID NO: 1124124 - protein, 9 aa, Homo Sapiens
PSGARRRGA

SEQ ID NO: 1124125 - protein, 9 aa, Homo Sapiens
VPISVKQVI

SEQ ID NO: 1124126 - protein, 9 aa, Homo Sapiens
TMRDNMLNL

SEQ ID NO: 1124127 - protein, 9 aa, Homo Sapiens
RKRKRRRSS

SEQ ID NO: 1124128 - protein, 9 aa, Homo Sapiens
NYEDTIRLY

SEQ ID NO: 1124129 - protein, 9 aa, Homo Sapiens
EVCGGTWPC

SEQ ID NO: 1124130 - protein, 9 aa, Homo Sapiens
SLVPTDSHE

SEQ ID NO: 1124131 - protein, 9 aa, Homo Sapiens
NQDHSVCYN

SEQ ID NO: 1124132 - protein, 9 aa, Homo Sapiens
EPPEDSPPR

SEQ ID NO: 1124133 - protein, 9 aa, Homo Sapiens
DDIKLYQKD

SEQ ID NO: 1124134 - protein, 9 aa, Homo Sapiens
CNPRLDFHP

SEQ ID NO: 1124135 - protein, 9 aa, Homo Sapiens
TELEDFKLQ

SEQ ID NO: 1124136 - protein, 9 aa, Homo Sapiens
SLACLNAML

SEQ ID NO: 1124137 - protein, 9 aa, Homo Sapiens
LPVHVYRTS

SEQ ID NO: 1124138 - protein, 9 aa, Homo Sapiens
SNMDNMLQK

SEQ ID NO: 1124139 - protein, 9 aa, Homo Sapiens
VVPAALLLR

SEQ ID NO: 1124140 - protein, 9 aa, Homo Sapiens
AVENATESV

SEQ ID NO: 1124141 - protein, 9 aa, Homo Sapiens
IQFLIILGP

SEQ ID NO: 1124142 - protein, 9 aa, Homo Sapiens
MHAAGLGML

SEQ ID NO: 1124143 - protein, 9 aa, Homo Sapiens
KITTNTEGE

SEQ ID NO: 1124144 - protein, 9 aa, Homo Sapiens
KWSRKAENV

SEQ ID NO: 1124145 - protein, 9 aa, Homo Sapiens
GDQRAGKDP

SEQ ID NO: 1124146 - protein, 9 aa, Homo Sapiens
AFSACGFYL

SEQ ID NO: 1124147 - protein, 9 aa, Homo Sapiens
QGVPGKTSL

SEQ ID NO: 1124148 - protein, 9 aa, Homo Sapiens
LLVLLLQRE

SEQ ID NO: 1124149 - protein, 9 aa, Homo Sapiens
RDVEAWFNE

SEQ ID NO: 1124150 - protein, 9 aa, Homo Sapiens
EELGGLEAS

SEQ ID NO: 1124151 - protein, 9 aa, Homo Sapiens
GVGERAPRT

SEQ ID NO: 1124152 - protein, 9 aa, Homo Sapiens
GILPIWQVM

SEQ ID NO: 1124153 - protein, 9 aa, Homo Sapiens
KCRKLGDPQ

SEQ ID NO: 1124154 - protein, 9 aa, Homo Sapiens
VFKRSPFLT

SEQ ID NO: 1124155 - protein, 9 aa, Homo Sapiens
PTCPLEKSP

SEQ ID NO: 1124156 - protein, 9 aa, Homo Sapiens
FLILLHLGL

SEQ ID NO: 1124157 - protein, 9 aa, Homo Sapiens
YLILFNYCL

SEQ ID NO: 1124158 - protein, 9 aa, Homo Sapiens
RVSTLTMES

SEQ ID NO: 1124159 - protein, 9 aa, Homo Sapiens
DSQEDKKIQ

SEQ ID NO: 1124160 - protein, 9 aa, Homo Sapiens
AYGAMTIGE

SEQ ID NO: 1124161 - protein, 9 aa, Homo Sapiens
QLKADSESA

SEQ ID NO: 1124162 - protein, 9 aa, Homo Sapiens
AAQPGQQQQ

SEQ ID NO: 1124163 - protein, 9 aa, Homo Sapiens
EETTSHDWG

SEQ ID NO: 1124164 - protein, 9 aa, Homo Sapiens
RQRGHLHPP

SEQ ID NO: 1124165 - protein, 9 aa, Homo Sapiens
VYYVGVTSC

SEQ ID NO: 1124166 - protein, 9 aa, Homo Sapiens
CPQSASRED

SEQ ID NO: 1124167 - protein, 9 aa, Homo Sapiens
DCGHPLLWG

SEQ ID NO: 1124168 - protein, 9 aa, Homo Sapiens
NLINYYEGQ

SEQ ID NO: 1124169 - protein, 9 aa, Homo Sapiens
RSAAASELE

SEQ ID NO: 1124170 - protein, 9 aa, Homo Sapiens
IVQMSILGK

SEQ ID NO: 1124171 - protein, 9 aa, Homo Sapiens
KIVQAFPSK

SEQ ID NO: 1124172 - protein, 9 aa, Homo Sapiens
LGRSHWSPL

SEQ ID NO: 1124173 - protein, 9 aa, Homo Sapiens
ETFWTTTGT

SEQ ID NO: 1124174 - protein, 9 aa, Homo Sapiens
GSRRRSVRP

SEQ ID NO: 1124175 - protein, 9 aa, Homo Sapiens
WAARSLSRT

SEQ ID NO: 1124176 - protein, 9 aa, Homo Sapiens
KMATQARGS

SEQ ID NO: 1124177 - protein, 9 aa, Homo Sapiens
LPLLLAADQ

SEQ ID NO: 1124178 - protein, 9 aa, Homo Sapiens
LTATWAPRR

SEQ ID NO: 1124179 - protein, 9 aa, Homo Sapiens
DCASRGMAG

SEQ ID NO: 1124180 - protein, 9 aa, Homo Sapiens
LRQRRGFAE

SEQ ID NO: 1124181 - protein, 9 aa, Homo Sapiens
IEFMSDAEK

SEQ ID NO: 1124182 - protein, 9 aa, Homo Sapiens
VPQVSLVEI

SEQ ID NO: 1124183 - protein, 9 aa, Homo Sapiens
PRCPAKGAD

SEQ ID NO: 1124184 - protein, 9 aa, Homo Sapiens
VPHPTMTTR

SEQ ID NO: 1124185 - protein, 9 aa, Homo Sapiens
SSPWSGLMS

SEQ ID NO: 1124186 - protein, 9 aa, Homo Sapiens
LMMHQMEQY

SEQ ID NO: 1124187 - protein, 9 aa, Homo Sapiens
TGGPVNETL

SEQ ID NO: 1124188 - protein, 9 aa, Homo Sapiens
ACFKLGGPR

SEQ ID NO: 1124189 - protein, 9 aa, Homo Sapiens
PGAPPSRNS

SEQ ID NO: 1124190 - protein, 9 aa, Homo Sapiens
KALKPIKRV

SEQ ID NO: 1124191 - protein, 9 aa, Homo Sapiens
KKKQEPPCT

SEQ ID NO: 1124192 - protein, 9 aa, Homo Sapiens
WEWQRQASD

SEQ ID NO: 1124193 - protein, 9 aa, Homo Sapiens
SVLQRVLYR

SEQ ID NO: 1124194 - protein, 9 aa, Homo Sapiens
EDGKRLQPL

SEQ ID NO: 1124195 - protein, 9 aa, Homo Sapiens
NCAENIHKH

SEQ ID NO: 1124196 - protein, 9 aa, Homo Sapiens
NPGVGPGLG

SEQ ID NO: 1124197 - protein, 9 aa, Homo Sapiens
DLDGILRKR

SEQ ID NO: 1124198 - protein, 9 aa, Homo Sapiens
SQPTQALTQ

SEQ ID NO: 1124199 - protein, 9 aa, Homo Sapiens
SFQRRGRRS

SEQ ID NO: 1124200 - protein, 9 aa, Homo Sapiens
KYSNMEFVC

SEQ ID NO: 1124201 - protein, 9 aa, Homo Sapiens
GVAQPWPSF

SEQ ID NO: 1124202 - protein, 9 aa, Homo Sapiens
IDEAWWLSN

SEQ ID NO: 1124203 - protein, 9 aa, Homo Sapiens
MTTRTSLPP

SEQ ID NO: 1124204 - protein, 9 aa, Homo Sapiens
DQELATVLL

SEQ ID NO: 1124205 - protein, 9 aa, Homo Sapiens
SQIVDILST

SEQ ID NO: 1124206 - protein, 9 aa, Homo Sapiens
VCLLCWMPY

SEQ ID NO: 1124207 - protein, 9 aa, Homo Sapiens
EFLQQEDTP

SEQ ID NO: 1124208 - protein, 9 aa, Homo Sapiens
VDPVYFKIL

SEQ ID NO: 1124209 - protein, 9 aa, Homo Sapiens
LRRPQWTQT

SEQ ID NO: 1124210 - protein, 9 aa, Homo Sapiens
KGQRIFLVL

SEQ ID NO: 1124211 - protein, 9 aa, Homo Sapiens
GGSWYCLTS

SEQ ID NO: 1124212 - protein, 9 aa, Homo Sapiens
PTEGACTPG

SEQ ID NO: 1124213 - protein, 9 aa, Homo Sapiens
DPILGSPFF

SEQ ID NO: 1124214 - protein, 9 aa, Homo Sapiens
AETRPERLL

SEQ ID NO: 1124215 - protein, 9 aa, Homo Sapiens
TDGKRAIVV

SEQ ID NO: 1124216 - protein, 9 aa, Homo Sapiens
LTLAPLGNA

SEQ ID NO: 1124217 - protein, 9 aa, Homo Sapiens
IMELKDECL

SEQ ID NO: 1124218 - protein, 9 aa, Homo Sapiens
HTGKKKFSC

SEQ ID NO: 1124219 - protein, 9 aa, Homo Sapiens
RACVLPGGT

SEQ ID NO: 1124220 - protein, 9 aa, Homo Sapiens
ANMHNLLIH

SEQ ID NO: 1124221 - protein, 9 aa, Homo Sapiens
IVQACRGEN

SEQ ID NO: 1124222 - protein, 9 aa, Homo Sapiens
NSYECEMFD

SEQ ID NO: 1124223 - protein, 9 aa, Homo Sapiens
EHAELILQQ

SEQ ID NO: 1124224 - protein, 9 aa, Homo Sapiens
HRIGELSGD

SEQ ID NO: 1124225 - protein, 9 aa, Homo Sapiens
KSESMVYSR

SEQ ID NO: 1124226 - protein, 9 aa, Homo Sapiens
LLHLGLQPP

SEQ ID NO: 1124227 - protein, 9 aa, Homo Sapiens
WSPEDPWSL

SEQ ID NO: 1124228 - protein, 9 aa, Homo Sapiens
KDNSAGVNE

SEQ ID NO: 1124229 - protein, 9 aa, Homo Sapiens
RYGDGQQDL

SEQ ID NO: 1124230 - protein, 9 aa, Homo Sapiens
GNGEHPEAS

SEQ ID NO: 1124231 - protein, 9 aa, Homo Sapiens
ATPVVTVPP

SEQ ID NO: 1124232 - protein, 9 aa, Homo Sapiens
VASDHRSFT

SEQ ID NO: 1124233 - protein, 9 aa, Homo Sapiens
LSRCHPIAS

SEQ ID NO: 1124234 - protein, 9 aa, Homo Sapiens
AMAPETTLW

SEQ ID NO: 1124235 - protein, 9 aa, Homo Sapiens
QLHLQEMAQ

SEQ ID NO: 1124236 - protein, 9 aa, Homo Sapiens
QPSDISSVP

SEQ ID NO: 1124237 - protein, 9 aa, Homo Sapiens
TQLHLQEMA

SEQ ID NO: 1124238 - protein, 9 aa, Homo Sapiens
MLFPTSVQE

SEQ ID NO: 1124239 - protein, 9 aa, Homo Sapiens
STWMRRRDT

SEQ ID NO: 1124240 - protein, 9 aa, Homo Sapiens
EHLQTVTNY

SEQ ID NO: 1124241 - protein, 9 aa, Homo Sapiens
PPSPLPAPR

SEQ ID NO: 1124242 - protein, 9 aa, Homo Sapiens
ALQPPPQPP

SEQ ID NO: 1124243 - protein, 9 aa, Homo Sapiens
RCRPHAWAP

SEQ ID NO: 1124244 - protein, 9 aa, Homo Sapiens
SIKWSPSCH

SEQ ID NO: 1124245 - protein, 9 aa, Homo Sapiens
KIGRSLEGE

SEQ ID NO: 1124246 - protein, 9 aa, Homo Sapiens
SYDHVLFLI

SEQ ID NO: 1124247 - protein, 9 aa, Homo Sapiens
VPQAEGEND

SEQ ID NO: 1124248 - protein, 9 aa, Homo Sapiens
AQPGQQQQV

SEQ ID NO: 1124249 - protein, 9 aa, Homo Sapiens
EESIPKKSY

SEQ ID NO: 1124250 - protein, 9 aa, Homo Sapiens
RVNLSASLL

SEQ ID NO: 1124251 - protein, 9 aa, Homo Sapiens
RPTLPPGNS

SEQ ID NO: 1124252 - protein, 9 aa, Homo Sapiens
GYVILEASE

SEQ ID NO: 1124253 - protein, 9 aa, Homo Sapiens
DETLQGPPG

SEQ ID NO: 1124254 - protein, 9 aa, Homo Sapiens
GEVRCHIHA

SEQ ID NO: 1124255 - protein, 9 aa, Homo Sapiens
YLNLINYYE

SEQ ID NO: 1124256 - protein, 9 aa, Homo Sapiens
SHDNVQLVS

SEQ ID NO: 1124257 - protein, 9 aa, Homo Sapiens
LRTGQTRGR

SEQ ID NO: 1124258 - protein, 9 aa, Homo Sapiens
LILFNYCLH

SEQ ID NO: 1124259 - protein, 9 aa, Homo Sapiens
RDAINTSCD

SEQ ID NO: 1124260 - protein, 9 aa, Homo Sapiens
GSRQRVVMC

SEQ ID NO: 1124261 - protein, 9 aa, Homo Sapiens
GFFVAAIER

SEQ ID NO: 1124262 - protein, 9 aa, Homo Sapiens
PSQGITPHG

SEQ ID NO: 1124263 - protein, 9 aa, Homo Sapiens
PSAPPPSAP

SEQ ID NO: 1124264 - protein, 9 aa, Homo Sapiens
VVCCLPGAE

SEQ ID NO: 1124265 - protein, 9 aa, Homo Sapiens
GCGFCHEIA

SEQ ID NO: 1124266 - protein, 9 aa, Homo Sapiens
RRIAWIKKL

SEQ ID NO: 1124267 - protein, 9 aa, Homo Sapiens
SLGRVLLPD

SEQ ID NO: 1124268 - protein, 9 aa, Homo Sapiens
DEEKPQASP

SEQ ID NO: 1124269 - protein, 9 aa, Homo Sapiens
VRAKGPVLL

SEQ ID NO: 1124270 - protein, 9 aa, Homo Sapiens
SRDPTTEVH

SEQ ID NO: 1124271 - protein, 9 aa, Homo Sapiens
RFLQVCDWL

SEQ ID NO: 1124272 - protein, 9 aa, Homo Sapiens
IVLSFHSSA

SEQ ID NO: 1124273 - protein, 9 aa, Homo Sapiens
SSPGPPTSL

SEQ ID NO: 1124274 - protein, 9 aa, Homo Sapiens
KDVLIGFGR

SEQ ID NO: 1124275 - protein, 9 aa, Homo Sapiens
KMQKDQEER

SEQ ID NO: 1124276 - protein, 9 aa, Homo Sapiens
CEPFHKSCL

SEQ ID NO: 1124277 - protein, 9 aa, Homo Sapiens
CRTGASTRA

SEQ ID NO: 1124278 - protein, 9 aa, Homo Sapiens
GTCNHLRIT

SEQ ID NO: 1124279 - protein, 9 aa, Homo Sapiens
DLLGIHWQC

SEQ ID NO: 1124280 - protein, 9 aa, Homo Sapiens
RGAPSGAPS

SEQ ID NO: 1124281 - protein, 9 aa, Homo Sapiens
LFISMQAVI

SEQ ID NO: 1124282 - protein, 9 aa, Homo Sapiens
TPLGYGAAF

SEQ ID NO: 1124283 - protein, 9 aa, Homo Sapiens
KHLKTLRLP

SEQ ID NO: 1124284 - protein, 9 aa, Homo Sapiens
REYMVEKNY

SEQ ID NO: 1124285 - protein, 9 aa, Homo Sapiens
CGQGTACLL

SEQ ID NO: 1124286 - protein, 9 aa, Homo Sapiens
VRYIRQGLC

SEQ ID NO: 1124287 - protein, 9 aa, Homo Sapiens
HKYIVRYKT

SEQ ID NO: 1124288 - protein, 9 aa, Homo Sapiens
NVMFSFVKY

SEQ ID NO: 1124289 - protein, 9 aa, Homo Sapiens
ADPEEELAA

SEQ ID NO: 1124290 - protein, 9 aa, Homo Sapiens
LGKYHEVLS

SEQ ID NO: 1124291 - protein, 9 aa, Homo Sapiens
VFSVCNTGS

SEQ ID NO: 1124292 - protein, 9 aa, Homo Sapiens
ASTSSVTAS

SEQ ID NO: 1124293 - protein, 9 aa, Homo Sapiens
QLPQHALVC

SEQ ID NO: 1124294 - protein, 9 aa, Homo Sapiens
VAPPAFSGR

SEQ ID NO: 1124295 - protein, 9 aa, Homo Sapiens
VHIILICLQ

SEQ ID NO: 1124296 - protein, 9 aa, Homo Sapiens
ETLQGPPGT

SEQ ID NO: 1124297 - protein, 9 aa, Homo Sapiens
PVAPFPATA

SEQ ID NO: 1124298 - protein, 9 aa, Homo Sapiens
SFNIECAGR

SEQ ID NO: 1124299 - protein, 9 aa, Homo Sapiens
THQEVPVVI

SEQ ID NO: 1124300 - protein, 9 aa, Homo Sapiens
LAPVKWGGN

SEQ ID NO: 1124301 - protein, 9 aa, Homo Sapiens
WIVFQINHA

SEQ ID NO: 1124302 - protein, 9 aa, Homo Sapiens
ATGKSTSTS

SEQ ID NO: 1124303 - protein, 9 aa, Homo Sapiens
TWLPGGGCC

SEQ ID NO: 1124304 - protein, 9 aa, Homo Sapiens
PRSSRSRCA

SEQ ID NO: 1124305 - protein, 9 aa, Homo Sapiens
HIMRHTQLQ

SEQ ID NO: 1124306 - protein, 9 aa, Homo Sapiens
PLKQNQIVD

SEQ ID NO: 1124307 - protein, 9 aa, Homo Sapiens
AAPMAEEEA

SEQ ID NO: 1124308 - protein, 9 aa, Homo Sapiens
SRCAYASAA

SEQ ID NO: 1124309 - protein, 9 aa, Homo Sapiens
IMLHIGIMH

SEQ ID NO: 1124310 - protein, 9 aa, Homo Sapiens
LMTTDCPEH

SEQ ID NO: 1124311 - protein, 9 aa, Homo Sapiens
LPVLWELCC

SEQ ID NO: 1124312 - protein, 9 aa, Homo Sapiens
LDREGWESQ

SEQ ID NO: 1124313 - protein, 9 aa, Homo Sapiens
PTQQLAWPD

SEQ ID NO: 1124314 - protein, 9 aa, Homo Sapiens
HHLKKTFTM

SEQ ID NO: 1124315 - protein, 9 aa, Homo Sapiens
DLVTFGIFC

SEQ ID NO: 1124316 - protein, 9 aa, Homo Sapiens
SNYLNLFII

SEQ ID NO: 1124317 - protein, 9 aa, Homo Sapiens
VRAAGVRMG

SEQ ID NO: 1124318 - protein, 9 aa, Homo Sapiens
LNSTNSWWT

SEQ ID NO: 1124319 - protein, 9 aa, Homo Sapiens
KCVKGRTWT

SEQ ID NO: 1124320 - protein, 9 aa, Homo Sapiens
QSINKNLVL

SEQ ID NO: 1124321 - protein, 9 aa, Homo Sapiens
GDDGPVAAE

SEQ ID NO: 1124322 - protein, 9 aa, Homo Sapiens
PGAQETESW

SEQ ID NO: 1124323 - protein, 9 aa, Homo Sapiens
EKHGPPSSI

SEQ ID NO: 1124324 - protein, 9 aa, Homo Sapiens
LFHNDIRVL

SEQ ID NO: 1124325 - protein, 9 aa, Homo Sapiens
SLRNSLPQH

SEQ ID NO: 1124326 - protein, 9 aa, Homo Sapiens
MKGASTPSS

SEQ ID NO: 1124327 - protein, 9 aa, Homo Sapiens
RKKCDKKTL

SEQ ID NO: 1124328 - protein, 9 aa, Homo Sapiens
FVVVKDPDM

SEQ ID NO: 1124329 - protein, 9 aa, Homo Sapiens
VRLNMLPLV

SEQ ID NO: 1124330 - protein, 9 aa, Homo Sapiens
NLGCLYADL

SEQ ID NO: 1124331 - protein, 9 aa, Homo Sapiens
LGVTLGLTA

SEQ ID NO: 1124332 - protein, 9 aa, Homo Sapiens
VVNPDWLRS

SEQ ID NO: 1124333 - protein, 9 aa, Homo Sapiens
CQGQMAWRL

SEQ ID NO: 1124334 - protein, 9 aa, Homo Sapiens
DVQSYSIEI

SEQ ID NO: 1124335 - protein, 9 aa, Homo Sapiens
PRASPRPWS

SEQ ID NO: 1124336 - protein, 9 aa, Homo Sapiens
GLGGGGRGG

SEQ ID NO: 1124337 - protein, 9 aa, Homo Sapiens
HPGHHGADV

SEQ ID NO: 1124338 - protein, 9 aa, Homo Sapiens
GSSTRPKDN

SEQ ID NO: 1124339 - protein, 9 aa, Homo Sapiens
PYCNAHYLK

SEQ ID NO: 1124340 - protein, 9 aa, Homo Sapiens
QDSSTWLTA

SEQ ID NO: 1124341 - protein, 9 aa, Homo Sapiens
CSEWPREPQ

SEQ ID NO: 1124342 - protein, 9 aa, Homo Sapiens
KSGQRSAST

SEQ ID NO: 1124343 - protein, 9 aa, Homo Sapiens
GQMAPPVLP

SEQ ID NO: 1124344 - protein, 9 aa, Homo Sapiens
LTQKATPNP

SEQ ID NO: 1124345 - protein, 9 aa, Homo Sapiens
RPVKFPSLS

SEQ ID NO: 1124346 - protein, 9 aa, Homo Sapiens
VTVRVPLQV

SEQ ID NO: 1124347 - protein, 9 aa, Homo Sapiens
AEGQHKMDR

SEQ ID NO: 1124348 - protein, 9 aa, Homo Sapiens
AFQFQCSLD

SEQ ID NO: 1124349 - protein, 9 aa, Homo Sapiens
VCQGQMAWR

SEQ ID NO: 1124350 - protein, 9 aa, Homo Sapiens
FLKTWAPAA

SEQ ID NO: 1124351 - protein, 9 aa, Homo Sapiens
GVGDKFKRP

SEQ ID NO: 1124352 - protein, 9 aa, Homo Sapiens
IRHSSSDFF

SEQ ID NO: 1124353 - protein, 9 aa, Homo Sapiens
SHIRTTMLS

SEQ ID NO: 1124354 - protein, 9 aa, Homo Sapiens
NKSGELLVK

SEQ ID NO: 1124355 - protein, 9 aa, Homo Sapiens
LSDCFIGSS

SEQ ID NO: 1124356 - protein, 9 aa, Homo Sapiens
FSLFGDVSS

SEQ ID NO: 1124357 - protein, 9 aa, Homo Sapiens
KYNISSEVY

SEQ ID NO: 1124358 - protein, 9 aa, Homo Sapiens
KEHHIQESV

SEQ ID NO: 1124359 - protein, 9 aa, Homo Sapiens
SQDCDQVCD

SEQ ID NO: 1124360 - protein, 9 aa, Homo Sapiens
PPRAREKLT

SEQ ID NO: 1124361 - protein, 9 aa, Homo Sapiens
KAARTGLHI

SEQ ID NO: 1124362 - protein, 9 aa, Homo Sapiens
EAMFSDLHP

SEQ ID NO: 1124363 - protein, 9 aa, Homo Sapiens
VYHSEGMKV

SEQ ID NO: 1124364 - protein, 9 aa, Homo Sapiens
HQLPMGRLD

SEQ ID NO: 1124365 - protein, 9 aa, Homo Sapiens
TQENFNSQQ

SEQ ID NO: 1124366 - protein, 9 aa, Homo Sapiens
GDLRGRQCS

SEQ ID NO: 1124367 - protein, 9 aa, Homo Sapiens
FWTTTGTFP

SEQ ID NO: 1124368 - protein, 9 aa, Homo Sapiens
YTLITKELH

SEQ ID NO: 1124369 - protein, 9 aa, Homo Sapiens
HRGLAARNI

SEQ ID NO: 1124370 - protein, 9 aa, Homo Sapiens
MVIKVDLCA

SEQ ID NO: 1124371 - protein, 9 aa, Homo Sapiens
LDAANQCQI

SEQ ID NO: 1124372 - protein, 9 aa, Homo Sapiens
PLHALGALP

SEQ ID NO: 1124373 - protein, 9 aa, Homo Sapiens
VWLLDVGII

SEQ ID NO: 1124374 - protein, 9 aa, Homo Sapiens
HESSGWSFQ

SEQ ID NO: 1124375 - protein, 9 aa, Homo Sapiens
GGSCMKGAS

SEQ ID NO: 1124376 - protein, 9 aa, Homo Sapiens
ENATESVST

SEQ ID NO: 1124377 - protein, 9 aa, Homo Sapiens
NMSAPDGPS

SEQ ID NO: 1124378 - protein, 9 aa, Homo Sapiens
HRMTHRLQK

SEQ ID NO: 1124379 - protein, 9 aa, Homo Sapiens
WDLRRPQWT

SEQ ID NO: 1124380 - protein, 9 aa, Homo Sapiens
SLRNFEVGE

SEQ ID NO: 1124381 - protein, 9 aa, Homo Sapiens
GTGIRTRPQ

SEQ ID NO: 1124382 - protein, 9 aa, Homo Sapiens
LSTSSSLEP

SEQ ID NO: 1124383 - protein, 9 aa, Homo Sapiens
DDAAILLQQ

SEQ ID NO: 1124384 - protein, 9 aa, Homo Sapiens
ATRAGWGTS

SEQ ID NO: 1124385 - protein, 9 aa, Homo Sapiens
ENHGELWVR

SEQ ID NO: 1124386 - protein, 9 aa, Homo Sapiens
VISSSPADT

SEQ ID NO: 1124387 - protein, 9 aa, Homo Sapiens
PPGAPPSRN

SEQ ID NO: 1124388 - protein, 9 aa, Homo Sapiens
GVYEEVKRG

SEQ ID NO: 1124389 - protein, 9 aa, Homo Sapiens
GAGAAGAGG

SEQ ID NO: 1124390 - protein, 9 aa, Homo Sapiens
KWEFTSWVS

SEQ ID NO: 1124391 - protein, 9 aa, Homo Sapiens
TNVDKPLHI

SEQ ID NO: 1124392 - protein, 9 aa, Homo Sapiens
GTCTCIAKN

SEQ ID NO: 1124393 - protein, 9 aa, Homo Sapiens
PAHPTRGLC

SEQ ID NO: 1124394 - protein, 9 aa, Homo Sapiens
KVHVNLLFL

SEQ ID NO: 1124395 - protein, 9 aa, Homo Sapiens
AKGHSHPGE

SEQ ID NO: 1124396 - protein, 9 aa, Homo Sapiens
AARSPLPPT

SEQ ID NO: 1124397 - protein, 9 aa, Homo Sapiens
GATEQGTYR

SEQ ID NO: 1124398 - protein, 9 aa, Homo Sapiens
GLGVIINGL

SEQ ID NO: 1124399 - protein, 9 aa, Homo Sapiens
GYERMEQFT

SEQ ID NO: 1124400 - protein, 9 aa, Homo Sapiens
LATKNAVLM

SEQ ID NO: 1124401 - protein, 9 aa, Homo Sapiens
GALEPKVTA

SEQ ID NO: 1124402 - protein, 9 aa, Homo Sapiens
KKTSRILNL

SEQ ID NO: 1124403 - protein, 9 aa, Homo Sapiens
CPRPPRSQP

SEQ ID NO: 1124404 - protein, 9 aa, Homo Sapiens
GEPWDTERN

SEQ ID NO: 1124405 - protein, 9 aa, Homo Sapiens
PVPHRSLQA

SEQ ID NO: 1124406 - protein, 9 aa, Homo Sapiens
YWLPLTDIQ

SEQ ID NO: 1124407 - protein, 9 aa, Homo Sapiens
FVPPLPERK

SEQ ID NO: 1124408 - protein, 9 aa, Homo Sapiens
SLHIFRDEI

SEQ ID NO: 1124409 - protein, 9 aa, Homo Sapiens
RMSSDAFGM

SEQ ID NO: 1124410 - protein, 9 aa, Homo Sapiens
LAVCLLCWM

SEQ ID NO: 1124411 - protein, 9 aa, Homo Sapiens
VLPCQACQV

SEQ ID NO: 1124412 - protein, 9 aa, Homo Sapiens
GPYATPLGY

SEQ ID NO: 1124413 - protein, 9 aa, Homo Sapiens
GVQKIPVLF

SEQ ID NO: 1124414 - protein, 9 aa, Homo Sapiens
IFAYLIFAL

SEQ ID NO: 1124415 - protein, 9 aa, Homo Sapiens
PPPGLRPCR

SEQ ID NO: 1124416 - protein, 9 aa, Homo Sapiens
PDCVNIEEV

SEQ ID NO: 1124417 - protein, 9 aa, Homo Sapiens
APLLLRILR

SEQ ID NO: 1124418 - protein, 9 aa, Homo Sapiens
SNEDGDIKH

SEQ ID NO: 1124419 - protein, 9 aa, Homo Sapiens
FTPPSGDMM

SEQ ID NO: 1124420 - protein, 9 aa, Homo Sapiens
APRGITPFT

SEQ ID NO: 1124421 - protein, 9 aa, Homo Sapiens
HLGLGLLQS

SEQ ID NO: 1124422 - protein, 9 aa, Homo Sapiens
PHGSPDSKG

SEQ ID NO: 1124423 - protein, 9 aa, Homo Sapiens
DIQRGNVCG

SEQ ID NO: 1124424 - protein, 9 aa, Homo Sapiens
DPAPSPSRG

SEQ ID NO: 1124425 - protein, 9 aa, Homo Sapiens
VLRTRYNQT

SEQ ID NO: 1124426 - protein, 9 aa, Homo Sapiens
RMMRPGQGQ

SEQ ID NO: 1124427 - protein, 9 aa, Homo Sapiens
NLRTLKQTG

SEQ ID NO: 1124428 - protein, 9 aa, Homo Sapiens
CVEADDAMC

SEQ ID NO: 1124429 - protein, 9 aa, Homo Sapiens
LAAVVYSLG

SEQ ID NO: 1124430 - protein, 9 aa, Homo Sapiens
PSERDFFRE

SEQ ID NO: 1124431 - protein, 9 aa, Homo Sapiens
TARGPGGAA

SEQ ID NO: 1124432 - protein, 9 aa, Homo Sapiens
RCLVQLSSA

SEQ ID NO: 1124433 - protein, 9 aa, Homo Sapiens
APPCGPRLT

SEQ ID NO: 1124434 - protein, 9 aa, Homo Sapiens
EKQELEEEE

SEQ ID NO: 1124435 - protein, 9 aa, Homo Sapiens
QTEYIEKFA

SEQ ID NO: 1124436 - protein, 9 aa, Homo Sapiens
TYSTCMSQT

SEQ ID NO: 1124437 - protein, 9 aa, Homo Sapiens
DEMFSSEKA

SEQ ID NO: 1124438 - protein, 9 aa, Homo Sapiens
KFTNGQLVS

SEQ ID NO: 1124439 - protein, 9 aa, Homo Sapiens
FMAPGKSRS

SEQ ID NO: 1124440 - protein, 9 aa, Homo Sapiens
MRLGCRTFH

SEQ ID NO: 1124441 - protein, 9 aa, Homo Sapiens
RSSLGARAR

SEQ ID NO: 1124442 - protein, 9 aa, Homo Sapiens
VKIPVADIK

SEQ ID NO: 1124443 - protein, 9 aa, Homo Sapiens
KDVEASLQS

SEQ ID NO: 1124444 - protein, 9 aa, Homo Sapiens
SPPDPQELL

SEQ ID NO: 1124445 - protein, 9 aa, Homo Sapiens
ASLLCFQPR

SEQ ID NO: 1124446 - protein, 9 aa, Homo Sapiens
SCMKGASTP

SEQ ID NO: 1124447 - protein, 9 aa, Homo Sapiens
TGSVTHQSS

SEQ ID NO: 1124448 - protein, 9 aa, Homo Sapiens
GDQLFNQKK

SEQ ID NO: 1124449 - protein, 9 aa, Homo Sapiens
ITALCPFRD

SEQ ID NO: 1124450 - protein, 9 aa, Homo Sapiens
CHVQRLWFQ

SEQ ID NO: 1124451 - protein, 9 aa, Homo Sapiens
DGQRRQQQQ

SEQ ID NO: 1124452 - protein, 9 aa, Homo Sapiens
LHRSYVRTR

SEQ ID NO: 1124453 - protein, 9 aa, Homo Sapiens
EGTGGFDGT

SEQ ID NO: 1124454 - protein, 9 aa, Homo Sapiens
GAPQPSAAP

SEQ ID NO: 1124455 - protein, 9 aa, Homo Sapiens
GEGERLVEE

SEQ ID NO: 1124456 - protein, 9 aa, Homo Sapiens
YGPLWSIPE

SEQ ID NO: 1124457 - protein, 9 aa, Homo Sapiens
TSFIIDSSL

SEQ ID NO: 1124458 - protein, 9 aa, Homo Sapiens
KRMSHQNTF

SEQ ID NO: 1124459 - protein, 9 aa, Homo Sapiens
AVLATYVFL

SEQ ID NO: 1124460 - protein, 9 aa, Homo Sapiens
EALKICEEF

SEQ ID NO: 1124461 - protein, 9 aa, Homo Sapiens
EDMFASQHH

SEQ ID NO: 1124462 - protein, 9 aa, Homo Sapiens
KPEQLTLPI

SEQ ID NO: 1124463 - protein, 9 aa, Homo Sapiens
FVCMKGPQG

SEQ ID NO: 1124464 - protein, 9 aa, Homo Sapiens
LALASTLES

SEQ ID NO: 1124465 - protein, 9 aa, Homo Sapiens
KPPRCCPCS

SEQ ID NO: 1124466 - protein, 9 aa, Homo Sapiens
SSLISGRLD

SEQ ID NO: 1124467 - protein, 9 aa, Homo Sapiens
AGLAPIFEA

SEQ ID NO: 1124468 - protein, 9 aa, Homo Sapiens
GHLGPSRGG

SEQ ID NO: 1124469 - protein, 9 aa, Homo Sapiens
VHGLCHPSS

SEQ ID NO: 1124470 - protein, 9 aa, Homo Sapiens
GLWHVQRSL

SEQ ID NO: 1124471 - protein, 9 aa, Homo Sapiens
AGRACVLPG

SEQ ID NO: 1124472 - protein, 9 aa, Homo Sapiens
TMRPSLAPE

SEQ ID NO: 1124473 - protein, 9 aa, Homo Sapiens
EAYVEDPEG

SEQ ID NO: 1124474 - protein, 9 aa, Homo Sapiens
METRAHCNS

SEQ ID NO: 1124475 - protein, 9 aa, Homo Sapiens
KKFSPPKKF

SEQ ID NO: 1124476 - protein, 9 aa, Homo Sapiens
RVAMENQHR

SEQ ID NO: 1124477 - protein, 9 aa, Homo Sapiens
RPSKRPSWY

SEQ ID NO: 1124478 - protein, 9 aa, Homo Sapiens
ALHDDMDQK

SEQ ID NO: 1124479 - protein, 9 aa, Homo Sapiens
MINLYHLSP

SEQ ID NO: 1124480 - protein, 9 aa, Homo Sapiens
ATESPWLGG

SEQ ID NO: 1124481 - protein, 9 aa, Homo Sapiens
LEDSRQGSP

SEQ ID NO: 1124482 - protein, 9 aa, Homo Sapiens
LKKARIFAD

SEQ ID NO: 1124483 - protein, 9 aa, Homo Sapiens
GPVKLGGHP

SEQ ID NO: 1124484 - protein, 9 aa, Homo Sapiens
KPLMLPPKP

SEQ ID NO: 1124485 - protein, 9 aa, Homo Sapiens
PQMETLVLN

SEQ ID NO: 1124486 - protein, 9 aa, Homo Sapiens
ARGIPRSTC

SEQ ID NO: 1124487 - protein, 9 aa, Homo Sapiens
VNRPWLFSL

SEQ ID NO: 1124488 - protein, 9 aa, Homo Sapiens
VMKALQHKR

SEQ ID NO: 1124489 - protein, 9 aa, Homo Sapiens
GGGCCAKPC

SEQ ID NO: 1124490 - protein, 9 aa, Homo Sapiens
SMEGLGHEE

SEQ ID NO: 1124491 - protein, 9 aa, Homo Sapiens
RCMRWCPTS

SEQ ID NO: 1124492 - protein, 9 aa, Homo Sapiens
ELLRDAEPG

SEQ ID NO: 1124493 - protein, 9 aa, Homo Sapiens
SASTARAGS

SEQ ID NO: 1124494 - protein, 9 aa, Homo Sapiens
LLPPDCGHP

SEQ ID NO: 1124495 - protein, 9 aa, Homo Sapiens
NPVHTLSEV

SEQ ID NO: 1124496 - protein, 9 aa, Homo Sapiens
PVNETLKLL

SEQ ID NO: 1124497 - protein, 9 aa, Homo Sapiens
CLRLLTTAW

SEQ ID NO: 1124498 - protein, 9 aa, Homo Sapiens
VQELQRSNQ

SEQ ID NO: 1124499 - protein, 9 aa, Homo Sapiens
QDVGTSSPS

SEQ ID NO: 1124500 - protein, 9 aa, Homo Sapiens
KEISSGTSL

SEQ ID NO: 1124501 - protein, 9 aa, Homo Sapiens
VHGINFDSP

SEQ ID NO: 1124502 - protein, 9 aa, Homo Sapiens
DLYLMTIIV

SEQ ID NO: 1124503 - protein, 9 aa, Homo Sapiens
ECGAGVRTH

SEQ ID NO: 1124504 - protein, 9 aa, Homo Sapiens
AVAHSIVEY

SEQ ID NO: 1124505 - protein, 9 aa, Homo Sapiens
GQMVPPLPD

SEQ ID NO: 1124506 - protein, 9 aa, Homo Sapiens
SPSLPHSRS

SEQ ID NO: 1124507 - protein, 9 aa, Homo Sapiens
SLKNLSWKK

SEQ ID NO: 1124508 - protein, 9 aa, Homo Sapiens
AASPRAAIW

SEQ ID NO: 1124509 - protein, 9 aa, Homo Sapiens
QRNGCHPYC

SEQ ID NO: 1124510 - protein, 9 aa, Homo Sapiens
DLWENTEFT

SEQ ID NO: 1124511 - protein, 9 aa, Homo Sapiens
NHGELWVRD

SEQ ID NO: 1124512 - protein, 9 aa, Homo Sapiens
ATNAHDALA

SEQ ID NO: 1124513 - protein, 9 aa, Homo Sapiens
RRRRKKKRR

SEQ ID NO: 1124514 - protein, 9 aa, Homo Sapiens
CSTGRKTMR

SEQ ID NO: 1124515 - protein, 9 aa, Homo Sapiens
RDHKRVHTG

SEQ ID NO: 1124516 - protein, 9 aa, Homo Sapiens
PFTIKLLLP

SEQ ID NO: 1124517 - protein, 9 aa, Homo Sapiens
TRSSVETLH

SEQ ID NO: 1124518 - protein, 9 aa, Homo Sapiens
MVRCGNLIV

SEQ ID NO: 1124519 - protein, 9 aa, Homo Sapiens
LWTCLITRS

SEQ ID NO: 1124520 - protein, 9 aa, Homo Sapiens
FSMEQAQTY

SEQ ID NO: 1124521 - protein, 9 aa, Homo Sapiens
NFLCLDHIL

SEQ ID NO: 1124522 - protein, 9 aa, Homo Sapiens
TAQDSWWLP

SEQ ID NO: 1124523 - protein, 9 aa, Homo Sapiens
LSLACTHTS

SEQ ID NO: 1124524 - protein, 9 aa, Homo Sapiens
LAHRGLGGL

SEQ ID NO: 1124525 - protein, 9 aa, Homo Sapiens
RSRACWERQ

SEQ ID NO: 1124526 - protein, 9 aa, Homo Sapiens
QMTTNRRWI

SEQ ID NO: 1124527 - protein, 9 aa, Homo Sapiens
LCKTSLFLH

SEQ ID NO: 1124528 - protein, 9 aa, Homo Sapiens
LSAIVSKRH

SEQ ID NO: 1124529 - protein, 9 aa, Homo Sapiens
AGPHVSGLG

SEQ ID NO: 1124530 - protein, 9 aa, Homo Sapiens
LSADKKCIM

SEQ ID NO: 1124531 - protein, 9 aa, Homo Sapiens
GYRERGGLS

SEQ ID NO: 1124532 - protein, 9 aa, Homo Sapiens
PLPPPGLAP

SEQ ID NO: 1124533 - protein, 9 aa, Homo Sapiens
KAPWKTQIQ

SEQ ID NO: 1124534 - protein, 9 aa, Homo Sapiens
LFHELVQCF

SEQ ID NO: 1124535 - protein, 9 aa, Homo Sapiens
VAIPSVTGH

SEQ ID NO: 1124536 - protein, 9 aa, Homo Sapiens
AKYAELDHE

SEQ ID NO: 1124537 - protein, 9 aa, Homo Sapiens
LPKEAVVLP

SEQ ID NO: 1124538 - protein, 9 aa, Homo Sapiens
KAEKRPQWM

SEQ ID NO: 1124539 - protein, 9 aa, Homo Sapiens
VTSLSVLWV

SEQ ID NO: 1124540 - protein, 9 aa, Homo Sapiens
ERNLRPLSL

SEQ ID NO: 1124541 - protein, 9 aa, Homo Sapiens
AAKQGFSNI

SEQ ID NO: 1124542 - protein, 9 aa, Homo Sapiens
RQSLGHSRQ

SEQ ID NO: 1124543 - protein, 9 aa, Homo Sapiens
PPGTTASSP

SEQ ID NO: 1124544 - protein, 9 aa, Homo Sapiens
SPPVILLFS

SEQ ID NO: 1124545 - protein, 9 aa, Homo Sapiens
VPPWDCGGS

SEQ ID NO: 1124546 - protein, 9 aa, Homo Sapiens
FSASPPSMR

SEQ ID NO: 1124547 - protein, 9 aa, Homo Sapiens
YVRSAIQLR

SEQ ID NO: 1124548 - protein, 9 aa, Homo Sapiens
NQTELGSRE

SEQ ID NO: 1124549 - protein, 9 aa, Homo Sapiens
DIWGNTANV

SEQ ID NO: 1124550 - protein, 9 aa, Homo Sapiens
GISTCGPTG

SEQ ID NO: 1124551 - protein, 9 aa, Homo Sapiens
GVCGPRVVE

SEQ ID NO: 1124552 - protein, 9 aa, Homo Sapiens
PPLPSLRTR

SEQ ID NO: 1124553 - protein, 9 aa, Homo Sapiens
VFNSIGADL

SEQ ID NO: 1124554 - protein, 9 aa, Homo Sapiens
AVTGSDGRS

SEQ ID NO: 1124555 - protein, 9 aa, Homo Sapiens
GSLFYVASD

SEQ ID NO: 1124556 - protein, 9 aa, Homo Sapiens
VKVAIDTGC

SEQ ID NO: 1124557 - protein, 9 aa, Homo Sapiens
WSGDKAISY

SEQ ID NO: 1124558 - protein, 9 aa, Homo Sapiens
VSVKSLPER

SEQ ID NO: 1124559 - protein, 9 aa, Homo Sapiens
FLKKNLYEI

SEQ ID NO: 1124560 - protein, 9 aa, Homo Sapiens
GTFGFLALP

SEQ ID NO: 1124561 - protein, 9 aa, Homo Sapiens
NLTREPSRV

SEQ ID NO: 1124562 - protein, 9 aa, Homo Sapiens
MSARVTFRY

SEQ ID NO: 1124563 - protein, 9 aa, Homo Sapiens
LLFRHILNF

SEQ ID NO: 1124564 - protein, 9 aa, Homo Sapiens
VTSMVTHAR

SEQ ID NO: 1124565 - protein, 9 aa, Homo Sapiens
EEDLDGILR

SEQ ID NO: 1124566 - protein, 9 aa, Homo Sapiens
TWKYYAKKN

SEQ ID NO: 1124567 - protein, 9 aa, Homo Sapiens
AQETQHEKT

SEQ ID NO: 1124568 - protein, 9 aa, Homo Sapiens
NLWAQEYLW

SEQ ID NO: 1124569 - protein, 9 aa, Homo Sapiens
LPGGRCQSP

SEQ ID NO: 1124570 - protein, 9 aa, Homo Sapiens
LWLLWTPVL

SEQ ID NO: 1124571 - protein, 9 aa, Homo Sapiens
RLTDGTDPF

SEQ ID NO: 1124572 - protein, 9 aa, Homo Sapiens
SPRPWSPED

SEQ ID NO: 1124573 - protein, 9 aa, Homo Sapiens
IPTCCFSAS

SEQ ID NO: 1124574 - protein, 9 aa, Homo Sapiens
RHALRILIH

SEQ ID NO: 1124575 - protein, 9 aa, Homo Sapiens
ASCLRTGQT

SEQ ID NO: 1124576 - protein, 9 aa, Homo Sapiens
LLNLRERYF

SEQ ID NO: 1124577 - protein, 9 aa, Homo Sapiens
TPWCPHCKK

SEQ ID NO: 1124578 - protein, 9 aa, Homo Sapiens
KDPDMKHKI

SEQ ID NO: 1124579 - protein, 9 aa, Homo Sapiens
CSRGARGAK

SEQ ID NO: 1124580 - protein, 9 aa, Homo Sapiens
TRFGGIGSS

SEQ ID NO: 1124581 - protein, 9 aa, Homo Sapiens
SRIPRGSYA

SEQ ID NO: 1124582 - protein, 9 aa, Homo Sapiens
NGYVPFYVN

SEQ ID NO: 1124583 - protein, 9 aa, Homo Sapiens
LASCSRGAR

SEQ ID NO: 1124584 - protein, 9 aa, Homo Sapiens
KIVNSFLIK

SEQ ID NO: 1124585 - protein, 9 aa, Homo Sapiens
VNGDPVKKA

SEQ ID NO: 1124586 - protein, 9 aa, Homo Sapiens
ARRRAALSP

SEQ ID NO: 1124587 - protein, 9 aa, Homo Sapiens
QKVCHRMND

SEQ ID NO: 1124588 - protein, 9 aa, Homo Sapiens
KGPHSYPVI

SEQ ID NO: 1124589 - protein, 9 aa, Homo Sapiens
RVGGLPKKS

SEQ ID NO: 1124590 - protein, 9 aa, Homo Sapiens
GSYAAWLSQ

SEQ ID NO: 1124591 - protein, 9 aa, Homo Sapiens
LQLHSLAHN

SEQ ID NO: 1124592 - protein, 9 aa, Homo Sapiens
PIIRQVILQ

SEQ ID NO: 1124593 - protein, 9 aa, Homo Sapiens
GMLNFLSLE

SEQ ID NO: 1124594 - protein, 9 aa, Homo Sapiens
FFVLVNLEV

SEQ ID NO: 1124595 - protein, 9 aa, Homo Sapiens
IEKIHRESF

SEQ ID NO: 1124596 - protein, 9 aa, Homo Sapiens
PTSVQESSR

SEQ ID NO: 1124597 - protein, 9 aa, Homo Sapiens
QPWQQCPLN

SEQ ID NO: 1124598 - protein, 9 aa, Homo Sapiens
MSKRYDGPQ

SEQ ID NO: 1124599 - protein, 9 aa, Homo Sapiens
KNRMERVKK

SEQ ID NO: 1124600 - protein, 9 aa, Homo Sapiens
SGTGEVRCH

SEQ ID NO: 1124601 - protein, 9 aa, Homo Sapiens
VQTLEKHGL

SEQ ID NO: 1124602 - protein, 9 aa, Homo Sapiens
PLIMQPPLD

SEQ ID NO: 1124603 - protein, 9 aa, Homo Sapiens
LHGKVGQCL

SEQ ID NO: 1124604 - protein, 9 aa, Homo Sapiens
VGGLPYHTI

SEQ ID NO: 1124605 - protein, 9 aa, Homo Sapiens
EELDAMIRK

SEQ ID NO: 1124606 - protein, 9 aa, Homo Sapiens
AYDCTIPPM

SEQ ID NO: 1124607 - protein, 9 aa, Homo Sapiens
RTLRCPTEP

SEQ ID NO: 1124608 - protein, 9 aa, Homo Sapiens
DSDAGRDGQ

SEQ ID NO: 1124609 - protein, 9 aa, Homo Sapiens
GKANTKKRH

SEQ ID NO: 1124610 - protein, 9 aa, Homo Sapiens
AISRIHLNH

SEQ ID NO: 1124611 - protein, 9 aa, Homo Sapiens
CWHRRLAPN

SEQ ID NO: 1124612 - protein, 9 aa, Homo Sapiens
ENKGRMLKL

SEQ ID NO: 1124613 - protein, 9 aa, Homo Sapiens
SEEPFPSTS

SEQ ID NO: 1124614 - protein, 9 aa, Homo Sapiens
GYRIYRCAH

SEQ ID NO: 1124615 - protein, 9 aa, Homo Sapiens
AASLPQLSP

SEQ ID NO: 1124616 - protein, 9 aa, Homo Sapiens
GKRKRKRRS

SEQ ID NO: 1124617 - protein, 9 aa, Homo Sapiens
FQYSSDSTN

SEQ ID NO: 1124618 - protein, 9 aa, Homo Sapiens
AWDAPCPLL

SEQ ID NO: 1124619 - protein, 9 aa, Homo Sapiens
GRHVVMNSR

SEQ ID NO: 1124620 - protein, 9 aa, Homo Sapiens
LKVCPVCQV

SEQ ID NO: 1124621 - protein, 9 aa, Homo Sapiens
TEQSLEAQV

SEQ ID NO: 1124622 - protein, 9 aa, Homo Sapiens
ECCAQGRKP

SEQ ID NO: 1124623 - protein, 9 aa, Homo Sapiens
ASSSPAPRG

SEQ ID NO: 1124624 - protein, 9 aa, Homo Sapiens
ASTKHCSIF

SEQ ID NO: 1124625 - protein, 9 aa, Homo Sapiens
QRCRDGALH

SEQ ID NO: 1124626 - protein, 9 aa, Homo Sapiens
SHGAGPAHP

SEQ ID NO: 1124627 - protein, 9 aa, Homo Sapiens
DVVLQDGDL

SEQ ID NO: 1124628 - protein, 9 aa, Homo Sapiens
GPSGTSRTR

SEQ ID NO: 1124629 - protein, 9 aa, Homo Sapiens
DGSVRMFVW

SEQ ID NO: 1124630 - protein, 9 aa, Homo Sapiens
PGICQLVWT

SEQ ID NO: 1124631 - protein, 9 aa, Homo Sapiens
LVQSFSGEV

SEQ ID NO: 1124632 - protein, 9 aa, Homo Sapiens
QKTKSSEDV

SEQ ID NO: 1124633 - protein, 9 aa, Homo Sapiens
VGSTDDDRM

SEQ ID NO: 1124634 - protein, 9 aa, Homo Sapiens
RNKKQLPYY

SEQ ID NO: 1124635 - protein, 9 aa, Homo Sapiens
KIYDSQPNF

SEQ ID NO: 1124636 - protein, 9 aa, Homo Sapiens
PGRPWPPSF

SEQ ID NO: 1124637 - protein, 9 aa, Homo Sapiens
ARARTEQGW

SEQ ID NO: 1124638 - protein, 9 aa, Homo Sapiens
AVFSGLICM

SEQ ID NO: 1124639 - protein, 9 aa, Homo Sapiens
ASPPRRWPP

SEQ ID NO: 1124640 - protein, 9 aa, Homo Sapiens
TITDYVSYT

SEQ ID NO: 1124641 - protein, 9 aa, Homo Sapiens
KAFTYDHSY

SEQ ID NO: 1124642 - protein, 9 aa, Homo Sapiens
QQQQRREDE

SEQ ID NO: 1124643 - protein, 9 aa, Homo Sapiens
CCLKTSCFK

SEQ ID NO: 1124644 - protein, 9 aa, Homo Sapiens
PLTYSNLHT

SEQ ID NO: 1124645 - protein, 9 aa, Homo Sapiens
AKEEATKKL

SEQ ID NO: 1124646 - protein, 9 aa, Homo Sapiens
QECDSSSSN

SEQ ID NO: 1124647 - protein, 9 aa, Homo Sapiens
DFKTDLCFQ

SEQ ID NO: 1124648 - protein, 9 aa, Homo Sapiens
SASGLVIST

SEQ ID NO: 1124649 - protein, 9 aa, Homo Sapiens
RDKHLRTTI

SEQ ID NO: 1124650 - protein, 9 aa, Homo Sapiens
YMKHKSREY

SEQ ID NO: 1124651 - protein, 9 aa, Homo Sapiens
SHPGELGWE

SEQ ID NO: 1124652 - protein, 9 aa, Homo Sapiens
YTAGVATDT

SEQ ID NO: 1124653 - protein, 9 aa, Homo Sapiens
GPQQALDLK

SEQ ID NO: 1124654 - protein, 9 aa, Homo Sapiens
EQSLEAQVN

SEQ ID NO: 1124655 - protein, 9 aa, Homo Sapiens
EGPGGHQED

SEQ ID NO: 1124656 - protein, 9 aa, Homo Sapiens
SARGGQSSL

SEQ ID NO: 1124657 - protein, 9 aa, Homo Sapiens
SPWSGLMSL

SEQ ID NO: 1124658 - protein, 9 aa, Homo Sapiens
HSVFGPARI

SEQ ID NO: 1124659 - protein, 9 aa, Homo Sapiens
GGEAVVAAA

SEQ ID NO: 1124660 - protein, 9 aa, Homo Sapiens
RPSLAPERG

SEQ ID NO: 1124661 - protein, 9 aa, Homo Sapiens
RNSGRSEVP

SEQ ID NO: 1124662 - protein, 9 aa, Homo Sapiens
DPVFLVFAK

SEQ ID NO: 1124663 - protein, 9 aa, Homo Sapiens
VAELVPVVE

SEQ ID NO: 1124664 - protein, 9 aa, Homo Sapiens
GEAVVAAAA

SEQ ID NO: 1124665 - protein, 9 aa, Homo Sapiens
EFLKVKARA

SEQ ID NO: 1124666 - protein, 9 aa, Homo Sapiens
PGEQQLNGN

SEQ ID NO: 1124667 - protein, 9 aa, Homo Sapiens
WRSTRRCPS

SEQ ID NO: 1124668 - protein, 9 aa, Homo Sapiens
STCGPTGPR

SEQ ID NO: 1124669 - protein, 9 aa, Homo Sapiens
NRQLLCGAL

SEQ ID NO: 1124670 - protein, 9 aa, Homo Sapiens
ENGKQLLYG

SEQ ID NO: 1124671 - protein, 9 aa, Homo Sapiens
PHWQDHITG

SEQ ID NO: 1124672 - protein, 9 aa, Homo Sapiens
MHNYFMLVK

SEQ ID NO: 1124673 - protein, 9 aa, Homo Sapiens
TRSDLEMQN

SEQ ID NO: 1124674 - protein, 9 aa, Homo Sapiens
DRRPRTSHI

SEQ ID NO: 1124675 - protein, 9 aa, Homo Sapiens
QATSELHQV

SEQ ID NO: 1124676 - protein, 9 aa, Homo Sapiens
VSTTSSQMW

SEQ ID NO: 1124677 - protein, 9 aa, Homo Sapiens
EVKYFPFGQ

SEQ ID NO: 1124678 - protein, 9 aa, Homo Sapiens
PARTLARPR

SEQ ID NO: 1124679 - protein, 9 aa, Homo Sapiens
RLHQLPRRP

SEQ ID NO: 1124680 - protein, 9 aa, Homo Sapiens
PERSRKENR

SEQ ID NO: 1124681 - protein, 9 aa, Homo Sapiens
CLRCLLYTL

SEQ ID NO: 1124682 - protein, 9 aa, Homo Sapiens
RSRTGSCPN

SEQ ID NO: 1124683 - protein, 9 aa, Homo Sapiens
FSSSQVPVQ

SEQ ID NO: 1124684 - protein, 9 aa, Homo Sapiens
AVNMLTHQE

SEQ ID NO: 1124685 - protein, 9 aa, Homo Sapiens
TLLEDQVRK

SEQ ID NO: 1124686 - protein, 9 aa, Homo Sapiens
VASSSMTTS

SEQ ID NO: 1124687 - protein, 9 aa, Homo Sapiens
ERNIFKDVL

SEQ ID NO: 1124688 - protein, 9 aa, Homo Sapiens
TLLRFPETH

SEQ ID NO: 1124689 - protein, 9 aa, Homo Sapiens
VDLLQDELA

SEQ ID NO: 1124690 - protein, 9 aa, Homo Sapiens
YSQCVTTMT

SEQ ID NO: 1124691 - protein, 9 aa, Homo Sapiens
ATQPVLEAG

SEQ ID NO: 1124692 - protein, 9 aa, Homo Sapiens
SRMLFPTSV

SEQ ID NO: 1124693 - protein, 9 aa, Homo Sapiens
GKWVLIGSL

SEQ ID NO: 1124694 - protein, 9 aa, Homo Sapiens
SNDCMRGSS

SEQ ID NO: 1124695 - protein, 9 aa, Homo Sapiens
NKVHTIPLR

SEQ ID NO: 1124696 - protein, 9 aa, Homo Sapiens
SIHVTFTKD

SEQ ID NO: 1124697 - protein, 9 aa, Homo Sapiens
DDGILSTFP

SEQ ID NO: 1124698 - protein, 9 aa, Homo Sapiens
ESGEFKLFM

SEQ ID NO: 1124699 - protein, 9 aa, Homo Sapiens
HPPPAAAGC

SEQ ID NO: 1124700 - protein, 9 aa, Homo Sapiens
PAALHTMPH

SEQ ID NO: 1124701 - protein, 9 aa, Homo Sapiens
LVVSHNGAT

SEQ ID NO: 1124702 - protein, 9 aa, Homo Sapiens
LSEVELLAF

SEQ ID NO: 1124703 - protein, 9 aa, Homo Sapiens
LHRAVRYAH

SEQ ID NO: 1124704 - protein, 9 aa, Homo Sapiens
YTLPQSYHA

SEQ ID NO: 1124705 - protein, 9 aa, Homo Sapiens
QSALIEGKN

SEQ ID NO: 1124706 - protein, 9 aa, Homo Sapiens
VAPASSFSS

SEQ ID NO: 1124707 - protein, 9 aa, Homo Sapiens
TWCLPPTTA

SEQ ID NO: 1124708 - protein, 9 aa, Homo Sapiens
KKILRSFMK

SEQ ID NO: 1124709 - protein, 9 aa, Homo Sapiens
MMAFRNVTV

SEQ ID NO: 1124710 - protein, 9 aa, Homo Sapiens
MVQLRKLLH

SEQ ID NO: 1124711 - protein, 9 aa, Homo Sapiens
LLTVMSFDH

SEQ ID NO: 1124712 - protein, 9 aa, Homo Sapiens
TITYRDSRF

SEQ ID NO: 1124713 - protein, 9 aa, Homo Sapiens
SEDVCKHGM

SEQ ID NO: 1124714 - protein, 9 aa, Homo Sapiens
PARETPTKL

SEQ ID NO: 1124715 - protein, 9 aa, Homo Sapiens
NCSRFTTIA

SEQ ID NO: 1124716 - protein, 9 aa, Homo Sapiens
LQTDGVPER

SEQ ID NO: 1124717 - protein, 9 aa, Homo Sapiens
RRHRHHGHK

SEQ ID NO: 1124718 - protein, 9 aa, Homo Sapiens
VSPLQSALQ

SEQ ID NO: 1124719 - protein, 9 aa, Homo Sapiens
IMKAFKLFD

SEQ ID NO: 1124720 - protein, 9 aa, Homo Sapiens
TVPAHRSIP

SEQ ID NO: 1124721 - protein, 9 aa, Homo Sapiens
KWFEHSAKQ

SEQ ID NO: 1124722 - protein, 9 aa, Homo Sapiens
VRTAYLDLL

SEQ ID NO: 1124723 - protein, 9 aa, Homo Sapiens
LRLPGGDPI

SEQ ID NO: 1124724 - protein, 9 aa, Homo Sapiens
AVRAESRQL

SEQ ID NO: 1124725 - protein, 9 aa, Homo Sapiens
LSDMAVLSV

SEQ ID NO: 1124726 - protein, 9 aa, Homo Sapiens
AHISPAILV

SEQ ID NO: 1124727 - protein, 9 aa, Homo Sapiens
QRRHGWNPR

SEQ ID NO: 1124728 - protein, 9 aa, Homo Sapiens
PVILAVSLE

SEQ ID NO: 1124729 - protein, 9 aa, Homo Sapiens
CRTPLASVQ

SEQ ID NO: 1124730 - protein, 9 aa, Homo Sapiens
TDTTILSGS

SEQ ID NO: 1124731 - protein, 9 aa, Homo Sapiens
CPTEPLGVE

SEQ ID NO: 1124732 - protein, 9 aa, Homo Sapiens
KLKPRGLFE

SEQ ID NO: 1124733 - protein, 9 aa, Homo Sapiens
FDYLQSILD

SEQ ID NO: 1124734 - protein, 9 aa, Homo Sapiens
CQLRHLESA

SEQ ID NO: 1124735 - protein, 9 aa, Homo Sapiens
AGAGPPTAA

SEQ ID NO: 1124736 - protein, 9 aa, Homo Sapiens
ASPHCEAIS

SEQ ID NO: 1124737 - protein, 9 aa, Homo Sapiens
ESGLVPAAA

SEQ ID NO: 1124738 - protein, 9 aa, Homo Sapiens
GWLTQMYFF

SEQ ID NO: 1124739 - protein, 9 aa, Homo Sapiens
RPGLQMQES

SEQ ID NO: 1124740 - protein, 9 aa, Homo Sapiens
LATYVFLVV

SEQ ID NO: 1124741 - protein, 9 aa, Homo Sapiens
GCAVPMPWG

SEQ ID NO: 1124742 - protein, 9 aa, Homo Sapiens
LKLCQQLLD

SEQ ID NO: 1124743 - protein, 9 aa, Homo Sapiens
AGGTRLTTV

SEQ ID NO: 1124744 - protein, 9 aa, Homo Sapiens
APRRTPMLR

SEQ ID NO: 1124745 - protein, 9 aa, Homo Sapiens
SLWVDVDLL

SEQ ID NO: 1124746 - protein, 9 aa, Homo Sapiens
SDQELYFFH

SEQ ID NO: 1124747 - protein, 9 aa, Homo Sapiens
KRIEATKKL

SEQ ID NO: 1124748 - protein, 9 aa, Homo Sapiens
GSLLKTLPQ

SEQ ID NO: 1124749 - protein, 9 aa, Homo Sapiens
EDVSSLALE

SEQ ID NO: 1124750 - protein, 9 aa, Homo Sapiens
HLFHELVQC

SEQ ID NO: 1124751 - protein, 9 aa, Homo Sapiens
YHVHCKGAT

SEQ ID NO: 1124752 - protein, 9 aa, Homo Sapiens
HLGPSRGGR

SEQ ID NO: 1124753 - protein, 9 aa, Homo Sapiens
PAHQPLGSM

SEQ ID NO: 1124754 - protein, 9 aa, Homo Sapiens
QKLQDERLL

SEQ ID NO: 1124755 - protein, 9 aa, Homo Sapiens
MATQARGSG

SEQ ID NO: 1124756 - protein, 9 aa, Homo Sapiens
GSTDDDRMV

SEQ ID NO: 1124757 - protein, 9 aa, Homo Sapiens
FGFAKCVKG

SEQ ID NO: 1124758 - protein, 9 aa, Homo Sapiens
ARKNSMIGL

SEQ ID NO: 1124759 - protein, 9 aa, Homo Sapiens
RGGTTIGEV

SEQ ID NO: 1124760 - protein, 9 aa, Homo Sapiens
SELPEHQTR

SEQ ID NO: 1124761 - protein, 9 aa, Homo Sapiens
TIKRPSPDE

SEQ ID NO: 1124762 - protein, 9 aa, Homo Sapiens
SAVARMCLH

SEQ ID NO: 1124763 - protein, 9 aa, Homo Sapiens
TKELTLEIE

SEQ ID NO: 1124764 - protein, 9 aa, Homo Sapiens
PSPTSERLT

SEQ ID NO: 1124765 - protein, 9 aa, Homo Sapiens
LLLDASCHP

SEQ ID NO: 1124766 - protein, 9 aa, Homo Sapiens
GSTETIEEV

SEQ ID NO: 1124767 - protein, 9 aa, Homo Sapiens
LYMKYIHPF

SEQ ID NO: 1124768 - protein, 9 aa, Homo Sapiens
HSFSGLVGL

SEQ ID NO: 1124769 - protein, 9 aa, Homo Sapiens
VWTRPQQLV

SEQ ID NO: 1124770 - protein, 9 aa, Homo Sapiens
RLWRMSPTD

SEQ ID NO: 1124771 - protein, 9 aa, Homo Sapiens
ITLDQHNGE

SEQ ID NO: 1124772 - protein, 9 aa, Homo Sapiens
LEEQQQQQE

SEQ ID NO: 1124773 - protein, 9 aa, Homo Sapiens
GPEIQEVLL

SEQ ID NO: 1124774 - protein, 9 aa, Homo Sapiens
PLRVLSFNI

SEQ ID NO: 1124775 - protein, 9 aa, Homo Sapiens
EDSVLLKRS

SEQ ID NO: 1124776 - protein, 9 aa, Homo Sapiens
LPQLSPTPS

SEQ ID NO: 1124777 - protein, 9 aa, Homo Sapiens
LATVMGNLL

SEQ ID NO: 1124778 - protein, 9 aa, Homo Sapiens
LTTAVTTTA

SEQ ID NO: 1124779 - protein, 9 aa, Homo Sapiens
PSPGRNSVA

SEQ ID NO: 1124780 - protein, 9 aa, Homo Sapiens
RRCNSINRN

SEQ ID NO: 1124781 - protein, 9 aa, Homo Sapiens
MFSYPIWQK

SEQ ID NO: 1124782 - protein, 9 aa, Homo Sapiens
ISPLRPEAP

SEQ ID NO: 1124783 - protein, 9 aa, Homo Sapiens
AAGCHPAVG

SEQ ID NO: 1124784 - protein, 9 aa, Homo Sapiens
PEAGHWRRC

SEQ ID NO: 1124785 - protein, 9 aa, Homo Sapiens
YVAQQAGTR

SEQ ID NO: 1124786 - protein, 9 aa, Homo Sapiens
RGVSIHRQL

SEQ ID NO: 1124787 - protein, 9 aa, Homo Sapiens
RQHLPWSIS

SEQ ID NO: 1124788 - protein, 9 aa, Homo Sapiens
HPWPPQASL

SEQ ID NO: 1124789 - protein, 9 aa, Homo Sapiens
TCLKPTACA

SEQ ID NO: 1124790 - protein, 9 aa, Homo Sapiens
QYFMCNNPE

SEQ ID NO: 1124791 - protein, 9 aa, Homo Sapiens
EDTLVHIWK

SEQ ID NO: 1124792 - protein, 9 aa, Homo Sapiens
SRTFMGQGA

SEQ ID NO: 1124793 - protein, 9 aa, Homo Sapiens
IARCLVQLS

SEQ ID NO: 1124794 - protein, 9 aa, Homo Sapiens
SWTHPLRMA

SEQ ID NO: 1124795 - protein, 9 aa, Homo Sapiens
VCSTITLCL

SEQ ID NO: 1124796 - protein, 9 aa, Homo Sapiens
GKEVGEALL

SEQ ID NO: 1124797 - protein, 9 aa, Homo Sapiens
MILELLTVA

SEQ ID NO: 1124798 - protein, 9 aa, Homo Sapiens
ECLAPLRLH

SEQ ID NO: 1124799 - protein, 9 aa, Homo Sapiens
REELQKKQE

SEQ ID NO: 1124800 - protein, 9 aa, Homo Sapiens
IFIYLPLMA

SEQ ID NO: 1124801 - protein, 9 aa, Homo Sapiens
DQVGLASTV

SEQ ID NO: 1124802 - protein, 9 aa, Homo Sapiens
PSMTSPFKQ

SEQ ID NO: 1124803 - protein, 9 aa, Homo Sapiens
EFYETARVN

SEQ ID NO: 1124804 - protein, 9 aa, Homo Sapiens
WVPLLLVLL

SEQ ID NO: 1124805 - protein, 9 aa, Homo Sapiens
DSESASSIG

SEQ ID NO: 1124806 - protein, 9 aa, Homo Sapiens
PQGSFFTGI

SEQ ID NO: 1124807 - protein, 9 aa, Homo Sapiens
TSTTAKKPA

SEQ ID NO: 1124808 - protein, 9 aa, Homo Sapiens
KSETPRGPL

SEQ ID NO: 1124809 - protein, 9 aa, Homo Sapiens
HASTSSVKT

SEQ ID NO: 1124810 - protein, 9 aa, Homo Sapiens
SCCLPGLTH

SEQ ID NO: 1124811 - protein, 9 aa, Homo Sapiens
LHPAPPCGP

SEQ ID NO: 1124812 - protein, 9 aa, Homo Sapiens
RTSRGQAQD

SEQ ID NO: 1124813 - protein, 9 aa, Homo Sapiens
RQSLKNLSW

SEQ ID NO: 1124814 - protein, 9 aa, Homo Sapiens
SRSRTFLDR

SEQ ID NO: 1124815 - protein, 9 aa, Homo Sapiens
LNEQWEEEW

SEQ ID NO: 1124816 - protein, 9 aa, Homo Sapiens
NVCLSKKFI

SEQ ID NO: 1124817 - protein, 9 aa, Homo Sapiens
AWSLSTGTR

SEQ ID NO: 1124818 - protein, 9 aa, Homo Sapiens
STVAYCYYL

SEQ ID NO: 1124819 - protein, 9 aa, Homo Sapiens
SDLCISIRQ

SEQ ID NO: 1124820 - protein, 9 aa, Homo Sapiens
KHGPPSSIR

SEQ ID NO: 1124821 - protein, 9 aa, Homo Sapiens
PYVLRFRNG

SEQ ID NO: 1124822 - protein, 9 aa, Homo Sapiens
TALCPFRDV

SEQ ID NO: 1124823 - protein, 9 aa, Homo Sapiens
TEAIKAFFQ

SEQ ID NO: 1124824 - protein, 9 aa, Homo Sapiens
QQVPFMAPG

SEQ ID NO: 1124825 - protein, 9 aa, Homo Sapiens
GRHRLCRGK

SEQ ID NO: 1124826 - protein, 9 aa, Homo Sapiens
KLKGPSEYV

SEQ ID NO: 1124827 - protein, 9 aa, Homo Sapiens
GKSMYYYIQ

SEQ ID NO: 1124828 - protein, 9 aa, Homo Sapiens
NNHTEAYNN

SEQ ID NO: 1124829 - protein, 9 aa, Homo Sapiens
LDVGLAHLV

SEQ ID NO: 1124830 - protein, 9 aa, Homo Sapiens
FRSSSCRSH

SEQ ID NO: 1124831 - protein, 9 aa, Homo Sapiens
PSPPLFQAG

SEQ ID NO: 1124832 - protein, 9 aa, Homo Sapiens
PKRMKGPAQ

SEQ ID NO: 1124833 - protein, 9 aa, Homo Sapiens
VMAAYPASH

SEQ ID NO: 1124834 - protein, 9 aa, Homo Sapiens
ASMTLPAPT

SEQ ID NO: 1124835 - protein, 9 aa, Homo Sapiens
DLELEHYDA

SEQ ID NO: 1124836 - protein, 9 aa, Homo Sapiens
PWANSSPTS

SEQ ID NO: 1124837 - protein, 9 aa, Homo Sapiens
FRLHCSMFF

SEQ ID NO: 1124838 - protein, 9 aa, Homo Sapiens
LTTRLHRLI

SEQ ID NO: 1124839 - protein, 9 aa, Homo Sapiens
VHVQPCFII

SEQ ID NO: 1124840 - protein, 9 aa, Homo Sapiens
PLPPYHSKP

SEQ ID NO: 1124841 - protein, 9 aa, Homo Sapiens
PTKKRGKSQ

SEQ ID NO: 1124842 - protein, 9 aa, Homo Sapiens
LGIHWQCGC

SEQ ID NO: 1124843 - protein, 9 aa, Homo Sapiens
APSAGRTSA

SEQ ID NO: 1124844 - protein, 9 aa, Homo Sapiens
DGLDLLQLP

SEQ ID NO: 1124845 - protein, 9 aa, Homo Sapiens
LETYDCQMN

SEQ ID NO: 1124846 - protein, 9 aa, Homo Sapiens
LHRYASFRN

SEQ ID NO: 1124847 - protein, 9 aa, Homo Sapiens
NSDNEVLLQ

SEQ ID NO: 1124848 - protein, 9 aa, Homo Sapiens
LFSLFGDVS

SEQ ID NO: 1124849 - protein, 9 aa, Homo Sapiens
QQVTVATAL

SEQ ID NO: 1124850 - protein, 9 aa, Homo Sapiens
LLCRETGEL

SEQ ID NO: 1124851 - protein, 9 aa, Homo Sapiens
RTKLEKALS

SEQ ID NO: 1124852 - protein, 9 aa, Homo Sapiens
LTHMCLAKN

SEQ ID NO: 1124853 - protein, 9 aa, Homo Sapiens
QIQLDDAVH

SEQ ID NO: 1124854 - protein, 9 aa, Homo Sapiens
RWNKKGEAK

SEQ ID NO: 1124855 - protein, 9 aa, Homo Sapiens
SSGEELNHR

SEQ ID NO: 1124856 - protein, 9 aa, Homo Sapiens
SRDKQVLEM

SEQ ID NO: 1124857 - protein, 9 aa, Homo Sapiens
ACNAKDVAV

SEQ ID NO: 1124858 - protein, 9 aa, Homo Sapiens
QQLHKNSQQ

SEQ ID NO: 1124859 - protein, 9 aa, Homo Sapiens
SAPTCQENL

SEQ ID NO: 1124860 - protein, 9 aa, Homo Sapiens
TSHISALIA

SEQ ID NO: 1124861 - protein, 9 aa, Homo Sapiens
LHTMPHLCP

SEQ ID NO: 1124862 - protein, 9 aa, Homo Sapiens
CVFRERAAR

SEQ ID NO: 1124863 - protein, 9 aa, Homo Sapiens
PPPANPQLL

SEQ ID NO: 1124864 - protein, 9 aa, Homo Sapiens
ESSALLSYE

SEQ ID NO: 1124865 - protein, 9 aa, Homo Sapiens
TVRVLSSMA

SEQ ID NO: 1124866 - protein, 9 aa, Homo Sapiens
AVVLYKWDH

SEQ ID NO: 1124867 - protein, 9 aa, Homo Sapiens
ATYTQLYTS

SEQ ID NO: 1124868 - protein, 9 aa, Homo Sapiens
GVEMLVENE

SEQ ID NO: 1124869 - protein, 9 aa, Homo Sapiens
RHRGTGPAH

SEQ ID NO: 1124870 - protein, 9 aa, Homo Sapiens
TVYHELVQP

SEQ ID NO: 1124871 - protein, 9 aa, Homo Sapiens
FTANSHLSP

SEQ ID NO: 1124872 - protein, 9 aa, Homo Sapiens
ATDFSQSTS

SEQ ID NO: 1124873 - protein, 9 aa, Homo Sapiens
AVREDNRHV

SEQ ID NO: 1124874 - protein, 9 aa, Homo Sapiens
NMLNLEVVL

SEQ ID NO: 1124875 - protein, 9 aa, Homo Sapiens
CLQVAVLII

SEQ ID NO: 1124876 - protein, 9 aa, Homo Sapiens
FQYRILRSQ

SEQ ID NO: 1124877 - protein, 9 aa, Homo Sapiens
HKVDPVYFK

SEQ ID NO: 1124878 - protein, 9 aa, Homo Sapiens
NEASVLLNL

SEQ ID NO: 1124879 - protein, 9 aa, Homo Sapiens
IILEKNPPL

SEQ ID NO: 1124880 - protein, 9 aa, Homo Sapiens
CLMSTMKIS

SEQ ID NO: 1124881 - protein, 9 aa, Homo Sapiens
IHQSLKAQN

SEQ ID NO: 1124882 - protein, 9 aa, Homo Sapiens
SLLDAANQC

SEQ ID NO: 1124883 - protein, 9 aa, Homo Sapiens
VAAKESQAS

SEQ ID NO: 1124884 - protein, 9 aa, Homo Sapiens
ICVVMAIFS

SEQ ID NO: 1124885 - protein, 9 aa, Homo Sapiens
TKATTKLSM

SEQ ID NO: 1124886 - protein, 9 aa, Homo Sapiens
LSVGFSVKE

SEQ ID NO: 1124887 - protein, 9 aa, Homo Sapiens
LHCSMFFSF

SEQ ID NO: 1124888 - protein, 9 aa, Homo Sapiens
EEEMEIAKK

SEQ ID NO: 1124889 - protein, 9 aa, Homo Sapiens
TAPRVKLME

SEQ ID NO: 1124890 - protein, 9 aa, Homo Sapiens
VRLSPVKMS

SEQ ID NO: 1124891 - protein, 9 aa, Homo Sapiens
GGHVQLLSR

SEQ ID NO: 1124892 - protein, 9 aa, Homo Sapiens
VILRDLLHF

SEQ ID NO: 1124893 - protein, 9 aa, Homo Sapiens
SIFRDDGDW

SEQ ID NO: 1124894 - protein, 9 aa, Homo Sapiens
GMSEIYRKD

SEQ ID NO: 1124895 - protein, 9 aa, Homo Sapiens
WAVESLDSP

SEQ ID NO: 1124896 - protein, 9 aa, Homo Sapiens
IHWNARIYY

SEQ ID NO: 1124897 - protein, 9 aa, Homo Sapiens
RRPLRRLGS

SEQ ID NO: 1124898 - protein, 9 aa, Homo Sapiens
KMHNYFMLV

SEQ ID NO: 1124899 - protein, 9 aa, Homo Sapiens
APVGSVMSC

SEQ ID NO: 1124900 - protein, 9 aa, Homo Sapiens
DGLGMIVQS

SEQ ID NO: 1124901 - protein, 9 aa, Homo Sapiens
HGERQSPDP

SEQ ID NO: 1124902 - protein, 9 aa, Homo Sapiens
WLLGPLKTE

SEQ ID NO: 1124903 - protein, 9 aa, Homo Sapiens
RDVMLENIN

SEQ ID NO: 1124904 - protein, 9 aa, Homo Sapiens
LGAPRPTWA

SEQ ID NO: 1124905 - protein, 9 aa, Homo Sapiens
GARLGAARS

SEQ ID NO: 1124906 - protein, 9 aa, Homo Sapiens
RSCKLLPDD

SEQ ID NO: 1124907 - protein, 9 aa, Homo Sapiens
TTVRKAKFC

SEQ ID NO: 1124908 - protein, 9 aa, Homo Sapiens
KASKEFTRR

SEQ ID NO: 1124909 - protein, 9 aa, Homo Sapiens
AATLRCPAV

SEQ ID NO: 1124910 - protein, 9 aa, Homo Sapiens
AKCVKGRTW

SEQ ID NO: 1124911 - protein, 9 aa, Homo Sapiens
NDTDEETMS

SEQ ID NO: 1124912 - protein, 9 aa, Homo Sapiens
AAASELEPL

SEQ ID NO: 1124913 - protein, 9 aa, Homo Sapiens
QVGFGPMLG

SEQ ID NO: 1124914 - protein, 9 aa, Homo Sapiens
GYCRCVLTF

SEQ ID NO: 1124915 - protein, 9 aa, Homo Sapiens
MVIPNAWGR

SEQ ID NO: 1124916 - protein, 9 aa, Homo Sapiens
RPHAWAPSW

SEQ ID NO: 1124917 - protein, 9 aa, Homo Sapiens
LIGKKFQNR

SEQ ID NO: 1124918 - protein, 9 aa, Homo Sapiens
LGPISCSGA

SEQ ID NO: 1124919 - protein, 9 aa, Homo Sapiens
TAASTQFST

SEQ ID NO: 1124920 - protein, 9 aa, Homo Sapiens
LPEYVVPCM

SEQ ID NO: 1124921 - protein, 9 aa, Homo Sapiens
GFGRCFQKY

SEQ ID NO: 1124922 - protein, 9 aa, Homo Sapiens
VVPTRHIRQ

SEQ ID NO: 1124923 - protein, 9 aa, Homo Sapiens
KVIDEIHRV

SEQ ID NO: 1124924 - protein, 9 aa, Homo Sapiens
ELRLLSLYR

SEQ ID NO: 1124925 - protein, 9 aa, Homo Sapiens
IRDIPSYTF

SEQ ID NO: 1124926 - protein, 9 aa, Homo Sapiens
YSVLEKGSV

SEQ ID NO: 1124927 - protein, 9 aa, Homo Sapiens
GSVCTRTQQ

SEQ ID NO: 1124928 - protein, 9 aa, Homo Sapiens
VPNNNERYY

SEQ ID NO: 1124929 - protein, 9 aa, Homo Sapiens
VAVSRGLPP

SEQ ID NO: 1124930 - protein, 9 aa, Homo Sapiens
PTAARPSAT

SEQ ID NO: 1124931 - protein, 9 aa, Homo Sapiens
KKNLYYLRQ

SEQ ID NO: 1124932 - protein, 9 aa, Homo Sapiens
EVRCHIHAC

SEQ ID NO: 1124933 - protein, 9 aa, Homo Sapiens
WVGQLTKRV

SEQ ID NO: 1124934 - protein, 9 aa, Homo Sapiens
SGTDGGGGA

SEQ ID NO: 1124935 - protein, 9 aa, Homo Sapiens
CTEDFDLET

SEQ ID NO: 1124936 - protein, 9 aa, Homo Sapiens
EPPCTRLHG

SEQ ID NO: 1124937 - protein, 9 aa, Homo Sapiens
PGKNKQTIF

SEQ ID NO: 1124938 - protein, 9 aa, Homo Sapiens
IRGKKQSPL

SEQ ID NO: 1124939 - protein, 9 aa, Homo Sapiens
LRDAFRELD

SEQ ID NO: 1124940 - protein, 9 aa, Homo Sapiens
LELGFTQRK

SEQ ID NO: 1124941 - protein, 9 aa, Homo Sapiens
MNSRLSVVH

SEQ ID NO: 1124942 - protein, 9 aa, Homo Sapiens
VAVHWRAMV

SEQ ID NO: 1124943 - protein, 9 aa, Homo Sapiens
PCLGSAEGA

SEQ ID NO: 1124944 - protein, 9 aa, Homo Sapiens
LAGFCAAGC

SEQ ID NO: 1124945 - protein, 9 aa, Homo Sapiens
SPSVSPASE

SEQ ID NO: 1124946 - protein, 9 aa, Homo Sapiens
PAVACRFHS

SEQ ID NO: 1124947 - protein, 9 aa, Homo Sapiens
PRTCCHRTP

SEQ ID NO: 1124948 - protein, 9 aa, Homo Sapiens
EFSRLRFWE

SEQ ID NO: 1124949 - protein, 9 aa, Homo Sapiens
VLPAWYALH

SEQ ID NO: 1124950 - protein, 9 aa, Homo Sapiens
SIHRQLLSK

SEQ ID NO: 1124951 - protein, 9 aa, Homo Sapiens
WVNVMFSFV

SEQ ID NO: 1124952 - protein, 9 aa, Homo Sapiens
DHWSSRYEY

SEQ ID NO: 1124953 - protein, 9 aa, Homo Sapiens
YALSNKNLL

SEQ ID NO: 1124954 - protein, 9 aa, Homo Sapiens
AVAGTASCL

SEQ ID NO: 1124955 - protein, 9 aa, Homo Sapiens
AEGRRRTVP

SEQ ID NO: 1124956 - protein, 9 aa, Homo Sapiens
GPDNSNIGT

SEQ ID NO: 1124957 - protein, 9 aa, Homo Sapiens
MGPQGPPEN

SEQ ID NO: 1124958 - protein, 9 aa, Homo Sapiens
EPSKEEGKP

SEQ ID NO: 1124959 - protein, 9 aa, Homo Sapiens
SSPIPRCVA

SEQ ID NO: 1124960 - protein, 9 aa, Homo Sapiens
YMRRAALAA

SEQ ID NO: 1124961 - protein, 9 aa, Homo Sapiens
HLASGTAGS

SEQ ID NO: 1124962 - protein, 9 aa, Homo Sapiens
CTASTATTR

SEQ ID NO: 1124963 - protein, 9 aa, Homo Sapiens
NNSYLKVLQ

SEQ ID NO: 1124964 - protein, 9 aa, Homo Sapiens
TVRKAKFCI

SEQ ID NO: 1124965 - protein, 9 aa, Homo Sapiens
LPDRLKWHL

SEQ ID NO: 1124966 - protein, 9 aa, Homo Sapiens
KLPSPPDPQ

SEQ ID NO: 1124967 - protein, 9 aa, Homo Sapiens
ATTKTLPFP

SEQ ID NO: 1124968 - protein, 9 aa, Homo Sapiens
SKNCRLPEI

SEQ ID NO: 1124969 - protein, 9 aa, Homo Sapiens
VLEKGSVTL

SEQ ID NO: 1124970 - protein, 9 aa, Homo Sapiens
VLPTMHYNM

SEQ ID NO: 1124971 - protein, 9 aa, Homo Sapiens
AVSSQPTSE

SEQ ID NO: 1124972 - protein, 9 aa, Homo Sapiens
PRYPLKYLI

SEQ ID NO: 1124973 - protein, 9 aa, Homo Sapiens
VQSFSGEVQ

SEQ ID NO: 1124974 - protein, 9 aa, Homo Sapiens
DVGTTQLLH

SEQ ID NO: 1124975 - protein, 9 aa, Homo Sapiens
NHRTEMKES

SEQ ID NO: 1124976 - protein, 9 aa, Homo Sapiens
TSCLRANYV

SEQ ID NO: 1124977 - protein, 9 aa, Homo Sapiens
YWAITVPID

SEQ ID NO: 1124978 - protein, 9 aa, Homo Sapiens
PAGLPRAPA

SEQ ID NO: 1124979 - protein, 9 aa, Homo Sapiens
SCASTGSST

SEQ ID NO: 1124980 - protein, 9 aa, Homo Sapiens
RPGRKHPPV

SEQ ID NO: 1124981 - protein, 9 aa, Homo Sapiens
DWKITFTVA

SEQ ID NO: 1124982 - protein, 9 aa, Homo Sapiens
MCKQKRREG

SEQ ID NO: 1124983 - protein, 9 aa, Homo Sapiens
DTKVGSELI

SEQ ID NO: 1124984 - protein, 9 aa, Homo Sapiens
PDKKSNPFI

SEQ ID NO: 1124985 - protein, 9 aa, Homo Sapiens
VILSSEVSP

SEQ ID NO: 1124986 - protein, 9 aa, Homo Sapiens
NEAMLLDTD

SEQ ID NO: 1124987 - protein, 9 aa, Homo Sapiens
HEHDQGHGH

SEQ ID NO: 1124988 - protein, 9 aa, Homo Sapiens
PTGTGPPAL

SEQ ID NO: 1124989 - protein, 9 aa, Homo Sapiens
GILSRNIPE

SEQ ID NO: 1124990 - protein, 9 aa, Homo Sapiens
GRAGAPAES

SEQ ID NO: 1124991 - protein, 9 aa, Homo Sapiens
YMGYDAFLG

SEQ ID NO: 1124992 - protein, 9 aa, Homo Sapiens
DGDYLNPPV

SEQ ID NO: 1124993 - protein, 9 aa, Homo Sapiens
QEQLYMRRA

SEQ ID NO: 1124994 - protein, 9 aa, Homo Sapiens
GASRRTASS

SEQ ID NO: 1124995 - protein, 9 aa, Homo Sapiens
LPQTHQKLK

SEQ ID NO: 1124996 - protein, 9 aa, Homo Sapiens
MSPNRGVLR

SEQ ID NO: 1124997 - protein, 9 aa, Homo Sapiens
FFIQDAYTQ

SEQ ID NO: 1124998 - protein, 9 aa, Homo Sapiens
VGAADGLDL

SEQ ID NO: 1124999 - protein, 9 aa, Homo Sapiens
SLTSEPGSA

SEQ ID NO: 1125000 - protein, 9 aa, Homo Sapiens
PDRPWGTGT

SEQ ID NO: 1125001 - protein, 9 aa, Homo Sapiens
SPFFATARE

SEQ ID NO: 1125002 - protein, 9 aa, Homo Sapiens
TEFVELGNI

SEQ ID NO: 1125003 - protein, 9 aa, Homo Sapiens
SPTSSPTAR

SEQ ID NO: 1125004 - protein, 9 aa, Homo Sapiens
RYFKKFMEK

SEQ ID NO: 1125005 - protein, 9 aa, Homo Sapiens
GIQFLIENG

SEQ ID NO: 1125006 - protein, 9 aa, Homo Sapiens
WRRPGPKEA

SEQ ID NO: 1125007 - protein, 9 aa, Homo Sapiens
PGTGERALP

SEQ ID NO: 1125008 - protein, 9 aa, Homo Sapiens
CFQKYGIGF

SEQ ID NO: 1125009 - protein, 9 aa, Homo Sapiens
ELSRSPRRS

SEQ ID NO: 1125010 - protein, 9 aa, Homo Sapiens
KKPIKKNPS

SEQ ID NO: 1125011 - protein, 9 aa, Homo Sapiens
LDSPMYWGS

SEQ ID NO: 1125012 - protein, 9 aa, Homo Sapiens
SCPNMTPRR

SEQ ID NO: 1125013 - protein, 9 aa, Homo Sapiens
TGERERLRE

SEQ ID NO: 1125014 - protein, 9 aa, Homo Sapiens
KTEAFTKSV

SEQ ID NO: 1125015 - protein, 9 aa, Homo Sapiens
TRCLRMRPP

SEQ ID NO: 1125016 - protein, 9 aa, Homo Sapiens
AREDTAEPF

SEQ ID NO: 1125017 - protein, 9 aa, Homo Sapiens
QKAVIQALR

SEQ ID NO: 1125018 - protein, 9 aa, Homo Sapiens
ENQHRSHEC

SEQ ID NO: 1125019 - protein, 9 aa, Homo Sapiens
HQTRLRNSC

SEQ ID NO: 1125020 - protein, 9 aa, Homo Sapiens
GNFLCLSTN

SEQ ID NO: 1125021 - protein, 9 aa, Homo Sapiens
GRSLCERHI

SEQ ID NO: 1125022 - protein, 9 aa, Homo Sapiens
RTRKQTKVL

SEQ ID NO: 1125023 - protein, 9 aa, Homo Sapiens
ELRSYMERI

SEQ ID NO: 1125024 - protein, 9 aa, Homo Sapiens
VSLAYTFET

SEQ ID NO: 1125025 - protein, 9 aa, Homo Sapiens
KVQDNNDNE

SEQ ID NO: 1125026 - protein, 9 aa, Homo Sapiens
GVTLGLTAA

SEQ ID NO: 1125027 - protein, 9 aa, Homo Sapiens
ILKDSTSSY

SEQ ID NO: 1125028 - protein, 9 aa, Homo Sapiens
HKWILQLMY

SEQ ID NO: 1125029 - protein, 9 aa, Homo Sapiens
TDQNYDYAS

SEQ ID NO: 1125030 - protein, 9 aa, Homo Sapiens
STVVGLTMV

SEQ ID NO: 1125031 - protein, 9 aa, Homo Sapiens
GTSRARRTN

SEQ ID NO: 1125032 - protein, 9 aa, Homo Sapiens
QGTHIRPSH

SEQ ID NO: 1125033 - protein, 9 aa, Homo Sapiens
EPFHKSCLE

SEQ ID NO: 1125034 - protein, 9 aa, Homo Sapiens
GFVNVSQRK

SEQ ID NO: 1125035 - protein, 9 aa, Homo Sapiens
AQLIMPLSE

SEQ ID NO: 1125036 - protein, 9 aa, Homo Sapiens
PRLERLYCQ

SEQ ID NO: 1125037 - protein, 9 aa, Homo Sapiens
SDLLGIHWQ

SEQ ID NO: 1125038 - protein, 9 aa, Homo Sapiens
EVVQVLLNA

SEQ ID NO: 1125039 - protein, 9 aa, Homo Sapiens
GGNPVAVAS

SEQ ID NO: 1125040 - protein, 9 aa, Homo Sapiens
FDNTFEMHD

SEQ ID NO: 1125041 - protein, 9 aa, Homo Sapiens
GPNVGCDVP

SEQ ID NO: 1125042 - protein, 9 aa, Homo Sapiens
PLPEHHSTA

SEQ ID NO: 1125043 - protein, 9 aa, Homo Sapiens
RHHQAWIGA

SEQ ID NO: 1125044 - protein, 9 aa, Homo Sapiens
FTAMAYDRY

SEQ ID NO: 1125045 - protein, 9 aa, Homo Sapiens
PPPSAPAMG

SEQ ID NO: 1125046 - protein, 9 aa, Homo Sapiens
TCEKPGQLN

SEQ ID NO: 1125047 - protein, 9 aa, Homo Sapiens
RDIPSYTFS

SEQ ID NO: 1125048 - protein, 9 aa, Homo Sapiens
AHSIVEYRE

SEQ ID NO: 1125049 - protein, 9 aa, Homo Sapiens
TACLLAECC

SEQ ID NO: 1125050 - protein, 9 aa, Homo Sapiens
KRLQPLWHV

SEQ ID NO: 1125051 - protein, 9 aa, Homo Sapiens
GYNLQVQGK

SEQ ID NO: 1125052 - protein, 9 aa, Homo Sapiens
CGEAFYGVS

SEQ ID NO: 1125053 - protein, 9 aa, Homo Sapiens
CRETGELVP

SEQ ID NO: 1125054 - protein, 9 aa, Homo Sapiens
PFFCSECGK

SEQ ID NO: 1125055 - protein, 9 aa, Homo Sapiens
TPPGAVLDP

SEQ ID NO: 1125056 - protein, 9 aa, Homo Sapiens
LLRDAEPGP

SEQ ID NO: 1125057 - protein, 9 aa, Homo Sapiens
TPFNESDFY

SEQ ID NO: 1125058 - protein, 9 aa, Homo Sapiens
VGVLRPSSP

SEQ ID NO: 1125059 - protein, 9 aa, Homo Sapiens
WPRMKSQPS

SEQ ID NO: 1125060 - protein, 9 aa, Homo Sapiens
PQGPVMAWT

SEQ ID NO: 1125061 - protein, 9 aa, Homo Sapiens
GEQGLPDPS

SEQ ID NO: 1125062 - protein, 9 aa, Homo Sapiens
KGEKLPEDL

SEQ ID NO: 1125063 - protein, 9 aa, Homo Sapiens
TSHAGKGLM

SEQ ID NO: 1125064 - protein, 9 aa, Homo Sapiens
KKRASSFDP

SEQ ID NO: 1125065 - protein, 9 aa, Homo Sapiens
LASREDFKQ

SEQ ID NO: 1125066 - protein, 9 aa, Homo Sapiens
KAAGVLEGG

SEQ ID NO: 1125067 - protein, 9 aa, Homo Sapiens
DGINTALCD

SEQ ID NO: 1125068 - protein, 9 aa, Homo Sapiens
MASSTWRST

SEQ ID NO: 1125069 - protein, 9 aa, Homo Sapiens
SATNPTWRR

SEQ ID NO: 1125070 - protein, 9 aa, Homo Sapiens
LCGLGFCPT

SEQ ID NO: 1125071 - protein, 9 aa, Homo Sapiens
GAQETESWI

SEQ ID NO: 1125072 - protein, 9 aa, Homo Sapiens
GRAPVSLER

SEQ ID NO: 1125073 - protein, 9 aa, Homo Sapiens
LSTPRDALL

SEQ ID NO: 1125074 - protein, 9 aa, Homo Sapiens
TVIRVLEQK

SEQ ID NO: 1125075 - protein, 9 aa, Homo Sapiens
EEWPVPWAG

SEQ ID NO: 1125076 - protein, 9 aa, Homo Sapiens
CRTHLKEYE

SEQ ID NO: 1125077 - protein, 9 aa, Homo Sapiens
LDEVLDRFP

SEQ ID NO: 1125078 - protein, 9 aa, Homo Sapiens
GTPSVWSPL

SEQ ID NO: 1125079 - protein, 9 aa, Homo Sapiens
QQNCMEKIV

SEQ ID NO: 1125080 - protein, 9 aa, Homo Sapiens
IHAIQNSFQ

SEQ ID NO: 1125081 - protein, 9 aa, Homo Sapiens
GPRVSQGYH

SEQ ID NO: 1125082 - protein, 9 aa, Homo Sapiens
GVLSLLLLL

SEQ ID NO: 1125083 - protein, 9 aa, Homo Sapiens
HAVYRRPPT

SEQ ID NO: 1125084 - protein, 9 aa, Homo Sapiens
VLTIIESEM

SEQ ID NO: 1125085 - protein, 9 aa, Homo Sapiens
TLPVSRCEN

SEQ ID NO: 1125086 - protein, 9 aa, Homo Sapiens
GEDDTDDLT

SEQ ID NO: 1125087 - protein, 9 aa, Homo Sapiens
PLSLPTRPR

SEQ ID NO: 1125088 - protein, 9 aa, Homo Sapiens
EMSLGPLRS

SEQ ID NO: 1125089 - protein, 9 aa, Homo Sapiens
GVLGHHTYG

SEQ ID NO: 1125090 - protein, 9 aa, Homo Sapiens
APDVVLRLS

SEQ ID NO: 1125091 - protein, 9 aa, Homo Sapiens
LPACSGTWC

SEQ ID NO: 1125092 - protein, 9 aa, Homo Sapiens
KYDVISVHG

SEQ ID NO: 1125093 - protein, 9 aa, Homo Sapiens
FSLLPTYLL

SEQ ID NO: 1125094 - protein, 9 aa, Homo Sapiens
AEKNFNTNL

SEQ ID NO: 1125095 - protein, 9 aa, Homo Sapiens
GSKASKEFT

SEQ ID NO: 1125096 - protein, 9 aa, Homo Sapiens
DESPGLYVF

SEQ ID NO: 1125097 - protein, 9 aa, Homo Sapiens
RAGKDPPAA

SEQ ID NO: 1125098 - protein, 9 aa, Homo Sapiens
IHPRPPPHT

SEQ ID NO: 1125099 - protein, 9 aa, Homo Sapiens
RSNMRMEHI

SEQ ID NO: 1125100 - protein, 9 aa, Homo Sapiens
GVTSCLREH

SEQ ID NO: 1125101 - protein, 9 aa, Homo Sapiens
GPNAGELPG

SEQ ID NO: 1125102 - protein, 9 aa, Homo Sapiens
RPEPGYERM

SEQ ID NO: 1125103 - protein, 9 aa, Homo Sapiens
VRTHSVVCM

SEQ ID NO: 1125104 - protein, 9 aa, Homo Sapiens
ERNGLHSVM

SEQ ID NO: 1125105 - protein, 9 aa, Homo Sapiens
APPHAEVTF

SEQ ID NO: 1125106 - protein, 9 aa, Homo Sapiens
IGIMHWLTE

SEQ ID NO: 1125107 - protein, 9 aa, Homo Sapiens
NLAARPPGE

SEQ ID NO: 1125108 - protein, 9 aa, Homo Sapiens
AVPSVARPS

SEQ ID NO: 1125109 - protein, 9 aa, Homo Sapiens
GEYSLLPEV

SEQ ID NO: 1125110 - protein, 9 aa, Homo Sapiens
NINHLVSLG

SEQ ID NO: 1125111 - protein, 9 aa, Homo Sapiens
WRARPAAAA

SEQ ID NO: 1125112 - protein, 9 aa, Homo Sapiens
PHLCSTGRK

SEQ ID NO: 1125113 - protein, 9 aa, Homo Sapiens
RLPDVGGGD

SEQ ID NO: 1125114 - protein, 9 aa, Homo Sapiens
DYLTAGTST

SEQ ID NO: 1125115 - protein, 9 aa, Homo Sapiens
SSPSPNWAD

SEQ ID NO: 1125116 - protein, 9 aa, Homo Sapiens
DGPVAAEAV

SEQ ID NO: 1125117 - protein, 9 aa, Homo Sapiens
AMLEGKMYI

SEQ ID NO: 1125118 - protein, 9 aa, Homo Sapiens
AQMGPKKNQ

SEQ ID NO: 1125119 - protein, 9 aa, Homo Sapiens
AGAMLEGKM

SEQ ID NO: 1125120 - protein, 9 aa, Homo Sapiens
SECGKIFNM

SEQ ID NO: 1125121 - protein, 9 aa, Homo Sapiens
ICSKCGKGF

SEQ ID NO: 1125122 - protein, 9 aa, Homo Sapiens
LIWQVFLKM

SEQ ID NO: 1125123 - protein, 9 aa, Homo Sapiens
HGGPPSSMP

SEQ ID NO: 1125124 - protein, 9 aa, Homo Sapiens
NQIMKRMCK

SEQ ID NO: 1125125 - protein, 9 aa, Homo Sapiens
FGEENTLMR

SEQ ID NO: 1125126 - protein, 9 aa, Homo Sapiens
YHPGHHGAD

SEQ ID NO: 1125127 - protein, 9 aa, Homo Sapiens
KYYAKKNLY

SEQ ID NO: 1125128 - protein, 9 aa, Homo Sapiens
MWICGSQIV

SEQ ID NO: 1125129 - protein, 9 aa, Homo Sapiens
HAWAPSWAC

SEQ ID NO: 1125130 - protein, 9 aa, Homo Sapiens
PVLGKLEMV

SEQ ID NO: 1125131 - protein, 9 aa, Homo Sapiens
DAQQPAKPP

SEQ ID NO: 1125132 - protein, 9 aa, Homo Sapiens
CPAKGADSF

SEQ ID NO: 1125133 - protein, 9 aa, Homo Sapiens
AGQREEDSE

SEQ ID NO: 1125134 - protein, 9 aa, Homo Sapiens
FFQKSGASV

SEQ ID NO: 1125135 - protein, 9 aa, Homo Sapiens
QRQQRQEAW

SEQ ID NO: 1125136 - protein, 9 aa, Homo Sapiens
EEAIIVEDE

SEQ ID NO: 1125137 - protein, 9 aa, Homo Sapiens
TFEEGLGHI

SEQ ID NO: 1125138 - protein, 9 aa, Homo Sapiens
VVSKKLTHM

SEQ ID NO: 1125139 - protein, 9 aa, Homo Sapiens
IVAGSTVGP

SEQ ID NO: 1125140 - protein, 9 aa, Homo Sapiens
AQGPEEGDV

SEQ ID NO: 1125141 - protein, 9 aa, Homo Sapiens
AQSPPHPRT

SEQ ID NO: 1125142 - protein, 9 aa, Homo Sapiens
WWHVGADAE

SEQ ID NO: 1125143 - protein, 9 aa, Homo Sapiens
PSRHRDYVC

SEQ ID NO: 1125144 - protein, 9 aa, Homo Sapiens
TTSSSGTSR

SEQ ID NO: 1125145 - protein, 9 aa, Homo Sapiens
YYSPYDQRE

SEQ ID NO: 1125146 - protein, 9 aa, Homo Sapiens
PPAAGRSPA

SEQ ID NO: 1125147 - protein, 9 aa, Homo Sapiens
ETHLGRLLL

SEQ ID NO: 1125148 - protein, 9 aa, Homo Sapiens
KLVATKLYK

SEQ ID NO: 1125149 - protein, 9 aa, Homo Sapiens
NGATYSTQV

SEQ ID NO: 1125150 - protein, 9 aa, Homo Sapiens
PWGAGGNWG

SEQ ID NO: 1125151 - protein, 9 aa, Homo Sapiens
GWPEEEEAE

SEQ ID NO: 1125152 - protein, 9 aa, Homo Sapiens
HGRVLFRPS

SEQ ID NO: 1125153 - protein, 9 aa, Homo Sapiens
PTWARTRSR

SEQ ID NO: 1125154 - protein, 9 aa, Homo Sapiens
LAKQGQWGP

SEQ ID NO: 1125155 - protein, 9 aa, Homo Sapiens
SPQKRVRSR

SEQ ID NO: 1125156 - protein, 9 aa, Homo Sapiens
KSHLLSNHQ

SEQ ID NO: 1125157 - protein, 9 aa, Homo Sapiens
WMNKKNEDL

SEQ ID NO: 1125158 - protein, 9 aa, Homo Sapiens
TPPTNALTL

SEQ ID NO: 1125159 - protein, 9 aa, Homo Sapiens
IAVLYLKKK

SEQ ID NO: 1125160 - protein, 9 aa, Homo Sapiens
QPLIMQPPL

SEQ ID NO: 1125161 - protein, 9 aa, Homo Sapiens
KALPFAQWD

SEQ ID NO: 1125162 - protein, 9 aa, Homo Sapiens
QRRGFAEGR

SEQ ID NO: 1125163 - protein, 9 aa, Homo Sapiens
APLTATDTT

SEQ ID NO: 1125164 - protein, 9 aa, Homo Sapiens
HQFGHTKVF

SEQ ID NO: 1125165 - protein, 9 aa, Homo Sapiens
CSLKILTTK

SEQ ID NO: 1125166 - protein, 9 aa, Homo Sapiens
QTKVVEKCG

SEQ ID NO: 1125167 - protein, 9 aa, Homo Sapiens
PLRPPPLSL

SEQ ID NO: 1125168 - protein, 9 aa, Homo Sapiens
SRPVCCPRA

SEQ ID NO: 1125169 - protein, 9 aa, Homo Sapiens
VLKSLYELV

SEQ ID NO: 1125170 - protein, 9 aa, Homo Sapiens
VGGQVGHGV

SEQ ID NO: 1125171 - protein, 9 aa, Homo Sapiens
FQAGTSLVQ

SEQ ID NO: 1125172 - protein, 9 aa, Homo Sapiens
FEKATDELQ

SEQ ID NO: 1125173 - protein, 9 aa, Homo Sapiens
VSTALMKLK

SEQ ID NO: 1125174 - protein, 9 aa, Homo Sapiens
ATLPCRRHC

SEQ ID NO: 1125175 - protein, 9 aa, Homo Sapiens
PTNALTLAQ

SEQ ID NO: 1125176 - protein, 9 aa, Homo Sapiens
RPPRSQPSL

SEQ ID NO: 1125177 - protein, 9 aa, Homo Sapiens
YLKKKGESQ

SEQ ID NO: 1125178 - protein, 9 aa, Homo Sapiens
SQSDPILGS

SEQ ID NO: 1125179 - protein, 9 aa, Homo Sapiens
AHNYLALRD

SEQ ID NO: 1125180 - protein, 9 aa, Homo Sapiens
DLCFQSSAV

SEQ ID NO: 1125181 - protein, 9 aa, Homo Sapiens
ETITSRDAT

SEQ ID NO: 1125182 - protein, 9 aa, Homo Sapiens
LECAGPKPA

SEQ ID NO: 1125183 - protein, 9 aa, Homo Sapiens
GGSGSGLRA

SEQ ID NO: 1125184 - protein, 9 aa, Homo Sapiens
CSFDNYEDT

SEQ ID NO: 1125185 - protein, 9 aa, Homo Sapiens
TNPTWRRTG

SEQ ID NO: 1125186 - protein, 9 aa, Homo Sapiens
HVQAAQFAK

SEQ ID NO: 1125187 - protein, 9 aa, Homo Sapiens
ISMDDDFQF

SEQ ID NO: 1125188 - protein, 9 aa, Homo Sapiens
QCLQLQEDV

SEQ ID NO: 1125189 - protein, 9 aa, Homo Sapiens
RCGGPRILL

SEQ ID NO: 1125190 - protein, 9 aa, Homo Sapiens
LGVRPLPPL

SEQ ID NO: 1125191 - protein, 9 aa, Homo Sapiens
PSILYVHKI

SEQ ID NO: 1125192 - protein, 9 aa, Homo Sapiens
MVEATRYCH

SEQ ID NO: 1125193 - protein, 9 aa, Homo Sapiens
TVTLEDGQI

SEQ ID NO: 1125194 - protein, 9 aa, Homo Sapiens
MYYLKEKHG

SEQ ID NO: 1125195 - protein, 9 aa, Homo Sapiens
DGALHEHGQ

SEQ ID NO: 1125196 - protein, 9 aa, Homo Sapiens
VGYGRSVSS

SEQ ID NO: 1125197 - protein, 9 aa, Homo Sapiens
RAISTFGTS

SEQ ID NO: 1125198 - protein, 9 aa, Homo Sapiens
YFRKHTGAK

SEQ ID NO: 1125199 - protein, 9 aa, Homo Sapiens
KTRPMSERL

SEQ ID NO: 1125200 - protein, 9 aa, Homo Sapiens
AGSTTLHTV

SEQ ID NO: 1125201 - protein, 9 aa, Homo Sapiens
ATFGRALLW

SEQ ID NO: 1125202 - protein, 9 aa, Homo Sapiens
TSFSCACAP

SEQ ID NO: 1125203 - protein, 9 aa, Homo Sapiens
SVGSQNDTY

SEQ ID NO: 1125204 - protein, 9 aa, Homo Sapiens
LPQFVPVLS

SEQ ID NO: 1125205 - protein, 9 aa, Homo Sapiens
NSAEGRKKG

SEQ ID NO: 1125206 - protein, 9 aa, Homo Sapiens
PPGKVVTVR

SEQ ID NO: 1125207 - protein, 9 aa, Homo Sapiens
DVEAWFNEK

SEQ ID NO: 1125208 - protein, 9 aa, Homo Sapiens
DPEAPLEGT

SEQ ID NO: 1125209 - protein, 9 aa, Homo Sapiens
KIEVNKNQS

SEQ ID NO: 1125210 - protein, 9 aa, Homo Sapiens
NLEYFSPAF

SEQ ID NO: 1125211 - protein, 9 aa, Homo Sapiens
FEKSKKYSG

SEQ ID NO: 1125212 - protein, 9 aa, Homo Sapiens
RMDYMKHKS

SEQ ID NO: 1125213 - protein, 9 aa, Homo Sapiens
RIPRWLPRL

SEQ ID NO: 1125214 - protein, 9 aa, Homo Sapiens
QNEEVSPQL

SEQ ID NO: 1125215 - protein, 9 aa, Homo Sapiens
ADPPNPARP

SEQ ID NO: 1125216 - protein, 9 aa, Homo Sapiens
SCGRVHHTV

SEQ ID NO: 1125217 - protein, 9 aa, Homo Sapiens
VLDPSLAST

SEQ ID NO: 1125218 - protein, 9 aa, Homo Sapiens
STLTGKILT

SEQ ID NO: 1125219 - protein, 9 aa, Homo Sapiens
EGVEAFFMN

SEQ ID NO: 1125220 - protein, 9 aa, Homo Sapiens
LRQLQVREH

SEQ ID NO: 1125221 - protein, 9 aa, Homo Sapiens
RGASTSSVT

SEQ ID NO: 1125222 - protein, 9 aa, Homo Sapiens
WPPSFSAPC

SEQ ID NO: 1125223 - protein, 9 aa, Homo Sapiens
HKHEHDQGH

SEQ ID NO: 1125224 - protein, 9 aa, Homo Sapiens
VYDREVQWA

SEQ ID NO: 1125225 - protein, 9 aa, Homo Sapiens
SSQEVILSS

SEQ ID NO: 1125226 - protein, 9 aa, Homo Sapiens
AVRVHVTSN

SEQ ID NO: 1125227 - protein, 9 aa, Homo Sapiens
PSWPWTRCL

SEQ ID NO: 1125228 - protein, 9 aa, Homo Sapiens
PCQRPQTGS

SEQ ID NO: 1125229 - protein, 9 aa, Homo Sapiens
FFHNQLPSL

SEQ ID NO: 1125230 - protein, 9 aa, Homo Sapiens
SNVTFSGPS

SEQ ID NO: 1125231 - protein, 9 aa, Homo Sapiens
QPVSFNGVR

SEQ ID NO: 1125232 - protein, 9 aa, Homo Sapiens
VISDERGWW

SEQ ID NO: 1125233 - protein, 9 aa, Homo Sapiens
VRNLTYMMT

SEQ ID NO: 1125234 - protein, 9 aa, Homo Sapiens
RTKKTSSCV

SEQ ID NO: 1125235 - protein, 9 aa, Homo Sapiens
KRVALGPGR

SEQ ID NO: 1125236 - protein, 9 aa, Homo Sapiens
DDAELATVQ

SEQ ID NO: 1125237 - protein, 9 aa, Homo Sapiens
VVQVLLNAG

SEQ ID NO: 1125238 - protein, 9 aa, Homo Sapiens
PATVLADNK

SEQ ID NO: 1125239 - protein, 9 aa, Homo Sapiens
ESRGSMSAR

SEQ ID NO: 1125240 - protein, 9 aa, Homo Sapiens
VLTLAPLGN

SEQ ID NO: 1125241 - protein, 9 aa, Homo Sapiens
AGCSIQEPG

SEQ ID NO: 1125242 - protein, 9 aa, Homo Sapiens
RLETYPDWF

SEQ ID NO: 1125243 - protein, 9 aa, Homo Sapiens
KVGVIEKRD

SEQ ID NO: 1125244 - protein, 9 aa, Homo Sapiens
GSQPSMTSP

SEQ ID NO: 1125245 - protein, 9 aa, Homo Sapiens
SMSARVTFR

SEQ ID NO: 1125246 - protein, 9 aa, Homo Sapiens
NMDHQANCL

SEQ ID NO: 1125247 - protein, 9 aa, Homo Sapiens
STFLKAQLV

SEQ ID NO: 1125248 - protein, 9 aa, Homo Sapiens
FCHLLDLPG

SEQ ID NO: 1125249 - protein, 9 aa, Homo Sapiens
AMGIPLEPT

SEQ ID NO: 1125250 - protein, 9 aa, Homo Sapiens
PWVRAKGPV

SEQ ID NO: 1125251 - protein, 9 aa, Homo Sapiens
PGGSWYCLT

SEQ ID NO: 1125252 - protein, 9 aa, Homo Sapiens
SRGGSDRTP

SEQ ID NO: 1125253 - protein, 9 aa, Homo Sapiens
MAKGVQKIP

SEQ ID NO: 1125254 - protein, 9 aa, Homo Sapiens
ELTEELGGL

SEQ ID NO: 1125255 - protein, 9 aa, Homo Sapiens
WTQTCPPKR

SEQ ID NO: 1125256 - protein, 9 aa, Homo Sapiens
GPRRTRPST

SEQ ID NO: 1125257 - protein, 9 aa, Homo Sapiens
CHIDNLHFS

SEQ ID NO: 1125258 - protein, 9 aa, Homo Sapiens
HLEVVEGVL

SEQ ID NO: 1125259 - protein, 9 aa, Homo Sapiens
SVLSLNITC

SEQ ID NO: 1125260 - protein, 9 aa, Homo Sapiens
TMHYNMGGI

SEQ ID NO: 1125261 - protein, 9 aa, Homo Sapiens
SEVGRRRRR

SEQ ID NO: 1125262 - protein, 9 aa, Homo Sapiens
TWYTETHAR

SEQ ID NO: 1125263 - protein, 9 aa, Homo Sapiens
FKLMMSSTN

SEQ ID NO: 1125264 - protein, 9 aa, Homo Sapiens
PVCQGQMAW

SEQ ID NO: 1125265 - protein, 9 aa, Homo Sapiens
PPAKILIIG

SEQ ID NO: 1125266 - protein, 9 aa, Homo Sapiens
RRHCPRCPA

SEQ ID NO: 1125267 - protein, 9 aa, Homo Sapiens
PSLDEGSIL

SEQ ID NO: 1125268 - protein, 9 aa, Homo Sapiens
VLIGSLLVG

SEQ ID NO: 1125269 - protein, 9 aa, Homo Sapiens
CGKIFNMKK

SEQ ID NO: 1125270 - protein, 9 aa, Homo Sapiens
GSVSDCSDD

SEQ ID NO: 1125271 - protein, 9 aa, Homo Sapiens
VKNVFFLVS

SEQ ID NO: 1125272 - protein, 9 aa, Homo Sapiens
KMGGPSTCS

SEQ ID NO: 1125273 - protein, 9 aa, Homo Sapiens
WMPYHLSTV

SEQ ID NO: 1125274 - protein, 9 aa, Homo Sapiens
VPVRSSMGD

SEQ ID NO: 1125275 - protein, 9 aa, Homo Sapiens
CSCGRPHAH

SEQ ID NO: 1125276 - protein, 9 aa, Homo Sapiens
RGAGAQPHL

SEQ ID NO: 1125277 - protein, 9 aa, Homo Sapiens
SDVFLCHHE

SEQ ID NO: 1125278 - protein, 9 aa, Homo Sapiens
AVFDGHGCV

SEQ ID NO: 1125279 - protein, 9 aa, Homo Sapiens
SQFLMAEKN

SEQ ID NO: 1125280 - protein, 9 aa, Homo Sapiens
GNTANVASR

SEQ ID NO: 1125281 - protein, 9 aa, Homo Sapiens
RFRVHGEPT

SEQ ID NO: 1125282 - protein, 9 aa, Homo Sapiens
AGILSRNIP

SEQ ID NO: 1125283 - protein, 9 aa, Homo Sapiens
IYLLYLQDM

SEQ ID NO: 1125284 - protein, 9 aa, Homo Sapiens
QERRRPKER

SEQ ID NO: 1125285 - protein, 9 aa, Homo Sapiens
LSMSGLTSG

SEQ ID NO: 1125286 - protein, 9 aa, Homo Sapiens
VATGVSYTL

SEQ ID NO: 1125287 - protein, 9 aa, Homo Sapiens
QDCDQVCDQ

SEQ ID NO: 1125288 - protein, 9 aa, Homo Sapiens
KWDHRAISI

SEQ ID NO: 1125289 - protein, 9 aa, Homo Sapiens
RWNQKGEET

SEQ ID NO: 1125290 - protein, 9 aa, Homo Sapiens
DAPAGPAHQ

SEQ ID NO: 1125291 - protein, 9 aa, Homo Sapiens
AGAGAKGPH

SEQ ID NO: 1125292 - protein, 9 aa, Homo Sapiens
RMKTPTVCG

SEQ ID NO: 1125293 - protein, 9 aa, Homo Sapiens
HSAWLTILE

SEQ ID NO: 1125294 - protein, 9 aa, Homo Sapiens
ECFPQAFFC

SEQ ID NO: 1125295 - protein, 9 aa, Homo Sapiens
PVLLQLLSF

SEQ ID NO: 1125296 - protein, 9 aa, Homo Sapiens
SSLPTQWGK

SEQ ID NO: 1125297 - protein, 9 aa, Homo Sapiens
LRVISDERG

SEQ ID NO: 1125298 - protein, 9 aa, Homo Sapiens
ACPVKQTCS

SEQ ID NO: 1125299 - protein, 9 aa, Homo Sapiens
NPDDFKMCV

SEQ ID NO: 1125300 - protein, 9 aa, Homo Sapiens
CECRPKKRT

SEQ ID NO: 1125301 - protein, 9 aa, Homo Sapiens
KLDCTDMFV

SEQ ID NO: 1125302 - protein, 9 aa, Homo Sapiens
LPTPQKFLD

SEQ ID NO: 1125303 - protein, 9 aa, Homo Sapiens
LLLMDAGAC

SEQ ID NO: 1125304 - protein, 9 aa, Homo Sapiens
LDTESFETI

SEQ ID NO: 1125305 - protein, 9 aa, Homo Sapiens
EGKMANFSF

SEQ ID NO: 1125306 - protein, 9 aa, Homo Sapiens
CASCPGPRR

SEQ ID NO: 1125307 - protein, 9 aa, Homo Sapiens
MKWKNDNKL

SEQ ID NO: 1125308 - protein, 9 aa, Homo Sapiens
NVSLQETSV

SEQ ID NO: 1125309 - protein, 9 aa, Homo Sapiens
RKHLNSHLS

SEQ ID NO: 1125310 - protein, 9 aa, Homo Sapiens
GAHRCRIPD

SEQ ID NO: 1125311 - protein, 9 aa, Homo Sapiens
STPRDALLT

SEQ ID NO: 1125312 - protein, 9 aa, Homo Sapiens
GEIYDDCIG

SEQ ID NO: 1125313 - protein, 9 aa, Homo Sapiens
REKCLTILK

SEQ ID NO: 1125314 - protein, 9 aa, Homo Sapiens
EPDAPLDHC

SEQ ID NO: 1125315 - protein, 9 aa, Homo Sapiens
LPPTTTPAL

SEQ ID NO: 1125316 - protein, 9 aa, Homo Sapiens
PPGPSRREP

SEQ ID NO: 1125317 - protein, 9 aa, Homo Sapiens
HRSFTTKQK

SEQ ID NO: 1125318 - protein, 9 aa, Homo Sapiens
HLLNRAGRW

SEQ ID NO: 1125319 - protein, 9 aa, Homo Sapiens
QPSPASACT

SEQ ID NO: 1125320 - protein, 9 aa, Homo Sapiens
MTYSYSNLP

SEQ ID NO: 1125321 - protein, 9 aa, Homo Sapiens
ICSLVRGTT

SEQ ID NO: 1125322 - protein, 9 aa, Homo Sapiens
PHICQRGPT

SEQ ID NO: 1125323 - protein, 9 aa, Homo Sapiens
LKKEGSWIQ

SEQ ID NO: 1125324 - protein, 9 aa, Homo Sapiens
PPLMDNGWA

SEQ ID NO: 1125325 - protein, 9 aa, Homo Sapiens
NFQRTTCHS

SEQ ID NO: 1125326 - protein, 9 aa, Homo Sapiens
NALTLAQWS

SEQ ID NO: 1125327 - protein, 9 aa, Homo Sapiens
STRAQAAPS

SEQ ID NO: 1125328 - protein, 9 aa, Homo Sapiens
DFTEFCNGT

SEQ ID NO: 1125329 - protein, 9 aa, Homo Sapiens
GQAAGRGGT

SEQ ID NO: 1125330 - protein, 9 aa, Homo Sapiens
CIPSTLMRR

SEQ ID NO: 1125331 - protein, 9 aa, Homo Sapiens
PPVPGDAPS

SEQ ID NO: 1125332 - protein, 9 aa, Homo Sapiens
SSYDGGSDV

SEQ ID NO: 1125333 - protein, 9 aa, Homo Sapiens
PLPDRADIS

SEQ ID NO: 1125334 - protein, 9 aa, Homo Sapiens
AVHAAGHVH

SEQ ID NO: 1125335 - protein, 9 aa, Homo Sapiens
QTRGRRCWR

SEQ ID NO: 1125336 - protein, 9 aa, Homo Sapiens
VVVPVPPLP

SEQ ID NO: 1125337 - protein, 9 aa, Homo Sapiens
KENNAIPQS

SEQ ID NO: 1125338 - protein, 9 aa, Homo Sapiens
LTTKNLLSY

SEQ ID NO: 1125339 - protein, 9 aa, Homo Sapiens
KSTKSIVIG

SEQ ID NO: 1125340 - protein, 9 aa, Homo Sapiens
FLHLDMRPF

SEQ ID NO: 1125341 - protein, 9 aa, Homo Sapiens
AINGKVFDA

SEQ ID NO: 1125342 - protein, 9 aa, Homo Sapiens
KKTHPCTML

SEQ ID NO: 1125343 - protein, 9 aa, Homo Sapiens
APSAVPSVA

SEQ ID NO: 1125344 - protein, 9 aa, Homo Sapiens
FVEDAFHGP

SEQ ID NO: 1125345 - protein, 9 aa, Homo Sapiens
VPIIRQVIL

SEQ ID NO: 1125346 - protein, 9 aa, Homo Sapiens
WGIRWTSSL

SEQ ID NO: 1125347 - protein, 9 aa, Homo Sapiens
EVADKGDAL

SEQ ID NO: 1125348 - protein, 9 aa, Homo Sapiens
IHSINPVRE

SEQ ID NO: 1125349 - protein, 9 aa, Homo Sapiens
SRYDRANTV

SEQ ID NO: 1125350 - protein, 9 aa, Homo Sapiens
ISQQLSLEL

SEQ ID NO: 1125351 - protein, 9 aa, Homo Sapiens
TEREYIQCL

SEQ ID NO: 1125352 - protein, 9 aa, Homo Sapiens
VGPARISMI

SEQ ID NO: 1125353 - protein, 9 aa, Homo Sapiens
AAEHRVPPF

SEQ ID NO: 1125354 - protein, 9 aa, Homo Sapiens
LGQVFATQP

SEQ ID NO: 1125355 - protein, 9 aa, Homo Sapiens
VAGPGPPPL

SEQ ID NO: 1125356 - protein, 9 aa, Homo Sapiens
DFSINFNED

SEQ ID NO: 1125357 - protein, 9 aa, Homo Sapiens
ITLCLHYRN

SEQ ID NO: 1125358 - protein, 9 aa, Homo Sapiens
EVGEALLYY

SEQ ID NO: 1125359 - protein, 9 aa, Homo Sapiens
RKRKRRSHW

SEQ ID NO: 1125360 - protein, 9 aa, Homo Sapiens
LIGSLLVGQ

SEQ ID NO: 1125361 - protein, 9 aa, Homo Sapiens
DPDMKHKIR

SEQ ID NO: 1125362 - protein, 9 aa, Homo Sapiens
EKGIEGVQG

SEQ ID NO: 1125363 - protein, 9 aa, Homo Sapiens
SGIMGAVVT

SEQ ID NO: 1125364 - protein, 9 aa, Homo Sapiens
SLRRRCLRL

SEQ ID NO: 1125365 - protein, 9 aa, Homo Sapiens
YADEAKKHS

SEQ ID NO: 1125366 - protein, 9 aa, Homo Sapiens
VQWALGAIL

SEQ ID NO: 1125367 - protein, 9 aa, Homo Sapiens
QIASTTHTS

SEQ ID NO: 1125368 - protein, 9 aa, Homo Sapiens
GKKMLSLTH

SEQ ID NO: 1125369 - protein, 9 aa, Homo Sapiens
AIVVFHCEF

SEQ ID NO: 1125370 - protein, 9 aa, Homo Sapiens
LMINLYHLS

SEQ ID NO: 1125371 - protein, 9 aa, Homo Sapiens
CTLICQVFQ

SEQ ID NO: 1125372 - protein, 9 aa, Homo Sapiens
RIVSTMSKY

SEQ ID NO: 1125373 - protein, 9 aa, Homo Sapiens
EEVLKWGEE

SEQ ID NO: 1125374 - protein, 9 aa, Homo Sapiens
RRRGQGAVW

SEQ ID NO: 1125375 - protein, 9 aa, Homo Sapiens
ALSDMAVLS

SEQ ID NO: 1125376 - protein, 9 aa, Homo Sapiens
LGCRKNKST

SEQ ID NO: 1125377 - protein, 9 aa, Homo Sapiens
REWLFAVFE

SEQ ID NO: 1125378 - protein, 9 aa, Homo Sapiens
CMERLQLQM

SEQ ID NO: 1125379 - protein, 9 aa, Homo Sapiens
TSGTAPSAV

SEQ ID NO: 1125380 - protein, 9 aa, Homo Sapiens
LLFPASGEM

SEQ ID NO: 1125381 - protein, 9 aa, Homo Sapiens
TRPLWSRLS

SEQ ID NO: 1125382 - protein, 9 aa, Homo Sapiens
VIRELAVRA

SEQ ID NO: 1125383 - protein, 9 aa, Homo Sapiens
LQINVCLSK

SEQ ID NO: 1125384 - protein, 9 aa, Homo Sapiens
DAFRELDTN

SEQ ID NO: 1125385 - protein, 9 aa, Homo Sapiens
APPPSAPAM

SEQ ID NO: 1125386 - protein, 9 aa, Homo Sapiens
SRCRPHAWA

SEQ ID NO: 1125387 - protein, 9 aa, Homo Sapiens
LIQKKQLAL

SEQ ID NO: 1125388 - protein, 9 aa, Homo Sapiens
FLFFVKSWN

SEQ ID NO: 1125389 - protein, 9 aa, Homo Sapiens
CSAHRGRTG

SEQ ID NO: 1125390 - protein, 9 aa, Homo Sapiens
CKLLVAGNR

SEQ ID NO: 1125391 - protein, 9 aa, Homo Sapiens
APGRGAAVG

SEQ ID NO: 1125392 - protein, 9 aa, Homo Sapiens
HSIRNTSYD

SEQ ID NO: 1125393 - protein, 9 aa, Homo Sapiens
EHHIQESVL

SEQ ID NO: 1125394 - protein, 9 aa, Homo Sapiens
RHPSWPWTR

SEQ ID NO: 1125395 - protein, 9 aa, Homo Sapiens
PPTVALLQA

SEQ ID NO: 1125396 - protein, 9 aa, Homo Sapiens
NEVLLQELS

SEQ ID NO: 1125397 - protein, 9 aa, Homo Sapiens
IGATTPPIG

SEQ ID NO: 1125398 - protein, 9 aa, Homo Sapiens
AHGPRTDRL

SEQ ID NO: 1125399 - protein, 9 aa, Homo Sapiens
RMVLQKAVE

SEQ ID NO: 1125400 - protein, 9 aa, Homo Sapiens
LARSDTAQI

SEQ ID NO: 1125401 - protein, 9 aa, Homo Sapiens
VYFSLVHGL

SEQ ID NO: 1125402 - protein, 9 aa, Homo Sapiens
HPRTQGHWH

SEQ ID NO: 1125403 - protein, 9 aa, Homo Sapiens
RRSVRPSTR

SEQ ID NO: 1125404 - protein, 9 aa, Homo Sapiens
HSRQGSGSR

SEQ ID NO: 1125405 - protein, 9 aa, Homo Sapiens
RDEVVSPLQ

SEQ ID NO: 1125406 - protein, 9 aa, Homo Sapiens
GVSWSTVRY

SEQ ID NO: 1125407 - protein, 9 aa, Homo Sapiens
TTITTTTMG

SEQ ID NO: 1125408 - protein, 9 aa, Homo Sapiens
RGWWKAISL

SEQ ID NO: 1125409 - protein, 9 aa, Homo Sapiens
VCFGRHVVM

SEQ ID NO: 1125410 - protein, 9 aa, Homo Sapiens
AVAASSVVR

SEQ ID NO: 1125411 - protein, 9 aa, Homo Sapiens
PDPFPLDVC

SEQ ID NO: 1125412 - protein, 9 aa, Homo Sapiens
ATVLTYGQT

SEQ ID NO: 1125413 - protein, 9 aa, Homo Sapiens
MMSNGCWGW

SEQ ID NO: 1125414 - protein, 9 aa, Homo Sapiens
ITDIRKYKV

SEQ ID NO: 1125415 - protein, 9 aa, Homo Sapiens
ENIRFVFHA

SEQ ID NO: 1125416 - protein, 9 aa, Homo Sapiens
KCFSQCSNL

SEQ ID NO: 1125417 - protein, 9 aa, Homo Sapiens
PCDFTSNVN

SEQ ID NO: 1125418 - protein, 9 aa, Homo Sapiens
LSEDDNDVA

SEQ ID NO: 1125419 - protein, 9 aa, Homo Sapiens
LSLELNTVS

SEQ ID NO: 1125420 - protein, 9 aa, Homo Sapiens
TANSHLSPE

SEQ ID NO: 1125421 - protein, 9 aa, Homo Sapiens
LTGYRIYRC

SEQ ID NO: 1125422 - protein, 9 aa, Homo Sapiens
TGVLYALQT

SEQ ID NO: 1125423 - protein, 9 aa, Homo Sapiens
DNKCHFRAK

SEQ ID NO: 1125424 - protein, 9 aa, Homo Sapiens
RIGGGTPLS

SEQ ID NO: 1125425 - protein, 9 aa, Homo Sapiens
AALLAGPRH

SEQ ID NO: 1125426 - protein, 9 aa, Homo Sapiens
SPMVMSNQK

SEQ ID NO: 1125427 - protein, 9 aa, Homo Sapiens
TFPFLIAVM

SEQ ID NO: 1125428 - protein, 9 aa, Homo Sapiens
LIILTADRS

SEQ ID NO: 1125429 - protein, 9 aa, Homo Sapiens
SGPLAANGP

SEQ ID NO: 1125430 - protein, 9 aa, Homo Sapiens
QEEPPLMDN

SEQ ID NO: 1125431 - protein, 9 aa, Homo Sapiens
LLPTLSLRR

SEQ ID NO: 1125432 - protein, 9 aa, Homo Sapiens
STCGRRTRK

SEQ ID NO: 1125433 - protein, 9 aa, Homo Sapiens
SRSSSPPST

SEQ ID NO: 1125434 - protein, 9 aa, Homo Sapiens
HLTDGSNKR

SEQ ID NO: 1125435 - protein, 9 aa, Homo Sapiens
KFKQHTIRA

SEQ ID NO: 1125436 - protein, 9 aa, Homo Sapiens
TGYSDGSKD

SEQ ID NO: 1125437 - protein, 9 aa, Homo Sapiens
EKDFICLDY

SEQ ID NO: 1125438 - protein, 9 aa, Homo Sapiens
VTTGTLGVG

SEQ ID NO: 1125439 - protein, 9 aa, Homo Sapiens
SSAASACAT

SEQ ID NO: 1125440 - protein, 9 aa, Homo Sapiens
TTRFYFKEI

SEQ ID NO: 1125441 - protein, 9 aa, Homo Sapiens
DLDSFLKSA

SEQ ID NO: 1125442 - protein, 9 aa, Homo Sapiens
AISKKAKAS

SEQ ID NO: 1125443 - protein, 9 aa, Homo Sapiens
TTTVQVLMM

SEQ ID NO: 1125444 - protein, 9 aa, Homo Sapiens
DQREFTAGF

SEQ ID NO: 1125445 - protein, 9 aa, Homo Sapiens
GRVHHTVPE

SEQ ID NO: 1125446 - protein, 9 aa, Homo Sapiens
RHPLGSQCV

SEQ ID NO: 1125447 - protein, 9 aa, Homo Sapiens
SCSQGPPVQ

SEQ ID NO: 1125448 - protein, 9 aa, Homo Sapiens
VDDDYSRAQ

SEQ ID NO: 1125449 - protein, 9 aa, Homo Sapiens
ARHSVVFSA

SEQ ID NO: 1125450 - protein, 9 aa, Homo Sapiens
PPSAVARMC

SEQ ID NO: 1125451 - protein, 9 aa, Homo Sapiens
LLDTHFELP

SEQ ID NO: 1125452 - protein, 9 aa, Homo Sapiens
CSQTRPLWS

SEQ ID NO: 1125453 - protein, 9 aa, Homo Sapiens
LFRRIAWIK

SEQ ID NO: 1125454 - protein, 9 aa, Homo Sapiens
SLQDAQCLF

SEQ ID NO: 1125455 - protein, 9 aa, Homo Sapiens
AIRLKVCPV

SEQ ID NO: 1125456 - protein, 9 aa, Homo Sapiens
TLLQTRQAD

SEQ ID NO: 1125457 - protein, 9 aa, Homo Sapiens
AVGAGAGLG

SEQ ID NO: 1125458 - protein, 9 aa, Homo Sapiens
LGTVAGATA

SEQ ID NO: 1125459 - protein, 9 aa, Homo Sapiens
TGSCPNMTP

SEQ ID NO: 1125460 - protein, 9 aa, Homo Sapiens
ARTRGAPAP

SEQ ID NO: 1125461 - protein, 9 aa, Homo Sapiens
TLHTVEKLQ

SEQ ID NO: 1125462 - protein, 9 aa, Homo Sapiens
VATQNPPGA

SEQ ID NO: 1125463 - protein, 9 aa, Homo Sapiens
VEEKPAHNY

SEQ ID NO: 1125464 - protein, 9 aa, Homo Sapiens
ELDAMIRKA

SEQ ID NO: 1125465 - protein, 9 aa, Homo Sapiens
TSAHPSRPC

SEQ ID NO: 1125466 - protein, 9 aa, Homo Sapiens
SIVIGPLDF

SEQ ID NO: 1125467 - protein, 9 aa, Homo Sapiens
LRALGTRSL

SEQ ID NO: 1125468 - protein, 9 aa, Homo Sapiens
LDSALVFKK

SEQ ID NO: 1125469 - protein, 9 aa, Homo Sapiens
SDEDSTWEP

SEQ ID NO: 1125470 - protein, 9 aa, Homo Sapiens
VLGPQPHFP

SEQ ID NO: 1125471 - protein, 9 aa, Homo Sapiens
TVEWGAGRG

SEQ ID NO: 1125472 - protein, 9 aa, Homo Sapiens
YTTNKVHTI

SEQ ID NO: 1125473 - protein, 9 aa, Homo Sapiens
SGSHCPRAA

SEQ ID NO: 1125474 - protein, 9 aa, Homo Sapiens
GFGGKEARS

SEQ ID NO: 1125475 - protein, 9 aa, Homo Sapiens
TQARSPSSA

SEQ ID NO: 1125476 - protein, 9 aa, Homo Sapiens
NFDSPVRNQ

SEQ ID NO: 1125477 - protein, 9 aa, Homo Sapiens
KQTKVLWPL

SEQ ID NO: 1125478 - protein, 9 aa, Homo Sapiens
ILFPPLIIQ

SEQ ID NO: 1125479 - protein, 9 aa, Homo Sapiens
GSSEADQVG

SEQ ID NO: 1125480 - protein, 9 aa, Homo Sapiens
SKPGHKTNQ

SEQ ID NO: 1125481 - protein, 9 aa, Homo Sapiens
AQWSPVIAA

SEQ ID NO: 1125482 - protein, 9 aa, Homo Sapiens
SMLTWLVFL

SEQ ID NO: 1125483 - protein, 9 aa, Homo Sapiens
QRLWFQSVL

SEQ ID NO: 1125484 - protein, 9 aa, Homo Sapiens
QQSWEIVME

SEQ ID NO: 1125485 - protein, 9 aa, Homo Sapiens
EVGGQVAVG

SEQ ID NO: 1125486 - protein, 9 aa, Homo Sapiens
AFQLTPYSW

SEQ ID NO: 1125487 - protein, 9 aa, Homo Sapiens
AIVSKRHHE

SEQ ID NO: 1125488 - protein, 9 aa, Homo Sapiens
KRQSLKNLS

SEQ ID NO: 1125489 - protein, 9 aa, Homo Sapiens
RPACTCISM

SEQ ID NO: 1125490 - protein, 9 aa, Homo Sapiens
QSGTIMMSS

SEQ ID NO: 1125491 - protein, 9 aa, Homo Sapiens
SSGELNCYD

SEQ ID NO: 1125492 - protein, 9 aa, Homo Sapiens
FAQRERPGV

SEQ ID NO: 1125493 - protein, 9 aa, Homo Sapiens
GALTGRSPC

SEQ ID NO: 1125494 - protein, 9 aa, Homo Sapiens
NTVSKRASR

SEQ ID NO: 1125495 - protein, 9 aa, Homo Sapiens
HPCPRPPRS

SEQ ID NO: 1125496 - protein, 9 aa, Homo Sapiens
PRHRFLCGG

SEQ ID NO: 1125497 - protein, 9 aa, Homo Sapiens
PTTTTSSPR

SEQ ID NO: 1125498 - protein, 9 aa, Homo Sapiens
SSTLACSRN

SEQ ID NO: 1125499 - protein, 9 aa, Homo Sapiens
SAGYHLGSP

SEQ ID NO: 1125500 - protein, 9 aa, Homo Sapiens
VQTYLTVCK

SEQ ID NO: 1125501 - protein, 9 aa, Homo Sapiens
TKTLPFPSR

SEQ ID NO: 1125502 - protein, 9 aa, Homo Sapiens
MPYEIKVQA

SEQ ID NO: 1125503 - protein, 9 aa, Homo Sapiens
TFNKIRLDQ

SEQ ID NO: 1125504 - protein, 9 aa, Homo Sapiens
LVVEYRAIS

SEQ ID NO: 1125505 - protein, 9 aa, Homo Sapiens
HGELGRPLY

SEQ ID NO: 1125506 - protein, 9 aa, Homo Sapiens
VMSGGGPSW

SEQ ID NO: 1125507 - protein, 9 aa, Homo Sapiens
AIRIGMYML

SEQ ID NO: 1125508 - protein, 9 aa, Homo Sapiens
SHRELLAGF

SEQ ID NO: 1125509 - protein, 9 aa, Homo Sapiens
RHCLHPQSR

SEQ ID NO: 1125510 - protein, 9 aa, Homo Sapiens
QSCSPSPRY

SEQ ID NO: 1125511 - protein, 9 aa, Homo Sapiens
HRTGESRHK

SEQ ID NO: 1125512 - protein, 9 aa, Homo Sapiens
VLGRNLPGE

SEQ ID NO: 1125513 - protein, 9 aa, Homo Sapiens
PSFIPHEVK

SEQ ID NO: 1125514 - protein, 9 aa, Homo Sapiens
MCEHLRRCN

SEQ ID NO: 1125515 - protein, 9 aa, Homo Sapiens
QCGCVDDFG

SEQ ID NO: 1125516 - protein, 9 aa, Homo Sapiens
AGPAAPRPH

SEQ ID NO: 1125517 - protein, 9 aa, Homo Sapiens
WSSRYEYLS

SEQ ID NO: 1125518 - protein, 9 aa, Homo Sapiens
GAYPNTGPR

SEQ ID NO: 1125519 - protein, 9 aa, Homo Sapiens
VGGELRAGD

SEQ ID NO: 1125520 - protein, 9 aa, Homo Sapiens
IIMHLTLQL

SEQ ID NO: 1125521 - protein, 9 aa, Homo Sapiens
QTIQILTCQ

SEQ ID NO: 1125522 - protein, 9 aa, Homo Sapiens
RAHMRVLSK

SEQ ID NO: 1125523 - protein, 9 aa, Homo Sapiens
GGSQPSMTS

SEQ ID NO: 1125524 - protein, 9 aa, Homo Sapiens
AEKEEWHTA

SEQ ID NO: 1125525 - protein, 9 aa, Homo Sapiens
PDMKHKIRK

SEQ ID NO: 1125526 - protein, 9 aa, Homo Sapiens
GTAPDMKSY

SEQ ID NO: 1125527 - protein, 9 aa, Homo Sapiens
TMGAICPLL

SEQ ID NO: 1125528 - protein, 9 aa, Homo Sapiens
FYFKEILPP

SEQ ID NO: 1125529 - protein, 9 aa, Homo Sapiens
DDVLHRYAS

SEQ ID NO: 1125530 - protein, 9 aa, Homo Sapiens
EPPLLVLGW

SEQ ID NO: 1125531 - protein, 9 aa, Homo Sapiens
AEQQLEFLN

SEQ ID NO: 1125532 - protein, 9 aa, Homo Sapiens
KRNNMSAPD

SEQ ID NO: 1125533 - protein, 9 aa, Homo Sapiens
RLDLGVHGE

SEQ ID NO: 1125534 - protein, 9 aa, Homo Sapiens
RAVAHSIVE

SEQ ID NO: 1125535 - protein, 9 aa, Homo Sapiens
PSSQLWRWK

SEQ ID NO: 1125536 - protein, 9 aa, Homo Sapiens
IPDCFSRSR

SEQ ID NO: 1125537 - protein, 9 aa, Homo Sapiens
KFIAGFWTI

SEQ ID NO: 1125538 - protein, 9 aa, Homo Sapiens
PGSEASTRP

SEQ ID NO: 1125539 - protein, 9 aa, Homo Sapiens
AVECAGRHR

SEQ ID NO: 1125540 - protein, 9 aa, Homo Sapiens
PLNTNIRLV

SEQ ID NO: 1125541 - protein, 9 aa, Homo Sapiens
SMEFLQQED

SEQ ID NO: 1125542 - protein, 9 aa, Homo Sapiens
CMDEAGRNI

SEQ ID NO: 1125543 - protein, 9 aa, Homo Sapiens
DDILRGELQ

SEQ ID NO: 1125544 - protein, 9 aa, Homo Sapiens
KSGELLVKN

SEQ ID NO: 1125545 - protein, 9 aa, Homo Sapiens
VTRCIIEVI

SEQ ID NO: 1125546 - protein, 9 aa, Homo Sapiens
PRSTPKDPC

SEQ ID NO: 1125547 - protein, 9 aa, Homo Sapiens
KKYSSCLKD

SEQ ID NO: 1125548 - protein, 9 aa, Homo Sapiens
GTIKLTPGL

SEQ ID NO: 1125549 - protein, 9 aa, Homo Sapiens
SKEEGKPKK

SEQ ID NO: 1125550 - protein, 9 aa, Homo Sapiens
YAWVPIRST

SEQ ID NO: 1125551 - protein, 9 aa, Homo Sapiens
LVCCPGPLD

SEQ ID NO: 1125552 - protein, 9 aa, Homo Sapiens
NPASTSGVF

SEQ ID NO: 1125553 - protein, 9 aa, Homo Sapiens
SLETHLKQT

SEQ ID NO: 1125554 - protein, 9 aa, Homo Sapiens
DSALRDLWT

SEQ ID NO: 1125555 - protein, 9 aa, Homo Sapiens
KAFQEKHPF

SEQ ID NO: 1125556 - protein, 9 aa, Homo Sapiens
SLLLLPHSR

SEQ ID NO: 1125557 - protein, 9 aa, Homo Sapiens
AHCYPDTLQ

SEQ ID NO: 1125558 - protein, 9 aa, Homo Sapiens
AKGPVLLGF

SEQ ID NO: 1125559 - protein, 9 aa, Homo Sapiens
SAFIKKHEE

SEQ ID NO: 1125560 - protein, 9 aa, Homo Sapiens
QIELGWRDS

SEQ ID NO: 1125561 - protein, 9 aa, Homo Sapiens
GTLPAPSSC

SEQ ID NO: 1125562 - protein, 9 aa, Homo Sapiens
FEEEDLDGI

SEQ ID NO: 1125563 - protein, 9 aa, Homo Sapiens
PDTTHPTCI

SEQ ID NO: 1125564 - protein, 9 aa, Homo Sapiens
PLWSRLSLL

SEQ ID NO: 1125565 - protein, 9 aa, Homo Sapiens
ASPCCLQAL

SEQ ID NO: 1125566 - protein, 9 aa, Homo Sapiens
MPRARDALC

SEQ ID NO: 1125567 - protein, 9 aa, Homo Sapiens
VDSGAPQPS

SEQ ID NO: 1125568 - protein, 9 aa, Homo Sapiens
SNTEENDTD

SEQ ID NO: 1125569 - protein, 9 aa, Homo Sapiens
TFAMTMYYQ

SEQ ID NO: 1125570 - protein, 9 aa, Homo Sapiens
GQKTFYSFF

SEQ ID NO: 1125571 - protein, 9 aa, Homo Sapiens
EHINGPRDL

SEQ ID NO: 1125572 - protein, 9 aa, Homo Sapiens
GWFAIQTDP

SEQ ID NO: 1125573 - protein, 9 aa, Homo Sapiens
ATRGISTCG

SEQ ID NO: 1125574 - protein, 9 aa, Homo Sapiens
HIGIMHWLT

SEQ ID NO: 1125575 - protein, 9 aa, Homo Sapiens
ANVASRMDS

SEQ ID NO: 1125576 - protein, 9 aa, Homo Sapiens
FQHLQNIMD

SEQ ID NO: 1125577 - protein, 9 aa, Homo Sapiens
PQVPPQLPQ

SEQ ID NO: 1125578 - protein, 9 aa, Homo Sapiens
SDRYYTTLY

SEQ ID NO: 1125579 - protein, 9 aa, Homo Sapiens
SGTWCLPPT

SEQ ID NO: 1125580 - protein, 9 aa, Homo Sapiens
AKPNLEYFS

SEQ ID NO: 1125581 - protein, 9 aa, Homo Sapiens
TGTGPPALE

SEQ ID NO: 1125582 - protein, 9 aa, Homo Sapiens
CLGSAMECC

SEQ ID NO: 1125583 - protein, 9 aa, Homo Sapiens
FVQKVSVKS

SEQ ID NO: 1125584 - protein, 9 aa, Homo Sapiens
HRDNLVVVE

SEQ ID NO: 1125585 - protein, 9 aa, Homo Sapiens
TGKILTLLG

SEQ ID NO: 1125586 - protein, 9 aa, Homo Sapiens
EDPGAAAGV

SEQ ID NO: 1125587 - protein, 9 aa, Homo Sapiens
EDGGWYGKA

SEQ ID NO: 1125588 - protein, 9 aa, Homo Sapiens
NVFELTGQI

SEQ ID NO: 1125589 - protein, 9 aa, Homo Sapiens
LHLPPTPLS

SEQ ID NO: 1125590 - protein, 9 aa, Homo Sapiens
GILSLRSET

SEQ ID NO: 1125591 - protein, 9 aa, Homo Sapiens
NAVLMYPSP

SEQ ID NO: 1125592 - protein, 9 aa, Homo Sapiens
RVNPFSLWE

SEQ ID NO: 1125593 - protein, 9 aa, Homo Sapiens
TSCLREHAP

SEQ ID NO: 1125594 - protein, 9 aa, Homo Sapiens
CKLRKEQLK

SEQ ID NO: 1125595 - protein, 9 aa, Homo Sapiens
TWEQVGVYE

SEQ ID NO: 1125596 - protein, 9 aa, Homo Sapiens
HQGDVGGQR

SEQ ID NO: 1125597 - protein, 9 aa, Homo Sapiens
VITTHTQMA

SEQ ID NO: 1125598 - protein, 9 aa, Homo Sapiens
RISHASTSS

SEQ ID NO: 1125599 - protein, 9 aa, Homo Sapiens
LLRLQSLLS

SEQ ID NO: 1125600 - protein, 9 aa, Homo Sapiens
DPEELRSYM

SEQ ID NO: 1125601 - protein, 9 aa, Homo Sapiens
SEIAVGPAR

SEQ ID NO: 1125602 - protein, 9 aa, Homo Sapiens
GRRRRGQGA

SEQ ID NO: 1125603 - protein, 9 aa, Homo Sapiens
SPRRPRPRQ

SEQ ID NO: 1125604 - protein, 9 aa, Homo Sapiens
PRSAEPGCL

SEQ ID NO: 1125605 - protein, 9 aa, Homo Sapiens
VTTTAATGP

SEQ ID NO: 1125606 - protein, 9 aa, Homo Sapiens
DSYGGPSPQ

SEQ ID NO: 1125607 - protein, 9 aa, Homo Sapiens
AVPAAACPP

SEQ ID NO: 1125608 - protein, 9 aa, Homo Sapiens
RHSSSDFFY

SEQ ID NO: 1125609 - protein, 9 aa, Homo Sapiens
LMVLDSPCW

SEQ ID NO: 1125610 - protein, 9 aa, Homo Sapiens
PEYADVVFW

SEQ ID NO: 1125611 - protein, 9 aa, Homo Sapiens
TDCPEHLLQ

SEQ ID NO: 1125612 - protein, 9 aa, Homo Sapiens
SHSEENKAN

SEQ ID NO: 1125613 - protein, 9 aa, Homo Sapiens
KARETLQAW

SEQ ID NO: 1125614 - protein, 9 aa, Homo Sapiens
HPFQGSYSF

SEQ ID NO: 1125615 - protein, 9 aa, Homo Sapiens
EPSRVLKSL

SEQ ID NO: 1125616 - protein, 9 aa, Homo Sapiens
ISLAGWLTQ

SEQ ID NO: 1125617 - protein, 9 aa, Homo Sapiens
PKKNHRWHW

SEQ ID NO: 1125618 - protein, 9 aa, Homo Sapiens
ALPLFIIVR

SEQ ID NO: 1125619 - protein, 9 aa, Homo Sapiens
WPVPWAGGA

SEQ ID NO: 1125620 - protein, 9 aa, Homo Sapiens
GRRAGCRPM

SEQ ID NO: 1125621 - protein, 9 aa, Homo Sapiens
SILALHLRV

SEQ ID NO: 1125622 - protein, 9 aa, Homo Sapiens
HLMERKTAT

SEQ ID NO: 1125623 - protein, 9 aa, Homo Sapiens
FQKYGIGFC

SEQ ID NO: 1125624 - protein, 9 aa, Homo Sapiens
PGQVCSTIT

SEQ ID NO: 1125625 - protein, 9 aa, Homo Sapiens
LVHADGDQT

SEQ ID NO: 1125626 - protein, 9 aa, Homo Sapiens
YEQLRDITI

SEQ ID NO: 1125627 - protein, 9 aa, Homo Sapiens
HSPTPNTWT

SEQ ID NO: 1125628 - protein, 9 aa, Homo Sapiens
RPNATLILV

SEQ ID NO: 1125629 - protein, 9 aa, Homo Sapiens
GWVRRPGRH

SEQ ID NO: 1125630 - protein, 9 aa, Homo Sapiens
ILCLSGDIV

SEQ ID NO: 1125631 - protein, 9 aa, Homo Sapiens
APSWACTCR

SEQ ID NO: 1125632 - protein, 9 aa, Homo Sapiens
RDIFLPGHH

SEQ ID NO: 1125633 - protein, 9 aa, Homo Sapiens
RMGCVRRRS

SEQ ID NO: 1125634 - protein, 9 aa, Homo Sapiens
TPSAPPQGF

SEQ ID NO: 1125635 - protein, 9 aa, Homo Sapiens
KTMVCCLKT

SEQ ID NO: 1125636 - protein, 9 aa, Homo Sapiens
WRRTGRGLR

SEQ ID NO: 1125637 - protein, 9 aa, Homo Sapiens
SMAGAANVS

SEQ ID NO: 1125638 - protein, 9 aa, Homo Sapiens
PDPPAGNSS

SEQ ID NO: 1125639 - protein, 9 aa, Homo Sapiens
KKSSQRHSI

SEQ ID NO: 1125640 - protein, 9 aa, Homo Sapiens
MVRALGRFK

SEQ ID NO: 1125641 - protein, 9 aa, Homo Sapiens
VWAKNMARR

SEQ ID NO: 1125642 - protein, 9 aa, Homo Sapiens
CCEVKQIAK

SEQ ID NO: 1125643 - protein, 9 aa, Homo Sapiens
AKILENERF

SEQ ID NO: 1125644 - protein, 9 aa, Homo Sapiens
PTTRRGTPG

SEQ ID NO: 1125645 - protein, 9 aa, Homo Sapiens
QLQRQTTEP

SEQ ID NO: 1125646 - protein, 9 aa, Homo Sapiens
YMEEEVLEM

SEQ ID NO: 1125647 - protein, 9 aa, Homo Sapiens
PFHRDTFHL

SEQ ID NO: 1125648 - protein, 9 aa, Homo Sapiens
ITDLFLLAI

SEQ ID NO: 1125649 - protein, 9 aa, Homo Sapiens
RSRCAYASA

SEQ ID NO: 1125650 - protein, 9 aa, Homo Sapiens
LFPLKSTFH

SEQ ID NO: 1125651 - protein, 9 aa, Homo Sapiens
RDLIPRLQI

SEQ ID NO: 1125652 - protein, 9 aa, Homo Sapiens
DSQIVDILS

SEQ ID NO: 1125653 - protein, 9 aa, Homo Sapiens
VGGNCHRCD

SEQ ID NO: 1125654 - protein, 9 aa, Homo Sapiens
KHTIEEAKA

SEQ ID NO: 1125655 - protein, 9 aa, Homo Sapiens
RDKVPGGED

SEQ ID NO: 1125656 - protein, 9 aa, Homo Sapiens
LLYPVLCSL

SEQ ID NO: 1125657 - protein, 9 aa, Homo Sapiens
QSPDPEPSV

SEQ ID NO: 1125658 - protein, 9 aa, Homo Sapiens
LDMGKTTHQ

SEQ ID NO: 1125659 - protein, 9 aa, Homo Sapiens
PQKYSTWEP

SEQ ID NO: 1125660 - protein, 9 aa, Homo Sapiens
LKRVRGERL

SEQ ID NO: 1125661 - protein, 9 aa, Homo Sapiens
HPQVPPQLP

SEQ ID NO: 1125662 - protein, 9 aa, Homo Sapiens
AAILELSAI

SEQ ID NO: 1125663 - protein, 9 aa, Homo Sapiens
QFGEVELSR

SEQ ID NO: 1125664 - protein, 9 aa, Homo Sapiens
KKIQDQDQE

SEQ ID NO: 1125665 - protein, 9 aa, Homo Sapiens
NKKPKRGSS

SEQ ID NO: 1125666 - protein, 9 aa, Homo Sapiens
VTDFGFAKC

SEQ ID NO: 1125667 - protein, 9 aa, Homo Sapiens
HQDMAHSNP

SEQ ID NO: 1125668 - protein, 9 aa, Homo Sapiens
ARCLVQLSS

SEQ ID NO: 1125669 - protein, 9 aa, Homo Sapiens
STPARSPTS

SEQ ID NO: 1125670 - protein, 9 aa, Homo Sapiens
VGISAMNLM

SEQ ID NO: 1125671 - protein, 9 aa, Homo Sapiens
GETGSDPQH

SEQ ID NO: 1125672 - protein, 9 aa, Homo Sapiens
PILASRAYA

SEQ ID NO: 1125673 - protein, 9 aa, Homo Sapiens
TLVFYISVG

SEQ ID NO: 1125674 - protein, 9 aa, Homo Sapiens
LQPAYRDSI

SEQ ID NO: 1125675 - protein, 9 aa, Homo Sapiens
LHASCDAPQ

SEQ ID NO: 1125676 - protein, 9 aa, Homo Sapiens
SLVSDGDYL

SEQ ID NO: 1125677 - protein, 9 aa, Homo Sapiens
LCCRTGSWW

SEQ ID NO: 1125678 - protein, 9 aa, Homo Sapiens
VGLAHLVVG

SEQ ID NO: 1125679 - protein, 9 aa, Homo Sapiens
VDTDKERTL

SEQ ID NO: 1125680 - protein, 9 aa, Homo Sapiens
FSQAQVSEL

SEQ ID NO: 1125681 - protein, 9 aa, Homo Sapiens
FIDEAKRLH

SEQ ID NO: 1125682 - protein, 9 aa, Homo Sapiens
SCCAGSSTR

SEQ ID NO: 1125683 - protein, 9 aa, Homo Sapiens
RPSPGPRLA

SEQ ID NO: 1125684 - protein, 9 aa, Homo Sapiens
LEDAGYCRC

SEQ ID NO: 1125685 - protein, 9 aa, Homo Sapiens
SCHHGLVAD

SEQ ID NO: 1125686 - protein, 9 aa, Homo Sapiens
AGDAPQWAM

SEQ ID NO: 1125687 - protein, 9 aa, Homo Sapiens
ATKKLKVKS

SEQ ID NO: 1125688 - protein, 9 aa, Homo Sapiens
TSLSVDDAA

SEQ ID NO: 1125689 - protein, 9 aa, Homo Sapiens
SRPPSLHPS

SEQ ID NO: 1125690 - protein, 9 aa, Homo Sapiens
ERRRGEAGG

SEQ ID NO: 1125691 - protein, 9 aa, Homo Sapiens
LTKHARQHT

SEQ ID NO: 1125692 - protein, 9 aa, Homo Sapiens
ERWNKKGEA

SEQ ID NO: 1125693 - protein, 9 aa, Homo Sapiens
SASCGPTSG

SEQ ID NO: 1125694 - protein, 9 aa, Homo Sapiens
VYSAPNVVA

SEQ ID NO: 1125695 - protein, 9 aa, Homo Sapiens
LTGLTNISN

SEQ ID NO: 1125696 - protein, 9 aa, Homo Sapiens
GEESSVVWQ

SEQ ID NO: 1125697 - protein, 9 aa, Homo Sapiens
CLTILKAVK

SEQ ID NO: 1125698 - protein, 9 aa, Homo Sapiens
SKAEKRPQW

SEQ ID NO: 1125699 - protein, 9 aa, Homo Sapiens
GDWKNHFMV

SEQ ID NO: 1125700 - protein, 9 aa, Homo Sapiens
LISQLLMGF

SEQ ID NO: 1125701 - protein, 9 aa, Homo Sapiens
SLLPPRPPA

SEQ ID NO: 1125702 - protein, 9 aa, Homo Sapiens
LRARGGTTI

SEQ ID NO: 1125703 - protein, 9 aa, Homo Sapiens
EQDPGPLRV

SEQ ID NO: 1125704 - protein, 9 aa, Homo Sapiens
PAQARHSVV

SEQ ID NO: 1125705 - protein, 9 aa, Homo Sapiens
VFPGAPGEG

SEQ ID NO: 1125706 - protein, 9 aa, Homo Sapiens
VHFSIEKNN

SEQ ID NO: 1125707 - protein, 9 aa, Homo Sapiens
AVAAQPGQQ

SEQ ID NO: 1125708 - protein, 9 aa, Homo Sapiens
DAFGIVAMA

SEQ ID NO: 1125709 - protein, 9 aa, Homo Sapiens
WCGTTGQLT

SEQ ID NO: 1125710 - protein, 9 aa, Homo Sapiens
VLEILLSRG

SEQ ID NO: 1125711 - protein, 9 aa, Homo Sapiens
RSEVCGGTW

SEQ ID NO: 1125712 - protein, 9 aa, Homo Sapiens
PPMHCPTAT

SEQ ID NO: 1125713 - protein, 9 aa, Homo Sapiens
RYYTTLYRK

SEQ ID NO: 1125714 - protein, 9 aa, Homo Sapiens
TLTRGASSS

SEQ ID NO: 1125715 - protein, 9 aa, Homo Sapiens
LRKLCFSVR

SEQ ID NO: 1125716 - protein, 9 aa, Homo Sapiens
CDCYDMAAL

SEQ ID NO: 1125717 - protein, 9 aa, Homo Sapiens
YKWLTVYKP

SEQ ID NO: 1125718 - protein, 9 aa, Homo Sapiens
DKKGCCRLL

SEQ ID NO: 1125719 - protein, 9 aa, Homo Sapiens
ATKLYKGVP

SEQ ID NO: 1125720 - protein, 9 aa, Homo Sapiens
SGLTSGGEC

SEQ ID NO: 1125721 - protein, 9 aa, Homo Sapiens
KLKYATEKR

SEQ ID NO: 1125722 - protein, 9 aa, Homo Sapiens
APERGSVCT

SEQ ID NO: 1125723 - protein, 9 aa, Homo Sapiens
ATPPRAAAP

SEQ ID NO: 1125724 - protein, 9 aa, Homo Sapiens
PVPGDAPSH

SEQ ID NO: 1125725 - protein, 9 aa, Homo Sapiens
HRRYFKKFM

SEQ ID NO: 1125726 - protein, 9 aa, Homo Sapiens
RNTSCHHGL

SEQ ID NO: 1125727 - protein, 9 aa, Homo Sapiens
FEAAPRRRA

SEQ ID NO: 1125728 - protein, 9 aa, Homo Sapiens
GWVATFEEG

SEQ ID NO: 1125729 - protein, 9 aa, Homo Sapiens
QLNGNDVEG

SEQ ID NO: 1125730 - protein, 9 aa, Homo Sapiens
NRPCKAGAQ

SEQ ID NO: 1125731 - protein, 9 aa, Homo Sapiens
DLHLEVVEG

SEQ ID NO: 1125732 - protein, 9 aa, Homo Sapiens
GSTVGPSGT

SEQ ID NO: 1125733 - protein, 9 aa, Homo Sapiens
HSHPGELGW

SEQ ID NO: 1125734 - protein, 9 aa, Homo Sapiens
LPRDRRPRT

SEQ ID NO: 1125735 - protein, 9 aa, Homo Sapiens
IEHSIDLRS

SEQ ID NO: 1125736 - protein, 9 aa, Homo Sapiens
SSLSFQCHL

SEQ ID NO: 1125737 - protein, 9 aa, Homo Sapiens
MQLLMKGSR

SEQ ID NO: 1125738 - protein, 9 aa, Homo Sapiens
EDSGGSSSS

SEQ ID NO: 1125739 - protein, 9 aa, Homo Sapiens
YSRQSCSPS

SEQ ID NO: 1125740 - protein, 9 aa, Homo Sapiens
TLAVHPPED

SEQ ID NO: 1125741 - protein, 9 aa, Homo Sapiens
IGSLLVGQP

SEQ ID NO: 1125742 - protein, 9 aa, Homo Sapiens
FHVTLDSAL

SEQ ID NO: 1125743 - protein, 9 aa, Homo Sapiens
WRDSEIAGL

SEQ ID NO: 1125744 - protein, 9 aa, Homo Sapiens
LKKTTYKAD

SEQ ID NO: 1125745 - protein, 9 aa, Homo Sapiens
HKTEKAINE

SEQ ID NO: 1125746 - protein, 9 aa, Homo Sapiens
SQTRPLWSR

SEQ ID NO: 1125747 - protein, 9 aa, Homo Sapiens
QGLRVIEIT

SEQ ID NO: 1125748 - protein, 9 aa, Homo Sapiens
PVSFELDNV

SEQ ID NO: 1125749 - protein, 9 aa, Homo Sapiens
HPNYLNPRT

SEQ ID NO: 1125750 - protein, 9 aa, Homo Sapiens
YMTVPAHRS

SEQ ID NO: 1125751 - protein, 9 aa, Homo Sapiens
FICLDYSHY

SEQ ID NO: 1125752 - protein, 9 aa, Homo Sapiens
EAKRLHAVH

SEQ ID NO: 1125753 - protein, 9 aa, Homo Sapiens
TGMTRASDR

SEQ ID NO: 1125754 - protein, 9 aa, Homo Sapiens
DQKELSVSP

SEQ ID NO: 1125755 - protein, 9 aa, Homo Sapiens
AQGARAGGL

SEQ ID NO: 1125756 - protein, 9 aa, Homo Sapiens
AVPGPCLVE

SEQ ID NO: 1125757 - protein, 9 aa, Homo Sapiens
ENRPKFSGL

SEQ ID NO: 1125758 - protein, 9 aa, Homo Sapiens
RLNKVPVRS

SEQ ID NO: 1125759 - protein, 9 aa, Homo Sapiens
SELDVARLQ

SEQ ID NO: 1125760 - protein, 9 aa, Homo Sapiens
RKKFGPLVG

SEQ ID NO: 1125761 - protein, 9 aa, Homo Sapiens
HSATSSVVT

SEQ ID NO: 1125762 - protein, 9 aa, Homo Sapiens
RSIVSLCPG

SEQ ID NO: 1125763 - protein, 9 aa, Homo Sapiens
YRERGGLSP

SEQ ID NO: 1125764 - protein, 9 aa, Homo Sapiens
MVRGKHFTG

SEQ ID NO: 1125765 - protein, 9 aa, Homo Sapiens
ITPEPRPLA

SEQ ID NO: 1125766 - protein, 9 aa, Homo Sapiens
RHPRWSHWT

SEQ ID NO: 1125767 - protein, 9 aa, Homo Sapiens
RALCNVLAK

SEQ ID NO: 1125768 - protein, 9 aa, Homo Sapiens
VKKERPTDE

SEQ ID NO: 1125769 - protein, 9 aa, Homo Sapiens
CHPAVGGGG

SEQ ID NO: 1125770 - protein, 9 aa, Homo Sapiens
DAEQQLEFL

SEQ ID NO: 1125771 - protein, 9 aa, Homo Sapiens
SPSILYVHK

SEQ ID NO: 1125772 - protein, 9 aa, Homo Sapiens
TGVVANLSP

SEQ ID NO: 1125773 - protein, 9 aa, Homo Sapiens
IFLVLRGVL

SEQ ID NO: 1125774 - protein, 9 aa, Homo Sapiens
VARWLDREE

SEQ ID NO: 1125775 - protein, 9 aa, Homo Sapiens
TYGHLGALE

SEQ ID NO: 1125776 - protein, 9 aa, Homo Sapiens
MAMYLMGLI

SEQ ID NO: 1125777 - protein, 9 aa, Homo Sapiens
AVVAPDAFG

SEQ ID NO: 1125778 - protein, 9 aa, Homo Sapiens
ELTMFSYPI

SEQ ID NO: 1125779 - protein, 9 aa, Homo Sapiens
PTSSPTARA

SEQ ID NO: 1125780 - protein, 9 aa, Homo Sapiens
SCPLDSNLS

SEQ ID NO: 1125781 - protein, 9 aa, Homo Sapiens
SSERQITVT

SEQ ID NO: 1125782 - protein, 9 aa, Homo Sapiens
KVCSERRYH

SEQ ID NO: 1125783 - protein, 9 aa, Homo Sapiens
LAELSTVHQ

SEQ ID NO: 1125784 - protein, 9 aa, Homo Sapiens
AARLAMAEA

SEQ ID NO: 1125785 - protein, 9 aa, Homo Sapiens
LASAVQETQ

SEQ ID NO: 1125786 - protein, 9 aa, Homo Sapiens
SKRSLIDRP

SEQ ID NO: 1125787 - protein, 9 aa, Homo Sapiens
EASTRPIAG

SEQ ID NO: 1125788 - protein, 9 aa, Homo Sapiens
PRHPCPRPP

SEQ ID NO: 1125789 - protein, 9 aa, Homo Sapiens
QPSCQQIAS

SEQ ID NO: 1125790 - protein, 9 aa, Homo Sapiens
SNVLVAMRK

SEQ ID NO: 1125791 - protein, 9 aa, Homo Sapiens
VQTTCWPSV

SEQ ID NO: 1125792 - protein, 9 aa, Homo Sapiens
DEAGRNITW

SEQ ID NO: 1125793 - protein, 9 aa, Homo Sapiens
VLGLAVLAV

SEQ ID NO: 1125794 - protein, 9 aa, Homo Sapiens
GRASGFARP

SEQ ID NO: 1125795 - protein, 9 aa, Homo Sapiens
SLLEMVLES

SEQ ID NO: 1125796 - protein, 9 aa, Homo Sapiens
TNINVKKMS

SEQ ID NO: 1125797 - protein, 9 aa, Homo Sapiens
FEVKRWNAV

SEQ ID NO: 1125798 - protein, 9 aa, Homo Sapiens
GTLDTEREV

SEQ ID NO: 1125799 - protein, 9 aa, Homo Sapiens
QRESECKAA

SEQ ID NO: 1125800 - protein, 9 aa, Homo Sapiens
NPPKYGKIE

SEQ ID NO: 1125801 - protein, 9 aa, Homo Sapiens
LTGETVYFI

SEQ ID NO: 1125802 - protein, 9 aa, Homo Sapiens
LDSLVLINK

SEQ ID NO: 1125803 - protein, 9 aa, Homo Sapiens
QLEEQQQQQ

SEQ ID NO: 1125804 - protein, 9 aa, Homo Sapiens
CSRNSLPPT

SEQ ID NO: 1125805 - protein, 9 aa, Homo Sapiens
KFNDNAWHN

SEQ ID NO: 1125806 - protein, 9 aa, Homo Sapiens
LQKTEAFTK

SEQ ID NO: 1125807 - protein, 9 aa, Homo Sapiens
RMEVVSHRA

SEQ ID NO: 1125808 - protein, 9 aa, Homo Sapiens
SILGKRLKT

SEQ ID NO: 1125809 - protein, 9 aa, Homo Sapiens
ALIAARGLC

SEQ ID NO: 1125810 - protein, 9 aa, Homo Sapiens
DSALVFKKG

SEQ ID NO: 1125811 - protein, 9 aa, Homo Sapiens
RTKAVIFCL

SEQ ID NO: 1125812 - protein, 9 aa, Homo Sapiens
PFAADIGHR

SEQ ID NO: 1125813 - protein, 9 aa, Homo Sapiens
RRQHLPWSI

SEQ ID NO: 1125814 - protein, 9 aa, Homo Sapiens
EPDLHLEVV

SEQ ID NO: 1125815 - protein, 9 aa, Homo Sapiens
GPISCSGAS

SEQ ID NO: 1125816 - protein, 9 aa, Homo Sapiens
GQCCCCCGA

SEQ ID NO: 1125817 - protein, 9 aa, Homo Sapiens
RLFEYDQGD

SEQ ID NO: 1125818 - protein, 9 aa, Homo Sapiens
RGRNSSMGL

SEQ ID NO: 1125819 - protein, 9 aa, Homo Sapiens
PPRAPHPPP

SEQ ID NO: 1125820 - protein, 9 aa, Homo Sapiens
TDPEEAGKF

SEQ ID NO: 1125821 - protein, 9 aa, Homo Sapiens
GSLSPTPMW

SEQ ID NO: 1125822 - protein, 9 aa, Homo Sapiens
IAGYPNEED

SEQ ID NO: 1125823 - protein, 9 aa, Homo Sapiens
EDEPVPDAP

SEQ ID NO: 1125824 - protein, 9 aa, Homo Sapiens
LPDRADISN

SEQ ID NO: 1125825 - protein, 9 aa, Homo Sapiens
RLLPLIHPR

SEQ ID NO: 1125826 - protein, 9 aa, Homo Sapiens
ALPSLPAGG

SEQ ID NO: 1125827 - protein, 9 aa, Homo Sapiens
PLLPLPPLP

SEQ ID NO: 1125828 - protein, 9 aa, Homo Sapiens
PLTVLGVRS

SEQ ID NO: 1125829 - protein, 9 aa, Homo Sapiens
LQQQQQQQS

SEQ ID NO: 1125830 - protein, 9 aa, Homo Sapiens
LLFSITPEV

SEQ ID NO: 1125831 - protein, 9 aa, Homo Sapiens
TEYMFCTGY

SEQ ID NO: 1125832 - protein, 9 aa, Homo Sapiens
VRPRVSGAP

SEQ ID NO: 1125833 - protein, 9 aa, Homo Sapiens
PHDGSLHVE

SEQ ID NO: 1125834 - protein, 9 aa, Homo Sapiens
KKEKKNQEK

SEQ ID NO: 1125835 - protein, 9 aa, Homo Sapiens
RLCQDTPTC

SEQ ID NO: 1125836 - protein, 9 aa, Homo Sapiens
QFILHPGHA

SEQ ID NO: 1125837 - protein, 9 aa, Homo Sapiens
DAPQWAMGI

SEQ ID NO: 1125838 - protein, 9 aa, Homo Sapiens
LAYDAPSPS

SEQ ID NO: 1125839 - protein, 9 aa, Homo Sapiens
VPTDSHEEL

SEQ ID NO: 1125840 - protein, 9 aa, Homo Sapiens
TPYEVHFKK

SEQ ID NO: 1125841 - protein, 9 aa, Homo Sapiens
RHVALATIV

SEQ ID NO: 1125842 - protein, 9 aa, Homo Sapiens
CRNSIHVIQ

SEQ ID NO: 1125843 - protein, 9 aa, Homo Sapiens
KVVNRPRPP

SEQ ID NO: 1125844 - protein, 9 aa, Homo Sapiens
ELATVLLQS

SEQ ID NO: 1125845 - protein, 9 aa, Homo Sapiens
KEHIMRHTQ

SEQ ID NO: 1125846 - protein, 9 aa, Homo Sapiens
IQLDASIHV

SEQ ID NO: 1125847 - protein, 9 aa, Homo Sapiens
VLYKWDHRA

SEQ ID NO: 1125848 - protein, 9 aa, Homo Sapiens
HEEVVDSGL

SEQ ID NO: 1125849 - protein, 9 aa, Homo Sapiens
RSSQDKTLT

SEQ ID NO: 1125850 - protein, 9 aa, Homo Sapiens
RRGPRTAIK

SEQ ID NO: 1125851 - protein, 9 aa, Homo Sapiens
QSWLPSPWV

SEQ ID NO: 1125852 - protein, 9 aa, Homo Sapiens
VRSLWWYPA

SEQ ID NO: 1125853 - protein, 9 aa, Homo Sapiens
RAKGIHSAN

SEQ ID NO: 1125854 - protein, 9 aa, Homo Sapiens
LLSVLLFVT

SEQ ID NO: 1125855 - protein, 9 aa, Homo Sapiens
KTLQDMEKK

SEQ ID NO: 1125856 - protein, 9 aa, Homo Sapiens
SEETAPAVA

SEQ ID NO: 1125857 - protein, 9 aa, Homo Sapiens
FEELQLKPQ

SEQ ID NO: 1125858 - protein, 9 aa, Homo Sapiens
SPGLPGNLR

SEQ ID NO: 1125859 - protein, 9 aa, Homo Sapiens
SQGDYQATP

SEQ ID NO: 1125860 - protein, 9 aa, Homo Sapiens
PKCDFHFVY

SEQ ID NO: 1125861 - protein, 9 aa, Homo Sapiens
LHSNTGQDC

SEQ ID NO: 1125862 - protein, 9 aa, Homo Sapiens
ETRPERLLA

SEQ ID NO: 1125863 - protein, 9 aa, Homo Sapiens
LRGRQCSSG

SEQ ID NO: 1125864 - protein, 9 aa, Homo Sapiens
PSKEEGKPK

SEQ ID NO: 1125865 - protein, 9 aa, Homo Sapiens
TSWAALPPS

SEQ ID NO: 1125866 - protein, 9 aa, Homo Sapiens
EAVQEVADG

SEQ ID NO: 1125867 - protein, 9 aa, Homo Sapiens
ALKRSLWVD

SEQ ID NO: 1125868 - protein, 9 aa, Homo Sapiens
RAPARAGEG

SEQ ID NO: 1125869 - protein, 9 aa, Homo Sapiens
SYSSTSERE

SEQ ID NO: 1125870 - protein, 9 aa, Homo Sapiens
FLGLFYLSL

SEQ ID NO: 1125871 - protein, 9 aa, Homo Sapiens
WCKTQPPKQ

SEQ ID NO: 1125872 - protein, 9 aa, Homo Sapiens
ASFSEGAYI

SEQ ID NO: 1125873 - protein, 9 aa, Homo Sapiens
ETGTFKLDK

SEQ ID NO: 1125874 - protein, 9 aa, Homo Sapiens
AAATSLATA

SEQ ID NO: 1125875 - protein, 9 aa, Homo Sapiens
YALFIRENN

SEQ ID NO: 1125876 - protein, 9 aa, Homo Sapiens
GFSMEQAQT

SEQ ID NO: 1125877 - protein, 9 aa, Homo Sapiens
QQQQSQQPY

SEQ ID NO: 1125878 - protein, 9 aa, Homo Sapiens
ELEKCDIDA

SEQ ID NO: 1125879 - protein, 9 aa, Homo Sapiens
LQATNAHDA

SEQ ID NO: 1125880 - protein, 9 aa, Homo Sapiens
CTPGLCPEC

SEQ ID NO: 1125881 - protein, 9 aa, Homo Sapiens
ESDLCISIR

SEQ ID NO: 1125882 - protein, 9 aa, Homo Sapiens
RDRRPRTSH

SEQ ID NO: 1125883 - protein, 9 aa, Homo Sapiens
EEEEEGGNV

SEQ ID NO: 1125884 - protein, 9 aa, Homo Sapiens
VLSDDHHGL

SEQ ID NO: 1125885 - protein, 9 aa, Homo Sapiens
CCEPFHKSC

SEQ ID NO: 1125886 - protein, 9 aa, Homo Sapiens
QGFKFNIMV

SEQ ID NO: 1125887 - protein, 9 aa, Homo Sapiens
VNMDGATLF

SEQ ID NO: 1125888 - protein, 9 aa, Homo Sapiens
QPLQRKGPL

SEQ ID NO: 1125889 - protein, 9 aa, Homo Sapiens
LLLTNVPSS

SEQ ID NO: 1125890 - protein, 9 aa, Homo Sapiens
QIALRIDGA

SEQ ID NO: 1125891 - protein, 9 aa, Homo Sapiens
PPPLCRKRP

SEQ ID NO: 1125892 - protein, 9 aa, Homo Sapiens
SDLPGLEPA

SEQ ID NO: 1125893 - protein, 9 aa, Homo Sapiens
RPSKTPPTN

SEQ ID NO: 1125894 - protein, 9 aa, Homo Sapiens
TPSPALPGG

SEQ ID NO: 1125895 - protein, 9 aa, Homo Sapiens
DLPGKDYCF

SEQ ID NO: 1125896 - protein, 9 aa, Homo Sapiens
NATESVSTF

SEQ ID NO: 1125897 - protein, 9 aa, Homo Sapiens
AFSGRILHQ

SEQ ID NO: 1125898 - protein, 9 aa, Homo Sapiens
KRSDLLGIH

SEQ ID NO: 1125899 - protein, 9 aa, Homo Sapiens
SNDHGDGGI

SEQ ID NO: 1125900 - protein, 9 aa, Homo Sapiens
LHAVHMKEY

SEQ ID NO: 1125901 - protein, 9 aa, Homo Sapiens
IYQDDTLLI

SEQ ID NO: 1125902 - protein, 9 aa, Homo Sapiens
ERKRDADQC

SEQ ID NO: 1125903 - protein, 9 aa, Homo Sapiens
PRSQPSLHL

SEQ ID NO: 1125904 - protein, 9 aa, Homo Sapiens
WPPPLRGPQ

SEQ ID NO: 1125905 - protein, 9 aa, Homo Sapiens
HRFLCGGAL

SEQ ID NO: 1125906 - protein, 9 aa, Homo Sapiens
GAKGPHSYP

SEQ ID NO: 1125907 - protein, 9 aa, Homo Sapiens
ATISRNIPW

SEQ ID NO: 1125908 - protein, 9 aa, Homo Sapiens
NHWSDMLAG

SEQ ID NO: 1125909 - protein, 9 aa, Homo Sapiens
PPLAAAAVG

SEQ ID NO: 1125910 - protein, 9 aa, Homo Sapiens
MYRCLWPNC

SEQ ID NO: 1125911 - protein, 9 aa, Homo Sapiens
PSPTTPRWR

SEQ ID NO: 1125912 - protein, 9 aa, Homo Sapiens
VSWTGNLRA

SEQ ID NO: 1125913 - protein, 9 aa, Homo Sapiens
RAAHGPRTD

SEQ ID NO: 1125914 - protein, 9 aa, Homo Sapiens
MPHLCSTGR

SEQ ID NO: 1125915 - protein, 9 aa, Homo Sapiens
KHISTKEWA

SEQ ID NO: 1125916 - protein, 9 aa, Homo Sapiens
RGKKQSPLI

SEQ ID NO: 1125917 - protein, 9 aa, Homo Sapiens
PWRRTGRGL

SEQ ID NO: 1125918 - protein, 9 aa, Homo Sapiens
CGAGVRTHS

SEQ ID NO: 1125919 - protein, 9 aa, Homo Sapiens
WDAKKGEYA

SEQ ID NO: 1125920 - protein, 9 aa, Homo Sapiens
RDAEPGPAS

SEQ ID NO: 1125921 - protein, 9 aa, Homo Sapiens
DDDEDDGAN

SEQ ID NO: 1125922 - protein, 9 aa, Homo Sapiens
DQQRMEIIP

SEQ ID NO: 1125923 - protein, 9 aa, Homo Sapiens
SRARRTNGA

SEQ ID NO: 1125924 - protein, 9 aa, Homo Sapiens
LHDDMDQKE

SEQ ID NO: 1125925 - protein, 9 aa, Homo Sapiens
YLKQSFTTV

SEQ ID NO: 1125926 - protein, 9 aa, Homo Sapiens
TCILGQRAT

SEQ ID NO: 1125927 - protein, 9 aa, Homo Sapiens
ANITTFNIQ

SEQ ID NO: 1125928 - protein, 9 aa, Homo Sapiens
KGIEGVQGI

SEQ ID NO: 1125929 - protein, 9 aa, Homo Sapiens
PAPSAGRTS

SEQ ID NO: 1125930 - protein, 9 aa, Homo Sapiens
SSTLSQVAM

SEQ ID NO: 1125931 - protein, 9 aa, Homo Sapiens
VMFSFVKYR

SEQ ID NO: 1125932 - protein, 9 aa, Homo Sapiens
LFTIVLSFH

SEQ ID NO: 1125933 - protein, 9 aa, Homo Sapiens
GAKVRFEEF

SEQ ID NO: 1125934 - protein, 9 aa, Homo Sapiens
LIKYQQEVK

SEQ ID NO: 1125935 - protein, 9 aa, Homo Sapiens
RWSHWTPYT

SEQ ID NO: 1125936 - protein, 9 aa, Homo Sapiens
HPSMETTRR

SEQ ID NO: 1125937 - protein, 9 aa, Homo Sapiens
LTGIADATK

SEQ ID NO: 1125938 - protein, 9 aa, Homo Sapiens
SFDHYTAIC

SEQ ID NO: 1125939 - protein, 9 aa, Homo Sapiens
DAPLCEDVV

SEQ ID NO: 1125940 - protein, 9 aa, Homo Sapiens
SEIYRKDLL

SEQ ID NO: 1125941 - protein, 9 aa, Homo Sapiens
CADIADLMD

SEQ ID NO: 1125942 - protein, 9 aa, Homo Sapiens
YRRILRRLV

SEQ ID NO: 1125943 - protein, 9 aa, Homo Sapiens
GARGRDRAG

SEQ ID NO: 1125944 - protein, 9 aa, Homo Sapiens
AFEGTVFFG

SEQ ID NO: 1125945 - protein, 9 aa, Homo Sapiens
KFAIFIMLN

SEQ ID NO: 1125946 - protein, 9 aa, Homo Sapiens
PTASSCLSH

SEQ ID NO: 1125947 - protein, 9 aa, Homo Sapiens
ESWGTQCRR

SEQ ID NO: 1125948 - protein, 9 aa, Homo Sapiens
PTPSAPPQG

SEQ ID NO: 1125949 - protein, 9 aa, Homo Sapiens
EVLEILLSR

SEQ ID NO: 1125950 - protein, 9 aa, Homo Sapiens
HYTAICHPL

SEQ ID NO: 1125951 - protein, 9 aa, Homo Sapiens
QDQDQELAT

SEQ ID NO: 1125952 - protein, 9 aa, Homo Sapiens
LCGQPQAQA

SEQ ID NO: 1125953 - protein, 9 aa, Homo Sapiens
AVKPGVQYR

SEQ ID NO: 1125954 - protein, 9 aa, Homo Sapiens
QMNSTSDDD

SEQ ID NO: 1125955 - protein, 9 aa, Homo Sapiens
TTYKADQIL

SEQ ID NO: 1125956 - protein, 9 aa, Homo Sapiens
EADQVGLAS

SEQ ID NO: 1125957 - protein, 9 aa, Homo Sapiens
KPIQFDPGM

SEQ ID NO: 1125958 - protein, 9 aa, Homo Sapiens
RSETTAAAI

SEQ ID NO: 1125959 - protein, 9 aa, Homo Sapiens
QLDQRLTLI

SEQ ID NO: 1125960 - protein, 9 aa, Homo Sapiens
LCYTSTIFS

SEQ ID NO: 1125961 - protein, 9 aa, Homo Sapiens
HHDLGPLPA

SEQ ID NO: 1125962 - protein, 9 aa, Homo Sapiens
LPSKWADSV

SEQ ID NO: 1125963 - protein, 9 aa, Homo Sapiens
VPRDRQLPG

SEQ ID NO: 1125964 - protein, 9 aa, Homo Sapiens
GAWQYFMCN

SEQ ID NO: 1125965 - protein, 9 aa, Homo Sapiens
IPPALGPIS

SEQ ID NO: 1125966 - protein, 9 aa, Homo Sapiens
RLQEMELRF

SEQ ID NO: 1125967 - protein, 9 aa, Homo Sapiens
LPLMAVAVF

SEQ ID NO: 1125968 - protein, 9 aa, Homo Sapiens
MDDMFLSAS

SEQ ID NO: 1125969 - protein, 9 aa, Homo Sapiens
NRPVVILAR

SEQ ID NO: 1125970 - protein, 9 aa, Homo Sapiens
GTDATMCCS

SEQ ID NO: 1125971 - protein, 9 aa, Homo Sapiens
LGNEVGHSI

SEQ ID NO: 1125972 - protein, 9 aa, Homo Sapiens
LWPPPLRGP

SEQ ID NO: 1125973 - protein, 9 aa, Homo Sapiens
KGALEPKVT

SEQ ID NO: 1125974 - protein, 9 aa, Homo Sapiens
LPPYHSKPG

SEQ ID NO: 1125975 - protein, 9 aa, Homo Sapiens
DTDLDSFLK

SEQ ID NO: 1125976 - protein, 9 aa, Homo Sapiens
QVQLHEEVV

SEQ ID NO: 1125977 - protein, 9 aa, Homo Sapiens
DVWCPWCRG

SEQ ID NO: 1125978 - protein, 9 aa, Homo Sapiens
ANTTMSLTA

SEQ ID NO: 1125979 - protein, 9 aa, Homo Sapiens
RQAEISNVK

SEQ ID NO: 1125980 - protein, 9 aa, Homo Sapiens
PGWGAPVPH

SEQ ID NO: 1125981 - protein, 9 aa, Homo Sapiens
KKFQNRIDS

SEQ ID NO: 1125982 - protein, 9 aa, Homo Sapiens
WSDFAHQSW

SEQ ID NO: 1125983 - protein, 9 aa, Homo Sapiens
AEKRPQWML

SEQ ID NO: 1125984 - protein, 9 aa, Homo Sapiens
CPGQAWLAL

SEQ ID NO: 1125985 - protein, 9 aa, Homo Sapiens
HLEDAVRAL

SEQ ID NO: 1125986 - protein, 9 aa, Homo Sapiens
WIVAPRGIT

SEQ ID NO: 1125987 - protein, 9 aa, Homo Sapiens
VWRLEGNHA

SEQ ID NO: 1125988 - protein, 9 aa, Homo Sapiens
PPSGARRRG

SEQ ID NO: 1125989 - protein, 9 aa, Homo Sapiens
VGFGPMLGG

SEQ ID NO: 1125990 - protein, 9 aa, Homo Sapiens
PPIPQRPGR

SEQ ID NO: 1125991 - protein, 9 aa, Homo Sapiens
APAQARHSV

SEQ ID NO: 1125992 - protein, 9 aa, Homo Sapiens
KLALKEDLL

SEQ ID NO: 1125993 - protein, 9 aa, Homo Sapiens
HLHPAPPCG

SEQ ID NO: 1125994 - protein, 9 aa, Homo Sapiens
LCSIEVTCK

SEQ ID NO: 1125995 - protein, 9 aa, Homo Sapiens
EREYIQCLG

SEQ ID NO: 1125996 - protein, 9 aa, Homo Sapiens
IDEELRALA

SEQ ID NO: 1125997 - protein, 9 aa, Homo Sapiens
WAAGCCCRC

SEQ ID NO: 1125998 - protein, 9 aa, Homo Sapiens
GKLPIVNDY

SEQ ID NO: 1125999 - protein, 9 aa, Homo Sapiens
QTFDYEQFR

SEQ ID NO: 1126000 - protein, 9 aa, Homo Sapiens
EYRAISFSG

SEQ ID NO: 1126001 - protein, 9 aa, Homo Sapiens
VISMDNALH

SEQ ID NO: 1126002 - protein, 9 aa, Homo Sapiens
EPVPGKVHK

SEQ ID NO: 1126003 - protein, 9 aa, Homo Sapiens
PETLAHTAS

SEQ ID NO: 1126004 - protein, 9 aa, Homo Sapiens
LTLLGPLQT

SEQ ID NO: 1126005 - protein, 9 aa, Homo Sapiens
RGSLEEKME

SEQ ID NO: 1126006 - protein, 9 aa, Homo Sapiens
LESGGASRA

SEQ ID NO: 1126007 - protein, 9 aa, Homo Sapiens
LGAPVLLAS

SEQ ID NO: 1126008 - protein, 9 aa, Homo Sapiens
HQAGVQRSL

SEQ ID NO: 1126009 - protein, 9 aa, Homo Sapiens
LPPSLWALP

SEQ ID NO: 1126010 - protein, 9 aa, Homo Sapiens
PSLSRSPAS

SEQ ID NO: 1126011 - protein, 9 aa, Homo Sapiens
LTYSVCHCT

SEQ ID NO: 1126012 - protein, 9 aa, Homo Sapiens
LLCQCDKKR

SEQ ID NO: 1126013 - protein, 9 aa, Homo Sapiens
FHFKWFEHS

SEQ ID NO: 1126014 - protein, 9 aa, Homo Sapiens
EPTERGFQT

SEQ ID NO: 1126015 - protein, 9 aa, Homo Sapiens
ELSLGCEEL

SEQ ID NO: 1126016 - protein, 9 aa, Homo Sapiens
TFSGPSGPS

SEQ ID NO: 1126017 - protein, 9 aa, Homo Sapiens
GILWLLWTP

SEQ ID NO: 1126018 - protein, 9 aa, Homo Sapiens
KESMTCSGV

SEQ ID NO: 1126019 - protein, 9 aa, Homo Sapiens
AAGDTPSGH

SEQ ID NO: 1126020 - protein, 9 aa, Homo Sapiens
RTLDATEVP

SEQ ID NO: 1126021 - protein, 9 aa, Homo Sapiens
KLFLKRNNM

SEQ ID NO: 1126022 - protein, 9 aa, Homo Sapiens
DTTILSGSL

SEQ ID NO: 1126023 - protein, 9 aa, Homo Sapiens
ITVNPAEKT

SEQ ID NO: 1126024 - protein, 9 aa, Homo Sapiens
MGPKKNQLL

SEQ ID NO: 1126025 - protein, 9 aa, Homo Sapiens
PQGLVAAYS

SEQ ID NO: 1126026 - protein, 9 aa, Homo Sapiens
CVQRALEIW

SEQ ID NO: 1126027 - protein, 9 aa, Homo Sapiens
SNSTIERKF

SEQ ID NO: 1126028 - protein, 9 aa, Homo Sapiens
EKEQEKDRS

SEQ ID NO: 1126029 - protein, 9 aa, Homo Sapiens
ANEPADGDD

SEQ ID NO: 1126030 - protein, 9 aa, Homo Sapiens
SIRYPHNRT

SEQ ID NO: 1126031 - protein, 9 aa, Homo Sapiens
RRGRNSSMG

SEQ ID NO: 1126032 - protein, 9 aa, Homo Sapiens
YAQDENATY

SEQ ID NO: 1126033 - protein, 9 aa, Homo Sapiens
TYRDSRFLR

SEQ ID NO: 1126034 - protein, 9 aa, Homo Sapiens
PPALQGCRC

SEQ ID NO: 1126035 - protein, 9 aa, Homo Sapiens
SPTWLTSAC

SEQ ID NO: 1126036 - protein, 9 aa, Homo Sapiens
KTKSIIFQW

SEQ ID NO: 1126037 - protein, 9 aa, Homo Sapiens
RSSRSRCAY

SEQ ID NO: 1126038 - protein, 9 aa, Homo Sapiens
EVRIYVANG

SEQ ID NO: 1126039 - protein, 9 aa, Homo Sapiens
WTPYTFSLA

SEQ ID NO: 1126040 - protein, 9 aa, Homo Sapiens
FLPFPPWKA

SEQ ID NO: 1126041 - protein, 9 aa, Homo Sapiens
EVGRRRRRR

SEQ ID NO: 1126042 - protein, 9 aa, Homo Sapiens
KEKRTQRIP

SEQ ID NO: 1126043 - protein, 9 aa, Homo Sapiens
ISRIHLNHS

SEQ ID NO: 1126044 - protein, 9 aa, Homo Sapiens
GFCLLAVTS

SEQ ID NO: 1126045 - protein, 9 aa, Homo Sapiens
TQTCPPKRG

SEQ ID NO: 1126046 - protein, 9 aa, Homo Sapiens
DTLIMMYRT

SEQ ID NO: 1126047 - protein, 9 aa, Homo Sapiens
ETTRRRVPH

SEQ ID NO: 1126048 - protein, 9 aa, Homo Sapiens
FQRRGRRSH

SEQ ID NO: 1126049 - protein, 9 aa, Homo Sapiens
RTVIIGGLF

SEQ ID NO: 1126050 - protein, 9 aa, Homo Sapiens
RFFVKIFFQ

SEQ ID NO: 1126051 - protein, 9 aa, Homo Sapiens
QEYLWGMDW

SEQ ID NO: 1126052 - protein, 9 aa, Homo Sapiens
ATMESLPAA

SEQ ID NO: 1126053 - protein, 9 aa, Homo Sapiens
KKKKQLVQK

SEQ ID NO: 1126054 - protein, 9 aa, Homo Sapiens
DHTSLEEDA

SEQ ID NO: 1126055 - protein, 9 aa, Homo Sapiens
SWKGSSRTV

SEQ ID NO: 1126056 - protein, 9 aa, Homo Sapiens
DLEMQNESF

SEQ ID NO: 1126057 - protein, 9 aa, Homo Sapiens
VQVLMMHQM

SEQ ID NO: 1126058 - protein, 9 aa, Homo Sapiens
AALHTMPHL

SEQ ID NO: 1126059 - protein, 9 aa, Homo Sapiens
KQHTIRAKQ

SEQ ID NO: 1126060 - protein, 9 aa, Homo Sapiens
LQNEFVGSM

SEQ ID NO: 1126061 - protein, 9 aa, Homo Sapiens
SIIAILSQG

SEQ ID NO: 1126062 - protein, 9 aa, Homo Sapiens
INGVAKSDQ

SEQ ID NO: 1126063 - protein, 9 aa, Homo Sapiens
SETEVALQP

SEQ ID NO: 1126064 - protein, 9 aa, Homo Sapiens
FYLSLARSV

SEQ ID NO: 1126065 - protein, 9 aa, Homo Sapiens
TGASGPVGP

SEQ ID NO: 1126066 - protein, 9 aa, Homo Sapiens
PAPVLLLLL

SEQ ID NO: 1126067 - protein, 9 aa, Homo Sapiens
KDRESLSSC

SEQ ID NO: 1126068 - protein, 9 aa, Homo Sapiens
QAETRPERL

SEQ ID NO: 1126069 - protein, 9 aa, Homo Sapiens
AVDCEQAVV

SEQ ID NO: 1126070 - protein, 9 aa, Homo Sapiens
WGAGGNWGA

SEQ ID NO: 1126071 - protein, 9 aa, Homo Sapiens
APPVLPAGR

SEQ ID NO: 1126072 - protein, 9 aa, Homo Sapiens
PLRGPQTHC

SEQ ID NO: 1126073 - protein, 9 aa, Homo Sapiens
KRVAVLGAS

SEQ ID NO: 1126074 - protein, 9 aa, Homo Sapiens
HVVMNSREY

SEQ ID NO: 1126075 - protein, 9 aa, Homo Sapiens
MGIPLEPTP

SEQ ID NO: 1126076 - protein, 9 aa, Homo Sapiens
TLAITSWGA

SEQ ID NO: 1126077 - protein, 9 aa, Homo Sapiens
SFQCHLLAI

SEQ ID NO: 1126078 - protein, 9 aa, Homo Sapiens
ITKLKPRGL

SEQ ID NO: 1126079 - protein, 9 aa, Homo Sapiens
KGPRRTRPS

SEQ ID NO: 1126080 - protein, 9 aa, Homo Sapiens
VIQHHDTHS

SEQ ID NO: 1126081 - protein, 9 aa, Homo Sapiens
MDALARRIL

SEQ ID NO: 1126082 - protein, 9 aa, Homo Sapiens
NVSQRKQYE

SEQ ID NO: 1126083 - protein, 9 aa, Homo Sapiens
VVEEKPAHN

SEQ ID NO: 1126084 - protein, 9 aa, Homo Sapiens
AMFSDLHPF

SEQ ID NO: 1126085 - protein, 9 aa, Homo Sapiens
DDSSQEVIL

SEQ ID NO: 1126086 - protein, 9 aa, Homo Sapiens
LLPQLPSAP

SEQ ID NO: 1126087 - protein, 9 aa, Homo Sapiens
VHGEGEGPG

SEQ ID NO: 1126088 - protein, 9 aa, Homo Sapiens
GLEELCPMG

SEQ ID NO: 1126089 - protein, 9 aa, Homo Sapiens
ALGAGGQCC

SEQ ID NO: 1126090 - protein, 9 aa, Homo Sapiens
KNQLLPVLW

SEQ ID NO: 1126091 - protein, 9 aa, Homo Sapiens
LPVTVANTT

SEQ ID NO: 1126092 - protein, 9 aa, Homo Sapiens
TALQKTQLH

SEQ ID NO: 1126093 - protein, 9 aa, Homo Sapiens
RGTHVYQGP

SEQ ID NO: 1126094 - protein, 9 aa, Homo Sapiens
GAKVGVIEK

SEQ ID NO: 1126095 - protein, 9 aa, Homo Sapiens
GLLPTLSLR

SEQ ID NO: 1126096 - protein, 9 aa, Homo Sapiens
TDISNARVF

SEQ ID NO: 1126097 - protein, 9 aa, Homo Sapiens
EARGRMLIR

SEQ ID NO: 1126098 - protein, 9 aa, Homo Sapiens
IMSKRYDGP

SEQ ID NO: 1126099 - protein, 9 aa, Homo Sapiens
CFQTKVVEK

SEQ ID NO: 1126100 - protein, 9 aa, Homo Sapiens
DPNLTFDAI

SEQ ID NO: 1126101 - protein, 9 aa, Homo Sapiens
GSCQHLRPA

SEQ ID NO: 1126102 - protein, 9 aa, Homo Sapiens
PERGSVCTR

SEQ ID NO: 1126103 - protein, 9 aa, Homo Sapiens
AREVIAYFL

SEQ ID NO: 1126104 - protein, 9 aa, Homo Sapiens
WLREGPSKL

SEQ ID NO: 1126105 - protein, 9 aa, Homo Sapiens
SRPVAPFPA

SEQ ID NO: 1126106 - protein, 9 aa, Homo Sapiens
VFCSSPQEE

SEQ ID NO: 1126107 - protein, 9 aa, Homo Sapiens
TIITEVRIY

SEQ ID NO: 1126108 - protein, 9 aa, Homo Sapiens
LICQERDIF

SEQ ID NO: 1126109 - protein, 9 aa, Homo Sapiens
NNRKRRRGS

SEQ ID NO: 1126110 - protein, 9 aa, Homo Sapiens
VLKAYTLYW

SEQ ID NO: 1126111 - protein, 9 aa, Homo Sapiens
IANITQSRS

SEQ ID NO: 1126112 - protein, 9 aa, Homo Sapiens
MLNVGGKLY

SEQ ID NO: 1126113 - protein, 9 aa, Homo Sapiens
LQLCPQRAP

SEQ ID NO: 1126114 - protein, 9 aa, Homo Sapiens
GPCCCWGFW

SEQ ID NO: 1126115 - protein, 9 aa, Homo Sapiens
TVDGQRTLE

SEQ ID NO: 1126116 - protein, 9 aa, Homo Sapiens
YSGKKPPST

SEQ ID NO: 1126117 - protein, 9 aa, Homo Sapiens
EDMTVHLPF

SEQ ID NO: 1126118 - protein, 9 aa, Homo Sapiens
ALLAGPRHR

SEQ ID NO: 1126119 - protein, 9 aa, Homo Sapiens
CESCSPNVR

SEQ ID NO: 1126120 - protein, 9 aa, Homo Sapiens
PCGFDSIHR

SEQ ID NO: 1126121 - protein, 9 aa, Homo Sapiens
PHGAARPLG

SEQ ID NO: 1126122 - protein, 9 aa, Homo Sapiens
KIQTKEGHI

SEQ ID NO: 1126123 - protein, 9 aa, Homo Sapiens
KIYKPLHEL

SEQ ID NO: 1126124 - protein, 9 aa, Homo Sapiens
ASRMSTASH

SEQ ID NO: 1126125 - protein, 9 aa, Homo Sapiens
PRAKKPCRT

SEQ ID NO: 1126126 - protein, 9 aa, Homo Sapiens
VACNAKDVA

SEQ ID NO: 1126127 - protein, 9 aa, Homo Sapiens
QSDSQSSNP

SEQ ID NO: 1126128 - protein, 9 aa, Homo Sapiens
KSWSCCGKF

SEQ ID NO: 1126129 - protein, 9 aa, Homo Sapiens
KRLKTGQKD

SEQ ID NO: 1126130 - protein, 9 aa, Homo Sapiens
VRMKTPTVC

SEQ ID NO: 1126131 - protein, 9 aa, Homo Sapiens
RVHPGAQAF

SEQ ID NO: 1126132 - protein, 9 aa, Homo Sapiens
INNLCFVGL

SEQ ID NO: 1126133 - protein, 9 aa, Homo Sapiens
HRVIYQQIV

SEQ ID NO: 1126134 - protein, 9 aa, Homo Sapiens
SKRYDGPQQ

SEQ ID NO: 1126135 - protein, 9 aa, Homo Sapiens
DSYQRFGQS

SEQ ID NO: 1126136 - protein, 9 aa, Homo Sapiens
SYFINNLRA

SEQ ID NO: 1126137 - protein, 9 aa, Homo Sapiens
DTIRSGRAI

SEQ ID NO: 1126138 - protein, 9 aa, Homo Sapiens
QSFFVVVAV

SEQ ID NO: 1126139 - protein, 9 aa, Homo Sapiens
YLYMKYIHP

SEQ ID NO: 1126140 - protein, 9 aa, Homo Sapiens
TQPVLEAGS

SEQ ID NO: 1126141 - protein, 9 aa, Homo Sapiens
EEITLSESV

SEQ ID NO: 1126142 - protein, 9 aa, Homo Sapiens
REKYVQEDA

SEQ ID NO: 1126143 - protein, 9 aa, Homo Sapiens
MIREFDNMV

SEQ ID NO: 1126144 - protein, 9 aa, Homo Sapiens
RATESPWLG

SEQ ID NO: 1126145 - protein, 9 aa, Homo Sapiens
SLQFILHPG

SEQ ID NO: 1126146 - protein, 9 aa, Homo Sapiens
ASSVVRLTP

SEQ ID NO: 1126147 - protein, 9 aa, Homo Sapiens
CPVCFDFVL

SEQ ID NO: 1126148 - protein, 9 aa, Homo Sapiens
WENTEFTDH

SEQ ID NO: 1126149 - protein, 9 aa, Homo Sapiens
TLQPRGWQP

SEQ ID NO: 1126150 - protein, 9 aa, Homo Sapiens
VRAPCCAGS

SEQ ID NO: 1126151 - protein, 9 aa, Homo Sapiens
VLLQELSSI

SEQ ID NO: 1126152 - protein, 9 aa, Homo Sapiens
VWAPRRGPL

SEQ ID NO: 1126153 - protein, 9 aa, Homo Sapiens
ANRDILARL

SEQ ID NO: 1126154 - protein, 9 aa, Homo Sapiens
TRETLESGG

SEQ ID NO: 1126155 - protein, 9 aa, Homo Sapiens
NKEDEGLAN

SEQ ID NO: 1126156 - protein, 9 aa, Homo Sapiens
PSSTYAPPN

SEQ ID NO: 1126157 - protein, 9 aa, Homo Sapiens
IISIYVGRL

SEQ ID NO: 1126158 - protein, 9 aa, Homo Sapiens
YVPLITSYQ

SEQ ID NO: 1126159 - protein, 9 aa, Homo Sapiens
GLGLLQSPV

SEQ ID NO: 1126160 - protein, 9 aa, Homo Sapiens
NFLSLENMH

SEQ ID NO: 1126161 - protein, 9 aa, Homo Sapiens
AAIMAITSI

SEQ ID NO: 1126162 - protein, 9 aa, Homo Sapiens
NQHNMTNSS

SEQ ID NO: 1126163 - protein, 9 aa, Homo Sapiens
AKCGIHGMF

SEQ ID NO: 1126164 - protein, 9 aa, Homo Sapiens
FEQKMLKKE

SEQ ID NO: 1126165 - protein, 9 aa, Homo Sapiens
LCGGPQGAF

SEQ ID NO: 1126166 - protein, 9 aa, Homo Sapiens
GEYDGNEKI

SEQ ID NO: 1126167 - protein, 9 aa, Homo Sapiens
SLQERGGVA

SEQ ID NO: 1126168 - protein, 9 aa, Homo Sapiens
FCILCLKQY

SEQ ID NO: 1126169 - protein, 9 aa, Homo Sapiens
ETSNKVRNH

SEQ ID NO: 1126170 - protein, 9 aa, Homo Sapiens
LAQKEHHIQ

SEQ ID NO: 1126171 - protein, 9 aa, Homo Sapiens
ALEYSALIV

SEQ ID NO: 1126172 - protein, 9 aa, Homo Sapiens
DVNVYLTIA

SEQ ID NO: 1126173 - protein, 9 aa, Homo Sapiens
PQLGVQYEL

SEQ ID NO: 1126174 - protein, 9 aa, Homo Sapiens
EAQVQTIQI

SEQ ID NO: 1126175 - protein, 9 aa, Homo Sapiens
YSYSNLPQV

SEQ ID NO: 1126176 - protein, 9 aa, Homo Sapiens
VCCLKTSCF

SEQ ID NO: 1126177 - protein, 9 aa, Homo Sapiens
YPLKYLIVW

SEQ ID NO: 1126178 - protein, 9 aa, Homo Sapiens
TRLRNSCEE

SEQ ID NO: 1126179 - protein, 9 aa, Homo Sapiens
VPGGSRPGW

SEQ ID NO: 1126180 - protein, 9 aa, Homo Sapiens
EQGTYRAGV

SEQ ID NO: 1126181 - protein, 9 aa, Homo Sapiens
TSPTWARTR

SEQ ID NO: 1126182 - protein, 9 aa, Homo Sapiens
SSEDVCKHG

SEQ ID NO: 1126183 - protein, 9 aa, Homo Sapiens
GAPSGAPSP

SEQ ID NO: 1126184 - protein, 9 aa, Homo Sapiens
SKDDEFRKK

SEQ ID NO: 1126185 - protein, 9 aa, Homo Sapiens
LRILRLRRH

SEQ ID NO: 1126186 - protein, 9 aa, Homo Sapiens
SLATVDSPP

SEQ ID NO: 1126187 - protein, 9 aa, Homo Sapiens
PLLESAHPV

SEQ ID NO: 1126188 - protein, 9 aa, Homo Sapiens
WRRVLSLSQ

SEQ ID NO: 1126189 - protein, 9 aa, Homo Sapiens
PFPPAAPCR

SEQ ID NO: 1126190 - protein, 9 aa, Homo Sapiens
SLGRVFWTL

SEQ ID NO: 1126191 - protein, 9 aa, Homo Sapiens
AAPLPPRAP

SEQ ID NO: 1126192 - protein, 9 aa, Homo Sapiens
RVNNITSVL

SEQ ID NO: 1126193 - protein, 9 aa, Homo Sapiens
RVMEEVLKW

SEQ ID NO: 1126194 - protein, 9 aa, Homo Sapiens
QAGTSLVQH

SEQ ID NO: 1126195 - protein, 9 aa, Homo Sapiens
ALCNVLAKV

SEQ ID NO: 1126196 - protein, 9 aa, Homo Sapiens
RLPHTRLSP

SEQ ID NO: 1126197 - protein, 9 aa, Homo Sapiens
YEKRLVQLL

SEQ ID NO: 1126198 - protein, 9 aa, Homo Sapiens
LEMVLESAL

SEQ ID NO: 1126199 - protein, 9 aa, Homo Sapiens
RFACFTWRT

SEQ ID NO: 1126200 - protein, 9 aa, Homo Sapiens
SGCYWIDPN

SEQ ID NO: 1126201 - protein, 9 aa, Homo Sapiens
NDSNDDSPD

SEQ ID NO: 1126202 - protein, 9 aa, Homo Sapiens
KPLVEKNKW

SEQ ID NO: 1126203 - protein, 9 aa, Homo Sapiens
SIRNTSYDG

SEQ ID NO: 1126204 - protein, 9 aa, Homo Sapiens
KYHEVLSRT

SEQ ID NO: 1126205 - protein, 9 aa, Homo Sapiens
NQTLDGTRC

SEQ ID NO: 1126206 - protein, 9 aa, Homo Sapiens
SINNYRFQM

SEQ ID NO: 1126207 - protein, 9 aa, Homo Sapiens
IDAVDNKKT

SEQ ID NO: 1126208 - protein, 9 aa, Homo Sapiens
GLTQKDLTT

SEQ ID NO: 1126209 - protein, 9 aa, Homo Sapiens
NNDIGEESS

SEQ ID NO: 1126210 - protein, 9 aa, Homo Sapiens
GLRGLTLGG

SEQ ID NO: 1126211 - protein, 9 aa, Homo Sapiens
LLPTTGLPP

SEQ ID NO: 1126212 - protein, 9 aa, Homo Sapiens
SSSAAPMAE

SEQ ID NO: 1126213 - protein, 9 aa, Homo Sapiens
RKHSSPMGR

SEQ ID NO: 1126214 - protein, 9 aa, Homo Sapiens
TSGHLLSAI

SEQ ID NO: 1126215 - protein, 9 aa, Homo Sapiens
RGTPGTCLK

SEQ ID NO: 1126216 - protein, 9 aa, Homo Sapiens
LKNQWFARC

SEQ ID NO: 1126217 - protein, 9 aa, Homo Sapiens
PSSGMLPPP

SEQ ID NO: 1126218 - protein, 9 aa, Homo Sapiens
KMLCFLSMI

SEQ ID NO: 1126219 - protein, 9 aa, Homo Sapiens
TTQLPVVEP

SEQ ID NO: 1126220 - protein, 9 aa, Homo Sapiens
KECGDLCPV

SEQ ID NO: 1126221 - protein, 9 aa, Homo Sapiens
LCTTGLLTL

SEQ ID NO: 1126222 - protein, 9 aa, Homo Sapiens
AGGSHVGAA

SEQ ID NO: 1126223 - protein, 9 aa, Homo Sapiens
KGSVVNVKP

SEQ ID NO: 1126224 - protein, 9 aa, Homo Sapiens
TASGCAVPM

SEQ ID NO: 1126225 - protein, 9 aa, Homo Sapiens
SFTTKQKAM

SEQ ID NO: 1126226 - protein, 9 aa, Homo Sapiens
ECFFPLSSM

SEQ ID NO: 1126227 - protein, 9 aa, Homo Sapiens
ILSRNIPED

SEQ ID NO: 1126228 - protein, 9 aa, Homo Sapiens
MKDDRRDRC

SEQ ID NO: 1126229 - protein, 9 aa, Homo Sapiens
HGRCVDGIT

SEQ ID NO: 1126230 - protein, 9 aa, Homo Sapiens
TPTRRKRRR

SEQ ID NO: 1126231 - protein, 9 aa, Homo Sapiens
QGGRILLQR

SEQ ID NO: 1126232 - protein, 9 aa, Homo Sapiens
PGQAWLALA

SEQ ID NO: 1126233 - protein, 9 aa, Homo Sapiens
SLISGRLDL

SEQ ID NO: 1126234 - protein, 9 aa, Homo Sapiens
PTDANADRL

SEQ ID NO: 1126235 - protein, 9 aa, Homo Sapiens
GACLNDSND

SEQ ID NO: 1126236 - protein, 9 aa, Homo Sapiens
CASRGMAGP

SEQ ID NO: 1126237 - protein, 9 aa, Homo Sapiens
GDNQHYNTL

SEQ ID NO: 1126238 - protein, 9 aa, Homo Sapiens
LHFLLIYLV

SEQ ID NO: 1126239 - protein, 9 aa, Homo Sapiens
CMRWCPTSR

SEQ ID NO: 1126240 - protein, 9 aa, Homo Sapiens
AAMLRKDKD

SEQ ID NO: 1126241 - protein, 9 aa, Homo Sapiens
PGQRASPGP

SEQ ID NO: 1126242 - protein, 9 aa, Homo Sapiens
EMGPQGPPE

SEQ ID NO: 1126243 - protein, 9 aa, Homo Sapiens
DHGRRRRTD

SEQ ID NO: 1126244 - protein, 9 aa, Homo Sapiens
AASSVVRLT

SEQ ID NO: 1126245 - protein, 9 aa, Homo Sapiens
ELCYGCGPW

SEQ ID NO: 1126246 - protein, 9 aa, Homo Sapiens
SISKEHVLK

SEQ ID NO: 1126247 - protein, 9 aa, Homo Sapiens
RTNLTPNTT

SEQ ID NO: 1126248 - protein, 9 aa, Homo Sapiens
LLFLALLTS

SEQ ID NO: 1126249 - protein, 9 aa, Homo Sapiens
EYTVSHDFS

SEQ ID NO: 1126250 - protein, 9 aa, Homo Sapiens
ARSPTWCRT

SEQ ID NO: 1126251 - protein, 9 aa, Homo Sapiens
GVRMGCVRR

SEQ ID NO: 1126252 - protein, 9 aa, Homo Sapiens
EVVLPAWYA

SEQ ID NO: 1126253 - protein, 9 aa, Homo Sapiens
NSVDVLDRE

SEQ ID NO: 1126254 - protein, 9 aa, Homo Sapiens
LSPEEKLRD

SEQ ID NO: 1126255 - protein, 9 aa, Homo Sapiens
LGFSFLEKI

SEQ ID NO: 1126256 - protein, 9 aa, Homo Sapiens
GAPAESHLL

SEQ ID NO: 1126257 - protein, 9 aa, Homo Sapiens
LDCGLWGPF

SEQ ID NO: 1126258 - protein, 9 aa, Homo Sapiens
ADQRDFRPA

SEQ ID NO: 1126259 - protein, 9 aa, Homo Sapiens
LGASGPVEG

SEQ ID NO: 1126260 - protein, 9 aa, Homo Sapiens
NISSEVYRQ

SEQ ID NO: 1126261 - protein, 9 aa, Homo Sapiens
RRRVPHPTM

SEQ ID NO: 1126262 - protein, 9 aa, Homo Sapiens
GALTPPHPA

SEQ ID NO: 1126263 - protein, 9 aa, Homo Sapiens
LEEARRKAL

SEQ ID NO: 1126264 - protein, 9 aa, Homo Sapiens
MEHGGPPSS

SEQ ID NO: 1126265 - protein, 9 aa, Homo Sapiens
ACVLPGGTL

SEQ ID NO: 1126266 - protein, 9 aa, Homo Sapiens
LFSQPTQAL

SEQ ID NO: 1126267 - protein, 9 aa, Homo Sapiens
CSHSWSLSP

SEQ ID NO: 1126268 - protein, 9 aa, Homo Sapiens
PGEPGTPSK

SEQ ID NO: 1126269 - protein, 9 aa, Homo Sapiens
HLVSQAYGA

SEQ ID NO: 1126270 - protein, 9 aa, Homo Sapiens
VNPPGLLLH

SEQ ID NO: 1126271 - protein, 9 aa, Homo Sapiens
SHRHRTGES

SEQ ID NO: 1126272 - protein, 9 aa, Homo Sapiens
LQKTQLHLQ

SEQ ID NO: 1126273 - protein, 9 aa, Homo Sapiens
ESGLRTHTG

SEQ ID NO: 1126274 - protein, 9 aa, Homo Sapiens
RLHTSERPY

SEQ ID NO: 1126275 - protein, 9 aa, Homo Sapiens
NTGQDCPPT

SEQ ID NO: 1126276 - protein, 9 aa, Homo Sapiens
GCNRGPDGA

SEQ ID NO: 1126277 - protein, 9 aa, Homo Sapiens
VGLDEVVSE

SEQ ID NO: 1126278 - protein, 9 aa, Homo Sapiens
REVIDLDPQ

SEQ ID NO: 1126279 - protein, 9 aa, Homo Sapiens
PSGLWVWMP

SEQ ID NO: 1126280 - protein, 9 aa, Homo Sapiens
QIRGQEKSK

SEQ ID NO: 1126281 - protein, 9 aa, Homo Sapiens
EFASVINSA

SEQ ID NO: 1126282 - protein, 9 aa, Homo Sapiens
VAVHCSDGW

SEQ ID NO: 1126283 - protein, 9 aa, Homo Sapiens
GPPRPTVAF

SEQ ID NO: 1126284 - protein, 9 aa, Homo Sapiens
WPHQGPCQR

SEQ ID NO: 1126285 - protein, 9 aa, Homo Sapiens
KNRFMGMLP

SEQ ID NO: 1126286 - protein, 9 aa, Homo Sapiens
QKFGSGSTR

SEQ ID NO: 1126287 - protein, 9 aa, Homo Sapiens
FVLVNLEVT

SEQ ID NO: 1126288 - protein, 9 aa, Homo Sapiens
STTLHTVEK

SEQ ID NO: 1126289 - protein, 9 aa, Homo Sapiens
KLQDERLLL

SEQ ID NO: 1126290 - protein, 9 aa, Homo Sapiens
SRARYGDGQ

SEQ ID NO: 1126291 - protein, 9 aa, Homo Sapiens
AVVVPVPPL

SEQ ID NO: 1126292 - protein, 9 aa, Homo Sapiens
PAEGGLHVQ

SEQ ID NO: 1126293 - protein, 9 aa, Homo Sapiens
LVCVARWLD

SEQ ID NO: 1126294 - protein, 9 aa, Homo Sapiens
PSAPPQGFR

SEQ ID NO: 1126295 - protein, 9 aa, Homo Sapiens
HLLSNHQQQ

SEQ ID NO: 1126296 - protein, 9 aa, Homo Sapiens
CGCGRAPAR

SEQ ID NO: 1126297 - protein, 9 aa, Homo Sapiens
FLGVHIILI

SEQ ID NO: 1126298 - protein, 9 aa, Homo Sapiens
ALGTRSLLS

SEQ ID NO: 1126299 - protein, 9 aa, Homo Sapiens
VQGQGPGHH

SEQ ID NO: 1126300 - protein, 9 aa, Homo Sapiens
SKTPPTNAL

SEQ ID NO: 1126301 - protein, 9 aa, Homo Sapiens
IRETAFVFV

SEQ ID NO: 1126302 - protein, 9 aa, Homo Sapiens
TAVTFNKEL

SEQ ID NO: 1126303 - protein, 9 aa, Homo Sapiens
VGQRLTLMA

SEQ ID NO: 1126304 - protein, 9 aa, Homo Sapiens
EHKKQSQQF

SEQ ID NO: 1126305 - protein, 9 aa, Homo Sapiens
GNMHGNETV

SEQ ID NO: 1126306 - protein, 9 aa, Homo Sapiens
RGQSGTGEV

SEQ ID NO: 1126307 - protein, 9 aa, Homo Sapiens
APCCWRLWP

SEQ ID NO: 1126308 - protein, 9 aa, Homo Sapiens
HFRAKGIHS

SEQ ID NO: 1126309 - protein, 9 aa, Homo Sapiens
GLALLLLMD

SEQ ID NO: 1126310 - protein, 9 aa, Homo Sapiens
LPAVLMVIP

SEQ ID NO: 1126311 - protein, 9 aa, Homo Sapiens
LEVDSLYLM

SEQ ID NO: 1126312 - protein, 9 aa, Homo Sapiens
RSSLCYGFV

SEQ ID NO: 1126313 - protein, 9 aa, Homo Sapiens
HILGVFSKV

SEQ ID NO: 1126314 - protein, 9 aa, Homo Sapiens
GWGRWTPKA

SEQ ID NO: 1126315 - protein, 9 aa, Homo Sapiens
AGAVDNLRR

SEQ ID NO: 1126316 - protein, 9 aa, Homo Sapiens
RGENHGELW

SEQ ID NO: 1126317 - protein, 9 aa, Homo Sapiens
EQDTDDEAA

SEQ ID NO: 1126318 - protein, 9 aa, Homo Sapiens
CPRDSRLSW

SEQ ID NO: 1126319 - protein, 9 aa, Homo Sapiens
VTGSDGRSV

SEQ ID NO: 1126320 - protein, 9 aa, Homo Sapiens
IPIPVINVA

SEQ ID NO: 1126321 - protein, 9 aa, Homo Sapiens
ENQSTPKKR

SEQ ID NO: 1126322 - protein, 9 aa, Homo Sapiens
HVHGIAPDV

SEQ ID NO: 1126323 - protein, 9 aa, Homo Sapiens
GELPGQVAG

SEQ ID NO: 1126324 - protein, 9 aa, Homo Sapiens
ICLLLDASC

SEQ ID NO: 1126325 - protein, 9 aa, Homo Sapiens
SAERLQLCP

SEQ ID NO: 1126326 - protein, 9 aa, Homo Sapiens
EDAVRALEK

SEQ ID NO: 1126327 - protein, 9 aa, Homo Sapiens
FPRVGFHVS

SEQ ID NO: 1126328 - protein, 9 aa, Homo Sapiens
KVNKGLEIL

SEQ ID NO: 1126329 - protein, 9 aa, Homo Sapiens
RVLSFNIEC

SEQ ID NO: 1126330 - protein, 9 aa, Homo Sapiens
TPAPRYPLK

SEQ ID NO: 1126331 - protein, 9 aa, Homo Sapiens
PPALLQPPQ

SEQ ID NO: 1126332 - protein, 9 aa, Homo Sapiens
AAIMATPVS

SEQ ID NO: 1126333 - protein, 9 aa, Homo Sapiens
ITEIPPLSS

SEQ ID NO: 1126334 - protein, 9 aa, Homo Sapiens
KGAGAAGAG

SEQ ID NO: 1126335 - protein, 9 aa, Homo Sapiens
NCHRCDHAP

SEQ ID NO: 1126336 - protein, 9 aa, Homo Sapiens
VCSERRYHQ

SEQ ID NO: 1126337 - protein, 9 aa, Homo Sapiens
KLQRCDLSS

SEQ ID NO: 1126338 - protein, 9 aa, Homo Sapiens
LLYTLNLLF

SEQ ID NO: 1126339 - protein, 9 aa, Homo Sapiens
IVFEEEDVC

SEQ ID NO: 1126340 - protein, 9 aa, Homo Sapiens
MYSCKEGYV

SEQ ID NO: 1126341 - protein, 9 aa, Homo Sapiens
TFPDLYKSL

SEQ ID NO: 1126342 - protein, 9 aa, Homo Sapiens
RTKRTTKSW

SEQ ID NO: 1126343 - protein, 9 aa, Homo Sapiens
SLPPTSWAA

SEQ ID NO: 1126344 - protein, 9 aa, Homo Sapiens
EAGKPIYSW

SEQ ID NO: 1126345 - protein, 9 aa, Homo Sapiens
PPHTHPLCP

SEQ ID NO: 1126346 - protein, 9 aa, Homo Sapiens
GRSVRLWSL

SEQ ID NO: 1126347 - protein, 9 aa, Homo Sapiens
CPAVERVST

SEQ ID NO: 1126348 - protein, 9 aa, Homo Sapiens
FPPVFALEL

SEQ ID NO: 1126349 - protein, 9 aa, Homo Sapiens
DLMKMVWPP

SEQ ID NO: 1126350 - protein, 9 aa, Homo Sapiens
KAEGEYTAF

SEQ ID NO: 1126351 - protein, 9 aa, Homo Sapiens
LTAANGAYA

SEQ ID NO: 1126352 - protein, 9 aa, Homo Sapiens
SGASASWPP

SEQ ID NO: 1126353 - protein, 9 aa, Homo Sapiens
LGFCLLAVT

SEQ ID NO: 1126354 - protein, 9 aa, Homo Sapiens
IEPYLKKKG

SEQ ID NO: 1126355 - protein, 9 aa, Homo Sapiens
LEINVLKKS

SEQ ID NO: 1126356 - protein, 9 aa, Homo Sapiens
WFAIQTDPN

SEQ ID NO: 1126357 - protein, 9 aa, Homo Sapiens
PAATPVVTV

SEQ ID NO: 1126358 - protein, 9 aa, Homo Sapiens
HAGILSRNI

SEQ ID NO: 1126359 - protein, 9 aa, Homo Sapiens
KHKKELTMF

SEQ ID NO: 1126360 - protein, 9 aa, Homo Sapiens
KLPLESLYQ

SEQ ID NO: 1126361 - protein, 9 aa, Homo Sapiens
WRHRTIFTS

SEQ ID NO: 1126362 - protein, 9 aa, Homo Sapiens
KKRWSRSRT

SEQ ID NO: 1126363 - protein, 9 aa, Homo Sapiens
NHDMLMMMT

SEQ ID NO: 1126364 - protein, 9 aa, Homo Sapiens
LLVSLQDLV

SEQ ID NO: 1126365 - protein, 9 aa, Homo Sapiens
DLSEIPCCN

SEQ ID NO: 1126366 - protein, 9 aa, Homo Sapiens
NYYEGQYIL

SEQ ID NO: 1126367 - protein, 9 aa, Homo Sapiens
PESYFINNL

SEQ ID NO: 1126368 - protein, 9 aa, Homo Sapiens
LQGPPGTSP

SEQ ID NO: 1126369 - protein, 9 aa, Homo Sapiens
LRELLRAKL

SEQ ID NO: 1126370 - protein, 9 aa, Homo Sapiens
SGPCCCWGF

SEQ ID NO: 1126371 - protein, 9 aa, Homo Sapiens
KQKDKVSIL

SEQ ID NO: 1126372 - protein, 9 aa, Homo Sapiens
IFKDVLIGF

SEQ ID NO: 1126373 - protein, 9 aa, Homo Sapiens
LYEKRLVQL

SEQ ID NO: 1126374 - protein, 9 aa, Homo Sapiens
VAWKKTAKR

SEQ ID NO: 1126375 - protein, 9 aa, Homo Sapiens
IDNTTVTYN

SEQ ID NO: 1126376 - protein, 9 aa, Homo Sapiens
FYFRFTSHG

SEQ ID NO: 1126377 - protein, 9 aa, Homo Sapiens
RRRPPALRA

SEQ ID NO: 1126378 - protein, 9 aa, Homo Sapiens
QRVVMCCTL

SEQ ID NO: 1126379 - protein, 9 aa, Homo Sapiens
PSPNEEGSE

SEQ ID NO: 1126380 - protein, 9 aa, Homo Sapiens
DVFRFPTYR

SEQ ID NO: 1126381 - protein, 9 aa, Homo Sapiens
SLVVKFVDT

SEQ ID NO: 1126382 - protein, 9 aa, Homo Sapiens
LRIGRLMNR

SEQ ID NO: 1126383 - protein, 9 aa, Homo Sapiens
LQHITQNLF

SEQ ID NO: 1126384 - protein, 9 aa, Homo Sapiens
GLFYLSLAR

SEQ ID NO: 1126385 - protein, 9 aa, Homo Sapiens
RFPGARSHQ

SEQ ID NO: 1126386 - protein, 9 aa, Homo Sapiens
GLASPPWRA

SEQ ID NO: 1126387 - protein, 9 aa, Homo Sapiens
KIHERKCGA

SEQ ID NO: 1126388 - protein, 9 aa, Homo Sapiens
WRSGGPRAK

SEQ ID NO: 1126389 - protein, 9 aa, Homo Sapiens
TARIPRPNV

SEQ ID NO: 1126390 - protein, 9 aa, Homo Sapiens
LINYYEGQY

SEQ ID NO: 1126391 - protein, 9 aa, Homo Sapiens
WTGTLSWAA

SEQ ID NO: 1126392 - protein, 9 aa, Homo Sapiens
EIHRVLRYV

SEQ ID NO: 1126393 - protein, 9 aa, Homo Sapiens
SCLKMNGDG

SEQ ID NO: 1126394 - protein, 9 aa, Homo Sapiens
NREHEINGV

SEQ ID NO: 1126395 - protein, 9 aa, Homo Sapiens
CHPIASWLC

SEQ ID NO: 1126396 - protein, 9 aa, Homo Sapiens
EKALCPTQE

SEQ ID NO: 1126397 - protein, 9 aa, Homo Sapiens
EEMFASTAY

SEQ ID NO: 1126398 - protein, 9 aa, Homo Sapiens
TADISTVIM

SEQ ID NO: 1126399 - protein, 9 aa, Homo Sapiens
VDGLTQKDK

SEQ ID NO: 1126400 - protein, 9 aa, Homo Sapiens
ALILVISMD

SEQ ID NO: 1126401 - protein, 9 aa, Homo Sapiens
AASDRVGPL

SEQ ID NO: 1126402 - protein, 9 aa, Homo Sapiens
EYMFCTGYS

SEQ ID NO: 1126403 - protein, 9 aa, Homo Sapiens
ATLGILSLR

SEQ ID NO: 1126404 - protein, 9 aa, Homo Sapiens
TDACQYECK

SEQ ID NO: 1126405 - protein, 9 aa, Homo Sapiens
LSRKVTELR

SEQ ID NO: 1126406 - protein, 9 aa, Homo Sapiens
HSHDTDNAY

SEQ ID NO: 1126407 - protein, 9 aa, Homo Sapiens
CPSSPIPRC

SEQ ID NO: 1126408 - protein, 9 aa, Homo Sapiens
VLVGQRLTL

SEQ ID NO: 1126409 - protein, 9 aa, Homo Sapiens
QPWPSFEAA

SEQ ID NO: 1126410 - protein, 9 aa, Homo Sapiens
GGECLMSTM

SEQ ID NO: 1126411 - protein, 9 aa, Homo Sapiens
ARETLQAWK

SEQ ID NO: 1126412 - protein, 9 aa, Homo Sapiens
AVLCDCYDM

SEQ ID NO: 1126413 - protein, 9 aa, Homo Sapiens
FELDNVFSP

SEQ ID NO: 1126414 - protein, 9 aa, Homo Sapiens
VMDDDLDTE

SEQ ID NO: 1126415 - protein, 9 aa, Homo Sapiens
FKFPLQEEI

SEQ ID NO: 1126416 - protein, 9 aa, Homo Sapiens
WQDHITGEF

SEQ ID NO: 1126417 - protein, 9 aa, Homo Sapiens
GVLYALQTF

SEQ ID NO: 1126418 - protein, 9 aa, Homo Sapiens
PAPAYVASR

SEQ ID NO: 1126419 - protein, 9 aa, Homo Sapiens
FNKKPKRGS

SEQ ID NO: 1126420 - protein, 9 aa, Homo Sapiens
GATAQIQRP

SEQ ID NO: 1126421 - protein, 9 aa, Homo Sapiens
SEDDNDVAA

SEQ ID NO: 1126422 - protein, 9 aa, Homo Sapiens
ASAPCWAPA

SEQ ID NO: 1126423 - protein, 9 aa, Homo Sapiens
NLSASLLPK

SEQ ID NO: 1126424 - protein, 9 aa, Homo Sapiens
SKREPVVVV

SEQ ID NO: 1126425 - protein, 9 aa, Homo Sapiens
LKLRLTYNH

SEQ ID NO: 1126426 - protein, 9 aa, Homo Sapiens
VQVLCHHLA

SEQ ID NO: 1126427 - protein, 9 aa, Homo Sapiens
CRYCNELRS

SEQ ID NO: 1126428 - protein, 9 aa, Homo Sapiens
NKIRLDQME

SEQ ID NO: 1126429 - protein, 9 aa, Homo Sapiens
YKGVPLPFY

SEQ ID NO: 1126430 - protein, 9 aa, Homo Sapiens
SRNTLFTRF

SEQ ID NO: 1126431 - protein, 9 aa, Homo Sapiens
TVCPAVERV

SEQ ID NO: 1126432 - protein, 9 aa, Homo Sapiens
FYCVECRAG

SEQ ID NO: 1126433 - protein, 9 aa, Homo Sapiens
YIEEIHSVS

SEQ ID NO: 1126434 - protein, 9 aa, Homo Sapiens
EDNRHVALA

SEQ ID NO: 1126435 - protein, 9 aa, Homo Sapiens
MFIVIHVGM

SEQ ID NO: 1126436 - protein, 9 aa, Homo Sapiens
APAACLDRD

SEQ ID NO: 1126437 - protein, 9 aa, Homo Sapiens
DEPVPDAPS

SEQ ID NO: 1126438 - protein, 9 aa, Homo Sapiens
GTTIGEVTS

SEQ ID NO: 1126439 - protein, 9 aa, Homo Sapiens
QTCPPKRGP

SEQ ID NO: 1126440 - protein, 9 aa, Homo Sapiens
AVHPPEDVQ

SEQ ID NO: 1126441 - protein, 9 aa, Homo Sapiens
SVSAAATTA

SEQ ID NO: 1126442 - protein, 9 aa, Homo Sapiens
GIHWQCGCV

SEQ ID NO: 1126443 - protein, 9 aa, Homo Sapiens
SGGASRALF

SEQ ID NO: 1126444 - protein, 9 aa, Homo Sapiens
VYIKFRREE

SEQ ID NO: 1126445 - protein, 9 aa, Homo Sapiens
GHEAETLAL

SEQ ID NO: 1126446 - protein, 9 aa, Homo Sapiens
CYGCGPWFW

SEQ ID NO: 1126447 - protein, 9 aa, Homo Sapiens
WRGCCSASS

SEQ ID NO: 1126448 - protein, 9 aa, Homo Sapiens
HDRGNYARL

SEQ ID NO: 1126449 - protein, 9 aa, Homo Sapiens
RLLLGLTIG

SEQ ID NO: 1126450 - protein, 9 aa, Homo Sapiens
NGHVYMRNI

SEQ ID NO: 1126451 - protein, 9 aa, Homo Sapiens
RGFQTSLLR

SEQ ID NO: 1126452 - protein, 9 aa, Homo Sapiens
KMNMDHQAN

SEQ ID NO: 1126453 - protein, 9 aa, Homo Sapiens
WPGLGGEGD

SEQ ID NO: 1126454 - protein, 9 aa, Homo Sapiens
LCNVLAKVK

SEQ ID NO: 1126455 - protein, 9 aa, Homo Sapiens
EDFKQKVEE

SEQ ID NO: 1126456 - protein, 9 aa, Homo Sapiens
ELVSQEDGL

SEQ ID NO: 1126457 - protein, 9 aa, Homo Sapiens
VLDHSRLVE

SEQ ID NO: 1126458 - protein, 9 aa, Homo Sapiens
HLLSAITNR

SEQ ID NO: 1126459 - protein, 9 aa, Homo Sapiens
GITSWGEGF

SEQ ID NO: 1126460 - protein, 9 aa, Homo Sapiens
TSSSRFFVK

SEQ ID NO: 1126461 - protein, 9 aa, Homo Sapiens
IGMPHLCST

SEQ ID NO: 1126462 - protein, 9 aa, Homo Sapiens
VWTAPPAAS

SEQ ID NO: 1126463 - protein, 9 aa, Homo Sapiens
HILFPLKST

SEQ ID NO: 1126464 - protein, 9 aa, Homo Sapiens
RAREKLTSS

SEQ ID NO: 1126465 - protein, 9 aa, Homo Sapiens
LCPHPPAAG

SEQ ID NO: 1126466 - protein, 9 aa, Homo Sapiens
IKVLTIIES

SEQ ID NO: 1126467 - protein, 9 aa, Homo Sapiens
SSCQLRHLE

SEQ ID NO: 1126468 - protein, 9 aa, Homo Sapiens
APSPWLPAV

SEQ ID NO: 1126469 - protein, 9 aa, Homo Sapiens
CSLAFSMDD

SEQ ID NO: 1126470 - protein, 9 aa, Homo Sapiens
KGFPRNSGR

SEQ ID NO: 1126471 - protein, 9 aa, Homo Sapiens
LIKVAWKKT

SEQ ID NO: 1126472 - protein, 9 aa, Homo Sapiens
HAELILQQN

SEQ ID NO: 1126473 - protein, 9 aa, Homo Sapiens
TAGQLLTDP

SEQ ID NO: 1126474 - protein, 9 aa, Homo Sapiens
TYPPGGGTR

SEQ ID NO: 1126475 - protein, 9 aa, Homo Sapiens
IASVTLYGL

SEQ ID NO: 1126476 - protein, 9 aa, Homo Sapiens
SVALLEVSL

SEQ ID NO: 1126477 - protein, 9 aa, Homo Sapiens
PVATQNPPG

SEQ ID NO: 1126478 - protein, 9 aa, Homo Sapiens
IDRPGPRDL

SEQ ID NO: 1126479 - protein, 9 aa, Homo Sapiens
ITTKMGGPS

SEQ ID NO: 1126480 - protein, 9 aa, Homo Sapiens
CCPRAPEVP

SEQ ID NO: 1126481 - protein, 9 aa, Homo Sapiens
LTWRRPGPK

SEQ ID NO: 1126482 - protein, 9 aa, Homo Sapiens
DLTVEDKDD

SEQ ID NO: 1126483 - protein, 9 aa, Homo Sapiens
RNSIHVIQQ

SEQ ID NO: 1126484 - protein, 9 aa, Homo Sapiens
KKRKTGVAF

SEQ ID NO: 1126485 - protein, 9 aa, Homo Sapiens
LKIQTKEGH

SEQ ID NO: 1126486 - protein, 9 aa, Homo Sapiens
EEDKTAVVK

SEQ ID NO: 1126487 - protein, 9 aa, Homo Sapiens
ARAKVAGPG

SEQ ID NO: 1126488 - protein, 9 aa, Homo Sapiens
AEKLEQAGS

SEQ ID NO: 1126489 - protein, 9 aa, Homo Sapiens
AHPTRGPRR

SEQ ID NO: 1126490 - protein, 9 aa, Homo Sapiens
LYFAGQVEW

SEQ ID NO: 1126491 - protein, 9 aa, Homo Sapiens
FTQSDRSPQ

SEQ ID NO: 1126492 - protein, 9 aa, Homo Sapiens
GSERSHGVT

SEQ ID NO: 1126493 - protein, 9 aa, Homo Sapiens
RVSGAPTRG

SEQ ID NO: 1126494 - protein, 9 aa, Homo Sapiens
TSTLIKHQR

SEQ ID NO: 1126495 - protein, 9 aa, Homo Sapiens
ERPLRLPGG

SEQ ID NO: 1126496 - protein, 9 aa, Homo Sapiens
AAGTTFTLV

SEQ ID NO: 1126497 - protein, 9 aa, Homo Sapiens
EGYPWGFSD

SEQ ID NO: 1126498 - protein, 9 aa, Homo Sapiens
FNIECAGRK

SEQ ID NO: 1126499 - protein, 9 aa, Homo Sapiens
DLSSAANDT

SEQ ID NO: 1126500 - protein, 9 aa, Homo Sapiens
CKLATFYRL

SEQ ID NO: 1126501 - protein, 9 aa, Homo Sapiens
SPGWWALQA

SEQ ID NO: 1126502 - protein, 9 aa, Homo Sapiens
IFGDLMHFC

SEQ ID NO: 1126503 - protein, 9 aa, Homo Sapiens
KNSVKVMYR

SEQ ID NO: 1126504 - protein, 9 aa, Homo Sapiens
VLYLKKKQE

SEQ ID NO: 1126505 - protein, 9 aa, Homo Sapiens
FDHYTAICH

SEQ ID NO: 1126506 - protein, 9 aa, Homo Sapiens
PSSSGELNC

SEQ ID NO: 1126507 - protein, 9 aa, Homo Sapiens
CTGYSDGSK

SEQ ID NO: 1126508 - protein, 9 aa, Homo Sapiens
ITYRDSRFL

SEQ ID NO: 1126509 - protein, 9 aa, Homo Sapiens
PLQEEISKC

SEQ ID NO: 1126510 - protein, 9 aa, Homo Sapiens
SGWLFIQLH

SEQ ID NO: 1126511 - protein, 9 aa, Homo Sapiens
NTCYMEEMR

SEQ ID NO: 1126512 - protein, 9 aa, Homo Sapiens
ASGRPPTCA

SEQ ID NO: 1126513 - protein, 9 aa, Homo Sapiens
VQESSRGLP

SEQ ID NO: 1126514 - protein, 9 aa, Homo Sapiens
KFGPLVGIS

SEQ ID NO: 1126515 - protein, 9 aa, Homo Sapiens
SQDKTHGGA

SEQ ID NO: 1126516 - protein, 9 aa, Homo Sapiens
RGRWQGPQV

SEQ ID NO: 1126517 - protein, 9 aa, Homo Sapiens
PSEGVSIWN

SEQ ID NO: 1126518 - protein, 9 aa, Homo Sapiens
NLLFLEARM

SEQ ID NO: 1126519 - protein, 9 aa, Homo Sapiens
FAGTLSDDL

SEQ ID NO: 1126520 - protein, 9 aa, Homo Sapiens
EYLWGMDWI

SEQ ID NO: 1126521 - protein, 9 aa, Homo Sapiens
VSQNYMLPC

SEQ ID NO: 1126522 - protein, 9 aa, Homo Sapiens
QKDLTTKIN

SEQ ID NO: 1126523 - protein, 9 aa, Homo Sapiens
LLHRATAEQ

SEQ ID NO: 1126524 - protein, 9 aa, Homo Sapiens
SSHRHRTGE

SEQ ID NO: 1126525 - protein, 9 aa, Homo Sapiens
SGTPRPSAD

SEQ ID NO: 1126526 - protein, 9 aa, Homo Sapiens
QQYHAASAG

SEQ ID NO: 1126527 - protein, 9 aa, Homo Sapiens
PTHPSTIAP

SEQ ID NO: 1126528 - protein, 9 aa, Homo Sapiens
LCMMSSHLH

SEQ ID NO: 1126529 - protein, 9 aa, Homo Sapiens
TRCQPRMKP

SEQ ID NO: 1126530 - protein, 9 aa, Homo Sapiens
PKLQRRQFL

SEQ ID NO: 1126531 - protein, 9 aa, Homo Sapiens
STLLVLQGA

SEQ ID NO: 1126532 - protein, 9 aa, Homo Sapiens
QMSAGNVFT

SEQ ID NO: 1126533 - protein, 9 aa, Homo Sapiens
QSMRDASVL

SEQ ID NO: 1126534 - protein, 9 aa, Homo Sapiens
GVHIILICL

SEQ ID NO: 1126535 - protein, 9 aa, Homo Sapiens
QIKDVKKRA

SEQ ID NO: 1126536 - protein, 9 aa, Homo Sapiens
RCPKPTLQI

SEQ ID NO: 1126537 - protein, 9 aa, Homo Sapiens
PPPQPPLHQ

SEQ ID NO: 1126538 - protein, 9 aa, Homo Sapiens
QKILDMRGL

SEQ ID NO: 1126539 - protein, 9 aa, Homo Sapiens
PQSPFPPTP

SEQ ID NO: 1126540 - protein, 9 aa, Homo Sapiens
PAVARMTTL

SEQ ID NO: 1126541 - protein, 9 aa, Homo Sapiens
RNSSMGLQE

SEQ ID NO: 1126542 - protein, 9 aa, Homo Sapiens
SKYGGNLIG

SEQ ID NO: 1126543 - protein, 9 aa, Homo Sapiens
LHTHYVIAK

SEQ ID NO: 1126544 - protein, 9 aa, Homo Sapiens
SITLSTIVA

SEQ ID NO: 1126545 - protein, 9 aa, Homo Sapiens
QLTLPISQQ

SEQ ID NO: 1126546 - protein, 9 aa, Homo Sapiens
DRSPQKRVR

SEQ ID NO: 1126547 - protein, 9 aa, Homo Sapiens
SLFLHHKDR

SEQ ID NO: 1126548 - protein, 9 aa, Homo Sapiens
FSTRLAVST

SEQ ID NO: 1126549 - protein, 9 aa, Homo Sapiens
GTLTTNCMT

SEQ ID NO: 1126550 - protein, 9 aa, Homo Sapiens
AHQPESYLP

SEQ ID NO: 1126551 - protein, 9 aa, Homo Sapiens
AFLEHRKMR

SEQ ID NO: 1126552 - protein, 9 aa, Homo Sapiens
KVACNMMKK

SEQ ID NO: 1126553 - protein, 9 aa, Homo Sapiens
WLPAVPHTA

SEQ ID NO: 1126554 - protein, 9 aa, Homo Sapiens
AAAMGGGSG

SEQ ID NO: 1126555 - protein, 9 aa, Homo Sapiens
GQVCSTITL

SEQ ID NO: 1126556 - protein, 9 aa, Homo Sapiens
SGQYNISWH

SEQ ID NO: 1126557 - protein, 9 aa, Homo Sapiens
GAPNDFSEQ

SEQ ID NO: 1126558 - protein, 9 aa, Homo Sapiens
EAPAAARSS

SEQ ID NO: 1126559 - protein, 9 aa, Homo Sapiens
DPISAGCCL

SEQ ID NO: 1126560 - protein, 9 aa, Homo Sapiens
GLPVTGSPR

SEQ ID NO: 1126561 - protein, 9 aa, Homo Sapiens
WTTTGTFPQ

SEQ ID NO: 1126562 - protein, 9 aa, Homo Sapiens
LKKNLYEIA

SEQ ID NO: 1126563 - protein, 9 aa, Homo Sapiens
AITNRSDLG

SEQ ID NO: 1126564 - protein, 9 aa, Homo Sapiens
ECNFSDLKE

SEQ ID NO: 1126565 - protein, 9 aa, Homo Sapiens
CIAFNGSVK

SEQ ID NO: 1126566 - protein, 9 aa, Homo Sapiens
SGLGGMSGD

SEQ ID NO: 1126567 - protein, 9 aa, Homo Sapiens
SDKNDGGQP

SEQ ID NO: 1126568 - protein, 9 aa, Homo Sapiens
LLPTSLSVD

SEQ ID NO: 1126569 - protein, 9 aa, Homo Sapiens
LQRCDLSSA

SEQ ID NO: 1126570 - protein, 9 aa, Homo Sapiens
IKCDMSVLQ

SEQ ID NO: 1126571 - protein, 9 aa, Homo Sapiens
ASGWSASCG

SEQ ID NO: 1126572 - protein, 9 aa, Homo Sapiens
RAGVQPPLP

SEQ ID NO: 1126573 - protein, 9 aa, Homo Sapiens
PPRLCVKAT

SEQ ID NO: 1126574 - protein, 9 aa, Homo Sapiens
YYEGQYILT

SEQ ID NO: 1126575 - protein, 9 aa, Homo Sapiens
DQRLTLITD

SEQ ID NO: 1126576 - protein, 9 aa, Homo Sapiens
AAGRGGTTC

SEQ ID NO: 1126577 - protein, 9 aa, Homo Sapiens
NMEFVCMKG

SEQ ID NO: 1126578 - protein, 9 aa, Homo Sapiens
RVIYQQIVQ

SEQ ID NO: 1126579 - protein, 9 aa, Homo Sapiens
LDAISKKAK

SEQ ID NO: 1126580 - protein, 9 aa, Homo Sapiens
GIPSLGPDN

SEQ ID NO: 1126581 - protein, 9 aa, Homo Sapiens
SPAMETRGC

SEQ ID NO: 1126582 - protein, 9 aa, Homo Sapiens
VTPATIINL

SEQ ID NO: 1126583 - protein, 9 aa, Homo Sapiens
LPCSVTLQL

SEQ ID NO: 1126584 - protein, 9 aa, Homo Sapiens
CEDVVLQDG

SEQ ID NO: 1126585 - protein, 9 aa, Homo Sapiens
MQHASGQKL

SEQ ID NO: 1126586 - protein, 9 aa, Homo Sapiens
MVTCMDEAG

SEQ ID NO: 1126587 - protein, 9 aa, Homo Sapiens
RPGARGEAR

SEQ ID NO: 1126588 - protein, 9 aa, Homo Sapiens
EPPEVHIAN

SEQ ID NO: 1126589 - protein, 9 aa, Homo Sapiens
SKMNKNRQR

SEQ ID NO: 1126590 - protein, 9 aa, Homo Sapiens
GIFCYGVTV

SEQ ID NO: 1126591 - protein, 9 aa, Homo Sapiens
PEIQEVLLE

SEQ ID NO: 1126592 - protein, 9 aa, Homo Sapiens
ATDYCSGSS

SEQ ID NO: 1126593 - protein, 9 aa, Homo Sapiens
APMWTHGWP

SEQ ID NO: 1126594 - protein, 9 aa, Homo Sapiens
VIIHQRQLD

SEQ ID NO: 1126595 - protein, 9 aa, Homo Sapiens
HRDLRSALI

SEQ ID NO: 1126596 - protein, 9 aa, Homo Sapiens
ALRTLRCPT

SEQ ID NO: 1126597 - protein, 9 aa, Homo Sapiens
PPVYPSVGI

SEQ ID NO: 1126598 - protein, 9 aa, Homo Sapiens
IQSFHMDTW

SEQ ID NO: 1126599 - protein, 9 aa, Homo Sapiens
GVPGSASHR

SEQ ID NO: 1126600 - protein, 9 aa, Homo Sapiens
KLQSPPERD

SEQ ID NO: 1126601 - protein, 9 aa, Homo Sapiens
AKRVAVLGA

SEQ ID NO: 1126602 - protein, 9 aa, Homo Sapiens
ELYSKVTPP

SEQ ID NO: 1126603 - protein, 9 aa, Homo Sapiens
ARSLSRTAQ

SEQ ID NO: 1126604 - protein, 9 aa, Homo Sapiens
HPSWPWTRC

SEQ ID NO: 1126605 - protein, 9 aa, Homo Sapiens
ARQHTEFHP

SEQ ID NO: 1126606 - protein, 9 aa, Homo Sapiens
LYVMYTIGY

SEQ ID NO: 1126607 - protein, 9 aa, Homo Sapiens
LCPVGGAEG

SEQ ID NO: 1126608 - protein, 9 aa, Homo Sapiens
EKMQKDQEE

SEQ ID NO: 1126609 - protein, 9 aa, Homo Sapiens
VNYDDDEDD

SEQ ID NO: 1126610 - protein, 9 aa, Homo Sapiens
CIIEVISNA

SEQ ID NO: 1126611 - protein, 9 aa, Homo Sapiens
RTGTLEDSR

SEQ ID NO: 1126612 - protein, 9 aa, Homo Sapiens
RSLRQDHVA

SEQ ID NO: 1126613 - protein, 9 aa, Homo Sapiens
SHPLFTMFS

SEQ ID NO: 1126614 - protein, 9 aa, Homo Sapiens
YRDSIRAPR

SEQ ID NO: 1126615 - protein, 9 aa, Homo Sapiens
LGSEALLDQ

SEQ ID NO: 1126616 - protein, 9 aa, Homo Sapiens
ESIFRDDGD

SEQ ID NO: 1126617 - protein, 9 aa, Homo Sapiens
QQLAQLHSS

SEQ ID NO: 1126618 - protein, 9 aa, Homo Sapiens
INTALCDCL

SEQ ID NO: 1126619 - protein, 9 aa, Homo Sapiens
DHDGDGPPT

SEQ ID NO: 1126620 - protein, 9 aa, Homo Sapiens
SGHPPQARR

SEQ ID NO: 1126621 - protein, 9 aa, Homo Sapiens
SYSSEDYTD

SEQ ID NO: 1126622 - protein, 9 aa, Homo Sapiens
MPCPMLEHC

SEQ ID NO: 1126623 - protein, 9 aa, Homo Sapiens
DTEQSLEAQ

SEQ ID NO: 1126624 - protein, 9 aa, Homo Sapiens
IEAPPPSTA

SEQ ID NO: 1126625 - protein, 9 aa, Homo Sapiens
GLRNGIKGG

SEQ ID NO: 1126626 - protein, 9 aa, Homo Sapiens
TKKLKVKSK

SEQ ID NO: 1126627 - protein, 9 aa, Homo Sapiens
QMTQERMTQ

SEQ ID NO: 1126628 - protein, 9 aa, Homo Sapiens
IGEESSVVW

SEQ ID NO: 1126629 - protein, 9 aa, Homo Sapiens
PLHPPHLVP

SEQ ID NO: 1126630 - protein, 9 aa, Homo Sapiens
DNSCRGLQT

SEQ ID NO: 1126631 - protein, 9 aa, Homo Sapiens
FIWPLSTLQ

SEQ ID NO: 1126632 - protein, 9 aa, Homo Sapiens
DLLQERFSL

SEQ ID NO: 1126633 - protein, 9 aa, Homo Sapiens
VPLQVVLPC

SEQ ID NO: 1126634 - protein, 9 aa, Homo Sapiens
PLLHPQWAP

SEQ ID NO: 1126635 - protein, 9 aa, Homo Sapiens
DHGEPVLTA

SEQ ID NO: 1126636 - protein, 9 aa, Homo Sapiens
IHFVEIRCH

SEQ ID NO: 1126637 - protein, 9 aa, Homo Sapiens
IQKAVHTAE

SEQ ID NO: 1126638 - protein, 9 aa, Homo Sapiens
LSIVRAAHG

SEQ ID NO: 1126639 - protein, 9 aa, Homo Sapiens
ENTDACQYE

SEQ ID NO: 1126640 - protein, 9 aa, Homo Sapiens
GATDWEVFQ

SEQ ID NO: 1126641 - protein, 9 aa, Homo Sapiens
YAFTTKSLL

SEQ ID NO: 1126642 - protein, 9 aa, Homo Sapiens
LKKKGESQE

SEQ ID NO: 1126643 - protein, 9 aa, Homo Sapiens
HISPAILVI

SEQ ID NO: 1126644 - protein, 9 aa, Homo Sapiens
ENHDMLMMM

SEQ ID NO: 1126645 - protein, 9 aa, Homo Sapiens
RSPDQPHPC

SEQ ID NO: 1126646 - protein, 9 aa, Homo Sapiens
ALSLRILTS

SEQ ID NO: 1126647 - protein, 9 aa, Homo Sapiens
PADPAPSPS

SEQ ID NO: 1126648 - protein, 9 aa, Homo Sapiens
KPEKVQAMA

SEQ ID NO: 1126649 - protein, 9 aa, Homo Sapiens
EKRKHTIEE

SEQ ID NO: 1126650 - protein, 9 aa, Homo Sapiens
RKKMVHELM

SEQ ID NO: 1126651 - protein, 9 aa, Homo Sapiens
GELFLVKET

SEQ ID NO: 1126652 - protein, 9 aa, Homo Sapiens
LVTRGTSRA

SEQ ID NO: 1126653 - protein, 9 aa, Homo Sapiens
RFYFKEILP

SEQ ID NO: 1126654 - protein, 9 aa, Homo Sapiens
FTNGQLVSQ

SEQ ID NO: 1126655 - protein, 9 aa, Homo Sapiens
QVLWCARLT

SEQ ID NO: 1126656 - protein, 9 aa, Homo Sapiens
RHDRSPELE

SEQ ID NO: 1126657 - protein, 9 aa, Homo Sapiens
LSASLLPKE

SEQ ID NO: 1126658 - protein, 9 aa, Homo Sapiens
HLVSTRFNQ

SEQ ID NO: 1126659 - protein, 9 aa, Homo Sapiens
QSWEIVMET

SEQ ID NO: 1126660 - protein, 9 aa, Homo Sapiens
AAWASRWLC

SEQ ID NO: 1126661 - protein, 9 aa, Homo Sapiens
SCQQPIGTK

SEQ ID NO: 1126662 - protein, 9 aa, Homo Sapiens
PKRGSSFSR

SEQ ID NO: 1126663 - protein, 9 aa, Homo Sapiens
SRACWERQL

SEQ ID NO: 1126664 - protein, 9 aa, Homo Sapiens
ALDSEAGVP

SEQ ID NO: 1126665 - protein, 9 aa, Homo Sapiens
RSGGVQGAQ

SEQ ID NO: 1126666 - protein, 9 aa, Homo Sapiens
LKQGKKEQI

SEQ ID NO: 1126667 - protein, 9 aa, Homo Sapiens
LVIRYVKWH

SEQ ID NO: 1126668 - protein, 9 aa, Homo Sapiens
SGGKTSLIT

SEQ ID NO: 1126669 - protein, 9 aa, Homo Sapiens
TNVLLIVHY

SEQ ID NO: 1126670 - protein, 9 aa, Homo Sapiens
PKLSKDPHF

SEQ ID NO: 1126671 - protein, 9 aa, Homo Sapiens
LTHSIMLRL

SEQ ID NO: 1126672 - protein, 9 aa, Homo Sapiens
SWWLPMGSL

SEQ ID NO: 1126673 - protein, 9 aa, Homo Sapiens
GDVGGQRCR

SEQ ID NO: 1126674 - protein, 9 aa, Homo Sapiens
ESPTGIDTS

SEQ ID NO: 1126675 - protein, 9 aa, Homo Sapiens
TRYNQTELG

SEQ ID NO: 1126676 - protein, 9 aa, Homo Sapiens
VSIIWGMYQ

SEQ ID NO: 1126677 - protein, 9 aa, Homo Sapiens
LLCEQNEEV

SEQ ID NO: 1126678 - protein, 9 aa, Homo Sapiens
CTDEAEEWP

SEQ ID NO: 1126679 - protein, 9 aa, Homo Sapiens
LRKSETPRG

SEQ ID NO: 1126680 - protein, 9 aa, Homo Sapiens
VTRFGGIGS

SEQ ID NO: 1126681 - protein, 9 aa, Homo Sapiens
LSVISCFWS

SEQ ID NO: 1126682 - protein, 9 aa, Homo Sapiens
KFQNRIDSF

SEQ ID NO: 1126683 - protein, 9 aa, Homo Sapiens
KGIVLSSQD

SEQ ID NO: 1126684 - protein, 9 aa, Homo Sapiens
NGCWGWQQS

SEQ ID NO: 1126685 - protein, 9 aa, Homo Sapiens
TPASPQPFC

SEQ ID NO: 1126686 - protein, 9 aa, Homo Sapiens
VSLCPGVRS

SEQ ID NO: 1126687 - protein, 9 aa, Homo Sapiens
QSMTMNLAD

SEQ ID NO: 1126688 - protein, 9 aa, Homo Sapiens
ARTRHQKGL

SEQ ID NO: 1126689 - protein, 9 aa, Homo Sapiens
LGCLGSAME

SEQ ID NO: 1126690 - protein, 9 aa, Homo Sapiens
DYLHIGHAK

SEQ ID NO: 1126691 - protein, 9 aa, Homo Sapiens
AALILVISM

SEQ ID NO: 1126692 - protein, 9 aa, Homo Sapiens
WLCKPVPPW

SEQ ID NO: 1126693 - protein, 9 aa, Homo Sapiens
AISTFGTSI

SEQ ID NO: 1126694 - protein, 9 aa, Homo Sapiens
PQYSAQPLT

SEQ ID NO: 1126695 - protein, 9 aa, Homo Sapiens
RSPSSAASA

SEQ ID NO: 1126696 - protein, 9 aa, Homo Sapiens
PCSVTLQLG

SEQ ID NO: 1126697 - protein, 9 aa, Homo Sapiens
TRGPRRRAW

SEQ ID NO: 1126698 - protein, 9 aa, Homo Sapiens
RRDFLREAG

SEQ ID NO: 1126699 - protein, 9 aa, Homo Sapiens
VAAVVRGLH

SEQ ID NO: 1126700 - protein, 9 aa, Homo Sapiens
RTHSVVCMT

SEQ ID NO: 1126701 - protein, 9 aa, Homo Sapiens
KCDKKTLFD

SEQ ID NO: 1126702 - protein, 9 aa, Homo Sapiens
YGAMTIGET

SEQ ID NO: 1126703 - protein, 9 aa, Homo Sapiens
VLAHVPGRV

SEQ ID NO: 1126704 - protein, 9 aa, Homo Sapiens
QEHSEDDED

SEQ ID NO: 1126705 - protein, 9 aa, Homo Sapiens
ASELPEHQT

SEQ ID NO: 1126706 - protein, 9 aa, Homo Sapiens
LGDLRSGLV

SEQ ID NO: 1126707 - protein, 9 aa, Homo Sapiens
DSRLHIIFG

SEQ ID NO: 1126708 - protein, 9 aa, Homo Sapiens
YYLYMKYIH

SEQ ID NO: 1126709 - protein, 9 aa, Homo Sapiens
AVEESHVEV

SEQ ID NO: 1126710 - protein, 9 aa, Homo Sapiens
RAWRALLYP

SEQ ID NO: 1126711 - protein, 9 aa, Homo Sapiens
LLHKMARIF

SEQ ID NO: 1126712 - protein, 9 aa, Homo Sapiens
DDLTPQLEE

SEQ ID NO: 1126713 - protein, 9 aa, Homo Sapiens
ASSWGRKSA

SEQ ID NO: 1126714 - protein, 9 aa, Homo Sapiens
FFCLLLPTD

SEQ ID NO: 1126715 - protein, 9 aa, Homo Sapiens
SAVKTKFKQ

SEQ ID NO: 1126716 - protein, 9 aa, Homo Sapiens
LSTGELGTI

SEQ ID NO: 1126717 - protein, 9 aa, Homo Sapiens
ECKAGLAPI

SEQ ID NO: 1126718 - protein, 9 aa, Homo Sapiens
ASYYSPYDQ

SEQ ID NO: 1126719 - protein, 9 aa, Homo Sapiens
SVKPLKQNQ

SEQ ID NO: 1126720 - protein, 9 aa, Homo Sapiens
WSSCLTWAS

SEQ ID NO: 1126721 - protein, 9 aa, Homo Sapiens
HNSIQGKHL

SEQ ID NO: 1126722 - protein, 9 aa, Homo Sapiens
LPPMHCPTA

SEQ ID NO: 1126723 - protein, 9 aa, Homo Sapiens
TYSVCHCTH

SEQ ID NO: 1126724 - protein, 9 aa, Homo Sapiens
DYPEFRQPL

SEQ ID NO: 1126725 - protein, 9 aa, Homo Sapiens
ELQLKPQLL

SEQ ID NO: 1126726 - protein, 9 aa, Homo Sapiens
TPSSGASWP

SEQ ID NO: 1126727 - protein, 9 aa, Homo Sapiens
AWVPIRSTN

SEQ ID NO: 1126728 - protein, 9 aa, Homo Sapiens
SSLDALCPT

SEQ ID NO: 1126729 - protein, 9 aa, Homo Sapiens
AAAHMSEQF

SEQ ID NO: 1126730 - protein, 9 aa, Homo Sapiens
DMFLSASSN

SEQ ID NO: 1126731 - protein, 9 aa, Homo Sapiens
TSAGRACVL

SEQ ID NO: 1126732 - protein, 9 aa, Homo Sapiens
VFNHHGRVL

SEQ ID NO: 1126733 - protein, 9 aa, Homo Sapiens
SQCKTHTCQ

SEQ ID NO: 1126734 - protein, 9 aa, Homo Sapiens
HFMVAQSEA

SEQ ID NO: 1126735 - protein, 9 aa, Homo Sapiens
VLVQSFSGE

SEQ ID NO: 1126736 - protein, 9 aa, Homo Sapiens
PSQVVVIRR

SEQ ID NO: 1126737 - protein, 9 aa, Homo Sapiens
GKYNISSEV

SEQ ID NO: 1126738 - protein, 9 aa, Homo Sapiens
MKMDDATIS

SEQ ID NO: 1126739 - protein, 9 aa, Homo Sapiens
CVCDRDDSL

SEQ ID NO: 1126740 - protein, 9 aa, Homo Sapiens
VQAGDGHGR

SEQ ID NO: 1126741 - protein, 9 aa, Homo Sapiens
LITRSQEEF

SEQ ID NO: 1126742 - protein, 9 aa, Homo Sapiens
SNPEIMRQT

SEQ ID NO: 1126743 - protein, 9 aa, Homo Sapiens
DVFLCHHEK

SEQ ID NO: 1126744 - protein, 9 aa, Homo Sapiens
GDPDTDLDS

SEQ ID NO: 1126745 - protein, 9 aa, Homo Sapiens
LLRSSMYRG

SEQ ID NO: 1126746 - protein, 9 aa, Homo Sapiens
RFSINDHFY

SEQ ID NO: 1126747 - protein, 9 aa, Homo Sapiens
SPVLKENNA

SEQ ID NO: 1126748 - protein, 9 aa, Homo Sapiens
EKTECKIAE

SEQ ID NO: 1126749 - protein, 9 aa, Homo Sapiens
GPPGSLRLS

SEQ ID NO: 1126750 - protein, 9 aa, Homo Sapiens
FCKTFPFHI

SEQ ID NO: 1126751 - protein, 9 aa, Homo Sapiens
TGGGYAKIY

SEQ ID NO: 1126752 - protein, 9 aa, Homo Sapiens
FSLWEDLRG

SEQ ID NO: 1126753 - protein, 9 aa, Homo Sapiens
LRDLWTDNC

SEQ ID NO: 1126754 - protein, 9 aa, Homo Sapiens
PPQARRRAA

SEQ ID NO: 1126755 - protein, 9 aa, Homo Sapiens
GFDKDLDRI

SEQ ID NO: 1126756 - protein, 9 aa, Homo Sapiens
PVSRCENNS

SEQ ID NO: 1126757 - protein, 9 aa, Homo Sapiens
VRLAVLNGK

SEQ ID NO: 1126758 - protein, 9 aa, Homo Sapiens
SASTRRQLS

SEQ ID NO: 1126759 - protein, 9 aa, Homo Sapiens
GGSDLIKHQ

SEQ ID NO: 1126760 - protein, 9 aa, Homo Sapiens
RNPLASAVQ

SEQ ID NO: 1126761 - protein, 9 aa, Homo Sapiens
VGKKPEQLT

SEQ ID NO: 1126762 - protein, 9 aa, Homo Sapiens
GGAVAAVAD

SEQ ID NO: 1126763 - protein, 9 aa, Homo Sapiens
LVYKCLAPE

SEQ ID NO: 1126764 - protein, 9 aa, Homo Sapiens
GVPQSPRTK

SEQ ID NO: 1126765 - protein, 9 aa, Homo Sapiens
NILYGIAQR

SEQ ID NO: 1126766 - protein, 9 aa, Homo Sapiens
KTTHQKFSG

SEQ ID NO: 1126767 - protein, 9 aa, Homo Sapiens
CTPYEVHFK

SEQ ID NO: 1126768 - protein, 9 aa, Homo Sapiens
EPILADDLI

SEQ ID NO: 1126769 - protein, 9 aa, Homo Sapiens
GPHVSGLGW

SEQ ID NO: 1126770 - protein, 9 aa, Homo Sapiens
LRGKSDPYT

SEQ ID NO: 1126771 - protein, 9 aa, Homo Sapiens
MRGSSQILT

SEQ ID NO: 1126772 - protein, 9 aa, Homo Sapiens
LNEVIHTDL

SEQ ID NO: 1126773 - protein, 9 aa, Homo Sapiens
NEQWEEEWT

SEQ ID NO: 1126774 - protein, 9 aa, Homo Sapiens
KPIKKNPSM

SEQ ID NO: 1126775 - protein, 9 aa, Homo Sapiens
CVECRAGWY

SEQ ID NO: 1126776 - protein, 9 aa, Homo Sapiens
HASPRKSTL

SEQ ID NO: 1126777 - protein, 9 aa, Homo Sapiens
HFLLIYLVF

SEQ ID NO: 1126778 - protein, 9 aa, Homo Sapiens
GTRDTQELL

SEQ ID NO: 1126779 - protein, 9 aa, Homo Sapiens
SKPEKVQAM

SEQ ID NO: 1126780 - protein, 9 aa, Homo Sapiens
HLGPNVGCD

SEQ ID NO: 1126781 - protein, 9 aa, Homo Sapiens
PSQLDSLVL

SEQ ID NO: 1126782 - protein, 9 aa, Homo Sapiens
NAAPATRIE

SEQ ID NO: 1126783 - protein, 9 aa, Homo Sapiens
TDEDKFFSQ

SEQ ID NO: 1126784 - protein, 9 aa, Homo Sapiens
LHSSLISGR

SEQ ID NO: 1126785 - protein, 9 aa, Homo Sapiens
PRQILGLRI

SEQ ID NO: 1126786 - protein, 9 aa, Homo Sapiens
TEAYNNLAV

SEQ ID NO: 1126787 - protein, 9 aa, Homo Sapiens
GVWSNVLRG

SEQ ID NO: 1126788 - protein, 9 aa, Homo Sapiens
PRQCLSGHP

SEQ ID NO: 1126789 - protein, 9 aa, Homo Sapiens
AAATTSPPT

SEQ ID NO: 1126790 - protein, 9 aa, Homo Sapiens
RDDAEGLLM

SEQ ID NO: 1126791 - protein, 9 aa, Homo Sapiens
LVLLLQRES

SEQ ID NO: 1126792 - protein, 9 aa, Homo Sapiens
PPTAASGRP

SEQ ID NO: 1126793 - protein, 9 aa, Homo Sapiens
DCGDTEARK

SEQ ID NO: 1126794 - protein, 9 aa, Homo Sapiens
INGHVYMRN

SEQ ID NO: 1126795 - protein, 9 aa, Homo Sapiens
APRTRPAPY

SEQ ID NO: 1126796 - protein, 9 aa, Homo Sapiens
WGPSPAPLR

SEQ ID NO: 1126797 - protein, 9 aa, Homo Sapiens
HRGTGPAHP

SEQ ID NO: 1126798 - protein, 9 aa, Homo Sapiens
QNDDICIYG

SEQ ID NO: 1126799 - protein, 9 aa, Homo Sapiens
CGPRGRGCT

SEQ ID NO: 1126800 - protein, 9 aa, Homo Sapiens
MTVTGNVLY

SEQ ID NO: 1126801 - protein, 9 aa, Homo Sapiens
TESPWLGGQ

SEQ ID NO: 1126802 - protein, 9 aa, Homo Sapiens
STLMRRLWG

SEQ ID NO: 1126803 - protein, 9 aa, Homo Sapiens
RSLIDRPGP

SEQ ID NO: 1126804 - protein, 9 aa, Homo Sapiens
ATLFQCVAA

SEQ ID NO: 1126805 - protein, 9 aa, Homo Sapiens
CRTGTLEDS

SEQ ID NO: 1126806 - protein, 9 aa, Homo Sapiens
PEIKICLKY

SEQ ID NO: 1126807 - protein, 9 aa, Homo Sapiens
HIDMYAMGL

SEQ ID NO: 1126808 - protein, 9 aa, Homo Sapiens
LCLDHILFP

SEQ ID NO: 1126809 - protein, 9 aa, Homo Sapiens
ALLFEHMQR

SEQ ID NO: 1126810 - protein, 9 aa, Homo Sapiens
GHIEGSSWL

SEQ ID NO: 1126811 - protein, 9 aa, Homo Sapiens
DRPWGTGTR

SEQ ID NO: 1126812 - protein, 9 aa, Homo Sapiens
TLWPHQGPC

SEQ ID NO: 1126813 - protein, 9 aa, Homo Sapiens
VKKPSFCTA

SEQ ID NO: 1126814 - protein, 9 aa, Homo Sapiens
CVSLSFSVH

SEQ ID NO: 1126815 - protein, 9 aa, Homo Sapiens
QLLVSLQDL

SEQ ID NO: 1126816 - protein, 9 aa, Homo Sapiens
VQKLQDERL

SEQ ID NO: 1126817 - protein, 9 aa, Homo Sapiens
MGKTTHQKF

SEQ ID NO: 1126818 - protein, 9 aa, Homo Sapiens
PPPPADPAP

SEQ ID NO: 1126819 - protein, 9 aa, Homo Sapiens
HENRISHAS

SEQ ID NO: 1126820 - protein, 9 aa, Homo Sapiens
TTKTLPFPS

SEQ ID NO: 1126821 - protein, 9 aa, Homo Sapiens
AVPRATTKT

SEQ ID NO: 1126822 - protein, 9 aa, Homo Sapiens
VVRTVGQAF

SEQ ID NO: 1126823 - protein, 9 aa, Homo Sapiens
NTEFRYLDD

SEQ ID NO: 1126824 - protein, 9 aa, Homo Sapiens
QRSLVPRCP

SEQ ID NO: 1126825 - protein, 9 aa, Homo Sapiens
STRGASKAS

SEQ ID NO: 1126826 - protein, 9 aa, Homo Sapiens
PATSASTQA

SEQ ID NO: 1126827 - protein, 9 aa, Homo Sapiens
GTDGEGEGA

SEQ ID NO: 1126828 - protein, 9 aa, Homo Sapiens
ALKPIKRVL

SEQ ID NO: 1126829 - protein, 9 aa, Homo Sapiens
KLYDGEFRE

SEQ ID NO: 1126830 - protein, 9 aa, Homo Sapiens
PAFSGRILH

SEQ ID NO: 1126831 - protein, 9 aa, Homo Sapiens
GKIFNMKKS

SEQ ID NO: 1126832 - protein, 9 aa, Homo Sapiens
EENKGRMLK

SEQ ID NO: 1126833 - protein, 9 aa, Homo Sapiens
GRWWLSSGT

SEQ ID NO: 1126834 - protein, 9 aa, Homo Sapiens
DRCEQVCVN

SEQ ID NO: 1126835 - protein, 9 aa, Homo Sapiens
SCWTKALME

SEQ ID NO: 1126836 - protein, 9 aa, Homo Sapiens
TRAWRRSGR

SEQ ID NO: 1126837 - protein, 9 aa, Homo Sapiens
FSATASTCR

SEQ ID NO: 1126838 - protein, 9 aa, Homo Sapiens
RSMSPTLTP

SEQ ID NO: 1126839 - protein, 9 aa, Homo Sapiens
PGQLNIDIS

SEQ ID NO: 1126840 - protein, 9 aa, Homo Sapiens
GQYVQAFCT

SEQ ID NO: 1126841 - protein, 9 aa, Homo Sapiens
SSQLWRWKP

SEQ ID NO: 1126842 - protein, 9 aa, Homo Sapiens
SASRGHGAA

SEQ ID NO: 1126843 - protein, 9 aa, Homo Sapiens
QWRITSCAM

SEQ ID NO: 1126844 - protein, 9 aa, Homo Sapiens
SPMYWGSTA

SEQ ID NO: 1126845 - protein, 9 aa, Homo Sapiens
PLRLPGGDP

SEQ ID NO: 1126846 - protein, 9 aa, Homo Sapiens
FRITTREAG

SEQ ID NO: 1126847 - protein, 9 aa, Homo Sapiens
KPRRYHGCR

SEQ ID NO: 1126848 - protein, 9 aa, Homo Sapiens
FLIKYKQKK

SEQ ID NO: 1126849 - protein, 9 aa, Homo Sapiens
IWLSYTISC

SEQ ID NO: 1126850 - protein, 9 aa, Homo Sapiens
RLSGTPRPS

SEQ ID NO: 1126851 - protein, 9 aa, Homo Sapiens
VRRDASRCL

SEQ ID NO: 1126852 - protein, 9 aa, Homo Sapiens
SKLAVTSCA

SEQ ID NO: 1126853 - protein, 9 aa, Homo Sapiens
TWVAEKTEC

SEQ ID NO: 1126854 - protein, 9 aa, Homo Sapiens
SLCERHILG

SEQ ID NO: 1126855 - protein, 9 aa, Homo Sapiens
IKFTVFIGK

SEQ ID NO: 1126856 - protein, 9 aa, Homo Sapiens
SGAPNDFSE

SEQ ID NO: 1126857 - protein, 9 aa, Homo Sapiens
MAQEDTAKG

SEQ ID NO: 1126858 - protein, 9 aa, Homo Sapiens
APRPRAGPR

SEQ ID NO: 1126859 - protein, 9 aa, Homo Sapiens
WDSDILCLS

SEQ ID NO: 1126860 - protein, 9 aa, Homo Sapiens
NDSYQMTQE

SEQ ID NO: 1126861 - protein, 9 aa, Homo Sapiens
HRTSQNHSK

SEQ ID NO: 1126862 - protein, 9 aa, Homo Sapiens
WAGPRAPPQ

SEQ ID NO: 1126863 - protein, 9 aa, Homo Sapiens
SQGGRILLQ

SEQ ID NO: 1126864 - protein, 9 aa, Homo Sapiens
ARLTIHIDE

SEQ ID NO: 1126865 - protein, 9 aa, Homo Sapiens
PLLRQPLIM

SEQ ID NO: 1126866 - protein, 9 aa, Homo Sapiens
PQPFCGNNF

SEQ ID NO: 1126867 - protein, 9 aa, Homo Sapiens
PRAMDALAR

SEQ ID NO: 1126868 - protein, 9 aa, Homo Sapiens
ILLLHQQAG

SEQ ID NO: 1126869 - protein, 9 aa, Homo Sapiens
SPLPAPRPT

SEQ ID NO: 1126870 - protein, 9 aa, Homo Sapiens
LLDVGIITQ

SEQ ID NO: 1126871 - protein, 9 aa, Homo Sapiens
GTTAAGIPD

SEQ ID NO: 1126872 - protein, 9 aa, Homo Sapiens
QAPQMYTYP

SEQ ID NO: 1126873 - protein, 9 aa, Homo Sapiens
PPWCATAAE

SEQ ID NO: 1126874 - protein, 9 aa, Homo Sapiens
GATYSTQVS

SEQ ID NO: 1126875 - protein, 9 aa, Homo Sapiens
LPAMGGAWP

SEQ ID NO: 1126876 - protein, 9 aa, Homo Sapiens
YLHPGEDER

SEQ ID NO: 1126877 - protein, 9 aa, Homo Sapiens
TESPLTDKK

SEQ ID NO: 1126878 - protein, 9 aa, Homo Sapiens
PQTKGKGGR

SEQ ID NO: 1126879 - protein, 9 aa, Homo Sapiens
EEVVQVLLN

SEQ ID NO: 1126880 - protein, 9 aa, Homo Sapiens
RTLDTPSDG

SEQ ID NO: 1126881 - protein, 9 aa, Homo Sapiens
PTHASGNLS

SEQ ID NO: 1126882 - protein, 9 aa, Homo Sapiens
RRGAPSGAP

SEQ ID NO: 1126883 - protein, 9 aa, Homo Sapiens
SNLTPGAFH

SEQ ID NO: 1126884 - protein, 9 aa, Homo Sapiens
LGLLQSPVT

SEQ ID NO: 1126885 - protein, 9 aa, Homo Sapiens
SFALCGSKV

SEQ ID NO: 1126886 - protein, 9 aa, Homo Sapiens
LHIVTELYF

SEQ ID NO: 1126887 - protein, 9 aa, Homo Sapiens
VLWCARLTS

SEQ ID NO: 1126888 - protein, 9 aa, Homo Sapiens
LRMAKNPQV

SEQ ID NO: 1126889 - protein, 9 aa, Homo Sapiens
LHHSFVSSV

SEQ ID NO: 1126890 - protein, 9 aa, Homo Sapiens
ENQVSVGLQ

SEQ ID NO: 1126891 - protein, 9 aa, Homo Sapiens
TRELAVRLA

SEQ ID NO: 1126892 - protein, 9 aa, Homo Sapiens
QPALVLAHV

SEQ ID NO: 1126893 - protein, 9 aa, Homo Sapiens
DFSEQRAGQ

SEQ ID NO: 1126894 - protein, 9 aa, Homo Sapiens
MSGGGPSWR

SEQ ID NO: 1126895 - protein, 9 aa, Homo Sapiens
VLSLLLLLL

SEQ ID NO: 1126896 - protein, 9 aa, Homo Sapiens
GPRCHRRRR

SEQ ID NO: 1126897 - protein, 9 aa, Homo Sapiens
TQLPVVEPP

SEQ ID NO: 1126898 - protein, 9 aa, Homo Sapiens
PQIHASPRK

SEQ ID NO: 1126899 - protein, 9 aa, Homo Sapiens
AAVHGLCHP

SEQ ID NO: 1126900 - protein, 9 aa, Homo Sapiens
LLNDFHMSE

SEQ ID NO: 1126901 - protein, 9 aa, Homo Sapiens
PELEILCSV

SEQ ID NO: 1126902 - protein, 9 aa, Homo Sapiens
LMNVQWSGC

SEQ ID NO: 1126903 - protein, 9 aa, Homo Sapiens
SLRAQSLKT

SEQ ID NO: 1126904 - protein, 9 aa, Homo Sapiens
WQRITQGFC

SEQ ID NO: 1126905 - protein, 9 aa, Homo Sapiens
MDKSLSKLV

SEQ ID NO: 1126906 - protein, 9 aa, Homo Sapiens
TCPPTSCPS

SEQ ID NO: 1126907 - protein, 9 aa, Homo Sapiens
VVCLLFPAS

SEQ ID NO: 1126908 - protein, 9 aa, Homo Sapiens
DGDEAVGGF

SEQ ID NO: 1126909 - protein, 9 aa, Homo Sapiens
AHLRQELQR

SEQ ID NO: 1126910 - protein, 9 aa, Homo Sapiens
EGSGAATTT

SEQ ID NO: 1126911 - protein, 9 aa, Homo Sapiens
CGKCFSQCS

SEQ ID NO: 1126912 - protein, 9 aa, Homo Sapiens
TAFTAEVLV

SEQ ID NO: 1126913 - protein, 9 aa, Homo Sapiens
WCPTSRSIV

SEQ ID NO: 1126914 - protein, 9 aa, Homo Sapiens
WKKTAKRKI

SEQ ID NO: 1126915 - protein, 9 aa, Homo Sapiens
RSQPSLHLR

SEQ ID NO: 1126916 - protein, 9 aa, Homo Sapiens
TGQKDLMSW

SEQ ID NO: 1126917 - protein, 9 aa, Homo Sapiens
YQIYQDDTL

SEQ ID NO: 1126918 - protein, 9 aa, Homo Sapiens
RNKLFVKVY

SEQ ID NO: 1126919 - protein, 9 aa, Homo Sapiens
STDHIEQEL

SEQ ID NO: 1126920 - protein, 9 aa, Homo Sapiens
RITSCAMLT

SEQ ID NO: 1126921 - protein, 9 aa, Homo Sapiens
AWTVSTGPP

SEQ ID NO: 1126922 - protein, 9 aa, Homo Sapiens
MLSAAIFVY

SEQ ID NO: 1126923 - protein, 9 aa, Homo Sapiens
SGQLVWYMG

SEQ ID NO: 1126924 - protein, 9 aa, Homo Sapiens
KPCGFDSIH

SEQ ID NO: 1126925 - protein, 9 aa, Homo Sapiens
SLLGTWIIS

SEQ ID NO: 1126926 - protein, 9 aa, Homo Sapiens
VANLSPANQ

SEQ ID NO: 1126927 - protein, 9 aa, Homo Sapiens
FNESDFYPT

SEQ ID NO: 1126928 - protein, 9 aa, Homo Sapiens
SRCHPIASW

SEQ ID NO: 1126929 - protein, 9 aa, Homo Sapiens
WKGFSDEDS

SEQ ID NO: 1126930 - protein, 9 aa, Homo Sapiens
KAHAYKEVS

SEQ ID NO: 1126931 - protein, 9 aa, Homo Sapiens
TRDTQELLP

SEQ ID NO: 1126932 - protein, 9 aa, Homo Sapiens
DLVIRLTDG

SEQ ID NO: 1126933 - protein, 9 aa, Homo Sapiens
LHKMARIFT

SEQ ID NO: 1126934 - protein, 9 aa, Homo Sapiens
AKPCPGTAT

SEQ ID NO: 1126935 - protein, 9 aa, Homo Sapiens
QPTWKLLVK

SEQ ID NO: 1126936 - protein, 9 aa, Homo Sapiens
VEAVKYSDV

SEQ ID NO: 1126937 - protein, 9 aa, Homo Sapiens
GGRGAHGAS

SEQ ID NO: 1126938 - protein, 9 aa, Homo Sapiens
QPTSELSLQ

SEQ ID NO: 1126939 - protein, 9 aa, Homo Sapiens
VSSLHDAMP

SEQ ID NO: 1126940 - protein, 9 aa, Homo Sapiens
DDRPSPPQG

SEQ ID NO: 1126941 - protein, 9 aa, Homo Sapiens
PLGFTGPPG

SEQ ID NO: 1126942 - protein, 9 aa, Homo Sapiens
PSQTLICKS

SEQ ID NO: 1126943 - protein, 9 aa, Homo Sapiens
LTGTKDTIC

SEQ ID NO: 1126944 - protein, 9 aa, Homo Sapiens
SIMFHWKKL

SEQ ID NO: 1126945 - protein, 9 aa, Homo Sapiens
PDAFGIVAM

SEQ ID NO: 1126946 - protein, 9 aa, Homo Sapiens
DSTWEPEEN

SEQ ID NO: 1126947 - protein, 9 aa, Homo Sapiens
LTLNSIGFL

SEQ ID NO: 1126948 - protein, 9 aa, Homo Sapiens
AGHDAPAGP

SEQ ID NO: 1126949 - protein, 9 aa, Homo Sapiens
ITEVRIYVA

SEQ ID NO: 1126950 - protein, 9 aa, Homo Sapiens
LWLGPASVA

SEQ ID NO: 1126951 - protein, 9 aa, Homo Sapiens
LINTTTITT

SEQ ID NO: 1126952 - protein, 9 aa, Homo Sapiens
LSSQDKTHG

SEQ ID NO: 1126953 - protein, 9 aa, Homo Sapiens
IPDVHGRSL

SEQ ID NO: 1126954 - protein, 9 aa, Homo Sapiens
GCCCRCKGW

SEQ ID NO: 1126955 - protein, 9 aa, Homo Sapiens
VDQKELSVS

SEQ ID NO: 1126956 - protein, 9 aa, Homo Sapiens
NIKKGQQIY

SEQ ID NO: 1126957 - protein, 9 aa, Homo Sapiens
TFIDFPVYN

SEQ ID NO: 1126958 - protein, 9 aa, Homo Sapiens
ADKGDALVA

SEQ ID NO: 1126959 - protein, 9 aa, Homo Sapiens
TIAVKYKRE

SEQ ID NO: 1126960 - protein, 9 aa, Homo Sapiens
VMILELLTV

SEQ ID NO: 1126961 - protein, 9 aa, Homo Sapiens
NFSRKSSTR

SEQ ID NO: 1126962 - protein, 9 aa, Homo Sapiens
KGWPQKYST

SEQ ID NO: 1126963 - protein, 9 aa, Homo Sapiens
VVEPPPSSS

SEQ ID NO: 1126964 - protein, 9 aa, Homo Sapiens
PRGRSQDCD

SEQ ID NO: 1126965 - protein, 9 aa, Homo Sapiens
SVETLHAGR

SEQ ID NO: 1126966 - protein, 9 aa, Homo Sapiens
CLKYYHGIS

SEQ ID NO: 1126967 - protein, 9 aa, Homo Sapiens
VTVFKGSKN

SEQ ID NO: 1126968 - protein, 9 aa, Homo Sapiens
EALKLCQQL

SEQ ID NO: 1126969 - protein, 9 aa, Homo Sapiens
ERRAVIVKP

SEQ ID NO: 1126970 - protein, 9 aa, Homo Sapiens
STNADALHV

SEQ ID NO: 1126971 - protein, 9 aa, Homo Sapiens
RSLVPRCPW

SEQ ID NO: 1126972 - protein, 9 aa, Homo Sapiens
RRCTAVSVP

SEQ ID NO: 1126973 - protein, 9 aa, Homo Sapiens
MLNLEVVLP

SEQ ID NO: 1126974 - protein, 9 aa, Homo Sapiens
SLVSRICPN

SEQ ID NO: 1126975 - protein, 9 aa, Homo Sapiens
AMNARGIPR

SEQ ID NO: 1126976 - protein, 9 aa, Homo Sapiens
LYMWSFCFS

SEQ ID NO: 1126977 - protein, 9 aa, Homo Sapiens
GGPGQAAGR

SEQ ID NO: 1126978 - protein, 9 aa, Homo Sapiens
GGGTPLSIS

SEQ ID NO: 1126979 - protein, 9 aa, Homo Sapiens
RERERVRAR

SEQ ID NO: 1126980 - protein, 9 aa, Homo Sapiens
DLDRIFLVS

SEQ ID NO: 1126981 - protein, 9 aa, Homo Sapiens
ASTATTRTR

SEQ ID NO: 1126982 - protein, 9 aa, Homo Sapiens
GDPTGWFAI

SEQ ID NO: 1126983 - protein, 9 aa, Homo Sapiens
EEEGGNVEK

SEQ ID NO: 1126984 - protein, 9 aa, Homo Sapiens
AGYHLGSPT

SEQ ID NO: 1126985 - protein, 9 aa, Homo Sapiens
TPVPTATAA

SEQ ID NO: 1126986 - protein, 9 aa, Homo Sapiens
WTVSTGPPH

SEQ ID NO: 1126987 - protein, 9 aa, Homo Sapiens
PTLLHRATA

SEQ ID NO: 1126988 - protein, 9 aa, Homo Sapiens
IRELAVRAL

SEQ ID NO: 1126989 - protein, 9 aa, Homo Sapiens
RPCSEWPRE

SEQ ID NO: 1126990 - protein, 9 aa, Homo Sapiens
EVKRWNAVA

SEQ ID NO: 1126991 - protein, 9 aa, Homo Sapiens
ILGKRLKTG

SEQ ID NO: 1126992 - protein, 9 aa, Homo Sapiens
ELDLLDSTE

SEQ ID NO: 1126993 - protein, 9 aa, Homo Sapiens
LCDCLPGFR

SEQ ID NO: 1126994 - protein, 9 aa, Homo Sapiens
LFGVLGVAT

SEQ ID NO: 1126995 - protein, 9 aa, Homo Sapiens
TLVHIWKLS

SEQ ID NO: 1126996 - protein, 9 aa, Homo Sapiens
YRTHCQCIL

SEQ ID NO: 1126997 - protein, 9 aa, Homo Sapiens
IFSSPPSVT

SEQ ID NO: 1126998 - protein, 9 aa, Homo Sapiens
NSVTKVFKV

SEQ ID NO: 1126999 - protein, 9 aa, Homo Sapiens
WRLEGNHAV

SEQ ID NO: 1127000 - protein, 9 aa, Homo Sapiens
NNREHIFSL

SEQ ID NO: 1127001 - protein, 9 aa, Homo Sapiens
ASEALLLFV

SEQ ID NO: 1127002 - protein, 9 aa, Homo Sapiens
HKSREYEQL

SEQ ID NO: 1127003 - protein, 9 aa, Homo Sapiens
ACRQRRRGG

SEQ ID NO: 1127004 - protein, 9 aa, Homo Sapiens
AKRVDLLQD

SEQ ID NO: 1127005 - protein, 9 aa, Homo Sapiens
YSNMEFVCM

SEQ ID NO: 1127006 - protein, 9 aa, Homo Sapiens
NGKKMLSLT

SEQ ID NO: 1127007 - protein, 9 aa, Homo Sapiens
MLACLGMAT

SEQ ID NO: 1127008 - protein, 9 aa, Homo Sapiens
SRPGWKRTQ

SEQ ID NO: 1127009 - protein, 9 aa, Homo Sapiens
RRPSCTDEA

SEQ ID NO: 1127010 - protein, 9 aa, Homo Sapiens
TAAAGGGGS

SEQ ID NO: 1127011 - protein, 9 aa, Homo Sapiens
CHFRAKGIH

SEQ ID NO: 1127012 - protein, 9 aa, Homo Sapiens
KEAVWAKNM

SEQ ID NO: 1127013 - protein, 9 aa, Homo Sapiens
VSIPDYRGP

SEQ ID NO: 1127014 - protein, 9 aa, Homo Sapiens
PWRTSRGQA

SEQ ID NO: 1127015 - protein, 9 aa, Homo Sapiens
LEQKEVEQL

SEQ ID NO: 1127016 - protein, 9 aa, Homo Sapiens
LNGNDVEGV

SEQ ID NO: 1127017 - protein, 9 aa, Homo Sapiens
DHRSFTTKQ

SEQ ID NO: 1127018 - protein, 9 aa, Homo Sapiens
FHQSINKNL

SEQ ID NO: 1127019 - protein, 9 aa, Homo Sapiens
VASSRTGKL

SEQ ID NO: 1127020 - protein, 9 aa, Homo Sapiens
LKHQLRHPL

SEQ ID NO: 1127021 - protein, 9 aa, Homo Sapiens
QQPAKPPYS

SEQ ID NO: 1127022 - protein, 9 aa, Homo Sapiens
HINGPRDLG

SEQ ID NO: 1127023 - protein, 9 aa, Homo Sapiens
KLLRCKLAT

SEQ ID NO: 1127024 - protein, 9 aa, Homo Sapiens
LSKEPESLI

SEQ ID NO: 1127025 - protein, 9 aa, Homo Sapiens
RGPPSHCQL

SEQ ID NO: 1127026 - protein, 9 aa, Homo Sapiens
ALCPFRDVP

SEQ ID NO: 1127027 - protein, 9 aa, Homo Sapiens
CQQIASTTH

SEQ ID NO: 1127028 - protein, 9 aa, Homo Sapiens
AAATRGIST

SEQ ID NO: 1127029 - protein, 9 aa, Homo Sapiens
RDAPGLGVQ

SEQ ID NO: 1127030 - protein, 9 aa, Homo Sapiens
ASGRGRWQG

SEQ ID NO: 1127031 - protein, 9 aa, Homo Sapiens
PVICSLVRG

SEQ ID NO: 1127032 - protein, 9 aa, Homo Sapiens
SPPQAPLPV

SEQ ID NO: 1127033 - protein, 9 aa, Homo Sapiens
HSEENKANK

SEQ ID NO: 1127034 - protein, 9 aa, Homo Sapiens
ARQSCCLPG

SEQ ID NO: 1127035 - protein, 9 aa, Homo Sapiens
TRSAVMSAN

SEQ ID NO: 1127036 - protein, 9 aa, Homo Sapiens
TEELGGLEA

SEQ ID NO: 1127037 - protein, 9 aa, Homo Sapiens
HQKFGSGST

SEQ ID NO: 1127038 - protein, 9 aa, Homo Sapiens
LGADPEEEL

SEQ ID NO: 1127039 - protein, 9 aa, Homo Sapiens
LRPSKRPSW

SEQ ID NO: 1127040 - protein, 9 aa, Homo Sapiens
SHGSPFTSA

SEQ ID NO: 1127041 - protein, 9 aa, Homo Sapiens
RVCRPQPAL

SEQ ID NO: 1127042 - protein, 9 aa, Homo Sapiens
ISLMIEYSE

SEQ ID NO: 1127043 - protein, 9 aa, Homo Sapiens
VWVPWLPLQ

SEQ ID NO: 1127044 - protein, 9 aa, Homo Sapiens
VNLKKYSSC

SEQ ID NO: 1127045 - protein, 9 aa, Homo Sapiens
LGSNGQSPF

SEQ ID NO: 1127046 - protein, 9 aa, Homo Sapiens
RQPTGAHRP

SEQ ID NO: 1127047 - protein, 9 aa, Homo Sapiens
FGDTFPPAQ

SEQ ID NO: 1127048 - protein, 9 aa, Homo Sapiens
NAVDCEQAV

SEQ ID NO: 1127049 - protein, 9 aa, Homo Sapiens
CRCQETITN

SEQ ID NO: 1127050 - protein, 9 aa, Homo Sapiens
NRISHASTS

SEQ ID NO: 1127051 - protein, 9 aa, Homo Sapiens
AWIGAGRAP

SEQ ID NO: 1127052 - protein, 9 aa, Homo Sapiens
PLIPLLGDQ

SEQ ID NO: 1127053 - protein, 9 aa, Homo Sapiens
IRGFILERI

SEQ ID NO: 1127054 - protein, 9 aa, Homo Sapiens
AQPASGESS

SEQ ID NO: 1127055 - protein, 9 aa, Homo Sapiens
RARVRAPCC

SEQ ID NO: 1127056 - protein, 9 aa, Homo Sapiens
LVVAAAVVV

SEQ ID NO: 1127057 - protein, 9 aa, Homo Sapiens
QPNKPRVCP

SEQ ID NO: 1127058 - protein, 9 aa, Homo Sapiens
YACQNPTIF

SEQ ID NO: 1127059 - protein, 9 aa, Homo Sapiens
VTIMCDKFS

SEQ ID NO: 1127060 - protein, 9 aa, Homo Sapiens
PRSRTGSCP

SEQ ID NO: 1127061 - protein, 9 aa, Homo Sapiens
YCRSGRNSA

SEQ ID NO: 1127062 - protein, 9 aa, Homo Sapiens
HPLCTVASP

SEQ ID NO: 1127063 - protein, 9 aa, Homo Sapiens
RPHGGLKLF

SEQ ID NO: 1127064 - protein, 9 aa, Homo Sapiens
VEPPPSSSQ

SEQ ID NO: 1127065 - protein, 9 aa, Homo Sapiens
KGRMLKLES

SEQ ID NO: 1127066 - protein, 9 aa, Homo Sapiens
APAPPARDP

SEQ ID NO: 1127067 - protein, 9 aa, Homo Sapiens
AAGSTTLHT

SEQ ID NO: 1127068 - protein, 9 aa, Homo Sapiens
MVCCLKTSC

SEQ ID NO: 1127069 - protein, 9 aa, Homo Sapiens
TLKQTGHVS

SEQ ID NO: 1127070 - protein, 9 aa, Homo Sapiens
CGIHSKYVR

SEQ ID NO: 1127071 - protein, 9 aa, Homo Sapiens
MNPRDLIPR

SEQ ID NO: 1127072 - protein, 9 aa, Homo Sapiens
NLFVVNRPW

SEQ ID NO: 1127073 - protein, 9 aa, Homo Sapiens
CTACSPPRL

SEQ ID NO: 1127074 - protein, 9 aa, Homo Sapiens
LTDYPEFRQ

SEQ ID NO: 1127075 - protein, 9 aa, Homo Sapiens
GFTGTCCHE

SEQ ID NO: 1127076 - protein, 9 aa, Homo Sapiens
QINCSRFTT

SEQ ID NO: 1127077 - protein, 9 aa, Homo Sapiens
VYKGIVLSS

SEQ ID NO: 1127078 - protein, 9 aa, Homo Sapiens
SGIYQFIMD

SEQ ID NO: 1127079 - protein, 9 aa, Homo Sapiens
RVKMWKRRW

SEQ ID NO: 1127080 - protein, 9 aa, Homo Sapiens
HRVPPFPSH

SEQ ID NO: 1127081 - protein, 9 aa, Homo Sapiens
FIYGTSIIV

SEQ ID NO: 1127082 - protein, 9 aa, Homo Sapiens
YLQPTNRRS

SEQ ID NO: 1127083 - protein, 9 aa, Homo Sapiens
LSRAPPVRD

SEQ ID NO: 1127084 - protein, 9 aa, Homo Sapiens
AVSIPDYRG

SEQ ID NO: 1127085 - protein, 9 aa, Homo Sapiens
PEVLQDLWE

SEQ ID NO: 1127086 - protein, 9 aa, Homo Sapiens
INHFFVTPQ

SEQ ID NO: 1127087 - protein, 9 aa, Homo Sapiens
VPHWQDHIT

SEQ ID NO: 1127088 - protein, 9 aa, Homo Sapiens
MLTHQEVPV

SEQ ID NO: 1127089 - protein, 9 aa, Homo Sapiens
MGRLDLATQ

SEQ ID NO: 1127090 - protein, 9 aa, Homo Sapiens
SSTRSYNWN

SEQ ID NO: 1127091 - protein, 9 aa, Homo Sapiens
DLLAHAFFC

SEQ ID NO: 1127092 - protein, 9 aa, Homo Sapiens
LTYSNLHTL

SEQ ID NO: 1127093 - protein, 9 aa, Homo Sapiens
CIGEESGGV

SEQ ID NO: 1127094 - protein, 9 aa, Homo Sapiens
WKRVHSKHS

SEQ ID NO: 1127095 - protein, 9 aa, Homo Sapiens
PPTTTTSSP

SEQ ID NO: 1127096 - protein, 9 aa, Homo Sapiens
TPALPTQQL

SEQ ID NO: 1127097 - protein, 9 aa, Homo Sapiens
SHHSAWLTI

SEQ ID NO: 1127098 - protein, 9 aa, Homo Sapiens
PKARPGTSP

SEQ ID NO: 1127099 - protein, 9 aa, Homo Sapiens
PVCFDFVLP

SEQ ID NO: 1127100 - protein, 9 aa, Homo Sapiens
VTGTPANIS

SEQ ID NO: 1127101 - protein, 9 aa, Homo Sapiens
ASRGSRAEV

SEQ ID NO: 1127102 - protein, 9 aa, Homo Sapiens
LEKALSALF

SEQ ID NO: 1127103 - protein, 9 aa, Homo Sapiens
PPPPPRTCC

SEQ ID NO: 1127104 - protein, 9 aa, Homo Sapiens
VKETGLFRK

SEQ ID NO: 1127105 - protein, 9 aa, Homo Sapiens
ASDYLHIGH

SEQ ID NO: 1127106 - protein, 9 aa, Homo Sapiens
SIALATSKA

SEQ ID NO: 1127107 - protein, 9 aa, Homo Sapiens
TLKKARIFA

SEQ ID NO: 1127108 - protein, 9 aa, Homo Sapiens
LMYITTVLG

SEQ ID NO: 1127109 - protein, 9 aa, Homo Sapiens
RRYHGCRAE

SEQ ID NO: 1127110 - protein, 9 aa, Homo Sapiens
GETSCSEQP

SEQ ID NO: 1127111 - protein, 9 aa, Homo Sapiens
FGRKLQRCD

SEQ ID NO: 1127112 - protein, 9 aa, Homo Sapiens
CSGSQRTSS

SEQ ID NO: 1127113 - protein, 9 aa, Homo Sapiens
KVKKERPTD

SEQ ID NO: 1127114 - protein, 9 aa, Homo Sapiens
IAFSTSITR

SEQ ID NO: 1127115 - protein, 9 aa, Homo Sapiens
LEGSAEMTG

SEQ ID NO: 1127116 - protein, 9 aa, Homo Sapiens
VKSLPERRF

SEQ ID NO: 1127117 - protein, 9 aa, Homo Sapiens
EAGHEPICD

SEQ ID NO: 1127118 - protein, 9 aa, Homo Sapiens
LLEMVLESA

SEQ ID NO: 1127119 - protein, 9 aa, Homo Sapiens
SNGKHITKS

SEQ ID NO: 1127120 - protein, 9 aa, Homo Sapiens
CAPQAPHPR

SEQ ID NO: 1127121 - protein, 9 aa, Homo Sapiens
QGGLGGSCQ

SEQ ID NO: 1127122 - protein, 9 aa, Homo Sapiens
ASQTCVAPD

SEQ ID NO: 1127123 - protein, 9 aa, Homo Sapiens
ILLHLGLQP

SEQ ID NO: 1127124 - protein, 9 aa, Homo Sapiens
GMYMLHLES

SEQ ID NO: 1127125 - protein, 9 aa, Homo Sapiens
QLAKRVDLL

SEQ ID NO: 1127126 - protein, 9 aa, Homo Sapiens
ASDSDSSTD

SEQ ID NO: 1127127 - protein, 9 aa, Homo Sapiens
SKIVQAFPS

SEQ ID NO: 1127128 - protein, 9 aa, Homo Sapiens
IHEVETLPR

SEQ ID NO: 1127129 - protein, 9 aa, Homo Sapiens
RILFDIICP

SEQ ID NO: 1127130 - protein, 9 aa, Homo Sapiens
DLKTKSIIF

SEQ ID NO: 1127131 - protein, 9 aa, Homo Sapiens
HIEQLSRFA

SEQ ID NO: 1127132 - protein, 9 aa, Homo Sapiens
EFRYLDDGG

SEQ ID NO: 1127133 - protein, 9 aa, Homo Sapiens
VNPFSLWED

SEQ ID NO: 1127134 - protein, 9 aa, Homo Sapiens
EKYVQEDAG

SEQ ID NO: 1127135 - protein, 9 aa, Homo Sapiens
LQLAKRVDL

SEQ ID NO: 1127136 - protein, 9 aa, Homo Sapiens
RSVESWGTQ

SEQ ID NO: 1127137 - protein, 9 aa, Homo Sapiens
RLGHGLVTV

SEQ ID NO: 1127138 - protein, 9 aa, Homo Sapiens
WFWSLCCTV

SEQ ID NO: 1127139 - protein, 9 aa, Homo Sapiens
HFCWLMAVV

SEQ ID NO: 1127140 - protein, 9 aa, Homo Sapiens
LGINVADKK

SEQ ID NO: 1127141 - protein, 9 aa, Homo Sapiens
PCWLSKEPE

SEQ ID NO: 1127142 - protein, 9 aa, Homo Sapiens
HDVHHLIHL

SEQ ID NO: 1127143 - protein, 9 aa, Homo Sapiens
TSCTTFTRH

SEQ ID NO: 1127144 - protein, 9 aa, Homo Sapiens
VGNAKTTHN

SEQ ID NO: 1127145 - protein, 9 aa, Homo Sapiens
SCSRGARGA

SEQ ID NO: 1127146 - protein, 9 aa, Homo Sapiens
ELAACSEYF

SEQ ID NO: 1127147 - protein, 9 aa, Homo Sapiens
EGELGAPRS

SEQ ID NO: 1127148 - protein, 9 aa, Homo Sapiens
RVVRTVGQA

SEQ ID NO: 1127149 - protein, 9 aa, Homo Sapiens
AYTFETKAD

SEQ ID NO: 1127150 - protein, 9 aa, Homo Sapiens
ACVLWKKKD

SEQ ID NO: 1127151 - protein, 9 aa, Homo Sapiens
MIFGDLMHF

SEQ ID NO: 1127152 - protein, 9 aa, Homo Sapiens
LMSTMKISL

SEQ ID NO: 1127153 - protein, 9 aa, Homo Sapiens
VRALGRFKL

SEQ ID NO: 1127154 - protein, 9 aa, Homo Sapiens
TRSSDLEAQ

SEQ ID NO: 1127155 - protein, 9 aa, Homo Sapiens
AVPILCLFW

SEQ ID NO: 1127156 - protein, 9 aa, Homo Sapiens
LRTLPFTIK

SEQ ID NO: 1127157 - protein, 9 aa, Homo Sapiens
RLSCPYHPG

SEQ ID NO: 1127158 - protein, 9 aa, Homo Sapiens
DLTEEMNKR

SEQ ID NO: 1127159 - protein, 9 aa, Homo Sapiens
EHENRISHA

SEQ ID NO: 1127160 - protein, 9 aa, Homo Sapiens
VDGITSFSC

SEQ ID NO: 1127161 - protein, 9 aa, Homo Sapiens
LHVLSDDHH

SEQ ID NO: 1127162 - protein, 9 aa, Homo Sapiens
GEFFGNCFI

SEQ ID NO: 1127163 - protein, 9 aa, Homo Sapiens
ILEVFVMGL

SEQ ID NO: 1127164 - protein, 9 aa, Homo Sapiens
PLFQAGTSL

SEQ ID NO: 1127165 - protein, 9 aa, Homo Sapiens
QARGRVNNI

SEQ ID NO: 1127166 - protein, 9 aa, Homo Sapiens
DDHETVDKI

SEQ ID NO: 1127167 - protein, 9 aa, Homo Sapiens
GPLRVPEGA

SEQ ID NO: 1127168 - protein, 9 aa, Homo Sapiens
RVRKIGDWK

SEQ ID NO: 1127169 - protein, 9 aa, Homo Sapiens
PRRRPCASC

SEQ ID NO: 1127170 - protein, 9 aa, Homo Sapiens
RKDCKWSSC

SEQ ID NO: 1127171 - protein, 9 aa, Homo Sapiens
VWSELPPGR

SEQ ID NO: 1127172 - protein, 9 aa, Homo Sapiens
RETLESGGA

SEQ ID NO: 1127173 - protein, 9 aa, Homo Sapiens
YDHSYPEGF

SEQ ID NO: 1127174 - protein, 9 aa, Homo Sapiens
TLALFRLNH

SEQ ID NO: 1127175 - protein, 9 aa, Homo Sapiens
FITAVKAVG

SEQ ID NO: 1127176 - protein, 9 aa, Homo Sapiens
SSLALESKS

SEQ ID NO: 1127177 - protein, 9 aa, Homo Sapiens
LEAGSFPTC

SEQ ID NO: 1127178 - protein, 9 aa, Homo Sapiens
AQAKLTGGL

SEQ ID NO: 1127179 - protein, 9 aa, Homo Sapiens
STWEPEENL

SEQ ID NO: 1127180 - protein, 9 aa, Homo Sapiens
APPQENKAV

SEQ ID NO: 1127181 - protein, 9 aa, Homo Sapiens
SAQPLTLPL

SEQ ID NO: 1127182 - protein, 9 aa, Homo Sapiens
VFVITAAGA

SEQ ID NO: 1127183 - protein, 9 aa, Homo Sapiens
KDLDRIFLV

SEQ ID NO: 1127184 - protein, 9 aa, Homo Sapiens
ADAAEALFY

SEQ ID NO: 1127185 - protein, 9 aa, Homo Sapiens
KANELYEPI

SEQ ID NO: 1127186 - protein, 9 aa, Homo Sapiens
ALFLSAPPH

SEQ ID NO: 1127187 - protein, 9 aa, Homo Sapiens
TTGGTAPMW

SEQ ID NO: 1127188 - protein, 9 aa, Homo Sapiens
PGPCLVEGT

SEQ ID NO: 1127189 - protein, 9 aa, Homo Sapiens
PRVNGCQDT

SEQ ID NO: 1127190 - protein, 9 aa, Homo Sapiens
KSYALSNKN

SEQ ID NO: 1127191 - protein, 9 aa, Homo Sapiens
LKLYFRGLK

SEQ ID NO: 1127192 - protein, 9 aa, Homo Sapiens
CLDVGLAHL

SEQ ID NO: 1127193 - protein, 9 aa, Homo Sapiens
YAPSSSNNL

SEQ ID NO: 1127194 - protein, 9 aa, Homo Sapiens
FIFAYLIFA

SEQ ID NO: 1127195 - protein, 9 aa, Homo Sapiens
DDDDDDDGL

SEQ ID NO: 1127196 - protein, 9 aa, Homo Sapiens
LALLLLMDA

SEQ ID NO: 1127197 - protein, 9 aa, Homo Sapiens
SSPDEAAED

SEQ ID NO: 1127198 - protein, 9 aa, Homo Sapiens
WLPLQIEVS

SEQ ID NO: 1127199 - protein, 9 aa, Homo Sapiens
VLSQKKSKQ

SEQ ID NO: 1127200 - protein, 9 aa, Homo Sapiens
NINVKKMSQ

SEQ ID NO: 1127201 - protein, 9 aa, Homo Sapiens
MCASLYVGW

SEQ ID NO: 1127202 - protein, 9 aa, Homo Sapiens
PLRMAKNPQ

SEQ ID NO: 1127203 - protein, 9 aa, Homo Sapiens
FSEQRAGQS

SEQ ID NO: 1127204 - protein, 9 aa, Homo Sapiens
HPTMTTRTS

SEQ ID NO: 1127205 - protein, 9 aa, Homo Sapiens
LLPEYVVPC

SEQ ID NO: 1127206 - protein, 9 aa, Homo Sapiens
PNLSLAQVK

SEQ ID NO: 1127207 - protein, 9 aa, Homo Sapiens
ASPSAPTSR

SEQ ID NO: 1127208 - protein, 9 aa, Homo Sapiens
NMANGTVIH

SEQ ID NO: 1127209 - protein, 9 aa, Homo Sapiens
QGHLLYRIR

SEQ ID NO: 1127210 - protein, 9 aa, Homo Sapiens
QVTVTATAV

SEQ ID NO: 1127211 - protein, 9 aa, Homo Sapiens
AGVATDTKV

SEQ ID NO: 1127212 - protein, 9 aa, Homo Sapiens
SMMVVHNIY

SEQ ID NO: 1127213 - protein, 9 aa, Homo Sapiens
VATDTKVGS

SEQ ID NO: 1127214 - protein, 9 aa, Homo Sapiens
CCHENIDDC

SEQ ID NO: 1127215 - protein, 9 aa, Homo Sapiens
KALKPQLSG

SEQ ID NO: 1127216 - protein, 9 aa, Homo Sapiens
RPELGPQLA

SEQ ID NO: 1127217 - protein, 9 aa, Homo Sapiens
RRRGSDGVD

SEQ ID NO: 1127218 - protein, 9 aa, Homo Sapiens
MRPGTMRLA

SEQ ID NO: 1127219 - protein, 9 aa, Homo Sapiens
SLAKQSWGA

SEQ ID NO: 1127220 - protein, 9 aa, Homo Sapiens
MVKAVQLRV

SEQ ID NO: 1127221 - protein, 9 aa, Homo Sapiens
KTIMELKDE

SEQ ID NO: 1127222 - protein, 9 aa, Homo Sapiens
NRPRPPTRP

SEQ ID NO: 1127223 - protein, 9 aa, Homo Sapiens
APRSQGAPT

SEQ ID NO: 1127224 - protein, 9 aa, Homo Sapiens
AAVLCDCYD

SEQ ID NO: 1127225 - protein, 9 aa, Homo Sapiens
EPKVTAEFD

SEQ ID NO: 1127226 - protein, 9 aa, Homo Sapiens
PRTQGHWHR

SEQ ID NO: 1127227 - protein, 9 aa, Homo Sapiens
SRNSLPPTS

SEQ ID NO: 1127228 - protein, 9 aa, Homo Sapiens
SSSSNEDEN

SEQ ID NO: 1127229 - protein, 9 aa, Homo Sapiens
GSHPDAILQ

SEQ ID NO: 1127230 - protein, 9 aa, Homo Sapiens
SRTAQDSWW

SEQ ID NO: 1127231 - protein, 9 aa, Homo Sapiens
ILKCHNSDA

SEQ ID NO: 1127232 - protein, 9 aa, Homo Sapiens
PGPPGSLRL

SEQ ID NO: 1127233 - protein, 9 aa, Homo Sapiens
PATSVEESL

SEQ ID NO: 1127234 - protein, 9 aa, Homo Sapiens
PVATNSCKG

SEQ ID NO: 1127235 - protein, 9 aa, Homo Sapiens
RPSTSTRCR

SEQ ID NO: 1127236 - protein, 9 aa, Homo Sapiens
DCMTSHVRG

SEQ ID NO: 1127237 - protein, 9 aa, Homo Sapiens
VQVLLNAGE

SEQ ID NO: 1127238 - protein, 9 aa, Homo Sapiens
SEQPALTCA

SEQ ID NO: 1127239 - protein, 9 aa, Homo Sapiens
ARHDRGNYA

SEQ ID NO: 1127240 - protein, 9 aa, Homo Sapiens
VFFFDAYFV

SEQ ID NO: 1127241 - protein, 9 aa, Homo Sapiens
GSDVQSYSI

SEQ ID NO: 1127242 - protein, 9 aa, Homo Sapiens
AGDGHGRLV

SEQ ID NO: 1127243 - protein, 9 aa, Homo Sapiens
RAERERAQA

SEQ ID NO: 1127244 - protein, 9 aa, Homo Sapiens
VYWCVIERR

SEQ ID NO: 1127245 - protein, 9 aa, Homo Sapiens
WKNRKEESY

SEQ ID NO: 1127246 - protein, 9 aa, Homo Sapiens
LFFKLMMSS

SEQ ID NO: 1127247 - protein, 9 aa, Homo Sapiens
CLVEGTAVR

SEQ ID NO: 1127248 - protein, 9 aa, Homo Sapiens
GLNNLSSPD

SEQ ID NO: 1127249 - protein, 9 aa, Homo Sapiens
CVWGGYVSI

SEQ ID NO: 1127250 - protein, 9 aa, Homo Sapiens
DEETKRKLR

SEQ ID NO: 1127251 - protein, 9 aa, Homo Sapiens
QHIRIDDST

SEQ ID NO: 1127252 - protein, 9 aa, Homo Sapiens
TKDTICSGV

SEQ ID NO: 1127253 - protein, 9 aa, Homo Sapiens
GVKKLMNAR

SEQ ID NO: 1127254 - protein, 9 aa, Homo Sapiens
RTAQDSWWL

SEQ ID NO: 1127255 - protein, 9 aa, Homo Sapiens
PYACEACQN

SEQ ID NO: 1127256 - protein, 9 aa, Homo Sapiens
QVRSKAKAE

SEQ ID NO: 1127257 - protein, 9 aa, Homo Sapiens
VSTPPASAT

SEQ ID NO: 1127258 - protein, 9 aa, Homo Sapiens
TSLKASRMS

SEQ ID NO: 1127259 - protein, 9 aa, Homo Sapiens
HVFIGINDL

SEQ ID NO: 1127260 - protein, 9 aa, Homo Sapiens
VIVGHLMGR

SEQ ID NO: 1127261 - protein, 9 aa, Homo Sapiens
VDGNFLCVW

SEQ ID NO: 1127262 - protein, 9 aa, Homo Sapiens
CIHEAIKKN

SEQ ID NO: 1127263 - protein, 9 aa, Homo Sapiens
PSCPRCPRP

SEQ ID NO: 1127264 - protein, 9 aa, Homo Sapiens
TAEFTTTEG

SEQ ID NO: 1127265 - protein, 9 aa, Homo Sapiens
NITWGQSLD

SEQ ID NO: 1127266 - protein, 9 aa, Homo Sapiens
QWGKSHSIP

SEQ ID NO: 1127267 - protein, 9 aa, Homo Sapiens
VRRAGRRPL

SEQ ID NO: 1127268 - protein, 9 aa, Homo Sapiens
AEKQYRGII

SEQ ID NO: 1127269 - protein, 9 aa, Homo Sapiens
VTLDSALVF

SEQ ID NO: 1127270 - protein, 9 aa, Homo Sapiens
LLHLEDAVR

SEQ ID NO: 1127271 - protein, 9 aa, Homo Sapiens
LYSRQGSTE

SEQ ID NO: 1127272 - protein, 9 aa, Homo Sapiens
YALQTFDYE

SEQ ID NO: 1127273 - protein, 9 aa, Homo Sapiens
NNKEGSFQR

SEQ ID NO: 1127274 - protein, 9 aa, Homo Sapiens
GASPCCLQA

SEQ ID NO: 1127275 - protein, 9 aa, Homo Sapiens
LLVGQPKNR

SEQ ID NO: 1127276 - protein, 9 aa, Homo Sapiens
AELVPVVEL

SEQ ID NO: 1127277 - protein, 9 aa, Homo Sapiens
LERGYRHPV

SEQ ID NO: 1127278 - protein, 9 aa, Homo Sapiens
VPELTQMFD

SEQ ID NO: 1127279 - protein, 9 aa, Homo Sapiens
DSLRGNSKT

SEQ ID NO: 1127280 - protein, 9 aa, Homo Sapiens
HMRKEGHEV

SEQ ID NO: 1127281 - protein, 9 aa, Homo Sapiens
RSYEGFGMY

SEQ ID NO: 1127282 - protein, 9 aa, Homo Sapiens
EITDDLDVG

SEQ ID NO: 1127283 - protein, 9 aa, Homo Sapiens
ASKASRAGG

SEQ ID NO: 1127284 - protein, 9 aa, Homo Sapiens
RDGLLFRHI

SEQ ID NO: 1127285 - protein, 9 aa, Homo Sapiens
DSPVRNQAS

SEQ ID NO: 1127286 - protein, 9 aa, Homo Sapiens
STFRDHKRV

SEQ ID NO: 1127287 - protein, 9 aa, Homo Sapiens
VPLLLVLLH

SEQ ID NO: 1127288 - protein, 9 aa, Homo Sapiens
TGLGILQQR

SEQ ID NO: 1127289 - protein, 9 aa, Homo Sapiens
SCGPTSGST

SEQ ID NO: 1127290 - protein, 9 aa, Homo Sapiens
GPCQRPQTG

SEQ ID NO: 1127291 - protein, 9 aa, Homo Sapiens
STTINRNHM

SEQ ID NO: 1127292 - protein, 9 aa, Homo Sapiens
GPNRELVCR

SEQ ID NO: 1127293 - protein, 9 aa, Homo Sapiens
SLFYVASDD

SEQ ID NO: 1127294 - protein, 9 aa, Homo Sapiens
SPCWLSKEP

SEQ ID NO: 1127295 - protein, 9 aa, Homo Sapiens
SPGACRPAC

SEQ ID NO: 1127296 - protein, 9 aa, Homo Sapiens
IPSTLMRRL

SEQ ID NO: 1127297 - protein, 9 aa, Homo Sapiens
RCVDGITSF

SEQ ID NO: 1127298 - protein, 9 aa, Homo Sapiens
QYSAQPLTL

SEQ ID NO: 1127299 - protein, 9 aa, Homo Sapiens
EKKNQEKIA

SEQ ID NO: 1127300 - protein, 9 aa, Homo Sapiens
PHEVKLSIE

SEQ ID NO: 1127301 - protein, 9 aa, Homo Sapiens
RFPTYRGLL

SEQ ID NO: 1127302 - protein, 9 aa, Homo Sapiens
DVSSDVHRF

SEQ ID NO: 1127303 - protein, 9 aa, Homo Sapiens
DGMLTVIGQ

SEQ ID NO: 1127304 - protein, 9 aa, Homo Sapiens
IDICPVGVL

SEQ ID NO: 1127305 - protein, 9 aa, Homo Sapiens
VVHMMTQSS

SEQ ID NO: 1127306 - protein, 9 aa, Homo Sapiens
QNHVSRGDV

SEQ ID NO: 1127307 - protein, 9 aa, Homo Sapiens
AERVWRLEG

SEQ ID NO: 1127308 - protein, 9 aa, Homo Sapiens
KKMKVSQSL

SEQ ID NO: 1127309 - protein, 9 aa, Homo Sapiens
VLPAGRIRS

SEQ ID NO: 1127310 - protein, 9 aa, Homo Sapiens
QRKIGDHGP

SEQ ID NO: 1127311 - protein, 9 aa, Homo Sapiens
VSMKKTIFM

SEQ ID NO: 1127312 - protein, 9 aa, Homo Sapiens
GDHESSGWS

SEQ ID NO: 1127313 - protein, 9 aa, Homo Sapiens
PNIPPVGLL

SEQ ID NO: 1127314 - protein, 9 aa, Homo Sapiens
YIKFRREED

SEQ ID NO: 1127315 - protein, 9 aa, Homo Sapiens
GKLEMVKAV

SEQ ID NO: 1127316 - protein, 9 aa, Homo Sapiens
LFIRENNSP

SEQ ID NO: 1127317 - protein, 9 aa, Homo Sapiens
REYVMCRTP

SEQ ID NO: 1127318 - protein, 9 aa, Homo Sapiens
TLSGIYQFI

SEQ ID NO: 1127319 - protein, 9 aa, Homo Sapiens
VHYIMLHIG

SEQ ID NO: 1127320 - protein, 9 aa, Homo Sapiens
PCCAPQAPH

SEQ ID NO: 1127321 - protein, 9 aa, Homo Sapiens
FLAEGGGVC

SEQ ID NO: 1127322 - protein, 9 aa, Homo Sapiens
FEDPLFPST

SEQ ID NO: 1127323 - protein, 9 aa, Homo Sapiens
LPQDVGTSS

SEQ ID NO: 1127324 - protein, 9 aa, Homo Sapiens
YWCVIERRG

SEQ ID NO: 1127325 - protein, 9 aa, Homo Sapiens
VSEDLRALG

SEQ ID NO: 1127326 - protein, 9 aa, Homo Sapiens
SMLSAAIFV

SEQ ID NO: 1127327 - protein, 9 aa, Homo Sapiens
QCRGTHVYQ

SEQ ID NO: 1127328 - protein, 9 aa, Homo Sapiens
LDNSTDDAD

SEQ ID NO: 1127329 - protein, 9 aa, Homo Sapiens
RSLQDAQCL

SEQ ID NO: 1127330 - protein, 9 aa, Homo Sapiens
VQGIPLIPG

SEQ ID NO: 1127331 - protein, 9 aa, Homo Sapiens
SRAPPVRDP

SEQ ID NO: 1127332 - protein, 9 aa, Homo Sapiens
RSLATVDSP

SEQ ID NO: 1127333 - protein, 9 aa, Homo Sapiens
QELEEEERR

SEQ ID NO: 1127334 - protein, 9 aa, Homo Sapiens
EVPAFLKTW

SEQ ID NO: 1127335 - protein, 9 aa, Homo Sapiens
WWLPMGSLS

SEQ ID NO: 1127336 - protein, 9 aa, Homo Sapiens
RSPTSAPTA

SEQ ID NO: 1127337 - protein, 9 aa, Homo Sapiens
DKVGRLSAP

SEQ ID NO: 1127338 - protein, 9 aa, Homo Sapiens
GAAVGAGAG

SEQ ID NO: 1127339 - protein, 9 aa, Homo Sapiens
TLSEVELLA

SEQ ID NO: 1127340 - protein, 9 aa, Homo Sapiens
QPYQREAPQ

SEQ ID NO: 1127341 - protein, 9 aa, Homo Sapiens
IRWTLTRML

SEQ ID NO: 1127342 - protein, 9 aa, Homo Sapiens
VQEGVDEYV

SEQ ID NO: 1127343 - protein, 9 aa, Homo Sapiens
ERIETIKAR

SEQ ID NO: 1127344 - protein, 9 aa, Homo Sapiens
DPTGWFAIQ

SEQ ID NO: 1127345 - protein, 9 aa, Homo Sapiens
CLDYGAHRC

SEQ ID NO: 1127346 - protein, 9 aa, Homo Sapiens
DAAEESCTL

SEQ ID NO: 1127347 - protein, 9 aa, Homo Sapiens
QGFCLTLRS

SEQ ID NO: 1127348 - protein, 9 aa, Homo Sapiens
RLSNVAPPA

SEQ ID NO: 1127349 - protein, 9 aa, Homo Sapiens
RVWRLEGNH

SEQ ID NO: 1127350 - protein, 9 aa, Homo Sapiens
TNLPTPQKF

SEQ ID NO: 1127351 - protein, 9 aa, Homo Sapiens
VSGPRVSQG

SEQ ID NO: 1127352 - protein, 9 aa, Homo Sapiens
LAGLLSAAY

SEQ ID NO: 1127353 - protein, 9 aa, Homo Sapiens
METFLSKAC

SEQ ID NO: 1127354 - protein, 9 aa, Homo Sapiens
LLYGRGENF

SEQ ID NO: 1127355 - protein, 9 aa, Homo Sapiens
SEDVKWPND

SEQ ID NO: 1127356 - protein, 9 aa, Homo Sapiens
VSKGALVQT

SEQ ID NO: 1127357 - protein, 9 aa, Homo Sapiens
GSAHPHPWL

SEQ ID NO: 1127358 - protein, 9 aa, Homo Sapiens
NRELVCRSC

SEQ ID NO: 1127359 - protein, 9 aa, Homo Sapiens
VEQDPGPLR

SEQ ID NO: 1127360 - protein, 9 aa, Homo Sapiens
SMEVDVQAL

SEQ ID NO: 1127361 - protein, 9 aa, Homo Sapiens
GVRSLWWYP

SEQ ID NO: 1127362 - protein, 9 aa, Homo Sapiens
PVVVVAAPA

SEQ ID NO: 1127363 - protein, 9 aa, Homo Sapiens
TDRERERVR

SEQ ID NO: 1127364 - protein, 9 aa, Homo Sapiens
EDQVRKQEN

SEQ ID NO: 1127365 - protein, 9 aa, Homo Sapiens
FHFAAISHR

SEQ ID NO: 1127366 - protein, 9 aa, Homo Sapiens
DLKELRHKE

SEQ ID NO: 1127367 - protein, 9 aa, Homo Sapiens
AEESCTLIC

SEQ ID NO: 1127368 - protein, 9 aa, Homo Sapiens
VCRPQPALQ

SEQ ID NO: 1127369 - protein, 9 aa, Homo Sapiens
SLRSPITSI

SEQ ID NO: 1127370 - protein, 9 aa, Homo Sapiens
AGQLLTDPS

SEQ ID NO: 1127371 - protein, 9 aa, Homo Sapiens
FLLIQWYIC

SEQ ID NO: 1127372 - protein, 9 aa, Homo Sapiens
SPTGSVTHQ

SEQ ID NO: 1127373 - protein, 9 aa, Homo Sapiens
GTYYGDNRF

SEQ ID NO: 1127374 - protein, 9 aa, Homo Sapiens
EPKARPGTS

SEQ ID NO: 1127375 - protein, 9 aa, Homo Sapiens
EIGVTLKDG

SEQ ID NO: 1127376 - protein, 9 aa, Homo Sapiens
PGKDYCFPN

SEQ ID NO: 1127377 - protein, 9 aa, Homo Sapiens
RRCWHRRLA

SEQ ID NO: 1127378 - protein, 9 aa, Homo Sapiens
GTLSDDLGK

SEQ ID NO: 1127379 - protein, 9 aa, Homo Sapiens
GPPVQPALT

SEQ ID NO: 1127380 - protein, 9 aa, Homo Sapiens
APQGALTPP

SEQ ID NO: 1127381 - protein, 9 aa, Homo Sapiens
SKKTKKKRK

SEQ ID NO: 1127382 - protein, 9 aa, Homo Sapiens
FKTDLCFQS

SEQ ID NO: 1127383 - protein, 9 aa, Homo Sapiens
LSLALWPPP

SEQ ID NO: 1127384 - protein, 9 aa, Homo Sapiens
CKGEKLPED

SEQ ID NO: 1127385 - protein, 9 aa, Homo Sapiens
DDGGRTGRF

SEQ ID NO: 1127386 - protein, 9 aa, Homo Sapiens
SGARRRGAR

SEQ ID NO: 1127387 - protein, 9 aa, Homo Sapiens
KDNYGLLDQ

SEQ ID NO: 1127388 - protein, 9 aa, Homo Sapiens
PSEEPFPST

SEQ ID NO: 1127389 - protein, 9 aa, Homo Sapiens
PKHKLPLES

SEQ ID NO: 1127390 - protein, 9 aa, Homo Sapiens
SEEVSVSYS

SEQ ID NO: 1127391 - protein, 9 aa, Homo Sapiens
VYSRDSNYL

SEQ ID NO: 1127392 - protein, 9 aa, Homo Sapiens
APKVPEATL

SEQ ID NO: 1127393 - protein, 9 aa, Homo Sapiens
FFATARERY

SEQ ID NO: 1127394 - protein, 9 aa, Homo Sapiens
EYCRLDACE

SEQ ID NO: 1127395 - protein, 9 aa, Homo Sapiens
VFATQPVLE

SEQ ID NO: 1127396 - protein, 9 aa, Homo Sapiens
APTRCLDEN

SEQ ID NO: 1127397 - protein, 9 aa, Homo Sapiens
VLRPSSPPS

SEQ ID NO: 1127398 - protein, 9 aa, Homo Sapiens
SGKTSVAVH

SEQ ID NO: 1127399 - protein, 9 aa, Homo Sapiens
MRCNLHRCP

SEQ ID NO: 1127400 - protein, 9 aa, Homo Sapiens
GRPLYFWFY

SEQ ID NO: 1127401 - protein, 9 aa, Homo Sapiens
NRPWLFSLL

SEQ ID NO: 1127402 - protein, 9 aa, Homo Sapiens
AFERLLGPS

SEQ ID NO: 1127403 - protein, 9 aa, Homo Sapiens
GPRAKKPCR

SEQ ID NO: 1127404 - protein, 9 aa, Homo Sapiens
LKAQLVCSV

SEQ ID NO: 1127405 - protein, 9 aa, Homo Sapiens
QSGTGEVRC

SEQ ID NO: 1127406 - protein, 9 aa, Homo Sapiens
HWPFLKLLG

SEQ ID NO: 1127407 - protein, 9 aa, Homo Sapiens
KNKSTKATK

SEQ ID NO: 1127408 - protein, 9 aa, Homo Sapiens
MDAAKEALY

SEQ ID NO: 1127409 - protein, 9 aa, Homo Sapiens
ACQYECKNT

SEQ ID NO: 1127410 - protein, 9 aa, Homo Sapiens
GLRGQSGTG

SEQ ID NO: 1127411 - protein, 9 aa, Homo Sapiens
QAGDGHGRL

SEQ ID NO: 1127412 - protein, 9 aa, Homo Sapiens
EQKKNRKKL

SEQ ID NO: 1127413 - protein, 9 aa, Homo Sapiens
NQIAMTIVS

SEQ ID NO: 1127414 - protein, 9 aa, Homo Sapiens
QALPFGGPS

SEQ ID NO: 1127415 - protein, 9 aa, Homo Sapiens
IKSKRSLID

SEQ ID NO: 1127416 - protein, 9 aa, Homo Sapiens
GSSSLPTQW

SEQ ID NO: 1127417 - protein, 9 aa, Homo Sapiens
GARGAKVSR

SEQ ID NO: 1127418 - protein, 9 aa, Homo Sapiens
GFCAAGCHP

SEQ ID NO: 1127419 - protein, 9 aa, Homo Sapiens
LGPSRGGRQ

SEQ ID NO: 1127420 - protein, 9 aa, Homo Sapiens
LSFALCGSK

SEQ ID NO: 1127421 - protein, 9 aa, Homo Sapiens
LIPPLRPSK

SEQ ID NO: 1127422 - protein, 9 aa, Homo Sapiens
YVTSFPVAL

SEQ ID NO: 1127423 - protein, 9 aa, Homo Sapiens
RVNPASTSG

SEQ ID NO: 1127424 - protein, 9 aa, Homo Sapiens
SGSSVPGAA

SEQ ID NO: 1127425 - protein, 9 aa, Homo Sapiens
GNDVEGVSS

SEQ ID NO: 1127426 - protein, 9 aa, Homo Sapiens
RTASSWGRK

SEQ ID NO: 1127427 - protein, 9 aa, Homo Sapiens
GEKPYICSK

SEQ ID NO: 1127428 - protein, 9 aa, Homo Sapiens
LEIHSVQLR

SEQ ID NO: 1127429 - protein, 9 aa, Homo Sapiens
RETAFVFVI

SEQ ID NO: 1127430 - protein, 9 aa, Homo Sapiens
MLPRHPCPR

SEQ ID NO: 1127431 - protein, 9 aa, Homo Sapiens
TISRNIPWA

SEQ ID NO: 1127432 - protein, 9 aa, Homo Sapiens
VTCKSASVM

SEQ ID NO: 1127433 - protein, 9 aa, Homo Sapiens
GAPVLLASV

SEQ ID NO: 1127434 - protein, 9 aa, Homo Sapiens
DCSDDTSEL

SEQ ID NO: 1127435 - protein, 9 aa, Homo Sapiens
IEQEQLNCF

SEQ ID NO: 1127436 - protein, 9 aa, Homo Sapiens
PARSAAAAS

SEQ ID NO: 1127437 - protein, 9 aa, Homo Sapiens
RAWRRSGRR

SEQ ID NO: 1127438 - protein, 9 aa, Homo Sapiens
RFVPCYNFT

SEQ ID NO: 1127439 - protein, 9 aa, Homo Sapiens
SHLLNRAGR

SEQ ID NO: 1127440 - protein, 9 aa, Homo Sapiens
ERVSTLTME

SEQ ID NO: 1127441 - protein, 9 aa, Homo Sapiens
SPPNPGCTL

SEQ ID NO: 1127442 - protein, 9 aa, Homo Sapiens
PPWDCGGSE

SEQ ID NO: 1127443 - protein, 9 aa, Homo Sapiens
GARRRGARW

SEQ ID NO: 1127444 - protein, 9 aa, Homo Sapiens
IGEAVCAAI

SEQ ID NO: 1127445 - protein, 9 aa, Homo Sapiens
SDAGSSGPW

SEQ ID NO: 1127446 - protein, 9 aa, Homo Sapiens
EPICDPETE

SEQ ID NO: 1127447 - protein, 9 aa, Homo Sapiens
ASPPWRALA

SEQ ID NO: 1127448 - protein, 9 aa, Homo Sapiens
APAPGLTKC

SEQ ID NO: 1127449 - protein, 9 aa, Homo Sapiens
PCPRPPRSQ

SEQ ID NO: 1127450 - protein, 9 aa, Homo Sapiens
ACIAWFTRE

SEQ ID NO: 1127451 - protein, 9 aa, Homo Sapiens
SWRNSESFG

SEQ ID NO: 1127452 - protein, 9 aa, Homo Sapiens
SPRAAIWRR

SEQ ID NO: 1127453 - protein, 9 aa, Homo Sapiens
PSSDQGLYS

SEQ ID NO: 1127454 - protein, 9 aa, Homo Sapiens
AKIGRGTTR

SEQ ID NO: 1127455 - protein, 9 aa, Homo Sapiens
AAVVYSLGR

SEQ ID NO: 1127456 - protein, 9 aa, Homo Sapiens
NLVRYIRQG

SEQ ID NO: 1127457 - protein, 9 aa, Homo Sapiens
AYPLPEHHS

SEQ ID NO: 1127458 - protein, 9 aa, Homo Sapiens
FNSIGADLL

SEQ ID NO: 1127459 - protein, 9 aa, Homo Sapiens
EIMKAFKLF

SEQ ID NO: 1127460 - protein, 9 aa, Homo Sapiens
AFCRPTTVR

SEQ ID NO: 1127461 - protein, 9 aa, Homo Sapiens
PEYTCTLST

SEQ ID NO: 1127462 - protein, 9 aa, Homo Sapiens
MCSTCGKVF

SEQ ID NO: 1127463 - protein, 9 aa, Homo Sapiens
DVHGRSLQN

SEQ ID NO: 1127464 - protein, 9 aa, Homo Sapiens
LGPQLAAML

SEQ ID NO: 1127465 - protein, 9 aa, Homo Sapiens
PRHCLHPQS

SEQ ID NO: 1127466 - protein, 9 aa, Homo Sapiens
TVPNIDNVT

SEQ ID NO: 1127467 - protein, 9 aa, Homo Sapiens
NISLSGIEI

SEQ ID NO: 1127468 - protein, 9 aa, Homo Sapiens
GGGAWLLGP

SEQ ID NO: 1127469 - protein, 9 aa, Homo Sapiens
LQFTETPTW

SEQ ID NO: 1127470 - protein, 9 aa, Homo Sapiens
GERLPDVGG

SEQ ID NO: 1127471 - protein, 9 aa, Homo Sapiens
ADALHVRGL

SEQ ID NO: 1127472 - protein, 9 aa, Homo Sapiens
PEVVASADL

SEQ ID NO: 1127473 - protein, 9 aa, Homo Sapiens
MSVYYSVIP

SEQ ID NO: 1127474 - protein, 9 aa, Homo Sapiens
PTKLGSNGQ

SEQ ID NO: 1127475 - protein, 9 aa, Homo Sapiens
KKSNPFIRT

SEQ ID NO: 1127476 - protein, 9 aa, Homo Sapiens
DDVVKELKK

SEQ ID NO: 1127477 - protein, 9 aa, Homo Sapiens
LAKKQKFRP

SEQ ID NO: 1127478 - protein, 9 aa, Homo Sapiens
FDYAYEAIK

SEQ ID NO: 1127479 - protein, 9 aa, Homo Sapiens
YKSLTDCFL

SEQ ID NO: 1127480 - protein, 9 aa, Homo Sapiens
FKEILPPDD

SEQ ID NO: 1127481 - protein, 9 aa, Homo Sapiens
EIKICLKYY

SEQ ID NO: 1127482 - protein, 9 aa, Homo Sapiens
VSLVVAAIP

SEQ ID NO: 1127483 - protein, 9 aa, Homo Sapiens
AQVFLVVFL

SEQ ID NO: 1127484 - protein, 9 aa, Homo Sapiens
YAYEAIKHK

SEQ ID NO: 1127485 - protein, 9 aa, Homo Sapiens
VPSGMNSPA

SEQ ID NO: 1127486 - protein, 9 aa, Homo Sapiens
VLETSAVLL

SEQ ID NO: 1127487 - protein, 9 aa, Homo Sapiens
FFDAYFVFE

SEQ ID NO: 1127488 - protein, 9 aa, Homo Sapiens
SAEVNYDDD

SEQ ID NO: 1127489 - protein, 9 aa, Homo Sapiens
SHRSEFEHC

SEQ ID NO: 1127490 - protein, 9 aa, Homo Sapiens
FGQQNCTLK

SEQ ID NO: 1127491 - protein, 9 aa, Homo Sapiens
AFTTKSLLG

SEQ ID NO: 1127492 - protein, 9 aa, Homo Sapiens
KKPKRGSSF

SEQ ID NO: 1127493 - protein, 9 aa, Homo Sapiens
VSKKLTHMC

SEQ ID NO: 1127494 - protein, 9 aa, Homo Sapiens
RTQALPFGG

SEQ ID NO: 1127495 - protein, 9 aa, Homo Sapiens
TCPEDNKTK

SEQ ID NO: 1127496 - protein, 9 aa, Homo Sapiens
FPTYRGLLC

SEQ ID NO: 1127497 - protein, 9 aa, Homo Sapiens
AHRGLSLLL

SEQ ID NO: 1127498 - protein, 9 aa, Homo Sapiens
DEGSILAPL

SEQ ID NO: 1127499 - protein, 9 aa, Homo Sapiens
GLDASQPSW

SEQ ID NO: 1127500 - protein, 9 aa, Homo Sapiens
VNLSASLLP

SEQ ID NO: 1127501 - protein, 9 aa, Homo Sapiens
TLSGQQDRR

SEQ ID NO: 1127502 - protein, 9 aa, Homo Sapiens
LPPARGPQP

SEQ ID NO: 1127503 - protein, 9 aa, Homo Sapiens
QVPFMAPGK

SEQ ID NO: 1127504 - protein, 9 aa, Homo Sapiens
NVLCYTSTI

SEQ ID NO: 1127505 - protein, 9 aa, Homo Sapiens
HHFQHHAKP

SEQ ID NO: 1127506 - protein, 9 aa, Homo Sapiens
VQYKKWYFE

SEQ ID NO: 1127507 - protein, 9 aa, Homo Sapiens
PHVLGLAVL

SEQ ID NO: 1127508 - protein, 9 aa, Homo Sapiens
FSACGFYLT

SEQ ID NO: 1127509 - protein, 9 aa, Homo Sapiens
VLSSSTQHK

SEQ ID NO: 1127510 - protein, 9 aa, Homo Sapiens
SLMIEYSEP

SEQ ID NO: 1127511 - protein, 9 aa, Homo Sapiens
PQLAAMLNF

SEQ ID NO: 1127512 - protein, 9 aa, Homo Sapiens
QGPSSQLWR

SEQ ID NO: 1127513 - protein, 9 aa, Homo Sapiens
GKTPDFLLL

SEQ ID NO: 1127514 - protein, 9 aa, Homo Sapiens
KSPAALKVG

SEQ ID NO: 1127515 - protein, 9 aa, Homo Sapiens
LAIAGNASL

SEQ ID NO: 1127516 - protein, 9 aa, Homo Sapiens
WTCLITRSQ

SEQ ID NO: 1127517 - protein, 9 aa, Homo Sapiens
GMSVYYSVI

SEQ ID NO: 1127518 - protein, 9 aa, Homo Sapiens
PGAAAGVQF

SEQ ID NO: 1127519 - protein, 9 aa, Homo Sapiens
NGAYAKQKL

SEQ ID NO: 1127520 - protein, 9 aa, Homo Sapiens
SKRALERQV

SEQ ID NO: 1127521 - protein, 9 aa, Homo Sapiens
RINGLPSTM

SEQ ID NO: 1127522 - protein, 9 aa, Homo Sapiens
DHTQHQFGH

SEQ ID NO: 1127523 - protein, 9 aa, Homo Sapiens
QAQLIMPLS

SEQ ID NO: 1127524 - protein, 9 aa, Homo Sapiens
DETSSINTT

SEQ ID NO: 1127525 - protein, 9 aa, Homo Sapiens
RLADSLIGN

SEQ ID NO: 1127526 - protein, 9 aa, Homo Sapiens
QLGSLKRDD

SEQ ID NO: 1127527 - protein, 9 aa, Homo Sapiens
NKMKNACHF

SEQ ID NO: 1127528 - protein, 9 aa, Homo Sapiens
TQMFDAKNM

SEQ ID NO: 1127529 - protein, 9 aa, Homo Sapiens
LNCYDLVRT

SEQ ID NO: 1127530 - protein, 9 aa, Homo Sapiens
PLTAFSNLC

SEQ ID NO: 1127531 - protein, 9 aa, Homo Sapiens
CISVKDHRT

SEQ ID NO: 1127532 - protein, 9 aa, Homo Sapiens
PIVNDYDEL

SEQ ID NO: 1127533 - protein, 9 aa, Homo Sapiens
LEYMEEEVL

SEQ ID NO: 1127534 - protein, 9 aa, Homo Sapiens
LFFVKSWNT

SEQ ID NO: 1127535 - protein, 9 aa, Homo Sapiens
ASLVRRGGQ

SEQ ID NO: 1127536 - protein, 9 aa, Homo Sapiens
SEFRNPLAS

SEQ ID NO: 1127537 - protein, 9 aa, Homo Sapiens
LRATLFQTM

SEQ ID NO: 1127538 - protein, 9 aa, Homo Sapiens
FGKRVALGP

SEQ ID NO: 1127539 - protein, 9 aa, Homo Sapiens
RKLYEKRLV

SEQ ID NO: 1127540 - protein, 9 aa, Homo Sapiens
LKPTACAGA

SEQ ID NO: 1127541 - protein, 9 aa, Homo Sapiens
TCCFSASPP

SEQ ID NO: 1127542 - protein, 9 aa, Homo Sapiens
ENNEGGKRS

SEQ ID NO: 1127543 - protein, 9 aa, Homo Sapiens
LPMTHFGDT

SEQ ID NO: 1127544 - protein, 9 aa, Homo Sapiens
WSASDTGYI

SEQ ID NO: 1127545 - protein, 9 aa, Homo Sapiens
VTVANTTMS

SEQ ID NO: 1127546 - protein, 9 aa, Homo Sapiens
LFCWFYVYH

SEQ ID NO: 1127547 - protein, 9 aa, Homo Sapiens
GLFPPLHSH

SEQ ID NO: 1127548 - protein, 9 aa, Homo Sapiens
AHHLPPAEG

SEQ ID NO: 1127549 - protein, 9 aa, Homo Sapiens
PITDLFLLA

SEQ ID NO: 1127550 - protein, 9 aa, Homo Sapiens
APTSSPATS

SEQ ID NO: 1127551 - protein, 9 aa, Homo Sapiens
PSLPGPCAS

SEQ ID NO: 1127552 - protein, 9 aa, Homo Sapiens
TFSQGIQTR

SEQ ID NO: 1127553 - protein, 9 aa, Homo Sapiens
VRPGRPSLA

SEQ ID NO: 1127554 - protein, 9 aa, Homo Sapiens
PSPASLLTR

SEQ ID NO: 1127555 - protein, 9 aa, Homo Sapiens
RGWAQGGPR

SEQ ID NO: 1127556 - protein, 9 aa, Homo Sapiens
ANTVFSPDG

SEQ ID NO: 1127557 - protein, 9 aa, Homo Sapiens
FFTANSHLS

SEQ ID NO: 1127558 - protein, 9 aa, Homo Sapiens
SGTSRAAGT

SEQ ID NO: 1127559 - protein, 9 aa, Homo Sapiens
YPLSLWKKS

SEQ ID NO: 1127560 - protein, 9 aa, Homo Sapiens
RALPGWIYT

SEQ ID NO: 1127561 - protein, 9 aa, Homo Sapiens
TDYPEFRQP

SEQ ID NO: 1127562 - protein, 9 aa, Homo Sapiens
WLDREERDA

SEQ ID NO: 1127563 - protein, 9 aa, Homo Sapiens
LVRSLALKL

SEQ ID NO: 1127564 - protein, 9 aa, Homo Sapiens
LGDTPQPSL

SEQ ID NO: 1127565 - protein, 9 aa, Homo Sapiens
EAPLEGTPF

SEQ ID NO: 1127566 - protein, 9 aa, Homo Sapiens
LNLQVLKKI

SEQ ID NO: 1127567 - protein, 9 aa, Homo Sapiens
TVFFGTYFL

SEQ ID NO: 1127568 - protein, 9 aa, Homo Sapiens
QLLYEFCTC

SEQ ID NO: 1127569 - protein, 9 aa, Homo Sapiens
GKYHEVLSR

SEQ ID NO: 1127570 - protein, 9 aa, Homo Sapiens
IAGNASLLQ

SEQ ID NO: 1127571 - protein, 9 aa, Homo Sapiens
MYLQPTNRR

SEQ ID NO: 1127572 - protein, 9 aa, Homo Sapiens
QNGVEMLVE

SEQ ID NO: 1127573 - protein, 9 aa, Homo Sapiens
QAHRGNEQI

SEQ ID NO: 1127574 - protein, 9 aa, Homo Sapiens
EKYQIYQDD

SEQ ID NO: 1127575 - protein, 9 aa, Homo Sapiens
WTELRQHEV

SEQ ID NO: 1127576 - protein, 9 aa, Homo Sapiens
KTLRLPCLL

SEQ ID NO: 1127577 - protein, 9 aa, Homo Sapiens
LFGRVCTLS

SEQ ID NO: 1127578 - protein, 9 aa, Homo Sapiens
GRGGGRRNK

SEQ ID NO: 1127579 - protein, 9 aa, Homo Sapiens
FYETARVNG

SEQ ID NO: 1127580 - protein, 9 aa, Homo Sapiens
AWLLGPLKT

SEQ ID NO: 1127581 - protein, 9 aa, Homo Sapiens
MSVDMILIS

SEQ ID NO: 1127582 - protein, 9 aa, Homo Sapiens
RGGGRRNKH

SEQ ID NO: 1127583 - protein, 9 aa, Homo Sapiens
LVGQRLTLM

SEQ ID NO: 1127584 - protein, 9 aa, Homo Sapiens
LPFSRFLNM

SEQ ID NO: 1127585 - protein, 9 aa, Homo Sapiens
DDSVSHQAG

SEQ ID NO: 1127586 - protein, 9 aa, Homo Sapiens
LASVLPPAT

SEQ ID NO: 1127587 - protein, 9 aa, Homo Sapiens
AEREKYVQE

SEQ ID NO: 1127588 - protein, 9 aa, Homo Sapiens
PFGPRSKMG

SEQ ID NO: 1127589 - protein, 9 aa, Homo Sapiens
VTMEEKPMC

SEQ ID NO: 1127590 - protein, 9 aa, Homo Sapiens
IGVEFGTRM

SEQ ID NO: 1127591 - protein, 9 aa, Homo Sapiens
YIAVIAKEN

SEQ ID NO: 1127592 - protein, 9 aa, Homo Sapiens
AAVREHLRE

SEQ ID NO: 1127593 - protein, 9 aa, Homo Sapiens
RPFREAGFP

SEQ ID NO: 1127594 - protein, 9 aa, Homo Sapiens
LLHTQLLSP

SEQ ID NO: 1127595 - protein, 9 aa, Homo Sapiens
SICPCPQYI

SEQ ID NO: 1127596 - protein, 9 aa, Homo Sapiens
NVPKRVQRE

SEQ ID NO: 1127597 - protein, 9 aa, Homo Sapiens
CRDGALHEH

SEQ ID NO: 1127598 - protein, 9 aa, Homo Sapiens
LIVGHPKSD

SEQ ID NO: 1127599 - protein, 9 aa, Homo Sapiens
LGLTIGLWL

SEQ ID NO: 1127600 - protein, 9 aa, Homo Sapiens
KILTLLGPL

SEQ ID NO: 1127601 - protein, 9 aa, Homo Sapiens
SQDQDVIKN

SEQ ID NO: 1127602 - protein, 9 aa, Homo Sapiens
PGLSKDAYS

SEQ ID NO: 1127603 - protein, 9 aa, Homo Sapiens
GHPLLWGCH

SEQ ID NO: 1127604 - protein, 9 aa, Homo Sapiens
EKIILYRSK

SEQ ID NO: 1127605 - protein, 9 aa, Homo Sapiens
NIHKHILHT

SEQ ID NO: 1127606 - protein, 9 aa, Homo Sapiens
RPPTRPSSP

SEQ ID NO: 1127607 - protein, 9 aa, Homo Sapiens
GKLPSPPDP

SEQ ID NO: 1127608 - protein, 9 aa, Homo Sapiens
LTYSTCMSQ

SEQ ID NO: 1127609 - protein, 9 aa, Homo Sapiens
EPYTVCDLA

SEQ ID NO: 1127610 - protein, 9 aa, Homo Sapiens
PQPGRRPPK

SEQ ID NO: 1127611 - protein, 9 aa, Homo Sapiens
GGQRCRDGA

SEQ ID NO: 1127612 - protein, 9 aa, Homo Sapiens
ATFPRAMDA

SEQ ID NO: 1127613 - protein, 9 aa, Homo Sapiens
AARRVLELH

SEQ ID NO: 1127614 - protein, 9 aa, Homo Sapiens
ATTPPIGPS

SEQ ID NO: 1127615 - protein, 9 aa, Homo Sapiens
NPYFRNKLF

SEQ ID NO: 1127616 - protein, 9 aa, Homo Sapiens
VDIFLSFLS

SEQ ID NO: 1127617 - protein, 9 aa, Homo Sapiens
SPLLAAVLC

SEQ ID NO: 1127618 - protein, 9 aa, Homo Sapiens
VFKGSKNLT

SEQ ID NO: 1127619 - protein, 9 aa, Homo Sapiens
ARWKGPRRT

SEQ ID NO: 1127620 - protein, 9 aa, Homo Sapiens
TEQGTYRAG

SEQ ID NO: 1127621 - protein, 9 aa, Homo Sapiens
RRTQALPFG

SEQ ID NO: 1127622 - protein, 9 aa, Homo Sapiens
LLGRCITSQ

SEQ ID NO: 1127623 - protein, 9 aa, Homo Sapiens
RKEAEARKV

SEQ ID NO: 1127624 - protein, 9 aa, Homo Sapiens
LAKGQRMLV

SEQ ID NO: 1127625 - protein, 9 aa, Homo Sapiens
VHESPTGID

SEQ ID NO: 1127626 - protein, 9 aa, Homo Sapiens
ITAIAKFEH

SEQ ID NO: 1127627 - protein, 9 aa, Homo Sapiens
ESTDKAQEG

SEQ ID NO: 1127628 - protein, 9 aa, Homo Sapiens
MVVTGDEEE

SEQ ID NO: 1127629 - protein, 9 aa, Homo Sapiens
LHKCIALRM

SEQ ID NO: 1127630 - protein, 9 aa, Homo Sapiens
TTRCTSTAT

SEQ ID NO: 1127631 - protein, 9 aa, Homo Sapiens
DGSMDERKL

SEQ ID NO: 1127632 - protein, 9 aa, Homo Sapiens
HGRSLQNAV

SEQ ID NO: 1127633 - protein, 9 aa, Homo Sapiens
PAPRAVITG

SEQ ID NO: 1127634 - protein, 9 aa, Homo Sapiens
VGPGGPGGG

SEQ ID NO: 1127635 - protein, 9 aa, Homo Sapiens
LTDEYFFDR

SEQ ID NO: 1127636 - protein, 9 aa, Homo Sapiens
ASPDQQQVL

SEQ ID NO: 1127637 - protein, 9 aa, Homo Sapiens
GATTPPIGP

SEQ ID NO: 1127638 - protein, 9 aa, Homo Sapiens
LTRPSGLLA

SEQ ID NO: 1127639 - protein, 9 aa, Homo Sapiens
PHPQVPPQL

SEQ ID NO: 1127640 - protein, 9 aa, Homo Sapiens
PDVTNNSNR

SEQ ID NO: 1127641 - protein, 9 aa, Homo Sapiens
GQGAVWKEG

SEQ ID NO: 1127642 - protein, 9 aa, Homo Sapiens
HLNQIMKRM

SEQ ID NO: 1127643 - protein, 9 aa, Homo Sapiens
IVSILSEVA

SEQ ID NO: 1127644 - protein, 9 aa, Homo Sapiens
EQRVTLSGI

SEQ ID NO: 1127645 - protein, 9 aa, Homo Sapiens
GSGSHCPRA

SEQ ID NO: 1127646 - protein, 9 aa, Homo Sapiens
AADIGHRNS

SEQ ID NO: 1127647 - protein, 9 aa, Homo Sapiens
HIRQDGPWW

SEQ ID NO: 1127648 - protein, 9 aa, Homo Sapiens
LSVLDSTLA

SEQ ID NO: 1127649 - protein, 9 aa, Homo Sapiens
AKYTTQGMK

SEQ ID NO: 1127650 - protein, 9 aa, Homo Sapiens
WLGGQLPVV

SEQ ID NO: 1127651 - protein, 9 aa, Homo Sapiens
TCTNSQKSI

SEQ ID NO: 1127652 - protein, 9 aa, Homo Sapiens
IEDEKMVAV

SEQ ID NO: 1127653 - protein, 9 aa, Homo Sapiens
YVVVIEYST

SEQ ID NO: 1127654 - protein, 9 aa, Homo Sapiens
SQKDVWCPW

SEQ ID NO: 1127655 - protein, 9 aa, Homo Sapiens
TGIADATKS

SEQ ID NO: 1127656 - protein, 9 aa, Homo Sapiens
CGEAFRSAS

SEQ ID NO: 1127657 - protein, 9 aa, Homo Sapiens
LPEPILADD

SEQ ID NO: 1127658 - protein, 9 aa, Homo Sapiens
NIRFVFHAV

SEQ ID NO: 1127659 - protein, 9 aa, Homo Sapiens
QCCEVKQIA

SEQ ID NO: 1127660 - protein, 9 aa, Homo Sapiens
VASRPFREA

SEQ ID NO: 1127661 - protein, 9 aa, Homo Sapiens
WQCGCVDDF

SEQ ID NO: 1127662 - protein, 9 aa, Homo Sapiens
DAAPGGSWY

SEQ ID NO: 1127663 - protein, 9 aa, Homo Sapiens
PPGAPPSQR

SEQ ID NO: 1127664 - protein, 9 aa, Homo Sapiens
SERGILRPP

SEQ ID NO: 1127665 - protein, 9 aa, Homo Sapiens
PRAREKLTS

SEQ ID NO: 1127666 - protein, 9 aa, Homo Sapiens
RRPLPRPRL

SEQ ID NO: 1127667 - protein, 9 aa, Homo Sapiens
AHWGSALPL

SEQ ID NO: 1127668 - protein, 9 aa, Homo Sapiens
LIASNSTIE

SEQ ID NO: 1127669 - protein, 9 aa, Homo Sapiens
SRLRFWEFV

SEQ ID NO: 1127670 - protein, 9 aa, Homo Sapiens
DVCITEALI

SEQ ID NO: 1127671 - protein, 9 aa, Homo Sapiens
LLVVSHNGA

SEQ ID NO: 1127672 - protein, 9 aa, Homo Sapiens
APSSSNNLS

SEQ ID NO: 1127673 - protein, 9 aa, Homo Sapiens
GSHCPRAAT

SEQ ID NO: 1127674 - protein, 9 aa, Homo Sapiens
DCASCSAPV

SEQ ID NO: 1127675 - protein, 9 aa, Homo Sapiens
KPLVRSLAL

SEQ ID NO: 1127676 - protein, 9 aa, Homo Sapiens
GIGGAAVAR

SEQ ID NO: 1127677 - protein, 9 aa, Homo Sapiens
TRRPWTAAA

SEQ ID NO: 1127678 - protein, 9 aa, Homo Sapiens
LDQRLTLIT

SEQ ID NO: 1127679 - protein, 9 aa, Homo Sapiens
EVVASADLK

SEQ ID NO: 1127680 - protein, 9 aa, Homo Sapiens
AIGDLKDQK

SEQ ID NO: 1127681 - protein, 9 aa, Homo Sapiens
PPRFLQVCD

SEQ ID NO: 1127682 - protein, 9 aa, Homo Sapiens
HWASSPSPN

SEQ ID NO: 1127683 - protein, 9 aa, Homo Sapiens
GITPFTATE

SEQ ID NO: 1127684 - protein, 9 aa, Homo Sapiens
HVQHIRIDD

SEQ ID NO: 1127685 - protein, 9 aa, Homo Sapiens
GLPASIVPL

SEQ ID NO: 1127686 - protein, 9 aa, Homo Sapiens
FIWPQHSYK

SEQ ID NO: 1127687 - protein, 9 aa, Homo Sapiens
APAMGTGIR

SEQ ID NO: 1127688 - protein, 9 aa, Homo Sapiens
SQTTDAIFA

SEQ ID NO: 1127689 - protein, 9 aa, Homo Sapiens
RGITPFTAT

SEQ ID NO: 1127690 - protein, 9 aa, Homo Sapiens
PWKTSCTTF

SEQ ID NO: 1127691 - protein, 9 aa, Homo Sapiens
RHHPRLRAA

SEQ ID NO: 1127692 - protein, 9 aa, Homo Sapiens
KHKVDPVYF

SEQ ID NO: 1127693 - protein, 9 aa, Homo Sapiens
EEEERRAVI

SEQ ID NO: 1127694 - protein, 9 aa, Homo Sapiens
RDHLGLILF

SEQ ID NO: 1127695 - protein, 9 aa, Homo Sapiens
HRLPCRLLG

SEQ ID NO: 1127696 - protein, 9 aa, Homo Sapiens
LDMRGLKRS

SEQ ID NO: 1127697 - protein, 9 aa, Homo Sapiens
QQQQHIFEP

SEQ ID NO: 1127698 - protein, 9 aa, Homo Sapiens
KLCFSVRNV

SEQ ID NO: 1127699 - protein, 9 aa, Homo Sapiens
YCLTSPPGA

SEQ ID NO: 1127700 - protein, 9 aa, Homo Sapiens
EEVPAFLKT

SEQ ID NO: 1127701 - protein, 9 aa, Homo Sapiens
IRAEGLKME

SEQ ID NO: 1127702 - protein, 9 aa, Homo Sapiens
QIMKRMCKQ

SEQ ID NO: 1127703 - protein, 9 aa, Homo Sapiens
HGCVDAARY

SEQ ID NO: 1127704 - protein, 9 aa, Homo Sapiens
ADAEAGSLH

SEQ ID NO: 1127705 - protein, 9 aa, Homo Sapiens
SGTSGKGFV

SEQ ID NO: 1127706 - protein, 9 aa, Homo Sapiens
CLQDRCEQV

SEQ ID NO: 1127707 - protein, 9 aa, Homo Sapiens
GPAEGRRDT

SEQ ID NO: 1127708 - protein, 9 aa, Homo Sapiens
GASWPPLPS

SEQ ID NO: 1127709 - protein, 9 aa, Homo Sapiens
GAGVRTHSV

SEQ ID NO: 1127710 - protein, 9 aa, Homo Sapiens
KIFNMKKSL

SEQ ID NO: 1127711 - protein, 9 aa, Homo Sapiens
LYSAYDCTI

SEQ ID NO: 1127712 - protein, 9 aa, Homo Sapiens
QFSLVSDGD

SEQ ID NO: 1127713 - protein, 9 aa, Homo Sapiens
VIKFTVFIG

SEQ ID NO: 1127714 - protein, 9 aa, Homo Sapiens
VDSLLYVIR

SEQ ID NO: 1127715 - protein, 9 aa, Homo Sapiens
TKVGSELIQ

SEQ ID NO: 1127716 - protein, 9 aa, Homo Sapiens
CRCGWGGPR

SEQ ID NO: 1127717 - protein, 9 aa, Homo Sapiens
TVIRTLDTP

SEQ ID NO: 1127718 - protein, 9 aa, Homo Sapiens
QRPPWRTSR

SEQ ID NO: 1127719 - protein, 9 aa, Homo Sapiens
FVKTMVCCL

SEQ ID NO: 1127720 - protein, 9 aa, Homo Sapiens
GQRGQEPLG

SEQ ID NO: 1127721 - protein, 9 aa, Homo Sapiens
QWFARCQEM

SEQ ID NO: 1127722 - protein, 9 aa, Homo Sapiens
WLTSACPSS

SEQ ID NO: 1127723 - protein, 9 aa, Homo Sapiens
PALLQPPQA

SEQ ID NO: 1127724 - protein, 9 aa, Homo Sapiens
CLPPLPRRD

SEQ ID NO: 1127725 - protein, 9 aa, Homo Sapiens
TDVVLLGYP

SEQ ID NO: 1127726 - protein, 9 aa, Homo Sapiens
THGGAVAAQ

SEQ ID NO: 1127727 - protein, 9 aa, Homo Sapiens
MLGTTDLLQ

SEQ ID NO: 1127728 - protein, 9 aa, Homo Sapiens
AASGRPPTC

SEQ ID NO: 1127729 - protein, 9 aa, Homo Sapiens
FSDETFGPN

SEQ ID NO: 1127730 - protein, 9 aa, Homo Sapiens
LVHSCWTKA

SEQ ID NO: 1127731 - protein, 9 aa, Homo Sapiens
MRLGAPVLL

SEQ ID NO: 1127732 - protein, 9 aa, Homo Sapiens
DYCSGSSTL

SEQ ID NO: 1127733 - protein, 9 aa, Homo Sapiens
PTTVRKAKF

SEQ ID NO: 1127734 - protein, 9 aa, Homo Sapiens
PELGPQLAA

SEQ ID NO: 1127735 - protein, 9 aa, Homo Sapiens
RDKQVLEMV

SEQ ID NO: 1127736 - protein, 9 aa, Homo Sapiens
RGQPPKARD

SEQ ID NO: 1127737 - protein, 9 aa, Homo Sapiens
WRTRPVCQG

SEQ ID NO: 1127738 - protein, 9 aa, Homo Sapiens
RSGRRSGSR

SEQ ID NO: 1127739 - protein, 9 aa, Homo Sapiens
PASCPLDSN

SEQ ID NO: 1127740 - protein, 9 aa, Homo Sapiens
ALRERGPPS

SEQ ID NO: 1127741 - protein, 9 aa, Homo Sapiens
TQSDRSPQK

SEQ ID NO: 1127742 - protein, 9 aa, Homo Sapiens
EKALSALFI

SEQ ID NO: 1127743 - protein, 9 aa, Homo Sapiens
KTTTVQVLM

SEQ ID NO: 1127744 - protein, 9 aa, Homo Sapiens
LLRILTSFT

SEQ ID NO: 1127745 - protein, 9 aa, Homo Sapiens
RELCLREFP

SEQ ID NO: 1127746 - protein, 9 aa, Homo Sapiens
ETRPTQRPR

SEQ ID NO: 1127747 - protein, 9 aa, Homo Sapiens
SPTDPKCCF

SEQ ID NO: 1127748 - protein, 9 aa, Homo Sapiens
GEQLCGVGL

SEQ ID NO: 1127749 - protein, 9 aa, Homo Sapiens
TQASMTLPA

SEQ ID NO: 1127750 - protein, 9 aa, Homo Sapiens
LGSDDVVKE

SEQ ID NO: 1127751 - protein, 9 aa, Homo Sapiens
VNQSDSQSS

SEQ ID NO: 1127752 - protein, 9 aa, Homo Sapiens
DKDLEYAHT

SEQ ID NO: 1127753 - protein, 9 aa, Homo Sapiens
YSERMEVVS

SEQ ID NO: 1127754 - protein, 9 aa, Homo Sapiens
LQFILHPGH

SEQ ID NO: 1127755 - protein, 9 aa, Homo Sapiens
AAARSSLGA

SEQ ID NO: 1127756 - protein, 9 aa, Homo Sapiens
TPTTRLMAP

SEQ ID NO: 1127757 - protein, 9 aa, Homo Sapiens
DPSDGQRRQ

SEQ ID NO: 1127758 - protein, 9 aa, Homo Sapiens
HLKLRNRTP

SEQ ID NO: 1127759 - protein, 9 aa, Homo Sapiens
RAAGTTFTL

SEQ ID NO: 1127760 - protein, 9 aa, Homo Sapiens
EGKLPSPPD

SEQ ID NO: 1127761 - protein, 9 aa, Homo Sapiens
QYHAASAGL

SEQ ID NO: 1127762 - protein, 9 aa, Homo Sapiens
GCYWIDPNQ

SEQ ID NO: 1127763 - protein, 9 aa, Homo Sapiens
PAAPCRRGA

SEQ ID NO: 1127764 - protein, 9 aa, Homo Sapiens
GVATPGRPW

SEQ ID NO: 1127765 - protein, 9 aa, Homo Sapiens
SDTGSVGAL

SEQ ID NO: 1127766 - protein, 9 aa, Homo Sapiens
SVVLSTKSP

SEQ ID NO: 1127767 - protein, 9 aa, Homo Sapiens
VGLNSLQNY

SEQ ID NO: 1127768 - protein, 9 aa, Homo Sapiens
QSAVKTKFK

SEQ ID NO: 1127769 - protein, 9 aa, Homo Sapiens
KEEISPSTV

SEQ ID NO: 1127770 - protein, 9 aa, Homo Sapiens
TGLLTLLWG

SEQ ID NO: 1127771 - protein, 9 aa, Homo Sapiens
RRKIPQCLQ

SEQ ID NO: 1127772 - protein, 9 aa, Homo Sapiens
LSVVAMALS

SEQ ID NO: 1127773 - protein, 9 aa, Homo Sapiens
KRTCKLRKE

SEQ ID NO: 1127774 - protein, 9 aa, Homo Sapiens
RFEEFASVI

SEQ ID NO: 1127775 - protein, 9 aa, Homo Sapiens
RSIRWDDRG

SEQ ID NO: 1127776 - protein, 9 aa, Homo Sapiens
LSSSLRMTP

SEQ ID NO: 1127777 - protein, 9 aa, Homo Sapiens
TLWGKMLIN

SEQ ID NO: 1127778 - protein, 9 aa, Homo Sapiens
SLTLVFKRS

SEQ ID NO: 1127779 - protein, 9 aa, Homo Sapiens
PSGPSFAYG

SEQ ID NO: 1127780 - protein, 9 aa, Homo Sapiens
SGKRKAFSA

SEQ ID NO: 1127781 - protein, 9 aa, Homo Sapiens
EACQNFFRN

SEQ ID NO: 1127782 - protein, 9 aa, Homo Sapiens
LRRPRRRRP

SEQ ID NO: 1127783 - protein, 9 aa, Homo Sapiens
PFRLHCSMF

SEQ ID NO: 1127784 - protein, 9 aa, Homo Sapiens
SMKKTIFMQ

SEQ ID NO: 1127785 - protein, 9 aa, Homo Sapiens
DGDGPPTTR

SEQ ID NO: 1127786 - protein, 9 aa, Homo Sapiens
EKCLTILKA

SEQ ID NO: 1127787 - protein, 9 aa, Homo Sapiens
FLRGTPDRF

SEQ ID NO: 1127788 - protein, 9 aa, Homo Sapiens
GFLSIADMY

SEQ ID NO: 1127789 - protein, 9 aa, Homo Sapiens
GFRQLTTHK

SEQ ID NO: 1127790 - protein, 9 aa, Homo Sapiens
EHTKPDRDN

SEQ ID NO: 1127791 - protein, 9 aa, Homo Sapiens
IHNQTYRRF

SEQ ID NO: 1127792 - protein, 9 aa, Homo Sapiens
ALKEDLLYL

SEQ ID NO: 1127793 - protein, 9 aa, Homo Sapiens
QRESRPVAP

SEQ ID NO: 1127794 - protein, 9 aa, Homo Sapiens
QNGYVPFYV

SEQ ID NO: 1127795 - protein, 9 aa, Homo Sapiens
AECCAQGRK

SEQ ID NO: 1127796 - protein, 9 aa, Homo Sapiens
SLASSCTPG

SEQ ID NO: 1127797 - protein, 9 aa, Homo Sapiens
PRPTHPLCT

SEQ ID NO: 1127798 - protein, 9 aa, Homo Sapiens
QEKIAGSLG

SEQ ID NO: 1127799 - protein, 9 aa, Homo Sapiens
RRIRGSRQR

SEQ ID NO: 1127800 - protein, 9 aa, Homo Sapiens
RLLSTVIRT

SEQ ID NO: 1127801 - protein, 9 aa, Homo Sapiens
LVLGWPAFY

SEQ ID NO: 1127802 - protein, 9 aa, Homo Sapiens
TVAFLPPMH

SEQ ID NO: 1127803 - protein, 9 aa, Homo Sapiens
FEDAVCPIQ

SEQ ID NO: 1127804 - protein, 9 aa, Homo Sapiens
QPSLPGPCA

SEQ ID NO: 1127805 - protein, 9 aa, Homo Sapiens
GSVMSCSLL

SEQ ID NO: 1127806 - protein, 9 aa, Homo Sapiens
CGGKMATQA

SEQ ID NO: 1127807 - protein, 9 aa, Homo Sapiens
MAKNPQVVP

SEQ ID NO: 1127808 - protein, 9 aa, Homo Sapiens
GAQLGGGQG

SEQ ID NO: 1127809 - protein, 9 aa, Homo Sapiens
DDEDVGTTQ

SEQ ID NO: 1127810 - protein, 9 aa, Homo Sapiens
CCGKFTTEA

SEQ ID NO: 1127811 - protein, 9 aa, Homo Sapiens
AINTSCDIE

SEQ ID NO: 1127812 - protein, 9 aa, Homo Sapiens
PARPGTSGT

SEQ ID NO: 1127813 - protein, 9 aa, Homo Sapiens
ASLQVVLEH

SEQ ID NO: 1127814 - protein, 9 aa, Homo Sapiens
IALKVQQKC

SEQ ID NO: 1127815 - protein, 9 aa, Homo Sapiens
INGLSVVVT

SEQ ID NO: 1127816 - protein, 9 aa, Homo Sapiens
VPVATQNPP

SEQ ID NO: 1127817 - protein, 9 aa, Homo Sapiens
LYWPEEGYC

SEQ ID NO: 1127818 - protein, 9 aa, Homo Sapiens
SHRSSQDKT

SEQ ID NO: 1127819 - protein, 9 aa, Homo Sapiens
LLLPPDCGH

SEQ ID NO: 1127820 - protein, 9 aa, Homo Sapiens
HTRLSLQGS

SEQ ID NO: 1127821 - protein, 9 aa, Homo Sapiens
SAEPGCLVT

SEQ ID NO: 1127822 - protein, 9 aa, Homo Sapiens
LPSPPDPQE

SEQ ID NO: 1127823 - protein, 9 aa, Homo Sapiens
HWQDHITGE

SEQ ID NO: 1127824 - protein, 9 aa, Homo Sapiens
TKVFKVLKS

SEQ ID NO: 1127825 - protein, 9 aa, Homo Sapiens
PPLPDLGVR

SEQ ID NO: 1127826 - protein, 9 aa, Homo Sapiens
RGFILERIP

SEQ ID NO: 1127827 - protein, 9 aa, Homo Sapiens
QNTFWYGIL

SEQ ID NO: 1127828 - protein, 9 aa, Homo Sapiens
YCCDAPHSF

SEQ ID NO: 1127829 - protein, 9 aa, Homo Sapiens
VTGHPLYTI

SEQ ID NO: 1127830 - protein, 9 aa, Homo Sapiens
TVPPQMGSF

SEQ ID NO: 1127831 - protein, 9 aa, Homo Sapiens
LSVPKHKLP

SEQ ID NO: 1127832 - protein, 9 aa, Homo Sapiens
RQRGSLAIF

SEQ ID NO: 1127833 - protein, 9 aa, Homo Sapiens
VFIGKNSVT

SEQ ID NO: 1127834 - protein, 9 aa, Homo Sapiens
PGLAPERLH

SEQ ID NO: 1127835 - protein, 9 aa, Homo Sapiens
LLQAGPVAA

SEQ ID NO: 1127836 - protein, 9 aa, Homo Sapiens
DGDWQACGQ

SEQ ID NO: 1127837 - protein, 9 aa, Homo Sapiens
PAQNLAARP

SEQ ID NO: 1127838 - protein, 9 aa, Homo Sapiens
RVPEGAIVS

SEQ ID NO: 1127839 - protein, 9 aa, Homo Sapiens
TSHGSPFTS

SEQ ID NO: 1127840 - protein, 9 aa, Homo Sapiens
STGRKTMRP

SEQ ID NO: 1127841 - protein, 9 aa, Homo Sapiens
ALHTMPHLC

SEQ ID NO: 1127842 - protein, 9 aa, Homo Sapiens
LGPNVGCDV

SEQ ID NO: 1127843 - protein, 9 aa, Homo Sapiens
LEMLRRTQA

SEQ ID NO: 1127844 - protein, 9 aa, Homo Sapiens
AQPGAERVW

SEQ ID NO: 1127845 - protein, 9 aa, Homo Sapiens
AFPDSATTS

SEQ ID NO: 1127846 - protein, 9 aa, Homo Sapiens
PDWPAKDMF

SEQ ID NO: 1127847 - protein, 9 aa, Homo Sapiens
EEQQQQQEE

SEQ ID NO: 1127848 - protein, 9 aa, Homo Sapiens
HYRKASRKS

SEQ ID NO: 1127849 - protein, 9 aa, Homo Sapiens
WSERVPRLL

SEQ ID NO: 1127850 - protein, 9 aa, Homo Sapiens
LFVKTMVCC

SEQ ID NO: 1127851 - protein, 9 aa, Homo Sapiens
RRQSSAPGS

SEQ ID NO: 1127852 - protein, 9 aa, Homo Sapiens
PLCTVASPP

SEQ ID NO: 1127853 - protein, 9 aa, Homo Sapiens
LVYFSLVHG

SEQ ID NO: 1127854 - protein, 9 aa, Homo Sapiens
RQSCCLPGL

SEQ ID NO: 1127855 - protein, 9 aa, Homo Sapiens
LGGRVKMWK

SEQ ID NO: 1127856 - protein, 9 aa, Homo Sapiens
KDESTDKAQ

SEQ ID NO: 1127857 - protein, 9 aa, Homo Sapiens
EALLYYGCR

SEQ ID NO: 1127858 - protein, 9 aa, Homo Sapiens
SRPTSRARQ

SEQ ID NO: 1127859 - protein, 9 aa, Homo Sapiens
SPATSASTQ

SEQ ID NO: 1127860 - protein, 9 aa, Homo Sapiens
YITGYDVKP

SEQ ID NO: 1127861 - protein, 9 aa, Homo Sapiens
AASLTQMSA

SEQ ID NO: 1127862 - protein, 9 aa, Homo Sapiens
LNISCHAAS

SEQ ID NO: 1127863 - protein, 9 aa, Homo Sapiens
AKAHSQYYV

SEQ ID NO: 1127864 - protein, 9 aa, Homo Sapiens
VLKKSRRRT

SEQ ID NO: 1127865 - protein, 9 aa, Homo Sapiens
IRELKPVEA

SEQ ID NO: 1127866 - protein, 9 aa, Homo Sapiens
QSFPTFGAT

SEQ ID NO: 1127867 - protein, 9 aa, Homo Sapiens
TSIVMMAYA

SEQ ID NO: 1127868 - protein, 9 aa, Homo Sapiens
LKEQFQSVE

SEQ ID NO: 1127869 - protein, 9 aa, Homo Sapiens
DSRSFFTSA

SEQ ID NO: 1127870 - protein, 9 aa, Homo Sapiens
ILRETPIFV

SEQ ID NO: 1127871 - protein, 9 aa, Homo Sapiens
VIGVWQMRH

SEQ ID NO: 1127872 - protein, 9 aa, Homo Sapiens
SGWSASCGP

SEQ ID NO: 1127873 - protein, 9 aa, Homo Sapiens
GIEFMSDAE

SEQ ID NO: 1127874 - protein, 9 aa, Homo Sapiens
DDESPGLYV

SEQ ID NO: 1127875 - protein, 9 aa, Homo Sapiens
GPPTTRCTS

SEQ ID NO: 1127876 - protein, 9 aa, Homo Sapiens
YAHTFMNVC

SEQ ID NO: 1127877 - protein, 9 aa, Homo Sapiens
QHEKTLRGL

SEQ ID NO: 1127878 - protein, 9 aa, Homo Sapiens
CATAAEHRV

SEQ ID NO: 1127879 - protein, 9 aa, Homo Sapiens
TEMGKRKRK

SEQ ID NO: 1127880 - protein, 9 aa, Homo Sapiens
QVPPQLPQA

SEQ ID NO: 1127881 - protein, 9 aa, Homo Sapiens
SSASLEKRV

SEQ ID NO: 1127882 - protein, 9 aa, Homo Sapiens
MKMLLSGIM

SEQ ID NO: 1127883 - protein, 9 aa, Homo Sapiens
KKVQELQRS

SEQ ID NO: 1127884 - protein, 9 aa, Homo Sapiens
GIRTRPQAS

SEQ ID NO: 1127885 - protein, 9 aa, Homo Sapiens
TCRCGWGGP

SEQ ID NO: 1127886 - protein, 9 aa, Homo Sapiens
EVMPRTLEG

SEQ ID NO: 1127887 - protein, 9 aa, Homo Sapiens
DGHGCVDAA

SEQ ID NO: 1127888 - protein, 9 aa, Homo Sapiens
LQVVLPCQA

SEQ ID NO: 1127889 - protein, 9 aa, Homo Sapiens
AEQRVLLLL

SEQ ID NO: 1127890 - protein, 9 aa, Homo Sapiens
FGGKEARST

SEQ ID NO: 1127891 - protein, 9 aa, Homo Sapiens
LPRAPASQM

SEQ ID NO: 1127892 - protein, 9 aa, Homo Sapiens
CPTSRQPSK

SEQ ID NO: 1127893 - protein, 9 aa, Homo Sapiens
PYHPGHHGA

SEQ ID NO: 1127894 - protein, 9 aa, Homo Sapiens
TTLHTVEKL

SEQ ID NO: 1127895 - protein, 9 aa, Homo Sapiens
PHAEVTFED

SEQ ID NO: 1127896 - protein, 9 aa, Homo Sapiens
GGVATPGRP

SEQ ID NO: 1127897 - protein, 9 aa, Homo Sapiens
NGIHYWLQL

SEQ ID NO: 1127898 - protein, 9 aa, Homo Sapiens
HICQRGPTH

SEQ ID NO: 1127899 - protein, 9 aa, Homo Sapiens
CPAVPAAAC

SEQ ID NO: 1127900 - protein, 9 aa, Homo Sapiens
LLQTRQADL

SEQ ID NO: 1127901 - protein, 9 aa, Homo Sapiens
CGECFPQAF

SEQ ID NO: 1127902 - protein, 9 aa, Homo Sapiens
LGHIEGSSW

SEQ ID NO: 1127903 - protein, 9 aa, Homo Sapiens
APYGITPEP

SEQ ID NO: 1127904 - protein, 9 aa, Homo Sapiens
TGAGISTAV

SEQ ID NO: 1127905 - protein, 9 aa, Homo Sapiens
QLGPEDTGK

SEQ ID NO: 1127906 - protein, 9 aa, Homo Sapiens
TGDPTEKQL

SEQ ID NO: 1127907 - protein, 9 aa, Homo Sapiens
CSTGTTRQQ

SEQ ID NO: 1127908 - protein, 9 aa, Homo Sapiens
DNQHYNTLL

SEQ ID NO: 1127909 - protein, 9 aa, Homo Sapiens
SLSDCFIGS

SEQ ID NO: 1127910 - protein, 9 aa, Homo Sapiens
KKRRRKRKR

SEQ ID NO: 1127911 - protein, 9 aa, Homo Sapiens
SPTSERLTR

SEQ ID NO: 1127912 - protein, 9 aa, Homo Sapiens
AYAESARHF

SEQ ID NO: 1127913 - protein, 9 aa, Homo Sapiens
SSVVRLTPA

SEQ ID NO: 1127914 - protein, 9 aa, Homo Sapiens
TYDDYDHFS

SEQ ID NO: 1127915 - protein, 9 aa, Homo Sapiens
VSLRPGARG

SEQ ID NO: 1127916 - protein, 9 aa, Homo Sapiens
DRDFDPVST

SEQ ID NO: 1127917 - protein, 9 aa, Homo Sapiens
SPEVLEVGS

SEQ ID NO: 1127918 - protein, 9 aa, Homo Sapiens
PVPAGWRSP

SEQ ID NO: 1127919 - protein, 9 aa, Homo Sapiens
SHASTSSVK

SEQ ID NO: 1127920 - protein, 9 aa, Homo Sapiens
QPGAEQGPS

SEQ ID NO: 1127921 - protein, 9 aa, Homo Sapiens
MAAMRLMPK

SEQ ID NO: 1127922 - protein, 9 aa, Homo Sapiens
LRRTPCVPS

SEQ ID NO: 1127923 - protein, 9 aa, Homo Sapiens
RALTAPRVK

SEQ ID NO: 1127924 - protein, 9 aa, Homo Sapiens
YCHPQGSFF

SEQ ID NO: 1127925 - protein, 9 aa, Homo Sapiens
SCSLLTQPS

SEQ ID NO: 1127926 - protein, 9 aa, Homo Sapiens
PFRSDPAKI

SEQ ID NO: 1127927 - protein, 9 aa, Homo Sapiens
KEAEARKVV

SEQ ID NO: 1127928 - protein, 9 aa, Homo Sapiens
FETIFGPKS

SEQ ID NO: 1127929 - protein, 9 aa, Homo Sapiens
NDWIVAPRG

SEQ ID NO: 1127930 - protein, 9 aa, Homo Sapiens
CYHLYHGLR

SEQ ID NO: 1127931 - protein, 9 aa, Homo Sapiens
RKFSSSQVP

SEQ ID NO: 1127932 - protein, 9 aa, Homo Sapiens
QLAQLHSSL

SEQ ID NO: 1127933 - protein, 9 aa, Homo Sapiens
TEHSDLGNS

SEQ ID NO: 1127934 - protein, 9 aa, Homo Sapiens
WGAADQSGP

SEQ ID NO: 1127935 - protein, 9 aa, Homo Sapiens
RLRFWEFVY

SEQ ID NO: 1127936 - protein, 9 aa, Homo Sapiens
IWVGQLTKR

SEQ ID NO: 1127937 - protein, 9 aa, Homo Sapiens
RLCVKATVC

SEQ ID NO: 1127938 - protein, 9 aa, Homo Sapiens
GASLTLVFK

SEQ ID NO: 1127939 - protein, 9 aa, Homo Sapiens
GVLEGGLGP

SEQ ID NO: 1127940 - protein, 9 aa, Homo Sapiens
DGTRCQPRM

SEQ ID NO: 1127941 - protein, 9 aa, Homo Sapiens
HVSGLGWPV

SEQ ID NO: 1127942 - protein, 9 aa, Homo Sapiens
NGEVQWRRV

SEQ ID NO: 1127943 - protein, 9 aa, Homo Sapiens
LCPGVRSLW

SEQ ID NO: 1127944 - protein, 9 aa, Homo Sapiens
KRTKAVIFC

SEQ ID NO: 1127945 - protein, 9 aa, Homo Sapiens
GGGQGGQDG

SEQ ID NO: 1127946 - protein, 9 aa, Homo Sapiens
PASACTMPP

SEQ ID NO: 1127947 - protein, 9 aa, Homo Sapiens
LPCEELAES

SEQ ID NO: 1127948 - protein, 9 aa, Homo Sapiens
IRTGDGRIF

SEQ ID NO: 1127949 - protein, 9 aa, Homo Sapiens
EARLHVAAM

SEQ ID NO: 1127950 - protein, 9 aa, Homo Sapiens
RLLVSRPPS

SEQ ID NO: 1127951 - protein, 9 aa, Homo Sapiens
ANSHLSPEE

SEQ ID NO: 1127952 - protein, 9 aa, Homo Sapiens
NQEIRAKFE

SEQ ID NO: 1127953 - protein, 9 aa, Homo Sapiens
PAYRDSIRA

SEQ ID NO: 1127954 - protein, 9 aa, Homo Sapiens
CCLPTCSTD

SEQ ID NO: 1127955 - protein, 9 aa, Homo Sapiens
LQPPVVLQG

SEQ ID NO: 1127956 - protein, 9 aa, Homo Sapiens
PLQVVLPCQ

SEQ ID NO: 1127957 - protein, 9 aa, Homo Sapiens
RDQAAAFLP

SEQ ID NO: 1127958 - protein, 9 aa, Homo Sapiens
PWEKNRQRG

SEQ ID NO: 1127959 - protein, 9 aa, Homo Sapiens
IVHVGQVLH

SEQ ID NO: 1127960 - protein, 9 aa, Homo Sapiens
GGSRPGWKR

SEQ ID NO: 1127961 - protein, 9 aa, Homo Sapiens
SPLSKELWQ

SEQ ID NO: 1127962 - protein, 9 aa, Homo Sapiens
RAESRQLVG

SEQ ID NO: 1127963 - protein, 9 aa, Homo Sapiens
GAAGDTPSG

SEQ ID NO: 1127964 - protein, 9 aa, Homo Sapiens
PTCVSCWKP

SEQ ID NO: 1127965 - protein, 9 aa, Homo Sapiens
QSQQPYPQQ

SEQ ID NO: 1127966 - protein, 9 aa, Homo Sapiens
TTSSPRRSP

SEQ ID NO: 1127967 - protein, 9 aa, Homo Sapiens
EVKAGKRMV

SEQ ID NO: 1127968 - protein, 9 aa, Homo Sapiens
KEDEGLANG

SEQ ID NO: 1127969 - protein, 9 aa, Homo Sapiens
GTLEDSRQG

SEQ ID NO: 1127970 - protein, 9 aa, Homo Sapiens
NNLSCGGGS

SEQ ID NO: 1127971 - protein, 9 aa, Homo Sapiens
EQLTLPISQ

SEQ ID NO: 1127972 - protein, 9 aa, Homo Sapiens
MMVRGPLPP

SEQ ID NO: 1127973 - protein, 9 aa, Homo Sapiens
FQGMRGGDA

SEQ ID NO: 1127974 - protein, 9 aa, Homo Sapiens
SECRLLYPV

SEQ ID NO: 1127975 - protein, 9 aa, Homo Sapiens
CGDLCPVTM

SEQ ID NO: 1127976 - protein, 9 aa, Homo Sapiens
ARWCIHALL

SEQ ID NO: 1127977 - protein, 9 aa, Homo Sapiens
VESWGTQCR

SEQ ID NO: 1127978 - protein, 9 aa, Homo Sapiens
GTCLKPTAC

SEQ ID NO: 1127979 - protein, 9 aa, Homo Sapiens
ELALLFEHM

SEQ ID NO: 1127980 - protein, 9 aa, Homo Sapiens
PDDRSLIVG

SEQ ID NO: 1127981 - protein, 9 aa, Homo Sapiens
WLMLCEFFG

SEQ ID NO: 1127982 - protein, 9 aa, Homo Sapiens
TDHIEQELL

SEQ ID NO: 1127983 - protein, 9 aa, Homo Sapiens
RKHTIEEAK

SEQ ID NO: 1127984 - protein, 9 aa, Homo Sapiens
LGRALTAPR

SEQ ID NO: 1127985 - protein, 9 aa, Homo Sapiens
LLNFLSEGV

SEQ ID NO: 1127986 - protein, 9 aa, Homo Sapiens
ALAAVECLG

SEQ ID NO: 1127987 - protein, 9 aa, Homo Sapiens
SKASRAGGT

SEQ ID NO: 1127988 - protein, 9 aa, Homo Sapiens
ATSSVVTDS

SEQ ID NO: 1127989 - protein, 9 aa, Homo Sapiens
QCLRRRSQG

SEQ ID NO: 1127990 - protein, 9 aa, Homo Sapiens
AGLGPGLGA

SEQ ID NO: 1127991 - protein, 9 aa, Homo Sapiens
ESKYVPLIT

SEQ ID NO: 1127992 - protein, 9 aa, Homo Sapiens
RGKDGHIVN

SEQ ID NO: 1127993 - protein, 9 aa, Homo Sapiens
VSTTAAGTK

SEQ ID NO: 1127994 - protein, 9 aa, Homo Sapiens
RRTRPSTST

SEQ ID NO: 1127995 - protein, 9 aa, Homo Sapiens
GAGRRAGCR

SEQ ID NO: 1127996 - protein, 9 aa, Homo Sapiens
IKHISTKEW

SEQ ID NO: 1127997 - protein, 9 aa, Homo Sapiens
SWIKHTQKK

SEQ ID NO: 1127998 - protein, 9 aa, Homo Sapiens
NTKKRHTPR

SEQ ID NO: 1127999 - protein, 9 aa, Homo Sapiens
NYVIDKSAK

SEQ ID NO: 1128000 - protein, 9 aa, Homo Sapiens
VQDNNDNEP

SEQ ID NO: 1128001 - protein, 9 aa, Homo Sapiens
ILENERFDT

SEQ ID NO: 1128002 - protein, 9 aa, Homo Sapiens
RGLKRSEQS

SEQ ID NO: 1128003 - protein, 9 aa, Homo Sapiens
DVGGGDRVP

SEQ ID NO: 1128004 - protein, 9 aa, Homo Sapiens
ITVYHELVQ

SEQ ID NO: 1128005 - protein, 9 aa, Homo Sapiens
LLRILRLRR

SEQ ID NO: 1128006 - protein, 9 aa, Homo Sapiens
ENADIACLC

SEQ ID NO: 1128007 - protein, 9 aa, Homo Sapiens
KFSAFIKKH

SEQ ID NO: 1128008 - protein, 9 aa, Homo Sapiens
ARISRSIYL

SEQ ID NO: 1128009 - protein, 9 aa, Homo Sapiens
RRTKKTSSC

SEQ ID NO: 1128010 - protein, 9 aa, Homo Sapiens
ELRRTPCVP

SEQ ID NO: 1128011 - protein, 9 aa, Homo Sapiens
LIHSINPVR

SEQ ID NO: 1128012 - protein, 9 aa, Homo Sapiens
LGLLLPAVN

SEQ ID NO: 1128013 - protein, 9 aa, Homo Sapiens
KNDNKLKSM

SEQ ID NO: 1128014 - protein, 9 aa, Homo Sapiens
QETESWIPG

SEQ ID NO: 1128015 - protein, 9 aa, Homo Sapiens
CFDPDPPAG

SEQ ID NO: 1128016 - protein, 9 aa, Homo Sapiens
CSVTLQLGP

SEQ ID NO: 1128017 - protein, 9 aa, Homo Sapiens
HTMRRAFRG

SEQ ID NO: 1128018 - protein, 9 aa, Homo Sapiens
GMAGSCLRR

SEQ ID NO: 1128019 - protein, 9 aa, Homo Sapiens
FAELLALDS

SEQ ID NO: 1128020 - protein, 9 aa, Homo Sapiens
KSYRVIQHH

SEQ ID NO: 1128021 - protein, 9 aa, Homo Sapiens
MDSNQNSPI

SEQ ID NO: 1128022 - protein, 9 aa, Homo Sapiens
PIEQGLRVI

SEQ ID NO: 1128023 - protein, 9 aa, Homo Sapiens
WSCPWAGPR

SEQ ID NO: 1128024 - protein, 9 aa, Homo Sapiens
AHTMRRAFR

SEQ ID NO: 1128025 - protein, 9 aa, Homo Sapiens
TISDRYYTT

SEQ ID NO: 1128026 - protein, 9 aa, Homo Sapiens
CTHTSMILI

SEQ ID NO: 1128027 - protein, 9 aa, Homo Sapiens
KHLSQCKTH

SEQ ID NO: 1128028 - protein, 9 aa, Homo Sapiens
LTWLVFLAS

SEQ ID NO: 1128029 - protein, 9 aa, Homo Sapiens
LVYEFINRQ

SEQ ID NO: 1128030 - protein, 9 aa, Homo Sapiens
GAGGQAGAS

SEQ ID NO: 1128031 - protein, 9 aa, Homo Sapiens
RTTMKSVMC

SEQ ID NO: 1128032 - protein, 9 aa, Homo Sapiens
GVVDKALKY

SEQ ID NO: 1128033 - protein, 9 aa, Homo Sapiens
PSRPATPGP

SEQ ID NO: 1128034 - protein, 9 aa, Homo Sapiens
RFNLILMMY

SEQ ID NO: 1128035 - protein, 9 aa, Homo Sapiens
NGQLVSQKS

SEQ ID NO: 1128036 - protein, 9 aa, Homo Sapiens
DPTELEDFK

SEQ ID NO: 1128037 - protein, 9 aa, Homo Sapiens
EMHDDIEVL

SEQ ID NO: 1128038 - protein, 9 aa, Homo Sapiens
CRVIGMPHL

SEQ ID NO: 1128039 - protein, 9 aa, Homo Sapiens
YSVCHCTHL

SEQ ID NO: 1128040 - protein, 9 aa, Homo Sapiens
VSDCSDDTS

SEQ ID NO: 1128041 - protein, 9 aa, Homo Sapiens
SPTATEIQD

SEQ ID NO: 1128042 - protein, 9 aa, Homo Sapiens
SYILGLISC

SEQ ID NO: 1128043 - protein, 9 aa, Homo Sapiens
VCAAISREP

SEQ ID NO: 1128044 - protein, 9 aa, Homo Sapiens
CQIEPVKKM

SEQ ID NO: 1128045 - protein, 9 aa, Homo Sapiens
YGQNVIHHK

SEQ ID NO: 1128046 - protein, 9 aa, Homo Sapiens
LGRAPVSLE

SEQ ID NO: 1128047 - protein, 9 aa, Homo Sapiens
ELNDTLKNS

SEQ ID NO: 1128048 - protein, 9 aa, Homo Sapiens
VVSELLIGR

SEQ ID NO: 1128049 - protein, 9 aa, Homo Sapiens
VGQSNDHGD

SEQ ID NO: 1128050 - protein, 9 aa, Homo Sapiens
PGFWLMLCE

SEQ ID NO: 1128051 - protein, 9 aa, Homo Sapiens
ELGAPRSQG

SEQ ID NO: 1128052 - protein, 9 aa, Homo Sapiens
TSERELDLL

SEQ ID NO: 1128053 - protein, 9 aa, Homo Sapiens
WKNHFMVAQ

SEQ ID NO: 1128054 - protein, 9 aa, Homo Sapiens
SCPRFRQCA

SEQ ID NO: 1128055 - protein, 9 aa, Homo Sapiens
GLRQRRGFA

SEQ ID NO: 1128056 - protein, 9 aa, Homo Sapiens
YWVGMRRLC

SEQ ID NO: 1128057 - protein, 9 aa, Homo Sapiens
TTYAGKLLI

SEQ ID NO: 1128058 - protein, 9 aa, Homo Sapiens
VASDDEFII

SEQ ID NO: 1128059 - protein, 9 aa, Homo Sapiens
TDQPGVQFP

SEQ ID NO: 1128060 - protein, 9 aa, Homo Sapiens
HKLDKVNYS

SEQ ID NO: 1128061 - protein, 9 aa, Homo Sapiens
ETRGCGTSQ

SEQ ID NO: 1128062 - protein, 9 aa, Homo Sapiens
PLLLRILRL

SEQ ID NO: 1128063 - protein, 9 aa, Homo Sapiens
SYSERMEVV

SEQ ID NO: 1128064 - protein, 9 aa, Homo Sapiens
AIAVQAGDG

SEQ ID NO: 1128065 - protein, 9 aa, Homo Sapiens
KAMKQGFKF

SEQ ID NO: 1128066 - protein, 9 aa, Homo Sapiens
QLYACQNPT

SEQ ID NO: 1128067 - protein, 9 aa, Homo Sapiens
LLSLYSVAV

SEQ ID NO: 1128068 - protein, 9 aa, Homo Sapiens
VVKEARGRM

SEQ ID NO: 1128069 - protein, 9 aa, Homo Sapiens
IGCEQDIDD

SEQ ID NO: 1128070 - protein, 9 aa, Homo Sapiens
QMYTYPVSN

SEQ ID NO: 1128071 - protein, 9 aa, Homo Sapiens
GGKAFFKGV

SEQ ID NO: 1128072 - protein, 9 aa, Homo Sapiens
RHSDKNDGG

SEQ ID NO: 1128073 - protein, 9 aa, Homo Sapiens
VKMACPRDQ

SEQ ID NO: 1128074 - protein, 9 aa, Homo Sapiens
RRSQGVSSC

SEQ ID NO: 1128075 - protein, 9 aa, Homo Sapiens
ADTFKKCVS

SEQ ID NO: 1128076 - protein, 9 aa, Homo Sapiens
FLWTCLITR

SEQ ID NO: 1128077 - protein, 9 aa, Homo Sapiens
RWTLTRMLL

SEQ ID NO: 1128078 - protein, 9 aa, Homo Sapiens
CLSGHPPQA

SEQ ID NO: 1128079 - protein, 9 aa, Homo Sapiens
SPTPMWWLI

SEQ ID NO: 1128080 - protein, 9 aa, Homo Sapiens
VMYTIGYSI

SEQ ID NO: 1128081 - protein, 9 aa, Homo Sapiens
SSHLHKTEK

SEQ ID NO: 1128082 - protein, 9 aa, Homo Sapiens
YNDCFFYHE

SEQ ID NO: 1128083 - protein, 9 aa, Homo Sapiens
KHTQKKYIY

SEQ ID NO: 1128084 - protein, 9 aa, Homo Sapiens
DTIYDSKAP

SEQ ID NO: 1128085 - protein, 9 aa, Homo Sapiens
QDKTLTHPS

SEQ ID NO: 1128086 - protein, 9 aa, Homo Sapiens
PVPGKVHKY

SEQ ID NO: 1128087 - protein, 9 aa, Homo Sapiens
TAPMWTHGW

SEQ ID NO: 1128088 - protein, 9 aa, Homo Sapiens
WVTLITENL

SEQ ID NO: 1128089 - protein, 9 aa, Homo Sapiens
QCSSPSCSA

SEQ ID NO: 1128090 - protein, 9 aa, Homo Sapiens
ATITEIPPL

SEQ ID NO: 1128091 - protein, 9 aa, Homo Sapiens
FKLDLSLNF

SEQ ID NO: 1128092 - protein, 9 aa, Homo Sapiens
AGVNEKVSC

SEQ ID NO: 1128093 - protein, 9 aa, Homo Sapiens
PPCCVPTTY

SEQ ID NO: 1128094 - protein, 9 aa, Homo Sapiens
TAIDTENIR

SEQ ID NO: 1128095 - protein, 9 aa, Homo Sapiens
LQLMYSCKE

SEQ ID NO: 1128096 - protein, 9 aa, Homo Sapiens
KRREGVKSE

SEQ ID NO: 1128097 - protein, 9 aa, Homo Sapiens
PWKIRDSNR

SEQ ID NO: 1128098 - protein, 9 aa, Homo Sapiens
ASLAYSEAI

SEQ ID NO: 1128099 - protein, 9 aa, Homo Sapiens
RATFIDFPV

SEQ ID NO: 1128100 - protein, 9 aa, Homo Sapiens
YGGNLIGNN

SEQ ID NO: 1128101 - protein, 9 aa, Homo Sapiens
PGAPPSQRL

SEQ ID NO: 1128102 - protein, 9 aa, Homo Sapiens
GDTFPPAQS

SEQ ID NO: 1128103 - protein, 9 aa, Homo Sapiens
CYDLVRTEI

SEQ ID NO: 1128104 - protein, 9 aa, Homo Sapiens
HQANCLSMS

SEQ ID NO: 1128105 - protein, 9 aa, Homo Sapiens
SMIMYSLPL

SEQ ID NO: 1128106 - protein, 9 aa, Homo Sapiens
KIPHFNADS

SEQ ID NO: 1128107 - protein, 9 aa, Homo Sapiens
TTDCPEHLL

SEQ ID NO: 1128108 - protein, 9 aa, Homo Sapiens
RTHTGSNID

SEQ ID NO: 1128109 - protein, 9 aa, Homo Sapiens
RTSQKDVWC

SEQ ID NO: 1128110 - protein, 9 aa, Homo Sapiens
TTDYHGATP

SEQ ID NO: 1128111 - protein, 9 aa, Homo Sapiens
DKDGAALRE

SEQ ID NO: 1128112 - protein, 9 aa, Homo Sapiens
SEGELGAPR

SEQ ID NO: 1128113 - protein, 9 aa, Homo Sapiens
ACGFYLTVV

SEQ ID NO: 1128114 - protein, 9 aa, Homo Sapiens
QGMKHSSQK

SEQ ID NO: 1128115 - protein, 9 aa, Homo Sapiens
ASQEGAQYP

SEQ ID NO: 1128116 - protein, 9 aa, Homo Sapiens
DHESSGWSF

SEQ ID NO: 1128117 - protein, 9 aa, Homo Sapiens
GLKDSQIVD

SEQ ID NO: 1128118 - protein, 9 aa, Homo Sapiens
DDQSETVYE

SEQ ID NO: 1128119 - protein, 9 aa, Homo Sapiens
FQTMSQAVG

SEQ ID NO: 1128120 - protein, 9 aa, Homo Sapiens
RSCSQGPPV

SEQ ID NO: 1128121 - protein, 9 aa, Homo Sapiens
SSKRLSIQE

SEQ ID NO: 1128122 - protein, 9 aa, Homo Sapiens
QGALTPPHP

SEQ ID NO: 1128123 - protein, 9 aa, Homo Sapiens
FHLLREEKF

SEQ ID NO: 1128124 - protein, 9 aa, Homo Sapiens
SKDPHFSKI

SEQ ID NO: 1128125 - protein, 9 aa, Homo Sapiens
GFVLDHSRL

SEQ ID NO: 1128126 - protein, 9 aa, Homo Sapiens
HRQLLSKKL

SEQ ID NO: 1128127 - protein, 9 aa, Homo Sapiens
SACPSSPIP

SEQ ID NO: 1128128 - protein, 9 aa, Homo Sapiens
TKLYKGVPL

SEQ ID NO: 1128129 - protein, 9 aa, Homo Sapiens
IEQLSRFAS

SEQ ID NO: 1128130 - protein, 9 aa, Homo Sapiens
PWCATAAEH

SEQ ID NO: 1128131 - protein, 9 aa, Homo Sapiens
RALERQVEE

SEQ ID NO: 1128132 - protein, 9 aa, Homo Sapiens
CFSASPPSM

SEQ ID NO: 1128133 - protein, 9 aa, Homo Sapiens
CSGGFNGGC

SEQ ID NO: 1128134 - protein, 9 aa, Homo Sapiens
ELRIGRLMN

SEQ ID NO: 1128135 - protein, 9 aa, Homo Sapiens
NNNNHTEAY

SEQ ID NO: 1128136 - protein, 9 aa, Homo Sapiens
TQKKYIYDN

SEQ ID NO: 1128137 - protein, 9 aa, Homo Sapiens
EPVVSDTIY

SEQ ID NO: 1128138 - protein, 9 aa, Homo Sapiens
LDLGVHGEG

SEQ ID NO: 1128139 - protein, 9 aa, Homo Sapiens
VGAGAGLGC

SEQ ID NO: 1128140 - protein, 9 aa, Homo Sapiens
GFDGTYYGD

SEQ ID NO: 1128141 - protein, 9 aa, Homo Sapiens
PNVGCDVPR

SEQ ID NO: 1128142 - protein, 9 aa, Homo Sapiens
EMANRVLRN

SEQ ID NO: 1128143 - protein, 9 aa, Homo Sapiens
QPGRMHRIG

SEQ ID NO: 1128144 - protein, 9 aa, Homo Sapiens
DSQSSNPCV

SEQ ID NO: 1128145 - protein, 9 aa, Homo Sapiens
ELDYYLYDQ

SEQ ID NO: 1128146 - protein, 9 aa, Homo Sapiens
SMRDASVLA

SEQ ID NO: 1128147 - protein, 9 aa, Homo Sapiens
DNKSLTAHI

SEQ ID NO: 1128148 - protein, 9 aa, Homo Sapiens
AGPAHQPGN

SEQ ID NO: 1128149 - protein, 9 aa, Homo Sapiens
AVNQVVAVP

SEQ ID NO: 1128150 - protein, 9 aa, Homo Sapiens
VLGHHTYGA

SEQ ID NO: 1128151 - protein, 9 aa, Homo Sapiens
PYEVHFKKD

SEQ ID NO: 1128152 - protein, 9 aa, Homo Sapiens
GDSEGGRAP

SEQ ID NO: 1128153 - protein, 9 aa, Homo Sapiens
LVQTTCWPS

SEQ ID NO: 1128154 - protein, 9 aa, Homo Sapiens
VVTVPPQMG

SEQ ID NO: 1128155 - protein, 9 aa, Homo Sapiens
PEHQTRLRN

SEQ ID NO: 1128156 - protein, 9 aa, Homo Sapiens
NLLDSSLDN

SEQ ID NO: 1128157 - protein, 9 aa, Homo Sapiens
KFLNSTNSW

SEQ ID NO: 1128158 - protein, 9 aa, Homo Sapiens
ETYDEEEEE

SEQ ID NO: 1128159 - protein, 9 aa, Homo Sapiens
SSTRPKDNP

SEQ ID NO: 1128160 - protein, 9 aa, Homo Sapiens
SKNFFDFLL

SEQ ID NO: 1128161 - protein, 9 aa, Homo Sapiens
PSEAGVPGS

SEQ ID NO: 1128162 - protein, 9 aa, Homo Sapiens
QLYFCRYCN

SEQ ID NO: 1128163 - protein, 9 aa, Homo Sapiens
RASFTYLSF

SEQ ID NO: 1128164 - protein, 9 aa, Homo Sapiens
ELLEGPDYS

SEQ ID NO: 1128165 - protein, 9 aa, Homo Sapiens
SEYPSLISI

SEQ ID NO: 1128166 - protein, 9 aa, Homo Sapiens
GSQGDYQAT

SEQ ID NO: 1128167 - protein, 9 aa, Homo Sapiens
IMVSEIQAD

SEQ ID NO: 1128168 - protein, 9 aa, Homo Sapiens
IYFMACTVA

SEQ ID NO: 1128169 - protein, 9 aa, Homo Sapiens
STDKAQEGT

SEQ ID NO: 1128170 - protein, 9 aa, Homo Sapiens
WNVLNRSGR

SEQ ID NO: 1128171 - protein, 9 aa, Homo Sapiens
ESVNAKESI

SEQ ID NO: 1128172 - protein, 9 aa, Homo Sapiens
VVPQNMVPL

SEQ ID NO: 1128173 - protein, 9 aa, Homo Sapiens
VHRSAGVGR

SEQ ID NO: 1128174 - protein, 9 aa, Homo Sapiens
STGMGRPPP

SEQ ID NO: 1128175 - protein, 9 aa, Homo Sapiens
GKGRVGGHW

SEQ ID NO: 1128176 - protein, 9 aa, Homo Sapiens
WVNSPEEVK

SEQ ID NO: 1128177 - protein, 9 aa, Homo Sapiens
WTPAPRYPL

SEQ ID NO: 1128178 - protein, 9 aa, Homo Sapiens
IQVQTGGRL

SEQ ID NO: 1128179 - protein, 9 aa, Homo Sapiens
HPWLRLRPQ

SEQ ID NO: 1128180 - protein, 9 aa, Homo Sapiens
IKAFFQKSG

SEQ ID NO: 1128181 - protein, 9 aa, Homo Sapiens
GTPDRFPEG

SEQ ID NO: 1128182 - protein, 9 aa, Homo Sapiens
ENNAIPQSP

SEQ ID NO: 1128183 - protein, 9 aa, Homo Sapiens
EPQQHFNTL

SEQ ID NO: 1128184 - protein, 9 aa, Homo Sapiens
YDREVQWAL

SEQ ID NO: 1128185 - protein, 9 aa, Homo Sapiens
DLEEEDEEE

SEQ ID NO: 1128186 - protein, 9 aa, Homo Sapiens
CTNSQKSIV

SEQ ID NO: 1128187 - protein, 9 aa, Homo Sapiens
PKTVAALWS

SEQ ID NO: 1128188 - protein, 9 aa, Homo Sapiens
GALGRRQLN

SEQ ID NO: 1128189 - protein, 9 aa, Homo Sapiens
ESPWLGGQL

SEQ ID NO: 1128190 - protein, 9 aa, Homo Sapiens
CKWSSCLTW

SEQ ID NO: 1128191 - protein, 9 aa, Homo Sapiens
PRPPGAPPS

SEQ ID NO: 1128192 - protein, 9 aa, Homo Sapiens
FTFYDSRQS

SEQ ID NO: 1128193 - protein, 9 aa, Homo Sapiens
GQGFIPDGD

SEQ ID NO: 1128194 - protein, 9 aa, Homo Sapiens
PSGLASLGK

SEQ ID NO: 1128195 - protein, 9 aa, Homo Sapiens
EKVQAMALL

SEQ ID NO: 1128196 - protein, 9 aa, Homo Sapiens
FGVEEMATK

SEQ ID NO: 1128197 - protein, 9 aa, Homo Sapiens
GLDPVFLVF

SEQ ID NO: 1128198 - protein, 9 aa, Homo Sapiens
ALPTQQLAW

SEQ ID NO: 1128199 - protein, 9 aa, Homo Sapiens
AHCMGEIVT

SEQ ID NO: 1128200 - protein, 9 aa, Homo Sapiens
IPEEFFDYS

SEQ ID NO: 1128201 - protein, 9 aa, Homo Sapiens
VDKPLHIIG

SEQ ID NO: 1128202 - protein, 9 aa, Homo Sapiens
PSPVSTAPS

SEQ ID NO: 1128203 - protein, 9 aa, Homo Sapiens
TLPHPHPHS

SEQ ID NO: 1128204 - protein, 9 aa, Homo Sapiens
LSTKGFPRN

SEQ ID NO: 1128205 - protein, 9 aa, Homo Sapiens
PPLHQPPPP

SEQ ID NO: 1128206 - protein, 9 aa, Homo Sapiens
VDVNVYLTI

SEQ ID NO: 1128207 - protein, 9 aa, Homo Sapiens
FHMDTWNFC

SEQ ID NO: 1128208 - protein, 9 aa, Homo Sapiens
MTIYIFCLH

SEQ ID NO: 1128209 - protein, 9 aa, Homo Sapiens
RRLWGTTQL

SEQ ID NO: 1128210 - protein, 9 aa, Homo Sapiens
LFLHHKDRE

SEQ ID NO: 1128211 - protein, 9 aa, Homo Sapiens
WLVFLASTR

SEQ ID NO: 1128212 - protein, 9 aa, Homo Sapiens
RHRFLCGGA

SEQ ID NO: 1128213 - protein, 9 aa, Homo Sapiens
NPAHGNDTV

SEQ ID NO: 1128214 - protein, 9 aa, Homo Sapiens
GTYRAGVVC

SEQ ID NO: 1128215 - protein, 9 aa, Homo Sapiens
RFRQCANTF

SEQ ID NO: 1128216 - protein, 9 aa, Homo Sapiens
TIRLYEMIL

SEQ ID NO: 1128217 - protein, 9 aa, Homo Sapiens
CPRCPRPCP

SEQ ID NO: 1128218 - protein, 9 aa, Homo Sapiens
WAPHSAGLS

SEQ ID NO: 1128219 - protein, 9 aa, Homo Sapiens
MSANAAVAS

SEQ ID NO: 1128220 - protein, 9 aa, Homo Sapiens
INVLKKSRR

SEQ ID NO: 1128221 - protein, 9 aa, Homo Sapiens
AYGAGAYRL

SEQ ID NO: 1128222 - protein, 9 aa, Homo Sapiens
VEIQPTWKL

SEQ ID NO: 1128223 - protein, 9 aa, Homo Sapiens
CCNCKATDE

SEQ ID NO: 1128224 - protein, 9 aa, Homo Sapiens
VQKIPVLFS

SEQ ID NO: 1128225 - protein, 9 aa, Homo Sapiens
DTLVHIWKL

SEQ ID NO: 1128226 - protein, 9 aa, Homo Sapiens
DVGGNCHRC

SEQ ID NO: 1128227 - protein, 9 aa, Homo Sapiens
LNRPPRFLQ

SEQ ID NO: 1128228 - protein, 9 aa, Homo Sapiens
QWMLKATLI

SEQ ID NO: 1128229 - protein, 9 aa, Homo Sapiens
ASTRPSGPP

SEQ ID NO: 1128230 - protein, 9 aa, Homo Sapiens
TLACSRNSL

SEQ ID NO: 1128231 - protein, 9 aa, Homo Sapiens
RELKMLCFL

SEQ ID NO: 1128232 - protein, 9 aa, Homo Sapiens
SRCASRRPL

SEQ ID NO: 1128233 - protein, 9 aa, Homo Sapiens
LLSRAAAQL

SEQ ID NO: 1128234 - protein, 9 aa, Homo Sapiens
SKELWQKYN

SEQ ID NO: 1128235 - protein, 9 aa, Homo Sapiens
SARELRVSS

SEQ ID NO: 1128236 - protein, 9 aa, Homo Sapiens
SLRLSCCLF

SEQ ID NO: 1128237 - protein, 9 aa, Homo Sapiens
KKAKRVAVL

SEQ ID NO: 1128238 - protein, 9 aa, Homo Sapiens
AKQKLDSKE

SEQ ID NO: 1128239 - protein, 9 aa, Homo Sapiens
SGLETTVFY

SEQ ID NO: 1128240 - protein, 9 aa, Homo Sapiens
ITSWGEGFA

SEQ ID NO: 1128241 - protein, 9 aa, Homo Sapiens
MFGFLLMTM

SEQ ID NO: 1128242 - protein, 9 aa, Homo Sapiens
LHREDVPRQ

SEQ ID NO: 1128243 - protein, 9 aa, Homo Sapiens
AAGVQFGEV

SEQ ID NO: 1128244 - protein, 9 aa, Homo Sapiens
SERDFFREV

SEQ ID NO: 1128245 - protein, 9 aa, Homo Sapiens
EKHGLSDIK

SEQ ID NO: 1128246 - protein, 9 aa, Homo Sapiens
GHRDVTGYL

SEQ ID NO: 1128247 - protein, 9 aa, Homo Sapiens
CGKKYTQKD

SEQ ID NO: 1128248 - protein, 9 aa, Homo Sapiens
RDSNYLNLF

SEQ ID NO: 1128249 - protein, 9 aa, Homo Sapiens
HLCPSEAGV

SEQ ID NO: 1128250 - protein, 9 aa, Homo Sapiens
LFVTVRLCR

SEQ ID NO: 1128251 - protein, 9 aa, Homo Sapiens
NMENLRQCV

SEQ ID NO: 1128252 - protein, 9 aa, Homo Sapiens
YAEQLKEYL

SEQ ID NO: 1128253 - protein, 9 aa, Homo Sapiens
VVSDTIYDS

SEQ ID NO: 1128254 - protein, 9 aa, Homo Sapiens
IYSWYGSVE

SEQ ID NO: 1128255 - protein, 9 aa, Homo Sapiens
CMIHLLAHD

SEQ ID NO: 1128256 - protein, 9 aa, Homo Sapiens
LTGNTAIIL

SEQ ID NO: 1128257 - protein, 9 aa, Homo Sapiens
ILICLQVAV

SEQ ID NO: 1128258 - protein, 9 aa, Homo Sapiens
HIKAFSTCS

SEQ ID NO: 1128259 - protein, 9 aa, Homo Sapiens
PPGLLLHAP

SEQ ID NO: 1128260 - protein, 9 aa, Homo Sapiens
GGQGGQDGH

SEQ ID NO: 1128261 - protein, 9 aa, Homo Sapiens
QEERRIRQE

SEQ ID NO: 1128262 - protein, 9 aa, Homo Sapiens
VTIHSFSGL

SEQ ID NO: 1128263 - protein, 9 aa, Homo Sapiens
LSKKFIAGF

SEQ ID NO: 1128264 - protein, 9 aa, Homo Sapiens
LKQSFTTVA

SEQ ID NO: 1128265 - protein, 9 aa, Homo Sapiens
CGNNFEDEP

SEQ ID NO: 1128266 - protein, 9 aa, Homo Sapiens
GGEALVPAA

SEQ ID NO: 1128267 - protein, 9 aa, Homo Sapiens
SRTSWRTLL

SEQ ID NO: 1128268 - protein, 9 aa, Homo Sapiens
KLEPSFSEY

SEQ ID NO: 1128269 - protein, 9 aa, Homo Sapiens
LKCHNSDAV

SEQ ID NO: 1128270 - protein, 9 aa, Homo Sapiens
GEKGTYSYL

SEQ ID NO: 1128271 - protein, 9 aa, Homo Sapiens
KIFISLPRS

SEQ ID NO: 1128272 - protein, 9 aa, Homo Sapiens
VPPLPERKT

SEQ ID NO: 1128273 - protein, 9 aa, Homo Sapiens
CVPNNNERY

SEQ ID NO: 1128274 - protein, 9 aa, Homo Sapiens
VKVQDEKRK

SEQ ID NO: 1128275 - protein, 9 aa, Homo Sapiens
LLPDGGITA

SEQ ID NO: 1128276 - protein, 9 aa, Homo Sapiens
HLHLPPTPL

SEQ ID NO: 1128277 - protein, 9 aa, Homo Sapiens
NLSPANQRK

SEQ ID NO: 1128278 - protein, 9 aa, Homo Sapiens
CPPGTTASS

SEQ ID NO: 1128279 - protein, 9 aa, Homo Sapiens
KFSPPKKFS

SEQ ID NO: 1128280 - protein, 9 aa, Homo Sapiens
KFLIKYQQE

SEQ ID NO: 1128281 - protein, 9 aa, Homo Sapiens
HFLFFVKSW

SEQ ID NO: 1128282 - protein, 9 aa, Homo Sapiens
DAPPSAAAL

SEQ ID NO: 1128283 - protein, 9 aa, Homo Sapiens
ETIFSTAHW

SEQ ID NO: 1128284 - protein, 9 aa, Homo Sapiens
AEAPPGCIL

SEQ ID NO: 1128285 - protein, 9 aa, Homo Sapiens
QPAAVHGLC

SEQ ID NO: 1128286 - protein, 9 aa, Homo Sapiens
LQVQDLSGN

SEQ ID NO: 1128287 - protein, 9 aa, Homo Sapiens
VSSCQLRHL

SEQ ID NO: 1128288 - protein, 9 aa, Homo Sapiens
RLVQLLVSP

SEQ ID NO: 1128289 - protein, 9 aa, Homo Sapiens
ELLQIEPEK

SEQ ID NO: 1128290 - protein, 9 aa, Homo Sapiens
NSNDCMRGS

SEQ ID NO: 1128291 - protein, 9 aa, Homo Sapiens
EPPMPPPAN

SEQ ID NO: 1128292 - protein, 9 aa, Homo Sapiens
HLLLPPDCG

SEQ ID NO: 1128293 - protein, 9 aa, Homo Sapiens
RALQPLWES

SEQ ID NO: 1128294 - protein, 9 aa, Homo Sapiens
PVRRDASRC

SEQ ID NO: 1128295 - protein, 9 aa, Homo Sapiens
GCFSDPGVV

SEQ ID NO: 1128296 - protein, 9 aa, Homo Sapiens
ASHKCLMDR

SEQ ID NO: 1128297 - protein, 9 aa, Homo Sapiens
THVNVPFIT

SEQ ID NO: 1128298 - protein, 9 aa, Homo Sapiens
KLQRRQFLA

SEQ ID NO: 1128299 - protein, 9 aa, Homo Sapiens
SVLERFLQE

SEQ ID NO: 1128300 - protein, 9 aa, Homo Sapiens
ATTTCPGPS

SEQ ID NO: 1128301 - protein, 9 aa, Homo Sapiens
TTPALQPPP

SEQ ID NO: 1128302 - protein, 9 aa, Homo Sapiens
DILVIEKHG

SEQ ID NO: 1128303 - protein, 9 aa, Homo Sapiens
WQFRCIEKQ

SEQ ID NO: 1128304 - protein, 9 aa, Homo Sapiens
EITALCPFR

SEQ ID NO: 1128305 - protein, 9 aa, Homo Sapiens
STLEQTQYS

SEQ ID NO: 1128306 - protein, 9 aa, Homo Sapiens
GKMPVYAEV

SEQ ID NO: 1128307 - protein, 9 aa, Homo Sapiens
GTSRAAGTT

SEQ ID NO: 1128308 - protein, 9 aa, Homo Sapiens
KATLIPGLW

SEQ ID NO: 1128309 - protein, 9 aa, Homo Sapiens
QQQQVFERL

SEQ ID NO: 1128310 - protein, 9 aa, Homo Sapiens
CDDYEELTD

SEQ ID NO: 1128311 - protein, 9 aa, Homo Sapiens
PSFAYGLAV

SEQ ID NO: 1128312 - protein, 9 aa, Homo Sapiens
RRAWRALLY

SEQ ID NO: 1128313 - protein, 9 aa, Homo Sapiens
RIRSGGVQG

SEQ ID NO: 1128314 - protein, 9 aa, Homo Sapiens
AREWLFAVF

SEQ ID NO: 1128315 - protein, 9 aa, Homo Sapiens
IGTTAAGIP

SEQ ID NO: 1128316 - protein, 9 aa, Homo Sapiens
ENVEAAQTE

SEQ ID NO: 1128317 - protein, 9 aa, Homo Sapiens
PYQEADQRD

SEQ ID NO: 1128318 - protein, 9 aa, Homo Sapiens
ASTARAGSS

SEQ ID NO: 1128319 - protein, 9 aa, Homo Sapiens
ELRAGDPWT

SEQ ID NO: 1128320 - protein, 9 aa, Homo Sapiens
GRICIESCK

SEQ ID NO: 1128321 - protein, 9 aa, Homo Sapiens
DHKYCCDAP

SEQ ID NO: 1128322 - protein, 9 aa, Homo Sapiens
PGLGKPLML

SEQ ID NO: 1128323 - protein, 9 aa, Homo Sapiens
HMDTWNFCD

SEQ ID NO: 1128324 - protein, 9 aa, Homo Sapiens
LGPDNSNIG

SEQ ID NO: 1128325 - protein, 9 aa, Homo Sapiens
CCRCKGWRG

SEQ ID NO: 1128326 - protein, 9 aa, Homo Sapiens
HPQLLTSVP

SEQ ID NO: 1128327 - protein, 9 aa, Homo Sapiens
LGPLPASPG

SEQ ID NO: 1128328 - protein, 9 aa, Homo Sapiens
LQGLFPPLH

SEQ ID NO: 1128329 - protein, 9 aa, Homo Sapiens
KNCDLYFPR

SEQ ID NO: 1128330 - protein, 9 aa, Homo Sapiens
DHITGEFQI

SEQ ID NO: 1128331 - protein, 9 aa, Homo Sapiens
LEDLSKNCR

SEQ ID NO: 1128332 - protein, 9 aa, Homo Sapiens
PATLPCRRH

SEQ ID NO: 1128333 - protein, 9 aa, Homo Sapiens
GRAFGHTST

SEQ ID NO: 1128334 - protein, 9 aa, Homo Sapiens
IMMSSCGIL

SEQ ID NO: 1128335 - protein, 9 aa, Homo Sapiens
PLKSTFHIL

SEQ ID NO: 1128336 - protein, 9 aa, Homo Sapiens
CLFLMSEAV

SEQ ID NO: 1128337 - protein, 9 aa, Homo Sapiens
YNLQVQGKF

SEQ ID NO: 1128338 - protein, 9 aa, Homo Sapiens
PAAGRASGF

SEQ ID NO: 1128339 - protein, 9 aa, Homo Sapiens
ICPCPQYIR

SEQ ID NO: 1128340 - protein, 9 aa, Homo Sapiens
IRFQYRILR

SEQ ID NO: 1128341 - protein, 9 aa, Homo Sapiens
GNWGAADQS

SEQ ID NO: 1128342 - protein, 9 aa, Homo Sapiens
LGCVAELGG

SEQ ID NO: 1128343 - protein, 9 aa, Homo Sapiens
MCKMNPMTD

SEQ ID NO: 1128344 - protein, 9 aa, Homo Sapiens
GLGRLLAPG

SEQ ID NO: 1128345 - protein, 9 aa, Homo Sapiens
IPISKAVES

SEQ ID NO: 1128346 - protein, 9 aa, Homo Sapiens
ELQPLPQCP

SEQ ID NO: 1128347 - protein, 9 aa, Homo Sapiens
LWRMSPTDA

SEQ ID NO: 1128348 - protein, 9 aa, Homo Sapiens
ALKHKVDPV

SEQ ID NO: 1128349 - protein, 9 aa, Homo Sapiens
ARRAISTFG

SEQ ID NO: 1128350 - protein, 9 aa, Homo Sapiens
GRNLPGEPG

SEQ ID NO: 1128351 - protein, 9 aa, Homo Sapiens
VMGKTKPEI

SEQ ID NO: 1128352 - protein, 9 aa, Homo Sapiens
PGTTASSPE

SEQ ID NO: 1128353 - protein, 9 aa, Homo Sapiens
ERNKKQLPY

SEQ ID NO: 1128354 - protein, 9 aa, Homo Sapiens
YVKGFYCVE

SEQ ID NO: 1128355 - protein, 9 aa, Homo Sapiens
GSDQELYFF

SEQ ID NO: 1128356 - protein, 9 aa, Homo Sapiens
TDLFLLAIF

SEQ ID NO: 1128357 - protein, 9 aa, Homo Sapiens
RRYFKKFME

SEQ ID NO: 1128358 - protein, 9 aa, Homo Sapiens
KKRGKSQGG

SEQ ID NO: 1128359 - protein, 9 aa, Homo Sapiens
KTRNRALQP

SEQ ID NO: 1128360 - protein, 9 aa, Homo Sapiens
WWSVAGLIH

SEQ ID NO: 1128361 - protein, 9 aa, Homo Sapiens
VIRTCVNTS

SEQ ID NO: 1128362 - protein, 9 aa, Homo Sapiens
KGHSHPGEL

SEQ ID NO: 1128363 - protein, 9 aa, Homo Sapiens
EVQWRRVLS

SEQ ID NO: 1128364 - protein, 9 aa, Homo Sapiens
TKEEIMKAF

SEQ ID NO: 1128365 - protein, 9 aa, Homo Sapiens
VVVPTRHIR

SEQ ID NO: 1128366 - protein, 9 aa, Homo Sapiens
TYKADQILL

SEQ ID NO: 1128367 - protein, 9 aa, Homo Sapiens
DVDCMTSHV

SEQ ID NO: 1128368 - protein, 9 aa, Homo Sapiens
QRNLLRLQS

SEQ ID NO: 1128369 - protein, 9 aa, Homo Sapiens
ILVVIGVWQ

SEQ ID NO: 1128370 - protein, 9 aa, Homo Sapiens
RWTSFGYVI

SEQ ID NO: 1128371 - protein, 9 aa, Homo Sapiens
SGARLGAAR

SEQ ID NO: 1128372 - protein, 9 aa, Homo Sapiens
EERAKLEYM

SEQ ID NO: 1128373 - protein, 9 aa, Homo Sapiens
PWKARWCIH

SEQ ID NO: 1128374 - protein, 9 aa, Homo Sapiens
RGQAQDTSG

SEQ ID NO: 1128375 - protein, 9 aa, Homo Sapiens
YLATVMGNL

SEQ ID NO: 1128376 - protein, 9 aa, Homo Sapiens
AGHWRRCGG

SEQ ID NO: 1128377 - protein, 9 aa, Homo Sapiens
IIVLLLGTV

SEQ ID NO: 1128378 - protein, 9 aa, Homo Sapiens
QYSRQSCSP

SEQ ID NO: 1128379 - protein, 9 aa, Homo Sapiens
SPPALQGCR

SEQ ID NO: 1128380 - protein, 9 aa, Homo Sapiens
SLALLRGSV

SEQ ID NO: 1128381 - protein, 9 aa, Homo Sapiens
SSDAGSSGP

SEQ ID NO: 1128382 - protein, 9 aa, Homo Sapiens
FFKGVWSNV

SEQ ID NO: 1128383 - protein, 9 aa, Homo Sapiens
SVKSFEELQ

SEQ ID NO: 1128384 - protein, 9 aa, Homo Sapiens
SQNWPPLEG

SEQ ID NO: 1128385 - protein, 9 aa, Homo Sapiens
VFLVVFLYM

SEQ ID NO: 1128386 - protein, 9 aa, Homo Sapiens
IIVRASFTY

SEQ ID NO: 1128387 - protein, 9 aa, Homo Sapiens
LRMTPTCPL

SEQ ID NO: 1128388 - protein, 9 aa, Homo Sapiens
DDSTSSAER

SEQ ID NO: 1128389 - protein, 9 aa, Homo Sapiens
ATVIHNVCE

SEQ ID NO: 1128390 - protein, 9 aa, Homo Sapiens
RRRRTPTRR

SEQ ID NO: 1128391 - protein, 9 aa, Homo Sapiens
SEKKAINGI

SEQ ID NO: 1128392 - protein, 9 aa, Homo Sapiens
MAEKNFNTN

SEQ ID NO: 1128393 - protein, 9 aa, Homo Sapiens
PCPGWGAPV

SEQ ID NO: 1128394 - protein, 9 aa, Homo Sapiens
VSGLRSVVA

SEQ ID NO: 1128395 - protein, 9 aa, Homo Sapiens
LLGALGRRQ

SEQ ID NO: 1128396 - protein, 9 aa, Homo Sapiens
KVTLMINLY

SEQ ID NO: 1128397 - protein, 9 aa, Homo Sapiens
VCLLFPASG

SEQ ID NO: 1128398 - protein, 9 aa, Homo Sapiens
DSQLASHLM

SEQ ID NO: 1128399 - protein, 9 aa, Homo Sapiens
PDTLQSPFG

SEQ ID NO: 1128400 - protein, 9 aa, Homo Sapiens
APRTPRASR

SEQ ID NO: 1128401 - protein, 9 aa, Homo Sapiens
LLAECCAQG

SEQ ID NO: 1128402 - protein, 9 aa, Homo Sapiens
VYVTRRCTA

SEQ ID NO: 1128403 - protein, 9 aa, Homo Sapiens
GFVASPGRR

SEQ ID NO: 1128404 - protein, 9 aa, Homo Sapiens
SLPILRPTG

SEQ ID NO: 1128405 - protein, 9 aa, Homo Sapiens
EDVGTTQLL

SEQ ID NO: 1128406 - protein, 9 aa, Homo Sapiens
ERFFERVTS

SEQ ID NO: 1128407 - protein, 9 aa, Homo Sapiens
GSTRDGSAL

SEQ ID NO: 1128408 - protein, 9 aa, Homo Sapiens
CDPNLTFDA

SEQ ID NO: 1128409 - protein, 9 aa, Homo Sapiens
AIFRKECNF

SEQ ID NO: 1128410 - protein, 9 aa, Homo Sapiens
NIFKDVLIG

SEQ ID NO: 1128411 - protein, 9 aa, Homo Sapiens
PSLMIQKAV

SEQ ID NO: 1128412 - protein, 9 aa, Homo Sapiens
KVLKSLYEL

SEQ ID NO: 1128413 - protein, 9 aa, Homo Sapiens
AATPRKQRW

SEQ ID NO: 1128414 - protein, 9 aa, Homo Sapiens
RLKTGQKDL

SEQ ID NO: 1128415 - protein, 9 aa, Homo Sapiens
NCLPLRFWA

SEQ ID NO: 1128416 - protein, 9 aa, Homo Sapiens
AVWAKNMAR

SEQ ID NO: 1128417 - protein, 9 aa, Homo Sapiens
RGACESGPC

SEQ ID NO: 1128418 - protein, 9 aa, Homo Sapiens
FQSIICKKD

SEQ ID NO: 1128419 - protein, 9 aa, Homo Sapiens
LSLDDIKLY

SEQ ID NO: 1128420 - protein, 9 aa, Homo Sapiens
NILDSPMYW

SEQ ID NO: 1128421 - protein, 9 aa, Homo Sapiens
VEAGAAKVK

SEQ ID NO: 1128422 - protein, 9 aa, Homo Sapiens
SVMDDDLDT

SEQ ID NO: 1128423 - protein, 9 aa, Homo Sapiens
KKSQAMRVV

SEQ ID NO: 1128424 - protein, 9 aa, Homo Sapiens
TIVLSFHSS

SEQ ID NO: 1128425 - protein, 9 aa, Homo Sapiens
QPSLHLRGQ

SEQ ID NO: 1128426 - protein, 9 aa, Homo Sapiens
DGKRLQPLW

SEQ ID NO: 1128427 - protein, 9 aa, Homo Sapiens
IIEDEKMVA

SEQ ID NO: 1128428 - protein, 9 aa, Homo Sapiens
QAGMERGQG

SEQ ID NO: 1128429 - protein, 9 aa, Homo Sapiens
KNLLDSSLD

SEQ ID NO: 1128430 - protein, 9 aa, Homo Sapiens
NALFLWLII

SEQ ID NO: 1128431 - protein, 9 aa, Homo Sapiens
NLDGSYWVT

SEQ ID NO: 1128432 - protein, 9 aa, Homo Sapiens
PGRPSLASS

SEQ ID NO: 1128433 - protein, 9 aa, Homo Sapiens
IGRRWERPG

SEQ ID NO: 1128434 - protein, 9 aa, Homo Sapiens
GKPTTENSV

SEQ ID NO: 1128435 - protein, 9 aa, Homo Sapiens
VLERFLQEL

SEQ ID NO: 1128436 - protein, 9 aa, Homo Sapiens
CASLLSTLS

SEQ ID NO: 1128437 - protein, 9 aa, Homo Sapiens
AREKLTSSQ

SEQ ID NO: 1128438 - protein, 9 aa, Homo Sapiens
NGPKSESMV

SEQ ID NO: 1128439 - protein, 9 aa, Homo Sapiens
MDIWLSLGV

SEQ ID NO: 1128440 - protein, 9 aa, Homo Sapiens
RVCPTSRQP

SEQ ID NO: 1128441 - protein, 9 aa, Homo Sapiens
LSFQCHLLA

SEQ ID NO: 1128442 - protein, 9 aa, Homo Sapiens
PEKNQRLQS

SEQ ID NO: 1128443 - protein, 9 aa, Homo Sapiens
GIPLIPGAG

SEQ ID NO: 1128444 - protein, 9 aa, Homo Sapiens
ESPLLGAED

SEQ ID NO: 1128445 - protein, 9 aa, Homo Sapiens
ILFPLKSTF

SEQ ID NO: 1128446 - protein, 9 aa, Homo Sapiens
GHGHKHEHD

SEQ ID NO: 1128447 - protein, 9 aa, Homo Sapiens
APETTLWLG

SEQ ID NO: 1128448 - protein, 9 aa, Homo Sapiens
GEPTEEALG

SEQ ID NO: 1128449 - protein, 9 aa, Homo Sapiens
WSELPPGRA

SEQ ID NO: 1128450 - protein, 9 aa, Homo Sapiens
PGRKHPPVG

SEQ ID NO: 1128451 - protein, 9 aa, Homo Sapiens
VQAPQMYTY

SEQ ID NO: 1128452 - protein, 9 aa, Homo Sapiens
GRPHAHPGP

SEQ ID NO: 1128453 - protein, 9 aa, Homo Sapiens
TNVEKHYET

SEQ ID NO: 1128454 - protein, 9 aa, Homo Sapiens
VSTRLTVLW

SEQ ID NO: 1128455 - protein, 9 aa, Homo Sapiens
PNDFSEQRA

SEQ ID NO: 1128456 - protein, 9 aa, Homo Sapiens
ACWALSHLT

SEQ ID NO: 1128457 - protein, 9 aa, Homo Sapiens
DWLYQRMYS

SEQ ID NO: 1128458 - protein, 9 aa, Homo Sapiens
GHLGDGKKM

SEQ ID NO: 1128459 - protein, 9 aa, Homo Sapiens
RCTACPPCP

SEQ ID NO: 1128460 - protein, 9 aa, Homo Sapiens
SGSGEGSEA

SEQ ID NO: 1128461 - protein, 9 aa, Homo Sapiens
ACLAAISDF

SEQ ID NO: 1128462 - protein, 9 aa, Homo Sapiens
SSVTASCAS

SEQ ID NO: 1128463 - protein, 9 aa, Homo Sapiens
SAGEDTLVH

SEQ ID NO: 1128464 - protein, 9 aa, Homo Sapiens
GTSPGWWSS

SEQ ID NO: 1128465 - protein, 9 aa, Homo Sapiens
EVEHFSRHS

SEQ ID NO: 1128466 - protein, 9 aa, Homo Sapiens
PYICSKCGK

SEQ ID NO: 1128467 - protein, 9 aa, Homo Sapiens
NVWMTHEME

SEQ ID NO: 1128468 - protein, 9 aa, Homo Sapiens
RLQPLWHVG

SEQ ID NO: 1128469 - protein, 9 aa, Homo Sapiens
VPIDYVNKR

SEQ ID NO: 1128470 - protein, 9 aa, Homo Sapiens
LPFIEIRIV

SEQ ID NO: 1128471 - protein, 9 aa, Homo Sapiens
WSPLTAASP

SEQ ID NO: 1128472 - protein, 9 aa, Homo Sapiens
KEEVVCLLF

SEQ ID NO: 1128473 - protein, 9 aa, Homo Sapiens
GKALWEMAL

SEQ ID NO: 1128474 - protein, 9 aa, Homo Sapiens
QSTLEQTQY

SEQ ID NO: 1128475 - protein, 9 aa, Homo Sapiens
EEIEQMRWP

SEQ ID NO: 1128476 - protein, 9 aa, Homo Sapiens
VGQGPLLLL

SEQ ID NO: 1128477 - protein, 9 aa, Homo Sapiens
NVKPTNTRP

SEQ ID NO: 1128478 - protein, 9 aa, Homo Sapiens
PRVLDPPFW

SEQ ID NO: 1128479 - protein, 9 aa, Homo Sapiens
DHKRVHTGQ

SEQ ID NO: 1128480 - protein, 9 aa, Homo Sapiens
ERGYRHPVL

SEQ ID NO: 1128481 - protein, 9 aa, Homo Sapiens
SNLHTLTIL

SEQ ID NO: 1128482 - protein, 9 aa, Homo Sapiens
PWSGLMSLG

SEQ ID NO: 1128483 - protein, 9 aa, Homo Sapiens
CRRGAPSGA

SEQ ID NO: 1128484 - protein, 9 aa, Homo Sapiens
AGMERGQGR

SEQ ID NO: 1128485 - protein, 9 aa, Homo Sapiens
TYDCQMNVN

SEQ ID NO: 1128486 - protein, 9 aa, Homo Sapiens
SSSMTTSTT

SEQ ID NO: 1128487 - protein, 9 aa, Homo Sapiens
AAAYQAAPL

SEQ ID NO: 1128488 - protein, 9 aa, Homo Sapiens
SALYLCAVR

SEQ ID NO: 1128489 - protein, 9 aa, Homo Sapiens
GEGEGPGKH

SEQ ID NO: 1128490 - protein, 9 aa, Homo Sapiens
TMVRCGNLI

SEQ ID NO: 1128491 - protein, 9 aa, Homo Sapiens
METSQFPDE

SEQ ID NO: 1128492 - protein, 9 aa, Homo Sapiens
PLIQKKQLA

SEQ ID NO: 1128493 - protein, 9 aa, Homo Sapiens
IHSGEKPHA

SEQ ID NO: 1128494 - protein, 9 aa, Homo Sapiens
LYPGAADPL

SEQ ID NO: 1128495 - protein, 9 aa, Homo Sapiens
QVQIPFPRC

SEQ ID NO: 1128496 - protein, 9 aa, Homo Sapiens
AQIRDARGR

SEQ ID NO: 1128497 - protein, 9 aa, Homo Sapiens
RVITSHAGK

SEQ ID NO: 1128498 - protein, 9 aa, Homo Sapiens
CNECGEAFY

SEQ ID NO: 1128499 - protein, 9 aa, Homo Sapiens
TLITTILPY

SEQ ID NO: 1128500 - protein, 9 aa, Homo Sapiens
DQESGVEVL

SEQ ID NO: 1128501 - protein, 9 aa, Homo Sapiens
FSTAHWGSA

SEQ ID NO: 1128502 - protein, 9 aa, Homo Sapiens
ATGPMGMCG

SEQ ID NO: 1128503 - protein, 9 aa, Homo Sapiens
EAMLLDTDY

SEQ ID NO: 1128504 - protein, 9 aa, Homo Sapiens
SSVRHRGAP

SEQ ID NO: 1128505 - protein, 9 aa, Homo Sapiens
SGRGRWQGP

SEQ ID NO: 1128506 - protein, 9 aa, Homo Sapiens
VSGARGWAQ

SEQ ID NO: 1128507 - protein, 9 aa, Homo Sapiens
ISQLLMGFL

SEQ ID NO: 1128508 - protein, 9 aa, Homo Sapiens
VVPIIENAP

SEQ ID NO: 1128509 - protein, 9 aa, Homo Sapiens
GPRHRFLCG

SEQ ID NO: 1128510 - protein, 9 aa, Homo Sapiens
AESPEKDVT

SEQ ID NO: 1128511 - protein, 9 aa, Homo Sapiens
MVLESALTD

SEQ ID NO: 1128512 - protein, 9 aa, Homo Sapiens
RRTWWRTRA

SEQ ID NO: 1128513 - protein, 9 aa, Homo Sapiens
DMWTTVIDM

SEQ ID NO: 1128514 - protein, 9 aa, Homo Sapiens
CWFVHDFST

SEQ ID NO: 1128515 - protein, 9 aa, Homo Sapiens
RPERYSSSS

SEQ ID NO: 1128516 - protein, 9 aa, Homo Sapiens
QWSPVIAAS

SEQ ID NO: 1128517 - protein, 9 aa, Homo Sapiens
KRVRGERLP

SEQ ID NO: 1128518 - protein, 9 aa, Homo Sapiens
KQLLYGRGE

SEQ ID NO: 1128519 - protein, 9 aa, Homo Sapiens
KVCHRMNDD

SEQ ID NO: 1128520 - protein, 9 aa, Homo Sapiens
PGPTVDDDY

SEQ ID NO: 1128521 - protein, 9 aa, Homo Sapiens
HQLPRRPPG

SEQ ID NO: 1128522 - protein, 9 aa, Homo Sapiens
SKAKPMCST

SEQ ID NO: 1128523 - protein, 9 aa, Homo Sapiens
ATPRKQRWE

SEQ ID NO: 1128524 - protein, 9 aa, Homo Sapiens
DVKKPIKKN

SEQ ID NO: 1128525 - protein, 9 aa, Homo Sapiens
LGHHTYGAL

SEQ ID NO: 1128526 - protein, 9 aa, Homo Sapiens
TSETVSMKK

SEQ ID NO: 1128527 - protein, 9 aa, Homo Sapiens
RVSATAGAC

SEQ ID NO: 1128528 - protein, 9 aa, Homo Sapiens
QGKKGRLTG

SEQ ID NO: 1128529 - protein, 9 aa, Homo Sapiens
DSALYLCAV

SEQ ID NO: 1128530 - protein, 9 aa, Homo Sapiens
AYRLLGCLG

SEQ ID NO: 1128531 - protein, 9 aa, Homo Sapiens
LRSCLERWD

SEQ ID NO: 1128532 - protein, 9 aa, Homo Sapiens
RRRTDSMSS

SEQ ID NO: 1128533 - protein, 9 aa, Homo Sapiens
SLKASRMST

SEQ ID NO: 1128534 - protein, 9 aa, Homo Sapiens
LPEHHSTAL

SEQ ID NO: 1128535 - protein, 9 aa, Homo Sapiens
MANSQGEVL

SEQ ID NO: 1128536 - protein, 9 aa, Homo Sapiens
HILEAHAHN

SEQ ID NO: 1128537 - protein, 9 aa, Homo Sapiens
NPERCQHYS

SEQ ID NO: 1128538 - protein, 9 aa, Homo Sapiens
FFFDAYFVF

SEQ ID NO: 1128539 - protein, 9 aa, Homo Sapiens
TYSTQVSML

SEQ ID NO: 1128540 - protein, 9 aa, Homo Sapiens
TRATFIDFP

SEQ ID NO: 1128541 - protein, 9 aa, Homo Sapiens
SKPCGFDSI

SEQ ID NO: 1128542 - protein, 9 aa, Homo Sapiens
QKQRQLLGH

SEQ ID NO: 1128543 - protein, 9 aa, Homo Sapiens
ELGADPEEE

SEQ ID NO: 1128544 - protein, 9 aa, Homo Sapiens
KTLPFPSRE

SEQ ID NO: 1128545 - protein, 9 aa, Homo Sapiens
WASSPSPNW

SEQ ID NO: 1128546 - protein, 9 aa, Homo Sapiens
HTVQLQLHS

SEQ ID NO: 1128547 - protein, 9 aa, Homo Sapiens
GHPLQMENA

SEQ ID NO: 1128548 - protein, 9 aa, Homo Sapiens
IKFLIKYQQ

SEQ ID NO: 1128549 - protein, 9 aa, Homo Sapiens
IENGLLKNT

SEQ ID NO: 1128550 - protein, 9 aa, Homo Sapiens
SPTPPYPGP

SEQ ID NO: 1128551 - protein, 9 aa, Homo Sapiens
ESLPAAHHL

SEQ ID NO: 1128552 - protein, 9 aa, Homo Sapiens
SQLLQKKCK

SEQ ID NO: 1128553 - protein, 9 aa, Homo Sapiens
RRPLRRPCT

SEQ ID NO: 1128554 - protein, 9 aa, Homo Sapiens
AGLCILVNT

SEQ ID NO: 1128555 - protein, 9 aa, Homo Sapiens
LRTRYNQTE

SEQ ID NO: 1128556 - protein, 9 aa, Homo Sapiens
PSSHFLAER

SEQ ID NO: 1128557 - protein, 9 aa, Homo Sapiens
LQDERLLLQ

SEQ ID NO: 1128558 - protein, 9 aa, Homo Sapiens
SDAVRHSRK

SEQ ID NO: 1128559 - protein, 9 aa, Homo Sapiens
VEDIDSQVD

SEQ ID NO: 1128560 - protein, 9 aa, Homo Sapiens
GENDGGHDG

SEQ ID NO: 1128561 - protein, 9 aa, Homo Sapiens
PGMTGLPRK

SEQ ID NO: 1128562 - protein, 9 aa, Homo Sapiens
KCGILWLLW

SEQ ID NO: 1128563 - protein, 9 aa, Homo Sapiens
PWARPARTR

SEQ ID NO: 1128564 - protein, 9 aa, Homo Sapiens
TTAFCRPTT

SEQ ID NO: 1128565 - protein, 9 aa, Homo Sapiens
RQQRSSGHR

SEQ ID NO: 1128566 - protein, 9 aa, Homo Sapiens
LGVQYELKD

SEQ ID NO: 1128567 - protein, 9 aa, Homo Sapiens
TPRKQRWER

SEQ ID NO: 1128568 - protein, 9 aa, Homo Sapiens
TYAAPKVPE

SEQ ID NO: 1128569 - protein, 9 aa, Homo Sapiens
NIGVTAVTF

SEQ ID NO: 1128570 - protein, 9 aa, Homo Sapiens
IILTLNSIG

SEQ ID NO: 1128571 - protein, 9 aa, Homo Sapiens
MRKLGRIHP

SEQ ID NO: 1128572 - protein, 9 aa, Homo Sapiens
KRKRRSHWM

SEQ ID NO: 1128573 - protein, 9 aa, Homo Sapiens
PVSLERSPC

SEQ ID NO: 1128574 - protein, 9 aa, Homo Sapiens
VSLERSPCP

SEQ ID NO: 1128575 - protein, 9 aa, Homo Sapiens
CCVPTTYAG

SEQ ID NO: 1128576 - protein, 9 aa, Homo Sapiens
PLPDRLKWH

SEQ ID NO: 1128577 - protein, 9 aa, Homo Sapiens
RPMTYSYSN

SEQ ID NO: 1128578 - protein, 9 aa, Homo Sapiens
HQQNQNRMW

SEQ ID NO: 1128579 - protein, 9 aa, Homo Sapiens
KRKRRRSSS

SEQ ID NO: 1128580 - protein, 9 aa, Homo Sapiens
GACTPGKPT

SEQ ID NO: 1128581 - protein, 9 aa, Homo Sapiens
TTSHDWGTP

SEQ ID NO: 1128582 - protein, 9 aa, Homo Sapiens
LLGCLGSAM

SEQ ID NO: 1128583 - protein, 9 aa, Homo Sapiens
RCFQKYGIG

SEQ ID NO: 1128584 - protein, 9 aa, Homo Sapiens
EQRAGQSHS

SEQ ID NO: 1128585 - protein, 9 aa, Homo Sapiens
GPAHCMGEI

SEQ ID NO: 1128586 - protein, 9 aa, Homo Sapiens
EKTLRGLAV

SEQ ID NO: 1128587 - protein, 9 aa, Homo Sapiens
KTEQGGLWH

SEQ ID NO: 1128588 - protein, 9 aa, Homo Sapiens
KEHRQESLE

SEQ ID NO: 1128589 - protein, 9 aa, Homo Sapiens
AAGASGWSA

SEQ ID NO: 1128590 - protein, 9 aa, Homo Sapiens
LWVDVDLLI

SEQ ID NO: 1128591 - protein, 9 aa, Homo Sapiens
SWAGAVDNL

SEQ ID NO: 1128592 - protein, 9 aa, Homo Sapiens
MVSTSSPEE

SEQ ID NO: 1128593 - protein, 9 aa, Homo Sapiens
EDDAETKKV

SEQ ID NO: 1128594 - protein, 9 aa, Homo Sapiens
KAAPPPLPS

SEQ ID NO: 1128595 - protein, 9 aa, Homo Sapiens
PRVNPASTS

SEQ ID NO: 1128596 - protein, 9 aa, Homo Sapiens
RCKEKLHDM

SEQ ID NO: 1128597 - protein, 9 aa, Homo Sapiens
KLIHKSASS

SEQ ID NO: 1128598 - protein, 9 aa, Homo Sapiens
QLMCPENAV

SEQ ID NO: 1128599 - protein, 9 aa, Homo Sapiens
PATPGNLVP

SEQ ID NO: 1128600 - protein, 9 aa, Homo Sapiens
HLTLQLDSE

SEQ ID NO: 1128601 - protein, 9 aa, Homo Sapiens
AGRTSARRR

SEQ ID NO: 1128602 - protein, 9 aa, Homo Sapiens
TKRTTPIEV

SEQ ID NO: 1128603 - protein, 9 aa, Homo Sapiens
ILQQNCMEK

SEQ ID NO: 1128604 - protein, 9 aa, Homo Sapiens
MDRPNGLHP

SEQ ID NO: 1128605 - protein, 9 aa, Homo Sapiens
APPSAAALD

SEQ ID NO: 1128606 - protein, 9 aa, Homo Sapiens
AAHHLPPAE

SEQ ID NO: 1128607 - protein, 9 aa, Homo Sapiens
VERINSTDH

SEQ ID NO: 1128608 - protein, 9 aa, Homo Sapiens
EYTCTLSTE

SEQ ID NO: 1128609 - protein, 9 aa, Homo Sapiens
HTVITTHTQ

SEQ ID NO: 1128610 - protein, 9 aa, Homo Sapiens
VMCKMNPMT

SEQ ID NO: 1128611 - protein, 9 aa, Homo Sapiens
VRHRGAPLR

SEQ ID NO: 1128612 - protein, 9 aa, Homo Sapiens
AYTKLVLDR

SEQ ID NO: 1128613 - protein, 9 aa, Homo Sapiens
AFLKTWAPA

SEQ ID NO: 1128614 - protein, 9 aa, Homo Sapiens
RGLFEVLVE

SEQ ID NO: 1128615 - protein, 9 aa, Homo Sapiens
PTCSTDSSS

SEQ ID NO: 1128616 - protein, 9 aa, Homo Sapiens
NKYDETYPL

SEQ ID NO: 1128617 - protein, 9 aa, Homo Sapiens
GTMSTTLCT

SEQ ID NO: 1128618 - protein, 9 aa, Homo Sapiens
RQLMCMINQ

SEQ ID NO: 1128619 - protein, 9 aa, Homo Sapiens
KMPVYAEVK

SEQ ID NO: 1128620 - protein, 9 aa, Homo Sapiens
SGASWPPLP

SEQ ID NO: 1128621 - protein, 9 aa, Homo Sapiens
LSAAYQLYY

SEQ ID NO: 1128622 - protein, 9 aa, Homo Sapiens
ALATGSSRG

SEQ ID NO: 1128623 - protein, 9 aa, Homo Sapiens
PYVHKEKRT

SEQ ID NO: 1128624 - protein, 9 aa, Homo Sapiens
SFPEVVASA

SEQ ID NO: 1128625 - protein, 9 aa, Homo Sapiens
YKADQILLQ

SEQ ID NO: 1128626 - protein, 9 aa, Homo Sapiens
PRLCATTTC

SEQ ID NO: 1128627 - protein, 9 aa, Homo Sapiens
PRTTAFCRP

SEQ ID NO: 1128628 - protein, 9 aa, Homo Sapiens
PAVGGREPC

SEQ ID NO: 1128629 - protein, 9 aa, Homo Sapiens
EGNSFLTVN

SEQ ID NO: 1128630 - protein, 9 aa, Homo Sapiens
LPGNLRSLL

SEQ ID NO: 1128631 - protein, 9 aa, Homo Sapiens
SCADIADLM

SEQ ID NO: 1128632 - protein, 9 aa, Homo Sapiens
LAQSPPHPR

SEQ ID NO: 1128633 - protein, 9 aa, Homo Sapiens
PWKTQIQYD

SEQ ID NO: 1128634 - protein, 9 aa, Homo Sapiens
KKMSQLLSV

SEQ ID NO: 1128635 - protein, 9 aa, Homo Sapiens
PVEKRRRGQ

SEQ ID NO: 1128636 - protein, 9 aa, Homo Sapiens
ERQSPDPEP

SEQ ID NO: 1128637 - protein, 9 aa, Homo Sapiens
LHLQEMAQK

SEQ ID NO: 1128638 - protein, 9 aa, Homo Sapiens
VHGSVHVTL

SEQ ID NO: 1128639 - protein, 9 aa, Homo Sapiens
GEKSQAVES

SEQ ID NO: 1128640 - protein, 9 aa, Homo Sapiens
LVLSTCVDP

SEQ ID NO: 1128641 - protein, 9 aa, Homo Sapiens
YDQREFTAG

SEQ ID NO: 1128642 - protein, 9 aa, Homo Sapiens
TVPELTQMF

SEQ ID NO: 1128643 - protein, 9 aa, Homo Sapiens
VKKEGSGAA

SEQ ID NO: 1128644 - protein, 9 aa, Homo Sapiens
HCLTTPMLL

SEQ ID NO: 1128645 - protein, 9 aa, Homo Sapiens
DPESIFRDD

SEQ ID NO: 1128646 - protein, 9 aa, Homo Sapiens
GREEMKWSR

SEQ ID NO: 1128647 - protein, 9 aa, Homo Sapiens
HTVEKLQVR

SEQ ID NO: 1128648 - protein, 9 aa, Homo Sapiens
AADQLLTGC

SEQ ID NO: 1128649 - protein, 9 aa, Homo Sapiens
TEKLILSEK

SEQ ID NO: 1128650 - protein, 9 aa, Homo Sapiens
RSLARDEGE

SEQ ID NO: 1128651 - protein, 9 aa, Homo Sapiens
QILGLRIPR

SEQ ID NO: 1128652 - protein, 9 aa, Homo Sapiens
GGNTPVILA

SEQ ID NO: 1128653 - protein, 9 aa, Homo Sapiens
DLRRPQWTQ

SEQ ID NO: 1128654 - protein, 9 aa, Homo Sapiens
IAYFLERNA

SEQ ID NO: 1128655 - protein, 9 aa, Homo Sapiens
STKATKFEG

SEQ ID NO: 1128656 - protein, 9 aa, Homo Sapiens
AESRQLVGI

SEQ ID NO: 1128657 - protein, 9 aa, Homo Sapiens
LSQVAMCTP

SEQ ID NO: 1128658 - protein, 9 aa, Homo Sapiens
LIPTCCFSA

SEQ ID NO: 1128659 - protein, 9 aa, Homo Sapiens
RPPSTRHGV

SEQ ID NO: 1128660 - protein, 9 aa, Homo Sapiens
YRAISFSGC

SEQ ID NO: 1128661 - protein, 9 aa, Homo Sapiens
GVTFEDVAI

SEQ ID NO: 1128662 - protein, 9 aa, Homo Sapiens
KMAAMIFKR

SEQ ID NO: 1128663 - protein, 9 aa, Homo Sapiens
YWLISGGWC

SEQ ID NO: 1128664 - protein, 9 aa, Homo Sapiens
GRFAFQLPF

SEQ ID NO: 1128665 - protein, 9 aa, Homo Sapiens
NCTHLGITV

SEQ ID NO: 1128666 - protein, 9 aa, Homo Sapiens
NLLLWRANT

SEQ ID NO: 1128667 - protein, 9 aa, Homo Sapiens
SATTSGLSQ

SEQ ID NO: 1128668 - protein, 9 aa, Homo Sapiens
RANMHNLLI

SEQ ID NO: 1128669 - protein, 9 aa, Homo Sapiens
WSLQTLPTD

SEQ ID NO: 1128670 - protein, 9 aa, Homo Sapiens
IQVLSNGLL

SEQ ID NO: 1128671 - protein, 9 aa, Homo Sapiens
ISQADSPCC

SEQ ID NO: 1128672 - protein, 9 aa, Homo Sapiens
SDGRSVRLW

SEQ ID NO: 1128673 - protein, 9 aa, Homo Sapiens
TRPMSERLK

SEQ ID NO: 1128674 - protein, 9 aa, Homo Sapiens
CPENAVDCE

SEQ ID NO: 1128675 - protein, 9 aa, Homo Sapiens
DKKIKTESG

SEQ ID NO: 1128676 - protein, 9 aa, Homo Sapiens
AAYALLLYD

SEQ ID NO: 1128677 - protein, 9 aa, Homo Sapiens
CFAMFGFLL

SEQ ID NO: 1128678 - protein, 9 aa, Homo Sapiens
ATSGTAPSA

SEQ ID NO: 1128679 - protein, 9 aa, Homo Sapiens
APVPAGWRS

SEQ ID NO: 1128680 - protein, 9 aa, Homo Sapiens
PRAPASQMV

SEQ ID NO: 1128681 - protein, 9 aa, Homo Sapiens
RRPPPAWGP

SEQ ID NO: 1128682 - protein, 9 aa, Homo Sapiens
RMFVWTRPQ

SEQ ID NO: 1128683 - protein, 9 aa, Homo Sapiens
HLIYSPQRQ

SEQ ID NO: 1128684 - protein, 9 aa, Homo Sapiens
PPRRWPPRT

SEQ ID NO: 1128685 - protein, 9 aa, Homo Sapiens
GPRILLLCG

SEQ ID NO: 1128686 - protein, 9 aa, Homo Sapiens
YYVGVTSCL

SEQ ID NO: 1128687 - protein, 9 aa, Homo Sapiens
AAKDNYGLL

SEQ ID NO: 1128688 - protein, 9 aa, Homo Sapiens
LETGDPPLL

SEQ ID NO: 1128689 - protein, 9 aa, Homo Sapiens
LLVWYPATV

SEQ ID NO: 1128690 - protein, 9 aa, Homo Sapiens
SHQAGVQRS

SEQ ID NO: 1128691 - protein, 9 aa, Homo Sapiens
GEKPHACRE

SEQ ID NO: 1128692 - protein, 9 aa, Homo Sapiens
SAAPAAPPR

SEQ ID NO: 1128693 - protein, 9 aa, Homo Sapiens
RGSDGVDGF

SEQ ID NO: 1128694 - protein, 9 aa, Homo Sapiens
SLVSKGALV

SEQ ID NO: 1128695 - protein, 9 aa, Homo Sapiens
RMVKSALEP

SEQ ID NO: 1128696 - protein, 9 aa, Homo Sapiens
SARVTFRYD

SEQ ID NO: 1128697 - protein, 9 aa, Homo Sapiens
VQAQAGMER

SEQ ID NO: 1128698 - protein, 9 aa, Homo Sapiens
APVPHRSLQ

SEQ ID NO: 1128699 - protein, 9 aa, Homo Sapiens
DTRWHEPQP

SEQ ID NO: 1128700 - protein, 9 aa, Homo Sapiens
QSCCLPGLT

SEQ ID NO: 1128701 - protein, 9 aa, Homo Sapiens
RDITIDNIC

SEQ ID NO: 1128702 - protein, 9 aa, Homo Sapiens
KERKVTLMI

SEQ ID NO: 1128703 - protein, 9 aa, Homo Sapiens
APSPSRGTA

SEQ ID NO: 1128704 - protein, 9 aa, Homo Sapiens
GEPAAARGA

SEQ ID NO: 1128705 - protein, 9 aa, Homo Sapiens
VGVIEKRDA

SEQ ID NO: 1128706 - protein, 9 aa, Homo Sapiens
TMPSQLDSL

SEQ ID NO: 1128707 - protein, 9 aa, Homo Sapiens
WLPGGGCCA

SEQ ID NO: 1128708 - protein, 9 aa, Homo Sapiens
NTNVDKPLH

SEQ ID NO: 1128709 - protein, 9 aa, Homo Sapiens
HKMARIFTH

SEQ ID NO: 1128710 - protein, 9 aa, Homo Sapiens
IFSTAHWGS

SEQ ID NO: 1128711 - protein, 9 aa, Homo Sapiens
CGPRLTRFP

SEQ ID NO: 1128712 - protein, 9 aa, Homo Sapiens
TCFICHSCQ

SEQ ID NO: 1128713 - protein, 9 aa, Homo Sapiens
IPLPALCPL

SEQ ID NO: 1128714 - protein, 9 aa, Homo Sapiens
GCHPAVGGG

SEQ ID NO: 1128715 - protein, 9 aa, Homo Sapiens
PTSRARQSC

SEQ ID NO: 1128716 - protein, 9 aa, Homo Sapiens
HKCLMDRSR

SEQ ID NO: 1128717 - protein, 9 aa, Homo Sapiens
TLSNPLNCT

SEQ ID NO: 1128718 - protein, 9 aa, Homo Sapiens
SQQRQQRQE

SEQ ID NO: 1128719 - protein, 9 aa, Homo Sapiens
PAAPPLPDR

SEQ ID NO: 1128720 - protein, 9 aa, Homo Sapiens
TEVREELQK

SEQ ID NO: 1128721 - protein, 9 aa, Homo Sapiens
GGPGHGAAG

SEQ ID NO: 1128722 - protein, 9 aa, Homo Sapiens
ITAAASRTA

SEQ ID NO: 1128723 - protein, 9 aa, Homo Sapiens
AMYYLKEKH

SEQ ID NO: 1128724 - protein, 9 aa, Homo Sapiens
GAGVGVLRP

SEQ ID NO: 1128725 - protein, 9 aa, Homo Sapiens
DAFPGGSRF

SEQ ID NO: 1128726 - protein, 9 aa, Homo Sapiens
VTSGTSFFS

SEQ ID NO: 1128727 - protein, 9 aa, Homo Sapiens
SVLDSTLAS

SEQ ID NO: 1128728 - protein, 9 aa, Homo Sapiens
PQHALVCLR

SEQ ID NO: 1128729 - protein, 9 aa, Homo Sapiens
ALTLAQWSP

SEQ ID NO: 1128730 - protein, 9 aa, Homo Sapiens
VIRDVVTYT

SEQ ID NO: 1128731 - protein, 9 aa, Homo Sapiens
KVEVLAETC

SEQ ID NO: 1128732 - protein, 9 aa, Homo Sapiens
QLAATKKLS

SEQ ID NO: 1128733 - protein, 9 aa, Homo Sapiens
GPPSHCQLC

SEQ ID NO: 1128734 - protein, 9 aa, Homo Sapiens
LTAALSFTL

SEQ ID NO: 1128735 - protein, 9 aa, Homo Sapiens
AKIFYDSIS

SEQ ID NO: 1128736 - protein, 9 aa, Homo Sapiens
RARGTSIAF

SEQ ID NO: 1128737 - protein, 9 aa, Homo Sapiens
ELQPAPGST

SEQ ID NO: 1128738 - protein, 9 aa, Homo Sapiens
GCLGSAMEC

SEQ ID NO: 1128739 - protein, 9 aa, Homo Sapiens
SIDLRSGDK

SEQ ID NO: 1128740 - protein, 9 aa, Homo Sapiens
QIEPEKTRS

SEQ ID NO: 1128741 - protein, 9 aa, Homo Sapiens
PDYLGLSNC

SEQ ID NO: 1128742 - protein, 9 aa, Homo Sapiens
VRDSDGDRA

SEQ ID NO: 1128743 - protein, 9 aa, Homo Sapiens
PQPPQRPPL

SEQ ID NO: 1128744 - protein, 9 aa, Homo Sapiens
LLEFVEDAF

SEQ ID NO: 1128745 - protein, 9 aa, Homo Sapiens
DGSALTAYE

SEQ ID NO: 1128746 - protein, 9 aa, Homo Sapiens
EQLNCFRGQ

SEQ ID NO: 1128747 - protein, 9 aa, Homo Sapiens
SPDQPHPCP

SEQ ID NO: 1128748 - protein, 9 aa, Homo Sapiens
GPSMEIMKR

SEQ ID NO: 1128749 - protein, 9 aa, Homo Sapiens
LPGGDPISA

SEQ ID NO: 1128750 - protein, 9 aa, Homo Sapiens
QAFFHNQLP

SEQ ID NO: 1128751 - protein, 9 aa, Homo Sapiens
LPSPPPHPQ

SEQ ID NO: 1128752 - protein, 9 aa, Homo Sapiens
ATVLTLAPL

SEQ ID NO: 1128753 - protein, 9 aa, Homo Sapiens
PDPEPSVCR

SEQ ID NO: 1128754 - protein, 9 aa, Homo Sapiens
RRCMRWCPT

SEQ ID NO: 1128755 - protein, 9 aa, Homo Sapiens
MDDDLDTEH

SEQ ID NO: 1128756 - protein, 9 aa, Homo Sapiens
LHIIGDPYK

SEQ ID NO: 1128757 - protein, 9 aa, Homo Sapiens
DPFPLDVCK

SEQ ID NO: 1128758 - protein, 9 aa, Homo Sapiens
LGMDDSVSH

SEQ ID NO: 1128759 - protein, 9 aa, Homo Sapiens
GGEQLCGVG

SEQ ID NO: 1128760 - protein, 9 aa, Homo Sapiens
CGFDSIHRG

SEQ ID NO: 1128761 - protein, 9 aa, Homo Sapiens
ITLSESVNA

SEQ ID NO: 1128762 - protein, 9 aa, Homo Sapiens
VECRAGWYG

SEQ ID NO: 1128763 - protein, 9 aa, Homo Sapiens
CEKPGQLNI

SEQ ID NO: 1128764 - protein, 9 aa, Homo Sapiens
DTHFELPLD

SEQ ID NO: 1128765 - protein, 9 aa, Homo Sapiens
GRTSARRRT

SEQ ID NO: 1128766 - protein, 9 aa, Homo Sapiens
EKLHDMDFY

SEQ ID NO: 1128767 - protein, 9 aa, Homo Sapiens
APGTGERAL

SEQ ID NO: 1128768 - protein, 9 aa, Homo Sapiens
GISGGSGHC

SEQ ID NO: 1128769 - protein, 9 aa, Homo Sapiens
HGMSYDHVL

SEQ ID NO: 1128770 - protein, 9 aa, Homo Sapiens
LEAQVQTIQ

SEQ ID NO: 1128771 - protein, 9 aa, Homo Sapiens
DFQMNSTSD

SEQ ID NO: 1128772 - protein, 9 aa, Homo Sapiens
SLWEDLRGG

SEQ ID NO: 1128773 - protein, 9 aa, Homo Sapiens
LPGGPGHGA

SEQ ID NO: 1128774 - protein, 9 aa, Homo Sapiens
HHLEVFPPV

SEQ ID NO: 1128775 - protein, 9 aa, Homo Sapiens
IAQDTDQNY

SEQ ID NO: 1128776 - protein, 9 aa, Homo Sapiens
QAPHPRPAP

SEQ ID NO: 1128777 - protein, 9 aa, Homo Sapiens
GGTTCPPTS

SEQ ID NO: 1128778 - protein, 9 aa, Homo Sapiens
KCVKKSKQP

SEQ ID NO: 1128779 - protein, 9 aa, Homo Sapiens
PHCEAISCK

SEQ ID NO: 1128780 - protein, 9 aa, Homo Sapiens
RSRSSSSIQ

SEQ ID NO: 1128781 - protein, 9 aa, Homo Sapiens
PPPTKKRGK

SEQ ID NO: 1128782 - protein, 9 aa, Homo Sapiens
ASSSPLWLP

SEQ ID NO: 1128783 - protein, 9 aa, Homo Sapiens
YLTGPGVAD

SEQ ID NO: 1128784 - protein, 9 aa, Homo Sapiens
ANVSSEGIS

SEQ ID NO: 1128785 - protein, 9 aa, Homo Sapiens
VLLQGHSVY

SEQ ID NO: 1128786 - protein, 9 aa, Homo Sapiens
DLLHFLLIY

SEQ ID NO: 1128787 - protein, 9 aa, Homo Sapiens
LHVRGLCLY

SEQ ID NO: 1128788 - protein, 9 aa, Homo Sapiens
LWQKYNVRS

SEQ ID NO: 1128789 - protein, 9 aa, Homo Sapiens
DPPAAPPLP

SEQ ID NO: 1128790 - protein, 9 aa, Homo Sapiens
EQPKKIKEV

SEQ ID NO: 1128791 - protein, 9 aa, Homo Sapiens
STKGCNRGP

SEQ ID NO: 1128792 - protein, 9 aa, Homo Sapiens
QFLGLFYLS

SEQ ID NO: 1128793 - protein, 9 aa, Homo Sapiens
GFTQRKESL

SEQ ID NO: 1128794 - protein, 9 aa, Homo Sapiens
AFTASCEVL

SEQ ID NO: 1128795 - protein, 9 aa, Homo Sapiens
FGKKWHRFG

SEQ ID NO: 1128796 - protein, 9 aa, Homo Sapiens
NISWHSDYE

SEQ ID NO: 1128797 - protein, 9 aa, Homo Sapiens
SVFPAREWL

SEQ ID NO: 1128798 - protein, 9 aa, Homo Sapiens
FTSLASGTS

SEQ ID NO: 1128799 - protein, 9 aa, Homo Sapiens
LLLLALPIL

SEQ ID NO: 1128800 - protein, 9 aa, Homo Sapiens
SSTKGCNRG

SEQ ID NO: 1128801 - protein, 9 aa, Homo Sapiens
EYAHTFMNV

SEQ ID NO: 1128802 - protein, 9 aa, Homo Sapiens
VIVPMHAAG

SEQ ID NO: 1128803 - protein, 9 aa, Homo Sapiens
EVYFEKHQQ

SEQ ID NO: 1128804 - protein, 9 aa, Homo Sapiens
ETFAEMNRH

SEQ ID NO: 1128805 - protein, 9 aa, Homo Sapiens
FIRVEDNKS

SEQ ID NO: 1128806 - protein, 9 aa, Homo Sapiens
DIGHRNSLE

SEQ ID NO: 1128807 - protein, 9 aa, Homo Sapiens
LYKGVPLPF

SEQ ID NO: 1128808 - protein, 9 aa, Homo Sapiens
SGAYDGKKL

SEQ ID NO: 1128809 - protein, 9 aa, Homo Sapiens
LEVSLRNDA

SEQ ID NO: 1128810 - protein, 9 aa, Homo Sapiens
QALSLRILT

SEQ ID NO: 1128811 - protein, 9 aa, Homo Sapiens
LETKATTKL

SEQ ID NO: 1128812 - protein, 9 aa, Homo Sapiens
GAGQREEDS

SEQ ID NO: 1128813 - protein, 9 aa, Homo Sapiens
RRPRRRRPP

SEQ ID NO: 1128814 - protein, 9 aa, Homo Sapiens
GLGFCPTNC

SEQ ID NO: 1128815 - protein, 9 aa, Homo Sapiens
IRRTKRTTK

SEQ ID NO: 1128816 - protein, 9 aa, Homo Sapiens
VATDFSQST

SEQ ID NO: 1128817 - protein, 9 aa, Homo Sapiens
PCLSGPVAV

SEQ ID NO: 1128818 - protein, 9 aa, Homo Sapiens
GRRPPKGAG

SEQ ID NO: 1128819 - protein, 9 aa, Homo Sapiens
EQVGVYEEV

SEQ ID NO: 1128820 - protein, 9 aa, Homo Sapiens
NLAALFPSE

SEQ ID NO: 1128821 - protein, 9 aa, Homo Sapiens
RKKLNQIAM

SEQ ID NO: 1128822 - protein, 9 aa, Homo Sapiens
LVVPIIENA

SEQ ID NO: 1128823 - protein, 9 aa, Homo Sapiens
EGISEPPHV

SEQ ID NO: 1128824 - protein, 9 aa, Homo Sapiens
RFLRPSKRP

SEQ ID NO: 1128825 - protein, 9 aa, Homo Sapiens
YVLRFRNGW

SEQ ID NO: 1128826 - protein, 9 aa, Homo Sapiens
RSHRPCLSG

SEQ ID NO: 1128827 - protein, 9 aa, Homo Sapiens
TTRTRSPRR

SEQ ID NO: 1128828 - protein, 9 aa, Homo Sapiens
NYSANMMVD

SEQ ID NO: 1128829 - protein, 9 aa, Homo Sapiens
KFGSGSTRE

SEQ ID NO: 1128830 - protein, 9 aa, Homo Sapiens
RSQRKDCKW

SEQ ID NO: 1128831 - protein, 9 aa, Homo Sapiens
GDMESNGKH

SEQ ID NO: 1128832 - protein, 9 aa, Homo Sapiens
LGLQPPVVL

SEQ ID NO: 1128833 - protein, 9 aa, Homo Sapiens
QTFPDLYKS

SEQ ID NO: 1128834 - protein, 9 aa, Homo Sapiens
DANEPADGD

SEQ ID NO: 1128835 - protein, 9 aa, Homo Sapiens
EVVEGVLID

SEQ ID NO: 1128836 - protein, 9 aa, Homo Sapiens
RPSSPPPLC

SEQ ID NO: 1128837 - protein, 9 aa, Homo Sapiens
SAMLACLGM

SEQ ID NO: 1128838 - protein, 9 aa, Homo Sapiens
ILALHLRVH

SEQ ID NO: 1128839 - protein, 9 aa, Homo Sapiens
GQCLDVGLA

SEQ ID NO: 1128840 - protein, 9 aa, Homo Sapiens
QFTETPTWA

SEQ ID NO: 1128841 - protein, 9 aa, Homo Sapiens
LGFCPTNCH

SEQ ID NO: 1128842 - protein, 9 aa, Homo Sapiens
VLSLPIRIY

SEQ ID NO: 1128843 - protein, 9 aa, Homo Sapiens
STPKRSRAQ

SEQ ID NO: 1128844 - protein, 9 aa, Homo Sapiens
EVVDSGLVH

SEQ ID NO: 1128845 - protein, 9 aa, Homo Sapiens
LLAGPRHRF

SEQ ID NO: 1128846 - protein, 9 aa, Homo Sapiens
VPAFLKTWA

SEQ ID NO: 1128847 - protein, 9 aa, Homo Sapiens
PTIGGNTPV

SEQ ID NO: 1128848 - protein, 9 aa, Homo Sapiens
EMGKRKRKR

SEQ ID NO: 1128849 - protein, 9 aa, Homo Sapiens
KDPPAAPPL

SEQ ID NO: 1128850 - protein, 9 aa, Homo Sapiens
GKLSWGTMV

SEQ ID NO: 1128851 - protein, 9 aa, Homo Sapiens
GNLENLFLR

SEQ ID NO: 1128852 - protein, 9 aa, Homo Sapiens
EVPQCLIVR

SEQ ID NO: 1128853 - protein, 9 aa, Homo Sapiens
LGSLKRDDN

SEQ ID NO: 1128854 - protein, 9 aa, Homo Sapiens
ITTREAGII

SEQ ID NO: 1128855 - protein, 9 aa, Homo Sapiens
WKARWCIHA

SEQ ID NO: 1128856 - protein, 9 aa, Homo Sapiens
CGFKGDRGP

SEQ ID NO: 1128857 - protein, 9 aa, Homo Sapiens
DDMFLSASS

SEQ ID NO: 1128858 - protein, 9 aa, Homo Sapiens
SDLGNSRFL

SEQ ID NO: 1128859 - protein, 9 aa, Homo Sapiens
ASTCRCGWG

SEQ ID NO: 1128860 - protein, 9 aa, Homo Sapiens
DSGAPQPSA

SEQ ID NO: 1128861 - protein, 9 aa, Homo Sapiens
GLTIGLWLT

SEQ ID NO: 1128862 - protein, 9 aa, Homo Sapiens
YICSKCGKG

SEQ ID NO: 1128863 - protein, 9 aa, Homo Sapiens
AVVAPATGP

SEQ ID NO: 1128864 - protein, 9 aa, Homo Sapiens
PEKKAAVWA

SEQ ID NO: 1128865 - protein, 9 aa, Homo Sapiens
TAQGEKNSP

SEQ ID NO: 1128866 - protein, 9 aa, Homo Sapiens
QKMSNGRLG

SEQ ID NO: 1128867 - protein, 9 aa, Homo Sapiens
PVLQQVSTA

SEQ ID NO: 1128868 - protein, 9 aa, Homo Sapiens
LPQCPSPWP

SEQ ID NO: 1128869 - protein, 9 aa, Homo Sapiens
TVAASLVRR

SEQ ID NO: 1128870 - protein, 9 aa, Homo Sapiens
LKASRMSTA

SEQ ID NO: 1128871 - protein, 9 aa, Homo Sapiens
EEETTSHDW

SEQ ID NO: 1128872 - protein, 9 aa, Homo Sapiens
AKLHREDVP

SEQ ID NO: 1128873 - protein, 9 aa, Homo Sapiens
RCSACHLIY

SEQ ID NO: 1128874 - protein, 9 aa, Homo Sapiens
HLRRCNIIP

SEQ ID NO: 1128875 - protein, 9 aa, Homo Sapiens
CFLQDFEKS

SEQ ID NO: 1128876 - protein, 9 aa, Homo Sapiens
QSALDCIFG

SEQ ID NO: 1128877 - protein, 9 aa, Homo Sapiens
EKVQIELGW

SEQ ID NO: 1128878 - protein, 9 aa, Homo Sapiens
VTKVFKVLK

SEQ ID NO: 1128879 - protein, 9 aa, Homo Sapiens
TLPKFTKKH

SEQ ID NO: 1128880 - protein, 9 aa, Homo Sapiens
SSAGPLVVH

SEQ ID NO: 1128881 - protein, 9 aa, Homo Sapiens
APPTVALLQ

SEQ ID NO: 1128882 - protein, 9 aa, Homo Sapiens
PGAADPLAV

SEQ ID NO: 1128883 - protein, 9 aa, Homo Sapiens
SSTQHKMLA

SEQ ID NO: 1128884 - protein, 9 aa, Homo Sapiens
PAGWRSPAA

SEQ ID NO: 1128885 - protein, 9 aa, Homo Sapiens
SVEESLPGA

SEQ ID NO: 1128886 - protein, 9 aa, Homo Sapiens
LDLMPNLSL

SEQ ID NO: 1128887 - protein, 9 aa, Homo Sapiens
IIFMYLQPT

SEQ ID NO: 1128888 - protein, 9 aa, Homo Sapiens
RMSHLALPS

SEQ ID NO: 1128889 - protein, 9 aa, Homo Sapiens
PAPLRLCWS

SEQ ID NO: 1128890 - protein, 9 aa, Homo Sapiens
DLRSALISL

SEQ ID NO: 1128891 - protein, 9 aa, Homo Sapiens
WRTSRTRET

SEQ ID NO: 1128892 - protein, 9 aa, Homo Sapiens
LEAQKRTCK

SEQ ID NO: 1128893 - protein, 9 aa, Homo Sapiens
RPIAGTQTV

SEQ ID NO: 1128894 - protein, 9 aa, Homo Sapiens
FTHHNGTGD

SEQ ID NO: 1128895 - protein, 9 aa, Homo Sapiens
WQQCPLNQQ

SEQ ID NO: 1128896 - protein, 9 aa, Homo Sapiens
RGRRTGQLP

SEQ ID NO: 1128897 - protein, 9 aa, Homo Sapiens
IQTRFSQEP

SEQ ID NO: 1128898 - protein, 9 aa, Homo Sapiens
KMIHTGENP

SEQ ID NO: 1128899 - protein, 9 aa, Homo Sapiens
VGRHLRELS

SEQ ID NO: 1128900 - protein, 9 aa, Homo Sapiens
SNLSPSEAV

SEQ ID NO: 1128901 - protein, 9 aa, Homo Sapiens
ASLFRHYTM

SEQ ID NO: 1128902 - protein, 9 aa, Homo Sapiens
RKIGDHGPT

SEQ ID NO: 1128903 - protein, 9 aa, Homo Sapiens
KKGVSWSTV

SEQ ID NO: 1128904 - protein, 9 aa, Homo Sapiens
ARGRDRAGV

SEQ ID NO: 1128905 - protein, 9 aa, Homo Sapiens
CLGRPRPCG

SEQ ID NO: 1128906 - protein, 9 aa, Homo Sapiens
DNSNIGTAT

SEQ ID NO: 1128907 - protein, 9 aa, Homo Sapiens
RKIKHQKSG

SEQ ID NO: 1128908 - protein, 9 aa, Homo Sapiens
INFDSPVRN

SEQ ID NO: 1128909 - protein, 9 aa, Homo Sapiens
LRRLVSYWA

SEQ ID NO: 1128910 - protein, 9 aa, Homo Sapiens
AIWRRIGAT

SEQ ID NO: 1128911 - protein, 9 aa, Homo Sapiens
VSTRFNQMR

SEQ ID NO: 1128912 - protein, 9 aa, Homo Sapiens
ACTMPPLLH

SEQ ID NO: 1128913 - protein, 9 aa, Homo Sapiens
DLTTKINEK

SEQ ID NO: 1128914 - protein, 9 aa, Homo Sapiens
NLEDTSHRM

SEQ ID NO: 1128915 - protein, 9 aa, Homo Sapiens
FYLILFNYC

SEQ ID NO: 1128916 - protein, 9 aa, Homo Sapiens
ILIHLHPRV

SEQ ID NO: 1128917 - protein, 9 aa, Homo Sapiens
VPPLPDSER

SEQ ID NO: 1128918 - protein, 9 aa, Homo Sapiens
SLASGTSRP

SEQ ID NO: 1128919 - protein, 9 aa, Homo Sapiens
DDAVHANDD

SEQ ID NO: 1128920 - protein, 9 aa, Homo Sapiens
WVAEQYEGI

SEQ ID NO: 1128921 - protein, 9 aa, Homo Sapiens
SESFGAWCR

SEQ ID NO: 1128922 - protein, 9 aa, Homo Sapiens
SSPATSAST

SEQ ID NO: 1128923 - protein, 9 aa, Homo Sapiens
MKMGDNVIE

SEQ ID NO: 1128924 - protein, 9 aa, Homo Sapiens
CGTKSQSEK

SEQ ID NO: 1128925 - protein, 9 aa, Homo Sapiens
SGLVISTWN

SEQ ID NO: 1128926 - protein, 9 aa, Homo Sapiens
DVTAVLVID

SEQ ID NO: 1128927 - protein, 9 aa, Homo Sapiens
SRSPASSAN

SEQ ID NO: 1128928 - protein, 9 aa, Homo Sapiens
RGQGAVWKE

SEQ ID NO: 1128929 - protein, 9 aa, Homo Sapiens
PKKSYALSN

SEQ ID NO: 1128930 - protein, 9 aa, Homo Sapiens
QDHSVCYND

SEQ ID NO: 1128931 - protein, 9 aa, Homo Sapiens
YLGLSNCET

SEQ ID NO: 1128932 - protein, 9 aa, Homo Sapiens
EVYAHAGAM

SEQ ID NO: 1128933 - protein, 9 aa, Homo Sapiens
LLYPRPWRR

SEQ ID NO: 1128934 - protein, 9 aa, Homo Sapiens
QQIQKGSHP

SEQ ID NO: 1128935 - protein, 9 aa, Homo Sapiens
VLMYPSPAA

SEQ ID NO: 1128936 - protein, 9 aa, Homo Sapiens
SRGDVHVGL

SEQ ID NO: 1128937 - protein, 9 aa, Homo Sapiens
GDGKKMDLD

SEQ ID NO: 1128938 - protein, 9 aa, Homo Sapiens
AQCQCIFCI

SEQ ID NO: 1128939 - protein, 9 aa, Homo Sapiens
AGSDRVAKT

SEQ ID NO: 1128940 - protein, 9 aa, Homo Sapiens
ATGSYGATE

SEQ ID NO: 1128941 - protein, 9 aa, Homo Sapiens
PQDGCNDGS

SEQ ID NO: 1128942 - protein, 9 aa, Homo Sapiens
ILGRGACES

SEQ ID NO: 1128943 - protein, 9 aa, Homo Sapiens
MFSVFGEIE

SEQ ID NO: 1128944 - protein, 9 aa, Homo Sapiens
AEQDTDDEA

SEQ ID NO: 1128945 - protein, 9 aa, Homo Sapiens
RCPWPSALP

SEQ ID NO: 1128946 - protein, 9 aa, Homo Sapiens
RFKTNRIAG

SEQ ID NO: 1128947 - protein, 9 aa, Homo Sapiens
SPTTPRWRT

SEQ ID NO: 1128948 - protein, 9 aa, Homo Sapiens
LADELLFRR

SEQ ID NO: 1128949 - protein, 9 aa, Homo Sapiens
SLNEVIHTD

SEQ ID NO: 1128950 - protein, 9 aa, Homo Sapiens
ATWEQVGVY

SEQ ID NO: 1128951 - protein, 9 aa, Homo Sapiens
CHCTHLTNF

SEQ ID NO: 1128952 - protein, 9 aa, Homo Sapiens
QMAAESQGL

SEQ ID NO: 1128953 - protein, 9 aa, Homo Sapiens
DLYATVIHN

SEQ ID NO: 1128954 - protein, 9 aa, Homo Sapiens
CIGNAKGDD

SEQ ID NO: 1128955 - protein, 9 aa, Homo Sapiens
QDSIHMGFV

SEQ ID NO: 1128956 - protein, 9 aa, Homo Sapiens
HHDTHSEGK

SEQ ID NO: 1128957 - protein, 9 aa, Homo Sapiens
CSPQQKLRQ

SEQ ID NO: 1128958 - protein, 9 aa, Homo Sapiens
MVYSRCGHG

SEQ ID NO: 1128959 - protein, 9 aa, Homo Sapiens
KAGLPASIV

SEQ ID NO: 1128960 - protein, 9 aa, Homo Sapiens
LIENGLLKN

SEQ ID NO: 1128961 - protein, 9 aa, Homo Sapiens
HAERIETIK

SEQ ID NO: 1128962 - protein, 9 aa, Homo Sapiens
DVPEIPPET

SEQ ID NO: 1128963 - protein, 9 aa, Homo Sapiens
KLKRDVESL

SEQ ID NO: 1128964 - protein, 9 aa, Homo Sapiens
KTAGPHVSG

SEQ ID NO: 1128965 - protein, 9 aa, Homo Sapiens
IRTVIIGGL

SEQ ID NO: 1128966 - protein, 9 aa, Homo Sapiens
ATVLLQSAL

SEQ ID NO: 1128967 - protein, 9 aa, Homo Sapiens
GQIGERPEI

SEQ ID NO: 1128968 - protein, 9 aa, Homo Sapiens
ILTLNSIGF

SEQ ID NO: 1128969 - protein, 9 aa, Homo Sapiens
ARGSGSHCP

SEQ ID NO: 1128970 - protein, 9 aa, Homo Sapiens
PYALVCLGT

SEQ ID NO: 1128971 - protein, 9 aa, Homo Sapiens
MKRKPMNTN

SEQ ID NO: 1128972 - protein, 9 aa, Homo Sapiens
EESGEFKLF

SEQ ID NO: 1128973 - protein, 9 aa, Homo Sapiens
NFLCVWGGY

SEQ ID NO: 1128974 - protein, 9 aa, Homo Sapiens
PHLNQIMKR

SEQ ID NO: 1128975 - protein, 9 aa, Homo Sapiens
IRSGGVQGA

SEQ ID NO: 1128976 - protein, 9 aa, Homo Sapiens
MKHKIRKII

SEQ ID NO: 1128977 - protein, 9 aa, Homo Sapiens
TTGTFPQEF

SEQ ID NO: 1128978 - protein, 9 aa, Homo Sapiens
DSKELQQRR

SEQ ID NO: 1128979 - protein, 9 aa, Homo Sapiens
PMGIIATNV

SEQ ID NO: 1128980 - protein, 9 aa, Homo Sapiens
PAPHIRAEN

SEQ ID NO: 1128981 - protein, 9 aa, Homo Sapiens
CKLYDGEFR

SEQ ID NO: 1128982 - protein, 9 aa, Homo Sapiens
YHLPATQEV

SEQ ID NO: 1128983 - protein, 9 aa, Homo Sapiens
PWGPLPMLT

SEQ ID NO: 1128984 - protein, 9 aa, Homo Sapiens
EARRKALPF

SEQ ID NO: 1128985 - protein, 9 aa, Homo Sapiens
HSRGPQPGR

SEQ ID NO: 1128986 - protein, 9 aa, Homo Sapiens
WYGSVEALS

SEQ ID NO: 1128987 - protein, 9 aa, Homo Sapiens
SSSCGSPGW

SEQ ID NO: 1128988 - protein, 9 aa, Homo Sapiens
RPLRRPCTA

SEQ ID NO: 1128989 - protein, 9 aa, Homo Sapiens
EQPPDQWCP

SEQ ID NO: 1128990 - protein, 9 aa, Homo Sapiens
NYNTPLWLN

SEQ ID NO: 1128991 - protein, 9 aa, Homo Sapiens
GHFAEVYKA

SEQ ID NO: 1128992 - protein, 9 aa, Homo Sapiens
RYRSIRWDD

SEQ ID NO: 1128993 - protein, 9 aa, Homo Sapiens
GNPSLDEGS

SEQ ID NO: 1128994 - protein, 9 aa, Homo Sapiens
STAPSKAGL

SEQ ID NO: 1128995 - protein, 9 aa, Homo Sapiens
VQMFIGDCA

SEQ ID NO: 1128996 - protein, 9 aa, Homo Sapiens
ERDIFLPGH

SEQ ID NO: 1128997 - protein, 9 aa, Homo Sapiens
RRAISTFGT

SEQ ID NO: 1128998 - protein, 9 aa, Homo Sapiens
FCHEIAVRI

SEQ ID NO: 1128999 - protein, 9 aa, Homo Sapiens
PAWGPSPAP

SEQ ID NO: 1129000 - protein, 9 aa, Homo Sapiens
IGDCAKLVR

SEQ ID NO: 1129001 - protein, 9 aa, Homo Sapiens
FVAAIERVE

SEQ ID NO: 1129002 - protein, 9 aa, Homo Sapiens
SSVETLHAG

SEQ ID NO: 1129003 - protein, 9 aa, Homo Sapiens
ARYILKTDD

SEQ ID NO: 1129004 - protein, 9 aa, Homo Sapiens
IAQVRSKAK

SEQ ID NO: 1129005 - protein, 9 aa, Homo Sapiens
KRDADQCCE

SEQ ID NO: 1129006 - protein, 9 aa, Homo Sapiens
MSQLLSVYL

SEQ ID NO: 1129007 - protein, 9 aa, Homo Sapiens
DNKQIALRI

SEQ ID NO: 1129008 - protein, 9 aa, Homo Sapiens
ASAATSRGM

SEQ ID NO: 1129009 - protein, 9 aa, Homo Sapiens
GQQQQVFER

SEQ ID NO: 1129010 - protein, 9 aa, Homo Sapiens
MEALLISQL

SEQ ID NO: 1129011 - protein, 9 aa, Homo Sapiens
GPYPAASAP

SEQ ID NO: 1129012 - protein, 9 aa, Homo Sapiens
KTVQASRLK

SEQ ID NO: 1129013 - protein, 9 aa, Homo Sapiens
CSRPVCCPR

SEQ ID NO: 1129014 - protein, 9 aa, Homo Sapiens
LLLILQHIT

SEQ ID NO: 1129015 - protein, 9 aa, Homo Sapiens
SQAAAAEAA

SEQ ID NO: 1129016 - protein, 9 aa, Homo Sapiens
QLNCFRGQQ

SEQ ID NO: 1129017 - protein, 9 aa, Homo Sapiens
GVSIHRQLL

SEQ ID NO: 1129018 - protein, 9 aa, Homo Sapiens
LTTVSGGTT

SEQ ID NO: 1129019 - protein, 9 aa, Homo Sapiens
HHGLVFGDD

SEQ ID NO: 1129020 - protein, 9 aa, Homo Sapiens
YNGTTMCYG

SEQ ID NO: 1129021 - protein, 9 aa, Homo Sapiens
FCLLAVTSL

SEQ ID NO: 1129022 - protein, 9 aa, Homo Sapiens
VVSPLQSAL

SEQ ID NO: 1129023 - protein, 9 aa, Homo Sapiens
PPTSAPTQA

SEQ ID NO: 1129024 - protein, 9 aa, Homo Sapiens
TSAVVAPAT

SEQ ID NO: 1129025 - protein, 9 aa, Homo Sapiens
GGKMATQAR

SEQ ID NO: 1129026 - protein, 9 aa, Homo Sapiens
KQEPPCTRL

SEQ ID NO: 1129027 - protein, 9 aa, Homo Sapiens
ETRASIIKK

SEQ ID NO: 1129028 - protein, 9 aa, Homo Sapiens
VKSFEELQL

SEQ ID NO: 1129029 - protein, 9 aa, Homo Sapiens
TRAGLGESS

SEQ ID NO: 1129030 - protein, 9 aa, Homo Sapiens
RPAGGVVLH

SEQ ID NO: 1129031 - protein, 9 aa, Homo Sapiens
HVDHTAELW

SEQ ID NO: 1129032 - protein, 9 aa, Homo Sapiens
GHWGADAAE

SEQ ID NO: 1129033 - protein, 9 aa, Homo Sapiens
LHAPQLLPH

SEQ ID NO: 1129034 - protein, 9 aa, Homo Sapiens
YETYDEEEE

SEQ ID NO: 1129035 - protein, 9 aa, Homo Sapiens
EQAQTYVMR

SEQ ID NO: 1129036 - protein, 9 aa, Homo Sapiens
AVPSNMWGG

SEQ ID NO: 1129037 - protein, 9 aa, Homo Sapiens
KLPVRRDAS

SEQ ID NO: 1129038 - protein, 9 aa, Homo Sapiens
GTRLTTVSG

SEQ ID NO: 1129039 - protein, 9 aa, Homo Sapiens
QPRMKPASC

SEQ ID NO: 1129040 - protein, 9 aa, Homo Sapiens
TPSVWSPLQ

SEQ ID NO: 1129041 - protein, 9 aa, Homo Sapiens
VLTSKPYAF

SEQ ID NO: 1129042 - protein, 9 aa, Homo Sapiens
QNREHEING

SEQ ID NO: 1129043 - protein, 9 aa, Homo Sapiens
YLPLMAVAV

SEQ ID NO: 1129044 - protein, 9 aa, Homo Sapiens
RGTLLNDFH

SEQ ID NO: 1129045 - protein, 9 aa, Homo Sapiens
KSLRKTIME

SEQ ID NO: 1129046 - protein, 9 aa, Homo Sapiens
TGIRTRPQA

SEQ ID NO: 1129047 - protein, 9 aa, Homo Sapiens
QLLCQNPEK

SEQ ID NO: 1129048 - protein, 9 aa, Homo Sapiens
DLIVSILSE

SEQ ID NO: 1129049 - protein, 9 aa, Homo Sapiens
LPRSRKTFS

SEQ ID NO: 1129050 - protein, 9 aa, Homo Sapiens
GTRRIRGSR

SEQ ID NO: 1129051 - protein, 9 aa, Homo Sapiens
SCGILTNGK

SEQ ID NO: 1129052 - protein, 9 aa, Homo Sapiens
HHGGAGGFL

SEQ ID NO: 1129053 - protein, 9 aa, Homo Sapiens
TTGMSVYYS

SEQ ID NO: 1129054 - protein, 9 aa, Homo Sapiens
CRPSRKNHS

SEQ ID NO: 1129055 - protein, 9 aa, Homo Sapiens
SWTKLWCML

SEQ ID NO: 1129056 - protein, 9 aa, Homo Sapiens
LATLCIAGQ

SEQ ID NO: 1129057 - protein, 9 aa, Homo Sapiens
THSSTFRDH

SEQ ID NO: 1129058 - protein, 9 aa, Homo Sapiens
ACSRPVCCP

SEQ ID NO: 1129059 - protein, 9 aa, Homo Sapiens
PPLRRSVSP

SEQ ID NO: 1129060 - protein, 9 aa, Homo Sapiens
NLAPVTRLR

SEQ ID NO: 1129061 - protein, 9 aa, Homo Sapiens
YCLSYIAEI

SEQ ID NO: 1129062 - protein, 9 aa, Homo Sapiens
VQLPGGPGH

SEQ ID NO: 1129063 - protein, 9 aa, Homo Sapiens
ENDGGHDGE

SEQ ID NO: 1129064 - protein, 9 aa, Homo Sapiens
PGGFRAWHT

SEQ ID NO: 1129065 - protein, 9 aa, Homo Sapiens
IAWFTRELA

SEQ ID NO: 1129066 - protein, 9 aa, Homo Sapiens
LPILRPTGT

SEQ ID NO: 1129067 - protein, 9 aa, Homo Sapiens
VQRNTRSSV

SEQ ID NO: 1129068 - protein, 9 aa, Homo Sapiens
NSLCGTKSQ

SEQ ID NO: 1129069 - protein, 9 aa, Homo Sapiens
AMRVVRTVG

SEQ ID NO: 1129070 - protein, 9 aa, Homo Sapiens
MANGTVIHL

SEQ ID NO: 1129071 - protein, 9 aa, Homo Sapiens
VPEHSATSS

SEQ ID NO: 1129072 - protein, 9 aa, Homo Sapiens
NHAEREKYV

SEQ ID NO: 1129073 - protein, 9 aa, Homo Sapiens
ATPACIGWV

SEQ ID NO: 1129074 - protein, 9 aa, Homo Sapiens
RGFRQLTTH

SEQ ID NO: 1129075 - protein, 9 aa, Homo Sapiens
DDMELTLTK

SEQ ID NO: 1129076 - protein, 9 aa, Homo Sapiens
RCSRRLSKE

SEQ ID NO: 1129077 - protein, 9 aa, Homo Sapiens
WLSASHFTT

SEQ ID NO: 1129078 - protein, 9 aa, Homo Sapiens
NIQVTVTAT

SEQ ID NO: 1129079 - protein, 9 aa, Homo Sapiens
IRIYYYISH

SEQ ID NO: 1129080 - protein, 9 aa, Homo Sapiens
LQTIDLLDW

SEQ ID NO: 1129081 - protein, 9 aa, Homo Sapiens
DQGKGYHIH

SEQ ID NO: 1129082 - protein, 9 aa, Homo Sapiens
MPHDGSLHV

SEQ ID NO: 1129083 - protein, 9 aa, Homo Sapiens
VVDVDCLPL

SEQ ID NO: 1129084 - protein, 9 aa, Homo Sapiens
ELTQKATPN

SEQ ID NO: 1129085 - protein, 9 aa, Homo Sapiens
GGRILLQRN

SEQ ID NO: 1129086 - protein, 9 aa, Homo Sapiens
ERSSTKGCN

SEQ ID NO: 1129087 - protein, 9 aa, Homo Sapiens
STFMDNYIT

SEQ ID NO: 1129088 - protein, 9 aa, Homo Sapiens
TKSEKLAGA

SEQ ID NO: 1129089 - protein, 9 aa, Homo Sapiens
GVKSENKQR

SEQ ID NO: 1129090 - protein, 9 aa, Homo Sapiens
VRQVIKLDC

SEQ ID NO: 1129091 - protein, 9 aa, Homo Sapiens
LGEFDQGCL

SEQ ID NO: 1129092 - protein, 9 aa, Homo Sapiens
NMGIRPFQC

SEQ ID NO: 1129093 - protein, 9 aa, Homo Sapiens
KVTVQFQYS

SEQ ID NO: 1129094 - protein, 9 aa, Homo Sapiens
DRETRASII

SEQ ID NO: 1129095 - protein, 9 aa, Homo Sapiens
DEPYEKVVV

SEQ ID NO: 1129096 - protein, 9 aa, Homo Sapiens
HRILLDTHF

SEQ ID NO: 1129097 - protein, 9 aa, Homo Sapiens
VKDLTYFLP

SEQ ID NO: 1129098 - protein, 9 aa, Homo Sapiens
EEEEKKKQL

SEQ ID NO: 1129099 - protein, 9 aa, Homo Sapiens
GGRYYGGDS

SEQ ID NO: 1129100 - protein, 9 aa, Homo Sapiens
WVKKLQRQA

SEQ ID NO: 1129101 - protein, 9 aa, Homo Sapiens
ASHRELLAG

SEQ ID NO: 1129102 - protein, 9 aa, Homo Sapiens
YWRRTAHVG

SEQ ID NO: 1129103 - protein, 9 aa, Homo Sapiens
ACPLCSVTD

SEQ ID NO: 1129104 - protein, 9 aa, Homo Sapiens
ELDHTSLEE

SEQ ID NO: 1129105 - protein, 9 aa, Homo Sapiens
HELMQVVLA

SEQ ID NO: 1129106 - protein, 9 aa, Homo Sapiens
CSDDTSELE

SEQ ID NO: 1129107 - protein, 9 aa, Homo Sapiens
TKSIIFQWL

SEQ ID NO: 1129108 - protein, 9 aa, Homo Sapiens
SMTMNLADP

SEQ ID NO: 1129109 - protein, 9 aa, Homo Sapiens
TLEGCISVK

SEQ ID NO: 1129110 - protein, 9 aa, Homo Sapiens
QGAPTQRTT

SEQ ID NO: 1129111 - protein, 9 aa, Homo Sapiens
AVQWSNHRV

SEQ ID NO: 1129112 - protein, 9 aa, Homo Sapiens
QSTPKKRKT

SEQ ID NO: 1129113 - protein, 9 aa, Homo Sapiens
PMVMSNQKE

SEQ ID NO: 1129114 - protein, 9 aa, Homo Sapiens
IFCLHYGTQ

SEQ ID NO: 1129115 - protein, 9 aa, Homo Sapiens
CLRLRTKLE

SEQ ID NO: 1129116 - protein, 9 aa, Homo Sapiens
QRRGRRSHD

SEQ ID NO: 1129117 - protein, 9 aa, Homo Sapiens
GCAEGPGGH

SEQ ID NO: 1129118 - protein, 9 aa, Homo Sapiens
RGAAVGAGA

SEQ ID NO: 1129119 - protein, 9 aa, Homo Sapiens
LERVAKSSR

SEQ ID NO: 1129120 - protein, 9 aa, Homo Sapiens
TEGACTPGK

SEQ ID NO: 1129121 - protein, 9 aa, Homo Sapiens
MSGLTSGGE

SEQ ID NO: 1129122 - protein, 9 aa, Homo Sapiens
LELSAIVSK

SEQ ID NO: 1129123 - protein, 9 aa, Homo Sapiens
FASVINSAL

SEQ ID NO: 1129124 - protein, 9 aa, Homo Sapiens
PLTLPLPTV

SEQ ID NO: 1129125 - protein, 9 aa, Homo Sapiens
TGSPRSFTD

SEQ ID NO: 1129126 - protein, 9 aa, Homo Sapiens
SEPSSEPMH

SEQ ID NO: 1129127 - protein, 9 aa, Homo Sapiens
RQYSRQSCS

SEQ ID NO: 1129128 - protein, 9 aa, Homo Sapiens
DLTHLAALV

SEQ ID NO: 1129129 - protein, 9 aa, Homo Sapiens
DEVLDRFPT

SEQ ID NO: 1129130 - protein, 9 aa, Homo Sapiens
LDCTDMFVV

SEQ ID NO: 1129131 - protein, 9 aa, Homo Sapiens
SLSGIEIID

SEQ ID NO: 1129132 - protein, 9 aa, Homo Sapiens
VPEATLGPC

SEQ ID NO: 1129133 - protein, 9 aa, Homo Sapiens
GHQEDQLSA

SEQ ID NO: 1129134 - protein, 9 aa, Homo Sapiens
ECGDLCPVT

SEQ ID NO: 1129135 - protein, 9 aa, Homo Sapiens
AGGQCCCCC

SEQ ID NO: 1129136 - protein, 9 aa, Homo Sapiens
MGGAITFKT

SEQ ID NO: 1129137 - protein, 9 aa, Homo Sapiens
LALLTSVTL

SEQ ID NO: 1129138 - protein, 9 aa, Homo Sapiens
ARRTLGTTG

SEQ ID NO: 1129139 - protein, 9 aa, Homo Sapiens
QQLEEEQRK

SEQ ID NO: 1129140 - protein, 9 aa, Homo Sapiens
MLNFLSLEN

SEQ ID NO: 1129141 - protein, 9 aa, Homo Sapiens
IPKLSKDPH

SEQ ID NO: 1129142 - protein, 9 aa, Homo Sapiens
QQGVPQVSL

SEQ ID NO: 1129143 - protein, 9 aa, Homo Sapiens
FSEYPSLIS

SEQ ID NO: 1129144 - protein, 9 aa, Homo Sapiens
DFDTFLRHP

SEQ ID NO: 1129145 - protein, 9 aa, Homo Sapiens
PSPWWRSQN

SEQ ID NO: 1129146 - protein, 9 aa, Homo Sapiens
MDNAGKERA

SEQ ID NO: 1129147 - protein, 9 aa, Homo Sapiens
PGHFCPLRT

SEQ ID NO: 1129148 - protein, 9 aa, Homo Sapiens
RASGFARPP

SEQ ID NO: 1129149 - protein, 9 aa, Homo Sapiens
AMHTWYTET

SEQ ID NO: 1129150 - protein, 9 aa, Homo Sapiens
PRLLVSRPP

SEQ ID NO: 1129151 - protein, 9 aa, Homo Sapiens
SLLSTLSQP

SEQ ID NO: 1129152 - protein, 9 aa, Homo Sapiens
TFKLDKRLD

SEQ ID NO: 1129153 - protein, 9 aa, Homo Sapiens
RALASSKGR

SEQ ID NO: 1129154 - protein, 9 aa, Homo Sapiens
RVHRRARRV

SEQ ID NO: 1129155 - protein, 9 aa, Homo Sapiens
RAQSSFCLR

SEQ ID NO: 1129156 - protein, 9 aa, Homo Sapiens
TAWAALGSC

SEQ ID NO: 1129157 - protein, 9 aa, Homo Sapiens
GARAGGLGP

SEQ ID NO: 1129158 - protein, 9 aa, Homo Sapiens
LSLVGLAKM

SEQ ID NO: 1129159 - protein, 9 aa, Homo Sapiens
ARLTWRRPG

SEQ ID NO: 1129160 - protein, 9 aa, Homo Sapiens
TKYAFSLRN

SEQ ID NO: 1129161 - protein, 9 aa, Homo Sapiens
GRGDVALPG

SEQ ID NO: 1129162 - protein, 9 aa, Homo Sapiens
FAYGLAVKS

SEQ ID NO: 1129163 - protein, 9 aa, Homo Sapiens
GRNITWALK

SEQ ID NO: 1129164 - protein, 9 aa, Homo Sapiens
GAVWKEGGE

SEQ ID NO: 1129165 - protein, 9 aa, Homo Sapiens
CSILARLVA

SEQ ID NO: 1129166 - protein, 9 aa, Homo Sapiens
RDRDQERER

SEQ ID NO: 1129167 - protein, 9 aa, Homo Sapiens
FEMHDDIEV

SEQ ID NO: 1129168 - protein, 9 aa, Homo Sapiens
ILFLVATHE

SEQ ID NO: 1129169 - protein, 9 aa, Homo Sapiens
LSPTPMWWL

SEQ ID NO: 1129170 - protein, 9 aa, Homo Sapiens
HIDNLHFSG

SEQ ID NO: 1129171 - protein, 9 aa, Homo Sapiens
GHLMGRRRR

SEQ ID NO: 1129172 - protein, 9 aa, Homo Sapiens
RARTEQGWS

SEQ ID NO: 1129173 - protein, 9 aa, Homo Sapiens
ASLEKRVKM

SEQ ID NO: 1129174 - protein, 9 aa, Homo Sapiens
SAQGVTFED

SEQ ID NO: 1129175 - protein, 9 aa, Homo Sapiens
LSAGEDTLV

SEQ ID NO: 1129176 - protein, 9 aa, Homo Sapiens
DKTHGGAVA

SEQ ID NO: 1129177 - protein, 9 aa, Homo Sapiens
SRPAAGRAS

SEQ ID NO: 1129178 - protein, 9 aa, Homo Sapiens
VAHCYPDTL

SEQ ID NO: 1129179 - protein, 9 aa, Homo Sapiens
SFTLQPGGF

SEQ ID NO: 1129180 - protein, 9 aa, Homo Sapiens
RGWPDFLRG

SEQ ID NO: 1129181 - protein, 9 aa, Homo Sapiens
WGSLLMARA

SEQ ID NO: 1129182 - protein, 9 aa, Homo Sapiens
TNQEIRAKF

SEQ ID NO: 1129183 - protein, 9 aa, Homo Sapiens
TAAQEGTCT

SEQ ID NO: 1129184 - protein, 9 aa, Homo Sapiens
SKEHVLKLE

SEQ ID NO: 1129185 - protein, 9 aa, Homo Sapiens
SMSAAAMGG

SEQ ID NO: 1129186 - protein, 9 aa, Homo Sapiens
STPKDPCLR

SEQ ID NO: 1129187 - protein, 9 aa, Homo Sapiens
AGRMGGRHP

SEQ ID NO: 1129188 - protein, 9 aa, Homo Sapiens
LMLPPKPEK

SEQ ID NO: 1129189 - protein, 9 aa, Homo Sapiens
GKVISSYVH

SEQ ID NO: 1129190 - protein, 9 aa, Homo Sapiens
HRDTFHLLR

SEQ ID NO: 1129191 - protein, 9 aa, Homo Sapiens
PPTNALTLA

SEQ ID NO: 1129192 - protein, 9 aa, Homo Sapiens
ERKKMVHEL

SEQ ID NO: 1129193 - protein, 9 aa, Homo Sapiens
RKLRKEDEE

SEQ ID NO: 1129194 - protein, 9 aa, Homo Sapiens
LTQVEASGR

SEQ ID NO: 1129195 - protein, 9 aa, Homo Sapiens
RAPPQTRTA

SEQ ID NO: 1129196 - protein, 9 aa, Homo Sapiens
PPALRAWPR

SEQ ID NO: 1129197 - protein, 9 aa, Homo Sapiens
APIKDKVFS

SEQ ID NO: 1129198 - protein, 9 aa, Homo Sapiens
SEQYFHYHY

SEQ ID NO: 1129199 - protein, 9 aa, Homo Sapiens
HAHQLVEQA

SEQ ID NO: 1129200 - protein, 9 aa, Homo Sapiens
LYGQNKKYK

SEQ ID NO: 1129201 - protein, 9 aa, Homo Sapiens
GMDSNQNSP

SEQ ID NO: 1129202 - protein, 9 aa, Homo Sapiens
AHRLNIAME

SEQ ID NO: 1129203 - protein, 9 aa, Homo Sapiens
VQFRVASLH

SEQ ID NO: 1129204 - protein, 9 aa, Homo Sapiens
RLVINRLVV

SEQ ID NO: 1129205 - protein, 9 aa, Homo Sapiens
SPVIAASPA

SEQ ID NO: 1129206 - protein, 9 aa, Homo Sapiens
IRGHLGPSR

SEQ ID NO: 1129207 - protein, 9 aa, Homo Sapiens
PQENKAVQP

SEQ ID NO: 1129208 - protein, 9 aa, Homo Sapiens
VSRGDVHVG

SEQ ID NO: 1129209 - protein, 9 aa, Homo Sapiens
TSSSIDLQA

SEQ ID NO: 1129210 - protein, 9 aa, Homo Sapiens
PPRCCPCSS

SEQ ID NO: 1129211 - protein, 9 aa, Homo Sapiens
RCTAVSVPD

SEQ ID NO: 1129212 - protein, 9 aa, Homo Sapiens
VSSTRSYNW

SEQ ID NO: 1129213 - protein, 9 aa, Homo Sapiens
TQRTTRATL

SEQ ID NO: 1129214 - protein, 9 aa, Homo Sapiens
HKLPLESLY

SEQ ID NO: 1129215 - protein, 9 aa, Homo Sapiens
DTGSVGALT

SEQ ID NO: 1129216 - protein, 9 aa, Homo Sapiens
LKWHLLSEH

SEQ ID NO: 1129217 - protein, 9 aa, Homo Sapiens
GQVGHGVWV

SEQ ID NO: 1129218 - protein, 9 aa, Homo Sapiens
APRVNLGLG

SEQ ID NO: 1129219 - protein, 9 aa, Homo Sapiens
HLHKTEKAI

SEQ ID NO: 1129220 - protein, 9 aa, Homo Sapiens
SSGFSGSLG

SEQ ID NO: 1129221 - protein, 9 aa, Homo Sapiens
LNRTVQRRQ

SEQ ID NO: 1129222 - protein, 9 aa, Homo Sapiens
LTIHHLKKT

SEQ ID NO: 1129223 - protein, 9 aa, Homo Sapiens
YSSTSEREL

SEQ ID NO: 1129224 - protein, 9 aa, Homo Sapiens
AAPGGSWYC

SEQ ID NO: 1129225 - protein, 9 aa, Homo Sapiens
HLLQPWLEG

SEQ ID NO: 1129226 - protein, 9 aa, Homo Sapiens
FFIANTKDS

SEQ ID NO: 1129227 - protein, 9 aa, Homo Sapiens
GMSYDHVLF

SEQ ID NO: 1129228 - protein, 9 aa, Homo Sapiens
SLARRPLLP

SEQ ID NO: 1129229 - protein, 9 aa, Homo Sapiens
ATDLSPVKD

SEQ ID NO: 1129230 - protein, 9 aa, Homo Sapiens
HCGLRGQSG

SEQ ID NO: 1129231 - protein, 9 aa, Homo Sapiens
TKKDMLPQK

SEQ ID NO: 1129232 - protein, 9 aa, Homo Sapiens
WCIHALLGV

SEQ ID NO: 1129233 - protein, 9 aa, Homo Sapiens
RHKTCPSPQ

SEQ ID NO: 1129234 - protein, 9 aa, Homo Sapiens
DRNTSCHHG

SEQ ID NO: 1129235 - protein, 9 aa, Homo Sapiens
SCEGKMANF

SEQ ID NO: 1129236 - protein, 9 aa, Homo Sapiens
GNEQISKER

SEQ ID NO: 1129237 - protein, 9 aa, Homo Sapiens
VACVGSGLQ

SEQ ID NO: 1129238 - protein, 9 aa, Homo Sapiens
TRFNQMRER

SEQ ID NO: 1129239 - protein, 9 aa, Homo Sapiens
DSTSSYEAQ

SEQ ID NO: 1129240 - protein, 9 aa, Homo Sapiens
FDKDLDRIF

SEQ ID NO: 1129241 - protein, 9 aa, Homo Sapiens
GGAEGIDRA

SEQ ID NO: 1129242 - protein, 9 aa, Homo Sapiens
QAEVGRAAQ

SEQ ID NO: 1129243 - protein, 9 aa, Homo Sapiens
ETLGVKTLC

SEQ ID NO: 1129244 - protein, 9 aa, Homo Sapiens
GSFFTGIPF

SEQ ID NO: 1129245 - protein, 9 aa, Homo Sapiens
QALVLKIKK

SEQ ID NO: 1129246 - protein, 9 aa, Homo Sapiens
RNRALQPLW

SEQ ID NO: 1129247 - protein, 9 aa, Homo Sapiens
GFQFVKGFG

SEQ ID NO: 1129248 - protein, 9 aa, Homo Sapiens
YLRPRSMRS

SEQ ID NO: 1129249 - protein, 9 aa, Homo Sapiens
ARGPAPASR

SEQ ID NO: 1129250 - protein, 9 aa, Homo Sapiens
RAGAPAESH

SEQ ID NO: 1129251 - protein, 9 aa, Homo Sapiens
NVPLFKHKS

SEQ ID NO: 1129252 - protein, 9 aa, Homo Sapiens
PAPPTVALL

SEQ ID NO: 1129253 - protein, 9 aa, Homo Sapiens
RTVPGGPGT

SEQ ID NO: 1129254 - protein, 9 aa, Homo Sapiens
LLCGQPQAQ

SEQ ID NO: 1129255 - protein, 9 aa, Homo Sapiens
PSFCTADIL

SEQ ID NO: 1129256 - protein, 9 aa, Homo Sapiens
ITPLPVTSP

SEQ ID NO: 1129257 - protein, 9 aa, Homo Sapiens
MELDETDED

SEQ ID NO: 1129258 - protein, 9 aa, Homo Sapiens
VVQSTLEQT

SEQ ID NO: 1129259 - protein, 9 aa, Homo Sapiens
HWCGTTGQL

SEQ ID NO: 1129260 - protein, 9 aa, Homo Sapiens
EDEEVPAFL

SEQ ID NO: 1129261 - protein, 9 aa, Homo Sapiens
GIDCSGGFN

SEQ ID NO: 1129262 - protein, 9 aa, Homo Sapiens
EVQVLCHHL

SEQ ID NO: 1129263 - protein, 9 aa, Homo Sapiens
CIHLVEGYL

SEQ ID NO: 1129264 - protein, 9 aa, Homo Sapiens
CRRHCPRCP

SEQ ID NO: 1129265 - protein, 9 aa, Homo Sapiens
DAPCPLLEG

SEQ ID NO: 1129266 - protein, 9 aa, Homo Sapiens
GEQSGGKTS

SEQ ID NO: 1129267 - protein, 9 aa, Homo Sapiens
ESMTCSGVK

SEQ ID NO: 1129268 - protein, 9 aa, Homo Sapiens
RREPSRASW

SEQ ID NO: 1129269 - protein, 9 aa, Homo Sapiens
QERFSLLSA

SEQ ID NO: 1129270 - protein, 9 aa, Homo Sapiens
SLALWPPPL

SEQ ID NO: 1129271 - protein, 9 aa, Homo Sapiens
KHTSSGSIK

SEQ ID NO: 1129272 - protein, 9 aa, Homo Sapiens
KKPCRTSTT

SEQ ID NO: 1129273 - protein, 9 aa, Homo Sapiens
NARGIPRST

SEQ ID NO: 1129274 - protein, 9 aa, Homo Sapiens
QLKQRRCTL

SEQ ID NO: 1129275 - protein, 9 aa, Homo Sapiens
FRCIEKQVL

SEQ ID NO: 1129276 - protein, 9 aa, Homo Sapiens
FQLVRDNSL

SEQ ID NO: 1129277 - protein, 9 aa, Homo Sapiens
RGRDRAGVQ

SEQ ID NO: 1129278 - protein, 9 aa, Homo Sapiens
PIKKIPRLL

SEQ ID NO: 1129279 - protein, 9 aa, Homo Sapiens
MLLLSALGH

SEQ ID NO: 1129280 - protein, 9 aa, Homo Sapiens
TITTTTMGE

SEQ ID NO: 1129281 - protein, 9 aa, Homo Sapiens
PTRPRLLPL

SEQ ID NO: 1129282 - protein, 9 aa, Homo Sapiens
SQEDKKIQD

SEQ ID NO: 1129283 - protein, 9 aa, Homo Sapiens
DVATDFSQS

SEQ ID NO: 1129284 - protein, 9 aa, Homo Sapiens
SLSEEEKLK

SEQ ID NO: 1129285 - protein, 9 aa, Homo Sapiens
VQLKQRRCT

SEQ ID NO: 1129286 - protein, 9 aa, Homo Sapiens
RAPASQMVQ

SEQ ID NO: 1129287 - protein, 9 aa, Homo Sapiens
ERGQMAPPV

SEQ ID NO: 1129288 - protein, 9 aa, Homo Sapiens
VLDSPCWLS

SEQ ID NO: 1129289 - protein, 9 aa, Homo Sapiens
MFLPTLLHR

SEQ ID NO: 1129290 - protein, 9 aa, Homo Sapiens
LMKMDDATI

SEQ ID NO: 1129291 - protein, 9 aa, Homo Sapiens
ELRPVDTKA

SEQ ID NO: 1129292 - protein, 9 aa, Homo Sapiens
PGPPRASPR

SEQ ID NO: 1129293 - protein, 9 aa, Homo Sapiens
LDALCPTRK

SEQ ID NO: 1129294 - protein, 9 aa, Homo Sapiens
PQLRLPRSR

SEQ ID NO: 1129295 - protein, 9 aa, Homo Sapiens
ELKRVRGER

SEQ ID NO: 1129296 - protein, 9 aa, Homo Sapiens
RMAKHLSQC

SEQ ID NO: 1129297 - protein, 9 aa, Homo Sapiens
WFARCQEMG

SEQ ID NO: 1129298 - protein, 9 aa, Homo Sapiens
ADSESASSI

SEQ ID NO: 1129299 - protein, 9 aa, Homo Sapiens
YKQHLSCRL

SEQ ID NO: 1129300 - protein, 9 aa, Homo Sapiens
IRKYKVLSV

SEQ ID NO: 1129301 - protein, 9 aa, Homo Sapiens
QEGTCTCIA

SEQ ID NO: 1129302 - protein, 9 aa, Homo Sapiens
EDEEFCELC

SEQ ID NO: 1129303 - protein, 9 aa, Homo Sapiens
MQKHTSSGS

SEQ ID NO: 1129304 - protein, 9 aa, Homo Sapiens
KSHRRHRHH

SEQ ID NO: 1129305 - protein, 9 aa, Homo Sapiens
RGRSQDCDQ

SEQ ID NO: 1129306 - protein, 9 aa, Homo Sapiens
ENINHLVSL

SEQ ID NO: 1129307 - protein, 9 aa, Homo Sapiens
KDFICLDYS

SEQ ID NO: 1129308 - protein, 9 aa, Homo Sapiens
DLLQLPEPI

SEQ ID NO: 1129309 - protein, 9 aa, Homo Sapiens
ASEKAIETD

SEQ ID NO: 1129310 - protein, 9 aa, Homo Sapiens
ACLDRDQGR

SEQ ID NO: 1129311 - protein, 9 aa, Homo Sapiens
LAALFPSEG

SEQ ID NO: 1129312 - protein, 9 aa, Homo Sapiens
YMLPCLSPD

SEQ ID NO: 1129313 - protein, 9 aa, Homo Sapiens
GKKWHRFGA

SEQ ID NO: 1129314 - protein, 9 aa, Homo Sapiens
NKWMNKKNE

SEQ ID NO: 1129315 - protein, 9 aa, Homo Sapiens
LFKDLGFFG

SEQ ID NO: 1129316 - protein, 9 aa, Homo Sapiens
SQGVSSCPS

SEQ ID NO: 1129317 - protein, 9 aa, Homo Sapiens
IEPSERRRF

SEQ ID NO: 1129318 - protein, 9 aa, Homo Sapiens
LKGKKIFLV

SEQ ID NO: 1129319 - protein, 9 aa, Homo Sapiens
VARPSTTRR

SEQ ID NO: 1129320 - protein, 9 aa, Homo Sapiens
ALVLKIKKL

SEQ ID NO: 1129321 - protein, 9 aa, Homo Sapiens
QRSMSPTLT

SEQ ID NO: 1129322 - protein, 9 aa, Homo Sapiens
CKQCGEAFR

SEQ ID NO: 1129323 - protein, 9 aa, Homo Sapiens
RVGFHVSKI

SEQ ID NO: 1129324 - protein, 9 aa, Homo Sapiens
KSPSSAGPL

SEQ ID NO: 1129325 - protein, 9 aa, Homo Sapiens
GRSNMRMEH

SEQ ID NO: 1129326 - protein, 9 aa, Homo Sapiens
EKGTYSYLA

SEQ ID NO: 1129327 - protein, 9 aa, Homo Sapiens
FSRSPPTLM

SEQ ID NO: 1129328 - protein, 9 aa, Homo Sapiens
EAGSFPTCG

SEQ ID NO: 1129329 - protein, 9 aa, Homo Sapiens
SSHAPRSLG

SEQ ID NO: 1129330 - protein, 9 aa, Homo Sapiens
AIRTVIIGG

SEQ ID NO: 1129331 - protein, 9 aa, Homo Sapiens
VKIELDHTS

SEQ ID NO: 1129332 - protein, 9 aa, Homo Sapiens
TVSHDFSIN

SEQ ID NO: 1129333 - protein, 9 aa, Homo Sapiens
LNKLIQQPR

SEQ ID NO: 1129334 - protein, 9 aa, Homo Sapiens
LGVKKLMNA

SEQ ID NO: 1129335 - protein, 9 aa, Homo Sapiens
GTSIAFSTS

SEQ ID NO: 1129336 - protein, 9 aa, Homo Sapiens
ELNCYDLVR

SEQ ID NO: 1129337 - protein, 9 aa, Homo Sapiens
RPTTVRKAK

SEQ ID NO: 1129338 - protein, 9 aa, Homo Sapiens
EVEKRKHTI

SEQ ID NO: 1129339 - protein, 9 aa, Homo Sapiens
CPMTACSIL

SEQ ID NO: 1129340 - protein, 9 aa, Homo Sapiens
RSPITSIKS

SEQ ID NO: 1129341 - protein, 9 aa, Homo Sapiens
LKGPWRTTP

SEQ ID NO: 1129342 - protein, 9 aa, Homo Sapiens
AFQEKHPFD

SEQ ID NO: 1129343 - protein, 9 aa, Homo Sapiens
AANVKPPRC

SEQ ID NO: 1129344 - protein, 9 aa, Homo Sapiens
KGDLNLSVV

SEQ ID NO: 1129345 - protein, 9 aa, Homo Sapiens
GEHASVYHI

SEQ ID NO: 1129346 - protein, 9 aa, Homo Sapiens
GLAHVFIGI

SEQ ID NO: 1129347 - protein, 9 aa, Homo Sapiens
GGVQGAQGL

SEQ ID NO: 1129348 - protein, 9 aa, Homo Sapiens
RCIEKQVLQ

SEQ ID NO: 1129349 - protein, 9 aa, Homo Sapiens
LVYALLYKC

SEQ ID NO: 1129350 - protein, 9 aa, Homo Sapiens
PPLHSHVEA

SEQ ID NO: 1129351 - protein, 9 aa, Homo Sapiens
SLHVLIEYF

SEQ ID NO: 1129352 - protein, 9 aa, Homo Sapiens
LVKDHGEPV

SEQ ID NO: 1129353 - protein, 9 aa, Homo Sapiens
DPEPSVCRH

SEQ ID NO: 1129354 - protein, 9 aa, Homo Sapiens
PQNGIVVAD

SEQ ID NO: 1129355 - protein, 9 aa, Homo Sapiens
GLHICDLLS

SEQ ID NO: 1129356 - protein, 9 aa, Homo Sapiens
GQQSLYCRS

SEQ ID NO: 1129357 - protein, 9 aa, Homo Sapiens
SPDSTVDQQ

SEQ ID NO: 1129358 - protein, 9 aa, Homo Sapiens
FTTTSRLSS

SEQ ID NO: 1129359 - protein, 9 aa, Homo Sapiens
PTDVIVFSY

SEQ ID NO: 1129360 - protein, 9 aa, Homo Sapiens
QSNDHGDGG

SEQ ID NO: 1129361 - protein, 9 aa, Homo Sapiens
SPACRSCRC

SEQ ID NO: 1129362 - protein, 9 aa, Homo Sapiens
IVIEPSERR

SEQ ID NO: 1129363 - protein, 9 aa, Homo Sapiens
AAPASVATA

SEQ ID NO: 1129364 - protein, 9 aa, Homo Sapiens
APTQRTTRA

SEQ ID NO: 1129365 - protein, 9 aa, Homo Sapiens
TRASGPTPV

SEQ ID NO: 1129366 - protein, 9 aa, Homo Sapiens
ALSAMLACL

SEQ ID NO: 1129367 - protein, 9 aa, Homo Sapiens
ERQRGYHKK

SEQ ID NO: 1129368 - protein, 9 aa, Homo Sapiens
LQGKLGPKE

SEQ ID NO: 1129369 - protein, 9 aa, Homo Sapiens
PSVARPSTT

SEQ ID NO: 1129370 - protein, 9 aa, Homo Sapiens
NTGPRRRPY

SEQ ID NO: 1129371 - protein, 9 aa, Homo Sapiens
CHRAALSAC

SEQ ID NO: 1129372 - protein, 9 aa, Homo Sapiens
GPPHPTRMS

SEQ ID NO: 1129373 - protein, 9 aa, Homo Sapiens
PLRPHHDLG

SEQ ID NO: 1129374 - protein, 9 aa, Homo Sapiens
NWWNHHHFQ

SEQ ID NO: 1129375 - protein, 9 aa, Homo Sapiens
NQVVIVEEA

SEQ ID NO: 1129376 - protein, 9 aa, Homo Sapiens
APRSTPKDP

SEQ ID NO: 1129377 - protein, 9 aa, Homo Sapiens
HPDAILQAQ

SEQ ID NO: 1129378 - protein, 9 aa, Homo Sapiens
SQQFLGVHI

SEQ ID NO: 1129379 - protein, 9 aa, Homo Sapiens
ELKMLCFLS

SEQ ID NO: 1129380 - protein, 9 aa, Homo Sapiens
ADPVKKSCG

SEQ ID NO: 1129381 - protein, 9 aa, Homo Sapiens
SGLGFSFLE

SEQ ID NO: 1129382 - protein, 9 aa, Homo Sapiens
RLVATPALP

SEQ ID NO: 1129383 - protein, 9 aa, Homo Sapiens
SDERGWWKA

SEQ ID NO: 1129384 - protein, 9 aa, Homo Sapiens
TVAIVKAMY

SEQ ID NO: 1129385 - protein, 9 aa, Homo Sapiens
GHIVNVTVI

SEQ ID NO: 1129386 - protein, 9 aa, Homo Sapiens
VMKKCRKLG

SEQ ID NO: 1129387 - protein, 9 aa, Homo Sapiens
THSIMLRLE

SEQ ID NO: 1129388 - protein, 9 aa, Homo Sapiens
RGASKASRA

SEQ ID NO: 1129389 - protein, 9 aa, Homo Sapiens
EHSDLGNSR

SEQ ID NO: 1129390 - protein, 9 aa, Homo Sapiens
NGITYASIA

SEQ ID NO: 1129391 - protein, 9 aa, Homo Sapiens
RLNAKEEAT

SEQ ID NO: 1129392 - protein, 9 aa, Homo Sapiens
VGIDAHTES

SEQ ID NO: 1129393 - protein, 9 aa, Homo Sapiens
AGLCPVLGP

SEQ ID NO: 1129394 - protein, 9 aa, Homo Sapiens
CVLVTEHPP

SEQ ID NO: 1129395 - protein, 9 aa, Homo Sapiens
PPNPGVGPG

SEQ ID NO: 1129396 - protein, 9 aa, Homo Sapiens
TATAASARS

SEQ ID NO: 1129397 - protein, 9 aa, Homo Sapiens
ALLVLLLQR

SEQ ID NO: 1129398 - protein, 9 aa, Homo Sapiens
RTRPQASTA

SEQ ID NO: 1129399 - protein, 9 aa, Homo Sapiens
RTFMPPGSP

SEQ ID NO: 1129400 - protein, 9 aa, Homo Sapiens
TLRPWKTSC

SEQ ID NO: 1129401 - protein, 9 aa, Homo Sapiens
AGRHRGTGP

SEQ ID NO: 1129402 - protein, 9 aa, Homo Sapiens
QPPQALPPA

SEQ ID NO: 1129403 - protein, 9 aa, Homo Sapiens
WMLKATLIP

SEQ ID NO: 1129404 - protein, 9 aa, Homo Sapiens
RESGLRTHT

SEQ ID NO: 1129405 - protein, 9 aa, Homo Sapiens
QRASPGPQR

SEQ ID NO: 1129406 - protein, 9 aa, Homo Sapiens
GRGGRGAHG

SEQ ID NO: 1129407 - protein, 9 aa, Homo Sapiens
TKRRGPRTA

SEQ ID NO: 1129408 - protein, 9 aa, Homo Sapiens
PGSPRLCAT

SEQ ID NO: 1129409 - protein, 9 aa, Homo Sapiens
APAAEGFDA

SEQ ID NO: 1129410 - protein, 9 aa, Homo Sapiens
YRCSACHLI

SEQ ID NO: 1129411 - protein, 9 aa, Homo Sapiens
GRKSAILPL

SEQ ID NO: 1129412 - protein, 9 aa, Homo Sapiens
ADGDDGPVA

SEQ ID NO: 1129413 - protein, 9 aa, Homo Sapiens
SASTKHCSI

SEQ ID NO: 1129414 - protein, 9 aa, Homo Sapiens
FKWFEHSAK

SEQ ID NO: 1129415 - protein, 9 aa, Homo Sapiens
QNFFRNKYQ

SEQ ID NO: 1129416 - protein, 9 aa, Homo Sapiens
RDLRSALIS

SEQ ID NO: 1129417 - protein, 9 aa, Homo Sapiens
GHLPPEVPG

SEQ ID NO: 1129418 - protein, 9 aa, Homo Sapiens
TKQGHLLYR

SEQ ID NO: 1129419 - protein, 9 aa, Homo Sapiens
DPQHNFKQW

SEQ ID NO: 1129420 - protein, 9 aa, Homo Sapiens
SCTDEAEEW

SEQ ID NO: 1129421 - protein, 9 aa, Homo Sapiens
TSGSPHPQL

SEQ ID NO: 1129422 - protein, 9 aa, Homo Sapiens
KEETRKIAV

SEQ ID NO: 1129423 - protein, 9 aa, Homo Sapiens
NLLLLALPI

SEQ ID NO: 1129424 - protein, 9 aa, Homo Sapiens
ANKYLEKKT

SEQ ID NO: 1129425 - protein, 9 aa, Homo Sapiens
MYTYPVSNS

SEQ ID NO: 1129426 - protein, 9 aa, Homo Sapiens
VRNVFKKED

SEQ ID NO: 1129427 - protein, 9 aa, Homo Sapiens
GQRQQLAQL

SEQ ID NO: 1129428 - protein, 9 aa, Homo Sapiens
DAPHSFFPY

SEQ ID NO: 1129429 - protein, 9 aa, Homo Sapiens
QPPKQTIHE

SEQ ID NO: 1129430 - protein, 9 aa, Homo Sapiens
EVEAVPSNM

SEQ ID NO: 1129431 - protein, 9 aa, Homo Sapiens
CKASLSTSS

SEQ ID NO: 1129432 - protein, 9 aa, Homo Sapiens
LDTPIAEVS

SEQ ID NO: 1129433 - protein, 9 aa, Homo Sapiens
APPPGCWTG

SEQ ID NO: 1129434 - protein, 9 aa, Homo Sapiens
TSPKATANR

SEQ ID NO: 1129435 - protein, 9 aa, Homo Sapiens
DCRFINIKK

SEQ ID NO: 1129436 - protein, 9 aa, Homo Sapiens
CVKGRTWTL

SEQ ID NO: 1129437 - protein, 9 aa, Homo Sapiens
LRPLGPGRS

SEQ ID NO: 1129438 - protein, 9 aa, Homo Sapiens
DRVAKTGVG

SEQ ID NO: 1129439 - protein, 9 aa, Homo Sapiens
KQVLEMVGQ

SEQ ID NO: 1129440 - protein, 9 aa, Homo Sapiens
MQRTVLPGL

SEQ ID NO: 1129441 - protein, 9 aa, Homo Sapiens
LKPQLSGKM

SEQ ID NO: 1129442 - protein, 9 aa, Homo Sapiens
SCQLRHLES

SEQ ID NO: 1129443 - protein, 9 aa, Homo Sapiens
IQFLIENGL

SEQ ID NO: 1129444 - protein, 9 aa, Homo Sapiens
QRDAFLHID

SEQ ID NO: 1129445 - protein, 9 aa, Homo Sapiens
GHGLVTVRV

SEQ ID NO: 1129446 - protein, 9 aa, Homo Sapiens
TIMCDKFSG

SEQ ID NO: 1129447 - protein, 9 aa, Homo Sapiens
VIARCLVQL

SEQ ID NO: 1129448 - protein, 9 aa, Homo Sapiens
ARRKALPFA

SEQ ID NO: 1129449 - protein, 9 aa, Homo Sapiens
PAGSSTLSQ

SEQ ID NO: 1129450 - protein, 9 aa, Homo Sapiens
ARGAKVSRN

SEQ ID NO: 1129451 - protein, 9 aa, Homo Sapiens
RCWHRRLAP

SEQ ID NO: 1129452 - protein, 9 aa, Homo Sapiens
HTNAKKILL

SEQ ID NO: 1129453 - protein, 9 aa, Homo Sapiens
THSVVCMTN

SEQ ID NO: 1129454 - protein, 9 aa, Homo Sapiens
NNGEKLEFC

SEQ ID NO: 1129455 - protein, 9 aa, Homo Sapiens
PPLRGPQTH

SEQ ID NO: 1129456 - protein, 9 aa, Homo Sapiens
FEGDHESSG

SEQ ID NO: 1129457 - protein, 9 aa, Homo Sapiens
HITDDWDHK

SEQ ID NO: 1129458 - protein, 9 aa, Homo Sapiens
YAPWSNLKK

SEQ ID NO: 1129459 - protein, 9 aa, Homo Sapiens
ALPFSLAEV

SEQ ID NO: 1129460 - protein, 9 aa, Homo Sapiens
GEYAFPAKK

SEQ ID NO: 1129461 - protein, 9 aa, Homo Sapiens
NPPGLLLHA

SEQ ID NO: 1129462 - protein, 9 aa, Homo Sapiens
TVLGINVAD

SEQ ID NO: 1129463 - protein, 9 aa, Homo Sapiens
GSVTLKCQG

SEQ ID NO: 1129464 - protein, 9 aa, Homo Sapiens
ESSLAHIWQ

SEQ ID NO: 1129465 - protein, 9 aa, Homo Sapiens
TDSMSSEST

SEQ ID NO: 1129466 - protein, 9 aa, Homo Sapiens
MRTHAGSTM

SEQ ID NO: 1129467 - protein, 9 aa, Homo Sapiens
SQPTSELSL

SEQ ID NO: 1129468 - protein, 9 aa, Homo Sapiens
SYDGVFIAL

SEQ ID NO: 1129469 - protein, 9 aa, Homo Sapiens
IKMRKEAEA

SEQ ID NO: 1129470 - protein, 9 aa, Homo Sapiens
ALFPSEGVS

SEQ ID NO: 1129471 - protein, 9 aa, Homo Sapiens
VKDCVLMVE

SEQ ID NO: 1129472 - protein, 9 aa, Homo Sapiens
PRVSQGYHQ

SEQ ID NO: 1129473 - protein, 9 aa, Homo Sapiens
APGSPRLCA

SEQ ID NO: 1129474 - protein, 9 aa, Homo Sapiens
HTSTLIKHQ

SEQ ID NO: 1129475 - protein, 9 aa, Homo Sapiens
EELQPLPQC

SEQ ID NO: 1129476 - protein, 9 aa, Homo Sapiens
LSNVLVAMR

SEQ ID NO: 1129477 - protein, 9 aa, Homo Sapiens
KKFMADLKE

SEQ ID NO: 1129478 - protein, 9 aa, Homo Sapiens
STYAPPNSY

SEQ ID NO: 1129479 - protein, 9 aa, Homo Sapiens
ADDLIKVSD

SEQ ID NO: 1129480 - protein, 9 aa, Homo Sapiens
FDLDEMFSS

SEQ ID NO: 1129481 - protein, 9 aa, Homo Sapiens
FGTRMITID

SEQ ID NO: 1129482 - protein, 9 aa, Homo Sapiens
VESPTATEI

SEQ ID NO: 1129483 - protein, 9 aa, Homo Sapiens
FLSRAPPVR

SEQ ID NO: 1129484 - protein, 9 aa, Homo Sapiens
PGVRSLWWY

SEQ ID NO: 1129485 - protein, 9 aa, Homo Sapiens
DLGLGTHRI

SEQ ID NO: 1129486 - protein, 9 aa, Homo Sapiens
KAPTSQVLW

SEQ ID NO: 1129487 - protein, 9 aa, Homo Sapiens
IILGPVLFM

SEQ ID NO: 1129488 - protein, 9 aa, Homo Sapiens
GSYAEVKPL

SEQ ID NO: 1129489 - protein, 9 aa, Homo Sapiens
HRGLGGLGQ

SEQ ID NO: 1129490 - protein, 9 aa, Homo Sapiens
CFFPLSSMA

SEQ ID NO: 1129491 - protein, 9 aa, Homo Sapiens
VGNVYIKFR

SEQ ID NO: 1129492 - protein, 9 aa, Homo Sapiens
AQPQAMANS

SEQ ID NO: 1129493 - protein, 9 aa, Homo Sapiens
LTGCPFRPR

SEQ ID NO: 1129494 - protein, 9 aa, Homo Sapiens
TCSTDSSSC

SEQ ID NO: 1129495 - protein, 9 aa, Homo Sapiens
RRILRRLVS

SEQ ID NO: 1129496 - protein, 9 aa, Homo Sapiens
TELTTAVTT

SEQ ID NO: 1129497 - protein, 9 aa, Homo Sapiens
VITSHAGKG

SEQ ID NO: 1129498 - protein, 9 aa, Homo Sapiens
LALATLCIA

SEQ ID NO: 1129499 - protein, 9 aa, Homo Sapiens
GELGRPLYF

SEQ ID NO: 1129500 - protein, 9 aa, Homo Sapiens
DGLTQKDKP

SEQ ID NO: 1129501 - protein, 9 aa, Homo Sapiens
RNSLPPTSW

SEQ ID NO: 1129502 - protein, 9 aa, Homo Sapiens
SLGPLRSLP

SEQ ID NO: 1129503 - protein, 9 aa, Homo Sapiens
DLSEGELGA

SEQ ID NO: 1129504 - protein, 9 aa, Homo Sapiens
IHKSASSRE

SEQ ID NO: 1129505 - protein, 9 aa, Homo Sapiens
QSHSKPCGF

SEQ ID NO: 1129506 - protein, 9 aa, Homo Sapiens
GKLGPKEEV

SEQ ID NO: 1129507 - protein, 9 aa, Homo Sapiens
QFRCIEKQV

SEQ ID NO: 1129508 - protein, 9 aa, Homo Sapiens
ERERVQFRV

SEQ ID NO: 1129509 - protein, 9 aa, Homo Sapiens
LLRTNLTPN

SEQ ID NO: 1129510 - protein, 9 aa, Homo Sapiens
NKKGEAKYR

SEQ ID NO: 1129511 - protein, 9 aa, Homo Sapiens
GGQAGASGE

SEQ ID NO: 1129512 - protein, 9 aa, Homo Sapiens
CRPGPTESP

SEQ ID NO: 1129513 - protein, 9 aa, Homo Sapiens
NLNDAQDIT

SEQ ID NO: 1129514 - protein, 9 aa, Homo Sapiens
SDRTPRGSP

SEQ ID NO: 1129515 - protein, 9 aa, Homo Sapiens
SQSPFFATA

SEQ ID NO: 1129516 - protein, 9 aa, Homo Sapiens
VAGVHYQAW

SEQ ID NO: 1129517 - protein, 9 aa, Homo Sapiens
IRWDDRGEG

SEQ ID NO: 1129518 - protein, 9 aa, Homo Sapiens
APHPPPAAA

SEQ ID NO: 1129519 - protein, 9 aa, Homo Sapiens
DLDVGDCPK

SEQ ID NO: 1129520 - protein, 9 aa, Homo Sapiens
DSLIGNAVE

SEQ ID NO: 1129521 - protein, 9 aa, Homo Sapiens
PRSQGAPTQ

SEQ ID NO: 1129522 - protein, 9 aa, Homo Sapiens
PRAPEVPRC

SEQ ID NO: 1129523 - protein, 9 aa, Homo Sapiens
QPKKIKEVY

SEQ ID NO: 1129524 - protein, 9 aa, Homo Sapiens
VHVLCRTHL

SEQ ID NO: 1129525 - protein, 9 aa, Homo Sapiens
RSSPTWLTS

SEQ ID NO: 1129526 - protein, 9 aa, Homo Sapiens
QALRAKLDG

SEQ ID NO: 1129527 - protein, 9 aa, Homo Sapiens
RHISAPEKT

SEQ ID NO: 1129528 - protein, 9 aa, Homo Sapiens
TVLVGQRLT

SEQ ID NO: 1129529 - protein, 9 aa, Homo Sapiens
SPRRSPALR

SEQ ID NO: 1129530 - protein, 9 aa, Homo Sapiens
DTDNAYVQI

SEQ ID NO: 1129531 - protein, 9 aa, Homo Sapiens
PSPASACTM

SEQ ID NO: 1129532 - protein, 9 aa, Homo Sapiens
SANWWNHHH

SEQ ID NO: 1129533 - protein, 9 aa, Homo Sapiens
EENTLMRDL

SEQ ID NO: 1129534 - protein, 9 aa, Homo Sapiens
KEKEQEKDR

SEQ ID NO: 1129535 - protein, 9 aa, Homo Sapiens
PQLLCQNPE

SEQ ID NO: 1129536 - protein, 9 aa, Homo Sapiens
EGDHESSGW

SEQ ID NO: 1129537 - protein, 9 aa, Homo Sapiens
KLGPKEEVV

SEQ ID NO: 1129538 - protein, 9 aa, Homo Sapiens
VKDHRTSQN

SEQ ID NO: 1129539 - protein, 9 aa, Homo Sapiens
CPWPSALPS

SEQ ID NO: 1129540 - protein, 9 aa, Homo Sapiens
KSQAMRVVR

SEQ ID NO: 1129541 - protein, 9 aa, Homo Sapiens
SGPVAVATD

SEQ ID NO: 1129542 - protein, 9 aa, Homo Sapiens
KVLAGPLAL

SEQ ID NO: 1129543 - protein, 9 aa, Homo Sapiens
RKKWRHRTI

SEQ ID NO: 1129544 - protein, 9 aa, Homo Sapiens
ETPTWAGTS

SEQ ID NO: 1129545 - protein, 9 aa, Homo Sapiens
IAHLIHSIN

SEQ ID NO: 1129546 - protein, 9 aa, Homo Sapiens
EIEFISVKE

SEQ ID NO: 1129547 - protein, 9 aa, Homo Sapiens
IDSSLSFQC

SEQ ID NO: 1129548 - protein, 9 aa, Homo Sapiens
CPMARYILK

SEQ ID NO: 1129549 - protein, 9 aa, Homo Sapiens
VEAAQTEYI

SEQ ID NO: 1129550 - protein, 9 aa, Homo Sapiens
TYYGDNRFN

SEQ ID NO: 1129551 - protein, 9 aa, Homo Sapiens
WWRSQNWPP

SEQ ID NO: 1129552 - protein, 9 aa, Homo Sapiens
RGHGAARSS

SEQ ID NO: 1129553 - protein, 9 aa, Homo Sapiens
RIEHSIDLR

SEQ ID NO: 1129554 - protein, 9 aa, Homo Sapiens
EGGPAEGRR

SEQ ID NO: 1129555 - protein, 9 aa, Homo Sapiens
ELPGLQVQD

SEQ ID NO: 1129556 - protein, 9 aa, Homo Sapiens
VSFNGVRKY

SEQ ID NO: 1129557 - protein, 9 aa, Homo Sapiens
RMHRIGELS

SEQ ID NO: 1129558 - protein, 9 aa, Homo Sapiens
NRASMEFLQ

SEQ ID NO: 1129559 - protein, 9 aa, Homo Sapiens
LLLVKKPLV

SEQ ID NO: 1129560 - protein, 9 aa, Homo Sapiens
NRDHRKIGS

SEQ ID NO: 1129561 - protein, 9 aa, Homo Sapiens
HHQPTVDKI

SEQ ID NO: 1129562 - protein, 9 aa, Homo Sapiens
SRKSSTRNK

SEQ ID NO: 1129563 - protein, 9 aa, Homo Sapiens
GFGSTVAYC

SEQ ID NO: 1129564 - protein, 9 aa, Homo Sapiens
ARAERERAQ

SEQ ID NO: 1129565 - protein, 9 aa, Homo Sapiens
TPTPGSAAA

SEQ ID NO: 1129566 - protein, 9 aa, Homo Sapiens
YSCKEGYVK

SEQ ID NO: 1129567 - protein, 9 aa, Homo Sapiens
GEALLYYGC

SEQ ID NO: 1129568 - protein, 9 aa, Homo Sapiens
LMDAGACYA

SEQ ID NO: 1129569 - protein, 9 aa, Homo Sapiens
TVHIVHVGQ

SEQ ID NO: 1129570 - protein, 9 aa, Homo Sapiens
LEVFPPVFA

SEQ ID NO: 1129571 - protein, 9 aa, Homo Sapiens
TERGFQTSL

SEQ ID NO: 1129572 - protein, 9 aa, Homo Sapiens
RRTPMLRPL

SEQ ID NO: 1129573 - protein, 9 aa, Homo Sapiens
KRQRGSLAI

SEQ ID NO: 1129574 - protein, 9 aa, Homo Sapiens
TLGASGPVE

SEQ ID NO: 1129575 - protein, 9 aa, Homo Sapiens
EQPCGECFP

SEQ ID NO: 1129576 - protein, 9 aa, Homo Sapiens
GPTSGSTPG

SEQ ID NO: 1129577 - protein, 9 aa, Homo Sapiens
QASLLCFQP

SEQ ID NO: 1129578 - protein, 9 aa, Homo Sapiens
PSSPPSLAR

SEQ ID NO: 1129579 - protein, 9 aa, Homo Sapiens
ISFTVPNID

SEQ ID NO: 1129580 - protein, 9 aa, Homo Sapiens
DAFHGPYGN

SEQ ID NO: 1129581 - protein, 9 aa, Homo Sapiens
ETTAAAIMA

SEQ ID NO: 1129582 - protein, 9 aa, Homo Sapiens
TRHIRQDGP

SEQ ID NO: 1129583 - protein, 9 aa, Homo Sapiens
LATGSSRGT

SEQ ID NO: 1129584 - protein, 9 aa, Homo Sapiens
GTPLSISRP

SEQ ID NO: 1129585 - protein, 9 aa, Homo Sapiens
KPYCNAHYL

SEQ ID NO: 1129586 - protein, 9 aa, Homo Sapiens
RERPLRLPG

SEQ ID NO: 1129587 - protein, 9 aa, Homo Sapiens
NYCLSYIAE

SEQ ID NO: 1129588 - protein, 9 aa, Homo Sapiens
QGHSVYGPL

SEQ ID NO: 1129589 - protein, 9 aa, Homo Sapiens
SSYVHVQPC

SEQ ID NO: 1129590 - protein, 9 aa, Homo Sapiens
TSSPQGSSR

SEQ ID NO: 1129591 - protein, 9 aa, Homo Sapiens
EEKVKKEGS

SEQ ID NO: 1129592 - protein, 9 aa, Homo Sapiens
TFSTLVTAL

SEQ ID NO: 1129593 - protein, 9 aa, Homo Sapiens
MLRPLGPGR

SEQ ID NO: 1129594 - protein, 9 aa, Homo Sapiens
SSAAPVRCS

SEQ ID NO: 1129595 - protein, 9 aa, Homo Sapiens
GIRDMHLEL

SEQ ID NO: 1129596 - protein, 9 aa, Homo Sapiens
AAVAAVSSS

SEQ ID NO: 1129597 - protein, 9 aa, Homo Sapiens
TWLLKDSLR

SEQ ID NO: 1129598 - protein, 9 aa, Homo Sapiens
QFQCSLDST

SEQ ID NO: 1129599 - protein, 9 aa, Homo Sapiens
TYVFLVVAN

SEQ ID NO: 1129600 - protein, 9 aa, Homo Sapiens
TAGVATDTK

SEQ ID NO: 1129601 - protein, 9 aa, Homo Sapiens
VGLTMVYAF

SEQ ID NO: 1129602 - protein, 9 aa, Homo Sapiens
ENLNISCHA

SEQ ID NO: 1129603 - protein, 9 aa, Homo Sapiens
PLRAGLMTA

SEQ ID NO: 1129604 - protein, 9 aa, Homo Sapiens
LCGALRRWK

SEQ ID NO: 1129605 - protein, 9 aa, Homo Sapiens
TASLGLFLN

SEQ ID NO: 1129606 - protein, 9 aa, Homo Sapiens
TAPPTPVPR

SEQ ID NO: 1129607 - protein, 9 aa, Homo Sapiens
ALPFVASLF

SEQ ID NO: 1129608 - protein, 9 aa, Homo Sapiens
KNRQRGHLH

SEQ ID NO: 1129609 - protein, 9 aa, Homo Sapiens
LTTNCMTVV

SEQ ID NO: 1129610 - protein, 9 aa, Homo Sapiens
YGDALKNVM

SEQ ID NO: 1129611 - protein, 9 aa, Homo Sapiens
IYGTSIIVE

SEQ ID NO: 1129612 - protein, 9 aa, Homo Sapiens
RLAVSTRGA

SEQ ID NO: 1129613 - protein, 9 aa, Homo Sapiens
SSMTTSTTA

SEQ ID NO: 1129614 - protein, 9 aa, Homo Sapiens
ISRSIYLGD

SEQ ID NO: 1129615 - protein, 9 aa, Homo Sapiens
LLLSALGHT

SEQ ID NO: 1129616 - protein, 9 aa, Homo Sapiens
SRQGSTETI

SEQ ID NO: 1129617 - protein, 9 aa, Homo Sapiens
AKWLGVQWR

SEQ ID NO: 1129618 - protein, 9 aa, Homo Sapiens
EKRPQWMLK

SEQ ID NO: 1129619 - protein, 9 aa, Homo Sapiens
QGCRCTACP

SEQ ID NO: 1129620 - protein, 9 aa, Homo Sapiens
SSPRRSPAL

SEQ ID NO: 1129621 - protein, 9 aa, Homo Sapiens
WAMGIPLEP

SEQ ID NO: 1129622 - protein, 9 aa, Homo Sapiens
NGIVVADAE

SEQ ID NO: 1129623 - protein, 9 aa, Homo Sapiens
RLLGCLGSA

SEQ ID NO: 1129624 - protein, 9 aa, Homo Sapiens
ERALPLPSR

SEQ ID NO: 1129625 - protein, 9 aa, Homo Sapiens
KADSESASS

SEQ ID NO: 1129626 - protein, 9 aa, Homo Sapiens
HSKCITECV

SEQ ID NO: 1129627 - protein, 9 aa, Homo Sapiens
QWALGAILY

SEQ ID NO: 1129628 - protein, 9 aa, Homo Sapiens
ILFNYCLHE

SEQ ID NO: 1129629 - protein, 9 aa, Homo Sapiens
LHALGALPP

SEQ ID NO: 1129630 - protein, 9 aa, Homo Sapiens
ASWSPSAWC

SEQ ID NO: 1129631 - protein, 9 aa, Homo Sapiens
KMQREKCLT

SEQ ID NO: 1129632 - protein, 9 aa, Homo Sapiens
TPEARFPVI

SEQ ID NO: 1129633 - protein, 9 aa, Homo Sapiens
GSGPRGVLS

SEQ ID NO: 1129634 - protein, 9 aa, Homo Sapiens
HSKYVRAMY

SEQ ID NO: 1129635 - protein, 9 aa, Homo Sapiens
PTSAAGCSI

SEQ ID NO: 1129636 - protein, 9 aa, Homo Sapiens
VSKISQADS

SEQ ID NO: 1129637 - protein, 9 aa, Homo Sapiens
RNSYECEMF

SEQ ID NO: 1129638 - protein, 9 aa, Homo Sapiens
DPSKQNLLL

SEQ ID NO: 1129639 - protein, 9 aa, Homo Sapiens
FMPPGSPTP

SEQ ID NO: 1129640 - protein, 9 aa, Homo Sapiens
DKTQSETIV

SEQ ID NO: 1129641 - protein, 9 aa, Homo Sapiens
NMTPRRRQS

SEQ ID NO: 1129642 - protein, 9 aa, Homo Sapiens
RTLLRTNLT

SEQ ID NO: 1129643 - protein, 9 aa, Homo Sapiens
AEHRVPPFP

SEQ ID NO: 1129644 - protein, 9 aa, Homo Sapiens
LRPCRCCRC

SEQ ID NO: 1129645 - protein, 9 aa, Homo Sapiens
VHVTSNLSA

SEQ ID NO: 1129646 - protein, 9 aa, Homo Sapiens
PLMAVAVFL

SEQ ID NO: 1129647 - protein, 9 aa, Homo Sapiens
LCILVNTLV

SEQ ID NO: 1129648 - protein, 9 aa, Homo Sapiens
SYNWNIDRS

SEQ ID NO: 1129649 - protein, 9 aa, Homo Sapiens
PVESSSPMV

SEQ ID NO: 1129650 - protein, 9 aa, Homo Sapiens
VTFGLFLHL

SEQ ID NO: 1129651 - protein, 9 aa, Homo Sapiens
EKDEWTMAS

SEQ ID NO: 1129652 - protein, 9 aa, Homo Sapiens
NTNIRLVYS

SEQ ID NO: 1129653 - protein, 9 aa, Homo Sapiens
ELQAGRETG

SEQ ID NO: 1129654 - protein, 9 aa, Homo Sapiens
GMHYLDIVR

SEQ ID NO: 1129655 - protein, 9 aa, Homo Sapiens
TGTLGVGDK

SEQ ID NO: 1129656 - protein, 9 aa, Homo Sapiens
REAGIMGQF

SEQ ID NO: 1129657 - protein, 9 aa, Homo Sapiens
TKEGHIKAF

SEQ ID NO: 1129658 - protein, 9 aa, Homo Sapiens
MPPLPQTHQ

SEQ ID NO: 1129659 - protein, 9 aa, Homo Sapiens
PPWKARWCI

SEQ ID NO: 1129660 - protein, 9 aa, Homo Sapiens
LAATKKLSI

SEQ ID NO: 1129661 - protein, 9 aa, Homo Sapiens
CMRGSSQIL

SEQ ID NO: 1129662 - protein, 9 aa, Homo Sapiens
SMYYYIQQD

SEQ ID NO: 1129663 - protein, 9 aa, Homo Sapiens
CQVGLLPTL

SEQ ID NO: 1129664 - protein, 9 aa, Homo Sapiens
GQVAVGLRN

SEQ ID NO: 1129665 - protein, 9 aa, Homo Sapiens
SARSPTSSP

SEQ ID NO: 1129666 - protein, 9 aa, Homo Sapiens
VEEMATKKH

SEQ ID NO: 1129667 - protein, 9 aa, Homo Sapiens
DSTGVVANL

SEQ ID NO: 1129668 - protein, 9 aa, Homo Sapiens
RTEDGGWYG

SEQ ID NO: 1129669 - protein, 9 aa, Homo Sapiens
KDSDSPNPA

SEQ ID NO: 1129670 - protein, 9 aa, Homo Sapiens
PPSAPPPSA

SEQ ID NO: 1129671 - protein, 9 aa, Homo Sapiens
AITSIVMMA

SEQ ID NO: 1129672 - protein, 9 aa, Homo Sapiens
RCPTEPLGV

SEQ ID NO: 1129673 - protein, 9 aa, Homo Sapiens
RFQKKMKVS

SEQ ID NO: 1129674 - protein, 9 aa, Homo Sapiens
PPGTSPGDQ

SEQ ID NO: 1129675 - protein, 9 aa, Homo Sapiens
ATQNPPGAP

SEQ ID NO: 1129676 - protein, 9 aa, Homo Sapiens
GVPGSMPNV

SEQ ID NO: 1129677 - protein, 9 aa, Homo Sapiens
RNLRPLSLQ

SEQ ID NO: 1129678 - protein, 9 aa, Homo Sapiens
VNSFLIKYK

SEQ ID NO: 1129679 - protein, 9 aa, Homo Sapiens
QTRKTYPIC

SEQ ID NO: 1129680 - protein, 9 aa, Homo Sapiens
PVGLLVVSH

SEQ ID NO: 1129681 - protein, 9 aa, Homo Sapiens
EQSWWGGDP

SEQ ID NO: 1129682 - protein, 9 aa, Homo Sapiens
VLLPQLPSA

SEQ ID NO: 1129683 - protein, 9 aa, Homo Sapiens
AAALDSGPE

SEQ ID NO: 1129684 - protein, 9 aa, Homo Sapiens
NLYHLSPHL

SEQ ID NO: 1129685 - protein, 9 aa, Homo Sapiens
RGGPGQAAG

SEQ ID NO: 1129686 - protein, 9 aa, Homo Sapiens
FGNAMCKLY

SEQ ID NO: 1129687 - protein, 9 aa, Homo Sapiens
ENAVDCEQA

SEQ ID NO: 1129688 - protein, 9 aa, Homo Sapiens
DSSTPKRSR

SEQ ID NO: 1129689 - protein, 9 aa, Homo Sapiens
TGKFTNGQL

SEQ ID NO: 1129690 - protein, 9 aa, Homo Sapiens
RKLGRIHPN

SEQ ID NO: 1129691 - protein, 9 aa, Homo Sapiens
WGTSASTAR

SEQ ID NO: 1129692 - protein, 9 aa, Homo Sapiens
LSRPWEKNR

SEQ ID NO: 1129693 - protein, 9 aa, Homo Sapiens
HPVKVYPNG

SEQ ID NO: 1129694 - protein, 9 aa, Homo Sapiens
FSVFEGVST

SEQ ID NO: 1129695 - protein, 9 aa, Homo Sapiens
ATCYFTMGL

SEQ ID NO: 1129696 - protein, 9 aa, Homo Sapiens
ISFVDGLTQ

SEQ ID NO: 1129697 - protein, 9 aa, Homo Sapiens
ELQAFARHG

SEQ ID NO: 1129698 - protein, 9 aa, Homo Sapiens
PRTGCRPRS

SEQ ID NO: 1129699 - protein, 9 aa, Homo Sapiens
TSQRPISFV

SEQ ID NO: 1129700 - protein, 9 aa, Homo Sapiens
PKQPAPKLE

SEQ ID NO: 1129701 - protein, 9 aa, Homo Sapiens
CQCIFCILC

SEQ ID NO: 1129702 - protein, 9 aa, Homo Sapiens
DAMSSSYET

SEQ ID NO: 1129703 - protein, 9 aa, Homo Sapiens
YGDGQQDLA

SEQ ID NO: 1129704 - protein, 9 aa, Homo Sapiens
PTARATSGT

SEQ ID NO: 1129705 - protein, 9 aa, Homo Sapiens
QFNASEQLP

SEQ ID NO: 1129706 - protein, 9 aa, Homo Sapiens
TLDTPSDGP

SEQ ID NO: 1129707 - protein, 9 aa, Homo Sapiens
PLAAAAVGP

SEQ ID NO: 1129708 - protein, 9 aa, Homo Sapiens
GTIRSHRPC

SEQ ID NO: 1129709 - protein, 9 aa, Homo Sapiens
RAKVAGPGP

SEQ ID NO: 1129710 - protein, 9 aa, Homo Sapiens
VEKNKWMNK

SEQ ID NO: 1129711 - protein, 9 aa, Homo Sapiens
QQHFNTLDV

SEQ ID NO: 1129712 - protein, 9 aa, Homo Sapiens
AEPGPASGG

SEQ ID NO: 1129713 - protein, 9 aa, Homo Sapiens
PVVVPTRHI

SEQ ID NO: 1129714 - protein, 9 aa, Homo Sapiens
GGGSGSGLR

SEQ ID NO: 1129715 - protein, 9 aa, Homo Sapiens
HSIRFEDCT

SEQ ID NO: 1129716 - protein, 9 aa, Homo Sapiens
SVTGHPLYT

SEQ ID NO: 1129717 - protein, 9 aa, Homo Sapiens
EESQNEETK

SEQ ID NO: 1129718 - protein, 9 aa, Homo Sapiens
LAQESLQLE

SEQ ID NO: 1129719 - protein, 9 aa, Homo Sapiens
PAKIGRGTT

SEQ ID NO: 1129720 - protein, 9 aa, Homo Sapiens
QPGGFRAWH

SEQ ID NO: 1129721 - protein, 9 aa, Homo Sapiens
KVLTIIESE

SEQ ID NO: 1129722 - protein, 9 aa, Homo Sapiens
LHGSLLLKR

SEQ ID NO: 1129723 - protein, 9 aa, Homo Sapiens
LLDASCHPQ

SEQ ID NO: 1129724 - protein, 9 aa, Homo Sapiens
LKAYCHPQG

SEQ ID NO: 1129725 - protein, 9 aa, Homo Sapiens
MGPPILGRG

SEQ ID NO: 1129726 - protein, 9 aa, Homo Sapiens
PSGTSRTRG

SEQ ID NO: 1129727 - protein, 9 aa, Homo Sapiens
GSCPNMTPR

SEQ ID NO: 1129728 - protein, 9 aa, Homo Sapiens
TFFALGRAP

SEQ ID NO: 1129729 - protein, 9 aa, Homo Sapiens
VRLKRCRRR

SEQ ID NO: 1129730 - protein, 9 aa, Homo Sapiens
GPRRRAWLT

SEQ ID NO: 1129731 - protein, 9 aa, Homo Sapiens
RLVTRHAAH

SEQ ID NO: 1129732 - protein, 9 aa, Homo Sapiens
HSSSLTRHQ

SEQ ID NO: 1129733 - protein, 9 aa, Homo Sapiens
ACATSAAAT

SEQ ID NO: 1129734 - protein, 9 aa, Homo Sapiens
TRASIIKKT

SEQ ID NO: 1129735 - protein, 9 aa, Homo Sapiens
SAASLTQMS

SEQ ID NO: 1129736 - protein, 9 aa, Homo Sapiens
WDEDTAQIV

SEQ ID NO: 1129737 - protein, 9 aa, Homo Sapiens
LHSHVEARE

SEQ ID NO: 1129738 - protein, 9 aa, Homo Sapiens
GCRPMERDL

SEQ ID NO: 1129739 - protein, 9 aa, Homo Sapiens
QFLGVHIIL

SEQ ID NO: 1129740 - protein, 9 aa, Homo Sapiens
LLAPKTTLP

SEQ ID NO: 1129741 - protein, 9 aa, Homo Sapiens
TDDWDHKLC

SEQ ID NO: 1129742 - protein, 9 aa, Homo Sapiens
SQGCGCGRA

SEQ ID NO: 1129743 - protein, 9 aa, Homo Sapiens
SALISLVSY

SEQ ID NO: 1129744 - protein, 9 aa, Homo Sapiens
ATDWEVFQI

SEQ ID NO: 1129745 - protein, 9 aa, Homo Sapiens
IAARLETYP

SEQ ID NO: 1129746 - protein, 9 aa, Homo Sapiens
QDAYTQKLS

SEQ ID NO: 1129747 - protein, 9 aa, Homo Sapiens
ASRRTASSW

SEQ ID NO: 1129748 - protein, 9 aa, Homo Sapiens
SPLTDKKAP

SEQ ID NO: 1129749 - protein, 9 aa, Homo Sapiens
VGSKDKVGR

SEQ ID NO: 1129750 - protein, 9 aa, Homo Sapiens
ITAEFTTTE

SEQ ID NO: 1129751 - protein, 9 aa, Homo Sapiens
FSLVSDGDY

SEQ ID NO: 1129752 - protein, 9 aa, Homo Sapiens
NEFGLLILF

SEQ ID NO: 1129753 - protein, 9 aa, Homo Sapiens
LTLCASSRK

SEQ ID NO: 1129754 - protein, 9 aa, Homo Sapiens
CLGKRRDQA

SEQ ID NO: 1129755 - protein, 9 aa, Homo Sapiens
LLMKGSRQR

SEQ ID NO: 1129756 - protein, 9 aa, Homo Sapiens
LQKMGKNRM

SEQ ID NO: 1129757 - protein, 9 aa, Homo Sapiens
FIIDSSLSF

SEQ ID NO: 1129758 - protein, 9 aa, Homo Sapiens
ALQFTETPT

SEQ ID NO: 1129759 - protein, 9 aa, Homo Sapiens
CICTVVQLR

SEQ ID NO: 1129760 - protein, 9 aa, Homo Sapiens
GELLVKNLS

SEQ ID NO: 1129761 - protein, 9 aa, Homo Sapiens
TYTQLYTSH

SEQ ID NO: 1129762 - protein, 9 aa, Homo Sapiens
RGDVALPGE

SEQ ID NO: 1129763 - protein, 9 aa, Homo Sapiens
INSTDHIEQ

SEQ ID NO: 1129764 - protein, 9 aa, Homo Sapiens
SRPFREAGF

SEQ ID NO: 1129765 - protein, 9 aa, Homo Sapiens
YKGEECGKA

SEQ ID NO: 1129766 - protein, 9 aa, Homo Sapiens
DTPQPSLPG

SEQ ID NO: 1129767 - protein, 9 aa, Homo Sapiens
RPMGIIATN

SEQ ID NO: 1129768 - protein, 9 aa, Homo Sapiens
RATLINTTT

SEQ ID NO: 1129769 - protein, 9 aa, Homo Sapiens
EGFQFVKGF

SEQ ID NO: 1129770 - protein, 9 aa, Homo Sapiens
NSHPPTTTT

SEQ ID NO: 1129771 - protein, 9 aa, Homo Sapiens
GFVSQIRGQ

SEQ ID NO: 1129772 - protein, 9 aa, Homo Sapiens
SPPSLARRP

SEQ ID NO: 1129773 - protein, 9 aa, Homo Sapiens
AAVLFNFPP

SEQ ID NO: 1129774 - protein, 9 aa, Homo Sapiens
RHGPYPAAS

SEQ ID NO: 1129775 - protein, 9 aa, Homo Sapiens
WEENRNGNS

SEQ ID NO: 1129776 - protein, 9 aa, Homo Sapiens
TGYKIHYRK

SEQ ID NO: 1129777 - protein, 9 aa, Homo Sapiens
QDTSGHRGS

SEQ ID NO: 1129778 - protein, 9 aa, Homo Sapiens
LPLLAMAPR

SEQ ID NO: 1129779 - protein, 9 aa, Homo Sapiens
GRSPCPKGL

SEQ ID NO: 1129780 - protein, 9 aa, Homo Sapiens
ATVCPAVER

SEQ ID NO: 1129781 - protein, 9 aa, Homo Sapiens
DRPLLPHKS

SEQ ID NO: 1129782 - protein, 9 aa, Homo Sapiens
GIVDIFLSF

SEQ ID NO: 1129783 - protein, 9 aa, Homo Sapiens
APPSAVARM

SEQ ID NO: 1129784 - protein, 9 aa, Homo Sapiens
TVDSPPHQK

SEQ ID NO: 1129785 - protein, 9 aa, Homo Sapiens
SMEIMKRNI

SEQ ID NO: 1129786 - protein, 9 aa, Homo Sapiens
SPAPSAGRT

SEQ ID NO: 1129787 - protein, 9 aa, Homo Sapiens
RRAGRRPLP

SEQ ID NO: 1129788 - protein, 9 aa, Homo Sapiens
ADQCCEVKQ

SEQ ID NO: 1129789 - protein, 9 aa, Homo Sapiens
IVQTYLTVC

SEQ ID NO: 1129790 - protein, 9 aa, Homo Sapiens
LPRHPCPRP

SEQ ID NO: 1129791 - protein, 9 aa, Homo Sapiens
SKKIYDSQP

SEQ ID NO: 1129792 - protein, 9 aa, Homo Sapiens
NTSCHHGLV

SEQ ID NO: 1129793 - protein, 9 aa, Homo Sapiens
GPGQRPARQ

SEQ ID NO: 1129794 - protein, 9 aa, Homo Sapiens
APLPPRAPH

SEQ ID NO: 1129795 - protein, 9 aa, Homo Sapiens
LPYQEADQR

SEQ ID NO: 1129796 - protein, 9 aa, Homo Sapiens
EDGKANTKK

SEQ ID NO: 1129797 - protein, 9 aa, Homo Sapiens
FCSECGKAF

SEQ ID NO: 1129798 - protein, 9 aa, Homo Sapiens
LEYAHTFMN

SEQ ID NO: 1129799 - protein, 9 aa, Homo Sapiens
TILSGSLST

SEQ ID NO: 1129800 - protein, 9 aa, Homo Sapiens
RRHRFSIND

SEQ ID NO: 1129801 - protein, 9 aa, Homo Sapiens
YMLHLESWL

SEQ ID NO: 1129802 - protein, 9 aa, Homo Sapiens
KAKVAFHLD

SEQ ID NO: 1129803 - protein, 9 aa, Homo Sapiens
PAGLCPVLG

SEQ ID NO: 1129804 - protein, 9 aa, Homo Sapiens
AVSVDYHVS

SEQ ID NO: 1129805 - protein, 9 aa, Homo Sapiens
CSKCGKGFP

SEQ ID NO: 1129806 - protein, 9 aa, Homo Sapiens
FGSGSTREE

SEQ ID NO: 1129807 - protein, 9 aa, Homo Sapiens
ALGRQQVMA

SEQ ID NO: 1129808 - protein, 9 aa, Homo Sapiens
DRDQERERE

SEQ ID NO: 1129809 - protein, 9 aa, Homo Sapiens
KVQAMALLL

SEQ ID NO: 1129810 - protein, 9 aa, Homo Sapiens
QYQRLTCSP

SEQ ID NO: 1129811 - protein, 9 aa, Homo Sapiens
QYRELGNII

SEQ ID NO: 1129812 - protein, 9 aa, Homo Sapiens
PGKSCDFYH

SEQ ID NO: 1129813 - protein, 9 aa, Homo Sapiens
AWKKTAKRK

SEQ ID NO: 1129814 - protein, 9 aa, Homo Sapiens
VECLGRPRP

SEQ ID NO: 1129815 - protein, 9 aa, Homo Sapiens
KLPNSVLGH

SEQ ID NO: 1129816 - protein, 9 aa, Homo Sapiens
AEAWGQKAN

SEQ ID NO: 1129817 - protein, 9 aa, Homo Sapiens
CVNIEEVLP

SEQ ID NO: 1129818 - protein, 9 aa, Homo Sapiens
GTSIIVERM

SEQ ID NO: 1129819 - protein, 9 aa, Homo Sapiens
GYHIHNQTY

SEQ ID NO: 1129820 - protein, 9 aa, Homo Sapiens
LLRSEPKCD

SEQ ID NO: 1129821 - protein, 9 aa, Homo Sapiens
DDRRDRCSA

SEQ ID NO: 1129822 - protein, 9 aa, Homo Sapiens
CLDRDQGRA

SEQ ID NO: 1129823 - protein, 9 aa, Homo Sapiens
SCKLLPDDR

SEQ ID NO: 1129824 - protein, 9 aa, Homo Sapiens
IFLFTAMAY

SEQ ID NO: 1129825 - protein, 9 aa, Homo Sapiens
TEENDTDEE

SEQ ID NO: 1129826 - protein, 9 aa, Homo Sapiens
GSSVDYCIH

SEQ ID NO: 1129827 - protein, 9 aa, Homo Sapiens
LNMEELIQD

SEQ ID NO: 1129828 - protein, 9 aa, Homo Sapiens
CLCTGRACC

SEQ ID NO: 1129829 - protein, 9 aa, Homo Sapiens
RRGTPGTCL

SEQ ID NO: 1129830 - protein, 9 aa, Homo Sapiens
NRDILARLH

SEQ ID NO: 1129831 - protein, 9 aa, Homo Sapiens
RRMKWKNDN

SEQ ID NO: 1129832 - protein, 9 aa, Homo Sapiens
RSFTDTITY

SEQ ID NO: 1129833 - protein, 9 aa, Homo Sapiens
DRAGVQPPL

SEQ ID NO: 1129834 - protein, 9 aa, Homo Sapiens
ALQGCRCTA

SEQ ID NO: 1129835 - protein, 9 aa, Homo Sapiens
FCNNHVSIA

SEQ ID NO: 1129836 - protein, 9 aa, Homo Sapiens
MDFGKNVMK

SEQ ID NO: 1129837 - protein, 9 aa, Homo Sapiens
ERSHGVTVA

SEQ ID NO: 1129838 - protein, 9 aa, Homo Sapiens
SKSHPKGTA

SEQ ID NO: 1129839 - protein, 9 aa, Homo Sapiens
MHVGQGPLL

SEQ ID NO: 1129840 - protein, 9 aa, Homo Sapiens
GLTAALSFT

SEQ ID NO: 1129841 - protein, 9 aa, Homo Sapiens
ESMTIYIFC

SEQ ID NO: 1129842 - protein, 9 aa, Homo Sapiens
HAHQLQHAE

SEQ ID NO: 1129843 - protein, 9 aa, Homo Sapiens
PKVAARLAM

SEQ ID NO: 1129844 - protein, 9 aa, Homo Sapiens
SDILCLSGD

SEQ ID NO: 1129845 - protein, 9 aa, Homo Sapiens
VLLQSALDC

SEQ ID NO: 1129846 - protein, 9 aa, Homo Sapiens
VLVTEHPPP

SEQ ID NO: 1129847 - protein, 9 aa, Homo Sapiens
ARCVCDRDD

SEQ ID NO: 1129848 - protein, 9 aa, Homo Sapiens
PQVVPAALL

SEQ ID NO: 1129849 - protein, 9 aa, Homo Sapiens
QQIVQTYLT

SEQ ID NO: 1129850 - protein, 9 aa, Homo Sapiens
MNSPAPKKS

SEQ ID NO: 1129851 - protein, 9 aa, Homo Sapiens
DDTDDLTPQ

SEQ ID NO: 1129852 - protein, 9 aa, Homo Sapiens
KEQDKEKEQ

SEQ ID NO: 1129853 - protein, 9 aa, Homo Sapiens
RREDEDDYE

SEQ ID NO: 1129854 - protein, 9 aa, Homo Sapiens
THVYQGPEE

SEQ ID NO: 1129855 - protein, 9 aa, Homo Sapiens
GKTKPEILK

SEQ ID NO: 1129856 - protein, 9 aa, Homo Sapiens
SGAQVDMVR

SEQ ID NO: 1129857 - protein, 9 aa, Homo Sapiens
AASTQFSTS

SEQ ID NO: 1129858 - protein, 9 aa, Homo Sapiens
DQLLTGCHL

SEQ ID NO: 1129859 - protein, 9 aa, Homo Sapiens
SYLKVLQWD

SEQ ID NO: 1129860 - protein, 9 aa, Homo Sapiens
WEDLRGGKI

SEQ ID NO: 1129861 - protein, 9 aa, Homo Sapiens
RHYRTHTGK

SEQ ID NO: 1129862 - protein, 9 aa, Homo Sapiens
TSGASGGTA

SEQ ID NO: 1129863 - protein, 9 aa, Homo Sapiens
KMKVSQSLF

SEQ ID NO: 1129864 - protein, 9 aa, Homo Sapiens
NRQRGHLHP

SEQ ID NO: 1129865 - protein, 9 aa, Homo Sapiens
GLLMEEEGH

SEQ ID NO: 1129866 - protein, 9 aa, Homo Sapiens
PSTRHGVED

SEQ ID NO: 1129867 - protein, 9 aa, Homo Sapiens
TASCLRTGQ

SEQ ID NO: 1129868 - protein, 9 aa, Homo Sapiens
YLKVLQWDY

SEQ ID NO: 1129869 - protein, 9 aa, Homo Sapiens
YYLYDQQRM

SEQ ID NO: 1129870 - protein, 9 aa, Homo Sapiens
LKLCQAMQP

SEQ ID NO: 1129871 - protein, 9 aa, Homo Sapiens
LAGADLAKL

SEQ ID NO: 1129872 - protein, 9 aa, Homo Sapiens
LRILIHLHP

SEQ ID NO: 1129873 - protein, 9 aa, Homo Sapiens
GIRLYYTVK

SEQ ID NO: 1129874 - protein, 9 aa, Homo Sapiens
VDDFGFSIV

SEQ ID NO: 1129875 - protein, 9 aa, Homo Sapiens
RQRESECKA

SEQ ID NO: 1129876 - protein, 9 aa, Homo Sapiens
AGVRTHSVV

SEQ ID NO: 1129877 - protein, 9 aa, Homo Sapiens
STIERKFSP

SEQ ID NO: 1129878 - protein, 9 aa, Homo Sapiens
LKRPSLSEE

SEQ ID NO: 1129879 - protein, 9 aa, Homo Sapiens
RERMDYMKH

SEQ ID NO: 1129880 - protein, 9 aa, Homo Sapiens
TWWRTRACT

SEQ ID NO: 1129881 - protein, 9 aa, Homo Sapiens
NPFIRTVKS

SEQ ID NO: 1129882 - protein, 9 aa, Homo Sapiens
IFYDSISKE

SEQ ID NO: 1129883 - protein, 9 aa, Homo Sapiens
MNNVNVVYA

SEQ ID NO: 1129884 - protein, 9 aa, Homo Sapiens
ESELDVARL

SEQ ID NO: 1129885 - protein, 9 aa, Homo Sapiens
RIPRPNVCH

SEQ ID NO: 1129886 - protein, 9 aa, Homo Sapiens
GAGATCWCR

SEQ ID NO: 1129887 - protein, 9 aa, Homo Sapiens
SEEQIQKKK

SEQ ID NO: 1129888 - protein, 9 aa, Homo Sapiens
DDGKDGGMG

SEQ ID NO: 1129889 - protein, 9 aa, Homo Sapiens
ALISLVSYL

SEQ ID NO: 1129890 - protein, 9 aa, Homo Sapiens
LGARARTEQ

SEQ ID NO: 1129891 - protein, 9 aa, Homo Sapiens
RRRGQPPKA

SEQ ID NO: 1129892 - protein, 9 aa, Homo Sapiens
RAFGHTSTL

SEQ ID NO: 1129893 - protein, 9 aa, Homo Sapiens
AAGLPVTGS

SEQ ID NO: 1129894 - protein, 9 aa, Homo Sapiens
SCPRCPRPC

SEQ ID NO: 1129895 - protein, 9 aa, Homo Sapiens
LVFCGLNHV

SEQ ID NO: 1129896 - protein, 9 aa, Homo Sapiens
FWANVIKNP

SEQ ID NO: 1129897 - protein, 9 aa, Homo Sapiens
CGSRRRSVR

SEQ ID NO: 1129898 - protein, 9 aa, Homo Sapiens
IKYQQEVKI

SEQ ID NO: 1129899 - protein, 9 aa, Homo Sapiens
FGPGFVNVS

SEQ ID NO: 1129900 - protein, 9 aa, Homo Sapiens
PMERDLPPP

SEQ ID NO: 1129901 - protein, 9 aa, Homo Sapiens
NVPSSDQGL

SEQ ID NO: 1129902 - protein, 9 aa, Homo Sapiens
IIHWNARIY

SEQ ID NO: 1129903 - protein, 9 aa, Homo Sapiens
LLQQLHKNS

SEQ ID NO: 1129904 - protein, 9 aa, Homo Sapiens
HIIFGGTKV

SEQ ID NO: 1129905 - protein, 9 aa, Homo Sapiens
GECRKIFNG

SEQ ID NO: 1129906 - protein, 9 aa, Homo Sapiens
FRSPTPPYP

SEQ ID NO: 1129907 - protein, 9 aa, Homo Sapiens
QSLLSLYSV

SEQ ID NO: 1129908 - protein, 9 aa, Homo Sapiens
AKIYKPLHE

SEQ ID NO: 1129909 - protein, 9 aa, Homo Sapiens
HISTKEWAK

SEQ ID NO: 1129910 - protein, 9 aa, Homo Sapiens
GKPIYSWYG

SEQ ID NO: 1129911 - protein, 9 aa, Homo Sapiens
APAVLVVAA

SEQ ID NO: 1129912 - protein, 9 aa, Homo Sapiens
HAAPTTSTL

SEQ ID NO: 1129913 - protein, 9 aa, Homo Sapiens
VANTTMSLT

SEQ ID NO: 1129914 - protein, 9 aa, Homo Sapiens
IYRKDLLAR

SEQ ID NO: 1129915 - protein, 9 aa, Homo Sapiens
ELTSETVSM

SEQ ID NO: 1129916 - protein, 9 aa, Homo Sapiens
AHQLQHAEL

SEQ ID NO: 1129917 - protein, 9 aa, Homo Sapiens
PAPPAPSPW

SEQ ID NO: 1129918 - protein, 9 aa, Homo Sapiens
IFTEIGTTA

SEQ ID NO: 1129919 - protein, 9 aa, Homo Sapiens
RRRKSQLGS

SEQ ID NO: 1129920 - protein, 9 aa, Homo Sapiens
EDNKQIALR

SEQ ID NO: 1129921 - protein, 9 aa, Homo Sapiens
FLSEGVNKL

SEQ ID NO: 1129922 - protein, 9 aa, Homo Sapiens
ANEAMLLDT

SEQ ID NO: 1129923 - protein, 9 aa, Homo Sapiens
KPDRDNHVT

SEQ ID NO: 1129924 - protein, 9 aa, Homo Sapiens
RALEIWKLI

SEQ ID NO: 1129925 - protein, 9 aa, Homo Sapiens
LTIGLWLTT

SEQ ID NO: 1129926 - protein, 9 aa, Homo Sapiens
SDSGAHALN

SEQ ID NO: 1129927 - protein, 9 aa, Homo Sapiens
LSVDDAAIL

SEQ ID NO: 1129928 - protein, 9 aa, Homo Sapiens
TMNLADPVG

SEQ ID NO: 1129929 - protein, 9 aa, Homo Sapiens
TILYYYQSG

SEQ ID NO: 1129930 - protein, 9 aa, Homo Sapiens
EGPAFSLRN

SEQ ID NO: 1129931 - protein, 9 aa, Homo Sapiens
EEQIQKKKI

SEQ ID NO: 1129932 - protein, 9 aa, Homo Sapiens
KRFEVKRWN

SEQ ID NO: 1129933 - protein, 9 aa, Homo Sapiens
GTLEIHSVQ

SEQ ID NO: 1129934 - protein, 9 aa, Homo Sapiens
QALGSARGG

SEQ ID NO: 1129935 - protein, 9 aa, Homo Sapiens
SSGASTDAG

SEQ ID NO: 1129936 - protein, 9 aa, Homo Sapiens
LSKDPHFSK

SEQ ID NO: 1129937 - protein, 9 aa, Homo Sapiens
KSEIAVGPA

SEQ ID NO: 1129938 - protein, 9 aa, Homo Sapiens
DMDFYKARM

SEQ ID NO: 1129939 - protein, 9 aa, Homo Sapiens
ICLQVAVLI

SEQ ID NO: 1129940 - protein, 9 aa, Homo Sapiens
SLGNSKIVQ

SEQ ID NO: 1129941 - protein, 9 aa, Homo Sapiens
PASSHAPRS

SEQ ID NO: 1129942 - protein, 9 aa, Homo Sapiens
MPTTGMSVY

SEQ ID NO: 1129943 - protein, 9 aa, Homo Sapiens
TTQAEGQHK

SEQ ID NO: 1129944 - protein, 9 aa, Homo Sapiens
WSPVIAASP

SEQ ID NO: 1129945 - protein, 9 aa, Homo Sapiens
APTTSTLVF

SEQ ID NO: 1129946 - protein, 9 aa, Homo Sapiens
RFQYRILRS

SEQ ID NO: 1129947 - protein, 9 aa, Homo Sapiens
IPKFKIRKI

SEQ ID NO: 1129948 - protein, 9 aa, Homo Sapiens
LSPGLPGNL

SEQ ID NO: 1129949 - protein, 9 aa, Homo Sapiens
HFSRDVLLN

SEQ ID NO: 1129950 - protein, 9 aa, Homo Sapiens
TEVALQPLL

SEQ ID NO: 1129951 - protein, 9 aa, Homo Sapiens
QMRLGCRTF

SEQ ID NO: 1129952 - protein, 9 aa, Homo Sapiens
TYLLVTYHI

SEQ ID NO: 1129953 - protein, 9 aa, Homo Sapiens
RCNLHRCPP

SEQ ID NO: 1129954 - protein, 9 aa, Homo Sapiens
GHIWKLSDV

SEQ ID NO: 1129955 - protein, 9 aa, Homo Sapiens
HPEASGSGE

SEQ ID NO: 1129956 - protein, 9 aa, Homo Sapiens
SASLLPKED

SEQ ID NO: 1129957 - protein, 9 aa, Homo Sapiens
ATTAAAGGG

SEQ ID NO: 1129958 - protein, 9 aa, Homo Sapiens
SERLKHNPP

SEQ ID NO: 1129959 - protein, 9 aa, Homo Sapiens
LNALKKKKQ

SEQ ID NO: 1129960 - protein, 9 aa, Homo Sapiens
RLTGLTNIS

SEQ ID NO: 1129961 - protein, 9 aa, Homo Sapiens
LLAIAGNAS

SEQ ID NO: 1129962 - protein, 9 aa, Homo Sapiens
LERVDGEKG

SEQ ID NO: 1129963 - protein, 9 aa, Homo Sapiens
LPLPSRRAL

SEQ ID NO: 1129964 - protein, 9 aa, Homo Sapiens
RLRTKLEKA

SEQ ID NO: 1129965 - protein, 9 aa, Homo Sapiens
SLARDEGES

SEQ ID NO: 1129966 - protein, 9 aa, Homo Sapiens
RTGDGRIFA

SEQ ID NO: 1129967 - protein, 9 aa, Homo Sapiens
NVADKKLSR

SEQ ID NO: 1129968 - protein, 9 aa, Homo Sapiens
LKKYMLSQN

SEQ ID NO: 1129969 - protein, 9 aa, Homo Sapiens
KDKVGRLSA

SEQ ID NO: 1129970 - protein, 9 aa, Homo Sapiens
ESLTDTVRV

SEQ ID NO: 1129971 - protein, 9 aa, Homo Sapiens
KQRKIGDHG

SEQ ID NO: 1129972 - protein, 9 aa, Homo Sapiens
PLSYVPDAP

SEQ ID NO: 1129973 - protein, 9 aa, Homo Sapiens
TCTNYNTPL

SEQ ID NO: 1129974 - protein, 9 aa, Homo Sapiens
GKVFDATKG

SEQ ID NO: 1129975 - protein, 9 aa, Homo Sapiens
PYPEQFWEK

SEQ ID NO: 1129976 - protein, 9 aa, Homo Sapiens
IIKVQDNND

SEQ ID NO: 1129977 - protein, 9 aa, Homo Sapiens
RNSVLVIQK

SEQ ID NO: 1129978 - protein, 9 aa, Homo Sapiens
ERDWPQGDP

SEQ ID NO: 1129979 - protein, 9 aa, Homo Sapiens
SGLNLAPVT

SEQ ID NO: 1129980 - protein, 9 aa, Homo Sapiens
FRFPTYRGL

SEQ ID NO: 1129981 - protein, 9 aa, Homo Sapiens
GDRSEWGLV

SEQ ID NO: 1129982 - protein, 9 aa, Homo Sapiens
SDTAQIVAD

SEQ ID NO: 1129983 - protein, 9 aa, Homo Sapiens
CHMRKEGHE

SEQ ID NO: 1129984 - protein, 9 aa, Homo Sapiens
HVFCSFCID

SEQ ID NO: 1129985 - protein, 9 aa, Homo Sapiens
MFQGMRGGD

SEQ ID NO: 1129986 - protein, 9 aa, Homo Sapiens
VCGVLDLDR

SEQ ID NO: 1129987 - protein, 9 aa, Homo Sapiens
EDEFNDVQS

SEQ ID NO: 1129988 - protein, 9 aa, Homo Sapiens
KAMREQEER

SEQ ID NO: 1129989 - protein, 9 aa, Homo Sapiens
ARGTSIAFS

SEQ ID NO: 1129990 - protein, 9 aa, Homo Sapiens
RAEVTLIDF

SEQ ID NO: 1129991 - protein, 9 aa, Homo Sapiens
SSCGILTNG

SEQ ID NO: 1129992 - protein, 9 aa, Homo Sapiens
LDEGSILAP

SEQ ID NO: 1129993 - protein, 9 aa, Homo Sapiens
FDPDPPAGN

SEQ ID NO: 1129994 - protein, 9 aa, Homo Sapiens
SVLVIQKAV

SEQ ID NO: 1129995 - protein, 9 aa, Homo Sapiens
RVPHPTMTT

SEQ ID NO: 1129996 - protein, 9 aa, Homo Sapiens
AIRFRQDGD

SEQ ID NO: 1129997 - protein, 9 aa, Homo Sapiens
EFPCHRAAL

SEQ ID NO: 1129998 - protein, 9 aa, Homo Sapiens
VEHFSRHSP

SEQ ID NO: 1129999 - protein, 9 aa, Homo Sapiens
RHAAHTIQT

SEQ ID NO: 1130000 - protein, 9 aa, Homo Sapiens
SETVYEEMK

SEQ ID NO: 1130001 - protein, 9 aa, Homo Sapiens
RERRQQHKN

SEQ ID NO: 1130002 - protein, 9 aa, Homo Sapiens
CLKMNGDGT

SEQ ID NO: 1130003 - protein, 9 aa, Homo Sapiens
QQISLEGAL

SEQ ID NO: 1130004 - protein, 9 aa, Homo Sapiens
AIEVEIQPT

SEQ ID NO: 1130005 - protein, 9 aa, Homo Sapiens
PLIRSQSLH

SEQ ID NO: 1130006 - protein, 9 aa, Homo Sapiens
ALAVSSIKW

SEQ ID NO: 1130007 - protein, 9 aa, Homo Sapiens
SLHPSQQAE

SEQ ID NO: 1130008 - protein, 9 aa, Homo Sapiens
ALTPRPATG

SEQ ID NO: 1130009 - protein, 9 aa, Homo Sapiens
LTERGSTEG

SEQ ID NO: 1130010 - protein, 9 aa, Homo Sapiens
LCRGKMATQ

SEQ ID NO: 1130011 - protein, 9 aa, Homo Sapiens
VLRRILHRA

SEQ ID NO: 1130012 - protein, 9 aa, Homo Sapiens
YICGFSLSA

SEQ ID NO: 1130013 - protein, 9 aa, Homo Sapiens
FRQCANTFG

SEQ ID NO: 1130014 - protein, 9 aa, Homo Sapiens
PASPGPPCG

SEQ ID NO: 1130015 - protein, 9 aa, Homo Sapiens
VKRWNAVAL

SEQ ID NO: 1130016 - protein, 9 aa, Homo Sapiens
LTDIQIVQK

SEQ ID NO: 1130017 - protein, 9 aa, Homo Sapiens
AALWSGDKA

SEQ ID NO: 1130018 - protein, 9 aa, Homo Sapiens
AAGCSIQEP

SEQ ID NO: 1130019 - protein, 9 aa, Homo Sapiens
WCPWCRGVT

SEQ ID NO: 1130020 - protein, 9 aa, Homo Sapiens
FAVFDGHGC

SEQ ID NO: 1130021 - protein, 9 aa, Homo Sapiens
IKRSCSASV

SEQ ID NO: 1130022 - protein, 9 aa, Homo Sapiens
AGSSTLSQV

SEQ ID NO: 1130023 - protein, 9 aa, Homo Sapiens
IIVERMYLR

SEQ ID NO: 1130024 - protein, 9 aa, Homo Sapiens
HSPSPLSMK

SEQ ID NO: 1130025 - protein, 9 aa, Homo Sapiens
PTEPLGVEL

SEQ ID NO: 1130026 - protein, 9 aa, Homo Sapiens
LPAWYALHG

SEQ ID NO: 1130027 - protein, 9 aa, Homo Sapiens
TGPTACPVK

SEQ ID NO: 1130028 - protein, 9 aa, Homo Sapiens
WYNDSVEHR

SEQ ID NO: 1130029 - protein, 9 aa, Homo Sapiens
CGPTSGSTP

SEQ ID NO: 1130030 - protein, 9 aa, Homo Sapiens
VTCMDEAGR

SEQ ID NO: 1130031 - protein, 9 aa, Homo Sapiens
LFGRGAARD

SEQ ID NO: 1130032 - protein, 9 aa, Homo Sapiens
EWTMASPLP

SEQ ID NO: 1130033 - protein, 9 aa, Homo Sapiens
STASAATSR

SEQ ID NO: 1130034 - protein, 9 aa, Homo Sapiens
NAPPNTMAE

SEQ ID NO: 1130035 - protein, 9 aa, Homo Sapiens
CRHIDGAYI

SEQ ID NO: 1130036 - protein, 9 aa, Homo Sapiens
CDSKELQQR

SEQ ID NO: 1130037 - protein, 9 aa, Homo Sapiens
KKLTHMCLA

SEQ ID NO: 1130038 - protein, 9 aa, Homo Sapiens
ILALCFAMF

SEQ ID NO: 1130039 - protein, 9 aa, Homo Sapiens
LYDQQRMEI

SEQ ID NO: 1130040 - protein, 9 aa, Homo Sapiens
TCKLRKEQL

SEQ ID NO: 1130041 - protein, 9 aa, Homo Sapiens
RLQEELKRV

SEQ ID NO: 1130042 - protein, 9 aa, Homo Sapiens
AGENELPSK

SEQ ID NO: 1130043 - protein, 9 aa, Homo Sapiens
VLLGCWDQA

SEQ ID NO: 1130044 - protein, 9 aa, Homo Sapiens
SLQNYTLSA

SEQ ID NO: 1130045 - protein, 9 aa, Homo Sapiens
MSHLALPSL

SEQ ID NO: 1130046 - protein, 9 aa, Homo Sapiens
APVLLASVL

SEQ ID NO: 1130047 - protein, 9 aa, Homo Sapiens
FNDNAWHNV

SEQ ID NO: 1130048 - protein, 9 aa, Homo Sapiens
FCGTCNHLR

SEQ ID NO: 1130049 - protein, 9 aa, Homo Sapiens
ERGSTEGGS

SEQ ID NO: 1130050 - protein, 9 aa, Homo Sapiens
QKRQRGSLA

SEQ ID NO: 1130051 - protein, 9 aa, Homo Sapiens
LHVVKRKPP

SEQ ID NO: 1130052 - protein, 9 aa, Homo Sapiens
SGSPHPQLQ

SEQ ID NO: 1130053 - protein, 9 aa, Homo Sapiens
EGEGASEEE

SEQ ID NO: 1130054 - protein, 9 aa, Homo Sapiens
FHYHYGWSF

SEQ ID NO: 1130055 - protein, 9 aa, Homo Sapiens
SPLLFTGLL

SEQ ID NO: 1130056 - protein, 9 aa, Homo Sapiens
EEKSCLSIS

SEQ ID NO: 1130057 - protein, 9 aa, Homo Sapiens
SMIRFQYRI

SEQ ID NO: 1130058 - protein, 9 aa, Homo Sapiens
RYEYLSHMG

SEQ ID NO: 1130059 - protein, 9 aa, Homo Sapiens
DNLVVVEGV

SEQ ID NO: 1130060 - protein, 9 aa, Homo Sapiens
GSCLKMNGD

SEQ ID NO: 1130061 - protein, 9 aa, Homo Sapiens
QNKAGGPLP

SEQ ID NO: 1130062 - protein, 9 aa, Homo Sapiens
SLVVAAIPE

SEQ ID NO: 1130063 - protein, 9 aa, Homo Sapiens
GNEVGHSIR

SEQ ID NO: 1130064 - protein, 9 aa, Homo Sapiens
RPPPAWGPS

SEQ ID NO: 1130065 - protein, 9 aa, Homo Sapiens
LVSDGDYLN

SEQ ID NO: 1130066 - protein, 9 aa, Homo Sapiens
TLFTRFACF

SEQ ID NO: 1130067 - protein, 9 aa, Homo Sapiens
TVYKPEVVT

SEQ ID NO: 1130068 - protein, 9 aa, Homo Sapiens
PPPLPSLRT

SEQ ID NO: 1130069 - protein, 9 aa, Homo Sapiens
IYRTMLQKR

SEQ ID NO: 1130070 - protein, 9 aa, Homo Sapiens
MSEHKKQSQ

SEQ ID NO: 1130071 - protein, 9 aa, Homo Sapiens
SINTTISDA

SEQ ID NO: 1130072 - protein, 9 aa, Homo Sapiens
ASSTSGPVG

SEQ ID NO: 1130073 - protein, 9 aa, Homo Sapiens
NVLLIVHYS

SEQ ID NO: 1130074 - protein, 9 aa, Homo Sapiens
PAYVASRPF

SEQ ID NO: 1130075 - protein, 9 aa, Homo Sapiens
CIFSSPPSV

SEQ ID NO: 1130076 - protein, 9 aa, Homo Sapiens
EEEQRKALY

SEQ ID NO: 1130077 - protein, 9 aa, Homo Sapiens
VFSFIWPLS

SEQ ID NO: 1130078 - protein, 9 aa, Homo Sapiens
STVIRTLDT

SEQ ID NO: 1130079 - protein, 9 aa, Homo Sapiens
GEVEKRKHT

SEQ ID NO: 1130080 - protein, 9 aa, Homo Sapiens
GVIINGLSV

SEQ ID NO: 1130081 - protein, 9 aa, Homo Sapiens
FSATMSNQQ

SEQ ID NO: 1130082 - protein, 9 aa, Homo Sapiens
NIRLVYSNG

SEQ ID NO: 1130083 - protein, 9 aa, Homo Sapiens
TIGGNTPVI

SEQ ID NO: 1130084 - protein, 9 aa, Homo Sapiens
SMRSPTEDK

SEQ ID NO: 1130085 - protein, 9 aa, Homo Sapiens
KSIVGHSPL

SEQ ID NO: 1130086 - protein, 9 aa, Homo Sapiens
RNLRTLKQT

SEQ ID NO: 1130087 - protein, 9 aa, Homo Sapiens
SHGGLRLSR

SEQ ID NO: 1130088 - protein, 9 aa, Homo Sapiens
APSSCWPVL

SEQ ID NO: 1130089 - protein, 9 aa, Homo Sapiens
LSRSPASSA

SEQ ID NO: 1130090 - protein, 9 aa, Homo Sapiens
TLPAAPNMN

SEQ ID NO: 1130091 - protein, 9 aa, Homo Sapiens
KKGRLTGLT

SEQ ID NO: 1130092 - protein, 9 aa, Homo Sapiens
KWKGWPQKY

SEQ ID NO: 1130093 - protein, 9 aa, Homo Sapiens
PPPADPAPS

SEQ ID NO: 1130094 - protein, 9 aa, Homo Sapiens
RAAGGARGR

SEQ ID NO: 1130095 - protein, 9 aa, Homo Sapiens
PSHKDAVLG

SEQ ID NO: 1130096 - protein, 9 aa, Homo Sapiens
PRPLAQSPP

SEQ ID NO: 1130097 - protein, 9 aa, Homo Sapiens
GKKKFSCPI

SEQ ID NO: 1130098 - protein, 9 aa, Homo Sapiens
PELVLVRFV

SEQ ID NO: 1130099 - protein, 9 aa, Homo Sapiens
QGRVHAVYR

SEQ ID NO: 1130100 - protein, 9 aa, Homo Sapiens
ERAKLEYME

SEQ ID NO: 1130101 - protein, 9 aa, Homo Sapiens
VWSNVLRGM

SEQ ID NO: 1130102 - protein, 9 aa, Homo Sapiens
DLTRPSGLL

SEQ ID NO: 1130103 - protein, 9 aa, Homo Sapiens
ERCQHYSVS

SEQ ID NO: 1130104 - protein, 9 aa, Homo Sapiens
QQEVPQCLI

SEQ ID NO: 1130105 - protein, 9 aa, Homo Sapiens
SHLGQPRQL

SEQ ID NO: 1130106 - protein, 9 aa, Homo Sapiens
EGGERGQMA

SEQ ID NO: 1130107 - protein, 9 aa, Homo Sapiens
RLLPLTRPR

SEQ ID NO: 1130108 - protein, 9 aa, Homo Sapiens
EVFVMGLKK

SEQ ID NO: 1130109 - protein, 9 aa, Homo Sapiens
IIATNVEKH

SEQ ID NO: 1130110 - protein, 9 aa, Homo Sapiens
SCLRTGQTR

SEQ ID NO: 1130111 - protein, 9 aa, Homo Sapiens
ENLVVEYRA

SEQ ID NO: 1130112 - protein, 9 aa, Homo Sapiens
KYVFDRANM

SEQ ID NO: 1130113 - protein, 9 aa, Homo Sapiens
VLITEHSDL

SEQ ID NO: 1130114 - protein, 9 aa, Homo Sapiens
RRRCGSRRR

SEQ ID NO: 1130115 - protein, 9 aa, Homo Sapiens
NFLSEGVNK

SEQ ID NO: 1130116 - protein, 9 aa, Homo Sapiens
ADDDKKGCC

SEQ ID NO: 1130117 - protein, 9 aa, Homo Sapiens
AQTPDMSFF

SEQ ID NO: 1130118 - protein, 9 aa, Homo Sapiens
TEGSKFPAH

SEQ ID NO: 1130119 - protein, 9 aa, Homo Sapiens
TLLAAAAAA

SEQ ID NO: 1130120 - protein, 9 aa, Homo Sapiens
RWERFVHNE

SEQ ID NO: 1130121 - protein, 9 aa, Homo Sapiens
VPPPPPIPQ

SEQ ID NO: 1130122 - protein, 9 aa, Homo Sapiens
SQSLHVVKR

SEQ ID NO: 1130123 - protein, 9 aa, Homo Sapiens
NVPPLHWKE

SEQ ID NO: 1130124 - protein, 9 aa, Homo Sapiens
KRTQQRPPW

SEQ ID NO: 1130125 - protein, 9 aa, Homo Sapiens
AIFARRAIS

SEQ ID NO: 1130126 - protein, 9 aa, Homo Sapiens
PIEAPPPST

SEQ ID NO: 1130127 - protein, 9 aa, Homo Sapiens
LNNLSSPDS

SEQ ID NO: 1130128 - protein, 9 aa, Homo Sapiens
NLICQERDI

SEQ ID NO: 1130129 - protein, 9 aa, Homo Sapiens
LKAHQPESY

SEQ ID NO: 1130130 - protein, 9 aa, Homo Sapiens
CPKRPEQLP

SEQ ID NO: 1130131 - protein, 9 aa, Homo Sapiens
PGPKEAISA

SEQ ID NO: 1130132 - protein, 9 aa, Homo Sapiens
IGVVILPLL

SEQ ID NO: 1130133 - protein, 9 aa, Homo Sapiens
KEGSFQRRG

SEQ ID NO: 1130134 - protein, 9 aa, Homo Sapiens
LDDGGLERK

SEQ ID NO: 1130135 - protein, 9 aa, Homo Sapiens
RSLSKKERK

SEQ ID NO: 1130136 - protein, 9 aa, Homo Sapiens
LYCRSGRNS

SEQ ID NO: 1130137 - protein, 9 aa, Homo Sapiens
YWPLLESAH

SEQ ID NO: 1130138 - protein, 9 aa, Homo Sapiens
TAKILENER

SEQ ID NO: 1130139 - protein, 9 aa, Homo Sapiens
KRWHRWQGH

SEQ ID NO: 1130140 - protein, 9 aa, Homo Sapiens
APPAPSPWL

SEQ ID NO: 1130141 - protein, 9 aa, Homo Sapiens
WHLTIMMDI

SEQ ID NO: 1130142 - protein, 9 aa, Homo Sapiens
PALPTQQLA

SEQ ID NO: 1130143 - protein, 9 aa, Homo Sapiens
CACFKLGGP

SEQ ID NO: 1130144 - protein, 9 aa, Homo Sapiens
SPFLWPGVK

SEQ ID NO: 1130145 - protein, 9 aa, Homo Sapiens
HFKWFEHSA

SEQ ID NO: 1130146 - protein, 9 aa, Homo Sapiens
FYDSRQSVM

SEQ ID NO: 1130147 - protein, 9 aa, Homo Sapiens
PTDGKRAIV

SEQ ID NO: 1130148 - protein, 9 aa, Homo Sapiens
SELRSFKFP

SEQ ID NO: 1130149 - protein, 9 aa, Homo Sapiens
CASRRPLRR

SEQ ID NO: 1130150 - protein, 9 aa, Homo Sapiens
ASPVPSGMN

SEQ ID NO: 1130151 - protein, 9 aa, Homo Sapiens
AEAYTTKGL

SEQ ID NO: 1130152 - protein, 9 aa, Homo Sapiens
RTEMKESKG

SEQ ID NO: 1130153 - protein, 9 aa, Homo Sapiens
APVSLERSP

SEQ ID NO: 1130154 - protein, 9 aa, Homo Sapiens
YVSYTESEQ

SEQ ID NO: 1130155 - protein, 9 aa, Homo Sapiens
EGEADLRGE

SEQ ID NO: 1130156 - protein, 9 aa, Homo Sapiens
DTVRVLSSM

SEQ ID NO: 1130157 - protein, 9 aa, Homo Sapiens
LAAAHMSEQ

SEQ ID NO: 1130158 - protein, 9 aa, Homo Sapiens
LDDGMDSNQ

SEQ ID NO: 1130159 - protein, 9 aa, Homo Sapiens
VCLSKKFIA

SEQ ID NO: 1130160 - protein, 9 aa, Homo Sapiens
IMNEENVNR

SEQ ID NO: 1130161 - protein, 9 aa, Homo Sapiens
PPAVGGREP

SEQ ID NO: 1130162 - protein, 9 aa, Homo Sapiens
HFSEDVYTL

SEQ ID NO: 1130163 - protein, 9 aa, Homo Sapiens
PACTCISMT

SEQ ID NO: 1130164 - protein, 9 aa, Homo Sapiens
WRITSCAML

SEQ ID NO: 1130165 - protein, 9 aa, Homo Sapiens
CWKTITDYV

SEQ ID NO: 1130166 - protein, 9 aa, Homo Sapiens
THPLCPPPS

SEQ ID NO: 1130167 - protein, 9 aa, Homo Sapiens
FSRSRACWE

SEQ ID NO: 1130168 - protein, 9 aa, Homo Sapiens
RISVLVPGF

SEQ ID NO: 1130169 - protein, 9 aa, Homo Sapiens
SLAGWLTQM

SEQ ID NO: 1130170 - protein, 9 aa, Homo Sapiens
RSPTWCRTG

SEQ ID NO: 1130171 - protein, 9 aa, Homo Sapiens
KIRDIPSYT

SEQ ID NO: 1130172 - protein, 9 aa, Homo Sapiens
VRASFTYLS

SEQ ID NO: 1130173 - protein, 9 aa, Homo Sapiens
TCGASIRRT

SEQ ID NO: 1130174 - protein, 9 aa, Homo Sapiens
YTCTLSTEA

SEQ ID NO: 1130175 - protein, 9 aa, Homo Sapiens
ILTTKNLLS

SEQ ID NO: 1130176 - protein, 9 aa, Homo Sapiens
VTLTRGASS

SEQ ID NO: 1130177 - protein, 9 aa, Homo Sapiens
LTQMSAGNV

SEQ ID NO: 1130178 - protein, 9 aa, Homo Sapiens
IRSTRSGGL

SEQ ID NO: 1130179 - protein, 9 aa, Homo Sapiens
KFPSLSRSP

SEQ ID NO: 1130180 - protein, 9 aa, Homo Sapiens
YNATVLTYG

SEQ ID NO: 1130181 - protein, 9 aa, Homo Sapiens
TVSMKKTIF

SEQ ID NO: 1130182 - protein, 9 aa, Homo Sapiens
PPLPSERLA

SEQ ID NO: 1130183 - protein, 9 aa, Homo Sapiens
ERLPYQEAD

SEQ ID NO: 1130184 - protein, 9 aa, Homo Sapiens
RIEATKKLK

SEQ ID NO: 1130185 - protein, 9 aa, Homo Sapiens
SEQQQQRRE

SEQ ID NO: 1130186 - protein, 9 aa, Homo Sapiens
CTADILHAG

SEQ ID NO: 1130187 - protein, 9 aa, Homo Sapiens
YSSKALKPQ

SEQ ID NO: 1130188 - protein, 9 aa, Homo Sapiens
REVEHFSRH

SEQ ID NO: 1130189 - protein, 9 aa, Homo Sapiens
NAKEEATKK

SEQ ID NO: 1130190 - protein, 9 aa, Homo Sapiens
ITWGQSLDN

SEQ ID NO: 1130191 - protein, 9 aa, Homo Sapiens
PSKPIQFDP

SEQ ID NO: 1130192 - protein, 9 aa, Homo Sapiens
GQEVYCHMR

SEQ ID NO: 1130193 - protein, 9 aa, Homo Sapiens
FFCEERGVH

SEQ ID NO: 1130194 - protein, 9 aa, Homo Sapiens
PRHPWPPQA

SEQ ID NO: 1130195 - protein, 9 aa, Homo Sapiens
WSVGRPHLG

SEQ ID NO: 1130196 - protein, 9 aa, Homo Sapiens
NSTIERKFS

SEQ ID NO: 1130197 - protein, 9 aa, Homo Sapiens
RSAPVPVAT

SEQ ID NO: 1130198 - protein, 9 aa, Homo Sapiens
DKKKKGKKI

SEQ ID NO: 1130199 - protein, 9 aa, Homo Sapiens
SASESPGPS

SEQ ID NO: 1130200 - protein, 9 aa, Homo Sapiens
IREFDNMVK

SEQ ID NO: 1130201 - protein, 9 aa, Homo Sapiens
IPDVAALSV

SEQ ID NO: 1130202 - protein, 9 aa, Homo Sapiens
GPKKNQLLP

SEQ ID NO: 1130203 - protein, 9 aa, Homo Sapiens
DPPRPTSGA

SEQ ID NO: 1130204 - protein, 9 aa, Homo Sapiens
GHHRDLRSA

SEQ ID NO: 1130205 - protein, 9 aa, Homo Sapiens
NQNAAPATR

SEQ ID NO: 1130206 - protein, 9 aa, Homo Sapiens
DPVKKAICT

SEQ ID NO: 1130207 - protein, 9 aa, Homo Sapiens
RPFLKLCQA

SEQ ID NO: 1130208 - protein, 9 aa, Homo Sapiens
LHQPEMAAM

SEQ ID NO: 1130209 - protein, 9 aa, Homo Sapiens
PRLPQDVGT

SEQ ID NO: 1130210 - protein, 9 aa, Homo Sapiens
EEFCELCTE

SEQ ID NO: 1130211 - protein, 9 aa, Homo Sapiens
VKDSSSEKR

SEQ ID NO: 1130212 - protein, 9 aa, Homo Sapiens
AQTPTLVPD

SEQ ID NO: 1130213 - protein, 9 aa, Homo Sapiens
QWLSCPSSS

SEQ ID NO: 1130214 - protein, 9 aa, Homo Sapiens
LVSRPPSLH

SEQ ID NO: 1130215 - protein, 9 aa, Homo Sapiens
SGKGRGDVA

SEQ ID NO: 1130216 - protein, 9 aa, Homo Sapiens
RMYSIMDEL

SEQ ID NO: 1130217 - protein, 9 aa, Homo Sapiens
IIRHISAPE

SEQ ID NO: 1130218 - protein, 9 aa, Homo Sapiens
LVQGPILHV

SEQ ID NO: 1130219 - protein, 9 aa, Homo Sapiens
CPTRKEEEA

SEQ ID NO: 1130220 - protein, 9 aa, Homo Sapiens
AMFGFLLMT

SEQ ID NO: 1130221 - protein, 9 aa, Homo Sapiens
GGEGDGTGP

SEQ ID NO: 1130222 - protein, 9 aa, Homo Sapiens
EIAVGPARI

SEQ ID NO: 1130223 - protein, 9 aa, Homo Sapiens
SIRAPRGLG

SEQ ID NO: 1130224 - protein, 9 aa, Homo Sapiens
LSLPTRPRL

SEQ ID NO: 1130225 - protein, 9 aa, Homo Sapiens
SPGLYVFLN

SEQ ID NO: 1130226 - protein, 9 aa, Homo Sapiens
EGVSTTAAG

SEQ ID NO: 1130227 - protein, 9 aa, Homo Sapiens
VTAFSNMDN

SEQ ID NO: 1130228 - protein, 9 aa, Homo Sapiens
GENELPSKW

SEQ ID NO: 1130229 - protein, 9 aa, Homo Sapiens
QPNVLCYTS

SEQ ID NO: 1130230 - protein, 9 aa, Homo Sapiens
DAELATVQS

SEQ ID NO: 1130231 - protein, 9 aa, Homo Sapiens
LPGVSTTSS

SEQ ID NO: 1130232 - protein, 9 aa, Homo Sapiens
FKDVGSKDK

SEQ ID NO: 1130233 - protein, 9 aa, Homo Sapiens
HLRQELQRV

SEQ ID NO: 1130234 - protein, 9 aa, Homo Sapiens
EQQVTVATA

SEQ ID NO: 1130235 - protein, 9 aa, Homo Sapiens
QGGLWHVQR

SEQ ID NO: 1130236 - protein, 9 aa, Homo Sapiens
DIDSQVDGS

SEQ ID NO: 1130237 - protein, 9 aa, Homo Sapiens
GSQGCGCGR

SEQ ID NO: 1130238 - protein, 9 aa, Homo Sapiens
VTLETEGSK

SEQ ID NO: 1130239 - protein, 9 aa, Homo Sapiens
CDLAREVAD

SEQ ID NO: 1130240 - protein, 9 aa, Homo Sapiens
LKRNNMSAP

SEQ ID NO: 1130241 - protein, 9 aa, Homo Sapiens
SSVAGRTTQ

SEQ ID NO: 1130242 - protein, 9 aa, Homo Sapiens
GTADDRLLC

SEQ ID NO: 1130243 - protein, 9 aa, Homo Sapiens
PSAAALDSG

SEQ ID NO: 1130244 - protein, 9 aa, Homo Sapiens
IGELSGDNY

SEQ ID NO: 1130245 - protein, 9 aa, Homo Sapiens
WRSPTASSC

SEQ ID NO: 1130246 - protein, 9 aa, Homo Sapiens
REEFITAVK

SEQ ID NO: 1130247 - protein, 9 aa, Homo Sapiens
LRRPCTAST

SEQ ID NO: 1130248 - protein, 9 aa, Homo Sapiens
HSDKNDGGQ

SEQ ID NO: 1130249 - protein, 9 aa, Homo Sapiens
LPDGGITAI

SEQ ID NO: 1130250 - protein, 9 aa, Homo Sapiens
GRAFISPSI

SEQ ID NO: 1130251 - protein, 9 aa, Homo Sapiens
EKNNYRKTA

SEQ ID NO: 1130252 - protein, 9 aa, Homo Sapiens
EVIHTDLQS

SEQ ID NO: 1130253 - protein, 9 aa, Homo Sapiens
LLPRLVCCP

SEQ ID NO: 1130254 - protein, 9 aa, Homo Sapiens
VEADDAMCR

SEQ ID NO: 1130255 - protein, 9 aa, Homo Sapiens
EHDQGHGHQ

SEQ ID NO: 1130256 - protein, 9 aa, Homo Sapiens
LATGASGPV

SEQ ID NO: 1130257 - protein, 9 aa, Homo Sapiens
TRCVWQQPS

SEQ ID NO: 1130258 - protein, 9 aa, Homo Sapiens
MSSAPRCPA

SEQ ID NO: 1130259 - protein, 9 aa, Homo Sapiens
DSLKIVQMS

SEQ ID NO: 1130260 - protein, 9 aa, Homo Sapiens
KAANVKPPR

SEQ ID NO: 1130261 - protein, 9 aa, Homo Sapiens
KLGGPRLEC

SEQ ID NO: 1130262 - protein, 9 aa, Homo Sapiens
SAGPLGLLL

SEQ ID NO: 1130263 - protein, 9 aa, Homo Sapiens
LKHPLFPKD

SEQ ID NO: 1130264 - protein, 9 aa, Homo Sapiens
WSRSRTKSK

SEQ ID NO: 1130265 - protein, 9 aa, Homo Sapiens
QEDGLPTGY

SEQ ID NO: 1130266 - protein, 9 aa, Homo Sapiens
EAVWAKNMA

SEQ ID NO: 1130267 - protein, 9 aa, Homo Sapiens
TTVTYNSNI

SEQ ID NO: 1130268 - protein, 9 aa, Homo Sapiens
WSHWTPYTF

SEQ ID NO: 1130269 - protein, 9 aa, Homo Sapiens
HIRGNMGIR

SEQ ID NO: 1130270 - protein, 9 aa, Homo Sapiens
VQPALTPRP

SEQ ID NO: 1130271 - protein, 9 aa, Homo Sapiens
SSCLKDIEI

SEQ ID NO: 1130272 - protein, 9 aa, Homo Sapiens
LQSPPERDW

SEQ ID NO: 1130273 - protein, 9 aa, Homo Sapiens
REEMKWSRK

SEQ ID NO: 1130274 - protein, 9 aa, Homo Sapiens
SRLSLLAPK

SEQ ID NO: 1130275 - protein, 9 aa, Homo Sapiens
EEQKKNRKK

SEQ ID NO: 1130276 - protein, 9 aa, Homo Sapiens
TDKSQEGFQ

SEQ ID NO: 1130277 - protein, 9 aa, Homo Sapiens
WWFWSLCCT

SEQ ID NO: 1130278 - protein, 9 aa, Homo Sapiens
ARGGENLIP

SEQ ID NO: 1130279 - protein, 9 aa, Homo Sapiens
FDRANMHNL

SEQ ID NO: 1130280 - protein, 9 aa, Homo Sapiens
QWDVDDNED

SEQ ID NO: 1130281 - protein, 9 aa, Homo Sapiens
RERPDVGRH

SEQ ID NO: 1130282 - protein, 9 aa, Homo Sapiens
FVTRFGGIG

SEQ ID NO: 1130283 - protein, 9 aa, Homo Sapiens
RMGGRHPSW

SEQ ID NO: 1130284 - protein, 9 aa, Homo Sapiens
ANMMVDGKP

SEQ ID NO: 1130285 - protein, 9 aa, Homo Sapiens
AGDWKITFT

SEQ ID NO: 1130286 - protein, 9 aa, Homo Sapiens
YSALIVGHP

SEQ ID NO: 1130287 - protein, 9 aa, Homo Sapiens
TREYVMCRT

SEQ ID NO: 1130288 - protein, 9 aa, Homo Sapiens
AGRNITWAL

SEQ ID NO: 1130289 - protein, 9 aa, Homo Sapiens
ATFYRLADL

SEQ ID NO: 1130290 - protein, 9 aa, Homo Sapiens
LPSSTYAPP

SEQ ID NO: 1130291 - protein, 9 aa, Homo Sapiens
LEEEERRAV

SEQ ID NO: 1130292 - protein, 9 aa, Homo Sapiens
CTCRACRTS

SEQ ID NO: 1130293 - protein, 9 aa, Homo Sapiens
GRMGGRHPS

SEQ ID NO: 1130294 - protein, 9 aa, Homo Sapiens
VDAKVEIIR

SEQ ID NO: 1130295 - protein, 9 aa, Homo Sapiens
HGLRASLLD

SEQ ID NO: 1130296 - protein, 9 aa, Homo Sapiens
ELNRTVQRR

SEQ ID NO: 1130297 - protein, 9 aa, Homo Sapiens
VYPSVGIDA

SEQ ID NO: 1130298 - protein, 9 aa, Homo Sapiens
ATRHGPYPA

SEQ ID NO: 1130299 - protein, 9 aa, Homo Sapiens
HPSSVSGAR

SEQ ID NO: 1130300 - protein, 9 aa, Homo Sapiens
NDSVEHRDN

SEQ ID NO: 1130301 - protein, 9 aa, Homo Sapiens
SKQKDKVSI

SEQ ID NO: 1130302 - protein, 9 aa, Homo Sapiens
SAKKGGNHI

SEQ ID NO: 1130303 - protein, 9 aa, Homo Sapiens
HRSYVRTRG

SEQ ID NO: 1130304 - protein, 9 aa, Homo Sapiens
IASTTHTSS

SEQ ID NO: 1130305 - protein, 9 aa, Homo Sapiens
AWAPAPPTR

SEQ ID NO: 1130306 - protein, 9 aa, Homo Sapiens
QTFGKKWHR

SEQ ID NO: 1130307 - protein, 9 aa, Homo Sapiens
NREKRKQNP

SEQ ID NO: 1130308 - protein, 9 aa, Homo Sapiens
LDPQLRLPR

SEQ ID NO: 1130309 - protein, 9 aa, Homo Sapiens
SNKKAKRVA

SEQ ID NO: 1130310 - protein, 9 aa, Homo Sapiens
TARDAGVPT

SEQ ID NO: 1130311 - protein, 9 aa, Homo Sapiens
SLRNKDVNE

SEQ ID NO: 1130312 - protein, 9 aa, Homo Sapiens
VSKPEKVQA

SEQ ID NO: 1130313 - protein, 9 aa, Homo Sapiens
PDVGGGDRV

SEQ ID NO: 1130314 - protein, 9 aa, Homo Sapiens
RRKKKRRRK

SEQ ID NO: 1130315 - protein, 9 aa, Homo Sapiens
EVKTLHVQA

SEQ ID NO: 1130316 - protein, 9 aa, Homo Sapiens
AFHGPYGNF

SEQ ID NO: 1130317 - protein, 9 aa, Homo Sapiens
RSSTKGCNR

SEQ ID NO: 1130318 - protein, 9 aa, Homo Sapiens
KTWAPAAPS

SEQ ID NO: 1130319 - protein, 9 aa, Homo Sapiens
DDEDDGANH

SEQ ID NO: 1130320 - protein, 9 aa, Homo Sapiens
GHSIRFEDC

SEQ ID NO: 1130321 - protein, 9 aa, Homo Sapiens
APDCRFINI

SEQ ID NO: 1130322 - protein, 9 aa, Homo Sapiens
RRTGASTPA

SEQ ID NO: 1130323 - protein, 9 aa, Homo Sapiens
GNEAWKEAE

SEQ ID NO: 1130324 - protein, 9 aa, Homo Sapiens
GVRTHSVVC

SEQ ID NO: 1130325 - protein, 9 aa, Homo Sapiens
VPGKVHKYI

SEQ ID NO: 1130326 - protein, 9 aa, Homo Sapiens
VHQLVDHAG

SEQ ID NO: 1130327 - protein, 9 aa, Homo Sapiens
KHITKSGTR

SEQ ID NO: 1130328 - protein, 9 aa, Homo Sapiens
DNTFEMHDD

SEQ ID NO: 1130329 - protein, 9 aa, Homo Sapiens
RYHGCRAEG

SEQ ID NO: 1130330 - protein, 9 aa, Homo Sapiens
QKVSVKSLP

SEQ ID NO: 1130331 - protein, 9 aa, Homo Sapiens
RRGQGAVWK

SEQ ID NO: 1130332 - protein, 9 aa, Homo Sapiens
RSQSLHVVK

SEQ ID NO: 1130333 - protein, 9 aa, Homo Sapiens
QINECKRRL

SEQ ID NO: 1130334 - protein, 9 aa, Homo Sapiens
RSPRRPRPR

SEQ ID NO: 1130335 - protein, 9 aa, Homo Sapiens
ENSHPPTTT

SEQ ID NO: 1130336 - protein, 9 aa, Homo Sapiens
KSLTDCFLK

SEQ ID NO: 1130337 - protein, 9 aa, Homo Sapiens
VGFDKDLDR

SEQ ID NO: 1130338 - protein, 9 aa, Homo Sapiens
QFSTSLWVV

SEQ ID NO: 1130339 - protein, 9 aa, Homo Sapiens
GPHSYPVIP

SEQ ID NO: 1130340 - protein, 9 aa, Homo Sapiens
ASVALLEVS

SEQ ID NO: 1130341 - protein, 9 aa, Homo Sapiens
SQNDTYDVP

SEQ ID NO: 1130342 - protein, 9 aa, Homo Sapiens
IILTADRSG

SEQ ID NO: 1130343 - protein, 9 aa, Homo Sapiens
VELSRCHPI

SEQ ID NO: 1130344 - protein, 9 aa, Homo Sapiens
LWSIPEEFF

SEQ ID NO: 1130345 - protein, 9 aa, Homo Sapiens
FDDLFKDLG

SEQ ID NO: 1130346 - protein, 9 aa, Homo Sapiens
ARKTGPFCV

SEQ ID NO: 1130347 - protein, 9 aa, Homo Sapiens
FGLCRALWE

SEQ ID NO: 1130348 - protein, 9 aa, Homo Sapiens
PRPWRRTGR

SEQ ID NO: 1130349 - protein, 9 aa, Homo Sapiens
IHRQLLSKK

SEQ ID NO: 1130350 - protein, 9 aa, Homo Sapiens
FFMNLTREP

SEQ ID NO: 1130351 - protein, 9 aa, Homo Sapiens
PIIFVMGLL

SEQ ID NO: 1130352 - protein, 9 aa, Homo Sapiens
VPKRMKGPA

SEQ ID NO: 1130353 - protein, 9 aa, Homo Sapiens
PLLTSTIEF

SEQ ID NO: 1130354 - protein, 9 aa, Homo Sapiens
NATYTQLYT

SEQ ID NO: 1130355 - protein, 9 aa, Homo Sapiens
KPPGRGRKH

SEQ ID NO: 1130356 - protein, 9 aa, Homo Sapiens
LFIIVRASF

SEQ ID NO: 1130357 - protein, 9 aa, Homo Sapiens
CMTSHVRGG

SEQ ID NO: 1130358 - protein, 9 aa, Homo Sapiens
LNLINYYEG

SEQ ID NO: 1130359 - protein, 9 aa, Homo Sapiens
HADTIRSGR

SEQ ID NO: 1130360 - protein, 9 aa, Homo Sapiens
ERGILRPPS

SEQ ID NO: 1130361 - protein, 9 aa, Homo Sapiens
MPLLTSTIE

SEQ ID NO: 1130362 - protein, 9 aa, Homo Sapiens
PGVTRAVAH

SEQ ID NO: 1130363 - protein, 9 aa, Homo Sapiens
TPQNGIVVA

SEQ ID NO: 1130364 - protein, 9 aa, Homo Sapiens
RWERTTFTR

SEQ ID NO: 1130365 - protein, 9 aa, Homo Sapiens
FRDVPSHSN

SEQ ID NO: 1130366 - protein, 9 aa, Homo Sapiens
TEGGEAQEN

SEQ ID NO: 1130367 - protein, 9 aa, Homo Sapiens
QGPILHVLS

SEQ ID NO: 1130368 - protein, 9 aa, Homo Sapiens
KLQEAYCQH

SEQ ID NO: 1130369 - protein, 9 aa, Homo Sapiens
RRCLALFLA

SEQ ID NO: 1130370 - protein, 9 aa, Homo Sapiens
YPPEYTCTL

SEQ ID NO: 1130371 - protein, 9 aa, Homo Sapiens
VSSKHWGDD

SEQ ID NO: 1130372 - protein, 9 aa, Homo Sapiens
KLGDPQSSS

SEQ ID NO: 1130373 - protein, 9 aa, Homo Sapiens
LNGNRTHPE

SEQ ID NO: 1130374 - protein, 9 aa, Homo Sapiens
LQPALVLAH

SEQ ID NO: 1130375 - protein, 9 aa, Homo Sapiens
QKEHHIQES

SEQ ID NO: 1130376 - protein, 9 aa, Homo Sapiens
AGSTSQLPT

SEQ ID NO: 1130377 - protein, 9 aa, Homo Sapiens
QHKLLCRET

SEQ ID NO: 1130378 - protein, 9 aa, Homo Sapiens
PILADDLIK

SEQ ID NO: 1130379 - protein, 9 aa, Homo Sapiens
PGRSISTGC

SEQ ID NO: 1130380 - protein, 9 aa, Homo Sapiens
PSWYNILTV

SEQ ID NO: 1130381 - protein, 9 aa, Homo Sapiens
LRLLSLYRP

SEQ ID NO: 1130382 - protein, 9 aa, Homo Sapiens
IDEIHRVLR

SEQ ID NO: 1130383 - protein, 9 aa, Homo Sapiens
MAFCSATVH

SEQ ID NO: 1130384 - protein, 9 aa, Homo Sapiens
LTVIGQGLV

SEQ ID NO: 1130385 - protein, 9 aa, Homo Sapiens
GTAGSTSQL

SEQ ID NO: 1130386 - protein, 9 aa, Homo Sapiens
SQEGFQFVK

SEQ ID NO: 1130387 - protein, 9 aa, Homo Sapiens
SRTRGTLHT

SEQ ID NO: 1130388 - protein, 9 aa, Homo Sapiens
DLIPRLQIW

SEQ ID NO: 1130389 - protein, 9 aa, Homo Sapiens
VQGKFQKAW

SEQ ID NO: 1130390 - protein, 9 aa, Homo Sapiens
EIKLPKKRG

SEQ ID NO: 1130391 - protein, 9 aa, Homo Sapiens
DVCENIITY

SEQ ID NO: 1130392 - protein, 9 aa, Homo Sapiens
KNPDDFKMC

SEQ ID NO: 1130393 - protein, 9 aa, Homo Sapiens
NGKHITKSG

SEQ ID NO: 1130394 - protein, 9 aa, Homo Sapiens
ETLALFRLN

SEQ ID NO: 1130395 - protein, 9 aa, Homo Sapiens
MGCVRRRSE

SEQ ID NO: 1130396 - protein, 9 aa, Homo Sapiens
IPVNKSPMI

SEQ ID NO: 1130397 - protein, 9 aa, Homo Sapiens
FDGRWYTNI

SEQ ID NO: 1130398 - protein, 9 aa, Homo Sapiens
NWGAADQSG

SEQ ID NO: 1130399 - protein, 9 aa, Homo Sapiens
FGSCLKMNG

SEQ ID NO: 1130400 - protein, 9 aa, Homo Sapiens
VKTISPLRP

SEQ ID NO: 1130401 - protein, 9 aa, Homo Sapiens
RPLPRPRLH

SEQ ID NO: 1130402 - protein, 9 aa, Homo Sapiens
VLQRVLYRH

SEQ ID NO: 1130403 - protein, 9 aa, Homo Sapiens
GFPRNSGRS

SEQ ID NO: 1130404 - protein, 9 aa, Homo Sapiens
FDFQSDIEG

SEQ ID NO: 1130405 - protein, 9 aa, Homo Sapiens
FGRFYPVYS

SEQ ID NO: 1130406 - protein, 9 aa, Homo Sapiens
ISANITTFN

SEQ ID NO: 1130407 - protein, 9 aa, Homo Sapiens
PAPQGPVMA

SEQ ID NO: 1130408 - protein, 9 aa, Homo Sapiens
SIQEPGPLR

SEQ ID NO: 1130409 - protein, 9 aa, Homo Sapiens
YHTIDASLR

SEQ ID NO: 1130410 - protein, 9 aa, Homo Sapiens
HRHRTGESR

SEQ ID NO: 1130411 - protein, 9 aa, Homo Sapiens
NARIYYAIS

SEQ ID NO: 1130412 - protein, 9 aa, Homo Sapiens
LRNHYRKYL

SEQ ID NO: 1130413 - protein, 9 aa, Homo Sapiens
NNTMGRDPS

SEQ ID NO: 1130414 - protein, 9 aa, Homo Sapiens
SFIIDSSLS

SEQ ID NO: 1130415 - protein, 9 aa, Homo Sapiens
TTISDATTG

SEQ ID NO: 1130416 - protein, 9 aa, Homo Sapiens
VNHFYCDTL

SEQ ID NO: 1130417 - protein, 9 aa, Homo Sapiens
VLLQLLSFA

SEQ ID NO: 1130418 - protein, 9 aa, Homo Sapiens
PRSAASLPQ

SEQ ID NO: 1130419 - protein, 9 aa, Homo Sapiens
KDSSSEKRE

SEQ ID NO: 1130420 - protein, 9 aa, Homo Sapiens
SSSPTSLCR

SEQ ID NO: 1130421 - protein, 9 aa, Homo Sapiens
AIKVMVVTG

SEQ ID NO: 1130422 - protein, 9 aa, Homo Sapiens
GHTEPVVLL

SEQ ID NO: 1130423 - protein, 9 aa, Homo Sapiens
LDSPCWLSK

SEQ ID NO: 1130424 - protein, 9 aa, Homo Sapiens
MDHQANCLS

SEQ ID NO: 1130425 - protein, 9 aa, Homo Sapiens
AKKQKFRPT

SEQ ID NO: 1130426 - protein, 9 aa, Homo Sapiens
PCTMLLPQG

SEQ ID NO: 1130427 - protein, 9 aa, Homo Sapiens
PPGPYATPL

SEQ ID NO: 1130428 - protein, 9 aa, Homo Sapiens
NSDFEESGE

SEQ ID NO: 1130429 - protein, 9 aa, Homo Sapiens
PGPQRRVRP

SEQ ID NO: 1130430 - protein, 9 aa, Homo Sapiens
SSGTSRAAG

SEQ ID NO: 1130431 - protein, 9 aa, Homo Sapiens
SDISSVPPQ

SEQ ID NO: 1130432 - protein, 9 aa, Homo Sapiens
LAQGVLGHH

SEQ ID NO: 1130433 - protein, 9 aa, Homo Sapiens
EAGVPGSAS

SEQ ID NO: 1130434 - protein, 9 aa, Homo Sapiens
WWLSNVDGT

SEQ ID NO: 1130435 - protein, 9 aa, Homo Sapiens
MKSVMCKMN

SEQ ID NO: 1130436 - protein, 9 aa, Homo Sapiens
VLCDCYDMA

SEQ ID NO: 1130437 - protein, 9 aa, Homo Sapiens
SFGYVILEA

SEQ ID NO: 1130438 - protein, 9 aa, Homo Sapiens
FGLLNISAQ

SEQ ID NO: 1130439 - protein, 9 aa, Homo Sapiens
QKDVWCPWC

SEQ ID NO: 1130440 - protein, 9 aa, Homo Sapiens
SPSVRSNIQ

SEQ ID NO: 1130441 - protein, 9 aa, Homo Sapiens
REKDQRDSL

SEQ ID NO: 1130442 - protein, 9 aa, Homo Sapiens
ESQNEETKP

SEQ ID NO: 1130443 - protein, 9 aa, Homo Sapiens
HGDGGIYIG

SEQ ID NO: 1130444 - protein, 9 aa, Homo Sapiens
GGDPTGWFA

SEQ ID NO: 1130445 - protein, 9 aa, Homo Sapiens
QFVPPLPER

SEQ ID NO: 1130446 - protein, 9 aa, Homo Sapiens
SRDATRFPI

SEQ ID NO: 1130447 - protein, 9 aa, Homo Sapiens
IMSQWWHVG

SEQ ID NO: 1130448 - protein, 9 aa, Homo Sapiens
PPLCRKRPP

SEQ ID NO: 1130449 - protein, 9 aa, Homo Sapiens
PDAPLDHCY

SEQ ID NO: 1130450 - protein, 9 aa, Homo Sapiens
TLSIWNQWL

SEQ ID NO: 1130451 - protein, 9 aa, Homo Sapiens
PGPCASLLS

SEQ ID NO: 1130452 - protein, 9 aa, Homo Sapiens
IAPTKKSLI

SEQ ID NO: 1130453 - protein, 9 aa, Homo Sapiens
AGKPIYSWY

SEQ ID NO: 1130454 - protein, 9 aa, Homo Sapiens
QPRYPRRIV

SEQ ID NO: 1130455 - protein, 9 aa, Homo Sapiens
NVKKMSQLL

SEQ ID NO: 1130456 - protein, 9 aa, Homo Sapiens
LDSGPEAGG

SEQ ID NO: 1130457 - protein, 9 aa, Homo Sapiens
SATQFRWNQ

SEQ ID NO: 1130458 - protein, 9 aa, Homo Sapiens
NITEYMFCT

SEQ ID NO: 1130459 - protein, 9 aa, Homo Sapiens
RIHLMERKT

SEQ ID NO: 1130460 - protein, 9 aa, Homo Sapiens
PSKTPPTNA

SEQ ID NO: 1130461 - protein, 9 aa, Homo Sapiens
AGVTPISVS

SEQ ID NO: 1130462 - protein, 9 aa, Homo Sapiens
MRDNMLNLE

SEQ ID NO: 1130463 - protein, 9 aa, Homo Sapiens
DVGTSSPSL

SEQ ID NO: 1130464 - protein, 9 aa, Homo Sapiens
TTHRCLLEG

SEQ ID NO: 1130465 - protein, 9 aa, Homo Sapiens
LPPPGLAPE

SEQ ID NO: 1130466 - protein, 9 aa, Homo Sapiens
KQNLLLWRA

SEQ ID NO: 1130467 - protein, 9 aa, Homo Sapiens
VVRIQSSGK

SEQ ID NO: 1130468 - protein, 9 aa, Homo Sapiens
RAENHDMLM

SEQ ID NO: 1130469 - protein, 9 aa, Homo Sapiens
PKADIYPFA

SEQ ID NO: 1130470 - protein, 9 aa, Homo Sapiens
IPSERDFFR

SEQ ID NO: 1130471 - protein, 9 aa, Homo Sapiens
RDSRFLRPS

SEQ ID NO: 1130472 - protein, 9 aa, Homo Sapiens
VARAVIVGH

SEQ ID NO: 1130473 - protein, 9 aa, Homo Sapiens
MLGERRRRT

SEQ ID NO: 1130474 - protein, 9 aa, Homo Sapiens
QKQKLMNTS

SEQ ID NO: 1130475 - protein, 9 aa, Homo Sapiens
RRKALPFAQ

SEQ ID NO: 1130476 - protein, 9 aa, Homo Sapiens
AQALVLKIK

SEQ ID NO: 1130477 - protein, 9 aa, Homo Sapiens
EGGLGPHVV

SEQ ID NO: 1130478 - protein, 9 aa, Homo Sapiens
DSAQGVTFE

SEQ ID NO: 1130479 - protein, 9 aa, Homo Sapiens
DEDLTRPSG

SEQ ID NO: 1130480 - protein, 9 aa, Homo Sapiens
SPNRGVLRS

SEQ ID NO: 1130481 - protein, 9 aa, Homo Sapiens
DLYKSLTDC

SEQ ID NO: 1130482 - protein, 9 aa, Homo Sapiens
PSPSAFAKS

SEQ ID NO: 1130483 - protein, 9 aa, Homo Sapiens
LKTGQKDLM

SEQ ID NO: 1130484 - protein, 9 aa, Homo Sapiens
GAPAPPARD

SEQ ID NO: 1130485 - protein, 9 aa, Homo Sapiens
LYWVGMRRL

SEQ ID NO: 1130486 - protein, 9 aa, Homo Sapiens
ERLYVMYTI

SEQ ID NO: 1130487 - protein, 9 aa, Homo Sapiens
DCVNIEEVL

SEQ ID NO: 1130488 - protein, 9 aa, Homo Sapiens
VHGIAPDVV

SEQ ID NO: 1130489 - protein, 9 aa, Homo Sapiens
VPQAVDGWV

SEQ ID NO: 1130490 - protein, 9 aa, Homo Sapiens
GKTSLKASR

SEQ ID NO: 1130491 - protein, 9 aa, Homo Sapiens
AEEKKLGSP

SEQ ID NO: 1130492 - protein, 9 aa, Homo Sapiens
RLAMAEALT

SEQ ID NO: 1130493 - protein, 9 aa, Homo Sapiens
TYAGKLLIS

SEQ ID NO: 1130494 - protein, 9 aa, Homo Sapiens
KIFLVAATL

SEQ ID NO: 1130495 - protein, 9 aa, Homo Sapiens
SLVMCLRLR

SEQ ID NO: 1130496 - protein, 9 aa, Homo Sapiens
LCKLERLDI

SEQ ID NO: 1130497 - protein, 9 aa, Homo Sapiens
VSYWAQPQD

SEQ ID NO: 1130498 - protein, 9 aa, Homo Sapiens
QRLERTLDA

SEQ ID NO: 1130499 - protein, 9 aa, Homo Sapiens
LHQLPMGRL

SEQ ID NO: 1130500 - protein, 9 aa, Homo Sapiens
MENALVACV

SEQ ID NO: 1130501 - protein, 9 aa, Homo Sapiens
EALLGVQEG

SEQ ID NO: 1130502 - protein, 9 aa, Homo Sapiens
LDWVNVMFS

SEQ ID NO: 1130503 - protein, 9 aa, Homo Sapiens
CGRPHAHPG

SEQ ID NO: 1130504 - protein, 9 aa, Homo Sapiens
MVHRLWVSR

SEQ ID NO: 1130505 - protein, 9 aa, Homo Sapiens
VEPRLERLY

SEQ ID NO: 1130506 - protein, 9 aa, Homo Sapiens
SLSLDDIKL

SEQ ID NO: 1130507 - protein, 9 aa, Homo Sapiens
PSRPCRMRL

SEQ ID NO: 1130508 - protein, 9 aa, Homo Sapiens
KLHDMDFYK

SEQ ID NO: 1130509 - protein, 9 aa, Homo Sapiens
TAVTTTAAT

SEQ ID NO: 1130510 - protein, 9 aa, Homo Sapiens
NLYEIARRH

SEQ ID NO: 1130511 - protein, 9 aa, Homo Sapiens
APQAPHPRP

SEQ ID NO: 1130512 - protein, 9 aa, Homo Sapiens
PRLLPLTRP

SEQ ID NO: 1130513 - protein, 9 aa, Homo Sapiens
EQEQLNCFR

SEQ ID NO: 1130514 - protein, 9 aa, Homo Sapiens
ALVLAHVPG

SEQ ID NO: 1130515 - protein, 9 aa, Homo Sapiens
GVWRARPAA

SEQ ID NO: 1130516 - protein, 9 aa, Homo Sapiens
KLVLDRHTD

SEQ ID NO: 1130517 - protein, 9 aa, Homo Sapiens
EQRRGRNSS

SEQ ID NO: 1130518 - protein, 9 aa, Homo Sapiens
GTQCRRCMR

SEQ ID NO: 1130519 - protein, 9 aa, Homo Sapiens
QLLQKKCKE

SEQ ID NO: 1130520 - protein, 9 aa, Homo Sapiens
LQVVLEHLR

SEQ ID NO: 1130521 - protein, 9 aa, Homo Sapiens
RKRSLATVD

SEQ ID NO: 1130522 - protein, 9 aa, Homo Sapiens
RLASSRPLS

SEQ ID NO: 1130523 - protein, 9 aa, Homo Sapiens
EQLCGVGLR

SEQ ID NO: 1130524 - protein, 9 aa, Homo Sapiens
PSWACTCRA

SEQ ID NO: 1130525 - protein, 9 aa, Homo Sapiens
KSLLGTWII

SEQ ID NO: 1130526 - protein, 9 aa, Homo Sapiens
LHLEDAVRA

SEQ ID NO: 1130527 - protein, 9 aa, Homo Sapiens
AAPTTSTLV

SEQ ID NO: 1130528 - protein, 9 aa, Homo Sapiens
AHQKKAVLH

SEQ ID NO: 1130529 - protein, 9 aa, Homo Sapiens
LPQMETLVL

SEQ ID NO: 1130530 - protein, 9 aa, Homo Sapiens
YCYYLLPGL

SEQ ID NO: 1130531 - protein, 9 aa, Homo Sapiens
ILASRAYAA

SEQ ID NO: 1130532 - protein, 9 aa, Homo Sapiens
LQRESRPVA

SEQ ID NO: 1130533 - protein, 9 aa, Homo Sapiens
HCFRKIKHQ

SEQ ID NO: 1130534 - protein, 9 aa, Homo Sapiens
HTQLQRQTT

SEQ ID NO: 1130535 - protein, 9 aa, Homo Sapiens
CHKCKCLCT

SEQ ID NO: 1130536 - protein, 9 aa, Homo Sapiens
LKYIKEKSL

SEQ ID NO: 1130537 - protein, 9 aa, Homo Sapiens
CVYWLISGG

SEQ ID NO: 1130538 - protein, 9 aa, Homo Sapiens
MIPGLGQIL

SEQ ID NO: 1130539 - protein, 9 aa, Homo Sapiens
LCPRDSRLS

SEQ ID NO: 1130540 - protein, 9 aa, Homo Sapiens
AKAKPNLEY

SEQ ID NO: 1130541 - protein, 9 aa, Homo Sapiens
VNHKHGDSV

SEQ ID NO: 1130542 - protein, 9 aa, Homo Sapiens
PFPSHLASP

SEQ ID NO: 1130543 - protein, 9 aa, Homo Sapiens
ESSSEEVSV

SEQ ID NO: 1130544 - protein, 9 aa, Homo Sapiens
LSWGTMVRA

SEQ ID NO: 1130545 - protein, 9 aa, Homo Sapiens
TPACIGWVA

SEQ ID NO: 1130546 - protein, 9 aa, Homo Sapiens
LIYLYLFHN

SEQ ID NO: 1130547 - protein, 9 aa, Homo Sapiens
ATCGLLYSR

SEQ ID NO: 1130548 - protein, 9 aa, Homo Sapiens
QENEEKEQD

SEQ ID NO: 1130549 - protein, 9 aa, Homo Sapiens
LRCLLYTLN

SEQ ID NO: 1130550 - protein, 9 aa, Homo Sapiens
VSPYPSHSL

SEQ ID NO: 1130551 - protein, 9 aa, Homo Sapiens
VGANFLCLW

SEQ ID NO: 1130552 - protein, 9 aa, Homo Sapiens
PTTYAGKLL

SEQ ID NO: 1130553 - protein, 9 aa, Homo Sapiens
LTLFSLKVW

SEQ ID NO: 1130554 - protein, 9 aa, Homo Sapiens
RTHCQCILD

SEQ ID NO: 1130555 - protein, 9 aa, Homo Sapiens
ARLHVAAMQ

SEQ ID NO: 1130556 - protein, 9 aa, Homo Sapiens
ERLLADGKW

SEQ ID NO: 1130557 - protein, 9 aa, Homo Sapiens
LSSPDSYQR

SEQ ID NO: 1130558 - protein, 9 aa, Homo Sapiens
LVTYHINNA

SEQ ID NO: 1130559 - protein, 9 aa, Homo Sapiens
EVLSCRSPS

SEQ ID NO: 1130560 - protein, 9 aa, Homo Sapiens
LLFVGLTYL

SEQ ID NO: 1130561 - protein, 9 aa, Homo Sapiens
PRASPRTCG

SEQ ID NO: 1130562 - protein, 9 aa, Homo Sapiens
VEHRDNLVV

SEQ ID NO: 1130563 - protein, 9 aa, Homo Sapiens
RERPERYSS

SEQ ID NO: 1130564 - protein, 9 aa, Homo Sapiens
FKLGGPRLE

SEQ ID NO: 1130565 - protein, 9 aa, Homo Sapiens
GESSLAHIW

SEQ ID NO: 1130566 - protein, 9 aa, Homo Sapiens
DCPEHLLQP

SEQ ID NO: 1130567 - protein, 9 aa, Homo Sapiens
MDYMKHKSR

SEQ ID NO: 1130568 - protein, 9 aa, Homo Sapiens
PQALPPARG

SEQ ID NO: 1130569 - protein, 9 aa, Homo Sapiens
GPVGPLGFT

SEQ ID NO: 1130570 - protein, 9 aa, Homo Sapiens
LVLVRFVVE

SEQ ID NO: 1130571 - protein, 9 aa, Homo Sapiens
HPHPWLRLR

SEQ ID NO: 1130572 - protein, 9 aa, Homo Sapiens
QLLMGFLSG

SEQ ID NO: 1130573 - protein, 9 aa, Homo Sapiens
GEGEHKDIV

SEQ ID NO: 1130574 - protein, 9 aa, Homo Sapiens
SHQDMAHSN

SEQ ID NO: 1130575 - protein, 9 aa, Homo Sapiens
DRCRLFEYD

SEQ ID NO: 1130576 - protein, 9 aa, Homo Sapiens
KNLLSYWHS

SEQ ID NO: 1130577 - protein, 9 aa, Homo Sapiens
GLDAISKKA

SEQ ID NO: 1130578 - protein, 9 aa, Homo Sapiens
MEKARETLQ

SEQ ID NO: 1130579 - protein, 9 aa, Homo Sapiens
SKGAMVNTT

SEQ ID NO: 1130580 - protein, 9 aa, Homo Sapiens
AFSEYPSLI

SEQ ID NO: 1130581 - protein, 9 aa, Homo Sapiens
SPVTGEVWR

SEQ ID NO: 1130582 - protein, 9 aa, Homo Sapiens
AMTIGETLV

SEQ ID NO: 1130583 - protein, 9 aa, Homo Sapiens
DRRDRCSAG

SEQ ID NO: 1130584 - protein, 9 aa, Homo Sapiens
QSGQEDKKI

SEQ ID NO: 1130585 - protein, 9 aa, Homo Sapiens
KKESFLNKK

SEQ ID NO: 1130586 - protein, 9 aa, Homo Sapiens
RSLWVDVDL

SEQ ID NO: 1130587 - protein, 9 aa, Homo Sapiens
QPRVGGLPK

SEQ ID NO: 1130588 - protein, 9 aa, Homo Sapiens
PMGRLDLAT

SEQ ID NO: 1130589 - protein, 9 aa, Homo Sapiens
DEAVGGFFS

SEQ ID NO: 1130590 - protein, 9 aa, Homo Sapiens
PQGAVACLA

SEQ ID NO: 1130591 - protein, 9 aa, Homo Sapiens
TLPCRRHCP

SEQ ID NO: 1130592 - protein, 9 aa, Homo Sapiens
ALLLMSWKQ

SEQ ID NO: 1130593 - protein, 9 aa, Homo Sapiens
ELRDAFREL

SEQ ID NO: 1130594 - protein, 9 aa, Homo Sapiens
ADGQERVPE

SEQ ID NO: 1130595 - protein, 9 aa, Homo Sapiens
GSCFPKNLV

SEQ ID NO: 1130596 - protein, 9 aa, Homo Sapiens
LFRQMVEAT

SEQ ID NO: 1130597 - protein, 9 aa, Homo Sapiens
VAMHTWYTE

SEQ ID NO: 1130598 - protein, 9 aa, Homo Sapiens
ARIFADCEA

SEQ ID NO: 1130599 - protein, 9 aa, Homo Sapiens
NKNRQRVRY

SEQ ID NO: 1130600 - protein, 9 aa, Homo Sapiens
RRRRRCCCC

SEQ ID NO: 1130601 - protein, 9 aa, Homo Sapiens
TSRLSSRSP

SEQ ID NO: 1130602 - protein, 9 aa, Homo Sapiens
HGSPDSKGA

SEQ ID NO: 1130603 - protein, 9 aa, Homo Sapiens
FHIMFDKDM

SEQ ID NO: 1130604 - protein, 9 aa, Homo Sapiens
PDGPASSTS

SEQ ID NO: 1130605 - protein, 9 aa, Homo Sapiens
KYVRAMYPT

SEQ ID NO: 1130606 - protein, 9 aa, Homo Sapiens
IKVQDNNDN

SEQ ID NO: 1130607 - protein, 9 aa, Homo Sapiens
GPRTAIKAK

SEQ ID NO: 1130608 - protein, 9 aa, Homo Sapiens
LRLEKKESF

SEQ ID NO: 1130609 - protein, 9 aa, Homo Sapiens
MASRYDRAN

SEQ ID NO: 1130610 - protein, 9 aa, Homo Sapiens
CYNDCFFYH

SEQ ID NO: 1130611 - protein, 9 aa, Homo Sapiens
ISLYATGRT

SEQ ID NO: 1130612 - protein, 9 aa, Homo Sapiens
ASRPTSSQT

SEQ ID NO: 1130613 - protein, 9 aa, Homo Sapiens
GVYYVGVTS

SEQ ID NO: 1130614 - protein, 9 aa, Homo Sapiens
TALPSSTYA

SEQ ID NO: 1130615 - protein, 9 aa, Homo Sapiens
ERQAMYTRH

SEQ ID NO: 1130616 - protein, 9 aa, Homo Sapiens
LKVCVNHWI

SEQ ID NO: 1130617 - protein, 9 aa, Homo Sapiens
TVIGQGLVG

SEQ ID NO: 1130618 - protein, 9 aa, Homo Sapiens
CPVKQTCSQ

SEQ ID NO: 1130619 - protein, 9 aa, Homo Sapiens
DLQPQRNFC

SEQ ID NO: 1130620 - protein, 9 aa, Homo Sapiens
LGALECAGP

SEQ ID NO: 1130621 - protein, 9 aa, Homo Sapiens
VHKRAIRII

SEQ ID NO: 1130622 - protein, 9 aa, Homo Sapiens
ELPPGRAWA

SEQ ID NO: 1130623 - protein, 9 aa, Homo Sapiens
LPPASTSSP

SEQ ID NO: 1130624 - protein, 9 aa, Homo Sapiens
DASPAPLVL

SEQ ID NO: 1130625 - protein, 9 aa, Homo Sapiens
IRPVLQQVS

SEQ ID NO: 1130626 - protein, 9 aa, Homo Sapiens
KKTNQRFDH

SEQ ID NO: 1130627 - protein, 9 aa, Homo Sapiens
PMSSPWPSA

SEQ ID NO: 1130628 - protein, 9 aa, Homo Sapiens
GTGRSSRCA

SEQ ID NO: 1130629 - protein, 9 aa, Homo Sapiens
LVGIWNTWY

SEQ ID NO: 1130630 - protein, 9 aa, Homo Sapiens
HCHVRSCQV

SEQ ID NO: 1130631 - protein, 9 aa, Homo Sapiens
PEGLKNEEM

SEQ ID NO: 1130632 - protein, 9 aa, Homo Sapiens
WTLGRSHWS

SEQ ID NO: 1130633 - protein, 9 aa, Homo Sapiens
GSMWRQRGR

SEQ ID NO: 1130634 - protein, 9 aa, Homo Sapiens
DPKKNHRWH

SEQ ID NO: 1130635 - protein, 9 aa, Homo Sapiens
TTCHSILSS

SEQ ID NO: 1130636 - protein, 9 aa, Homo Sapiens
SHHHSQNYC

SEQ ID NO: 1130637 - protein, 9 aa, Homo Sapiens
ARKGPPNPG

SEQ ID NO: 1130638 - protein, 9 aa, Homo Sapiens
HRGAPLRSC

SEQ ID NO: 1130639 - protein, 9 aa, Homo Sapiens
TREPSRVLK

SEQ ID NO: 1130640 - protein, 9 aa, Homo Sapiens
SEEQKKNRK

SEQ ID NO: 1130641 - protein, 9 aa, Homo Sapiens
VKQVITFTD

SEQ ID NO: 1130642 - protein, 9 aa, Homo Sapiens
TPSSGRHPA

SEQ ID NO: 1130643 - protein, 9 aa, Homo Sapiens
WCPPGTTAS

SEQ ID NO: 1130644 - protein, 9 aa, Homo Sapiens
SLPLTYSNL

SEQ ID NO: 1130645 - protein, 9 aa, Homo Sapiens
AVQAPQMYT

SEQ ID NO: 1130646 - protein, 9 aa, Homo Sapiens
PGPGAGQGP

SEQ ID NO: 1130647 - protein, 9 aa, Homo Sapiens
TAAGASGWS

SEQ ID NO: 1130648 - protein, 9 aa, Homo Sapiens
GSMSARVTF

SEQ ID NO: 1130649 - protein, 9 aa, Homo Sapiens
QNVEDDAET

SEQ ID NO: 1130650 - protein, 9 aa, Homo Sapiens
ACIGWVATF

SEQ ID NO: 1130651 - protein, 9 aa, Homo Sapiens
WYTETHARH

SEQ ID NO: 1130652 - protein, 9 aa, Homo Sapiens
RAATLGILS

SEQ ID NO: 1130653 - protein, 9 aa, Homo Sapiens
LRPPSTRHG

SEQ ID NO: 1130654 - protein, 9 aa, Homo Sapiens
CMINQLTSL

SEQ ID NO: 1130655 - protein, 9 aa, Homo Sapiens
HFKKDHSLL

SEQ ID NO: 1130656 - protein, 9 aa, Homo Sapiens
AKFEHLQTV

SEQ ID NO: 1130657 - protein, 9 aa, Homo Sapiens
VQFGEVELS

SEQ ID NO: 1130658 - protein, 9 aa, Homo Sapiens
YCNELRSLE

SEQ ID NO: 1130659 - protein, 9 aa, Homo Sapiens
ENNYIKIRD

SEQ ID NO: 1130660 - protein, 9 aa, Homo Sapiens
ATVQDSIAW

SEQ ID NO: 1130661 - protein, 9 aa, Homo Sapiens
LTEVREELQ

SEQ ID NO: 1130662 - protein, 9 aa, Homo Sapiens
NDQASFAVN

SEQ ID NO: 1130663 - protein, 9 aa, Homo Sapiens
NDVEGVSSA

SEQ ID NO: 1130664 - protein, 9 aa, Homo Sapiens
FCQALGSAR

SEQ ID NO: 1130665 - protein, 9 aa, Homo Sapiens
NKGRMLKLE

SEQ ID NO: 1130666 - protein, 9 aa, Homo Sapiens
LTPGAFHGL

SEQ ID NO: 1130667 - protein, 9 aa, Homo Sapiens
VAQCLLDKD

SEQ ID NO: 1130668 - protein, 9 aa, Homo Sapiens
CRPLTYSTC

SEQ ID NO: 1130669 - protein, 9 aa, Homo Sapiens
LKHKVDPVY

SEQ ID NO: 1130670 - protein, 9 aa, Homo Sapiens
LTTKINEKP

SEQ ID NO: 1130671 - protein, 9 aa, Homo Sapiens
ASTDAGSTH

SEQ ID NO: 1130672 - protein, 9 aa, Homo Sapiens
LESAHPVKF

SEQ ID NO: 1130673 - protein, 9 aa, Homo Sapiens
SIMDELVCV

SEQ ID NO: 1130674 - protein, 9 aa, Homo Sapiens
KPVSFELDN

SEQ ID NO: 1130675 - protein, 9 aa, Homo Sapiens
SAPHISSPD

SEQ ID NO: 1130676 - protein, 9 aa, Homo Sapiens
RAKTWVKKL

SEQ ID NO: 1130677 - protein, 9 aa, Homo Sapiens
LAKAGLPAS

SEQ ID NO: 1130678 - protein, 9 aa, Homo Sapiens
FCIGNAKGD

SEQ ID NO: 1130679 - protein, 9 aa, Homo Sapiens
WRDSTRLRL

SEQ ID NO: 1130680 - protein, 9 aa, Homo Sapiens
FKAEGEYTA

SEQ ID NO: 1130681 - protein, 9 aa, Homo Sapiens
MAGSCLRRF

SEQ ID NO: 1130682 - protein, 9 aa, Homo Sapiens
YCHMRKEGH

SEQ ID NO: 1130683 - protein, 9 aa, Homo Sapiens
KIRPVREDH

SEQ ID NO: 1130684 - protein, 9 aa, Homo Sapiens
LLPGHLWKR

SEQ ID NO: 1130685 - protein, 9 aa, Homo Sapiens
VQIELGWRD

SEQ ID NO: 1130686 - protein, 9 aa, Homo Sapiens
IKKNYCTKP

SEQ ID NO: 1130687 - protein, 9 aa, Homo Sapiens
FGSGPGVES

SEQ ID NO: 1130688 - protein, 9 aa, Homo Sapiens
VFAKLYIRD

SEQ ID NO: 1130689 - protein, 9 aa, Homo Sapiens
MQRNVAVLR

SEQ ID NO: 1130690 - protein, 9 aa, Homo Sapiens
YCQHLLSYD

SEQ ID NO: 1130691 - protein, 9 aa, Homo Sapiens
RFVSSKHWG

SEQ ID NO: 1130692 - protein, 9 aa, Homo Sapiens
SRRTRGRAG

SEQ ID NO: 1130693 - protein, 9 aa, Homo Sapiens
HDTHSEGKP

SEQ ID NO: 1130694 - protein, 9 aa, Homo Sapiens
TTPPIGPSC

SEQ ID NO: 1130695 - protein, 9 aa, Homo Sapiens
KKAELAKKQ

SEQ ID NO: 1130696 - protein, 9 aa, Homo Sapiens
RPWSPEDPW

SEQ ID NO: 1130697 - protein, 9 aa, Homo Sapiens
HTMPHLCPS

SEQ ID NO: 1130698 - protein, 9 aa, Homo Sapiens
PTWCRTGAS

SEQ ID NO: 1130699 - protein, 9 aa, Homo Sapiens
RGPTHTRLS

SEQ ID NO: 1130700 - protein, 9 aa, Homo Sapiens
ESEEVPDVL

SEQ ID NO: 1130701 - protein, 9 aa, Homo Sapiens
ALPFAQWDG

SEQ ID NO: 1130702 - protein, 9 aa, Homo Sapiens
SVAVHCSDG

SEQ ID NO: 1130703 - protein, 9 aa, Homo Sapiens
FPRNSGRSE

SEQ ID NO: 1130704 - protein, 9 aa, Homo Sapiens
GRTRVHSEA

SEQ ID NO: 1130705 - protein, 9 aa, Homo Sapiens
REVEAVPSN

SEQ ID NO: 1130706 - protein, 9 aa, Homo Sapiens
WGPLPMLTG

SEQ ID NO: 1130707 - protein, 9 aa, Homo Sapiens
RQQHKNREA

SEQ ID NO: 1130708 - protein, 9 aa, Homo Sapiens
PSKWADSVP

SEQ ID NO: 1130709 - protein, 9 aa, Homo Sapiens
PFQLVRDNS

SEQ ID NO: 1130710 - protein, 9 aa, Homo Sapiens
KRRSHWMKA

SEQ ID NO: 1130711 - protein, 9 aa, Homo Sapiens
LPCFQDVHA

SEQ ID NO: 1130712 - protein, 9 aa, Homo Sapiens
GHCYHLYHG

SEQ ID NO: 1130713 - protein, 9 aa, Homo Sapiens
SGEPTEEAL

SEQ ID NO: 1130714 - protein, 9 aa, Homo Sapiens
CPESVKNGF

SEQ ID NO: 1130715 - protein, 9 aa, Homo Sapiens
KGREEMKWS

SEQ ID NO: 1130716 - protein, 9 aa, Homo Sapiens
TAVVKLEAI

SEQ ID NO: 1130717 - protein, 9 aa, Homo Sapiens
KAVQDLSRI

SEQ ID NO: 1130718 - protein, 9 aa, Homo Sapiens
IFNVSTFLF

SEQ ID NO: 1130719 - protein, 9 aa, Homo Sapiens
WGGPRVLDP

SEQ ID NO: 1130720 - protein, 9 aa, Homo Sapiens
SFETIFGPK

SEQ ID NO: 1130721 - protein, 9 aa, Homo Sapiens
TSLASSSSC

SEQ ID NO: 1130722 - protein, 9 aa, Homo Sapiens
LGKEPFPPA

SEQ ID NO: 1130723 - protein, 9 aa, Homo Sapiens
HGGLRLSRT

SEQ ID NO: 1130724 - protein, 9 aa, Homo Sapiens
SIVMMAYAD

SEQ ID NO: 1130725 - protein, 9 aa, Homo Sapiens
TRFACFTWR

SEQ ID NO: 1130726 - protein, 9 aa, Homo Sapiens
ASPRAAIWR

SEQ ID NO: 1130727 - protein, 9 aa, Homo Sapiens
LCLSTNFLC

SEQ ID NO: 1130728 - protein, 9 aa, Homo Sapiens
SAWTVSTGP

SEQ ID NO: 1130729 - protein, 9 aa, Homo Sapiens
GVTRAVAHS

SEQ ID NO: 1130730 - protein, 9 aa, Homo Sapiens
NKSGCKHDL

SEQ ID NO: 1130731 - protein, 9 aa, Homo Sapiens
HIHGVPPLV

SEQ ID NO: 1130732 - protein, 9 aa, Homo Sapiens
MLSAVPQQV

SEQ ID NO: 1130733 - protein, 9 aa, Homo Sapiens
VWISGIWHL

SEQ ID NO: 1130734 - protein, 9 aa, Homo Sapiens
ACLLAECCA

SEQ ID NO: 1130735 - protein, 9 aa, Homo Sapiens
WEDVASLQS

SEQ ID NO: 1130736 - protein, 9 aa, Homo Sapiens
SVAMHTWYT

SEQ ID NO: 1130737 - protein, 9 aa, Homo Sapiens
KDDGILSTF

SEQ ID NO: 1130738 - protein, 9 aa, Homo Sapiens
ILIPTCCFS

SEQ ID NO: 1130739 - protein, 9 aa, Homo Sapiens
MKKTIFMQE

SEQ ID NO: 1130740 - protein, 9 aa, Homo Sapiens
GTGEVRCHI

SEQ ID NO: 1130741 - protein, 9 aa, Homo Sapiens
SVISVAIPS

SEQ ID NO: 1130742 - protein, 9 aa, Homo Sapiens
FEKGDDVPE

SEQ ID NO: 1130743 - protein, 9 aa, Homo Sapiens
RTRVHSEAL

SEQ ID NO: 1130744 - protein, 9 aa, Homo Sapiens
LDETDEDKF

SEQ ID NO: 1130745 - protein, 9 aa, Homo Sapiens
EVGSLTLHS

SEQ ID NO: 1130746 - protein, 9 aa, Homo Sapiens
LKIHIPEPG

SEQ ID NO: 1130747 - protein, 9 aa, Homo Sapiens
KNFRPAGGV

SEQ ID NO: 1130748 - protein, 9 aa, Homo Sapiens
SMDNALHAP

SEQ ID NO: 1130749 - protein, 9 aa, Homo Sapiens
QACSHGAGP

SEQ ID NO: 1130750 - protein, 9 aa, Homo Sapiens
KTMNLTIEQ

SEQ ID NO: 1130751 - protein, 9 aa, Homo Sapiens
QDIQQSLER

SEQ ID NO: 1130752 - protein, 9 aa, Homo Sapiens
KIPDCFSRS

SEQ ID NO: 1130753 - protein, 9 aa, Homo Sapiens
HTIPLRSSW

SEQ ID NO: 1130754 - protein, 9 aa, Homo Sapiens
ESPGPSGLA

SEQ ID NO: 1130755 - protein, 9 aa, Homo Sapiens
ASRPTSSHG

SEQ ID NO: 1130756 - protein, 9 aa, Homo Sapiens
SGPSPAPSA

SEQ ID NO: 1130757 - protein, 9 aa, Homo Sapiens
MVERALDFG

SEQ ID NO: 1130758 - protein, 9 aa, Homo Sapiens
TSAAATTSP

SEQ ID NO: 1130759 - protein, 9 aa, Homo Sapiens
GTTRFYFKE

SEQ ID NO: 1130760 - protein, 9 aa, Homo Sapiens
SVACSARWK

SEQ ID NO: 1130761 - protein, 9 aa, Homo Sapiens
AHPHPWLRL

SEQ ID NO: 1130762 - protein, 9 aa, Homo Sapiens
MANRVLRNH

SEQ ID NO: 1130763 - protein, 9 aa, Homo Sapiens
ESLTGYRIY

SEQ ID NO: 1130764 - protein, 9 aa, Homo Sapiens
EDPEGLKNE

SEQ ID NO: 1130765 - protein, 9 aa, Homo Sapiens
IHQRQLDRK

SEQ ID NO: 1130766 - protein, 9 aa, Homo Sapiens
LGEVAQGGS

SEQ ID NO: 1130767 - protein, 9 aa, Homo Sapiens
AMGGAWPRP

SEQ ID NO: 1130768 - protein, 9 aa, Homo Sapiens
TWIISIYVG

SEQ ID NO: 1130769 - protein, 9 aa, Homo Sapiens
PQQALDLKG

SEQ ID NO: 1130770 - protein, 9 aa, Homo Sapiens
MKRRIHLKL

SEQ ID NO: 1130771 - protein, 9 aa, Homo Sapiens
TPFVLLMLL

SEQ ID NO: 1130772 - protein, 9 aa, Homo Sapiens
MAVSPDPEN

SEQ ID NO: 1130773 - protein, 9 aa, Homo Sapiens
EPADRFKTN

SEQ ID NO: 1130774 - protein, 9 aa, Homo Sapiens
IRGSRQRVV

SEQ ID NO: 1130775 - protein, 9 aa, Homo Sapiens
VWRARPAAA

SEQ ID NO: 1130776 - protein, 9 aa, Homo Sapiens
KHPVPAKRY

SEQ ID NO: 1130777 - protein, 9 aa, Homo Sapiens
LPVTGSPRS

SEQ ID NO: 1130778 - protein, 9 aa, Homo Sapiens
VEASLQSDP

SEQ ID NO: 1130779 - protein, 9 aa, Homo Sapiens
DTDDEAADD

SEQ ID NO: 1130780 - protein, 9 aa, Homo Sapiens
CDLYFPRKP

SEQ ID NO: 1130781 - protein, 9 aa, Homo Sapiens
SGGWCSPLF

SEQ ID NO: 1130782 - protein, 9 aa, Homo Sapiens
VFDGHGCVD

SEQ ID NO: 1130783 - protein, 9 aa, Homo Sapiens
QRQNFRSPT

SEQ ID NO: 1130784 - protein, 9 aa, Homo Sapiens
LKETLSKNF

SEQ ID NO: 1130785 - protein, 9 aa, Homo Sapiens
ASPTSSVAG

SEQ ID NO: 1130786 - protein, 9 aa, Homo Sapiens
WKPATPSPA

SEQ ID NO: 1130787 - protein, 9 aa, Homo Sapiens
WFEDAVCPI

SEQ ID NO: 1130788 - protein, 9 aa, Homo Sapiens
AGLGCVAEL

SEQ ID NO: 1130789 - protein, 9 aa, Homo Sapiens
VCDRDDSLV

SEQ ID NO: 1130790 - protein, 9 aa, Homo Sapiens
LPNIRHSSS

SEQ ID NO: 1130791 - protein, 9 aa, Homo Sapiens
LTALKSRKL

SEQ ID NO: 1130792 - protein, 9 aa, Homo Sapiens
PTGPRCPGS

SEQ ID NO: 1130793 - protein, 9 aa, Homo Sapiens
GRVKMWKRR

SEQ ID NO: 1130794 - protein, 9 aa, Homo Sapiens
THRCLLEGY

SEQ ID NO: 1130795 - protein, 9 aa, Homo Sapiens
RQITVTGTP

SEQ ID NO: 1130796 - protein, 9 aa, Homo Sapiens
KRWSRSRTK

SEQ ID NO: 1130797 - protein, 9 aa, Homo Sapiens
PTPNTWTSP

SEQ ID NO: 1130798 - protein, 9 aa, Homo Sapiens
QITGYKIHY

SEQ ID NO: 1130799 - protein, 9 aa, Homo Sapiens
HLDIFRRGF

SEQ ID NO: 1130800 - protein, 9 aa, Homo Sapiens
PFPATARGP

SEQ ID NO: 1130801 - protein, 9 aa, Homo Sapiens
VVMEMANRV

SEQ ID NO: 1130802 - protein, 9 aa, Homo Sapiens
TSITRFAFS

SEQ ID NO: 1130803 - protein, 9 aa, Homo Sapiens
THFELPLDI

SEQ ID NO: 1130804 - protein, 9 aa, Homo Sapiens
FPDSATTSG

SEQ ID NO: 1130805 - protein, 9 aa, Homo Sapiens
LVTRHAAHT

SEQ ID NO: 1130806 - protein, 9 aa, Homo Sapiens
KFPAHRSLL

SEQ ID NO: 1130807 - protein, 9 aa, Homo Sapiens
LILFPPLII

SEQ ID NO: 1130808 - protein, 9 aa, Homo Sapiens
NVTVQIANQ

SEQ ID NO: 1130809 - protein, 9 aa, Homo Sapiens
GIKGGLGEV

SEQ ID NO: 1130810 - protein, 9 aa, Homo Sapiens
RSLQAADPT

SEQ ID NO: 1130811 - protein, 9 aa, Homo Sapiens
LLHILEAHA

SEQ ID NO: 1130812 - protein, 9 aa, Homo Sapiens
TVRVPLQVV

SEQ ID NO: 1130813 - protein, 9 aa, Homo Sapiens
DQLFYTNVY

SEQ ID NO: 1130814 - protein, 9 aa, Homo Sapiens
ATTPGILPS

SEQ ID NO: 1130815 - protein, 9 aa, Homo Sapiens
YHLSPHLNQ

SEQ ID NO: 1130816 - protein, 9 aa, Homo Sapiens
RNEMLKKVV

SEQ ID NO: 1130817 - protein, 9 aa, Homo Sapiens
TAHWGSALP

SEQ ID NO: 1130818 - protein, 9 aa, Homo Sapiens
SSTASAATS

SEQ ID NO: 1130819 - protein, 9 aa, Homo Sapiens
FTVFIGKNS

SEQ ID NO: 1130820 - protein, 9 aa, Homo Sapiens
LLWQYDNEK

SEQ ID NO: 1130821 - protein, 9 aa, Homo Sapiens
VWSPLQLLS

SEQ ID NO: 1130822 - protein, 9 aa, Homo Sapiens
SCQHLRPAG

SEQ ID NO: 1130823 - protein, 9 aa, Homo Sapiens
MKALQHKRL

SEQ ID NO: 1130824 - protein, 9 aa, Homo Sapiens
LWEMALTSI

SEQ ID NO: 1130825 - protein, 9 aa, Homo Sapiens
QDVIKNQQP

SEQ ID NO: 1130826 - protein, 9 aa, Homo Sapiens
MNLADPVGS

SEQ ID NO: 1130827 - protein, 9 aa, Homo Sapiens
LRVHPGAQA

SEQ ID NO: 1130828 - protein, 9 aa, Homo Sapiens
CKLLPDDRS

SEQ ID NO: 1130829 - protein, 9 aa, Homo Sapiens
ALQMTTNRR

SEQ ID NO: 1130830 - protein, 9 aa, Homo Sapiens
KILEAKQNG

SEQ ID NO: 1130831 - protein, 9 aa, Homo Sapiens
NDHFYNHKT

SEQ ID NO: 1130832 - protein, 9 aa, Homo Sapiens
RTCCHRTPW

SEQ ID NO: 1130833 - protein, 9 aa, Homo Sapiens
GKNKMNMDH

SEQ ID NO: 1130834 - protein, 9 aa, Homo Sapiens
AASEDAQQP

SEQ ID NO: 1130835 - protein, 9 aa, Homo Sapiens
QHLPWSISR

SEQ ID NO: 1130836 - protein, 9 aa, Homo Sapiens
CIFCILCLK

SEQ ID NO: 1130837 - protein, 9 aa, Homo Sapiens
GAQGLVQGQ

SEQ ID NO: 1130838 - protein, 9 aa, Homo Sapiens
SQGLSRKKE

SEQ ID NO: 1130839 - protein, 9 aa, Homo Sapiens
AVLMVIPNA

SEQ ID NO: 1130840 - protein, 9 aa, Homo Sapiens
SGERSSTKG

SEQ ID NO: 1130841 - protein, 9 aa, Homo Sapiens
RTRPVCQGQ

SEQ ID NO: 1130842 - protein, 9 aa, Homo Sapiens
PGMHYLDIV

SEQ ID NO: 1130843 - protein, 9 aa, Homo Sapiens
LEVHQLVDH

SEQ ID NO: 1130844 - protein, 9 aa, Homo Sapiens
NFSRSPPTL

SEQ ID NO: 1130845 - protein, 9 aa, Homo Sapiens
WLTILEALE

SEQ ID NO: 1130846 - protein, 9 aa, Homo Sapiens
RNTLGPQYL

SEQ ID NO: 1130847 - protein, 9 aa, Homo Sapiens
PQWAPHSAG

SEQ ID NO: 1130848 - protein, 9 aa, Homo Sapiens
LSNGLLLIK

SEQ ID NO: 1130849 - protein, 9 aa, Homo Sapiens
DSELMAQQY

SEQ ID NO: 1130850 - protein, 9 aa, Homo Sapiens
SSATDPISV

SEQ ID NO: 1130851 - protein, 9 aa, Homo Sapiens
DTICSGVTG

SEQ ID NO: 1130852 - protein, 9 aa, Homo Sapiens
RDVTGYLRT

SEQ ID NO: 1130853 - protein, 9 aa, Homo Sapiens
PRSSSAAPM

SEQ ID NO: 1130854 - protein, 9 aa, Homo Sapiens
RSLEGEFKI

SEQ ID NO: 1130855 - protein, 9 aa, Homo Sapiens
QRGYHKKSS

SEQ ID NO: 1130856 - protein, 9 aa, Homo Sapiens
RIKEAVWAK

SEQ ID NO: 1130857 - protein, 9 aa, Homo Sapiens
ADHGWAFSP

SEQ ID NO: 1130858 - protein, 9 aa, Homo Sapiens
LGKLEMVKA

SEQ ID NO: 1130859 - protein, 9 aa, Homo Sapiens
SHRMTHRLQ

SEQ ID NO: 1130860 - protein, 9 aa, Homo Sapiens
MSNGCWGWQ

SEQ ID NO: 1130861 - protein, 9 aa, Homo Sapiens
IPQCLQLQE

SEQ ID NO: 1130862 - protein, 9 aa, Homo Sapiens
EFEHCVQRA

SEQ ID NO: 1130863 - protein, 9 aa, Homo Sapiens
ADQILLQTQ

SEQ ID NO: 1130864 - protein, 9 aa, Homo Sapiens
SDQETGTAL

SEQ ID NO: 1130865 - protein, 9 aa, Homo Sapiens
HSNTGQDCP

SEQ ID NO: 1130866 - protein, 9 aa, Homo Sapiens
PPGLAPERL

SEQ ID NO: 1130867 - protein, 9 aa, Homo Sapiens
LSLDCGLWG

SEQ ID NO: 1130868 - protein, 9 aa, Homo Sapiens
QLFNQKKEQ

SEQ ID NO: 1130869 - protein, 9 aa, Homo Sapiens
ERAARRVLE

SEQ ID NO: 1130870 - protein, 9 aa, Homo Sapiens
RSVRPSTRA

SEQ ID NO: 1130871 - protein, 9 aa, Homo Sapiens
KGTYIRTGD

SEQ ID NO: 1130872 - protein, 9 aa, Homo Sapiens
MAQQYHAAS

SEQ ID NO: 1130873 - protein, 9 aa, Homo Sapiens
YYQVVKADT

SEQ ID NO: 1130874 - protein, 9 aa, Homo Sapiens
ARGLCSAAA

SEQ ID NO: 1130875 - protein, 9 aa, Homo Sapiens
EKATDELQR

SEQ ID NO: 1130876 - protein, 9 aa, Homo Sapiens
RRRPSCTDE

SEQ ID NO: 1130877 - protein, 9 aa, Homo Sapiens
GRCQSPAHA

SEQ ID NO: 1130878 - protein, 9 aa, Homo Sapiens
PPCLHDESL

SEQ ID NO: 1130879 - protein, 9 aa, Homo Sapiens
LAVRAESRQ

SEQ ID NO: 1130880 - protein, 9 aa, Homo Sapiens
PGVKGPDSP

SEQ ID NO: 1130881 - protein, 9 aa, Homo Sapiens
PAAHLRQEL

SEQ ID NO: 1130882 - protein, 9 aa, Homo Sapiens
LRLPCLLRF

SEQ ID NO: 1130883 - protein, 9 aa, Homo Sapiens
LWENTEFTD

SEQ ID NO: 1130884 - protein, 9 aa, Homo Sapiens
VGPSGTSRT

SEQ ID NO: 1130885 - protein, 9 aa, Homo Sapiens
TSFVQKVSV

SEQ ID NO: 1130886 - protein, 9 aa, Homo Sapiens
PAGTLPAPS

SEQ ID NO: 1130887 - protein, 9 aa, Homo Sapiens
QNFRTEDGG

SEQ ID NO: 1130888 - protein, 9 aa, Homo Sapiens
FLKVKARAF

SEQ ID NO: 1130889 - protein, 9 aa, Homo Sapiens
DPEEELAAL

SEQ ID NO: 1130890 - protein, 9 aa, Homo Sapiens
SPRVMEEVL

SEQ ID NO: 1130891 - protein, 9 aa, Homo Sapiens
SKVPGGSRP

SEQ ID NO: 1130892 - protein, 9 aa, Homo Sapiens
PAPPTRCVW

SEQ ID NO: 1130893 - protein, 9 aa, Homo Sapiens
AHAEERFFE

SEQ ID NO: 1130894 - protein, 9 aa, Homo Sapiens
EFTPPSGDM

SEQ ID NO: 1130895 - protein, 9 aa, Homo Sapiens
AVAAVSSSE

SEQ ID NO: 1130896 - protein, 9 aa, Homo Sapiens
AWHNVRVTR

SEQ ID NO: 1130897 - protein, 9 aa, Homo Sapiens
VELGNISAL

SEQ ID NO: 1130898 - protein, 9 aa, Homo Sapiens
VKQRKIGDH

SEQ ID NO: 1130899 - protein, 9 aa, Homo Sapiens
GCPLLASQW

SEQ ID NO: 1130900 - protein, 9 aa, Homo Sapiens
KFRKKLNQI

SEQ ID NO: 1130901 - protein, 9 aa, Homo Sapiens
QRVLLLLSP

SEQ ID NO: 1130902 - protein, 9 aa, Homo Sapiens
ICGSQIVAL

SEQ ID NO: 1130903 - protein, 9 aa, Homo Sapiens
SQAYGAGAY

SEQ ID NO: 1130904 - protein, 9 aa, Homo Sapiens
PALQGCRCT

SEQ ID NO: 1130905 - protein, 9 aa, Homo Sapiens
FSLAPGYSA

SEQ ID NO: 1130906 - protein, 9 aa, Homo Sapiens
LLLGLTIGL

SEQ ID NO: 1130907 - protein, 9 aa, Homo Sapiens
EETGKSHLL

SEQ ID NO: 1130908 - protein, 9 aa, Homo Sapiens
PPQPAAVHG

SEQ ID NO: 1130909 - protein, 9 aa, Homo Sapiens
CLSTNFLCL

SEQ ID NO: 1130910 - protein, 9 aa, Homo Sapiens
LHDGIKTSK

SEQ ID NO: 1130911 - protein, 9 aa, Homo Sapiens
TRLSLQGSK

SEQ ID NO: 1130912 - protein, 9 aa, Homo Sapiens
EAGHWRRCG

SEQ ID NO: 1130913 - protein, 9 aa, Homo Sapiens
GLGGNPVAV

SEQ ID NO: 1130914 - protein, 9 aa, Homo Sapiens
FLCLDHILF

SEQ ID NO: 1130915 - protein, 9 aa, Homo Sapiens
AQPSSGTKE

SEQ ID NO: 1130916 - protein, 9 aa, Homo Sapiens
IPRLQIWWK

SEQ ID NO: 1130917 - protein, 9 aa, Homo Sapiens
SMVDSLDIE

SEQ ID NO: 1130918 - protein, 9 aa, Homo Sapiens
FTEEPEPEA

SEQ ID NO: 1130919 - protein, 9 aa, Homo Sapiens
CDCEGTAGV

SEQ ID NO: 1130920 - protein, 9 aa, Homo Sapiens
HHNGTGDKS

SEQ ID NO: 1130921 - protein, 9 aa, Homo Sapiens
RPSLASSCT

SEQ ID NO: 1130922 - protein, 9 aa, Homo Sapiens
GYQLCSHHV

SEQ ID NO: 1130923 - protein, 9 aa, Homo Sapiens
RGPLPPYHS

SEQ ID NO: 1130924 - protein, 9 aa, Homo Sapiens
SPAGPAGTG

SEQ ID NO: 1130925 - protein, 9 aa, Homo Sapiens
SSCRSHGYG

SEQ ID NO: 1130926 - protein, 9 aa, Homo Sapiens
SYTTNKVHT

SEQ ID NO: 1130927 - protein, 9 aa, Homo Sapiens
LARETSLAS

SEQ ID NO: 1130928 - protein, 9 aa, Homo Sapiens
WKVQLPEPS

SEQ ID NO: 1130929 - protein, 9 aa, Homo Sapiens
LQIEPEKTR

SEQ ID NO: 1130930 - protein, 9 aa, Homo Sapiens
HVVNPDWLR

SEQ ID NO: 1130931 - protein, 9 aa, Homo Sapiens
LLQRESRPV

SEQ ID NO: 1130932 - protein, 9 aa, Homo Sapiens
RSEPKCDFH

SEQ ID NO: 1130933 - protein, 9 aa, Homo Sapiens
FTAEVLVQS

SEQ ID NO: 1130934 - protein, 9 aa, Homo Sapiens
AQDTDQNYD

SEQ ID NO: 1130935 - protein, 9 aa, Homo Sapiens
KKAAVWAPR

SEQ ID NO: 1130936 - protein, 9 aa, Homo Sapiens
MVVHNIYVW

SEQ ID NO: 1130937 - protein, 9 aa, Homo Sapiens
LLCWMPYHL

SEQ ID NO: 1130938 - protein, 9 aa, Homo Sapiens
DQERERERD

SEQ ID NO: 1130939 - protein, 9 aa, Homo Sapiens
DDLLFSITP

SEQ ID NO: 1130940 - protein, 9 aa, Homo Sapiens
MKLDWVNVM

SEQ ID NO: 1130941 - protein, 9 aa, Homo Sapiens
GCSRSLAKE

SEQ ID NO: 1130942 - protein, 9 aa, Homo Sapiens
LITEHSDLG

SEQ ID NO: 1130943 - protein, 9 aa, Homo Sapiens
NPFAADIGH

SEQ ID NO: 1130944 - protein, 9 aa, Homo Sapiens
QWNVLNRSG

SEQ ID NO: 1130945 - protein, 9 aa, Homo Sapiens
QITEWRSLA

SEQ ID NO: 1130946 - protein, 9 aa, Homo Sapiens
GAPLRSCIP

SEQ ID NO: 1130947 - protein, 9 aa, Homo Sapiens
DDVTAVLVI

SEQ ID NO: 1130948 - protein, 9 aa, Homo Sapiens
PALPGGRCQ

SEQ ID NO: 1130949 - protein, 9 aa, Homo Sapiens
IVDLTVEDK

SEQ ID NO: 1130950 - protein, 9 aa, Homo Sapiens
LRGEQGLPD

SEQ ID NO: 1130951 - protein, 9 aa, Homo Sapiens
APAAPPRSS

SEQ ID NO: 1130952 - protein, 9 aa, Homo Sapiens
RDLGIHVFD

SEQ ID NO: 1130953 - protein, 9 aa, Homo Sapiens
FPLDVCKLL

SEQ ID NO: 1130954 - protein, 9 aa, Homo Sapiens
DVDLLIGSS

SEQ ID NO: 1130955 - protein, 9 aa, Homo Sapiens
NLVTSGTSF

SEQ ID NO: 1130956 - protein, 9 aa, Homo Sapiens
FTLVTRGTS

SEQ ID NO: 1130957 - protein, 9 aa, Homo Sapiens
QSGPLAANG

SEQ ID NO: 1130958 - protein, 9 aa, Homo Sapiens
PPAQNLAAR

SEQ ID NO: 1130959 - protein, 9 aa, Homo Sapiens
AKAKVAFHL

SEQ ID NO: 1130960 - protein, 9 aa, Homo Sapiens
HGQRQQLAQ

SEQ ID NO: 1130961 - protein, 9 aa, Homo Sapiens
MCLHASGSR

SEQ ID NO: 1130962 - protein, 9 aa, Homo Sapiens
GLAKMAFCS

SEQ ID NO: 1130963 - protein, 9 aa, Homo Sapiens
RSPSLCSPR

SEQ ID NO: 1130964 - protein, 9 aa, Homo Sapiens
RGSVRRAGR

SEQ ID NO: 1130965 - protein, 9 aa, Homo Sapiens
ASQPSWNPK

SEQ ID NO: 1130966 - protein, 9 aa, Homo Sapiens
LLAGLCILV

SEQ ID NO: 1130967 - protein, 9 aa, Homo Sapiens
CRPRSRTGS

SEQ ID NO: 1130968 - protein, 9 aa, Homo Sapiens
RLVEWDVEE

SEQ ID NO: 1130969 - protein, 9 aa, Homo Sapiens
GVIEKRDAF

SEQ ID NO: 1130970 - protein, 9 aa, Homo Sapiens
GDVHVGLGR

SEQ ID NO: 1130971 - protein, 9 aa, Homo Sapiens
NDDLLFSIT

SEQ ID NO: 1130972 - protein, 9 aa, Homo Sapiens
KQGKKEQIE

SEQ ID NO: 1130973 - protein, 9 aa, Homo Sapiens
RCSAGKRGG

SEQ ID NO: 1130974 - protein, 9 aa, Homo Sapiens
QVGLASTVR

SEQ ID NO: 1130975 - protein, 9 aa, Homo Sapiens
IKIRDIPSY

SEQ ID NO: 1130976 - protein, 9 aa, Homo Sapiens
GFAQRERPG

SEQ ID NO: 1130977 - protein, 9 aa, Homo Sapiens
LQAADPTPS

SEQ ID NO: 1130978 - protein, 9 aa, Homo Sapiens
EVTCKSASV

SEQ ID NO: 1130979 - protein, 9 aa, Homo Sapiens
RDPTTEVHK

SEQ ID NO: 1130980 - protein, 9 aa, Homo Sapiens
AQLDVNLKP

SEQ ID NO: 1130981 - protein, 9 aa, Homo Sapiens
VATDLSPVK

SEQ ID NO: 1130982 - protein, 9 aa, Homo Sapiens
VHGTEKLIE

SEQ ID NO: 1130983 - protein, 9 aa, Homo Sapiens
YASACVNPP

SEQ ID NO: 1130984 - protein, 9 aa, Homo Sapiens
ITGYKIHYR

SEQ ID NO: 1130985 - protein, 9 aa, Homo Sapiens
GQKDALECC

SEQ ID NO: 1130986 - protein, 9 aa, Homo Sapiens
GDPSKQNLL

SEQ ID NO: 1130987 - protein, 9 aa, Homo Sapiens
RVELLRDAE

SEQ ID NO: 1130988 - protein, 9 aa, Homo Sapiens
YGTMRDNML

SEQ ID NO: 1130989 - protein, 9 aa, Homo Sapiens
RATLFQTMS

SEQ ID NO: 1130990 - protein, 9 aa, Homo Sapiens
NHRKKEVRK

SEQ ID NO: 1130991 - protein, 9 aa, Homo Sapiens
PTAAKPSAR

SEQ ID NO: 1130992 - protein, 9 aa, Homo Sapiens
VEGRVARGS

SEQ ID NO: 1130993 - protein, 9 aa, Homo Sapiens
PLPAPQGAL

SEQ ID NO: 1130994 - protein, 9 aa, Homo Sapiens
CLSESDAPT

SEQ ID NO: 1130995 - protein, 9 aa, Homo Sapiens
GSMDAAKEA

SEQ ID NO: 1130996 - protein, 9 aa, Homo Sapiens
PPTPIYQVL

SEQ ID NO: 1130997 - protein, 9 aa, Homo Sapiens
DRLKWHLLS

SEQ ID NO: 1130998 - protein, 9 aa, Homo Sapiens
HYIMLHIGI

SEQ ID NO: 1130999 - protein, 9 aa, Homo Sapiens
AMIRKADVD

SEQ ID NO: 1131000 - protein, 9 aa, Homo Sapiens
GERRRRTPT

SEQ ID NO: 1131001 - protein, 9 aa, Homo Sapiens
PLFPLLSRP

SEQ ID NO: 1131002 - protein, 9 aa, Homo Sapiens
PGRPARPGT

SEQ ID NO: 1131003 - protein, 9 aa, Homo Sapiens
LHPQWAPHS

SEQ ID NO: 1131004 - protein, 9 aa, Homo Sapiens
SLSRTAQDS

SEQ ID NO: 1131005 - protein, 9 aa, Homo Sapiens
VGLTGNTAI

SEQ ID NO: 1131006 - protein, 9 aa, Homo Sapiens
QGWSCPWAG

SEQ ID NO: 1131007 - protein, 9 aa, Homo Sapiens
CLLSLRAQS

SEQ ID NO: 1131008 - protein, 9 aa, Homo Sapiens
LWSGDKAIS

SEQ ID NO: 1131009 - protein, 9 aa, Homo Sapiens
YVGIGCEQD

SEQ ID NO: 1131010 - protein, 9 aa, Homo Sapiens
KFYFRFTSH

SEQ ID NO: 1131011 - protein, 9 aa, Homo Sapiens
LPGYTQPSD

SEQ ID NO: 1131012 - protein, 9 aa, Homo Sapiens
IRIGMYMLH

SEQ ID NO: 1131013 - protein, 9 aa, Homo Sapiens
FCLLLPTDV

SEQ ID NO: 1131014 - protein, 9 aa, Homo Sapiens
GDGRIFAVR

SEQ ID NO: 1131015 - protein, 9 aa, Homo Sapiens
SGQKREMCA

SEQ ID NO: 1131016 - protein, 9 aa, Homo Sapiens
GEHKDIVSS

SEQ ID NO: 1131017 - protein, 9 aa, Homo Sapiens
GPTACPVKQ

SEQ ID NO: 1131018 - protein, 9 aa, Homo Sapiens
LTIHIDEEL

SEQ ID NO: 1131019 - protein, 9 aa, Homo Sapiens
RMSPTDALV

SEQ ID NO: 1131020 - protein, 9 aa, Homo Sapiens
EMALPFSLA

SEQ ID NO: 1131021 - protein, 9 aa, Homo Sapiens
GHSHPGELG

SEQ ID NO: 1131022 - protein, 9 aa, Homo Sapiens
VLESALTDI

SEQ ID NO: 1131023 - protein, 9 aa, Homo Sapiens
PGGAPGAPP

SEQ ID NO: 1131024 - protein, 9 aa, Homo Sapiens
EEVVCLLFP

SEQ ID NO: 1131025 - protein, 9 aa, Homo Sapiens
SGETTHRDK

SEQ ID NO: 1131026 - protein, 9 aa, Homo Sapiens
CCCRCKGWR

SEQ ID NO: 1131027 - protein, 9 aa, Homo Sapiens
VISSYVHVQ

SEQ ID NO: 1131028 - protein, 9 aa, Homo Sapiens
EDPLFPSTD

SEQ ID NO: 1131029 - protein, 9 aa, Homo Sapiens
GPVFPPLIP

SEQ ID NO: 1131030 - protein, 9 aa, Homo Sapiens
PPARGPQPV

SEQ ID NO: 1131031 - protein, 9 aa, Homo Sapiens
PFRDVPSHS

SEQ ID NO: 1131032 - protein, 9 aa, Homo Sapiens
TPIAEVSEL

SEQ ID NO: 1131033 - protein, 9 aa, Homo Sapiens
LPWKIRDSN

SEQ ID NO: 1131034 - protein, 9 aa, Homo Sapiens
NIHAIQNSF

SEQ ID NO: 1131035 - protein, 9 aa, Homo Sapiens
LQPLPQCPS

SEQ ID NO: 1131036 - protein, 9 aa, Homo Sapiens
QSLHVVKRK

SEQ ID NO: 1131037 - protein, 9 aa, Homo Sapiens
EAFTKSVEV

SEQ ID NO: 1131038 - protein, 9 aa, Homo Sapiens
VRLRHRLPC

SEQ ID NO: 1131039 - protein, 9 aa, Homo Sapiens
YKCDLFEQF

SEQ ID NO: 1131040 - protein, 9 aa, Homo Sapiens
LPPPGGPRH

SEQ ID NO: 1131041 - protein, 9 aa, Homo Sapiens
VLQATGGDE

SEQ ID NO: 1131042 - protein, 9 aa, Homo Sapiens
SKLPGYASH

SEQ ID NO: 1131043 - protein, 9 aa, Homo Sapiens
VCDCEGTAG

SEQ ID NO: 1131044 - protein, 9 aa, Homo Sapiens
PGPPPLSSS

SEQ ID NO: 1131045 - protein, 9 aa, Homo Sapiens
RCLRLLTTA

SEQ ID NO: 1131046 - protein, 9 aa, Homo Sapiens
TPPRAAAPA

SEQ ID NO: 1131047 - protein, 9 aa, Homo Sapiens
CSTCGKVFS

SEQ ID NO: 1131048 - protein, 9 aa, Homo Sapiens
ARELRVSSE

SEQ ID NO: 1131049 - protein, 9 aa, Homo Sapiens
WSRKAENVP

SEQ ID NO: 1131050 - protein, 9 aa, Homo Sapiens
LSRPRSAAS

SEQ ID NO: 1131051 - protein, 9 aa, Homo Sapiens
GAYIPPQVF

SEQ ID NO: 1131052 - protein, 9 aa, Homo Sapiens
SKNPKNHYE

SEQ ID NO: 1131053 - protein, 9 aa, Homo Sapiens
APGGGVAYN

SEQ ID NO: 1131054 - protein, 9 aa, Homo Sapiens
REFDNMVKV

SEQ ID NO: 1131055 - protein, 9 aa, Homo Sapiens
NTVKVNGTH

SEQ ID NO: 1131056 - protein, 9 aa, Homo Sapiens
TPHHPFQGS

SEQ ID NO: 1131057 - protein, 9 aa, Homo Sapiens
LASSCTPGL

SEQ ID NO: 1131058 - protein, 9 aa, Homo Sapiens
GTTLPSRGS

SEQ ID NO: 1131059 - protein, 9 aa, Homo Sapiens
GMPHLCSTG

SEQ ID NO: 1131060 - protein, 9 aa, Homo Sapiens
PLRRLGSEV

SEQ ID NO: 1131061 - protein, 9 aa, Homo Sapiens
PPVLPAGRI

SEQ ID NO: 1131062 - protein, 9 aa, Homo Sapiens
LSAAIFVYA

SEQ ID NO: 1131063 - protein, 9 aa, Homo Sapiens
PKVAQCLLD

SEQ ID NO: 1131064 - protein, 9 aa, Homo Sapiens
QRIVSTMSK

SEQ ID NO: 1131065 - protein, 9 aa, Homo Sapiens
TLYWPEEGY

SEQ ID NO: 1131066 - protein, 9 aa, Homo Sapiens
SSIDLQAKH

SEQ ID NO: 1131067 - protein, 9 aa, Homo Sapiens
DSPKNSNIA

SEQ ID NO: 1131068 - protein, 9 aa, Homo Sapiens
AVACRFHSP

SEQ ID NO: 1131069 - protein, 9 aa, Homo Sapiens
TSAPRITAA

SEQ ID NO: 1131070 - protein, 9 aa, Homo Sapiens
TLTTRLHRL

SEQ ID NO: 1131071 - protein, 9 aa, Homo Sapiens
KKFSILPSS

SEQ ID NO: 1131072 - protein, 9 aa, Homo Sapiens
PVWLHARLI

SEQ ID NO: 1131073 - protein, 9 aa, Homo Sapiens
VLNGKGLGE

SEQ ID NO: 1131074 - protein, 9 aa, Homo Sapiens
FVSSKHWGD

SEQ ID NO: 1131075 - protein, 9 aa, Homo Sapiens
AESGLVPAA

SEQ ID NO: 1131076 - protein, 9 aa, Homo Sapiens
ALLYPRPWR

SEQ ID NO: 1131077 - protein, 9 aa, Homo Sapiens
LQRIVSTMS

SEQ ID NO: 1131078 - protein, 9 aa, Homo Sapiens
SGVGLDEVV

SEQ ID NO: 1131079 - protein, 9 aa, Homo Sapiens
PFPPTPMDS

SEQ ID NO: 1131080 - protein, 9 aa, Homo Sapiens
AMMQALKYF

SEQ ID NO: 1131081 - protein, 9 aa, Homo Sapiens
HQLRHPLHP

SEQ ID NO: 1131082 - protein, 9 aa, Homo Sapiens
VSSSEETAP

SEQ ID NO: 1131083 - protein, 9 aa, Homo Sapiens
LRVSSEKLH

SEQ ID NO: 1131084 - protein, 9 aa, Homo Sapiens
RPLYFWFYF

SEQ ID NO: 1131085 - protein, 9 aa, Homo Sapiens
IKEAVWAKN

SEQ ID NO: 1131086 - protein, 9 aa, Homo Sapiens
SEASSSPLW

SEQ ID NO: 1131087 - protein, 9 aa, Homo Sapiens
YNLGCLYAD

SEQ ID NO: 1131088 - protein, 9 aa, Homo Sapiens
PDQWCPDGS

SEQ ID NO: 1131089 - protein, 9 aa, Homo Sapiens
LLLMSWKQM

SEQ ID NO: 1131090 - protein, 9 aa, Homo Sapiens
SQPRNQTLD

SEQ ID NO: 1131091 - protein, 9 aa, Homo Sapiens
VADKKLSRP

SEQ ID NO: 1131092 - protein, 9 aa, Homo Sapiens
TGERALPLP

SEQ ID NO: 1131093 - protein, 9 aa, Homo Sapiens
CGKGFAQHS

SEQ ID NO: 1131094 - protein, 9 aa, Homo Sapiens
STRLAVSTR

SEQ ID NO: 1131095 - protein, 9 aa, Homo Sapiens
FSEDVYTLI

SEQ ID NO: 1131096 - protein, 9 aa, Homo Sapiens
PSAVARMCL

SEQ ID NO: 1131097 - protein, 9 aa, Homo Sapiens
SVLEKGSVT

SEQ ID NO: 1131098 - protein, 9 aa, Homo Sapiens
DVGIITQET

SEQ ID NO: 1131099 - protein, 9 aa, Homo Sapiens
KCLMKTSRC

SEQ ID NO: 1131100 - protein, 9 aa, Homo Sapiens
VNRPRPPTR

SEQ ID NO: 1131101 - protein, 9 aa, Homo Sapiens
KAMYYLKEK

SEQ ID NO: 1131102 - protein, 9 aa, Homo Sapiens
SHCPRAATL

SEQ ID NO: 1131103 - protein, 9 aa, Homo Sapiens
AQAEQRVLL

SEQ ID NO: 1131104 - protein, 9 aa, Homo Sapiens
RKYVFDRAN

SEQ ID NO: 1131105 - protein, 9 aa, Homo Sapiens
GPSSQLWRW

SEQ ID NO: 1131106 - protein, 9 aa, Homo Sapiens
AVSSSEETA

SEQ ID NO: 1131107 - protein, 9 aa, Homo Sapiens
VLWELCCRT

SEQ ID NO: 1131108 - protein, 9 aa, Homo Sapiens
AKFSAFIKK

SEQ ID NO: 1131109 - protein, 9 aa, Homo Sapiens
GPNIPKQFV

SEQ ID NO: 1131110 - protein, 9 aa, Homo Sapiens
YDQQVPFMA

SEQ ID NO: 1131111 - protein, 9 aa, Homo Sapiens
QARGSGSHC

SEQ ID NO: 1131112 - protein, 9 aa, Homo Sapiens
DIRKYKVLS

SEQ ID NO: 1131113 - protein, 9 aa, Homo Sapiens
GLVQTTCWP

SEQ ID NO: 1131114 - protein, 9 aa, Homo Sapiens
TATTRTRSP

SEQ ID NO: 1131115 - protein, 9 aa, Homo Sapiens
TGQLPVSPS

SEQ ID NO: 1131116 - protein, 9 aa, Homo Sapiens
GEAFYGVSS

SEQ ID NO: 1131117 - protein, 9 aa, Homo Sapiens
ETNKNITWG

SEQ ID NO: 1131118 - protein, 9 aa, Homo Sapiens
LCPECSCGR

SEQ ID NO: 1131119 - protein, 9 aa, Homo Sapiens
PPLPERKTS

SEQ ID NO: 1131120 - protein, 9 aa, Homo Sapiens
CRSGRNSAG

SEQ ID NO: 1131121 - protein, 9 aa, Homo Sapiens
TSNKVRNHR

SEQ ID NO: 1131122 - protein, 9 aa, Homo Sapiens
TRTLKITTN

SEQ ID NO: 1131123 - protein, 9 aa, Homo Sapiens
VGERAPRTP

SEQ ID NO: 1131124 - protein, 9 aa, Homo Sapiens
EQRGVAQPW

SEQ ID NO: 1131125 - protein, 9 aa, Homo Sapiens
KMSQLLSVY

SEQ ID NO: 1131126 - protein, 9 aa, Homo Sapiens
PPTSWAALP

SEQ ID NO: 1131127 - protein, 9 aa, Homo Sapiens
GSAMQSLYI

SEQ ID NO: 1131128 - protein, 9 aa, Homo Sapiens
AVGGREPCA

SEQ ID NO: 1131129 - protein, 9 aa, Homo Sapiens
LGTVEWTQD

SEQ ID NO: 1131130 - protein, 9 aa, Homo Sapiens
AGRASGFAR

SEQ ID NO: 1131131 - protein, 9 aa, Homo Sapiens
EVISNALSK

SEQ ID NO: 1131132 - protein, 9 aa, Homo Sapiens
TPPAWLVWV

SEQ ID NO: 1131133 - protein, 9 aa, Homo Sapiens
PRSEVCGGT

SEQ ID NO: 1131134 - protein, 9 aa, Homo Sapiens
VEVLAETCT

SEQ ID NO: 1131135 - protein, 9 aa, Homo Sapiens
VLDASELGM

SEQ ID NO: 1131136 - protein, 9 aa, Homo Sapiens
DCTDMFVVE

SEQ ID NO: 1131137 - protein, 9 aa, Homo Sapiens
TTRTSLPPT

SEQ ID NO: 1131138 - protein, 9 aa, Homo Sapiens
TACSILARL

SEQ ID NO: 1131139 - protein, 9 aa, Homo Sapiens
HLCQTLAIT

SEQ ID NO: 1131140 - protein, 9 aa, Homo Sapiens
KFMADLKEL

SEQ ID NO: 1131141 - protein, 9 aa, Homo Sapiens
SNARVFKEL

SEQ ID NO: 1131142 - protein, 9 aa, Homo Sapiens
KISLSTVLS

SEQ ID NO: 1131143 - protein, 9 aa, Homo Sapiens
ALRDLWTDN

SEQ ID NO: 1131144 - protein, 9 aa, Homo Sapiens
IKEIATDPE

SEQ ID NO: 1131145 - protein, 9 aa, Homo Sapiens
GSQRTSSAM

SEQ ID NO: 1131146 - protein, 9 aa, Homo Sapiens
CNLHLPCFQ

SEQ ID NO: 1131147 - protein, 9 aa, Homo Sapiens
VAMRKAAAK

SEQ ID NO: 1131148 - protein, 9 aa, Homo Sapiens
QAWVAEQYE

SEQ ID NO: 1131149 - protein, 9 aa, Homo Sapiens
DSFDEDLTR

SEQ ID NO: 1131150 - protein, 9 aa, Homo Sapiens
GTAGVCRKA

SEQ ID NO: 1131151 - protein, 9 aa, Homo Sapiens
PVPDAPSPT

SEQ ID NO: 1131152 - protein, 9 aa, Homo Sapiens
PPLPPWPAS

SEQ ID NO: 1131153 - protein, 9 aa, Homo Sapiens
GTSSPSLPH

SEQ ID NO: 1131154 - protein, 9 aa, Homo Sapiens
RETPIFVKA

SEQ ID NO: 1131155 - protein, 9 aa, Homo Sapiens
PGNLRSLLP

SEQ ID NO: 1131156 - protein, 9 aa, Homo Sapiens
LRCPAVPAA

SEQ ID NO: 1131157 - protein, 9 aa, Homo Sapiens
VYEEVKRGA

SEQ ID NO: 1131158 - protein, 9 aa, Homo Sapiens
PQPVTRGRR

SEQ ID NO: 1131159 - protein, 9 aa, Homo Sapiens
KGFSDEDST

SEQ ID NO: 1131160 - protein, 9 aa, Homo Sapiens
VAFIILEKN

SEQ ID NO: 1131161 - protein, 9 aa, Homo Sapiens
SMTSPFKQE

SEQ ID NO: 1131162 - protein, 9 aa, Homo Sapiens
TPKQPAPKL

SEQ ID NO: 1131163 - protein, 9 aa, Homo Sapiens
PGLRPCRCC

SEQ ID NO: 1131164 - protein, 9 aa, Homo Sapiens
QLLTDRAFQ

SEQ ID NO: 1131165 - protein, 9 aa, Homo Sapiens
RIDLFDFQS

SEQ ID NO: 1131166 - protein, 9 aa, Homo Sapiens
REQVLKVCV

SEQ ID NO: 1131167 - protein, 9 aa, Homo Sapiens
PATIINLLR

SEQ ID NO: 1131168 - protein, 9 aa, Homo Sapiens
DNVQLVSGV

SEQ ID NO: 1131169 - protein, 9 aa, Homo Sapiens
LAAISDFYY

SEQ ID NO: 1131170 - protein, 9 aa, Homo Sapiens
APPARDPPR

SEQ ID NO: 1131171 - protein, 9 aa, Homo Sapiens
AVALLAVSD

SEQ ID NO: 1131172 - protein, 9 aa, Homo Sapiens
LVATPALPT

SEQ ID NO: 1131173 - protein, 9 aa, Homo Sapiens
RRRSCRHSV

SEQ ID NO: 1131174 - protein, 9 aa, Homo Sapiens
AGEKPYHCP

SEQ ID NO: 1131175 - protein, 9 aa, Homo Sapiens
RGTLHTTLA

SEQ ID NO: 1131176 - protein, 9 aa, Homo Sapiens
SAKGPKGGE

SEQ ID NO: 1131177 - protein, 9 aa, Homo Sapiens
RPRPPTRPS

SEQ ID NO: 1131178 - protein, 9 aa, Homo Sapiens
SVSGARGWA

SEQ ID NO: 1131179 - protein, 9 aa, Homo Sapiens
MAVLGYEWV

SEQ ID NO: 1131180 - protein, 9 aa, Homo Sapiens
VDCEQAVVH

SEQ ID NO: 1131181 - protein, 9 aa, Homo Sapiens
HIEGSSWLP

SEQ ID NO: 1131182 - protein, 9 aa, Homo Sapiens
ALGSARGGQ

SEQ ID NO: 1131183 - protein, 9 aa, Homo Sapiens
CGLWGPFEE

SEQ ID NO: 1131184 - protein, 9 aa, Homo Sapiens
MAVEFGNHM

SEQ ID NO: 1131185 - protein, 9 aa, Homo Sapiens
AAGGADPPN

SEQ ID NO: 1131186 - protein, 9 aa, Homo Sapiens
RCTSTATRA

SEQ ID NO: 1131187 - protein, 9 aa, Homo Sapiens
SMTNLVRYI

SEQ ID NO: 1131188 - protein, 9 aa, Homo Sapiens
SLGCEELQW

SEQ ID NO: 1131189 - protein, 9 aa, Homo Sapiens
AMGTGIRTR

SEQ ID NO: 1131190 - protein, 9 aa, Homo Sapiens
NVLNRSGRW

SEQ ID NO: 1131191 - protein, 9 aa, Homo Sapiens
LPLSYVPDA

SEQ ID NO: 1131192 - protein, 9 aa, Homo Sapiens
PTSGARLGA

SEQ ID NO: 1131193 - protein, 9 aa, Homo Sapiens
DKPGKSCDF

SEQ ID NO: 1131194 - protein, 9 aa, Homo Sapiens
DTLLGALGR

SEQ ID NO: 1131195 - protein, 9 aa, Homo Sapiens
GVIRELAVR

SEQ ID NO: 1131196 - protein, 9 aa, Homo Sapiens
TMAEKFSDL

SEQ ID NO: 1131197 - protein, 9 aa, Homo Sapiens
DERLLLQER

SEQ ID NO: 1131198 - protein, 9 aa, Homo Sapiens
TKKSLILFP

SEQ ID NO: 1131199 - protein, 9 aa, Homo Sapiens
ARVTLVTAP

SEQ ID NO: 1131200 - protein, 9 aa, Homo Sapiens
DPLNEQWEE

SEQ ID NO: 1131201 - protein, 9 aa, Homo Sapiens
FPSEGVSIW

SEQ ID NO: 1131202 - protein, 9 aa, Homo Sapiens
ERGGVATPG

SEQ ID NO: 1131203 - protein, 9 aa, Homo Sapiens
PPPPTKKRG

SEQ ID NO: 1131204 - protein, 9 aa, Homo Sapiens
ATDPEEAGK

SEQ ID NO: 1131205 - protein, 9 aa, Homo Sapiens
GGNCHRCDH

SEQ ID NO: 1131206 - protein, 9 aa, Homo Sapiens
WEDQIPRGF

SEQ ID NO: 1131207 - protein, 9 aa, Homo Sapiens
VDLTVEDKD

SEQ ID NO: 1131208 - protein, 9 aa, Homo Sapiens
ATASTCRCG

SEQ ID NO: 1131209 - protein, 9 aa, Homo Sapiens
SGSPRRRPC

SEQ ID NO: 1131210 - protein, 9 aa, Homo Sapiens
KVVEKCGCA

SEQ ID NO: 1131211 - protein, 9 aa, Homo Sapiens
RCLALFLAR

SEQ ID NO: 1131212 - protein, 9 aa, Homo Sapiens
LELLTVAVE

SEQ ID NO: 1131213 - protein, 9 aa, Homo Sapiens
TRPVCQGQM

SEQ ID NO: 1131214 - protein, 9 aa, Homo Sapiens
EHGQRQQLA

SEQ ID NO: 1131215 - protein, 9 aa, Homo Sapiens
KKTAKRKIK

SEQ ID NO: 1131216 - protein, 9 aa, Homo Sapiens
VDYCIHLVE

SEQ ID NO: 1131217 - protein, 9 aa, Homo Sapiens
PGGGAWLLG

SEQ ID NO: 1131218 - protein, 9 aa, Homo Sapiens
GVADYLTAG

SEQ ID NO: 1131219 - protein, 9 aa, Homo Sapiens
ACLCVILVG

SEQ ID NO: 1131220 - protein, 9 aa, Homo Sapiens
TCYMEEMRH

SEQ ID NO: 1131221 - protein, 9 aa, Homo Sapiens
NQDAPAACL

SEQ ID NO: 1131222 - protein, 9 aa, Homo Sapiens
EPGYERMEQ

SEQ ID NO: 1131223 - protein, 9 aa, Homo Sapiens
PVLLLLLLL

SEQ ID NO: 1131224 - protein, 9 aa, Homo Sapiens
YVTRRCTAV

SEQ ID NO: 1131225 - protein, 9 aa, Homo Sapiens
APPPLPSLR

SEQ ID NO: 1131226 - protein, 9 aa, Homo Sapiens
NTECKAGLA

SEQ ID NO: 1131227 - protein, 9 aa, Homo Sapiens
FPVYNANIN

SEQ ID NO: 1131228 - protein, 9 aa, Homo Sapiens
RAAVQLMAE

SEQ ID NO: 1131229 - protein, 9 aa, Homo Sapiens
SARPGEIAC

SEQ ID NO: 1131230 - protein, 9 aa, Homo Sapiens
APTKKSLIL

SEQ ID NO: 1131231 - protein, 9 aa, Homo Sapiens
PRQPTGAHR

SEQ ID NO: 1131232 - protein, 9 aa, Homo Sapiens
WARTRSRRT

SEQ ID NO: 1131233 - protein, 9 aa, Homo Sapiens
SACVNPPGL

SEQ ID NO: 1131234 - protein, 9 aa, Homo Sapiens
VLSEEQIQK

SEQ ID NO: 1131235 - protein, 9 aa, Homo Sapiens
YRDSRFLRP

SEQ ID NO: 1131236 - protein, 9 aa, Homo Sapiens
WYKQHLSCR

SEQ ID NO: 1131237 - protein, 9 aa, Homo Sapiens
PAPKLEPSF

SEQ ID NO: 1131238 - protein, 9 aa, Homo Sapiens
TISQQLSLE

SEQ ID NO: 1131239 - protein, 9 aa, Homo Sapiens
LRSEPKCDF

SEQ ID NO: 1131240 - protein, 9 aa, Homo Sapiens
VEESLPGAM

SEQ ID NO: 1131241 - protein, 9 aa, Homo Sapiens
HPRPAPEPT

SEQ ID NO: 1131242 - protein, 9 aa, Homo Sapiens
MVMSNQKEV

SEQ ID NO: 1131243 - protein, 9 aa, Homo Sapiens
REHTLHRCQ

SEQ ID NO: 1131244 - protein, 9 aa, Homo Sapiens
PLAANGPRG

SEQ ID NO: 1131245 - protein, 9 aa, Homo Sapiens
QTTDAIFAR

SEQ ID NO: 1131246 - protein, 9 aa, Homo Sapiens
KLAVTSCAD

SEQ ID NO: 1131247 - protein, 9 aa, Homo Sapiens
LAPGYSAQL

SEQ ID NO: 1131248 - protein, 9 aa, Homo Sapiens
EQVLKVCVN

SEQ ID NO: 1131249 - protein, 9 aa, Homo Sapiens
AALLLRSSM

SEQ ID NO: 1131250 - protein, 9 aa, Homo Sapiens
KQTPVARTL

SEQ ID NO: 1131251 - protein, 9 aa, Homo Sapiens
VSDGDYLNP

SEQ ID NO: 1131252 - protein, 9 aa, Homo Sapiens
TAFSNMDNM

SEQ ID NO: 1131253 - protein, 9 aa, Homo Sapiens
EDDDQSETV

SEQ ID NO: 1131254 - protein, 9 aa, Homo Sapiens
TTSSSRFFV

SEQ ID NO: 1131255 - protein, 9 aa, Homo Sapiens
LGSAEGAGQ

SEQ ID NO: 1131256 - protein, 9 aa, Homo Sapiens
GRKPGAQET

SEQ ID NO: 1131257 - protein, 9 aa, Homo Sapiens
VQIPFPRCS

SEQ ID NO: 1131258 - protein, 9 aa, Homo Sapiens
VEKRRRGQP

SEQ ID NO: 1131259 - protein, 9 aa, Homo Sapiens
DALARRILS

SEQ ID NO: 1131260 - protein, 9 aa, Homo Sapiens
PIAPTKKSL

SEQ ID NO: 1131261 - protein, 9 aa, Homo Sapiens
GSVVNVKPT

SEQ ID NO: 1131262 - protein, 9 aa, Homo Sapiens
HVPGRVTQL

SEQ ID NO: 1131263 - protein, 9 aa, Homo Sapiens
GASGWSASC

SEQ ID NO: 1131264 - protein, 9 aa, Homo Sapiens
LGEAEHING

SEQ ID NO: 1131265 - protein, 9 aa, Homo Sapiens
PRAVITGHD

SEQ ID NO: 1131266 - protein, 9 aa, Homo Sapiens
RTRLLPATS

SEQ ID NO: 1131267 - protein, 9 aa, Homo Sapiens
VGLRNGIKG

SEQ ID NO: 1131268 - protein, 9 aa, Homo Sapiens
YFMLVKNEI

SEQ ID NO: 1131269 - protein, 9 aa, Homo Sapiens
DEDDGANHS

SEQ ID NO: 1131270 - protein, 9 aa, Homo Sapiens
PTYLLVTYH

SEQ ID NO: 1131271 - protein, 9 aa, Homo Sapiens
WAPRRTPML

SEQ ID NO: 1131272 - protein, 9 aa, Homo Sapiens
TASSCLSHG

SEQ ID NO: 1131273 - protein, 9 aa, Homo Sapiens
VAAIMAITS

SEQ ID NO: 1131274 - protein, 9 aa, Homo Sapiens
ARRARWDLR

SEQ ID NO: 1131275 - protein, 9 aa, Homo Sapiens
TAACVLKGL

SEQ ID NO: 1131276 - protein, 9 aa, Homo Sapiens
CLGTQTFCS

SEQ ID NO: 1131277 - protein, 9 aa, Homo Sapiens
NTPLWLNTG

SEQ ID NO: 1131278 - protein, 9 aa, Homo Sapiens
DDEATDYCS

SEQ ID NO: 1131279 - protein, 9 aa, Homo Sapiens
LNKKERRCN

SEQ ID NO: 1131280 - protein, 9 aa, Homo Sapiens
SSSYETYDE

SEQ ID NO: 1131281 - protein, 9 aa, Homo Sapiens
MIHTGENPY

SEQ ID NO: 1131282 - protein, 9 aa, Homo Sapiens
TFPKGIAGS

SEQ ID NO: 1131283 - protein, 9 aa, Homo Sapiens
AKSPSPATS

SEQ ID NO: 1131284 - protein, 9 aa, Homo Sapiens
CTLSTEAQR

SEQ ID NO: 1131285 - protein, 9 aa, Homo Sapiens
SASHRELLA

SEQ ID NO: 1131286 - protein, 9 aa, Homo Sapiens
MMQALKYFH

SEQ ID NO: 1131287 - protein, 9 aa, Homo Sapiens
QYVKTISPL

SEQ ID NO: 1131288 - protein, 9 aa, Homo Sapiens
VISTVEWGA

SEQ ID NO: 1131289 - protein, 9 aa, Homo Sapiens
SRGTATPSS

SEQ ID NO: 1131290 - protein, 9 aa, Homo Sapiens
GDYLNPPVI

SEQ ID NO: 1131291 - protein, 9 aa, Homo Sapiens
LPPTTASGC

SEQ ID NO: 1131292 - protein, 9 aa, Homo Sapiens
LKKRILCGK

SEQ ID NO: 1131293 - protein, 9 aa, Homo Sapiens
GRHPSWPWT

SEQ ID NO: 1131294 - protein, 9 aa, Homo Sapiens
QNFTEAAYA

SEQ ID NO: 1131295 - protein, 9 aa, Homo Sapiens
KDGHIVNVT

SEQ ID NO: 1131296 - protein, 9 aa, Homo Sapiens
LQSALQGPS

SEQ ID NO: 1131297 - protein, 9 aa, Homo Sapiens
RDSNINGHV

SEQ ID NO: 1131298 - protein, 9 aa, Homo Sapiens
LPAGPPPGG

SEQ ID NO: 1131299 - protein, 9 aa, Homo Sapiens
SSTFRDHKR

SEQ ID NO: 1131300 - protein, 9 aa, Homo Sapiens
RGRDADASP

SEQ ID NO: 1131301 - protein, 9 aa, Homo Sapiens
IAKKGLVEH

SEQ ID NO: 1131302 - protein, 9 aa, Homo Sapiens
LRSLLPPAS

SEQ ID NO: 1131303 - protein, 9 aa, Homo Sapiens
MHLELKDLT

SEQ ID NO: 1131304 - protein, 9 aa, Homo Sapiens
EQGLRVIEI

SEQ ID NO: 1131305 - protein, 9 aa, Homo Sapiens
PTQWIVTFG

SEQ ID NO: 1131306 - protein, 9 aa, Homo Sapiens
TQQGMPAFS

SEQ ID NO: 1131307 - protein, 9 aa, Homo Sapiens
SIVGHSPLS

SEQ ID NO: 1131308 - protein, 9 aa, Homo Sapiens
TMRRAFRGP

SEQ ID NO: 1131309 - protein, 9 aa, Homo Sapiens
SKGAQKSLE

SEQ ID NO: 1131310 - protein, 9 aa, Homo Sapiens
SRPRSAASL

SEQ ID NO: 1131311 - protein, 9 aa, Homo Sapiens
THRDKVPGG

SEQ ID NO: 1131312 - protein, 9 aa, Homo Sapiens
LPIVNDYDE

SEQ ID NO: 1131313 - protein, 9 aa, Homo Sapiens
QTDGVPERT

SEQ ID NO: 1131314 - protein, 9 aa, Homo Sapiens
KCHFRAKGI

SEQ ID NO: 1131315 - protein, 9 aa, Homo Sapiens
EALLLMSWK

SEQ ID NO: 1131316 - protein, 9 aa, Homo Sapiens
PPAWLVWVP

SEQ ID NO: 1131317 - protein, 9 aa, Homo Sapiens
EDVCENIIT

SEQ ID NO: 1131318 - protein, 9 aa, Homo Sapiens
TFYDSRQSV

SEQ ID NO: 1131319 - protein, 9 aa, Homo Sapiens
AATPVVTVP

SEQ ID NO: 1131320 - protein, 9 aa, Homo Sapiens
TGILLFLAL

SEQ ID NO: 1131321 - protein, 9 aa, Homo Sapiens
MREEVSFFI

SEQ ID NO: 1131322 - protein, 9 aa, Homo Sapiens
AVATDLSPV

SEQ ID NO: 1131323 - protein, 9 aa, Homo Sapiens
CMVRGKHFT

SEQ ID NO: 1131324 - protein, 9 aa, Homo Sapiens
ARSPTSAPT

SEQ ID NO: 1131325 - protein, 9 aa, Homo Sapiens
KNSNIAGTV

SEQ ID NO: 1131326 - protein, 9 aa, Homo Sapiens
FGRCFQKYG

SEQ ID NO: 1131327 - protein, 9 aa, Homo Sapiens
VPALLVLLL

SEQ ID NO: 1131328 - protein, 9 aa, Homo Sapiens
LPLESLYQA

SEQ ID NO: 1131329 - protein, 9 aa, Homo Sapiens
LTQMFDAKN

SEQ ID NO: 1131330 - protein, 9 aa, Homo Sapiens
TNADALHVR

SEQ ID NO: 1131331 - protein, 9 aa, Homo Sapiens
TNLQMTAVT

SEQ ID NO: 1131332 - protein, 9 aa, Homo Sapiens
TLGVGDKFK

SEQ ID NO: 1131333 - protein, 9 aa, Homo Sapiens
FFVAAIERV

SEQ ID NO: 1131334 - protein, 9 aa, Homo Sapiens
PGKVVTVRS

SEQ ID NO: 1131335 - protein, 9 aa, Homo Sapiens
NEPADGDDG

SEQ ID NO: 1131336 - protein, 9 aa, Homo Sapiens
RSAGVGRTG

SEQ ID NO: 1131337 - protein, 9 aa, Homo Sapiens
GLRRFPRVG

SEQ ID NO: 1131338 - protein, 9 aa, Homo Sapiens
GSFPTCGPL

SEQ ID NO: 1131339 - protein, 9 aa, Homo Sapiens
SVVNVKPTN

SEQ ID NO: 1131340 - protein, 9 aa, Homo Sapiens
GPIPPDAQT

SEQ ID NO: 1131341 - protein, 9 aa, Homo Sapiens
EEPSKEEGK

SEQ ID NO: 1131342 - protein, 9 aa, Homo Sapiens
PCRTGTLED

SEQ ID NO: 1131343 - protein, 9 aa, Homo Sapiens
HTTLARETS

SEQ ID NO: 1131344 - protein, 9 aa, Homo Sapiens
RTRLQEMEL

SEQ ID NO: 1131345 - protein, 9 aa, Homo Sapiens
TGMTCQSRS

SEQ ID NO: 1131346 - protein, 9 aa, Homo Sapiens
RHKISFSFA

SEQ ID NO: 1131347 - protein, 9 aa, Homo Sapiens
TEGSTNGFI

SEQ ID NO: 1131348 - protein, 9 aa, Homo Sapiens
AANQCQIEP

SEQ ID NO: 1131349 - protein, 9 aa, Homo Sapiens
DDDEATDYC

SEQ ID NO: 1131350 - protein, 9 aa, Homo Sapiens
ERSRKENRS

SEQ ID NO: 1131351 - protein, 9 aa, Homo Sapiens
GYNATVLTY

SEQ ID NO: 1131352 - protein, 9 aa, Homo Sapiens
TCMSQTVQR

SEQ ID NO: 1131353 - protein, 9 aa, Homo Sapiens
SAPAMGTGI

SEQ ID NO: 1131354 - protein, 9 aa, Homo Sapiens
SRQGSGSRQ

SEQ ID NO: 1131355 - protein, 9 aa, Homo Sapiens
AQDFKTDLC

SEQ ID NO: 1131356 - protein, 9 aa, Homo Sapiens
EEREHTLHR

SEQ ID NO: 1131357 - protein, 9 aa, Homo Sapiens
SGTAGSTSQ

SEQ ID NO: 1131358 - protein, 9 aa, Homo Sapiens
LLSLYRPPL

SEQ ID NO: 1131359 - protein, 9 aa, Homo Sapiens
IIDRDFDPV

SEQ ID NO: 1131360 - protein, 9 aa, Homo Sapiens
PCPQCLRRR

SEQ ID NO: 1131361 - protein, 9 aa, Homo Sapiens
PLIHPRPPP

SEQ ID NO: 1131362 - protein, 9 aa, Homo Sapiens
ELTTAVTTT

SEQ ID NO: 1131363 - protein, 9 aa, Homo Sapiens
TKPFRLHCS

SEQ ID NO: 1131364 - protein, 9 aa, Homo Sapiens
FPSTSTLCP

SEQ ID NO: 1131365 - protein, 9 aa, Homo Sapiens
VTDYHAIVS

SEQ ID NO: 1131366 - protein, 9 aa, Homo Sapiens
RQSPDPEPS

SEQ ID NO: 1131367 - protein, 9 aa, Homo Sapiens
QLAAMLNFN

SEQ ID NO: 1131368 - protein, 9 aa, Homo Sapiens
PLPRPRLHQ

SEQ ID NO: 1131369 - protein, 9 aa, Homo Sapiens
TAVKAVGVP

SEQ ID NO: 1131370 - protein, 9 aa, Homo Sapiens
RSRKENRSS

SEQ ID NO: 1131371 - protein, 9 aa, Homo Sapiens
WSISRSWTG

SEQ ID NO: 1131372 - protein, 9 aa, Homo Sapiens
LENMSAGYH

SEQ ID NO: 1131373 - protein, 9 aa, Homo Sapiens
AQLYACQNP

SEQ ID NO: 1131374 - protein, 9 aa, Homo Sapiens
LAAWDAPCP

SEQ ID NO: 1131375 - protein, 9 aa, Homo Sapiens
TSTTRAIVF

SEQ ID NO: 1131376 - protein, 9 aa, Homo Sapiens
FKRKYGKSM

SEQ ID NO: 1131377 - protein, 9 aa, Homo Sapiens
SDFEESGEF

SEQ ID NO: 1131378 - protein, 9 aa, Homo Sapiens
KPPQPRVGG

SEQ ID NO: 1131379 - protein, 9 aa, Homo Sapiens
GEDDPGHWG

SEQ ID NO: 1131380 - protein, 9 aa, Homo Sapiens
GPDFGPNLP

SEQ ID NO: 1131381 - protein, 9 aa, Homo Sapiens
SHPPTTTTS

SEQ ID NO: 1131382 - protein, 9 aa, Homo Sapiens
TSMVTHARV

SEQ ID NO: 1131383 - protein, 9 aa, Homo Sapiens
RGTTLPSRG

SEQ ID NO: 1131384 - protein, 9 aa, Homo Sapiens
FATIRMSSD

SEQ ID NO: 1131385 - protein, 9 aa, Homo Sapiens
SFIWPLSTL

SEQ ID NO: 1131386 - protein, 9 aa, Homo Sapiens
LDNSEGKIL

SEQ ID NO: 1131387 - protein, 9 aa, Homo Sapiens
NTTISDATT

SEQ ID NO: 1131388 - protein, 9 aa, Homo Sapiens
SDKVIIITR

SEQ ID NO: 1131389 - protein, 9 aa, Homo Sapiens
AIATTCNHR

SEQ ID NO: 1131390 - protein, 9 aa, Homo Sapiens
RSKQKDKVS

SEQ ID NO: 1131391 - protein, 9 aa, Homo Sapiens
SALVFKKGK

SEQ ID NO: 1131392 - protein, 9 aa, Homo Sapiens
ASGFARPPQ

SEQ ID NO: 1131393 - protein, 9 aa, Homo Sapiens
DFRFSYKLK

SEQ ID NO: 1131394 - protein, 9 aa, Homo Sapiens
RVPEIISFA

SEQ ID NO: 1131395 - protein, 9 aa, Homo Sapiens
PNRGVLRSL

SEQ ID NO: 1131396 - protein, 9 aa, Homo Sapiens
PISCSGASA

SEQ ID NO: 1131397 - protein, 9 aa, Homo Sapiens
ERLQLQMRL

SEQ ID NO: 1131398 - protein, 9 aa, Homo Sapiens
RRLEVEAGP

SEQ ID NO: 1131399 - protein, 9 aa, Homo Sapiens
VPLFKHKST

SEQ ID NO: 1131400 - protein, 9 aa, Homo Sapiens
RRRRRSKQK

SEQ ID NO: 1131401 - protein, 9 aa, Homo Sapiens
GFQHGELGR

SEQ ID NO: 1131402 - protein, 9 aa, Homo Sapiens
KEPGKNKQT

SEQ ID NO: 1131403 - protein, 9 aa, Homo Sapiens
HKEIALHKY

SEQ ID NO: 1131404 - protein, 9 aa, Homo Sapiens
EGAVGVIVD

SEQ ID NO: 1131405 - protein, 9 aa, Homo Sapiens
SWEYCRLDA

SEQ ID NO: 1131406 - protein, 9 aa, Homo Sapiens
AARPPGEQQ

SEQ ID NO: 1131407 - protein, 9 aa, Homo Sapiens
AGLGESSVW

SEQ ID NO: 1131408 - protein, 9 aa, Homo Sapiens
PRHHQAWIG

SEQ ID NO: 1131409 - protein, 9 aa, Homo Sapiens
TTGTLGVGD

SEQ ID NO: 1131410 - protein, 9 aa, Homo Sapiens
VPKHKLPLE

SEQ ID NO: 1131411 - protein, 9 aa, Homo Sapiens
ILTEAIKAF

SEQ ID NO: 1131412 - protein, 9 aa, Homo Sapiens
LHVLTLMKF

SEQ ID NO: 1131413 - protein, 9 aa, Homo Sapiens
VNTYGPDFG

SEQ ID NO: 1131414 - protein, 9 aa, Homo Sapiens
GPCPSAAGG

SEQ ID NO: 1131415 - protein, 9 aa, Homo Sapiens
TVHYIMLHI

SEQ ID NO: 1131416 - protein, 9 aa, Homo Sapiens
QRSNQVAFQ

SEQ ID NO: 1131417 - protein, 9 aa, Homo Sapiens
KATANRDIL

SEQ ID NO: 1131418 - protein, 9 aa, Homo Sapiens
NLVVEYRAI

SEQ ID NO: 1131419 - protein, 9 aa, Homo Sapiens
QKDQEERER

SEQ ID NO: 1131420 - protein, 9 aa, Homo Sapiens
SGTIRSHRP

SEQ ID NO: 1131421 - protein, 9 aa, Homo Sapiens
RSPDGPASS

SEQ ID NO: 1131422 - protein, 9 aa, Homo Sapiens
APGLTKCVK

SEQ ID NO: 1131423 - protein, 9 aa, Homo Sapiens
LGMAGSCLR

SEQ ID NO: 1131424 - protein, 9 aa, Homo Sapiens
HFAAISHRS

SEQ ID NO: 1131425 - protein, 9 aa, Homo Sapiens
SDGQRRQQQ

SEQ ID NO: 1131426 - protein, 9 aa, Homo Sapiens
AMYTRHECR

SEQ ID NO: 1131427 - protein, 9 aa, Homo Sapiens
KYFPFGQQN

SEQ ID NO: 1131428 - protein, 9 aa, Homo Sapiens
GSASHRELL

SEQ ID NO: 1131429 - protein, 9 aa, Homo Sapiens
RSLKDVEAS

SEQ ID NO: 1131430 - protein, 9 aa, Homo Sapiens
CLSKKFIAG

SEQ ID NO: 1131431 - protein, 9 aa, Homo Sapiens
RFPRVGFHV

SEQ ID NO: 1131432 - protein, 9 aa, Homo Sapiens
LFDLDEMFS

SEQ ID NO: 1131433 - protein, 9 aa, Homo Sapiens
HVNHFYCDT

SEQ ID NO: 1131434 - protein, 9 aa, Homo Sapiens
EILFSNGKR

SEQ ID NO: 1131435 - protein, 9 aa, Homo Sapiens
APWRSRSIC

SEQ ID NO: 1131436 - protein, 9 aa, Homo Sapiens
VPRQQRETR

SEQ ID NO: 1131437 - protein, 9 aa, Homo Sapiens
SIIVERMYL

SEQ ID NO: 1131438 - protein, 9 aa, Homo Sapiens
TIMKRKPMN

SEQ ID NO: 1131439 - protein, 9 aa, Homo Sapiens
EQGPSSQLW

SEQ ID NO: 1131440 - protein, 9 aa, Homo Sapiens
YAHAGAMLE

SEQ ID NO: 1131441 - protein, 9 aa, Homo Sapiens
LTMFSYPIW

SEQ ID NO: 1131442 - protein, 9 aa, Homo Sapiens
ARSHQGALM

SEQ ID NO: 1131443 - protein, 9 aa, Homo Sapiens
SLVPRCPWP

SEQ ID NO: 1131444 - protein, 9 aa, Homo Sapiens
HHRFHHGEK

SEQ ID NO: 1131445 - protein, 9 aa, Homo Sapiens
EGQHKMDRK

SEQ ID NO: 1131446 - protein, 9 aa, Homo Sapiens
EPSRASWRS

SEQ ID NO: 1131447 - protein, 9 aa, Homo Sapiens
FPQLGVQYE

SEQ ID NO: 1131448 - protein, 9 aa, Homo Sapiens
TIGETLVLA

SEQ ID NO: 1131449 - protein, 9 aa, Homo Sapiens
LFPPLIIQR

SEQ ID NO: 1131450 - protein, 9 aa, Homo Sapiens
SNQPERVWV

SEQ ID NO: 1131451 - protein, 9 aa, Homo Sapiens
GDQLVGGQV

SEQ ID NO: 1131452 - protein, 9 aa, Homo Sapiens
LTCSPQQKL

SEQ ID NO: 1131453 - protein, 9 aa, Homo Sapiens
MEFLQQEDT

SEQ ID NO: 1131454 - protein, 9 aa, Homo Sapiens
SAGCCLCPH

SEQ ID NO: 1131455 - protein, 9 aa, Homo Sapiens
HIIGDPYKV

SEQ ID NO: 1131456 - protein, 9 aa, Homo Sapiens
VHSEALLHS

SEQ ID NO: 1131457 - protein, 9 aa, Homo Sapiens
TDGTDPFFL

SEQ ID NO: 1131458 - protein, 9 aa, Homo Sapiens
VHADGDQTS

SEQ ID NO: 1131459 - protein, 9 aa, Homo Sapiens
KFFLNGNRT

SEQ ID NO: 1131460 - protein, 9 aa, Homo Sapiens
GPRTGCRPR

SEQ ID NO: 1131461 - protein, 9 aa, Homo Sapiens
TSGSTPGSG

SEQ ID NO: 1131462 - protein, 9 aa, Homo Sapiens
VHELMQVVL

SEQ ID NO: 1131463 - protein, 9 aa, Homo Sapiens
QAHQKKAVL

SEQ ID NO: 1131464 - protein, 9 aa, Homo Sapiens
FIILEKNPP

SEQ ID NO: 1131465 - protein, 9 aa, Homo Sapiens
CLLAECCAQ

SEQ ID NO: 1131466 - protein, 9 aa, Homo Sapiens
ENCVLVTEH

SEQ ID NO: 1131467 - protein, 9 aa, Homo Sapiens
YPWGFSDPG

SEQ ID NO: 1131468 - protein, 9 aa, Homo Sapiens
YAKQKLDSK

SEQ ID NO: 1131469 - protein, 9 aa, Homo Sapiens
LTHPAHQPL

SEQ ID NO: 1131470 - protein, 9 aa, Homo Sapiens
PAAVCSGRL

SEQ ID NO: 1131471 - protein, 9 aa, Homo Sapiens
LRRRSQGVS

SEQ ID NO: 1131472 - protein, 9 aa, Homo Sapiens
VWGNLAGRN

SEQ ID NO: 1131473 - protein, 9 aa, Homo Sapiens
QVTVATALP

SEQ ID NO: 1131474 - protein, 9 aa, Homo Sapiens
GFCHEIAVR

SEQ ID NO: 1131475 - protein, 9 aa, Homo Sapiens
DSPNPARGH

SEQ ID NO: 1131476 - protein, 9 aa, Homo Sapiens
QNEETKPFS

SEQ ID NO: 1131477 - protein, 9 aa, Homo Sapiens
CRSHGYGSR

SEQ ID NO: 1131478 - protein, 9 aa, Homo Sapiens
TPPEEPPTA

SEQ ID NO: 1131479 - protein, 9 aa, Homo Sapiens
LPPEGPLKE

SEQ ID NO: 1131480 - protein, 9 aa, Homo Sapiens
DRVELLRDA

SEQ ID NO: 1131481 - protein, 9 aa, Homo Sapiens
QLMYSCKEG

SEQ ID NO: 1131482 - protein, 9 aa, Homo Sapiens
STALMKLKS

SEQ ID NO: 1131483 - protein, 9 aa, Homo Sapiens
NVSEQQSFF

SEQ ID NO: 1131484 - protein, 9 aa, Homo Sapiens
IFLPGHHCS

SEQ ID NO: 1131485 - protein, 9 aa, Homo Sapiens
YAVRLAVLN

SEQ ID NO: 1131486 - protein, 9 aa, Homo Sapiens
EFVEDAFHG

SEQ ID NO: 1131487 - protein, 9 aa, Homo Sapiens
TNVPSSDQG

SEQ ID NO: 1131488 - protein, 9 aa, Homo Sapiens
LRHRLPCRL

SEQ ID NO: 1131489 - protein, 9 aa, Homo Sapiens
WVSLVSRIC

SEQ ID NO: 1131490 - protein, 9 aa, Homo Sapiens
DNYSANMMV

SEQ ID NO: 1131491 - protein, 9 aa, Homo Sapiens
GRPWPPSFS

SEQ ID NO: 1131492 - protein, 9 aa, Homo Sapiens
RIGATTPPI

SEQ ID NO: 1131493 - protein, 9 aa, Homo Sapiens
KKPFGPRSK

SEQ ID NO: 1131494 - protein, 9 aa, Homo Sapiens
KTPPTNALT

SEQ ID NO: 1131495 - protein, 9 aa, Homo Sapiens
IHGVPPLVL

SEQ ID NO: 1131496 - protein, 9 aa, Homo Sapiens
PSAGRTSAR

SEQ ID NO: 1131497 - protein, 9 aa, Homo Sapiens
HHTVPEPEG

SEQ ID NO: 1131498 - protein, 9 aa, Homo Sapiens
RTGLHICDL

SEQ ID NO: 1131499 - protein, 9 aa, Homo Sapiens
PGQVGFGPM

SEQ ID NO: 1131500 - protein, 9 aa, Homo Sapiens
VILPGKMPV

SEQ ID NO: 1131501 - protein, 9 aa, Homo Sapiens
LCQIVMAAY

SEQ ID NO: 1131502 - protein, 9 aa, Homo Sapiens
KSRDKKMVG

SEQ ID NO: 1131503 - protein, 9 aa, Homo Sapiens
ARPPGEQQL

SEQ ID NO: 1131504 - protein, 9 aa, Homo Sapiens
LTIEQSSQA

SEQ ID NO: 1131505 - protein, 9 aa, Homo Sapiens
IHEAIKKNY

SEQ ID NO: 1131506 - protein, 9 aa, Homo Sapiens
PLEGTPFVL

SEQ ID NO: 1131507 - protein, 9 aa, Homo Sapiens
PTTRLMAPV

SEQ ID NO: 1131508 - protein, 9 aa, Homo Sapiens
EDLTRPSGL

SEQ ID NO: 1131509 - protein, 9 aa, Homo Sapiens
QMPPLPQTH

SEQ ID NO: 1131510 - protein, 9 aa, Homo Sapiens
GEKPFFCSE

SEQ ID NO: 1131511 - protein, 9 aa, Homo Sapiens
KAKPMCSTC

SEQ ID NO: 1131512 - protein, 9 aa, Homo Sapiens
ALCPTRKEE

SEQ ID NO: 1131513 - protein, 9 aa, Homo Sapiens
TLQGPPGTS

SEQ ID NO: 1131514 - protein, 9 aa, Homo Sapiens
PFNILDSPM

SEQ ID NO: 1131515 - protein, 9 aa, Homo Sapiens
PVDTKAEEK

SEQ ID NO: 1131516 - protein, 9 aa, Homo Sapiens
GHITDDWDH

SEQ ID NO: 1131517 - protein, 9 aa, Homo Sapiens
PFFATARER

SEQ ID NO: 1131518 - protein, 9 aa, Homo Sapiens
AFEKGDDVP

SEQ ID NO: 1131519 - protein, 9 aa, Homo Sapiens
CRSPVPPPP

SEQ ID NO: 1131520 - protein, 9 aa, Homo Sapiens
NIMNEENVN

SEQ ID NO: 1131521 - protein, 9 aa, Homo Sapiens
ECEDSQLAS

SEQ ID NO: 1131522 - protein, 9 aa, Homo Sapiens
GAANVSSEG

SEQ ID NO: 1131523 - protein, 9 aa, Homo Sapiens
TLEDGQIGE

SEQ ID NO: 1131524 - protein, 9 aa, Homo Sapiens
CASLYVGWA

SEQ ID NO: 1131525 - protein, 9 aa, Homo Sapiens
KGSRQRTQE

SEQ ID NO: 1131526 - protein, 9 aa, Homo Sapiens
EAVTFGLFL

SEQ ID NO: 1131527 - protein, 9 aa, Homo Sapiens
VASSLSTPA

SEQ ID NO: 1131528 - protein, 9 aa, Homo Sapiens
RSPTSSPTA

SEQ ID NO: 1131529 - protein, 9 aa, Homo Sapiens
RPTKLGSNG

SEQ ID NO: 1131530 - protein, 9 aa, Homo Sapiens
APCCAPQAP

SEQ ID NO: 1131531 - protein, 9 aa, Homo Sapiens
PEPILADDL

SEQ ID NO: 1131532 - protein, 9 aa, Homo Sapiens
AAVASSSMT

SEQ ID NO: 1131533 - protein, 9 aa, Homo Sapiens
SNGLLLIKH

SEQ ID NO: 1131534 - protein, 9 aa, Homo Sapiens
HFVIPKKAN

SEQ ID NO: 1131535 - protein, 9 aa, Homo Sapiens
LSSWAESPE

SEQ ID NO: 1131536 - protein, 9 aa, Homo Sapiens
AETEGISEP

SEQ ID NO: 1131537 - protein, 9 aa, Homo Sapiens
NAKTTHNDN

SEQ ID NO: 1131538 - protein, 9 aa, Homo Sapiens
SQEDGLPTG

SEQ ID NO: 1131539 - protein, 9 aa, Homo Sapiens
CDLFEQFRT

SEQ ID NO: 1131540 - protein, 9 aa, Homo Sapiens
QPLTLPLPT

SEQ ID NO: 1131541 - protein, 9 aa, Homo Sapiens
EYMVEKNYP

SEQ ID NO: 1131542 - protein, 9 aa, Homo Sapiens
HVHCKGATC

SEQ ID NO: 1131543 - protein, 9 aa, Homo Sapiens
RFVHNENQH

SEQ ID NO: 1131544 - protein, 9 aa, Homo Sapiens
CLGMATGIF

SEQ ID NO: 1131545 - protein, 9 aa, Homo Sapiens
LHTLTILKK

SEQ ID NO: 1131546 - protein, 9 aa, Homo Sapiens
ASSTWRSTR

SEQ ID NO: 1131547 - protein, 9 aa, Homo Sapiens
LSGTIRSHR

SEQ ID NO: 1131548 - protein, 9 aa, Homo Sapiens
VKARAFRCS

SEQ ID NO: 1131549 - protein, 9 aa, Homo Sapiens
PAARGGENL

SEQ ID NO: 1131550 - protein, 9 aa, Homo Sapiens
VATNSCKGE

SEQ ID NO: 1131551 - protein, 9 aa, Homo Sapiens
LKQTGHVSS

SEQ ID NO: 1131552 - protein, 9 aa, Homo Sapiens
QRSASTKHC

SEQ ID NO: 1131553 - protein, 9 aa, Homo Sapiens
SSSRDQKLP

SEQ ID NO: 1131554 - protein, 9 aa, Homo Sapiens
DTSTIITEV

SEQ ID NO: 1131555 - protein, 9 aa, Homo Sapiens
HKSCLEENE

SEQ ID NO: 1131556 - protein, 9 aa, Homo Sapiens
VFCSFCIDL

SEQ ID NO: 1131557 - protein, 9 aa, Homo Sapiens
MSSHLHKTE

SEQ ID NO: 1131558 - protein, 9 aa, Homo Sapiens
CPECSCGRP

SEQ ID NO: 1131559 - protein, 9 aa, Homo Sapiens
LLQGHSVYG

SEQ ID NO: 1131560 - protein, 9 aa, Homo Sapiens
QDGSVRMFV

SEQ ID NO: 1131561 - protein, 9 aa, Homo Sapiens
PILHVLSDD

SEQ ID NO: 1131562 - protein, 9 aa, Homo Sapiens
PVLCTLQPR

SEQ ID NO: 1131563 - protein, 9 aa, Homo Sapiens
PLASAVQET

SEQ ID NO: 1131564 - protein, 9 aa, Homo Sapiens
LSGIYQFIM

SEQ ID NO: 1131565 - protein, 9 aa, Homo Sapiens
TGRLQTIDL

SEQ ID NO: 1131566 - protein, 9 aa, Homo Sapiens
YNHFHQSVQ

SEQ ID NO: 1131567 - protein, 9 aa, Homo Sapiens
HSIMLRLED

SEQ ID NO: 1131568 - protein, 9 aa, Homo Sapiens
LEDGQIGER

SEQ ID NO: 1131569 - protein, 9 aa, Homo Sapiens
RPPLRPHHD

SEQ ID NO: 1131570 - protein, 9 aa, Homo Sapiens
LQVQLHEEV

SEQ ID NO: 1131571 - protein, 9 aa, Homo Sapiens
ASQWPRVNG

SEQ ID NO: 1131572 - protein, 9 aa, Homo Sapiens
NGRTRTLKI

SEQ ID NO: 1131573 - protein, 9 aa, Homo Sapiens
RAGVVCCLP

SEQ ID NO: 1131574 - protein, 9 aa, Homo Sapiens
EATGMTCQS

SEQ ID NO: 1131575 - protein, 9 aa, Homo Sapiens
AAWLSQDSS

SEQ ID NO: 1131576 - protein, 9 aa, Homo Sapiens
DDDQLFYTN

SEQ ID NO: 1131577 - protein, 9 aa, Homo Sapiens
LAKRVDLLQ

SEQ ID NO: 1131578 - protein, 9 aa, Homo Sapiens
PISHDGSHQ

SEQ ID NO: 1131579 - protein, 9 aa, Homo Sapiens
PFLKLLGNF

SEQ ID NO: 1131580 - protein, 9 aa, Homo Sapiens
TYDHSYPEG

SEQ ID NO: 1131581 - protein, 9 aa, Homo Sapiens
TTTCPGPSW

SEQ ID NO: 1131582 - protein, 9 aa, Homo Sapiens
KDPHFSKIL

SEQ ID NO: 1131583 - protein, 9 aa, Homo Sapiens
QPPPQAPSQ

SEQ ID NO: 1131584 - protein, 9 aa, Homo Sapiens
RRCLRLLTT

SEQ ID NO: 1131585 - protein, 9 aa, Homo Sapiens
SWSCCGKFT

SEQ ID NO: 1131586 - protein, 9 aa, Homo Sapiens
TNRRSKNQG

SEQ ID NO: 1131587 - protein, 9 aa, Homo Sapiens
IGRGTTRFY

SEQ ID NO: 1131588 - protein, 9 aa, Homo Sapiens
VLAETCTDL

SEQ ID NO: 1131589 - protein, 9 aa, Homo Sapiens
GGQPWQQCP

SEQ ID NO: 1131590 - protein, 9 aa, Homo Sapiens
LVYPTDANA

SEQ ID NO: 1131591 - protein, 9 aa, Homo Sapiens
GLGILQQRQ

SEQ ID NO: 1131592 - protein, 9 aa, Homo Sapiens
QYVQAFCTH

SEQ ID NO: 1131593 - protein, 9 aa, Homo Sapiens
NVTISFDRC

SEQ ID NO: 1131594 - protein, 9 aa, Homo Sapiens
FSTLTTHKR

SEQ ID NO: 1131595 - protein, 9 aa, Homo Sapiens
MWLSASHFT

SEQ ID NO: 1131596 - protein, 9 aa, Homo Sapiens
KCSDESKPF

SEQ ID NO: 1131597 - protein, 9 aa, Homo Sapiens
CCFFGASPG

SEQ ID NO: 1131598 - protein, 9 aa, Homo Sapiens
FPAREWLFA

SEQ ID NO: 1131599 - protein, 9 aa, Homo Sapiens
DPVVPQNMV

SEQ ID NO: 1131600 - protein, 9 aa, Homo Sapiens
ILVNTLVPH

SEQ ID NO: 1131601 - protein, 9 aa, Homo Sapiens
LHRATAEQQ

SEQ ID NO: 1131602 - protein, 9 aa, Homo Sapiens
NICRNSIHV

SEQ ID NO: 1131603 - protein, 9 aa, Homo Sapiens
FQLTPYSWV

SEQ ID NO: 1131604 - protein, 9 aa, Homo Sapiens
LLGCYPEED

SEQ ID NO: 1131605 - protein, 9 aa, Homo Sapiens
PTSCPSWSP

SEQ ID NO: 1131606 - protein, 9 aa, Homo Sapiens
LPSRGSRGG

SEQ ID NO: 1131607 - protein, 9 aa, Homo Sapiens
TSDCSLPEN

SEQ ID NO: 1131608 - protein, 9 aa, Homo Sapiens
GNSEGEFFG

SEQ ID NO: 1131609 - protein, 9 aa, Homo Sapiens
HCRPSRKNH

SEQ ID NO: 1131610 - protein, 9 aa, Homo Sapiens
TQQRPPWRT

SEQ ID NO: 1131611 - protein, 9 aa, Homo Sapiens
GALECAGPK

SEQ ID NO: 1131612 - protein, 9 aa, Homo Sapiens
PPWRTSRGQ

SEQ ID NO: 1131613 - protein, 9 aa, Homo Sapiens
NTTVTYNSN

SEQ ID NO: 1131614 - protein, 9 aa, Homo Sapiens
PTCTNSQKS

SEQ ID NO: 1131615 - protein, 9 aa, Homo Sapiens
WIGAGRAPL

SEQ ID NO: 1131616 - protein, 9 aa, Homo Sapiens
QAGRILFDI

SEQ ID NO: 1131617 - protein, 9 aa, Homo Sapiens
CFSQCSNLI

SEQ ID NO: 1131618 - protein, 9 aa, Homo Sapiens
LGRPLYFWF

SEQ ID NO: 1131619 - protein, 9 aa, Homo Sapiens
HRNLPLCVS

SEQ ID NO: 1131620 - protein, 9 aa, Homo Sapiens
NFDDLFKDL

SEQ ID NO: 1131621 - protein, 9 aa, Homo Sapiens
AYLTEFVEL

SEQ ID NO: 1131622 - protein, 9 aa, Homo Sapiens
GTYQNPNMT

SEQ ID NO: 1131623 - protein, 9 aa, Homo Sapiens
EYIQCLGYV

SEQ ID NO: 1131624 - protein, 9 aa, Homo Sapiens
PGHHQRRAG

SEQ ID NO: 1131625 - protein, 9 aa, Homo Sapiens
SGGGSTRDG

SEQ ID NO: 1131626 - protein, 9 aa, Homo Sapiens
ILWTLSIWN

SEQ ID NO: 1131627 - protein, 9 aa, Homo Sapiens
EPVVLLVIH

SEQ ID NO: 1131628 - protein, 9 aa, Homo Sapiens
KNYPQIPDH

SEQ ID NO: 1131629 - protein, 9 aa, Homo Sapiens
MADSSDAGS

SEQ ID NO: 1131630 - protein, 9 aa, Homo Sapiens
CKGWRGRLK

SEQ ID NO: 1131631 - protein, 9 aa, Homo Sapiens
TRCTSTATR

SEQ ID NO: 1131632 - protein, 9 aa, Homo Sapiens
LKQMFSVFG

SEQ ID NO: 1131633 - protein, 9 aa, Homo Sapiens
HDRSPELEI

SEQ ID NO: 1131634 - protein, 9 aa, Homo Sapiens
INVADKKLS

SEQ ID NO: 1131635 - protein, 9 aa, Homo Sapiens
CILPFLACD

SEQ ID NO: 1131636 - protein, 9 aa, Homo Sapiens
DADASPAPL

SEQ ID NO: 1131637 - protein, 9 aa, Homo Sapiens
WPTRRSTMS

SEQ ID NO: 1131638 - protein, 9 aa, Homo Sapiens
ELATVQSLN

SEQ ID NO: 1131639 - protein, 9 aa, Homo Sapiens
DDLIVSILS

SEQ ID NO: 1131640 - protein, 9 aa, Homo Sapiens
SRRRTKKTS

SEQ ID NO: 1131641 - protein, 9 aa, Homo Sapiens
QPQAMANSQ

SEQ ID NO: 1131642 - protein, 9 aa, Homo Sapiens
TGAGRRAGC

SEQ ID NO: 1131643 - protein, 9 aa, Homo Sapiens
EHPEASGSG

SEQ ID NO: 1131644 - protein, 9 aa, Homo Sapiens
LDACESLTR

SEQ ID NO: 1131645 - protein, 9 aa, Homo Sapiens
EHRDNLVVV

SEQ ID NO: 1131646 - protein, 9 aa, Homo Sapiens
LPPQQQQHI

SEQ ID NO: 1131647 - protein, 9 aa, Homo Sapiens
VQLQLHSLA

SEQ ID NO: 1131648 - protein, 9 aa, Homo Sapiens
PLGRDSPQE

SEQ ID NO: 1131649 - protein, 9 aa, Homo Sapiens
YPNTGPRRR

SEQ ID NO: 1131650 - protein, 9 aa, Homo Sapiens
SCTTFTRHS

SEQ ID NO: 1131651 - protein, 9 aa, Homo Sapiens
ARQPSRPTG

SEQ ID NO: 1131652 - protein, 9 aa, Homo Sapiens
HGSPFTSAN

SEQ ID NO: 1131653 - protein, 9 aa, Homo Sapiens
MELRFHELE

SEQ ID NO: 1131654 - protein, 9 aa, Homo Sapiens
PGRGAAVGA

SEQ ID NO: 1131655 - protein, 9 aa, Homo Sapiens
RLLTEMGKR

SEQ ID NO: 1131656 - protein, 9 aa, Homo Sapiens
EGISFGLLN

SEQ ID NO: 1131657 - protein, 9 aa, Homo Sapiens
SDLIEGPAF

SEQ ID NO: 1131658 - protein, 9 aa, Homo Sapiens
ALVFFFDAY

SEQ ID NO: 1131659 - protein, 9 aa, Homo Sapiens
GTDPFFLYN

SEQ ID NO: 1131660 - protein, 9 aa, Homo Sapiens
SIYLGDSEG

SEQ ID NO: 1131661 - protein, 9 aa, Homo Sapiens
DSVLLKRSL

SEQ ID NO: 1131662 - protein, 9 aa, Homo Sapiens
YLYLFHNDI

SEQ ID NO: 1131663 - protein, 9 aa, Homo Sapiens
GGASRALFT

SEQ ID NO: 1131664 - protein, 9 aa, Homo Sapiens
MIVQSIIHG

SEQ ID NO: 1131665 - protein, 9 aa, Homo Sapiens
HKCKCLCTG

SEQ ID NO: 1131666 - protein, 9 aa, Homo Sapiens
TPAEVATTP

SEQ ID NO: 1131667 - protein, 9 aa, Homo Sapiens
PGPSGLASL

SEQ ID NO: 1131668 - protein, 9 aa, Homo Sapiens
ARTLARPRL

SEQ ID NO: 1131669 - protein, 9 aa, Homo Sapiens
ENERFDTHE

SEQ ID NO: 1131670 - protein, 9 aa, Homo Sapiens
LTIAICAVS

SEQ ID NO: 1131671 - protein, 9 aa, Homo Sapiens
VLQDGDLSP

SEQ ID NO: 1131672 - protein, 9 aa, Homo Sapiens
SLQAADPTP

SEQ ID NO: 1131673 - protein, 9 aa, Homo Sapiens
AMANSQGEV

SEQ ID NO: 1131674 - protein, 9 aa, Homo Sapiens
EGSILAPLY

SEQ ID NO: 1131675 - protein, 9 aa, Homo Sapiens
RDRQLPGRL

SEQ ID NO: 1131676 - protein, 9 aa, Homo Sapiens
FIRSSDYIR

SEQ ID NO: 1131677 - protein, 9 aa, Homo Sapiens
ASKPRQILG

SEQ ID NO: 1131678 - protein, 9 aa, Homo Sapiens
STAVNVFEL

SEQ ID NO: 1131679 - protein, 9 aa, Homo Sapiens
ESGKTSVAV

SEQ ID NO: 1131680 - protein, 9 aa, Homo Sapiens
GDGTGPLSM

SEQ ID NO: 1131681 - protein, 9 aa, Homo Sapiens
WTRCLRMRP

SEQ ID NO: 1131682 - protein, 9 aa, Homo Sapiens
AFLHIDMYA

SEQ ID NO: 1131683 - protein, 9 aa, Homo Sapiens
CLLDKDLII

SEQ ID NO: 1131684 - protein, 9 aa, Homo Sapiens
DSNDDSPDL

SEQ ID NO: 1131685 - protein, 9 aa, Homo Sapiens
QADVEKCQD

SEQ ID NO: 1131686 - protein, 9 aa, Homo Sapiens
ILPFLACDW

SEQ ID NO: 1131687 - protein, 9 aa, Homo Sapiens
KTECKIAEL

SEQ ID NO: 1131688 - protein, 9 aa, Homo Sapiens
CNVLAKVKR

SEQ ID NO: 1131689 - protein, 9 aa, Homo Sapiens
PLHGDSGVG

SEQ ID NO: 1131690 - protein, 9 aa, Homo Sapiens
EISPSTVEL

SEQ ID NO: 1131691 - protein, 9 aa, Homo Sapiens
RYHQITIPR

SEQ ID NO: 1131692 - protein, 9 aa, Homo Sapiens
DPSRHRDYV

SEQ ID NO: 1131693 - protein, 9 aa, Homo Sapiens
ECKRRLENI

SEQ ID NO: 1131694 - protein, 9 aa, Homo Sapiens
QLKKRARTR

SEQ ID NO: 1131695 - protein, 9 aa, Homo Sapiens
LAMAEALTN

SEQ ID NO: 1131696 - protein, 9 aa, Homo Sapiens
SQNDDICIY

SEQ ID NO: 1131697 - protein, 9 aa, Homo Sapiens
PENRPKFSG

SEQ ID NO: 1131698 - protein, 9 aa, Homo Sapiens
KPQLQNAHT

SEQ ID NO: 1131699 - protein, 9 aa, Homo Sapiens
FIGDCAKLV

SEQ ID NO: 1131700 - protein, 9 aa, Homo Sapiens
PPLTGSWEW

SEQ ID NO: 1131701 - protein, 9 aa, Homo Sapiens
EFMSDAEKL

SEQ ID NO: 1131702 - protein, 9 aa, Homo Sapiens
RLGLIPCIM

SEQ ID NO: 1131703 - protein, 9 aa, Homo Sapiens
RRRAPGGGA

SEQ ID NO: 1131704 - protein, 9 aa, Homo Sapiens
NVFFLVSTM

SEQ ID NO: 1131705 - protein, 9 aa, Homo Sapiens
HPLTVLGVR

SEQ ID NO: 1131706 - protein, 9 aa, Homo Sapiens
LITTILPYW

SEQ ID NO: 1131707 - protein, 9 aa, Homo Sapiens
PKFSGLQKE

SEQ ID NO: 1131708 - protein, 9 aa, Homo Sapiens
IITYVSSLH

SEQ ID NO: 1131709 - protein, 9 aa, Homo Sapiens
LLALPILAS

SEQ ID NO: 1131710 - protein, 9 aa, Homo Sapiens
RQFLGLFYL

SEQ ID NO: 1131711 - protein, 9 aa, Homo Sapiens
NVSVADGKF

SEQ ID NO: 1131712 - protein, 9 aa, Homo Sapiens
VPVLSTPRD

SEQ ID NO: 1131713 - protein, 9 aa, Homo Sapiens
FESLQVKIP

SEQ ID NO: 1131714 - protein, 9 aa, Homo Sapiens
WSVAGLIHY

SEQ ID NO: 1131715 - protein, 9 aa, Homo Sapiens
LADGKWLSI

SEQ ID NO: 1131716 - protein, 9 aa, Homo Sapiens
TFESLQVKI

SEQ ID NO: 1131717 - protein, 9 aa, Homo Sapiens
ANIHAIQNS

SEQ ID NO: 1131718 - protein, 9 aa, Homo Sapiens
SLILFPPLI

SEQ ID NO: 1131719 - protein, 9 aa, Homo Sapiens
LRVIAEAYT

SEQ ID NO: 1131720 - protein, 9 aa, Homo Sapiens
LKDSLRGNS

SEQ ID NO: 1131721 - protein, 9 aa, Homo Sapiens
RWQGPQVSQ

SEQ ID NO: 1131722 - protein, 9 aa, Homo Sapiens
SCPYHPGHH

SEQ ID NO: 1131723 - protein, 9 aa, Homo Sapiens
EALATSPLL

SEQ ID NO: 1131724 - protein, 9 aa, Homo Sapiens
GGVAYNLGA

SEQ ID NO: 1131725 - protein, 9 aa, Homo Sapiens
ALSVGFSVK

SEQ ID NO: 1131726 - protein, 9 aa, Homo Sapiens
TLTGKILTL

SEQ ID NO: 1131727 - protein, 9 aa, Homo Sapiens
HQNGVEMLV

SEQ ID NO: 1131728 - protein, 9 aa, Homo Sapiens
APKRPPKLQ

SEQ ID NO: 1131729 - protein, 9 aa, Homo Sapiens
DVCKHGMLM

SEQ ID NO: 1131730 - protein, 9 aa, Homo Sapiens
LRSALISLV

SEQ ID NO: 1131731 - protein, 9 aa, Homo Sapiens
QMENALVAC

SEQ ID NO: 1131732 - protein, 9 aa, Homo Sapiens
RGHLGPSRG

SEQ ID NO: 1131733 - protein, 9 aa, Homo Sapiens
TGTAAATSL

SEQ ID NO: 1131734 - protein, 9 aa, Homo Sapiens
DDDQSETVY

SEQ ID NO: 1131735 - protein, 9 aa, Homo Sapiens
RLLCPHAFY

SEQ ID NO: 1131736 - protein, 9 aa, Homo Sapiens
EIATDPEEA

SEQ ID NO: 1131737 - protein, 9 aa, Homo Sapiens
CFLCCSASY

SEQ ID NO: 1131738 - protein, 9 aa, Homo Sapiens
APPITDLFL

SEQ ID NO: 1131739 - protein, 9 aa, Homo Sapiens
KDGAALRED

SEQ ID NO: 1131740 - protein, 9 aa, Homo Sapiens
SGLICMAMY

SEQ ID NO: 1131741 - protein, 9 aa, Homo Sapiens
RRPPGPSPA

SEQ ID NO: 1131742 - protein, 9 aa, Homo Sapiens
QVSELERRF

SEQ ID NO: 1131743 - protein, 9 aa, Homo Sapiens
EKTCEKPGQ

SEQ ID NO: 1131744 - protein, 9 aa, Homo Sapiens
TEDGGWYGK

SEQ ID NO: 1131745 - protein, 9 aa, Homo Sapiens
RSSAKKGGN

SEQ ID NO: 1131746 - protein, 9 aa, Homo Sapiens
PGCLVTKVV

SEQ ID NO: 1131747 - protein, 9 aa, Homo Sapiens
HPPQARRRA

SEQ ID NO: 1131748 - protein, 9 aa, Homo Sapiens
GSLRLSCCL

SEQ ID NO: 1131749 - protein, 9 aa, Homo Sapiens
QERDIFLPG

SEQ ID NO: 1131750 - protein, 9 aa, Homo Sapiens
RSHCRPSRK

SEQ ID NO: 1131751 - protein, 9 aa, Homo Sapiens
MPYLGSDDV

SEQ ID NO: 1131752 - protein, 9 aa, Homo Sapiens
ILKLKYIKE

SEQ ID NO: 1131753 - protein, 9 aa, Homo Sapiens
LLEGSAEMT

SEQ ID NO: 1131754 - protein, 9 aa, Homo Sapiens
FMILRETPI

SEQ ID NO: 1131755 - protein, 9 aa, Homo Sapiens
HTHYVIAKV

SEQ ID NO: 1131756 - protein, 9 aa, Homo Sapiens
LHPNYLNPR

SEQ ID NO: 1131757 - protein, 9 aa, Homo Sapiens
LQNREHEIN

SEQ ID NO: 1131758 - protein, 9 aa, Homo Sapiens
PQVSLVEIE

SEQ ID NO: 1131759 - protein, 9 aa, Homo Sapiens
ASTSSPASC

SEQ ID NO: 1131760 - protein, 9 aa, Homo Sapiens
VPAGWRSPA

SEQ ID NO: 1131761 - protein, 9 aa, Homo Sapiens
RRRTVPGGP

SEQ ID NO: 1131762 - protein, 9 aa, Homo Sapiens
ELFLVKETG

SEQ ID NO: 1131763 - protein, 9 aa, Homo Sapiens
PDTSNSLLV

SEQ ID NO: 1131764 - protein, 9 aa, Homo Sapiens
AEVNYDDDE

SEQ ID NO: 1131765 - protein, 9 aa, Homo Sapiens
AEGRKKGLC

SEQ ID NO: 1131766 - protein, 9 aa, Homo Sapiens
PPVVLQGLF

SEQ ID NO: 1131767 - protein, 9 aa, Homo Sapiens
AQKRTCKLR

SEQ ID NO: 1131768 - protein, 9 aa, Homo Sapiens
QHTEFHPSM

SEQ ID NO: 1131769 - protein, 9 aa, Homo Sapiens
ILGQRATRH

SEQ ID NO: 1131770 - protein, 9 aa, Homo Sapiens
KLDWVNVMF

SEQ ID NO: 1131771 - protein, 9 aa, Homo Sapiens
VVDKALKYL

SEQ ID NO: 1131772 - protein, 9 aa, Homo Sapiens
STKGFPRNS

SEQ ID NO: 1131773 - protein, 9 aa, Homo Sapiens
AQPWPSFEA

SEQ ID NO: 1131774 - protein, 9 aa, Homo Sapiens
KLNVSLQET

SEQ ID NO: 1131775 - protein, 9 aa, Homo Sapiens
KPSRIPRGS

SEQ ID NO: 1131776 - protein, 9 aa, Homo Sapiens
FMADLKELR

SEQ ID NO: 1131777 - protein, 9 aa, Homo Sapiens
AGRETGDPT

SEQ ID NO: 1131778 - protein, 9 aa, Homo Sapiens
RRRRSKQKD

SEQ ID NO: 1131779 - protein, 9 aa, Homo Sapiens
ACRGENHGE

SEQ ID NO: 1131780 - protein, 9 aa, Homo Sapiens
RQRSMSPTL

SEQ ID NO: 1131781 - protein, 9 aa, Homo Sapiens
LIAARGLCS

SEQ ID NO: 1131782 - protein, 9 aa, Homo Sapiens
MAPRPRAGP

SEQ ID NO: 1131783 - protein, 9 aa, Homo Sapiens
ATHAERIET

SEQ ID NO: 1131784 - protein, 9 aa, Homo Sapiens
LAVRALHNL

SEQ ID NO: 1131785 - protein, 9 aa, Homo Sapiens
ATDTKVGSE

SEQ ID NO: 1131786 - protein, 9 aa, Homo Sapiens
TSRAAGTTF

SEQ ID NO: 1131787 - protein, 9 aa, Homo Sapiens
LATVLLQSA

SEQ ID NO: 1131788 - protein, 9 aa, Homo Sapiens
VIVDLTVED

SEQ ID NO: 1131789 - protein, 9 aa, Homo Sapiens
PLTLQCNPR

SEQ ID NO: 1131790 - protein, 9 aa, Homo Sapiens
KEDDDQSET

SEQ ID NO: 1131791 - protein, 9 aa, Homo Sapiens
NEVIHTDLQ

SEQ ID NO: 1131792 - protein, 9 aa, Homo Sapiens
NPYNDLVKE

SEQ ID NO: 1131793 - protein, 9 aa, Homo Sapiens
GASTDAGST

SEQ ID NO: 1131794 - protein, 9 aa, Homo Sapiens
PRRWPPRTP

SEQ ID NO: 1131795 - protein, 9 aa, Homo Sapiens
GSRTFMGQG

SEQ ID NO: 1131796 - protein, 9 aa, Homo Sapiens
TKLLHLEDA

SEQ ID NO: 1131797 - protein, 9 aa, Homo Sapiens
GCSWTCSQT

SEQ ID NO: 1131798 - protein, 9 aa, Homo Sapiens
SMVYSRCGH

SEQ ID NO: 1131799 - protein, 9 aa, Homo Sapiens
WGSALPLAI

SEQ ID NO: 1131800 - protein, 9 aa, Homo Sapiens
MGFAAPSPT

SEQ ID NO: 1131801 - protein, 9 aa, Homo Sapiens
LCFAMFGFL

SEQ ID NO: 1131802 - protein, 9 aa, Homo Sapiens
SCPGPRRAW

SEQ ID NO: 1131803 - protein, 9 aa, Homo Sapiens
QKFRPTLPP

SEQ ID NO: 1131804 - protein, 9 aa, Homo Sapiens
DPISVPGAR

SEQ ID NO: 1131805 - protein, 9 aa, Homo Sapiens
AVDSNTSSQ

SEQ ID NO: 1131806 - protein, 9 aa, Homo Sapiens
PRPATGKST

SEQ ID NO: 1131807 - protein, 9 aa, Homo Sapiens
VIDKSAKNL

SEQ ID NO: 1131808 - protein, 9 aa, Homo Sapiens
RTGRGLRQR

SEQ ID NO: 1131809 - protein, 9 aa, Homo Sapiens
LLTDPIEQG

SEQ ID NO: 1131810 - protein, 9 aa, Homo Sapiens
RHRTGESRH

SEQ ID NO: 1131811 - protein, 9 aa, Homo Sapiens
SSPPVILLF

SEQ ID NO: 1131812 - protein, 9 aa, Homo Sapiens
TVYEEMKYP

SEQ ID NO: 1131813 - protein, 9 aa, Homo Sapiens
MCDKFSGHP

SEQ ID NO: 1131814 - protein, 9 aa, Homo Sapiens
RYGDALKNV

SEQ ID NO: 1131815 - protein, 9 aa, Homo Sapiens
NHCQMSGTS

SEQ ID NO: 1131816 - protein, 9 aa, Homo Sapiens
SLRSETTAA

SEQ ID NO: 1131817 - protein, 9 aa, Homo Sapiens
ASCPGPRRA

SEQ ID NO: 1131818 - protein, 9 aa, Homo Sapiens
ERIPIPVIN

SEQ ID NO: 1131819 - protein, 9 aa, Homo Sapiens
EVKIELDHT

SEQ ID NO: 1131820 - protein, 9 aa, Homo Sapiens
NMMKKKNQN

SEQ ID NO: 1131821 - protein, 9 aa, Homo Sapiens
IGVTLKDGA

SEQ ID NO: 1131822 - protein, 9 aa, Homo Sapiens
EVSIIWGMY

SEQ ID NO: 1131823 - protein, 9 aa, Homo Sapiens
SSAVMPCPM

SEQ ID NO: 1131824 - protein, 9 aa, Homo Sapiens
VLTFSIVFG

SEQ ID NO: 1131825 - protein, 9 aa, Homo Sapiens
TPSAEPSTR

SEQ ID NO: 1131826 - protein, 9 aa, Homo Sapiens
YIQCLGYVI

SEQ ID NO: 1131827 - protein, 9 aa, Homo Sapiens
SRFQKKMKV

SEQ ID NO: 1131828 - protein, 9 aa, Homo Sapiens
AAQDPVICS

SEQ ID NO: 1131829 - protein, 9 aa, Homo Sapiens
HVLTLMKFP

SEQ ID NO: 1131830 - protein, 9 aa, Homo Sapiens
TTRQQRSSG

SEQ ID NO: 1131831 - protein, 9 aa, Homo Sapiens
TYSLSVISC

SEQ ID NO: 1131832 - protein, 9 aa, Homo Sapiens
LLAAVLCDC

SEQ ID NO: 1131833 - protein, 9 aa, Homo Sapiens
SSATVQDSI

SEQ ID NO: 1131834 - protein, 9 aa, Homo Sapiens
QVQDLSGNP

SEQ ID NO: 1131835 - protein, 9 aa, Homo Sapiens
TTCNHRKKE

SEQ ID NO: 1131836 - protein, 9 aa, Homo Sapiens
PDCRFINIK

SEQ ID NO: 1131837 - protein, 9 aa, Homo Sapiens
TVEKLQVRL

SEQ ID NO: 1131838 - protein, 9 aa, Homo Sapiens
KHTLVMFYT

SEQ ID NO: 1131839 - protein, 9 aa, Homo Sapiens
QKSLRKTIM

SEQ ID NO: 1131840 - protein, 9 aa, Homo Sapiens
VFSFCWFVH

SEQ ID NO: 1131841 - protein, 9 aa, Homo Sapiens
PQTRTAQSP

SEQ ID NO: 1131842 - protein, 9 aa, Homo Sapiens
PSKQNLLLW

SEQ ID NO: 1131843 - protein, 9 aa, Homo Sapiens
CCRLLTEMG

SEQ ID NO: 1131844 - protein, 9 aa, Homo Sapiens
LVFICVVMA

SEQ ID NO: 1131845 - protein, 9 aa, Homo Sapiens
TLQINVCLS

SEQ ID NO: 1131846 - protein, 9 aa, Homo Sapiens
DSEAGVPAL

SEQ ID NO: 1131847 - protein, 9 aa, Homo Sapiens
VSLQERGGV

SEQ ID NO: 1131848 - protein, 9 aa, Homo Sapiens
MNILYGIAQ

SEQ ID NO: 1131849 - protein, 9 aa, Homo Sapiens
AALAQGVLG

SEQ ID NO: 1131850 - protein, 9 aa, Homo Sapiens
YWPEEGYCQ

SEQ ID NO: 1131851 - protein, 9 aa, Homo Sapiens
RPGTSPGWW

SEQ ID NO: 1131852 - protein, 9 aa, Homo Sapiens
SRGHGAARS

SEQ ID NO: 1131853 - protein, 9 aa, Homo Sapiens
ATLINTTTI

SEQ ID NO: 1131854 - protein, 9 aa, Homo Sapiens
GQHCSGSQR

SEQ ID NO: 1131855 - protein, 9 aa, Homo Sapiens
ASTSGSPHP

SEQ ID NO: 1131856 - protein, 9 aa, Homo Sapiens
AGNASLLQK

SEQ ID NO: 1131857 - protein, 9 aa, Homo Sapiens
RKTATVECM

SEQ ID NO: 1131858 - protein, 9 aa, Homo Sapiens
VSTGDITPL

SEQ ID NO: 1131859 - protein, 9 aa, Homo Sapiens
VCNTGSRAA

SEQ ID NO: 1131860 - protein, 9 aa, Homo Sapiens
PNPGVGPGL

SEQ ID NO: 1131861 - protein, 9 aa, Homo Sapiens
LRLNAKEEA

SEQ ID NO: 1131862 - protein, 9 aa, Homo Sapiens
GGLEASSDE

SEQ ID NO: 1131863 - protein, 9 aa, Homo Sapiens
ITSHAGKGL

SEQ ID NO: 1131864 - protein, 9 aa, Homo Sapiens
TVKVNGTHV

SEQ ID NO: 1131865 - protein, 9 aa, Homo Sapiens
TLIPGLWRP

SEQ ID NO: 1131866 - protein, 9 aa, Homo Sapiens
RKTPSHTMM

SEQ ID NO: 1131867 - protein, 9 aa, Homo Sapiens
PTRPPGPSR

SEQ ID NO: 1131868 - protein, 9 aa, Homo Sapiens
LSGHPPQAR

SEQ ID NO: 1131869 - protein, 9 aa, Homo Sapiens
QSQQFLGVH

SEQ ID NO: 1131870 - protein, 9 aa, Homo Sapiens
PTDALVWAG

SEQ ID NO: 1131871 - protein, 9 aa, Homo Sapiens
MFSDLHPFH

SEQ ID NO: 1131872 - protein, 9 aa, Homo Sapiens
LTPYSWVRF

SEQ ID NO: 1131873 - protein, 9 aa, Homo Sapiens
STRPKDNPL

SEQ ID NO: 1131874 - protein, 9 aa, Homo Sapiens
VLVPGFPCH

SEQ ID NO: 1131875 - protein, 9 aa, Homo Sapiens
RREAPAAAR

SEQ ID NO: 1131876 - protein, 9 aa, Homo Sapiens
VYGQNVIHH

SEQ ID NO: 1131877 - protein, 9 aa, Homo Sapiens
SSVPRDRQL

SEQ ID NO: 1131878 - protein, 9 aa, Homo Sapiens
RMLSAVPQQ

SEQ ID NO: 1131879 - protein, 9 aa, Homo Sapiens
GTTSSSGTS

SEQ ID NO: 1131880 - protein, 9 aa, Homo Sapiens
TLMINLYHL

SEQ ID NO: 1131881 - protein, 9 aa, Homo Sapiens
QVLLNAGEE

SEQ ID NO: 1131882 - protein, 9 aa, Homo Sapiens
VPIRAATLA

SEQ ID NO: 1131883 - protein, 9 aa, Homo Sapiens
GKVVTVRSR

SEQ ID NO: 1131884 - protein, 9 aa, Homo Sapiens
AAAVVVVVV

SEQ ID NO: 1131885 - protein, 9 aa, Homo Sapiens
PKEEISPST

SEQ ID NO: 1131886 - protein, 9 aa, Homo Sapiens
VVVYDQSMR

SEQ ID NO: 1131887 - protein, 9 aa, Homo Sapiens
DAGRDGQEP

SEQ ID NO: 1131888 - protein, 9 aa, Homo Sapiens
HSQNYCYQV

SEQ ID NO: 1131889 - protein, 9 aa, Homo Sapiens
EGSCFPKNL

SEQ ID NO: 1131890 - protein, 9 aa, Homo Sapiens
VPDPCPPCP

SEQ ID NO: 1131891 - protein, 9 aa, Homo Sapiens
AEQNRRDVE

SEQ ID NO: 1131892 - protein, 9 aa, Homo Sapiens
MSFDHYTAI

SEQ ID NO: 1131893 - protein, 9 aa, Homo Sapiens
KLNALKKKK

SEQ ID NO: 1131894 - protein, 9 aa, Homo Sapiens
VLRFRNGWE

SEQ ID NO: 1131895 - protein, 9 aa, Homo Sapiens
EFCTCIPPV

SEQ ID NO: 1131896 - protein, 9 aa, Homo Sapiens
PEVGGQVAV

SEQ ID NO: 1131897 - protein, 9 aa, Homo Sapiens
CKLYTGLYH

SEQ ID NO: 1131898 - protein, 9 aa, Homo Sapiens
IVLDMGYTK

SEQ ID NO: 1131899 - protein, 9 aa, Homo Sapiens
ALWPPPLRG

SEQ ID NO: 1131900 - protein, 9 aa, Homo Sapiens
GLRLSRTSW

SEQ ID NO: 1131901 - protein, 9 aa, Homo Sapiens
GQITGYKIH

SEQ ID NO: 1131902 - protein, 9 aa, Homo Sapiens
PPKQTIHEE

SEQ ID NO: 1131903 - protein, 9 aa, Homo Sapiens
GLQLKADSE

SEQ ID NO: 1131904 - protein, 9 aa, Homo Sapiens
LVENEGPQS

SEQ ID NO: 1131905 - protein, 9 aa, Homo Sapiens
PIFPQLGVQ

SEQ ID NO: 1131906 - protein, 9 aa, Homo Sapiens
LVEQAWPWR

SEQ ID NO: 1131907 - protein, 9 aa, Homo Sapiens
MMRPGQGQN

SEQ ID NO: 1131908 - protein, 9 aa, Homo Sapiens
CPCSSPACR

SEQ ID NO: 1131909 - protein, 9 aa, Homo Sapiens
MIMYSLPLT

SEQ ID NO: 1131910 - protein, 9 aa, Homo Sapiens
TSLASCSRG

SEQ ID NO: 1131911 - protein, 9 aa, Homo Sapiens
SPRTKSLGI

SEQ ID NO: 1131912 - protein, 9 aa, Homo Sapiens
FAQHSNLVT

SEQ ID NO: 1131913 - protein, 9 aa, Homo Sapiens
HKNSQQLWE

SEQ ID NO: 1131914 - protein, 9 aa, Homo Sapiens
GASGGTASS

SEQ ID NO: 1131915 - protein, 9 aa, Homo Sapiens
STATTRTRS

SEQ ID NO: 1131916 - protein, 9 aa, Homo Sapiens
NGEATFGRA

SEQ ID NO: 1131917 - protein, 9 aa, Homo Sapiens
MELTLTKVE

SEQ ID NO: 1131918 - protein, 9 aa, Homo Sapiens
SLRKTIMEL

SEQ ID NO: 1131919 - protein, 9 aa, Homo Sapiens
LLSALAVAV

SEQ ID NO: 1131920 - protein, 9 aa, Homo Sapiens
IGSTHNRSA

SEQ ID NO: 1131921 - protein, 9 aa, Homo Sapiens
IDLDPQLRL

SEQ ID NO: 1131922 - protein, 9 aa, Homo Sapiens
MTTNRRWIH

SEQ ID NO: 1131923 - protein, 9 aa, Homo Sapiens
HYGVSASEG

SEQ ID NO: 1131924 - protein, 9 aa, Homo Sapiens
DPIPLPALC

SEQ ID NO: 1131925 - protein, 9 aa, Homo Sapiens
VVAPDAFGI

SEQ ID NO: 1131926 - protein, 9 aa, Homo Sapiens
LLPGVSTTS

SEQ ID NO: 1131927 - protein, 9 aa, Homo Sapiens
KADVDQDGR

SEQ ID NO: 1131928 - protein, 9 aa, Homo Sapiens
EHGGPPSSM

SEQ ID NO: 1131929 - protein, 9 aa, Homo Sapiens
SIADMYSSV

SEQ ID NO: 1131930 - protein, 9 aa, Homo Sapiens
RAVFPGAPG

SEQ ID NO: 1131931 - protein, 9 aa, Homo Sapiens
CRLDACESL

SEQ ID NO: 1131932 - protein, 9 aa, Homo Sapiens
LVFFFDAYF

SEQ ID NO: 1131933 - protein, 9 aa, Homo Sapiens
ASSSTSRDS

SEQ ID NO: 1131934 - protein, 9 aa, Homo Sapiens
SFSFAFPKK

SEQ ID NO: 1131935 - protein, 9 aa, Homo Sapiens
AELGGHTAH

SEQ ID NO: 1131936 - protein, 9 aa, Homo Sapiens
VWVPHPLTV

SEQ ID NO: 1131937 - protein, 9 aa, Homo Sapiens
LSKKGNFQR

SEQ ID NO: 1131938 - protein, 9 aa, Homo Sapiens
AKLQRELDE

SEQ ID NO: 1131939 - protein, 9 aa, Homo Sapiens
WGPAHCMGE

SEQ ID NO: 1131940 - protein, 9 aa, Homo Sapiens
LQINCSRFT

SEQ ID NO: 1131941 - protein, 9 aa, Homo Sapiens
HHGADVEPD

SEQ ID NO: 1131942 - protein, 9 aa, Homo Sapiens
ETEGISEPP

SEQ ID NO: 1131943 - protein, 9 aa, Homo Sapiens
GVAYNLGAP

SEQ ID NO: 1131944 - protein, 9 aa, Homo Sapiens
VPAALLLRS

SEQ ID NO: 1131945 - protein, 9 aa, Homo Sapiens
CTRLLWKRS

SEQ ID NO: 1131946 - protein, 9 aa, Homo Sapiens
CRPFLKLCQ

SEQ ID NO: 1131947 - protein, 9 aa, Homo Sapiens
QMFSVFGEI

SEQ ID NO: 1131948 - protein, 9 aa, Homo Sapiens
TCTNQEIRA

SEQ ID NO: 1131949 - protein, 9 aa, Homo Sapiens
STELRPQHS

SEQ ID NO: 1131950 - protein, 9 aa, Homo Sapiens
SAGNVFTTA

SEQ ID NO: 1131951 - protein, 9 aa, Homo Sapiens
CNMMKKKNQ

SEQ ID NO: 1131952 - protein, 9 aa, Homo Sapiens
CHGERQSPD

SEQ ID NO: 1131953 - protein, 9 aa, Homo Sapiens
YDDYDHFSE

SEQ ID NO: 1131954 - protein, 9 aa, Homo Sapiens
LSFLSFFVV

SEQ ID NO: 1131955 - protein, 9 aa, Homo Sapiens
KNYCTKPQK

SEQ ID NO: 1131956 - protein, 9 aa, Homo Sapiens
HPFLAKAGL

SEQ ID NO: 1131957 - protein, 9 aa, Homo Sapiens
PLCEDVVLQ

SEQ ID NO: 1131958 - protein, 9 aa, Homo Sapiens
LADDLIKVS

SEQ ID NO: 1131959 - protein, 9 aa, Homo Sapiens
PTRGPRRRA

SEQ ID NO: 1131960 - protein, 9 aa, Homo Sapiens
TEGISEPPH

SEQ ID NO: 1131961 - protein, 9 aa, Homo Sapiens
ASHSEENKA

SEQ ID NO: 1131962 - protein, 9 aa, Homo Sapiens
PIPQRPGRK

SEQ ID NO: 1131963 - protein, 9 aa, Homo Sapiens
DSPMYWGST

SEQ ID NO: 1131964 - protein, 9 aa, Homo Sapiens
LGRNLPGEP

SEQ ID NO: 1131965 - protein, 9 aa, Homo Sapiens
NLENLFLRC

SEQ ID NO: 1131966 - protein, 9 aa, Homo Sapiens
ITPHGQIAG

SEQ ID NO: 1131967 - protein, 9 aa, Homo Sapiens
VKSRDKKMV

SEQ ID NO: 1131968 - protein, 9 aa, Homo Sapiens
PSDGQRRQQ

SEQ ID NO: 1131969 - protein, 9 aa, Homo Sapiens
EEQTCRALE

SEQ ID NO: 1131970 - protein, 9 aa, Homo Sapiens
MSERLKHNP

SEQ ID NO: 1131971 - protein, 9 aa, Homo Sapiens
IDDSTSSAE

SEQ ID NO: 1131972 - protein, 9 aa, Homo Sapiens
PLLAAVLCD

SEQ ID NO: 1131973 - protein, 9 aa, Homo Sapiens
EHFSRHSPS

SEQ ID NO: 1131974 - protein, 9 aa, Homo Sapiens
PSTRAWRRS

SEQ ID NO: 1131975 - protein, 9 aa, Homo Sapiens
PPAALHTMP

SEQ ID NO: 1131976 - protein, 9 aa, Homo Sapiens
EQGLPDPSG

SEQ ID NO: 1131977 - protein, 9 aa, Homo Sapiens
DGFHFAAIS

SEQ ID NO: 1131978 - protein, 9 aa, Homo Sapiens
NATLILVIG

SEQ ID NO: 1131979 - protein, 9 aa, Homo Sapiens
NEEKSSLGV

SEQ ID NO: 1131980 - protein, 9 aa, Homo Sapiens
RLLQQLHKN

SEQ ID NO: 1131981 - protein, 9 aa, Homo Sapiens
FWEFVYQEA

SEQ ID NO: 1131982 - protein, 9 aa, Homo Sapiens
GPSFAYGLA

SEQ ID NO: 1131983 - protein, 9 aa, Homo Sapiens
SFDEDLTRP

SEQ ID NO: 1131984 - protein, 9 aa, Homo Sapiens
DVKWPNDIS

SEQ ID NO: 1131985 - protein, 9 aa, Homo Sapiens
DLIYLCRFC

SEQ ID NO: 1131986 - protein, 9 aa, Homo Sapiens
DLGVRPLPP

SEQ ID NO: 1131987 - protein, 9 aa, Homo Sapiens
EMFSSEKAR

SEQ ID NO: 1131988 - protein, 9 aa, Homo Sapiens
LKKSRRRTK

SEQ ID NO: 1131989 - protein, 9 aa, Homo Sapiens
PTPPAPPTV

SEQ ID NO: 1131990 - protein, 9 aa, Homo Sapiens
PRPTVAFLP

SEQ ID NO: 1131991 - protein, 9 aa, Homo Sapiens
RGPQPVTRG

SEQ ID NO: 1131992 - protein, 9 aa, Homo Sapiens
LQNAHTMRR

SEQ ID NO: 1131993 - protein, 9 aa, Homo Sapiens
KVKSKQYVK

SEQ ID NO: 1131994 - protein, 9 aa, Homo Sapiens
RQSVMSGRS

SEQ ID NO: 1131995 - protein, 9 aa, Homo Sapiens
YSNLHTLTI

SEQ ID NO: 1131996 - protein, 9 aa, Homo Sapiens
RSHPETLAH

SEQ ID NO: 1131997 - protein, 9 aa, Homo Sapiens
NMLTHQEVP

SEQ ID NO: 1131998 - protein, 9 aa, Homo Sapiens
LRGPQTHCE

SEQ ID NO: 1131999 - protein, 9 aa, Homo Sapiens
ELRVSSEKL

SEQ ID NO: 1132000 - protein, 9 aa, Homo Sapiens
PPKYGKIED

SEQ ID NO: 1132001 - protein, 9 aa, Homo Sapiens
VPCMIHLLA

SEQ ID NO: 1132002 - protein, 9 aa, Homo Sapiens
SNYPCLAPV

SEQ ID NO: 1132003 - protein, 9 aa, Homo Sapiens
NINATLSSL

SEQ ID NO: 1132004 - protein, 9 aa, Homo Sapiens
SAQLLTDRA

SEQ ID NO: 1132005 - protein, 9 aa, Homo Sapiens
NAQNPSLFV

SEQ ID NO: 1132006 - protein, 9 aa, Homo Sapiens
ALLRGSVRR

SEQ ID NO: 1132007 - protein, 9 aa, Homo Sapiens
TGSNTCYME

SEQ ID NO: 1132008 - protein, 9 aa, Homo Sapiens
PAEVATTPG

SEQ ID NO: 1132009 - protein, 9 aa, Homo Sapiens
GRTTMKSVM

SEQ ID NO: 1132010 - protein, 9 aa, Homo Sapiens
LCPGQAWLA

SEQ ID NO: 1132011 - protein, 9 aa, Homo Sapiens
PEHSATSSV

SEQ ID NO: 1132012 - protein, 9 aa, Homo Sapiens
DGQEPQPRP

SEQ ID NO: 1132013 - protein, 9 aa, Homo Sapiens
PEYVVPCMI

SEQ ID NO: 1132014 - protein, 9 aa, Homo Sapiens
LGDPAIHQS

SEQ ID NO: 1132015 - protein, 9 aa, Homo Sapiens
VPGSASHRE

SEQ ID NO: 1132016 - protein, 9 aa, Homo Sapiens
RKYMTVPAH

SEQ ID NO: 1132017 - protein, 9 aa, Homo Sapiens
GRARRARWD

SEQ ID NO: 1132018 - protein, 9 aa, Homo Sapiens
DLEAQLDVN

SEQ ID NO: 1132019 - protein, 9 aa, Homo Sapiens
CGRAPARAG

SEQ ID NO: 1132020 - protein, 9 aa, Homo Sapiens
ALCPTQENF

SEQ ID NO: 1132021 - protein, 9 aa, Homo Sapiens
RGPRRRAWL

SEQ ID NO: 1132022 - protein, 9 aa, Homo Sapiens
TRKIAVPAN

SEQ ID NO: 1132023 - protein, 9 aa, Homo Sapiens
NLLRLQSLL

SEQ ID NO: 1132024 - protein, 9 aa, Homo Sapiens
GAKVSRNTL

SEQ ID NO: 1132025 - protein, 9 aa, Homo Sapiens
LTSVPSLVF

SEQ ID NO: 1132026 - protein, 9 aa, Homo Sapiens
KFCIFSSPP

SEQ ID NO: 1132027 - protein, 9 aa, Homo Sapiens
PSHCQLCSP

SEQ ID NO: 1132028 - protein, 9 aa, Homo Sapiens
SQNYMLPCL

SEQ ID NO: 1132029 - protein, 9 aa, Homo Sapiens
LIYSPQRQK

SEQ ID NO: 1132030 - protein, 9 aa, Homo Sapiens
HLQINCSRF

SEQ ID NO: 1132031 - protein, 9 aa, Homo Sapiens
PYKEPLKKR

SEQ ID NO: 1132032 - protein, 9 aa, Homo Sapiens
IQLAATKKL

SEQ ID NO: 1132033 - protein, 9 aa, Homo Sapiens
VAMENQHRS

SEQ ID NO: 1132034 - protein, 9 aa, Homo Sapiens
QYTTLISPV

SEQ ID NO: 1132035 - protein, 9 aa, Homo Sapiens
LAQCMGPNR

SEQ ID NO: 1132036 - protein, 9 aa, Homo Sapiens
AMCRCAYGY

SEQ ID NO: 1132037 - protein, 9 aa, Homo Sapiens
ALVQTKGTG

SEQ ID NO: 1132038 - protein, 9 aa, Homo Sapiens
VDFFIQDAY

SEQ ID NO: 1132039 - protein, 9 aa, Homo Sapiens
VFCGLNHVN

SEQ ID NO: 1132040 - protein, 9 aa, Homo Sapiens
GLAHLVVGR

SEQ ID NO: 1132041 - protein, 9 aa, Homo Sapiens
QSPAHAHQL

SEQ ID NO: 1132042 - protein, 9 aa, Homo Sapiens
LWLMTAMWL

SEQ ID NO: 1132043 - protein, 9 aa, Homo Sapiens
PKRVQRERN

SEQ ID NO: 1132044 - protein, 9 aa, Homo Sapiens
HRSSQDKTL

SEQ ID NO: 1132045 - protein, 9 aa, Homo Sapiens
DWIVFQINH

SEQ ID NO: 1132046 - protein, 9 aa, Homo Sapiens
EVSELQQRL

SEQ ID NO: 1132047 - protein, 9 aa, Homo Sapiens
RKNSMIGLS

SEQ ID NO: 1132048 - protein, 9 aa, Homo Sapiens
CQAMQPVYT

SEQ ID NO: 1132049 - protein, 9 aa, Homo Sapiens
TVQFQYSSD

SEQ ID NO: 1132050 - protein, 9 aa, Homo Sapiens
SMEQAQTYV

SEQ ID NO: 1132051 - protein, 9 aa, Homo Sapiens
LLCFQPRTR

SEQ ID NO: 1132052 - protein, 9 aa, Homo Sapiens
LCPPPSPLP

SEQ ID NO: 1132053 - protein, 9 aa, Homo Sapiens
VALLAVSDA

SEQ ID NO: 1132054 - protein, 9 aa, Homo Sapiens
SLKVLAGPL

SEQ ID NO: 1132055 - protein, 9 aa, Homo Sapiens
ADVEPDLHL

SEQ ID NO: 1132056 - protein, 9 aa, Homo Sapiens
QRTLEKKGS

SEQ ID NO: 1132057 - protein, 9 aa, Homo Sapiens
LDLICEGLY

SEQ ID NO: 1132058 - protein, 9 aa, Homo Sapiens
LAREVADKG

SEQ ID NO: 1132059 - protein, 9 aa, Homo Sapiens
SWFEDAVCP

SEQ ID NO: 1132060 - protein, 9 aa, Homo Sapiens
HPFDFDFFA

SEQ ID NO: 1132061 - protein, 9 aa, Homo Sapiens
QLLSFALCG

SEQ ID NO: 1132062 - protein, 9 aa, Homo Sapiens
LGSAWSLST

SEQ ID NO: 1132063 - protein, 9 aa, Homo Sapiens
YRLLGCLGS

SEQ ID NO: 1132064 - protein, 9 aa, Homo Sapiens
SELKQMFSV

SEQ ID NO: 1132065 - protein, 9 aa, Homo Sapiens
QEWGPAHCM

SEQ ID NO: 1132066 - protein, 9 aa, Homo Sapiens
ALQASWSPS

SEQ ID NO: 1132067 - protein, 9 aa, Homo Sapiens
PASSTSGPV

SEQ ID NO: 1132068 - protein, 9 aa, Homo Sapiens
GLVLAMQRT

SEQ ID NO: 1132069 - protein, 9 aa, Homo Sapiens
SRGLDSLAG

SEQ ID NO: 1132070 - protein, 9 aa, Homo Sapiens
HSINPVREV

SEQ ID NO: 1132071 - protein, 9 aa, Homo Sapiens
HGDSGVGLD

SEQ ID NO: 1132072 - protein, 9 aa, Homo Sapiens
RVPLQVVLP

SEQ ID NO: 1132073 - protein, 9 aa, Homo Sapiens
EHLRPSWCP

SEQ ID NO: 1132074 - protein, 9 aa, Homo Sapiens
MEKLTEVRE

SEQ ID NO: 1132075 - protein, 9 aa, Homo Sapiens
NGEKSQAVE

SEQ ID NO: 1132076 - protein, 9 aa, Homo Sapiens
QIQKGSHPD

SEQ ID NO: 1132077 - protein, 9 aa, Homo Sapiens
CLVTKVVAV

SEQ ID NO: 1132078 - protein, 9 aa, Homo Sapiens
LELTQKATP

SEQ ID NO: 1132079 - protein, 9 aa, Homo Sapiens
TYMMTRREK

SEQ ID NO: 1132080 - protein, 9 aa, Homo Sapiens
RPQWMLKAT

SEQ ID NO: 1132081 - protein, 9 aa, Homo Sapiens
QLHSLAHNL

SEQ ID NO: 1132082 - protein, 9 aa, Homo Sapiens
RYDRANTVF

SEQ ID NO: 1132083 - protein, 9 aa, Homo Sapiens
ILQTLILVV

SEQ ID NO: 1132084 - protein, 9 aa, Homo Sapiens
DHILFPLKS

SEQ ID NO: 1132085 - protein, 9 aa, Homo Sapiens
TWAPAAPSP

SEQ ID NO: 1132086 - protein, 9 aa, Homo Sapiens
IPAVARMTT

SEQ ID NO: 1132087 - protein, 9 aa, Homo Sapiens
LALVGGEIT

SEQ ID NO: 1132088 - protein, 9 aa, Homo Sapiens
QTTCWPSVV

SEQ ID NO: 1132089 - protein, 9 aa, Homo Sapiens
KVDPVYFKI

SEQ ID NO: 1132090 - protein, 9 aa, Homo Sapiens
ITPEIRALC

SEQ ID NO: 1132091 - protein, 9 aa, Homo Sapiens
SNSNDCMRG

SEQ ID NO: 1132092 - protein, 9 aa, Homo Sapiens
FRERAARRV

SEQ ID NO: 1132093 - protein, 9 aa, Homo Sapiens
PGTATMESL

SEQ ID NO: 1132094 - protein, 9 aa, Homo Sapiens
DISSVPPQP

SEQ ID NO: 1132095 - protein, 9 aa, Homo Sapiens
RRCWRGCCS

SEQ ID NO: 1132096 - protein, 9 aa, Homo Sapiens
RGLPSPPPH

SEQ ID NO: 1132097 - protein, 9 aa, Homo Sapiens
ESQFLMAEK

SEQ ID NO: 1132098 - protein, 9 aa, Homo Sapiens
VIRLTDGTD

SEQ ID NO: 1132099 - protein, 9 aa, Homo Sapiens
TQALPFGGP

SEQ ID NO: 1132100 - protein, 9 aa, Homo Sapiens
WLAEAGLPV

SEQ ID NO: 1132101 - protein, 9 aa, Homo Sapiens
TDGINTALC

SEQ ID NO: 1132102 - protein, 9 aa, Homo Sapiens
IDKVFNSIG

SEQ ID NO: 1132103 - protein, 9 aa, Homo Sapiens
RPPLRAGLM

SEQ ID NO: 1132104 - protein, 9 aa, Homo Sapiens
NITTFNIQG

SEQ ID NO: 1132105 - protein, 9 aa, Homo Sapiens
PDFGPNLPN

SEQ ID NO: 1132106 - protein, 9 aa, Homo Sapiens
TNAHDALAK

SEQ ID NO: 1132107 - protein, 9 aa, Homo Sapiens
RKAVAWMRT

SEQ ID NO: 1132108 - protein, 9 aa, Homo Sapiens
ILARHNETG

SEQ ID NO: 1132109 - protein, 9 aa, Homo Sapiens
GLGPPAALH

SEQ ID NO: 1132110 - protein, 9 aa, Homo Sapiens
PGARSHQGA

SEQ ID NO: 1132111 - protein, 9 aa, Homo Sapiens
NLYLLLTGE

SEQ ID NO: 1132112 - protein, 9 aa, Homo Sapiens
EHPVALEAE

SEQ ID NO: 1132113 - protein, 9 aa, Homo Sapiens
DVSSVLERF

SEQ ID NO: 1132114 - protein, 9 aa, Homo Sapiens
GGSCQHLRP

SEQ ID NO: 1132115 - protein, 9 aa, Homo Sapiens
DKKSNPFIR

SEQ ID NO: 1132116 - protein, 9 aa, Homo Sapiens
LCPVTMEEK

SEQ ID NO: 1132117 - protein, 9 aa, Homo Sapiens
SDYVLLKEV

SEQ ID NO: 1132118 - protein, 9 aa, Homo Sapiens
TQKDQLEYH

SEQ ID NO: 1132119 - protein, 9 aa, Homo Sapiens
ATCSMMVVH

SEQ ID NO: 1132120 - protein, 9 aa, Homo Sapiens
QLLIIDRDF

SEQ ID NO: 1132121 - protein, 9 aa, Homo Sapiens
RSLWWYPAV

SEQ ID NO: 1132122 - protein, 9 aa, Homo Sapiens
QPPLTATWA

SEQ ID NO: 1132123 - protein, 9 aa, Homo Sapiens
LLWTPVLLQ

SEQ ID NO: 1132124 - protein, 9 aa, Homo Sapiens
PTRLYPGAA

SEQ ID NO: 1132125 - protein, 9 aa, Homo Sapiens
PVPPLPACS

SEQ ID NO: 1132126 - protein, 9 aa, Homo Sapiens
FYVASDDEF

SEQ ID NO: 1132127 - protein, 9 aa, Homo Sapiens
CPHTQGSRP

SEQ ID NO: 1132128 - protein, 9 aa, Homo Sapiens
ILFSMLCCF

SEQ ID NO: 1132129 - protein, 9 aa, Homo Sapiens
DHGLRGLTL

SEQ ID NO: 1132130 - protein, 9 aa, Homo Sapiens
ADFLQNIMA

SEQ ID NO: 1132131 - protein, 9 aa, Homo Sapiens
SDLIYKLYE

SEQ ID NO: 1132132 - protein, 9 aa, Homo Sapiens
QTRPLWSRL

SEQ ID NO: 1132133 - protein, 9 aa, Homo Sapiens
VPTATAASA

SEQ ID NO: 1132134 - protein, 9 aa, Homo Sapiens
VCEEFEQKN

SEQ ID NO: 1132135 - protein, 9 aa, Homo Sapiens
VMSCSLLTQ

SEQ ID NO: 1132136 - protein, 9 aa, Homo Sapiens
MGFVSGLKK

SEQ ID NO: 1132137 - protein, 9 aa, Homo Sapiens
KERAAVQLM

SEQ ID NO: 1132138 - protein, 9 aa, Homo Sapiens
GIHYWLQLL

SEQ ID NO: 1132139 - protein, 9 aa, Homo Sapiens
CHDPRDDDL

SEQ ID NO: 1132140 - protein, 9 aa, Homo Sapiens
LRPLSLQCQ

SEQ ID NO: 1132141 - protein, 9 aa, Homo Sapiens
AGQGPGQRP

SEQ ID NO: 1132142 - protein, 9 aa, Homo Sapiens
SFFTSAHPS

SEQ ID NO: 1132143 - protein, 9 aa, Homo Sapiens
LHEEVVDSG

SEQ ID NO: 1132144 - protein, 9 aa, Homo Sapiens
RKKGLCHLL

SEQ ID NO: 1132145 - protein, 9 aa, Homo Sapiens
SRFTTIARP

SEQ ID NO: 1132146 - protein, 9 aa, Homo Sapiens
LVWTAPPAA

SEQ ID NO: 1132147 - protein, 9 aa, Homo Sapiens
RGVLSLLLL

SEQ ID NO: 1132148 - protein, 9 aa, Homo Sapiens
DLPGLEPAL

SEQ ID NO: 1132149 - protein, 9 aa, Homo Sapiens
NPGCTLWPH

SEQ ID NO: 1132150 - protein, 9 aa, Homo Sapiens
IVEAMVACR

SEQ ID NO: 1132151 - protein, 9 aa, Homo Sapiens
VSMNYRVGT

SEQ ID NO: 1132152 - protein, 9 aa, Homo Sapiens
VTFGATITP

SEQ ID NO: 1132153 - protein, 9 aa, Homo Sapiens
GSNTCYMEE

SEQ ID NO: 1132154 - protein, 9 aa, Homo Sapiens
ELTMDDVTA

SEQ ID NO: 1132155 - protein, 9 aa, Homo Sapiens
RLLAPGRGA

SEQ ID NO: 1132156 - protein, 9 aa, Homo Sapiens
DAKKGEYAF

SEQ ID NO: 1132157 - protein, 9 aa, Homo Sapiens
LPAVPHTAR

SEQ ID NO: 1132158 - protein, 9 aa, Homo Sapiens
SAPRITAAA

SEQ ID NO: 1132159 - protein, 9 aa, Homo Sapiens
TTVLGNGAL

SEQ ID NO: 1132160 - protein, 9 aa, Homo Sapiens
GNDGSMDAA

SEQ ID NO: 1132161 - protein, 9 aa, Homo Sapiens
LLCPVGGAE

SEQ ID NO: 1132162 - protein, 9 aa, Homo Sapiens
APTAAKPSA

SEQ ID NO: 1132163 - protein, 9 aa, Homo Sapiens
PPGRAWAPA

SEQ ID NO: 1132164 - protein, 9 aa, Homo Sapiens
VFALVLYGQ

SEQ ID NO: 1132165 - protein, 9 aa, Homo Sapiens
DVVTYTEHA

SEQ ID NO: 1132166 - protein, 9 aa, Homo Sapiens
ALQKTQLHL

SEQ ID NO: 1132167 - protein, 9 aa, Homo Sapiens
AGGNWGAAD

SEQ ID NO: 1132168 - protein, 9 aa, Homo Sapiens
KVSVKSLPE

SEQ ID NO: 1132169 - protein, 9 aa, Homo Sapiens
AVAYRLLGC

SEQ ID NO: 1132170 - protein, 9 aa, Homo Sapiens
CTHQGFCLT

SEQ ID NO: 1132171 - protein, 9 aa, Homo Sapiens
VASLFRHYT

SEQ ID NO: 1132172 - protein, 9 aa, Homo Sapiens
RRCTLKNRG

SEQ ID NO: 1132173 - protein, 9 aa, Homo Sapiens
AKVGVIEKR

SEQ ID NO: 1132174 - protein, 9 aa, Homo Sapiens
LTVMSFDHY

SEQ ID NO: 1132175 - protein, 9 aa, Homo Sapiens
LSRRLEVEA

SEQ ID NO: 1132176 - protein, 9 aa, Homo Sapiens
ARLLWQYDN

SEQ ID NO: 1132177 - protein, 9 aa, Homo Sapiens
VRITAATRA

SEQ ID NO: 1132178 - protein, 9 aa, Homo Sapiens
HPHPHSHSH

SEQ ID NO: 1132179 - protein, 9 aa, Homo Sapiens
VMCLRLRTK

SEQ ID NO: 1132180 - protein, 9 aa, Homo Sapiens
GSCEGKMAN

SEQ ID NO: 1132181 - protein, 9 aa, Homo Sapiens
PLRSERQPR

SEQ ID NO: 1132182 - protein, 9 aa, Homo Sapiens
MRPCSEWPR

SEQ ID NO: 1132183 - protein, 9 aa, Homo Sapiens
QDPGPLRVP

SEQ ID NO: 1132184 - protein, 9 aa, Homo Sapiens
AIERVEMPT

SEQ ID NO: 1132185 - protein, 9 aa, Homo Sapiens
RLQLCPQRA

SEQ ID NO: 1132186 - protein, 9 aa, Homo Sapiens
GPTSAVVAP

SEQ ID NO: 1132187 - protein, 9 aa, Homo Sapiens
LMMAFRNVT

SEQ ID NO: 1132188 - protein, 9 aa, Homo Sapiens
TCHWNGKKM

SEQ ID NO: 1132189 - protein, 9 aa, Homo Sapiens
WLSEDDNDV

SEQ ID NO: 1132190 - protein, 9 aa, Homo Sapiens
RSCSASVSF

SEQ ID NO: 1132191 - protein, 9 aa, Homo Sapiens
KAHSQYYVA

SEQ ID NO: 1132192 - protein, 9 aa, Homo Sapiens
RRSCRHSVQ

SEQ ID NO: 1132193 - protein, 9 aa, Homo Sapiens
VTLGELRRK

SEQ ID NO: 1132194 - protein, 9 aa, Homo Sapiens
DSPPQPRAP

SEQ ID NO: 1132195 - protein, 9 aa, Homo Sapiens
GGGRRNKHQ

SEQ ID NO: 1132196 - protein, 9 aa, Homo Sapiens
EGGLHVQLP

SEQ ID NO: 1132197 - protein, 9 aa, Homo Sapiens
AGCCLCPHP

SEQ ID NO: 1132198 - protein, 9 aa, Homo Sapiens
RGRQCSSGS

SEQ ID NO: 1132199 - protein, 9 aa, Homo Sapiens
RLSCCLFSP

SEQ ID NO: 1132200 - protein, 9 aa, Homo Sapiens
PPLSLPTRP

SEQ ID NO: 1132201 - protein, 9 aa, Homo Sapiens
TKMGGPSTC

SEQ ID NO: 1132202 - protein, 9 aa, Homo Sapiens
QSSKRLSIQ

SEQ ID NO: 1132203 - protein, 9 aa, Homo Sapiens
NYRFQMKFY

SEQ ID NO: 1132204 - protein, 9 aa, Homo Sapiens
GTLLNDFHM

SEQ ID NO: 1132205 - protein, 9 aa, Homo Sapiens
LQLPEPILA

SEQ ID NO: 1132206 - protein, 9 aa, Homo Sapiens
RRCLLPTTG

SEQ ID NO: 1132207 - protein, 9 aa, Homo Sapiens
PGAEQGPSS

SEQ ID NO: 1132208 - protein, 9 aa, Homo Sapiens
LRERKAHAY

SEQ ID NO: 1132209 - protein, 9 aa, Homo Sapiens
VSSALRFGK

SEQ ID NO: 1132210 - protein, 9 aa, Homo Sapiens
PASTSGVFP

SEQ ID NO: 1132211 - protein, 9 aa, Homo Sapiens
NFWQRITQG

SEQ ID NO: 1132212 - protein, 9 aa, Homo Sapiens
KGFAQHSNL

SEQ ID NO: 1132213 - protein, 9 aa, Homo Sapiens
LLFSFLIFL

SEQ ID NO: 1132214 - protein, 9 aa, Homo Sapiens
AAMIFKRGV

SEQ ID NO: 1132215 - protein, 9 aa, Homo Sapiens
LCDDYEELT

SEQ ID NO: 1132216 - protein, 9 aa, Homo Sapiens
RARPAAAAA

SEQ ID NO: 1132217 - protein, 9 aa, Homo Sapiens
NKNITWGQS

SEQ ID NO: 1132218 - protein, 9 aa, Homo Sapiens
TPPHPARTL

SEQ ID NO: 1132219 - protein, 9 aa, Homo Sapiens
RRQAEISNV

SEQ ID NO: 1132220 - protein, 9 aa, Homo Sapiens
GAQPHLSVS

SEQ ID NO: 1132221 - protein, 9 aa, Homo Sapiens
KQTGHVSSE

SEQ ID NO: 1132222 - protein, 9 aa, Homo Sapiens
PFSRFLNME

SEQ ID NO: 1132223 - protein, 9 aa, Homo Sapiens
EKWNLHKCI

SEQ ID NO: 1132224 - protein, 9 aa, Homo Sapiens
WHHHGGAGG

SEQ ID NO: 1132225 - protein, 9 aa, Homo Sapiens
GAQVDMVRT

SEQ ID NO: 1132226 - protein, 9 aa, Homo Sapiens
AGPVAAVLF

SEQ ID NO: 1132227 - protein, 9 aa, Homo Sapiens
KEALLLMSW

SEQ ID NO: 1132228 - protein, 9 aa, Homo Sapiens
VVAVPILCL

SEQ ID NO: 1132229 - protein, 9 aa, Homo Sapiens
LEPSFSEYA

SEQ ID NO: 1132230 - protein, 9 aa, Homo Sapiens
RADISNCGN

SEQ ID NO: 1132231 - protein, 9 aa, Homo Sapiens
KGSSLEPQQ

SEQ ID NO: 1132232 - protein, 9 aa, Homo Sapiens
LLYKCDLFE

SEQ ID NO: 1132233 - protein, 9 aa, Homo Sapiens
ASKDNSAGV

SEQ ID NO: 1132234 - protein, 9 aa, Homo Sapiens
NSKIVQAFP

SEQ ID NO: 1132235 - protein, 9 aa, Homo Sapiens
RLLERPYPE

SEQ ID NO: 1132236 - protein, 9 aa, Homo Sapiens
LNAGEEVTL

SEQ ID NO: 1132237 - protein, 9 aa, Homo Sapiens
RNVAVLREL

SEQ ID NO: 1132238 - protein, 9 aa, Homo Sapiens
LDASIHVTF

SEQ ID NO: 1132239 - protein, 9 aa, Homo Sapiens
KRSMVDSLD

SEQ ID NO: 1132240 - protein, 9 aa, Homo Sapiens
AAARHLRSP

SEQ ID NO: 1132241 - protein, 9 aa, Homo Sapiens
ATAGPSYPG

SEQ ID NO: 1132242 - protein, 9 aa, Homo Sapiens
QEVLHIGST

SEQ ID NO: 1132243 - protein, 9 aa, Homo Sapiens
ETFLSKACL

SEQ ID NO: 1132244 - protein, 9 aa, Homo Sapiens
GVLVSQNYM

SEQ ID NO: 1132245 - protein, 9 aa, Homo Sapiens
VQDLSGNPK

SEQ ID NO: 1132246 - protein, 9 aa, Homo Sapiens
AVARMCLHA

SEQ ID NO: 1132247 - protein, 9 aa, Homo Sapiens
WTGAGRRAG

SEQ ID NO: 1132248 - protein, 9 aa, Homo Sapiens
KDCVLMVEG

SEQ ID NO: 1132249 - protein, 9 aa, Homo Sapiens
PAMGTGIRT

SEQ ID NO: 1132250 - protein, 9 aa, Homo Sapiens
LLLHQQAGR

SEQ ID NO: 1132251 - protein, 9 aa, Homo Sapiens
ISCHAASNP

SEQ ID NO: 1132252 - protein, 9 aa, Homo Sapiens
AVHWRAMVG

SEQ ID NO: 1132253 - protein, 9 aa, Homo Sapiens
GSSFSRSRA

SEQ ID NO: 1132254 - protein, 9 aa, Homo Sapiens
WGQSLDNLI

SEQ ID NO: 1132255 - protein, 9 aa, Homo Sapiens
VVLYKWDHR

SEQ ID NO: 1132256 - protein, 9 aa, Homo Sapiens
DMMSSGFSG

SEQ ID NO: 1132257 - protein, 9 aa, Homo Sapiens
HFSRHSPSP

SEQ ID NO: 1132258 - protein, 9 aa, Homo Sapiens
WRSQNWPPL

SEQ ID NO: 1132259 - protein, 9 aa, Homo Sapiens
HPLRMAKNP

SEQ ID NO: 1132260 - protein, 9 aa, Homo Sapiens
PQPGAEQGP

SEQ ID NO: 1132261 - protein, 9 aa, Homo Sapiens
ANMVDPGVV

SEQ ID NO: 1132262 - protein, 9 aa, Homo Sapiens
HLVHQLHGK

SEQ ID NO: 1132263 - protein, 9 aa, Homo Sapiens
TRPIAGTQT

SEQ ID NO: 1132264 - protein, 9 aa, Homo Sapiens
EQPALTCAR

SEQ ID NO: 1132265 - protein, 9 aa, Homo Sapiens
FPTFGATDW

SEQ ID NO: 1132266 - protein, 9 aa, Homo Sapiens
RMLVGDGMS

SEQ ID NO: 1132267 - protein, 9 aa, Homo Sapiens
HKSGSLSET

SEQ ID NO: 1132268 - protein, 9 aa, Homo Sapiens
DSSQEVILS

SEQ ID NO: 1132269 - protein, 9 aa, Homo Sapiens
VEDPEGLKN

SEQ ID NO: 1132270 - protein, 9 aa, Homo Sapiens
PDPSGPPGL

SEQ ID NO: 1132271 - protein, 9 aa, Homo Sapiens
KGVWSNVLR

SEQ ID NO: 1132272 - protein, 9 aa, Homo Sapiens
ELMAQQYHA

SEQ ID NO: 1132273 - protein, 9 aa, Homo Sapiens
FSSMLEYRK

SEQ ID NO: 1132274 - protein, 9 aa, Homo Sapiens
LSMIMYSLP

SEQ ID NO: 1132275 - protein, 9 aa, Homo Sapiens
FSITPEVVM

SEQ ID NO: 1132276 - protein, 9 aa, Homo Sapiens
AWRALLYPR

SEQ ID NO: 1132277 - protein, 9 aa, Homo Sapiens
NNERYYGYT

SEQ ID NO: 1132278 - protein, 9 aa, Homo Sapiens
NELRHKHPV

SEQ ID NO: 1132279 - protein, 9 aa, Homo Sapiens
CNCVFRDAA

SEQ ID NO: 1132280 - protein, 9 aa, Homo Sapiens
ASGAVPGPC

SEQ ID NO: 1132281 - protein, 9 aa, Homo Sapiens
SPAPTSSPA

SEQ ID NO: 1132282 - protein, 9 aa, Homo Sapiens
FSSVSHIRT

SEQ ID NO: 1132283 - protein, 9 aa, Homo Sapiens
VHPGAQAFQ

SEQ ID NO: 1132284 - protein, 9 aa, Homo Sapiens
EAVPSNMWG

SEQ ID NO: 1132285 - protein, 9 aa, Homo Sapiens
HSQDDHHLE

SEQ ID NO: 1132286 - protein, 9 aa, Homo Sapiens
LKSPFQLVR

SEQ ID NO: 1132287 - protein, 9 aa, Homo Sapiens
PCLHDESLP

SEQ ID NO: 1132288 - protein, 9 aa, Homo Sapiens
EMELRFHEL

SEQ ID NO: 1132289 - protein, 9 aa, Homo Sapiens
SCTPGLCPE

SEQ ID NO: 1132290 - protein, 9 aa, Homo Sapiens
GEDTLVHIW

SEQ ID NO: 1132291 - protein, 9 aa, Homo Sapiens
ERVKDCVLM

SEQ ID NO: 1132292 - protein, 9 aa, Homo Sapiens
STFSTLVTA

SEQ ID NO: 1132293 - protein, 9 aa, Homo Sapiens
QSPRTKSLG

SEQ ID NO: 1132294 - protein, 9 aa, Homo Sapiens
IPSVTGHPL

SEQ ID NO: 1132295 - protein, 9 aa, Homo Sapiens
PGFRIVLDM

SEQ ID NO: 1132296 - protein, 9 aa, Homo Sapiens
AACRPGPTE

SEQ ID NO: 1132297 - protein, 9 aa, Homo Sapiens
EHSEDDEDV

SEQ ID NO: 1132298 - protein, 9 aa, Homo Sapiens
VLMMHQMEQ

SEQ ID NO: 1132299 - protein, 9 aa, Homo Sapiens
KAELAACSE

SEQ ID NO: 1132300 - protein, 9 aa, Homo Sapiens
TLTTNCMTV

SEQ ID NO: 1132301 - protein, 9 aa, Homo Sapiens
LKENNAIPQ

SEQ ID NO: 1132302 - protein, 9 aa, Homo Sapiens
TLQLGPEDT

SEQ ID NO: 1132303 - protein, 9 aa, Homo Sapiens
VWYMGYDAF

SEQ ID NO: 1132304 - protein, 9 aa, Homo Sapiens
TGKSHLLSN

SEQ ID NO: 1132305 - protein, 9 aa, Homo Sapiens
CLLFPASGE

SEQ ID NO: 1132306 - protein, 9 aa, Homo Sapiens
VGQGFIPDG

SEQ ID NO: 1132307 - protein, 9 aa, Homo Sapiens
MGSAHPHPW

SEQ ID NO: 1132308 - protein, 9 aa, Homo Sapiens
NRPSFDTIL

SEQ ID NO: 1132309 - protein, 9 aa, Homo Sapiens
MVDPGVVNT

SEQ ID NO: 1132310 - protein, 9 aa, Homo Sapiens
HDGSHQDMA

SEQ ID NO: 1132311 - protein, 9 aa, Homo Sapiens
SCLKDIEIS

SEQ ID NO: 1132312 - protein, 9 aa, Homo Sapiens
SISRSWTGT

SEQ ID NO: 1132313 - protein, 9 aa, Homo Sapiens
PCMIHLLAH

SEQ ID NO: 1132314 - protein, 9 aa, Homo Sapiens
NSESFGAWC

SEQ ID NO: 1132315 - protein, 9 aa, Homo Sapiens
EGANGSSAW

SEQ ID NO: 1132316 - protein, 9 aa, Homo Sapiens
QQHKNREAF

SEQ ID NO: 1132317 - protein, 9 aa, Homo Sapiens
GSDGVDGFE

SEQ ID NO: 1132318 - protein, 9 aa, Homo Sapiens
LRLSRTSWR

SEQ ID NO: 1132319 - protein, 9 aa, Homo Sapiens
SDRSPQKRV

SEQ ID NO: 1132320 - protein, 9 aa, Homo Sapiens
VVYSLGRVF

SEQ ID NO: 1132321 - protein, 9 aa, Homo Sapiens
RPLTYSTCM

SEQ ID NO: 1132322 - protein, 9 aa, Homo Sapiens
ADIREEKAP

SEQ ID NO: 1132323 - protein, 9 aa, Homo Sapiens
LSLTHLFLV

SEQ ID NO: 1132324 - protein, 9 aa, Homo Sapiens
VHHTVPEPE

SEQ ID NO: 1132325 - protein, 9 aa, Homo Sapiens
GLISVRLNM

SEQ ID NO: 1132326 - protein, 9 aa, Homo Sapiens
FTQRKESLA

SEQ ID NO: 1132327 - protein, 9 aa, Homo Sapiens
STCGKVFSE

SEQ ID NO: 1132328 - protein, 9 aa, Homo Sapiens
YSAYDCTIP

SEQ ID NO: 1132329 - protein, 9 aa, Homo Sapiens
STPSSGASW

SEQ ID NO: 1132330 - protein, 9 aa, Homo Sapiens
HIDEELRAL

SEQ ID NO: 1132331 - protein, 9 aa, Homo Sapiens
TPTAFSEYP

SEQ ID NO: 1132332 - protein, 9 aa, Homo Sapiens
DEEETTSHD

SEQ ID NO: 1132333 - protein, 9 aa, Homo Sapiens
VDGQRTLEK

SEQ ID NO: 1132334 - protein, 9 aa, Homo Sapiens
QMRWPTGTQ

SEQ ID NO: 1132335 - protein, 9 aa, Homo Sapiens
KAVQPLKKM

SEQ ID NO: 1132336 - protein, 9 aa, Homo Sapiens
DLEDLEEED

SEQ ID NO: 1132337 - protein, 9 aa, Homo Sapiens
PPGCILPFL

SEQ ID NO: 1132338 - protein, 9 aa, Homo Sapiens
GDHGPTLKA

SEQ ID NO: 1132339 - protein, 9 aa, Homo Sapiens
LLKVPIIRQ

SEQ ID NO: 1132340 - protein, 9 aa, Homo Sapiens
MKQGFKFNI

SEQ ID NO: 1132341 - protein, 9 aa, Homo Sapiens
GRRQLNLGQ

SEQ ID NO: 1132342 - protein, 9 aa, Homo Sapiens
KQGFKFNIM

SEQ ID NO: 1132343 - protein, 9 aa, Homo Sapiens
ALFNELTAR

SEQ ID NO: 1132344 - protein, 9 aa, Homo Sapiens
PPPGSSPGP

SEQ ID NO: 1132345 - protein, 9 aa, Homo Sapiens
RVRARVRAP

SEQ ID NO: 1132346 - protein, 9 aa, Homo Sapiens
WYTNINATL

SEQ ID NO: 1132347 - protein, 9 aa, Homo Sapiens
KERKKMVHE

SEQ ID NO: 1132348 - protein, 9 aa, Homo Sapiens
LTVLWEDQI

SEQ ID NO: 1132349 - protein, 9 aa, Homo Sapiens
IWNTWYGEQ

SEQ ID NO: 1132350 - protein, 9 aa, Homo Sapiens
VGSSVDYCI

SEQ ID NO: 1132351 - protein, 9 aa, Homo Sapiens
RIAWIKKLP

SEQ ID NO: 1132352 - protein, 9 aa, Homo Sapiens
SPSCPRCPR

SEQ ID NO: 1132353 - protein, 9 aa, Homo Sapiens
LHIGIMHWL

SEQ ID NO: 1132354 - protein, 9 aa, Homo Sapiens
RTPTTRLMA

SEQ ID NO: 1132355 - protein, 9 aa, Homo Sapiens
TCTLSTEAQ

SEQ ID NO: 1132356 - protein, 9 aa, Homo Sapiens
FFKLMMSST

SEQ ID NO: 1132357 - protein, 9 aa, Homo Sapiens
ADSLIGNAV

SEQ ID NO: 1132358 - protein, 9 aa, Homo Sapiens
ELVPVAELV

SEQ ID NO: 1132359 - protein, 9 aa, Homo Sapiens
SWLPERHGL

SEQ ID NO: 1132360 - protein, 9 aa, Homo Sapiens
NVCHLSTKG

SEQ ID NO: 1132361 - protein, 9 aa, Homo Sapiens
GGCCAKPCP

SEQ ID NO: 1132362 - protein, 9 aa, Homo Sapiens
RGPRTAIKA

SEQ ID NO: 1132363 - protein, 9 aa, Homo Sapiens
QKREMCASL

SEQ ID NO: 1132364 - protein, 9 aa, Homo Sapiens
MTCSGVKMI

SEQ ID NO: 1132365 - protein, 9 aa, Homo Sapiens
DLMPNLSLA

SEQ ID NO: 1132366 - protein, 9 aa, Homo Sapiens
ETVGRELLI

SEQ ID NO: 1132367 - protein, 9 aa, Homo Sapiens
KGMVSTSSP

SEQ ID NO: 1132368 - protein, 9 aa, Homo Sapiens
LFQTMSQAV

SEQ ID NO: 1132369 - protein, 9 aa, Homo Sapiens
CMGEIVTKF

SEQ ID NO: 1132370 - protein, 9 aa, Homo Sapiens
KEAAVLVEH

SEQ ID NO: 1132371 - protein, 9 aa, Homo Sapiens
SISSSLTSE

SEQ ID NO: 1132372 - protein, 9 aa, Homo Sapiens
HGSLLLKRS

SEQ ID NO: 1132373 - protein, 9 aa, Homo Sapiens
GEIACRQRR

SEQ ID NO: 1132374 - protein, 9 aa, Homo Sapiens
FPAPLPGRC

SEQ ID NO: 1132375 - protein, 9 aa, Homo Sapiens
CSRSLAKEM

SEQ ID NO: 1132376 - protein, 9 aa, Homo Sapiens
DIYPFAITL

SEQ ID NO: 1132377 - protein, 9 aa, Homo Sapiens
YYVAQQAGT

SEQ ID NO: 1132378 - protein, 9 aa, Homo Sapiens
VRSCQVPRT

SEQ ID NO: 1132379 - protein, 9 aa, Homo Sapiens
GFCPTNCHI

SEQ ID NO: 1132380 - protein, 9 aa, Homo Sapiens
ENELPSKWA

SEQ ID NO: 1132381 - protein, 9 aa, Homo Sapiens
TTPIEVLCE

SEQ ID NO: 1132382 - protein, 9 aa, Homo Sapiens
SFHMDTWNF

SEQ ID NO: 1132383 - protein, 9 aa, Homo Sapiens
DADVYWCVI

SEQ ID NO: 1132384 - protein, 9 aa, Homo Sapiens
SAPCWAPAP

SEQ ID NO: 1132385 - protein, 9 aa, Homo Sapiens
CPGSAGRHR

SEQ ID NO: 1132386 - protein, 9 aa, Homo Sapiens
GFSFLEKII

SEQ ID NO: 1132387 - protein, 9 aa, Homo Sapiens
NRIDSFHSR

SEQ ID NO: 1132388 - protein, 9 aa, Homo Sapiens
NDGIPDDRD

SEQ ID NO: 1132389 - protein, 9 aa, Homo Sapiens
VDNNHCQMS

SEQ ID NO: 1132390 - protein, 9 aa, Homo Sapiens
LNSTFPSML

SEQ ID NO: 1132391 - protein, 9 aa, Homo Sapiens
AHGNDTVQI

SEQ ID NO: 1132392 - protein, 9 aa, Homo Sapiens
EAPPPSTAA

SEQ ID NO: 1132393 - protein, 9 aa, Homo Sapiens
MCCTLRSGT

SEQ ID NO: 1132394 - protein, 9 aa, Homo Sapiens
TFGRALLWT

SEQ ID NO: 1132395 - protein, 9 aa, Homo Sapiens
ERFLQELTE

SEQ ID NO: 1132396 - protein, 9 aa, Homo Sapiens
HKDAVLGCR

SEQ ID NO: 1132397 - protein, 9 aa, Homo Sapiens
VKEARGRML

SEQ ID NO: 1132398 - protein, 9 aa, Homo Sapiens
AGESMEGLG

SEQ ID NO: 1132399 - protein, 9 aa, Homo Sapiens
AKVAFHLDF

SEQ ID NO: 1132400 - protein, 9 aa, Homo Sapiens
GFYCVECRA

SEQ ID NO: 1132401 - protein, 9 aa, Homo Sapiens
GYNGTTMCY

SEQ ID NO: 1132402 - protein, 9 aa, Homo Sapiens
GTHVYQGPE

SEQ ID NO: 1132403 - protein, 9 aa, Homo Sapiens
ATKFEGDHE

SEQ ID NO: 1132404 - protein, 9 aa, Homo Sapiens
YNTLLAAAA

SEQ ID NO: 1132405 - protein, 9 aa, Homo Sapiens
VVLAPGGGV

SEQ ID NO: 1132406 - protein, 9 aa, Homo Sapiens
PGQGQNYPR

SEQ ID NO: 1132407 - protein, 9 aa, Homo Sapiens
PDLTEEMNK

SEQ ID NO: 1132408 - protein, 9 aa, Homo Sapiens
AWLALAAVE

SEQ ID NO: 1132409 - protein, 9 aa, Homo Sapiens
HTPALPGLP

SEQ ID NO: 1132410 - protein, 9 aa, Homo Sapiens
HRQESLEEG

SEQ ID NO: 1132411 - protein, 9 aa, Homo Sapiens
NGLVQTTCW

SEQ ID NO: 1132412 - protein, 9 aa, Homo Sapiens
WLTQMYFFF

SEQ ID NO: 1132413 - protein, 9 aa, Homo Sapiens
GLRPCRCCR

SEQ ID NO: 1132414 - protein, 9 aa, Homo Sapiens
FLQQEDTPG

SEQ ID NO: 1132415 - protein, 9 aa, Homo Sapiens
RDLLHFLLI

SEQ ID NO: 1132416 - protein, 9 aa, Homo Sapiens
HGPYPAASA

SEQ ID NO: 1132417 - protein, 9 aa, Homo Sapiens
HVSIAKYNI

SEQ ID NO: 1132418 - protein, 9 aa, Homo Sapiens
TCLITRSQE

SEQ ID NO: 1132419 - protein, 9 aa, Homo Sapiens
YMKYIHPFI

SEQ ID NO: 1132420 - protein, 9 aa, Homo Sapiens
SSYETYDEE

SEQ ID NO: 1132421 - protein, 9 aa, Homo Sapiens
PLSASGLRQ

SEQ ID NO: 1132422 - protein, 9 aa, Homo Sapiens
TADRPPTPI

SEQ ID NO: 1132423 - protein, 9 aa, Homo Sapiens
GLQTDGVPE

SEQ ID NO: 1132424 - protein, 9 aa, Homo Sapiens
RNVFKKEDE

SEQ ID NO: 1132425 - protein, 9 aa, Homo Sapiens
LDTHFELPL

SEQ ID NO: 1132426 - protein, 9 aa, Homo Sapiens
GPAAPRPHS

SEQ ID NO: 1132427 - protein, 9 aa, Homo Sapiens
PLAVWISGI

SEQ ID NO: 1132428 - protein, 9 aa, Homo Sapiens
IRFRQDGDE

SEQ ID NO: 1132429 - protein, 9 aa, Homo Sapiens
AYTTKGLCL

SEQ ID NO: 1132430 - protein, 9 aa, Homo Sapiens
HWGSALPLA

SEQ ID NO: 1132431 - protein, 9 aa, Homo Sapiens
YGSYPPARQ

SEQ ID NO: 1132432 - protein, 9 aa, Homo Sapiens
YARLNMKQK

SEQ ID NO: 1132433 - protein, 9 aa, Homo Sapiens
QGGKQTPVA

SEQ ID NO: 1132434 - protein, 9 aa, Homo Sapiens
ITLILVYPI

SEQ ID NO: 1132435 - protein, 9 aa, Homo Sapiens
EDDLLPWKI

SEQ ID NO: 1132436 - protein, 9 aa, Homo Sapiens
LLLHAPSLS

SEQ ID NO: 1132437 - protein, 9 aa, Homo Sapiens
VACFHFKWF

SEQ ID NO: 1132438 - protein, 9 aa, Homo Sapiens
AFSMDDMFL

SEQ ID NO: 1132439 - protein, 9 aa, Homo Sapiens
PGSTRIPFR

SEQ ID NO: 1132440 - protein, 9 aa, Homo Sapiens
NIRAEGLKM

SEQ ID NO: 1132441 - protein, 9 aa, Homo Sapiens
LHARLIPFP

SEQ ID NO: 1132442 - protein, 9 aa, Homo Sapiens
EKEHEMNIL

SEQ ID NO: 1132443 - protein, 9 aa, Homo Sapiens
APPAFSGRI

SEQ ID NO: 1132444 - protein, 9 aa, Homo Sapiens
AHVPGRVTQ

SEQ ID NO: 1132445 - protein, 9 aa, Homo Sapiens
NLSRGVSPC

SEQ ID NO: 1132446 - protein, 9 aa, Homo Sapiens
SSGMLPPPS

SEQ ID NO: 1132447 - protein, 9 aa, Homo Sapiens
KVTPPEEPP

SEQ ID NO: 1132448 - protein, 9 aa, Homo Sapiens
SPHTPLVFS

SEQ ID NO: 1132449 - protein, 9 aa, Homo Sapiens
IILICLQVA

SEQ ID NO: 1132450 - protein, 9 aa, Homo Sapiens
PSLRPWARP

SEQ ID NO: 1132451 - protein, 9 aa, Homo Sapiens
RHPVLLLHP

SEQ ID NO: 1132452 - protein, 9 aa, Homo Sapiens
TVQWPPGEP

SEQ ID NO: 1132453 - protein, 9 aa, Homo Sapiens
ATNSCKGEK

SEQ ID NO: 1132454 - protein, 9 aa, Homo Sapiens
ESCTLICQV

SEQ ID NO: 1132455 - protein, 9 aa, Homo Sapiens
PFSLWEDLR

SEQ ID NO: 1132456 - protein, 9 aa, Homo Sapiens
HAHPGPTAA

SEQ ID NO: 1132457 - protein, 9 aa, Homo Sapiens
TDLCFQSSA

SEQ ID NO: 1132458 - protein, 9 aa, Homo Sapiens
ANGTVIHLA

SEQ ID NO: 1132459 - protein, 9 aa, Homo Sapiens
KRKYGKSMY

SEQ ID NO: 1132460 - protein, 9 aa, Homo Sapiens
RHLESASYS

SEQ ID NO: 1132461 - protein, 9 aa, Homo Sapiens
GPLAANGPR

SEQ ID NO: 1132462 - protein, 9 aa, Homo Sapiens
PQQQQHIFE

SEQ ID NO: 1132463 - protein, 9 aa, Homo Sapiens
GTTFTLVTR

SEQ ID NO: 1132464 - protein, 9 aa, Homo Sapiens
TKGTYIRTG

SEQ ID NO: 1132465 - protein, 9 aa, Homo Sapiens
FHLDFEFSK

SEQ ID NO: 1132466 - protein, 9 aa, Homo Sapiens
SHDWGTPRE

SEQ ID NO: 1132467 - protein, 9 aa, Homo Sapiens
PTPHLASGT

SEQ ID NO: 1132468 - protein, 9 aa, Homo Sapiens
RLEALKICE

SEQ ID NO: 1132469 - protein, 9 aa, Homo Sapiens
GGAVAAQPG

SEQ ID NO: 1132470 - protein, 9 aa, Homo Sapiens
RYPLKYLIV

SEQ ID NO: 1132471 - protein, 9 aa, Homo Sapiens
PDLRVITSH

SEQ ID NO: 1132472 - protein, 9 aa, Homo Sapiens
LQTLILVVI

SEQ ID NO: 1132473 - protein, 9 aa, Homo Sapiens
YTQLYTSHF

SEQ ID NO: 1132474 - protein, 9 aa, Homo Sapiens
MLVGDGMSQ

SEQ ID NO: 1132475 - protein, 9 aa, Homo Sapiens
QWIVTFGAT

SEQ ID NO: 1132476 - protein, 9 aa, Homo Sapiens
AFGIVAMAA

SEQ ID NO: 1132477 - protein, 9 aa, Homo Sapiens
GFGFGSRTF

SEQ ID NO: 1132478 - protein, 9 aa, Homo Sapiens
NNNERYYGY

SEQ ID NO: 1132479 - protein, 9 aa, Homo Sapiens
ALELGCACF

SEQ ID NO: 1132480 - protein, 9 aa, Homo Sapiens
TPRSSSAAP

SEQ ID NO: 1132481 - protein, 9 aa, Homo Sapiens
ATYVFLVVA

SEQ ID NO: 1132482 - protein, 9 aa, Homo Sapiens
RGGVATPGR

SEQ ID NO: 1132483 - protein, 9 aa, Homo Sapiens
AASACATSA

SEQ ID NO: 1132484 - protein, 9 aa, Homo Sapiens
SSGRHPATR

SEQ ID NO: 1132485 - protein, 9 aa, Homo Sapiens
ATPAEVATT

SEQ ID NO: 1132486 - protein, 9 aa, Homo Sapiens
SVNQSDSQS

SEQ ID NO: 1132487 - protein, 9 aa, Homo Sapiens
GSDDVVKEL

SEQ ID NO: 1132488 - protein, 9 aa, Homo Sapiens
ATQACSHGA

SEQ ID NO: 1132489 - protein, 9 aa, Homo Sapiens
QDLSGNPKL

SEQ ID NO: 1132490 - protein, 9 aa, Homo Sapiens
RRPLLPGVS

SEQ ID NO: 1132491 - protein, 9 aa, Homo Sapiens
PGVGPGLGG

SEQ ID NO: 1132492 - protein, 9 aa, Homo Sapiens
PPARQPSRP

SEQ ID NO: 1132493 - protein, 9 aa, Homo Sapiens
FPEPPCLHD

SEQ ID NO: 1132494 - protein, 9 aa, Homo Sapiens
LEHLRPSWC

SEQ ID NO: 1132495 - protein, 9 aa, Homo Sapiens
KKRGASSST

SEQ ID NO: 1132496 - protein, 9 aa, Homo Sapiens
GGGGAFIDL

SEQ ID NO: 1132497 - protein, 9 aa, Homo Sapiens
ITTTTMGET

SEQ ID NO: 1132498 - protein, 9 aa, Homo Sapiens
DPHFSKILE

SEQ ID NO: 1132499 - protein, 9 aa, Homo Sapiens
VTYNSNIFT

SEQ ID NO: 1132500 - protein, 9 aa, Homo Sapiens
TATDTTILS

SEQ ID NO: 1132501 - protein, 9 aa, Homo Sapiens
IGSDQELYF

SEQ ID NO: 1132502 - protein, 9 aa, Homo Sapiens
HCYVRPNHI

SEQ ID NO: 1132503 - protein, 9 aa, Homo Sapiens
KQGPLPHGA

SEQ ID NO: 1132504 - protein, 9 aa, Homo Sapiens
QELTAAVLD

SEQ ID NO: 1132505 - protein, 9 aa, Homo Sapiens
ALTAYEDVL

SEQ ID NO: 1132506 - protein, 9 aa, Homo Sapiens
ARPSTTRRD

SEQ ID NO: 1132507 - protein, 9 aa, Homo Sapiens
KEEWHTAFV

SEQ ID NO: 1132508 - protein, 9 aa, Homo Sapiens
VYFEKHQQE

SEQ ID NO: 1132509 - protein, 9 aa, Homo Sapiens
ELFDYAYEA

SEQ ID NO: 1132510 - protein, 9 aa, Homo Sapiens
EETRKIAVP

SEQ ID NO: 1132511 - protein, 9 aa, Homo Sapiens
LPVLLALTA

SEQ ID NO: 1132512 - protein, 9 aa, Homo Sapiens
PTNRRSKNQ

SEQ ID NO: 1132513 - protein, 9 aa, Homo Sapiens
LRFHELEAI

SEQ ID NO: 1132514 - protein, 9 aa, Homo Sapiens
NDNAWHNVR

SEQ ID NO: 1132515 - protein, 9 aa, Homo Sapiens
QRARHREGS

SEQ ID NO: 1132516 - protein, 9 aa, Homo Sapiens
VTVATALPG

SEQ ID NO: 1132517 - protein, 9 aa, Homo Sapiens
EGTCTCIAK

SEQ ID NO: 1132518 - protein, 9 aa, Homo Sapiens
TGTRRIRGS

SEQ ID NO: 1132519 - protein, 9 aa, Homo Sapiens
KMLLLSALG

SEQ ID NO: 1132520 - protein, 9 aa, Homo Sapiens
LTALAVECA

SEQ ID NO: 1132521 - protein, 9 aa, Homo Sapiens
GRNKSGCKH

SEQ ID NO: 1132522 - protein, 9 aa, Homo Sapiens
GDWQACGQG

SEQ ID NO: 1132523 - protein, 9 aa, Homo Sapiens
PPTPVPRSL

SEQ ID NO: 1132524 - protein, 9 aa, Homo Sapiens
PDDGGRTGR

SEQ ID NO: 1132525 - protein, 9 aa, Homo Sapiens
GEQSWWGGD

SEQ ID NO: 1132526 - protein, 9 aa, Homo Sapiens
VPLISLMIE

SEQ ID NO: 1132527 - protein, 9 aa, Homo Sapiens
GKMATQACS

SEQ ID NO: 1132528 - protein, 9 aa, Homo Sapiens
LHLRGQGGK

SEQ ID NO: 1132529 - protein, 9 aa, Homo Sapiens
LVSQEDGLP

SEQ ID NO: 1132530 - protein, 9 aa, Homo Sapiens
SEPGSAGAT

SEQ ID NO: 1132531 - protein, 9 aa, Homo Sapiens
PRPTSGARL

SEQ ID NO: 1132532 - protein, 9 aa, Homo Sapiens
SVPKHKLPL

SEQ ID NO: 1132533 - protein, 9 aa, Homo Sapiens
GQPPKARDL

SEQ ID NO: 1132534 - protein, 9 aa, Homo Sapiens
ALECCLDPS

SEQ ID NO: 1132535 - protein, 9 aa, Homo Sapiens
EVVSELLIG

SEQ ID NO: 1132536 - protein, 9 aa, Homo Sapiens
IWTEMIITK

SEQ ID NO: 1132537 - protein, 9 aa, Homo Sapiens
RRKSQLGSL

SEQ ID NO: 1132538 - protein, 9 aa, Homo Sapiens
LGQRATRHG

SEQ ID NO: 1132539 - protein, 9 aa, Homo Sapiens
FWWTALIAW

SEQ ID NO: 1132540 - protein, 9 aa, Homo Sapiens
LVWYPATVL

SEQ ID NO: 1132541 - protein, 9 aa, Homo Sapiens
ASGPVEGRV

SEQ ID NO: 1132542 - protein, 9 aa, Homo Sapiens
HSVQLRDRG

SEQ ID NO: 1132543 - protein, 9 aa, Homo Sapiens
GEQPPDQWC

SEQ ID NO: 1132544 - protein, 9 aa, Homo Sapiens
GAPGAPPPG

SEQ ID NO: 1132545 - protein, 9 aa, Homo Sapiens
VQLHEEVVD

SEQ ID NO: 1132546 - protein, 9 aa, Homo Sapiens
EERRAVIVK

SEQ ID NO: 1132547 - protein, 9 aa, Homo Sapiens
QGIHRHKIS

SEQ ID NO: 1132548 - protein, 9 aa, Homo Sapiens
QLHKNSQQL

SEQ ID NO: 1132549 - protein, 9 aa, Homo Sapiens
RRQFLAKQG

SEQ ID NO: 1132550 - protein, 9 aa, Homo Sapiens
SSKKTKKKR

SEQ ID NO: 1132551 - protein, 9 aa, Homo Sapiens
KHARQHTEF

SEQ ID NO: 1132552 - protein, 9 aa, Homo Sapiens
RDIDDMELT

SEQ ID NO: 1132553 - protein, 9 aa, Homo Sapiens
TALCDCLPG

SEQ ID NO: 1132554 - protein, 9 aa, Homo Sapiens
TLKITTNTE

SEQ ID NO: 1132555 - protein, 9 aa, Homo Sapiens
TLVTALKGR

SEQ ID NO: 1132556 - protein, 9 aa, Homo Sapiens
TVSWGSLLM

SEQ ID NO: 1132557 - protein, 9 aa, Homo Sapiens
AQESLQLEN

SEQ ID NO: 1132558 - protein, 9 aa, Homo Sapiens
DNMLQKAHL

SEQ ID NO: 1132559 - protein, 9 aa, Homo Sapiens
RRPGPKEAI

SEQ ID NO: 1132560 - protein, 9 aa, Homo Sapiens
PVVLQGLFP

SEQ ID NO: 1132561 - protein, 9 aa, Homo Sapiens
SSSIDLQAK

SEQ ID NO: 1132562 - protein, 9 aa, Homo Sapiens
AAVWAPRRG

SEQ ID NO: 1132563 - protein, 9 aa, Homo Sapiens
GASGGEGGL

SEQ ID NO: 1132564 - protein, 9 aa, Homo Sapiens
QILGMIPGL

SEQ ID NO: 1132565 - protein, 9 aa, Homo Sapiens
VTGEVWRGC

SEQ ID NO: 1132566 - protein, 9 aa, Homo Sapiens
LKIVQMSIL

SEQ ID NO: 1132567 - protein, 9 aa, Homo Sapiens
ARPHAYYTL

SEQ ID NO: 1132568 - protein, 9 aa, Homo Sapiens
GQCHVQRLW

SEQ ID NO: 1132569 - protein, 9 aa, Homo Sapiens
RAGRRPLPR

SEQ ID NO: 1132570 - protein, 9 aa, Homo Sapiens
KVNYSHLAK

SEQ ID NO: 1132571 - protein, 9 aa, Homo Sapiens
LSKNPKNHY

SEQ ID NO: 1132572 - protein, 9 aa, Homo Sapiens
NHVSIAKYN

SEQ ID NO: 1132573 - protein, 9 aa, Homo Sapiens
HDWGTPREL

SEQ ID NO: 1132574 - protein, 9 aa, Homo Sapiens
GPSPAPSAG

SEQ ID NO: 1132575 - protein, 9 aa, Homo Sapiens
QKCLMKTSR

SEQ ID NO: 1132576 - protein, 9 aa, Homo Sapiens
PTFGATDWE

SEQ ID NO: 1132577 - protein, 9 aa, Homo Sapiens
TRMSHLALP

SEQ ID NO: 1132578 - protein, 9 aa, Homo Sapiens
EGDGTGPLS

SEQ ID NO: 1132579 - protein, 9 aa, Homo Sapiens
SSDTGSVGA

SEQ ID NO: 1132580 - protein, 9 aa, Homo Sapiens
EVTRNYAWV

SEQ ID NO: 1132581 - protein, 9 aa, Homo Sapiens
KLSWGTMVR

SEQ ID NO: 1132582 - protein, 9 aa, Homo Sapiens
PPLLHPQWA

SEQ ID NO: 1132583 - protein, 9 aa, Homo Sapiens
LCTVASPPR

SEQ ID NO: 1132584 - protein, 9 aa, Homo Sapiens
AALGSCVFL

SEQ ID NO: 1132585 - protein, 9 aa, Homo Sapiens
VPWLPLQIE

SEQ ID NO: 1132586 - protein, 9 aa, Homo Sapiens
LTYNHFHQS

SEQ ID NO: 1132587 - protein, 9 aa, Homo Sapiens
HGTYQNPNM

SEQ ID NO: 1132588 - protein, 9 aa, Homo Sapiens
HGLCHPSSV

SEQ ID NO: 1132589 - protein, 9 aa, Homo Sapiens
GKRVALGPG

SEQ ID NO: 1132590 - protein, 9 aa, Homo Sapiens
GEGFAQRER

SEQ ID NO: 1132591 - protein, 9 aa, Homo Sapiens
RSAIQLRNY

SEQ ID NO: 1132592 - protein, 9 aa, Homo Sapiens
FRHDRSPEL

SEQ ID NO: 1132593 - protein, 9 aa, Homo Sapiens
DHEDDFCEA

SEQ ID NO: 1132594 - protein, 9 aa, Homo Sapiens
VSWSTVRYM

SEQ ID NO: 1132595 - protein, 9 aa, Homo Sapiens
VIGMPHLCS

SEQ ID NO: 1132596 - protein, 9 aa, Homo Sapiens
IMLRLEDMS

SEQ ID NO: 1132597 - protein, 9 aa, Homo Sapiens
VPPSPTTPR

SEQ ID NO: 1132598 - protein, 9 aa, Homo Sapiens
ATANRDILA

SEQ ID NO: 1132599 - protein, 9 aa, Homo Sapiens
RSAFPSRSL

SEQ ID NO: 1132600 - protein, 9 aa, Homo Sapiens
TFMPPGSPT

SEQ ID NO: 1132601 - protein, 9 aa, Homo Sapiens
DDATISRNI

SEQ ID NO: 1132602 - protein, 9 aa, Homo Sapiens
LIDRPGPRD

SEQ ID NO: 1132603 - protein, 9 aa, Homo Sapiens
TGTAGCCAM

SEQ ID NO: 1132604 - protein, 9 aa, Homo Sapiens
DCAKLVRDA

SEQ ID NO: 1132605 - protein, 9 aa, Homo Sapiens
FMLVKNEIN

SEQ ID NO: 1132606 - protein, 9 aa, Homo Sapiens
KLKCGILWL

SEQ ID NO: 1132607 - protein, 9 aa, Homo Sapiens
IYLPLMAVA

SEQ ID NO: 1132608 - protein, 9 aa, Homo Sapiens
ERSPCPGWG

SEQ ID NO: 1132609 - protein, 9 aa, Homo Sapiens
KEHTNAKKI

SEQ ID NO: 1132610 - protein, 9 aa, Homo Sapiens
PHLVPKLQR

SEQ ID NO: 1132611 - protein, 9 aa, Homo Sapiens
KYIHPFIFA

SEQ ID NO: 1132612 - protein, 9 aa, Homo Sapiens
EVLQDLWEN

SEQ ID NO: 1132613 - protein, 9 aa, Homo Sapiens
GRSLQNAVR

SEQ ID NO: 1132614 - protein, 9 aa, Homo Sapiens
SSTWRSTRR

SEQ ID NO: 1132615 - protein, 9 aa, Homo Sapiens
AAEAVTFGL

SEQ ID NO: 1132616 - protein, 9 aa, Homo Sapiens
LYTIVDFTL

SEQ ID NO: 1132617 - protein, 9 aa, Homo Sapiens
SALIVGHPK

SEQ ID NO: 1132618 - protein, 9 aa, Homo Sapiens
LFRLGAEAL

SEQ ID NO: 1132619 - protein, 9 aa, Homo Sapiens
LIGNNCNFV

SEQ ID NO: 1132620 - protein, 9 aa, Homo Sapiens
LDVCKLLVA

SEQ ID NO: 1132621 - protein, 9 aa, Homo Sapiens
GSSATVQDS

SEQ ID NO: 1132622 - protein, 9 aa, Homo Sapiens
SPPPLCRKR

SEQ ID NO: 1132623 - protein, 9 aa, Homo Sapiens
KDTCKSDAG

SEQ ID NO: 1132624 - protein, 9 aa, Homo Sapiens
KDMLPQKFW

SEQ ID NO: 1132625 - protein, 9 aa, Homo Sapiens
MTRASDRPS

SEQ ID NO: 1132626 - protein, 9 aa, Homo Sapiens
TLSYCALIL

SEQ ID NO: 1132627 - protein, 9 aa, Homo Sapiens
LMNARDAKE

SEQ ID NO: 1132628 - protein, 9 aa, Homo Sapiens
DAGVPTLGS

SEQ ID NO: 1132629 - protein, 9 aa, Homo Sapiens
HLGRAVFPG

SEQ ID NO: 1132630 - protein, 9 aa, Homo Sapiens
FGYVILEAS

SEQ ID NO: 1132631 - protein, 9 aa, Homo Sapiens
YGQNKKYKN

SEQ ID NO: 1132632 - protein, 9 aa, Homo Sapiens
PSAPTCQEN

SEQ ID NO: 1132633 - protein, 9 aa, Homo Sapiens
SRGRNFWQR

SEQ ID NO: 1132634 - protein, 9 aa, Homo Sapiens
SFPTCGPLC

SEQ ID NO: 1132635 - protein, 9 aa, Homo Sapiens
EWDVEEVPE

SEQ ID NO: 1132636 - protein, 9 aa, Homo Sapiens
GGEGGLRLR

SEQ ID NO: 1132637 - protein, 9 aa, Homo Sapiens
FWTIFHILL

SEQ ID NO: 1132638 - protein, 9 aa, Homo Sapiens
GRRPLPRPR

SEQ ID NO: 1132639 - protein, 9 aa, Homo Sapiens
TLTPKAGKI

SEQ ID NO: 1132640 - protein, 9 aa, Homo Sapiens
SPSSAASAC

SEQ ID NO: 1132641 - protein, 9 aa, Homo Sapiens
HTLTILKKY

SEQ ID NO: 1132642 - protein, 9 aa, Homo Sapiens
LKVKSKQYV

SEQ ID NO: 1132643 - protein, 9 aa, Homo Sapiens
MKTVVWGSA

SEQ ID NO: 1132644 - protein, 9 aa, Homo Sapiens
YFINNLRAL

SEQ ID NO: 1132645 - protein, 9 aa, Homo Sapiens
PIYSWYGSV

SEQ ID NO: 1132646 - protein, 9 aa, Homo Sapiens
KELNDTLKN

SEQ ID NO: 1132647 - protein, 9 aa, Homo Sapiens
IVSLAYTFE

SEQ ID NO: 1132648 - protein, 9 aa, Homo Sapiens
TIYDSKAPN

SEQ ID NO: 1132649 - protein, 9 aa, Homo Sapiens
LTAASTQFS

SEQ ID NO: 1132650 - protein, 9 aa, Homo Sapiens
IVSTMSKYY

SEQ ID NO: 1132651 - protein, 9 aa, Homo Sapiens
SCDPPSSMG

SEQ ID NO: 1132652 - protein, 9 aa, Homo Sapiens
FIDEPTSSS

SEQ ID NO: 1132653 - protein, 9 aa, Homo Sapiens
PDVHGRSLQ

SEQ ID NO: 1132654 - protein, 9 aa, Homo Sapiens
LPAPSSCWP

SEQ ID NO: 1132655 - protein, 9 aa, Homo Sapiens
IAEAYTTKG

SEQ ID NO: 1132656 - protein, 9 aa, Homo Sapiens
CFGRHVVMN

SEQ ID NO: 1132657 - protein, 9 aa, Homo Sapiens
VVAAIPEGL

SEQ ID NO: 1132658 - protein, 9 aa, Homo Sapiens
TSSPSLPHS

SEQ ID NO: 1132659 - protein, 9 aa, Homo Sapiens
SCDFYHTCY

SEQ ID NO: 1132660 - protein, 9 aa, Homo Sapiens
GAAAGVQFG

SEQ ID NO: 1132661 - protein, 9 aa, Homo Sapiens
WCSSAAPVR

SEQ ID NO: 1132662 - protein, 9 aa, Homo Sapiens
LRLSCPYHP

SEQ ID NO: 1132663 - protein, 9 aa, Homo Sapiens
TPLPWANSS

SEQ ID NO: 1132664 - protein, 9 aa, Homo Sapiens
DKTTTVQVL

SEQ ID NO: 1132665 - protein, 9 aa, Homo Sapiens
AEAGLPVEA

SEQ ID NO: 1132666 - protein, 9 aa, Homo Sapiens
GAAGAGGQA

SEQ ID NO: 1132667 - protein, 9 aa, Homo Sapiens
IPHACDPNL

SEQ ID NO: 1132668 - protein, 9 aa, Homo Sapiens
RAWHHHGGA

SEQ ID NO: 1132669 - protein, 9 aa, Homo Sapiens
SVVWQDLIH

SEQ ID NO: 1132670 - protein, 9 aa, Homo Sapiens
VAVRSDHVS

SEQ ID NO: 1132671 - protein, 9 aa, Homo Sapiens
KVPAVPRAT

SEQ ID NO: 1132672 - protein, 9 aa, Homo Sapiens
NGILLSGAK

SEQ ID NO: 1132673 - protein, 9 aa, Homo Sapiens
IGRLGEYSL

SEQ ID NO: 1132674 - protein, 9 aa, Homo Sapiens
LLSRPRSAA

SEQ ID NO: 1132675 - protein, 9 aa, Homo Sapiens
AVRALHNLA

SEQ ID NO: 1132676 - protein, 9 aa, Homo Sapiens
FTEAAYALL

SEQ ID NO: 1132677 - protein, 9 aa, Homo Sapiens
TVHGSVHVT

SEQ ID NO: 1132678 - protein, 9 aa, Homo Sapiens
VEEMFASTA

SEQ ID NO: 1132679 - protein, 9 aa, Homo Sapiens
EEPSSGMLP

SEQ ID NO: 1132680 - protein, 9 aa, Homo Sapiens
RLAVLNGKG

SEQ ID NO: 1132681 - protein, 9 aa, Homo Sapiens
ILRLRRHLP

SEQ ID NO: 1132682 - protein, 9 aa, Homo Sapiens
AAISDFYYT

SEQ ID NO: 1132683 - protein, 9 aa, Homo Sapiens
GSARGGQSS

SEQ ID NO: 1132684 - protein, 9 aa, Homo Sapiens
KHEHDQGHG

SEQ ID NO: 1132685 - protein, 9 aa, Homo Sapiens
TLPGLFVKT

SEQ ID NO: 1132686 - protein, 9 aa, Homo Sapiens
ANQCQIEPV

SEQ ID NO: 1132687 - protein, 9 aa, Homo Sapiens
HSIVEYREY

SEQ ID NO: 1132688 - protein, 9 aa, Homo Sapiens
ADLRGEPRI

SEQ ID NO: 1132689 - protein, 9 aa, Homo Sapiens
VLSRTHNSR

SEQ ID NO: 1132690 - protein, 9 aa, Homo Sapiens
IDILVIEKH

SEQ ID NO: 1132691 - protein, 9 aa, Homo Sapiens
TSGKGFVAS

SEQ ID NO: 1132692 - protein, 9 aa, Homo Sapiens
TVSKRASRP

SEQ ID NO: 1132693 - protein, 9 aa, Homo Sapiens
QACRGENHG

SEQ ID NO: 1132694 - protein, 9 aa, Homo Sapiens
EEEDEPVPD

SEQ ID NO: 1132695 - protein, 9 aa, Homo Sapiens
ASRGHGAAR

SEQ ID NO: 1132696 - protein, 9 aa, Homo Sapiens
DIDAMIYTR

SEQ ID NO: 1132697 - protein, 9 aa, Homo Sapiens
AGAQLRNGK

SEQ ID NO: 1132698 - protein, 9 aa, Homo Sapiens
SAGRACVLP

SEQ ID NO: 1132699 - protein, 9 aa, Homo Sapiens
FYVYHSEGM

SEQ ID NO: 1132700 - protein, 9 aa, Homo Sapiens
RLSLLAPKT

SEQ ID NO: 1132701 - protein, 9 aa, Homo Sapiens
GKERAAVQL

SEQ ID NO: 1132702 - protein, 9 aa, Homo Sapiens
TSSINTTIS

SEQ ID NO: 1132703 - protein, 9 aa, Homo Sapiens
QGGPRPPGA

SEQ ID NO: 1132704 - protein, 9 aa, Homo Sapiens
QESSSEEVS

SEQ ID NO: 1132705 - protein, 9 aa, Homo Sapiens
PSPPDPQEL

SEQ ID NO: 1132706 - protein, 9 aa, Homo Sapiens
GIADATKSL

SEQ ID NO: 1132707 - protein, 9 aa, Homo Sapiens
RPSFDTILY

SEQ ID NO: 1132708 - protein, 9 aa, Homo Sapiens
ACPMTACSI

SEQ ID NO: 1132709 - protein, 9 aa, Homo Sapiens
TFLSKACLP

SEQ ID NO: 1132710 - protein, 9 aa, Homo Sapiens
VQAVASPDQ

SEQ ID NO: 1132711 - protein, 9 aa, Homo Sapiens
GRVLLPDGG

SEQ ID NO: 1132712 - protein, 9 aa, Homo Sapiens
CFKLGGPRL

SEQ ID NO: 1132713 - protein, 9 aa, Homo Sapiens
KPGKSCDFY

SEQ ID NO: 1132714 - protein, 9 aa, Homo Sapiens
HQKSGRVLA

SEQ ID NO: 1132715 - protein, 9 aa, Homo Sapiens
APSPGRNSV

SEQ ID NO: 1132716 - protein, 9 aa, Homo Sapiens
ASGPTPVPT

SEQ ID NO: 1132717 - protein, 9 aa, Homo Sapiens
RLTLPPSKI

SEQ ID NO: 1132718 - protein, 9 aa, Homo Sapiens
KTWLPGGGC

SEQ ID NO: 1132719 - protein, 9 aa, Homo Sapiens
PCCSDFSNK

SEQ ID NO: 1132720 - protein, 9 aa, Homo Sapiens
DGRWYTNIN

SEQ ID NO: 1132721 - protein, 9 aa, Homo Sapiens
HRTEMKESK

SEQ ID NO: 1132722 - protein, 9 aa, Homo Sapiens
EMVKAVQLR

SEQ ID NO: 1132723 - protein, 9 aa, Homo Sapiens
TLNLLFWLM

SEQ ID NO: 1132724 - protein, 9 aa, Homo Sapiens
TVSTGPPHP

SEQ ID NO: 1132725 - protein, 9 aa, Homo Sapiens
DKYPAAHLR

SEQ ID NO: 1132726 - protein, 9 aa, Homo Sapiens
HGQDLGMAG

SEQ ID NO: 1132727 - protein, 9 aa, Homo Sapiens
TATVECMYG

SEQ ID NO: 1132728 - protein, 9 aa, Homo Sapiens
QMASKPRQI

SEQ ID NO: 1132729 - protein, 9 aa, Homo Sapiens
TVIPSKPIQ

SEQ ID NO: 1132730 - protein, 9 aa, Homo Sapiens
GRCIAFNGS

SEQ ID NO: 1132731 - protein, 9 aa, Homo Sapiens
ASVSFTYSL

SEQ ID NO: 1132732 - protein, 9 aa, Homo Sapiens
SSVKKPFGP

SEQ ID NO: 1132733 - protein, 9 aa, Homo Sapiens
YKVACNMMK

SEQ ID NO: 1132734 - protein, 9 aa, Homo Sapiens
LSPHLNQIM

SEQ ID NO: 1132735 - protein, 9 aa, Homo Sapiens
LFSIMNSWL

SEQ ID NO: 1132736 - protein, 9 aa, Homo Sapiens
FLNSTNSWW

SEQ ID NO: 1132737 - protein, 9 aa, Homo Sapiens
RKSQLGSLK

SEQ ID NO: 1132738 - protein, 9 aa, Homo Sapiens
LGKRLKTGQ

SEQ ID NO: 1132739 - protein, 9 aa, Homo Sapiens
KEEAIIVED

SEQ ID NO: 1132740 - protein, 9 aa, Homo Sapiens
LHGDSGVGL

SEQ ID NO: 1132741 - protein, 9 aa, Homo Sapiens
SALPSQGAV

SEQ ID NO: 1132742 - protein, 9 aa, Homo Sapiens
GLGEVAQGG

SEQ ID NO: 1132743 - protein, 9 aa, Homo Sapiens
TIEFYTKGM

SEQ ID NO: 1132744 - protein, 9 aa, Homo Sapiens
AKILEAKQN

SEQ ID NO: 1132745 - protein, 9 aa, Homo Sapiens
MQQIQKGSH

SEQ ID NO: 1132746 - protein, 9 aa, Homo Sapiens
GNSFLTVND

SEQ ID NO: 1132747 - protein, 9 aa, Homo Sapiens
RKIGDWKVM

SEQ ID NO: 1132748 - protein, 9 aa, Homo Sapiens
ALVGGEITD

SEQ ID NO: 1132749 - protein, 9 aa, Homo Sapiens
LVLSSSTQH

SEQ ID NO: 1132750 - protein, 9 aa, Homo Sapiens
HSAEQDTDD

SEQ ID NO: 1132751 - protein, 9 aa, Homo Sapiens
PRRPPGPSP

SEQ ID NO: 1132752 - protein, 9 aa, Homo Sapiens
GGDSEGGRA

SEQ ID NO: 1132753 - protein, 9 aa, Homo Sapiens
ATMKMAAMI

SEQ ID NO: 1132754 - protein, 9 aa, Homo Sapiens
DDLLPWKIR

SEQ ID NO: 1132755 - protein, 9 aa, Homo Sapiens
IHVIQQGAF

SEQ ID NO: 1132756 - protein, 9 aa, Homo Sapiens
YVVPCMIHL

SEQ ID NO: 1132757 - protein, 9 aa, Homo Sapiens
SFDPSRHRD

SEQ ID NO: 1132758 - protein, 9 aa, Homo Sapiens
EESLPGAMN

SEQ ID NO: 1132759 - protein, 9 aa, Homo Sapiens
RWSRSRTKS

SEQ ID NO: 1132760 - protein, 9 aa, Homo Sapiens
AQLHSSLIS

SEQ ID NO: 1132761 - protein, 9 aa, Homo Sapiens
PSMEIMKRN

SEQ ID NO: 1132762 - protein, 9 aa, Homo Sapiens
GKVRTARAL

SEQ ID NO: 1132763 - protein, 9 aa, Homo Sapiens
VQWRRVLSL

SEQ ID NO: 1132764 - protein, 9 aa, Homo Sapiens
VPRTDAHTV

SEQ ID NO: 1132765 - protein, 9 aa, Homo Sapiens
RQPAGLCPV

SEQ ID NO: 1132766 - protein, 9 aa, Homo Sapiens
VSLQDLVHV

SEQ ID NO: 1132767 - protein, 9 aa, Homo Sapiens
PEPAGVTPI

SEQ ID NO: 1132768 - protein, 9 aa, Homo Sapiens
GSPTPTPLS

SEQ ID NO: 1132769 - protein, 9 aa, Homo Sapiens
DGGRTGRFA

SEQ ID NO: 1132770 - protein, 9 aa, Homo Sapiens
QTKPSGLET

SEQ ID NO: 1132771 - protein, 9 aa, Homo Sapiens
DPVLCTLQP

SEQ ID NO: 1132772 - protein, 9 aa, Homo Sapiens
GFSASGLVI

SEQ ID NO: 1132773 - protein, 9 aa, Homo Sapiens
PEQRVTLSG

SEQ ID NO: 1132774 - protein, 9 aa, Homo Sapiens
ILGLRIPRW

SEQ ID NO: 1132775 - protein, 9 aa, Homo Sapiens
GRRSQHRPA

SEQ ID NO: 1132776 - protein, 9 aa, Homo Sapiens
SPPKKFSIL

SEQ ID NO: 1132777 - protein, 9 aa, Homo Sapiens
QPERVWVHE

SEQ ID NO: 1132778 - protein, 9 aa, Homo Sapiens
TRKLYEKRL

SEQ ID NO: 1132779 - protein, 9 aa, Homo Sapiens
SLLTQPSPA

SEQ ID NO: 1132780 - protein, 9 aa, Homo Sapiens
QSALQGPSG

SEQ ID NO: 1132781 - protein, 9 aa, Homo Sapiens
PEEPPTAPR

SEQ ID NO: 1132782 - protein, 9 aa, Homo Sapiens
GPAHPTRGL

SEQ ID NO: 1132783 - protein, 9 aa, Homo Sapiens
PLHSHVEAR

SEQ ID NO: 1132784 - protein, 9 aa, Homo Sapiens
QCGEAFRSA

SEQ ID NO: 1132785 - protein, 9 aa, Homo Sapiens
EASDYLHIG

SEQ ID NO: 1132786 - protein, 9 aa, Homo Sapiens
SINPVREVK

SEQ ID NO: 1132787 - protein, 9 aa, Homo Sapiens
GPAHPTRGP

SEQ ID NO: 1132788 - protein, 9 aa, Homo Sapiens
WNDWIVAPR

SEQ ID NO: 1132789 - protein, 9 aa, Homo Sapiens
GRGGTTCPP

SEQ ID NO: 1132790 - protein, 9 aa, Homo Sapiens
LQQSFLAAA

SEQ ID NO: 1132791 - protein, 9 aa, Homo Sapiens
TPFTATENA

SEQ ID NO: 1132792 - protein, 9 aa, Homo Sapiens
ASPLPCAWQ

SEQ ID NO: 1132793 - protein, 9 aa, Homo Sapiens
QAKLQRELD

SEQ ID NO: 1132794 - protein, 9 aa, Homo Sapiens
ERGFQTSLL

SEQ ID NO: 1132795 - protein, 9 aa, Homo Sapiens
PDRDRESIM

SEQ ID NO: 1132796 - protein, 9 aa, Homo Sapiens
QRGNVCGDS

SEQ ID NO: 1132797 - protein, 9 aa, Homo Sapiens
DTKRTTPIE

SEQ ID NO: 1132798 - protein, 9 aa, Homo Sapiens
QVKSKSPSS

SEQ ID NO: 1132799 - protein, 9 aa, Homo Sapiens
PRRPRPRQP

SEQ ID NO: 1132800 - protein, 9 aa, Homo Sapiens
HFLWTCLIT

SEQ ID NO: 1132801 - protein, 9 aa, Homo Sapiens
QPRSPLRSE

SEQ ID NO: 1132802 - protein, 9 aa, Homo Sapiens
AGPRHRFLC

SEQ ID NO: 1132803 - protein, 9 aa, Homo Sapiens
DAGYCRCVL

SEQ ID NO: 1132804 - protein, 9 aa, Homo Sapiens
PYECKQCGE

SEQ ID NO: 1132805 - protein, 9 aa, Homo Sapiens
IRKADVDQD

SEQ ID NO: 1132806 - protein, 9 aa, Homo Sapiens
NMCQDVCEG

SEQ ID NO: 1132807 - protein, 9 aa, Homo Sapiens
GADGQERVP

SEQ ID NO: 1132808 - protein, 9 aa, Homo Sapiens
HCSGSQRTS

SEQ ID NO: 1132809 - protein, 9 aa, Homo Sapiens
RAGLMTAAA

SEQ ID NO: 1132810 - protein, 9 aa, Homo Sapiens
GGGVAYNLG

SEQ ID NO: 1132811 - protein, 9 aa, Homo Sapiens
ERAAVQLMA

SEQ ID NO: 1132812 - protein, 9 aa, Homo Sapiens
TGELGTIDS

SEQ ID NO: 1132813 - protein, 9 aa, Homo Sapiens
FDEDLTRPS

SEQ ID NO: 1132814 - protein, 9 aa, Homo Sapiens
ARDLYATVI

SEQ ID NO: 1132815 - protein, 9 aa, Homo Sapiens
APSPPPPPA

SEQ ID NO: 1132816 - protein, 9 aa, Homo Sapiens
AATRAGLGE

SEQ ID NO: 1132817 - protein, 9 aa, Homo Sapiens
DDFPVFLRR

SEQ ID NO: 1132818 - protein, 9 aa, Homo Sapiens
VLGASRRTA

SEQ ID NO: 1132819 - protein, 9 aa, Homo Sapiens
VLEHLRPSW

SEQ ID NO: 1132820 - protein, 9 aa, Homo Sapiens
KMIFGDLMH

SEQ ID NO: 1132821 - protein, 9 aa, Homo Sapiens
RFHHGEKPY

SEQ ID NO: 1132822 - protein, 9 aa, Homo Sapiens
TNKNITWGQ

SEQ ID NO: 1132823 - protein, 9 aa, Homo Sapiens
YKPLHELIM

SEQ ID NO: 1132824 - protein, 9 aa, Homo Sapiens
NVYIDPLKR

SEQ ID NO: 1132825 - protein, 9 aa, Homo Sapiens
CPHEGPGGG

SEQ ID NO: 1132826 - protein, 9 aa, Homo Sapiens
GFGSRTFMG

SEQ ID NO: 1132827 - protein, 9 aa, Homo Sapiens
PATPSPALP

SEQ ID NO: 1132828 - protein, 9 aa, Homo Sapiens
AAPRRRAPG

SEQ ID NO: 1132829 - protein, 9 aa, Homo Sapiens
MNYRVGTFG

SEQ ID NO: 1132830 - protein, 9 aa, Homo Sapiens
VSSEKLHFS

SEQ ID NO: 1132831 - protein, 9 aa, Homo Sapiens
LPVAVSRGL

SEQ ID NO: 1132832 - protein, 9 aa, Homo Sapiens
LSTCVDPYL

SEQ ID NO: 1132833 - protein, 9 aa, Homo Sapiens
TISVSLVVA

SEQ ID NO: 1132834 - protein, 9 aa, Homo Sapiens
NYIRCINPN

SEQ ID NO: 1132835 - protein, 9 aa, Homo Sapiens
QSRSSYMDT

SEQ ID NO: 1132836 - protein, 9 aa, Homo Sapiens
DGKANTKKR

SEQ ID NO: 1132837 - protein, 9 aa, Homo Sapiens
LSVRLKRCR

SEQ ID NO: 1132838 - protein, 9 aa, Homo Sapiens
SNIAGTVVK

SEQ ID NO: 1132839 - protein, 9 aa, Homo Sapiens
SNGCWGWQQ

SEQ ID NO: 1132840 - protein, 9 aa, Homo Sapiens
SLSNLTPGA

SEQ ID NO: 1132841 - protein, 9 aa, Homo Sapiens
PPITDLFLL

SEQ ID NO: 1132842 - protein, 9 aa, Homo Sapiens
YPKKPPQPR

SEQ ID NO: 1132843 - protein, 9 aa, Homo Sapiens
DGIDPTELE

SEQ ID NO: 1132844 - protein, 9 aa, Homo Sapiens
APQWAMGIP

SEQ ID NO: 1132845 - protein, 9 aa, Homo Sapiens
TYNHFHQSV

SEQ ID NO: 1132846 - protein, 9 aa, Homo Sapiens
GGGSGNMSA

SEQ ID NO: 1132847 - protein, 9 aa, Homo Sapiens
LKPRRYHGC

SEQ ID NO: 1132848 - protein, 9 aa, Homo Sapiens
IACLCVILV

SEQ ID NO: 1132849 - protein, 9 aa, Homo Sapiens
LPPLPAPQG

SEQ ID NO: 1132850 - protein, 9 aa, Homo Sapiens
KKRSAFPSR

SEQ ID NO: 1132851 - protein, 9 aa, Homo Sapiens
SKSPSSAGP

SEQ ID NO: 1132852 - protein, 9 aa, Homo Sapiens
ARPPLRPHH

SEQ ID NO: 1132853 - protein, 9 aa, Homo Sapiens
RGASSSPHI

SEQ ID NO: 1132854 - protein, 9 aa, Homo Sapiens
KFEEEDLDG

SEQ ID NO: 1132855 - protein, 9 aa, Homo Sapiens
GKESRGSMS

SEQ ID NO: 1132856 - protein, 9 aa, Homo Sapiens
GYHYGVSAS

SEQ ID NO: 1132857 - protein, 9 aa, Homo Sapiens
LFEHMQRAR

SEQ ID NO: 1132858 - protein, 9 aa, Homo Sapiens
WERFVHNEN

SEQ ID NO: 1132859 - protein, 9 aa, Homo Sapiens
RGSTWMRRR

SEQ ID NO: 1132860 - protein, 9 aa, Homo Sapiens
WEEMWLSKG

SEQ ID NO: 1132861 - protein, 9 aa, Homo Sapiens
INDQASFAV

SEQ ID NO: 1132862 - protein, 9 aa, Homo Sapiens
PPSFSAPCC

SEQ ID NO: 1132863 - protein, 9 aa, Homo Sapiens
CSNLIAHNR

SEQ ID NO: 1132864 - protein, 9 aa, Homo Sapiens
RRPPKGAGR

SEQ ID NO: 1132865 - protein, 9 aa, Homo Sapiens
LQNKAGGPL

SEQ ID NO: 1132866 - protein, 9 aa, Homo Sapiens
PPGFRIVLD

SEQ ID NO: 1132867 - protein, 9 aa, Homo Sapiens
RLNIAMEQV

SEQ ID NO: 1132868 - protein, 9 aa, Homo Sapiens
VEAMVACRQ

SEQ ID NO: 1132869 - protein, 9 aa, Homo Sapiens
AYCYYLLPG

SEQ ID NO: 1132870 - protein, 9 aa, Homo Sapiens
PVIVPMHAA

SEQ ID NO: 1132871 - protein, 9 aa, Homo Sapiens
FGFLLMTMS

SEQ ID NO: 1132872 - protein, 9 aa, Homo Sapiens
TCGPTGPRC

SEQ ID NO: 1132873 - protein, 9 aa, Homo Sapiens
WPRVNGCQD

SEQ ID NO: 1132874 - protein, 9 aa, Homo Sapiens
NIKQCESCS

SEQ ID NO: 1132875 - protein, 9 aa, Homo Sapiens
EEKMEYCFE

SEQ ID NO: 1132876 - protein, 9 aa, Homo Sapiens
KSVMCKMNP

SEQ ID NO: 1132877 - protein, 9 aa, Homo Sapiens
SQVVVIRRE

SEQ ID NO: 1132878 - protein, 9 aa, Homo Sapiens
SGRSSAKKG

SEQ ID NO: 1132879 - protein, 9 aa, Homo Sapiens
LWLMSPNRG

SEQ ID NO: 1132880 - protein, 9 aa, Homo Sapiens
ISSEVYRQL

SEQ ID NO: 1132881 - protein, 9 aa, Homo Sapiens
ELQRLQNSA

SEQ ID NO: 1132882 - protein, 9 aa, Homo Sapiens
VRSNIQVTV

SEQ ID NO: 1132883 - protein, 9 aa, Homo Sapiens
GGTPLSISR

SEQ ID NO: 1132884 - protein, 9 aa, Homo Sapiens
DHTAELWGI

SEQ ID NO: 1132885 - protein, 9 aa, Homo Sapiens
GEAQENGIY

SEQ ID NO: 1132886 - protein, 9 aa, Homo Sapiens
SSDYIRHQR

SEQ ID NO: 1132887 - protein, 9 aa, Homo Sapiens
FICHSCQQP

SEQ ID NO: 1132888 - protein, 9 aa, Homo Sapiens
LRGQSGTGE

SEQ ID NO: 1132889 - protein, 9 aa, Homo Sapiens
DAVLGCRKN

SEQ ID NO: 1132890 - protein, 9 aa, Homo Sapiens
NECKRRLEN

SEQ ID NO: 1132891 - protein, 9 aa, Homo Sapiens
AYFLERNAC

SEQ ID NO: 1132892 - protein, 9 aa, Homo Sapiens
VDAHMLDHL

SEQ ID NO: 1132893 - protein, 9 aa, Homo Sapiens
VIVLFCEMV

SEQ ID NO: 1132894 - protein, 9 aa, Homo Sapiens
LPPQQSGGA

SEQ ID NO: 1132895 - protein, 9 aa, Homo Sapiens
PGPRRPKQL

SEQ ID NO: 1132896 - protein, 9 aa, Homo Sapiens
FGLLILFLA

SEQ ID NO: 1132897 - protein, 9 aa, Homo Sapiens
ELFDLDEMF

SEQ ID NO: 1132898 - protein, 9 aa, Homo Sapiens
LKFFLNGNR

SEQ ID NO: 1132899 - protein, 9 aa, Homo Sapiens
ADGIINPST

SEQ ID NO: 1132900 - protein, 9 aa, Homo Sapiens
VRSKAKAES

SEQ ID NO: 1132901 - protein, 9 aa, Homo Sapiens
HYGWSFAFA

SEQ ID NO: 1132902 - protein, 9 aa, Homo Sapiens
NGLLLIKHV

SEQ ID NO: 1132903 - protein, 9 aa, Homo Sapiens
VESLDSPPQ

SEQ ID NO: 1132904 - protein, 9 aa, Homo Sapiens
VGPTRLYPG

SEQ ID NO: 1132905 - protein, 9 aa, Homo Sapiens
RDSRLSWLT

SEQ ID NO: 1132906 - protein, 9 aa, Homo Sapiens
GLTNISNME

SEQ ID NO: 1132907 - protein, 9 aa, Homo Sapiens
SSNYPCLAP

SEQ ID NO: 1132908 - protein, 9 aa, Homo Sapiens
PRPSLRPWA

SEQ ID NO: 1132909 - protein, 9 aa, Homo Sapiens
ALCDCLPGF

SEQ ID NO: 1132910 - protein, 9 aa, Homo Sapiens
REDLMKMVW

SEQ ID NO: 1132911 - protein, 9 aa, Homo Sapiens
AKQGQWGPP

SEQ ID NO: 1132912 - protein, 9 aa, Homo Sapiens
NDCFFYHEK

SEQ ID NO: 1132913 - protein, 9 aa, Homo Sapiens
MYRGLWLMS

SEQ ID NO: 1132914 - protein, 9 aa, Homo Sapiens
MRKEGHEVV

SEQ ID NO: 1132915 - protein, 9 aa, Homo Sapiens
CWSVGRPHL

SEQ ID NO: 1132916 - protein, 9 aa, Homo Sapiens
YTTQGMKHS

SEQ ID NO: 1132917 - protein, 9 aa, Homo Sapiens
LRKFSSSQV

SEQ ID NO: 1132918 - protein, 9 aa, Homo Sapiens
MYYYIQQDT

SEQ ID NO: 1132919 - protein, 9 aa, Homo Sapiens
SSQTRTSAP

SEQ ID NO: 1132920 - protein, 9 aa, Homo Sapiens
RDSWPTRRS

SEQ ID NO: 1132921 - protein, 9 aa, Homo Sapiens
KLPGPRRPK

SEQ ID NO: 1132922 - protein, 9 aa, Homo Sapiens
NMDGATLFQ

SEQ ID NO: 1132923 - protein, 9 aa, Homo Sapiens
GAYDGKKLK

SEQ ID NO: 1132924 - protein, 9 aa, Homo Sapiens
SVWGNLAGR

SEQ ID NO: 1132925 - protein, 9 aa, Homo Sapiens
QAWPWRTRP

SEQ ID NO: 1132926 - protein, 9 aa, Homo Sapiens
QLHHSFVSS

SEQ ID NO: 1132927 - protein, 9 aa, Homo Sapiens
SVRNVFKKE

SEQ ID NO: 1132928 - protein, 9 aa, Homo Sapiens
SPTPNTWTS

SEQ ID NO: 1132929 - protein, 9 aa, Homo Sapiens
ALLWWFWSL

SEQ ID NO: 1132930 - protein, 9 aa, Homo Sapiens
LEHRKMRKS

SEQ ID NO: 1132931 - protein, 9 aa, Homo Sapiens
TFKKCVSKN

SEQ ID NO: 1132932 - protein, 9 aa, Homo Sapiens
QDLGMAGSC

SEQ ID NO: 1132933 - protein, 9 aa, Homo Sapiens
GWGTSASTA

SEQ ID NO: 1132934 - protein, 9 aa, Homo Sapiens
KLKYLELGF

SEQ ID NO: 1132935 - protein, 9 aa, Homo Sapiens
CFSDPGVVD

SEQ ID NO: 1132936 - protein, 9 aa, Homo Sapiens
ATAACPMTA

SEQ ID NO: 1132937 - protein, 9 aa, Homo Sapiens
PYTFSLAPG

SEQ ID NO: 1132938 - protein, 9 aa, Homo Sapiens
GPKEEVVCL

SEQ ID NO: 1132939 - protein, 9 aa, Homo Sapiens
HTNRNHNSS

SEQ ID NO: 1132940 - protein, 9 aa, Homo Sapiens
RNIRAEGLK

SEQ ID NO: 1132941 - protein, 9 aa, Homo Sapiens
SQGAPTQRT

SEQ ID NO: 1132942 - protein, 9 aa, Homo Sapiens
ICKKDAPHS

SEQ ID NO: 1132943 - protein, 9 aa, Homo Sapiens
TDDVNFPIN

SEQ ID NO: 1132944 - protein, 9 aa, Homo Sapiens
VMSANAAVA

SEQ ID NO: 1132945 - protein, 9 aa, Homo Sapiens
HTLLSALAV

SEQ ID NO: 1132946 - protein, 9 aa, Homo Sapiens
YLPVTVANT

SEQ ID NO: 1132947 - protein, 9 aa, Homo Sapiens
TRFPIIASC

SEQ ID NO: 1132948 - protein, 9 aa, Homo Sapiens
LVDHAGRQP

SEQ ID NO: 1132949 - protein, 9 aa, Homo Sapiens
RPHHDLGPL

SEQ ID NO: 1132950 - protein, 9 aa, Homo Sapiens
LVPVAELVP

SEQ ID NO: 1132951 - protein, 9 aa, Homo Sapiens
ATDELQRLQ

SEQ ID NO: 1132952 - protein, 9 aa, Homo Sapiens
QRLQNSAMT

SEQ ID NO: 1132953 - protein, 9 aa, Homo Sapiens
KWMASSWKG

SEQ ID NO: 1132954 - protein, 9 aa, Homo Sapiens
PTAAGPAAP

SEQ ID NO: 1132955 - protein, 9 aa, Homo Sapiens
NEDGDIKHI

SEQ ID NO: 1132956 - protein, 9 aa, Homo Sapiens
RAGDPWTGA

SEQ ID NO: 1132957 - protein, 9 aa, Homo Sapiens
TAAKPSARS

SEQ ID NO: 1132958 - protein, 9 aa, Homo Sapiens
NEGGKRSRC

SEQ ID NO: 1132959 - protein, 9 aa, Homo Sapiens
HVPRRKRCN

SEQ ID NO: 1132960 - protein, 9 aa, Homo Sapiens
AETLALVGG

SEQ ID NO: 1132961 - protein, 9 aa, Homo Sapiens
YNISWHSDY

SEQ ID NO: 1132962 - protein, 9 aa, Homo Sapiens
GCRKNKSTK

SEQ ID NO: 1132963 - protein, 9 aa, Homo Sapiens
PRAGPRCHR

SEQ ID NO: 1132964 - protein, 9 aa, Homo Sapiens
SSEQYFHYH

SEQ ID NO: 1132965 - protein, 9 aa, Homo Sapiens
DPGAAAGVQ

SEQ ID NO: 1132966 - protein, 9 aa, Homo Sapiens
PRCHRRRRR

SEQ ID NO: 1132967 - protein, 9 aa, Homo Sapiens
TGGTAPMWT

SEQ ID NO: 1132968 - protein, 9 aa, Homo Sapiens
GIIATNVEK

SEQ ID NO: 1132969 - protein, 9 aa, Homo Sapiens
NLTYMMTRR

SEQ ID NO: 1132970 - protein, 9 aa, Homo Sapiens
SESIGRSGA

SEQ ID NO: 1132971 - protein, 9 aa, Homo Sapiens
LCPTRKEEE

SEQ ID NO: 1132972 - protein, 9 aa, Homo Sapiens
HLESASYSS

SEQ ID NO: 1132973 - protein, 9 aa, Homo Sapiens
IGNMHGNET

SEQ ID NO: 1132974 - protein, 9 aa, Homo Sapiens
CYCPVKNVF

SEQ ID NO: 1132975 - protein, 9 aa, Homo Sapiens
KTKKKRKFA

SEQ ID NO: 1132976 - protein, 9 aa, Homo Sapiens
ERDRDRDQE

SEQ ID NO: 1132977 - protein, 9 aa, Homo Sapiens
IGDLKDQKQ

SEQ ID NO: 1132978 - protein, 9 aa, Homo Sapiens
NGSAMQSLY

SEQ ID NO: 1132979 - protein, 9 aa, Homo Sapiens
RRRRTDSMS

SEQ ID NO: 1132980 - protein, 9 aa, Homo Sapiens
SWPWTRCLR

SEQ ID NO: 1132981 - protein, 9 aa, Homo Sapiens
TGCPFRPRV

SEQ ID NO: 1132982 - protein, 9 aa, Homo Sapiens
TLCPRDSRL

SEQ ID NO: 1132983 - protein, 9 aa, Homo Sapiens
TSYALFIRE

SEQ ID NO: 1132984 - protein, 9 aa, Homo Sapiens
IGQKTFYSF

SEQ ID NO: 1132985 - protein, 9 aa, Homo Sapiens
PGFVNVSQR

SEQ ID NO: 1132986 - protein, 9 aa, Homo Sapiens
RDRGYNQVT

SEQ ID NO: 1132987 - protein, 9 aa, Homo Sapiens
RLNMLPLVK

SEQ ID NO: 1132988 - protein, 9 aa, Homo Sapiens
VAKNQNAAP

SEQ ID NO: 1132989 - protein, 9 aa, Homo Sapiens
GMIVQSIIH

SEQ ID NO: 1132990 - protein, 9 aa, Homo Sapiens
PAFLKTWAP

SEQ ID NO: 1132991 - protein, 9 aa, Homo Sapiens
CGAPRVNLG

SEQ ID NO: 1132992 - protein, 9 aa, Homo Sapiens
HITKLKPRG

SEQ ID NO: 1132993 - protein, 9 aa, Homo Sapiens
CGDWKNHFM

SEQ ID NO: 1132994 - protein, 9 aa, Homo Sapiens
REPSRVLKS

SEQ ID NO: 1132995 - protein, 9 aa, Homo Sapiens
CSAPVLLGC

SEQ ID NO: 1132996 - protein, 9 aa, Homo Sapiens
RFINIKKGQ

SEQ ID NO: 1132997 - protein, 9 aa, Homo Sapiens
LHTSERPYK

SEQ ID NO: 1132998 - protein, 9 aa, Homo Sapiens
NCVFRDAAQ

SEQ ID NO: 1132999 - protein, 9 aa, Homo Sapiens
SWYGSVEAL

SEQ ID NO: 1133000 - protein, 9 aa, Homo Sapiens
GLEILFSNG

SEQ ID NO: 1133001 - protein, 9 aa, Homo Sapiens
VYRRSAAAS

SEQ ID NO: 1133002 - protein, 9 aa, Homo Sapiens
PGLTKCVKK

SEQ ID NO: 1133003 - protein, 9 aa, Homo Sapiens
SDYLHIGHA

SEQ ID NO: 1133004 - protein, 9 aa, Homo Sapiens
GAQEAVQEV

SEQ ID NO: 1133005 - protein, 9 aa, Homo Sapiens
RETRASIIK

SEQ ID NO: 1133006 - protein, 9 aa, Homo Sapiens
VKTMVCCLK

SEQ ID NO: 1133007 - protein, 9 aa, Homo Sapiens
STQLCKKQN

SEQ ID NO: 1133008 - protein, 9 aa, Homo Sapiens
NSKKIYDSQ

SEQ ID NO: 1133009 - protein, 9 aa, Homo Sapiens
PKELVQGPI

SEQ ID NO: 1133010 - protein, 9 aa, Homo Sapiens
LPDRPWGTG

SEQ ID NO: 1133011 - protein, 9 aa, Homo Sapiens
QPEMAAMRL

SEQ ID NO: 1133012 - protein, 9 aa, Homo Sapiens
PAPPQENKA

SEQ ID NO: 1133013 - protein, 9 aa, Homo Sapiens
RSWTGTLSW

SEQ ID NO: 1133014 - protein, 9 aa, Homo Sapiens
KNRTVAGTG

SEQ ID NO: 1133015 - protein, 9 aa, Homo Sapiens
LGLRIPRWL

SEQ ID NO: 1133016 - protein, 9 aa, Homo Sapiens
RVIAEAYTT

SEQ ID NO: 1133017 - protein, 9 aa, Homo Sapiens
RAFLGLDRF

SEQ ID NO: 1133018 - protein, 9 aa, Homo Sapiens
RTPMLRPLG

SEQ ID NO: 1133019 - protein, 9 aa, Homo Sapiens
PFPLDVCKL

SEQ ID NO: 1133020 - protein, 9 aa, Homo Sapiens
TWPCPQCLR

SEQ ID NO: 1133021 - protein, 9 aa, Homo Sapiens
DQDQELATV

SEQ ID NO: 1133022 - protein, 9 aa, Homo Sapiens
INRLVVDVD

SEQ ID NO: 1133023 - protein, 9 aa, Homo Sapiens
RLWFQSVLD

SEQ ID NO: 1133024 - protein, 9 aa, Homo Sapiens
AQIQRPIQV

SEQ ID NO: 1133025 - protein, 9 aa, Homo Sapiens
NPEKLALKE

SEQ ID NO: 1133026 - protein, 9 aa, Homo Sapiens
SLTHVMGKT

SEQ ID NO: 1133027 - protein, 9 aa, Homo Sapiens
STTRRDSWP

SEQ ID NO: 1133028 - protein, 9 aa, Homo Sapiens
DMQRNVAVL

SEQ ID NO: 1133029 - protein, 9 aa, Homo Sapiens
APASRAAVS

SEQ ID NO: 1133030 - protein, 9 aa, Homo Sapiens
STRAWRRSG

SEQ ID NO: 1133031 - protein, 9 aa, Homo Sapiens
LLQLPEPIL

SEQ ID NO: 1133032 - protein, 9 aa, Homo Sapiens
GRIRSGGVQ

SEQ ID NO: 1133033 - protein, 9 aa, Homo Sapiens
ERKTATVEC

SEQ ID NO: 1133034 - protein, 9 aa, Homo Sapiens
HLYGSYPPA

SEQ ID NO: 1133035 - protein, 9 aa, Homo Sapiens
MEKLPVRRD

SEQ ID NO: 1133036 - protein, 9 aa, Homo Sapiens
EEICLLTAF

SEQ ID NO: 1133037 - protein, 9 aa, Homo Sapiens
QIDKVFNSI

SEQ ID NO: 1133038 - protein, 9 aa, Homo Sapiens
MEPEIKICL

SEQ ID NO: 1133039 - protein, 9 aa, Homo Sapiens
PGRRDPQDG

SEQ ID NO: 1133040 - protein, 9 aa, Homo Sapiens
WLGEFDQGC

SEQ ID NO: 1133041 - protein, 9 aa, Homo Sapiens
TPYTFSLAP

SEQ ID NO: 1133042 - protein, 9 aa, Homo Sapiens
DVGFDKDLD

SEQ ID NO: 1133043 - protein, 9 aa, Homo Sapiens
EKEQDANKG

SEQ ID NO: 1133044 - protein, 9 aa, Homo Sapiens
LQEMELRFH

SEQ ID NO: 1133045 - protein, 9 aa, Homo Sapiens
YQRLTCSPQ

SEQ ID NO: 1133046 - protein, 9 aa, Homo Sapiens
FRVHGEPTH

SEQ ID NO: 1133047 - protein, 9 aa, Homo Sapiens
ILERIPIPV

SEQ ID NO: 1133048 - protein, 9 aa, Homo Sapiens
QPSSGTKEK

SEQ ID NO: 1133049 - protein, 9 aa, Homo Sapiens
PGDAPSHSP

SEQ ID NO: 1133050 - protein, 9 aa, Homo Sapiens
ERSLQDAQC

SEQ ID NO: 1133051 - protein, 9 aa, Homo Sapiens
KYATEKRQL

SEQ ID NO: 1133052 - protein, 9 aa, Homo Sapiens
YVFDRANMH

SEQ ID NO: 1133053 - protein, 9 aa, Homo Sapiens
GLILFSMLC

SEQ ID NO: 1133054 - protein, 9 aa, Homo Sapiens
VSRPPSLHP

SEQ ID NO: 1133055 - protein, 9 aa, Homo Sapiens
RGKMATQAC

SEQ ID NO: 1133056 - protein, 9 aa, Homo Sapiens
GRWYTNINA

SEQ ID NO: 1133057 - protein, 9 aa, Homo Sapiens
VNETLKLLL

SEQ ID NO: 1133058 - protein, 9 aa, Homo Sapiens
CSRRLSKEG

SEQ ID NO: 1133059 - protein, 9 aa, Homo Sapiens
WPGVKGPDS

SEQ ID NO: 1133060 - protein, 9 aa, Homo Sapiens
QSILDDFYT

SEQ ID NO: 1133061 - protein, 9 aa, Homo Sapiens
RQSSAPGSR

SEQ ID NO: 1133062 - protein, 9 aa, Homo Sapiens
SSWGRKSAI

SEQ ID NO: 1133063 - protein, 9 aa, Homo Sapiens
PRRRQSSAP

SEQ ID NO: 1133064 - protein, 9 aa, Homo Sapiens
RAEGLKMEK

SEQ ID NO: 1133065 - protein, 9 aa, Homo Sapiens
WWALQASWS

SEQ ID NO: 1133066 - protein, 9 aa, Homo Sapiens
PYDQREFTA

SEQ ID NO: 1133067 - protein, 9 aa, Homo Sapiens
AGHGASLQV

SEQ ID NO: 1133068 - protein, 9 aa, Homo Sapiens
GEQQLNGND

SEQ ID NO: 1133069 - protein, 9 aa, Homo Sapiens
ALEVSGLRS

SEQ ID NO: 1133070 - protein, 9 aa, Homo Sapiens
KGYNATVLT

SEQ ID NO: 1133071 - protein, 9 aa, Homo Sapiens
KARAFRCSL

SEQ ID NO: 1133072 - protein, 9 aa, Homo Sapiens
LVSTRFNQM

SEQ ID NO: 1133073 - protein, 9 aa, Homo Sapiens
ETYDCQMNV

SEQ ID NO: 1133074 - protein, 9 aa, Homo Sapiens
KKLGSPAPR

SEQ ID NO: 1133075 - protein, 9 aa, Homo Sapiens
WLPERHGLG

SEQ ID NO: 1133076 - protein, 9 aa, Homo Sapiens
LQDMWTTVI

SEQ ID NO: 1133077 - protein, 9 aa, Homo Sapiens
VENTAEEKK

SEQ ID NO: 1133078 - protein, 9 aa, Homo Sapiens
VGVYEEVKR

SEQ ID NO: 1133079 - protein, 9 aa, Homo Sapiens
RQPLLGAGL

SEQ ID NO: 1133080 - protein, 9 aa, Homo Sapiens
GGDEPAGWK

SEQ ID NO: 1133081 - protein, 9 aa, Homo Sapiens
FPGARSHQG

SEQ ID NO: 1133082 - protein, 9 aa, Homo Sapiens
AESHLLNRA

SEQ ID NO: 1133083 - protein, 9 aa, Homo Sapiens
EIQEVLLEV

SEQ ID NO: 1133084 - protein, 9 aa, Homo Sapiens
AANARERAH

SEQ ID NO: 1133085 - protein, 9 aa, Homo Sapiens
NQHRSHECR

SEQ ID NO: 1133086 - protein, 9 aa, Homo Sapiens
TSLGLSPDV

SEQ ID NO: 1133087 - protein, 9 aa, Homo Sapiens
QWYSVLEKG

SEQ ID NO: 1133088 - protein, 9 aa, Homo Sapiens
LELRLLSLY

SEQ ID NO: 1133089 - protein, 9 aa, Homo Sapiens
GGAAVARAV

SEQ ID NO: 1133090 - protein, 9 aa, Homo Sapiens
PYEKVVVRI

SEQ ID NO: 1133091 - protein, 9 aa, Homo Sapiens
HERGVSIHR

SEQ ID NO: 1133092 - protein, 9 aa, Homo Sapiens
PPPAAAGCS

SEQ ID NO: 1133093 - protein, 9 aa, Homo Sapiens
IQEEALATS

SEQ ID NO: 1133094 - protein, 9 aa, Homo Sapiens
KMRKSLETP

SEQ ID NO: 1133095 - protein, 9 aa, Homo Sapiens
LWRWKPATP

SEQ ID NO: 1133096 - protein, 9 aa, Homo Sapiens
ALETKATTK

SEQ ID NO: 1133097 - protein, 9 aa, Homo Sapiens
SFLSFFVVA

SEQ ID NO: 1133098 - protein, 9 aa, Homo Sapiens
MSCSLLTQP

SEQ ID NO: 1133099 - protein, 9 aa, Homo Sapiens
SAPVLLGCW

SEQ ID NO: 1133100 - protein, 9 aa, Homo Sapiens
LGLFGVLGV

SEQ ID NO: 1133101 - protein, 9 aa, Homo Sapiens
CLEPYTVCD

SEQ ID NO: 1133102 - protein, 9 aa, Homo Sapiens
PQAPLPVAV

SEQ ID NO: 1133103 - protein, 9 aa, Homo Sapiens
AQPLTLPLP

SEQ ID NO: 1133104 - protein, 9 aa, Homo Sapiens
SMIGLSDFF

SEQ ID NO: 1133105 - protein, 9 aa, Homo Sapiens
TSSSGTSRA

SEQ ID NO: 1133106 - protein, 9 aa, Homo Sapiens
SATASTCRC

SEQ ID NO: 1133107 - protein, 9 aa, Homo Sapiens
RTHTGKKKF

SEQ ID NO: 1133108 - protein, 9 aa, Homo Sapiens
QTPTLVPDP

SEQ ID NO: 1133109 - protein, 9 aa, Homo Sapiens
YVASDDEFI

SEQ ID NO: 1133110 - protein, 9 aa, Homo Sapiens
TVALLQAGP

SEQ ID NO: 1133111 - protein, 9 aa, Homo Sapiens
IPRPNVCHL

SEQ ID NO: 1133112 - protein, 9 aa, Homo Sapiens
SNPSKPGHK

SEQ ID NO: 1133113 - protein, 9 aa, Homo Sapiens
ELLTVAVET

SEQ ID NO: 1133114 - protein, 9 aa, Homo Sapiens
NSSQLITCH

SEQ ID NO: 1133115 - protein, 9 aa, Homo Sapiens
LAHLVVGRV

SEQ ID NO: 1133116 - protein, 9 aa, Homo Sapiens
ETQHEKTLR

SEQ ID NO: 1133117 - protein, 9 aa, Homo Sapiens
IEKQVLQLE

SEQ ID NO: 1133118 - protein, 9 aa, Homo Sapiens
LLSKNPKNH

SEQ ID NO: 1133119 - protein, 9 aa, Homo Sapiens
QTYVMRYFE

SEQ ID NO: 1133120 - protein, 9 aa, Homo Sapiens
REPVVVVAA

SEQ ID NO: 1133121 - protein, 9 aa, Homo Sapiens
ECLGRPRPC

SEQ ID NO: 1133122 - protein, 9 aa, Homo Sapiens
DPAKIGRGT

SEQ ID NO: 1133123 - protein, 9 aa, Homo Sapiens
RILNLQVLK

SEQ ID NO: 1133124 - protein, 9 aa, Homo Sapiens
ISSYVHVQP

SEQ ID NO: 1133125 - protein, 9 aa, Homo Sapiens
QGQKDALEC

SEQ ID NO: 1133126 - protein, 9 aa, Homo Sapiens
PVPPPPPIP

SEQ ID NO: 1133127 - protein, 9 aa, Homo Sapiens
QNVIHHKVL

SEQ ID NO: 1133128 - protein, 9 aa, Homo Sapiens
RGKSDPYTK

SEQ ID NO: 1133129 - protein, 9 aa, Homo Sapiens
TTTMGETSC

SEQ ID NO: 1133130 - protein, 9 aa, Homo Sapiens
PPGTQEVDA

SEQ ID NO: 1133131 - protein, 9 aa, Homo Sapiens
PRRIVRSSP

SEQ ID NO: 1133132 - protein, 9 aa, Homo Sapiens
GRNFWQRIT

SEQ ID NO: 1133133 - protein, 9 aa, Homo Sapiens
AYDGKKLKC

SEQ ID NO: 1133134 - protein, 9 aa, Homo Sapiens
QPQAQAEQR

SEQ ID NO: 1133135 - protein, 9 aa, Homo Sapiens
FEQKWTMFI

SEQ ID NO: 1133136 - protein, 9 aa, Homo Sapiens
SIGQLETVC

SEQ ID NO: 1133137 - protein, 9 aa, Homo Sapiens
IPQLNPPTD

SEQ ID NO: 1133138 - protein, 9 aa, Homo Sapiens
LRSFKFPLQ

SEQ ID NO: 1133139 - protein, 9 aa, Homo Sapiens
TDDLDVGDC

SEQ ID NO: 1133140 - protein, 9 aa, Homo Sapiens
ATKKLSINN

SEQ ID NO: 1133141 - protein, 9 aa, Homo Sapiens
LLEDLSKNC

SEQ ID NO: 1133142 - protein, 9 aa, Homo Sapiens
HCPHWASSP

SEQ ID NO: 1133143 - protein, 9 aa, Homo Sapiens
DLETMDIWL

SEQ ID NO: 1133144 - protein, 9 aa, Homo Sapiens
PCFYTPATP

SEQ ID NO: 1133145 - protein, 9 aa, Homo Sapiens
CCLPGAELL

SEQ ID NO: 1133146 - protein, 9 aa, Homo Sapiens
QWRRVLSLS

SEQ ID NO: 1133147 - protein, 9 aa, Homo Sapiens
TRRCTAVSV

SEQ ID NO: 1133148 - protein, 9 aa, Homo Sapiens
SIFQDFSLS

SEQ ID NO: 1133149 - protein, 9 aa, Homo Sapiens
DHRAISIPD

SEQ ID NO: 1133150 - protein, 9 aa, Homo Sapiens
LTSFPEVVA

SEQ ID NO: 1133151 - protein, 9 aa, Homo Sapiens
KHGAQKMSN

SEQ ID NO: 1133152 - protein, 9 aa, Homo Sapiens
AWLTALAVE

SEQ ID NO: 1133153 - protein, 9 aa, Homo Sapiens
RVLSLSQAS

SEQ ID NO: 1133154 - protein, 9 aa, Homo Sapiens
KVEIIRHIS

SEQ ID NO: 1133155 - protein, 9 aa, Homo Sapiens
QDAPAACLD

SEQ ID NO: 1133156 - protein, 9 aa, Homo Sapiens
YGKSMYYYI

SEQ ID NO: 1133157 - protein, 9 aa, Homo Sapiens
GEVAQGGSA

SEQ ID NO: 1133158 - protein, 9 aa, Homo Sapiens
GLQGPVGPL

SEQ ID NO: 1133159 - protein, 9 aa, Homo Sapiens
DEVTRNYAW

SEQ ID NO: 1133160 - protein, 9 aa, Homo Sapiens
ACVNPPGLL

SEQ ID NO: 1133161 - protein, 9 aa, Homo Sapiens
TLVTRGTSR

SEQ ID NO: 1133162 - protein, 9 aa, Homo Sapiens
YEELTDEYF

SEQ ID NO: 1133163 - protein, 9 aa, Homo Sapiens
KGKKIFLVA

SEQ ID NO: 1133164 - protein, 9 aa, Homo Sapiens
HSLKARGAL

SEQ ID NO: 1133165 - protein, 9 aa, Homo Sapiens
ERKYAIGDL

SEQ ID NO: 1133166 - protein, 9 aa, Homo Sapiens
HPRRRLSSG

SEQ ID NO: 1133167 - protein, 9 aa, Homo Sapiens
NQKKEQKPE

SEQ ID NO: 1133168 - protein, 9 aa, Homo Sapiens
LLDLPGKDY

SEQ ID NO: 1133169 - protein, 9 aa, Homo Sapiens
VEGLTSRAP

SEQ ID NO: 1133170 - protein, 9 aa, Homo Sapiens
RRTASSWGR

SEQ ID NO: 1133171 - protein, 9 aa, Homo Sapiens
LEGALSSQE

SEQ ID NO: 1133172 - protein, 9 aa, Homo Sapiens
TYVMRYFES

SEQ ID NO: 1133173 - protein, 9 aa, Homo Sapiens
HQRQLDRKA

SEQ ID NO: 1133174 - protein, 9 aa, Homo Sapiens
HDLNGLLSS

SEQ ID NO: 1133175 - protein, 9 aa, Homo Sapiens
YLELGFTQR

SEQ ID NO: 1133176 - protein, 9 aa, Homo Sapiens
KFTLLEDQV

SEQ ID NO: 1133177 - protein, 9 aa, Homo Sapiens
PYKGEECGK

SEQ ID NO: 1133178 - protein, 9 aa, Homo Sapiens
AWCVNCFSC

SEQ ID NO: 1133179 - protein, 9 aa, Homo Sapiens
PRGLFEVLV

SEQ ID NO: 1133180 - protein, 9 aa, Homo Sapiens
QVLAGHGAS

SEQ ID NO: 1133181 - protein, 9 aa, Homo Sapiens
GDCPKRPEQ

SEQ ID NO: 1133182 - protein, 9 aa, Homo Sapiens
VDVISLKQG

SEQ ID NO: 1133183 - protein, 9 aa, Homo Sapiens
HKISFSFAF

SEQ ID NO: 1133184 - protein, 9 aa, Homo Sapiens
ISVDGASPC

SEQ ID NO: 1133185 - protein, 9 aa, Homo Sapiens
AGSSTRPKD

SEQ ID NO: 1133186 - protein, 9 aa, Homo Sapiens
TFETKADLC

SEQ ID NO: 1133187 - protein, 9 aa, Homo Sapiens
LWEDVASLQ

SEQ ID NO: 1133188 - protein, 9 aa, Homo Sapiens
TCAACRPGP

SEQ ID NO: 1133189 - protein, 9 aa, Homo Sapiens
APWSNLKKT

SEQ ID NO: 1133190 - protein, 9 aa, Homo Sapiens
VDKALKYLE

SEQ ID NO: 1133191 - protein, 9 aa, Homo Sapiens
VVILARTQT

SEQ ID NO: 1133192 - protein, 9 aa, Homo Sapiens
LYFPRKPCS

SEQ ID NO: 1133193 - protein, 9 aa, Homo Sapiens
VGVTSCLRE

SEQ ID NO: 1133194 - protein, 9 aa, Homo Sapiens
AAASLAYSE

SEQ ID NO: 1133195 - protein, 9 aa, Homo Sapiens
NVNHKHGDS

SEQ ID NO: 1133196 - protein, 9 aa, Homo Sapiens
GKVGQCLDV

SEQ ID NO: 1133197 - protein, 9 aa, Homo Sapiens
LRYARPADT

SEQ ID NO: 1133198 - protein, 9 aa, Homo Sapiens
PPTRCVWQQ

SEQ ID NO: 1133199 - protein, 9 aa, Homo Sapiens
CTRTQQGMP

SEQ ID NO: 1133200 - protein, 9 aa, Homo Sapiens
RKIGSDQEL

SEQ ID NO: 1133201 - protein, 9 aa, Homo Sapiens
RIYYAISKS

SEQ ID NO: 1133202 - protein, 9 aa, Homo Sapiens
LQDLWENTE

SEQ ID NO: 1133203 - protein, 9 aa, Homo Sapiens
ADATKSLGP

SEQ ID NO: 1133204 - protein, 9 aa, Homo Sapiens
EATKKLKVK

SEQ ID NO: 1133205 - protein, 9 aa, Homo Sapiens
GNPVAVASS

SEQ ID NO: 1133206 - protein, 9 aa, Homo Sapiens
PVPQAEGEN

SEQ ID NO: 1133207 - protein, 9 aa, Homo Sapiens
SWSPSAWCS

SEQ ID NO: 1133208 - protein, 9 aa, Homo Sapiens
MVRGPLPPY

SEQ ID NO: 1133209 - protein, 9 aa, Homo Sapiens
QEVPQCLIV

SEQ ID NO: 1133210 - protein, 9 aa, Homo Sapiens
VYLETYDCQ

SEQ ID NO: 1133211 - protein, 9 aa, Homo Sapiens
TNQRFDHEM

SEQ ID NO: 1133212 - protein, 9 aa, Homo Sapiens
VVANLSPAN

SEQ ID NO: 1133213 - protein, 9 aa, Homo Sapiens
PTPAGSSTL

SEQ ID NO: 1133214 - protein, 9 aa, Homo Sapiens
GGHQEDQLS

SEQ ID NO: 1133215 - protein, 9 aa, Homo Sapiens
RWNAVALWA

SEQ ID NO: 1133216 - protein, 9 aa, Homo Sapiens
NGLHSVMDD

SEQ ID NO: 1133217 - protein, 9 aa, Homo Sapiens
MTIIVLLLG

SEQ ID NO: 1133218 - protein, 9 aa, Homo Sapiens
PQAPHPRPA

SEQ ID NO: 1133219 - protein, 9 aa, Homo Sapiens
ISHASTSSV

SEQ ID NO: 1133220 - protein, 9 aa, Homo Sapiens
QGPCQRPQT

SEQ ID NO: 1133221 - protein, 9 aa, Homo Sapiens
PVARLTWRR

SEQ ID NO: 1133222 - protein, 9 aa, Homo Sapiens
TRPQASTAV

SEQ ID NO: 1133223 - protein, 9 aa, Homo Sapiens
LIEKNLIWQ

SEQ ID NO: 1133224 - protein, 9 aa, Homo Sapiens
VLCSLCTTG

SEQ ID NO: 1133225 - protein, 9 aa, Homo Sapiens
LEHYDAAFA

SEQ ID NO: 1133226 - protein, 9 aa, Homo Sapiens
QHYNTLLAA

SEQ ID NO: 1133227 - protein, 9 aa, Homo Sapiens
AAVARAVIV

SEQ ID NO: 1133228 - protein, 9 aa, Homo Sapiens
LAQWSPVIA

SEQ ID NO: 1133229 - protein, 9 aa, Homo Sapiens
PDAPDATVA

SEQ ID NO: 1133230 - protein, 9 aa, Homo Sapiens
PDCFSRSRT

SEQ ID NO: 1133231 - protein, 9 aa, Homo Sapiens
SESPGPSGL

SEQ ID NO: 1133232 - protein, 9 aa, Homo Sapiens
EIWCPQSAS

SEQ ID NO: 1133233 - protein, 9 aa, Homo Sapiens
SSPLSKELW

SEQ ID NO: 1133234 - protein, 9 aa, Homo Sapiens
RLLADGKWL

SEQ ID NO: 1133235 - protein, 9 aa, Homo Sapiens
TAFPDSATT

SEQ ID NO: 1133236 - protein, 9 aa, Homo Sapiens
KYGIGFCRN

SEQ ID NO: 1133237 - protein, 9 aa, Homo Sapiens
LEKVSKKRL

SEQ ID NO: 1133238 - protein, 9 aa, Homo Sapiens
EHELHVAGA

SEQ ID NO: 1133239 - protein, 9 aa, Homo Sapiens
KVTLTRGAS

SEQ ID NO: 1133240 - protein, 9 aa, Homo Sapiens
GAGAQPHLS

SEQ ID NO: 1133241 - protein, 9 aa, Homo Sapiens
QYDIWGNTA

SEQ ID NO: 1133242 - protein, 9 aa, Homo Sapiens
WPASSHAPR

SEQ ID NO: 1133243 - protein, 9 aa, Homo Sapiens
SLAPERGSV

SEQ ID NO: 1133244 - protein, 9 aa, Homo Sapiens
EKNFNTNLL

SEQ ID NO: 1133245 - protein, 9 aa, Homo Sapiens
SALDCIFGV

SEQ ID NO: 1133246 - protein, 9 aa, Homo Sapiens
CSSPQEENL

SEQ ID NO: 1133247 - protein, 9 aa, Homo Sapiens
NDVLKILEV

SEQ ID NO: 1133248 - protein, 9 aa, Homo Sapiens
NPGAAMQGT

SEQ ID NO: 1133249 - protein, 9 aa, Homo Sapiens
NLMTVTGNV

SEQ ID NO: 1133250 - protein, 9 aa, Homo Sapiens
LMGFLSGEP

SEQ ID NO: 1133251 - protein, 9 aa, Homo Sapiens
KDLGFFGQN

SEQ ID NO: 1133252 - protein, 9 aa, Homo Sapiens
SLHLRGQGG

SEQ ID NO: 1133253 - protein, 9 aa, Homo Sapiens
SSRDPTTEV

SEQ ID NO: 1133254 - protein, 9 aa, Homo Sapiens
VIGQGLVGM

SEQ ID NO: 1133255 - protein, 9 aa, Homo Sapiens
QKYGIGFCR

SEQ ID NO: 1133256 - protein, 9 aa, Homo Sapiens
GLVGMTPRD

SEQ ID NO: 1133257 - protein, 9 aa, Homo Sapiens
PQPSLPGPC

SEQ ID NO: 1133258 - protein, 9 aa, Homo Sapiens
TTRRGTPGT

SEQ ID NO: 1133259 - protein, 9 aa, Homo Sapiens
RCPAKGADS

SEQ ID NO: 1133260 - protein, 9 aa, Homo Sapiens
RNFWQRITQ

SEQ ID NO: 1133261 - protein, 9 aa, Homo Sapiens
LLLLAVALL

SEQ ID NO: 1133262 - protein, 9 aa, Homo Sapiens
VPHPLTVLG

SEQ ID NO: 1133263 - protein, 9 aa, Homo Sapiens
ARVRAPCCA

SEQ ID NO: 1133264 - protein, 9 aa, Homo Sapiens
TPPAPPTVA

SEQ ID NO: 1133265 - protein, 9 aa, Homo Sapiens
LGRQQVMAQ

SEQ ID NO: 1133266 - protein, 9 aa, Homo Sapiens
DSDSPNPAR

SEQ ID NO: 1133267 - protein, 9 aa, Homo Sapiens
ILWLLWTPV

SEQ ID NO: 1133268 - protein, 9 aa, Homo Sapiens
PAGVTPISV

SEQ ID NO: 1133269 - protein, 9 aa, Homo Sapiens
LSTFPAERG

SEQ ID NO: 1133270 - protein, 9 aa, Homo Sapiens
AAQTEYIEK

SEQ ID NO: 1133271 - protein, 9 aa, Homo Sapiens
LGASRRTAS

SEQ ID NO: 1133272 - protein, 9 aa, Homo Sapiens
SQLLSVYLE

SEQ ID NO: 1133273 - protein, 9 aa, Homo Sapiens
KQELEEEER

SEQ ID NO: 1133274 - protein, 9 aa, Homo Sapiens
LITCHTPAL

SEQ ID NO: 1133275 - protein, 9 aa, Homo Sapiens
VRVHVTSNL

SEQ ID NO: 1133276 - protein, 9 aa, Homo Sapiens
SGFLSIADM

SEQ ID NO: 1133277 - protein, 9 aa, Homo Sapiens
GVQGIPLIP

SEQ ID NO: 1133278 - protein, 9 aa, Homo Sapiens
SLGPDGGGS

SEQ ID NO: 1133279 - protein, 9 aa, Homo Sapiens
STETIEEVE

SEQ ID NO: 1133280 - protein, 9 aa, Homo Sapiens
AVACLAAIS

SEQ ID NO: 1133281 - protein, 9 aa, Homo Sapiens
FGSHHHSQN

SEQ ID NO: 1133282 - protein, 9 aa, Homo Sapiens
FVEIRCHID

SEQ ID NO: 1133283 - protein, 9 aa, Homo Sapiens
CHPQGSFFT

SEQ ID NO: 1133284 - protein, 9 aa, Homo Sapiens
ASGSGEGSE

SEQ ID NO: 1133285 - protein, 9 aa, Homo Sapiens
FGAWCRYGK

SEQ ID NO: 1133286 - protein, 9 aa, Homo Sapiens
APEVPRCAM

SEQ ID NO: 1133287 - protein, 9 aa, Homo Sapiens
PLSSHGSDS

SEQ ID NO: 1133288 - protein, 9 aa, Homo Sapiens
DTFKKCVSK

SEQ ID NO: 1133289 - protein, 9 aa, Homo Sapiens
GILLFLALL

SEQ ID NO: 1133290 - protein, 9 aa, Homo Sapiens
GTWIISIYV

SEQ ID NO: 1133291 - protein, 9 aa, Homo Sapiens
SAIAQDTDQ

SEQ ID NO: 1133292 - protein, 9 aa, Homo Sapiens
IMDKPQKAV

SEQ ID NO: 1133293 - protein, 9 aa, Homo Sapiens
LRLLTTAWA

SEQ ID NO: 1133294 - protein, 9 aa, Homo Sapiens
ESLVQLKIM

SEQ ID NO: 1133295 - protein, 9 aa, Homo Sapiens
RPRPSLRPW

SEQ ID NO: 1133296 - protein, 9 aa, Homo Sapiens
YGATEQGTY

SEQ ID NO: 1133297 - protein, 9 aa, Homo Sapiens
SCIRGKKQS

SEQ ID NO: 1133298 - protein, 9 aa, Homo Sapiens
LPQLPSAPT

SEQ ID NO: 1133299 - protein, 9 aa, Homo Sapiens
NSTVVGLTM

SEQ ID NO: 1133300 - protein, 9 aa, Homo Sapiens
QVGHGVWVG

SEQ ID NO: 1133301 - protein, 9 aa, Homo Sapiens
PSDISSVPP

SEQ ID NO: 1133302 - protein, 9 aa, Homo Sapiens
PLRRSVSPY

SEQ ID NO: 1133303 - protein, 9 aa, Homo Sapiens
PGEVVKQTD

SEQ ID NO: 1133304 - protein, 9 aa, Homo Sapiens
PCASCPGPR

SEQ ID NO: 1133305 - protein, 9 aa, Homo Sapiens
GQLTQENSS

SEQ ID NO: 1133306 - protein, 9 aa, Homo Sapiens
GLLEKCCQC

SEQ ID NO: 1133307 - protein, 9 aa, Homo Sapiens
INRNHMGRD

SEQ ID NO: 1133308 - protein, 9 aa, Homo Sapiens
TSLQRSQSD

SEQ ID NO: 1133309 - protein, 9 aa, Homo Sapiens
GAEALCQKG

SEQ ID NO: 1133310 - protein, 9 aa, Homo Sapiens
KHKLPLESL

SEQ ID NO: 1133311 - protein, 9 aa, Homo Sapiens
LTDPIEQGL

SEQ ID NO: 1133312 - protein, 9 aa, Homo Sapiens
VKVMYRCLW

SEQ ID NO: 1133313 - protein, 9 aa, Homo Sapiens
PLCLRVRPR

SEQ ID NO: 1133314 - protein, 9 aa, Homo Sapiens
TEPLGVELH

SEQ ID NO: 1133315 - protein, 9 aa, Homo Sapiens
SMTIYIFCL

SEQ ID NO: 1133316 - protein, 9 aa, Homo Sapiens
PCWAPAPGS

SEQ ID NO: 1133317 - protein, 9 aa, Homo Sapiens
GEAKYRPRA

SEQ ID NO: 1133318 - protein, 9 aa, Homo Sapiens
RGLQTDGVP

SEQ ID NO: 1133319 - protein, 9 aa, Homo Sapiens
CTIKEIATD

SEQ ID NO: 1133320 - protein, 9 aa, Homo Sapiens
QLPRDRRPR

SEQ ID NO: 1133321 - protein, 9 aa, Homo Sapiens
HLGQPRQLP

SEQ ID NO: 1133322 - protein, 9 aa, Homo Sapiens
LLPHSRGGC

SEQ ID NO: 1133323 - protein, 9 aa, Homo Sapiens
CIGRRWERP

SEQ ID NO: 1133324 - protein, 9 aa, Homo Sapiens
CPLDSNLSE

SEQ ID NO: 1133325 - protein, 9 aa, Homo Sapiens
FYDSISKEH

SEQ ID NO: 1133326 - protein, 9 aa, Homo Sapiens
RNGNSGNSW

SEQ ID NO: 1133327 - protein, 9 aa, Homo Sapiens
MLLAIPEAM

SEQ ID NO: 1133328 - protein, 9 aa, Homo Sapiens
RLLYPVLCS

SEQ ID NO: 1133329 - protein, 9 aa, Homo Sapiens
DSTRLRLWL

SEQ ID NO: 1133330 - protein, 9 aa, Homo Sapiens
GTWKRVHSK

SEQ ID NO: 1133331 - protein, 9 aa, Homo Sapiens
EKLSMIRFQ

SEQ ID NO: 1133332 - protein, 9 aa, Homo Sapiens
VHRVTIMCD

SEQ ID NO: 1133333 - protein, 9 aa, Homo Sapiens
EVLLQELSS

SEQ ID NO: 1133334 - protein, 9 aa, Homo Sapiens
LLFRRIAWI

SEQ ID NO: 1133335 - protein, 9 aa, Homo Sapiens
TLILVVIGV

SEQ ID NO: 1133336 - protein, 9 aa, Homo Sapiens
ITPFTATEN

SEQ ID NO: 1133337 - protein, 9 aa, Homo Sapiens
WKTITDYVS

SEQ ID NO: 1133338 - protein, 9 aa, Homo Sapiens
QTFSATMSN

SEQ ID NO: 1133339 - protein, 9 aa, Homo Sapiens
GRSLEGEFK

SEQ ID NO: 1133340 - protein, 9 aa, Homo Sapiens
DSRFLRPSK

SEQ ID NO: 1133341 - protein, 9 aa, Homo Sapiens
IVQSIIHGG

SEQ ID NO: 1133342 - protein, 9 aa, Homo Sapiens
LSVLLFVTV

SEQ ID NO: 1133343 - protein, 9 aa, Homo Sapiens
GPAPASRAA

SEQ ID NO: 1133344 - protein, 9 aa, Homo Sapiens
RILTSFTLQ

SEQ ID NO: 1133345 - protein, 9 aa, Homo Sapiens
ASLKVLAGP

SEQ ID NO: 1133346 - protein, 9 aa, Homo Sapiens
IMWALSDMA

SEQ ID NO: 1133347 - protein, 9 aa, Homo Sapiens
GSTREEQEI

SEQ ID NO: 1133348 - protein, 9 aa, Homo Sapiens
DPVICSLVR

SEQ ID NO: 1133349 - protein, 9 aa, Homo Sapiens
PLSTLQINV

SEQ ID NO: 1133350 - protein, 9 aa, Homo Sapiens
EPVVVVAAP

SEQ ID NO: 1133351 - protein, 9 aa, Homo Sapiens
RKAQIPQLN

SEQ ID NO: 1133352 - protein, 9 aa, Homo Sapiens
VYLAGLLSA

SEQ ID NO: 1133353 - protein, 9 aa, Homo Sapiens
EDKAEQRAR

SEQ ID NO: 1133354 - protein, 9 aa, Homo Sapiens
GASRALFTS

SEQ ID NO: 1133355 - protein, 9 aa, Homo Sapiens
PVEAVSVDY

SEQ ID NO: 1133356 - protein, 9 aa, Homo Sapiens
PAPGLTKCV

SEQ ID NO: 1133357 - protein, 9 aa, Homo Sapiens
ARNSAKGPK

SEQ ID NO: 1133358 - protein, 9 aa, Homo Sapiens
MKMAAMIFK

SEQ ID NO: 1133359 - protein, 9 aa, Homo Sapiens
VDLAGSDRV

SEQ ID NO: 1133360 - protein, 9 aa, Homo Sapiens
KELVQGPIL

SEQ ID NO: 1133361 - protein, 9 aa, Homo Sapiens
QLTQENSSC

SEQ ID NO: 1133362 - protein, 9 aa, Homo Sapiens
ISESLHIFR

SEQ ID NO: 1133363 - protein, 9 aa, Homo Sapiens
HTQKKYIYD

SEQ ID NO: 1133364 - protein, 9 aa, Homo Sapiens
LFTRFACFT

SEQ ID NO: 1133365 - protein, 9 aa, Homo Sapiens
DNYEDTIRL

SEQ ID NO: 1133366 - protein, 9 aa, Homo Sapiens
HGPPSSIRL

SEQ ID NO: 1133367 - protein, 9 aa, Homo Sapiens
CWLSKEPES

SEQ ID NO: 1133368 - protein, 9 aa, Homo Sapiens
PSFYVFNHH

SEQ ID NO: 1133369 - protein, 9 aa, Homo Sapiens
KRQKQASDS

SEQ ID NO: 1133370 - protein, 9 aa, Homo Sapiens
TIIVLLLGT

SEQ ID NO: 1133371 - protein, 9 aa, Homo Sapiens
LEKCCQCQE

SEQ ID NO: 1133372 - protein, 9 aa, Homo Sapiens
CLAPVKWGG

SEQ ID NO: 1133373 - protein, 9 aa, Homo Sapiens
RILCGKHVD

SEQ ID NO: 1133374 - protein, 9 aa, Homo Sapiens
PSLAPERGS

SEQ ID NO: 1133375 - protein, 9 aa, Homo Sapiens
LGSQCVSLS

SEQ ID NO: 1133376 - protein, 9 aa, Homo Sapiens
EAGRNITWA

SEQ ID NO: 1133377 - protein, 9 aa, Homo Sapiens
GLPVEALKL

SEQ ID NO: 1133378 - protein, 9 aa, Homo Sapiens
ELAILLPKE

SEQ ID NO: 1133379 - protein, 9 aa, Homo Sapiens
STAVSIPDY

SEQ ID NO: 1133380 - protein, 9 aa, Homo Sapiens
IKKNPSMKS

SEQ ID NO: 1133381 - protein, 9 aa, Homo Sapiens
EYDGNEKIY

SEQ ID NO: 1133382 - protein, 9 aa, Homo Sapiens
PSVVLSTKS

SEQ ID NO: 1133383 - protein, 9 aa, Homo Sapiens
GESIHGEKF

SEQ ID NO: 1133384 - protein, 9 aa, Homo Sapiens
PTVALLQAG

SEQ ID NO: 1133385 - protein, 9 aa, Homo Sapiens
LHLPCFQDV

SEQ ID NO: 1133386 - protein, 9 aa, Homo Sapiens
GSDLPGLEP

SEQ ID NO: 1133387 - protein, 9 aa, Homo Sapiens
AEGPGGHQE

SEQ ID NO: 1133388 - protein, 9 aa, Homo Sapiens
LGILQQRQK

SEQ ID NO: 1133389 - protein, 9 aa, Homo Sapiens
SKYVRAMYP

SEQ ID NO: 1133390 - protein, 9 aa, Homo Sapiens
VTVPPQMGS

SEQ ID NO: 1133391 - protein, 9 aa, Homo Sapiens
ASTSSPQGS

SEQ ID NO: 1133392 - protein, 9 aa, Homo Sapiens
QAAAGGSQG

SEQ ID NO: 1133393 - protein, 9 aa, Homo Sapiens
KYDETYPLS

SEQ ID NO: 1133394 - protein, 9 aa, Homo Sapiens
SACTMPPLL

SEQ ID NO: 1133395 - protein, 9 aa, Homo Sapiens
ARGGTTIGE

SEQ ID NO: 1133396 - protein, 9 aa, Homo Sapiens
PPSAAALDS

SEQ ID NO: 1133397 - protein, 9 aa, Homo Sapiens
EGRRRTVPG

SEQ ID NO: 1133398 - protein, 9 aa, Homo Sapiens
KSARPTKLG

SEQ ID NO: 1133399 - protein, 9 aa, Homo Sapiens
LEELQSQHD

SEQ ID NO: 1133400 - protein, 9 aa, Homo Sapiens
PERLLAPLI

SEQ ID NO: 1133401 - protein, 9 aa, Homo Sapiens
AIKAFFQKS

SEQ ID NO: 1133402 - protein, 9 aa, Homo Sapiens
EFSDETFGP

SEQ ID NO: 1133403 - protein, 9 aa, Homo Sapiens
THGFDKTQS

SEQ ID NO: 1133404 - protein, 9 aa, Homo Sapiens
SPAPLRLCW

SEQ ID NO: 1133405 - protein, 9 aa, Homo Sapiens
VAASLVRRG

SEQ ID NO: 1133406 - protein, 9 aa, Homo Sapiens
NAGVAQPAS

SEQ ID NO: 1133407 - protein, 9 aa, Homo Sapiens
HKMLAIFWF

SEQ ID NO: 1133408 - protein, 9 aa, Homo Sapiens
THLAALVYK

SEQ ID NO: 1133409 - protein, 9 aa, Homo Sapiens
PDFLLLQSV

SEQ ID NO: 1133410 - protein, 9 aa, Homo Sapiens
LCSHHVTHT

SEQ ID NO: 1133411 - protein, 9 aa, Homo Sapiens
LPPATPPPR

SEQ ID NO: 1133412 - protein, 9 aa, Homo Sapiens
KLLCRETGE

SEQ ID NO: 1133413 - protein, 9 aa, Homo Sapiens
APRAVITGH

SEQ ID NO: 1133414 - protein, 9 aa, Homo Sapiens
QYRILRSQH

SEQ ID NO: 1133415 - protein, 9 aa, Homo Sapiens
FSFKAFSPD

SEQ ID NO: 1133416 - protein, 9 aa, Homo Sapiens
SDQESGVEV

SEQ ID NO: 1133417 - protein, 9 aa, Homo Sapiens
TWEEMWLSK

SEQ ID NO: 1133418 - protein, 9 aa, Homo Sapiens
PPSMRCVHY

SEQ ID NO: 1133419 - protein, 9 aa, Homo Sapiens
SSALRFGKR

SEQ ID NO: 1133420 - protein, 9 aa, Homo Sapiens
PRAFLGLDR

SEQ ID NO: 1133421 - protein, 9 aa, Homo Sapiens
PTSAPTAAK

SEQ ID NO: 1133422 - protein, 9 aa, Homo Sapiens
QKIPVLFSI

SEQ ID NO: 1133423 - protein, 9 aa, Homo Sapiens
GLCRALWED

SEQ ID NO: 1133424 - protein, 9 aa, Homo Sapiens
EKKAINGIL

SEQ ID NO: 1133425 - protein, 9 aa, Homo Sapiens
RGVAQPWPS

SEQ ID NO: 1133426 - protein, 9 aa, Homo Sapiens
PKEEVVCLL

SEQ ID NO: 1133427 - protein, 9 aa, Homo Sapiens
QRGVAQPWP

SEQ ID NO: 1133428 - protein, 9 aa, Homo Sapiens
VPSVARPST

SEQ ID NO: 1133429 - protein, 9 aa, Homo Sapiens
HPSRPCRMR

SEQ ID NO: 1133430 - protein, 9 aa, Homo Sapiens
QLPVVEPPP

SEQ ID NO: 1133431 - protein, 9 aa, Homo Sapiens
GAMNARGIP

SEQ ID NO: 1133432 - protein, 9 aa, Homo Sapiens
YGCGPWFWI

SEQ ID NO: 1133433 - protein, 9 aa, Homo Sapiens
IPKEVFMLH

SEQ ID NO: 1133434 - protein, 9 aa, Homo Sapiens
FASTAYLEL

SEQ ID NO: 1133435 - protein, 9 aa, Homo Sapiens
SLLPEVGGQ

SEQ ID NO: 1133436 - protein, 9 aa, Homo Sapiens
RQPRSPLRS

SEQ ID NO: 1133437 - protein, 9 aa, Homo Sapiens
GRKKGLCHL

SEQ ID NO: 1133438 - protein, 9 aa, Homo Sapiens
LGHFVIPKK

SEQ ID NO: 1133439 - protein, 9 aa, Homo Sapiens
DGEKGTYSY

SEQ ID NO: 1133440 - protein, 9 aa, Homo Sapiens
NSDDRNTSC

SEQ ID NO: 1133441 - protein, 9 aa, Homo Sapiens
YIGWPANRD

SEQ ID NO: 1133442 - protein, 9 aa, Homo Sapiens
ERAHMRVLS

SEQ ID NO: 1133443 - protein, 9 aa, Homo Sapiens
DGTLEIHSV

SEQ ID NO: 1133444 - protein, 9 aa, Homo Sapiens
TSTIEFYTK

SEQ ID NO: 1133445 - protein, 9 aa, Homo Sapiens
SLGLSPDVQ

SEQ ID NO: 1133446 - protein, 9 aa, Homo Sapiens
KDDRRDRCS

SEQ ID NO: 1133447 - protein, 9 aa, Homo Sapiens
EQTCRALEL

SEQ ID NO: 1133448 - protein, 9 aa, Homo Sapiens
MKNACHFPA

SEQ ID NO: 1133449 - protein, 9 aa, Homo Sapiens
ITDDLDVGD

SEQ ID NO: 1133450 - protein, 9 aa, Homo Sapiens
LRKYVFDRA

SEQ ID NO: 1133451 - protein, 9 aa, Homo Sapiens
GDPGVGERA

SEQ ID NO: 1133452 - protein, 9 aa, Homo Sapiens
RARYGDGQQ

SEQ ID NO: 1133453 - protein, 9 aa, Homo Sapiens
ISEPPHVER

SEQ ID NO: 1133454 - protein, 9 aa, Homo Sapiens
VKQTDVVLL

SEQ ID NO: 1133455 - protein, 9 aa, Homo Sapiens
CAAISREPD

SEQ ID NO: 1133456 - protein, 9 aa, Homo Sapiens
RICIESCKL

SEQ ID NO: 1133457 - protein, 9 aa, Homo Sapiens
TAALSLSRT

SEQ ID NO: 1133458 - protein, 9 aa, Homo Sapiens
ASTREYVMC

SEQ ID NO: 1133459 - protein, 9 aa, Homo Sapiens
LKLKYIKEK

SEQ ID NO: 1133460 - protein, 9 aa, Homo Sapiens
KKRFEVKRW

SEQ ID NO: 1133461 - protein, 9 aa, Homo Sapiens
LGRRQLNLG

SEQ ID NO: 1133462 - protein, 9 aa, Homo Sapiens
RCLLYTLNL

SEQ ID NO: 1133463 - protein, 9 aa, Homo Sapiens
VGAQEAVQE

SEQ ID NO: 1133464 - protein, 9 aa, Homo Sapiens
IMAITSIVM

SEQ ID NO: 1133465 - protein, 9 aa, Homo Sapiens
GRHPATRPL

SEQ ID NO: 1133466 - protein, 9 aa, Homo Sapiens
GVVCCLPGA

SEQ ID NO: 1133467 - protein, 9 aa, Homo Sapiens
PPDAQTPDM

SEQ ID NO: 1133468 - protein, 9 aa, Homo Sapiens
VGGGDRVPG

SEQ ID NO: 1133469 - protein, 9 aa, Homo Sapiens
PPQTRTAQS

SEQ ID NO: 1133470 - protein, 9 aa, Homo Sapiens
YHQITIPRG

SEQ ID NO: 1133471 - protein, 9 aa, Homo Sapiens
STHNRSAMP

SEQ ID NO: 1133472 - protein, 9 aa, Homo Sapiens
RRTVPGGPG

SEQ ID NO: 1133473 - protein, 9 aa, Homo Sapiens
LKTLRLPCL

SEQ ID NO: 1133474 - protein, 9 aa, Homo Sapiens
LFASLVPTD

SEQ ID NO: 1133475 - protein, 9 aa, Homo Sapiens
HQEVPVVIL

SEQ ID NO: 1133476 - protein, 9 aa, Homo Sapiens
IFMYLQPTN

SEQ ID NO: 1133477 - protein, 9 aa, Homo Sapiens
GQLVWYMGY

SEQ ID NO: 1133478 - protein, 9 aa, Homo Sapiens
RPSPPQGLV

SEQ ID NO: 1133479 - protein, 9 aa, Homo Sapiens
PCGPRLTRF

SEQ ID NO: 1133480 - protein, 9 aa, Homo Sapiens
EQETGTFKL

SEQ ID NO: 1133481 - protein, 9 aa, Homo Sapiens
YECKNTFGS

SEQ ID NO: 1133482 - protein, 9 aa, Homo Sapiens
HHLPPAEGG

SEQ ID NO: 1133483 - protein, 9 aa, Homo Sapiens
VGVDVATDF

SEQ ID NO: 1133484 - protein, 9 aa, Homo Sapiens
SEGEDDTDD

SEQ ID NO: 1133485 - protein, 9 aa, Homo Sapiens
KWSTFLKAQ

SEQ ID NO: 1133486 - protein, 9 aa, Homo Sapiens
VFLASTRPS

SEQ ID NO: 1133487 - protein, 9 aa, Homo Sapiens
PQTHQKLKE

SEQ ID NO: 1133488 - protein, 9 aa, Homo Sapiens
ATSYSSEDY

SEQ ID NO: 1133489 - protein, 9 aa, Homo Sapiens
YSRQGSTET

SEQ ID NO: 1133490 - protein, 9 aa, Homo Sapiens
RPARTRGAP

SEQ ID NO: 1133491 - protein, 9 aa, Homo Sapiens
LCVILVGEM

SEQ ID NO: 1133492 - protein, 9 aa, Homo Sapiens
KVGQCLDVG

SEQ ID NO: 1133493 - protein, 9 aa, Homo Sapiens
VVTVRSRSP

SEQ ID NO: 1133494 - protein, 9 aa, Homo Sapiens
LHQVLTKPQ

SEQ ID NO: 1133495 - protein, 9 aa, Homo Sapiens
ASTSSVKTG

SEQ ID NO: 1133496 - protein, 9 aa, Homo Sapiens
IEVNKNQSA

SEQ ID NO: 1133497 - protein, 9 aa, Homo Sapiens
AGAPELGAD

SEQ ID NO: 1133498 - protein, 9 aa, Homo Sapiens
WVATFEEGL

SEQ ID NO: 1133499 - protein, 9 aa, Homo Sapiens
PQAMANSQG

SEQ ID NO: 1133500 - protein, 9 aa, Homo Sapiens
WTPVLLQGH

SEQ ID NO: 1133501 - protein, 9 aa, Homo Sapiens
GLDPDLETM

SEQ ID NO: 1133502 - protein, 9 aa, Homo Sapiens
EHFCGTCNH

SEQ ID NO: 1133503 - protein, 9 aa, Homo Sapiens
GGFGGKEAR

SEQ ID NO: 1133504 - protein, 9 aa, Homo Sapiens
SPVKDLTYF

SEQ ID NO: 1133505 - protein, 9 aa, Homo Sapiens
GVSLRPGAR

SEQ ID NO: 1133506 - protein, 9 aa, Homo Sapiens
PDLGVRPLP

SEQ ID NO: 1133507 - protein, 9 aa, Homo Sapiens
CPVGVLTSK

SEQ ID NO: 1133508 - protein, 9 aa, Homo Sapiens
YEYKWMASS

SEQ ID NO: 1133509 - protein, 9 aa, Homo Sapiens
ATGMTCQSR

SEQ ID NO: 1133510 - protein, 9 aa, Homo Sapiens
AGLMTAAAT

SEQ ID NO: 1133511 - protein, 9 aa, Homo Sapiens
IRHISAPEK

SEQ ID NO: 1133512 - protein, 9 aa, Homo Sapiens
HTAKTIKTV

SEQ ID NO: 1133513 - protein, 9 aa, Homo Sapiens
QTCRALELE

SEQ ID NO: 1133514 - protein, 9 aa, Homo Sapiens
CRTSTTRAI

SEQ ID NO: 1133515 - protein, 9 aa, Homo Sapiens
SGRARGTSI

SEQ ID NO: 1133516 - protein, 9 aa, Homo Sapiens
GHCPHEGPG

SEQ ID NO: 1133517 - protein, 9 aa, Homo Sapiens
ERLTRSVES

SEQ ID NO: 1133518 - protein, 9 aa, Homo Sapiens
SGGEQLCGV

SEQ ID NO: 1133519 - protein, 9 aa, Homo Sapiens
PRTPLFPLL

SEQ ID NO: 1133520 - protein, 9 aa, Homo Sapiens
PPGVMVYSG

SEQ ID NO: 1133521 - protein, 9 aa, Homo Sapiens
VKWKGWPQK

SEQ ID NO: 1133522 - protein, 9 aa, Homo Sapiens
SSAPGSRDS

SEQ ID NO: 1133523 - protein, 9 aa, Homo Sapiens
AWMRLGAPV

SEQ ID NO: 1133524 - protein, 9 aa, Homo Sapiens
LNFLSLENM

SEQ ID NO: 1133525 - protein, 9 aa, Homo Sapiens
ITISLLVGI

SEQ ID NO: 1133526 - protein, 9 aa, Homo Sapiens
RPAAAAAGA

SEQ ID NO: 1133527 - protein, 9 aa, Homo Sapiens
NTYGPDFGP

SEQ ID NO: 1133528 - protein, 9 aa, Homo Sapiens
PNTGPRRRP

SEQ ID NO: 1133529 - protein, 9 aa, Homo Sapiens
IYPNIAMGF

SEQ ID NO: 1133530 - protein, 9 aa, Homo Sapiens
SVLGHIWKL

SEQ ID NO: 1133531 - protein, 9 aa, Homo Sapiens
PRITAAASR

SEQ ID NO: 1133532 - protein, 9 aa, Homo Sapiens
DAVRALEKH

SEQ ID NO: 1133533 - protein, 9 aa, Homo Sapiens
IIWGMYQNL

SEQ ID NO: 1133534 - protein, 9 aa, Homo Sapiens
LCTEDFDLE

SEQ ID NO: 1133535 - protein, 9 aa, Homo Sapiens
YIRQGLCWL

SEQ ID NO: 1133536 - protein, 9 aa, Homo Sapiens
EKNRQRGHL

SEQ ID NO: 1133537 - protein, 9 aa, Homo Sapiens
EGRRDTPGG

SEQ ID NO: 1133538 - protein, 9 aa, Homo Sapiens
SIWLSYTIS

SEQ ID NO: 1133539 - protein, 9 aa, Homo Sapiens
APLAAPRST

SEQ ID NO: 1133540 - protein, 9 aa, Homo Sapiens
VEDNKSLTA

SEQ ID NO: 1133541 - protein, 9 aa, Homo Sapiens
CEMVERALD

SEQ ID NO: 1133542 - protein, 9 aa, Homo Sapiens
HWEENRNGN

SEQ ID NO: 1133543 - protein, 9 aa, Homo Sapiens
GVTLKDGAT

SEQ ID NO: 1133544 - protein, 9 aa, Homo Sapiens
ESPDSTVDQ

SEQ ID NO: 1133545 - protein, 9 aa, Homo Sapiens
LILVIGAFT

SEQ ID NO: 1133546 - protein, 9 aa, Homo Sapiens
SGPSPARSA

SEQ ID NO: 1133547 - protein, 9 aa, Homo Sapiens
QVLCHHLAT

SEQ ID NO: 1133548 - protein, 9 aa, Homo Sapiens
KKRILCGKH

SEQ ID NO: 1133549 - protein, 9 aa, Homo Sapiens
LGAEALCQK

SEQ ID NO: 1133550 - protein, 9 aa, Homo Sapiens
HPLCPPPSP

SEQ ID NO: 1133551 - protein, 9 aa, Homo Sapiens
HAEERFFER

SEQ ID NO: 1133552 - protein, 9 aa, Homo Sapiens
LKMACKEDV

SEQ ID NO: 1133553 - protein, 9 aa, Homo Sapiens
GPLPPYHSK

SEQ ID NO: 1133554 - protein, 9 aa, Homo Sapiens
RKQRWERTT

SEQ ID NO: 1133555 - protein, 9 aa, Homo Sapiens
HGAQKMSNG

SEQ ID NO: 1133556 - protein, 9 aa, Homo Sapiens
LIGLLKVPI

SEQ ID NO: 1133557 - protein, 9 aa, Homo Sapiens
DVGLAHLVV

SEQ ID NO: 1133558 - protein, 9 aa, Homo Sapiens
DIQIVQKEA

SEQ ID NO: 1133559 - protein, 9 aa, Homo Sapiens
ITTVLGNGA

SEQ ID NO: 1133560 - protein, 9 aa, Homo Sapiens
AGGLPAVLM

SEQ ID NO: 1133561 - protein, 9 aa, Homo Sapiens
SPAILVIIT

SEQ ID NO: 1133562 - protein, 9 aa, Homo Sapiens
MFTISVSLV

SEQ ID NO: 1133563 - protein, 9 aa, Homo Sapiens
ELLAGFCAA

SEQ ID NO: 1133564 - protein, 9 aa, Homo Sapiens
KADQILLQT

SEQ ID NO: 1133565 - protein, 9 aa, Homo Sapiens
GMIPGLGQI

SEQ ID NO: 1133566 - protein, 9 aa, Homo Sapiens
SPLHGDSGV

SEQ ID NO: 1133567 - protein, 9 aa, Homo Sapiens
WLHARLIPF

SEQ ID NO: 1133568 - protein, 9 aa, Homo Sapiens
PTTENSVYK

SEQ ID NO: 1133569 - protein, 9 aa, Homo Sapiens
ALHEHGQRQ

SEQ ID NO: 1133570 - protein, 9 aa, Homo Sapiens
APEQRVTLS

SEQ ID NO: 1133571 - protein, 9 aa, Homo Sapiens
LYHLSPHLN

SEQ ID NO: 1133572 - protein, 9 aa, Homo Sapiens
GFAAPSPTS

SEQ ID NO: 1133573 - protein, 9 aa, Homo Sapiens
CLYADLNRH

SEQ ID NO: 1133574 - protein, 9 aa, Homo Sapiens
ARVFKELPV

SEQ ID NO: 1133575 - protein, 9 aa, Homo Sapiens
SPVARLTWR

SEQ ID NO: 1133576 - protein, 9 aa, Homo Sapiens
ITNLERWVK

SEQ ID NO: 1133577 - protein, 9 aa, Homo Sapiens
PGPCIGEES

SEQ ID NO: 1133578 - protein, 9 aa, Homo Sapiens
GALSSQEVE

SEQ ID NO: 1133579 - protein, 9 aa, Homo Sapiens
PTSRSIVSL

SEQ ID NO: 1133580 - protein, 9 aa, Homo Sapiens
TDPIPLPAL

SEQ ID NO: 1133581 - protein, 9 aa, Homo Sapiens
ERLRELLRA

SEQ ID NO: 1133582 - protein, 9 aa, Homo Sapiens
YDGKKLKCG

SEQ ID NO: 1133583 - protein, 9 aa, Homo Sapiens
RGRRCWRGC

SEQ ID NO: 1133584 - protein, 9 aa, Homo Sapiens
RPDKKSNPF

SEQ ID NO: 1133585 - protein, 9 aa, Homo Sapiens
NNYRFQMKF

SEQ ID NO: 1133586 - protein, 9 aa, Homo Sapiens
MAVLSVRPM

SEQ ID NO: 1133587 - protein, 9 aa, Homo Sapiens
PPARDPPRP

SEQ ID NO: 1133588 - protein, 9 aa, Homo Sapiens
PLRRPCTAS

SEQ ID NO: 1133589 - protein, 9 aa, Homo Sapiens
RSEFEHCVQ

SEQ ID NO: 1133590 - protein, 9 aa, Homo Sapiens
FAEMNRHSN

SEQ ID NO: 1133591 - protein, 9 aa, Homo Sapiens
SQEVILSSE

SEQ ID NO: 1133592 - protein, 9 aa, Homo Sapiens
AVQQLEGRW

SEQ ID NO: 1133593 - protein, 9 aa, Homo Sapiens
GDLQHALAQ

SEQ ID NO: 1133594 - protein, 9 aa, Homo Sapiens
KKGPRKRSC

SEQ ID NO: 1133595 - protein, 9 aa, Homo Sapiens
PAGPPPGGR

SEQ ID NO: 1133596 - protein, 9 aa, Homo Sapiens
VLDNSEGKI

SEQ ID NO: 1133597 - protein, 9 aa, Homo Sapiens
GGRGGGRRN

SEQ ID NO: 1133598 - protein, 9 aa, Homo Sapiens
KICEEFKEK

SEQ ID NO: 1133599 - protein, 9 aa, Homo Sapiens
MFVWTRPQQ

SEQ ID NO: 1133600 - protein, 9 aa, Homo Sapiens
TLITKELHR

SEQ ID NO: 1133601 - protein, 9 aa, Homo Sapiens
HFVEIRCHI

SEQ ID NO: 1133602 - protein, 9 aa, Homo Sapiens
YQLCSHHVT

SEQ ID NO: 1133603 - protein, 9 aa, Homo Sapiens
GRLVIVGHG

SEQ ID NO: 1133604 - protein, 9 aa, Homo Sapiens
GLGGSCQHL

SEQ ID NO: 1133605 - protein, 9 aa, Homo Sapiens
TRKTYPICK

SEQ ID NO: 1133606 - protein, 9 aa, Homo Sapiens
AAQKCHKKT

SEQ ID NO: 1133607 - protein, 9 aa, Homo Sapiens
MMEDNKQIA

SEQ ID NO: 1133608 - protein, 9 aa, Homo Sapiens
STAATTAAG

SEQ ID NO: 1133609 - protein, 9 aa, Homo Sapiens
MEMANRVLR

SEQ ID NO: 1133610 - protein, 9 aa, Homo Sapiens
AAGGARGRD

SEQ ID NO: 1133611 - protein, 9 aa, Homo Sapiens
LHWRIGGGT

SEQ ID NO: 1133612 - protein, 9 aa, Homo Sapiens
HHPSNKEDE

SEQ ID NO: 1133613 - protein, 9 aa, Homo Sapiens
LYTGLYHIG

SEQ ID NO: 1133614 - protein, 9 aa, Homo Sapiens
AFKAEGEYT

SEQ ID NO: 1133615 - protein, 9 aa, Homo Sapiens
RRSQHRPAR

SEQ ID NO: 1133616 - protein, 9 aa, Homo Sapiens
QQSQQPYPQ

SEQ ID NO: 1133617 - protein, 9 aa, Homo Sapiens
MANFSFGGV

SEQ ID NO: 1133618 - protein, 9 aa, Homo Sapiens
PAAGGEAVV

SEQ ID NO: 1133619 - protein, 9 aa, Homo Sapiens
EVLSRTHNS

SEQ ID NO: 1133620 - protein, 9 aa, Homo Sapiens
HSCPESVKN

SEQ ID NO: 1133621 - protein, 9 aa, Homo Sapiens
RPATGKSTS

SEQ ID NO: 1133622 - protein, 9 aa, Homo Sapiens
VASPPRRWP

SEQ ID NO: 1133623 - protein, 9 aa, Homo Sapiens
LAVHPPEDV

SEQ ID NO: 1133624 - protein, 9 aa, Homo Sapiens
FTRRRRPSC

SEQ ID NO: 1133625 - protein, 9 aa, Homo Sapiens
RQHEVTICN

SEQ ID NO: 1133626 - protein, 9 aa, Homo Sapiens
LAWAVESLD

SEQ ID NO: 1133627 - protein, 9 aa, Homo Sapiens
PEMAAMRLM

SEQ ID NO: 1133628 - protein, 9 aa, Homo Sapiens
RLEPVVSDT

SEQ ID NO: 1133629 - protein, 9 aa, Homo Sapiens
SGRHPATRP

SEQ ID NO: 1133630 - protein, 9 aa, Homo Sapiens
VRLQVQLHE

SEQ ID NO: 1133631 - protein, 9 aa, Homo Sapiens
RGSRAEVTL

SEQ ID NO: 1133632 - protein, 9 aa, Homo Sapiens
KQLIYLYLF

SEQ ID NO: 1133633 - protein, 9 aa, Homo Sapiens
CCPGPLDQD

SEQ ID NO: 1133634 - protein, 9 aa, Homo Sapiens
YPCSLVGIW

SEQ ID NO: 1133635 - protein, 9 aa, Homo Sapiens
LCIHTGCEL

SEQ ID NO: 1133636 - protein, 9 aa, Homo Sapiens
LGHSRQGSG

SEQ ID NO: 1133637 - protein, 9 aa, Homo Sapiens
VDISDQETG

SEQ ID NO: 1133638 - protein, 9 aa, Homo Sapiens
ISSRHQTDK

SEQ ID NO: 1133639 - protein, 9 aa, Homo Sapiens
HGRSRSSSS

SEQ ID NO: 1133640 - protein, 9 aa, Homo Sapiens
GRGACESGP

SEQ ID NO: 1133641 - protein, 9 aa, Homo Sapiens
GTAGCCAMA

SEQ ID NO: 1133642 - protein, 9 aa, Homo Sapiens
IGWPANRDT

SEQ ID NO: 1133643 - protein, 9 aa, Homo Sapiens
YPKGVFTKE

SEQ ID NO: 1133644 - protein, 9 aa, Homo Sapiens
GKRSRCRPH

SEQ ID NO: 1133645 - protein, 9 aa, Homo Sapiens
TDLALTFLQ

SEQ ID NO: 1133646 - protein, 9 aa, Homo Sapiens
AGTASCLRT

SEQ ID NO: 1133647 - protein, 9 aa, Homo Sapiens
YDLYSAYDC

SEQ ID NO: 1133648 - protein, 9 aa, Homo Sapiens
LYRSKLMPA

SEQ ID NO: 1133649 - protein, 9 aa, Homo Sapiens
TFATIRMSS

SEQ ID NO: 1133650 - protein, 9 aa, Homo Sapiens
TECVRTALN

SEQ ID NO: 1133651 - protein, 9 aa, Homo Sapiens
GCILPFLAC

SEQ ID NO: 1133652 - protein, 9 aa, Homo Sapiens
NLMVLDSPC

SEQ ID NO: 1133653 - protein, 9 aa, Homo Sapiens
HDSAQLLTD

SEQ ID NO: 1133654 - protein, 9 aa, Homo Sapiens
WKRSLLLLP

SEQ ID NO: 1133655 - protein, 9 aa, Homo Sapiens
NRALQPLWE

SEQ ID NO: 1133656 - protein, 9 aa, Homo Sapiens
ARIRSTRSG

SEQ ID NO: 1133657 - protein, 9 aa, Homo Sapiens
SSKALKPQL

SEQ ID NO: 1133658 - protein, 9 aa, Homo Sapiens
KEVFMLHIQ

SEQ ID NO: 1133659 - protein, 9 aa, Homo Sapiens
SEVVMEMAN

SEQ ID NO: 1133660 - protein, 9 aa, Homo Sapiens
LLSAGEDTL

SEQ ID NO: 1133661 - protein, 9 aa, Homo Sapiens
RKSHDNVQL

SEQ ID NO: 1133662 - protein, 9 aa, Homo Sapiens
TPMWWLIGA

SEQ ID NO: 1133663 - protein, 9 aa, Homo Sapiens
KDSFISNNE

SEQ ID NO: 1133664 - protein, 9 aa, Homo Sapiens
FLSLENMHS

SEQ ID NO: 1133665 - protein, 9 aa, Homo Sapiens
RGGRGAHGA

SEQ ID NO: 1133666 - protein, 9 aa, Homo Sapiens
VEAWFNEKS

SEQ ID NO: 1133667 - protein, 9 aa, Homo Sapiens
SASRPTSSH

SEQ ID NO: 1133668 - protein, 9 aa, Homo Sapiens
KDPVVPQNM

SEQ ID NO: 1133669 - protein, 9 aa, Homo Sapiens
APHPRPAPE

SEQ ID NO: 1133670 - protein, 9 aa, Homo Sapiens
RNTLFTRFA

SEQ ID NO: 1133671 - protein, 9 aa, Homo Sapiens
TRPAPYGIT

SEQ ID NO: 1133672 - protein, 9 aa, Homo Sapiens
LRNGIKGGL

SEQ ID NO: 1133673 - protein, 9 aa, Homo Sapiens
TPIYQVLGF

SEQ ID NO: 1133674 - protein, 9 aa, Homo Sapiens
CLIGSWKMH

SEQ ID NO: 1133675 - protein, 9 aa, Homo Sapiens
FLASTRPSG

SEQ ID NO: 1133676 - protein, 9 aa, Homo Sapiens
EDDNDVAAI

SEQ ID NO: 1133677 - protein, 9 aa, Homo Sapiens
PPLSSSPTS

SEQ ID NO: 1133678 - protein, 9 aa, Homo Sapiens
SPAVPIRAA

SEQ ID NO: 1133679 - protein, 9 aa, Homo Sapiens
STKSPAALK

SEQ ID NO: 1133680 - protein, 9 aa, Homo Sapiens
SIEVTCKSA

SEQ ID NO: 1133681 - protein, 9 aa, Homo Sapiens
HAAHTIQTA

SEQ ID NO: 1133682 - protein, 9 aa, Homo Sapiens
NDYDELVAI

SEQ ID NO: 1133683 - protein, 9 aa, Homo Sapiens
VHVGQVLHA

SEQ ID NO: 1133684 - protein, 9 aa, Homo Sapiens
LARPRLPRH

SEQ ID NO: 1133685 - protein, 9 aa, Homo Sapiens
LMSLGNSRH

SEQ ID NO: 1133686 - protein, 9 aa, Homo Sapiens
AQDIQQSLE

SEQ ID NO: 1133687 - protein, 9 aa, Homo Sapiens
HMCLAKNPI

SEQ ID NO: 1133688 - protein, 9 aa, Homo Sapiens
KTVDTIKRP

SEQ ID NO: 1133689 - protein, 9 aa, Homo Sapiens
TTCWPSVVT

SEQ ID NO: 1133690 - protein, 9 aa, Homo Sapiens
VFFLVSTMK

SEQ ID NO: 1133691 - protein, 9 aa, Homo Sapiens
GLVHQGDVG

SEQ ID NO: 1133692 - protein, 9 aa, Homo Sapiens
VKPPRCCPC

SEQ ID NO: 1133693 - protein, 9 aa, Homo Sapiens
APRPTHPLC

SEQ ID NO: 1133694 - protein, 9 aa, Homo Sapiens
ALKSRKLTK

SEQ ID NO: 1133695 - protein, 9 aa, Homo Sapiens
KSTKATKFE

SEQ ID NO: 1133696 - protein, 9 aa, Homo Sapiens
LFEDPLFPS

SEQ ID NO: 1133697 - protein, 9 aa, Homo Sapiens
TEAFTKSVE

SEQ ID NO: 1133698 - protein, 9 aa, Homo Sapiens
NMYHLPATQ

SEQ ID NO: 1133699 - protein, 9 aa, Homo Sapiens
YVKWHLTIM

SEQ ID NO: 1133700 - protein, 9 aa, Homo Sapiens
SSSQVPVQT

SEQ ID NO: 1133701 - protein, 9 aa, Homo Sapiens
NGLHPNYLN

SEQ ID NO: 1133702 - protein, 9 aa, Homo Sapiens
CLPTCSTDS

SEQ ID NO: 1133703 - protein, 9 aa, Homo Sapiens
VMSFDHYTA

SEQ ID NO: 1133704 - protein, 9 aa, Homo Sapiens
HLPQMETLV

SEQ ID NO: 1133705 - protein, 9 aa, Homo Sapiens
TAKRKIKEK

SEQ ID NO: 1133706 - protein, 9 aa, Homo Sapiens
LPHLRKFSS

SEQ ID NO: 1133707 - protein, 9 aa, Homo Sapiens
VSFFIANTK

SEQ ID NO: 1133708 - protein, 9 aa, Homo Sapiens
PPSLARRPL

SEQ ID NO: 1133709 - protein, 9 aa, Homo Sapiens
ICELRPHGG

SEQ ID NO: 1133710 - protein, 9 aa, Homo Sapiens
RYPHNRTLN

SEQ ID NO: 1133711 - protein, 9 aa, Homo Sapiens
VTLAVQPHL

SEQ ID NO: 1133712 - protein, 9 aa, Homo Sapiens
RMTTLNEEL

SEQ ID NO: 1133713 - protein, 9 aa, Homo Sapiens
LPGQVCSTI

SEQ ID NO: 1133714 - protein, 9 aa, Homo Sapiens
ELNISESLH

SEQ ID NO: 1133715 - protein, 9 aa, Homo Sapiens
KPATPSPAL

SEQ ID NO: 1133716 - protein, 9 aa, Homo Sapiens
ERRCNSINR

SEQ ID NO: 1133717 - protein, 9 aa, Homo Sapiens
NTFWYGILK

SEQ ID NO: 1133718 - protein, 9 aa, Homo Sapiens
KKEGSGAAT

SEQ ID NO: 1133719 - protein, 9 aa, Homo Sapiens
SHSHSTTRV

SEQ ID NO: 1133720 - protein, 9 aa, Homo Sapiens
YQKVCHRMN

SEQ ID NO: 1133721 - protein, 9 aa, Homo Sapiens
SGGGPSWRT

SEQ ID NO: 1133722 - protein, 9 aa, Homo Sapiens
SASVSFTYS

SEQ ID NO: 1133723 - protein, 9 aa, Homo Sapiens
SSCWPVLLP

SEQ ID NO: 1133724 - protein, 9 aa, Homo Sapiens
IWPLSTLQI

SEQ ID NO: 1133725 - protein, 9 aa, Homo Sapiens
DNSTDDADA

SEQ ID NO: 1133726 - protein, 9 aa, Homo Sapiens
YEAELLGCY

SEQ ID NO: 1133727 - protein, 9 aa, Homo Sapiens
CVKKSKQPL

SEQ ID NO: 1133728 - protein, 9 aa, Homo Sapiens
MASLRSPIT

SEQ ID NO: 1133729 - protein, 9 aa, Homo Sapiens
LIILGPVLF

SEQ ID NO: 1133730 - protein, 9 aa, Homo Sapiens
HVTSNLSAN

SEQ ID NO: 1133731 - protein, 9 aa, Homo Sapiens
KACLPLGAT

SEQ ID NO: 1133732 - protein, 9 aa, Homo Sapiens
FLGRALTAP

SEQ ID NO: 1133733 - protein, 9 aa, Homo Sapiens
HGAARSSSR

SEQ ID NO: 1133734 - protein, 9 aa, Homo Sapiens
LGGSCQHLR

SEQ ID NO: 1133735 - protein, 9 aa, Homo Sapiens
LFDYAYEAI

SEQ ID NO: 1133736 - protein, 9 aa, Homo Sapiens
VFQLQRIVS

SEQ ID NO: 1133737 - protein, 9 aa, Homo Sapiens
LPERHGLGK

SEQ ID NO: 1133738 - protein, 9 aa, Homo Sapiens
SEITGGPVN

SEQ ID NO: 1133739 - protein, 9 aa, Homo Sapiens
LNVSVADGK

SEQ ID NO: 1133740 - protein, 9 aa, Homo Sapiens
EPKCDFHFV

SEQ ID NO: 1133741 - protein, 9 aa, Homo Sapiens
MIVLTFSIV

SEQ ID NO: 1133742 - protein, 9 aa, Homo Sapiens
KLRLTYNHF

SEQ ID NO: 1133743 - protein, 9 aa, Homo Sapiens
LRQHEVTIC

SEQ ID NO: 1133744 - protein, 9 aa, Homo Sapiens
KPPRPLTGR

SEQ ID NO: 1133745 - protein, 9 aa, Homo Sapiens
GDPVKKAIC

SEQ ID NO: 1133746 - protein, 9 aa, Homo Sapiens
SGLWVWMPL

SEQ ID NO: 1133747 - protein, 9 aa, Homo Sapiens
ERQYSRQSC

SEQ ID NO: 1133748 - protein, 9 aa, Homo Sapiens
EVNYDDDED

SEQ ID NO: 1133749 - protein, 9 aa, Homo Sapiens
WLTYPPGGG

SEQ ID NO: 1133750 - protein, 9 aa, Homo Sapiens
TWLVFLAST

SEQ ID NO: 1133751 - protein, 9 aa, Homo Sapiens
RPWVRAKGP

SEQ ID NO: 1133752 - protein, 9 aa, Homo Sapiens
EFCTQGQLY

SEQ ID NO: 1133753 - protein, 9 aa, Homo Sapiens
GISEPPHVE

SEQ ID NO: 1133754 - protein, 9 aa, Homo Sapiens
KREMCASLY

SEQ ID NO: 1133755 - protein, 9 aa, Homo Sapiens
GLQVQDLSG

SEQ ID NO: 1133756 - protein, 9 aa, Homo Sapiens
QGPEEGDVC

SEQ ID NO: 1133757 - protein, 9 aa, Homo Sapiens
AEVATTPGI

SEQ ID NO: 1133758 - protein, 9 aa, Homo Sapiens
SPSAKGHSH

SEQ ID NO: 1133759 - protein, 9 aa, Homo Sapiens
LVLAHVPGR

SEQ ID NO: 1133760 - protein, 9 aa, Homo Sapiens
EAAVLVEHA

SEQ ID NO: 1133761 - protein, 9 aa, Homo Sapiens
EEKEQDANK

SEQ ID NO: 1133762 - protein, 9 aa, Homo Sapiens
IFPQLGVQY

SEQ ID NO: 1133763 - protein, 9 aa, Homo Sapiens
DEFNDVQSI

SEQ ID NO: 1133764 - protein, 9 aa, Homo Sapiens
TLRCPTEPL

SEQ ID NO: 1133765 - protein, 9 aa, Homo Sapiens
GADAAEAAT

SEQ ID NO: 1133766 - protein, 9 aa, Homo Sapiens
CRTFMPPGS

SEQ ID NO: 1133767 - protein, 9 aa, Homo Sapiens
NVSFILPNL

SEQ ID NO: 1133768 - protein, 9 aa, Homo Sapiens
ILCYEGEAD

SEQ ID NO: 1133769 - protein, 9 aa, Homo Sapiens
GTHVNVPFI

SEQ ID NO: 1133770 - protein, 9 aa, Homo Sapiens
FLTEDKKNG

SEQ ID NO: 1133771 - protein, 9 aa, Homo Sapiens
IMCDKFSGH

SEQ ID NO: 1133772 - protein, 9 aa, Homo Sapiens
ARPRLPRHC

SEQ ID NO: 1133773 - protein, 9 aa, Homo Sapiens
AKPVTPPAW

SEQ ID NO: 1133774 - protein, 9 aa, Homo Sapiens
LVEKNKWMN

SEQ ID NO: 1133775 - protein, 9 aa, Homo Sapiens
LTSTIEFYT

SEQ ID NO: 1133776 - protein, 9 aa, Homo Sapiens
SGNLSRGVS

SEQ ID NO: 1133777 - protein, 9 aa, Homo Sapiens
LKVKARAFR

SEQ ID NO: 1133778 - protein, 9 aa, Homo Sapiens
RDSIRAPRG

SEQ ID NO: 1133779 - protein, 9 aa, Homo Sapiens
IRYPHNRTL

SEQ ID NO: 1133780 - protein, 9 aa, Homo Sapiens
HGEPVLTAT

SEQ ID NO: 1133781 - protein, 9 aa, Homo Sapiens
CDFTEFCNG

SEQ ID NO: 1133782 - protein, 9 aa, Homo Sapiens
APCWAPAPG

SEQ ID NO: 1133783 - protein, 9 aa, Homo Sapiens
DFQSDIEGR

SEQ ID NO: 1133784 - protein, 9 aa, Homo Sapiens
VVRLTPAAN

SEQ ID NO: 1133785 - protein, 9 aa, Homo Sapiens
SNVNHKHGD

SEQ ID NO: 1133786 - protein, 9 aa, Homo Sapiens
QHKNREAFQ

SEQ ID NO: 1133787 - protein, 9 aa, Homo Sapiens
LFSQAQVSE

SEQ ID NO: 1133788 - protein, 9 aa, Homo Sapiens
DDNDVAAIH

SEQ ID NO: 1133789 - protein, 9 aa, Homo Sapiens
RTGQTRGRR

SEQ ID NO: 1133790 - protein, 9 aa, Homo Sapiens
SLPTQWGKS

SEQ ID NO: 1133791 - protein, 9 aa, Homo Sapiens
LHQLPRRPP

SEQ ID NO: 1133792 - protein, 9 aa, Homo Sapiens
LRPPWCATA

SEQ ID NO: 1133793 - protein, 9 aa, Homo Sapiens
ANRLAVDSN

SEQ ID NO: 1133794 - protein, 9 aa, Homo Sapiens
QENFNSQQK

SEQ ID NO: 1133795 - protein, 9 aa, Homo Sapiens
GVAQPASGE

SEQ ID NO: 1133796 - protein, 9 aa, Homo Sapiens
ATPGRPWPP

SEQ ID NO: 1133797 - protein, 9 aa, Homo Sapiens
PGVSTTSSQ

SEQ ID NO: 1133798 - protein, 9 aa, Homo Sapiens
SAQPQAMAN

SEQ ID NO: 1133799 - protein, 9 aa, Homo Sapiens
EYMEEEVLE

SEQ ID NO: 1133800 - protein, 9 aa, Homo Sapiens
QLVWYMGYD

SEQ ID NO: 1133801 - protein, 9 aa, Homo Sapiens
LLIFIYLPL

SEQ ID NO: 1133802 - protein, 9 aa, Homo Sapiens
SAFAKSQPN

SEQ ID NO: 1133803 - protein, 9 aa, Homo Sapiens
FSGLVGLFR

SEQ ID NO: 1133804 - protein, 9 aa, Homo Sapiens
DVRSLSKKE

SEQ ID NO: 1133805 - protein, 9 aa, Homo Sapiens
LWEDLRGGK

SEQ ID NO: 1133806 - protein, 9 aa, Homo Sapiens
HLSQCKTHT

SEQ ID NO: 1133807 - protein, 9 aa, Homo Sapiens
MSKNTAALS

SEQ ID NO: 1133808 - protein, 9 aa, Homo Sapiens
HLHPPGTQE

SEQ ID NO: 1133809 - protein, 9 aa, Homo Sapiens
PPAAGLPVT

SEQ ID NO: 1133810 - protein, 9 aa, Homo Sapiens
YAAWLSQDS

SEQ ID NO: 1133811 - protein, 9 aa, Homo Sapiens
LICMAMYLM

SEQ ID NO: 1133812 - protein, 9 aa, Homo Sapiens
KCLTILKAV

SEQ ID NO: 1133813 - protein, 9 aa, Homo Sapiens
SVHVLCRTH

SEQ ID NO: 1133814 - protein, 9 aa, Homo Sapiens
AFIILEKNP

SEQ ID NO: 1133815 - protein, 9 aa, Homo Sapiens
PIQFDPGMS

SEQ ID NO: 1133816 - protein, 9 aa, Homo Sapiens
NDIGEESSV

SEQ ID NO: 1133817 - protein, 9 aa, Homo Sapiens
EKPYECMVR

SEQ ID NO: 1133818 - protein, 9 aa, Homo Sapiens
NESDFYPTT

SEQ ID NO: 1133819 - protein, 9 aa, Homo Sapiens
PGPRRAWRA

SEQ ID NO: 1133820 - protein, 9 aa, Homo Sapiens
FEEEDVCEN

SEQ ID NO: 1133821 - protein, 9 aa, Homo Sapiens
NNLSSPDSY

SEQ ID NO: 1133822 - protein, 9 aa, Homo Sapiens
SAHDSTLLV

SEQ ID NO: 1133823 - protein, 9 aa, Homo Sapiens
KTFFALGRA

SEQ ID NO: 1133824 - protein, 9 aa, Homo Sapiens
AFLPPMHCP

SEQ ID NO: 1133825 - protein, 9 aa, Homo Sapiens
LPKELVQGP

SEQ ID NO: 1133826 - protein, 9 aa, Homo Sapiens
GALHEHGQR

SEQ ID NO: 1133827 - protein, 9 aa, Homo Sapiens
CPDGSHLGQ

SEQ ID NO: 1133828 - protein, 9 aa, Homo Sapiens
AAGGSQGAL

SEQ ID NO: 1133829 - protein, 9 aa, Homo Sapiens
SIKKGEIPS

SEQ ID NO: 1133830 - protein, 9 aa, Homo Sapiens
VRGPLPPYH

SEQ ID NO: 1133831 - protein, 9 aa, Homo Sapiens
PLAAPRSTP

SEQ ID NO: 1133832 - protein, 9 aa, Homo Sapiens
NGTGGESIH

SEQ ID NO: 1133833 - protein, 9 aa, Homo Sapiens
ISGGWCSPL

SEQ ID NO: 1133834 - protein, 9 aa, Homo Sapiens
SGMNSPAPK

SEQ ID NO: 1133835 - protein, 9 aa, Homo Sapiens
AELLALDSE

SEQ ID NO: 1133836 - protein, 9 aa, Homo Sapiens
YVSSLHDAM

SEQ ID NO: 1133837 - protein, 9 aa, Homo Sapiens
HIVNVTVIR

SEQ ID NO: 1133838 - protein, 9 aa, Homo Sapiens
KDQRDSLKI

SEQ ID NO: 1133839 - protein, 9 aa, Homo Sapiens
LYFCRYCNE

SEQ ID NO: 1133840 - protein, 9 aa, Homo Sapiens
DDYDHFSED

SEQ ID NO: 1133841 - protein, 9 aa, Homo Sapiens
TCPVHESPT

SEQ ID NO: 1133842 - protein, 9 aa, Homo Sapiens
PLEPTPAGS

SEQ ID NO: 1133843 - protein, 9 aa, Homo Sapiens
MELKDECLI

SEQ ID NO: 1133844 - protein, 9 aa, Homo Sapiens
SILWGVRHP

SEQ ID NO: 1133845 - protein, 9 aa, Homo Sapiens
FLPPMHCPT

SEQ ID NO: 1133846 - protein, 9 aa, Homo Sapiens
PLGLVLAMQ

SEQ ID NO: 1133847 - protein, 9 aa, Homo Sapiens
SWMRPCSEW

SEQ ID NO: 1133848 - protein, 9 aa, Homo Sapiens
LPYWRRTAH

SEQ ID NO: 1133849 - protein, 9 aa, Homo Sapiens
EKEEWHTAF

SEQ ID NO: 1133850 - protein, 9 aa, Homo Sapiens
CGASIRRTK

SEQ ID NO: 1133851 - protein, 9 aa, Homo Sapiens
HGVWVGAQE

SEQ ID NO: 1133852 - protein, 9 aa, Homo Sapiens
RDSPASPSA

SEQ ID NO: 1133853 - protein, 9 aa, Homo Sapiens
SQTLICKSQ

SEQ ID NO: 1133854 - protein, 9 aa, Homo Sapiens
FACFTWRTS

SEQ ID NO: 1133855 - protein, 9 aa, Homo Sapiens
KCIALRMVL

SEQ ID NO: 1133856 - protein, 9 aa, Homo Sapiens
GLVISTWNG

SEQ ID NO: 1133857 - protein, 9 aa, Homo Sapiens
SLSRSPASS

SEQ ID NO: 1133858 - protein, 9 aa, Homo Sapiens
LSCPYHPGH

SEQ ID NO: 1133859 - protein, 9 aa, Homo Sapiens
VYDQSMRDA

SEQ ID NO: 1133860 - protein, 9 aa, Homo Sapiens
TTTEGTTVG

SEQ ID NO: 1133861 - protein, 9 aa, Homo Sapiens
SSALLSYES

SEQ ID NO: 1133862 - protein, 9 aa, Homo Sapiens
VYSRCGHGE

SEQ ID NO: 1133863 - protein, 9 aa, Homo Sapiens
PGYSSKALK

SEQ ID NO: 1133864 - protein, 9 aa, Homo Sapiens
AVHAGILSR

SEQ ID NO: 1133865 - protein, 9 aa, Homo Sapiens
PTYRGLLCA

SEQ ID NO: 1133866 - protein, 9 aa, Homo Sapiens
PQPPLHQPP

SEQ ID NO: 1133867 - protein, 9 aa, Homo Sapiens
FDFQMNSTS

SEQ ID NO: 1133868 - protein, 9 aa, Homo Sapiens
NGTTMCYGQ

SEQ ID NO: 1133869 - protein, 9 aa, Homo Sapiens
FSGRILHQP

SEQ ID NO: 1133870 - protein, 9 aa, Homo Sapiens
KYTQKDQLE

SEQ ID NO: 1133871 - protein, 9 aa, Homo Sapiens
DAKVEIIRH

SEQ ID NO: 1133872 - protein, 9 aa, Homo Sapiens
HTMMLKDGQ

SEQ ID NO: 1133873 - protein, 9 aa, Homo Sapiens
TADDRLLCP

SEQ ID NO: 1133874 - protein, 9 aa, Homo Sapiens
PGAAMQGTG

SEQ ID NO: 1133875 - protein, 9 aa, Homo Sapiens
QSFLAAAHM

SEQ ID NO: 1133876 - protein, 9 aa, Homo Sapiens
GDEAVGGFF

SEQ ID NO: 1133877 - protein, 9 aa, Homo Sapiens
SCFWSIPLV

SEQ ID NO: 1133878 - protein, 9 aa, Homo Sapiens
PASATRAGW

SEQ ID NO: 1133879 - protein, 9 aa, Homo Sapiens
QKRTCKLRK

SEQ ID NO: 1133880 - protein, 9 aa, Homo Sapiens
KMDRPNGLH

SEQ ID NO: 1133881 - protein, 9 aa, Homo Sapiens
PSVSPASEK

SEQ ID NO: 1133882 - protein, 9 aa, Homo Sapiens
EEFITAVKA

SEQ ID NO: 1133883 - protein, 9 aa, Homo Sapiens
EGGKRSRCR

SEQ ID NO: 1133884 - protein, 9 aa, Homo Sapiens
GHILSNPEI

SEQ ID NO: 1133885 - protein, 9 aa, Homo Sapiens
SSDAFGMLA

SEQ ID NO: 1133886 - protein, 9 aa, Homo Sapiens
ILGSEALLD

SEQ ID NO: 1133887 - protein, 9 aa, Homo Sapiens
GHFGRSLKV

SEQ ID NO: 1133888 - protein, 9 aa, Homo Sapiens
FTVPNIDNV

SEQ ID NO: 1133889 - protein, 9 aa, Homo Sapiens
AGLTDYPEF

SEQ ID NO: 1133890 - protein, 9 aa, Homo Sapiens
RLQSRATPQ

SEQ ID NO: 1133891 - protein, 9 aa, Homo Sapiens
AGAWQYFMC

SEQ ID NO: 1133892 - protein, 9 aa, Homo Sapiens
PKAATLAVH

SEQ ID NO: 1133893 - protein, 9 aa, Homo Sapiens
GKLQSPPER

SEQ ID NO: 1133894 - protein, 9 aa, Homo Sapiens
LICKSQARH

SEQ ID NO: 1133895 - protein, 9 aa, Homo Sapiens
PHSIRNTSY

SEQ ID NO: 1133896 - protein, 9 aa, Homo Sapiens
RWLDREERD

SEQ ID NO: 1133897 - protein, 9 aa, Homo Sapiens
LTVHHRFHH

SEQ ID NO: 1133898 - protein, 9 aa, Homo Sapiens
GWIITISLL

SEQ ID NO: 1133899 - protein, 9 aa, Homo Sapiens
ELGRPLYFW

SEQ ID NO: 1133900 - protein, 9 aa, Homo Sapiens
LTHVMGKTK

SEQ ID NO: 1133901 - protein, 9 aa, Homo Sapiens
CDILKCHNS

SEQ ID NO: 1133902 - protein, 9 aa, Homo Sapiens
LLEEARRKA

SEQ ID NO: 1133903 - protein, 9 aa, Homo Sapiens
GSRGGSDRT

SEQ ID NO: 1133904 - protein, 9 aa, Homo Sapiens
MGHFGRSLK

SEQ ID NO: 1133905 - protein, 9 aa, Homo Sapiens
KIRKIPDCF

SEQ ID NO: 1133906 - protein, 9 aa, Homo Sapiens
LALSDTEQS

SEQ ID NO: 1133907 - protein, 9 aa, Homo Sapiens
CLALFLARK

SEQ ID NO: 1133908 - protein, 9 aa, Homo Sapiens
SEAVQWSNH

SEQ ID NO: 1133909 - protein, 9 aa, Homo Sapiens
PMGMCGFKG

SEQ ID NO: 1133910 - protein, 9 aa, Homo Sapiens
INPSTFYIY

SEQ ID NO: 1133911 - protein, 9 aa, Homo Sapiens
DQHNGEKSQ

SEQ ID NO: 1133912 - protein, 9 aa, Homo Sapiens
RLVVDVDCL

SEQ ID NO: 1133913 - protein, 9 aa, Homo Sapiens
EQDKEKEQE

SEQ ID NO: 1133914 - protein, 9 aa, Homo Sapiens
VSSIKWSPS

SEQ ID NO: 1133915 - protein, 9 aa, Homo Sapiens
EDEEQNQEH

SEQ ID NO: 1133916 - protein, 9 aa, Homo Sapiens
WALSDMAVL

SEQ ID NO: 1133917 - protein, 9 aa, Homo Sapiens
TRPLARILT

SEQ ID NO: 1133918 - protein, 9 aa, Homo Sapiens
DLDGMLTVI

SEQ ID NO: 1133919 - protein, 9 aa, Homo Sapiens
ALPPSLWAL

SEQ ID NO: 1133920 - protein, 9 aa, Homo Sapiens
PEPGLRSMV

SEQ ID NO: 1133921 - protein, 9 aa, Homo Sapiens
ITPVWLHAR

SEQ ID NO: 1133922 - protein, 9 aa, Homo Sapiens
GPGHHQRRA

SEQ ID NO: 1133923 - protein, 9 aa, Homo Sapiens
DVLLNMCQD

SEQ ID NO: 1133924 - protein, 9 aa, Homo Sapiens
GHVQLLSRA

SEQ ID NO: 1133925 - protein, 9 aa, Homo Sapiens
ELHRSYVRT

SEQ ID NO: 1133926 - protein, 9 aa, Homo Sapiens
LQSPVTGEV

SEQ ID NO: 1133927 - protein, 9 aa, Homo Sapiens
LLRGSVRRA

SEQ ID NO: 1133928 - protein, 9 aa, Homo Sapiens
RILHRAVRY

SEQ ID NO: 1133929 - protein, 9 aa, Homo Sapiens
VTRGTSRAR

SEQ ID NO: 1133930 - protein, 9 aa, Homo Sapiens
LRFGKRVAL

SEQ ID NO: 1133931 - protein, 9 aa, Homo Sapiens
FQTSLLRIL

SEQ ID NO: 1133932 - protein, 9 aa, Homo Sapiens
VGIGCEQDI

SEQ ID NO: 1133933 - protein, 9 aa, Homo Sapiens
QISAEKQYR

SEQ ID NO: 1133934 - protein, 9 aa, Homo Sapiens
AGRHRLCRG

SEQ ID NO: 1133935 - protein, 9 aa, Homo Sapiens
HAVHMKEYP

SEQ ID NO: 1133936 - protein, 8 aa, Homo Sapiens
SKRLRSSE

SEQ ID NO: 1133937 - protein, 9 aa, Homo Sapiens
RKKRQRESE

SEQ ID NO: 1133938 - protein, 9 aa, Homo Sapiens
LAQAGLAHV

SEQ ID NO: 1133939 - protein, 9 aa, Homo Sapiens
NPLNCTHLG

SEQ ID NO: 1133940 - protein, 9 aa, Homo Sapiens
QPTQALTQS

SEQ ID NO: 1133941 - protein, 9 aa, Homo Sapiens
PITSIKSGL

SEQ ID NO: 1133942 - protein, 9 aa, Homo Sapiens
SSRYEYLSH

SEQ ID NO: 1133943 - protein, 9 aa, Homo Sapiens
LSKKERKVT

SEQ ID NO: 1133944 - protein, 9 aa, Homo Sapiens
NPKNHYEES

SEQ ID NO: 1133945 - protein, 9 aa, Homo Sapiens
DRANMHNLL

SEQ ID NO: 1133946 - protein, 9 aa, Homo Sapiens
AGRNKSGCK

SEQ ID NO: 1133947 - protein, 9 aa, Homo Sapiens
SSLRMTPTC

SEQ ID NO: 1133948 - protein, 9 aa, Homo Sapiens
ETCTDLLSH

SEQ ID NO: 1133949 - protein, 9 aa, Homo Sapiens
GAHFIAQDP

SEQ ID NO: 1133950 - protein, 9 aa, Homo Sapiens
PTILDIEKI

SEQ ID NO: 1133951 - protein, 9 aa, Homo Sapiens
PRRPLRRLG

SEQ ID NO: 1133952 - protein, 9 aa, Homo Sapiens
RCQPRMKPA

SEQ ID NO: 1133953 - protein, 9 aa, Homo Sapiens
HKAELAACS

SEQ ID NO: 1133954 - protein, 9 aa, Homo Sapiens
TRSKDESTD

SEQ ID NO: 1133955 - protein, 9 aa, Homo Sapiens
NTYGRTAGQ

SEQ ID NO: 1133956 - protein, 9 aa, Homo Sapiens
SSCTPGLCP

SEQ ID NO: 1133957 - protein, 9 aa, Homo Sapiens
KQGHLLYRI

SEQ ID NO: 1133958 - protein, 9 aa, Homo Sapiens
PLVLNSPQG

SEQ ID NO: 1133959 - protein, 9 aa, Homo Sapiens
MATQACSHG

SEQ ID NO: 1133960 - protein, 9 aa, Homo Sapiens
HKRSMVDSL

SEQ ID NO: 1133961 - protein, 9 aa, Homo Sapiens
VPKRVQRER

SEQ ID NO: 1133962 - protein, 9 aa, Homo Sapiens
SPSPATSVE

SEQ ID NO: 1133963 - protein, 9 aa, Homo Sapiens
QEVYCHMRK

SEQ ID NO: 1133964 - protein, 9 aa, Homo Sapiens
IVVKIESIM

SEQ ID NO: 1133965 - protein, 9 aa, Homo Sapiens
EESCTLICQ

SEQ ID NO: 1133966 - protein, 9 aa, Homo Sapiens
VDSPKNSNI

SEQ ID NO: 1133967 - protein, 9 aa, Homo Sapiens
EGPDYSVDV

SEQ ID NO: 1133968 - protein, 9 aa, Homo Sapiens
HDGDGPPTT

SEQ ID NO: 1133969 - protein, 9 aa, Homo Sapiens
LEYSALIVG

SEQ ID NO: 1133970 - protein, 9 aa, Homo Sapiens
FLGVAEGSV

SEQ ID NO: 1133971 - protein, 9 aa, Homo Sapiens
EQQSFFVVV

SEQ ID NO: 1133972 - protein, 9 aa, Homo Sapiens
SPLFPWKLP

SEQ ID NO: 1133973 - protein, 9 aa, Homo Sapiens
PLPPATPPP

SEQ ID NO: 1133974 - protein, 9 aa, Homo Sapiens
TGWFAIQTD

SEQ ID NO: 1133975 - protein, 9 aa, Homo Sapiens
ALMECLAPL

SEQ ID NO: 1133976 - protein, 9 aa, Homo Sapiens
RLKKEKKNQ

SEQ ID NO: 1133977 - protein, 9 aa, Homo Sapiens
CCAKPCPGT

SEQ ID NO: 1133978 - protein, 9 aa, Homo Sapiens
VVLRLSCPY

SEQ ID NO: 1133979 - protein, 9 aa, Homo Sapiens
VVGLTMVYA

SEQ ID NO: 1133980 - protein, 9 aa, Homo Sapiens
PYHTIDASL

SEQ ID NO: 1133981 - protein, 9 aa, Homo Sapiens
RCDLSSAAN

SEQ ID NO: 1133982 - protein, 9 aa, Homo Sapiens
LNDAQDITV

SEQ ID NO: 1133983 - protein, 9 aa, Homo Sapiens
LLEKVSKKR

SEQ ID NO: 1133984 - protein, 9 aa, Homo Sapiens
ISAQPSSGT

SEQ ID NO: 1133985 - protein, 9 aa, Homo Sapiens
LEELCPMGS

SEQ ID NO: 1133986 - protein, 9 aa, Homo Sapiens
LGNDGSMDA

SEQ ID NO: 1133987 - protein, 9 aa, Homo Sapiens
WHLDIFRRG

SEQ ID NO: 1133988 - protein, 9 aa, Homo Sapiens
ATPPPRHPW

SEQ ID NO: 1133989 - protein, 9 aa, Homo Sapiens
SHLALPSLP

SEQ ID NO: 1133990 - protein, 9 aa, Homo Sapiens
NVELSLGCE

SEQ ID NO: 1133991 - protein, 9 aa, Homo Sapiens
AQEGTCTCI

SEQ ID NO: 1133992 - protein, 9 aa, Homo Sapiens
LGAKVGVIE

SEQ ID NO: 1133993 - protein, 9 aa, Homo Sapiens
EYPTLKFFL

SEQ ID NO: 1133994 - protein, 9 aa, Homo Sapiens
LGNFLCLST

SEQ ID NO: 1133995 - protein, 9 aa, Homo Sapiens
RHKHPVPAK

SEQ ID NO: 1133996 - protein, 9 aa, Homo Sapiens
CDCGDTEAR

SEQ ID NO: 1133997 - protein, 9 aa, Homo Sapiens
HKHILHTGK

SEQ ID NO: 1133998 - protein, 9 aa, Homo Sapiens
VLKWGEELG

SEQ ID NO: 1133999 - protein, 9 aa, Homo Sapiens
DMLPQKFWG

SEQ ID NO: 1134000 - protein, 9 aa, Homo Sapiens
LTLCPRDSR

SEQ ID NO: 1134001 - protein, 9 aa, Homo Sapiens
EEEEEEECA

SEQ ID NO: 1134002 - protein, 9 aa, Homo Sapiens
AKILIIGGG

SEQ ID NO: 1134003 - protein, 9 aa, Homo Sapiens
IALRIDGAV

SEQ ID NO: 1134004 - protein, 9 aa, Homo Sapiens
HPVPAKRYD

SEQ ID NO: 1134005 - protein, 9 aa, Homo Sapiens
NCMEKIVNS

SEQ ID NO: 1134006 - protein, 9 aa, Homo Sapiens
QLRAPELVL

SEQ ID NO: 1134007 - protein, 9 aa, Homo Sapiens
ALRFGKRVA

SEQ ID NO: 1134008 - protein, 9 aa, Homo Sapiens
CWPVLLPGH

SEQ ID NO: 1134009 - protein, 9 aa, Homo Sapiens
RAGPRCHRR

SEQ ID NO: 1134010 - protein, 9 aa, Homo Sapiens
MDKPQKAVL

SEQ ID NO: 1134011 - protein, 9 aa, Homo Sapiens
YTTKGLCLE

SEQ ID NO: 1134012 - protein, 9 aa, Homo Sapiens
TVATALPGH

SEQ ID NO: 1134013 - protein, 9 aa, Homo Sapiens
LAPLGNAHA

SEQ ID NO: 1134014 - protein, 9 aa, Homo Sapiens
QVAVGLRNG

SEQ ID NO: 1134015 - protein, 9 aa, Homo Sapiens
RYSSSSGGG

SEQ ID NO: 1134016 - protein, 9 aa, Homo Sapiens
GAFIDLPLA

SEQ ID NO: 1134017 - protein, 9 aa, Homo Sapiens
CFPKNLVAC

SEQ ID NO: 1134018 - protein, 9 aa, Homo Sapiens
TPLSSHGSD

SEQ ID NO: 1134019 - protein, 9 aa, Homo Sapiens
TPAGSSTLS

SEQ ID NO: 1134020 - protein, 9 aa, Homo Sapiens
KFNIMVVGQ

SEQ ID NO: 1134021 - protein, 9 aa, Homo Sapiens
GQRLTLMAE

SEQ ID NO: 1134022 - protein, 9 aa, Homo Sapiens
HKTCPSPQE

SEQ ID NO: 1134023 - protein, 9 aa, Homo Sapiens
VSDTVTLPA

SEQ ID NO: 1134024 - protein, 9 aa, Homo Sapiens
EFNDVQSIK

SEQ ID NO: 1134025 - protein, 9 aa, Homo Sapiens
RRRCWHRRL

SEQ ID NO: 1134026 - protein, 9 aa, Homo Sapiens
IWCPQSASR

SEQ ID NO: 1134027 - protein, 9 aa, Homo Sapiens
QLPRRPPGP

SEQ ID NO: 1134028 - protein, 9 aa, Homo Sapiens
LVMCLRLRT

SEQ ID NO: 1134029 - protein, 9 aa, Homo Sapiens
ETRKIAVPA

SEQ ID NO: 1134030 - protein, 9 aa, Homo Sapiens
NTANVASRM

SEQ ID NO: 1134031 - protein, 9 aa, Homo Sapiens
ILRDLLHFL

SEQ ID NO: 1134032 - protein, 9 aa, Homo Sapiens
QADSRLHII

SEQ ID NO: 1134033 - protein, 9 aa, Homo Sapiens
AAPVRCSRP

SEQ ID NO: 1134034 - protein, 9 aa, Homo Sapiens
KQPAPKLEP

SEQ ID NO: 1134035 - protein, 9 aa, Homo Sapiens
QQGMPAFSF

SEQ ID NO: 1134036 - protein, 9 aa, Homo Sapiens
LAAPRSTPK

SEQ ID NO: 1134037 - protein, 9 aa, Homo Sapiens
HLPFIEIRI

SEQ ID NO: 1134038 - protein, 9 aa, Homo Sapiens
IRLYYTVKL

SEQ ID NO: 1134039 - protein, 9 aa, Homo Sapiens
SLKILTTKN

SEQ ID NO: 1134040 - protein, 9 aa, Homo Sapiens
VCCLPTCST

SEQ ID NO: 1134041 - protein, 9 aa, Homo Sapiens
PLPPTPGRP

SEQ ID NO: 1134042 - protein, 9 aa, Homo Sapiens
LSWEYCRLD

SEQ ID NO: 1134043 - protein, 9 aa, Homo Sapiens
TTAAGASGW

SEQ ID NO: 1134044 - protein, 9 aa, Homo Sapiens
AGSRGGSDR

SEQ ID NO: 1134045 - protein, 9 aa, Homo Sapiens
MLTHSIMLR

SEQ ID NO: 1134046 - protein, 9 aa, Homo Sapiens
KKRKKWRHR

SEQ ID NO: 1134047 - protein, 9 aa, Homo Sapiens
TPLSISRPT

SEQ ID NO: 1134048 - protein, 9 aa, Homo Sapiens
MVYAFCTLP

SEQ ID NO: 1134049 - protein, 9 aa, Homo Sapiens
PSERRRFFR

SEQ ID NO: 1134050 - protein, 9 aa, Homo Sapiens
KYIKEKSLG

SEQ ID NO: 1134051 - protein, 9 aa, Homo Sapiens
FQMKFYFRF

SEQ ID NO: 1134052 - protein, 9 aa, Homo Sapiens
HDGSLHVEP

SEQ ID NO: 1134053 - protein, 9 aa, Homo Sapiens
HPGEDERVA

SEQ ID NO: 1134054 - protein, 9 aa, Homo Sapiens
YLRTSGEPW

SEQ ID NO: 1134055 - protein, 9 aa, Homo Sapiens
HRERPLRLP

SEQ ID NO: 1134056 - protein, 9 aa, Homo Sapiens
DATHAERIE

SEQ ID NO: 1134057 - protein, 9 aa, Homo Sapiens
ASLPGSSAT

SEQ ID NO: 1134058 - protein, 9 aa, Homo Sapiens
DSWPTRRST

SEQ ID NO: 1134059 - protein, 9 aa, Homo Sapiens
SRQSCSPSP

SEQ ID NO: 1134060 - protein, 9 aa, Homo Sapiens
LAVECAGRH

SEQ ID NO: 1134061 - protein, 9 aa, Homo Sapiens
NGNDVEGVS

SEQ ID NO: 1134062 - protein, 9 aa, Homo Sapiens
PRVMEEVLK

SEQ ID NO: 1134063 - protein, 9 aa, Homo Sapiens
MVKPGMHYL

SEQ ID NO: 1134064 - protein, 9 aa, Homo Sapiens
IWNQWLSCP

SEQ ID NO: 1134065 - protein, 9 aa, Homo Sapiens
TTEVHKRAI

SEQ ID NO: 1134066 - protein, 9 aa, Homo Sapiens
HLFSLHVLI

SEQ ID NO: 1134067 - protein, 9 aa, Homo Sapiens
LPKVPAVPR

SEQ ID NO: 1134068 - protein, 9 aa, Homo Sapiens
VVVIEYSTE

SEQ ID NO: 1134069 - protein, 9 aa, Homo Sapiens
DREPDTSNS

SEQ ID NO: 1134070 - protein, 9 aa, Homo Sapiens
IIDICPVGV

SEQ ID NO: 1134071 - protein, 9 aa, Homo Sapiens
RGVYKGIVL

SEQ ID NO: 1134072 - protein, 9 aa, Homo Sapiens
IAFQLTPYS

SEQ ID NO: 1134073 - protein, 9 aa, Homo Sapiens
SSYAPSSSN

SEQ ID NO: 1134074 - protein, 9 aa, Homo Sapiens
SPGRRDPQD

SEQ ID NO: 1134075 - protein, 9 aa, Homo Sapiens
WWRTRACTP

SEQ ID NO: 1134076 - protein, 9 aa, Homo Sapiens
APELVLVRF

SEQ ID NO: 1134077 - protein, 9 aa, Homo Sapiens
YLQERRTVP

SEQ ID NO: 1134078 - protein, 9 aa, Homo Sapiens
PASRAAVST

SEQ ID NO: 1134079 - protein, 9 aa, Homo Sapiens
HTSLEEDAE

SEQ ID NO: 1134080 - protein, 9 aa, Homo Sapiens
SNLSEDEDL

SEQ ID NO: 1134081 - protein, 9 aa, Homo Sapiens
VAFQFQCSL

SEQ ID NO: 1134082 - protein, 9 aa, Homo Sapiens
ADECDDDQA

SEQ ID NO: 1134083 - protein, 9 aa, Homo Sapiens
LPVSPSCPR

SEQ ID NO: 1134084 - protein, 9 aa, Homo Sapiens
CTADCGGHG

SEQ ID NO: 1134085 - protein, 9 aa, Homo Sapiens
PRLLPLIHP

SEQ ID NO: 1134086 - protein, 9 aa, Homo Sapiens
SVNLFVVNR

SEQ ID NO: 1134087 - protein, 9 aa, Homo Sapiens
GPLPMLTGC

SEQ ID NO: 1134088 - protein, 9 aa, Homo Sapiens
VLCTLQPRG

SEQ ID NO: 1134089 - protein, 9 aa, Homo Sapiens
QTPPGAVLD

SEQ ID NO: 1134090 - protein, 9 aa, Homo Sapiens
KSQSEKHRI

SEQ ID NO: 1134091 - protein, 9 aa, Homo Sapiens
GSNGQSPFH

SEQ ID NO: 1134092 - protein, 9 aa, Homo Sapiens
EAVVAAAAT

SEQ ID NO: 1134093 - protein, 9 aa, Homo Sapiens
HIHACQASG

SEQ ID NO: 1134094 - protein, 9 aa, Homo Sapiens
REAPAAARS

SEQ ID NO: 1134095 - protein, 9 aa, Homo Sapiens
FCTGYSDGS

SEQ ID NO: 1134096 - protein, 9 aa, Homo Sapiens
VSFTYSLSV

SEQ ID NO: 1134097 - protein, 9 aa, Homo Sapiens
FCIDLWLKN

SEQ ID NO: 1134098 - protein, 9 aa, Homo Sapiens
PRAAIWRRI

SEQ ID NO: 1134099 - protein, 9 aa, Homo Sapiens
LPFLACDWL

SEQ ID NO: 1134100 - protein, 9 aa, Homo Sapiens
VIINGLSVV

SEQ ID NO: 1134101 - protein, 9 aa, Homo Sapiens
ERLYCQFSE

SEQ ID NO: 1134102 - protein, 9 aa, Homo Sapiens
TTFTRHSLK

SEQ ID NO: 1134103 - protein, 9 aa, Homo Sapiens
LQKAVEESH

SEQ ID NO: 1134104 - protein, 9 aa, Homo Sapiens
FLLLQSVDQ

SEQ ID NO: 1134105 - protein, 9 aa, Homo Sapiens
MESAKPVTP

SEQ ID NO: 1134106 - protein, 9 aa, Homo Sapiens
HFIAQDPYD

SEQ ID NO: 1134107 - protein, 9 aa, Homo Sapiens
MEEFVRQYK

SEQ ID NO: 1134108 - protein, 9 aa, Homo Sapiens
DPQDGCNDG

SEQ ID NO: 1134109 - protein, 9 aa, Homo Sapiens
RIGELSGDN

SEQ ID NO: 1134110 - protein, 9 aa, Homo Sapiens
KASRGSRAE

SEQ ID NO: 1134111 - protein, 9 aa, Homo Sapiens
GSLTLHSVT

SEQ ID NO: 1134112 - protein, 9 aa, Homo Sapiens
DLALTFLQY

SEQ ID NO: 1134113 - protein, 9 aa, Homo Sapiens
HLGRLLLCH

SEQ ID NO: 1134114 - protein, 9 aa, Homo Sapiens
GGWCSPLFP

SEQ ID NO: 1134115 - protein, 9 aa, Homo Sapiens
PTSERLTRS

SEQ ID NO: 1134116 - protein, 9 aa, Homo Sapiens
SETTAAAIM

SEQ ID NO: 1134117 - protein, 9 aa, Homo Sapiens
KIVFSVCNT

SEQ ID NO: 1134118 - protein, 9 aa, Homo Sapiens
IGRLMNRSI

SEQ ID NO: 1134119 - protein, 9 aa, Homo Sapiens
STSTRCRWA

SEQ ID NO: 1134120 - protein, 9 aa, Homo Sapiens
LSPVKMSTK

SEQ ID NO: 1134121 - protein, 9 aa, Homo Sapiens
RLSPVKMST

SEQ ID NO: 1134122 - protein, 9 aa, Homo Sapiens
PSCQQIAST

SEQ ID NO: 1134123 - protein, 9 aa, Homo Sapiens
YDGNEKIYE

SEQ ID NO: 1134124 - protein, 9 aa, Homo Sapiens
FVQSVIARC

SEQ ID NO: 1134125 - protein, 9 aa, Homo Sapiens
HCPTATAAC

SEQ ID NO: 1134126 - protein, 9 aa, Homo Sapiens
FCTQGQLYE

SEQ ID NO: 1134127 - protein, 9 aa, Homo Sapiens
RTGCRPRSR

SEQ ID NO: 1134128 - protein, 9 aa, Homo Sapiens
HASVYHITY

SEQ ID NO: 1134129 - protein, 9 aa, Homo Sapiens
NSSPTSTPA

SEQ ID NO: 1134130 - protein, 9 aa, Homo Sapiens
GLGFCLLAV

SEQ ID NO: 1134131 - protein, 9 aa, Homo Sapiens
GSESIGRSG

SEQ ID NO: 1134132 - protein, 9 aa, Homo Sapiens
YFLERNACL

SEQ ID NO: 1134133 - protein, 9 aa, Homo Sapiens
GVSETEVAL

SEQ ID NO: 1134134 - protein, 9 aa, Homo Sapiens
GSSTASAAT

SEQ ID NO: 1134135 - protein, 9 aa, Homo Sapiens
ETAGAWQYF

SEQ ID NO: 1134136 - protein, 9 aa, Homo Sapiens
DELTRYFRK

SEQ ID NO: 1134137 - protein, 9 aa, Homo Sapiens
KEFSRGKTR

SEQ ID NO: 1134138 - protein, 9 aa, Homo Sapiens
LTIMKRKPM

SEQ ID NO: 1134139 - protein, 9 aa, Homo Sapiens
ICSVTSGAS

SEQ ID NO: 1134140 - protein, 9 aa, Homo Sapiens
AGISTAVSI

SEQ ID NO: 1134141 - protein, 9 aa, Homo Sapiens
DYSGKKPPS

SEQ ID NO: 1134142 - protein, 9 aa, Homo Sapiens
QMWWRRQHL

SEQ ID NO: 1134143 - protein, 9 aa, Homo Sapiens
RTSGLGKNP

SEQ ID NO: 1134144 - protein, 9 aa, Homo Sapiens
VGHPKSDLP

SEQ ID NO: 1134145 - protein, 9 aa, Homo Sapiens
LGQYVQAFC

SEQ ID NO: 1134146 - protein, 9 aa, Homo Sapiens
EHYAEQLKE

SEQ ID NO: 1134147 - protein, 9 aa, Homo Sapiens
TGRSSRCAS

SEQ ID NO: 1134148 - protein, 9 aa, Homo Sapiens
YIYPNIAMG

SEQ ID NO: 1134149 - protein, 9 aa, Homo Sapiens
NLQVQGKFQ

SEQ ID NO: 1134150 - protein, 9 aa, Homo Sapiens
ETDLALTFL

SEQ ID NO: 1134151 - protein, 9 aa, Homo Sapiens
KASRAGGTR

SEQ ID NO: 1134152 - protein, 9 aa, Homo Sapiens
SKEFTRRRR

SEQ ID NO: 1134153 - protein, 9 aa, Homo Sapiens
VKSKQYVKT

SEQ ID NO: 1134154 - protein, 9 aa, Homo Sapiens
PSLALLRGS

SEQ ID NO: 1134155 - protein, 9 aa, Homo Sapiens
LTEDKKNGI

SEQ ID NO: 1134156 - protein, 9 aa, Homo Sapiens
VFGPARIRS

SEQ ID NO: 1134157 - protein, 9 aa, Homo Sapiens
LEQVHQKLL

SEQ ID NO: 1134158 - protein, 9 aa, Homo Sapiens
FDSPVRNQA

SEQ ID NO: 1134159 - protein, 9 aa, Homo Sapiens
SQPPLTATW

SEQ ID NO: 1134160 - protein, 9 aa, Homo Sapiens
GASRSGRNA

SEQ ID NO: 1134161 - protein, 9 aa, Homo Sapiens
EIGQVPTLL

SEQ ID NO: 1134162 - protein, 9 aa, Homo Sapiens
SPTPTPLSA

SEQ ID NO: 1134163 - protein, 9 aa, Homo Sapiens
VQPHLLDIL

SEQ ID NO: 1134164 - protein, 9 aa, Homo Sapiens
ELLVKNLSH

SEQ ID NO: 1134165 - protein, 9 aa, Homo Sapiens
TVIHNVCEQ

SEQ ID NO: 1134166 - protein, 9 aa, Homo Sapiens
RPLTGRPSY

SEQ ID NO: 1134167 - protein, 9 aa, Homo Sapiens
RPRPCGGKM

SEQ ID NO: 1134168 - protein, 9 aa, Homo Sapiens
FQDSIHMGF

SEQ ID NO: 1134169 - protein, 9 aa, Homo Sapiens
EATMKMAAM

SEQ ID NO: 1134170 - protein, 9 aa, Homo Sapiens
RRSGRRSGS

SEQ ID NO: 1134171 - protein, 9 aa, Homo Sapiens
NLHLPCFQD

SEQ ID NO: 1134172 - protein, 9 aa, Homo Sapiens
TMESLPAAH

SEQ ID NO: 1134173 - protein, 9 aa, Homo Sapiens
RLTWRRPGP

SEQ ID NO: 1134174 - protein, 9 aa, Homo Sapiens
CHLIYSPQR

SEQ ID NO: 1134175 - protein, 9 aa, Homo Sapiens
SNCAENIHK

SEQ ID NO: 1134176 - protein, 9 aa, Homo Sapiens
QCESCSPNV

SEQ ID NO: 1134177 - protein, 9 aa, Homo Sapiens
RSQDCDQVC

SEQ ID NO: 1134178 - protein, 9 aa, Homo Sapiens
LLWTMTIKS

SEQ ID NO: 1134179 - protein, 9 aa, Homo Sapiens
LARKWHLLS

SEQ ID NO: 1134180 - protein, 9 aa, Homo Sapiens
ILHQPEMAA

SEQ ID NO: 1134181 - protein, 9 aa, Homo Sapiens
KDTVDGQRT

SEQ ID NO: 1134182 - protein, 9 aa, Homo Sapiens
HRCRIPDRP

SEQ ID NO: 1134183 - protein, 9 aa, Homo Sapiens
FIPPYVLRF

SEQ ID NO: 1134184 - protein, 9 aa, Homo Sapiens
RHTQLQRQT

SEQ ID NO: 1134185 - protein, 9 aa, Homo Sapiens
CSGASASWP

SEQ ID NO: 1134186 - protein, 9 aa, Homo Sapiens
PSGAPSPPP

SEQ ID NO: 1134187 - protein, 9 aa, Homo Sapiens
RLAVDSNTS

SEQ ID NO: 1134188 - protein, 9 aa, Homo Sapiens
AEGGGVCGP

SEQ ID NO: 1134189 - protein, 9 aa, Homo Sapiens
LVKNLSHLD

SEQ ID NO: 1134190 - protein, 9 aa, Homo Sapiens
WAALGSCVF

SEQ ID NO: 1134191 - protein, 9 aa, Homo Sapiens
TSEPGSAGA

SEQ ID NO: 1134192 - protein, 9 aa, Homo Sapiens
PSVWSPLQL

SEQ ID NO: 1134193 - protein, 9 aa, Homo Sapiens
PSATNPTWR

SEQ ID NO: 1134194 - protein, 9 aa, Homo Sapiens
STSQLPTSF

SEQ ID NO: 1134195 - protein, 9 aa, Homo Sapiens
NSAKGPKGG

SEQ ID NO: 1134196 - protein, 9 aa, Homo Sapiens
MWLSKGLAT

SEQ ID NO: 1134197 - protein, 9 aa, Homo Sapiens
GPPPLSSSL

SEQ ID NO: 1134198 - protein, 9 aa, Homo Sapiens
GFLSGEPTE

SEQ ID NO: 1134199 - protein, 9 aa, Homo Sapiens
CGLLYSRTT

SEQ ID NO: 1134200 - protein, 9 aa, Homo Sapiens
IMLNVGGKL

SEQ ID NO: 1134201 - protein, 9 aa, Homo Sapiens
IAVKYKREN

SEQ ID NO: 1134202 - protein, 9 aa, Homo Sapiens
GHHSLRVPM

SEQ ID NO: 1134203 - protein, 9 aa, Homo Sapiens
ADIGHRNSL

SEQ ID NO: 1134204 - protein, 9 aa, Homo Sapiens
RAQGGLGGS

SEQ ID NO: 1134205 - protein, 9 aa, Homo Sapiens
YIDLLKEPG

SEQ ID NO: 1134206 - protein, 9 aa, Homo Sapiens
PEVHIANIT

SEQ ID NO: 1134207 - protein, 9 aa, Homo Sapiens
STRCRWAGA

SEQ ID NO: 1134208 - protein, 9 aa, Homo Sapiens
GPAFSLRNF

SEQ ID NO: 1134209 - protein, 9 aa, Homo Sapiens
QACDTMDTV

SEQ ID NO: 1134210 - protein, 9 aa, Homo Sapiens
LTYGQTGSG

SEQ ID NO: 1134211 - protein, 9 aa, Homo Sapiens
MNIPVNKSP

SEQ ID NO: 1134212 - protein, 9 aa, Homo Sapiens
QGQNYPRSG

SEQ ID NO: 1134213 - protein, 9 aa, Homo Sapiens
PILVHRSAG

SEQ ID NO: 1134214 - protein, 9 aa, Homo Sapiens
RRRTPTRRK

SEQ ID NO: 1134215 - protein, 9 aa, Homo Sapiens
QVDGSSQPD

SEQ ID NO: 1134216 - protein, 9 aa, Homo Sapiens
GMDDSVSHQ

SEQ ID NO: 1134217 - protein, 9 aa, Homo Sapiens
GSGGSDSDS

SEQ ID NO: 1134218 - protein, 9 aa, Homo Sapiens
SSDNKCHFR

SEQ ID NO: 1134219 - protein, 9 aa, Homo Sapiens
EWTQDSEGS

SEQ ID NO: 1134220 - protein, 9 aa, Homo Sapiens
ACRFHSPLL

SEQ ID NO: 1134221 - protein, 9 aa, Homo Sapiens
RATTKTLPF

SEQ ID NO: 1134222 - protein, 9 aa, Homo Sapiens
SGGTASSLS

SEQ ID NO: 1134223 - protein, 9 aa, Homo Sapiens
FGVLGVATI

SEQ ID NO: 1134224 - protein, 9 aa, Homo Sapiens
LIPGLWRPS

SEQ ID NO: 1134225 - protein, 9 aa, Homo Sapiens
GIVAMAAGG

SEQ ID NO: 1134226 - protein, 9 aa, Homo Sapiens
KVKKEGSGA

SEQ ID NO: 1134227 - protein, 9 aa, Homo Sapiens
WQGHHSLRV

SEQ ID NO: 1134228 - protein, 9 aa, Homo Sapiens
TGTFPQEFI

SEQ ID NO: 1134229 - protein, 9 aa, Homo Sapiens
LPHPHPHSH

SEQ ID NO: 1134230 - protein, 9 aa, Homo Sapiens
DRSLIVGGE

SEQ ID NO: 1134231 - protein, 9 aa, Homo Sapiens
CRWAGARGR

SEQ ID NO: 1134232 - protein, 9 aa, Homo Sapiens
ISLEGALSS

SEQ ID NO: 1134233 - protein, 9 aa, Homo Sapiens
RDASRCLIG

SEQ ID NO: 1134234 - protein, 9 aa, Homo Sapiens
PLTDKKAPG

SEQ ID NO: 1134235 - protein, 9 aa, Homo Sapiens
NQNRMWWQI

SEQ ID NO: 1134236 - protein, 9 aa, Homo Sapiens
GLKHPLFPK

SEQ ID NO: 1134237 - protein, 9 aa, Homo Sapiens
SKDNSAGVN

SEQ ID NO: 1134238 - protein, 9 aa, Homo Sapiens
SDPAKIGRG

SEQ ID NO: 1134239 - protein, 9 aa, Homo Sapiens
AEVSELQQR

SEQ ID NO: 1134240 - protein, 9 aa, Homo Sapiens
APRCPAKGA

SEQ ID NO: 1134241 - protein, 9 aa, Homo Sapiens
ACSKVKSSK

SEQ ID NO: 1134242 - protein, 9 aa, Homo Sapiens
WTLLRSFRI

SEQ ID NO: 1134243 - protein, 9 aa, Homo Sapiens
CLLPTTGLP

SEQ ID NO: 1134244 - protein, 9 aa, Homo Sapiens
DYILETWTL

SEQ ID NO: 1134245 - protein, 9 aa, Homo Sapiens
RGGSDRTPR

SEQ ID NO: 1134246 - protein, 9 aa, Homo Sapiens
FVWTRPQQL

SEQ ID NO: 1134247 - protein, 9 aa, Homo Sapiens
DISVDDQWI

SEQ ID NO: 1134248 - protein, 9 aa, Homo Sapiens
PRRTPMLRP

SEQ ID NO: 1134249 - protein, 9 aa, Homo Sapiens
AHTFMNVCF

SEQ ID NO: 1134250 - protein, 9 aa, Homo Sapiens
GTRREAPAA

SEQ ID NO: 1134251 - protein, 9 aa, Homo Sapiens
PGLQVQDLS

SEQ ID NO: 1134252 - protein, 9 aa, Homo Sapiens
PPWRALASS

SEQ ID NO: 1134253 - protein, 9 aa, Homo Sapiens
SVVFSATAS

SEQ ID NO: 1134254 - protein, 9 aa, Homo Sapiens
FTATENALF

SEQ ID NO: 1134255 - protein, 9 aa, Homo Sapiens
IKKGQQIYV

SEQ ID NO: 1134256 - protein, 9 aa, Homo Sapiens
FLARLKEHR

SEQ ID NO: 1134257 - protein, 9 aa, Homo Sapiens
RILLLCGQP

SEQ ID NO: 1134258 - protein, 9 aa, Homo Sapiens
SLPCPLGSS

SEQ ID NO: 1134259 - protein, 9 aa, Homo Sapiens
ICTADCGGH

SEQ ID NO: 1134260 - protein, 9 aa, Homo Sapiens
SDEENCVLV

SEQ ID NO: 1134261 - protein, 9 aa, Homo Sapiens
SQYYVAQQA

SEQ ID NO: 1134262 - protein, 9 aa, Homo Sapiens
LATSPLLED

SEQ ID NO: 1134263 - protein, 9 aa, Homo Sapiens
RLPMTHFGD

SEQ ID NO: 1134264 - protein, 9 aa, Homo Sapiens
VIVGHGHEA

SEQ ID NO: 1134265 - protein, 9 aa, Homo Sapiens
LDSSLDNTL

SEQ ID NO: 1134266 - protein, 9 aa, Homo Sapiens
ECSCGRPHA

SEQ ID NO: 1134267 - protein, 9 aa, Homo Sapiens
APPRSSRSR

SEQ ID NO: 1134268 - protein, 9 aa, Homo Sapiens
PVRCSRPSP

SEQ ID NO: 1134269 - protein, 9 aa, Homo Sapiens
VDTKAEEKE

SEQ ID NO: 1134270 - protein, 9 aa, Homo Sapiens
GAMLEGKMY

SEQ ID NO: 1134271 - protein, 9 aa, Homo Sapiens
RHPRRRLSS

SEQ ID NO: 1134272 - protein, 9 aa, Homo Sapiens
VAVLRELDN

SEQ ID NO: 1134273 - protein, 9 aa, Homo Sapiens
AGLPASIVP

SEQ ID NO: 1134274 - protein, 9 aa, Homo Sapiens
FQCSLDSTN

SEQ ID NO: 1134275 - protein, 9 aa, Homo Sapiens
SPCPGWGAP

SEQ ID NO: 1134276 - protein, 9 aa, Homo Sapiens
EELNHRTEM

SEQ ID NO: 1134277 - protein, 9 aa, Homo Sapiens
DSGVGLDEV

SEQ ID NO: 1134278 - protein, 9 aa, Homo Sapiens
ILKQSMTMN

SEQ ID NO: 1134279 - protein, 9 aa, Homo Sapiens
HGVEADNLP

SEQ ID NO: 1134280 - protein, 9 aa, Homo Sapiens
ASREDFKQK

SEQ ID NO: 1134281 - protein, 9 aa, Homo Sapiens
RLVCCPGPL

SEQ ID NO: 1134282 - protein, 9 aa, Homo Sapiens
LSGPVAVAT

SEQ ID NO: 1134283 - protein, 9 aa, Homo Sapiens
FRAESEEVP

SEQ ID NO: 1134284 - protein, 9 aa, Homo Sapiens
KIELDHTSL

SEQ ID NO: 1134285 - protein, 9 aa, Homo Sapiens
EGSHVTANM

SEQ ID NO: 1134286 - protein, 9 aa, Homo Sapiens
DEEQNQEHS

SEQ ID NO: 1134287 - protein, 9 aa, Homo Sapiens
ITEYMFCTG

SEQ ID NO: 1134288 - protein, 9 aa, Homo Sapiens
LSLQGSKAS

SEQ ID NO: 1134289 - protein, 9 aa, Homo Sapiens
LYDDFTPFN

SEQ ID NO: 1134290 - protein, 9 aa, Homo Sapiens
INNLRALSV

SEQ ID NO: 1134291 - protein, 9 aa, Homo Sapiens
NAVGILSRH

SEQ ID NO: 1134292 - protein, 9 aa, Homo Sapiens
RMLLQKAEL

SEQ ID NO: 1134293 - protein, 9 aa, Homo Sapiens
KKNPDDFKM

SEQ ID NO: 1134294 - protein, 9 aa, Homo Sapiens
EELTDEYFF

SEQ ID NO: 1134295 - protein, 9 aa, Homo Sapiens
QDAQCLFLM

SEQ ID NO: 1134296 - protein, 9 aa, Homo Sapiens
SRGSRAEVT

SEQ ID NO: 1134297 - protein, 9 aa, Homo Sapiens
KNKWMNKKN

SEQ ID NO: 1134298 - protein, 9 aa, Homo Sapiens
GDLCPVTME

SEQ ID NO: 1134299 - protein, 9 aa, Homo Sapiens
SWYNILTVN

SEQ ID NO: 1134300 - protein, 9 aa, Homo Sapiens
IKGGLGEVA

SEQ ID NO: 1134301 - protein, 9 aa, Homo Sapiens
RPCGGKMAT

SEQ ID NO: 1134302 - protein, 9 aa, Homo Sapiens
DGRSNMRME

SEQ ID NO: 1134303 - protein, 9 aa, Homo Sapiens
RSDLEMQNE

SEQ ID NO: 1134304 - protein, 9 aa, Homo Sapiens
NHTKLKGPS

SEQ ID NO: 1134305 - protein, 9 aa, Homo Sapiens
SPPPRQCLS

SEQ ID NO: 1134306 - protein, 9 aa, Homo Sapiens
RYGTMRDNM

SEQ ID NO: 1134307 - protein, 9 aa, Homo Sapiens
GLRKSETPR

SEQ ID NO: 1134308 - protein, 9 aa, Homo Sapiens
ACGQGTACL

SEQ ID NO: 1134309 - protein, 9 aa, Homo Sapiens
RDHRKIGSD

SEQ ID NO: 1134310 - protein, 9 aa, Homo Sapiens
TGLSWSLQT

SEQ ID NO: 1134311 - protein, 9 aa, Homo Sapiens
VMEKLPVRR

SEQ ID NO: 1134312 - protein, 9 aa, Homo Sapiens
AVISLYATG

SEQ ID NO: 1134313 - protein, 9 aa, Homo Sapiens
PQGQHKLLC

SEQ ID NO: 1134314 - protein, 9 aa, Homo Sapiens
RSQGAPTQR

SEQ ID NO: 1134315 - protein, 9 aa, Homo Sapiens
ALSLKAHQP

SEQ ID NO: 1134316 - protein, 9 aa, Homo Sapiens
IINPSTFYI

SEQ ID NO: 1134317 - protein, 9 aa, Homo Sapiens
PPMPPPANP

SEQ ID NO: 1134318 - protein, 9 aa, Homo Sapiens
NSTQTFSAT

SEQ ID NO: 1134319 - protein, 9 aa, Homo Sapiens
KKGEAKYRP

SEQ ID NO: 1134320 - protein, 9 aa, Homo Sapiens
IVDILSTSG

SEQ ID NO: 1134321 - protein, 9 aa, Homo Sapiens
CRACRTSLA

SEQ ID NO: 1134322 - protein, 9 aa, Homo Sapiens
LSGIEIIDE

SEQ ID NO: 1134323 - protein, 9 aa, Homo Sapiens
IAGSVVQLS

SEQ ID NO: 1134324 - protein, 9 aa, Homo Sapiens
HRHKISFSF

SEQ ID NO: 1134325 - protein, 9 aa, Homo Sapiens
GTGSNTCYM

SEQ ID NO: 1134326 - protein, 9 aa, Homo Sapiens
TSRGQAQDT

SEQ ID NO: 1134327 - protein, 9 aa, Homo Sapiens
DLVHVHPHD

SEQ ID NO: 1134328 - protein, 9 aa, Homo Sapiens
QRNLRTLKQ

SEQ ID NO: 1134329 - protein, 9 aa, Homo Sapiens
KLSINNYRF

SEQ ID NO: 1134330 - protein, 9 aa, Homo Sapiens
VHRHALRIL

SEQ ID NO: 1134331 - protein, 9 aa, Homo Sapiens
ALPPARGPQ

SEQ ID NO: 1134332 - protein, 9 aa, Homo Sapiens
LETMDIWLS

SEQ ID NO: 1134333 - protein, 9 aa, Homo Sapiens
RRSAAASEL

SEQ ID NO: 1134334 - protein, 9 aa, Homo Sapiens
RLKWHLLSE

SEQ ID NO: 1134335 - protein, 9 aa, Homo Sapiens
KWKHCETLG

SEQ ID NO: 1134336 - protein, 9 aa, Homo Sapiens
SSLAFLTAA

SEQ ID NO: 1134337 - protein, 9 aa, Homo Sapiens
DPTTEVHKR

SEQ ID NO: 1134338 - protein, 9 aa, Homo Sapiens
HRGAERWNK

SEQ ID NO: 1134339 - protein, 9 aa, Homo Sapiens
PWRTRPVCQ

SEQ ID NO: 1134340 - protein, 9 aa, Homo Sapiens
PKTTLPGLF

SEQ ID NO: 1134341 - protein, 9 aa, Homo Sapiens
GRVNNITSV

SEQ ID NO: 1134342 - protein, 9 aa, Homo Sapiens
TRAGWGTSA

SEQ ID NO: 1134343 - protein, 9 aa, Homo Sapiens
AHTASPHPG

SEQ ID NO: 1134344 - protein, 9 aa, Homo Sapiens
LEILWTLSI

SEQ ID NO: 1134345 - protein, 9 aa, Homo Sapiens
PAREWLFAV

SEQ ID NO: 1134346 - protein, 9 aa, Homo Sapiens
SIIWGMYQN

SEQ ID NO: 1134347 - protein, 9 aa, Homo Sapiens
PETTLWLGP

SEQ ID NO: 1134348 - protein, 9 aa, Homo Sapiens
HALKHKVDP

SEQ ID NO: 1134349 - protein, 9 aa, Homo Sapiens
RRATESPWL

SEQ ID NO: 1134350 - protein, 9 aa, Homo Sapiens
YPARPEVSI

SEQ ID NO: 1134351 - protein, 9 aa, Homo Sapiens
RNNLYLLLT

SEQ ID NO: 1134352 - protein, 9 aa, Homo Sapiens
LTRYFRKHT

SEQ ID NO: 1134353 - protein, 9 aa, Homo Sapiens
GGSNGATYS

SEQ ID NO: 1134354 - protein, 9 aa, Homo Sapiens
GAAVARAVI

SEQ ID NO: 1134355 - protein, 9 aa, Homo Sapiens
PPPHTHPLC

SEQ ID NO: 1134356 - protein, 9 aa, Homo Sapiens
SAKNLLTSM

SEQ ID NO: 1134357 - protein, 9 aa, Homo Sapiens
GSSQILTPP

SEQ ID NO: 1134358 - protein, 9 aa, Homo Sapiens
EQEKDRSKE

SEQ ID NO: 1134359 - protein, 9 aa, Homo Sapiens
PSPVLGKLE

SEQ ID NO: 1134360 - protein, 9 aa, Homo Sapiens
ADQLLTGCH

SEQ ID NO: 1134361 - protein, 9 aa, Homo Sapiens
QFQSVEVPG

SEQ ID NO: 1134362 - protein, 9 aa, Homo Sapiens
APPTRCVWQ

SEQ ID NO: 1134363 - protein, 9 aa, Homo Sapiens
NRMWWQILL

SEQ ID NO: 1134364 - protein, 9 aa, Homo Sapiens
VKQTCSQTA

SEQ ID NO: 1134365 - protein, 9 aa, Homo Sapiens
SGTSRPGGP

SEQ ID NO: 1134366 - protein, 9 aa, Homo Sapiens
SCRALPGWI

SEQ ID NO: 1134367 - protein, 9 aa, Homo Sapiens
DEDVGTTQL

SEQ ID NO: 1134368 - protein, 9 aa, Homo Sapiens
PNIPKQFVP

SEQ ID NO: 1134369 - protein, 9 aa, Homo Sapiens
WSIPEEFFD

SEQ ID NO: 1134370 - protein, 9 aa, Homo Sapiens
IFGPKSQRK

SEQ ID NO: 1134371 - protein, 9 aa, Homo Sapiens
ALKHQLRHP

SEQ ID NO: 1134372 - protein, 9 aa, Homo Sapiens
QVTIDAIHE

SEQ ID NO: 1134373 - protein, 9 aa, Homo Sapiens
QILTCQKTE

SEQ ID NO: 1134374 - protein, 9 aa, Homo Sapiens
TRMITIDGK

SEQ ID NO: 1134375 - protein, 9 aa, Homo Sapiens
GNAVEHVFE

SEQ ID NO: 1134376 - protein, 9 aa, Homo Sapiens
LRPVDTKAE

SEQ ID NO: 1134377 - protein, 9 aa, Homo Sapiens
AHMLDHLTK

SEQ ID NO: 1134378 - protein, 9 aa, Homo Sapiens
SPPPHPQVP

SEQ ID NO: 1134379 - protein, 9 aa, Homo Sapiens
SHLLSNHQQ

SEQ ID NO: 1134380 - protein, 9 aa, Homo Sapiens
MPPVYPSVG

SEQ ID NO: 1134381 - protein, 9 aa, Homo Sapiens
PPTLMMSNG

SEQ ID NO: 1134382 - protein, 9 aa, Homo Sapiens
MKVSQSLFR

SEQ ID NO: 1134383 - protein, 9 aa, Homo Sapiens
AGIGGAAVA

SEQ ID NO: 1134384 - protein, 9 aa, Homo Sapiens
NGHAARCVC

SEQ ID NO: 1134385 - protein, 9 aa, Homo Sapiens
HQGFCLTLR

SEQ ID NO: 1134386 - protein, 9 aa, Homo Sapiens
IEFAAISSR

SEQ ID NO: 1134387 - protein, 9 aa, Homo Sapiens
WLSKEPESL

SEQ ID NO: 1134388 - protein, 9 aa, Homo Sapiens
AYCQHLLSY

SEQ ID NO: 1134389 - protein, 9 aa, Homo Sapiens
LGLGAAPLP

SEQ ID NO: 1134390 - protein, 9 aa, Homo Sapiens
CGDTEARKT

SEQ ID NO: 1134391 - protein, 9 aa, Homo Sapiens
ECEMFDKAS

SEQ ID NO: 1134392 - protein, 9 aa, Homo Sapiens
FSDVLEKKI

SEQ ID NO: 1134393 - protein, 9 aa, Homo Sapiens
AMLYNNREH

SEQ ID NO: 1134394 - protein, 9 aa, Homo Sapiens
TLLRSFRIT

SEQ ID NO: 1134395 - protein, 9 aa, Homo Sapiens
SDLEMQNES

SEQ ID NO: 1134396 - protein, 9 aa, Homo Sapiens
PLIFIFAYL

SEQ ID NO: 1134397 - protein, 9 aa, Homo Sapiens
PPRPTSGAR

SEQ ID NO: 1134398 - protein, 9 aa, Homo Sapiens
HHGHKHRKR

SEQ ID NO: 1134399 - protein, 9 aa, Homo Sapiens
RSSSCRSHG

SEQ ID NO: 1134400 - protein, 9 aa, Homo Sapiens
SNNLSCGGG

SEQ ID NO: 1134401 - protein, 9 aa, Homo Sapiens
RVVMCCTLR

SEQ ID NO: 1134402 - protein, 9 aa, Homo Sapiens
REASVSPPR

SEQ ID NO: 1134403 - protein, 9 aa, Homo Sapiens
GEKTFKCTQ

SEQ ID NO: 1134404 - protein, 9 aa, Homo Sapiens
LTEELGGLE

SEQ ID NO: 1134405 - protein, 9 aa, Homo Sapiens
ETVCNVTIS

SEQ ID NO: 1134406 - protein, 9 aa, Homo Sapiens
NVAKNQNAA

SEQ ID NO: 1134407 - protein, 9 aa, Homo Sapiens
HCPMARYIL

SEQ ID NO: 1134408 - protein, 9 aa, Homo Sapiens
RLLWQYDNE

SEQ ID NO: 1134409 - protein, 9 aa, Homo Sapiens
WTIFHILLL

SEQ ID NO: 1134410 - protein, 9 aa, Homo Sapiens
AARGASTSS

SEQ ID NO: 1134411 - protein, 9 aa, Homo Sapiens
FSNLCKLER

SEQ ID NO: 1134412 - protein, 9 aa, Homo Sapiens
YPPARQPSR

SEQ ID NO: 1134413 - protein, 9 aa, Homo Sapiens
SLYLMQKHT

SEQ ID NO: 1134414 - protein, 9 aa, Homo Sapiens
GKAVSSQPT

SEQ ID NO: 1134415 - protein, 9 aa, Homo Sapiens
DPSGLWVWM

SEQ ID NO: 1134416 - protein, 9 aa, Homo Sapiens
RSPPTLMMS

SEQ ID NO: 1134417 - protein, 9 aa, Homo Sapiens
APKTVAALW

SEQ ID NO: 1134418 - protein, 9 aa, Homo Sapiens
GQPLKPPDG

SEQ ID NO: 1134419 - protein, 9 aa, Homo Sapiens
FPKNLVACP

SEQ ID NO: 1134420 - protein, 9 aa, Homo Sapiens
ARRRTWWRT

SEQ ID NO: 1134421 - protein, 9 aa, Homo Sapiens
PTPVPTATA

SEQ ID NO: 1134422 - protein, 9 aa, Homo Sapiens
VSVFPAREW

SEQ ID NO: 1134423 - protein, 9 aa, Homo Sapiens
LVVDGMGHF

SEQ ID NO: 1134424 - protein, 9 aa, Homo Sapiens
SIRTVQWPP

SEQ ID NO: 1134425 - protein, 9 aa, Homo Sapiens
QRIFLVLRG

SEQ ID NO: 1134426 - protein, 9 aa, Homo Sapiens
TEMALPFSL

SEQ ID NO: 1134427 - protein, 9 aa, Homo Sapiens
STTLCTGLV

SEQ ID NO: 1134428 - protein, 9 aa, Homo Sapiens
PDSKGAQKS

SEQ ID NO: 1134429 - protein, 9 aa, Homo Sapiens
GSWALLWSP

SEQ ID NO: 1134430 - protein, 9 aa, Homo Sapiens
LSNVAPPAF

SEQ ID NO: 1134431 - protein, 9 aa, Homo Sapiens
LLEVHQLVD

SEQ ID NO: 1134432 - protein, 9 aa, Homo Sapiens
RDSTRLRLW

SEQ ID NO: 1134433 - protein, 9 aa, Homo Sapiens
STQTFSATM

SEQ ID NO: 1134434 - protein, 9 aa, Homo Sapiens
PFLKLCQAM

SEQ ID NO: 1134435 - protein, 9 aa, Homo Sapiens
LKQNQIVDR

SEQ ID NO: 1134436 - protein, 9 aa, Homo Sapiens
FDFVLPPIL

SEQ ID NO: 1134437 - protein, 9 aa, Homo Sapiens
DESTDKAQE

SEQ ID NO: 1134438 - protein, 9 aa, Homo Sapiens
VRALHNLAQ

SEQ ID NO: 1134439 - protein, 9 aa, Homo Sapiens
CPLRTLPFT

SEQ ID NO: 1134440 - protein, 9 aa, Homo Sapiens
SPQPFCGNN

SEQ ID NO: 1134441 - protein, 9 aa, Homo Sapiens
CHRMNDDWA

SEQ ID NO: 1134442 - protein, 9 aa, Homo Sapiens
THFTQSDRS

SEQ ID NO: 1134443 - protein, 9 aa, Homo Sapiens
VAYRLLGCL

SEQ ID NO: 1134444 - protein, 9 aa, Homo Sapiens
FRRRCWHRR

SEQ ID NO: 1134445 - protein, 9 aa, Homo Sapiens
SQEGAQYPP

SEQ ID NO: 1134446 - protein, 9 aa, Homo Sapiens
NRYSIDRSS

SEQ ID NO: 1134447 - protein, 9 aa, Homo Sapiens
WSCCGKFTT

SEQ ID NO: 1134448 - protein, 9 aa, Homo Sapiens
FLIENGLLK

SEQ ID NO: 1134449 - protein, 9 aa, Homo Sapiens
DAHAEERFF

SEQ ID NO: 1134450 - protein, 9 aa, Homo Sapiens
DEHKRSMVD

SEQ ID NO: 1134451 - protein, 9 aa, Homo Sapiens
FTSNVNHKH

SEQ ID NO: 1134452 - protein, 9 aa, Homo Sapiens
SSAKKGGNH

SEQ ID NO: 1134453 - protein, 9 aa, Homo Sapiens
SGNSLTERG

SEQ ID NO: 1134454 - protein, 9 aa, Homo Sapiens
ITSPLHALG

SEQ ID NO: 1134455 - protein, 9 aa, Homo Sapiens
NVPISVKQV

SEQ ID NO: 1134456 - protein, 9 aa, Homo Sapiens
LENEFLVYE

SEQ ID NO: 1134457 - protein, 9 aa, Homo Sapiens
YHVSQSPFF

SEQ ID NO: 1134458 - protein, 9 aa, Homo Sapiens
PTQALTQSN

SEQ ID NO: 1134459 - protein, 9 aa, Homo Sapiens
MFASTAYLE

SEQ ID NO: 1134460 - protein, 9 aa, Homo Sapiens
PSRPTGRTP

SEQ ID NO: 1134461 - protein, 9 aa, Homo Sapiens
PTSLSVDDA

SEQ ID NO: 1134462 - protein, 9 aa, Homo Sapiens
LGVGDKFKR

SEQ ID NO: 1134463 - protein, 9 aa, Homo Sapiens
PDSATTSGL

SEQ ID NO: 1134464 - protein, 9 aa, Homo Sapiens
VDGASPCCL

SEQ ID NO: 1134465 - protein, 9 aa, Homo Sapiens
LVPRCPWPS

SEQ ID NO: 1134466 - protein, 9 aa, Homo Sapiens
CETLGVKTL

SEQ ID NO: 1134467 - protein, 9 aa, Homo Sapiens
VNVFELTGQ

SEQ ID NO: 1134468 - protein, 9 aa, Homo Sapiens
FSRLRFWEF

SEQ ID NO: 1134469 - protein, 9 aa, Homo Sapiens
GRSSAASPP

SEQ ID NO: 1134470 - protein, 9 aa, Homo Sapiens
LFIWPQHSY

SEQ ID NO: 1134471 - protein, 9 aa, Homo Sapiens
AGCHPAVGG

SEQ ID NO: 1134472 - protein, 9 aa, Homo Sapiens
PTWLTSACP

SEQ ID NO: 1134473 - protein, 9 aa, Homo Sapiens
LKTWAPAAP

SEQ ID NO: 1134474 - protein, 9 aa, Homo Sapiens
KAKPNLEYF

SEQ ID NO: 1134475 - protein, 9 aa, Homo Sapiens
KEGGERGQM

SEQ ID NO: 1134476 - protein, 9 aa, Homo Sapiens
TTLPSRGSR

SEQ ID NO: 1134477 - protein, 9 aa, Homo Sapiens
HSERKKRQR

SEQ ID NO: 1134478 - protein, 9 aa, Homo Sapiens
WNNLCQIVM

SEQ ID NO: 1134479 - protein, 9 aa, Homo Sapiens
NHSQDDHHL

SEQ ID NO: 1134480 - protein, 9 aa, Homo Sapiens
YCPVKNVFF

SEQ ID NO: 1134481 - protein, 9 aa, Homo Sapiens
LTSPPGAPP

SEQ ID NO: 1134482 - protein, 9 aa, Homo Sapiens
PKPPRPLTG

SEQ ID NO: 1134483 - protein, 9 aa, Homo Sapiens
RELRVSSEK

SEQ ID NO: 1134484 - protein, 9 aa, Homo Sapiens
ACQNFFRNK

SEQ ID NO: 1134485 - protein, 9 aa, Homo Sapiens
GAFYSLQPP

SEQ ID NO: 1134486 - protein, 9 aa, Homo Sapiens
RRHSDKNDG

SEQ ID NO: 1134487 - protein, 9 aa, Homo Sapiens
LWKRFHDIW

SEQ ID NO: 1134488 - protein, 9 aa, Homo Sapiens
AILLPKELV

SEQ ID NO: 1134489 - protein, 9 aa, Homo Sapiens
WPPGEPGRP

SEQ ID NO: 1134490 - protein, 9 aa, Homo Sapiens
MRHTQLQRQ

SEQ ID NO: 1134491 - protein, 9 aa, Homo Sapiens
LGEYSLLPE

SEQ ID NO: 1134492 - protein, 9 aa, Homo Sapiens
GRPARPGTS

SEQ ID NO: 1134493 - protein, 9 aa, Homo Sapiens
PHSAGLSPG

SEQ ID NO: 1134494 - protein, 9 aa, Homo Sapiens
EEVSIIWGM

SEQ ID NO: 1134495 - protein, 9 aa, Homo Sapiens
HRPCLSGPV

SEQ ID NO: 1134496 - protein, 9 aa, Homo Sapiens
LFPASGEMK

SEQ ID NO: 1134497 - protein, 9 aa, Homo Sapiens
KSYKCHKCG

SEQ ID NO: 1134498 - protein, 9 aa, Homo Sapiens
AWLVWVPHP

SEQ ID NO: 1134499 - protein, 9 aa, Homo Sapiens
ATQFRWNQK

SEQ ID NO: 1134500 - protein, 9 aa, Homo Sapiens
ETEGSKFPA

SEQ ID NO: 1134501 - protein, 9 aa, Homo Sapiens
VTLYGLPRP

SEQ ID NO: 1134502 - protein, 9 aa, Homo Sapiens
EHASVYHIT

SEQ ID NO: 1134503 - protein, 9 aa, Homo Sapiens
RRSYEGFGM

SEQ ID NO: 1134504 - protein, 9 aa, Homo Sapiens
KTSCFKLDL

SEQ ID NO: 1134505 - protein, 9 aa, Homo Sapiens
YHYGWSFAF

SEQ ID NO: 1134506 - protein, 9 aa, Homo Sapiens
FSEGAYIPP

SEQ ID NO: 1134507 - protein, 9 aa, Homo Sapiens
TPTEGACTP

SEQ ID NO: 1134508 - protein, 9 aa, Homo Sapiens
EAQLDVNLK

SEQ ID NO: 1134509 - protein, 9 aa, Homo Sapiens
EGSLKKTSR

SEQ ID NO: 1134510 - protein, 9 aa, Homo Sapiens
PPGEQQLNG

SEQ ID NO: 1134511 - protein, 9 aa, Homo Sapiens
KANTKKRHT

SEQ ID NO: 1134512 - protein, 9 aa, Homo Sapiens
LLECHKCKC

SEQ ID NO: 1134513 - protein, 9 aa, Homo Sapiens
LPLPPTPGR

SEQ ID NO: 1134514 - protein, 9 aa, Homo Sapiens
TPHLASGTA

SEQ ID NO: 1134515 - protein, 9 aa, Homo Sapiens
ASLELSRSP

SEQ ID NO: 1134516 - protein, 9 aa, Homo Sapiens
HFNADSGYS

SEQ ID NO: 1134517 - protein, 9 aa, Homo Sapiens
VHLPFIEIR

SEQ ID NO: 1134518 - protein, 9 aa, Homo Sapiens
VTSCLREHA

SEQ ID NO: 1134519 - protein, 9 aa, Homo Sapiens
VSELLIGRL

SEQ ID NO: 1134520 - protein, 9 aa, Homo Sapiens
TALAVECAG

SEQ ID NO: 1134521 - protein, 9 aa, Homo Sapiens
AKDNYGLLD

SEQ ID NO: 1134522 - protein, 9 aa, Homo Sapiens
ETYPLSLWK

SEQ ID NO: 1134523 - protein, 9 aa, Homo Sapiens
DVYWCVIER

SEQ ID NO: 1134524 - protein, 9 aa, Homo Sapiens
RALRFVSSK

SEQ ID NO: 1134525 - protein, 9 aa, Homo Sapiens
GAVGVIVDL

SEQ ID NO: 1134526 - protein, 9 aa, Homo Sapiens
LPGMTGLPR

SEQ ID NO: 1134527 - protein, 9 aa, Homo Sapiens
LTLYWVGMR

SEQ ID NO: 1134528 - protein, 9 aa, Homo Sapiens
DSRLSWLTD

SEQ ID NO: 1134529 - protein, 9 aa, Homo Sapiens
GLLKRSRCP

SEQ ID NO: 1134530 - protein, 9 aa, Homo Sapiens
KRKAFSACG

SEQ ID NO: 1134531 - protein, 9 aa, Homo Sapiens
FLAKAGLPA

SEQ ID NO: 1134532 - protein, 9 aa, Homo Sapiens
GRDADASPA

SEQ ID NO: 1134533 - protein, 9 aa, Homo Sapiens
QQPRYPRRI

SEQ ID NO: 1134534 - protein, 9 aa, Homo Sapiens
RNSESFGAW

SEQ ID NO: 1134535 - protein, 9 aa, Homo Sapiens
PTDSHEELP

SEQ ID NO: 1134536 - protein, 9 aa, Homo Sapiens
PAHCMGEIV

SEQ ID NO: 1134537 - protein, 9 aa, Homo Sapiens
AVQPHLLDI

SEQ ID NO: 1134538 - protein, 9 aa, Homo Sapiens
EADNLPTFD

SEQ ID NO: 1134539 - protein, 9 aa, Homo Sapiens
TLDATEVPF

SEQ ID NO: 1134540 - protein, 9 aa, Homo Sapiens
GCELRCKVF

SEQ ID NO: 1134541 - protein, 9 aa, Homo Sapiens
GEECGKAFN

SEQ ID NO: 1134542 - protein, 9 aa, Homo Sapiens
DMLAGFLTG

SEQ ID NO: 1134543 - protein, 9 aa, Homo Sapiens
PLLLVLLHE

SEQ ID NO: 1134544 - protein, 9 aa, Homo Sapiens
IPAPVLLLL

SEQ ID NO: 1134545 - protein, 9 aa, Homo Sapiens
TVLSQKKSK

SEQ ID NO: 1134546 - protein, 9 aa, Homo Sapiens
VTISFDRCK

SEQ ID NO: 1134547 - protein, 9 aa, Homo Sapiens
TLICKSQAR

SEQ ID NO: 1134548 - protein, 9 aa, Homo Sapiens
ATEKRQLIV

SEQ ID NO: 1134549 - protein, 9 aa, Homo Sapiens
QDDAELATV

SEQ ID NO: 1134550 - protein, 9 aa, Homo Sapiens
GGRAWAPQT

SEQ ID NO: 1134551 - protein, 9 aa, Homo Sapiens
PIRKSEIAV

SEQ ID NO: 1134552 - protein, 9 aa, Homo Sapiens
RSICPCPQY

SEQ ID NO: 1134553 - protein, 9 aa, Homo Sapiens
DEPTSSSID

SEQ ID NO: 1134554 - protein, 9 aa, Homo Sapiens
EVDAHRERP

SEQ ID NO: 1134555 - protein, 9 aa, Homo Sapiens
KRASRPTSS

SEQ ID NO: 1134556 - protein, 9 aa, Homo Sapiens
KWMNKKNED

SEQ ID NO: 1134557 - protein, 9 aa, Homo Sapiens
WGTGTRREA

SEQ ID NO: 1134558 - protein, 9 aa, Homo Sapiens
AFCTHPDEP

SEQ ID NO: 1134559 - protein, 9 aa, Homo Sapiens
TSVTLRPWK

SEQ ID NO: 1134560 - protein, 9 aa, Homo Sapiens
HGAPPMAAA

SEQ ID NO: 1134561 - protein, 9 aa, Homo Sapiens
LKAYTLYWP

SEQ ID NO: 1134562 - protein, 9 aa, Homo Sapiens
LEPTPAGSS

SEQ ID NO: 1134563 - protein, 9 aa, Homo Sapiens
QAAAAEAAA

SEQ ID NO: 1134564 - protein, 9 aa, Homo Sapiens
LIRSQSLHV

SEQ ID NO: 1134565 - protein, 9 aa, Homo Sapiens
QQFLGVHII

SEQ ID NO: 1134566 - protein, 9 aa, Homo Sapiens
TRDGSALRC

SEQ ID NO: 1134567 - protein, 9 aa, Homo Sapiens
KHKSREYEQ

SEQ ID NO: 1134568 - protein, 9 aa, Homo Sapiens
KSLDGSMDE

SEQ ID NO: 1134569 - protein, 9 aa, Homo Sapiens
LLNVSVADG

SEQ ID NO: 1134570 - protein, 9 aa, Homo Sapiens
LYKCDLFEQ

SEQ ID NO: 1134571 - protein, 9 aa, Homo Sapiens
GYQNVEDDA

SEQ ID NO: 1134572 - protein, 9 aa, Homo Sapiens
HLSTGELGT

SEQ ID NO: 1134573 - protein, 9 aa, Homo Sapiens
RAGRWRSGG

SEQ ID NO: 1134574 - protein, 9 aa, Homo Sapiens
KRWNAVALW

SEQ ID NO: 1134575 - protein, 9 aa, Homo Sapiens
SVSSSSSLR

SEQ ID NO: 1134576 - protein, 9 aa, Homo Sapiens
AHAYKEVSE

SEQ ID NO: 1134577 - protein, 9 aa, Homo Sapiens
VKVVYVACN

SEQ ID NO: 1134578 - protein, 9 aa, Homo Sapiens
TRTAQSPAG

SEQ ID NO: 1134579 - protein, 9 aa, Homo Sapiens
LQPGGFRAW

SEQ ID NO: 1134580 - protein, 9 aa, Homo Sapiens
VADKGDALV

SEQ ID NO: 1134581 - protein, 9 aa, Homo Sapiens
THGMSYDHV

SEQ ID NO: 1134582 - protein, 9 aa, Homo Sapiens
ARKWHLLSE

SEQ ID NO: 1134583 - protein, 9 aa, Homo Sapiens
TPSDKQGMS

SEQ ID NO: 1134584 - protein, 9 aa, Homo Sapiens
VPTLGSNVT

SEQ ID NO: 1134585 - protein, 9 aa, Homo Sapiens
ASELGMEER

SEQ ID NO: 1134586 - protein, 9 aa, Homo Sapiens
PRPNVCHLS

SEQ ID NO: 1134587 - protein, 9 aa, Homo Sapiens
LRVTNPYND

SEQ ID NO: 1134588 - protein, 9 aa, Homo Sapiens
LTLAQWSPV

SEQ ID NO: 1134589 - protein, 9 aa, Homo Sapiens
GRLLGASSV

SEQ ID NO: 1134590 - protein, 9 aa, Homo Sapiens
GGITAEFTT

SEQ ID NO: 1134591 - protein, 9 aa, Homo Sapiens
AVLGYEWVN

SEQ ID NO: 1134592 - protein, 9 aa, Homo Sapiens
EHRNLPLCV

SEQ ID NO: 1134593 - protein, 9 aa, Homo Sapiens
TAPSKAGLP

SEQ ID NO: 1134594 - protein, 9 aa, Homo Sapiens
GPSKLPGYA

SEQ ID NO: 1134595 - protein, 9 aa, Homo Sapiens
YAFSLRNSL

SEQ ID NO: 1134596 - protein, 9 aa, Homo Sapiens
TRGCGTSQL

SEQ ID NO: 1134597 - protein, 9 aa, Homo Sapiens
AKDMFDHPT

SEQ ID NO: 1134598 - protein, 9 aa, Homo Sapiens
GPGQAAGRG

SEQ ID NO: 1134599 - protein, 9 aa, Homo Sapiens
EAKKLYPKG

SEQ ID NO: 1134600 - protein, 9 aa, Homo Sapiens
VPFMAPGKS

SEQ ID NO: 1134601 - protein, 9 aa, Homo Sapiens
EGACTPGKP

SEQ ID NO: 1134602 - protein, 9 aa, Homo Sapiens
SPASACTMP

SEQ ID NO: 1134603 - protein, 9 aa, Homo Sapiens
SYLDLMPNL

SEQ ID NO: 1134604 - protein, 9 aa, Homo Sapiens
SKSVLELTQ

SEQ ID NO: 1134605 - protein, 9 aa, Homo Sapiens
VHMMTQSSS

SEQ ID NO: 1134606 - protein, 9 aa, Homo Sapiens
RGRKHSSPM

SEQ ID NO: 1134607 - protein, 9 aa, Homo Sapiens
EEDEPVPDA

SEQ ID NO: 1134608 - protein, 9 aa, Homo Sapiens
KALCPTQEN

SEQ ID NO: 1134609 - protein, 9 aa, Homo Sapiens
CSGTWCLPP

SEQ ID NO: 1134610 - protein, 9 aa, Homo Sapiens
QASGGCPAE

SEQ ID NO: 1134611 - protein, 9 aa, Homo Sapiens
HILCKTSLF

SEQ ID NO: 1134612 - protein, 9 aa, Homo Sapiens
VNESLTDTV

SEQ ID NO: 1134613 - protein, 9 aa, Homo Sapiens
DKHLRTTIT

SEQ ID NO: 1134614 - protein, 9 aa, Homo Sapiens
LLFLILLHL

SEQ ID NO: 1134615 - protein, 9 aa, Homo Sapiens
QPALTCARA

SEQ ID NO: 1134616 - protein, 9 aa, Homo Sapiens
PPATGSYGA

SEQ ID NO: 1134617 - protein, 9 aa, Homo Sapiens
GTDATHAER

SEQ ID NO: 1134618 - protein, 9 aa, Homo Sapiens
QKQSPSWRS

SEQ ID NO: 1134619 - protein, 9 aa, Homo Sapiens
LMYSCKEGY

SEQ ID NO: 1134620 - protein, 9 aa, Homo Sapiens
ENLIPCQPR

SEQ ID NO: 1134621 - protein, 9 aa, Homo Sapiens
LGIHGRKKC

SEQ ID NO: 1134622 - protein, 9 aa, Homo Sapiens
TLQPGGFRA

SEQ ID NO: 1134623 - protein, 9 aa, Homo Sapiens
GHSRQGSGS

SEQ ID NO: 1134624 - protein, 9 aa, Homo Sapiens
GIHRHKISF

SEQ ID NO: 1134625 - protein, 9 aa, Homo Sapiens
RPWEKNRQR

SEQ ID NO: 1134626 - protein, 9 aa, Homo Sapiens
TSQNHSKCI

SEQ ID NO: 1134627 - protein, 9 aa, Homo Sapiens
RQVIKLDCT

SEQ ID NO: 1134628 - protein, 9 aa, Homo Sapiens
NYTVANEAM

SEQ ID NO: 1134629 - protein, 9 aa, Homo Sapiens
TTEGTTVGF

SEQ ID NO: 1134630 - protein, 9 aa, Homo Sapiens
RDMKTGLSW

SEQ ID NO: 1134631 - protein, 9 aa, Homo Sapiens
EAQKRTCKL

SEQ ID NO: 1134632 - protein, 9 aa, Homo Sapiens
GGTEIFLFT

SEQ ID NO: 1134633 - protein, 9 aa, Homo Sapiens
GTSPGDQRA

SEQ ID NO: 1134634 - protein, 9 aa, Homo Sapiens
GENKCVPNN

SEQ ID NO: 1134635 - protein, 9 aa, Homo Sapiens
PKTVDTIKR

SEQ ID NO: 1134636 - protein, 9 aa, Homo Sapiens
RKPMNTNDL

SEQ ID NO: 1134637 - protein, 9 aa, Homo Sapiens
LPFSLAEVR

SEQ ID NO: 1134638 - protein, 9 aa, Homo Sapiens
WRTFTTTSR

SEQ ID NO: 1134639 - protein, 9 aa, Homo Sapiens
GRAWAPAPP

SEQ ID NO: 1134640 - protein, 9 aa, Homo Sapiens
ERDLPPPGG

SEQ ID NO: 1134641 - protein, 9 aa, Homo Sapiens
VANELRHKH

SEQ ID NO: 1134642 - protein, 9 aa, Homo Sapiens
NGLMKREET

SEQ ID NO: 1134643 - protein, 9 aa, Homo Sapiens
APPNTMAEK

SEQ ID NO: 1134644 - protein, 9 aa, Homo Sapiens
RPYKGEECG

SEQ ID NO: 1134645 - protein, 9 aa, Homo Sapiens
PRRYHGCRA

SEQ ID NO: 1134646 - protein, 9 aa, Homo Sapiens
NSMIGLSDF

SEQ ID NO: 1134647 - protein, 9 aa, Homo Sapiens
DWQACGQGT

SEQ ID NO: 1134648 - protein, 9 aa, Homo Sapiens
LSKLAVTSC

SEQ ID NO: 1134649 - protein, 9 aa, Homo Sapiens
KISFSFAFP

SEQ ID NO: 1134650 - protein, 9 aa, Homo Sapiens
IVVADAEAG

SEQ ID NO: 1134651 - protein, 9 aa, Homo Sapiens
LRPSSPPSL

SEQ ID NO: 1134652 - protein, 9 aa, Homo Sapiens
RLGRVFYVT

SEQ ID NO: 1134653 - protein, 9 aa, Homo Sapiens
LLALLALAT

SEQ ID NO: 1134654 - protein, 9 aa, Homo Sapiens
VQASRLKTE

SEQ ID NO: 1134655 - protein, 9 aa, Homo Sapiens
LLWSPLLFT

SEQ ID NO: 1134656 - protein, 9 aa, Homo Sapiens
IENAPEEKD

SEQ ID NO: 1134657 - protein, 9 aa, Homo Sapiens
LIQWYICGF

SEQ ID NO: 1134658 - protein, 9 aa, Homo Sapiens
PVKKAICTG

SEQ ID NO: 1134659 - protein, 9 aa, Homo Sapiens
TDPKCCFFG

SEQ ID NO: 1134660 - protein, 9 aa, Homo Sapiens
VLLTNVELS

SEQ ID NO: 1134661 - protein, 9 aa, Homo Sapiens
SVADGKFTT

SEQ ID NO: 1134662 - protein, 9 aa, Homo Sapiens
PTRMSHLAL

SEQ ID NO: 1134663 - protein, 9 aa, Homo Sapiens
FLCHHEKIF

SEQ ID NO: 1134664 - protein, 9 aa, Homo Sapiens
GLETTVFYI

SEQ ID NO: 1134665 - protein, 9 aa, Homo Sapiens
THERGVSIH

SEQ ID NO: 1134666 - protein, 9 aa, Homo Sapiens
SLLTRPRPA

SEQ ID NO: 1134667 - protein, 9 aa, Homo Sapiens
SGDMMSSGF

SEQ ID NO: 1134668 - protein, 9 aa, Homo Sapiens
WRSRSICPC

SEQ ID NO: 1134669 - protein, 9 aa, Homo Sapiens
LPKFTKKHT

SEQ ID NO: 1134670 - protein, 9 aa, Homo Sapiens
LHDPKKNHR

SEQ ID NO: 1134671 - protein, 9 aa, Homo Sapiens
DGANHSQDD

SEQ ID NO: 1134672 - protein, 9 aa, Homo Sapiens
VEEWYNDSV

SEQ ID NO: 1134673 - protein, 9 aa, Homo Sapiens
KNSVTKVFK

SEQ ID NO: 1134674 - protein, 9 aa, Homo Sapiens
RYARPADTL

SEQ ID NO: 1134675 - protein, 9 aa, Homo Sapiens
HGEKPYECK

SEQ ID NO: 1134676 - protein, 9 aa, Homo Sapiens
YALHGEVSS

SEQ ID NO: 1134677 - protein, 9 aa, Homo Sapiens
PGTAEGPAA

SEQ ID NO: 1134678 - protein, 9 aa, Homo Sapiens
EGTAGVCRK

SEQ ID NO: 1134679 - protein, 9 aa, Homo Sapiens
DCQMNVNDT

SEQ ID NO: 1134680 - protein, 9 aa, Homo Sapiens
PLPSLRTRR

SEQ ID NO: 1134681 - protein, 9 aa, Homo Sapiens
RRAGCRPME

SEQ ID NO: 1134682 - protein, 9 aa, Homo Sapiens
AMKMGDNVI

SEQ ID NO: 1134683 - protein, 9 aa, Homo Sapiens
SRQRTQEPT

SEQ ID NO: 1134684 - protein, 9 aa, Homo Sapiens
SHKSNLLYT

SEQ ID NO: 1134685 - protein, 9 aa, Homo Sapiens
VSVDYHVSL

SEQ ID NO: 1134686 - protein, 9 aa, Homo Sapiens
CHHEKIFHP

SEQ ID NO: 1134687 - protein, 9 aa, Homo Sapiens
SWRSPTASS

SEQ ID NO: 1134688 - protein, 9 aa, Homo Sapiens
VNCLTTVQE

SEQ ID NO: 1134689 - protein, 9 aa, Homo Sapiens
SLQDLVHVH

SEQ ID NO: 1134690 - protein, 9 aa, Homo Sapiens
SAFPSRSLS

SEQ ID NO: 1134691 - protein, 9 aa, Homo Sapiens
LGSDLPGLE

SEQ ID NO: 1134692 - protein, 9 aa, Homo Sapiens
TPTVCGVLD

SEQ ID NO: 1134693 - protein, 9 aa, Homo Sapiens
RDVESLVQL

SEQ ID NO: 1134694 - protein, 9 aa, Homo Sapiens
FCNGTSSNC

SEQ ID NO: 1134695 - protein, 9 aa, Homo Sapiens
QISLEGALS

SEQ ID NO: 1134696 - protein, 9 aa, Homo Sapiens
QEEVEEVEV

SEQ ID NO: 1134697 - protein, 9 aa, Homo Sapiens
PSAWCSSAA

SEQ ID NO: 1134698 - protein, 9 aa, Homo Sapiens
ENRSSEGTK

SEQ ID NO: 1134699 - protein, 9 aa, Homo Sapiens
QYNISWHSD

SEQ ID NO: 1134700 - protein, 9 aa, Homo Sapiens
NDCMRGSSQ

SEQ ID NO: 1134701 - protein, 9 aa, Homo Sapiens
KHPLFPKDI

SEQ ID NO: 1134702 - protein, 9 aa, Homo Sapiens
NKKAKRVAV

SEQ ID NO: 1134703 - protein, 9 aa, Homo Sapiens
NQINDQASF

SEQ ID NO: 1134704 - protein, 9 aa, Homo Sapiens
AVAFLAQES

SEQ ID NO: 1134705 - protein, 9 aa, Homo Sapiens
DVNFPINNL

SEQ ID NO: 1134706 - protein, 9 aa, Homo Sapiens
ISSSPADTT

SEQ ID NO: 1134707 - protein, 9 aa, Homo Sapiens
GNMYHLPAT

SEQ ID NO: 1134708 - protein, 9 aa, Homo Sapiens
EELDYYLYD

SEQ ID NO: 1134709 - protein, 9 aa, Homo Sapiens
WALLWSPLL

SEQ ID NO: 1134710 - protein, 9 aa, Homo Sapiens
ELDNVFSPQ

SEQ ID NO: 1134711 - protein, 9 aa, Homo Sapiens
LDASQPSWN

SEQ ID NO: 1134712 - protein, 9 aa, Homo Sapiens
RSASTKHCS

SEQ ID NO: 1134713 - protein, 9 aa, Homo Sapiens
FLPDYLGLS

SEQ ID NO: 1134714 - protein, 9 aa, Homo Sapiens
SSWFEDAVC

SEQ ID NO: 1134715 - protein, 9 aa, Homo Sapiens
GKNPHCGLR

SEQ ID NO: 1134716 - protein, 9 aa, Homo Sapiens
IVRSLRQDH

SEQ ID NO: 1134717 - protein, 9 aa, Homo Sapiens
LGKDLTQVE

SEQ ID NO: 1134718 - protein, 9 aa, Homo Sapiens
LRHPLHPPH

SEQ ID NO: 1134719 - protein, 9 aa, Homo Sapiens
TSSVAGRTT

SEQ ID NO: 1134720 - protein, 9 aa, Homo Sapiens
QVGGTLDTE

SEQ ID NO: 1134721 - protein, 9 aa, Homo Sapiens
ESPLTDKKA

SEQ ID NO: 1134722 - protein, 9 aa, Homo Sapiens
KVRFEEFAS

SEQ ID NO: 1134723 - protein, 9 aa, Homo Sapiens
YTLEKSYIE

SEQ ID NO: 1134724 - protein, 9 aa, Homo Sapiens
LAAPMGHPP

SEQ ID NO: 1134725 - protein, 9 aa, Homo Sapiens
DRGNYARLN

SEQ ID NO: 1134726 - protein, 9 aa, Homo Sapiens
VEDAFHGPY

SEQ ID NO: 1134727 - protein, 9 aa, Homo Sapiens
PCPGTATME

SEQ ID NO: 1134728 - protein, 9 aa, Homo Sapiens
QIAMTIVSF

SEQ ID NO: 1134729 - protein, 9 aa, Homo Sapiens
LRPPPLSLP

SEQ ID NO: 1134730 - protein, 9 aa, Homo Sapiens
VKAGKRMVR

SEQ ID NO: 1134731 - protein, 9 aa, Homo Sapiens
HCMGEIVTK

SEQ ID NO: 1134732 - protein, 9 aa, Homo Sapiens
GTSDCSLPE

SEQ ID NO: 1134733 - protein, 9 aa, Homo Sapiens
DIKKGVSWS

SEQ ID NO: 1134734 - protein, 9 aa, Homo Sapiens
LLSTLSQPP

SEQ ID NO: 1134735 - protein, 9 aa, Homo Sapiens
RGAERWNKK

SEQ ID NO: 1134736 - protein, 9 aa, Homo Sapiens
MDDATISRN

SEQ ID NO: 1134737 - protein, 9 aa, Homo Sapiens
CQQSAPWRS

SEQ ID NO: 1134738 - protein, 9 aa, Homo Sapiens
SRGSMSARV

SEQ ID NO: 1134739 - protein, 9 aa, Homo Sapiens
FADPVKKSC

SEQ ID NO: 1134740 - protein, 9 aa, Homo Sapiens
GASSSPHIC

SEQ ID NO: 1134741 - protein, 9 aa, Homo Sapiens
QDERLLLQE

SEQ ID NO: 1134742 - protein, 9 aa, Homo Sapiens
MNLTREPSR

SEQ ID NO: 1134743 - protein, 9 aa, Homo Sapiens
TVRSRSPRC

SEQ ID NO: 1134744 - protein, 9 aa, Homo Sapiens
LATSYSSED

SEQ ID NO: 1134745 - protein, 9 aa, Homo Sapiens
LLGPLKTEQ

SEQ ID NO: 1134746 - protein, 9 aa, Homo Sapiens
LRRLRGGQR

SEQ ID NO: 1134747 - protein, 9 aa, Homo Sapiens
NMVKVQDEK

SEQ ID NO: 1134748 - protein, 9 aa, Homo Sapiens
RKSLETPIK

SEQ ID NO: 1134749 - protein, 9 aa, Homo Sapiens
EFCTRLLWK

SEQ ID NO: 1134750 - protein, 9 aa, Homo Sapiens
CVVMAIFSA

SEQ ID NO: 1134751 - protein, 9 aa, Homo Sapiens
VATPACIGW

SEQ ID NO: 1134752 - protein, 9 aa, Homo Sapiens
NQVVAVPIL

SEQ ID NO: 1134753 - protein, 9 aa, Homo Sapiens
LMMSSTNNW

SEQ ID NO: 1134754 - protein, 9 aa, Homo Sapiens
KNKMNMDHQ

SEQ ID NO: 1134755 - protein, 9 aa, Homo Sapiens
MACTVAYAV

SEQ ID NO: 1134756 - protein, 9 aa, Homo Sapiens
SLSTVLSQK

SEQ ID NO: 1134757 - protein, 9 aa, Homo Sapiens
KAGGPLPPR

SEQ ID NO: 1134758 - protein, 9 aa, Homo Sapiens
LAQLHSSLI

SEQ ID NO: 1134759 - protein, 9 aa, Homo Sapiens
SQQLSLELN

SEQ ID NO: 1134760 - protein, 9 aa, Homo Sapiens
AENNEGGKR

SEQ ID NO: 1134761 - protein, 9 aa, Homo Sapiens
EISSGTSLA

SEQ ID NO: 1134762 - protein, 9 aa, Homo Sapiens
LSDDLGKTM

SEQ ID NO: 1134763 - protein, 9 aa, Homo Sapiens
EGDLQHALA

SEQ ID NO: 1134764 - protein, 9 aa, Homo Sapiens
LYYPPGVMV

SEQ ID NO: 1134765 - protein, 9 aa, Homo Sapiens
YPNEEDMFA

SEQ ID NO: 1134766 - protein, 9 aa, Homo Sapiens
HICDLLSDF

SEQ ID NO: 1134767 - protein, 9 aa, Homo Sapiens
DSPASPSAP

SEQ ID NO: 1134768 - protein, 9 aa, Homo Sapiens
KPIYSWYGS

SEQ ID NO: 1134769 - protein, 9 aa, Homo Sapiens
SSQDKTHGG

SEQ ID NO: 1134770 - protein, 9 aa, Homo Sapiens
MNWTHTAAC

SEQ ID NO: 1134771 - protein, 9 aa, Homo Sapiens
SRPTGRTPT

SEQ ID NO: 1134772 - protein, 9 aa, Homo Sapiens
AYHVHCKGA

SEQ ID NO: 1134773 - protein, 9 aa, Homo Sapiens
GCWGWQQSW

SEQ ID NO: 1134774 - protein, 9 aa, Homo Sapiens
GRNASASRP

SEQ ID NO: 1134775 - protein, 9 aa, Homo Sapiens
ALLLYDELL

SEQ ID NO: 1134776 - protein, 9 aa, Homo Sapiens
QADSPCCSD

SEQ ID NO: 1134777 - protein, 9 aa, Homo Sapiens
TDEVKAGKR

SEQ ID NO: 1134778 - protein, 9 aa, Homo Sapiens
SSTYAPPNS

SEQ ID NO: 1134779 - protein, 9 aa, Homo Sapiens
ECHKCKCLC

SEQ ID NO: 1134780 - protein, 9 aa, Homo Sapiens
LGPLRSLPC

SEQ ID NO: 1134781 - protein, 9 aa, Homo Sapiens
PPGPSPASL

SEQ ID NO: 1134782 - protein, 9 aa, Homo Sapiens
DGNSEGEFF

SEQ ID NO: 1134783 - protein, 9 aa, Homo Sapiens
PARGPQPVT

SEQ ID NO: 1134784 - protein, 9 aa, Homo Sapiens
VGLTYLGSP

SEQ ID NO: 1134785 - protein, 9 aa, Homo Sapiens
GPSPAPLRL

SEQ ID NO: 1134786 - protein, 9 aa, Homo Sapiens
NNGIHYWLQ

SEQ ID NO: 1134787 - protein, 9 aa, Homo Sapiens
SMDERKLRE

SEQ ID NO: 1134788 - protein, 9 aa, Homo Sapiens
GKGFAQHSN

SEQ ID NO: 1134789 - protein, 9 aa, Homo Sapiens
MESLPAAHH

SEQ ID NO: 1134790 - protein, 9 aa, Homo Sapiens
QDQELATVL

SEQ ID NO: 1134791 - protein, 9 aa, Homo Sapiens
HIEQELLLQ

SEQ ID NO: 1134792 - protein, 9 aa, Homo Sapiens
MADLKELRH

SEQ ID NO: 1134793 - protein, 9 aa, Homo Sapiens
QHCSGSQRT

SEQ ID NO: 1134794 - protein, 9 aa, Homo Sapiens
GITPHGQIA

SEQ ID NO: 1134795 - protein, 9 aa, Homo Sapiens
TKHCSIFPS

SEQ ID NO: 1134796 - protein, 9 aa, Homo Sapiens
ITLSTIVAG

SEQ ID NO: 1134797 - protein, 9 aa, Homo Sapiens
AATLAPAQA

SEQ ID NO: 1134798 - protein, 9 aa, Homo Sapiens
PPRAAAPAS

SEQ ID NO: 1134799 - protein, 9 aa, Homo Sapiens
PWLPAVPHT

SEQ ID NO: 1134800 - protein, 9 aa, Homo Sapiens
ILEAKQNGY

SEQ ID NO: 1134801 - protein, 9 aa, Homo Sapiens
CFQDVHAMV

SEQ ID NO: 1134802 - protein, 9 aa, Homo Sapiens
HRGNEQISK

SEQ ID NO: 1134803 - protein, 9 aa, Homo Sapiens
EFDQGCLAL

SEQ ID NO: 1134804 - protein, 9 aa, Homo Sapiens
QNCMEKIVN

SEQ ID NO: 1134805 - protein, 9 aa, Homo Sapiens
DSIRAPRGL

SEQ ID NO: 1134806 - protein, 9 aa, Homo Sapiens
LFSVFEGVS

SEQ ID NO: 1134807 - protein, 9 aa, Homo Sapiens
QTSYALFIR

SEQ ID NO: 1134808 - protein, 9 aa, Homo Sapiens
DDMDQKERD

SEQ ID NO: 1134809 - protein, 9 aa, Homo Sapiens
GDAPQWAMG

SEQ ID NO: 1134810 - protein, 9 aa, Homo Sapiens
ATCWCRLKT

SEQ ID NO: 1134811 - protein, 9 aa, Homo Sapiens
KYPAAHLRQ

SEQ ID NO: 1134812 - protein, 9 aa, Homo Sapiens
MGAICPLLY

SEQ ID NO: 1134813 - protein, 9 aa, Homo Sapiens
QFTPGFWLM

SEQ ID NO: 1134814 - protein, 9 aa, Homo Sapiens
EPQRDKHLR

SEQ ID NO: 1134815 - protein, 9 aa, Homo Sapiens
LDRPLLPHK

SEQ ID NO: 1134816 - protein, 9 aa, Homo Sapiens
RNFEVGEDE

SEQ ID NO: 1134817 - protein, 9 aa, Homo Sapiens
SAAASEDAQ

SEQ ID NO: 1134818 - protein, 9 aa, Homo Sapiens
TSSGSIKRS

SEQ ID NO: 1134819 - protein, 9 aa, Homo Sapiens
KAQIPQLNP

SEQ ID NO: 1134820 - protein, 9 aa, Homo Sapiens
PGPGPPSGA

SEQ ID NO: 1134821 - protein, 9 aa, Homo Sapiens
GEDGKRLQP

SEQ ID NO: 1134822 - protein, 9 aa, Homo Sapiens
WKEGGERGQ

SEQ ID NO: 1134823 - protein, 9 aa, Homo Sapiens
LISLMIEYS

SEQ ID NO: 1134824 - protein, 9 aa, Homo Sapiens
GADLRHPRR

SEQ ID NO: 1134825 - protein, 9 aa, Homo Sapiens
VLIEYFHLD

SEQ ID NO: 1134826 - protein, 9 aa, Homo Sapiens
FNKQRNGCH

SEQ ID NO: 1134827 - protein, 9 aa, Homo Sapiens
FASILFMIV

SEQ ID NO: 1134828 - protein, 9 aa, Homo Sapiens
QIVPKRIRK

SEQ ID NO: 1134829 - protein, 9 aa, Homo Sapiens
KRLSIQERR

SEQ ID NO: 1134830 - protein, 9 aa, Homo Sapiens
ARWDLRRPQ

SEQ ID NO: 1134831 - protein, 9 aa, Homo Sapiens
PAGPAGTGR

SEQ ID NO: 1134832 - protein, 9 aa, Homo Sapiens
KQKFRPTLP

SEQ ID NO: 1134833 - protein, 9 aa, Homo Sapiens
GHIANRLAV

SEQ ID NO: 1134834 - protein, 9 aa, Homo Sapiens
TAVSVPDSL

SEQ ID NO: 1134835 - protein, 9 aa, Homo Sapiens
VPTDGKRAI

SEQ ID NO: 1134836 - protein, 9 aa, Homo Sapiens
YSIMDELVC

SEQ ID NO: 1134837 - protein, 9 aa, Homo Sapiens
EINKRIEHS

SEQ ID NO: 1134838 - protein, 9 aa, Homo Sapiens
EGLKMEKES

SEQ ID NO: 1134839 - protein, 9 aa, Homo Sapiens
LAVAFLAQE

SEQ ID NO: 1134840 - protein, 9 aa, Homo Sapiens
LTGPGVADY

SEQ ID NO: 1134841 - protein, 9 aa, Homo Sapiens
DASELGMEE

SEQ ID NO: 1134842 - protein, 9 aa, Homo Sapiens
DVTTHFDEV

SEQ ID NO: 1134843 - protein, 9 aa, Homo Sapiens
KGIDCSGGF

SEQ ID NO: 1134844 - protein, 9 aa, Homo Sapiens
KGQHIEQLS

SEQ ID NO: 1134845 - protein, 9 aa, Homo Sapiens
LMKMVWPPY

SEQ ID NO: 1134846 - protein, 9 aa, Homo Sapiens
EHRKMRKSL

SEQ ID NO: 1134847 - protein, 9 aa, Homo Sapiens
ITVATGVSY

SEQ ID NO: 1134848 - protein, 9 aa, Homo Sapiens
ALVYDITSR

SEQ ID NO: 1134849 - protein, 9 aa, Homo Sapiens
PPQGLVAAY

SEQ ID NO: 1134850 - protein, 9 aa, Homo Sapiens
KLILSEKLF

SEQ ID NO: 1134851 - protein, 9 aa, Homo Sapiens
RLPQDVGTS

SEQ ID NO: 1134852 - protein, 9 aa, Homo Sapiens
FIMLNYNTN

SEQ ID NO: 1134853 - protein, 9 aa, Homo Sapiens
GGGFGGKEA

SEQ ID NO: 1134854 - protein, 9 aa, Homo Sapiens
GLPAMGGAW

SEQ ID NO: 1134855 - protein, 9 aa, Homo Sapiens
RGYRHPVLL

SEQ ID NO: 1134856 - protein, 9 aa, Homo Sapiens
SLRTRRPWT

SEQ ID NO: 1134857 - protein, 9 aa, Homo Sapiens
FRDHKRVHT

SEQ ID NO: 1134858 - protein, 9 aa, Homo Sapiens
GPAGLPRAP

SEQ ID NO: 1134859 - protein, 9 aa, Homo Sapiens
DQKLPVFGQ

SEQ ID NO: 1134860 - protein, 9 aa, Homo Sapiens
LRTLKQTGH

SEQ ID NO: 1134861 - protein, 9 aa, Homo Sapiens
RGKSQGGRI

SEQ ID NO: 1134862 - protein, 9 aa, Homo Sapiens
GGRWTSFGY

SEQ ID NO: 1134863 - protein, 9 aa, Homo Sapiens
DAGACYAAG

SEQ ID NO: 1134864 - protein, 9 aa, Homo Sapiens
PGSAGRHRG

SEQ ID NO: 1134865 - protein, 9 aa, Homo Sapiens
ALYLCAVRD

SEQ ID NO: 1134866 - protein, 9 aa, Homo Sapiens
NLVACPDLR

SEQ ID NO: 1134867 - protein, 9 aa, Homo Sapiens
LKNGRKFPC

SEQ ID NO: 1134868 - protein, 9 aa, Homo Sapiens
KPNLEYFSP

SEQ ID NO: 1134869 - protein, 9 aa, Homo Sapiens
NLNISCHAA

SEQ ID NO: 1134870 - protein, 9 aa, Homo Sapiens
CGLGFCPTN

SEQ ID NO: 1134871 - protein, 9 aa, Homo Sapiens
VAFKAEGEY

SEQ ID NO: 1134872 - protein, 9 aa, Homo Sapiens
SYKLKMACK

SEQ ID NO: 1134873 - protein, 9 aa, Homo Sapiens
CDFTSNVNH

SEQ ID NO: 1134874 - protein, 9 aa, Homo Sapiens
ALSDTEQSL

SEQ ID NO: 1134875 - protein, 9 aa, Homo Sapiens
SATMSNQQP

SEQ ID NO: 1134876 - protein, 9 aa, Homo Sapiens
IRDWRGPSW

SEQ ID NO: 1134877 - protein, 9 aa, Homo Sapiens
IAMTIVSFY

SEQ ID NO: 1134878 - protein, 9 aa, Homo Sapiens
RGTTRFYFK

SEQ ID NO: 1134879 - protein, 9 aa, Homo Sapiens
PPLPQTHQK

SEQ ID NO: 1134880 - protein, 9 aa, Homo Sapiens
GMSVLSLNI

SEQ ID NO: 1134881 - protein, 9 aa, Homo Sapiens
CFLSMIMYS

SEQ ID NO: 1134882 - protein, 9 aa, Homo Sapiens
QVGHYVVVI

SEQ ID NO: 1134883 - protein, 9 aa, Homo Sapiens
QPRGWQPAP

SEQ ID NO: 1134884 - protein, 9 aa, Homo Sapiens
HPPGTQEVD

SEQ ID NO: 1134885 - protein, 9 aa, Homo Sapiens
VQRSLVPRC

SEQ ID NO: 1134886 - protein, 9 aa, Homo Sapiens
VTRAVAHSI

SEQ ID NO: 1134887 - protein, 9 aa, Homo Sapiens
RNHRIFEKD

SEQ ID NO: 1134888 - protein, 9 aa, Homo Sapiens
SREIFRNEM

SEQ ID NO: 1134889 - protein, 9 aa, Homo Sapiens
TLQKMGKNR

SEQ ID NO: 1134890 - protein, 9 aa, Homo Sapiens
LEIGQVPTL

SEQ ID NO: 1134891 - protein, 9 aa, Homo Sapiens
SGGDPTGWF

SEQ ID NO: 1134892 - protein, 9 aa, Homo Sapiens
VESSSPMVM

SEQ ID NO: 1134893 - protein, 9 aa, Homo Sapiens
EEEEGGNVE

SEQ ID NO: 1134894 - protein, 9 aa, Homo Sapiens
EEKPAHNYL

SEQ ID NO: 1134895 - protein, 9 aa, Homo Sapiens
SSIRTVQWP

SEQ ID NO: 1134896 - protein, 9 aa, Homo Sapiens
EAAQTEYIE

SEQ ID NO: 1134897 - protein, 9 aa, Homo Sapiens
RRSKQKDKV

SEQ ID NO: 1134898 - protein, 9 aa, Homo Sapiens
MKKCRKLGD

SEQ ID NO: 1134899 - protein, 9 aa, Homo Sapiens
HTISDGIVQ

SEQ ID NO: 1134900 - protein, 9 aa, Homo Sapiens
PEQLPQHAL

SEQ ID NO: 1134901 - protein, 9 aa, Homo Sapiens
PMGSCVCGS

SEQ ID NO: 1134902 - protein, 9 aa, Homo Sapiens
KTGLSWSLQ

SEQ ID NO: 1134903 - protein, 9 aa, Homo Sapiens
CVNCFSCST

SEQ ID NO: 1134904 - protein, 9 aa, Homo Sapiens
HYEESSRDV

SEQ ID NO: 1134905 - protein, 9 aa, Homo Sapiens
ILPLLNRPC

SEQ ID NO: 1134906 - protein, 9 aa, Homo Sapiens
QSPVTGEVW

SEQ ID NO: 1134907 - protein, 9 aa, Homo Sapiens
YRGIIDCVV

SEQ ID NO: 1134908 - protein, 9 aa, Homo Sapiens
PMCSTCGKV

SEQ ID NO: 1134909 - protein, 9 aa, Homo Sapiens
YIHPFIFAL

SEQ ID NO: 1134910 - protein, 9 aa, Homo Sapiens
RARGGTTIG

SEQ ID NO: 1134911 - protein, 9 aa, Homo Sapiens
TATAACPMT

SEQ ID NO: 1134912 - protein, 9 aa, Homo Sapiens
SHWTPYTFS

SEQ ID NO: 1134913 - protein, 9 aa, Homo Sapiens
SEDYTDQRI

SEQ ID NO: 1134914 - protein, 9 aa, Homo Sapiens
LAVAVALGV

SEQ ID NO: 1134915 - protein, 9 aa, Homo Sapiens
LRPTGTGPP

SEQ ID NO: 1134916 - protein, 9 aa, Homo Sapiens
EMLVENEGP

SEQ ID NO: 1134917 - protein, 9 aa, Homo Sapiens
AGCTPYEVH

SEQ ID NO: 1134918 - protein, 9 aa, Homo Sapiens
LKARGALAT

SEQ ID NO: 1134919 - protein, 9 aa, Homo Sapiens
EVPEQQVTV

SEQ ID NO: 1134920 - protein, 9 aa, Homo Sapiens
FAFSTRLAV

SEQ ID NO: 1134921 - protein, 9 aa, Homo Sapiens
AGDEHKRSM

SEQ ID NO: 1134922 - protein, 9 aa, Homo Sapiens
GVPELRIGR

SEQ ID NO: 1134923 - protein, 9 aa, Homo Sapiens
DWPAKDMFD

SEQ ID NO: 1134924 - protein, 9 aa, Homo Sapiens
KICLKYYHG

SEQ ID NO: 1134925 - protein, 9 aa, Homo Sapiens
EQGRVHAVY

SEQ ID NO: 1134926 - protein, 9 aa, Homo Sapiens
TVIIGGLFP

SEQ ID NO: 1134927 - protein, 9 aa, Homo Sapiens
TDPIEQGLR

SEQ ID NO: 1134928 - protein, 9 aa, Homo Sapiens
LRSPITSIK

SEQ ID NO: 1134929 - protein, 9 aa, Homo Sapiens
WYNILTVNR

SEQ ID NO: 1134930 - protein, 9 aa, Homo Sapiens
LNLRERYFS

SEQ ID NO: 1134931 - protein, 9 aa, Homo Sapiens
LLLRILRLR

SEQ ID NO: 1134932 - protein, 9 aa, Homo Sapiens
GQGLVGMTP

SEQ ID NO: 1134933 - protein, 9 aa, Homo Sapiens
PRPRQPTGA

SEQ ID NO: 1134934 - protein, 9 aa, Homo Sapiens
YHAPIKDKV

SEQ ID NO: 1134935 - protein, 9 aa, Homo Sapiens
AHCNSSNKS

SEQ ID NO: 1134936 - protein, 9 aa, Homo Sapiens
GPPGTSPGD

SEQ ID NO: 1134937 - protein, 9 aa, Homo Sapiens
RSSSAAPMA

SEQ ID NO: 1134938 - protein, 9 aa, Homo Sapiens
VDMVRTAYL

SEQ ID NO: 1134939 - protein, 9 aa, Homo Sapiens
VCGGTWPCP

SEQ ID NO: 1134940 - protein, 9 aa, Homo Sapiens
TAPRHHQAW

SEQ ID NO: 1134941 - protein, 9 aa, Homo Sapiens
VPCYNFTRG

SEQ ID NO: 1134942 - protein, 9 aa, Homo Sapiens
IDSQVDGSS

SEQ ID NO: 1134943 - protein, 9 aa, Homo Sapiens
QSVLDASEL

SEQ ID NO: 1134944 - protein, 9 aa, Homo Sapiens
WGFSDPGVW

SEQ ID NO: 1134945 - protein, 9 aa, Homo Sapiens
RQKQASDSD

SEQ ID NO: 1134946 - protein, 9 aa, Homo Sapiens
SPTLPVSRC

SEQ ID NO: 1134947 - protein, 9 aa, Homo Sapiens
RMKWKNDNK

SEQ ID NO: 1134948 - protein, 9 aa, Homo Sapiens
IIFQWLIEL

SEQ ID NO: 1134949 - protein, 9 aa, Homo Sapiens
LRELCLREF

SEQ ID NO: 1134950 - protein, 9 aa, Homo Sapiens
RVTLVTAPQ

SEQ ID NO: 1134951 - protein, 9 aa, Homo Sapiens
HLRSPSCPR

SEQ ID NO: 1134952 - protein, 9 aa, Homo Sapiens
MTPRDLGTV

SEQ ID NO: 1134953 - protein, 9 aa, Homo Sapiens
SESLHIFRD

SEQ ID NO: 1134954 - protein, 9 aa, Homo Sapiens
GMTPRDLGT

SEQ ID NO: 1134955 - protein, 9 aa, Homo Sapiens
RAQSLKTLR

SEQ ID NO: 1134956 - protein, 9 aa, Homo Sapiens
TAKTIKTVQ

SEQ ID NO: 1134957 - protein, 9 aa, Homo Sapiens
IDCSGGFNG

SEQ ID NO: 1134958 - protein, 9 aa, Homo Sapiens
KECNFSDLK

SEQ ID NO: 1134959 - protein, 9 aa, Homo Sapiens
NYSHLAKRL

SEQ ID NO: 1134960 - protein, 9 aa, Homo Sapiens
GGTTSSSGT

SEQ ID NO: 1134961 - protein, 9 aa, Homo Sapiens
IVNDYDELV

SEQ ID NO: 1134962 - protein, 9 aa, Homo Sapiens
PSPARSAAA

SEQ ID NO: 1134963 - protein, 9 aa, Homo Sapiens
GSYPPARQP

SEQ ID NO: 1134964 - protein, 9 aa, Homo Sapiens
EKSCLSISG

SEQ ID NO: 1134965 - protein, 9 aa, Homo Sapiens
AKKPAVTTR

SEQ ID NO: 1134966 - protein, 9 aa, Homo Sapiens
QNRRDVEAW

SEQ ID NO: 1134967 - protein, 9 aa, Homo Sapiens
HLGALECAG

SEQ ID NO: 1134968 - protein, 9 aa, Homo Sapiens
GGLPYHTID

SEQ ID NO: 1134969 - protein, 9 aa, Homo Sapiens
VSQIRGQEK

SEQ ID NO: 1134970 - protein, 9 aa, Homo Sapiens
HRTPWLCKP

SEQ ID NO: 1134971 - protein, 9 aa, Homo Sapiens
KKTKYAFSL

SEQ ID NO: 1134972 - protein, 9 aa, Homo Sapiens
SDKQGMSVL

SEQ ID NO: 1134973 - protein, 9 aa, Homo Sapiens
HGADVEPDL

SEQ ID NO: 1134974 - protein, 9 aa, Homo Sapiens
PHEKKKKRW

SEQ ID NO: 1134975 - protein, 9 aa, Homo Sapiens
NYPCLAPVK

SEQ ID NO: 1134976 - protein, 9 aa, Homo Sapiens
GGKEARSTV

SEQ ID NO: 1134977 - protein, 9 aa, Homo Sapiens
IDVGFDKDL

SEQ ID NO: 1134978 - protein, 9 aa, Homo Sapiens
VVITDGCHD

SEQ ID NO: 1134979 - protein, 9 aa, Homo Sapiens
PYQREAPQV

SEQ ID NO: 1134980 - protein, 9 aa, Homo Sapiens
YKLYEVQTV

SEQ ID NO: 1134981 - protein, 9 aa, Homo Sapiens
NKVSYLHSN

SEQ ID NO: 1134982 - protein, 9 aa, Homo Sapiens
YRNHWSDML

SEQ ID NO: 1134983 - protein, 9 aa, Homo Sapiens
PRPCPGICQ

SEQ ID NO: 1134984 - protein, 9 aa, Homo Sapiens
ATEQGTYRA

SEQ ID NO: 1134985 - protein, 9 aa, Homo Sapiens
GGSANSLRV

SEQ ID NO: 1134986 - protein, 9 aa, Homo Sapiens
VQGQMVPPL

SEQ ID NO: 1134987 - protein, 9 aa, Homo Sapiens
CRFHSPLLP

SEQ ID NO: 1134988 - protein, 9 aa, Homo Sapiens
LQTFDYEQF

SEQ ID NO: 1134989 - protein, 9 aa, Homo Sapiens
RAPLHGVPQ

SEQ ID NO: 1134990 - protein, 9 aa, Homo Sapiens
LCRTHLKEY

SEQ ID NO: 1134991 - protein, 9 aa, Homo Sapiens
CSTTINRNH

SEQ ID NO: 1134992 - protein, 9 aa, Homo Sapiens
HCERRNLSN

SEQ ID NO: 1134993 - protein, 9 aa, Homo Sapiens
QLRKLLHVL

SEQ ID NO: 1134994 - protein, 9 aa, Homo Sapiens
AMLENYRNL

SEQ ID NO: 1134995 - protein, 9 aa, Homo Sapiens
PEELVPVAE

SEQ ID NO: 1134996 - protein, 9 aa, Homo Sapiens
LLLLMDAGA

SEQ ID NO: 1134997 - protein, 9 aa, Homo Sapiens
RKTGVAFKA

SEQ ID NO: 1134998 - protein, 9 aa, Homo Sapiens
TRTRSPRRP

SEQ ID NO: 1134999 - protein, 9 aa, Homo Sapiens
PGGDPISAG

SEQ ID NO: 1135000 - protein, 9 aa, Homo Sapiens
PGIPPALGP

SEQ ID NO: 1135001 - protein, 9 aa, Homo Sapiens
RLLLVKKPL

SEQ ID NO: 1135002 - protein, 9 aa, Homo Sapiens
ELLIGRLGE

SEQ ID NO: 1135003 - protein, 9 aa, Homo Sapiens
APLRLCWSV

SEQ ID NO: 1135004 - protein, 9 aa, Homo Sapiens
PAWLVWVPH

SEQ ID NO: 1135005 - protein, 9 aa, Homo Sapiens
NVEAAQTEY

SEQ ID NO: 1135006 - protein, 9 aa, Homo Sapiens
MIEYSEPWM

SEQ ID NO: 1135007 - protein, 9 aa, Homo Sapiens
KKILKLKYI

SEQ ID NO: 1135008 - protein, 9 aa, Homo Sapiens
WRSLARDEG

SEQ ID NO: 1135009 - protein, 9 aa, Homo Sapiens
TITNLERWV

SEQ ID NO: 1135010 - protein, 9 aa, Homo Sapiens
GETTHRDKV

SEQ ID NO: 1135011 - protein, 9 aa, Homo Sapiens
AQSSFCLRD

SEQ ID NO: 1135012 - protein, 9 aa, Homo Sapiens
VSTAPSKAG

SEQ ID NO: 1135013 - protein, 9 aa, Homo Sapiens
NLADECDDD

SEQ ID NO: 1135014 - protein, 9 aa, Homo Sapiens
LFLNSTFPS

SEQ ID NO: 1135015 - protein, 9 aa, Homo Sapiens
SRGGAVAAV

SEQ ID NO: 1135016 - protein, 9 aa, Homo Sapiens
YRAWKVQLP

SEQ ID NO: 1135017 - protein, 9 aa, Homo Sapiens
KKQEPPCTR

SEQ ID NO: 1135018 - protein, 9 aa, Homo Sapiens
TPVSRTTVP

SEQ ID NO: 1135019 - protein, 9 aa, Homo Sapiens
DLGTVAGAT

SEQ ID NO: 1135020 - protein, 9 aa, Homo Sapiens
SPSCPRRPL

SEQ ID NO: 1135021 - protein, 9 aa, Homo Sapiens
LTYPPGGGT

SEQ ID NO: 1135022 - protein, 9 aa, Homo Sapiens
ALAVAVALG

SEQ ID NO: 1135023 - protein, 9 aa, Homo Sapiens
VKLGNEVGH

SEQ ID NO: 1135024 - protein, 9 aa, Homo Sapiens
GVEVLSCRS

SEQ ID NO: 1135025 - protein, 9 aa, Homo Sapiens
TGRKTMRPS

SEQ ID NO: 1135026 - protein, 9 aa, Homo Sapiens
RPRAGPRCH

SEQ ID NO: 1135027 - protein, 9 aa, Homo Sapiens
LVIVGHGHE

SEQ ID NO: 1135028 - protein, 9 aa, Homo Sapiens
INIMNEENV

SEQ ID NO: 1135029 - protein, 9 aa, Homo Sapiens
APAAPSPGR

SEQ ID NO: 1135030 - protein, 9 aa, Homo Sapiens
FAIFRKECN

SEQ ID NO: 1135031 - protein, 9 aa, Homo Sapiens
AVSTRGASK

SEQ ID NO: 1135032 - protein, 9 aa, Homo Sapiens
FDDHETVDK

SEQ ID NO: 1135033 - protein, 9 aa, Homo Sapiens
VYFTEEPEP

SEQ ID NO: 1135034 - protein, 9 aa, Homo Sapiens
TLITDMLHQ

SEQ ID NO: 1135035 - protein, 9 aa, Homo Sapiens
DSETVKMAC

SEQ ID NO: 1135036 - protein, 9 aa, Homo Sapiens
TFAEMNRHS

SEQ ID NO: 1135037 - protein, 9 aa, Homo Sapiens
GAGLGPGLG

SEQ ID NO: 1135038 - protein, 9 aa, Homo Sapiens
LCWSVGRPH

SEQ ID NO: 1135039 - protein, 9 aa, Homo Sapiens
GINFDSPVR

SEQ ID NO: 1135040 - protein, 9 aa, Homo Sapiens
LLSLRAQSL

SEQ ID NO: 1135041 - protein, 9 aa, Homo Sapiens
SPSSAGPLV

SEQ ID NO: 1135042 - protein, 9 aa, Homo Sapiens
SLISVDGAS

SEQ ID NO: 1135043 - protein, 9 aa, Homo Sapiens
TLFSLKVWE

SEQ ID NO: 1135044 - protein, 9 aa, Homo Sapiens
AVGILSRHL

SEQ ID NO: 1135045 - protein, 9 aa, Homo Sapiens
IHSVQLRDR

SEQ ID NO: 1135046 - protein, 9 aa, Homo Sapiens
RACIGRRWE

SEQ ID NO: 1135047 - protein, 9 aa, Homo Sapiens
EQQLNGNDV

SEQ ID NO: 1135048 - protein, 9 aa, Homo Sapiens
TPATIINLL

SEQ ID NO: 1135049 - protein, 9 aa, Homo Sapiens
VTVWVPWLP

SEQ ID NO: 1135050 - protein, 9 aa, Homo Sapiens
LQITEWRSL

SEQ ID NO: 1135051 - protein, 9 aa, Homo Sapiens
QWGPPRARE

SEQ ID NO: 1135052 - protein, 9 aa, Homo Sapiens
RERKAHAYK

SEQ ID NO: 1135053 - protein, 9 aa, Homo Sapiens
IHASPRKST

SEQ ID NO: 1135054 - protein, 9 aa, Homo Sapiens
EYAFPAKKK

SEQ ID NO: 1135055 - protein, 9 aa, Homo Sapiens
KPSGLETTV

SEQ ID NO: 1135056 - protein, 9 aa, Homo Sapiens
SMDAAKEAL

SEQ ID NO: 1135057 - protein, 9 aa, Homo Sapiens
WILQLMYSC

SEQ ID NO: 1135058 - protein, 9 aa, Homo Sapiens
SDTEQSLEA

SEQ ID NO: 1135059 - protein, 9 aa, Homo Sapiens
STLVTALKG

SEQ ID NO: 1135060 - protein, 9 aa, Homo Sapiens
TASCEVLEI

SEQ ID NO: 1135061 - protein, 9 aa, Homo Sapiens
IKICLKYYH

SEQ ID NO: 1135062 - protein, 9 aa, Homo Sapiens
EEVLIPPLR

SEQ ID NO: 1135063 - protein, 9 aa, Homo Sapiens
PPGSSPGPP

SEQ ID NO: 1135064 - protein, 9 aa, Homo Sapiens
TSRARQSCC

SEQ ID NO: 1135065 - protein, 9 aa, Homo Sapiens
YLQDMWTTV

SEQ ID NO: 1135066 - protein, 9 aa, Homo Sapiens
ISPAILVII

SEQ ID NO: 1135067 - protein, 9 aa, Homo Sapiens
DSPCWLSKE

SEQ ID NO: 1135068 - protein, 9 aa, Homo Sapiens
MSWMAKGVQ

SEQ ID NO: 1135069 - protein, 9 aa, Homo Sapiens
KKSYALSNK

SEQ ID NO: 1135070 - protein, 9 aa, Homo Sapiens
ASTSGVFPA

SEQ ID NO: 1135071 - protein, 9 aa, Homo Sapiens
KEFPCHRAA

SEQ ID NO: 1135072 - protein, 9 aa, Homo Sapiens
RIYRCAHPL

SEQ ID NO: 1135073 - protein, 9 aa, Homo Sapiens
ARHFHTFRS

SEQ ID NO: 1135074 - protein, 9 aa, Homo Sapiens
NNFSRSPPT

SEQ ID NO: 1135075 - protein, 9 aa, Homo Sapiens
GSTSQLPTS

SEQ ID NO: 1135076 - protein, 9 aa, Homo Sapiens
QPALTPRPA

SEQ ID NO: 1135077 - protein, 9 aa, Homo Sapiens
HTQLLSPSG

SEQ ID NO: 1135078 - protein, 9 aa, Homo Sapiens
GTRCQPRMK

SEQ ID NO: 1135079 - protein, 9 aa, Homo Sapiens
IRKIPDCFS

SEQ ID NO: 1135080 - protein, 9 aa, Homo Sapiens
FLKLLGNFL

SEQ ID NO: 1135081 - protein, 9 aa, Homo Sapiens
DLYHSEEEE

SEQ ID NO: 1135082 - protein, 9 aa, Homo Sapiens
GVRSQRKDC

SEQ ID NO: 1135083 - protein, 9 aa, Homo Sapiens
ARSDTAQIV

SEQ ID NO: 1135084 - protein, 9 aa, Homo Sapiens
PLLPPPVLP

SEQ ID NO: 1135085 - protein, 9 aa, Homo Sapiens
PLFIIVRAS

SEQ ID NO: 1135086 - protein, 9 aa, Homo Sapiens
EVCSDFLKA

SEQ ID NO: 1135087 - protein, 9 aa, Homo Sapiens
RPEVSIFQD

SEQ ID NO: 1135088 - protein, 9 aa, Homo Sapiens
RMCKQKRRE

SEQ ID NO: 1135089 - protein, 9 aa, Homo Sapiens
LLNRAGRWR

SEQ ID NO: 1135090 - protein, 9 aa, Homo Sapiens
KWADSVPLP

SEQ ID NO: 1135091 - protein, 9 aa, Homo Sapiens
VITAAGASH

SEQ ID NO: 1135092 - protein, 9 aa, Homo Sapiens
FNVSTFLFL

SEQ ID NO: 1135093 - protein, 9 aa, Homo Sapiens
PLPERKTSA

SEQ ID NO: 1135094 - protein, 9 aa, Homo Sapiens
LSTVIRTLD

SEQ ID NO: 1135095 - protein, 9 aa, Homo Sapiens
DRPPTPIYQ

SEQ ID NO: 1135096 - protein, 9 aa, Homo Sapiens
LKKRARTRH

SEQ ID NO: 1135097 - protein, 9 aa, Homo Sapiens
FLVVFLYMW

SEQ ID NO: 1135098 - protein, 9 aa, Homo Sapiens
RTRPAPYGI

SEQ ID NO: 1135099 - protein, 9 aa, Homo Sapiens
MPDSSSSWK

SEQ ID NO: 1135100 - protein, 9 aa, Homo Sapiens
EHLLQPWLE

SEQ ID NO: 1135101 - protein, 9 aa, Homo Sapiens
VYSPFRSDP

SEQ ID NO: 1135102 - protein, 9 aa, Homo Sapiens
PHRRYFKKF

SEQ ID NO: 1135103 - protein, 9 aa, Homo Sapiens
TPDLLLGKN

SEQ ID NO: 1135104 - protein, 9 aa, Homo Sapiens
ELVLVRFVV

SEQ ID NO: 1135105 - protein, 9 aa, Homo Sapiens
GGNEAWKEA

SEQ ID NO: 1135106 - protein, 9 aa, Homo Sapiens
GKVTVQFQY

SEQ ID NO: 1135107 - protein, 9 aa, Homo Sapiens
DKVNYSHLA

SEQ ID NO: 1135108 - protein, 9 aa, Homo Sapiens
ALKKKKQLV

SEQ ID NO: 1135109 - protein, 9 aa, Homo Sapiens
NSSMGLQEY

SEQ ID NO: 1135110 - protein, 9 aa, Homo Sapiens
WAALPPSLW

SEQ ID NO: 1135111 - protein, 9 aa, Homo Sapiens
LPDPSGPPG

SEQ ID NO: 1135112 - protein, 9 aa, Homo Sapiens
PAPQGALTP

SEQ ID NO: 1135113 - protein, 9 aa, Homo Sapiens
TLPFTIKLL

SEQ ID NO: 1135114 - protein, 9 aa, Homo Sapiens
QDDHHLEVF

SEQ ID NO: 1135115 - protein, 9 aa, Homo Sapiens
STVEWGAGR

SEQ ID NO: 1135116 - protein, 9 aa, Homo Sapiens
TLGVKTLCN

SEQ ID NO: 1135117 - protein, 9 aa, Homo Sapiens
PPHLVPKLQ

SEQ ID NO: 1135118 - protein, 9 aa, Homo Sapiens
ISPYEVPPS

SEQ ID NO: 1135119 - protein, 9 aa, Homo Sapiens
GPLPPRRPP

SEQ ID NO: 1135120 - protein, 9 aa, Homo Sapiens
ETESWIPGM

SEQ ID NO: 1135121 - protein, 9 aa, Homo Sapiens
RLSVVHMMT

SEQ ID NO: 1135122 - protein, 9 aa, Homo Sapiens
AHALKHKVD

SEQ ID NO: 1135123 - protein, 9 aa, Homo Sapiens
TSGRGGRGA

SEQ ID NO: 1135124 - protein, 9 aa, Homo Sapiens
AVTSCADIA

SEQ ID NO: 1135125 - protein, 9 aa, Homo Sapiens
MTMNLADPV

SEQ ID NO: 1135126 - protein, 9 aa, Homo Sapiens
GVAFKAEGE

SEQ ID NO: 1135127 - protein, 9 aa, Homo Sapiens
AVAPASSFS

SEQ ID NO: 1135128 - protein, 9 aa, Homo Sapiens
PLDVCKLLV

SEQ ID NO: 1135129 - protein, 9 aa, Homo Sapiens
HTQHQFGHT

SEQ ID NO: 1135130 - protein, 9 aa, Homo Sapiens
ETTSHDWGT

SEQ ID NO: 1135131 - protein, 9 aa, Homo Sapiens
LATADDFPV

SEQ ID NO: 1135132 - protein, 9 aa, Homo Sapiens
SEKLAGADL

SEQ ID NO: 1135133 - protein, 9 aa, Homo Sapiens
WCMLKPGVL

SEQ ID NO: 1135134 - protein, 9 aa, Homo Sapiens
GALQMTTNR

SEQ ID NO: 1135135 - protein, 9 aa, Homo Sapiens
ATPEARFPV

SEQ ID NO: 1135136 - protein, 9 aa, Homo Sapiens
LISVRLNML

SEQ ID NO: 1135137 - protein, 9 aa, Homo Sapiens
LLIQWYICG

SEQ ID NO: 1135138 - protein, 9 aa, Homo Sapiens
QGGDFTHHN

SEQ ID NO: 1135139 - protein, 9 aa, Homo Sapiens
PPSTAATTA

SEQ ID NO: 1135140 - protein, 9 aa, Homo Sapiens
LFIQLHHSF

SEQ ID NO: 1135141 - protein, 9 aa, Homo Sapiens
VEQAWPWRT

SEQ ID NO: 1135142 - protein, 9 aa, Homo Sapiens
SAWSLSTGT

SEQ ID NO: 1135143 - protein, 9 aa, Homo Sapiens
TPCVPSVIR

SEQ ID NO: 1135144 - protein, 9 aa, Homo Sapiens
MRRAALAAR

SEQ ID NO: 1135145 - protein, 9 aa, Homo Sapiens
LRGNSKTAM

SEQ ID NO: 1135146 - protein, 9 aa, Homo Sapiens
LAILLPKEL

SEQ ID NO: 1135147 - protein, 9 aa, Homo Sapiens
QRRVRPGRP

SEQ ID NO: 1135148 - protein, 9 aa, Homo Sapiens
IAEVSELQQ

SEQ ID NO: 1135149 - protein, 9 aa, Homo Sapiens
FCIFSSPPS

SEQ ID NO: 1135150 - protein, 9 aa, Homo Sapiens
TDLSPVKDL

SEQ ID NO: 1135151 - protein, 9 aa, Homo Sapiens
AWAPSWACT

SEQ ID NO: 1135152 - protein, 9 aa, Homo Sapiens
NGPNAGELP

SEQ ID NO: 1135153 - protein, 9 aa, Homo Sapiens
RPRPRQPTG

SEQ ID NO: 1135154 - protein, 9 aa, Homo Sapiens
SAIYQKVCH

SEQ ID NO: 1135155 - protein, 9 aa, Homo Sapiens
RSFTTKQKA

SEQ ID NO: 1135156 - protein, 9 aa, Homo Sapiens
YDDCIGTVV

SEQ ID NO: 1135157 - protein, 9 aa, Homo Sapiens
HPEWSSGCY

SEQ ID NO: 1135158 - protein, 9 aa, Homo Sapiens
QKWTMFITQ

SEQ ID NO: 1135159 - protein, 9 aa, Homo Sapiens
TETHARHQA

SEQ ID NO: 1135160 - protein, 9 aa, Homo Sapiens
YTSTIFSSV

SEQ ID NO: 1135161 - protein, 9 aa, Homo Sapiens
SEPPHVERN

SEQ ID NO: 1135162 - protein, 9 aa, Homo Sapiens
EELQSQHDE

SEQ ID NO: 1135163 - protein, 9 aa, Homo Sapiens
DLGPLPASP

SEQ ID NO: 1135164 - protein, 9 aa, Homo Sapiens
STLSQPPPQ

SEQ ID NO: 1135165 - protein, 9 aa, Homo Sapiens
SGSGLRASP

SEQ ID NO: 1135166 - protein, 9 aa, Homo Sapiens
RETGELVPH

SEQ ID NO: 1135167 - protein, 9 aa, Homo Sapiens
INIKKGQQI

SEQ ID NO: 1135168 - protein, 9 aa, Homo Sapiens
MLLQATDDI

SEQ ID NO: 1135169 - protein, 9 aa, Homo Sapiens
NCDLYFPRK

SEQ ID NO: 1135170 - protein, 9 aa, Homo Sapiens
PWRTTPRPR

SEQ ID NO: 1135171 - protein, 9 aa, Homo Sapiens
MPKFLNSTN

SEQ ID NO: 1135172 - protein, 9 aa, Homo Sapiens
TASTRSAVM

SEQ ID NO: 1135173 - protein, 9 aa, Homo Sapiens
PGVQYRELG

SEQ ID NO: 1135174 - protein, 9 aa, Homo Sapiens
MSSTNNWVL

SEQ ID NO: 1135175 - protein, 9 aa, Homo Sapiens
GQYLHPGED

SEQ ID NO: 1135176 - protein, 9 aa, Homo Sapiens
HQRRAGRHT

SEQ ID NO: 1135177 - protein, 9 aa, Homo Sapiens
PEGSCFPKN

SEQ ID NO: 1135178 - protein, 9 aa, Homo Sapiens
FPKGIAGSV

SEQ ID NO: 1135179 - protein, 9 aa, Homo Sapiens
VKATVCPAV

SEQ ID NO: 1135180 - protein, 9 aa, Homo Sapiens
TFPRAMDAL

SEQ ID NO: 1135181 - protein, 9 aa, Homo Sapiens
RYPRRIVRS

SEQ ID NO: 1135182 - protein, 9 aa, Homo Sapiens
ILHRAVRYA

SEQ ID NO: 1135183 - protein, 9 aa, Homo Sapiens
LRFPETHLG

SEQ ID NO: 1135184 - protein, 9 aa, Homo Sapiens
DFIWVGQLT

SEQ ID NO: 1135185 - protein, 9 aa, Homo Sapiens
RRGRTRVHS

SEQ ID NO: 1135186 - protein, 9 aa, Homo Sapiens
VEDDAETKK

SEQ ID NO: 1135187 - protein, 9 aa, Homo Sapiens
KTKELTLEI

SEQ ID NO: 1135188 - protein, 9 aa, Homo Sapiens
WPPYSYSAL

SEQ ID NO: 1135189 - protein, 9 aa, Homo Sapiens
CVGKKPEQL

SEQ ID NO: 1135190 - protein, 9 aa, Homo Sapiens
NTLLCPVGG

SEQ ID NO: 1135191 - protein, 9 aa, Homo Sapiens
LGPGRRSQH

SEQ ID NO: 1135192 - protein, 9 aa, Homo Sapiens
KSEKLAGAD

SEQ ID NO: 1135193 - protein, 9 aa, Homo Sapiens
CNGLVQTTC

SEQ ID NO: 1135194 - protein, 9 aa, Homo Sapiens
NISCHAASN

SEQ ID NO: 1135195 - protein, 9 aa, Homo Sapiens
VPMPWGPLP

SEQ ID NO: 1135196 - protein, 9 aa, Homo Sapiens
YWVTLITEN

SEQ ID NO: 1135197 - protein, 9 aa, Homo Sapiens
LDTNGDGRI

SEQ ID NO: 1135198 - protein, 9 aa, Homo Sapiens
SVCDCEGTA

SEQ ID NO: 1135199 - protein, 9 aa, Homo Sapiens
QLQVREHPV

SEQ ID NO: 1135200 - protein, 9 aa, Homo Sapiens
GACRPACTC

SEQ ID NO: 1135201 - protein, 9 aa, Homo Sapiens
RRAQSSFCL

SEQ ID NO: 1135202 - protein, 9 aa, Homo Sapiens
DDLDVGDCP

SEQ ID NO: 1135203 - protein, 9 aa, Homo Sapiens
GWCSPLFPW

SEQ ID NO: 1135204 - protein, 9 aa, Homo Sapiens
TVQVLMMHQ

SEQ ID NO: 1135205 - protein, 9 aa, Homo Sapiens
DVGDCPKRP

SEQ ID NO: 1135206 - protein, 9 aa, Homo Sapiens
PRLHQLPRR

SEQ ID NO: 1135207 - protein, 9 aa, Homo Sapiens
PPHPQVPPQ

SEQ ID NO: 1135208 - protein, 9 aa, Homo Sapiens
ISEITGGPV

SEQ ID NO: 1135209 - protein, 9 aa, Homo Sapiens
RKPGAQETE

SEQ ID NO: 1135210 - protein, 9 aa, Homo Sapiens
FIPHEVKLS

SEQ ID NO: 1135211 - protein, 9 aa, Homo Sapiens
DHIEQELLL

SEQ ID NO: 1135212 - protein, 9 aa, Homo Sapiens
ILEALEERP

SEQ ID NO: 1135213 - protein, 9 aa, Homo Sapiens
RTLEKKGSA

SEQ ID NO: 1135214 - protein, 9 aa, Homo Sapiens
FYVTSFPVA

SEQ ID NO: 1135215 - protein, 9 aa, Homo Sapiens
NSLQNYTLS

SEQ ID NO: 1135216 - protein, 9 aa, Homo Sapiens
TKSLLGTWI

SEQ ID NO: 1135217 - protein, 9 aa, Homo Sapiens
LMSKMNKNR

SEQ ID NO: 1135218 - protein, 9 aa, Homo Sapiens
MNLTIEQSS

SEQ ID NO: 1135219 - protein, 9 aa, Homo Sapiens
RNHMGRDKK

SEQ ID NO: 1135220 - protein, 9 aa, Homo Sapiens
CTHLGITVT

SEQ ID NO: 1135221 - protein, 9 aa, Homo Sapiens
DAVCPIQRV

SEQ ID NO: 1135222 - protein, 9 aa, Homo Sapiens
LCRFCSYTS

SEQ ID NO: 1135223 - protein, 9 aa, Homo Sapiens
PTTSTLVFY

SEQ ID NO: 1135224 - protein, 9 aa, Homo Sapiens
THTAACVLK

SEQ ID NO: 1135225 - protein, 9 aa, Homo Sapiens
IHVGMALHT

SEQ ID NO: 1135226 - protein, 9 aa, Homo Sapiens
TSTFMPYEI

SEQ ID NO: 1135227 - protein, 9 aa, Homo Sapiens
HQEDQLSAE

SEQ ID NO: 1135228 - protein, 9 aa, Homo Sapiens
NLQMTAVTM

SEQ ID NO: 1135229 - protein, 9 aa, Homo Sapiens
HFELPLDIP

SEQ ID NO: 1135230 - protein, 9 aa, Homo Sapiens
KKLKRQSLK

SEQ ID NO: 1135231 - protein, 9 aa, Homo Sapiens
RSRTFLDRV

SEQ ID NO: 1135232 - protein, 9 aa, Homo Sapiens
EGDVCITEA

SEQ ID NO: 1135233 - protein, 9 aa, Homo Sapiens
APLPGRCRL

SEQ ID NO: 1135234 - protein, 9 aa, Homo Sapiens
VICSLVRGT

SEQ ID NO: 1135235 - protein, 9 aa, Homo Sapiens
IIGGGVAGL

SEQ ID NO: 1135236 - protein, 9 aa, Homo Sapiens
KYKRENKEI

SEQ ID NO: 1135237 - protein, 9 aa, Homo Sapiens
LLAPLIQKK

SEQ ID NO: 1135238 - protein, 9 aa, Homo Sapiens
YTYLRPRSM

SEQ ID NO: 1135239 - protein, 9 aa, Homo Sapiens
RLPNIRHSS

SEQ ID NO: 1135240 - protein, 9 aa, Homo Sapiens
EKLAGADLA

SEQ ID NO: 1135241 - protein, 9 aa, Homo Sapiens
PATARGPGG

SEQ ID NO: 1135242 - protein, 9 aa, Homo Sapiens
FPSHLASPP

SEQ ID NO: 1135243 - protein, 9 aa, Homo Sapiens
AKRLHAVHM

SEQ ID NO: 1135244 - protein, 9 aa, Homo Sapiens
RSLLPPAST

SEQ ID NO: 1135245 - protein, 9 aa, Homo Sapiens
HKSNLLYTK

SEQ ID NO: 1135246 - protein, 9 aa, Homo Sapiens
RKAHAYKEV

SEQ ID NO: 1135247 - protein, 9 aa, Homo Sapiens
WCYCPVKNV

SEQ ID NO: 1135248 - protein, 9 aa, Homo Sapiens
WTCSQTRPL

SEQ ID NO: 1135249 - protein, 9 aa, Homo Sapiens
WTMASPLPC

SEQ ID NO: 1135250 - protein, 9 aa, Homo Sapiens
AEGEYTAFP

SEQ ID NO: 1135251 - protein, 9 aa, Homo Sapiens
SSGSIKRSC

SEQ ID NO: 1135252 - protein, 9 aa, Homo Sapiens
YLGDSEGPI

SEQ ID NO: 1135253 - protein, 9 aa, Homo Sapiens
THRIKCRVH

SEQ ID NO: 1135254 - protein, 9 aa, Homo Sapiens
LHILEAHAH

SEQ ID NO: 1135255 - protein, 9 aa, Homo Sapiens
IRVLEQKEV

SEQ ID NO: 1135256 - protein, 9 aa, Homo Sapiens
SGMLPPPSS

SEQ ID NO: 1135257 - protein, 9 aa, Homo Sapiens
ELENSNKKC

SEQ ID NO: 1135258 - protein, 9 aa, Homo Sapiens
NGNSGNSWN

SEQ ID NO: 1135259 - protein, 9 aa, Homo Sapiens
ERGSMLSAA

SEQ ID NO: 1135260 - protein, 9 aa, Homo Sapiens
KQRRCTLKN

SEQ ID NO: 1135261 - protein, 9 aa, Homo Sapiens
SSEEVSVSY

SEQ ID NO: 1135262 - protein, 9 aa, Homo Sapiens
SAPWRSRSI

SEQ ID NO: 1135263 - protein, 9 aa, Homo Sapiens
LEPVVSDTI

SEQ ID NO: 1135264 - protein, 9 aa, Homo Sapiens
MSAIYQKVC

SEQ ID NO: 1135265 - protein, 9 aa, Homo Sapiens
AEGSLKKTS

SEQ ID NO: 1135266 - protein, 9 aa, Homo Sapiens
MSSPWPSAL

SEQ ID NO: 1135267 - protein, 9 aa, Homo Sapiens
SRFLNMEEL

SEQ ID NO: 1135268 - protein, 9 aa, Homo Sapiens
IPFPRCSRR

SEQ ID NO: 1135269 - protein, 9 aa, Homo Sapiens
QQYQRLTCS

SEQ ID NO: 1135270 - protein, 9 aa, Homo Sapiens
CPGVRSLWW

SEQ ID NO: 1135271 - protein, 9 aa, Homo Sapiens
LCATTTCPG

SEQ ID NO: 1135272 - protein, 9 aa, Homo Sapiens
LDVGIITQE

SEQ ID NO: 1135273 - protein, 9 aa, Homo Sapiens
RKIMEHGGP

SEQ ID NO: 1135274 - protein, 9 aa, Homo Sapiens
ERSQCGRRD

SEQ ID NO: 1135275 - protein, 9 aa, Homo Sapiens
IFQERLLAD

SEQ ID NO: 1135276 - protein, 9 aa, Homo Sapiens
EIRALCNVL

SEQ ID NO: 1135277 - protein, 9 aa, Homo Sapiens
TFMPYEIKV

SEQ ID NO: 1135278 - protein, 9 aa, Homo Sapiens
VVLPAWYAL

SEQ ID NO: 1135279 - protein, 9 aa, Homo Sapiens
SFGAWCRYG

SEQ ID NO: 1135280 - protein, 9 aa, Homo Sapiens
LAVTSCADI

SEQ ID NO: 1135281 - protein, 9 aa, Homo Sapiens
QAGDAPQWA

SEQ ID NO: 1135282 - protein, 9 aa, Homo Sapiens
LVLKIKKLK

SEQ ID NO: 1135283 - protein, 9 aa, Homo Sapiens
LNSLNEVIH

SEQ ID NO: 1135284 - protein, 9 aa, Homo Sapiens
PTGIDTSET

SEQ ID NO: 1135285 - protein, 9 aa, Homo Sapiens
GGGSPAAVC

SEQ ID NO: 1135286 - protein, 9 aa, Homo Sapiens
TCYFTMGLY

SEQ ID NO: 1135287 - protein, 9 aa, Homo Sapiens
PLSSWTHPL

SEQ ID NO: 1135288 - protein, 9 aa, Homo Sapiens
PGKVIDEIH

SEQ ID NO: 1135289 - protein, 9 aa, Homo Sapiens
DKKNGIWEV

SEQ ID NO: 1135290 - protein, 9 aa, Homo Sapiens
HPLLWTMTI

SEQ ID NO: 1135291 - protein, 9 aa, Homo Sapiens
LGSARGGQS

SEQ ID NO: 1135292 - protein, 9 aa, Homo Sapiens
FVDTDKERT

SEQ ID NO: 1135293 - protein, 9 aa, Homo Sapiens
QPKVAQCLL

SEQ ID NO: 1135294 - protein, 9 aa, Homo Sapiens
MTNLVRYIR

SEQ ID NO: 1135295 - protein, 9 aa, Homo Sapiens
GELGAPRSQ

SEQ ID NO: 1135296 - protein, 9 aa, Homo Sapiens
SSLHDAMPR

SEQ ID NO: 1135297 - protein, 9 aa, Homo Sapiens
VCCPGPLDQ

SEQ ID NO: 1135298 - protein, 9 aa, Homo Sapiens
PSAAGGGPG

SEQ ID NO: 1135299 - protein, 9 aa, Homo Sapiens
GTIMMSSCG

SEQ ID NO: 1135300 - protein, 9 aa, Homo Sapiens
TLDQHNGEK

SEQ ID NO: 1135301 - protein, 9 aa, Homo Sapiens
GECGKGFAQ

SEQ ID NO: 1135302 - protein, 9 aa, Homo Sapiens
KLKYIKEKS

SEQ ID NO: 1135303 - protein, 9 aa, Homo Sapiens
SGVEVLSCR

SEQ ID NO: 1135304 - protein, 9 aa, Homo Sapiens
MQRARNGGL

SEQ ID NO: 1135305 - protein, 9 aa, Homo Sapiens
TDVIVFSYV

SEQ ID NO: 1135306 - protein, 9 aa, Homo Sapiens
EVPDVLRWL

SEQ ID NO: 1135307 - protein, 9 aa, Homo Sapiens
CLIVRLQVQ

SEQ ID NO: 1135308 - protein, 9 aa, Homo Sapiens
YFSPAFYTH

SEQ ID NO: 1135309 - protein, 9 aa, Homo Sapiens
MTHFGDTFP

SEQ ID NO: 1135310 - protein, 9 aa, Homo Sapiens
DLDEMFSSE

SEQ ID NO: 1135311 - protein, 9 aa, Homo Sapiens
GIVLSSQDK

SEQ ID NO: 1135312 - protein, 9 aa, Homo Sapiens
RPIQVQTGG

SEQ ID NO: 1135313 - protein, 9 aa, Homo Sapiens
NTGILLFLA

SEQ ID NO: 1135314 - protein, 9 aa, Homo Sapiens
LLLIKHVVE

SEQ ID NO: 1135315 - protein, 9 aa, Homo Sapiens
HCTHLTNFA

SEQ ID NO: 1135316 - protein, 9 aa, Homo Sapiens
AGGVVLHSP

SEQ ID NO: 1135317 - protein, 9 aa, Homo Sapiens
KWILQLMYS

SEQ ID NO: 1135318 - protein, 9 aa, Homo Sapiens
CPCPQYIRK

SEQ ID NO: 1135319 - protein, 9 aa, Homo Sapiens
AAPAAPPRS

SEQ ID NO: 1135320 - protein, 9 aa, Homo Sapiens
PHFSKILEN

SEQ ID NO: 1135321 - protein, 9 aa, Homo Sapiens
LRNSLPQHL

SEQ ID NO: 1135322 - protein, 9 aa, Homo Sapiens
WKNDNKLKS

SEQ ID NO: 1135323 - protein, 9 aa, Homo Sapiens
AIMSEHKKQ

SEQ ID NO: 1135324 - protein, 9 aa, Homo Sapiens
LATQCSSPS

SEQ ID NO: 1135325 - protein, 9 aa, Homo Sapiens
RASIIKKTS

SEQ ID NO: 1135326 - protein, 9 aa, Homo Sapiens
RRCPSPSRA

SEQ ID NO: 1135327 - protein, 9 aa, Homo Sapiens
VAWMRTHAG

SEQ ID NO: 1135328 - protein, 9 aa, Homo Sapiens
DAEPGPASG

SEQ ID NO: 1135329 - protein, 9 aa, Homo Sapiens
LRERGPPSH

SEQ ID NO: 1135330 - protein, 9 aa, Homo Sapiens
AGDPWTGAG

SEQ ID NO: 1135331 - protein, 9 aa, Homo Sapiens
GKMLGERRR

SEQ ID NO: 1135332 - protein, 9 aa, Homo Sapiens
NTLAAPMGH

SEQ ID NO: 1135333 - protein, 9 aa, Homo Sapiens
FGATDWEVF

SEQ ID NO: 1135334 - protein, 9 aa, Homo Sapiens
RRRFFRRED

SEQ ID NO: 1135335 - protein, 9 aa, Homo Sapiens
KTQSETIVS

SEQ ID NO: 1135336 - protein, 9 aa, Homo Sapiens
VATPGRPWP

SEQ ID NO: 1135337 - protein, 9 aa, Homo Sapiens
VPGAALQDP

SEQ ID NO: 1135338 - protein, 9 aa, Homo Sapiens
CKCLCTGRA

SEQ ID NO: 1135339 - protein, 9 aa, Homo Sapiens
KETDPLNEQ

SEQ ID NO: 1135340 - protein, 9 aa, Homo Sapiens
VSIAKYNII

SEQ ID NO: 1135341 - protein, 9 aa, Homo Sapiens
VAEKTECKI

SEQ ID NO: 1135342 - protein, 9 aa, Homo Sapiens
VEKWNLHKC

SEQ ID NO: 1135343 - protein, 9 aa, Homo Sapiens
RCMSVGQQT

SEQ ID NO: 1135344 - protein, 9 aa, Homo Sapiens
MERGQGRID

SEQ ID NO: 1135345 - protein, 9 aa, Homo Sapiens
DGNEKIYEN

SEQ ID NO: 1135346 - protein, 9 aa, Homo Sapiens
SPQQKLRQL

SEQ ID NO: 1135347 - protein, 9 aa, Homo Sapiens
PLHQPPPPA

SEQ ID NO: 1135348 - protein, 9 aa, Homo Sapiens
TVANEAMLL

SEQ ID NO: 1135349 - protein, 9 aa, Homo Sapiens
KEGSGAATT

SEQ ID NO: 1135350 - protein, 9 aa, Homo Sapiens
PDLYKSLTD

SEQ ID NO: 1135351 - protein, 9 aa, Homo Sapiens
IACRQRRRG

SEQ ID NO: 1135352 - protein, 9 aa, Homo Sapiens
LSRTAQDSW

SEQ ID NO: 1135353 - protein, 9 aa, Homo Sapiens
DVQSIKKTR

SEQ ID NO: 1135354 - protein, 9 aa, Homo Sapiens
KKEMLPRHP

SEQ ID NO: 1135355 - protein, 9 aa, Homo Sapiens
GAVNQVVAV

SEQ ID NO: 1135356 - protein, 9 aa, Homo Sapiens
CTPASGPSP

SEQ ID NO: 1135357 - protein, 9 aa, Homo Sapiens
FAGRNKSGC

SEQ ID NO: 1135358 - protein, 9 aa, Homo Sapiens
IKECLGDLR

SEQ ID NO: 1135359 - protein, 9 aa, Homo Sapiens
NLRPLSLQC

SEQ ID NO: 1135360 - protein, 9 aa, Homo Sapiens
SPQGAFYSL

SEQ ID NO: 1135361 - protein, 9 aa, Homo Sapiens
SGEPWDTER

SEQ ID NO: 1135362 - protein, 9 aa, Homo Sapiens
PTGRTPTTR

SEQ ID NO: 1135363 - protein, 9 aa, Homo Sapiens
ASGGEGGLR

SEQ ID NO: 1135364 - protein, 9 aa, Homo Sapiens
VFLNVIVHS

SEQ ID NO: 1135365 - protein, 9 aa, Homo Sapiens
TDGEGEGAS

SEQ ID NO: 1135366 - protein, 9 aa, Homo Sapiens
VLSEEKSCL

SEQ ID NO: 1135367 - protein, 9 aa, Homo Sapiens
CPGWGAPVP

SEQ ID NO: 1135368 - protein, 9 aa, Homo Sapiens
ALWSGDKAI

SEQ ID NO: 1135369 - protein, 9 aa, Homo Sapiens
QEKHPFDFD

SEQ ID NO: 1135370 - protein, 9 aa, Homo Sapiens
HFTQSDRSP

SEQ ID NO: 1135371 - protein, 9 aa, Homo Sapiens
KNSMIGLSD

SEQ ID NO: 1135372 - protein, 9 aa, Homo Sapiens
ASAIAQDTD

SEQ ID NO: 1135373 - protein, 9 aa, Homo Sapiens
GVTPATIIN

SEQ ID NO: 1135374 - protein, 9 aa, Homo Sapiens
WHKMHNYFM

SEQ ID NO: 1135375 - protein, 9 aa, Homo Sapiens
YPEFRQPLF

SEQ ID NO: 1135376 - protein, 9 aa, Homo Sapiens
RVEDNKSLT

SEQ ID NO: 1135377 - protein, 9 aa, Homo Sapiens
GMNSPAPKK

SEQ ID NO: 1135378 - protein, 9 aa, Homo Sapiens
PLRFNLILM

SEQ ID NO: 1135379 - protein, 9 aa, Homo Sapiens
KLMEEFVRQ

SEQ ID NO: 1135380 - protein, 9 aa, Homo Sapiens
KWHRFGASL

SEQ ID NO: 1135381 - protein, 9 aa, Homo Sapiens
CLMKTSRCG

SEQ ID NO: 1135382 - protein, 9 aa, Homo Sapiens
HVAFCVTSF

SEQ ID NO: 1135383 - protein, 9 aa, Homo Sapiens
PSEAVQWSN

SEQ ID NO: 1135384 - protein, 9 aa, Homo Sapiens
DKKIQDQDQ

SEQ ID NO: 1135385 - protein, 9 aa, Homo Sapiens
PGRAWAPAP

SEQ ID NO: 1135386 - protein, 9 aa, Homo Sapiens
KVLPESYFI

SEQ ID NO: 1135387 - protein, 9 aa, Homo Sapiens
VLYALQTFD

SEQ ID NO: 1135388 - protein, 9 aa, Homo Sapiens
HQSSMSQTS

SEQ ID NO: 1135389 - protein, 9 aa, Homo Sapiens
FGPARIRST

SEQ ID NO: 1135390 - protein, 9 aa, Homo Sapiens
CPMLEHCNN

SEQ ID NO: 1135391 - protein, 9 aa, Homo Sapiens
GEGGLRLRP

SEQ ID NO: 1135392 - protein, 9 aa, Homo Sapiens
VLNRSGRWK

SEQ ID NO: 1135393 - protein, 9 aa, Homo Sapiens
GSCMKGAST

SEQ ID NO: 1135394 - protein, 9 aa, Homo Sapiens
EVQWALGAI

SEQ ID NO: 1135395 - protein, 9 aa, Homo Sapiens
DHCYVRPNH

SEQ ID NO: 1135396 - protein, 9 aa, Homo Sapiens
YYEVMEKLP

SEQ ID NO: 1135397 - protein, 9 aa, Homo Sapiens
FSRFLNMEE

SEQ ID NO: 1135398 - protein, 9 aa, Homo Sapiens
ATLCIAGQA

SEQ ID NO: 1135399 - protein, 9 aa, Homo Sapiens
TWCSSSVRH

SEQ ID NO: 1135400 - protein, 9 aa, Homo Sapiens
LFMIVLTFS

SEQ ID NO: 1135401 - protein, 9 aa, Homo Sapiens
IDTGCRHID

SEQ ID NO: 1135402 - protein, 9 aa, Homo Sapiens
PRLRAAGGA

SEQ ID NO: 1135403 - protein, 9 aa, Homo Sapiens
FTDTITYRD

SEQ ID NO: 1135404 - protein, 9 aa, Homo Sapiens
AEPSTRWSL

SEQ ID NO: 1135405 - protein, 9 aa, Homo Sapiens
VRSAIQLRN

SEQ ID NO: 1135406 - protein, 9 aa, Homo Sapiens
QEIRAKFEE

SEQ ID NO: 1135407 - protein, 9 aa, Homo Sapiens
EVLIPPLRP

SEQ ID NO: 1135408 - protein, 9 aa, Homo Sapiens
ARGALATGS

SEQ ID NO: 1135409 - protein, 9 aa, Homo Sapiens
QGPQVSQQG

SEQ ID NO: 1135410 - protein, 9 aa, Homo Sapiens
LCPTQENFN

SEQ ID NO: 1135411 - protein, 9 aa, Homo Sapiens
VIRVLEQKE

SEQ ID NO: 1135412 - protein, 9 aa, Homo Sapiens
RGLCPGQAW

SEQ ID NO: 1135413 - protein, 9 aa, Homo Sapiens
PSHLASPPP

SEQ ID NO: 1135414 - protein, 9 aa, Homo Sapiens
QLLPVLWEL

SEQ ID NO: 1135415 - protein, 9 aa, Homo Sapiens
GIDPTELED

SEQ ID NO: 1135416 - protein, 9 aa, Homo Sapiens
YSPYDQREF

SEQ ID NO: 1135417 - protein, 9 aa, Homo Sapiens
AAISSRHQT

SEQ ID NO: 1135418 - protein, 9 aa, Homo Sapiens
TDPISVPGA

SEQ ID NO: 1135419 - protein, 9 aa, Homo Sapiens
KSVLELTQK

SEQ ID NO: 1135420 - protein, 9 aa, Homo Sapiens
ETITNLERW

SEQ ID NO: 1135421 - protein, 9 aa, Homo Sapiens
PVVTVPPQM

SEQ ID NO: 1135422 - protein, 9 aa, Homo Sapiens
GKQVLAGHG

SEQ ID NO: 1135423 - protein, 9 aa, Homo Sapiens
RPKDNPLAL

SEQ ID NO: 1135424 - protein, 9 aa, Homo Sapiens
HFSKILENL

SEQ ID NO: 1135425 - protein, 9 aa, Homo Sapiens
LSALFIWPQ

SEQ ID NO: 1135426 - protein, 9 aa, Homo Sapiens
DDLIKVSDD

SEQ ID NO: 1135427 - protein, 9 aa, Homo Sapiens
QQLNGEATF

SEQ ID NO: 1135428 - protein, 9 aa, Homo Sapiens
IEENKGRML

SEQ ID NO: 1135429 - protein, 9 aa, Homo Sapiens
CVARWLDRE

SEQ ID NO: 1135430 - protein, 9 aa, Homo Sapiens
TSPGDQRAG

SEQ ID NO: 1135431 - protein, 9 aa, Homo Sapiens
PNTTLISLP

SEQ ID NO: 1135432 - protein, 9 aa, Homo Sapiens
GGLGPEAGH

SEQ ID NO: 1135433 - protein, 9 aa, Homo Sapiens
ELRQAPRTT

SEQ ID NO: 1135434 - protein, 9 aa, Homo Sapiens
QVDGFHFAA

SEQ ID NO: 1135435 - protein, 9 aa, Homo Sapiens
QSLGFSASG

SEQ ID NO: 1135436 - protein, 9 aa, Homo Sapiens
SGLVPAAAA

SEQ ID NO: 1135437 - protein, 9 aa, Homo Sapiens
IASNSTIER

SEQ ID NO: 1135438 - protein, 9 aa, Homo Sapiens
VEAVSVDYH

SEQ ID NO: 1135439 - protein, 9 aa, Homo Sapiens
VAHSIVEYR

SEQ ID NO: 1135440 - protein, 9 aa, Homo Sapiens
LVYRRSAAA

SEQ ID NO: 1135441 - protein, 9 aa, Homo Sapiens
PMSERLKHN

SEQ ID NO: 1135442 - protein, 9 aa, Homo Sapiens
LLYSRTTSP

SEQ ID NO: 1135443 - protein, 9 aa, Homo Sapiens
PQDVGTSSP

SEQ ID NO: 1135444 - protein, 9 aa, Homo Sapiens
MKPASCRAL

SEQ ID NO: 1135445 - protein, 9 aa, Homo Sapiens
PSNQCHNSI

SEQ ID NO: 1135446 - protein, 9 aa, Homo Sapiens
PPLIPLLGD

SEQ ID NO: 1135447 - protein, 9 aa, Homo Sapiens
QTLDGTRCQ

SEQ ID NO: 1135448 - protein, 9 aa, Homo Sapiens
QAQDTSGHR

SEQ ID NO: 1135449 - protein, 9 aa, Homo Sapiens
AMSSSYETY

SEQ ID NO: 1135450 - protein, 9 aa, Homo Sapiens
NPNYIRCIN

SEQ ID NO: 1135451 - protein, 9 aa, Homo Sapiens
PHLCPSEAG

SEQ ID NO: 1135452 - protein, 9 aa, Homo Sapiens
ANHTKLKGP

SEQ ID NO: 1135453 - protein, 9 aa, Homo Sapiens
SSATQASMT

SEQ ID NO: 1135454 - protein, 9 aa, Homo Sapiens
GVTAVTFNK

SEQ ID NO: 1135455 - protein, 9 aa, Homo Sapiens
VVAAAATEE

SEQ ID NO: 1135456 - protein, 9 aa, Homo Sapiens
IRTLDTPSD

SEQ ID NO: 1135457 - protein, 9 aa, Homo Sapiens
LVPQAVDGW

SEQ ID NO: 1135458 - protein, 9 aa, Homo Sapiens
KKKQLSHPA

SEQ ID NO: 1135459 - protein, 9 aa, Homo Sapiens
PKAGIGGAA

SEQ ID NO: 1135460 - protein, 9 aa, Homo Sapiens
FCRNVSFIL

SEQ ID NO: 1135461 - protein, 9 aa, Homo Sapiens
PTEEALGEA

SEQ ID NO: 1135462 - protein, 9 aa, Homo Sapiens
VLDREGWES

SEQ ID NO: 1135463 - protein, 9 aa, Homo Sapiens
RPQWTQTCP

SEQ ID NO: 1135464 - protein, 9 aa, Homo Sapiens
LIEGEREPQ

SEQ ID NO: 1135465 - protein, 9 aa, Homo Sapiens
SPPCEVQVL

SEQ ID NO: 1135466 - protein, 9 aa, Homo Sapiens
YTVSHDFSI

SEQ ID NO: 1135467 - protein, 9 aa, Homo Sapiens
SPIPRCVAG

SEQ ID NO: 1135468 - protein, 9 aa, Homo Sapiens
LRETPIFVK

SEQ ID NO: 1135469 - protein, 9 aa, Homo Sapiens
VQVFSFCWF

SEQ ID NO: 1135470 - protein, 9 aa, Homo Sapiens
GCRAEGGPV

SEQ ID NO: 1135471 - protein, 9 aa, Homo Sapiens
FVITAAGAS

SEQ ID NO: 1135472 - protein, 9 aa, Homo Sapiens
AVHGLCHPS

SEQ ID NO: 1135473 - protein, 9 aa, Homo Sapiens
DKKMVGDVT

SEQ ID NO: 1135474 - protein, 9 aa, Homo Sapiens
KGLATYAQR

SEQ ID NO: 1135475 - protein, 9 aa, Homo Sapiens
FRRKAQIPQ

SEQ ID NO: 1135476 - protein, 9 aa, Homo Sapiens
GNDVATPAC

SEQ ID NO: 1135477 - protein, 9 aa, Homo Sapiens
LVMFYTPWC

SEQ ID NO: 1135478 - protein, 9 aa, Homo Sapiens
DAISKKAKA

SEQ ID NO: 1135479 - protein, 9 aa, Homo Sapiens
AFSTRLAVS

SEQ ID NO: 1135480 - protein, 9 aa, Homo Sapiens
KSCLEENER

SEQ ID NO: 1135481 - protein, 9 aa, Homo Sapiens
GKKFQNRID

SEQ ID NO: 1135482 - protein, 9 aa, Homo Sapiens
RLPYQEADQ

SEQ ID NO: 1135483 - protein, 9 aa, Homo Sapiens
TYVSEDLRA

SEQ ID NO: 1135484 - protein, 9 aa, Homo Sapiens
PMPPPANPQ

SEQ ID NO: 1135485 - protein, 9 aa, Homo Sapiens
EAGAAKVKK

SEQ ID NO: 1135486 - protein, 9 aa, Homo Sapiens
ATPSPALPG

SEQ ID NO: 1135487 - protein, 9 aa, Homo Sapiens
KTFYSFFSP

SEQ ID NO: 1135488 - protein, 9 aa, Homo Sapiens
SPGPQRRVR

SEQ ID NO: 1135489 - protein, 9 aa, Homo Sapiens
TFDYLQSIL

SEQ ID NO: 1135490 - protein, 9 aa, Homo Sapiens
GRRSGSRSE

SEQ ID NO: 1135491 - protein, 9 aa, Homo Sapiens
NTLMRDLKP

SEQ ID NO: 1135492 - protein, 9 aa, Homo Sapiens
KGAMVNTTD

SEQ ID NO: 1135493 - protein, 9 aa, Homo Sapiens
VDCMTSHVR

SEQ ID NO: 1135494 - protein, 9 aa, Homo Sapiens
PQNTLAAPM

SEQ ID NO: 1135495 - protein, 9 aa, Homo Sapiens
GLGGLGQVF

SEQ ID NO: 1135496 - protein, 9 aa, Homo Sapiens
MPHLCPSEA

SEQ ID NO: 1135497 - protein, 9 aa, Homo Sapiens
PLTDADHGW

SEQ ID NO: 1135498 - protein, 9 aa, Homo Sapiens
LTAYEDVLV

SEQ ID NO: 1135499 - protein, 9 aa, Homo Sapiens
ACIGRRWER

SEQ ID NO: 1135500 - protein, 9 aa, Homo Sapiens
PPLRAGLMT

SEQ ID NO: 1135501 - protein, 9 aa, Homo Sapiens
SHISALIAA

SEQ ID NO: 1135502 - protein, 9 aa, Homo Sapiens
TNYNTPLWL

SEQ ID NO: 1135503 - protein, 9 aa, Homo Sapiens
SYSSKAEKR

SEQ ID NO: 1135504 - protein, 9 aa, Homo Sapiens
RWDLRRPQW

SEQ ID NO: 1135505 - protein, 9 aa, Homo Sapiens
WGNTANVAS

SEQ ID NO: 1135506 - protein, 9 aa, Homo Sapiens
AATLAVHPP

SEQ ID NO: 1135507 - protein, 9 aa, Homo Sapiens
HDALAKHIY

SEQ ID NO: 1135508 - protein, 9 aa, Homo Sapiens
CYFNASQTC

SEQ ID NO: 1135509 - protein, 9 aa, Homo Sapiens
FRHYTMVAV

SEQ ID NO: 1135510 - protein, 9 aa, Homo Sapiens
SSEDYTDQR

SEQ ID NO: 1135511 - protein, 9 aa, Homo Sapiens
CVPSVIRIK

SEQ ID NO: 1135512 - protein, 9 aa, Homo Sapiens
VFKELPVNA

SEQ ID NO: 1135513 - protein, 9 aa, Homo Sapiens
LAPLRLHSP

SEQ ID NO: 1135514 - protein, 9 aa, Homo Sapiens
LLQSALDCI

SEQ ID NO: 1135515 - protein, 9 aa, Homo Sapiens
VERVSTLTM

SEQ ID NO: 1135516 - protein, 9 aa, Homo Sapiens
VAPRGITPF

SEQ ID NO: 1135517 - protein, 9 aa, Homo Sapiens
KNSQQLWEV

SEQ ID NO: 1135518 - protein, 9 aa, Homo Sapiens
EMLRVTNPY

SEQ ID NO: 1135519 - protein, 9 aa, Homo Sapiens
DAPTRCLDE

SEQ ID NO: 1135520 - protein, 9 aa, Homo Sapiens
VRSSPTWLT

SEQ ID NO: 1135521 - protein, 9 aa, Homo Sapiens
SEALLLFVG

SEQ ID NO: 1135522 - protein, 9 aa, Homo Sapiens
HTKLKGPSE

SEQ ID NO: 1135523 - protein, 9 aa, Homo Sapiens
EMTGLGKQV

SEQ ID NO: 1135524 - protein, 9 aa, Homo Sapiens
AVMPCPMLE

SEQ ID NO: 1135525 - protein, 9 aa, Homo Sapiens
GNTAIILVI

SEQ ID NO: 1135526 - protein, 9 aa, Homo Sapiens
FQERLLADG

SEQ ID NO: 1135527 - protein, 9 aa, Homo Sapiens
PRLAPTQTL

SEQ ID NO: 1135528 - protein, 9 aa, Homo Sapiens
LEKQKRQRG

SEQ ID NO: 1135529 - protein, 9 aa, Homo Sapiens
GKDYCFPNV

SEQ ID NO: 1135530 - protein, 9 aa, Homo Sapiens
MAITSIVMM

SEQ ID NO: 1135531 - protein, 9 aa, Homo Sapiens
TSTIITEVR

SEQ ID NO: 1135532 - protein, 9 aa, Homo Sapiens
GQRRQQQQQ

SEQ ID NO: 1135533 - protein, 9 aa, Homo Sapiens
IGSSDVGSL

SEQ ID NO: 1135534 - protein, 9 aa, Homo Sapiens
APSPTSERL

SEQ ID NO: 1135535 - protein, 9 aa, Homo Sapiens
PKVTAEFDL

SEQ ID NO: 1135536 - protein, 9 aa, Homo Sapiens
VASPGRRDP

SEQ ID NO: 1135537 - protein, 9 aa, Homo Sapiens
ALFIRENNS

SEQ ID NO: 1135538 - protein, 9 aa, Homo Sapiens
HRHHGHKHR

SEQ ID NO: 1135539 - protein, 9 aa, Homo Sapiens
SLWVVTSKK

SEQ ID NO: 1135540 - protein, 9 aa, Homo Sapiens
RGALATGSS

SEQ ID NO: 1135541 - protein, 9 aa, Homo Sapiens
RYYGGDSEG

SEQ ID NO: 1135542 - protein, 9 aa, Homo Sapiens
LRLQSLLSL

SEQ ID NO: 1135543 - protein, 9 aa, Homo Sapiens
KCLGKRRDQ

SEQ ID NO: 1135544 - protein, 9 aa, Homo Sapiens
HDMDFYKAR

SEQ ID NO: 1135545 - protein, 9 aa, Homo Sapiens
CDAPQHAHQ

SEQ ID NO: 1135546 - protein, 9 aa, Homo Sapiens
APSPNEEGS

SEQ ID NO: 1135547 - protein, 9 aa, Homo Sapiens
DDVPEIPPE

SEQ ID NO: 1135548 - protein, 9 aa, Homo Sapiens
IAASPAPTS

SEQ ID NO: 1135549 - protein, 9 aa, Homo Sapiens
RFGGIGSSR

SEQ ID NO: 1135550 - protein, 9 aa, Homo Sapiens
ACFHFKWFE

SEQ ID NO: 1135551 - protein, 9 aa, Homo Sapiens
EFTRRRRPS

SEQ ID NO: 1135552 - protein, 9 aa, Homo Sapiens
IKTVQASRL

SEQ ID NO: 1135553 - protein, 9 aa, Homo Sapiens
SWEIVMETL

SEQ ID NO: 1135554 - protein, 9 aa, Homo Sapiens
GLTSRAPPM

SEQ ID NO: 1135555 - protein, 9 aa, Homo Sapiens
SKWADSVPL

SEQ ID NO: 1135556 - protein, 9 aa, Homo Sapiens
SLSEQQQQR

SEQ ID NO: 1135557 - protein, 9 aa, Homo Sapiens
ATMCCSFSP

SEQ ID NO: 1135558 - protein, 9 aa, Homo Sapiens
GSDILIPTC

SEQ ID NO: 1135559 - protein, 9 aa, Homo Sapiens
PFSLAEVRV

SEQ ID NO: 1135560 - protein, 9 aa, Homo Sapiens
INKNLVLQS

SEQ ID NO: 1135561 - protein, 9 aa, Homo Sapiens
GRVFYVTSF

SEQ ID NO: 1135562 - protein, 9 aa, Homo Sapiens
CFSRSRTFL

SEQ ID NO: 1135563 - protein, 9 aa, Homo Sapiens
KQRWERTTF

SEQ ID NO: 1135564 - protein, 9 aa, Homo Sapiens
DRANTVFSP

SEQ ID NO: 1135565 - protein, 9 aa, Homo Sapiens
TTINRNHMG

SEQ ID NO: 1135566 - protein, 9 aa, Homo Sapiens
TPLSASGLR

SEQ ID NO: 1135567 - protein, 9 aa, Homo Sapiens
GNHAEREKY

SEQ ID NO: 1135568 - protein, 9 aa, Homo Sapiens
GTKDTICSG

SEQ ID NO: 1135569 - protein, 9 aa, Homo Sapiens
VAQGGSAAP

SEQ ID NO: 1135570 - protein, 9 aa, Homo Sapiens
LCERHILGV

SEQ ID NO: 1135571 - protein, 9 aa, Homo Sapiens
WRRCGGPRI

SEQ ID NO: 1135572 - protein, 9 aa, Homo Sapiens
RLQLQMRLG

SEQ ID NO: 1135573 - protein, 9 aa, Homo Sapiens
RHSVVFSAT

SEQ ID NO: 1135574 - protein, 9 aa, Homo Sapiens
TLILVYPII

SEQ ID NO: 1135575 - protein, 9 aa, Homo Sapiens
TSSVVTDSI

SEQ ID NO: 1135576 - protein, 9 aa, Homo Sapiens
GRDGQEPQP

SEQ ID NO: 1135577 - protein, 9 aa, Homo Sapiens
AKPKNRTVA

SEQ ID NO: 1135578 - protein, 9 aa, Homo Sapiens
SASLEKRVK

SEQ ID NO: 1135579 - protein, 9 aa, Homo Sapiens
FYSFFSPSP

SEQ ID NO: 1135580 - protein, 9 aa, Homo Sapiens
VTLGLTAAL

SEQ ID NO: 1135581 - protein, 9 aa, Homo Sapiens
PLPPLPAPQ

SEQ ID NO: 1135582 - protein, 9 aa, Homo Sapiens
RPISFVDGL

SEQ ID NO: 1135583 - protein, 9 aa, Homo Sapiens
KTHGGAVAA

SEQ ID NO: 1135584 - protein, 9 aa, Homo Sapiens
LTLPLPTVG

SEQ ID NO: 1135585 - protein, 9 aa, Homo Sapiens
AQPHLSVSA

SEQ ID NO: 1135586 - protein, 9 aa, Homo Sapiens
WLVWVPHPL

SEQ ID NO: 1135587 - protein, 9 aa, Homo Sapiens
TPLFPLLSR

SEQ ID NO: 1135588 - protein, 9 aa, Homo Sapiens
TLFQCVAAV

SEQ ID NO: 1135589 - protein, 9 aa, Homo Sapiens
HGKALWEMA

SEQ ID NO: 1135590 - protein, 9 aa, Homo Sapiens
RKIPHFNAD

SEQ ID NO: 1135591 - protein, 9 aa, Homo Sapiens
LPTSFIIDS

SEQ ID NO: 1135592 - protein, 9 aa, Homo Sapiens
ELCTEDFDL

SEQ ID NO: 1135593 - protein, 9 aa, Homo Sapiens
TPPLRRSVS

SEQ ID NO: 1135594 - protein, 9 aa, Homo Sapiens
YALLLYDEL

SEQ ID NO: 1135595 - protein, 9 aa, Homo Sapiens
FSQCSNLIA

SEQ ID NO: 1135596 - protein, 9 aa, Homo Sapiens
DCMRGSSQI

SEQ ID NO: 1135597 - protein, 9 aa, Homo Sapiens
ANHSQDDHH

SEQ ID NO: 1135598 - protein, 9 aa, Homo Sapiens
DQSMRDASV

SEQ ID NO: 1135599 - protein, 9 aa, Homo Sapiens
MFSSEKARL

SEQ ID NO: 1135600 - protein, 9 aa, Homo Sapiens
VVMCCTLRS

SEQ ID NO: 1135601 - protein, 9 aa, Homo Sapiens
SQGPPVQPA

SEQ ID NO: 1135602 - protein, 9 aa, Homo Sapiens
PRCARSPSL

SEQ ID NO: 1135603 - protein, 9 aa, Homo Sapiens
DQSETVYEE

SEQ ID NO: 1135604 - protein, 9 aa, Homo Sapiens
NSVACSARW

SEQ ID NO: 1135605 - protein, 9 aa, Homo Sapiens
PLHKEIALH

SEQ ID NO: 1135606 - protein, 9 aa, Homo Sapiens
LLTQPSPAS

SEQ ID NO: 1135607 - protein, 9 aa, Homo Sapiens
KKIPRLLVS

SEQ ID NO: 1135608 - protein, 9 aa, Homo Sapiens
SAVPQQVQC

SEQ ID NO: 1135609 - protein, 9 aa, Homo Sapiens
SAVPSVARP

SEQ ID NO: 1135610 - protein, 9 aa, Homo Sapiens
RLRRHLPPA

SEQ ID NO: 1135611 - protein, 9 aa, Homo Sapiens
RYCNELRSL

SEQ ID NO: 1135612 - protein, 9 aa, Homo Sapiens
GKILTLLGP

SEQ ID NO: 1135613 - protein, 9 aa, Homo Sapiens
YDSISKEHV

SEQ ID NO: 1135614 - protein, 9 aa, Homo Sapiens
MEFCTQGQL

SEQ ID NO: 1135615 - protein, 9 aa, Homo Sapiens
PLTATDTTI

SEQ ID NO: 1135616 - protein, 9 aa, Homo Sapiens
CLCVILVGE

SEQ ID NO: 1135617 - protein, 9 aa, Homo Sapiens
LRVPEGAIV

SEQ ID NO: 1135618 - protein, 9 aa, Homo Sapiens
EILWTLSIW

SEQ ID NO: 1135619 - protein, 9 aa, Homo Sapiens
VWKEGGERG

SEQ ID NO: 1135620 - protein, 9 aa, Homo Sapiens
QLMCMINQL

SEQ ID NO: 1135621 - protein, 9 aa, Homo Sapiens
TSVQESSRG

SEQ ID NO: 1135622 - protein, 9 aa, Homo Sapiens
EEKKLGSPA

SEQ ID NO: 1135623 - protein, 9 aa, Homo Sapiens
TEIWCPQSA

SEQ ID NO: 1135624 - protein, 9 aa, Homo Sapiens
KLSGLKGKK

SEQ ID NO: 1135625 - protein, 9 aa, Homo Sapiens
TVGRELLIF

SEQ ID NO: 1135626 - protein, 9 aa, Homo Sapiens
FIAQDPYDL

SEQ ID NO: 1135627 - protein, 9 aa, Homo Sapiens
LLPVLWELC

SEQ ID NO: 1135628 - protein, 9 aa, Homo Sapiens
GNETVGREL

SEQ ID NO: 1135629 - protein, 9 aa, Homo Sapiens
SSQMWWRRQ

SEQ ID NO: 1135630 - protein, 9 aa, Homo Sapiens
FGRALLWTT

SEQ ID NO: 1135631 - protein, 9 aa, Homo Sapiens
WRAMVGGLT

SEQ ID NO: 1135632 - protein, 9 aa, Homo Sapiens
FFVVVAVDF

SEQ ID NO: 1135633 - protein, 9 aa, Homo Sapiens
KKGNFQRTT

SEQ ID NO: 1135634 - protein, 9 aa, Homo Sapiens
QRPISFVDG

SEQ ID NO: 1135635 - protein, 9 aa, Homo Sapiens
KGAQLGGGQ

SEQ ID NO: 1135636 - protein, 9 aa, Homo Sapiens
NESFTEELA

SEQ ID NO: 1135637 - protein, 9 aa, Homo Sapiens
MGLLRALGT

SEQ ID NO: 1135638 - protein, 9 aa, Homo Sapiens
DNAWHNVRV

SEQ ID NO: 1135639 - protein, 9 aa, Homo Sapiens
HSRSSSPPS

SEQ ID NO: 1135640 - protein, 9 aa, Homo Sapiens
QTLICKSQA

SEQ ID NO: 1135641 - protein, 9 aa, Homo Sapiens
SSPAPRGRP

SEQ ID NO: 1135642 - protein, 9 aa, Homo Sapiens
GRPSLASSC

SEQ ID NO: 1135643 - protein, 9 aa, Homo Sapiens
CQETITNLE

SEQ ID NO: 1135644 - protein, 9 aa, Homo Sapiens
LYPKGVFTK

SEQ ID NO: 1135645 - protein, 9 aa, Homo Sapiens
PWQQCPLNQ

SEQ ID NO: 1135646 - protein, 9 aa, Homo Sapiens
RAQAAPSTC

SEQ ID NO: 1135647 - protein, 9 aa, Homo Sapiens
EALLLFVGL

SEQ ID NO: 1135648 - protein, 9 aa, Homo Sapiens
SLRERKAHA

SEQ ID NO: 1135649 - protein, 9 aa, Homo Sapiens
GSSPQRPPL

SEQ ID NO: 1135650 - protein, 9 aa, Homo Sapiens
KQCESCSPN

SEQ ID NO: 1135651 - protein, 9 aa, Homo Sapiens
WTHPLRMAK

SEQ ID NO: 1135652 - protein, 9 aa, Homo Sapiens
TKASRGSRA

SEQ ID NO: 1135653 - protein, 9 aa, Homo Sapiens
APQHAHQLQ

SEQ ID NO: 1135654 - protein, 9 aa, Homo Sapiens
ASSSSCGSP

SEQ ID NO: 1135655 - protein, 9 aa, Homo Sapiens
CILGQRATR

SEQ ID NO: 1135656 - protein, 9 aa, Homo Sapiens
EQPLELRLL

SEQ ID NO: 1135657 - protein, 9 aa, Homo Sapiens
NFEVGEDEE

SEQ ID NO: 1135658 - protein, 9 aa, Homo Sapiens
VGSGAALAN

SEQ ID NO: 1135659 - protein, 9 aa, Homo Sapiens
SLQVVLEHL

SEQ ID NO: 1135660 - protein, 9 aa, Homo Sapiens
VLLHELQAP

SEQ ID NO: 1135661 - protein, 9 aa, Homo Sapiens
GTFPQEFII

SEQ ID NO: 1135662 - protein, 9 aa, Homo Sapiens
KEVYFEKHQ

SEQ ID NO: 1135663 - protein, 9 aa, Homo Sapiens
KIKEVYFEK

SEQ ID NO: 1135664 - protein, 9 aa, Homo Sapiens
EWPVPWAGG

SEQ ID NO: 1135665 - protein, 9 aa, Homo Sapiens
HGASGGEGG

SEQ ID NO: 1135666 - protein, 9 aa, Homo Sapiens
AINGILLSG

SEQ ID NO: 1135667 - protein, 9 aa, Homo Sapiens
RGRNFWQRI

SEQ ID NO: 1135668 - protein, 9 aa, Homo Sapiens
KDCKWSSCL

SEQ ID NO: 1135669 - protein, 9 aa, Homo Sapiens
KQIALRIDG

SEQ ID NO: 1135670 - protein, 9 aa, Homo Sapiens
SNKVRNHRI

SEQ ID NO: 1135671 - protein, 9 aa, Homo Sapiens
PSKREPVVV

SEQ ID NO: 1135672 - protein, 9 aa, Homo Sapiens
KMNIPFCIG

SEQ ID NO: 1135673 - protein, 9 aa, Homo Sapiens
QGPEEEGDM

SEQ ID NO: 1135674 - protein, 9 aa, Homo Sapiens
ETSCLRANY

SEQ ID NO: 1135675 - protein, 9 aa, Homo Sapiens
EYQEKLQVT

SEQ ID NO: 1135676 - protein, 9 aa, Homo Sapiens
ELSVSPSLL

SEQ ID NO: 1135677 - protein, 9 aa, Homo Sapiens
MVGEDVSSL

SEQ ID NO: 1135678 - protein, 9 aa, Homo Sapiens
ELLFRRIAW

SEQ ID NO: 1135679 - protein, 9 aa, Homo Sapiens
SYEGFGMYR

SEQ ID NO: 1135680 - protein, 9 aa, Homo Sapiens
LAVWISGIW

SEQ ID NO: 1135681 - protein, 9 aa, Homo Sapiens
QETQHEKTL

SEQ ID NO: 1135682 - protein, 9 aa, Homo Sapiens
TTRRDSWPT

SEQ ID NO: 1135683 - protein, 9 aa, Homo Sapiens
RIHLKLRNR

SEQ ID NO: 1135684 - protein, 9 aa, Homo Sapiens
QKMLKKEGS

SEQ ID NO: 1135685 - protein, 9 aa, Homo Sapiens
PVSPSCPRC

SEQ ID NO: 1135686 - protein, 9 aa, Homo Sapiens
TFLKKNLYE

SEQ ID NO: 1135687 - protein, 9 aa, Homo Sapiens
ENALVACVG

SEQ ID NO: 1135688 - protein, 9 aa, Homo Sapiens
EKESEALNI

SEQ ID NO: 1135689 - protein, 9 aa, Homo Sapiens
ITVPIDYVN

SEQ ID NO: 1135690 - protein, 9 aa, Homo Sapiens
EITVATGVS

SEQ ID NO: 1135691 - protein, 9 aa, Homo Sapiens
FTATKKDML

SEQ ID NO: 1135692 - protein, 9 aa, Homo Sapiens
QDRCEQVCV

SEQ ID NO: 1135693 - protein, 9 aa, Homo Sapiens
EDDDDDDDG

SEQ ID NO: 1135694 - protein, 9 aa, Homo Sapiens
GGLGPHVVT

SEQ ID NO: 1135695 - protein, 9 aa, Homo Sapiens
WTAPPAASW

SEQ ID NO: 1135696 - protein, 9 aa, Homo Sapiens
ADTIRSGRA

SEQ ID NO: 1135697 - protein, 9 aa, Homo Sapiens
YGFNESDLC

SEQ ID NO: 1135698 - protein, 9 aa, Homo Sapiens
SSCLTWASP

SEQ ID NO: 1135699 - protein, 9 aa, Homo Sapiens
APLDNSTDD

SEQ ID NO: 1135700 - protein, 9 aa, Homo Sapiens
RPTHPLCTV

SEQ ID NO: 1135701 - protein, 9 aa, Homo Sapiens
LSSWFEDAV

SEQ ID NO: 1135702 - protein, 9 aa, Homo Sapiens
EDNKSLTAH

SEQ ID NO: 1135703 - protein, 9 aa, Homo Sapiens
VKTKFKQHT

SEQ ID NO: 1135704 - protein, 9 aa, Homo Sapiens
MEKKTMNLT

SEQ ID NO: 1135705 - protein, 9 aa, Homo Sapiens
LDASELGME

SEQ ID NO: 1135706 - protein, 9 aa, Homo Sapiens
ISAMNLMTV

SEQ ID NO: 1135707 - protein, 9 aa, Homo Sapiens
LAMQRTVLP

SEQ ID NO: 1135708 - protein, 9 aa, Homo Sapiens
KYMTVPAHR

SEQ ID NO: 1135709 - protein, 9 aa, Homo Sapiens
KQTDVVLLG

SEQ ID NO: 1135710 - protein, 9 aa, Homo Sapiens
QAQAEQRVL

SEQ ID NO: 1135711 - protein, 9 aa, Homo Sapiens
RERSASRGH

SEQ ID NO: 1135712 - protein, 9 aa, Homo Sapiens
AQETESWIP

SEQ ID NO: 1135713 - protein, 9 aa, Homo Sapiens
HARVLGSPT

SEQ ID NO: 1135714 - protein, 9 aa, Homo Sapiens
VAELGGHTA

SEQ ID NO: 1135715 - protein, 9 aa, Homo Sapiens
TRHGPYPAA

SEQ ID NO: 1135716 - protein, 9 aa, Homo Sapiens
SPFRSDPAK

SEQ ID NO: 1135717 - protein, 9 aa, Homo Sapiens
TMSIDRALA

SEQ ID NO: 1135718 - protein, 9 aa, Homo Sapiens
TSSPEELHR

SEQ ID NO: 1135719 - protein, 9 aa, Homo Sapiens
ISTAVSIPD

SEQ ID NO: 1135720 - protein, 9 aa, Homo Sapiens
AFLTAASTQ

SEQ ID NO: 1135721 - protein, 9 aa, Homo Sapiens
VVYAPWSNL

SEQ ID NO: 1135722 - protein, 9 aa, Homo Sapiens
KKKSQAMRV

SEQ ID NO: 1135723 - protein, 9 aa, Homo Sapiens
AGAKGPHSY

SEQ ID NO: 1135724 - protein, 9 aa, Homo Sapiens
QPGQQQQVF

SEQ ID NO: 1135725 - protein, 9 aa, Homo Sapiens
QAGLAHVFI

SEQ ID NO: 1135726 - protein, 9 aa, Homo Sapiens
TPGHFCPLR

SEQ ID NO: 1135727 - protein, 9 aa, Homo Sapiens
VELEQVHQK

SEQ ID NO: 1135728 - protein, 9 aa, Homo Sapiens
QPGRRPPKG

SEQ ID NO: 1135729 - protein, 9 aa, Homo Sapiens
ACLPLGATS

SEQ ID NO: 1135730 - protein, 9 aa, Homo Sapiens
VVKQTDVVL

SEQ ID NO: 1135731 - protein, 9 aa, Homo Sapiens
ATSAGRACV

SEQ ID NO: 1135732 - protein, 9 aa, Homo Sapiens
PGLGGGGRG

SEQ ID NO: 1135733 - protein, 9 aa, Homo Sapiens
QLKPQLLQG

SEQ ID NO: 1135734 - protein, 9 aa, Homo Sapiens
ALLQPPQAL

SEQ ID NO: 1135735 - protein, 9 aa, Homo Sapiens
ASTGSSTAS

SEQ ID NO: 1135736 - protein, 9 aa, Homo Sapiens
PGPPSGARR

SEQ ID NO: 1135737 - protein, 9 aa, Homo Sapiens
CEEFEQKNQ

SEQ ID NO: 1135738 - protein, 9 aa, Homo Sapiens
HRGEQPPDQ

SEQ ID NO: 1135739 - protein, 9 aa, Homo Sapiens
LSWSLQTLP

SEQ ID NO: 1135740 - protein, 9 aa, Homo Sapiens
PAVGGELRA

SEQ ID NO: 1135741 - protein, 9 aa, Homo Sapiens
QMSILGKRL

SEQ ID NO: 1135742 - protein, 9 aa, Homo Sapiens
KSMYYYIQQ

SEQ ID NO: 1135743 - protein, 9 aa, Homo Sapiens
YPIWQKMFN

SEQ ID NO: 1135744 - protein, 9 aa, Homo Sapiens
YTAFPSRRR

SEQ ID NO: 1135745 - protein, 9 aa, Homo Sapiens
CQCDKKRGA

SEQ ID NO: 1135746 - protein, 9 aa, Homo Sapiens
LDGYNGTTM

SEQ ID NO: 1135747 - protein, 9 aa, Homo Sapiens
IIIMCCTNA

SEQ ID NO: 1135748 - protein, 9 aa, Homo Sapiens
KKSKQQGVP

SEQ ID NO: 1135749 - protein, 9 aa, Homo Sapiens
DHEVKTLHV

SEQ ID NO: 1135750 - protein, 9 aa, Homo Sapiens
KAGIGGAAV

SEQ ID NO: 1135751 - protein, 9 aa, Homo Sapiens
FLGDPDTDL

SEQ ID NO: 1135752 - protein, 9 aa, Homo Sapiens
SYTLEKSYI

SEQ ID NO: 1135753 - protein, 9 aa, Homo Sapiens
RRIVRSSPT

SEQ ID NO: 1135754 - protein, 9 aa, Homo Sapiens
SLLYVIRTC

SEQ ID NO: 1135755 - protein, 9 aa, Homo Sapiens
GHGASLQVV

SEQ ID NO: 1135756 - protein, 9 aa, Homo Sapiens
TRPSGPPFP

SEQ ID NO: 1135757 - protein, 9 aa, Homo Sapiens
RSLRLSGTP

SEQ ID NO: 1135758 - protein, 9 aa, Homo Sapiens
RRRRGQGAV

SEQ ID NO: 1135759 - protein, 9 aa, Homo Sapiens
PARQDMEKA

SEQ ID NO: 1135760 - protein, 9 aa, Homo Sapiens
YSVKSRDKK

SEQ ID NO: 1135761 - protein, 9 aa, Homo Sapiens
TPAQTPTLV

SEQ ID NO: 1135762 - protein, 9 aa, Homo Sapiens
ACYQNPEKN

SEQ ID NO: 1135763 - protein, 9 aa, Homo Sapiens
CLPLRFWAN

SEQ ID NO: 1135764 - protein, 9 aa, Homo Sapiens
RSAEPGCLV

SEQ ID NO: 1135765 - protein, 9 aa, Homo Sapiens
VNRATCYFT

SEQ ID NO: 1135766 - protein, 9 aa, Homo Sapiens
TTHRDKVPG

SEQ ID NO: 1135767 - protein, 9 aa, Homo Sapiens
HGWAFSPAR

SEQ ID NO: 1135768 - protein, 9 aa, Homo Sapiens
RVNLGLGEA

SEQ ID NO: 1135769 - protein, 9 aa, Homo Sapiens
TAGCCAMAS

SEQ ID NO: 1135770 - protein, 9 aa, Homo Sapiens
HLRKGGNLV

SEQ ID NO: 1135771 - protein, 9 aa, Homo Sapiens
PAILVIITA

SEQ ID NO: 1135772 - protein, 9 aa, Homo Sapiens
PDKARLLWQ

SEQ ID NO: 1135773 - protein, 9 aa, Homo Sapiens
SPSQRSHCR

SEQ ID NO: 1135774 - protein, 9 aa, Homo Sapiens
PNTMAEKFS

SEQ ID NO: 1135775 - protein, 9 aa, Homo Sapiens
KTSCTTFTR

SEQ ID NO: 1135776 - protein, 9 aa, Homo Sapiens
PLPQTHQKL

SEQ ID NO: 1135777 - protein, 9 aa, Homo Sapiens
RNKSGCKHD

SEQ ID NO: 1135778 - protein, 9 aa, Homo Sapiens
GAPVPHRSL

SEQ ID NO: 1135779 - protein, 9 aa, Homo Sapiens
TCTHQGFCL

SEQ ID NO: 1135780 - protein, 9 aa, Homo Sapiens
RTSWRTLLR

SEQ ID NO: 1135781 - protein, 9 aa, Homo Sapiens
ANFSFGGVY

SEQ ID NO: 1135782 - protein, 9 aa, Homo Sapiens
RKRERPERY

SEQ ID NO: 1135783 - protein, 9 aa, Homo Sapiens
SMTTSTTAK

SEQ ID NO: 1135784 - protein, 9 aa, Homo Sapiens
LGKNPHCGL

SEQ ID NO: 1135785 - protein, 9 aa, Homo Sapiens
QRSQSDPIL

SEQ ID NO: 1135786 - protein, 9 aa, Homo Sapiens
DSDSEPDSP

SEQ ID NO: 1135787 - protein, 9 aa, Homo Sapiens
NPVPLRPKA

SEQ ID NO: 1135788 - protein, 9 aa, Homo Sapiens
TKKRWEETI

SEQ ID NO: 1135789 - protein, 9 aa, Homo Sapiens
TGYLRTATG

SEQ ID NO: 1135790 - protein, 9 aa, Homo Sapiens
LKYYHGISG

SEQ ID NO: 1135791 - protein, 9 aa, Homo Sapiens
GNQSIRYPH

SEQ ID NO: 1135792 - protein, 9 aa, Homo Sapiens
NIDNVTVLD

SEQ ID NO: 1135793 - protein, 9 aa, Homo Sapiens
DRADISNCG

SEQ ID NO: 1135794 - protein, 9 aa, Homo Sapiens
SLDSPPQPR

SEQ ID NO: 1135795 - protein, 9 aa, Homo Sapiens
ICGFSLSAV

SEQ ID NO: 1135796 - protein, 9 aa, Homo Sapiens
KKKKRWSRS

SEQ ID NO: 1135797 - protein, 9 aa, Homo Sapiens
EQLSRFASA

SEQ ID NO: 1135798 - protein, 9 aa, Homo Sapiens
EQNQEHSED

SEQ ID NO: 1135799 - protein, 9 aa, Homo Sapiens
SLSTGTRRI

SEQ ID NO: 1135800 - protein, 9 aa, Homo Sapiens
PSWIGVVIL

SEQ ID NO: 1135801 - protein, 9 aa, Homo Sapiens
RAGCRPMER

SEQ ID NO: 1135802 - protein, 9 aa, Homo Sapiens
HSLSLDDIK

SEQ ID NO: 1135803 - protein, 9 aa, Homo Sapiens
QQQQQSQQP

SEQ ID NO: 1135804 - protein, 9 aa, Homo Sapiens
RQYKSEALG

SEQ ID NO: 1135805 - protein, 9 aa, Homo Sapiens
YRSEENAKN

SEQ ID NO: 1135806 - protein, 9 aa, Homo Sapiens
PRAATLGIL

SEQ ID NO: 1135807 - protein, 9 aa, Homo Sapiens
FEYLMFILI

SEQ ID NO: 1135808 - protein, 9 aa, Homo Sapiens
PKATANRDI

SEQ ID NO: 1135809 - protein, 9 aa, Homo Sapiens
AGRARRARW

SEQ ID NO: 1135810 - protein, 9 aa, Homo Sapiens
NSFLIKYKQ

SEQ ID NO: 1135811 - protein, 9 aa, Homo Sapiens
GSKDKVGRL

SEQ ID NO: 1135812 - protein, 9 aa, Homo Sapiens
LNRAGRWRS

SEQ ID NO: 1135813 - protein, 9 aa, Homo Sapiens
TTGLLTLLW

SEQ ID NO: 1135814 - protein, 9 aa, Homo Sapiens
SGVRGSTWM

SEQ ID NO: 1135815 - protein, 9 aa, Homo Sapiens
LGAVENATE

SEQ ID NO: 1135816 - protein, 9 aa, Homo Sapiens
SSLCYGFVL

SEQ ID NO: 1135817 - protein, 9 aa, Homo Sapiens
PPMAAASLA

SEQ ID NO: 1135818 - protein, 9 aa, Homo Sapiens
RLHRLITAY

SEQ ID NO: 1135819 - protein, 9 aa, Homo Sapiens
GGPPRPTVA

SEQ ID NO: 1135820 - protein, 9 aa, Homo Sapiens
PEHHSTALA

SEQ ID NO: 1135821 - protein, 9 aa, Homo Sapiens
ESSGWSFQT

SEQ ID NO: 1135822 - protein, 9 aa, Homo Sapiens
PFQGSYSFD

SEQ ID NO: 1135823 - protein, 9 aa, Homo Sapiens
WEIVMETLQ

SEQ ID NO: 1135824 - protein, 9 aa, Homo Sapiens
HAYYTLSYC

SEQ ID NO: 1135825 - protein, 9 aa, Homo Sapiens
RLLTTAWAA

SEQ ID NO: 1135826 - protein, 9 aa, Homo Sapiens
SSRHQTDKS

SEQ ID NO: 1135827 - protein, 9 aa, Homo Sapiens
DCIHEAIKK

SEQ ID NO: 1135828 - protein, 9 aa, Homo Sapiens
ESHLLNRAG

SEQ ID NO: 1135829 - protein, 9 aa, Homo Sapiens
SDNKCHFRA

SEQ ID NO: 1135830 - protein, 9 aa, Homo Sapiens
FIWVGQLTK

SEQ ID NO: 1135831 - protein, 9 aa, Homo Sapiens
VGKKRHPVK

SEQ ID NO: 1135832 - protein, 9 aa, Homo Sapiens
ADTRISVLV

SEQ ID NO: 1135833 - protein, 9 aa, Homo Sapiens
TLQSPFGDL

SEQ ID NO: 1135834 - protein, 9 aa, Homo Sapiens
TMCCSFSPE

SEQ ID NO: 1135835 - protein, 9 aa, Homo Sapiens
RWRTFTTTS

SEQ ID NO: 1135836 - protein, 9 aa, Homo Sapiens
VLAVHLGES

SEQ ID NO: 1135837 - protein, 9 aa, Homo Sapiens
TAGAWQYFM

SEQ ID NO: 1135838 - protein, 9 aa, Homo Sapiens
GGKTSLITR

SEQ ID NO: 1135839 - protein, 9 aa, Homo Sapiens
EPETVCNVT

SEQ ID NO: 1135840 - protein, 9 aa, Homo Sapiens
IRFVFHAVK

SEQ ID NO: 1135841 - protein, 9 aa, Homo Sapiens
AVASPDQQQ

SEQ ID NO: 1135842 - protein, 9 aa, Homo Sapiens
IQLHHSFVS

SEQ ID NO: 1135843 - protein, 9 aa, Homo Sapiens
QQARGRVNN

SEQ ID NO: 1135844 - protein, 9 aa, Homo Sapiens
VNVMFSFVK

SEQ ID NO: 1135845 - protein, 9 aa, Homo Sapiens
VPDAPDATV

SEQ ID NO: 1135846 - protein, 9 aa, Homo Sapiens
LAGLCILVN

SEQ ID NO: 1135847 - protein, 9 aa, Homo Sapiens
LPLTYSNLH

SEQ ID NO: 1135848 - protein, 9 aa, Homo Sapiens
PVPLPPSAP

SEQ ID NO: 1135849 - protein, 9 aa, Homo Sapiens
LHIFRDEIN

SEQ ID NO: 1135850 - protein, 9 aa, Homo Sapiens
RSFRITTRE

SEQ ID NO: 1135851 - protein, 9 aa, Homo Sapiens
LARHNETGS

SEQ ID NO: 1135852 - protein, 9 aa, Homo Sapiens
SVITSPLHA

SEQ ID NO: 1135853 - protein, 9 aa, Homo Sapiens
QPIKFLIKY

SEQ ID NO: 1135854 - protein, 9 aa, Homo Sapiens
LMEEFVRQY

SEQ ID NO: 1135855 - protein, 9 aa, Homo Sapiens
VVKIESIMF

SEQ ID NO: 1135856 - protein, 9 aa, Homo Sapiens
KRLHAVHMK

SEQ ID NO: 1135857 - protein, 9 aa, Homo Sapiens
FDNYSANMM

SEQ ID NO: 1135858 - protein, 9 aa, Homo Sapiens
LPPDCGHPL

SEQ ID NO: 1135859 - protein, 9 aa, Homo Sapiens
NNKAQASHS

SEQ ID NO: 1135860 - protein, 9 aa, Homo Sapiens
VPVPPLPAC

SEQ ID NO: 1135861 - protein, 9 aa, Homo Sapiens
SPPRRWPPR

SEQ ID NO: 1135862 - protein, 9 aa, Homo Sapiens
KRDVESLVQ

SEQ ID NO: 1135863 - protein, 9 aa, Homo Sapiens
ERQLMCMIN

SEQ ID NO: 1135864 - protein, 9 aa, Homo Sapiens
WMALCPRQA

SEQ ID NO: 1135865 - protein, 9 aa, Homo Sapiens
LTYFLPFPP

SEQ ID NO: 1135866 - protein, 9 aa, Homo Sapiens
LGLTAALSF

SEQ ID NO: 1135867 - protein, 9 aa, Homo Sapiens
TPQPSLPGP

SEQ ID NO: 1135868 - protein, 9 aa, Homo Sapiens
RKTGPFCVN

SEQ ID NO: 1135869 - protein, 9 aa, Homo Sapiens
LPRLVCCPG

SEQ ID NO: 1135870 - protein, 9 aa, Homo Sapiens
ITYVSSLHD

SEQ ID NO: 1135871 - protein, 9 aa, Homo Sapiens
SACGFYLTV

SEQ ID NO: 1135872 - protein, 9 aa, Homo Sapiens
GNTPVILAV

SEQ ID NO: 1135873 - protein, 9 aa, Homo Sapiens
GPGPCIGEE

SEQ ID NO: 1135874 - protein, 9 aa, Homo Sapiens
RGYHKKSSQ

SEQ ID NO: 1135875 - protein, 9 aa, Homo Sapiens
CLQLQEDVD

SEQ ID NO: 1135876 - protein, 9 aa, Homo Sapiens
LEKCDIDAM

SEQ ID NO: 1135877 - protein, 9 aa, Homo Sapiens
PGVVDKALK

SEQ ID NO: 1135878 - protein, 9 aa, Homo Sapiens
EFIRVEDNK

SEQ ID NO: 1135879 - protein, 9 aa, Homo Sapiens
PQRPPLQPV

SEQ ID NO: 1135880 - protein, 9 aa, Homo Sapiens
DTKEEIMKA

SEQ ID NO: 1135881 - protein, 9 aa, Homo Sapiens
KRYDGPQQA

SEQ ID NO: 1135882 - protein, 9 aa, Homo Sapiens
QLVGGQVGH

SEQ ID NO: 1135883 - protein, 9 aa, Homo Sapiens
AGVPTLGSN

SEQ ID NO: 1135884 - protein, 9 aa, Homo Sapiens
DSPCCSDFS

SEQ ID NO: 1135885 - protein, 9 aa, Homo Sapiens
TSSQTRTSA

SEQ ID NO: 1135886 - protein, 9 aa, Homo Sapiens
STVRYMIGE

SEQ ID NO: 1135887 - protein, 9 aa, Homo Sapiens
VEAVPSNMW

SEQ ID NO: 1135888 - protein, 9 aa, Homo Sapiens
TGYRIYRCA

SEQ ID NO: 1135889 - protein, 9 aa, Homo Sapiens
YDCQMNVND

SEQ ID NO: 1135890 - protein, 9 aa, Homo Sapiens
SNETPKKKR

SEQ ID NO: 1135891 - protein, 9 aa, Homo Sapiens
AAAASPRAA

SEQ ID NO: 1135892 - protein, 9 aa, Homo Sapiens
SLTERGSTE

SEQ ID NO: 1135893 - protein, 9 aa, Homo Sapiens
IRGQEKSKM

SEQ ID NO: 1135894 - protein, 9 aa, Homo Sapiens
ALLALATLC

SEQ ID NO: 1135895 - protein, 9 aa, Homo Sapiens
CPSPWPQAS

SEQ ID NO: 1135896 - protein, 9 aa, Homo Sapiens
ATVMGNLLI

SEQ ID NO: 1135897 - protein, 9 aa, Homo Sapiens
LCSLLNFLS

SEQ ID NO: 1135898 - protein, 9 aa, Homo Sapiens
KVTAEFDLT

SEQ ID NO: 1135899 - protein, 9 aa, Homo Sapiens
EGEHKDIVS

SEQ ID NO: 1135900 - protein, 9 aa, Homo Sapiens
RNGIKGGLG

SEQ ID NO: 1135901 - protein, 9 aa, Homo Sapiens
MGSWALLWS

SEQ ID NO: 1135902 - protein, 9 aa, Homo Sapiens
AGHTLTAHR

SEQ ID NO: 1135903 - protein, 9 aa, Homo Sapiens
QHNGEKSQA

SEQ ID NO: 1135904 - protein, 9 aa, Homo Sapiens
PGQPLKPPD

SEQ ID NO: 1135905 - protein, 9 aa, Homo Sapiens
RQPLIMQPP

SEQ ID NO: 1135906 - protein, 9 aa, Homo Sapiens
TKVLWPLRP

SEQ ID NO: 1135907 - protein, 9 aa, Homo Sapiens
IFNMKKSLC

SEQ ID NO: 1135908 - protein, 9 aa, Homo Sapiens
KKVEVLAET

SEQ ID NO: 1135909 - protein, 9 aa, Homo Sapiens
PNVSWTGNL

SEQ ID NO: 1135910 - protein, 9 aa, Homo Sapiens
TSGETTHRD

SEQ ID NO: 1135911 - protein, 9 aa, Homo Sapiens
PDTLLGALG

SEQ ID NO: 1135912 - protein, 9 aa, Homo Sapiens
VQYRELGNI

SEQ ID NO: 1135913 - protein, 9 aa, Homo Sapiens
GAGQGPGQR

SEQ ID NO: 1135914 - protein, 9 aa, Homo Sapiens
TLPQSYHAP

SEQ ID NO: 1135915 - protein, 9 aa, Homo Sapiens
TFMDNYITG

SEQ ID NO: 1135916 - protein, 9 aa, Homo Sapiens
IISFTVPNI

SEQ ID NO: 1135917 - protein, 9 aa, Homo Sapiens
LGFFGQNQN

SEQ ID NO: 1135918 - protein, 9 aa, Homo Sapiens
RRGGPGQAA

SEQ ID NO: 1135919 - protein, 9 aa, Homo Sapiens
SAGRHRGTG

SEQ ID NO: 1135920 - protein, 9 aa, Homo Sapiens
SVQESSRGL

SEQ ID NO: 1135921 - protein, 9 aa, Homo Sapiens
VNTTDYHGA

SEQ ID NO: 1135922 - protein, 9 aa, Homo Sapiens
RTPCVPSVI

SEQ ID NO: 1135923 - protein, 9 aa, Homo Sapiens
PEPPCLHDE

SEQ ID NO: 1135924 - protein, 9 aa, Homo Sapiens
HGDGTDGEG

SEQ ID NO: 1135925 - protein, 9 aa, Homo Sapiens
EIEQMRWPT

SEQ ID NO: 1135926 - protein, 9 aa, Homo Sapiens
PIQVQTGGR

SEQ ID NO: 1135927 - protein, 9 aa, Homo Sapiens
GFSSMLEYR

SEQ ID NO: 1135928 - protein, 9 aa, Homo Sapiens
ICQERDIFL

SEQ ID NO: 1135929 - protein, 9 aa, Homo Sapiens
LKKGAGAAG

SEQ ID NO: 1135930 - protein, 9 aa, Homo Sapiens
HKKSSQRHS

SEQ ID NO: 1135931 - protein, 9 aa, Homo Sapiens
FFPLSSMAV

SEQ ID NO: 1135932 - protein, 9 aa, Homo Sapiens
REHLRELCL

SEQ ID NO: 1135933 - protein, 9 aa, Homo Sapiens
FMLHIQVQA

SEQ ID NO: 1135934 - protein, 9 aa, Homo Sapiens
KRTTKSWSC

SEQ ID NO: 1135935 - protein, 9 aa, Homo Sapiens
TVDQQKSSL

SEQ ID NO: 1135936 - protein, 9 aa, Homo Sapiens
HLSTKGFPR

SEQ ID NO: 1135937 - protein, 9 aa, Homo Sapiens
SVRMFVWTR

SEQ ID NO: 1135938 - protein, 9 aa, Homo Sapiens
VAKEDGKAN

SEQ ID NO: 1135939 - protein, 9 aa, Homo Sapiens
EEALATSPL

SEQ ID NO: 1135940 - protein, 9 aa, Homo Sapiens
ITGYDVKPP

SEQ ID NO: 1135941 - protein, 9 aa, Homo Sapiens
LGGHPLQME

SEQ ID NO: 1135942 - protein, 9 aa, Homo Sapiens
GDTAYTKLV

SEQ ID NO: 1135943 - protein, 9 aa, Homo Sapiens
WPNDISVDD

SEQ ID NO: 1135944 - protein, 9 aa, Homo Sapiens
QNPTIFEER

SEQ ID NO: 1135945 - protein, 9 aa, Homo Sapiens
GEIPSELQG

SEQ ID NO: 1135946 - protein, 9 aa, Homo Sapiens
SVLETSAVL

SEQ ID NO: 1135947 - protein, 9 aa, Homo Sapiens
RSASRGHGA

SEQ ID NO: 1135948 - protein, 9 aa, Homo Sapiens
IWGNTANVA

SEQ ID NO: 1135949 - protein, 9 aa, Homo Sapiens
LSTLQINVC

SEQ ID NO: 1135950 - protein, 9 aa, Homo Sapiens
STIAPSTVC

SEQ ID NO: 1135951 - protein, 9 aa, Homo Sapiens
ITREEFITA

SEQ ID NO: 1135952 - protein, 9 aa, Homo Sapiens
HLLSEHSGS

SEQ ID NO: 1135953 - protein, 9 aa, Homo Sapiens
PMAAASLAY

SEQ ID NO: 1135954 - protein, 9 aa, Homo Sapiens
PSGKGRGDV

SEQ ID NO: 1135955 - protein, 9 aa, Homo Sapiens
VIEPSERRR

SEQ ID NO: 1135956 - protein, 9 aa, Homo Sapiens
IHQKFGSGS

SEQ ID NO: 1135957 - protein, 9 aa, Homo Sapiens
STWRSTRRC

SEQ ID NO: 1135958 - protein, 9 aa, Homo Sapiens
NARVFKELP

SEQ ID NO: 1135959 - protein, 9 aa, Homo Sapiens
QVLSNGLLL

SEQ ID NO: 1135960 - protein, 9 aa, Homo Sapiens
ISDVFLCHH

SEQ ID NO: 1135961 - protein, 9 aa, Homo Sapiens
LAPERGSVC

SEQ ID NO: 1135962 - protein, 9 aa, Homo Sapiens
NDTVQIPCP

SEQ ID NO: 1135963 - protein, 9 aa, Homo Sapiens
QRLTLITDM

SEQ ID NO: 1135964 - protein, 9 aa, Homo Sapiens
MAAVQQLEG

SEQ ID NO: 1135965 - protein, 9 aa, Homo Sapiens
ARETPTKLE

SEQ ID NO: 1135966 - protein, 9 aa, Homo Sapiens
HKKELTMFS

SEQ ID NO: 1135967 - protein, 9 aa, Homo Sapiens
GSAGRHRGT

SEQ ID NO: 1135968 - protein, 9 aa, Homo Sapiens
KIQDQDQEL

SEQ ID NO: 1135969 - protein, 9 aa, Homo Sapiens
LAGPLALAS

SEQ ID NO: 1135970 - protein, 9 aa, Homo Sapiens
ESLHIFRDE

SEQ ID NO: 1135971 - protein, 9 aa, Homo Sapiens
DDRLLCPHA

SEQ ID NO: 1135972 - protein, 9 aa, Homo Sapiens
ENGTSDCSL

SEQ ID NO: 1135973 - protein, 9 aa, Homo Sapiens
RRARWDLRR

SEQ ID NO: 1135974 - protein, 9 aa, Homo Sapiens
THNRSAMPF

SEQ ID NO: 1135975 - protein, 9 aa, Homo Sapiens
VFPPLIPLL

SEQ ID NO: 1135976 - protein, 9 aa, Homo Sapiens
TTMGETSCS

SEQ ID NO: 1135977 - protein, 9 aa, Homo Sapiens
HTAACVLKG

SEQ ID NO: 1135978 - protein, 9 aa, Homo Sapiens
LQLKPQLLQ

SEQ ID NO: 1135979 - protein, 9 aa, Homo Sapiens
ESCKLYDGE

SEQ ID NO: 1135980 - protein, 9 aa, Homo Sapiens
MPSWIGVVI

SEQ ID NO: 1135981 - protein, 9 aa, Homo Sapiens
TTASSPECG

SEQ ID NO: 1135982 - protein, 9 aa, Homo Sapiens
GDICSLYTE

SEQ ID NO: 1135983 - protein, 9 aa, Homo Sapiens
ETSCSEQPA

SEQ ID NO: 1135984 - protein, 9 aa, Homo Sapiens
SQNYCYQVC

SEQ ID NO: 1135985 - protein, 9 aa, Homo Sapiens
SSVTKMHRF

SEQ ID NO: 1135986 - protein, 9 aa, Homo Sapiens
ACSGTWCLP

SEQ ID NO: 1135987 - protein, 9 aa, Homo Sapiens
YSKAKPMCS

SEQ ID NO: 1135988 - protein, 9 aa, Homo Sapiens
WDPTARIPR

SEQ ID NO: 1135989 - protein, 9 aa, Homo Sapiens
GASQTTDAI

SEQ ID NO: 1135990 - protein, 9 aa, Homo Sapiens
LSRHLQEAL

SEQ ID NO: 1135991 - protein, 9 aa, Homo Sapiens
PPIKKIPRL

SEQ ID NO: 1135992 - protein, 9 aa, Homo Sapiens
SAWRPPRYL

SEQ ID NO: 1135993 - protein, 9 aa, Homo Sapiens
DHGDGGIYI

SEQ ID NO: 1135994 - protein, 9 aa, Homo Sapiens
VREVEAVPS

SEQ ID NO: 1135995 - protein, 9 aa, Homo Sapiens
RTASTRSAV

SEQ ID NO: 1135996 - protein, 9 aa, Homo Sapiens
FLNMEELIQ

SEQ ID NO: 1135997 - protein, 9 aa, Homo Sapiens
EIRDWRGPS

SEQ ID NO: 1135998 - protein, 9 aa, Homo Sapiens
ISASTRRQL

SEQ ID NO: 1135999 - protein, 9 aa, Homo Sapiens
KCKEYEKDV

SEQ ID NO: 1136000 - protein, 9 aa, Homo Sapiens
KKCKEYEKD

SEQ ID NO: 1136001 - protein, 9 aa, Homo Sapiens
PRSLRLSGT

SEQ ID NO: 1136002 - protein, 9 aa, Homo Sapiens
QCSSGSGEQ

SEQ ID NO: 1136003 - protein, 9 aa, Homo Sapiens
APASVATAP

SEQ ID NO: 1136004 - protein, 9 aa, Homo Sapiens
KPCRTSTTR

SEQ ID NO: 1136005 - protein, 9 aa, Homo Sapiens
RLSPGPPGS

SEQ ID NO: 1136006 - protein, 9 aa, Homo Sapiens
TKNAVLMYP

SEQ ID NO: 1136007 - protein, 9 aa, Homo Sapiens
VSQSPFFAT

SEQ ID NO: 1136008 - protein, 9 aa, Homo Sapiens
LRLSCCLFS

SEQ ID NO: 1136009 - protein, 9 aa, Homo Sapiens
SMLEYRKHL

SEQ ID NO: 1136010 - protein, 9 aa, Homo Sapiens
GDPISAGCC

SEQ ID NO: 1136011 - protein, 9 aa, Homo Sapiens
TAGPHVSGL

SEQ ID NO: 1136012 - protein, 9 aa, Homo Sapiens
KRLNKVPVR

SEQ ID NO: 1136013 - protein, 9 aa, Homo Sapiens
LMFILILLN

SEQ ID NO: 1136014 - protein, 9 aa, Homo Sapiens
DFTPFNESD

SEQ ID NO: 1136015 - protein, 9 aa, Homo Sapiens
DGWVEEWYN

SEQ ID NO: 1136016 - protein, 9 aa, Homo Sapiens
FNELTAREH

SEQ ID NO: 1136017 - protein, 9 aa, Homo Sapiens
KAGKRMVRG

SEQ ID NO: 1136018 - protein, 9 aa, Homo Sapiens
NTPVILAVS

SEQ ID NO: 1136019 - protein, 9 aa, Homo Sapiens
QCQIEPVKK

SEQ ID NO: 1136020 - protein, 9 aa, Homo Sapiens
QLPEPILAD

SEQ ID NO: 1136021 - protein, 9 aa, Homo Sapiens
SGENLTSVI

SEQ ID NO: 1136022 - protein, 9 aa, Homo Sapiens
ILRPPSTRH

SEQ ID NO: 1136023 - protein, 9 aa, Homo Sapiens
KQASDSDSS

SEQ ID NO: 1136024 - protein, 9 aa, Homo Sapiens
QLLERGYRH

SEQ ID NO: 1136025 - protein, 9 aa, Homo Sapiens
MQKENHFLF

SEQ ID NO: 1136026 - protein, 9 aa, Homo Sapiens
EKCDIDAMI

SEQ ID NO: 1136027 - protein, 9 aa, Homo Sapiens
EGFGMYREK

SEQ ID NO: 1136028 - protein, 9 aa, Homo Sapiens
SGRSEVPPS

SEQ ID NO: 1136029 - protein, 9 aa, Homo Sapiens
DFFIQDAYT

SEQ ID NO: 1136030 - protein, 9 aa, Homo Sapiens
INGLPSTMQ

SEQ ID NO: 1136031 - protein, 9 aa, Homo Sapiens
AGGLGPEAG

SEQ ID NO: 1136032 - protein, 9 aa, Homo Sapiens
TMDIWLSLG

SEQ ID NO: 1136033 - protein, 9 aa, Homo Sapiens
LMEFCTQGQ

SEQ ID NO: 1136034 - protein, 9 aa, Homo Sapiens
ELGPQLAAM

SEQ ID NO: 1136035 - protein, 9 aa, Homo Sapiens
LLQRNLLRL

SEQ ID NO: 1136036 - protein, 9 aa, Homo Sapiens
KVRTARALL

SEQ ID NO: 1136037 - protein, 9 aa, Homo Sapiens
RNRPSFDTI

SEQ ID NO: 1136038 - protein, 9 aa, Homo Sapiens
VTNSDNEVL

SEQ ID NO: 1136039 - protein, 9 aa, Homo Sapiens
SIEKNNYRK

SEQ ID NO: 1136040 - protein, 9 aa, Homo Sapiens
VTSCADIAD

SEQ ID NO: 1136041 - protein, 9 aa, Homo Sapiens
PMWICGSQI

SEQ ID NO: 1136042 - protein, 9 aa, Homo Sapiens
LGNEETKES

SEQ ID NO: 1136043 - protein, 9 aa, Homo Sapiens
KWLGVQWRI

SEQ ID NO: 1136044 - protein, 9 aa, Homo Sapiens
HDTGKFTNG

SEQ ID NO: 1136045 - protein, 9 aa, Homo Sapiens
IRDMHLELK

SEQ ID NO: 1136046 - protein, 9 aa, Homo Sapiens
RTRYNQTEL

SEQ ID NO: 1136047 - protein, 9 aa, Homo Sapiens
ILELSAIVS

SEQ ID NO: 1136048 - protein, 9 aa, Homo Sapiens
STRLRLWLK

SEQ ID NO: 1136049 - protein, 9 aa, Homo Sapiens
ETIFGPKSQ

SEQ ID NO: 1136050 - protein, 9 aa, Homo Sapiens
YRDAMLENY

SEQ ID NO: 1136051 - protein, 9 aa, Homo Sapiens
VWVGAQEAV

SEQ ID NO: 1136052 - protein, 9 aa, Homo Sapiens
SDHRSFTTK

SEQ ID NO: 1136053 - protein, 9 aa, Homo Sapiens
SSGWSFQTR

SEQ ID NO: 1136054 - protein, 9 aa, Homo Sapiens
LILLSETSC

SEQ ID NO: 1136055 - protein, 9 aa, Homo Sapiens
PVHTLSEVE

SEQ ID NO: 1136056 - protein, 9 aa, Homo Sapiens
PADTTSVGF

SEQ ID NO: 1136057 - protein, 9 aa, Homo Sapiens
RETGDPTEK

SEQ ID NO: 1136058 - protein, 9 aa, Homo Sapiens
HYVIAKVIV

SEQ ID NO: 1136059 - protein, 9 aa, Homo Sapiens
FPFNILDSP

SEQ ID NO: 1136060 - protein, 9 aa, Homo Sapiens
DSQPNFNMQ

SEQ ID NO: 1136061 - protein, 9 aa, Homo Sapiens
CPGPRRAWR

SEQ ID NO: 1136062 - protein, 9 aa, Homo Sapiens
NGCHPYCDV

SEQ ID NO: 1136063 - protein, 9 aa, Homo Sapiens
YHGCRAEGG

SEQ ID NO: 1136064 - protein, 9 aa, Homo Sapiens
RTSGEPWDT

SEQ ID NO: 1136065 - protein, 9 aa, Homo Sapiens
HRCDHAPNP

SEQ ID NO: 1136066 - protein, 9 aa, Homo Sapiens
NFQDSIHMG

SEQ ID NO: 1136067 - protein, 9 aa, Homo Sapiens
IVDIFLSFL

SEQ ID NO: 1136068 - protein, 9 aa, Homo Sapiens
QNYMLPCLS

SEQ ID NO: 1136069 - protein, 9 aa, Homo Sapiens
VCDLAPRAG

SEQ ID NO: 1136070 - protein, 9 aa, Homo Sapiens
HGQCHVQRL

SEQ ID NO: 1136071 - protein, 9 aa, Homo Sapiens
PPWPASSHA

SEQ ID NO: 1136072 - protein, 9 aa, Homo Sapiens
ITSIVMMAY

SEQ ID NO: 1136073 - protein, 9 aa, Homo Sapiens
TGPGVADYL

SEQ ID NO: 1136074 - protein, 9 aa, Homo Sapiens
KNPHCGLRG

SEQ ID NO: 1136075 - protein, 9 aa, Homo Sapiens
PSTIAPSTV

SEQ ID NO: 1136076 - protein, 9 aa, Homo Sapiens
TRVHSEALL

SEQ ID NO: 1136077 - protein, 9 aa, Homo Sapiens
SGRSSAASP

SEQ ID NO: 1136078 - protein, 9 aa, Homo Sapiens
SPTCTNQEI

SEQ ID NO: 1136079 - protein, 9 aa, Homo Sapiens
MLQKRLKRT

SEQ ID NO: 1136080 - protein, 9 aa, Homo Sapiens
PSTVELSGT

SEQ ID NO: 1136081 - protein, 9 aa, Homo Sapiens
TSSLAFLTA

SEQ ID NO: 1136082 - protein, 9 aa, Homo Sapiens
GLSWSLQTL

SEQ ID NO: 1136083 - protein, 9 aa, Homo Sapiens
KQVLQLERA

SEQ ID NO: 1136084 - protein, 9 aa, Homo Sapiens
TISPLRPEA

SEQ ID NO: 1136085 - protein, 9 aa, Homo Sapiens
RSEEQKKNR

SEQ ID NO: 1136086 - protein, 9 aa, Homo Sapiens
PVAELVPVV

SEQ ID NO: 1136087 - protein, 9 aa, Homo Sapiens
DTYDVPRGV

SEQ ID NO: 1136088 - protein, 9 aa, Homo Sapiens
LKSLYELVT

SEQ ID NO: 1136089 - protein, 9 aa, Homo Sapiens
EASKDNSAG

SEQ ID NO: 1136090 - protein, 9 aa, Homo Sapiens
DLCPVTMEE

SEQ ID NO: 1136091 - protein, 9 aa, Homo Sapiens
VNPASTSGV

SEQ ID NO: 1136092 - protein, 9 aa, Homo Sapiens
GTRMITIDG

SEQ ID NO: 1136093 - protein, 9 aa, Homo Sapiens
LLKRSRCPP

SEQ ID NO: 1136094 - protein, 9 aa, Homo Sapiens
EKLEQAGSA

SEQ ID NO: 1136095 - protein, 9 aa, Homo Sapiens
NLIEQEQLN

SEQ ID NO: 1136096 - protein, 9 aa, Homo Sapiens
FTLQPGGFR

SEQ ID NO: 1136097 - protein, 9 aa, Homo Sapiens
SGELNCYDL

SEQ ID NO: 1136098 - protein, 9 aa, Homo Sapiens
GLGKNPHCG

SEQ ID NO: 1136099 - protein, 9 aa, Homo Sapiens
SAVLLKEII

SEQ ID NO: 1136100 - protein, 9 aa, Homo Sapiens
QVEASGRGR

SEQ ID NO: 1136101 - protein, 9 aa, Homo Sapiens
RPSGPPFPL

SEQ ID NO: 1136102 - protein, 9 aa, Homo Sapiens
EFTSWVSLV

SEQ ID NO: 1136103 - protein, 9 aa, Homo Sapiens
PVPPWDCGG

SEQ ID NO: 1136104 - protein, 9 aa, Homo Sapiens
PRSTCGRRT

SEQ ID NO: 1136105 - protein, 9 aa, Homo Sapiens
GSQNDTYDV

SEQ ID NO: 1136106 - protein, 9 aa, Homo Sapiens
TRPERLLAP

SEQ ID NO: 1136107 - protein, 9 aa, Homo Sapiens
IPPLSSSPT

SEQ ID NO: 1136108 - protein, 9 aa, Homo Sapiens
LISLPVPLP

SEQ ID NO: 1136109 - protein, 9 aa, Homo Sapiens
MKKEKESEA

SEQ ID NO: 1136110 - protein, 9 aa, Homo Sapiens
CHPYCDVLI

SEQ ID NO: 1136111 - protein, 9 aa, Homo Sapiens
RRRGRTRVH

SEQ ID NO: 1136112 - protein, 9 aa, Homo Sapiens
HCSMFFSFC

SEQ ID NO: 1136113 - protein, 9 aa, Homo Sapiens
CSSAAPVRC

SEQ ID NO: 1136114 - protein, 9 aa, Homo Sapiens
YASIALATS

SEQ ID NO: 1136115 - protein, 9 aa, Homo Sapiens
TNFWVLLHD

SEQ ID NO: 1136116 - protein, 9 aa, Homo Sapiens
GDVSSDVHR

SEQ ID NO: 1136117 - protein, 9 aa, Homo Sapiens
AQGVTFEDV

SEQ ID NO: 1136118 - protein, 9 aa, Homo Sapiens
GTSFFSSKQ

SEQ ID NO: 1136119 - protein, 9 aa, Homo Sapiens
GLFVKTMVC

SEQ ID NO: 1136120 - protein, 9 aa, Homo Sapiens
QQAGRILFD

SEQ ID NO: 1136121 - protein, 9 aa, Homo Sapiens
RGGAVAAVA

SEQ ID NO: 1136122 - protein, 9 aa, Homo Sapiens
LHWKEFVRR

SEQ ID NO: 1136123 - protein, 9 aa, Homo Sapiens
ELHQVLTKP

SEQ ID NO: 1136124 - protein, 9 aa, Homo Sapiens
ACLEPYTVC

SEQ ID NO: 1136125 - protein, 9 aa, Homo Sapiens
GGGAFIDLP

SEQ ID NO: 1136126 - protein, 9 aa, Homo Sapiens
IEQGLRVIE

SEQ ID NO: 1136127 - protein, 9 aa, Homo Sapiens
GKEPFPPAA

SEQ ID NO: 1136128 - protein, 9 aa, Homo Sapiens
SPALGPLSA

SEQ ID NO: 1136129 - protein, 9 aa, Homo Sapiens
CPNMTPRRR

SEQ ID NO: 1136130 - protein, 9 aa, Homo Sapiens
GITAEFTTT

SEQ ID NO: 1136131 - protein, 9 aa, Homo Sapiens
PRCVAGASR

SEQ ID NO: 1136132 - protein, 9 aa, Homo Sapiens
TDEAEEWPV

SEQ ID NO: 1136133 - protein, 9 aa, Homo Sapiens
AASLAYSEA

SEQ ID NO: 1136134 - protein, 9 aa, Homo Sapiens
LLEETLALF

SEQ ID NO: 1136135 - protein, 9 aa, Homo Sapiens
RHPATRPLA

SEQ ID NO: 1136136 - protein, 9 aa, Homo Sapiens
LFDWIVFQI

SEQ ID NO: 1136137 - protein, 9 aa, Homo Sapiens
VMFYTPWCP

SEQ ID NO: 1136138 - protein, 9 aa, Homo Sapiens
CHTPALPGL

SEQ ID NO: 1136139 - protein, 9 aa, Homo Sapiens
TITEIPPLS

SEQ ID NO: 1136140 - protein, 9 aa, Homo Sapiens
LQRKGPLPF

SEQ ID NO: 1136141 - protein, 9 aa, Homo Sapiens
GSDLIEGPA

SEQ ID NO: 1136142 - protein, 9 aa, Homo Sapiens
GGPPSSMPL

SEQ ID NO: 1136143 - protein, 9 aa, Homo Sapiens
DFHPRSSSG

SEQ ID NO: 1136144 - protein, 9 aa, Homo Sapiens
VHTLSEVEL

SEQ ID NO: 1136145 - protein, 9 aa, Homo Sapiens
NKSTKATKF

SEQ ID NO: 1136146 - protein, 9 aa, Homo Sapiens
MYNLQTLPP

SEQ ID NO: 1136147 - protein, 9 aa, Homo Sapiens
RCQHYSVSF

SEQ ID NO: 1136148 - protein, 9 aa, Homo Sapiens
APAPAAEGF

SEQ ID NO: 1136149 - protein, 9 aa, Homo Sapiens
WGWCLGSAW

SEQ ID NO: 1136150 - protein, 9 aa, Homo Sapiens
STDDSLYYK

SEQ ID NO: 1136151 - protein, 9 aa, Homo Sapiens
QGPPVQPAL

SEQ ID NO: 1136152 - protein, 9 aa, Homo Sapiens
VTPPAWLVW

SEQ ID NO: 1136153 - protein, 9 aa, Homo Sapiens
SDRPSSARC

SEQ ID NO: 1136154 - protein, 9 aa, Homo Sapiens
ADDRLLCPH

SEQ ID NO: 1136155 - protein, 9 aa, Homo Sapiens
PLYNVPEES

SEQ ID NO: 1136156 - protein, 9 aa, Homo Sapiens
MFITQLPDI

SEQ ID NO: 1136157 - protein, 9 aa, Homo Sapiens
WNKKGEAKY

SEQ ID NO: 1136158 - protein, 9 aa, Homo Sapiens
GPPPGGRAW

SEQ ID NO: 1136159 - protein, 9 aa, Homo Sapiens
IRFALEVSG

SEQ ID NO: 1136160 - protein, 9 aa, Homo Sapiens
SEDVYTLIP

SEQ ID NO: 1136161 - protein, 9 aa, Homo Sapiens
FHRDTFHLL

SEQ ID NO: 1136162 - protein, 9 aa, Homo Sapiens
PVTMEEKPM

SEQ ID NO: 1136163 - protein, 9 aa, Homo Sapiens
RRGFRQLTT

SEQ ID NO: 1136164 - protein, 9 aa, Homo Sapiens
FGIFCYGVT

SEQ ID NO: 1136165 - protein, 9 aa, Homo Sapiens
GLSDIKVED

SEQ ID NO: 1136166 - protein, 9 aa, Homo Sapiens
RGSGSGGSD

SEQ ID NO: 1136167 - protein, 9 aa, Homo Sapiens
PCPPACNCV

SEQ ID NO: 1136168 - protein, 9 aa, Homo Sapiens
KEKLHDMDF

SEQ ID NO: 1136169 - protein, 9 aa, Homo Sapiens
EVHIANITQ

SEQ ID NO: 1136170 - protein, 9 aa, Homo Sapiens
ASLLTRPRP

SEQ ID NO: 1136171 - protein, 9 aa, Homo Sapiens
LWGVRHPHI

SEQ ID NO: 1136172 - protein, 9 aa, Homo Sapiens
HGHKHEHDQ

SEQ ID NO: 1136173 - protein, 9 aa, Homo Sapiens
ESDAPTRCL

SEQ ID NO: 1136174 - protein, 9 aa, Homo Sapiens
SETSCLRAN

SEQ ID NO: 1136175 - protein, 9 aa, Homo Sapiens
ADRFKTNRI

SEQ ID NO: 1136176 - protein, 9 aa, Homo Sapiens
HHLIHLGLG

SEQ ID NO: 1136177 - protein, 9 aa, Homo Sapiens
EKGDLNLSV

SEQ ID NO: 1136178 - protein, 9 aa, Homo Sapiens
EQPSCQQIA

SEQ ID NO: 1136179 - protein, 9 aa, Homo Sapiens
LSAERLQLC

SEQ ID NO: 1136180 - protein, 9 aa, Homo Sapiens
GNPGAAMQG

SEQ ID NO: 1136181 - protein, 9 aa, Homo Sapiens
RHRGAPLRS

SEQ ID NO: 1136182 - protein, 9 aa, Homo Sapiens
ERRRFFRRE

SEQ ID NO: 1136183 - protein, 9 aa, Homo Sapiens
EAFYGVSSL

SEQ ID NO: 1136184 - protein, 9 aa, Homo Sapiens
TVMGNLLII

SEQ ID NO: 1136185 - protein, 9 aa, Homo Sapiens
FSNQPERVW

SEQ ID NO: 1136186 - protein, 9 aa, Homo Sapiens
DNMLNLEVV

SEQ ID NO: 1136187 - protein, 9 aa, Homo Sapiens
CKTSLFLHH

SEQ ID NO: 1136188 - protein, 9 aa, Homo Sapiens
ILVIEKHGP

SEQ ID NO: 1136189 - protein, 9 aa, Homo Sapiens
HLVPKLQRR

SEQ ID NO: 1136190 - protein, 9 aa, Homo Sapiens
YPEQFWEKY

SEQ ID NO: 1136191 - protein, 9 aa, Homo Sapiens
KKPSFCTAD

SEQ ID NO: 1136192 - protein, 9 aa, Homo Sapiens
MVQLNEEKS

SEQ ID NO: 1136193 - protein, 9 aa, Homo Sapiens
QAQDIQQSL

SEQ ID NO: 1136194 - protein, 9 aa, Homo Sapiens
WLVHSCWTK

SEQ ID NO: 1136195 - protein, 9 aa, Homo Sapiens
LSQAQLIMP

SEQ ID NO: 1136196 - protein, 9 aa, Homo Sapiens
FHLAVAFLA

SEQ ID NO: 1136197 - protein, 9 aa, Homo Sapiens
ANWWNHHHF

SEQ ID NO: 1136198 - protein, 9 aa, Homo Sapiens
GKPVGKKRH

SEQ ID NO: 1136199 - protein, 9 aa, Homo Sapiens
VQSTELRPQ

SEQ ID NO: 1136200 - protein, 9 aa, Homo Sapiens
DLLLGKNKM

SEQ ID NO: 1136201 - protein, 9 aa, Homo Sapiens
TVTLPAAPN

SEQ ID NO: 1136202 - protein, 9 aa, Homo Sapiens
DVLHLVHQL

SEQ ID NO: 1136203 - protein, 9 aa, Homo Sapiens
PQLLTSVPS

SEQ ID NO: 1136204 - protein, 9 aa, Homo Sapiens
LPERKTSAV

SEQ ID NO: 1136205 - protein, 9 aa, Homo Sapiens
ENVNRVNKA

SEQ ID NO: 1136206 - protein, 9 aa, Homo Sapiens
VIANPFAAD

SEQ ID NO: 1136207 - protein, 9 aa, Homo Sapiens
PESEGISFG

SEQ ID NO: 1136208 - protein, 9 aa, Homo Sapiens
IQCLGYVID

SEQ ID NO: 1136209 - protein, 9 aa, Homo Sapiens
GKKGRLTGL

SEQ ID NO: 1136210 - protein, 9 aa, Homo Sapiens
CPPCPVHRP

SEQ ID NO: 1136211 - protein, 9 aa, Homo Sapiens
NNHVFCSFC

SEQ ID NO: 1136212 - protein, 9 aa, Homo Sapiens
RSEVPPSRA

SEQ ID NO: 1136213 - protein, 9 aa, Homo Sapiens
LLVSRPPSL

SEQ ID NO: 1136214 - protein, 9 aa, Homo Sapiens
IDAHAEERF

SEQ ID NO: 1136215 - protein, 9 aa, Homo Sapiens
SILDDFYTA

SEQ ID NO: 1136216 - protein, 9 aa, Homo Sapiens
LEPQQHFNT

SEQ ID NO: 1136217 - protein, 9 aa, Homo Sapiens
ASDTGYILF

SEQ ID NO: 1136218 - protein, 9 aa, Homo Sapiens
LEVFVMGLK

SEQ ID NO: 1136219 - protein, 9 aa, Homo Sapiens
KYTTQGMKH

SEQ ID NO: 1136220 - protein, 9 aa, Homo Sapiens
EWYNDSVEH

SEQ ID NO: 1136221 - protein, 9 aa, Homo Sapiens
DHPLLWTMT

SEQ ID NO: 1136222 - protein, 9 aa, Homo Sapiens
HVEAREDTA

SEQ ID NO: 1136223 - protein, 9 aa, Homo Sapiens
ILVYPIIFV

SEQ ID NO: 1136224 - protein, 9 aa, Homo Sapiens
LDEVVSELL

SEQ ID NO: 1136225 - protein, 9 aa, Homo Sapiens
EALVPAAVL

SEQ ID NO: 1136226 - protein, 9 aa, Homo Sapiens
VLLNMCQDV

SEQ ID NO: 1136227 - protein, 9 aa, Homo Sapiens
AQSVLDASE

SEQ ID NO: 1136228 - protein, 9 aa, Homo Sapiens
NQVSVGLQG

SEQ ID NO: 1136229 - protein, 9 aa, Homo Sapiens
REAGIITTK

SEQ ID NO: 1136230 - protein, 9 aa, Homo Sapiens
RLSSAVMPC

SEQ ID NO: 1136231 - protein, 9 aa, Homo Sapiens
AQGGLGGSC

SEQ ID NO: 1136232 - protein, 9 aa, Homo Sapiens
VSNDAGSAA

SEQ ID NO: 1136233 - protein, 9 aa, Homo Sapiens
VKTLHVQAA

SEQ ID NO: 1136234 - protein, 9 aa, Homo Sapiens
APQTCSAHR

SEQ ID NO: 1136235 - protein, 9 aa, Homo Sapiens
FHNQLPSLR

SEQ ID NO: 1136236 - protein, 9 aa, Homo Sapiens
YILETWTLL

SEQ ID NO: 1136237 - protein, 9 aa, Homo Sapiens
RNIFKDVLI

SEQ ID NO: 1136238 - protein, 9 aa, Homo Sapiens
YTNINATLS

SEQ ID NO: 1136239 - protein, 9 aa, Homo Sapiens
NRNHMGRDK

SEQ ID NO: 1136240 - protein, 9 aa, Homo Sapiens
TIITFPFLI

SEQ ID NO: 1136241 - protein, 9 aa, Homo Sapiens
GTNQINDQA

SEQ ID NO: 1136242 - protein, 9 aa, Homo Sapiens
DFTVSALHD

SEQ ID NO: 1136243 - protein, 9 aa, Homo Sapiens
RCPRPCPGI

SEQ ID NO: 1136244 - protein, 9 aa, Homo Sapiens
PGPGPTVDD

SEQ ID NO: 1136245 - protein, 9 aa, Homo Sapiens
VPTAARPSA

SEQ ID NO: 1136246 - protein, 9 aa, Homo Sapiens
IKVMVVTGD

SEQ ID NO: 1136247 - protein, 9 aa, Homo Sapiens
VIQKAVHTA

SEQ ID NO: 1136248 - protein, 9 aa, Homo Sapiens
LGTRSLLSS

SEQ ID NO: 1136249 - protein, 9 aa, Homo Sapiens
CVDPYLFPY

SEQ ID NO: 1136250 - protein, 9 aa, Homo Sapiens
CRNVSFILP

SEQ ID NO: 1136251 - protein, 9 aa, Homo Sapiens
WCATAAEHR

SEQ ID NO: 1136252 - protein, 9 aa, Homo Sapiens
GHDAPAGPA

SEQ ID NO: 1136253 - protein, 9 aa, Homo Sapiens
RIPGVTPAT

SEQ ID NO: 1136254 - protein, 9 aa, Homo Sapiens
KCCFFGASP

SEQ ID NO: 1136255 - protein, 9 aa, Homo Sapiens
LCFQSSAVM

SEQ ID NO: 1136256 - protein, 9 aa, Homo Sapiens
GRGAHGASG

SEQ ID NO: 1136257 - protein, 9 aa, Homo Sapiens
SPPSVTIHS

SEQ ID NO: 1136258 - protein, 9 aa, Homo Sapiens
DPGVGERAP

SEQ ID NO: 1136259 - protein, 9 aa, Homo Sapiens
RPLPPLPDL

SEQ ID NO: 1136260 - protein, 9 aa, Homo Sapiens
HVAAKESQA

SEQ ID NO: 1136261 - protein, 9 aa, Homo Sapiens
RRGSDGVDG

SEQ ID NO: 1136262 - protein, 9 aa, Homo Sapiens
WEMALTSIR

SEQ ID NO: 1136263 - protein, 9 aa, Homo Sapiens
CLVLSTCVD

SEQ ID NO: 1136264 - protein, 9 aa, Homo Sapiens
TTSTTAKKP

SEQ ID NO: 1136265 - protein, 9 aa, Homo Sapiens
FDWIVFQIN

SEQ ID NO: 1136266 - protein, 9 aa, Homo Sapiens
LRVCRPQPA

SEQ ID NO: 1136267 - protein, 9 aa, Homo Sapiens
RGTSRARRT

SEQ ID NO: 1136268 - protein, 9 aa, Homo Sapiens
EPYLKKKGE

SEQ ID NO: 1136269 - protein, 9 aa, Homo Sapiens
SAAIFVYAA

SEQ ID NO: 1136270 - protein, 9 aa, Homo Sapiens
VTIDAIHEV

SEQ ID NO: 1136271 - protein, 9 aa, Homo Sapiens
SRPATPGPG

SEQ ID NO: 1136272 - protein, 9 aa, Homo Sapiens
KKLNQIAMT

SEQ ID NO: 1136273 - protein, 9 aa, Homo Sapiens
KIHYRKASR

SEQ ID NO: 1136274 - protein, 9 aa, Homo Sapiens
PLISLMIEY

SEQ ID NO: 1136275 - protein, 9 aa, Homo Sapiens
ALTFLQYPH

SEQ ID NO: 1136276 - protein, 9 aa, Homo Sapiens
SFSAPCCWR

SEQ ID NO: 1136277 - protein, 9 aa, Homo Sapiens
GTGGFDGTY

SEQ ID NO: 1136278 - protein, 9 aa, Homo Sapiens
GAVDNLRRS

SEQ ID NO: 1136279 - protein, 9 aa, Homo Sapiens
TSLLRILTS

SEQ ID NO: 1136280 - protein, 9 aa, Homo Sapiens
REGVKSENK

SEQ ID NO: 1136281 - protein, 9 aa, Homo Sapiens
ARVNGLMKR

SEQ ID NO: 1136282 - protein, 9 aa, Homo Sapiens
EHKDIVSSS

SEQ ID NO: 1136283 - protein, 9 aa, Homo Sapiens
LGYEWVNSP

SEQ ID NO: 1136284 - protein, 9 aa, Homo Sapiens
WVPWLPLQI

SEQ ID NO: 1136285 - protein, 9 aa, Homo Sapiens
LRKDKDGAA

SEQ ID NO: 1136286 - protein, 9 aa, Homo Sapiens
ITEHSDLGN

SEQ ID NO: 1136287 - protein, 9 aa, Homo Sapiens
DLPPPGGPR

SEQ ID NO: 1136288 - protein, 9 aa, Homo Sapiens
ATQASMTLP

SEQ ID NO: 1136289 - protein, 9 aa, Homo Sapiens
LGRVFWTLA

SEQ ID NO: 1136290 - protein, 9 aa, Homo Sapiens
PLFTMFSSG

SEQ ID NO: 1136291 - protein, 9 aa, Homo Sapiens
LSNSSGAST

SEQ ID NO: 1136292 - protein, 9 aa, Homo Sapiens
KDMFDHPTP

SEQ ID NO: 1136293 - protein, 9 aa, Homo Sapiens
KTWVKKLQR

SEQ ID NO: 1136294 - protein, 9 aa, Homo Sapiens
RPTGTGPPA

SEQ ID NO: 1136295 - protein, 9 aa, Homo Sapiens
FSEKVSATR

SEQ ID NO: 1136296 - protein, 9 aa, Homo Sapiens
SERSHGVTV

SEQ ID NO: 1136297 - protein, 9 aa, Homo Sapiens
PPAVPPVLL

SEQ ID NO: 1136298 - protein, 9 aa, Homo Sapiens
DSGAHALNS

SEQ ID NO: 1136299 - protein, 9 aa, Homo Sapiens
SQAKLQREL

SEQ ID NO: 1136300 - protein, 9 aa, Homo Sapiens
AARDAPGLG

SEQ ID NO: 1136301 - protein, 9 aa, Homo Sapiens
QGQGPGHHQ

SEQ ID NO: 1136302 - protein, 9 aa, Homo Sapiens
LEMQNESFT

SEQ ID NO: 1136303 - protein, 9 aa, Homo Sapiens
ESFHQSINK

SEQ ID NO: 1136304 - protein, 9 aa, Homo Sapiens
NGDGTVQSS

SEQ ID NO: 1136305 - protein, 9 aa, Homo Sapiens
LGPEAGHWR

SEQ ID NO: 1136306 - protein, 9 aa, Homo Sapiens
FKMCVSLAV

SEQ ID NO: 1136307 - protein, 9 aa, Homo Sapiens
TGQLTQENS

SEQ ID NO: 1136308 - protein, 9 aa, Homo Sapiens
LSWLTDPIP

SEQ ID NO: 1136309 - protein, 9 aa, Homo Sapiens
VGLGRLLAP

SEQ ID NO: 1136310 - protein, 9 aa, Homo Sapiens
MMTQSSSGT

SEQ ID NO: 1136311 - protein, 9 aa, Homo Sapiens
YPSVGIDAH

SEQ ID NO: 1136312 - protein, 9 aa, Homo Sapiens
FQVCFGRHV

SEQ ID NO: 1136313 - protein, 9 aa, Homo Sapiens
NSDAVRHSR

SEQ ID NO: 1136314 - protein, 9 aa, Homo Sapiens
PLELRLLSL

SEQ ID NO: 1136315 - protein, 9 aa, Homo Sapiens
PVILLFSFL

SEQ ID NO: 1136316 - protein, 9 aa, Homo Sapiens
PVGPLGFTG

SEQ ID NO: 1136317 - protein, 9 aa, Homo Sapiens
LPHSRSSSP

SEQ ID NO: 1136318 - protein, 9 aa, Homo Sapiens
DLGIHVFDA

SEQ ID NO: 1136319 - protein, 9 aa, Homo Sapiens
AEGRRDTPG

SEQ ID NO: 1136320 - protein, 9 aa, Homo Sapiens
LTDQPGVQF

SEQ ID NO: 1136321 - protein, 9 aa, Homo Sapiens
SMQAVISLY

SEQ ID NO: 1136322 - protein, 9 aa, Homo Sapiens
ASPPAAGRS

SEQ ID NO: 1136323 - protein, 9 aa, Homo Sapiens
PGHLWKRQM

SEQ ID NO: 1136324 - protein, 9 aa, Homo Sapiens
YTPATPGNL

SEQ ID NO: 1136325 - protein, 9 aa, Homo Sapiens
QANCLSMSG

SEQ ID NO: 1136326 - protein, 9 aa, Homo Sapiens
LPPLPDLGV

SEQ ID NO: 1136327 - protein, 9 aa, Homo Sapiens
LPASIVPLM

SEQ ID NO: 1136328 - protein, 9 aa, Homo Sapiens
PRKQRWERT

SEQ ID NO: 1136329 - protein, 9 aa, Homo Sapiens
LLREEKFWM

SEQ ID NO: 1136330 - protein, 9 aa, Homo Sapiens
TLYWVGMRR

SEQ ID NO: 1136331 - protein, 9 aa, Homo Sapiens
LQAFARHGR

SEQ ID NO: 1136332 - protein, 9 aa, Homo Sapiens
TGIRDMHLE

SEQ ID NO: 1136333 - protein, 9 aa, Homo Sapiens
LGPDGGGSG

SEQ ID NO: 1136334 - protein, 9 aa, Homo Sapiens
WKRFHDIWT

SEQ ID NO: 1136335 - protein, 9 aa, Homo Sapiens
LKGREEMKW

SEQ ID NO: 1136336 - protein, 9 aa, Homo Sapiens
SEEVPDVLR

SEQ ID NO: 1136337 - protein, 9 aa, Homo Sapiens
YRTHTGKKK

SEQ ID NO: 1136338 - protein, 9 aa, Homo Sapiens
TNSCKGEKL

SEQ ID NO: 1136339 - protein, 9 aa, Homo Sapiens
VPGPCLVEG

SEQ ID NO: 1136340 - protein, 9 aa, Homo Sapiens
FLQNIMAQE

SEQ ID NO: 1136341 - protein, 9 aa, Homo Sapiens
EEHLGRAVF

SEQ ID NO: 1136342 - protein, 9 aa, Homo Sapiens
PGSSATVQD

SEQ ID NO: 1136343 - protein, 9 aa, Homo Sapiens
VGDCPKRPE

SEQ ID NO: 1136344 - protein, 9 aa, Homo Sapiens
TESDQACDT

SEQ ID NO: 1136345 - protein, 9 aa, Homo Sapiens
LCKKQNDRI

SEQ ID NO: 1136346 - protein, 9 aa, Homo Sapiens
MLKPGVLLI

SEQ ID NO: 1136347 - protein, 9 aa, Homo Sapiens
SYVPDAPDA

SEQ ID NO: 1136348 - protein, 9 aa, Homo Sapiens
PFNESDFYP

SEQ ID NO: 1136349 - protein, 9 aa, Homo Sapiens
RHSNEWKTV

SEQ ID NO: 1136350 - protein, 9 aa, Homo Sapiens
LWCMLKPGV

SEQ ID NO: 1136351 - protein, 9 aa, Homo Sapiens
VNIEEVLPH

SEQ ID NO: 1136352 - protein, 9 aa, Homo Sapiens
AQRLRICHS

SEQ ID NO: 1136353 - protein, 9 aa, Homo Sapiens
STQHKMLAI

SEQ ID NO: 1136354 - protein, 9 aa, Homo Sapiens
APIFEAQLS

SEQ ID NO: 1136355 - protein, 9 aa, Homo Sapiens
NNLCFVGLI

SEQ ID NO: 1136356 - protein, 9 aa, Homo Sapiens
HLVDLAGSD

SEQ ID NO: 1136357 - protein, 9 aa, Homo Sapiens
FNILDSPMY

SEQ ID NO: 1136358 - protein, 9 aa, Homo Sapiens
RCNRFVKKN

SEQ ID NO: 1136359 - protein, 9 aa, Homo Sapiens
ECLVDAHML

SEQ ID NO: 1136360 - protein, 9 aa, Homo Sapiens
LGVAEGSVQ

SEQ ID NO: 1136361 - protein, 9 aa, Homo Sapiens
MSYSWAGAV

SEQ ID NO: 1136362 - protein, 9 aa, Homo Sapiens
SPEDPWSLY

SEQ ID NO: 1136363 - protein, 9 aa, Homo Sapiens
QNSFQYLRA

SEQ ID NO: 1136364 - protein, 9 aa, Homo Sapiens
GRRRTVPGG

SEQ ID NO: 1136365 - protein, 9 aa, Homo Sapiens
DFAHQSWLP

SEQ ID NO: 1136366 - protein, 9 aa, Homo Sapiens
KKLPKEAVV

SEQ ID NO: 1136367 - protein, 9 aa, Homo Sapiens
SRVLKSLWK

SEQ ID NO: 1136368 - protein, 9 aa, Homo Sapiens
TAEFDLTLD

SEQ ID NO: 1136369 - protein, 9 aa, Homo Sapiens
FSPLWLMTA

SEQ ID NO: 1136370 - protein, 9 aa, Homo Sapiens
TTNKVHTIP

SEQ ID NO: 1136371 - protein, 9 aa, Homo Sapiens
VIKNQQPAS

SEQ ID NO: 1136372 - protein, 9 aa, Homo Sapiens
KQKVEECTL

SEQ ID NO: 1136373 - protein, 9 aa, Homo Sapiens
LLQKKCKEY

SEQ ID NO: 1136374 - protein, 9 aa, Homo Sapiens
YVFNHHGRV

SEQ ID NO: 1136375 - protein, 9 aa, Homo Sapiens
SWTLGRSHW

SEQ ID NO: 1136376 - protein, 9 aa, Homo Sapiens
NATVLTYGQ

SEQ ID NO: 1136377 - protein, 9 aa, Homo Sapiens
VLLLGTVIA

SEQ ID NO: 1136378 - protein, 9 aa, Homo Sapiens
VRKEALLLM

SEQ ID NO: 1136379 - protein, 9 aa, Homo Sapiens
EYSLLPEVG

SEQ ID NO: 1136380 - protein, 9 aa, Homo Sapiens
GHPLYTIVD

SEQ ID NO: 1136381 - protein, 9 aa, Homo Sapiens
DGDDGPVAA

SEQ ID NO: 1136382 - protein, 9 aa, Homo Sapiens
EQAHRGNEQ

SEQ ID NO: 1136383 - protein, 9 aa, Homo Sapiens
GKNRMERVK

SEQ ID NO: 1136384 - protein, 9 aa, Homo Sapiens
PRNNPVPLR

SEQ ID NO: 1136385 - protein, 9 aa, Homo Sapiens
EPARETPTK

SEQ ID NO: 1136386 - protein, 9 aa, Homo Sapiens
HLKKTFTMS

SEQ ID NO: 1136387 - protein, 9 aa, Homo Sapiens
TCREASVSP

SEQ ID NO: 1136388 - protein, 9 aa, Homo Sapiens
HPTRGLCPG

SEQ ID NO: 1136389 - protein, 9 aa, Homo Sapiens
FLVYRRSAA

SEQ ID NO: 1136390 - protein, 9 aa, Homo Sapiens
CVLSEEQIQ

SEQ ID NO: 1136391 - protein, 9 aa, Homo Sapiens
SFDNYEDTI

SEQ ID NO: 1136392 - protein, 9 aa, Homo Sapiens
ELDTNGDGR

SEQ ID NO: 1136393 - protein, 9 aa, Homo Sapiens
TPEKKAAVW

SEQ ID NO: 1136394 - protein, 9 aa, Homo Sapiens
VCCLPGAEL

SEQ ID NO: 1136395 - protein, 9 aa, Homo Sapiens
TANMVDPGV

SEQ ID NO: 1136396 - protein, 9 aa, Homo Sapiens
ENDTDEETM

SEQ ID NO: 1136397 - protein, 9 aa, Homo Sapiens
DRSEWGLVV

SEQ ID NO: 1136398 - protein, 9 aa, Homo Sapiens
QSDRSPQKR

SEQ ID NO: 1136399 - protein, 9 aa, Homo Sapiens
NRNGNSGNS

SEQ ID NO: 1136400 - protein, 9 aa, Homo Sapiens
GTPQIHASP

SEQ ID NO: 1136401 - protein, 9 aa, Homo Sapiens
GASIAARLE

SEQ ID NO: 1136402 - protein, 9 aa, Homo Sapiens
APKTTLPGL

SEQ ID NO: 1136403 - protein, 9 aa, Homo Sapiens
GPQPVTRGR

SEQ ID NO: 1136404 - protein, 9 aa, Homo Sapiens
SPITSIKSG

SEQ ID NO: 1136405 - protein, 9 aa, Homo Sapiens
EGVPQLLII

SEQ ID NO: 1136406 - protein, 9 aa, Homo Sapiens
QMSGTSGKG

SEQ ID NO: 1136407 - protein, 9 aa, Homo Sapiens
RTTAFCRPT

SEQ ID NO: 1136408 - protein, 9 aa, Homo Sapiens
DALHVRGLC

SEQ ID NO: 1136409 - protein, 9 aa, Homo Sapiens
KLYQKDFLR

SEQ ID NO: 1136410 - protein, 9 aa, Homo Sapiens
GPILHVLSD

SEQ ID NO: 1136411 - protein, 9 aa, Homo Sapiens
EQRKALYGL

SEQ ID NO: 1136412 - protein, 9 aa, Homo Sapiens
TKKTSSCVS

SEQ ID NO: 1136413 - protein, 9 aa, Homo Sapiens
AFTKSVEVQ

SEQ ID NO: 1136414 - protein, 9 aa, Homo Sapiens
RRHGWNPRD

SEQ ID NO: 1136415 - protein, 9 aa, Homo Sapiens
LKTEQGGLW

SEQ ID NO: 1136416 - protein, 9 aa, Homo Sapiens
GILSRHLQE

SEQ ID NO: 1136417 - protein, 9 aa, Homo Sapiens
SPDGPASST

SEQ ID NO: 1136418 - protein, 9 aa, Homo Sapiens
PIMSQWWHV

SEQ ID NO: 1136419 - protein, 9 aa, Homo Sapiens
SVKDIQRGN

SEQ ID NO: 1136420 - protein, 9 aa, Homo Sapiens
PGLTHPAHQ

SEQ ID NO: 1136421 - protein, 9 aa, Homo Sapiens
SESSALLSY

SEQ ID NO: 1136422 - protein, 9 aa, Homo Sapiens
PARIRSTRS

SEQ ID NO: 1136423 - protein, 9 aa, Homo Sapiens
NHHGRVLFR

SEQ ID NO: 1136424 - protein, 9 aa, Homo Sapiens
DSLYLMQKH

SEQ ID NO: 1136425 - protein, 9 aa, Homo Sapiens
AGRIRSGGV

SEQ ID NO: 1136426 - protein, 9 aa, Homo Sapiens
LVFSFIWPL

SEQ ID NO: 1136427 - protein, 9 aa, Homo Sapiens
ANLSPANQR

SEQ ID NO: 1136428 - protein, 9 aa, Homo Sapiens
EIFRNEMLK

SEQ ID NO: 1136429 - protein, 9 aa, Homo Sapiens
LCHPSSVSG

SEQ ID NO: 1136430 - protein, 9 aa, Homo Sapiens
GEQMAAESQ

SEQ ID NO: 1136431 - protein, 9 aa, Homo Sapiens
LGKRRDQAA

SEQ ID NO: 1136432 - protein, 9 aa, Homo Sapiens
ARTGLHICD

SEQ ID NO: 1136433 - protein, 9 aa, Homo Sapiens
PTARKGPPN

SEQ ID NO: 1136434 - protein, 9 aa, Homo Sapiens
HACRECGKA

SEQ ID NO: 1136435 - protein, 9 aa, Homo Sapiens
VEVCSDFLK

SEQ ID NO: 1136436 - protein, 9 aa, Homo Sapiens
SVSPPRSEA

SEQ ID NO: 1136437 - protein, 9 aa, Homo Sapiens
CLPGLTHPA

SEQ ID NO: 1136438 - protein, 9 aa, Homo Sapiens
EYVMCRTPL

SEQ ID NO: 1136439 - protein, 9 aa, Homo Sapiens
SRAPRTLLQ

SEQ ID NO: 1136440 - protein, 9 aa, Homo Sapiens
PPPRQCLSG

SEQ ID NO: 1136441 - protein, 9 aa, Homo Sapiens
KTLHVQAAQ

SEQ ID NO: 1136442 - protein, 9 aa, Homo Sapiens
LPPTSWAAL

SEQ ID NO: 1136443 - protein, 9 aa, Homo Sapiens
PQESSSEEV

SEQ ID NO: 1136444 - protein, 9 aa, Homo Sapiens
CGGTWPCPQ

SEQ ID NO: 1136445 - protein, 9 aa, Homo Sapiens
LLVKNLSHL

SEQ ID NO: 1136446 - protein, 9 aa, Homo Sapiens
QRSHCRPSR

SEQ ID NO: 1136447 - protein, 9 aa, Homo Sapiens
REKGDQLFN

SEQ ID NO: 1136448 - protein, 9 aa, Homo Sapiens
ARLGAARSP

SEQ ID NO: 1136449 - protein, 9 aa, Homo Sapiens
LPLKGPWRT

SEQ ID NO: 1136450 - protein, 9 aa, Homo Sapiens
LLRFPETHL

SEQ ID NO: 1136451 - protein, 9 aa, Homo Sapiens
SGSGGSDSD

SEQ ID NO: 1136452 - protein, 9 aa, Homo Sapiens
LIDVLHLVH

SEQ ID NO: 1136453 - protein, 9 aa, Homo Sapiens
VSSCPSPWW

SEQ ID NO: 1136454 - protein, 9 aa, Homo Sapiens
YLCRFCSYT

SEQ ID NO: 1136455 - protein, 9 aa, Homo Sapiens
TFNIQGLVI

SEQ ID NO: 1136456 - protein, 9 aa, Homo Sapiens
PQARRRAAL

SEQ ID NO: 1136457 - protein, 9 aa, Homo Sapiens
MVTHARVLG

SEQ ID NO: 1136458 - protein, 9 aa, Homo Sapiens
LRINGLPST

SEQ ID NO: 1136459 - protein, 9 aa, Homo Sapiens
AMQMSSFEK

SEQ ID NO: 1136460 - protein, 9 aa, Homo Sapiens
THPCTMLLP

SEQ ID NO: 1136461 - protein, 9 aa, Homo Sapiens
PPGCWTGTA

SEQ ID NO: 1136462 - protein, 9 aa, Homo Sapiens
LKPPGRGRK

SEQ ID NO: 1136463 - protein, 9 aa, Homo Sapiens
LFKHKSTVQ

SEQ ID NO: 1136464 - protein, 9 aa, Homo Sapiens
RGASSSTSR

SEQ ID NO: 1136465 - protein, 9 aa, Homo Sapiens
PRLWRMSPT

SEQ ID NO: 1136466 - protein, 9 aa, Homo Sapiens
TMASPLPCA

SEQ ID NO: 1136467 - protein, 9 aa, Homo Sapiens
TAMWLSASH

SEQ ID NO: 1136468 - protein, 9 aa, Homo Sapiens
PENAVDCEQ

SEQ ID NO: 1136469 - protein, 9 aa, Homo Sapiens
LLESAHPVK

SEQ ID NO: 1136470 - protein, 9 aa, Homo Sapiens
FAPCCAPQA

SEQ ID NO: 1136471 - protein, 9 aa, Homo Sapiens
ALWEMALTS

SEQ ID NO: 1136472 - protein, 9 aa, Homo Sapiens
RMKGPAQAK

SEQ ID NO: 1136473 - protein, 9 aa, Homo Sapiens
NPVAVASSL

SEQ ID NO: 1136474 - protein, 9 aa, Homo Sapiens
PLHGVPQSP

SEQ ID NO: 1136475 - protein, 9 aa, Homo Sapiens
PVVSDTIYD

SEQ ID NO: 1136476 - protein, 9 aa, Homo Sapiens
VRAESRQLV

SEQ ID NO: 1136477 - protein, 9 aa, Homo Sapiens
AEGENDGGH

SEQ ID NO: 1136478 - protein, 9 aa, Homo Sapiens
NPSTFYIYL

SEQ ID NO: 1136479 - protein, 9 aa, Homo Sapiens
GLAARNILV

SEQ ID NO: 1136480 - protein, 9 aa, Homo Sapiens
IYPFAITLW

SEQ ID NO: 1136481 - protein, 9 aa, Homo Sapiens
PSSAASACA

SEQ ID NO: 1136482 - protein, 9 aa, Homo Sapiens
ERLQLCPQR

SEQ ID NO: 1136483 - protein, 9 aa, Homo Sapiens
FVELGNISA

SEQ ID NO: 1136484 - protein, 9 aa, Homo Sapiens
QPHPCPQFM

SEQ ID NO: 1136485 - protein, 9 aa, Homo Sapiens
HNNRKRRRG

SEQ ID NO: 1136486 - protein, 9 aa, Homo Sapiens
SWTGTLSWA

SEQ ID NO: 1136487 - protein, 9 aa, Homo Sapiens
KASQQRQQR

SEQ ID NO: 1136488 - protein, 9 aa, Homo Sapiens
QIYQDDTLL

SEQ ID NO: 1136489 - protein, 9 aa, Homo Sapiens
SAEKQYRGI

SEQ ID NO: 1136490 - protein, 9 aa, Homo Sapiens
QQRREDEDD

SEQ ID NO: 1136491 - protein, 9 aa, Homo Sapiens
EWTELRQHE

SEQ ID NO: 1136492 - protein, 9 aa, Homo Sapiens
LVRRGGQRG

SEQ ID NO: 1136493 - protein, 9 aa, Homo Sapiens
EGQYILTLS

SEQ ID NO: 1136494 - protein, 9 aa, Homo Sapiens
GELGTIDSA

SEQ ID NO: 1136495 - protein, 9 aa, Homo Sapiens
HLPCFQDVH

SEQ ID NO: 1136496 - protein, 9 aa, Homo Sapiens
WGPPRAREK

SEQ ID NO: 1136497 - protein, 9 aa, Homo Sapiens
TNKVHTIPL

SEQ ID NO: 1136498 - protein, 9 aa, Homo Sapiens
PIRAATLAP

SEQ ID NO: 1136499 - protein, 9 aa, Homo Sapiens
RSAVMSANA

SEQ ID NO: 1136500 - protein, 9 aa, Homo Sapiens
TSHDWGTPR

SEQ ID NO: 1136501 - protein, 9 aa, Homo Sapiens
LPTRPRLLP

SEQ ID NO: 1136502 - protein, 9 aa, Homo Sapiens
GALTFRDVV

SEQ ID NO: 1136503 - protein, 9 aa, Homo Sapiens
SCIPSTLMR

SEQ ID NO: 1136504 - protein, 9 aa, Homo Sapiens
HPKGTASQS

SEQ ID NO: 1136505 - protein, 9 aa, Homo Sapiens
IEIIDEKTG

SEQ ID NO: 1136506 - protein, 9 aa, Homo Sapiens
LAFSMDDMF

SEQ ID NO: 1136507 - protein, 9 aa, Homo Sapiens
TDATHAERI

SEQ ID NO: 1136508 - protein, 9 aa, Homo Sapiens
CPVHRPACI

SEQ ID NO: 1136509 - protein, 9 aa, Homo Sapiens
PPDKARLLW

SEQ ID NO: 1136510 - protein, 9 aa, Homo Sapiens
NKLNVSLQE

SEQ ID NO: 1136511 - protein, 9 aa, Homo Sapiens
PPRDHLGLI

SEQ ID NO: 1136512 - protein, 9 aa, Homo Sapiens
PRPLTGRPS

SEQ ID NO: 1136513 - protein, 9 aa, Homo Sapiens
TKSIVIGPL

SEQ ID NO: 1136514 - protein, 9 aa, Homo Sapiens
PVTVANTTM

SEQ ID NO: 1136515 - protein, 9 aa, Homo Sapiens
WASRWLCRK

SEQ ID NO: 1136516 - protein, 9 aa, Homo Sapiens
PPILGRGAC

SEQ ID NO: 1136517 - protein, 9 aa, Homo Sapiens
IKLDCTDMF

SEQ ID NO: 1136518 - protein, 9 aa, Homo Sapiens
KSRKLTKAE

SEQ ID NO: 1136519 - protein, 9 aa, Homo Sapiens
ARSSLGARA

SEQ ID NO: 1136520 - protein, 9 aa, Homo Sapiens
IAPSTVCPC

SEQ ID NO: 1136521 - protein, 9 aa, Homo Sapiens
QKDKVSILS

SEQ ID NO: 1136522 - protein, 9 aa, Homo Sapiens
LAPAQARHS

SEQ ID NO: 1136523 - protein, 9 aa, Homo Sapiens
PESLISVDG

SEQ ID NO: 1136524 - protein, 9 aa, Homo Sapiens
RPRVSGAPT

SEQ ID NO: 1136525 - protein, 9 aa, Homo Sapiens
RVGTFGFLA

SEQ ID NO: 1136526 - protein, 9 aa, Homo Sapiens
MAPETTLWL

SEQ ID NO: 1136527 - protein, 9 aa, Homo Sapiens
DWQVYFTEE

SEQ ID NO: 1136528 - protein, 9 aa, Homo Sapiens
SPALPGGRC

SEQ ID NO: 1136529 - protein, 9 aa, Homo Sapiens
CTMPPLLHP

SEQ ID NO: 1136530 - protein, 9 aa, Homo Sapiens
RPLWSRLSL

SEQ ID NO: 1136531 - protein, 9 aa, Homo Sapiens
KEKKNQEKI

SEQ ID NO: 1136532 - protein, 9 aa, Homo Sapiens
PDVVLRLSC

SEQ ID NO: 1136533 - protein, 9 aa, Homo Sapiens
GWSASCGPT

SEQ ID NO: 1136534 - protein, 9 aa, Homo Sapiens
SQQLKKRAR

SEQ ID NO: 1136535 - protein, 9 aa, Homo Sapiens
LVNTLVPHE

SEQ ID NO: 1136536 - protein, 9 aa, Homo Sapiens
SLRINGLPS

SEQ ID NO: 1136537 - protein, 9 aa, Homo Sapiens
LFYTNVYID

SEQ ID NO: 1136538 - protein, 9 aa, Homo Sapiens
DRCSAGKRG

SEQ ID NO: 1136539 - protein, 9 aa, Homo Sapiens
SHSKPCGFD

SEQ ID NO: 1136540 - protein, 9 aa, Homo Sapiens
IPSELQGIF

SEQ ID NO: 1136541 - protein, 9 aa, Homo Sapiens
RHPCPRPPR

SEQ ID NO: 1136542 - protein, 9 aa, Homo Sapiens
PPTSLPDCR

SEQ ID NO: 1136543 - protein, 9 aa, Homo Sapiens
EDVPRQQRE

SEQ ID NO: 1136544 - protein, 9 aa, Homo Sapiens
SPQEENLTR

SEQ ID NO: 1136545 - protein, 9 aa, Homo Sapiens
CRKLGDPQS

SEQ ID NO: 1136546 - protein, 9 aa, Homo Sapiens
IEVISNALS

SEQ ID NO: 1136547 - protein, 9 aa, Homo Sapiens
VQYELKDSP

SEQ ID NO: 1136548 - protein, 9 aa, Homo Sapiens
RAATLAPAQ

SEQ ID NO: 1136549 - protein, 9 aa, Homo Sapiens
LRHLESASY

SEQ ID NO: 1136550 - protein, 9 aa, Homo Sapiens
RPRSRTGSC

SEQ ID NO: 1136551 - protein, 9 aa, Homo Sapiens
ARKDSDSPN

SEQ ID NO: 1136552 - protein, 9 aa, Homo Sapiens
RGTPDRFPE

SEQ ID NO: 1136553 - protein, 9 aa, Homo Sapiens
ANVKPPRCC

SEQ ID NO: 1136554 - protein, 9 aa, Homo Sapiens
MVTIWWSVA

SEQ ID NO: 1136555 - protein, 9 aa, Homo Sapiens
AVAVALGVL

SEQ ID NO: 1136556 - protein, 9 aa, Homo Sapiens
TAPSAVPSV

SEQ ID NO: 1136557 - protein, 9 aa, Homo Sapiens
FARHGRSLP

SEQ ID NO: 1136558 - protein, 9 aa, Homo Sapiens
RAKKPCRTS

SEQ ID NO: 1136559 - protein, 9 aa, Homo Sapiens
LLAIPEAMF

SEQ ID NO: 1136560 - protein, 9 aa, Homo Sapiens
IHWQCGCVD

SEQ ID NO: 1136561 - protein, 9 aa, Homo Sapiens
PLVPLISLM

SEQ ID NO: 1136562 - protein, 9 aa, Homo Sapiens
HGRKKCSGS

SEQ ID NO: 1136563 - protein, 9 aa, Homo Sapiens
LLGTWIISI

SEQ ID NO: 1136564 - protein, 9 aa, Homo Sapiens
PPRPPALLQ

SEQ ID NO: 1136565 - protein, 9 aa, Homo Sapiens
RDFDPVSTV

SEQ ID NO: 1136566 - protein, 9 aa, Homo Sapiens
LEAKQNGYV

SEQ ID NO: 1136567 - protein, 9 aa, Homo Sapiens
PPRASPRTC

SEQ ID NO: 1136568 - protein, 9 aa, Homo Sapiens
PGSSPGPPT

SEQ ID NO: 1136569 - protein, 9 aa, Homo Sapiens
FGDVSSDVH

SEQ ID NO: 1136570 - protein, 9 aa, Homo Sapiens
EDDGANHSQ

SEQ ID NO: 1136571 - protein, 9 aa, Homo Sapiens
CLRRRSQGV

SEQ ID NO: 1136572 - protein, 9 aa, Homo Sapiens
AARSLSRTA

SEQ ID NO: 1136573 - protein, 9 aa, Homo Sapiens
LLAMAPRPR

SEQ ID NO: 1136574 - protein, 9 aa, Homo Sapiens
TAFCRPTTV

SEQ ID NO: 1136575 - protein, 9 aa, Homo Sapiens
EEVPEQQVT

SEQ ID NO: 1136576 - protein, 9 aa, Homo Sapiens
SSMVIKVDL

SEQ ID NO: 1136577 - protein, 9 aa, Homo Sapiens
SSPHICQRG

SEQ ID NO: 1136578 - protein, 9 aa, Homo Sapiens
AVLFNFPPA

SEQ ID NO: 1136579 - protein, 9 aa, Homo Sapiens
KITLILVYP

SEQ ID NO: 1136580 - protein, 9 aa, Homo Sapiens
RPPGPPRAS

SEQ ID NO: 1136581 - protein, 9 aa, Homo Sapiens
VLSTPRDAL

SEQ ID NO: 1136582 - protein, 9 aa, Homo Sapiens
SEKGDLNLS

SEQ ID NO: 1136583 - protein, 9 aa, Homo Sapiens
NYFMLVKNE

SEQ ID NO: 1136584 - protein, 9 aa, Homo Sapiens
FMKLYHSLV

SEQ ID NO: 1136585 - protein, 9 aa, Homo Sapiens
FTHSSTFRD

SEQ ID NO: 1136586 - protein, 9 aa, Homo Sapiens
DWVNVMFSF

SEQ ID NO: 1136587 - protein, 9 aa, Homo Sapiens
FSGLICMAM

SEQ ID NO: 1136588 - protein, 9 aa, Homo Sapiens
LQLGPEDTG

SEQ ID NO: 1136589 - protein, 9 aa, Homo Sapiens
MTQSSSGTS

SEQ ID NO: 1136590 - protein, 9 aa, Homo Sapiens
HLILLSETS

SEQ ID NO: 1136591 - protein, 9 aa, Homo Sapiens
GTWCLPPTT

SEQ ID NO: 1136592 - protein, 9 aa, Homo Sapiens
SQPVSFNGV

SEQ ID NO: 1136593 - protein, 9 aa, Homo Sapiens
TPPSGDMMS

SEQ ID NO: 1136594 - protein, 9 aa, Homo Sapiens
LHAPSLSPG

SEQ ID NO: 1136595 - protein, 9 aa, Homo Sapiens
RLGSEVGRR

SEQ ID NO: 1136596 - protein, 9 aa, Homo Sapiens
MLPCLSPDA

SEQ ID NO: 1136597 - protein, 9 aa, Homo Sapiens
FSLRNSLPQ

SEQ ID NO: 1136598 - protein, 9 aa, Homo Sapiens
WLCRKLRAR

SEQ ID NO: 1136599 - protein, 9 aa, Homo Sapiens
STLLSVLDS

SEQ ID NO: 1136600 - protein, 9 aa, Homo Sapiens
LNMCQDVCE

SEQ ID NO: 1136601 - protein, 9 aa, Homo Sapiens
FIDLPLAKT

SEQ ID NO: 1136602 - protein, 9 aa, Homo Sapiens
FCPLRTLPF

SEQ ID NO: 1136603 - protein, 9 aa, Homo Sapiens
DVPRQQRET

SEQ ID NO: 1136604 - protein, 9 aa, Homo Sapiens
GTEIFLFTA

SEQ ID NO: 1136605 - protein, 9 aa, Homo Sapiens
RRELRRTPC

SEQ ID NO: 1136606 - protein, 9 aa, Homo Sapiens
NVVYAPWSN

SEQ ID NO: 1136607 - protein, 9 aa, Homo Sapiens
DGRSYIVDA

SEQ ID NO: 1136608 - protein, 9 aa, Homo Sapiens
YCRCVLTFA

SEQ ID NO: 1136609 - protein, 9 aa, Homo Sapiens
TKLKPRGLF

SEQ ID NO: 1136610 - protein, 9 aa, Homo Sapiens
NRVAMENQH

SEQ ID NO: 1136611 - protein, 9 aa, Homo Sapiens
VVLQDGDLS

SEQ ID NO: 1136612 - protein, 9 aa, Homo Sapiens
KPIKRVLSS

SEQ ID NO: 1136613 - protein, 9 aa, Homo Sapiens
ADGKWLSIN

SEQ ID NO: 1136614 - protein, 9 aa, Homo Sapiens
KIGRGTTRF

SEQ ID NO: 1136615 - protein, 9 aa, Homo Sapiens
GLAPERLHA

SEQ ID NO: 1136616 - protein, 9 aa, Homo Sapiens
ESEGISFGL

SEQ ID NO: 1136617 - protein, 9 aa, Homo Sapiens
KRCNRFVKK

SEQ ID NO: 1136618 - protein, 9 aa, Homo Sapiens
TTLCTGLVA

SEQ ID NO: 1136619 - protein, 9 aa, Homo Sapiens
HDCSIEICT

SEQ ID NO: 1136620 - protein, 9 aa, Homo Sapiens
VEIIRHISA

SEQ ID NO: 1136621 - protein, 9 aa, Homo Sapiens
NELRSLECV

SEQ ID NO: 1136622 - protein, 9 aa, Homo Sapiens
FALGRAPVS

SEQ ID NO: 1136623 - protein, 9 aa, Homo Sapiens
RGCCSASST

SEQ ID NO: 1136624 - protein, 9 aa, Homo Sapiens
RGARGAKVS

SEQ ID NO: 1136625 - protein, 9 aa, Homo Sapiens
TGRTPTTRL

SEQ ID NO: 1136626 - protein, 9 aa, Homo Sapiens
GSHHHSQNY

SEQ ID NO: 1136627 - protein, 9 aa, Homo Sapiens
PTLGSNVTL

SEQ ID NO: 1136628 - protein, 9 aa, Homo Sapiens
AAAASTSSP

SEQ ID NO: 1136629 - protein, 9 aa, Homo Sapiens
AYGLAVKSP

SEQ ID NO: 1136630 - protein, 9 aa, Homo Sapiens
LTLITDMLH

SEQ ID NO: 1136631 - protein, 9 aa, Homo Sapiens
MTHEMESLT

SEQ ID NO: 1136632 - protein, 9 aa, Homo Sapiens
LMAQQYHAA

SEQ ID NO: 1136633 - protein, 9 aa, Homo Sapiens
IHYWLQLLY

SEQ ID NO: 1136634 - protein, 9 aa, Homo Sapiens
GGREPCAAP

SEQ ID NO: 1136635 - protein, 9 aa, Homo Sapiens
DVAGSQVTV

SEQ ID NO: 1136636 - protein, 9 aa, Homo Sapiens
KRKRKRRSH

SEQ ID NO: 1136637 - protein, 9 aa, Homo Sapiens
EDSTWEPEE

SEQ ID NO: 1136638 - protein, 9 aa, Homo Sapiens
LKLGGRVKM

SEQ ID NO: 1136639 - protein, 9 aa, Homo Sapiens
LKNLSWKKY

SEQ ID NO: 1136640 - protein, 9 aa, Homo Sapiens
ETEVALQPL

SEQ ID NO: 1136641 - protein, 9 aa, Homo Sapiens
IYDEETKRK

SEQ ID NO: 1136642 - protein, 9 aa, Homo Sapiens
PDSSTPKRS

SEQ ID NO: 1136643 - protein, 9 aa, Homo Sapiens
HLAALVYKC

SEQ ID NO: 1136644 - protein, 9 aa, Homo Sapiens
ILKTDDDVY

SEQ ID NO: 1136645 - protein, 9 aa, Homo Sapiens
QATGGDEPA

SEQ ID NO: 1136646 - protein, 9 aa, Homo Sapiens
MTVAIVKAM

SEQ ID NO: 1136647 - protein, 9 aa, Homo Sapiens
TYVSSLHDA

SEQ ID NO: 1136648 - protein, 9 aa, Homo Sapiens
VKMVSQSFT

SEQ ID NO: 1136649 - protein, 9 aa, Homo Sapiens
TKDGRSNMR

SEQ ID NO: 1136650 - protein, 9 aa, Homo Sapiens
HANDDLKEN

SEQ ID NO: 1136651 - protein, 9 aa, Homo Sapiens
QGLSRKKEE

SEQ ID NO: 1136652 - protein, 9 aa, Homo Sapiens
NHKHGDSVW

SEQ ID NO: 1136653 - protein, 9 aa, Homo Sapiens
ISLKQGKKE

SEQ ID NO: 1136654 - protein, 9 aa, Homo Sapiens
QPPLPSERL

SEQ ID NO: 1136655 - protein, 9 aa, Homo Sapiens
LQQLHKNSQ

SEQ ID NO: 1136656 - protein, 9 aa, Homo Sapiens
VTGSPRSFT

SEQ ID NO: 1136657 - protein, 9 aa, Homo Sapiens
VTAVTFNKE

SEQ ID NO: 1136658 - protein, 9 aa, Homo Sapiens
KTVVWGSAM

SEQ ID NO: 1136659 - protein, 9 aa, Homo Sapiens
CMTVVQAYV

SEQ ID NO: 1136660 - protein, 9 aa, Homo Sapiens
SASDTGYIL

SEQ ID NO: 1136661 - protein, 9 aa, Homo Sapiens
ECGKGFAQH

SEQ ID NO: 1136662 - protein, 9 aa, Homo Sapiens
APLGNAHAC

SEQ ID NO: 1136663 - protein, 9 aa, Homo Sapiens
EKIVNSFLI

SEQ ID NO: 1136664 - protein, 9 aa, Homo Sapiens
AHRGLGGLG

SEQ ID NO: 1136665 - protein, 9 aa, Homo Sapiens
AELILQQNC

SEQ ID NO: 1136666 - protein, 9 aa, Homo Sapiens
EKVHVNLLF

SEQ ID NO: 1136667 - protein, 9 aa, Homo Sapiens
DTADRPPTP

SEQ ID NO: 1136668 - protein, 9 aa, Homo Sapiens
QLQNAHTMR

SEQ ID NO: 1136669 - protein, 9 aa, Homo Sapiens
YSWYGSVEA

SEQ ID NO: 1136670 - protein, 9 aa, Homo Sapiens
HMRVLSKAF

SEQ ID NO: 1136671 - protein, 9 aa, Homo Sapiens
RKALPFAQW

SEQ ID NO: 1136672 - protein, 9 aa, Homo Sapiens
TIAPSTVCP

SEQ ID NO: 1136673 - protein, 9 aa, Homo Sapiens
SMWRQRGRV

SEQ ID NO: 1136674 - protein, 9 aa, Homo Sapiens
DQDVIKNQQ

SEQ ID NO: 1136675 - protein, 9 aa, Homo Sapiens
GDFTHHNGT

SEQ ID NO: 1136676 - protein, 9 aa, Homo Sapiens
SDPYALVCL

SEQ ID NO: 1136677 - protein, 9 aa, Homo Sapiens
RIDDSTSSA

SEQ ID NO: 1136678 - protein, 9 aa, Homo Sapiens
PRWSHWTPY

SEQ ID NO: 1136679 - protein, 9 aa, Homo Sapiens
LRSLPCPLG

SEQ ID NO: 1136680 - protein, 9 aa, Homo Sapiens
FCYFNASQT

SEQ ID NO: 1136681 - protein, 9 aa, Homo Sapiens
LQDRCEQVC

SEQ ID NO: 1136682 - protein, 9 aa, Homo Sapiens
LILFSMLCC

SEQ ID NO: 1136683 - protein, 9 aa, Homo Sapiens
KSRARYGDG

SEQ ID NO: 1136684 - protein, 9 aa, Homo Sapiens
TFRLKLPVL

SEQ ID NO: 1136685 - protein, 9 aa, Homo Sapiens
TLQNREHEI

SEQ ID NO: 1136686 - protein, 9 aa, Homo Sapiens
CLLLPTDVI

SEQ ID NO: 1136687 - protein, 9 aa, Homo Sapiens
KKIIQNKKL

SEQ ID NO: 1136688 - protein, 9 aa, Homo Sapiens
YRPGENLNI

SEQ ID NO: 1136689 - protein, 9 aa, Homo Sapiens
RGSTEGGSK

SEQ ID NO: 1136690 - protein, 9 aa, Homo Sapiens
DHGPTLKAY

SEQ ID NO: 1136691 - protein, 9 aa, Homo Sapiens
PMWWLIGAE

SEQ ID NO: 1136692 - protein, 9 aa, Homo Sapiens
NVGCDVPRL

SEQ ID NO: 1136693 - protein, 9 aa, Homo Sapiens
YVASRPFRE

SEQ ID NO: 1136694 - protein, 9 aa, Homo Sapiens
LISGRLDLG

SEQ ID NO: 1136695 - protein, 9 aa, Homo Sapiens
YYPPGVMVY

SEQ ID NO: 1136696 - protein, 9 aa, Homo Sapiens
AAASTSSPA

SEQ ID NO: 1136697 - protein, 9 aa, Homo Sapiens
ADPSGLWVW

SEQ ID NO: 1136698 - protein, 9 aa, Homo Sapiens
PPACNCVFR

SEQ ID NO: 1136699 - protein, 9 aa, Homo Sapiens
YNSDFEESG

SEQ ID NO: 1136700 - protein, 9 aa, Homo Sapiens
PRLQIWWKK

SEQ ID NO: 1136701 - protein, 9 aa, Homo Sapiens
VFDANEPAD

SEQ ID NO: 1136702 - protein, 9 aa, Homo Sapiens
QSPHTPLVF

SEQ ID NO: 1136703 - protein, 9 aa, Homo Sapiens
TKVVEKCGC

SEQ ID NO: 1136704 - protein, 9 aa, Homo Sapiens
HSDYEDPAF

SEQ ID NO: 1136705 - protein, 9 aa, Homo Sapiens
VYAPWSNLK

SEQ ID NO: 1136706 - protein, 9 aa, Homo Sapiens
ELSNVLVAM

SEQ ID NO: 1136707 - protein, 9 aa, Homo Sapiens
TSRAPPMMG

SEQ ID NO: 1136708 - protein, 9 aa, Homo Sapiens
LIGILTLFS

SEQ ID NO: 1136709 - protein, 9 aa, Homo Sapiens
QSQWDVDDN

SEQ ID NO: 1136710 - protein, 9 aa, Homo Sapiens
LDRVYSPFR

SEQ ID NO: 1136711 - protein, 9 aa, Homo Sapiens
PGSPTPTPL

SEQ ID NO: 1136712 - protein, 9 aa, Homo Sapiens
GGPAEGRRD

SEQ ID NO: 1136713 - protein, 9 aa, Homo Sapiens
SPPPPPADP

SEQ ID NO: 1136714 - protein, 9 aa, Homo Sapiens
SCSAWTVST

SEQ ID NO: 1136715 - protein, 9 aa, Homo Sapiens
EGALSSQEV

SEQ ID NO: 1136716 - protein, 9 aa, Homo Sapiens
GAALANAQN

SEQ ID NO: 1136717 - protein, 9 aa, Homo Sapiens
WAPAAPSPG

SEQ ID NO: 1136718 - protein, 9 aa, Homo Sapiens
VSALHDDMD

SEQ ID NO: 1136719 - protein, 9 aa, Homo Sapiens
WVLIGSLLV

SEQ ID NO: 1136720 - protein, 9 aa, Homo Sapiens
HPCPQFMAQ

SEQ ID NO: 1136721 - protein, 9 aa, Homo Sapiens
HFLAERKVS

SEQ ID NO: 1136722 - protein, 9 aa, Homo Sapiens
DGSCEGKMA

SEQ ID NO: 1136723 - protein, 9 aa, Homo Sapiens
FARPPQLRR

SEQ ID NO: 1136724 - protein, 9 aa, Homo Sapiens
QPGGDKEKA

SEQ ID NO: 1136725 - protein, 9 aa, Homo Sapiens
LWSPPGQVG

SEQ ID NO: 1136726 - protein, 9 aa, Homo Sapiens
SRARQSCCL

SEQ ID NO: 1136727 - protein, 9 aa, Homo Sapiens
SVKVMYRCL

SEQ ID NO: 1136728 - protein, 9 aa, Homo Sapiens
MGEIVTKFG

SEQ ID NO: 1136729 - protein, 9 aa, Homo Sapiens
KQLALKHQL

SEQ ID NO: 1136730 - protein, 9 aa, Homo Sapiens
VQSVIARCL

SEQ ID NO: 1136731 - protein, 9 aa, Homo Sapiens
DMVRTAYLD

SEQ ID NO: 1136732 - protein, 9 aa, Homo Sapiens
DLYSAYDCT

SEQ ID NO: 1136733 - protein, 9 aa, Homo Sapiens
EGCISVKDH

SEQ ID NO: 1136734 - protein, 9 aa, Homo Sapiens
GCDVPRLSL

SEQ ID NO: 1136735 - protein, 9 aa, Homo Sapiens
LLMGFLSGE

SEQ ID NO: 1136736 - protein, 9 aa, Homo Sapiens
LLLVLLHEL

SEQ ID NO: 1136737 - protein, 9 aa, Homo Sapiens
DNDGIPDDR

SEQ ID NO: 1136738 - protein, 9 aa, Homo Sapiens
CLSISGWFH

SEQ ID NO: 1136739 - protein, 9 aa, Homo Sapiens
NHFFVTPQL

SEQ ID NO: 1136740 - protein, 9 aa, Homo Sapiens
EMALTSIRC

SEQ ID NO: 1136741 - protein, 9 aa, Homo Sapiens
VKDHGEPVL

SEQ ID NO: 1136742 - protein, 9 aa, Homo Sapiens
PRVGFHVSK

SEQ ID NO: 1136743 - protein, 9 aa, Homo Sapiens
LLGAKVGVI

SEQ ID NO: 1136744 - protein, 9 aa, Homo Sapiens
TERNLRPLS

SEQ ID NO: 1136745 - protein, 9 aa, Homo Sapiens
IWEVMPRTL

SEQ ID NO: 1136746 - protein, 9 aa, Homo Sapiens
AGPLGLLLP

SEQ ID NO: 1136747 - protein, 9 aa, Homo Sapiens
KPAHNYLAL

SEQ ID NO: 1136748 - protein, 9 aa, Homo Sapiens
AERERAQAE

SEQ ID NO: 1136749 - protein, 9 aa, Homo Sapiens
RHILNFLRN

SEQ ID NO: 1136750 - protein, 9 aa, Homo Sapiens
KGPWRTTPR

SEQ ID NO: 1136751 - protein, 9 aa, Homo Sapiens
FLREAGIMG

SEQ ID NO: 1136752 - protein, 9 aa, Homo Sapiens
EDAVCPIQR

SEQ ID NO: 1136753 - protein, 9 aa, Homo Sapiens
LVLNNNALS

SEQ ID NO: 1136754 - protein, 9 aa, Homo Sapiens
LRSEGGPPR

SEQ ID NO: 1136755 - protein, 9 aa, Homo Sapiens
DCFSRSRTF

SEQ ID NO: 1136756 - protein, 9 aa, Homo Sapiens
ASVTLYGLP

SEQ ID NO: 1136757 - protein, 9 aa, Homo Sapiens
RFPETHLGR

SEQ ID NO: 1136758 - protein, 9 aa, Homo Sapiens
HVLSLPIRI

SEQ ID NO: 1136759 - protein, 9 aa, Homo Sapiens
PRVSGAPTR

SEQ ID NO: 1136760 - protein, 9 aa, Homo Sapiens
PALGRQQVM

SEQ ID NO: 1136761 - protein, 9 aa, Homo Sapiens
LGQELEKCD

SEQ ID NO: 1136762 - protein, 9 aa, Homo Sapiens
RPPALRAWP

SEQ ID NO: 1136763 - protein, 9 aa, Homo Sapiens
QRALEIWKL

SEQ ID NO: 1136764 - protein, 9 aa, Homo Sapiens
IHRGAERWN

SEQ ID NO: 1136765 - protein, 9 aa, Homo Sapiens
ESGVEVLSC

SEQ ID NO: 1136766 - protein, 9 aa, Homo Sapiens
MQKDQEERE

SEQ ID NO: 1136767 - protein, 9 aa, Homo Sapiens
QLLGHLQDL

SEQ ID NO: 1136768 - protein, 9 aa, Homo Sapiens
LNEEKSSLG

SEQ ID NO: 1136769 - protein, 9 aa, Homo Sapiens
PTTRCTSTA

SEQ ID NO: 1136770 - protein, 9 aa, Homo Sapiens
SGLASLGKH

SEQ ID NO: 1136771 - protein, 9 aa, Homo Sapiens
DRPSSARCS

SEQ ID NO: 1136772 - protein, 9 aa, Homo Sapiens
SSLLPPRPP

SEQ ID NO: 1136773 - protein, 9 aa, Homo Sapiens
LERLYCQFS

SEQ ID NO: 1136774 - protein, 9 aa, Homo Sapiens
AVASSSMTT

SEQ ID NO: 1136775 - protein, 9 aa, Homo Sapiens
FAIFIMLNY

SEQ ID NO: 1136776 - protein, 9 aa, Homo Sapiens
SLCDDYEEL

SEQ ID NO: 1136777 - protein, 9 aa, Homo Sapiens
LFLSAPPHA

SEQ ID NO: 1136778 - protein, 9 aa, Homo Sapiens
LLSPSGLFR

SEQ ID NO: 1136779 - protein, 9 aa, Homo Sapiens
PTSAVVAPA

SEQ ID NO: 1136780 - protein, 9 aa, Homo Sapiens
LTNVPSSDQ

SEQ ID NO: 1136781 - protein, 9 aa, Homo Sapiens
QVSTALMKL

SEQ ID NO: 1136782 - protein, 9 aa, Homo Sapiens
SGLGKNPHC

SEQ ID NO: 1136783 - protein, 9 aa, Homo Sapiens
RGNSKTAMV

SEQ ID NO: 1136784 - protein, 9 aa, Homo Sapiens
HRKTPSHTM

SEQ ID NO: 1136785 - protein, 9 aa, Homo Sapiens
TYSYSNLPQ

SEQ ID NO: 1136786 - protein, 9 aa, Homo Sapiens
KILTTKNLL

SEQ ID NO: 1136787 - protein, 9 aa, Homo Sapiens
LKKEKKNQE

SEQ ID NO: 1136788 - protein, 9 aa, Homo Sapiens
AQIPQLNPP

SEQ ID NO: 1136789 - protein, 9 aa, Homo Sapiens
PIPPNGHCI

SEQ ID NO: 1136790 - protein, 9 aa, Homo Sapiens
ATDDILRGE

SEQ ID NO: 1136791 - protein, 9 aa, Homo Sapiens
LLEMLRVTN

SEQ ID NO: 1136792 - protein, 9 aa, Homo Sapiens
QREKEAGHF

SEQ ID NO: 1136793 - protein, 9 aa, Homo Sapiens
KKSCGVAHA

SEQ ID NO: 1136794 - protein, 9 aa, Homo Sapiens
AATKKLSIN

SEQ ID NO: 1136795 - protein, 9 aa, Homo Sapiens
YPGAADPLA

SEQ ID NO: 1136796 - protein, 9 aa, Homo Sapiens
IINGLSVVV

SEQ ID NO: 1136797 - protein, 9 aa, Homo Sapiens
EKKKKRWSR

SEQ ID NO: 1136798 - protein, 9 aa, Homo Sapiens
VLLALTARE

SEQ ID NO: 1136799 - protein, 9 aa, Homo Sapiens
SGVGNPGAA

SEQ ID NO: 1136800 - protein, 9 aa, Homo Sapiens
LGKPLMLPP

SEQ ID NO: 1136801 - protein, 9 aa, Homo Sapiens
VVILPGKMP

SEQ ID NO: 1136802 - protein, 9 aa, Homo Sapiens
LFLVKETGL

SEQ ID NO: 1136803 - protein, 9 aa, Homo Sapiens
GKQLLYGRG

SEQ ID NO: 1136804 - protein, 9 aa, Homo Sapiens
RTVLVYPTD

SEQ ID NO: 1136805 - protein, 9 aa, Homo Sapiens
VVIGVWQMR

SEQ ID NO: 1136806 - protein, 9 aa, Homo Sapiens
TKKKRKFAH

SEQ ID NO: 1136807 - protein, 9 aa, Homo Sapiens
EPTEEALGE

SEQ ID NO: 1136808 - protein, 9 aa, Homo Sapiens
APRRRAPGG

SEQ ID NO: 1136809 - protein, 9 aa, Homo Sapiens
ATTCNHRKK

SEQ ID NO: 1136810 - protein, 9 aa, Homo Sapiens
WWNHHHFQH

SEQ ID NO: 1136811 - protein, 9 aa, Homo Sapiens
ALHLRVHPG

SEQ ID NO: 1136812 - protein, 9 aa, Homo Sapiens
CPSPWWRSQ

SEQ ID NO: 1136813 - protein, 9 aa, Homo Sapiens
VNVKPTNTR

SEQ ID NO: 1136814 - protein, 9 aa, Homo Sapiens
CLRMRPPRS

SEQ ID NO: 1136815 - protein, 9 aa, Homo Sapiens
IAIATTCNH

SEQ ID NO: 1136816 - protein, 9 aa, Homo Sapiens
RGLGGLGQV

SEQ ID NO: 1136817 - protein, 9 aa, Homo Sapiens
AHQLVEQAW

SEQ ID NO: 1136818 - protein, 9 aa, Homo Sapiens
KTFRLKLPV

SEQ ID NO: 1136819 - protein, 9 aa, Homo Sapiens
CCSHSWSLS

SEQ ID NO: 1136820 - protein, 9 aa, Homo Sapiens
IGGVSLRPG

SEQ ID NO: 1136821 - protein, 9 aa, Homo Sapiens
DVLKILEVF

SEQ ID NO: 1136822 - protein, 9 aa, Homo Sapiens
LPGLQVQDL

SEQ ID NO: 1136823 - protein, 9 aa, Homo Sapiens
PVYPSVGID

SEQ ID NO: 1136824 - protein, 9 aa, Homo Sapiens
LRGTPDRFP

SEQ ID NO: 1136825 - protein, 9 aa, Homo Sapiens
SLGIHGRKK

SEQ ID NO: 1136826 - protein, 9 aa, Homo Sapiens
TQFRWNQKG

SEQ ID NO: 1136827 - protein, 9 aa, Homo Sapiens
KDLMSWMAK

SEQ ID NO: 1136828 - protein, 9 aa, Homo Sapiens
VKIFISLPR

SEQ ID NO: 1136829 - protein, 9 aa, Homo Sapiens
VVSLCGLCL

SEQ ID NO: 1136830 - protein, 9 aa, Homo Sapiens
HGGAGGFLL

SEQ ID NO: 1136831 - protein, 9 aa, Homo Sapiens
TGHPLYTIV

SEQ ID NO: 1136832 - protein, 9 aa, Homo Sapiens
EIPPLSSSP

SEQ ID NO: 1136833 - protein, 9 aa, Homo Sapiens
YMFCTGYSD

SEQ ID NO: 1136834 - protein, 9 aa, Homo Sapiens
GVWVGAQEA

SEQ ID NO: 1136835 - protein, 9 aa, Homo Sapiens
FPPLHSHVE

SEQ ID NO: 1136836 - protein, 9 aa, Homo Sapiens
SPSRGTATP

SEQ ID NO: 1136837 - protein, 9 aa, Homo Sapiens
RRRTWWRTR

SEQ ID NO: 1136838 - protein, 9 aa, Homo Sapiens
ARLNMKQKH

SEQ ID NO: 1136839 - protein, 9 aa, Homo Sapiens
PPQRPPLQP

SEQ ID NO: 1136840 - protein, 9 aa, Homo Sapiens
QQIDKVFNS

SEQ ID NO: 1136841 - protein, 9 aa, Homo Sapiens
CILMEFCTQ

SEQ ID NO: 1136842 - protein, 9 aa, Homo Sapiens
YSISSSLTS

SEQ ID NO: 1136843 - protein, 9 aa, Homo Sapiens
LALPSLPAG

SEQ ID NO: 1136844 - protein, 9 aa, Homo Sapiens
DFLQNIMAQ

SEQ ID NO: 1136845 - protein, 9 aa, Homo Sapiens
TPTPLSASG

SEQ ID NO: 1136846 - protein, 9 aa, Homo Sapiens
MESNGKHIT

SEQ ID NO: 1136847 - protein, 9 aa, Homo Sapiens
IPRLLVSRP

SEQ ID NO: 1136848 - protein, 9 aa, Homo Sapiens
VPVAELVPV

SEQ ID NO: 1136849 - protein, 9 aa, Homo Sapiens
TYAPPNSYA

SEQ ID NO: 1136850 - protein, 9 aa, Homo Sapiens
LGKQVLAGH

SEQ ID NO: 1136851 - protein, 9 aa, Homo Sapiens
VHQKLLQLL

SEQ ID NO: 1136852 - protein, 9 aa, Homo Sapiens
IALASEKAI

SEQ ID NO: 1136853 - protein, 9 aa, Homo Sapiens
ELGFTQRKE

SEQ ID NO: 1136854 - protein, 9 aa, Homo Sapiens
ITKELHRSY

SEQ ID NO: 1136855 - protein, 9 aa, Homo Sapiens
GKEETRKIA

SEQ ID NO: 1136856 - protein, 9 aa, Homo Sapiens
TATMESLPA

SEQ ID NO: 1136857 - protein, 9 aa, Homo Sapiens
RIVLDMGYT

SEQ ID NO: 1136858 - protein, 9 aa, Homo Sapiens
NESLTDTVR

SEQ ID NO: 1136859 - protein, 9 aa, Homo Sapiens
YILGLISCS

SEQ ID NO: 1136860 - protein, 9 aa, Homo Sapiens
EELAESGLV

SEQ ID NO: 1136861 - protein, 9 aa, Homo Sapiens
QPGAERVWR

SEQ ID NO: 1136862 - protein, 9 aa, Homo Sapiens
DANKGEPLA

SEQ ID NO: 1136863 - protein, 9 aa, Homo Sapiens
KILENERFD

SEQ ID NO: 1136864 - protein, 9 aa, Homo Sapiens
CQASGGCPA

SEQ ID NO: 1136865 - protein, 9 aa, Homo Sapiens
PQRPPLRAG

SEQ ID NO: 1136866 - protein, 9 aa, Homo Sapiens
GFWHEHTKP

SEQ ID NO: 1136867 - protein, 9 aa, Homo Sapiens
DIFRRGFRQ

SEQ ID NO: 1136868 - protein, 9 aa, Homo Sapiens
LVTALKGRI

SEQ ID NO: 1136869 - protein, 9 aa, Homo Sapiens
YHIHNQTYR

SEQ ID NO: 1136870 - protein, 9 aa, Homo Sapiens
SRKVTELRQ

SEQ ID NO: 1136871 - protein, 9 aa, Homo Sapiens
HCMMNWTHT

SEQ ID NO: 1136872 - protein, 9 aa, Homo Sapiens
TCCHENIDD

SEQ ID NO: 1136873 - protein, 9 aa, Homo Sapiens
HRFHHGEKP

SEQ ID NO: 1136874 - protein, 9 aa, Homo Sapiens
TACPPCPVH

SEQ ID NO: 1136875 - protein, 9 aa, Homo Sapiens
VVTSPKSAL

SEQ ID NO: 1136876 - protein, 9 aa, Homo Sapiens
SGIEIIDEK

SEQ ID NO: 1136877 - protein, 9 aa, Homo Sapiens
SNSSGASTD

SEQ ID NO: 1136878 - protein, 9 aa, Homo Sapiens
LDVDCMTSH

SEQ ID NO: 1136879 - protein, 9 aa, Homo Sapiens
HGLVFGDDA

SEQ ID NO: 1136880 - protein, 9 aa, Homo Sapiens
RQQVMAQSL

SEQ ID NO: 1136881 - protein, 9 aa, Homo Sapiens
EATFGRALL

SEQ ID NO: 1136882 - protein, 9 aa, Homo Sapiens
MDSFDEDLT

SEQ ID NO: 1136883 - protein, 9 aa, Homo Sapiens
PLNCTHLGI

SEQ ID NO: 1136884 - protein, 9 aa, Homo Sapiens
AGARGRWWL

SEQ ID NO: 1136885 - protein, 9 aa, Homo Sapiens
LGNMYHLPA

SEQ ID NO: 1136886 - protein, 9 aa, Homo Sapiens
VVVVAAPAS

SEQ ID NO: 1136887 - protein, 9 aa, Homo Sapiens
VKWPNDISV

SEQ ID NO: 1136888 - protein, 9 aa, Homo Sapiens
SHGVTVALK

SEQ ID NO: 1136889 - protein, 9 aa, Homo Sapiens
PHSYPVIPV

SEQ ID NO: 1136890 - protein, 9 aa, Homo Sapiens
PSKLPGYAS

SEQ ID NO: 1136891 - protein, 9 aa, Homo Sapiens
CNTGSRAAF

SEQ ID NO: 1136892 - protein, 9 aa, Homo Sapiens
REQEERRIR

SEQ ID NO: 1136893 - protein, 9 aa, Homo Sapiens
IVLFCEMVE

SEQ ID NO: 1136894 - protein, 9 aa, Homo Sapiens
KKQKFRPTL

SEQ ID NO: 1136895 - protein, 9 aa, Homo Sapiens
QVRRLMSVD

SEQ ID NO: 1136896 - protein, 9 aa, Homo Sapiens
PQSRGLDSL

SEQ ID NO: 1136897 - protein, 9 aa, Homo Sapiens
CPPGFRIVL

SEQ ID NO: 1136898 - protein, 9 aa, Homo Sapiens
KPSARSPTW

SEQ ID NO: 1136899 - protein, 9 aa, Homo Sapiens
MNRHSNEWK

SEQ ID NO: 1136900 - protein, 9 aa, Homo Sapiens
LYLFHNDIR

SEQ ID NO: 1136901 - protein, 9 aa, Homo Sapiens
SLMNSRLSV

SEQ ID NO: 1136902 - protein, 9 aa, Homo Sapiens
WHSDYEDPA

SEQ ID NO: 1136903 - protein, 9 aa, Homo Sapiens
PVEALKLCQ

SEQ ID NO: 1136904 - protein, 9 aa, Homo Sapiens
QGGQPWQQC

SEQ ID NO: 1136905 - protein, 9 aa, Homo Sapiens
CPGICQLVW

SEQ ID NO: 1136906 - protein, 9 aa, Homo Sapiens
SSTSGPVGR

SEQ ID NO: 1136907 - protein, 9 aa, Homo Sapiens
TAASGRPPT

SEQ ID NO: 1136908 - protein, 9 aa, Homo Sapiens
SSMLEYRKH

SEQ ID NO: 1136909 - protein, 9 aa, Homo Sapiens
SSVLLTMSI

SEQ ID NO: 1136910 - protein, 9 aa, Homo Sapiens
ARAFRCSLY

SEQ ID NO: 1136911 - protein, 9 aa, Homo Sapiens
RMCGKKYTQ

SEQ ID NO: 1136912 - protein, 9 aa, Homo Sapiens
TVQRRQAEI

SEQ ID NO: 1136913 - protein, 9 aa, Homo Sapiens
NSEGEFFGN

SEQ ID NO: 1136914 - protein, 9 aa, Homo Sapiens
HITGEFQIL

SEQ ID NO: 1136915 - protein, 9 aa, Homo Sapiens
GLCPECSCG

SEQ ID NO: 1136916 - protein, 9 aa, Homo Sapiens
DAQSVLDAS

SEQ ID NO: 1136917 - protein, 9 aa, Homo Sapiens
QVVVIRRER

SEQ ID NO: 1136918 - protein, 9 aa, Homo Sapiens
AYSQCVTTM

SEQ ID NO: 1136919 - protein, 9 aa, Homo Sapiens
RTSRTRETL

SEQ ID NO: 1136920 - protein, 9 aa, Homo Sapiens
GRAWHHHGG

SEQ ID NO: 1136921 - protein, 9 aa, Homo Sapiens
RKSAILPLL

SEQ ID NO: 1136922 - protein, 9 aa, Homo Sapiens
WGNLAGRNT

SEQ ID NO: 1136923 - protein, 9 aa, Homo Sapiens
EAEEWPVPW

SEQ ID NO: 1136924 - protein, 9 aa, Homo Sapiens
VPGKTSLKA

SEQ ID NO: 1136925 - protein, 9 aa, Homo Sapiens
GSTGIRDMH

SEQ ID NO: 1136926 - protein, 9 aa, Homo Sapiens
MGRRRRGQG

SEQ ID NO: 1136927 - protein, 9 aa, Homo Sapiens
QPLLGAGLG

SEQ ID NO: 1136928 - protein, 9 aa, Homo Sapiens
LQAGDAPQW

SEQ ID NO: 1136929 - protein, 9 aa, Homo Sapiens
NFRPAGGVV

SEQ ID NO: 1136930 - protein, 9 aa, Homo Sapiens
MHTWYTETH

SEQ ID NO: 1136931 - protein, 9 aa, Homo Sapiens
NEVGHSIRF

SEQ ID NO: 1136932 - protein, 9 aa, Homo Sapiens
VRMFVWTRP

SEQ ID NO: 1136933 - protein, 9 aa, Homo Sapiens
WLPSPWVLR

SEQ ID NO: 1136934 - protein, 9 aa, Homo Sapiens
PSMETTRRR

SEQ ID NO: 1136935 - protein, 9 aa, Homo Sapiens
REPQAFENI

SEQ ID NO: 1136936 - protein, 9 aa, Homo Sapiens
SFCIDLWLK

SEQ ID NO: 1136937 - protein, 9 aa, Homo Sapiens
GIWVLFGSD

SEQ ID NO: 1136938 - protein, 9 aa, Homo Sapiens
DPDTDLDSF

SEQ ID NO: 1136939 - protein, 9 aa, Homo Sapiens
YDGPQQALD

SEQ ID NO: 1136940 - protein, 9 aa, Homo Sapiens
YFIYSYILG

SEQ ID NO: 1136941 - protein, 9 aa, Homo Sapiens
GMRRLCRRR

SEQ ID NO: 1136942 - protein, 9 aa, Homo Sapiens
LSLENMHSR

SEQ ID NO: 1136943 - protein, 9 aa, Homo Sapiens
GRRWERPGA

SEQ ID NO: 1136944 - protein, 9 aa, Homo Sapiens
KKMVHELMQ

SEQ ID NO: 1136945 - protein, 9 aa, Homo Sapiens
QGDYQATPE

SEQ ID NO: 1136946 - protein, 9 aa, Homo Sapiens
PPYVLRFRN

SEQ ID NO: 1136947 - protein, 9 aa, Homo Sapiens
RLEVEAGPA

SEQ ID NO: 1136948 - protein, 9 aa, Homo Sapiens
EMFASTAYL

SEQ ID NO: 1136949 - protein, 9 aa, Homo Sapiens
TVDTIKRPS

SEQ ID NO: 1136950 - protein, 9 aa, Homo Sapiens
NGPRDLGIH

SEQ ID NO: 1136951 - protein, 9 aa, Homo Sapiens
KKLKVKSKQ

SEQ ID NO: 1136952 - protein, 9 aa, Homo Sapiens
DEVFCSSPQ

SEQ ID NO: 1136953 - protein, 9 aa, Homo Sapiens
PPPLSSSLR

SEQ ID NO: 1136954 - protein, 9 aa, Homo Sapiens
PRPCGGKMA

SEQ ID NO: 1136955 - protein, 9 aa, Homo Sapiens
DPAIHQSLK

SEQ ID NO: 1136956 - protein, 9 aa, Homo Sapiens
EQLYMRRAA

SEQ ID NO: 1136957 - protein, 9 aa, Homo Sapiens
DTLYSQIKD

SEQ ID NO: 1136958 - protein, 9 aa, Homo Sapiens
SVSHQAGVQ

SEQ ID NO: 1136959 - protein, 9 aa, Homo Sapiens
NFRTEDGGW

SEQ ID NO: 1136960 - protein, 9 aa, Homo Sapiens
PTCILGQRA

SEQ ID NO: 1136961 - protein, 9 aa, Homo Sapiens
TYYLYMKYI

SEQ ID NO: 1136962 - protein, 9 aa, Homo Sapiens
CLTWASPLA

SEQ ID NO: 1136963 - protein, 9 aa, Homo Sapiens
TFKTGKVGR

SEQ ID NO: 1136964 - protein, 9 aa, Homo Sapiens
TAHAVRVHV

SEQ ID NO: 1136965 - protein, 9 aa, Homo Sapiens
QKELSVSPS

SEQ ID NO: 1136966 - protein, 9 aa, Homo Sapiens
HTSMILIED

SEQ ID NO: 1136967 - protein, 9 aa, Homo Sapiens
YPRPWRRTG

SEQ ID NO: 1136968 - protein, 9 aa, Homo Sapiens
FRIVLDMGY

SEQ ID NO: 1136969 - protein, 9 aa, Homo Sapiens
DGTGPLSML

SEQ ID NO: 1136970 - protein, 9 aa, Homo Sapiens
NEETKPFSP

SEQ ID NO: 1136971 - protein, 9 aa, Homo Sapiens
CYWIDPNQG

SEQ ID NO: 1136972 - protein, 9 aa, Homo Sapiens
AWQYFMCNN

SEQ ID NO: 1136973 - protein, 9 aa, Homo Sapiens
SELPPGRAW

SEQ ID NO: 1136974 - protein, 9 aa, Homo Sapiens
STLVFYISV

SEQ ID NO: 1136975 - protein, 9 aa, Homo Sapiens
GSGNTTHRC

SEQ ID NO: 1136976 - protein, 9 aa, Homo Sapiens
LSTEAQRGL

SEQ ID NO: 1136977 - protein, 9 aa, Homo Sapiens
HVSKISQAD

SEQ ID NO: 1136978 - protein, 9 aa, Homo Sapiens
RGSMLSAAI

SEQ ID NO: 1136979 - protein, 9 aa, Homo Sapiens
TWNFCDIGY

SEQ ID NO: 1136980 - protein, 9 aa, Homo Sapiens
NAHDALAKH

SEQ ID NO: 1136981 - protein, 9 aa, Homo Sapiens
GLTDYPEFR

SEQ ID NO: 1136982 - protein, 9 aa, Homo Sapiens
RGNEQISKE

SEQ ID NO: 1136983 - protein, 9 aa, Homo Sapiens
CGIHGMFPL

SEQ ID NO: 1136984 - protein, 9 aa, Homo Sapiens
PPHPTRMSH

SEQ ID NO: 1136985 - protein, 9 aa, Homo Sapiens
SSEKREKDQ

SEQ ID NO: 1136986 - protein, 9 aa, Homo Sapiens
QKQASDSDS

SEQ ID NO: 1136987 - protein, 9 aa, Homo Sapiens
VPRCPWPSA

SEQ ID NO: 1136988 - protein, 9 aa, Homo Sapiens
DEENCVLVT

SEQ ID NO: 1136989 - protein, 9 aa, Homo Sapiens
DSPGIPPAL

SEQ ID NO: 1136990 - protein, 9 aa, Homo Sapiens
GRLGHGLVT

SEQ ID NO: 1136991 - protein, 9 aa, Homo Sapiens
NRHVALATI

SEQ ID NO: 1136992 - protein, 9 aa, Homo Sapiens
PPDCGHPLL

SEQ ID NO: 1136993 - protein, 9 aa, Homo Sapiens
SPPRLCVKA

SEQ ID NO: 1136994 - protein, 9 aa, Homo Sapiens
PRPHSRGPQ

SEQ ID NO: 1136995 - protein, 9 aa, Homo Sapiens
MAAMIFKRG

SEQ ID NO: 1136996 - protein, 9 aa, Homo Sapiens
IGGNTPVIL

SEQ ID NO: 1136997 - protein, 9 aa, Homo Sapiens
LKEDLLYLR

SEQ ID NO: 1136998 - protein, 9 aa, Homo Sapiens
LCPMGSCVC

SEQ ID NO: 1136999 - protein, 9 aa, Homo Sapiens
TKSQSEKHR

SEQ ID NO: 1137000 - protein, 9 aa, Homo Sapiens
IHVTFTKDN

SEQ ID NO: 1137001 - protein, 9 aa, Homo Sapiens
LVGGQVGHG

SEQ ID NO: 1137002 - protein, 9 aa, Homo Sapiens
SEGKILVRK

SEQ ID NO: 1137003 - protein, 9 aa, Homo Sapiens
GGVCGPRVV

SEQ ID NO: 1137004 - protein, 9 aa, Homo Sapiens
FPLSSMAVS

SEQ ID NO: 1137005 - protein, 9 aa, Homo Sapiens
MMVVHNIYV

SEQ ID NO: 1137006 - protein, 9 aa, Homo Sapiens
YFLPFPPWK

SEQ ID NO: 1137007 - protein, 9 aa, Homo Sapiens
ETCFICHSC

SEQ ID NO: 1137008 - protein, 9 aa, Homo Sapiens
IHHLKKTFT

SEQ ID NO: 1137009 - protein, 9 aa, Homo Sapiens
YLAPPITDL

SEQ ID NO: 1137010 - protein, 9 aa, Homo Sapiens
MAYLTEFVE

SEQ ID NO: 1137011 - protein, 9 aa, Homo Sapiens
VGGEITDDL

SEQ ID NO: 1137012 - protein, 9 aa, Homo Sapiens
PTPAVGGEL

SEQ ID NO: 1137013 - protein, 9 aa, Homo Sapiens
NGEHPEASG

SEQ ID NO: 1137014 - protein, 9 aa, Homo Sapiens
HRSEFEHCV

SEQ ID NO: 1137015 - protein, 9 aa, Homo Sapiens
ATQARGSGS

SEQ ID NO: 1137016 - protein, 9 aa, Homo Sapiens
IHRESFFYT

SEQ ID NO: 1137017 - protein, 9 aa, Homo Sapiens
EKHPFDFDF

SEQ ID NO: 1137018 - protein, 9 aa, Homo Sapiens
IEATKKLKV

SEQ ID NO: 1137019 - protein, 9 aa, Homo Sapiens
SRAGGTRLT

SEQ ID NO: 1137020 - protein, 9 aa, Homo Sapiens
RSIYLGDSE

SEQ ID NO: 1137021 - protein, 9 aa, Homo Sapiens
ALFIWPQHS

SEQ ID NO: 1137022 - protein, 9 aa, Homo Sapiens
LDSNLSEDE

SEQ ID NO: 1137023 - protein, 9 aa, Homo Sapiens
CRGTHVYQG

SEQ ID NO: 1137024 - protein, 9 aa, Homo Sapiens
QGAQGLVQG

SEQ ID NO: 1137025 - protein, 9 aa, Homo Sapiens
DMGGAITFK

SEQ ID NO: 1137026 - protein, 9 aa, Homo Sapiens
FNMKKSLCQ

SEQ ID NO: 1137027 - protein, 9 aa, Homo Sapiens
SFLEKIILY

SEQ ID NO: 1137028 - protein, 9 aa, Homo Sapiens
NDGSMDAAK

SEQ ID NO: 1137029 - protein, 9 aa, Homo Sapiens
RTRSPRRPR

SEQ ID NO: 1137030 - protein, 9 aa, Homo Sapiens
QRELDESLQ

SEQ ID NO: 1137031 - protein, 9 aa, Homo Sapiens
GLQKELTII

SEQ ID NO: 1137032 - protein, 9 aa, Homo Sapiens
LVPTDSHEE

SEQ ID NO: 1137033 - protein, 9 aa, Homo Sapiens
CSDFSNKKA

SEQ ID NO: 1137034 - protein, 9 aa, Homo Sapiens
AMLLDTDYD

SEQ ID NO: 1137035 - protein, 9 aa, Homo Sapiens
TMRKRMSKN

SEQ ID NO: 1137036 - protein, 9 aa, Homo Sapiens
KVFKVLKSL

SEQ ID NO: 1137037 - protein, 9 aa, Homo Sapiens
DEVPPIKKI

SEQ ID NO: 1137038 - protein, 9 aa, Homo Sapiens
TRPSGLLAQ

SEQ ID NO: 1137039 - protein, 9 aa, Homo Sapiens
RTIKMRKEA

SEQ ID NO: 1137040 - protein, 9 aa, Homo Sapiens
PSAEPSTRW

SEQ ID NO: 1137041 - protein, 9 aa, Homo Sapiens
DAHMLDHLT

SEQ ID NO: 1137042 - protein, 9 aa, Homo Sapiens
WYCLTSPPG

SEQ ID NO: 1137043 - protein, 9 aa, Homo Sapiens
SRRCLLPTT

SEQ ID NO: 1137044 - protein, 9 aa, Homo Sapiens
GTTDLLQER

SEQ ID NO: 1137045 - protein, 9 aa, Homo Sapiens
MLKKVVRLA

SEQ ID NO: 1137046 - protein, 9 aa, Homo Sapiens
KTKSEKLAG

SEQ ID NO: 1137047 - protein, 9 aa, Homo Sapiens
ICIESCKLY

SEQ ID NO: 1137048 - protein, 9 aa, Homo Sapiens
LHIIFGGTK

SEQ ID NO: 1137049 - protein, 9 aa, Homo Sapiens
QGLEELCPM

SEQ ID NO: 1137050 - protein, 9 aa, Homo Sapiens
QDAEQQLEF

SEQ ID NO: 1137051 - protein, 9 aa, Homo Sapiens
RHNETGSIL

SEQ ID NO: 1137052 - protein, 9 aa, Homo Sapiens
AAHTIQTAF

SEQ ID NO: 1137053 - protein, 9 aa, Homo Sapiens
KLAQKEHHI

SEQ ID NO: 1137054 - protein, 9 aa, Homo Sapiens
DIDVGFDKD

SEQ ID NO: 1137055 - protein, 9 aa, Homo Sapiens
AWAALGSCV

SEQ ID NO: 1137056 - protein, 9 aa, Homo Sapiens
TCVDPYLFP

SEQ ID NO: 1137057 - protein, 9 aa, Homo Sapiens
FFCSECGKA

SEQ ID NO: 1137058 - protein, 9 aa, Homo Sapiens
RLDACESLT

SEQ ID NO: 1137059 - protein, 9 aa, Homo Sapiens
CSIEVTCKS

SEQ ID NO: 1137060 - protein, 9 aa, Homo Sapiens
RCKLATFYR

SEQ ID NO: 1137061 - protein, 9 aa, Homo Sapiens
AELDDGMDS

SEQ ID NO: 1137062 - protein, 9 aa, Homo Sapiens
SESMVYSRC

SEQ ID NO: 1137063 - protein, 9 aa, Homo Sapiens
VKDIQRGNV

SEQ ID NO: 1137064 - protein, 9 aa, Homo Sapiens
DTMDTVDIA

SEQ ID NO: 1137065 - protein, 9 aa, Homo Sapiens
TESCEGDSG

SEQ ID NO: 1137066 - protein, 9 aa, Homo Sapiens
GGTWPCPQC

SEQ ID NO: 1137067 - protein, 9 aa, Homo Sapiens
VVPCMIHLL

SEQ ID NO: 1137068 - protein, 9 aa, Homo Sapiens
LNNSYLKVL

SEQ ID NO: 1137069 - protein, 9 aa, Homo Sapiens
AMVGGLTAG

SEQ ID NO: 1137070 - protein, 9 aa, Homo Sapiens
AVCLLCWMP

SEQ ID NO: 1137071 - protein, 9 aa, Homo Sapiens
REEKAPWKT

SEQ ID NO: 1137072 - protein, 9 aa, Homo Sapiens
WCSSSVRHR

SEQ ID NO: 1137073 - protein, 9 aa, Homo Sapiens
AHDALAKHI

SEQ ID NO: 1137074 - protein, 9 aa, Homo Sapiens
ESSSPMVMS

SEQ ID NO: 1137075 - protein, 9 aa, Homo Sapiens
HVNVPFITG

SEQ ID NO: 1137076 - protein, 9 aa, Homo Sapiens
ACRPACTCI

SEQ ID NO: 1137077 - protein, 9 aa, Homo Sapiens
AIMATPVSR

SEQ ID NO: 1137078 - protein, 9 aa, Homo Sapiens
PPVVVPTRH

SEQ ID NO: 1137079 - protein, 9 aa, Homo Sapiens
ANARERAHM

SEQ ID NO: 1137080 - protein, 9 aa, Homo Sapiens
LDRRGGPGQ

SEQ ID NO: 1137081 - protein, 9 aa, Homo Sapiens
IMCCTNATG

SEQ ID NO: 1137082 - protein, 9 aa, Homo Sapiens
LHQQAGRIL

SEQ ID NO: 1137083 - protein, 9 aa, Homo Sapiens
TQERMTQAE

SEQ ID NO: 1137084 - protein, 9 aa, Homo Sapiens
VVADAEAGS

SEQ ID NO: 1137085 - protein, 9 aa, Homo Sapiens
GNLRSLLPP

SEQ ID NO: 1137086 - protein, 9 aa, Homo Sapiens
SFELDNVFS

SEQ ID NO: 1137087 - protein, 9 aa, Homo Sapiens
LGYGAAFSA

SEQ ID NO: 1137088 - protein, 9 aa, Homo Sapiens
KNITWGQSL

SEQ ID NO: 1137089 - protein, 9 aa, Homo Sapiens
ALDGYNGTT

SEQ ID NO: 1137090 - protein, 9 aa, Homo Sapiens
GQRASPGPQ

SEQ ID NO: 1137091 - protein, 9 aa, Homo Sapiens
SVLELTQKA

SEQ ID NO: 1137092 - protein, 9 aa, Homo Sapiens
VNVSQRKQY

SEQ ID NO: 1137093 - protein, 9 aa, Homo Sapiens
SFYVFNHHG

SEQ ID NO: 1137094 - protein, 9 aa, Homo Sapiens
FGWARVTLV

SEQ ID NO: 1137095 - protein, 9 aa, Homo Sapiens
VTDKSQEGF

SEQ ID NO: 1137096 - protein, 9 aa, Homo Sapiens
PDNSNIGTA

SEQ ID NO: 1137097 - protein, 9 aa, Homo Sapiens
VRMGCVRRR

SEQ ID NO: 1137098 - protein, 9 aa, Homo Sapiens
APDMKSYLW

SEQ ID NO: 1137099 - protein, 9 aa, Homo Sapiens
NHFLFFVKS

SEQ ID NO: 1137100 - protein, 9 aa, Homo Sapiens
PNLEYFSPA

SEQ ID NO: 1137101 - protein, 9 aa, Homo Sapiens
YQREAPQVS

SEQ ID NO: 1137102 - protein, 9 aa, Homo Sapiens
NSYLKVLQW

SEQ ID NO: 1137103 - protein, 9 aa, Homo Sapiens
WGFWGWCLG

SEQ ID NO: 1137104 - protein, 9 aa, Homo Sapiens
GLSSRRRRC

SEQ ID NO: 1137105 - protein, 9 aa, Homo Sapiens
LNQIAMTIV

SEQ ID NO: 1137106 - protein, 9 aa, Homo Sapiens
RILRRLVSY

SEQ ID NO: 1137107 - protein, 9 aa, Homo Sapiens
RTQQGMPAF

SEQ ID NO: 1137108 - protein, 9 aa, Homo Sapiens
PGFFLSRAP

SEQ ID NO: 1137109 - protein, 9 aa, Homo Sapiens
WRGCRGTTL

SEQ ID NO: 1137110 - protein, 9 aa, Homo Sapiens
QLVDHAGRQ

SEQ ID NO: 1137111 - protein, 9 aa, Homo Sapiens
SKRASRPTS

SEQ ID NO: 1137112 - protein, 9 aa, Homo Sapiens
AVIQALRKM

SEQ ID NO: 1137113 - protein, 9 aa, Homo Sapiens
GIAPDVVLR

SEQ ID NO: 1137114 - protein, 9 aa, Homo Sapiens
CLFSPFAGC

SEQ ID NO: 1137115 - protein, 9 aa, Homo Sapiens
SVATAPVPA

SEQ ID NO: 1137116 - protein, 9 aa, Homo Sapiens
AYYNMANGT

SEQ ID NO: 1137117 - protein, 9 aa, Homo Sapiens
LQERGDHDL

SEQ ID NO: 1137118 - protein, 9 aa, Homo Sapiens
RLHSAEQDT

SEQ ID NO: 1137119 - protein, 9 aa, Homo Sapiens
RFNQMRERE

SEQ ID NO: 1137120 - protein, 9 aa, Homo Sapiens
PTPLSASGL

SEQ ID NO: 1137121 - protein, 9 aa, Homo Sapiens
EIGTTAAGI

SEQ ID NO: 1137122 - protein, 9 aa, Homo Sapiens
IPLVPLISL

SEQ ID NO: 1137123 - protein, 9 aa, Homo Sapiens
SFFVVVAVD

SEQ ID NO: 1137124 - protein, 9 aa, Homo Sapiens
PGRMHRIGE

SEQ ID NO: 1137125 - protein, 9 aa, Homo Sapiens
QQGKEVGEA

SEQ ID NO: 1137126 - protein, 9 aa, Homo Sapiens
HSDLIYLCR

SEQ ID NO: 1137127 - protein, 9 aa, Homo Sapiens
ATTSPPTSA

SEQ ID NO: 1137128 - protein, 9 aa, Homo Sapiens
KVRLSPVKM

SEQ ID NO: 1137129 - protein, 9 aa, Homo Sapiens
KARIFADCE

SEQ ID NO: 1137130 - protein, 9 aa, Homo Sapiens
KFAGTLSDD

SEQ ID NO: 1137131 - protein, 9 aa, Homo Sapiens
PATGSYGAT

SEQ ID NO: 1137132 - protein, 9 aa, Homo Sapiens
LASQEGAQY

SEQ ID NO: 1137133 - protein, 9 aa, Homo Sapiens
FISPSILYV

SEQ ID NO: 1137134 - protein, 9 aa, Homo Sapiens
VGKGHFAEV

SEQ ID NO: 1137135 - protein, 9 aa, Homo Sapiens
TSWVSLVSR

SEQ ID NO: 1137136 - protein, 9 aa, Homo Sapiens
YECEMFDKA

SEQ ID NO: 1137137 - protein, 9 aa, Homo Sapiens
THIRPSHKD

SEQ ID NO: 1137138 - protein, 9 aa, Homo Sapiens
DLDVGLNSL

SEQ ID NO: 1137139 - protein, 9 aa, Homo Sapiens
LASGTAGST

SEQ ID NO: 1137140 - protein, 9 aa, Homo Sapiens
RVRGERLPD

SEQ ID NO: 1137141 - protein, 9 aa, Homo Sapiens
VEIRCHIDN

SEQ ID NO: 1137142 - protein, 9 aa, Homo Sapiens
MLTWLVFLA

SEQ ID NO: 1137143 - protein, 9 aa, Homo Sapiens
LCRCQETIT

SEQ ID NO: 1137144 - protein, 9 aa, Homo Sapiens
LFPWKLPGP

SEQ ID NO: 1137145 - protein, 9 aa, Homo Sapiens
KGCNRGPDG

SEQ ID NO: 1137146 - protein, 9 aa, Homo Sapiens
LPTSLSVDD

SEQ ID NO: 1137147 - protein, 9 aa, Homo Sapiens
CNPGYVGIG

SEQ ID NO: 1137148 - protein, 9 aa, Homo Sapiens
FEAGHEPIC

SEQ ID NO: 1137149 - protein, 9 aa, Homo Sapiens
HGHEAETLA

SEQ ID NO: 1137150 - protein, 9 aa, Homo Sapiens
EPGCLVTKV

SEQ ID NO: 1137151 - protein, 9 aa, Homo Sapiens
VPTLLESEL

SEQ ID NO: 1137152 - protein, 9 aa, Homo Sapiens
FRFSYKLKM

SEQ ID NO: 1137153 - protein, 9 aa, Homo Sapiens
PLAVTGSDG

SEQ ID NO: 1137154 - protein, 9 aa, Homo Sapiens
TAQIQRPIQ

SEQ ID NO: 1137155 - protein, 9 aa, Homo Sapiens
AFFMNLTRE

SEQ ID NO: 1137156 - protein, 9 aa, Homo Sapiens
RTNYVIDKS

SEQ ID NO: 1137157 - protein, 9 aa, Homo Sapiens
PLESLYQAV

SEQ ID NO: 1137158 - protein, 9 aa, Homo Sapiens
RVHAVYRRP

SEQ ID NO: 1137159 - protein, 9 aa, Homo Sapiens
NMLGADLRH

SEQ ID NO: 1137160 - protein, 9 aa, Homo Sapiens
HALAQAIAV

SEQ ID NO: 1137161 - protein, 9 aa, Homo Sapiens
ARIYYAISK

SEQ ID NO: 1137162 - protein, 9 aa, Homo Sapiens
QALAELSTV

SEQ ID NO: 1137163 - protein, 9 aa, Homo Sapiens
PLDNSTDDA

SEQ ID NO: 1137164 - protein, 9 aa, Homo Sapiens
SKLMFDFQM

SEQ ID NO: 1137165 - protein, 9 aa, Homo Sapiens
QGKLGPKEE

SEQ ID NO: 1137166 - protein, 9 aa, Homo Sapiens
ENLVTSGTS

SEQ ID NO: 1137167 - protein, 9 aa, Homo Sapiens
ASIIKKTSD

SEQ ID NO: 1137168 - protein, 9 aa, Homo Sapiens
GPPTSLPDC

SEQ ID NO: 1137169 - protein, 9 aa, Homo Sapiens
RSGTWKRVH

SEQ ID NO: 1137170 - protein, 9 aa, Homo Sapiens
RNVSFILPN

SEQ ID NO: 1137171 - protein, 9 aa, Homo Sapiens
EYFSPAFYT

SEQ ID NO: 1137172 - protein, 9 aa, Homo Sapiens
KNLVACPDL

SEQ ID NO: 1137173 - protein, 9 aa, Homo Sapiens
MDSHRSSQD

SEQ ID NO: 1137174 - protein, 9 aa, Homo Sapiens
QLEEEQRKA

SEQ ID NO: 1137175 - protein, 9 aa, Homo Sapiens
VSSDVHRFS

SEQ ID NO: 1137176 - protein, 9 aa, Homo Sapiens
TVEWTQDSE

SEQ ID NO: 1137177 - protein, 9 aa, Homo Sapiens
IHLMERKTA

SEQ ID NO: 1137178 - protein, 9 aa, Homo Sapiens
SPTRPPGPS

SEQ ID NO: 1137179 - protein, 9 aa, Homo Sapiens
ESDQACDTM

SEQ ID NO: 1137180 - protein, 9 aa, Homo Sapiens
VREELQKKQ

SEQ ID NO: 1137181 - protein, 9 aa, Homo Sapiens
VNDYDELVA

SEQ ID NO: 1137182 - protein, 9 aa, Homo Sapiens
KIVQMSILG

SEQ ID NO: 1137183 - protein, 9 aa, Homo Sapiens
PVPRSLRLS

SEQ ID NO: 1137184 - protein, 9 aa, Homo Sapiens
ANAAVASSS

SEQ ID NO: 1137185 - protein, 9 aa, Homo Sapiens
GQRMLVGDG

SEQ ID NO: 1137186 - protein, 9 aa, Homo Sapiens
TWARTRSRR

SEQ ID NO: 1137187 - protein, 9 aa, Homo Sapiens
ASTTHTSSY

SEQ ID NO: 1137188 - protein, 9 aa, Homo Sapiens
GERAPRTPR

SEQ ID NO: 1137189 - protein, 9 aa, Homo Sapiens
LFCEMVERA

SEQ ID NO: 1137190 - protein, 9 aa, Homo Sapiens
TRSYNWNID

SEQ ID NO: 1137191 - protein, 9 aa, Homo Sapiens
TCTDLLSHQ

SEQ ID NO: 1137192 - protein, 9 aa, Homo Sapiens
VKAKVRQYL

SEQ ID NO: 1137193 - protein, 9 aa, Homo Sapiens
LVPKLQRRQ

SEQ ID NO: 1137194 - protein, 9 aa, Homo Sapiens
TQGQLYEVL

SEQ ID NO: 1137195 - protein, 9 aa, Homo Sapiens
SDETFGPNI

SEQ ID NO: 1137196 - protein, 9 aa, Homo Sapiens
HSVVCMTNH

SEQ ID NO: 1137197 - protein, 9 aa, Homo Sapiens
TGAHRPSLA

SEQ ID NO: 1137198 - protein, 9 aa, Homo Sapiens
TFNKELDPI

SEQ ID NO: 1137199 - protein, 9 aa, Homo Sapiens
CIAWFTREL

SEQ ID NO: 1137200 - protein, 9 aa, Homo Sapiens
SSWLPERHG

SEQ ID NO: 1137201 - protein, 9 aa, Homo Sapiens
NKDPTQWIV

SEQ ID NO: 1137202 - protein, 9 aa, Homo Sapiens
PGHKTNQLQ

SEQ ID NO: 1137203 - protein, 9 aa, Homo Sapiens
SRSSYMDTE

SEQ ID NO: 1137204 - protein, 9 aa, Homo Sapiens
KMHRFYHIE

SEQ ID NO: 1137205 - protein, 9 aa, Homo Sapiens
LRLTYNHFH

SEQ ID NO: 1137206 - protein, 9 aa, Homo Sapiens
PKKRKTGVA

SEQ ID NO: 1137207 - protein, 9 aa, Homo Sapiens
PAPRPTHPL

SEQ ID NO: 1137208 - protein, 9 aa, Homo Sapiens
GDTEARKTG

SEQ ID NO: 1137209 - protein, 9 aa, Homo Sapiens
TSPLLEDLR

SEQ ID NO: 1137210 - protein, 9 aa, Homo Sapiens
VTLEDGQIG

SEQ ID NO: 1137211 - protein, 9 aa, Homo Sapiens
KNNPVHTLS

SEQ ID NO: 1137212 - protein, 9 aa, Homo Sapiens
IQKKKIRKQ

SEQ ID NO: 1137213 - protein, 9 aa, Homo Sapiens
LSQDSSTWL

SEQ ID NO: 1137214 - protein, 9 aa, Homo Sapiens
PEGQYLHPG

SEQ ID NO: 1137215 - protein, 9 aa, Homo Sapiens
EVIVLFCEM

SEQ ID NO: 1137216 - protein, 9 aa, Homo Sapiens
NLTPGAFHG

SEQ ID NO: 1137217 - protein, 9 aa, Homo Sapiens
FCELCTEDF

SEQ ID NO: 1137218 - protein, 9 aa, Homo Sapiens
PTSLPDCRL

SEQ ID NO: 1137219 - protein, 9 aa, Homo Sapiens
SVLVPGFPC

SEQ ID NO: 1137220 - protein, 9 aa, Homo Sapiens
TTDLLQERF

SEQ ID NO: 1137221 - protein, 9 aa, Homo Sapiens
SAVMPCPML

SEQ ID NO: 1137222 - protein, 9 aa, Homo Sapiens
SPPTLMMSN

SEQ ID NO: 1137223 - protein, 9 aa, Homo Sapiens
EPSQAAAAE

SEQ ID NO: 1137224 - protein, 9 aa, Homo Sapiens
DEEHYAEQL

SEQ ID NO: 1137225 - protein, 9 aa, Homo Sapiens
ETLESGGAS

SEQ ID NO: 1137226 - protein, 9 aa, Homo Sapiens
LEGGLGPHV

SEQ ID NO: 1137227 - protein, 9 aa, Homo Sapiens
TAVNVFELT

SEQ ID NO: 1137228 - protein, 9 aa, Homo Sapiens
GTASCLRTG

SEQ ID NO: 1137229 - protein, 9 aa, Homo Sapiens
APQTKGKGG

SEQ ID NO: 1137230 - protein, 9 aa, Homo Sapiens
ISCIRGKKQ

SEQ ID NO: 1137231 - protein, 9 aa, Homo Sapiens
NLHTLTILK

SEQ ID NO: 1137232 - protein, 9 aa, Homo Sapiens
GSQGALFGR

SEQ ID NO: 1137233 - protein, 9 aa, Homo Sapiens
PCIMVSEIQ

SEQ ID NO: 1137234 - protein, 9 aa, Homo Sapiens
TASAATSRG

SEQ ID NO: 1137235 - protein, 9 aa, Homo Sapiens
FPWKLPGPR

SEQ ID NO: 1137236 - protein, 9 aa, Homo Sapiens
SGSSTLACS

SEQ ID NO: 1137237 - protein, 9 aa, Homo Sapiens
SSGLGFSFL

SEQ ID NO: 1137238 - protein, 9 aa, Homo Sapiens
THTGSNIDC

SEQ ID NO: 1137239 - protein, 9 aa, Homo Sapiens
KERRCNSIN

SEQ ID NO: 1137240 - protein, 9 aa, Homo Sapiens
PAPDNFLDK

SEQ ID NO: 1137241 - protein, 9 aa, Homo Sapiens
LLLWRANTD

SEQ ID NO: 1137242 - protein, 9 aa, Homo Sapiens
HWGADAAEA

SEQ ID NO: 1137243 - protein, 9 aa, Homo Sapiens
QMQHASGQK

SEQ ID NO: 1137244 - protein, 9 aa, Homo Sapiens
VSFELDNVF

SEQ ID NO: 1137245 - protein, 9 aa, Homo Sapiens
VRSLSKKER

SEQ ID NO: 1137246 - protein, 9 aa, Homo Sapiens
EPTPAGSST

SEQ ID NO: 1137247 - protein, 9 aa, Homo Sapiens
MGTIKLTPG

SEQ ID NO: 1137248 - protein, 9 aa, Homo Sapiens
LGRSSHRHR

SEQ ID NO: 1137249 - protein, 9 aa, Homo Sapiens
GQVGFGPML

SEQ ID NO: 1137250 - protein, 9 aa, Homo Sapiens
AVWISGIWH

SEQ ID NO: 1137251 - protein, 9 aa, Homo Sapiens
YFNASQTCV

SEQ ID NO: 1137252 - protein, 9 aa, Homo Sapiens
TYAVRLAVL

SEQ ID NO: 1137253 - protein, 9 aa, Homo Sapiens
MVRTAYLDL

SEQ ID NO: 1137254 - protein, 9 aa, Homo Sapiens
KSQEGFQFV

SEQ ID NO: 1137255 - protein, 9 aa, Homo Sapiens
DVESLVQLK

SEQ ID NO: 1137256 - protein, 9 aa, Homo Sapiens
MLRRTQALP

SEQ ID NO: 1137257 - protein, 9 aa, Homo Sapiens
VQLVSGVYF

SEQ ID NO: 1137258 - protein, 9 aa, Homo Sapiens
VCRPFLKLC

SEQ ID NO: 1137259 - protein, 9 aa, Homo Sapiens
ILTVNRPVV

SEQ ID NO: 1137260 - protein, 9 aa, Homo Sapiens
QYLQERRTV

SEQ ID NO: 1137261 - protein, 9 aa, Homo Sapiens
NMRMEHIAD

SEQ ID NO: 1137262 - protein, 9 aa, Homo Sapiens
AVVKLEAIF

SEQ ID NO: 1137263 - protein, 9 aa, Homo Sapiens
CDTYKDSFI

SEQ ID NO: 1137264 - protein, 9 aa, Homo Sapiens
TLISPVCLA

SEQ ID NO: 1137265 - protein, 9 aa, Homo Sapiens
AALVYKCLA

SEQ ID NO: 1137266 - protein, 9 aa, Homo Sapiens
VVVEGVHGP

SEQ ID NO: 1137267 - protein, 9 aa, Homo Sapiens
THQKLKESL

SEQ ID NO: 1137268 - protein, 9 aa, Homo Sapiens
ARQPTPAVG

SEQ ID NO: 1137269 - protein, 9 aa, Homo Sapiens
MRTSQKDVW

SEQ ID NO: 1137270 - protein, 9 aa, Homo Sapiens
CRPTTVRKA

SEQ ID NO: 1137271 - protein, 9 aa, Homo Sapiens
QGTACLLAE

SEQ ID NO: 1137272 - protein, 9 aa, Homo Sapiens
GTWCSSSVR

SEQ ID NO: 1137273 - protein, 9 aa, Homo Sapiens
PERHGLGKD

SEQ ID NO: 1137274 - protein, 9 aa, Homo Sapiens
SSTSRDSRS

SEQ ID NO: 1137275 - protein, 9 aa, Homo Sapiens
QVTISQQLS

SEQ ID NO: 1137276 - protein, 9 aa, Homo Sapiens
VEHELHVAG

SEQ ID NO: 1137277 - protein, 9 aa, Homo Sapiens
FWQRITQGF

SEQ ID NO: 1137278 - protein, 9 aa, Homo Sapiens
ACRPGPTES

SEQ ID NO: 1137279 - protein, 9 aa, Homo Sapiens
SPPTSAPTQ

SEQ ID NO: 1137280 - protein, 9 aa, Homo Sapiens
WTKLWCMLK

SEQ ID NO: 1137281 - protein, 9 aa, Homo Sapiens
EYRNHWSDM

SEQ ID NO: 1137282 - protein, 9 aa, Homo Sapiens
HRDREPDTS

SEQ ID NO: 1137283 - protein, 9 aa, Homo Sapiens
VVIRRERAG

SEQ ID NO: 1137284 - protein, 9 aa, Homo Sapiens
KVAQAKLTG

SEQ ID NO: 1137285 - protein, 9 aa, Homo Sapiens
ECGKCFSQC

SEQ ID NO: 1137286 - protein, 9 aa, Homo Sapiens
CSLVGIWNT

SEQ ID NO: 1137287 - protein, 9 aa, Homo Sapiens
KMCVSLAVS

SEQ ID NO: 1137288 - protein, 9 aa, Homo Sapiens
IRYVKWHLT

SEQ ID NO: 1137289 - protein, 9 aa, Homo Sapiens
KHGKALWEM

SEQ ID NO: 1137290 - protein, 9 aa, Homo Sapiens
NVLKKSRRR

SEQ ID NO: 1137291 - protein, 9 aa, Homo Sapiens
DGPQQALDL

SEQ ID NO: 1137292 - protein, 9 aa, Homo Sapiens
PPQASLLCF

SEQ ID NO: 1137293 - protein, 9 aa, Homo Sapiens
RVISDERGW

SEQ ID NO: 1137294 - protein, 9 aa, Homo Sapiens
TTLYRKMLD

SEQ ID NO: 1137295 - protein, 9 aa, Homo Sapiens
EDAQQPAKP

SEQ ID NO: 1137296 - protein, 9 aa, Homo Sapiens
RRVRPGRPS

SEQ ID NO: 1137297 - protein, 9 aa, Homo Sapiens
CLAAISDFY

SEQ ID NO: 1137298 - protein, 9 aa, Homo Sapiens
MPYHLSTVV

SEQ ID NO: 1137299 - protein, 9 aa, Homo Sapiens
PQSPRTKSL

SEQ ID NO: 1137300 - protein, 9 aa, Homo Sapiens
SRMSYSWAG

SEQ ID NO: 1137301 - protein, 9 aa, Homo Sapiens
RGSAQPQAM

SEQ ID NO: 1137302 - protein, 9 aa, Homo Sapiens
PDEEKPQAS

SEQ ID NO: 1137303 - protein, 9 aa, Homo Sapiens
CDFYHTCYC

SEQ ID NO: 1137304 - protein, 9 aa, Homo Sapiens
EATDYCSGS

SEQ ID NO: 1137305 - protein, 9 aa, Homo Sapiens
LCYGCGPWF

SEQ ID NO: 1137306 - protein, 9 aa, Homo Sapiens
PVPTATAAS

SEQ ID NO: 1137307 - protein, 9 aa, Homo Sapiens
MLINLMVLD

SEQ ID NO: 1137308 - protein, 9 aa, Homo Sapiens
FNSDDRNTS

SEQ ID NO: 1137309 - protein, 9 aa, Homo Sapiens
RLGAARSPL

SEQ ID NO: 1137310 - protein, 9 aa, Homo Sapiens
AHDSTLLVL

SEQ ID NO: 1137311 - protein, 9 aa, Homo Sapiens
EDSPPRGRS

SEQ ID NO: 1137312 - protein, 9 aa, Homo Sapiens
QEDKKIQDQ

SEQ ID NO: 1137313 - protein, 9 aa, Homo Sapiens
NKVRNHRIF

SEQ ID NO: 1137314 - protein, 9 aa, Homo Sapiens
TPIFVKAAR

SEQ ID NO: 1137315 - protein, 9 aa, Homo Sapiens
NHDKNRFMG

SEQ ID NO: 1137316 - protein, 9 aa, Homo Sapiens
AAMGGGSGN

SEQ ID NO: 1137317 - protein, 9 aa, Homo Sapiens
GRILLQRNL

SEQ ID NO: 1137318 - protein, 9 aa, Homo Sapiens
VSLVEIEFI

SEQ ID NO: 1137319 - protein, 9 aa, Homo Sapiens
EDRAGPAPQ

SEQ ID NO: 1137320 - protein, 9 aa, Homo Sapiens
DIEKIHRES

SEQ ID NO: 1137321 - protein, 9 aa, Homo Sapiens
MVPPLPDSE

SEQ ID NO: 1137322 - protein, 9 aa, Homo Sapiens
IEKTCEKPG

SEQ ID NO: 1137323 - protein, 9 aa, Homo Sapiens
EFFGNCFIQ

SEQ ID NO: 1137324 - protein, 9 aa, Homo Sapiens
RLGAPVLLA

SEQ ID NO: 1137325 - protein, 9 aa, Homo Sapiens
LENINHLVS

SEQ ID NO: 1137326 - protein, 9 aa, Homo Sapiens
TQRIPIPPP

SEQ ID NO: 1137327 - protein, 9 aa, Homo Sapiens
MQRLLERPY

SEQ ID NO: 1137328 - protein, 9 aa, Homo Sapiens
SRFRRRCWH

SEQ ID NO: 1137329 - protein, 9 aa, Homo Sapiens
RSMVDSLDI

SEQ ID NO: 1137330 - protein, 9 aa, Homo Sapiens
PHHPFQGSY

SEQ ID NO: 1137331 - protein, 9 aa, Homo Sapiens
GIGFCRNVS

SEQ ID NO: 1137332 - protein, 9 aa, Homo Sapiens
IKHQKSGRV

SEQ ID NO: 1137333 - protein, 9 aa, Homo Sapiens
NDGGHDGET

SEQ ID NO: 1137334 - protein, 9 aa, Homo Sapiens
PCLSESDAP

SEQ ID NO: 1137335 - protein, 9 aa, Homo Sapiens
GTDGGGGAA

SEQ ID NO: 1137336 - protein, 9 aa, Homo Sapiens
HDQGHGHQR

SEQ ID NO: 1137337 - protein, 9 aa, Homo Sapiens
MSKMNKNRQ

SEQ ID NO: 1137338 - protein, 9 aa, Homo Sapiens
GVPQLLIIL

SEQ ID NO: 1137339 - protein, 9 aa, Homo Sapiens
GGPSWRTRR

SEQ ID NO: 1137340 - protein, 9 aa, Homo Sapiens
WLTDPIPLP

SEQ ID NO: 1137341 - protein, 9 aa, Homo Sapiens
KTPDFLLLQ

SEQ ID NO: 1137342 - protein, 9 aa, Homo Sapiens
KRSKKSHKK

SEQ ID NO: 1137343 - protein, 9 aa, Homo Sapiens
GGGSGGGST

SEQ ID NO: 1137344 - protein, 9 aa, Homo Sapiens
GRKTMRPSL

SEQ ID NO: 1137345 - protein, 9 aa, Homo Sapiens
MCKLYTGLY

SEQ ID NO: 1137346 - protein, 9 aa, Homo Sapiens
NQCQIEPVK

SEQ ID NO: 1137347 - protein, 9 aa, Homo Sapiens
FSTSLWVVT

SEQ ID NO: 1137348 - protein, 9 aa, Homo Sapiens
TQWGKSHSI

SEQ ID NO: 1137349 - protein, 9 aa, Homo Sapiens
AMTMYYQVV

SEQ ID NO: 1137350 - protein, 9 aa, Homo Sapiens
LQSQHDEQV

SEQ ID NO: 1137351 - protein, 9 aa, Homo Sapiens
PHPARTLAR

SEQ ID NO: 1137352 - protein, 9 aa, Homo Sapiens
KNHRWHWSS

SEQ ID NO: 1137353 - protein, 9 aa, Homo Sapiens
YVKTISPLR

SEQ ID NO: 1137354 - protein, 9 aa, Homo Sapiens
PFAITLWQM

SEQ ID NO: 1137355 - protein, 9 aa, Homo Sapiens
AFISPSILY

SEQ ID NO: 1137356 - protein, 9 aa, Homo Sapiens
REIFRNEML

SEQ ID NO: 1137357 - protein, 9 aa, Homo Sapiens
SFSEGAYIP

SEQ ID NO: 1137358 - protein, 9 aa, Homo Sapiens
GKTVIRVLE

SEQ ID NO: 1137359 - protein, 9 aa, Homo Sapiens
LRSPSCPRR

SEQ ID NO: 1137360 - protein, 9 aa, Homo Sapiens
PVKAPTSQV

SEQ ID NO: 1137361 - protein, 9 aa, Homo Sapiens
QGIPLIPGA

SEQ ID NO: 1137362 - protein, 9 aa, Homo Sapiens
KELTEELGG

SEQ ID NO: 1137363 - protein, 9 aa, Homo Sapiens
SITPVWLHA

SEQ ID NO: 1137364 - protein, 9 aa, Homo Sapiens
RTLPFTIKL

SEQ ID NO: 1137365 - protein, 9 aa, Homo Sapiens
SDDVVKELK

SEQ ID NO: 1137366 - protein, 9 aa, Homo Sapiens
ERVNLSASL

SEQ ID NO: 1137367 - protein, 9 aa, Homo Sapiens
RTGSCPNMT

SEQ ID NO: 1137368 - protein, 9 aa, Homo Sapiens
FTETPTWAG

SEQ ID NO: 1137369 - protein, 9 aa, Homo Sapiens
ASGGTASSL

SEQ ID NO: 1137370 - protein, 9 aa, Homo Sapiens
DLIYKLYEV

SEQ ID NO: 1137371 - protein, 9 aa, Homo Sapiens
GCCAMASST

SEQ ID NO: 1137372 - protein, 9 aa, Homo Sapiens
DNEVLLQEL

SEQ ID NO: 1137373 - protein, 9 aa, Homo Sapiens
ALFRLNHDQ

SEQ ID NO: 1137374 - protein, 9 aa, Homo Sapiens
GPTESPTTR

SEQ ID NO: 1137375 - protein, 9 aa, Homo Sapiens
HIVHVGQVL

SEQ ID NO: 1137376 - protein, 9 aa, Homo Sapiens
QCLSGHPPQ

SEQ ID NO: 1137377 - protein, 9 aa, Homo Sapiens
ASVPRARGE

SEQ ID NO: 1137378 - protein, 9 aa, Homo Sapiens
SQLEISTQL

SEQ ID NO: 1137379 - protein, 9 aa, Homo Sapiens
ECGEAFYGV

SEQ ID NO: 1137380 - protein, 9 aa, Homo Sapiens
GSMPTTGMS

SEQ ID NO: 1137381 - protein, 9 aa, Homo Sapiens
DSNSKKIYD

SEQ ID NO: 1137382 - protein, 9 aa, Homo Sapiens
SPNVCAVQK

SEQ ID NO: 1137383 - protein, 9 aa, Homo Sapiens
VLADNKPVA

SEQ ID NO: 1137384 - protein, 9 aa, Homo Sapiens
YITTVLGNG

SEQ ID NO: 1137385 - protein, 9 aa, Homo Sapiens
FSGPSGPSF

SEQ ID NO: 1137386 - protein, 9 aa, Homo Sapiens
HRAVRYAHE

SEQ ID NO: 1137387 - protein, 9 aa, Homo Sapiens
RAESEEVPD

SEQ ID NO: 1137388 - protein, 9 aa, Homo Sapiens
ICMAMYLMG

SEQ ID NO: 1137389 - protein, 9 aa, Homo Sapiens
RGRQHSPNV

SEQ ID NO: 1137390 - protein, 9 aa, Homo Sapiens
DFTSNVNHK

SEQ ID NO: 1137391 - protein, 9 aa, Homo Sapiens
MTTLNEELG

SEQ ID NO: 1137392 - protein, 9 aa, Homo Sapiens
LLQKTEAFT

SEQ ID NO: 1137393 - protein, 9 aa, Homo Sapiens
GKTTHQKFS

SEQ ID NO: 1137394 - protein, 9 aa, Homo Sapiens
YGVSASEGC

SEQ ID NO: 1137395 - protein, 9 aa, Homo Sapiens
EEKAPWKTQ

SEQ ID NO: 1137396 - protein, 9 aa, Homo Sapiens
TYSNLHTLT

SEQ ID NO: 1137397 - protein, 9 aa, Homo Sapiens
AICPLLYAD

SEQ ID NO: 1137398 - protein, 9 aa, Homo Sapiens
THCERRNLS

SEQ ID NO: 1137399 - protein, 9 aa, Homo Sapiens
ELRSFKFPL

SEQ ID NO: 1137400 - protein, 9 aa, Homo Sapiens
LFSHKSNLL

SEQ ID NO: 1137401 - protein, 9 aa, Homo Sapiens
TCARAWMRL

SEQ ID NO: 1137402 - protein, 9 aa, Homo Sapiens
PVSTAPSKA

SEQ ID NO: 1137403 - protein, 9 aa, Homo Sapiens
AGKGRVGGH

SEQ ID NO: 1137404 - protein, 9 aa, Homo Sapiens
RTESDQACD

SEQ ID NO: 1137405 - protein, 9 aa, Homo Sapiens
TTKGLCLEK

SEQ ID NO: 1137406 - protein, 9 aa, Homo Sapiens
EVHQLVDHA

SEQ ID NO: 1137407 - protein, 9 aa, Homo Sapiens
TPGKPTLVC

SEQ ID NO: 1137408 - protein, 9 aa, Homo Sapiens
DDLGKTMDN

SEQ ID NO: 1137409 - protein, 9 aa, Homo Sapiens
PPAAPCRRG

SEQ ID NO: 1137410 - protein, 9 aa, Homo Sapiens
LLAGFCAAG

SEQ ID NO: 1137411 - protein, 9 aa, Homo Sapiens
TAFQKKGPR

SEQ ID NO: 1137412 - protein, 9 aa, Homo Sapiens
GPVGPGGPG

SEQ ID NO: 1137413 - protein, 9 aa, Homo Sapiens
LQQRRRSLA

SEQ ID NO: 1137414 - protein, 9 aa, Homo Sapiens
PECSCGRPH

SEQ ID NO: 1137415 - protein, 9 aa, Homo Sapiens
PPNPGCTLW

SEQ ID NO: 1137416 - protein, 9 aa, Homo Sapiens
MMLKDGQER

SEQ ID NO: 1137417 - protein, 9 aa, Homo Sapiens
AHFIAQDPY

SEQ ID NO: 1137418 - protein, 9 aa, Homo Sapiens
EWGPAHCMG

SEQ ID NO: 1137419 - protein, 9 aa, Homo Sapiens
IILGHFVIP

SEQ ID NO: 1137420 - protein, 9 aa, Homo Sapiens
CGRVHHTVP

SEQ ID NO: 1137421 - protein, 9 aa, Homo Sapiens
GGVVDNNHC

SEQ ID NO: 1137422 - protein, 9 aa, Homo Sapiens
DTTHPTCIL

SEQ ID NO: 1137423 - protein, 9 aa, Homo Sapiens
EDTIRLYEM

SEQ ID NO: 1137424 - protein, 9 aa, Homo Sapiens
CDSSSSNED

SEQ ID NO: 1137425 - protein, 9 aa, Homo Sapiens
EQDANKGEP

SEQ ID NO: 1137426 - protein, 9 aa, Homo Sapiens
KGCCRLLTE

SEQ ID NO: 1137427 - protein, 9 aa, Homo Sapiens
TGGAAKQGF

SEQ ID NO: 1137428 - protein, 9 aa, Homo Sapiens
ETPKKKRSA

SEQ ID NO: 1137429 - protein, 9 aa, Homo Sapiens
INCSRFTTI

SEQ ID NO: 1137430 - protein, 9 aa, Homo Sapiens
YNWNIDRSG

SEQ ID NO: 1137431 - protein, 9 aa, Homo Sapiens
CKEYEKDVA

SEQ ID NO: 1137432 - protein, 9 aa, Homo Sapiens
SWWPRMKSQ

SEQ ID NO: 1137433 - protein, 9 aa, Homo Sapiens
IPGLWRPSM

SEQ ID NO: 1137434 - protein, 9 aa, Homo Sapiens
LDVGDCPKR

SEQ ID NO: 1137435 - protein, 9 aa, Homo Sapiens
DGKRAIVVF

SEQ ID NO: 1137436 - protein, 9 aa, Homo Sapiens
TESPTTRRG

SEQ ID NO: 1137437 - protein, 9 aa, Homo Sapiens
VGALTGRSP

SEQ ID NO: 1137438 - protein, 9 aa, Homo Sapiens
HPPEDVQPS

SEQ ID NO: 1137439 - protein, 9 aa, Homo Sapiens
GEPVLTATA

SEQ ID NO: 1137440 - protein, 9 aa, Homo Sapiens
GTHIRPSHK

SEQ ID NO: 1137441 - protein, 9 aa, Homo Sapiens
VAQPASGES

SEQ ID NO: 1137442 - protein, 9 aa, Homo Sapiens
FRAGKLEVD

SEQ ID NO: 1137443 - protein, 9 aa, Homo Sapiens
LTPSQGTHI

SEQ ID NO: 1137444 - protein, 9 aa, Homo Sapiens
DALECCLDP

SEQ ID NO: 1137445 - protein, 9 aa, Homo Sapiens
SIIFQWLIE

SEQ ID NO: 1137446 - protein, 9 aa, Homo Sapiens
APVTRLRTT

SEQ ID NO: 1137447 - protein, 9 aa, Homo Sapiens
ALLMPPPGL

SEQ ID NO: 1137448 - protein, 9 aa, Homo Sapiens
RLSSRSPTR

SEQ ID NO: 1137449 - protein, 9 aa, Homo Sapiens
SMYRGLWLM

SEQ ID NO: 1137450 - protein, 9 aa, Homo Sapiens
REEIEQMRW

SEQ ID NO: 1137451 - protein, 9 aa, Homo Sapiens
RLHIIFGGT

SEQ ID NO: 1137452 - protein, 9 aa, Homo Sapiens
SQMQHASGQ

SEQ ID NO: 1137453 - protein, 9 aa, Homo Sapiens
VAAVLFNFP

SEQ ID NO: 1137454 - protein, 9 aa, Homo Sapiens
IQERRRPKE

SEQ ID NO: 1137455 - protein, 9 aa, Homo Sapiens
EIGHILSNP

SEQ ID NO: 1137456 - protein, 9 aa, Homo Sapiens
ESSARFVPC

SEQ ID NO: 1137457 - protein, 9 aa, Homo Sapiens
LVPAAVLLG

SEQ ID NO: 1137458 - protein, 9 aa, Homo Sapiens
LVSQAYGAG

SEQ ID NO: 1137459 - protein, 9 aa, Homo Sapiens
PAGAGPPTA

SEQ ID NO: 1137460 - protein, 9 aa, Homo Sapiens
GAPPPGCWT

SEQ ID NO: 1137461 - protein, 9 aa, Homo Sapiens
SHVEAREDT

SEQ ID NO: 1137462 - protein, 9 aa, Homo Sapiens
KEAGHFKTW

SEQ ID NO: 1137463 - protein, 9 aa, Homo Sapiens
LKCGILWLL

SEQ ID NO: 1137464 - protein, 9 aa, Homo Sapiens
GLHVQLPGG

SEQ ID NO: 1137465 - protein, 9 aa, Homo Sapiens
CLGDLRSGL

SEQ ID NO: 1137466 - protein, 9 aa, Homo Sapiens
AWLGEFDQG

SEQ ID NO: 1137467 - protein, 9 aa, Homo Sapiens
HAEVTFEDV

SEQ ID NO: 1137468 - protein, 9 aa, Homo Sapiens
PRPAPEPTE

SEQ ID NO: 1137469 - protein, 9 aa, Homo Sapiens
KIGDHGPTL

SEQ ID NO: 1137470 - protein, 9 aa, Homo Sapiens
INPNDKKAA

SEQ ID NO: 1137471 - protein, 9 aa, Homo Sapiens
NHYEESSRD

SEQ ID NO: 1137472 - protein, 9 aa, Homo Sapiens
FAAVAASSV

SEQ ID NO: 1137473 - protein, 9 aa, Homo Sapiens
TVTTGTLGV

SEQ ID NO: 1137474 - protein, 9 aa, Homo Sapiens
SEGEFFGNC

SEQ ID NO: 1137475 - protein, 9 aa, Homo Sapiens
REHEINGVA

SEQ ID NO: 1137476 - protein, 9 aa, Homo Sapiens
YHKKSSQRH

SEQ ID NO: 1137477 - protein, 9 aa, Homo Sapiens
TFYIYLTAW

SEQ ID NO: 1137478 - protein, 9 aa, Homo Sapiens
DAVHANDDL

SEQ ID NO: 1137479 - protein, 9 aa, Homo Sapiens
QQNIEENKG

SEQ ID NO: 1137480 - protein, 9 aa, Homo Sapiens
ASPRPWSPE

SEQ ID NO: 1137481 - protein, 9 aa, Homo Sapiens
KSRRRTKKT

SEQ ID NO: 1137482 - protein, 9 aa, Homo Sapiens
KCDIDAMIY

SEQ ID NO: 1137483 - protein, 9 aa, Homo Sapiens
VKPGMHYLD

SEQ ID NO: 1137484 - protein, 9 aa, Homo Sapiens
PASVAPATL

SEQ ID NO: 1137485 - protein, 9 aa, Homo Sapiens
SLLLKRSDL

SEQ ID NO: 1137486 - protein, 9 aa, Homo Sapiens
TTPNGNLAD

SEQ ID NO: 1137487 - protein, 9 aa, Homo Sapiens
FSQPTQALT

SEQ ID NO: 1137488 - protein, 9 aa, Homo Sapiens
PRQLPRDRR

SEQ ID NO: 1137489 - protein, 9 aa, Homo Sapiens
EEARRKALP

SEQ ID NO: 1137490 - protein, 9 aa, Homo Sapiens
FRLGAEALC

SEQ ID NO: 1137491 - protein, 9 aa, Homo Sapiens
KKARIFADC

SEQ ID NO: 1137492 - protein, 9 aa, Homo Sapiens
NGTVIHLAL

SEQ ID NO: 1137493 - protein, 9 aa, Homo Sapiens
LFFVLVNLE

SEQ ID NO: 1137494 - protein, 9 aa, Homo Sapiens
NEALRKVMG

SEQ ID NO: 1137495 - protein, 9 aa, Homo Sapiens
GSLKRDDNM

SEQ ID NO: 1137496 - protein, 9 aa, Homo Sapiens
LEKKESFLN

SEQ ID NO: 1137497 - protein, 9 aa, Homo Sapiens
AAWDAPCPL

SEQ ID NO: 1137498 - protein, 9 aa, Homo Sapiens
IILYRSKLM

SEQ ID NO: 1137499 - protein, 9 aa, Homo Sapiens
DPSPVSTAP

SEQ ID NO: 1137500 - protein, 9 aa, Homo Sapiens
LETWTLLRS

SEQ ID NO: 1137501 - protein, 9 aa, Homo Sapiens
GQEDKKIKT

SEQ ID NO: 1137502 - protein, 9 aa, Homo Sapiens
PEESPLLGA

SEQ ID NO: 1137503 - protein, 9 aa, Homo Sapiens
MFDFQMNST

SEQ ID NO: 1137504 - protein, 9 aa, Homo Sapiens
SLDSTNGTG

SEQ ID NO: 1137505 - protein, 9 aa, Homo Sapiens
LTDPIPLPA

SEQ ID NO: 1137506 - protein, 9 aa, Homo Sapiens
RGIPSLGPD

SEQ ID NO: 1137507 - protein, 9 aa, Homo Sapiens
IRALCNVLA

SEQ ID NO: 1137508 - protein, 9 aa, Homo Sapiens
TTMCYGQTG

SEQ ID NO: 1137509 - protein, 9 aa, Homo Sapiens
IKDVKKRAV

SEQ ID NO: 1137510 - protein, 9 aa, Homo Sapiens
ALWEDVASL

SEQ ID NO: 1137511 - protein, 9 aa, Homo Sapiens
RTSQNHSKC

SEQ ID NO: 1137512 - protein, 9 aa, Homo Sapiens
PGAPPPGTG

SEQ ID NO: 1137513 - protein, 9 aa, Homo Sapiens
QIPQLNPPT

SEQ ID NO: 1137514 - protein, 9 aa, Homo Sapiens
PSLGPDNSN

SEQ ID NO: 1137515 - protein, 9 aa, Homo Sapiens
KPTACAGAA

SEQ ID NO: 1137516 - protein, 9 aa, Homo Sapiens
ITSWGAGFV

SEQ ID NO: 1137517 - protein, 9 aa, Homo Sapiens
QPTGEKGTR

SEQ ID NO: 1137518 - protein, 9 aa, Homo Sapiens
ICRNSIHVI

SEQ ID NO: 1137519 - protein, 9 aa, Homo Sapiens
LSAMLACLG

SEQ ID NO: 1137520 - protein, 9 aa, Homo Sapiens
VGTTQLLHI

SEQ ID NO: 1137521 - protein, 9 aa, Homo Sapiens
PTQRPRAGG

SEQ ID NO: 1137522 - protein, 9 aa, Homo Sapiens
LSFHSSATG

SEQ ID NO: 1137523 - protein, 9 aa, Homo Sapiens
AGRRAGCRP

SEQ ID NO: 1137524 - protein, 9 aa, Homo Sapiens
LFLILLHLG

SEQ ID NO: 1137525 - protein, 9 aa, Homo Sapiens
RITAATRAG

SEQ ID NO: 1137526 - protein, 9 aa, Homo Sapiens
PSLHPSQQA

SEQ ID NO: 1137527 - protein, 9 aa, Homo Sapiens
LLYYPPGVM

SEQ ID NO: 1137528 - protein, 9 aa, Homo Sapiens
TTPRPRVPV

SEQ ID NO: 1137529 - protein, 9 aa, Homo Sapiens
RASDRPSSA

SEQ ID NO: 1137530 - protein, 9 aa, Homo Sapiens
RSYMERIRG

SEQ ID NO: 1137531 - protein, 9 aa, Homo Sapiens
YDELVAIIA

SEQ ID NO: 1137532 - protein, 9 aa, Homo Sapiens
KFTVFIGKN

SEQ ID NO: 1137533 - protein, 9 aa, Homo Sapiens
AMWLSASHF

SEQ ID NO: 1137534 - protein, 9 aa, Homo Sapiens
KMKRIAFQL

SEQ ID NO: 1137535 - protein, 9 aa, Homo Sapiens
LREGPSKLP

SEQ ID NO: 1137536 - protein, 9 aa, Homo Sapiens
SLPLPDRAD

SEQ ID NO: 1137537 - protein, 9 aa, Homo Sapiens
HQKKAVLHV

SEQ ID NO: 1137538 - protein, 9 aa, Homo Sapiens
KGSVTLKCQ

SEQ ID NO: 1137539 - protein, 9 aa, Homo Sapiens
SYQMTQERM

SEQ ID NO: 1137540 - protein, 9 aa, Homo Sapiens
HVGADAEAQ

SEQ ID NO: 1137541 - protein, 9 aa, Homo Sapiens
HSKGIDCSG

SEQ ID NO: 1137542 - protein, 9 aa, Homo Sapiens
RARTRHQKG

SEQ ID NO: 1137543 - protein, 9 aa, Homo Sapiens
YIAEIKLPK

SEQ ID NO: 1137544 - protein, 9 aa, Homo Sapiens
KMLGERRRR

SEQ ID NO: 1137545 - protein, 9 aa, Homo Sapiens
LTREPSRVL

SEQ ID NO: 1137546 - protein, 9 aa, Homo Sapiens
RPYPEQFWE

SEQ ID NO: 1137547 - protein, 9 aa, Homo Sapiens
QGQWGPPRA

SEQ ID NO: 1137548 - protein, 9 aa, Homo Sapiens
ALVNNNNHT

SEQ ID NO: 1137549 - protein, 9 aa, Homo Sapiens
KDEWTMASP

SEQ ID NO: 1137550 - protein, 9 aa, Homo Sapiens
YEVPPSPTT

SEQ ID NO: 1137551 - protein, 9 aa, Homo Sapiens
SCFPKNLVA

SEQ ID NO: 1137552 - protein, 9 aa, Homo Sapiens
ALFDWIVFQ

SEQ ID NO: 1137553 - protein, 9 aa, Homo Sapiens
KAATLAVHP

SEQ ID NO: 1137554 - protein, 9 aa, Homo Sapiens
TVNMDGATL

SEQ ID NO: 1137555 - protein, 9 aa, Homo Sapiens
PLFFKLMMS

SEQ ID NO: 1137556 - protein, 9 aa, Homo Sapiens
GDGTVQSSV

SEQ ID NO: 1137557 - protein, 9 aa, Homo Sapiens
LRTKLEKAL

SEQ ID NO: 1137558 - protein, 9 aa, Homo Sapiens
TPGPGAGQG

SEQ ID NO: 1137559 - protein, 9 aa, Homo Sapiens
VPEELVPVA

SEQ ID NO: 1137560 - protein, 9 aa, Homo Sapiens
DHSISLAGW

SEQ ID NO: 1137561 - protein, 9 aa, Homo Sapiens
VVVAAPASS

SEQ ID NO: 1137562 - protein, 9 aa, Homo Sapiens
RSSSSIQES

SEQ ID NO: 1137563 - protein, 9 aa, Homo Sapiens
SLRVCRPQP

SEQ ID NO: 1137564 - protein, 9 aa, Homo Sapiens
RPGPTESPT

SEQ ID NO: 1137565 - protein, 9 aa, Homo Sapiens
RSRAQRPQS

SEQ ID NO: 1137566 - protein, 9 aa, Homo Sapiens
AAMQMSSFE

SEQ ID NO: 1137567 - protein, 9 aa, Homo Sapiens
SRPTSSQTR

SEQ ID NO: 1137568 - protein, 9 aa, Homo Sapiens
HCKGATCGL

SEQ ID NO: 1137569 - protein, 9 aa, Homo Sapiens
LSVVHMMTQ

SEQ ID NO: 1137570 - protein, 9 aa, Homo Sapiens
GPCLVEGTA

SEQ ID NO: 1137571 - protein, 9 aa, Homo Sapiens
SPSPTDPKC

SEQ ID NO: 1137572 - protein, 9 aa, Homo Sapiens
YKHRGEGEH

SEQ ID NO: 1137573 - protein, 9 aa, Homo Sapiens
ELSILWGVR

SEQ ID NO: 1137574 - protein, 9 aa, Homo Sapiens
ARKALKPIK

SEQ ID NO: 1137575 - protein, 9 aa, Homo Sapiens
TTTSSSRFF

SEQ ID NO: 1137576 - protein, 9 aa, Homo Sapiens
RRDASRCLI

SEQ ID NO: 1137577 - protein, 9 aa, Homo Sapiens
FLDRVYSPF

SEQ ID NO: 1137578 - protein, 9 aa, Homo Sapiens
ITCHTPALP

SEQ ID NO: 1137579 - protein, 9 aa, Homo Sapiens
RTCVNTSDY

SEQ ID NO: 1137580 - protein, 9 aa, Homo Sapiens
SHKCLMDRS

SEQ ID NO: 1137581 - protein, 9 aa, Homo Sapiens
HIILICLQV

SEQ ID NO: 1137582 - protein, 9 aa, Homo Sapiens
KETLSKNFF

SEQ ID NO: 1137583 - protein, 9 aa, Homo Sapiens
VDHAGRQPH

SEQ ID NO: 1137584 - protein, 9 aa, Homo Sapiens
MERLQLQMR

SEQ ID NO: 1137585 - protein, 9 aa, Homo Sapiens
RSPCPGWGA

SEQ ID NO: 1137586 - protein, 9 aa, Homo Sapiens
RPPPHTHPL

SEQ ID NO: 1137587 - protein, 9 aa, Homo Sapiens
TITLCLHYR

SEQ ID NO: 1137588 - protein, 9 aa, Homo Sapiens
AYVASRPFR

SEQ ID NO: 1137589 - protein, 9 aa, Homo Sapiens
WNQKGEETE

SEQ ID NO: 1137590 - protein, 9 aa, Homo Sapiens
VGGEALVPA

SEQ ID NO: 1137591 - protein, 9 aa, Homo Sapiens
QPPPQPPLH

SEQ ID NO: 1137592 - protein, 9 aa, Homo Sapiens
PPQALPPAR

SEQ ID NO: 1137593 - protein, 9 aa, Homo Sapiens
DVAWLGEFD

SEQ ID NO: 1137594 - protein, 9 aa, Homo Sapiens
PLMDNGWAG

SEQ ID NO: 1137595 - protein, 9 aa, Homo Sapiens
DVCKLLVAG

SEQ ID NO: 1137596 - protein, 9 aa, Homo Sapiens
QCLLDKDLI

SEQ ID NO: 1137597 - protein, 9 aa, Homo Sapiens
VSEQQSFFV

SEQ ID NO: 1137598 - protein, 9 aa, Homo Sapiens
STQFNKGPR

SEQ ID NO: 1137599 - protein, 9 aa, Homo Sapiens
KVLWPLRPP

SEQ ID NO: 1137600 - protein, 9 aa, Homo Sapiens
EMLPRHPCP

SEQ ID NO: 1137601 - protein, 9 aa, Homo Sapiens
IHGRKKCSG

SEQ ID NO: 1137602 - protein, 9 aa, Homo Sapiens
TPDFLLLQS

SEQ ID NO: 1137603 - protein, 9 aa, Homo Sapiens
QKENHFLFF

SEQ ID NO: 1137604 - protein, 9 aa, Homo Sapiens
HFLARLKEH

SEQ ID NO: 1137605 - protein, 9 aa, Homo Sapiens
RSSDYIRHQ

SEQ ID NO: 1137606 - protein, 9 aa, Homo Sapiens
TQHKMLAIF

SEQ ID NO: 1137607 - protein, 9 aa, Homo Sapiens
EKLPVRRDA

SEQ ID NO: 1137608 - protein, 9 aa, Homo Sapiens
WAKNMARRA

SEQ ID NO: 1137609 - protein, 9 aa, Homo Sapiens
LCGTKSQSE

SEQ ID NO: 1137610 - protein, 9 aa, Homo Sapiens
IYSYILGLI

SEQ ID NO: 1137611 - protein, 9 aa, Homo Sapiens
RLSLQGSKA

SEQ ID NO: 1137612 - protein, 9 aa, Homo Sapiens
WSGLMSLGN

SEQ ID NO: 1137613 - protein, 9 aa, Homo Sapiens
ELPSKWADS

SEQ ID NO: 1137614 - protein, 9 aa, Homo Sapiens
LIMPLSEVC

SEQ ID NO: 1137615 - protein, 9 aa, Homo Sapiens
GLVQGQAAA

SEQ ID NO: 1137616 - protein, 9 aa, Homo Sapiens
PLAQSPPHP

SEQ ID NO: 1137617 - protein, 9 aa, Homo Sapiens
EKPHACREC

SEQ ID NO: 1137618 - protein, 9 aa, Homo Sapiens
PVSFNGVRK

SEQ ID NO: 1137619 - protein, 9 aa, Homo Sapiens
GIHVFDANE

SEQ ID NO: 1137620 - protein, 9 aa, Homo Sapiens
VPNIDNVTV

SEQ ID NO: 1137621 - protein, 9 aa, Homo Sapiens
MPSSHFLAE

SEQ ID NO: 1137622 - protein, 9 aa, Homo Sapiens
QEQDLLHKM

SEQ ID NO: 1137623 - protein, 9 aa, Homo Sapiens
RTVQRRQAE

SEQ ID NO: 1137624 - protein, 9 aa, Homo Sapiens
ASSCTPGLC

SEQ ID NO: 1137625 - protein, 9 aa, Homo Sapiens
IWRRIGATT

SEQ ID NO: 1137626 - protein, 9 aa, Homo Sapiens
WMTHEMESL

SEQ ID NO: 1137627 - protein, 9 aa, Homo Sapiens
FEGVSTTAA

SEQ ID NO: 1137628 - protein, 9 aa, Homo Sapiens
PSTTRRDSW

SEQ ID NO: 1137629 - protein, 9 aa, Homo Sapiens
KMLKKEGSW

SEQ ID NO: 1137630 - protein, 9 aa, Homo Sapiens
LDPDLETMD

SEQ ID NO: 1137631 - protein, 9 aa, Homo Sapiens
LGGPRLECI

SEQ ID NO: 1137632 - protein, 9 aa, Homo Sapiens
LKTSCFKLD

SEQ ID NO: 1137633 - protein, 9 aa, Homo Sapiens
SNTGQDCPP

SEQ ID NO: 1137634 - protein, 9 aa, Homo Sapiens
AHVPRRKRC

SEQ ID NO: 1137635 - protein, 9 aa, Homo Sapiens
RLRLEKKES

SEQ ID NO: 1137636 - protein, 9 aa, Homo Sapiens
RRNKHQGGW

SEQ ID NO: 1137637 - protein, 9 aa, Homo Sapiens
FIAGFWTIF

SEQ ID NO: 1137638 - protein, 9 aa, Homo Sapiens
PMTACSILA

SEQ ID NO: 1137639 - protein, 9 aa, Homo Sapiens
KTNQRFDHE

SEQ ID NO: 1137640 - protein, 9 aa, Homo Sapiens
YDSRQSVMS

SEQ ID NO: 1137641 - protein, 9 aa, Homo Sapiens
ITECVRTAL

SEQ ID NO: 1137642 - protein, 9 aa, Homo Sapiens
EMAAMRLMP

SEQ ID NO: 1137643 - protein, 9 aa, Homo Sapiens
QRQEAWLSS

SEQ ID NO: 1137644 - protein, 9 aa, Homo Sapiens
DMGKTTHQK

SEQ ID NO: 1137645 - protein, 9 aa, Homo Sapiens
FSRGKTRKT

SEQ ID NO: 1137646 - protein, 9 aa, Homo Sapiens
CLLSHWPFL

SEQ ID NO: 1137647 - protein, 9 aa, Homo Sapiens
LRTNLTPNT

SEQ ID NO: 1137648 - protein, 9 aa, Homo Sapiens
GAVAAQPGQ

SEQ ID NO: 1137649 - protein, 9 aa, Homo Sapiens
NPLPLSYVP

SEQ ID NO: 1137650 - protein, 9 aa, Homo Sapiens
RGLRQRRGF

SEQ ID NO: 1137651 - protein, 9 aa, Homo Sapiens
RPRQPTGAH

SEQ ID NO: 1137652 - protein, 9 aa, Homo Sapiens
GVSTTSSQM

SEQ ID NO: 1137653 - protein, 9 aa, Homo Sapiens
TLETEGSKF

SEQ ID NO: 1137654 - protein, 9 aa, Homo Sapiens
MWKRRWFIL

SEQ ID NO: 1137655 - protein, 9 aa, Homo Sapiens
SSGTSLACL

SEQ ID NO: 1137656 - protein, 9 aa, Homo Sapiens
WSLSTGTRR

SEQ ID NO: 1137657 - protein, 9 aa, Homo Sapiens
TPARSPTSA

SEQ ID NO: 1137658 - protein, 9 aa, Homo Sapiens
NLASIGKNG

SEQ ID NO: 1137659 - protein, 9 aa, Homo Sapiens
RDQKLPVFG

SEQ ID NO: 1137660 - protein, 9 aa, Homo Sapiens
TSHRMTHRL

SEQ ID NO: 1137661 - protein, 9 aa, Homo Sapiens
PPGLRPCRC

SEQ ID NO: 1137662 - protein, 9 aa, Homo Sapiens
HLPPTPLSS

SEQ ID NO: 1137663 - protein, 9 aa, Homo Sapiens
RGQGGKQTP

SEQ ID NO: 1137664 - protein, 9 aa, Homo Sapiens
SAPCCWRLW

SEQ ID NO: 1137665 - protein, 9 aa, Homo Sapiens
SSGASWPPL

SEQ ID NO: 1137666 - protein, 9 aa, Homo Sapiens
PTKLEPKPI

SEQ ID NO: 1137667 - protein, 9 aa, Homo Sapiens
PMGSLSPTP

SEQ ID NO: 1137668 - protein, 9 aa, Homo Sapiens
GLQPPVVLQ

SEQ ID NO: 1137669 - protein, 9 aa, Homo Sapiens
PQQSNAGVA

SEQ ID NO: 1137670 - protein, 9 aa, Homo Sapiens
NKVAQAKLT

SEQ ID NO: 1137671 - protein, 9 aa, Homo Sapiens
EDTADRPPT

SEQ ID NO: 1137672 - protein, 9 aa, Homo Sapiens
FCEERGVHV

SEQ ID NO: 1137673 - protein, 9 aa, Homo Sapiens
WNQWLSCPS

SEQ ID NO: 1137674 - protein, 9 aa, Homo Sapiens
PHPTRMSHL

SEQ ID NO: 1137675 - protein, 9 aa, Homo Sapiens
QRCDLSSAA

SEQ ID NO: 1137676 - protein, 9 aa, Homo Sapiens
QVASSRTGK

SEQ ID NO: 1137677 - protein, 9 aa, Homo Sapiens
PKKKRSAFP

SEQ ID NO: 1137678 - protein, 9 aa, Homo Sapiens
RSTPKDPCL

SEQ ID NO: 1137679 - protein, 9 aa, Homo Sapiens
GLWGPFEES

SEQ ID NO: 1137680 - protein, 9 aa, Homo Sapiens
WRTLLRTNL

SEQ ID NO: 1137681 - protein, 9 aa, Homo Sapiens
VVCKQNVDR

SEQ ID NO: 1137682 - protein, 9 aa, Homo Sapiens
KPMNTNDLE

SEQ ID NO: 1137683 - protein, 9 aa, Homo Sapiens
TLMAEVSET

SEQ ID NO: 1137684 - protein, 9 aa, Homo Sapiens
GEGPGKHGA

SEQ ID NO: 1137685 - protein, 9 aa, Homo Sapiens
GVDEYVKLG

SEQ ID NO: 1137686 - protein, 9 aa, Homo Sapiens
LRNKDVNEA

SEQ ID NO: 1137687 - protein, 9 aa, Homo Sapiens
QVCSTITLC

SEQ ID NO: 1137688 - protein, 9 aa, Homo Sapiens
LLVLQGALG

SEQ ID NO: 1137689 - protein, 9 aa, Homo Sapiens
GLCHLLLPP

SEQ ID NO: 1137690 - protein, 9 aa, Homo Sapiens
MKYIHPFIF

SEQ ID NO: 1137691 - protein, 9 aa, Homo Sapiens
EVLKWGEEL

SEQ ID NO: 1137692 - protein, 9 aa, Homo Sapiens
DTIKRPSPD

SEQ ID NO: 1137693 - protein, 9 aa, Homo Sapiens
VIRYVKWHL

SEQ ID NO: 1137694 - protein, 9 aa, Homo Sapiens
AGGEAVVAA

SEQ ID NO: 1137695 - protein, 9 aa, Homo Sapiens
EDSALRDLW

SEQ ID NO: 1137696 - protein, 9 aa, Homo Sapiens
AWGQKANEL

SEQ ID NO: 1137697 - protein, 9 aa, Homo Sapiens
LHLHAPQLL

SEQ ID NO: 1137698 - protein, 9 aa, Homo Sapiens
NVQWSGCSR

SEQ ID NO: 1137699 - protein, 9 aa, Homo Sapiens
PALGPLSAS

SEQ ID NO: 1137700 - protein, 9 aa, Homo Sapiens
FPFHIMFDK

SEQ ID NO: 1137701 - protein, 9 aa, Homo Sapiens
NTTTITTTT

SEQ ID NO: 1137702 - protein, 9 aa, Homo Sapiens
RSLSRTAQD

SEQ ID NO: 1137703 - protein, 9 aa, Homo Sapiens
DKSAKNLLT

SEQ ID NO: 1137704 - protein, 9 aa, Homo Sapiens
ESSNYPCLA

SEQ ID NO: 1137705 - protein, 9 aa, Homo Sapiens
GGLQLKADS

SEQ ID NO: 1137706 - protein, 9 aa, Homo Sapiens
VGPGLGGGG

SEQ ID NO: 1137707 - protein, 9 aa, Homo Sapiens
SQGTHIRPS

SEQ ID NO: 1137708 - protein, 9 aa, Homo Sapiens
RLLGPSMEI

SEQ ID NO: 1137709 - protein, 9 aa, Homo Sapiens
LENERFDTH

SEQ ID NO: 1137710 - protein, 9 aa, Homo Sapiens
KSHSIPKFK

SEQ ID NO: 1137711 - protein, 9 aa, Homo Sapiens
DHKLCRVYL

SEQ ID NO: 1137712 - protein, 9 aa, Homo Sapiens
NQSALIEGK

SEQ ID NO: 1137713 - protein, 9 aa, Homo Sapiens
ALPAPPAPS

SEQ ID NO: 1137714 - protein, 9 aa, Homo Sapiens
LLWKRSLLL

SEQ ID NO: 1137715 - protein, 9 aa, Homo Sapiens
RPPGEQQLN

SEQ ID NO: 1137716 - protein, 9 aa, Homo Sapiens
RHFLWTCLI

SEQ ID NO: 1137717 - protein, 9 aa, Homo Sapiens
SLEEKMEYC

SEQ ID NO: 1137718 - protein, 9 aa, Homo Sapiens
HTTAFPDSA

SEQ ID NO: 1137719 - protein, 9 aa, Homo Sapiens
NPPLRFNLI

SEQ ID NO: 1137720 - protein, 9 aa, Homo Sapiens
FCSSPQEEN

SEQ ID NO: 1137721 - protein, 9 aa, Homo Sapiens
LVGLAKMAF

SEQ ID NO: 1137722 - protein, 9 aa, Homo Sapiens
LTQENSSCG

SEQ ID NO: 1137723 - protein, 9 aa, Homo Sapiens
SRRPLRRPC

SEQ ID NO: 1137724 - protein, 9 aa, Homo Sapiens
PKEVFMLHI

SEQ ID NO: 1137725 - protein, 9 aa, Homo Sapiens
RDSPQECST

SEQ ID NO: 1137726 - protein, 9 aa, Homo Sapiens
PSERLAHQQ

SEQ ID NO: 1137727 - protein, 9 aa, Homo Sapiens
SYLAPPITD

SEQ ID NO: 1137728 - protein, 9 aa, Homo Sapiens
FNGGSDLIK

SEQ ID NO: 1137729 - protein, 9 aa, Homo Sapiens
QPCGECFPQ

SEQ ID NO: 1137730 - protein, 9 aa, Homo Sapiens
QAESEVGWP

SEQ ID NO: 1137731 - protein, 9 aa, Homo Sapiens
ALQDLAPPL

SEQ ID NO: 1137732 - protein, 9 aa, Homo Sapiens
VDDNEDESS

SEQ ID NO: 1137733 - protein, 9 aa, Homo Sapiens
VMYRCLWPN

SEQ ID NO: 1137734 - protein, 9 aa, Homo Sapiens
PPQPRVGGL

SEQ ID NO: 1137735 - protein, 9 aa, Homo Sapiens
FMDNYITGY

SEQ ID NO: 1137736 - protein, 9 aa, Homo Sapiens
RGELFLVKE

SEQ ID NO: 1137737 - protein, 9 aa, Homo Sapiens
ASACTMPPL

SEQ ID NO: 1137738 - protein, 9 aa, Homo Sapiens
WRNSESFGA

SEQ ID NO: 1137739 - protein, 9 aa, Homo Sapiens
VLSTCVDPY

SEQ ID NO: 1137740 - protein, 9 aa, Homo Sapiens
QKFLDTSHY

SEQ ID NO: 1137741 - protein, 9 aa, Homo Sapiens
GLFGVLGVA

SEQ ID NO: 1137742 - protein, 9 aa, Homo Sapiens
LEEIGNQVV

SEQ ID NO: 1137743 - protein, 9 aa, Homo Sapiens
MMSSTNNWV

SEQ ID NO: 1137744 - protein, 9 aa, Homo Sapiens
GNAHTNRNH

SEQ ID NO: 1137745 - protein, 9 aa, Homo Sapiens
PSPRCARSP

SEQ ID NO: 1137746 - protein, 9 aa, Homo Sapiens
PNVLCYTST

SEQ ID NO: 1137747 - protein, 9 aa, Homo Sapiens
HRYASFRNL

SEQ ID NO: 1137748 - protein, 9 aa, Homo Sapiens
PYPAASAPC

SEQ ID NO: 1137749 - protein, 9 aa, Homo Sapiens
GIEIIDEKT

SEQ ID NO: 1137750 - protein, 9 aa, Homo Sapiens
GSGAALANA

SEQ ID NO: 1137751 - protein, 9 aa, Homo Sapiens
DPYLFPYFI

SEQ ID NO: 1137752 - protein, 9 aa, Homo Sapiens
EVGEDEEQN

SEQ ID NO: 1137753 - protein, 9 aa, Homo Sapiens
LSSSTQHKM

SEQ ID NO: 1137754 - protein, 9 aa, Homo Sapiens
EQEERRIRQ

SEQ ID NO: 1137755 - protein, 9 aa, Homo Sapiens
GENLIPCQP

SEQ ID NO: 1137756 - protein, 9 aa, Homo Sapiens
ITSIKSGLK

SEQ ID NO: 1137757 - protein, 9 aa, Homo Sapiens
DVSSLALES

SEQ ID NO: 1137758 - protein, 9 aa, Homo Sapiens
VSHQAGVQR

SEQ ID NO: 1137759 - protein, 9 aa, Homo Sapiens
AGRDGQEPQ

SEQ ID NO: 1137760 - protein, 9 aa, Homo Sapiens
VLGKLEMVK

SEQ ID NO: 1137761 - protein, 9 aa, Homo Sapiens
AAGGGSPAA

SEQ ID NO: 1137762 - protein, 9 aa, Homo Sapiens
KRILCGKHV

SEQ ID NO: 1137763 - protein, 9 aa, Homo Sapiens
APEEKDLKD

SEQ ID NO: 1137764 - protein, 9 aa, Homo Sapiens
PPRSQPSLH

SEQ ID NO: 1137765 - protein, 9 aa, Homo Sapiens
GPGPPSGAR

SEQ ID NO: 1137766 - protein, 9 aa, Homo Sapiens
LRNFEVGED

SEQ ID NO: 1137767 - protein, 9 aa, Homo Sapiens
PAPGSTRIP

SEQ ID NO: 1137768 - protein, 9 aa, Homo Sapiens
LAANGPRGS

SEQ ID NO: 1137769 - protein, 9 aa, Homo Sapiens
PEPTERGFQ

SEQ ID NO: 1137770 - protein, 9 aa, Homo Sapiens
AKVEIIRHI

SEQ ID NO: 1137771 - protein, 9 aa, Homo Sapiens
RGLCSAAAS

SEQ ID NO: 1137772 - protein, 9 aa, Homo Sapiens
SPLIFIFAY

SEQ ID NO: 1137773 - protein, 9 aa, Homo Sapiens
GRNSVACSA

SEQ ID NO: 1137774 - protein, 9 aa, Homo Sapiens
GPTRLYPGA

SEQ ID NO: 1137775 - protein, 9 aa, Homo Sapiens
GEKEHTNAK

SEQ ID NO: 1137776 - protein, 9 aa, Homo Sapiens
ARRVRDSDG

SEQ ID NO: 1137777 - protein, 9 aa, Homo Sapiens
PVAHCYPDT

SEQ ID NO: 1137778 - protein, 9 aa, Homo Sapiens
VHIANITQS

SEQ ID NO: 1137779 - protein, 9 aa, Homo Sapiens
ALTAPRVKL

SEQ ID NO: 1137780 - protein, 9 aa, Homo Sapiens
SAMQSLYIE

SEQ ID NO: 1137781 - protein, 9 aa, Homo Sapiens
VGPLAVWIS

SEQ ID NO: 1137782 - protein, 9 aa, Homo Sapiens
PIKRVLSST

SEQ ID NO: 1137783 - protein, 9 aa, Homo Sapiens
DWLRSCLER

SEQ ID NO: 1137784 - protein, 9 aa, Homo Sapiens
PPDPQELLD

SEQ ID NO: 1137785 - protein, 9 aa, Homo Sapiens
HEVKTLHVQ

SEQ ID NO: 1137786 - protein, 9 aa, Homo Sapiens
APAPPTRCV

SEQ ID NO: 1137787 - protein, 9 aa, Homo Sapiens
DPEEAGKFV

SEQ ID NO: 1137788 - protein, 9 aa, Homo Sapiens
SVARPSTTR

SEQ ID NO: 1137789 - protein, 9 aa, Homo Sapiens
PVTGEVWRG

SEQ ID NO: 1137790 - protein, 9 aa, Homo Sapiens
LPPTGMTRA

SEQ ID NO: 1137791 - protein, 9 aa, Homo Sapiens
LLKTLPQPG

SEQ ID NO: 1137792 - protein, 9 aa, Homo Sapiens
IPRGSYAEV

SEQ ID NO: 1137793 - protein, 9 aa, Homo Sapiens
APGKSRSEE

SEQ ID NO: 1137794 - protein, 9 aa, Homo Sapiens
HWSDMLAGF

SEQ ID NO: 1137795 - protein, 9 aa, Homo Sapiens
IVRASFTYL

SEQ ID NO: 1137796 - protein, 9 aa, Homo Sapiens
SCTLICQVF

SEQ ID NO: 1137797 - protein, 9 aa, Homo Sapiens
LVPDPCPPC

SEQ ID NO: 1137798 - protein, 9 aa, Homo Sapiens
TMFITQLPD

SEQ ID NO: 1137799 - protein, 9 aa, Homo Sapiens
DAEGLLMEE

SEQ ID NO: 1137800 - protein, 9 aa, Homo Sapiens
AERWNKKGE

SEQ ID NO: 1137801 - protein, 9 aa, Homo Sapiens
FLFTAMAYD

SEQ ID NO: 1137802 - protein, 9 aa, Homo Sapiens
NELPSKWAD

SEQ ID NO: 1137803 - protein, 9 aa, Homo Sapiens
SSPQRPPLR

SEQ ID NO: 1137804 - protein, 9 aa, Homo Sapiens
MLKKEGSWI

SEQ ID NO: 1137805 - protein, 9 aa, Homo Sapiens
SGQVQALRN

SEQ ID NO: 1137806 - protein, 9 aa, Homo Sapiens
RAWAPAPPT

SEQ ID NO: 1137807 - protein, 9 aa, Homo Sapiens
YGIGFCRNV

SEQ ID NO: 1137808 - protein, 9 aa, Homo Sapiens
SGHLLSAIT

SEQ ID NO: 1137809 - protein, 9 aa, Homo Sapiens
CSPSPRYSR

SEQ ID NO: 1137810 - protein, 9 aa, Homo Sapiens
NYRVGTFGF

SEQ ID NO: 1137811 - protein, 9 aa, Homo Sapiens
QTPVARTLP

SEQ ID NO: 1137812 - protein, 9 aa, Homo Sapiens
ISSGTSLAC

SEQ ID NO: 1137813 - protein, 9 aa, Homo Sapiens
APPSRNSGR

SEQ ID NO: 1137814 - protein, 9 aa, Homo Sapiens
KLYPKGVFT

SEQ ID NO: 1137815 - protein, 9 aa, Homo Sapiens
RPPWRTSRG

SEQ ID NO: 1137816 - protein, 9 aa, Homo Sapiens
PTWKLLVKQ

SEQ ID NO: 1137817 - protein, 9 aa, Homo Sapiens
HRKKEVRKG

SEQ ID NO: 1137818 - protein, 9 aa, Homo Sapiens
AMETRGCGT

SEQ ID NO: 1137819 - protein, 9 aa, Homo Sapiens
RTGASTRAS

SEQ ID NO: 1137820 - protein, 9 aa, Homo Sapiens
YTVKLRRFN

SEQ ID NO: 1137821 - protein, 9 aa, Homo Sapiens
QKTGLGILQ

SEQ ID NO: 1137822 - protein, 9 aa, Homo Sapiens
TKKRKKWRH

SEQ ID NO: 1137823 - protein, 9 aa, Homo Sapiens
ALATSPLLE

SEQ ID NO: 1137824 - protein, 9 aa, Homo Sapiens
RKVTLMINL

SEQ ID NO: 1137825 - protein, 9 aa, Homo Sapiens
KNGRTRTLK

SEQ ID NO: 1137826 - protein, 9 aa, Homo Sapiens
YQRMYSIMD

SEQ ID NO: 1137827 - protein, 9 aa, Homo Sapiens
AAARGASTS

SEQ ID NO: 1137828 - protein, 9 aa, Homo Sapiens
HLGLILFSM

SEQ ID NO: 1137829 - protein, 9 aa, Homo Sapiens
IHVFDANEP

SEQ ID NO: 1137830 - protein, 9 aa, Homo Sapiens
CPHWASSPS

SEQ ID NO: 1137831 - protein, 9 aa, Homo Sapiens
SWACTCRAC

SEQ ID NO: 1137832 - protein, 9 aa, Homo Sapiens
DVEVCSDFL

SEQ ID NO: 1137833 - protein, 9 aa, Homo Sapiens
AQDPVICSL

SEQ ID NO: 1137834 - protein, 9 aa, Homo Sapiens
DGSMDAAKE

SEQ ID NO: 1137835 - protein, 9 aa, Homo Sapiens
LESSSHTPT

SEQ ID NO: 1137836 - protein, 9 aa, Homo Sapiens
PGVADYLTA

SEQ ID NO: 1137837 - protein, 9 aa, Homo Sapiens
TIERKFSPW

SEQ ID NO: 1137838 - protein, 9 aa, Homo Sapiens
AQQPAKPPY

SEQ ID NO: 1137839 - protein, 9 aa, Homo Sapiens
TPGFWLMLC

SEQ ID NO: 1137840 - protein, 9 aa, Homo Sapiens
LLPEVGGQV

SEQ ID NO: 1137841 - protein, 9 aa, Homo Sapiens
PEPDAPLDH

SEQ ID NO: 1137842 - protein, 9 aa, Homo Sapiens
VPRMMRPGQ

SEQ ID NO: 1137843 - protein, 9 aa, Homo Sapiens
AGALVYDIT

SEQ ID NO: 1137844 - protein, 9 aa, Homo Sapiens
MDNYITGYD

SEQ ID NO: 1137845 - protein, 9 aa, Homo Sapiens
HFPGMSEIY

SEQ ID NO: 1137846 - protein, 9 aa, Homo Sapiens
AEQRARHRE

SEQ ID NO: 1137847 - protein, 9 aa, Homo Sapiens
VNGLMKREE

SEQ ID NO: 1137848 - protein, 9 aa, Homo Sapiens
ASKVPGGSR

SEQ ID NO: 1137849 - protein, 9 aa, Homo Sapiens
WKRQMASKP

SEQ ID NO: 1137850 - protein, 9 aa, Homo Sapiens
TPGRPWPPS

SEQ ID NO: 1137851 - protein, 9 aa, Homo Sapiens
KNLYEIARR

SEQ ID NO: 1137852 - protein, 9 aa, Homo Sapiens
IAVQAGDGH

SEQ ID NO: 1137853 - protein, 9 aa, Homo Sapiens
QTHCERRNL

SEQ ID NO: 1137854 - protein, 9 aa, Homo Sapiens
LISGGWCSP

SEQ ID NO: 1137855 - protein, 9 aa, Homo Sapiens
PPCGPRLTR

SEQ ID NO: 1137856 - protein, 9 aa, Homo Sapiens
SDAAPGGSW

SEQ ID NO: 1137857 - protein, 9 aa, Homo Sapiens
GCSIQEPGP

SEQ ID NO: 1137858 - protein, 9 aa, Homo Sapiens
AMRLMPKFL

SEQ ID NO: 1137859 - protein, 9 aa, Homo Sapiens
EEMWLSKGL

SEQ ID NO: 1137860 - protein, 9 aa, Homo Sapiens
RRDRGVSGR

SEQ ID NO: 1137861 - protein, 9 aa, Homo Sapiens
PEIISFAET

SEQ ID NO: 1137862 - protein, 9 aa, Homo Sapiens
RKLTKAEKL

SEQ ID NO: 1137863 - protein, 9 aa, Homo Sapiens
FNFPPAQNL

SEQ ID NO: 1137864 - protein, 9 aa, Homo Sapiens
HVQLPGGPG

SEQ ID NO: 1137865 - protein, 9 aa, Homo Sapiens
TGAGATCWC

SEQ ID NO: 1137866 - protein, 9 aa, Homo Sapiens
QWWHVGADA

SEQ ID NO: 1137867 - protein, 9 aa, Homo Sapiens
HTRLSPGPP

SEQ ID NO: 1137868 - protein, 9 aa, Homo Sapiens
AKVRFEEFA

SEQ ID NO: 1137869 - protein, 9 aa, Homo Sapiens
IGNQVVIVE

SEQ ID NO: 1137870 - protein, 9 aa, Homo Sapiens
KAKRVAVLG

SEQ ID NO: 1137871 - protein, 9 aa, Homo Sapiens
ADLKELRHK

SEQ ID NO: 1137872 - protein, 9 aa, Homo Sapiens
SSPTSLCRG

SEQ ID NO: 1137873 - protein, 9 aa, Homo Sapiens
IPPNGHCIG

SEQ ID NO: 1137874 - protein, 9 aa, Homo Sapiens
AGIITTKMG

SEQ ID NO: 1137875 - protein, 9 aa, Homo Sapiens
GGERGQMAP

SEQ ID NO: 1137876 - protein, 9 aa, Homo Sapiens
EEADDDKKG

SEQ ID NO: 1137877 - protein, 9 aa, Homo Sapiens
LKVQQKCLM

SEQ ID NO: 1137878 - protein, 9 aa, Homo Sapiens
IHERKCGAV

SEQ ID NO: 1137879 - protein, 9 aa, Homo Sapiens
TGCRPRSRT

SEQ ID NO: 1137880 - protein, 9 aa, Homo Sapiens
FMGFAAPSP

SEQ ID NO: 1137881 - protein, 9 aa, Homo Sapiens
ATVDSPPHQ

SEQ ID NO: 1137882 - protein, 9 aa, Homo Sapiens
LPGLTHPAH

SEQ ID NO: 1137883 - protein, 9 aa, Homo Sapiens
LQPQRNFCL

SEQ ID NO: 1137884 - protein, 9 aa, Homo Sapiens
LLHVLTLMK

SEQ ID NO: 1137885 - protein, 9 aa, Homo Sapiens
CPLNQQQWM

SEQ ID NO: 1137886 - protein, 9 aa, Homo Sapiens
SITSVTLRP

SEQ ID NO: 1137887 - protein, 9 aa, Homo Sapiens
VKPGVQYRE

SEQ ID NO: 1137888 - protein, 9 aa, Homo Sapiens
APQGPVMAW

SEQ ID NO: 1137889 - protein, 9 aa, Homo Sapiens
SVPRDRQLP

SEQ ID NO: 1137890 - protein, 9 aa, Homo Sapiens
AITSWGAGF

SEQ ID NO: 1137891 - protein, 9 aa, Homo Sapiens
VILLFSFLI

SEQ ID NO: 1137892 - protein, 9 aa, Homo Sapiens
PHAHPGPTA

SEQ ID NO: 1137893 - protein, 9 aa, Homo Sapiens
GGAGGFLLR

SEQ ID NO: 1137894 - protein, 9 aa, Homo Sapiens
PGTAPDMKS

SEQ ID NO: 1137895 - protein, 9 aa, Homo Sapiens
QKTFYSFFS

SEQ ID NO: 1137896 - protein, 9 aa, Homo Sapiens
WEYCRLDAC

SEQ ID NO: 1137897 - protein, 9 aa, Homo Sapiens
NRPSKTPPT

SEQ ID NO: 1137898 - protein, 9 aa, Homo Sapiens
CQLVWTAPP

SEQ ID NO: 1137899 - protein, 9 aa, Homo Sapiens
SIAFSTSIT

SEQ ID NO: 1137900 - protein, 9 aa, Homo Sapiens
VLEMVGQIT

SEQ ID NO: 1137901 - protein, 9 aa, Homo Sapiens
AVLVEHAEL

SEQ ID NO: 1137902 - protein, 9 aa, Homo Sapiens
PTPMWWLIG

SEQ ID NO: 1137903 - protein, 9 aa, Homo Sapiens
TRHAAHTIQ

SEQ ID NO: 1137904 - protein, 9 aa, Homo Sapiens
HNVRVTRNL

SEQ ID NO: 1137905 - protein, 9 aa, Homo Sapiens
TLALVGGEI

SEQ ID NO: 1137906 - protein, 9 aa, Homo Sapiens
YPIIFVMGL

SEQ ID NO: 1137907 - protein, 9 aa, Homo Sapiens
TGELVPHWQ

SEQ ID NO: 1137908 - protein, 9 aa, Homo Sapiens
NLKKYSSCL

SEQ ID NO: 1137909 - protein, 9 aa, Homo Sapiens
IEKHGPPSS

SEQ ID NO: 1137910 - protein, 9 aa, Homo Sapiens
CCSASSTWA

SEQ ID NO: 1137911 - protein, 9 aa, Homo Sapiens
RSPVPPPPP

SEQ ID NO: 1137912 - protein, 9 aa, Homo Sapiens
VLLPDGGIT

SEQ ID NO: 1137913 - protein, 9 aa, Homo Sapiens
GSMDERKLR

SEQ ID NO: 1137914 - protein, 9 aa, Homo Sapiens
CVVTSMVTH

SEQ ID NO: 1137915 - protein, 9 aa, Homo Sapiens
GERGQMAPP

SEQ ID NO: 1137916 - protein, 9 aa, Homo Sapiens
QVTVHIVHV

SEQ ID NO: 1137917 - protein, 9 aa, Homo Sapiens
WFTRELAVR

SEQ ID NO: 1137918 - protein, 9 aa, Homo Sapiens
LRAGLMTAA

SEQ ID NO: 1137919 - protein, 9 aa, Homo Sapiens
DSDILCLSG

SEQ ID NO: 1137920 - protein, 9 aa, Homo Sapiens
APLEGTPFV

SEQ ID NO: 1137921 - protein, 9 aa, Homo Sapiens
RAPCCAGSR

SEQ ID NO: 1137922 - protein, 9 aa, Homo Sapiens
DLSLNFGRI

SEQ ID NO: 1137923 - protein, 9 aa, Homo Sapiens
MKGSRQRTQ

SEQ ID NO: 1137924 - protein, 9 aa, Homo Sapiens
ALRFVSSKH

SEQ ID NO: 1137925 - protein, 9 aa, Homo Sapiens
ASRSGRNAS

SEQ ID NO: 1137926 - protein, 9 aa, Homo Sapiens
RDSDAGRDG

SEQ ID NO: 1137927 - protein, 9 aa, Homo Sapiens
GLKGKKIFL

SEQ ID NO: 1137928 - protein, 9 aa, Homo Sapiens
WDHKLCRVY

SEQ ID NO: 1137929 - protein, 9 aa, Homo Sapiens
AQEAVQEVA

SEQ ID NO: 1137930 - protein, 9 aa, Homo Sapiens
SLLVGQPKN

SEQ ID NO: 1137931 - protein, 9 aa, Homo Sapiens
PQGALTPPH

SEQ ID NO: 1137932 - protein, 9 aa, Homo Sapiens
LAVTGSDGR

SEQ ID NO: 1137933 - protein, 9 aa, Homo Sapiens
SMETTRRRV

SEQ ID NO: 1137934 - protein, 9 aa, Homo Sapiens
HQVLTKPQQ

SEQ ID NO: 1137935 - protein, 9 aa, Homo Sapiens
VYKLIHKSA

SEQ ID NO: 1137936 - protein, 9 aa, Homo Sapiens
TTVQVLMMH

SEQ ID NO: 1137937 - protein, 9 aa, Homo Sapiens
VLDMGYTKR

SEQ ID NO: 1137938 - protein, 9 aa, Homo Sapiens
LPHGAARPL

SEQ ID NO: 1137939 - protein, 9 aa, Homo Sapiens
RPRRRRPPA

SEQ ID NO: 1137940 - protein, 9 aa, Homo Sapiens
PGRHTVSWG

SEQ ID NO: 1137941 - protein, 9 aa, Homo Sapiens
TYPLSLWKK

SEQ ID NO: 1137942 - protein, 9 aa, Homo Sapiens
FQTKVVEKC

SEQ ID NO: 1137943 - protein, 9 aa, Homo Sapiens
LQRSNQVAF

SEQ ID NO: 1137944 - protein, 9 aa, Homo Sapiens
VLGWPAFYQ

SEQ ID NO: 1137945 - protein, 9 aa, Homo Sapiens
ALRAWPRQR

SEQ ID NO: 1137946 - protein, 9 aa, Homo Sapiens
PVLLGFPVL

SEQ ID NO: 1137947 - protein, 9 aa, Homo Sapiens
EVLLPRLVC

SEQ ID NO: 1137948 - protein, 9 aa, Homo Sapiens
LAGFVSQIR

SEQ ID NO: 1137949 - protein, 9 aa, Homo Sapiens
ESGGASRAL

SEQ ID NO: 1137950 - protein, 9 aa, Homo Sapiens
SPEKDVTGA

SEQ ID NO: 1137951 - protein, 9 aa, Homo Sapiens
GQTDRERER

SEQ ID NO: 1137952 - protein, 9 aa, Homo Sapiens
IVLSSQDKT

SEQ ID NO: 1137953 - protein, 9 aa, Homo Sapiens
CPPTSCPSW

SEQ ID NO: 1137954 - protein, 9 aa, Homo Sapiens
FIVIHVGMA

SEQ ID NO: 1137955 - protein, 9 aa, Homo Sapiens
SPGPPCGPC

SEQ ID NO: 1137956 - protein, 9 aa, Homo Sapiens
IQEVLLEVQ

SEQ ID NO: 1137957 - protein, 9 aa, Homo Sapiens
PANPQLLCQ

SEQ ID NO: 1137958 - protein, 9 aa, Homo Sapiens
SEFEHCVQR

SEQ ID NO: 1137959 - protein, 9 aa, Homo Sapiens
MGGRHPSWP

SEQ ID NO: 1137960 - protein, 9 aa, Homo Sapiens
NREHIFSLP

SEQ ID NO: 1137961 - protein, 9 aa, Homo Sapiens
SLTGIADAT

SEQ ID NO: 1137962 - protein, 9 aa, Homo Sapiens
HSEALLHSL

SEQ ID NO: 1137963 - protein, 9 aa, Homo Sapiens
LLADGKWLS

SEQ ID NO: 1137964 - protein, 9 aa, Homo Sapiens
LTNLQMTAV

SEQ ID NO: 1137965 - protein, 9 aa, Homo Sapiens
APLIQKKQL

SEQ ID NO: 1137966 - protein, 9 aa, Homo Sapiens
ENRISHAST

SEQ ID NO: 1137967 - protein, 9 aa, Homo Sapiens
PTATAACPM

SEQ ID NO: 1137968 - protein, 9 aa, Homo Sapiens
SPQGQHKLL

SEQ ID NO: 1137969 - protein, 9 aa, Homo Sapiens
ARSAAAASP

SEQ ID NO: 1137970 - protein, 9 aa, Homo Sapiens
HLRITADGN

SEQ ID NO: 1137971 - protein, 9 aa, Homo Sapiens
INVCLSKKF

SEQ ID NO: 1137972 - protein, 9 aa, Homo Sapiens
MMTRREKIK

SEQ ID NO: 1137973 - protein, 9 aa, Homo Sapiens
YFAGQVEWE

SEQ ID NO: 1137974 - protein, 9 aa, Homo Sapiens
NTMGRDPSP

SEQ ID NO: 1137975 - protein, 9 aa, Homo Sapiens
RALPLPSRR

SEQ ID NO: 1137976 - protein, 9 aa, Homo Sapiens
PRDLGTVAG

SEQ ID NO: 1137977 - protein, 9 aa, Homo Sapiens
DLTYFLPFP

SEQ ID NO: 1137978 - protein, 9 aa, Homo Sapiens
MDTWNFCDI

SEQ ID NO: 1137979 - protein, 9 aa, Homo Sapiens
PSALPSQGA

SEQ ID NO: 1137980 - protein, 9 aa, Homo Sapiens
TDADHGWAF

SEQ ID NO: 1137981 - protein, 9 aa, Homo Sapiens
AINRVAMEN

SEQ ID NO: 1137982 - protein, 9 aa, Homo Sapiens
TDSSSCCQQ

SEQ ID NO: 1137983 - protein, 9 aa, Homo Sapiens
AEMTGLGKQ

SEQ ID NO: 1137984 - protein, 9 aa, Homo Sapiens
DVAAIHCKA

SEQ ID NO: 1137985 - protein, 9 aa, Homo Sapiens
DHQANCLSM

SEQ ID NO: 1137986 - protein, 9 aa, Homo Sapiens
GYTQPSDIS

SEQ ID NO: 1137987 - protein, 9 aa, Homo Sapiens
SPLRSERQP

SEQ ID NO: 1137988 - protein, 9 aa, Homo Sapiens
RPGRHICEG

SEQ ID NO: 1137989 - protein, 9 aa, Homo Sapiens
QQVSTALMK

SEQ ID NO: 1137990 - protein, 9 aa, Homo Sapiens
LGPLGRDSP

SEQ ID NO: 1137991 - protein, 9 aa, Homo Sapiens
MKKKNQNKK

SEQ ID NO: 1137992 - protein, 9 aa, Homo Sapiens
TRYFRKHTG

SEQ ID NO: 1137993 - protein, 9 aa, Homo Sapiens
FQNRIDSFH

SEQ ID NO: 1137994 - protein, 9 aa, Homo Sapiens
LMSWKQMLD

SEQ ID NO: 1137995 - protein, 9 aa, Homo Sapiens
SGAPQPSAA

SEQ ID NO: 1137996 - protein, 9 aa, Homo Sapiens
SERELDLLD

SEQ ID NO: 1137997 - protein, 9 aa, Homo Sapiens
DLFLLAIFC

SEQ ID NO: 1137998 - protein, 9 aa, Homo Sapiens
VSLVSRICP

SEQ ID NO: 1137999 - protein, 9 aa, Homo Sapiens
GPQTHCERR

SEQ ID NO: 1138000 - protein, 9 aa, Homo Sapiens
QRQQLAQLH

SEQ ID NO: 1138001 - protein, 9 aa, Homo Sapiens
PIAEVSELQ

SEQ ID NO: 1138002 - protein, 9 aa, Homo Sapiens
VKPLKQNQI

SEQ ID NO: 1138003 - protein, 9 aa, Homo Sapiens
APGAPPPGT

SEQ ID NO: 1138004 - protein, 9 aa, Homo Sapiens
PTWRRTGAS

SEQ ID NO: 1138005 - protein, 9 aa, Homo Sapiens
KVQADVEKC

SEQ ID NO: 1138006 - protein, 9 aa, Homo Sapiens
GCCRLLTEM

SEQ ID NO: 1138007 - protein, 9 aa, Homo Sapiens
LVIHSCQCS

SEQ ID NO: 1138008 - protein, 9 aa, Homo Sapiens
GLSNCETGR

SEQ ID NO: 1138009 - protein, 9 aa, Homo Sapiens
VQEKSTKSI

SEQ ID NO: 1138010 - protein, 9 aa, Homo Sapiens
HDMQRNVAV

SEQ ID NO: 1138011 - protein, 9 aa, Homo Sapiens
YVILEASET

SEQ ID NO: 1138012 - protein, 9 aa, Homo Sapiens
NFTEAAYAL

SEQ ID NO: 1138013 - protein, 9 aa, Homo Sapiens
EKRTQRIPI

SEQ ID NO: 1138014 - protein, 9 aa, Homo Sapiens
RLEKKESFL

SEQ ID NO: 1138015 - protein, 9 aa, Homo Sapiens
ISLPLPDRA

SEQ ID NO: 1138016 - protein, 9 aa, Homo Sapiens
ATARGPGGA

SEQ ID NO: 1138017 - protein, 9 aa, Homo Sapiens
LSKACLPLG

SEQ ID NO: 1138018 - protein, 9 aa, Homo Sapiens
LGDPDTDLD

SEQ ID NO: 1138019 - protein, 9 aa, Homo Sapiens
RERAQAEVG

SEQ ID NO: 1138020 - protein, 9 aa, Homo Sapiens
PTFPKGIAG

SEQ ID NO: 1138021 - protein, 9 aa, Homo Sapiens
LRPAGTLPA

SEQ ID NO: 1138022 - protein, 9 aa, Homo Sapiens
EPHPLCGLG

SEQ ID NO: 1138023 - protein, 9 aa, Homo Sapiens
VAEAPPGCI

SEQ ID NO: 1138024 - protein, 9 aa, Homo Sapiens
VKVNGTHVN

SEQ ID NO: 1138025 - protein, 9 aa, Homo Sapiens
SAFAPCCAP

SEQ ID NO: 1138026 - protein, 9 aa, Homo Sapiens
LDGMLTVIG

SEQ ID NO: 1138027 - protein, 9 aa, Homo Sapiens
GPQRRVRPG

SEQ ID NO: 1138028 - protein, 9 aa, Homo Sapiens
CDMSVLQRV

SEQ ID NO: 1138029 - protein, 9 aa, Homo Sapiens
STIEFYTKG

SEQ ID NO: 1138030 - protein, 9 aa, Homo Sapiens
GCKHDLLMR

SEQ ID NO: 1138031 - protein, 9 aa, Homo Sapiens
NDTYDVPRG

SEQ ID NO: 1138032 - protein, 9 aa, Homo Sapiens
YVMYTIGYS

SEQ ID NO: 1138033 - protein, 9 aa, Homo Sapiens
MYSLPLTYS

SEQ ID NO: 1138034 - protein, 9 aa, Homo Sapiens
KATKFEGDH

SEQ ID NO: 1138035 - protein, 9 aa, Homo Sapiens
EDVVLQDGD

SEQ ID NO: 1138036 - protein, 9 aa, Homo Sapiens
LLLFLILLH

SEQ ID NO: 1138037 - protein, 9 aa, Homo Sapiens
DELLFRRIA

SEQ ID NO: 1138038 - protein, 9 aa, Homo Sapiens
TRREAPAAA

SEQ ID NO: 1138039 - protein, 9 aa, Homo Sapiens
LPVEALKLC

SEQ ID NO: 1138040 - protein, 9 aa, Homo Sapiens
ECCLDPSMT

SEQ ID NO: 1138041 - protein, 9 aa, Homo Sapiens
CTLWPHQGP

SEQ ID NO: 1138042 - protein, 9 aa, Homo Sapiens
QLIVVKIES

SEQ ID NO: 1138043 - protein, 9 aa, Homo Sapiens
KHKSTVQVC

SEQ ID NO: 1138044 - protein, 9 aa, Homo Sapiens
PGQRPARQP

SEQ ID NO: 1138045 - protein, 9 aa, Homo Sapiens
PTSQVLWCA

SEQ ID NO: 1138046 - protein, 9 aa, Homo Sapiens
GSAEMTGLG

SEQ ID NO: 1138047 - protein, 9 aa, Homo Sapiens
NIRHSSSDF

SEQ ID NO: 1138048 - protein, 9 aa, Homo Sapiens
PCRRHCPRC

SEQ ID NO: 1138049 - protein, 9 aa, Homo Sapiens
GHIKAFSTC

SEQ ID NO: 1138050 - protein, 9 aa, Homo Sapiens
ETKESMTCS

SEQ ID NO: 1138051 - protein, 9 aa, Homo Sapiens
GSTWMRRRD

SEQ ID NO: 1138052 - protein, 9 aa, Homo Sapiens
PAGTGRSSR

SEQ ID NO: 1138053 - protein, 9 aa, Homo Sapiens
IVRLQVQLH

SEQ ID NO: 1138054 - protein, 9 aa, Homo Sapiens
RRFFRREDR

SEQ ID NO: 1138055 - protein, 9 aa, Homo Sapiens
AHRCRIPDR

SEQ ID NO: 1138056 - protein, 9 aa, Homo Sapiens
TAVSIPDYR

SEQ ID NO: 1138057 - protein, 9 aa, Homo Sapiens
SAITNRSDL

SEQ ID NO: 1138058 - protein, 9 aa, Homo Sapiens
AAVGPNRCD

SEQ ID NO: 1138059 - protein, 9 aa, Homo Sapiens
TQHEKTLRG

SEQ ID NO: 1138060 - protein, 9 aa, Homo Sapiens
AKVSRNTLF

SEQ ID NO: 1138061 - protein, 9 aa, Homo Sapiens
LGMIVQSII

SEQ ID NO: 1138062 - protein, 9 aa, Homo Sapiens
ITGGPVNET

SEQ ID NO: 1138063 - protein, 9 aa, Homo Sapiens
ERPYKGEEC

SEQ ID NO: 1138064 - protein, 9 aa, Homo Sapiens
AQLENMSAG

SEQ ID NO: 1138065 - protein, 9 aa, Homo Sapiens
NAVEHVFEG

SEQ ID NO: 1138066 - protein, 9 aa, Homo Sapiens
KLEEIGNQV

SEQ ID NO: 1138067 - protein, 9 aa, Homo Sapiens
IDKDLEYAH

SEQ ID NO: 1138068 - protein, 9 aa, Homo Sapiens
DVTNNSNRY

SEQ ID NO: 1138069 - protein, 9 aa, Homo Sapiens
HPTRMSHLA

SEQ ID NO: 1138070 - protein, 9 aa, Homo Sapiens
DYVSYTESE

SEQ ID NO: 1138071 - protein, 9 aa, Homo Sapiens
DIFLSFLSF

SEQ ID NO: 1138072 - protein, 9 aa, Homo Sapiens
NQKGEETEK

SEQ ID NO: 1138073 - protein, 9 aa, Homo Sapiens
SLVLINKIK

SEQ ID NO: 1138074 - protein, 9 aa, Homo Sapiens
GFRIVLDMG

SEQ ID NO: 1138075 - protein, 9 aa, Homo Sapiens
ALATLCIAG

SEQ ID NO: 1138076 - protein, 9 aa, Homo Sapiens
LFRAGKLEV

SEQ ID NO: 1138077 - protein, 9 aa, Homo Sapiens
LLKEPGKNK

SEQ ID NO: 1138078 - protein, 9 aa, Homo Sapiens
PSSGASWPP

SEQ ID NO: 1138079 - protein, 9 aa, Homo Sapiens
IVSLCPGVR

SEQ ID NO: 1138080 - protein, 9 aa, Homo Sapiens
HLVGNVYIK

SEQ ID NO: 1138081 - protein, 9 aa, Homo Sapiens
QKIGDTKRT

SEQ ID NO: 1138082 - protein, 9 aa, Homo Sapiens
KLAGADLAK

SEQ ID NO: 1138083 - protein, 9 aa, Homo Sapiens
TKSLDGSMD

SEQ ID NO: 1138084 - protein, 9 aa, Homo Sapiens
SRRTASSWG

SEQ ID NO: 1138085 - protein, 9 aa, Homo Sapiens
KKTTYKADQ

SEQ ID NO: 1138086 - protein, 9 aa, Homo Sapiens
QLLCGALRR

SEQ ID NO: 1138087 - protein, 9 aa, Homo Sapiens
FEHMQRARN

SEQ ID NO: 1138088 - protein, 9 aa, Homo Sapiens
RASPRPWSP

SEQ ID NO: 1138089 - protein, 9 aa, Homo Sapiens
KRSLWVDVD

SEQ ID NO: 1138090 - protein, 9 aa, Homo Sapiens
CQDTPTCVS

SEQ ID NO: 1138091 - protein, 9 aa, Homo Sapiens
LASGTSRPG

SEQ ID NO: 1138092 - protein, 9 aa, Homo Sapiens
TLGTTGGTA

SEQ ID NO: 1138093 - protein, 9 aa, Homo Sapiens
MSDAEKLEQ

SEQ ID NO: 1138094 - protein, 9 aa, Homo Sapiens
PVKNVFFLV

SEQ ID NO: 1138095 - protein, 9 aa, Homo Sapiens
LSALDVDCM

SEQ ID NO: 1138096 - protein, 9 aa, Homo Sapiens
GVATDTKVG

SEQ ID NO: 1138097 - protein, 9 aa, Homo Sapiens
AWRRSGRRS

SEQ ID NO: 1138098 - protein, 9 aa, Homo Sapiens
VKQEPAPPA

SEQ ID NO: 1138099 - protein, 9 aa, Homo Sapiens
HIFEPPPPK

SEQ ID NO: 1138100 - protein, 9 aa, Homo Sapiens
TMSQAVGLP

SEQ ID NO: 1138101 - protein, 9 aa, Homo Sapiens
LKQRRCTLK

SEQ ID NO: 1138102 - protein, 9 aa, Homo Sapiens
NTDISNARV

SEQ ID NO: 1138103 - protein, 9 aa, Homo Sapiens
LDTLKKARI

SEQ ID NO: 1138104 - protein, 9 aa, Homo Sapiens
ATADDFPVF

SEQ ID NO: 1138105 - protein, 9 aa, Homo Sapiens
VEATRYCHG

SEQ ID NO: 1138106 - protein, 9 aa, Homo Sapiens
CSIQEPGPL

SEQ ID NO: 1138107 - protein, 9 aa, Homo Sapiens
SGRLDLGVH

SEQ ID NO: 1138108 - protein, 9 aa, Homo Sapiens
DETDEDKFF

SEQ ID NO: 1138109 - protein, 9 aa, Homo Sapiens
EETLALFRL

SEQ ID NO: 1138110 - protein, 9 aa, Homo Sapiens
NEEKEQDAN

SEQ ID NO: 1138111 - protein, 9 aa, Homo Sapiens
PDHGRRRRT

SEQ ID NO: 1138112 - protein, 9 aa, Homo Sapiens
GADPPNPAR

SEQ ID NO: 1138113 - protein, 9 aa, Homo Sapiens
PRRKRCNRF

SEQ ID NO: 1138114 - protein, 9 aa, Homo Sapiens
SFDTILYYY

SEQ ID NO: 1138115 - protein, 9 aa, Homo Sapiens
LINLMVLDS

SEQ ID NO: 1138116 - protein, 9 aa, Homo Sapiens
PCKAGAQLR

SEQ ID NO: 1138117 - protein, 9 aa, Homo Sapiens
EIAVRIKGR

SEQ ID NO: 1138118 - protein, 9 aa, Homo Sapiens
YRVIQHHDT

SEQ ID NO: 1138119 - protein, 9 aa, Homo Sapiens
LLPPPVLPG

SEQ ID NO: 1138120 - protein, 9 aa, Homo Sapiens
LLWGTWCSS

SEQ ID NO: 1138121 - protein, 9 aa, Homo Sapiens
TAFSNLCKL

SEQ ID NO: 1138122 - protein, 9 aa, Homo Sapiens
LTSEPGSAG

SEQ ID NO: 1138123 - protein, 9 aa, Homo Sapiens
YLDLMPNLS

SEQ ID NO: 1138124 - protein, 9 aa, Homo Sapiens
GGSQGALFG

SEQ ID NO: 1138125 - protein, 9 aa, Homo Sapiens
TIKTVQASR

SEQ ID NO: 1138126 - protein, 9 aa, Homo Sapiens
FSCVGKKPE

SEQ ID NO: 1138127 - protein, 9 aa, Homo Sapiens
LNVSLQETS

SEQ ID NO: 1138128 - protein, 9 aa, Homo Sapiens
ELGGHTAHP

SEQ ID NO: 1138129 - protein, 9 aa, Homo Sapiens
VQSIKKTRL

SEQ ID NO: 1138130 - protein, 9 aa, Homo Sapiens
TRCIIEVIS

SEQ ID NO: 1138131 - protein, 9 aa, Homo Sapiens
ERVQFRVAS

SEQ ID NO: 1138132 - protein, 9 aa, Homo Sapiens
RVLEQKEVE

SEQ ID NO: 1138133 - protein, 9 aa, Homo Sapiens
QGKEVGEAL

SEQ ID NO: 1138134 - protein, 9 aa, Homo Sapiens
EAEQRRGRN

SEQ ID NO: 1138135 - protein, 9 aa, Homo Sapiens
FLEKIILYR

SEQ ID NO: 1138136 - protein, 9 aa, Homo Sapiens
LHTVEKLQV

SEQ ID NO: 1138137 - protein, 9 aa, Homo Sapiens
TKGFPRNSG

SEQ ID NO: 1138138 - protein, 9 aa, Homo Sapiens
NKRIEHSID

SEQ ID NO: 1138139 - protein, 9 aa, Homo Sapiens
KWKNDNKLK

SEQ ID NO: 1138140 - protein, 9 aa, Homo Sapiens
ASRAGGTRL

SEQ ID NO: 1138141 - protein, 9 aa, Homo Sapiens
LPLRFWANV

SEQ ID NO: 1138142 - protein, 9 aa, Homo Sapiens
PGRRSQHRP

SEQ ID NO: 1138143 - protein, 9 aa, Homo Sapiens
APMGHPPTS

SEQ ID NO: 1138144 - protein, 9 aa, Homo Sapiens
GSPGWWALQ

SEQ ID NO: 1138145 - protein, 9 aa, Homo Sapiens
SELRPVDTK

SEQ ID NO: 1138146 - protein, 9 aa, Homo Sapiens
EHHSTALAN

SEQ ID NO: 1138147 - protein, 9 aa, Homo Sapiens
CKQKRREGV

SEQ ID NO: 1138148 - protein, 9 aa, Homo Sapiens
VMEMANRVL

SEQ ID NO: 1138149 - protein, 9 aa, Homo Sapiens
GYHKKSSQR

SEQ ID NO: 1138150 - protein, 9 aa, Homo Sapiens
KVAIDTGCR

SEQ ID NO: 1138151 - protein, 9 aa, Homo Sapiens
KAWCVNCFS

SEQ ID NO: 1138152 - protein, 9 aa, Homo Sapiens
TLSTEAQRG

SEQ ID NO: 1138153 - protein, 9 aa, Homo Sapiens
SLKQGKKEQ

SEQ ID NO: 1138154 - protein, 9 aa, Homo Sapiens
VGMTPRDLG

SEQ ID NO: 1138155 - protein, 9 aa, Homo Sapiens
LTHQEVPVV

SEQ ID NO: 1138156 - protein, 9 aa, Homo Sapiens
SVTIHSFSG

SEQ ID NO: 1138157 - protein, 9 aa, Homo Sapiens
LYKWDHRAI

SEQ ID NO: 1138158 - protein, 9 aa, Homo Sapiens
EQAWPWRTR

SEQ ID NO: 1138159 - protein, 9 aa, Homo Sapiens
MSSGTDGGG

SEQ ID NO: 1138160 - protein, 9 aa, Homo Sapiens
RSECRLLYP

SEQ ID NO: 1138161 - protein, 9 aa, Homo Sapiens
WLGPASVAP

SEQ ID NO: 1138162 - protein, 9 aa, Homo Sapiens
VACRFHSPL

SEQ ID NO: 1138163 - protein, 9 aa, Homo Sapiens
PAACLDRDQ

SEQ ID NO: 1138164 - protein, 9 aa, Homo Sapiens
SNAGVAQPA

SEQ ID NO: 1138165 - protein, 9 aa, Homo Sapiens
TPRRRQSSA

SEQ ID NO: 1138166 - protein, 9 aa, Homo Sapiens
QKLPVFGQH

SEQ ID NO: 1138167 - protein, 9 aa, Homo Sapiens
RKGGNLVNK

SEQ ID NO: 1138168 - protein, 9 aa, Homo Sapiens
GERERLREL

SEQ ID NO: 1138169 - protein, 9 aa, Homo Sapiens
RHGRSRSSS

SEQ ID NO: 1138170 - protein, 9 aa, Homo Sapiens
AGAGLGCVA

SEQ ID NO: 1138171 - protein, 9 aa, Homo Sapiens
IAPDVVLRL

SEQ ID NO: 1138172 - protein, 9 aa, Homo Sapiens
LLASVLPPA

SEQ ID NO: 1138173 - protein, 9 aa, Homo Sapiens
LDRRRSCRH

SEQ ID NO: 1138174 - protein, 9 aa, Homo Sapiens
PASVATAPV

SEQ ID NO: 1138175 - protein, 9 aa, Homo Sapiens
PTTGMSVYY

SEQ ID NO: 1138176 - protein, 9 aa, Homo Sapiens
SYAPSSSNN

SEQ ID NO: 1138177 - protein, 9 aa, Homo Sapiens
RAWKVQLPE

SEQ ID NO: 1138178 - protein, 9 aa, Homo Sapiens
PPPPGSSPG

SEQ ID NO: 1138179 - protein, 9 aa, Homo Sapiens
LKVLAGPLA

SEQ ID NO: 1138180 - protein, 9 aa, Homo Sapiens
ARRALRFVS

SEQ ID NO: 1138181 - protein, 9 aa, Homo Sapiens
ACSILARLV

SEQ ID NO: 1138182 - protein, 9 aa, Homo Sapiens
SAYPLPEHH

SEQ ID NO: 1138183 - protein, 9 aa, Homo Sapiens
AGCRPMERD

SEQ ID NO: 1138184 - protein, 9 aa, Homo Sapiens
GRPEPGYER

SEQ ID NO: 1138185 - protein, 9 aa, Homo Sapiens
MERSQCGRR

SEQ ID NO: 1138186 - protein, 9 aa, Homo Sapiens
RLRAAGGAR

SEQ ID NO: 1138187 - protein, 9 aa, Homo Sapiens
LPASPGPPC

SEQ ID NO: 1138188 - protein, 9 aa, Homo Sapiens
RTRGRAGAP

SEQ ID NO: 1138189 - protein, 9 aa, Homo Sapiens
ASVSPPRSE

SEQ ID NO: 1138190 - protein, 9 aa, Homo Sapiens
MGHPPTSGV

SEQ ID NO: 1138191 - protein, 9 aa, Homo Sapiens
TPKRSRAQR

SEQ ID NO: 1138192 - protein, 9 aa, Homo Sapiens
LQSVDQLAR

SEQ ID NO: 1138193 - protein, 9 aa, Homo Sapiens
NKAGGPLPP

SEQ ID NO: 1138194 - protein, 9 aa, Homo Sapiens
GKKLKCGIL

SEQ ID NO: 1138195 - protein, 9 aa, Homo Sapiens
RGSRGGAVA

SEQ ID NO: 1138196 - protein, 9 aa, Homo Sapiens
RALFTSLAS

SEQ ID NO: 1138197 - protein, 9 aa, Homo Sapiens
ILQHITQNL

SEQ ID NO: 1138198 - protein, 9 aa, Homo Sapiens
CPLLYADLD

SEQ ID NO: 1138199 - protein, 9 aa, Homo Sapiens
REPCAAPCC

SEQ ID NO: 1138200 - protein, 9 aa, Homo Sapiens
QRWERTTFT

SEQ ID NO: 1138201 - protein, 9 aa, Homo Sapiens
AIQNSFQYL

SEQ ID NO: 1138202 - protein, 9 aa, Homo Sapiens
LACTHTSMI

SEQ ID NO: 1138203 - protein, 9 aa, Homo Sapiens
LTSACPSSP

SEQ ID NO: 1138204 - protein, 9 aa, Homo Sapiens
VITDGCHDP

SEQ ID NO: 1138205 - protein, 9 aa, Homo Sapiens
KGTASQSEN

SEQ ID NO: 1138206 - protein, 9 aa, Homo Sapiens
RRRRPSCTD

SEQ ID NO: 1138207 - protein, 9 aa, Homo Sapiens
SWRSECRLL

SEQ ID NO: 1138208 - protein, 9 aa, Homo Sapiens
WRIERQAMY

SEQ ID NO: 1138209 - protein, 9 aa, Homo Sapiens
PTSSHGGLR

SEQ ID NO: 1138210 - protein, 9 aa, Homo Sapiens
PSAVPSVAR

SEQ ID NO: 1138211 - protein, 9 aa, Homo Sapiens
ILVHRSAGV

SEQ ID NO: 1138212 - protein, 9 aa, Homo Sapiens
CPVTMEEKP

SEQ ID NO: 1138213 - protein, 9 aa, Homo Sapiens
LKLRNRTPA

SEQ ID NO: 1138214 - protein, 9 aa, Homo Sapiens
NKRKRQKQA

SEQ ID NO: 1138215 - protein, 9 aa, Homo Sapiens
HRGLSLLLV

SEQ ID NO: 1138216 - protein, 9 aa, Homo Sapiens
YRRTVRLRH

SEQ ID NO: 1138217 - protein, 9 aa, Homo Sapiens
VGSMWRQRG

SEQ ID NO: 1138218 - protein, 9 aa, Homo Sapiens
ARGGQSSLP

SEQ ID NO: 1138219 - protein, 9 aa, Homo Sapiens
DNVIESKAY

SEQ ID NO: 1138220 - protein, 9 aa, Homo Sapiens
DFEKSKKYS

SEQ ID NO: 1138221 - protein, 9 aa, Homo Sapiens
DRPGPRDLS

SEQ ID NO: 1138222 - protein, 9 aa, Homo Sapiens
ARTLPKVPA

SEQ ID NO: 1138223 - protein, 9 aa, Homo Sapiens
HEVETLPRK

SEQ ID NO: 1138224 - protein, 9 aa, Homo Sapiens
HEPICDPET

SEQ ID NO: 1138225 - protein, 9 aa, Homo Sapiens
PTTASGCAV

SEQ ID NO: 1138226 - protein, 9 aa, Homo Sapiens
GQGTPQIHA

SEQ ID NO: 1138227 - protein, 9 aa, Homo Sapiens
EGFAQRERP

SEQ ID NO: 1138228 - protein, 9 aa, Homo Sapiens
ALKICEEFK

SEQ ID NO: 1138229 - protein, 9 aa, Homo Sapiens
VQWSGCSRS

SEQ ID NO: 1138230 - protein, 9 aa, Homo Sapiens
RKALYGLEA

SEQ ID NO: 1138231 - protein, 9 aa, Homo Sapiens
SSQLSAGPL

SEQ ID NO: 1138232 - protein, 9 aa, Homo Sapiens
LPRHCLHPQ

SEQ ID NO: 1138233 - protein, 9 aa, Homo Sapiens
IQRLTIHHL

SEQ ID NO: 1138234 - protein, 9 aa, Homo Sapiens
SSAADVTTH

SEQ ID NO: 1138235 - protein, 9 aa, Homo Sapiens
PPAPPTVAL

SEQ ID NO: 1138236 - protein, 9 aa, Homo Sapiens
YQDDTLLIQ

SEQ ID NO: 1138237 - protein, 9 aa, Homo Sapiens
SPTWARTRS

SEQ ID NO: 1138238 - protein, 9 aa, Homo Sapiens
ENVIRDVVT

SEQ ID NO: 1138239 - protein, 9 aa, Homo Sapiens
AMQGTGIQG

SEQ ID NO: 1138240 - protein, 9 aa, Homo Sapiens
QASHSEENK

SEQ ID NO: 1138241 - protein, 9 aa, Homo Sapiens
AAVLVEHAE

SEQ ID NO: 1138242 - protein, 9 aa, Homo Sapiens
VKKMSQLLS

SEQ ID NO: 1138243 - protein, 9 aa, Homo Sapiens
HLSCRLVNW

SEQ ID NO: 1138244 - protein, 9 aa, Homo Sapiens
SMTTISRAT

SEQ ID NO: 1138245 - protein, 9 aa, Homo Sapiens
SARSPTWCR

SEQ ID NO: 1138246 - protein, 9 aa, Homo Sapiens
RPMSERLKH

SEQ ID NO: 1138247 - protein, 9 aa, Homo Sapiens
LLLAADQLL

SEQ ID NO: 1138248 - protein, 9 aa, Homo Sapiens
AQARHSVVF

SEQ ID NO: 1138249 - protein, 9 aa, Homo Sapiens
ATSELHQVL

SEQ ID NO: 1138250 - protein, 9 aa, Homo Sapiens
SSSSIQESS

SEQ ID NO: 1138251 - protein, 9 aa, Homo Sapiens
RDLWTDNCL

SEQ ID NO: 1138252 - protein, 9 aa, Homo Sapiens
GRGLPSPPP

SEQ ID NO: 1138253 - protein, 9 aa, Homo Sapiens
ARPGTSPGW

SEQ ID NO: 1138254 - protein, 9 aa, Homo Sapiens
IKCRVHPNF

SEQ ID NO: 1138255 - protein, 9 aa, Homo Sapiens
QTDVVLLGY

SEQ ID NO: 1138256 - protein, 9 aa, Homo Sapiens
PPSPTTPRW

SEQ ID NO: 1138257 - protein, 9 aa, Homo Sapiens
EFCELCTED

SEQ ID NO: 1138258 - protein, 9 aa, Homo Sapiens
NTGRLQTID

SEQ ID NO: 1138259 - protein, 9 aa, Homo Sapiens
RGLDSLAGR

SEQ ID NO: 1138260 - protein, 9 aa, Homo Sapiens
EKVVVRIQS

SEQ ID NO: 1138261 - protein, 9 aa, Homo Sapiens
SPVELEQVH

SEQ ID NO: 1138262 - protein, 9 aa, Homo Sapiens
QCLFLMSEA

SEQ ID NO: 1138263 - protein, 9 aa, Homo Sapiens
CHRTPWLCK

SEQ ID NO: 1138264 - protein, 9 aa, Homo Sapiens
HCPHEGPGG

SEQ ID NO: 1138265 - protein, 9 aa, Homo Sapiens
SREQPCGEC

SEQ ID NO: 1138266 - protein, 9 aa, Homo Sapiens
RMLFPTSVQ

SEQ ID NO: 1138267 - protein, 9 aa, Homo Sapiens
KRVQRERNP

SEQ ID NO: 1138268 - protein, 9 aa, Homo Sapiens
YIMLHIGIM

SEQ ID NO: 1138269 - protein, 9 aa, Homo Sapiens
KKTMNLTIE

SEQ ID NO: 1138270 - protein, 9 aa, Homo Sapiens
QCLDVGLAH

SEQ ID NO: 1138271 - protein, 9 aa, Homo Sapiens
QPRAFLGLD

SEQ ID NO: 1138272 - protein, 9 aa, Homo Sapiens
GGAWLLGPL

SEQ ID NO: 1138273 - protein, 9 aa, Homo Sapiens
EGSKFPAHR

SEQ ID NO: 1138274 - protein, 9 aa, Homo Sapiens
LGFQIKKKN

SEQ ID NO: 1138275 - protein, 9 aa, Homo Sapiens
EVLHIGSTH

SEQ ID NO: 1138276 - protein, 9 aa, Homo Sapiens
LHVAAMQMS

SEQ ID NO: 1138277 - protein, 9 aa, Homo Sapiens
KQSQQFLGV

SEQ ID NO: 1138278 - protein, 9 aa, Homo Sapiens
HCQLCSPVA

SEQ ID NO: 1138279 - protein, 9 aa, Homo Sapiens
LDYGAHRCR

SEQ ID NO: 1138280 - protein, 9 aa, Homo Sapiens
NAALILVIS

SEQ ID NO: 1138281 - protein, 9 aa, Homo Sapiens
GFAEGRRRT

SEQ ID NO: 1138282 - protein, 9 aa, Homo Sapiens
VGTFGFLAL

SEQ ID NO: 1138283 - protein, 9 aa, Homo Sapiens
FLRPELGPQ

SEQ ID NO: 1138284 - protein, 9 aa, Homo Sapiens
FSGLQKELT

SEQ ID NO: 1138285 - protein, 9 aa, Homo Sapiens
RRRRCCCCC

SEQ ID NO: 1138286 - protein, 9 aa, Homo Sapiens
LEETLALFR

SEQ ID NO: 1138287 - protein, 9 aa, Homo Sapiens
RCLRMRPPR

SEQ ID NO: 1138288 - protein, 9 aa, Homo Sapiens
AYCHPQGSF

SEQ ID NO: 1138289 - protein, 9 aa, Homo Sapiens
LLRCKLATF

SEQ ID NO: 1138290 - protein, 9 aa, Homo Sapiens
RPGSGISAQ

SEQ ID NO: 1138291 - protein, 9 aa, Homo Sapiens
DPVYFKILS

SEQ ID NO: 1138292 - protein, 9 aa, Homo Sapiens
AEGFDAKEE

SEQ ID NO: 1138293 - protein, 9 aa, Homo Sapiens
DVLLLLLLV

SEQ ID NO: 1138294 - protein, 9 aa, Homo Sapiens
VNNITSVLG

SEQ ID NO: 1138295 - protein, 9 aa, Homo Sapiens
PEEEAKKLY

SEQ ID NO: 1138296 - protein, 9 aa, Homo Sapiens
CLSGDIVPA

SEQ ID NO: 1138297 - protein, 9 aa, Homo Sapiens
TYNSNIFTD

SEQ ID NO: 1138298 - protein, 9 aa, Homo Sapiens
PSHPVSQMQ

SEQ ID NO: 1138299 - protein, 9 aa, Homo Sapiens
TTKNLLSYW

SEQ ID NO: 1138300 - protein, 9 aa, Homo Sapiens
SDTVTLPAA

SEQ ID NO: 1138301 - protein, 9 aa, Homo Sapiens
STVLSQKKS

SEQ ID NO: 1138302 - protein, 9 aa, Homo Sapiens
GPHSIRNTS

SEQ ID NO: 1138303 - protein, 9 aa, Homo Sapiens
LLRPSFIPH

SEQ ID NO: 1138304 - protein, 9 aa, Homo Sapiens
SVKSLPERR

SEQ ID NO: 1138305 - protein, 9 aa, Homo Sapiens
SLSFQCHLL

SEQ ID NO: 1138306 - protein, 9 aa, Homo Sapiens
LASSSSCGS

SEQ ID NO: 1138307 - protein, 9 aa, Homo Sapiens
EKDQRDSLK

SEQ ID NO: 1138308 - protein, 9 aa, Homo Sapiens
DSHRSSQDK

SEQ ID NO: 1138309 - protein, 9 aa, Homo Sapiens
REKEAGHFK

SEQ ID NO: 1138310 - protein, 9 aa, Homo Sapiens
LTAFSNLCK

SEQ ID NO: 1138311 - protein, 9 aa, Homo Sapiens
ILQNKAGGP

SEQ ID NO: 1138312 - protein, 9 aa, Homo Sapiens
ALALASTLE

SEQ ID NO: 1138313 - protein, 9 aa, Homo Sapiens
GEFDQGCLA

SEQ ID NO: 1138314 - protein, 9 aa, Homo Sapiens
RGILRPPST

SEQ ID NO: 1138315 - protein, 9 aa, Homo Sapiens
SSNEDENEA

SEQ ID NO: 1138316 - protein, 9 aa, Homo Sapiens
DSIHMGFVS

SEQ ID NO: 1138317 - protein, 9 aa, Homo Sapiens
WLLKDSLRG

SEQ ID NO: 1138318 - protein, 9 aa, Homo Sapiens
TLNSIGFLL

SEQ ID NO: 1138319 - protein, 9 aa, Homo Sapiens
PISKAVESP

SEQ ID NO: 1138320 - protein, 9 aa, Homo Sapiens
AQNLAARPP

SEQ ID NO: 1138321 - protein, 9 aa, Homo Sapiens
PSKRPSWYN

SEQ ID NO: 1138322 - protein, 9 aa, Homo Sapiens
MWWRDSTRL

SEQ ID NO: 1138323 - protein, 9 aa, Homo Sapiens
PDGGGSGSG

SEQ ID NO: 1138324 - protein, 9 aa, Homo Sapiens
FMACTVAYA

SEQ ID NO: 1138325 - protein, 9 aa, Homo Sapiens
SKTAGPHVS

SEQ ID NO: 1138326 - protein, 9 aa, Homo Sapiens
SITRFAFST

SEQ ID NO: 1138327 - protein, 9 aa, Homo Sapiens
HGHKHRKRD

SEQ ID NO: 1138328 - protein, 9 aa, Homo Sapiens
SQKSIVGHS

SEQ ID NO: 1138329 - protein, 9 aa, Homo Sapiens
VVFWWTALI

SEQ ID NO: 1138330 - protein, 9 aa, Homo Sapiens
ALSHLTDGS

SEQ ID NO: 1138331 - protein, 9 aa, Homo Sapiens
AREEPSSGM

SEQ ID NO: 1138332 - protein, 9 aa, Homo Sapiens
ALKGRITAL

SEQ ID NO: 1138333 - protein, 9 aa, Homo Sapiens
RDAAEESCT

SEQ ID NO: 1138334 - protein, 9 aa, Homo Sapiens
PLPALCPLT

SEQ ID NO: 1138335 - protein, 9 aa, Homo Sapiens
SREDFKQKV

SEQ ID NO: 1138336 - protein, 9 aa, Homo Sapiens
TWRSTRRCP

SEQ ID NO: 1138337 - protein, 9 aa, Homo Sapiens
GRALTAPRV

SEQ ID NO: 1138338 - protein, 9 aa, Homo Sapiens
RLTLITDML

SEQ ID NO: 1138339 - protein, 9 aa, Homo Sapiens
RPSLRPWAR

SEQ ID NO: 1138340 - protein, 9 aa, Homo Sapiens
LFLPDYLGL

SEQ ID NO: 1138341 - protein, 9 aa, Homo Sapiens
EHMQRARNG

SEQ ID NO: 1138342 - protein, 9 aa, Homo Sapiens
SSSPMVMSN

SEQ ID NO: 1138343 - protein, 9 aa, Homo Sapiens
SDDRPSPPQ

SEQ ID NO: 1138344 - protein, 9 aa, Homo Sapiens
RAARRVLEL

SEQ ID NO: 1138345 - protein, 9 aa, Homo Sapiens
CVAELGGHT

SEQ ID NO: 1138346 - protein, 9 aa, Homo Sapiens
QKEHRNLPL

SEQ ID NO: 1138347 - protein, 9 aa, Homo Sapiens
GQHIEQLSR

SEQ ID NO: 1138348 - protein, 9 aa, Homo Sapiens
PDYSVDVEE

SEQ ID NO: 1138349 - protein, 9 aa, Homo Sapiens
ALIVGHPKS

SEQ ID NO: 1138350 - protein, 9 aa, Homo Sapiens
ALERQVEEM

SEQ ID NO: 1138351 - protein, 9 aa, Homo Sapiens
SGCSLKILT

SEQ ID NO: 1138352 - protein, 9 aa, Homo Sapiens
KRLKKEKKN

SEQ ID NO: 1138353 - protein, 9 aa, Homo Sapiens
IMFIVIHVG

SEQ ID NO: 1138354 - protein, 9 aa, Homo Sapiens
SWNPKEHLS

SEQ ID NO: 1138355 - protein, 9 aa, Homo Sapiens
YNEFGLLIL

SEQ ID NO: 1138356 - protein, 9 aa, Homo Sapiens
AYEAIKHKL

SEQ ID NO: 1138357 - protein, 9 aa, Homo Sapiens
RAGHDAPAG

SEQ ID NO: 1138358 - protein, 9 aa, Homo Sapiens
LPPRPPALL

SEQ ID NO: 1138359 - protein, 9 aa, Homo Sapiens
RARQSCCLP

SEQ ID NO: 1138360 - protein, 9 aa, Homo Sapiens
PGVGERAPR

SEQ ID NO: 1138361 - protein, 9 aa, Homo Sapiens
LQPRGWQPA

SEQ ID NO: 1138362 - protein, 9 aa, Homo Sapiens
SVDVLDREG

SEQ ID NO: 1138363 - protein, 9 aa, Homo Sapiens
HEMNILYGI

SEQ ID NO: 1138364 - protein, 9 aa, Homo Sapiens
VIDEIHRVL

SEQ ID NO: 1138365 - protein, 9 aa, Homo Sapiens
RQLQVREHP

SEQ ID NO: 1138366 - protein, 9 aa, Homo Sapiens
RPSWYNILT

SEQ ID NO: 1138367 - protein, 9 aa, Homo Sapiens
APVNTYGPD

SEQ ID NO: 1138368 - protein, 9 aa, Homo Sapiens
EVMEKLPVR

SEQ ID NO: 1138369 - protein, 9 aa, Homo Sapiens
FRKKLNQIA

SEQ ID NO: 1138370 - protein, 9 aa, Homo Sapiens
NPSLDEGSI

SEQ ID NO: 1138371 - protein, 9 aa, Homo Sapiens
GGPSPQGQH

SEQ ID NO: 1138372 - protein, 9 aa, Homo Sapiens
FVRQYKSEA

SEQ ID NO: 1138373 - protein, 9 aa, Homo Sapiens
RSGQHCSGS

SEQ ID NO: 1138374 - protein, 9 aa, Homo Sapiens
VLKVCVNHW

SEQ ID NO: 1138375 - protein, 9 aa, Homo Sapiens
VTQQINECK

SEQ ID NO: 1138376 - protein, 9 aa, Homo Sapiens
ATSAAATTS

SEQ ID NO: 1138377 - protein, 9 aa, Homo Sapiens
FIGGVSLRP

SEQ ID NO: 1138378 - protein, 9 aa, Homo Sapiens
SPRLCATTT

SEQ ID NO: 1138379 - protein, 9 aa, Homo Sapiens
HLQNIMDFG

SEQ ID NO: 1138380 - protein, 9 aa, Homo Sapiens
PAAPPRSSR

SEQ ID NO: 1138381 - protein, 9 aa, Homo Sapiens
TLHGTYQNP

SEQ ID NO: 1138382 - protein, 9 aa, Homo Sapiens
RVRAPCCAG

SEQ ID NO: 1138383 - protein, 9 aa, Homo Sapiens
RKIFNGGSD

SEQ ID NO: 1138384 - protein, 9 aa, Homo Sapiens
VSQAYGAGA

SEQ ID NO: 1138385 - protein, 9 aa, Homo Sapiens
MIRKADVDQ

SEQ ID NO: 1138386 - protein, 9 aa, Homo Sapiens
ERIIIMCCT

SEQ ID NO: 1138387 - protein, 9 aa, Homo Sapiens
QLGGGQGGQ

SEQ ID NO: 1138388 - protein, 9 aa, Homo Sapiens
HILSNPEIM

SEQ ID NO: 1138389 - protein, 9 aa, Homo Sapiens
KEARSTVVS

SEQ ID NO: 1138390 - protein, 9 aa, Homo Sapiens
HLRTTITPE

SEQ ID NO: 1138391 - protein, 9 aa, Homo Sapiens
VGIWNTWYG

SEQ ID NO: 1138392 - protein, 9 aa, Homo Sapiens
GHCPHWASS

SEQ ID NO: 1138393 - protein, 9 aa, Homo Sapiens
NKPRVCPTS

SEQ ID NO: 1138394 - protein, 9 aa, Homo Sapiens
VGHGHEAET

SEQ ID NO: 1138395 - protein, 9 aa, Homo Sapiens
TQTRKTYPI

SEQ ID NO: 1138396 - protein, 9 aa, Homo Sapiens
SPSAFAKSQ

SEQ ID NO: 1138397 - protein, 9 aa, Homo Sapiens
KRSLLEMVL

SEQ ID NO: 1138398 - protein, 9 aa, Homo Sapiens
GPMGMCGFK

SEQ ID NO: 1138399 - protein, 9 aa, Homo Sapiens
PAAGLPVTG

SEQ ID NO: 1138400 - protein, 9 aa, Homo Sapiens
NTALCDCLP

SEQ ID NO: 1138401 - protein, 9 aa, Homo Sapiens
FQLRAPELV

SEQ ID NO: 1138402 - protein, 9 aa, Homo Sapiens
SDLEPPLLV

SEQ ID NO: 1138403 - protein, 9 aa, Homo Sapiens
HTGEKTFKC

SEQ ID NO: 1138404 - protein, 9 aa, Homo Sapiens
VQFPLFFLF

SEQ ID NO: 1138405 - protein, 9 aa, Homo Sapiens
LEALKICEE

SEQ ID NO: 1138406 - protein, 9 aa, Homo Sapiens
HGGNEAWKE

SEQ ID NO: 1138407 - protein, 9 aa, Homo Sapiens
LGVKTLCNL

SEQ ID NO: 1138408 - protein, 9 aa, Homo Sapiens
LFNYCLHEQ

SEQ ID NO: 1138409 - protein, 9 aa, Homo Sapiens
TALKSRKLT

SEQ ID NO: 1138410 - protein, 9 aa, Homo Sapiens
GRRTRKQTK

SEQ ID NO: 1138411 - protein, 9 aa, Homo Sapiens
KPSFCTADI

SEQ ID NO: 1138412 - protein, 9 aa, Homo Sapiens
EQVGGTLDT

SEQ ID NO: 1138413 - protein, 9 aa, Homo Sapiens
TTASGCAVP

SEQ ID NO: 1138414 - protein, 9 aa, Homo Sapiens
LQVREHPVA

SEQ ID NO: 1138415 - protein, 9 aa, Homo Sapiens
VAGSQVTVH

SEQ ID NO: 1138416 - protein, 9 aa, Homo Sapiens
LVDITDIRK

SEQ ID NO: 1138417 - protein, 9 aa, Homo Sapiens
VSLRNDAEE

SEQ ID NO: 1138418 - protein, 9 aa, Homo Sapiens
VLNNSYLKV

SEQ ID NO: 1138419 - protein, 9 aa, Homo Sapiens
LREEEEKKK

SEQ ID NO: 1138420 - protein, 9 aa, Homo Sapiens
GVQFPLFFL

SEQ ID NO: 1138421 - protein, 9 aa, Homo Sapiens
SMAVSPDPE

SEQ ID NO: 1138422 - protein, 9 aa, Homo Sapiens
WWRDSTRLR

SEQ ID NO: 1138423 - protein, 9 aa, Homo Sapiens
GAYAKQKLD

SEQ ID NO: 1138424 - protein, 9 aa, Homo Sapiens
ASCDAPQHA

SEQ ID NO: 1138425 - protein, 9 aa, Homo Sapiens
DLGKTMDNR

SEQ ID NO: 1138426 - protein, 9 aa, Homo Sapiens
GQVQKQSPS

SEQ ID NO: 1138427 - protein, 9 aa, Homo Sapiens
GFDAKEEHA

SEQ ID NO: 1138428 - protein, 9 aa, Homo Sapiens
IRGLDAISK

SEQ ID NO: 1138429 - protein, 9 aa, Homo Sapiens
AGRAPLHGV

SEQ ID NO: 1138430 - protein, 9 aa, Homo Sapiens
LYPRPWRRT

SEQ ID NO: 1138431 - protein, 9 aa, Homo Sapiens
VKAPTSQVL

SEQ ID NO: 1138432 - protein, 9 aa, Homo Sapiens
PQASLLCFQ

SEQ ID NO: 1138433 - protein, 9 aa, Homo Sapiens
VYPIIFVMG

SEQ ID NO: 1138434 - protein, 9 aa, Homo Sapiens
QPVIVPMHA

SEQ ID NO: 1138435 - protein, 9 aa, Homo Sapiens
VNRPVVILA

SEQ ID NO: 1138436 - protein, 9 aa, Homo Sapiens
HDGIKTSKI

SEQ ID NO: 1138437 - protein, 9 aa, Homo Sapiens
AHPTRGLCP

SEQ ID NO: 1138438 - protein, 9 aa, Homo Sapiens
YRFQMKFYF

SEQ ID NO: 1138439 - protein, 9 aa, Homo Sapiens
LLARLTIHI

SEQ ID NO: 1138440 - protein, 9 aa, Homo Sapiens
LCRALWEDV

SEQ ID NO: 1138441 - protein, 9 aa, Homo Sapiens
PNDISVDDQ

SEQ ID NO: 1138442 - protein, 9 aa, Homo Sapiens
LGLFYLSLA

SEQ ID NO: 1138443 - protein, 9 aa, Homo Sapiens
GPEEGDVCI

SEQ ID NO: 1138444 - protein, 9 aa, Homo Sapiens
GIHGRKKCS

SEQ ID NO: 1138445 - protein, 9 aa, Homo Sapiens
QFQYSSDST

SEQ ID NO: 1138446 - protein, 9 aa, Homo Sapiens
EILTLCASS

SEQ ID NO: 1138447 - protein, 9 aa, Homo Sapiens
EVDSLYLMQ

SEQ ID NO: 1138448 - protein, 9 aa, Homo Sapiens
GVEFGTRMI

SEQ ID NO: 1138449 - protein, 9 aa, Homo Sapiens
LLCQNPEKL

SEQ ID NO: 1138450 - protein, 9 aa, Homo Sapiens
RVVQSTLEQ

SEQ ID NO: 1138451 - protein, 9 aa, Homo Sapiens
AQQYHAASA

SEQ ID NO: 1138452 - protein, 9 aa, Homo Sapiens
VAIDTGCRH

SEQ ID NO: 1138453 - protein, 9 aa, Homo Sapiens
QTFMILRET

SEQ ID NO: 1138454 - protein, 9 aa, Homo Sapiens
AAGRASGFA

SEQ ID NO: 1138455 - protein, 9 aa, Homo Sapiens
YLKKKQEPP

SEQ ID NO: 1138456 - protein, 9 aa, Homo Sapiens
LPVPLPPSA

SEQ ID NO: 1138457 - protein, 9 aa, Homo Sapiens
KRQRESECK

SEQ ID NO: 1138458 - protein, 9 aa, Homo Sapiens
FPINNLCFV

SEQ ID NO: 1138459 - protein, 9 aa, Homo Sapiens
FMSDAEKLE

SEQ ID NO: 1138460 - protein, 9 aa, Homo Sapiens
DSEALHYDY

SEQ ID NO: 1138461 - protein, 9 aa, Homo Sapiens
QELLPPEGP

SEQ ID NO: 1138462 - protein, 9 aa, Homo Sapiens
EKMEYCFEV

SEQ ID NO: 1138463 - protein, 9 aa, Homo Sapiens
LWGMDWILA

SEQ ID NO: 1138464 - protein, 9 aa, Homo Sapiens
EGPAARAKV

SEQ ID NO: 1138465 - protein, 9 aa, Homo Sapiens
MMKKKNQNK

SEQ ID NO: 1138466 - protein, 9 aa, Homo Sapiens
DLAGSDRVA

SEQ ID NO: 1138467 - protein, 9 aa, Homo Sapiens
MTQERMTQA

SEQ ID NO: 1138468 - protein, 9 aa, Homo Sapiens
AKTTHNDNS

SEQ ID NO: 1138469 - protein, 9 aa, Homo Sapiens
WEHLVSTRF

SEQ ID NO: 1138470 - protein, 9 aa, Homo Sapiens
EHIMRHTQL

SEQ ID NO: 1138471 - protein, 9 aa, Homo Sapiens
SSGTPNAPH

SEQ ID NO: 1138472 - protein, 9 aa, Homo Sapiens
YVEDPEGLK

SEQ ID NO: 1138473 - protein, 9 aa, Homo Sapiens
DMEKARETL

SEQ ID NO: 1138474 - protein, 9 aa, Homo Sapiens
FEEGLGHIE

SEQ ID NO: 1138475 - protein, 9 aa, Homo Sapiens
PPPSPLPAP

SEQ ID NO: 1138476 - protein, 9 aa, Homo Sapiens
IDGRSYIVD

SEQ ID NO: 1138477 - protein, 9 aa, Homo Sapiens
LRTSGEPWD

SEQ ID NO: 1138478 - protein, 9 aa, Homo Sapiens
TSQVLWCAR

SEQ ID NO: 1138479 - protein, 9 aa, Homo Sapiens
VPRARGEEL

SEQ ID NO: 1138480 - protein, 9 aa, Homo Sapiens
KRKTGVAFK

SEQ ID NO: 1138481 - protein, 9 aa, Homo Sapiens
GKNSVTKVF

SEQ ID NO: 1138482 - protein, 9 aa, Homo Sapiens
CQQLLDEVL

SEQ ID NO: 1138483 - protein, 9 aa, Homo Sapiens
CGNQSIRYP

SEQ ID NO: 1138484 - protein, 9 aa, Homo Sapiens
AQGVLGHHT

SEQ ID NO: 1138485 - protein, 9 aa, Homo Sapiens
HLALPSLPA

SEQ ID NO: 1138486 - protein, 9 aa, Homo Sapiens
LGVYYVGVT

SEQ ID NO: 1138487 - protein, 9 aa, Homo Sapiens
PHGQIAGFI

SEQ ID NO: 1138488 - protein, 9 aa, Homo Sapiens
IQLKKGAGA

SEQ ID NO: 1138489 - protein, 9 aa, Homo Sapiens
NLRSLLPPA

SEQ ID NO: 1138490 - protein, 9 aa, Homo Sapiens
NECGEAFYG

SEQ ID NO: 1138491 - protein, 9 aa, Homo Sapiens
YVFLNVIVH

SEQ ID NO: 1138492 - protein, 9 aa, Homo Sapiens
RRTKRTTKS

SEQ ID NO: 1138493 - protein, 9 aa, Homo Sapiens
WGTMVRALG

SEQ ID NO: 1138494 - protein, 9 aa, Homo Sapiens
RRTGQLPVS

SEQ ID NO: 1138495 - protein, 9 aa, Homo Sapiens
ITDHGLRGL

SEQ ID NO: 1138496 - protein, 9 aa, Homo Sapiens
FGDLMHFCW

SEQ ID NO: 1138497 - protein, 9 aa, Homo Sapiens
PSAPTSRRA

SEQ ID NO: 1138498 - protein, 9 aa, Homo Sapiens
AKNPQVVPA

SEQ ID NO: 1138499 - protein, 9 aa, Homo Sapiens
PRNKVAQAK

SEQ ID NO: 1138500 - protein, 9 aa, Homo Sapiens
TLPAPSSCW

SEQ ID NO: 1138501 - protein, 9 aa, Homo Sapiens
PSSPIPRCV

SEQ ID NO: 1138502 - protein, 9 aa, Homo Sapiens
TRNKPSEGK

SEQ ID NO: 1138503 - protein, 9 aa, Homo Sapiens
FVVNRPWLF

SEQ ID NO: 1138504 - protein, 9 aa, Homo Sapiens
TSYDGVFIA

SEQ ID NO: 1138505 - protein, 9 aa, Homo Sapiens
VDGFHFAAI

SEQ ID NO: 1138506 - protein, 9 aa, Homo Sapiens
IYRCAHPLA

SEQ ID NO: 1138507 - protein, 9 aa, Homo Sapiens
LTVNRPVVI

SEQ ID NO: 1138508 - protein, 9 aa, Homo Sapiens
GVEEMATKK

SEQ ID NO: 1138509 - protein, 9 aa, Homo Sapiens
SPNEEGSED

SEQ ID NO: 1138510 - protein, 9 aa, Homo Sapiens
VLEQKEVEQ

SEQ ID NO: 1138511 - protein, 9 aa, Homo Sapiens
MAGAANVSS

SEQ ID NO: 1138512 - protein, 9 aa, Homo Sapiens
KHSTLLSVL

SEQ ID NO: 1138513 - protein, 9 aa, Homo Sapiens
VMVYSGGRY

SEQ ID NO: 1138514 - protein, 9 aa, Homo Sapiens
GGGSTRDGS

SEQ ID NO: 1138515 - protein, 9 aa, Homo Sapiens
ATPGNLVPV

SEQ ID NO: 1138516 - protein, 9 aa, Homo Sapiens
PSGLETTVF

SEQ ID NO: 1138517 - protein, 9 aa, Homo Sapiens
EKRVKMVSQ

SEQ ID NO: 1138518 - protein, 9 aa, Homo Sapiens
CEDSQLASH

SEQ ID NO: 1138519 - protein, 9 aa, Homo Sapiens
HQKLLQLLR

SEQ ID NO: 1138520 - protein, 9 aa, Homo Sapiens
VFLCHHEKI

SEQ ID NO: 1138521 - protein, 9 aa, Homo Sapiens
GHGHEAETL

SEQ ID NO: 1138522 - protein, 9 aa, Homo Sapiens
FIIVRASFT

SEQ ID NO: 1138523 - protein, 9 aa, Homo Sapiens
LGRAVFPGA

SEQ ID NO: 1138524 - protein, 9 aa, Homo Sapiens
LKTLPQPGA

SEQ ID NO: 1138525 - protein, 9 aa, Homo Sapiens
TESVSTFLK

SEQ ID NO: 1138526 - protein, 9 aa, Homo Sapiens
KLGVPELRI

SEQ ID NO: 1138527 - protein, 9 aa, Homo Sapiens
DTLKKARIF

SEQ ID NO: 1138528 - protein, 9 aa, Homo Sapiens
LRSCIPSTL

SEQ ID NO: 1138529 - protein, 9 aa, Homo Sapiens
QVLMMHQME

SEQ ID NO: 1138530 - protein, 9 aa, Homo Sapiens
GAHALNSWT

SEQ ID NO: 1138531 - protein, 9 aa, Homo Sapiens
SRQSVMSGR

SEQ ID NO: 1138532 - protein, 9 aa, Homo Sapiens
AFGNAHTNR

SEQ ID NO: 1138533 - protein, 9 aa, Homo Sapiens
GLGGEGDGT

SEQ ID NO: 1138534 - protein, 9 aa, Homo Sapiens
MRSPTEDKV

SEQ ID NO: 1138535 - protein, 9 aa, Homo Sapiens
SASPPSMRC

SEQ ID NO: 1138536 - protein, 9 aa, Homo Sapiens
VGRRRRRRK

SEQ ID NO: 1138537 - protein, 9 aa, Homo Sapiens
LVVFALVLY

SEQ ID NO: 1138538 - protein, 9 aa, Homo Sapiens
SVGALTGRS

SEQ ID NO: 1138539 - protein, 9 aa, Homo Sapiens
SPTSSVAGR

SEQ ID NO: 1138540 - protein, 9 aa, Homo Sapiens
AGFWTIFHI

SEQ ID NO: 1138541 - protein, 9 aa, Homo Sapiens
PGVTPATII

SEQ ID NO: 1138542 - protein, 9 aa, Homo Sapiens
KLHREDVPR

SEQ ID NO: 1138543 - protein, 9 aa, Homo Sapiens
SLACTHTSM

SEQ ID NO: 1138544 - protein, 9 aa, Homo Sapiens
KSKQQGVPQ

SEQ ID NO: 1138545 - protein, 9 aa, Homo Sapiens
IDTENIRFV

SEQ ID NO: 1138546 - protein, 9 aa, Homo Sapiens
YERMEQFTV

SEQ ID NO: 1138547 - protein, 9 aa, Homo Sapiens
YATEKRQLI

SEQ ID NO: 1138548 - protein, 9 aa, Homo Sapiens
CRLLTEMGK

SEQ ID NO: 1138549 - protein, 9 aa, Homo Sapiens
PPASATRAG

SEQ ID NO: 1138550 - protein, 9 aa, Homo Sapiens
VTVRSRSPR

SEQ ID NO: 1138551 - protein, 9 aa, Homo Sapiens
KKPPQPRVG

SEQ ID NO: 1138552 - protein, 9 aa, Homo Sapiens
FIGKNSVTK

SEQ ID NO: 1138553 - protein, 9 aa, Homo Sapiens
RWRSGGPRA

SEQ ID NO: 1138554 - protein, 9 aa, Homo Sapiens
VSIHRQLLS

SEQ ID NO: 1138555 - protein, 9 aa, Homo Sapiens
ALEKQKRQR

SEQ ID NO: 1138556 - protein, 9 aa, Homo Sapiens
QYSSDSTNG

SEQ ID NO: 1138557 - protein, 9 aa, Homo Sapiens
RTLKITTNT

SEQ ID NO: 1138558 - protein, 9 aa, Homo Sapiens
KVQLPEPSC

SEQ ID NO: 1138559 - protein, 9 aa, Homo Sapiens
TRIPFRVGL

SEQ ID NO: 1138560 - protein, 9 aa, Homo Sapiens
QLDDAVHAN

SEQ ID NO: 1138561 - protein, 9 aa, Homo Sapiens
AQDTSGHRG

SEQ ID NO: 1138562 - protein, 9 aa, Homo Sapiens
PGVQGQMVP

SEQ ID NO: 1138563 - protein, 9 aa, Homo Sapiens
EYADVVFWW

SEQ ID NO: 1138564 - protein, 9 aa, Homo Sapiens
DTFPPAQST

SEQ ID NO: 1138565 - protein, 9 aa, Homo Sapiens
GASLQVVLE

SEQ ID NO: 1138566 - protein, 9 aa, Homo Sapiens
PQQHFNTLD

SEQ ID NO: 1138567 - protein, 9 aa, Homo Sapiens
SYETYDEEE

SEQ ID NO: 1138568 - protein, 9 aa, Homo Sapiens
DCEGTAGVC

SEQ ID NO: 1138569 - protein, 9 aa, Homo Sapiens
NTWTSPSSR

SEQ ID NO: 1138570 - protein, 9 aa, Homo Sapiens
KETGLFRKI

SEQ ID NO: 1138571 - protein, 9 aa, Homo Sapiens
LAESGLVPA

SEQ ID NO: 1138572 - protein, 9 aa, Homo Sapiens
RPNGLHPNY

SEQ ID NO: 1138573 - protein, 9 aa, Homo Sapiens
DVPDQGLCD

SEQ ID NO: 1138574 - protein, 9 aa, Homo Sapiens
QENKAVQPL

SEQ ID NO: 1138575 - protein, 9 aa, Homo Sapiens
RPRTSHISA

SEQ ID NO: 1138576 - protein, 9 aa, Homo Sapiens
DIKLYQKDF

SEQ ID NO: 1138577 - protein, 9 aa, Homo Sapiens
EMVLESALT

SEQ ID NO: 1138578 - protein, 9 aa, Homo Sapiens
AGRGLPSPP

SEQ ID NO: 1138579 - protein, 9 aa, Homo Sapiens
KKKQLVQKA

SEQ ID NO: 1138580 - protein, 9 aa, Homo Sapiens
AIFIMLNYN

SEQ ID NO: 1138581 - protein, 9 aa, Homo Sapiens
RASRPTSSQ

SEQ ID NO: 1138582 - protein, 9 aa, Homo Sapiens
FADTFKKCV

SEQ ID NO: 1138583 - protein, 9 aa, Homo Sapiens
IANTKDSVP

SEQ ID NO: 1138584 - protein, 9 aa, Homo Sapiens
RIGMYMLHL

SEQ ID NO: 1138585 - protein, 9 aa, Homo Sapiens
ETKATTKLS

SEQ ID NO: 1138586 - protein, 9 aa, Homo Sapiens
LRFRNGWEP

SEQ ID NO: 1138587 - protein, 9 aa, Homo Sapiens
RRPWTAAAR

SEQ ID NO: 1138588 - protein, 9 aa, Homo Sapiens
LTLPPSKIT

SEQ ID NO: 1138589 - protein, 9 aa, Homo Sapiens
RGLWLMSPN

SEQ ID NO: 1138590 - protein, 9 aa, Homo Sapiens
KTATVECMY

SEQ ID NO: 1138591 - protein, 9 aa, Homo Sapiens
PGWKRTQQR

SEQ ID NO: 1138592 - protein, 9 aa, Homo Sapiens
EENCVLVTE

SEQ ID NO: 1138593 - protein, 9 aa, Homo Sapiens
LFRHYTMVA

SEQ ID NO: 1138594 - protein, 9 aa, Homo Sapiens
PAPPARDPP

SEQ ID NO: 1138595 - protein, 9 aa, Homo Sapiens
VLAGPLALA

SEQ ID NO: 1138596 - protein, 9 aa, Homo Sapiens
CTHPDEPLY

SEQ ID NO: 1138597 - protein, 9 aa, Homo Sapiens
ILTLCASSR

SEQ ID NO: 1138598 - protein, 9 aa, Homo Sapiens
LSDIKVEDT

SEQ ID NO: 1138599 - protein, 9 aa, Homo Sapiens
ECAGPKPAL

SEQ ID NO: 1138600 - protein, 9 aa, Homo Sapiens
NYHPSKKCK

SEQ ID NO: 1138601 - protein, 9 aa, Homo Sapiens
KAAVWAPRR

SEQ ID NO: 1138602 - protein, 9 aa, Homo Sapiens
LEKNPPLRF

SEQ ID NO: 1138603 - protein, 9 aa, Homo Sapiens
KQRLERTLD

SEQ ID NO: 1138604 - protein, 9 aa, Homo Sapiens
TGEKTFKCT

SEQ ID NO: 1138605 - protein, 9 aa, Homo Sapiens
STASHSFMA

SEQ ID NO: 1138606 - protein, 9 aa, Homo Sapiens
VSIFQDFSL

SEQ ID NO: 1138607 - protein, 9 aa, Homo Sapiens
REHIFSLPI

SEQ ID NO: 1138608 - protein, 9 aa, Homo Sapiens
SKGLATYAQ

SEQ ID NO: 1138609 - protein, 9 aa, Homo Sapiens
KEHEMNILY

SEQ ID NO: 1138610 - protein, 9 aa, Homo Sapiens
CCFSASPPS

SEQ ID NO: 1138611 - protein, 9 aa, Homo Sapiens
IQIVQKEAE

SEQ ID NO: 1138612 - protein, 9 aa, Homo Sapiens
DAVLARSDT

SEQ ID NO: 1138613 - protein, 9 aa, Homo Sapiens
STVGPSGTS

SEQ ID NO: 1138614 - protein, 9 aa, Homo Sapiens
ESPEKDVTG

SEQ ID NO: 1138615 - protein, 9 aa, Homo Sapiens
KAVAWMRTH

SEQ ID NO: 1138616 - protein, 9 aa, Homo Sapiens
MCGIWVLFG

SEQ ID NO: 1138617 - protein, 9 aa, Homo Sapiens
DRAGRMGGR

SEQ ID NO: 1138618 - protein, 9 aa, Homo Sapiens
VLFGSDDCL

SEQ ID NO: 1138619 - protein, 9 aa, Homo Sapiens
MAPGKSRSE

SEQ ID NO: 1138620 - protein, 9 aa, Homo Sapiens
PGYVGIGCE

SEQ ID NO: 1138621 - protein, 9 aa, Homo Sapiens
TLSLRRRCL

SEQ ID NO: 1138622 - protein, 9 aa, Homo Sapiens
PQCDALFNE

SEQ ID NO: 1138623 - protein, 9 aa, Homo Sapiens
FTSHGSPFT

SEQ ID NO: 1138624 - protein, 9 aa, Homo Sapiens
DQLFNQKKE

SEQ ID NO: 1138625 - protein, 9 aa, Homo Sapiens
FHNDIRVLR

SEQ ID NO: 1138626 - protein, 9 aa, Homo Sapiens
ASVLLNLRE

SEQ ID NO: 1138627 - protein, 9 aa, Homo Sapiens
GEEEEEGGN

SEQ ID NO: 1138628 - protein, 9 aa, Homo Sapiens
DTFHLLREE

SEQ ID NO: 1138629 - protein, 9 aa, Homo Sapiens
SLPPTGMTR

SEQ ID NO: 1138630 - protein, 9 aa, Homo Sapiens
GQHGILPIW

SEQ ID NO: 1138631 - protein, 9 aa, Homo Sapiens
HQITIPRGK

SEQ ID NO: 1138632 - protein, 9 aa, Homo Sapiens
NKDTCKSDA

SEQ ID NO: 1138633 - protein, 9 aa, Homo Sapiens
KTGTLTTNC

SEQ ID NO: 1138634 - protein, 9 aa, Homo Sapiens
KVFNSIGAD

SEQ ID NO: 1138635 - protein, 9 aa, Homo Sapiens
GVQYRELGN

SEQ ID NO: 1138636 - protein, 9 aa, Homo Sapiens
RDVLLNMCQ

SEQ ID NO: 1138637 - protein, 9 aa, Homo Sapiens
ASSSMTTST

SEQ ID NO: 1138638 - protein, 9 aa, Homo Sapiens
ASCPLDSNL

SEQ ID NO: 1138639 - protein, 9 aa, Homo Sapiens
GTKASRGSR

SEQ ID NO: 1138640 - protein, 9 aa, Homo Sapiens
GCSLKILTT

SEQ ID NO: 1138641 - protein, 9 aa, Homo Sapiens
AFICELRPH

SEQ ID NO: 1138642 - protein, 9 aa, Homo Sapiens
VEFGTRMIT

SEQ ID NO: 1138643 - protein, 9 aa, Homo Sapiens
FLNGNRTHP

SEQ ID NO: 1138644 - protein, 9 aa, Homo Sapiens
THTSMILIE

SEQ ID NO: 1138645 - protein, 9 aa, Homo Sapiens
QLWRWKPAT

SEQ ID NO: 1138646 - protein, 9 aa, Homo Sapiens
KLEVDSLYL

SEQ ID NO: 1138647 - protein, 9 aa, Homo Sapiens
TKLEPKPII

SEQ ID NO: 1138648 - protein, 9 aa, Homo Sapiens
DLFKDLGFF

SEQ ID NO: 1138649 - protein, 9 aa, Homo Sapiens
TNQINDQAS

SEQ ID NO: 1138650 - protein, 9 aa, Homo Sapiens
EERDLELEH

SEQ ID NO: 1138651 - protein, 9 aa, Homo Sapiens
TFEMHDDIE

SEQ ID NO: 1138652 - protein, 9 aa, Homo Sapiens
TLVYFSLVH

SEQ ID NO: 1138653 - protein, 9 aa, Homo Sapiens
CKIAELLSP

SEQ ID NO: 1138654 - protein, 9 aa, Homo Sapiens
DVEPDLHLE

SEQ ID NO: 1138655 - protein, 9 aa, Homo Sapiens
PKNSNIAGT

SEQ ID NO: 1138656 - protein, 9 aa, Homo Sapiens
SGRRSGSRS

SEQ ID NO: 1138657 - protein, 9 aa, Homo Sapiens
CLVIIHQRQ

SEQ ID NO: 1138658 - protein, 9 aa, Homo Sapiens
LWVEPRLER

SEQ ID NO: 1138659 - protein, 9 aa, Homo Sapiens
RSAASLPQL

SEQ ID NO: 1138660 - protein, 9 aa, Homo Sapiens
RKIPDCFSR

SEQ ID NO: 1138661 - protein, 9 aa, Homo Sapiens
VDHTAELWG

SEQ ID NO: 1138662 - protein, 9 aa, Homo Sapiens
SAPTQAKSP

SEQ ID NO: 1138663 - protein, 9 aa, Homo Sapiens
MARIFTHHL

SEQ ID NO: 1138664 - protein, 9 aa, Homo Sapiens
WSASCGPTS

SEQ ID NO: 1138665 - protein, 9 aa, Homo Sapiens
ETFGPNIPK

SEQ ID NO: 1138666 - protein, 9 aa, Homo Sapiens
RKALKPIKR

SEQ ID NO: 1138667 - protein, 9 aa, Homo Sapiens
RPVCQGQMA

SEQ ID NO: 1138668 - protein, 9 aa, Homo Sapiens
LAGRNTLGP

SEQ ID NO: 1138669 - protein, 9 aa, Homo Sapiens
ICQRGPTHT

SEQ ID NO: 1138670 - protein, 9 aa, Homo Sapiens
VCCEPFHKS

SEQ ID NO: 1138671 - protein, 9 aa, Homo Sapiens
AFSLRNFEV

SEQ ID NO: 1138672 - protein, 9 aa, Homo Sapiens
GKAFFKGVW

SEQ ID NO: 1138673 - protein, 9 aa, Homo Sapiens
PVIAASPAP

SEQ ID NO: 1138674 - protein, 9 aa, Homo Sapiens
ILLDTHFEL

SEQ ID NO: 1138675 - protein, 9 aa, Homo Sapiens
NIYRTMLQK

SEQ ID NO: 1138676 - protein, 9 aa, Homo Sapiens
DFGFAKCVK

SEQ ID NO: 1138677 - protein, 9 aa, Homo Sapiens
RSYNWNIDR

SEQ ID NO: 1138678 - protein, 9 aa, Homo Sapiens
RNSAKGPKG

SEQ ID NO: 1138679 - protein, 9 aa, Homo Sapiens
ELCPMGSCV

SEQ ID NO: 1138680 - protein, 9 aa, Homo Sapiens
NNPVHTLSE

SEQ ID NO: 1138681 - protein, 9 aa, Homo Sapiens
MRLMPKFLN

SEQ ID NO: 1138682 - protein, 9 aa, Homo Sapiens
RQYLQERRT

SEQ ID NO: 1138683 - protein, 9 aa, Homo Sapiens
VCHRMNDDW

SEQ ID NO: 1138684 - protein, 9 aa, Homo Sapiens
PPLTATWAP

SEQ ID NO: 1138685 - protein, 9 aa, Homo Sapiens
VHLDTLKKA

SEQ ID NO: 1138686 - protein, 9 aa, Homo Sapiens
RRPRPSLRP

SEQ ID NO: 1138687 - protein, 9 aa, Homo Sapiens
LRSFMKLYH

SEQ ID NO: 1138688 - protein, 9 aa, Homo Sapiens
PWPASSHAP

SEQ ID NO: 1138689 - protein, 9 aa, Homo Sapiens
QQLTNLQMT

SEQ ID NO: 1138690 - protein, 9 aa, Homo Sapiens
DSEGGRAPK

SEQ ID NO: 1138691 - protein, 9 aa, Homo Sapiens
SGERPYKGE

SEQ ID NO: 1138692 - protein, 9 aa, Homo Sapiens
TAACPMTAC

SEQ ID NO: 1138693 - protein, 9 aa, Homo Sapiens
SGEHASVYH

SEQ ID NO: 1138694 - protein, 9 aa, Homo Sapiens
PEVPRCAMA

SEQ ID NO: 1138695 - protein, 9 aa, Homo Sapiens
QAEGENDGG

SEQ ID NO: 1138696 - protein, 9 aa, Homo Sapiens
TAAATSLAT

SEQ ID NO: 1138697 - protein, 9 aa, Homo Sapiens
PPQQSGGAR

SEQ ID NO: 1138698 - protein, 9 aa, Homo Sapiens
WTSPSSRPG

SEQ ID NO: 1138699 - protein, 9 aa, Homo Sapiens
HILNFLRNG

SEQ ID NO: 1138700 - protein, 9 aa, Homo Sapiens
SERRRFFRR

SEQ ID NO: 1138701 - protein, 9 aa, Homo Sapiens
HPSQQAETR

SEQ ID NO: 1138702 - protein, 9 aa, Homo Sapiens
KTVDAAIRT

SEQ ID NO: 1138703 - protein, 9 aa, Homo Sapiens
SCRLVNWPE

SEQ ID NO: 1138704 - protein, 9 aa, Homo Sapiens
MKHKSREYE

SEQ ID NO: 1138705 - protein, 9 aa, Homo Sapiens
WKGWPQKYS

SEQ ID NO: 1138706 - protein, 9 aa, Homo Sapiens
QGARAGGLG

SEQ ID NO: 1138707 - protein, 9 aa, Homo Sapiens
HACQASGGC

SEQ ID NO: 1138708 - protein, 9 aa, Homo Sapiens
YHSEEEEEE

SEQ ID NO: 1138709 - protein, 9 aa, Homo Sapiens
SQTRTSAPR

SEQ ID NO: 1138710 - protein, 9 aa, Homo Sapiens
AVARMTTLN

SEQ ID NO: 1138711 - protein, 9 aa, Homo Sapiens
GMPAFSFSQ

SEQ ID NO: 1138712 - protein, 9 aa, Homo Sapiens
DFIGGVSLR

SEQ ID NO: 1138713 - protein, 9 aa, Homo Sapiens
LKSWIKHTQ

SEQ ID NO: 1138714 - protein, 9 aa, Homo Sapiens
NRTVAGTGA

SEQ ID NO: 1138715 - protein, 9 aa, Homo Sapiens
GGQQSLYCR

SEQ ID NO: 1138716 - protein, 9 aa, Homo Sapiens
QMVPPLPDS

SEQ ID NO: 1138717 - protein, 9 aa, Homo Sapiens
TLAHTASPH

SEQ ID NO: 1138718 - protein, 9 aa, Homo Sapiens
CTNATGLHK

SEQ ID NO: 1138719 - protein, 9 aa, Homo Sapiens
LARRPLLPG

SEQ ID NO: 1138720 - protein, 9 aa, Homo Sapiens
LLTVAVETQ

SEQ ID NO: 1138721 - protein, 9 aa, Homo Sapiens
KQVITFTDV

SEQ ID NO: 1138722 - protein, 9 aa, Homo Sapiens
VNFPINNLC

SEQ ID NO: 1138723 - protein, 9 aa, Homo Sapiens
AGWRSPAAV

SEQ ID NO: 1138724 - protein, 9 aa, Homo Sapiens
LQPLWHVGS

SEQ ID NO: 1138725 - protein, 9 aa, Homo Sapiens
EVREELQKK

SEQ ID NO: 1138726 - protein, 9 aa, Homo Sapiens
KDSTSSYEA

SEQ ID NO: 1138727 - protein, 9 aa, Homo Sapiens
GLFLNSTFP

SEQ ID NO: 1138728 - protein, 9 aa, Homo Sapiens
TSTRCRWAG

SEQ ID NO: 1138729 - protein, 9 aa, Homo Sapiens
NVQLVSGVY

SEQ ID NO: 1138730 - protein, 9 aa, Homo Sapiens
MPVYAEVKR

SEQ ID NO: 1138731 - protein, 9 aa, Homo Sapiens
KYCCDAPHS

SEQ ID NO: 1138732 - protein, 9 aa, Homo Sapiens
PGVSETEVA

SEQ ID NO: 1138733 - protein, 9 aa, Homo Sapiens
KNRQRVRYD

SEQ ID NO: 1138734 - protein, 9 aa, Homo Sapiens
VNPYKWLTV

SEQ ID NO: 1138735 - protein, 9 aa, Homo Sapiens
RRSYNEFGL

SEQ ID NO: 1138736 - protein, 9 aa, Homo Sapiens
KWHLLSEHS

SEQ ID NO: 1138737 - protein, 9 aa, Homo Sapiens
QQHIFEPPP

SEQ ID NO: 1138738 - protein, 9 aa, Homo Sapiens
WPEEEEAEA

SEQ ID NO: 1138739 - protein, 9 aa, Homo Sapiens
RPTSRARQS

SEQ ID NO: 1138740 - protein, 9 aa, Homo Sapiens
TPSQGTHIR

SEQ ID NO: 1138741 - protein, 9 aa, Homo Sapiens
HYSVSFSKE

SEQ ID NO: 1138742 - protein, 9 aa, Homo Sapiens
QPHLSVSAQ

SEQ ID NO: 1138743 - protein, 9 aa, Homo Sapiens
KPDCVNIEE

SEQ ID NO: 1138744 - protein, 9 aa, Homo Sapiens
DGYNGTTMC

SEQ ID NO: 1138745 - protein, 9 aa, Homo Sapiens
RLKVCPVCQ

SEQ ID NO: 1138746 - protein, 9 aa, Homo Sapiens
NCHKTKLKA

SEQ ID NO: 1138747 - protein, 9 aa, Homo Sapiens
PEEFFDYSL

SEQ ID NO: 1138748 - protein, 9 aa, Homo Sapiens
NVIHHKVLS

SEQ ID NO: 1138749 - protein, 9 aa, Homo Sapiens
KRWERFVHN

SEQ ID NO: 1138750 - protein, 9 aa, Homo Sapiens
RPRLLPLTR

SEQ ID NO: 1138751 - protein, 9 aa, Homo Sapiens
GVKGPDSPD

SEQ ID NO: 1138752 - protein, 9 aa, Homo Sapiens
LFGLISVRL

SEQ ID NO: 1138753 - protein, 9 aa, Homo Sapiens
WSFCFSPLW

SEQ ID NO: 1138754 - protein, 9 aa, Homo Sapiens
GRQQVMAQS

SEQ ID NO: 1138755 - protein, 9 aa, Homo Sapiens
GMSPALHRK

SEQ ID NO: 1138756 - protein, 9 aa, Homo Sapiens
GRRCWRGCC

SEQ ID NO: 1138757 - protein, 9 aa, Homo Sapiens
SSQPPLTAT

SEQ ID NO: 1138758 - protein, 9 aa, Homo Sapiens
DQQKSSLSN

SEQ ID NO: 1138759 - protein, 9 aa, Homo Sapiens
VRRLMSVDM

SEQ ID NO: 1138760 - protein, 9 aa, Homo Sapiens
PVGVLTSKP

SEQ ID NO: 1138761 - protein, 9 aa, Homo Sapiens
DEMLTHSIM

SEQ ID NO: 1138762 - protein, 9 aa, Homo Sapiens
HKLLCRETG

SEQ ID NO: 1138763 - protein, 9 aa, Homo Sapiens
RGAISRIHL

SEQ ID NO: 1138764 - protein, 9 aa, Homo Sapiens
PPPGGRAWA

SEQ ID NO: 1138765 - protein, 9 aa, Homo Sapiens
HVLGLAVLA

SEQ ID NO: 1138766 - protein, 9 aa, Homo Sapiens
DGKFAIFIM

SEQ ID NO: 1138767 - protein, 9 aa, Homo Sapiens
GTSITLSTI

SEQ ID NO: 1138768 - protein, 9 aa, Homo Sapiens
QSLEAQVNR

SEQ ID NO: 1138769 - protein, 9 aa, Homo Sapiens
HVYMRNIVH

SEQ ID NO: 1138770 - protein, 9 aa, Homo Sapiens
YTLYWPEEG

SEQ ID NO: 1138771 - protein, 9 aa, Homo Sapiens
GIVEAMVAC

SEQ ID NO: 1138772 - protein, 9 aa, Homo Sapiens
IEKNLIWQV

SEQ ID NO: 1138773 - protein, 9 aa, Homo Sapiens
RWKGPRRTR

SEQ ID NO: 1138774 - protein, 9 aa, Homo Sapiens
ESPGLYVFL

SEQ ID NO: 1138775 - protein, 9 aa, Homo Sapiens
VEAREDTAE

SEQ ID NO: 1138776 - protein, 9 aa, Homo Sapiens
QQKCLMKTS

SEQ ID NO: 1138777 - protein, 9 aa, Homo Sapiens
RASAIAQDT

SEQ ID NO: 1138778 - protein, 9 aa, Homo Sapiens
RSGRWKPPA

SEQ ID NO: 1138779 - protein, 9 aa, Homo Sapiens
IVASDHRSF

SEQ ID NO: 1138780 - protein, 9 aa, Homo Sapiens
TAGPSYPGL

SEQ ID NO: 1138781 - protein, 9 aa, Homo Sapiens
LMDRSREQY

SEQ ID NO: 1138782 - protein, 9 aa, Homo Sapiens
SSSPHICQR

SEQ ID NO: 1138783 - protein, 9 aa, Homo Sapiens
EAKQNGYVP

SEQ ID NO: 1138784 - protein, 9 aa, Homo Sapiens
SKQYVKTIS

SEQ ID NO: 1138785 - protein, 9 aa, Homo Sapiens
RQVKSKSPS

SEQ ID NO: 1138786 - protein, 9 aa, Homo Sapiens
AYSVKSRDK

SEQ ID NO: 1138787 - protein, 9 aa, Homo Sapiens
RDDGDWQAC

SEQ ID NO: 1138788 - protein, 9 aa, Homo Sapiens
GFARPPQLR

SEQ ID NO: 1138789 - protein, 9 aa, Homo Sapiens
HSWSLSPLH

SEQ ID NO: 1138790 - protein, 9 aa, Homo Sapiens
YVLLKEVVK

SEQ ID NO: 1138791 - protein, 9 aa, Homo Sapiens
EEQRKALYG

SEQ ID NO: 1138792 - protein, 9 aa, Homo Sapiens
LFPLLSRPR

SEQ ID NO: 1138793 - protein, 9 aa, Homo Sapiens
GAEQGPSSQ

SEQ ID NO: 1138794 - protein, 9 aa, Homo Sapiens
LHPGEDERV

SEQ ID NO: 1138795 - protein, 9 aa, Homo Sapiens
GADPEEELA

SEQ ID NO: 1138796 - protein, 9 aa, Homo Sapiens
FEGTVFFGT

SEQ ID NO: 1138797 - protein, 9 aa, Homo Sapiens
MSSDAFGML

SEQ ID NO: 1138798 - protein, 9 aa, Homo Sapiens
AQATSELHQ

SEQ ID NO: 1138799 - protein, 9 aa, Homo Sapiens
WKYYAKKNL

SEQ ID NO: 1138800 - protein, 9 aa, Homo Sapiens
EPLKKRILC

SEQ ID NO: 1138801 - protein, 9 aa, Homo Sapiens
PCRTSTTRA

SEQ ID NO: 1138802 - protein, 9 aa, Homo Sapiens
VSTGPPHPT

SEQ ID NO: 1138803 - protein, 9 aa, Homo Sapiens
WDAPCPLLE

SEQ ID NO: 1138804 - protein, 9 aa, Homo Sapiens
QLCPQRAPA

SEQ ID NO: 1138805 - protein, 9 aa, Homo Sapiens
KLYFRGLKH

SEQ ID NO: 1138806 - protein, 9 aa, Homo Sapiens
GNTTHRCLL

SEQ ID NO: 1138807 - protein, 9 aa, Homo Sapiens
EKVSKKRLP

SEQ ID NO: 1138808 - protein, 9 aa, Homo Sapiens
TTSRLSSRS

SEQ ID NO: 1138809 - protein, 9 aa, Homo Sapiens
GQGTACLLA

SEQ ID NO: 1138810 - protein, 9 aa, Homo Sapiens
ASDHRSFTT

SEQ ID NO: 1138811 - protein, 9 aa, Homo Sapiens
RGLTLGGGL

SEQ ID NO: 1138812 - protein, 9 aa, Homo Sapiens
TVKMACPRD

SEQ ID NO: 1138813 - protein, 9 aa, Homo Sapiens
LSQCKTHTC

SEQ ID NO: 1138814 - protein, 9 aa, Homo Sapiens
MYHLPATQE

SEQ ID NO: 1138815 - protein, 9 aa, Homo Sapiens
EVVMEMANR

SEQ ID NO: 1138816 - protein, 9 aa, Homo Sapiens
SSVLERFLQ

SEQ ID NO: 1138817 - protein, 9 aa, Homo Sapiens
FFLNGNRTH

SEQ ID NO: 1138818 - protein, 9 aa, Homo Sapiens
GLWLMSPNR

SEQ ID NO: 1138819 - protein, 9 aa, Homo Sapiens
ILSLRSETT

SEQ ID NO: 1138820 - protein, 9 aa, Homo Sapiens
MSWKQMLDH

SEQ ID NO: 1138821 - protein, 9 aa, Homo Sapiens
NNSNRYSID

SEQ ID NO: 1138822 - protein, 9 aa, Homo Sapiens
KIESIMFHW

SEQ ID NO: 1138823 - protein, 9 aa, Homo Sapiens
GGDFTHHNG

SEQ ID NO: 1138824 - protein, 9 aa, Homo Sapiens
HFFVTPQLF

SEQ ID NO: 1138825 - protein, 9 aa, Homo Sapiens
AIKKNYCTK

SEQ ID NO: 1138826 - protein, 9 aa, Homo Sapiens
SYAAWLSQD

SEQ ID NO: 1138827 - protein, 9 aa, Homo Sapiens
VLDSTLASM

SEQ ID NO: 1138828 - protein, 9 aa, Homo Sapiens
RSPTPPYPG

SEQ ID NO: 1138829 - protein, 9 aa, Homo Sapiens
SWALLWSPL

SEQ ID NO: 1138830 - protein, 9 aa, Homo Sapiens
EADDDKKGC

SEQ ID NO: 1138831 - protein, 9 aa, Homo Sapiens
STREEQEIR

SEQ ID NO: 1138832 - protein, 9 aa, Homo Sapiens
LLAVALLAV

SEQ ID NO: 1138833 - protein, 9 aa, Homo Sapiens
VHVHPHDVH

SEQ ID NO: 1138834 - protein, 9 aa, Homo Sapiens
CERHILGVF

SEQ ID NO: 1138835 - protein, 9 aa, Homo Sapiens
GAQLYACQN

SEQ ID NO: 1138836 - protein, 9 aa, Homo Sapiens
RPHAYYTLS

SEQ ID NO: 1138837 - protein, 9 aa, Homo Sapiens
KNPSMKSFI

SEQ ID NO: 1138838 - protein, 9 aa, Homo Sapiens
LEDQVRKQE

SEQ ID NO: 1138839 - protein, 9 aa, Homo Sapiens
AEARKVVLA

SEQ ID NO: 1138840 - protein, 9 aa, Homo Sapiens
SWMAKGVQK

SEQ ID NO: 1138841 - protein, 9 aa, Homo Sapiens
SFGYNLQVQ

SEQ ID NO: 1138842 - protein, 9 aa, Homo Sapiens
KDSLRGNSK

SEQ ID NO: 1138843 - protein, 9 aa, Homo Sapiens
LSNPLNCTH

SEQ ID NO: 1138844 - protein, 9 aa, Homo Sapiens
IADMYSSVA

SEQ ID NO: 1138845 - protein, 9 aa, Homo Sapiens
LTAFAQMAQ

SEQ ID NO: 1138846 - protein, 9 aa, Homo Sapiens
YDQQRMEII

SEQ ID NO: 1138847 - protein, 9 aa, Homo Sapiens
IAYGAMTIG

SEQ ID NO: 1138848 - protein, 9 aa, Homo Sapiens
RAVIVGHLM

SEQ ID NO: 1138849 - protein, 9 aa, Homo Sapiens
EAWWLSNVD

SEQ ID NO: 1138850 - protein, 9 aa, Homo Sapiens
LEEKMEYCF

SEQ ID NO: 1138851 - protein, 9 aa, Homo Sapiens
TYIRTGDGR

SEQ ID NO: 1138852 - protein, 9 aa, Homo Sapiens
SSPSCSAWT

SEQ ID NO: 1138853 - protein, 9 aa, Homo Sapiens
KGYHIHNQT

SEQ ID NO: 1138854 - protein, 9 aa, Homo Sapiens
NLPGEPGTP

SEQ ID NO: 1138855 - protein, 9 aa, Homo Sapiens
PIPLPALCP

SEQ ID NO: 1138856 - protein, 9 aa, Homo Sapiens
GAGPPTAAS

SEQ ID NO: 1138857 - protein, 9 aa, Homo Sapiens
GCCSASSTW

SEQ ID NO: 1138858 - protein, 9 aa, Homo Sapiens
ASPQPFCGN

SEQ ID NO: 1138859 - protein, 9 aa, Homo Sapiens
SSRRRRCLA

SEQ ID NO: 1138860 - protein, 9 aa, Homo Sapiens
RTPWLCKPV

SEQ ID NO: 1138861 - protein, 9 aa, Homo Sapiens
YAIGDLKDQ

SEQ ID NO: 1138862 - protein, 9 aa, Homo Sapiens
SIRRTKRTT

SEQ ID NO: 1138863 - protein, 9 aa, Homo Sapiens
TLVTAPQDL

SEQ ID NO: 1138864 - protein, 9 aa, Homo Sapiens
GPVNETLKL

SEQ ID NO: 1138865 - protein, 9 aa, Homo Sapiens
SPDVQRVDA

SEQ ID NO: 1138866 - protein, 9 aa, Homo Sapiens
GIMGQFDHP

SEQ ID NO: 1138867 - protein, 9 aa, Homo Sapiens
WHRFGASLY

SEQ ID NO: 1138868 - protein, 9 aa, Homo Sapiens
MRPGQGQNY

SEQ ID NO: 1138869 - protein, 9 aa, Homo Sapiens
SIDEAWWLS

SEQ ID NO: 1138870 - protein, 9 aa, Homo Sapiens
TSCSEQPAL

SEQ ID NO: 1138871 - protein, 9 aa, Homo Sapiens
PHLASGTAG

SEQ ID NO: 1138872 - protein, 9 aa, Homo Sapiens
CLKPTACAG

SEQ ID NO: 1138873 - protein, 9 aa, Homo Sapiens
LPPGRAWAP

SEQ ID NO: 1138874 - protein, 9 aa, Homo Sapiens
HACDPNLTF

SEQ ID NO: 1138875 - protein, 9 aa, Homo Sapiens
DKVFNSIGA

SEQ ID NO: 1138876 - protein, 9 aa, Homo Sapiens
TLEIHSVQL

SEQ ID NO: 1138877 - protein, 9 aa, Homo Sapiens
RQPSRPTGR

SEQ ID NO: 1138878 - protein, 9 aa, Homo Sapiens
PRRRAWLTA

SEQ ID NO: 1138879 - protein, 9 aa, Homo Sapiens
SKDKVGRLS

SEQ ID NO: 1138880 - protein, 9 aa, Homo Sapiens
PPPQAPSQV

SEQ ID NO: 1138881 - protein, 9 aa, Homo Sapiens
VQSIIHGGA

SEQ ID NO: 1138882 - protein, 9 aa, Homo Sapiens
RTRSRRTRG

SEQ ID NO: 1138883 - protein, 9 aa, Homo Sapiens
KLVHADGDQ

SEQ ID NO: 1138884 - protein, 9 aa, Homo Sapiens
DPNIYRTML

SEQ ID NO: 1138885 - protein, 9 aa, Homo Sapiens
QIQKKKIRK

SEQ ID NO: 1138886 - protein, 9 aa, Homo Sapiens
TSAPTQAKS

SEQ ID NO: 1138887 - protein, 9 aa, Homo Sapiens
EVGHSIRFE

SEQ ID NO: 1138888 - protein, 9 aa, Homo Sapiens
KENHFLFFV

SEQ ID NO: 1138889 - protein, 9 aa, Homo Sapiens
VGRPHLGPP

SEQ ID NO: 1138890 - protein, 9 aa, Homo Sapiens
KWYKQHLSC

SEQ ID NO: 1138891 - protein, 9 aa, Homo Sapiens
SEQRAGQSH

SEQ ID NO: 1138892 - protein, 9 aa, Homo Sapiens
NCFSCSTCN

SEQ ID NO: 1138893 - protein, 9 aa, Homo Sapiens
TNLTPNTTL

SEQ ID NO: 1138894 - protein, 9 aa, Homo Sapiens
QVGVYEEVK

SEQ ID NO: 1138895 - protein, 9 aa, Homo Sapiens
EKRRRGQPP

SEQ ID NO: 1138896 - protein, 9 aa, Homo Sapiens
PLPPRRPPP

SEQ ID NO: 1138897 - protein, 9 aa, Homo Sapiens
MREQEERRI

SEQ ID NO: 1138898 - protein, 9 aa, Homo Sapiens
LQASWSPSA

SEQ ID NO: 1138899 - protein, 9 aa, Homo Sapiens
HRRRRRCCC

SEQ ID NO: 1138900 - protein, 9 aa, Homo Sapiens
RVIQHHDTH

SEQ ID NO: 1138901 - protein, 9 aa, Homo Sapiens
KAICTGPND

SEQ ID NO: 1138902 - protein, 9 aa, Homo Sapiens
AGVHYQAWV

SEQ ID NO: 1138903 - protein, 9 aa, Homo Sapiens
VLQDLWENT

SEQ ID NO: 1138904 - protein, 9 aa, Homo Sapiens
SKFPAHRSL

SEQ ID NO: 1138905 - protein, 9 aa, Homo Sapiens
VASADLKEL

SEQ ID NO: 1138906 - protein, 9 aa, Homo Sapiens
GLLYSRTTS

SEQ ID NO: 1138907 - protein, 9 aa, Homo Sapiens
QTKKRKKWR

SEQ ID NO: 1138908 - protein, 9 aa, Homo Sapiens
RCINPNDKK

SEQ ID NO: 1138909 - protein, 9 aa, Homo Sapiens
PFLIAVMFG

SEQ ID NO: 1138910 - protein, 9 aa, Homo Sapiens
GTKQGHLLY

SEQ ID NO: 1138911 - protein, 9 aa, Homo Sapiens
LHIHGVPPL

SEQ ID NO: 1138912 - protein, 9 aa, Homo Sapiens
YYGGDSEGG

SEQ ID NO: 1138913 - protein, 9 aa, Homo Sapiens
NNPSQAKLQ

SEQ ID NO: 1138914 - protein, 9 aa, Homo Sapiens
WGLDPVFLV

SEQ ID NO: 1138915 - protein, 9 aa, Homo Sapiens
PGHWGADAA

SEQ ID NO: 1138916 - protein, 9 aa, Homo Sapiens
KLGAPRPTW

SEQ ID NO: 1138917 - protein, 9 aa, Homo Sapiens
YEYLSHMGP

SEQ ID NO: 1138918 - protein, 9 aa, Homo Sapiens
AQIVPKRIR

SEQ ID NO: 1138919 - protein, 9 aa, Homo Sapiens
LHKEIALHK

SEQ ID NO: 1138920 - protein, 9 aa, Homo Sapiens
LLPLPPLPA

SEQ ID NO: 1138921 - protein, 9 aa, Homo Sapiens
TVWVPWLPL

SEQ ID NO: 1138922 - protein, 9 aa, Homo Sapiens
QKVVTSPKS

SEQ ID NO: 1138923 - protein, 9 aa, Homo Sapiens
VTSFPVALP

SEQ ID NO: 1138924 - protein, 9 aa, Homo Sapiens
KESRGSMSA

SEQ ID NO: 1138925 - protein, 9 aa, Homo Sapiens
EDDTDDLTP

SEQ ID NO: 1138926 - protein, 9 aa, Homo Sapiens
PESKYVPLI

SEQ ID NO: 1138927 - protein, 9 aa, Homo Sapiens
YPSIDEAWW

SEQ ID NO: 1138928 - protein, 9 aa, Homo Sapiens
RFMGMLPPD

SEQ ID NO: 1138929 - protein, 9 aa, Homo Sapiens
DIPSYTFSC

SEQ ID NO: 1138930 - protein, 9 aa, Homo Sapiens
SQLSAGPLG

SEQ ID NO: 1138931 - protein, 9 aa, Homo Sapiens
HSIDLRSGD

SEQ ID NO: 1138932 - protein, 9 aa, Homo Sapiens
CEGKMANFS

SEQ ID NO: 1138933 - protein, 9 aa, Homo Sapiens
SSPMVMSNQ

SEQ ID NO: 1138934 - protein, 9 aa, Homo Sapiens
QVFLKMILG

SEQ ID NO: 1138935 - protein, 9 aa, Homo Sapiens
PPCTRLHGN

SEQ ID NO: 1138936 - protein, 9 aa, Homo Sapiens
LLTGETVYF

SEQ ID NO: 1138937 - protein, 9 aa, Homo Sapiens
RGEQGLPDP

SEQ ID NO: 1138938 - protein, 9 aa, Homo Sapiens
PHQAVCLTR

SEQ ID NO: 1138939 - protein, 9 aa, Homo Sapiens
CEQNEEVSP

SEQ ID NO: 1138940 - protein, 9 aa, Homo Sapiens
TKDDGILST

SEQ ID NO: 1138941 - protein, 9 aa, Homo Sapiens
AGCVYWLIS

SEQ ID NO: 1138942 - protein, 9 aa, Homo Sapiens
PPPPRTCCH

SEQ ID NO: 1138943 - protein, 9 aa, Homo Sapiens
SHLTDGSNK

SEQ ID NO: 1138944 - protein, 9 aa, Homo Sapiens
ECRLLYPVL

SEQ ID NO: 1138945 - protein, 9 aa, Homo Sapiens
LSLRAQSLK

SEQ ID NO: 1138946 - protein, 9 aa, Homo Sapiens
LLDAANQCQ

SEQ ID NO: 1138947 - protein, 9 aa, Homo Sapiens
TPHRRYFKK

SEQ ID NO: 1138948 - protein, 9 aa, Homo Sapiens
HSYPEGFVY

SEQ ID NO: 1138949 - protein, 9 aa, Homo Sapiens
NGLSVVVTT

SEQ ID NO: 1138950 - protein, 9 aa, Homo Sapiens
PLLGAGLGP

SEQ ID NO: 1138951 - protein, 9 aa, Homo Sapiens
RFSYKLKMA

SEQ ID NO: 1138952 - protein, 9 aa, Homo Sapiens
LALFRLNHD

SEQ ID NO: 1138953 - protein, 9 aa, Homo Sapiens
SVMSCSLLT

SEQ ID NO: 1138954 - protein, 9 aa, Homo Sapiens
TVLNRPPRF

SEQ ID NO: 1138955 - protein, 9 aa, Homo Sapiens
ASASRPTSS

SEQ ID NO: 1138956 - protein, 9 aa, Homo Sapiens
KSALETKAT

SEQ ID NO: 1138957 - protein, 9 aa, Homo Sapiens
RVTNPYNDL

SEQ ID NO: 1138958 - protein, 9 aa, Homo Sapiens
SLQGSKASK

SEQ ID NO: 1138959 - protein, 9 aa, Homo Sapiens
WAGARGRWW

SEQ ID NO: 1138960 - protein, 9 aa, Homo Sapiens
DDRGEGLLI

SEQ ID NO: 1138961 - protein, 9 aa, Homo Sapiens
SLDLDHTQH

SEQ ID NO: 1138962 - protein, 9 aa, Homo Sapiens
PISQQKPSP

SEQ ID NO: 1138963 - protein, 9 aa, Homo Sapiens
TAEEKKLGS

SEQ ID NO: 1138964 - protein, 9 aa, Homo Sapiens
KDPTQWIVT

SEQ ID NO: 1138965 - protein, 9 aa, Homo Sapiens
LVNNNNHTE

SEQ ID NO: 1138966 - protein, 9 aa, Homo Sapiens
SNMRMEHIA

SEQ ID NO: 1138967 - protein, 9 aa, Homo Sapiens
FGRGAARDA

SEQ ID NO: 1138968 - protein, 9 aa, Homo Sapiens
QQINECKRR

SEQ ID NO: 1138969 - protein, 9 aa, Homo Sapiens
AKESQASIC

SEQ ID NO: 1138970 - protein, 9 aa, Homo Sapiens
PRDSDAGRD

SEQ ID NO: 1138971 - protein, 9 aa, Homo Sapiens
VPGLHGSLL

SEQ ID NO: 1138972 - protein, 9 aa, Homo Sapiens
SDCSDDTSE

SEQ ID NO: 1138973 - protein, 9 aa, Homo Sapiens
QATPEARFP

SEQ ID NO: 1138974 - protein, 9 aa, Homo Sapiens
THAERIETI

SEQ ID NO: 1138975 - protein, 9 aa, Homo Sapiens
YRTMLQKRL

SEQ ID NO: 1138976 - protein, 9 aa, Homo Sapiens
RETSLASCS

SEQ ID NO: 1138977 - protein, 9 aa, Homo Sapiens
VHQVWVKFD

SEQ ID NO: 1138978 - protein, 9 aa, Homo Sapiens
YALLYKCDL

SEQ ID NO: 1138979 - protein, 9 aa, Homo Sapiens
RQDMEKARE

SEQ ID NO: 1138980 - protein, 9 aa, Homo Sapiens
HHKDRESLS

SEQ ID NO: 1138981 - protein, 9 aa, Homo Sapiens
RLSWLTDPI

SEQ ID NO: 1138982 - protein, 9 aa, Homo Sapiens
LLKRSDLLG

SEQ ID NO: 1138983 - protein, 9 aa, Homo Sapiens
MGGAWPRPL

SEQ ID NO: 1138984 - protein, 9 aa, Homo Sapiens
SFSQPRNQT

SEQ ID NO: 1138985 - protein, 9 aa, Homo Sapiens
PKKNQLLPV

SEQ ID NO: 1138986 - protein, 9 aa, Homo Sapiens
EAIIVEDED

SEQ ID NO: 1138987 - protein, 9 aa, Homo Sapiens
VWGSAMPVD

SEQ ID NO: 1138988 - protein, 9 aa, Homo Sapiens
APKLEPSFS

SEQ ID NO: 1138989 - protein, 9 aa, Homo Sapiens
ATLAVHPPE

SEQ ID NO: 1138990 - protein, 9 aa, Homo Sapiens
QTMSQAVGL

SEQ ID NO: 1138991 - protein, 9 aa, Homo Sapiens
SLQRSQSDP

SEQ ID NO: 1138992 - protein, 9 aa, Homo Sapiens
TFDYEQFRD

SEQ ID NO: 1138993 - protein, 9 aa, Homo Sapiens
KVKAKVRQY

SEQ ID NO: 1138994 - protein, 9 aa, Homo Sapiens
PSNKEDEGL

SEQ ID NO: 1138995 - protein, 9 aa, Homo Sapiens
NLAGRNTLG

SEQ ID NO: 1138996 - protein, 9 aa, Homo Sapiens
ALASTLESS

SEQ ID NO: 1138997 - protein, 9 aa, Homo Sapiens
AKKLPKEAV

SEQ ID NO: 1138998 - protein, 9 aa, Homo Sapiens
NNMENLRQC

SEQ ID NO: 1138999 - protein, 9 aa, Homo Sapiens
VYVACNAKD

SEQ ID NO: 1139000 - protein, 9 aa, Homo Sapiens
HLPPEVPGL

SEQ ID NO: 1139001 - protein, 9 aa, Homo Sapiens
RAKGPVLLG

SEQ ID NO: 1139002 - protein, 9 aa, Homo Sapiens
KSKQYVKTI

SEQ ID NO: 1139003 - protein, 9 aa, Homo Sapiens
GKLEVDSLY

SEQ ID NO: 1139004 - protein, 9 aa, Homo Sapiens
APAPGSPRL

SEQ ID NO: 1139005 - protein, 9 aa, Homo Sapiens
IHSVLETSA

SEQ ID NO: 1139006 - protein, 9 aa, Homo Sapiens
PGAERVWRL

SEQ ID NO: 1139007 - protein, 9 aa, Homo Sapiens
RCLWPNCGK

SEQ ID NO: 1139008 - protein, 9 aa, Homo Sapiens
RSDAAPGGS

SEQ ID NO: 1139009 - protein, 9 aa, Homo Sapiens
AYLIFALGN

SEQ ID NO: 1139010 - protein, 9 aa, Homo Sapiens
TAARPSATN

SEQ ID NO: 1139011 - protein, 9 aa, Homo Sapiens
AAIERVEMP

SEQ ID NO: 1139012 - protein, 9 aa, Homo Sapiens
KGQRMLVGD

SEQ ID NO: 1139013 - protein, 9 aa, Homo Sapiens
AVQAGDGHG

SEQ ID NO: 1139014 - protein, 9 aa, Homo Sapiens
TNGITYASI

SEQ ID NO: 1139015 - protein, 9 aa, Homo Sapiens
GWIYTLSGT

SEQ ID NO: 1139016 - protein, 9 aa, Homo Sapiens
CLWMALCPR

SEQ ID NO: 1139017 - protein, 9 aa, Homo Sapiens
SAYDCTIPP

SEQ ID NO: 1139018 - protein, 9 aa, Homo Sapiens
LRDAEPGPA

SEQ ID NO: 1139019 - protein, 9 aa, Homo Sapiens
FGNAHTNRN

SEQ ID NO: 1139020 - protein, 9 aa, Homo Sapiens
GAQYPPPAA

SEQ ID NO: 1139021 - protein, 9 aa, Homo Sapiens
DVGRHLREL

SEQ ID NO: 1139022 - protein, 9 aa, Homo Sapiens
KLFASLVPT

SEQ ID NO: 1139023 - protein, 9 aa, Homo Sapiens
PPTRPSSPP

SEQ ID NO: 1139024 - protein, 9 aa, Homo Sapiens
AHQQGLQHH

SEQ ID NO: 1139025 - protein, 9 aa, Homo Sapiens
NVAPPAFSG

SEQ ID NO: 1139026 - protein, 9 aa, Homo Sapiens
LPYHTIDAS

SEQ ID NO: 1139027 - protein, 9 aa, Homo Sapiens
AMASSTWRS

SEQ ID NO: 1139028 - protein, 9 aa, Homo Sapiens
GNLTYSVCH

SEQ ID NO: 1139029 - protein, 9 aa, Homo Sapiens
ALPILASRA

SEQ ID NO: 1139030 - protein, 9 aa, Homo Sapiens
PPPHPQVPP

SEQ ID NO: 1139031 - protein, 9 aa, Homo Sapiens
CAQGRKPGA

SEQ ID NO: 1139032 - protein, 9 aa, Homo Sapiens
TQTSYALFI

SEQ ID NO: 1139033 - protein, 9 aa, Homo Sapiens
MWWLIGAES

SEQ ID NO: 1139034 - protein, 9 aa, Homo Sapiens
LWLPLPPTP

SEQ ID NO: 1139035 - protein, 9 aa, Homo Sapiens
HTDLQSKFS

SEQ ID NO: 1139036 - protein, 9 aa, Homo Sapiens
TIRSHRPCL

SEQ ID NO: 1139037 - protein, 9 aa, Homo Sapiens
VAPATGPAP

SEQ ID NO: 1139038 - protein, 9 aa, Homo Sapiens
NEDENEAER

SEQ ID NO: 1139039 - protein, 9 aa, Homo Sapiens
PCSEWPREP

SEQ ID NO: 1139040 - protein, 9 aa, Homo Sapiens
VVAAPASSE

SEQ ID NO: 1139041 - protein, 9 aa, Homo Sapiens
SPDDGGRTG

SEQ ID NO: 1139042 - protein, 9 aa, Homo Sapiens
ACDTMDTVD

SEQ ID NO: 1139043 - protein, 9 aa, Homo Sapiens
LKYLELGFT

SEQ ID NO: 1139044 - protein, 9 aa, Homo Sapiens
LLERPYPEQ

SEQ ID NO: 1139045 - protein, 9 aa, Homo Sapiens
RERAGQTSV

SEQ ID NO: 1139046 - protein, 9 aa, Homo Sapiens
QHYSVSFSK

SEQ ID NO: 1139047 - protein, 9 aa, Homo Sapiens
YNTPLWLNT

SEQ ID NO: 1139048 - protein, 9 aa, Homo Sapiens
VSRGAISRI

SEQ ID NO: 1139049 - protein, 9 aa, Homo Sapiens
VLASHKCLM

SEQ ID NO: 1139050 - protein, 9 aa, Homo Sapiens
VTLPAAPNM

SEQ ID NO: 1139051 - protein, 9 aa, Homo Sapiens
PTPMDSHRS

SEQ ID NO: 1139052 - protein, 9 aa, Homo Sapiens
DQILLQTQK

SEQ ID NO: 1139053 - protein, 9 aa, Homo Sapiens
ALRNHYRKY

SEQ ID NO: 1139054 - protein, 9 aa, Homo Sapiens
EGLIRSRVC

SEQ ID NO: 1139055 - protein, 9 aa, Homo Sapiens
FSLHVLIEY

SEQ ID NO: 1139056 - protein, 9 aa, Homo Sapiens
PGLFVKTMV

SEQ ID NO: 1139057 - protein, 9 aa, Homo Sapiens
FDKTQSETI

SEQ ID NO: 1139058 - protein, 9 aa, Homo Sapiens
TVATGVSYT

SEQ ID NO: 1139059 - protein, 9 aa, Homo Sapiens
VQEQDIETV

SEQ ID NO: 1139060 - protein, 9 aa, Homo Sapiens
PLMLPPKPE

SEQ ID NO: 1139061 - protein, 9 aa, Homo Sapiens
ESAKPVTPP

SEQ ID NO: 1139062 - protein, 9 aa, Homo Sapiens
PPEYTCTLS

SEQ ID NO: 1139063 - protein, 9 aa, Homo Sapiens
TKPSGLETT

SEQ ID NO: 1139064 - protein, 9 aa, Homo Sapiens
LTMESAKPV

SEQ ID NO: 1139065 - protein, 9 aa, Homo Sapiens
LGGMSGDQA

SEQ ID NO: 1139066 - protein, 9 aa, Homo Sapiens
GGGYAKIYK

SEQ ID NO: 1139067 - protein, 9 aa, Homo Sapiens
PWRALASSK

SEQ ID NO: 1139068 - protein, 9 aa, Homo Sapiens
LFPPLHSHV

SEQ ID NO: 1139069 - protein, 9 aa, Homo Sapiens
VFLGRALTA

SEQ ID NO: 1139070 - protein, 9 aa, Homo Sapiens
QCPLNQQQW

SEQ ID NO: 1139071 - protein, 9 aa, Homo Sapiens
ARNSVLVIQ

SEQ ID NO: 1139072 - protein, 9 aa, Homo Sapiens
SDPQHNFKQ

SEQ ID NO: 1139073 - protein, 9 aa, Homo Sapiens
LDHEDDFCE

SEQ ID NO: 1139074 - protein, 9 aa, Homo Sapiens
VTVHIVHVG

SEQ ID NO: 1139075 - protein, 9 aa, Homo Sapiens
RISDVFLCH

SEQ ID NO: 1139076 - protein, 9 aa, Homo Sapiens
CQMSGTSGK

SEQ ID NO: 1139077 - protein, 9 aa, Homo Sapiens
PAHNYLALR

SEQ ID NO: 1139078 - protein, 9 aa, Homo Sapiens
LLPDLQPQR

SEQ ID NO: 1139079 - protein, 9 aa, Homo Sapiens
QAQTYVMRY

SEQ ID NO: 1139080 - protein, 9 aa, Homo Sapiens
WFSTLTTHK

SEQ ID NO: 1139081 - protein, 9 aa, Homo Sapiens
SHQNTFWYG

SEQ ID NO: 1139082 - protein, 9 aa, Homo Sapiens
EKFLSKKGN

SEQ ID NO: 1139083 - protein, 9 aa, Homo Sapiens
ISFGLLNIS

SEQ ID NO: 1139084 - protein, 9 aa, Homo Sapiens
NIMAQEDTA

SEQ ID NO: 1139085 - protein, 9 aa, Homo Sapiens
QQRQEAWLS

SEQ ID NO: 1139086 - protein, 9 aa, Homo Sapiens
DTPIAEVSE

SEQ ID NO: 1139087 - protein, 9 aa, Homo Sapiens
CYPEEDNEA

SEQ ID NO: 1139088 - protein, 9 aa, Homo Sapiens
AALSVGFSV

SEQ ID NO: 1139089 - protein, 9 aa, Homo Sapiens
YAFPAKKKL

SEQ ID NO: 1139090 - protein, 9 aa, Homo Sapiens
AVALQPPAE

SEQ ID NO: 1139091 - protein, 9 aa, Homo Sapiens
TAPVPAGWR

SEQ ID NO: 1139092 - protein, 9 aa, Homo Sapiens
QVLHASCDA

SEQ ID NO: 1139093 - protein, 9 aa, Homo Sapiens
CHEIAVRIK

SEQ ID NO: 1139094 - protein, 9 aa, Homo Sapiens
WRRQHLPWS

SEQ ID NO: 1139095 - protein, 9 aa, Homo Sapiens
PPTTASGCA

SEQ ID NO: 1139096 - protein, 9 aa, Homo Sapiens
RAISFSGCI

SEQ ID NO: 1139097 - protein, 9 aa, Homo Sapiens
LKRSDLLGI

SEQ ID NO: 1139098 - protein, 9 aa, Homo Sapiens
AHAHQLVEQ

SEQ ID NO: 1139099 - protein, 9 aa, Homo Sapiens
QSFHMDTWN

SEQ ID NO: 1139100 - protein, 9 aa, Homo Sapiens
SVVRLTPAA

SEQ ID NO: 1139101 - protein, 9 aa, Homo Sapiens
RSGGPRAKK

SEQ ID NO: 1139102 - protein, 9 aa, Homo Sapiens
KELQQRRRS

SEQ ID NO: 1139103 - protein, 9 aa, Homo Sapiens
RVISSSPAD

SEQ ID NO: 1139104 - protein, 9 aa, Homo Sapiens
EAGLPVEAL

SEQ ID NO: 1139105 - protein, 9 aa, Homo Sapiens
LCVSRGAIS

SEQ ID NO: 1139106 - protein, 9 aa, Homo Sapiens
ISGRLDLGV

SEQ ID NO: 1139107 - protein, 9 aa, Homo Sapiens
SVFEGVSTT

SEQ ID NO: 1139108 - protein, 9 aa, Homo Sapiens
RQLLVSLQD

SEQ ID NO: 1139109 - protein, 9 aa, Homo Sapiens
PRSKMGKWC

SEQ ID NO: 1139110 - protein, 9 aa, Homo Sapiens
PTLLLLAVA

SEQ ID NO: 1139111 - protein, 9 aa, Homo Sapiens
GEGEGASEE

SEQ ID NO: 1139112 - protein, 9 aa, Homo Sapiens
GLPSPPPHP

SEQ ID NO: 1139113 - protein, 9 aa, Homo Sapiens
ATPTEGACT

SEQ ID NO: 1139114 - protein, 9 aa, Homo Sapiens
IEYSTEAAQ

SEQ ID NO: 1139115 - protein, 9 aa, Homo Sapiens
LDSLAGRGL

SEQ ID NO: 1139116 - protein, 9 aa, Homo Sapiens
PAVWLLDVG

SEQ ID NO: 1139117 - protein, 9 aa, Homo Sapiens
QHAHQLQHA

SEQ ID NO: 1139118 - protein, 9 aa, Homo Sapiens
DPYALVCLG

SEQ ID NO: 1139119 - protein, 9 aa, Homo Sapiens
PVAVSRGLP

SEQ ID NO: 1139120 - protein, 9 aa, Homo Sapiens
LYKSLTDCF

SEQ ID NO: 1139121 - protein, 9 aa, Homo Sapiens
HEIAVRIKG

SEQ ID NO: 1139122 - protein, 9 aa, Homo Sapiens
PGAMNARGI

SEQ ID NO: 1139123 - protein, 9 aa, Homo Sapiens
GPGPTVDDD

SEQ ID NO: 1139124 - protein, 9 aa, Homo Sapiens
SNDAGSAAC

SEQ ID NO: 1139125 - protein, 9 aa, Homo Sapiens
ATYSTQVSM

SEQ ID NO: 1139126 - protein, 9 aa, Homo Sapiens
SLQTKPSGL

SEQ ID NO: 1139127 - protein, 9 aa, Homo Sapiens
SLEGEFKIS

SEQ ID NO: 1139128 - protein, 9 aa, Homo Sapiens
QPTPAVGGE

SEQ ID NO: 1139129 - protein, 9 aa, Homo Sapiens
SLPTRPRLL

SEQ ID NO: 1139130 - protein, 9 aa, Homo Sapiens
SARWKGPRR

SEQ ID NO: 1139131 - protein, 9 aa, Homo Sapiens
AVYIAVIAK

SEQ ID NO: 1139132 - protein, 9 aa, Homo Sapiens
YRRSAAASE

SEQ ID NO: 1139133 - protein, 9 aa, Homo Sapiens
DTSELEEPL

SEQ ID NO: 1139134 - protein, 9 aa, Homo Sapiens
EVDFDTFLR

SEQ ID NO: 1139135 - protein, 9 aa, Homo Sapiens
IFQWLIELH

SEQ ID NO: 1139136 - protein, 9 aa, Homo Sapiens
VFALELGCA

SEQ ID NO: 1139137 - protein, 9 aa, Homo Sapiens
SSNNLSCGG

SEQ ID NO: 1139138 - protein, 9 aa, Homo Sapiens
YHSEGMKVY

SEQ ID NO: 1139139 - protein, 9 aa, Homo Sapiens
EQRVLLLLS

SEQ ID NO: 1139140 - protein, 9 aa, Homo Sapiens
YPPGVMVYS

SEQ ID NO: 1139141 - protein, 9 aa, Homo Sapiens
ISVKEAAVL

SEQ ID NO: 1139142 - protein, 9 aa, Homo Sapiens
MKMVWPPYS

SEQ ID NO: 1139143 - protein, 9 aa, Homo Sapiens
LALLRGSVR

SEQ ID NO: 1139144 - protein, 9 aa, Homo Sapiens
KTLTHPSME

SEQ ID NO: 1139145 - protein, 9 aa, Homo Sapiens
TNYVIDKSA

SEQ ID NO: 1139146 - protein, 9 aa, Homo Sapiens
TAGVCRKAQ

SEQ ID NO: 1139147 - protein, 9 aa, Homo Sapiens
EFRNPLASA

SEQ ID NO: 1139148 - protein, 9 aa, Homo Sapiens
KRPSWYNIL

SEQ ID NO: 1139149 - protein, 9 aa, Homo Sapiens
SLEAQVNRN

SEQ ID NO: 1139150 - protein, 9 aa, Homo Sapiens
RRRRRKKKR

SEQ ID NO: 1139151 - protein, 9 aa, Homo Sapiens
AVQSTELRP

SEQ ID NO: 1139152 - protein, 9 aa, Homo Sapiens
IKYKQKKHP

SEQ ID NO: 1139153 - protein, 9 aa, Homo Sapiens
FFLSRAPPV

SEQ ID NO: 1139154 - protein, 9 aa, Homo Sapiens
HLRPSWCPP

SEQ ID NO: 1139155 - protein, 9 aa, Homo Sapiens
VGGQRCRDG

SEQ ID NO: 1139156 - protein, 9 aa, Homo Sapiens
GVGPGLGGG

SEQ ID NO: 1139157 - protein, 9 aa, Homo Sapiens
VPTRHIRQD

SEQ ID NO: 1139158 - protein, 9 aa, Homo Sapiens
HDIWTEMII

SEQ ID NO: 1139159 - protein, 9 aa, Homo Sapiens
LRRFPRVGF

SEQ ID NO: 1139160 - protein, 9 aa, Homo Sapiens
QLRHPLHPP

SEQ ID NO: 1139161 - protein, 9 aa, Homo Sapiens
LQRLQNSAM

SEQ ID NO: 1139162 - protein, 9 aa, Homo Sapiens
QNQEHSEDD

SEQ ID NO: 1139163 - protein, 9 aa, Homo Sapiens
LVLDRHTDT

SEQ ID NO: 1139164 - protein, 9 aa, Homo Sapiens
QNAAPATRI

SEQ ID NO: 1139165 - protein, 9 aa, Homo Sapiens
REDNRHVAL

SEQ ID NO: 1139166 - protein, 9 aa, Homo Sapiens
CVNHWITTT

SEQ ID NO: 1139167 - protein, 9 aa, Homo Sapiens
ESMEGLGHE

SEQ ID NO: 1139168 - protein, 9 aa, Homo Sapiens
SKPRQILGL

SEQ ID NO: 1139169 - protein, 9 aa, Homo Sapiens
APLLPLPPL

SEQ ID NO: 1139170 - protein, 9 aa, Homo Sapiens
ITFPFLIAV

SEQ ID NO: 1139171 - protein, 9 aa, Homo Sapiens
HFLDTPIAE

SEQ ID NO: 1139172 - protein, 9 aa, Homo Sapiens
RKGPPNPGV

SEQ ID NO: 1139173 - protein, 9 aa, Homo Sapiens
LYSQIKDVK

SEQ ID NO: 1139174 - protein, 9 aa, Homo Sapiens
SGGSQPSMT

SEQ ID NO: 1139175 - protein, 9 aa, Homo Sapiens
VLQWDYQKK

SEQ ID NO: 1139176 - protein, 9 aa, Homo Sapiens
LASEKAIET

SEQ ID NO: 1139177 - protein, 9 aa, Homo Sapiens
MYREKDIQA

SEQ ID NO: 1139178 - protein, 9 aa, Homo Sapiens
LHSGENLTS

SEQ ID NO: 1139179 - protein, 9 aa, Homo Sapiens
PPLPAPQGA

SEQ ID NO: 1139180 - protein, 9 aa, Homo Sapiens
VGWPEEEEA

SEQ ID NO: 1139181 - protein, 9 aa, Homo Sapiens
FQFNASEQL

SEQ ID NO: 1139182 - protein, 9 aa, Homo Sapiens
YSYILGLIS

SEQ ID NO: 1139183 - protein, 9 aa, Homo Sapiens
SGAPSPPPP

SEQ ID NO: 1139184 - protein, 9 aa, Homo Sapiens
QAEGQHKMD

SEQ ID NO: 1139185 - protein, 9 aa, Homo Sapiens
DAVDNKKTH

SEQ ID NO: 1139186 - protein, 9 aa, Homo Sapiens
VRSDHVSLV

SEQ ID NO: 1139187 - protein, 9 aa, Homo Sapiens
SSHFLAERK

SEQ ID NO: 1139188 - protein, 9 aa, Homo Sapiens
ERSASRGHG

SEQ ID NO: 1139189 - protein, 9 aa, Homo Sapiens
YRGAAGALV

SEQ ID NO: 1139190 - protein, 9 aa, Homo Sapiens
GLIRSRVCG

SEQ ID NO: 1139191 - protein, 9 aa, Homo Sapiens
LSSQPPLTA

SEQ ID NO: 1139192 - protein, 9 aa, Homo Sapiens
SNDDSPDLD

SEQ ID NO: 1139193 - protein, 9 aa, Homo Sapiens
RSDELTRYF

SEQ ID NO: 1139194 - protein, 9 aa, Homo Sapiens
ARSPSLCSP

SEQ ID NO: 1139195 - protein, 9 aa, Homo Sapiens
RLQSLLSLY

SEQ ID NO: 1139196 - protein, 9 aa, Homo Sapiens
TLSQPPPQA

SEQ ID NO: 1139197 - protein, 9 aa, Homo Sapiens
SDSALYLCA

SEQ ID NO: 1139198 - protein, 9 aa, Homo Sapiens
RSLPCPLGS

SEQ ID NO: 1139199 - protein, 9 aa, Homo Sapiens
TMFSYPIWQ

SEQ ID NO: 1139200 - protein, 9 aa, Homo Sapiens
PVGKKRHPV

SEQ ID NO: 1139201 - protein, 9 aa, Homo Sapiens
VQRLWFQSV

SEQ ID NO: 1139202 - protein, 9 aa, Homo Sapiens
HSVCYNDCF

SEQ ID NO: 1139203 - protein, 9 aa, Homo Sapiens
SFVDGLTQK

SEQ ID NO: 1139204 - protein, 9 aa, Homo Sapiens
LSTGTRRIR

SEQ ID NO: 1139205 - protein, 9 aa, Homo Sapiens
GEGDGTGPL

SEQ ID NO: 1139206 - protein, 9 aa, Homo Sapiens
RGLDRRRSC

SEQ ID NO: 1139207 - protein, 9 aa, Homo Sapiens
DEAEEWPVP

SEQ ID NO: 1139208 - protein, 9 aa, Homo Sapiens
DMKSYLWER

SEQ ID NO: 1139209 - protein, 9 aa, Homo Sapiens
GPLALASGQ

SEQ ID NO: 1139210 - protein, 9 aa, Homo Sapiens
KLYHSLVMC

SEQ ID NO: 1139211 - protein, 9 aa, Homo Sapiens
FIGSSDVGS

SEQ ID NO: 1139212 - protein, 9 aa, Homo Sapiens
VDSGLVHQG

SEQ ID NO: 1139213 - protein, 9 aa, Homo Sapiens
RGHRDVTGY

SEQ ID NO: 1139214 - protein, 9 aa, Homo Sapiens
ALTFRDVVI

SEQ ID NO: 1139215 - protein, 9 aa, Homo Sapiens
TNINATLSS

SEQ ID NO: 1139216 - protein, 9 aa, Homo Sapiens
PSQGTHIRP

SEQ ID NO: 1139217 - protein, 9 aa, Homo Sapiens
VAGTASCLR

SEQ ID NO: 1139218 - protein, 9 aa, Homo Sapiens
VRQYKSEAL

SEQ ID NO: 1139219 - protein, 9 aa, Homo Sapiens
PALQPPPQP

SEQ ID NO: 1139220 - protein, 9 aa, Homo Sapiens
ISVAIPSVT

SEQ ID NO: 1139221 - protein, 9 aa, Homo Sapiens
RSMRSPTED

SEQ ID NO: 1139222 - protein, 9 aa, Homo Sapiens
AIKAKQLET

SEQ ID NO: 1139223 - protein, 9 aa, Homo Sapiens
SEEICLLTA

SEQ ID NO: 1139224 - protein, 9 aa, Homo Sapiens
TQFSTSLWV

SEQ ID NO: 1139225 - protein, 9 aa, Homo Sapiens
ERTLDATEV

SEQ ID NO: 1139226 - protein, 9 aa, Homo Sapiens
TEREVKTRE

SEQ ID NO: 1139227 - protein, 9 aa, Homo Sapiens
CVPTTYAGK

SEQ ID NO: 1139228 - protein, 9 aa, Homo Sapiens
SATSSVVTD

SEQ ID NO: 1139229 - protein, 9 aa, Homo Sapiens
IAVQSTELR

SEQ ID NO: 1139230 - protein, 9 aa, Homo Sapiens
RGAAGALVY

SEQ ID NO: 1139231 - protein, 9 aa, Homo Sapiens
KNLVLQSIE

SEQ ID NO: 1139232 - protein, 9 aa, Homo Sapiens
MPPPGLRPC

SEQ ID NO: 1139233 - protein, 9 aa, Homo Sapiens
QLPMGRLDL

SEQ ID NO: 1139234 - protein, 9 aa, Homo Sapiens
LHDAMPRVP

SEQ ID NO: 1139235 - protein, 9 aa, Homo Sapiens
NVTFSGPSG

SEQ ID NO: 1139236 - protein, 9 aa, Homo Sapiens
QGSYSFDDH

SEQ ID NO: 1139237 - protein, 9 aa, Homo Sapiens
YQVVKADTY

SEQ ID NO: 1139238 - protein, 9 aa, Homo Sapiens
EHLRRCNII

SEQ ID NO: 1139239 - protein, 9 aa, Homo Sapiens
PPRQCLSGH

SEQ ID NO: 1139240 - protein, 9 aa, Homo Sapiens
ALGAHFIAQ

SEQ ID NO: 1139241 - protein, 9 aa, Homo Sapiens
DAIHEVETL

SEQ ID NO: 1139242 - protein, 9 aa, Homo Sapiens
EAELLGCYP

SEQ ID NO: 1139243 - protein, 9 aa, Homo Sapiens
ALQHKRLVR

SEQ ID NO: 1139244 - protein, 9 aa, Homo Sapiens
DNYGLLDQI

SEQ ID NO: 1139245 - protein, 9 aa, Homo Sapiens
PGGRAWAPQ

SEQ ID NO: 1139246 - protein, 9 aa, Homo Sapiens
PPAPSPWLP

SEQ ID NO: 1139247 - protein, 9 aa, Homo Sapiens
LSPALGPLS

SEQ ID NO: 1139248 - protein, 9 aa, Homo Sapiens
TMGRDPSPR

SEQ ID NO: 1139249 - protein, 9 aa, Homo Sapiens
CTVVQLRQL

SEQ ID NO: 1139250 - protein, 9 aa, Homo Sapiens
WIVTFGATI

SEQ ID NO: 1139251 - protein, 9 aa, Homo Sapiens
KIGLQPLQR

SEQ ID NO: 1139252 - protein, 9 aa, Homo Sapiens
KKNLYEIAR

SEQ ID NO: 1139253 - protein, 9 aa, Homo Sapiens
SVRPSTRAW

SEQ ID NO: 1139254 - protein, 9 aa, Homo Sapiens
KSWIKHTQK

SEQ ID NO: 1139255 - protein, 9 aa, Homo Sapiens
DHHGLVFGD

SEQ ID NO: 1139256 - protein, 9 aa, Homo Sapiens
KKGEYAFPA

SEQ ID NO: 1139257 - protein, 9 aa, Homo Sapiens
YIKEKSLGE

SEQ ID NO: 1139258 - protein, 9 aa, Homo Sapiens
RSELKQMFS

SEQ ID NO: 1139259 - protein, 9 aa, Homo Sapiens
TVCGVLDLD

SEQ ID NO: 1139260 - protein, 9 aa, Homo Sapiens
LCHLLLPPD

SEQ ID NO: 1139261 - protein, 9 aa, Homo Sapiens
PPQAPSQVW

SEQ ID NO: 1139262 - protein, 9 aa, Homo Sapiens
EFVRQYKSE

SEQ ID NO: 1139263 - protein, 9 aa, Homo Sapiens
SPHCEAISC

SEQ ID NO: 1139264 - protein, 9 aa, Homo Sapiens
YFMACTVAY

SEQ ID NO: 1139265 - protein, 9 aa, Homo Sapiens
CPPPSPLPA

SEQ ID NO: 1139266 - protein, 9 aa, Homo Sapiens
CIGWVATFE

SEQ ID NO: 1139267 - protein, 9 aa, Homo Sapiens
AHRGRTGVL

SEQ ID NO: 1139268 - protein, 9 aa, Homo Sapiens
PGPPTSLPD

SEQ ID NO: 1139269 - protein, 9 aa, Homo Sapiens
QREAPQVSS

SEQ ID NO: 1139270 - protein, 9 aa, Homo Sapiens
LTRPRPATP

SEQ ID NO: 1139271 - protein, 9 aa, Homo Sapiens
MTPRRRQSS

SEQ ID NO: 1139272 - protein, 9 aa, Homo Sapiens
RTAGQLLTD

SEQ ID NO: 1139273 - protein, 9 aa, Homo Sapiens
YHGLRASLL

SEQ ID NO: 1139274 - protein, 9 aa, Homo Sapiens
LNTNIRLVY

SEQ ID NO: 1139275 - protein, 9 aa, Homo Sapiens
ENKAVQPLK

SEQ ID NO: 1139276 - protein, 9 aa, Homo Sapiens
KGVPLPFYQ

SEQ ID NO: 1139277 - protein, 9 aa, Homo Sapiens
SPVSTAPSK

SEQ ID NO: 1139278 - protein, 9 aa, Homo Sapiens
KGHFAEVYK

SEQ ID NO: 1139279 - protein, 9 aa, Homo Sapiens
LLGAGLGPG

SEQ ID NO: 1139280 - protein, 9 aa, Homo Sapiens
IGRSLEGEF

SEQ ID NO: 1139281 - protein, 9 aa, Homo Sapiens
KRRIHLKLR

SEQ ID NO: 1139282 - protein, 9 aa, Homo Sapiens
PTDPKCCFF

SEQ ID NO: 1139283 - protein, 9 aa, Homo Sapiens
NPSDYVLLK

SEQ ID NO: 1139284 - protein, 9 aa, Homo Sapiens
HHPLGDTPQ

SEQ ID NO: 1139285 - protein, 9 aa, Homo Sapiens
EPDTSNSLL

SEQ ID NO: 1139286 - protein, 9 aa, Homo Sapiens
AGKRMVRGR

SEQ ID NO: 1139287 - protein, 9 aa, Homo Sapiens
DQAAKDNYG

SEQ ID NO: 1139288 - protein, 9 aa, Homo Sapiens
KGALVQTKG

SEQ ID NO: 1139289 - protein, 9 aa, Homo Sapiens
PRTKSLGIH

SEQ ID NO: 1139290 - protein, 9 aa, Homo Sapiens
TRSLLSSPR

SEQ ID NO: 1139291 - protein, 9 aa, Homo Sapiens
GAAPLPPRA

SEQ ID NO: 1139292 - protein, 9 aa, Homo Sapiens
PLTSLGLSP

SEQ ID NO: 1139293 - protein, 9 aa, Homo Sapiens
KAKVRQYLQ

SEQ ID NO: 1139294 - protein, 9 aa, Homo Sapiens
AGPAHPTRG

SEQ ID NO: 1139295 - protein, 9 aa, Homo Sapiens
VLWPLRPPP

SEQ ID NO: 1139296 - protein, 9 aa, Homo Sapiens
PPRHPWPPQ

SEQ ID NO: 1139297 - protein, 9 aa, Homo Sapiens
SGDIVPAPG

SEQ ID NO: 1139298 - protein, 9 aa, Homo Sapiens
LSQKKSKQQ

SEQ ID NO: 1139299 - protein, 9 aa, Homo Sapiens
SCKLYDGEF

SEQ ID NO: 1139300 - protein, 9 aa, Homo Sapiens
DAHRERPLR

SEQ ID NO: 1139301 - protein, 9 aa, Homo Sapiens
PRDLGIHVF

SEQ ID NO: 1139302 - protein, 9 aa, Homo Sapiens
IRCHIDNLH

SEQ ID NO: 1139303 - protein, 9 aa, Homo Sapiens
GPPRAREKL

SEQ ID NO: 1139304 - protein, 9 aa, Homo Sapiens
DVLHRYASF

SEQ ID NO: 1139305 - protein, 9 aa, Homo Sapiens
CSEQPALTC

SEQ ID NO: 1139306 - protein, 9 aa, Homo Sapiens
EGQLQDAEQ

SEQ ID NO: 1139307 - protein, 9 aa, Homo Sapiens
TMNLTIEQS

SEQ ID NO: 1139308 - protein, 9 aa, Homo Sapiens
HGINFDSPV

SEQ ID NO: 1139309 - protein, 9 aa, Homo Sapiens
LAGLTDYPE

SEQ ID NO: 1139310 - protein, 9 aa, Homo Sapiens
KMVWPPYSY

SEQ ID NO: 1139311 - protein, 9 aa, Homo Sapiens
WDHRAISIP

SEQ ID NO: 1139312 - protein, 9 aa, Homo Sapiens
WARPSPGPR

SEQ ID NO: 1139313 - protein, 9 aa, Homo Sapiens
IGDTKRTTP

SEQ ID NO: 1139314 - protein, 9 aa, Homo Sapiens
LCKPVPPWD

SEQ ID NO: 1139315 - protein, 9 aa, Homo Sapiens
VVENVPPLH

SEQ ID NO: 1139316 - protein, 9 aa, Homo Sapiens
NPRDLIPRL

SEQ ID NO: 1139317 - protein, 9 aa, Homo Sapiens
LTCPEDNKT

SEQ ID NO: 1139318 - protein, 9 aa, Homo Sapiens
ARAGGLGPE

SEQ ID NO: 1139319 - protein, 9 aa, Homo Sapiens
LTRMLLQKA

SEQ ID NO: 1139320 - protein, 9 aa, Homo Sapiens
ITTNTEGEI

SEQ ID NO: 1139321 - protein, 9 aa, Homo Sapiens
FWVLLHDGI

SEQ ID NO: 1139322 - protein, 9 aa, Homo Sapiens
RTHTGEKTF

SEQ ID NO: 1139323 - protein, 9 aa, Homo Sapiens
LFSRGRDAD

SEQ ID NO: 1139324 - protein, 9 aa, Homo Sapiens
PEVPGLHGS

SEQ ID NO: 1139325 - protein, 9 aa, Homo Sapiens
YLMYITTVL

SEQ ID NO: 1139326 - protein, 9 aa, Homo Sapiens
YTEGSTNGF

SEQ ID NO: 1139327 - protein, 9 aa, Homo Sapiens
RPEGQYLHP

SEQ ID NO: 1139328 - protein, 9 aa, Homo Sapiens
GIDGEKEHT

SEQ ID NO: 1139329 - protein, 9 aa, Homo Sapiens
LDQRLRLQE

SEQ ID NO: 1139330 - protein, 9 aa, Homo Sapiens
LQDAQCLFL

SEQ ID NO: 1139331 - protein, 9 aa, Homo Sapiens
PEDDLLPWK

SEQ ID NO: 1139332 - protein, 9 aa, Homo Sapiens
VFRERAARR

SEQ ID NO: 1139333 - protein, 9 aa, Homo Sapiens
EITGGPVNE

SEQ ID NO: 1139334 - protein, 9 aa, Homo Sapiens
AHALNSWTQ

SEQ ID NO: 1139335 - protein, 9 aa, Homo Sapiens
RKMRKSLET

SEQ ID NO: 1139336 - protein, 9 aa, Homo Sapiens
PTGSVTHQS

SEQ ID NO: 1139337 - protein, 9 aa, Homo Sapiens
HQLHGKVGQ

SEQ ID NO: 1139338 - protein, 9 aa, Homo Sapiens
LAVLAVHLG

SEQ ID NO: 1139339 - protein, 9 aa, Homo Sapiens
ITRFAFSTR

SEQ ID NO: 1139340 - protein, 9 aa, Homo Sapiens
SYKCHKCGK

SEQ ID NO: 1139341 - protein, 9 aa, Homo Sapiens
GRYYGGDSE

SEQ ID NO: 1139342 - protein, 9 aa, Homo Sapiens
RAQAEVGRA

SEQ ID NO: 1139343 - protein, 9 aa, Homo Sapiens
PTNVLLIVH

SEQ ID NO: 1139344 - protein, 9 aa, Homo Sapiens
TECKAGLAP

SEQ ID NO: 1139345 - protein, 9 aa, Homo Sapiens
CHNSIQGKH

SEQ ID NO: 1139346 - protein, 9 aa, Homo Sapiens
DFQSQWDVD

SEQ ID NO: 1139347 - protein, 9 aa, Homo Sapiens
GLLKNTCED

SEQ ID NO: 1139348 - protein, 9 aa, Homo Sapiens
NPNMTVAQD

SEQ ID NO: 1139349 - protein, 9 aa, Homo Sapiens
TSPPTSAPT

SEQ ID NO: 1139350 - protein, 9 aa, Homo Sapiens
PPVILLFSF

SEQ ID NO: 1139351 - protein, 9 aa, Homo Sapiens
HGVTVALKL

SEQ ID NO: 1139352 - protein, 9 aa, Homo Sapiens
LTPPLRRSV

SEQ ID NO: 1139353 - protein, 9 aa, Homo Sapiens
VFADPVKKS

SEQ ID NO: 1139354 - protein, 9 aa, Homo Sapiens
MSNGRLGHG

SEQ ID NO: 1139355 - protein, 9 aa, Homo Sapiens
QFLIILGPV

SEQ ID NO: 1139356 - protein, 9 aa, Homo Sapiens
AVQAQAGME

SEQ ID NO: 1139357 - protein, 9 aa, Homo Sapiens
RSPCPKGLE

SEQ ID NO: 1139358 - protein, 9 aa, Homo Sapiens
KDVNEALRK

SEQ ID NO: 1139359 - protein, 9 aa, Homo Sapiens
EQKEVEQLI

SEQ ID NO: 1139360 - protein, 9 aa, Homo Sapiens
HDNKDTCKS

SEQ ID NO: 1139361 - protein, 9 aa, Homo Sapiens
TDSSVTKMH

SEQ ID NO: 1139362 - protein, 9 aa, Homo Sapiens
TLPFPSREE

SEQ ID NO: 1139363 - protein, 9 aa, Homo Sapiens
TLCTGLVAG

SEQ ID NO: 1139364 - protein, 9 aa, Homo Sapiens
RQRRGFAEG

SEQ ID NO: 1139365 - protein, 9 aa, Homo Sapiens
AEGRGTESC

SEQ ID NO: 1139366 - protein, 9 aa, Homo Sapiens
PRGSGGEQL

SEQ ID NO: 1139367 - protein, 9 aa, Homo Sapiens
LKILEVFVM

SEQ ID NO: 1139368 - protein, 9 aa, Homo Sapiens
WFYVYHSEG

SEQ ID NO: 1139369 - protein, 9 aa, Homo Sapiens
VTPKADIYP

SEQ ID NO: 1139370 - protein, 9 aa, Homo Sapiens
GKFAIFIML

SEQ ID NO: 1139371 - protein, 9 aa, Homo Sapiens
PIMLNVGGK

SEQ ID NO: 1139372 - protein, 9 aa, Homo Sapiens
DDGPVAAEA

SEQ ID NO: 1139373 - protein, 9 aa, Homo Sapiens
AGEDTLVHI

SEQ ID NO: 1139374 - protein, 9 aa, Homo Sapiens
PRSMRSPTE

SEQ ID NO: 1139375 - protein, 9 aa, Homo Sapiens
MVCRTTLSG

SEQ ID NO: 1139376 - protein, 9 aa, Homo Sapiens
GHYVVVIEY

SEQ ID NO: 1139377 - protein, 9 aa, Homo Sapiens
QNRIDSFHS

SEQ ID NO: 1139378 - protein, 9 aa, Homo Sapiens
VAAIERVEM

SEQ ID NO: 1139379 - protein, 9 aa, Homo Sapiens
SVVAMALSG

SEQ ID NO: 1139380 - protein, 9 aa, Homo Sapiens
GLDTRWHEP

SEQ ID NO: 1139381 - protein, 9 aa, Homo Sapiens
WCSPLFPWK

SEQ ID NO: 1139382 - protein, 9 aa, Homo Sapiens
NPNDKKAAH

SEQ ID NO: 1139383 - protein, 9 aa, Homo Sapiens
VCPTSRQPS

SEQ ID NO: 1139384 - protein, 9 aa, Homo Sapiens
LWMALCPRQ

SEQ ID NO: 1139385 - protein, 9 aa, Homo Sapiens
TAFPSRRRS

SEQ ID NO: 1139386 - protein, 9 aa, Homo Sapiens
SHCQLCSPV

SEQ ID NO: 1139387 - protein, 9 aa, Homo Sapiens
ETPIFVKAA

SEQ ID NO: 1139388 - protein, 9 aa, Homo Sapiens
SQPPPQAPS

SEQ ID NO: 1139389 - protein, 9 aa, Homo Sapiens
QGALMDSQQ

SEQ ID NO: 1139390 - protein, 9 aa, Homo Sapiens
AFVFVITAA

SEQ ID NO: 1139391 - protein, 9 aa, Homo Sapiens
THLKEYEQC

SEQ ID NO: 1139392 - protein, 9 aa, Homo Sapiens
KRTTPIEVL

SEQ ID NO: 1139393 - protein, 9 aa, Homo Sapiens
DVAALSVGF

SEQ ID NO: 1139394 - protein, 9 aa, Homo Sapiens
TESFETIFG

SEQ ID NO: 1139395 - protein, 9 aa, Homo Sapiens
GVSYTLEKS

SEQ ID NO: 1139396 - protein, 9 aa, Homo Sapiens
KVVYVACNA

SEQ ID NO: 1139397 - protein, 9 aa, Homo Sapiens
TFLQYPHFL

SEQ ID NO: 1139398 - protein, 9 aa, Homo Sapiens
LSTVLSQKK

SEQ ID NO: 1139399 - protein, 9 aa, Homo Sapiens
LNRPCKAGA

SEQ ID NO: 1139400 - protein, 9 aa, Homo Sapiens
PARTRGAPA

SEQ ID NO: 1139401 - protein, 9 aa, Homo Sapiens
SFGLCRALW

SEQ ID NO: 1139402 - protein, 9 aa, Homo Sapiens
STDDDRMVK

SEQ ID NO: 1139403 - protein, 9 aa, Homo Sapiens
IMDFGKNVM

SEQ ID NO: 1139404 - protein, 9 aa, Homo Sapiens
DSVSHQAGV

SEQ ID NO: 1139405 - protein, 9 aa, Homo Sapiens
GCGRAPARA

SEQ ID NO: 1139406 - protein, 9 aa, Homo Sapiens
LRLSGTPRP

SEQ ID NO: 1139407 - protein, 9 aa, Homo Sapiens
GAVACLAAI

SEQ ID NO: 1139408 - protein, 9 aa, Homo Sapiens
PAARAKVAG

SEQ ID NO: 1139409 - protein, 9 aa, Homo Sapiens
EFVELGNIS

SEQ ID NO: 1139410 - protein, 9 aa, Homo Sapiens
NKLIQQPRY

SEQ ID NO: 1139411 - protein, 9 aa, Homo Sapiens
IVGHPKSDL

SEQ ID NO: 1139412 - protein, 9 aa, Homo Sapiens
MKLYHSLVM

SEQ ID NO: 1139413 - protein, 9 aa, Homo Sapiens
LVGKGHFAE

SEQ ID NO: 1139414 - protein, 9 aa, Homo Sapiens
PRGITPFTA

SEQ ID NO: 1139415 - protein, 9 aa, Homo Sapiens
RAGCPHTQG

SEQ ID NO: 1139416 - protein, 9 aa, Homo Sapiens
RDGQEPQPR

SEQ ID NO: 1139417 - protein, 9 aa, Homo Sapiens
QLVRDNSLA

SEQ ID NO: 1139418 - protein, 9 aa, Homo Sapiens
RQAMYTRHE

SEQ ID NO: 1139419 - protein, 9 aa, Homo Sapiens
PRRKIPQCL

SEQ ID NO: 1139420 - protein, 9 aa, Homo Sapiens
VLVYPTDAN

SEQ ID NO: 1139421 - protein, 9 aa, Homo Sapiens
VRHQRIHAG

SEQ ID NO: 1139422 - protein, 9 aa, Homo Sapiens
VVMAIFSAL

SEQ ID NO: 1139423 - protein, 9 aa, Homo Sapiens
QAPKTVDTI

SEQ ID NO: 1139424 - protein, 9 aa, Homo Sapiens
QLKSPFQLV

SEQ ID NO: 1139425 - protein, 9 aa, Homo Sapiens
PWDTERNLR

SEQ ID NO: 1139426 - protein, 9 aa, Homo Sapiens
DYAYEAIKH

SEQ ID NO: 1139427 - protein, 9 aa, Homo Sapiens
CLMDRSREQ

SEQ ID NO: 1139428 - protein, 9 aa, Homo Sapiens
RYVKWHLTI

SEQ ID NO: 1139429 - protein, 9 aa, Homo Sapiens
VDPYLFPYF

SEQ ID NO: 1139430 - protein, 9 aa, Homo Sapiens
IRDYSGKKP

SEQ ID NO: 1139431 - protein, 9 aa, Homo Sapiens
CWTKALMEE

SEQ ID NO: 1139432 - protein, 9 aa, Homo Sapiens
DKRMSHQNT

SEQ ID NO: 1139433 - protein, 9 aa, Homo Sapiens
GGALQMTTN

SEQ ID NO: 1139434 - protein, 9 aa, Homo Sapiens
FMVAQSEAF

SEQ ID NO: 1139435 - protein, 9 aa, Homo Sapiens
TSAPTAAKP

SEQ ID NO: 1139436 - protein, 9 aa, Homo Sapiens
LVSQNYMLP

SEQ ID NO: 1139437 - protein, 9 aa, Homo Sapiens
KQYVKTISP

SEQ ID NO: 1139438 - protein, 9 aa, Homo Sapiens
MTMRPGTMR

SEQ ID NO: 1139439 - protein, 9 aa, Homo Sapiens
MDDDFQFNA

SEQ ID NO: 1139440 - protein, 9 aa, Homo Sapiens
GKMQREKCL

SEQ ID NO: 1139441 - protein, 9 aa, Homo Sapiens
PRARDALCH

SEQ ID NO: 1139442 - protein, 9 aa, Homo Sapiens
RRSSSLLPP

SEQ ID NO: 1139443 - protein, 9 aa, Homo Sapiens
KICLLSLRA

SEQ ID NO: 1139444 - protein, 9 aa, Homo Sapiens
KNACHFPAI

SEQ ID NO: 1139445 - protein, 9 aa, Homo Sapiens
FQMNSTSDD

SEQ ID NO: 1139446 - protein, 9 aa, Homo Sapiens
RVPPFPSHL

SEQ ID NO: 1139447 - protein, 9 aa, Homo Sapiens
LHICDLLSD

SEQ ID NO: 1139448 - protein, 9 aa, Homo Sapiens
DLPLAKTGR

SEQ ID NO: 1139449 - protein, 9 aa, Homo Sapiens
PPAWGPSPA

SEQ ID NO: 1139450 - protein, 9 aa, Homo Sapiens
LQKQKLMNT

SEQ ID NO: 1139451 - protein, 9 aa, Homo Sapiens
SEGVSIWNP

SEQ ID NO: 1139452 - protein, 9 aa, Homo Sapiens
PRMKPASCR

SEQ ID NO: 1139453 - protein, 9 aa, Homo Sapiens
CEVQVLCHH

SEQ ID NO: 1139454 - protein, 9 aa, Homo Sapiens
KVPEATLGP

SEQ ID NO: 1139455 - protein, 9 aa, Homo Sapiens
AASLPGSSA

SEQ ID NO: 1139456 - protein, 9 aa, Homo Sapiens
GDTKRTTPI

SEQ ID NO: 1139457 - protein, 9 aa, Homo Sapiens
SVTLYGLPR

SEQ ID NO: 1139458 - protein, 9 aa, Homo Sapiens
ARQDMEKAR

SEQ ID NO: 1139459 - protein, 9 aa, Homo Sapiens
PSMKSFIFV

SEQ ID NO: 1139460 - protein, 9 aa, Homo Sapiens
WLTALAVEC

SEQ ID NO: 1139461 - protein, 9 aa, Homo Sapiens
PVVLLVIHS

SEQ ID NO: 1139462 - protein, 9 aa, Homo Sapiens
RKVYLETYD

SEQ ID NO: 1139463 - protein, 9 aa, Homo Sapiens
DMSVLQRVL

SEQ ID NO: 1139464 - protein, 9 aa, Homo Sapiens
PASGEMKDP

SEQ ID NO: 1139465 - protein, 9 aa, Homo Sapiens
DPIEQGLRV

SEQ ID NO: 1139466 - protein, 9 aa, Homo Sapiens
NTAIILVIL

SEQ ID NO: 1139467 - protein, 9 aa, Homo Sapiens
KVDSPKNSN

SEQ ID NO: 1139468 - protein, 9 aa, Homo Sapiens
KPFFCSECG

SEQ ID NO: 1139469 - protein, 9 aa, Homo Sapiens
PPLPRRDSH

SEQ ID NO: 1139470 - protein, 9 aa, Homo Sapiens
LTAHRGLSL

SEQ ID NO: 1139471 - protein, 9 aa, Homo Sapiens
CMEKIVNSF

SEQ ID NO: 1139472 - protein, 9 aa, Homo Sapiens
LSDTFSQGI

SEQ ID NO: 1139473 - protein, 9 aa, Homo Sapiens
ALGRRQLNL

SEQ ID NO: 1139474 - protein, 9 aa, Homo Sapiens
ALIAWDPSP

SEQ ID NO: 1139475 - protein, 9 aa, Homo Sapiens
FLKLCQAMQ

SEQ ID NO: 1139476 - protein, 9 aa, Homo Sapiens
SDHVSLVDM

SEQ ID NO: 1139477 - protein, 9 aa, Homo Sapiens
HLIHSINPV

SEQ ID NO: 1139478 - protein, 9 aa, Homo Sapiens
VYEAELLGC

SEQ ID NO: 1139479 - protein, 9 aa, Homo Sapiens
MYRTHCQCI

SEQ ID NO: 1139480 - protein, 9 aa, Homo Sapiens
CFTWRTSRT

SEQ ID NO: 1139481 - protein, 9 aa, Homo Sapiens
PPLIIQRLT

SEQ ID NO: 1139482 - protein, 9 aa, Homo Sapiens
GMYREKDIQ

SEQ ID NO: 1139483 - protein, 9 aa, Homo Sapiens
GCVDDFGFS

SEQ ID NO: 1139484 - protein, 9 aa, Homo Sapiens
GTTCPPTSC

SEQ ID NO: 1139485 - protein, 9 aa, Homo Sapiens
LQCQSLALP

SEQ ID NO: 1139486 - protein, 9 aa, Homo Sapiens
ECAGRHRLC

SEQ ID NO: 1139487 - protein, 9 aa, Homo Sapiens
FPPTPMDSH

SEQ ID NO: 1139488 - protein, 9 aa, Homo Sapiens
LIPRLQIWW

SEQ ID NO: 1139489 - protein, 9 aa, Homo Sapiens
TLAQWSPVI

SEQ ID NO: 1139490 - protein, 9 aa, Homo Sapiens
NINGHVYMR

SEQ ID NO: 1139491 - protein, 9 aa, Homo Sapiens
FRRGFRQLT

SEQ ID NO: 1139492 - protein, 9 aa, Homo Sapiens
QKPSPVLGK

SEQ ID NO: 1139493 - protein, 9 aa, Homo Sapiens
DEATDYCSG

SEQ ID NO: 1139494 - protein, 9 aa, Homo Sapiens
SYECEMFDK

SEQ ID NO: 1139495 - protein, 9 aa, Homo Sapiens
NLPTPQKFL

SEQ ID NO: 1139496 - protein, 9 aa, Homo Sapiens
QELQRSNQV

SEQ ID NO: 1139497 - protein, 9 aa, Homo Sapiens
ITDDWDHKL

SEQ ID NO: 1139498 - protein, 9 aa, Homo Sapiens
PGAVLDPSL

SEQ ID NO: 1139499 - protein, 9 aa, Homo Sapiens
TMPHLCPSE

SEQ ID NO: 1139500 - protein, 9 aa, Homo Sapiens
HASCDAPQH

SEQ ID NO: 1139501 - protein, 9 aa, Homo Sapiens
FPSQGITPH

SEQ ID NO: 1139502 - protein, 9 aa, Homo Sapiens
ELGNISALR

SEQ ID NO: 1139503 - protein, 9 aa, Homo Sapiens
EVLEVGSLT

SEQ ID NO: 1139504 - protein, 9 aa, Homo Sapiens
SPASLLTRP

SEQ ID NO: 1139505 - protein, 9 aa, Homo Sapiens
SESDAPTRC

SEQ ID NO: 1139506 - protein, 9 aa, Homo Sapiens
RMGIQLKKG

SEQ ID NO: 1139507 - protein, 9 aa, Homo Sapiens
QCVDRVFHA

SEQ ID NO: 1139508 - protein, 9 aa, Homo Sapiens
VADASVPRA

SEQ ID NO: 1139509 - protein, 9 aa, Homo Sapiens
PEKLALKED

SEQ ID NO: 1139510 - protein, 9 aa, Homo Sapiens
RQNFRSPTP

SEQ ID NO: 1139511 - protein, 9 aa, Homo Sapiens
DAGSAACLF

SEQ ID NO: 1139512 - protein, 9 aa, Homo Sapiens
VTELYFAGQ

SEQ ID NO: 1139513 - protein, 9 aa, Homo Sapiens
DATISRNIP

SEQ ID NO: 1139514 - protein, 9 aa, Homo Sapiens
ATAASARSP

SEQ ID NO: 1139515 - protein, 9 aa, Homo Sapiens
GMVSTSSPE

SEQ ID NO: 1139516 - protein, 9 aa, Homo Sapiens
AAVSTPPAS

SEQ ID NO: 1139517 - protein, 9 aa, Homo Sapiens
RKGSVVNVK

SEQ ID NO: 1139518 - protein, 9 aa, Homo Sapiens
ACLGMATGI

SEQ ID NO: 1139519 - protein, 9 aa, Homo Sapiens
SSFDPSRHR

SEQ ID NO: 1139520 - protein, 9 aa, Homo Sapiens
PPGPPRASP

SEQ ID NO: 1139521 - protein, 9 aa, Homo Sapiens
LSAVPQQVQ

SEQ ID NO: 1139522 - protein, 9 aa, Homo Sapiens
RGSVCTRTQ

SEQ ID NO: 1139523 - protein, 9 aa, Homo Sapiens
APPMAAASL

SEQ ID NO: 1139524 - protein, 9 aa, Homo Sapiens
HKKQSQQFL

SEQ ID NO: 1139525 - protein, 9 aa, Homo Sapiens
GYVVGWIIT

SEQ ID NO: 1139526 - protein, 9 aa, Homo Sapiens
YECKQCGEA

SEQ ID NO: 1139527 - protein, 9 aa, Homo Sapiens
HPAHQPLGS

SEQ ID NO: 1139528 - protein, 9 aa, Homo Sapiens
NPRDCSENI

SEQ ID NO: 1139529 - protein, 9 aa, Homo Sapiens
KVAGPGPPP

SEQ ID NO: 1139530 - protein, 9 aa, Homo Sapiens
LPPWPASSH

SEQ ID NO: 1139531 - protein, 9 aa, Homo Sapiens
YDSQPNFNM

SEQ ID NO: 1139532 - protein, 9 aa, Homo Sapiens
PGCFLQDFE

SEQ ID NO: 1139533 - protein, 9 aa, Homo Sapiens
SSRTGKLFP

SEQ ID NO: 1139534 - protein, 9 aa, Homo Sapiens
ATTSGLSQE

SEQ ID NO: 1139535 - protein, 9 aa, Homo Sapiens
QGTPQIHAS

SEQ ID NO: 1139536 - protein, 9 aa, Homo Sapiens
RTLGASGPV

SEQ ID NO: 1139537 - protein, 9 aa, Homo Sapiens
KKKRSAFPS

SEQ ID NO: 1139538 - protein, 9 aa, Homo Sapiens
GAQKMSNGR

SEQ ID NO: 1139539 - protein, 9 aa, Homo Sapiens
RSLCERHIL

SEQ ID NO: 1139540 - protein, 9 aa, Homo Sapiens
SAAGCSIQE

SEQ ID NO: 1139541 - protein, 9 aa, Homo Sapiens
WMRRRDTPR

SEQ ID NO: 1139542 - protein, 9 aa, Homo Sapiens
LIPLLGDQL

SEQ ID NO: 1139543 - protein, 9 aa, Homo Sapiens
VSQEDGLPT

SEQ ID NO: 1139544 - protein, 9 aa, Homo Sapiens
FATQPVLEA

SEQ ID NO: 1139545 - protein, 9 aa, Homo Sapiens
DGMGHFGRS

SEQ ID NO: 1139546 - protein, 9 aa, Homo Sapiens
KVQIELGWR

SEQ ID NO: 1139547 - protein, 9 aa, Homo Sapiens
GAADPLAVK

SEQ ID NO: 1139548 - protein, 9 aa, Homo Sapiens
KKDMLPQKF

SEQ ID NO: 1139549 - protein, 9 aa, Homo Sapiens
CGSPGWWAL

SEQ ID NO: 1139550 - protein, 9 aa, Homo Sapiens
RELRRTPCV

SEQ ID NO: 1139551 - protein, 9 aa, Homo Sapiens
ALDRRGGPG

SEQ ID NO: 1139552 - protein, 9 aa, Homo Sapiens
SSCPSPWWR

SEQ ID NO: 1139553 - protein, 9 aa, Homo Sapiens
FYVKGFYCV

SEQ ID NO: 1139554 - protein, 9 aa, Homo Sapiens
TLHVQAAQF

SEQ ID NO: 1139555 - protein, 9 aa, Homo Sapiens
NLLSYWHSL

SEQ ID NO: 1139556 - protein, 9 aa, Homo Sapiens
CQEQEVCFA

SEQ ID NO: 1139557 - protein, 9 aa, Homo Sapiens
RNASASRPT

SEQ ID NO: 1139558 - protein, 9 aa, Homo Sapiens
SAAATTSPP

SEQ ID NO: 1139559 - protein, 9 aa, Homo Sapiens
PAPTSSPAT

SEQ ID NO: 1139560 - protein, 9 aa, Homo Sapiens
QEAVQEVAD

SEQ ID NO: 1139561 - protein, 9 aa, Homo Sapiens
CWGWQQSWE

SEQ ID NO: 1139562 - protein, 9 aa, Homo Sapiens
GNFQRTTCH

SEQ ID NO: 1139563 - protein, 9 aa, Homo Sapiens
WLPLPPTPG

SEQ ID NO: 1139564 - protein, 9 aa, Homo Sapiens
WRPPRYLLS

SEQ ID NO: 1139565 - protein, 9 aa, Homo Sapiens
HQAVCLTRH

SEQ ID NO: 1139566 - protein, 9 aa, Homo Sapiens
LGPPAALHT

SEQ ID NO: 1139567 - protein, 9 aa, Homo Sapiens
MTMVRCGNL

SEQ ID NO: 1139568 - protein, 9 aa, Homo Sapiens
LVIITAVYS

SEQ ID NO: 1139569 - protein, 9 aa, Homo Sapiens
CSVSNDAGS

SEQ ID NO: 1139570 - protein, 9 aa, Homo Sapiens
CLKTSCFKL

SEQ ID NO: 1139571 - protein, 9 aa, Homo Sapiens
NQSTCTNYN

SEQ ID NO: 1139572 - protein, 9 aa, Homo Sapiens
WPLLESAHP

SEQ ID NO: 1139573 - protein, 9 aa, Homo Sapiens
MGAVVTWVI

SEQ ID NO: 1139574 - protein, 9 aa, Homo Sapiens
ASGQKREMC

SEQ ID NO: 1139575 - protein, 9 aa, Homo Sapiens
KSCGVAHAG

SEQ ID NO: 1139576 - protein, 9 aa, Homo Sapiens
KQSPLIFIF

SEQ ID NO: 1139577 - protein, 9 aa, Homo Sapiens
VADAEAGSL

SEQ ID NO: 1139578 - protein, 9 aa, Homo Sapiens
AELLGCYPE

SEQ ID NO: 1139579 - protein, 9 aa, Homo Sapiens
TLMMAFRNV

SEQ ID NO: 1139580 - protein, 9 aa, Homo Sapiens
ETDPLNEQW

SEQ ID NO: 1139581 - protein, 9 aa, Homo Sapiens
LVVGRVVEA

SEQ ID NO: 1139582 - protein, 9 aa, Homo Sapiens
AHPSRPCRM

SEQ ID NO: 1139583 - protein, 9 aa, Homo Sapiens
PTTTPALQP

SEQ ID NO: 1139584 - protein, 9 aa, Homo Sapiens
AQVRSKAKA

SEQ ID NO: 1139585 - protein, 9 aa, Homo Sapiens
PSQVWTAAT

SEQ ID NO: 1139586 - protein, 9 aa, Homo Sapiens
AFQKKGPRK

SEQ ID NO: 1139587 - protein, 9 aa, Homo Sapiens
IDKSAKNLL

SEQ ID NO: 1139588 - protein, 9 aa, Homo Sapiens
LTCARAWMR

SEQ ID NO: 1139589 - protein, 9 aa, Homo Sapiens
KKRARTRHQ

SEQ ID NO: 1139590 - protein, 9 aa, Homo Sapiens
KSLILFPPL

SEQ ID NO: 1139591 - protein, 9 aa, Homo Sapiens
PAQYTTLIS

SEQ ID NO: 1139592 - protein, 9 aa, Homo Sapiens
PNGLHPNYL

SEQ ID NO: 1139593 - protein, 9 aa, Homo Sapiens
HNSDAVRHS

SEQ ID NO: 1139594 - protein, 9 aa, Homo Sapiens
QHIFEPPPP

SEQ ID NO: 1139595 - protein, 9 aa, Homo Sapiens
NNDNEPKFL

SEQ ID NO: 1139596 - protein, 9 aa, Homo Sapiens
FCTCIPPVK

SEQ ID NO: 1139597 - protein, 9 aa, Homo Sapiens
CIESCKLYD

SEQ ID NO: 1139598 - protein, 9 aa, Homo Sapiens
AGWLTQMYF

SEQ ID NO: 1139599 - protein, 9 aa, Homo Sapiens
EHSIDLRSG

SEQ ID NO: 1139600 - protein, 9 aa, Homo Sapiens
VAGSTVGPS

SEQ ID NO: 1139601 - protein, 9 aa, Homo Sapiens
DESKPFPRY

SEQ ID NO: 1139602 - protein, 9 aa, Homo Sapiens
MKISLSTVL

SEQ ID NO: 1139603 - protein, 9 aa, Homo Sapiens
PAVLVVAAA

SEQ ID NO: 1139604 - protein, 9 aa, Homo Sapiens
LVWVPHPLT

SEQ ID NO: 1139605 - protein, 9 aa, Homo Sapiens
TVFKGSKNL

SEQ ID NO: 1139606 - protein, 9 aa, Homo Sapiens
LGFTGPPGP

SEQ ID NO: 1139607 - protein, 9 aa, Homo Sapiens
QTYAAPKVP

SEQ ID NO: 1139608 - protein, 9 aa, Homo Sapiens
LHLRVHPGA

SEQ ID NO: 1139609 - protein, 9 aa, Homo Sapiens
LYRDAMLEN

SEQ ID NO: 1139610 - protein, 9 aa, Homo Sapiens
TRGISTCGP

SEQ ID NO: 1139611 - protein, 9 aa, Homo Sapiens
IDLYHSEEE

SEQ ID NO: 1139612 - protein, 9 aa, Homo Sapiens
ILSRHLQEA

SEQ ID NO: 1139613 - protein, 9 aa, Homo Sapiens
RPRLHQLPR

SEQ ID NO: 1139614 - protein, 9 aa, Homo Sapiens
FDAYFVFEN

SEQ ID NO: 1139615 - protein, 9 aa, Homo Sapiens
LSKLVHADG

SEQ ID NO: 1139616 - protein, 9 aa, Homo Sapiens
NVAVLRELD

SEQ ID NO: 1139617 - protein, 9 aa, Homo Sapiens
ASIHVTFTK

SEQ ID NO: 1139618 - protein, 9 aa, Homo Sapiens
ERELERERV

SEQ ID NO: 1139619 - protein, 9 aa, Homo Sapiens
PQASTAVAP

SEQ ID NO: 1139620 - protein, 9 aa, Homo Sapiens
ADVYWCVIE

SEQ ID NO: 1139621 - protein, 9 aa, Homo Sapiens
EFKISYEWA

SEQ ID NO: 1139622 - protein, 9 aa, Homo Sapiens
SSVSTGDIT

SEQ ID NO: 1139623 - protein, 9 aa, Homo Sapiens
EEIGNQVVI

SEQ ID NO: 1139624 - protein, 9 aa, Homo Sapiens
SDRVGPLAV

SEQ ID NO: 1139625 - protein, 9 aa, Homo Sapiens
TLSESVNAK

SEQ ID NO: 1139626 - protein, 9 aa, Homo Sapiens
GLGTHRIKC

SEQ ID NO: 1139627 - protein, 9 aa, Homo Sapiens
PHACDPNLT

SEQ ID NO: 1139628 - protein, 9 aa, Homo Sapiens
HHSTALANQ

SEQ ID NO: 1139629 - protein, 9 aa, Homo Sapiens
FIDFPVYNA

SEQ ID NO: 1139630 - protein, 9 aa, Homo Sapiens
AGRTTQSLG

SEQ ID NO: 1139631 - protein, 9 aa, Homo Sapiens
ISVKQVITF

SEQ ID NO: 1139632 - protein, 9 aa, Homo Sapiens
PVAVATDLS

SEQ ID NO: 1139633 - protein, 9 aa, Homo Sapiens
WLGVQWRIT

SEQ ID NO: 1139634 - protein, 9 aa, Homo Sapiens
ILSTFPAER

SEQ ID NO: 1139635 - protein, 9 aa, Homo Sapiens
KCGIHGMFP

SEQ ID NO: 1139636 - protein, 9 aa, Homo Sapiens
APLFFKLMM

SEQ ID NO: 1139637 - protein, 9 aa, Homo Sapiens
KVFDATKGR

SEQ ID NO: 1139638 - protein, 9 aa, Homo Sapiens
LGDQLVGGQ

SEQ ID NO: 1139639 - protein, 9 aa, Homo Sapiens
QAWIGAGRA

SEQ ID NO: 1139640 - protein, 9 aa, Homo Sapiens
AKNQNAAPA

SEQ ID NO: 1139641 - protein, 9 aa, Homo Sapiens
AHKAELAAC

SEQ ID NO: 1139642 - protein, 9 aa, Homo Sapiens
QSLGHSRQG

SEQ ID NO: 1139643 - protein, 9 aa, Homo Sapiens
YAKKNLYYL

SEQ ID NO: 1139644 - protein, 9 aa, Homo Sapiens
RKTIMELKD

SEQ ID NO: 1139645 - protein, 9 aa, Homo Sapiens
QRGSLAIFC

SEQ ID NO: 1139646 - protein, 9 aa, Homo Sapiens
GHEPICDPE

SEQ ID NO: 1139647 - protein, 9 aa, Homo Sapiens
GRMHRIGEL

SEQ ID NO: 1139648 - protein, 9 aa, Homo Sapiens
TERGSMLSA

SEQ ID NO: 1139649 - protein, 9 aa, Homo Sapiens
ATYLRKIPH

SEQ ID NO: 1139650 - protein, 9 aa, Homo Sapiens
REEEEKKKQ

SEQ ID NO: 1139651 - protein, 9 aa, Homo Sapiens
AMGGGSGNM

SEQ ID NO: 1139652 - protein, 9 aa, Homo Sapiens
PKKFSILPS

SEQ ID NO: 1139653 - protein, 9 aa, Homo Sapiens
ADDFPVFLR

SEQ ID NO: 1139654 - protein, 9 aa, Homo Sapiens
SDMLAGFLT

SEQ ID NO: 1139655 - protein, 9 aa, Homo Sapiens
TVPIKHKKE

SEQ ID NO: 1139656 - protein, 9 aa, Homo Sapiens
LQVTLGELR

SEQ ID NO: 1139657 - protein, 9 aa, Homo Sapiens
AGELPGQVA

SEQ ID NO: 1139658 - protein, 9 aa, Homo Sapiens
TPMLRPLGP

SEQ ID NO: 1139659 - protein, 9 aa, Homo Sapiens
EAIKHKLCR

SEQ ID NO: 1139660 - protein, 9 aa, Homo Sapiens
GTTQLLHIL

SEQ ID NO: 1139661 - protein, 9 aa, Homo Sapiens
SWAARSLSR

SEQ ID NO: 1139662 - protein, 9 aa, Homo Sapiens
KKEGSWIQE

SEQ ID NO: 1139663 - protein, 9 aa, Homo Sapiens
MLQITEWRS

SEQ ID NO: 1139664 - protein, 9 aa, Homo Sapiens
TGPMGMCGF

SEQ ID NO: 1139665 - protein, 9 aa, Homo Sapiens
VLQVASSRT

SEQ ID NO: 1139666 - protein, 9 aa, Homo Sapiens
HAAGHVHGI

SEQ ID NO: 1139667 - protein, 9 aa, Homo Sapiens
LSVSPSLLK

SEQ ID NO: 1139668 - protein, 9 aa, Homo Sapiens
LPPLAAAAV

SEQ ID NO: 1139669 - protein, 9 aa, Homo Sapiens
MRGLKRSEQ

SEQ ID NO: 1139670 - protein, 9 aa, Homo Sapiens
GRILFDIIC

SEQ ID NO: 1139671 - protein, 9 aa, Homo Sapiens
SWSLSPLHG

SEQ ID NO: 1139672 - protein, 9 aa, Homo Sapiens
FSTLVTALK

SEQ ID NO: 1139673 - protein, 9 aa, Homo Sapiens
TSERPYKCN

SEQ ID NO: 1139674 - protein, 9 aa, Homo Sapiens
NLIPCQPRA

SEQ ID NO: 1139675 - protein, 9 aa, Homo Sapiens
PATRPLARI

SEQ ID NO: 1139676 - protein, 9 aa, Homo Sapiens
RQGSTETIE

SEQ ID NO: 1139677 - protein, 9 aa, Homo Sapiens
KYVKIFISL

SEQ ID NO: 1139678 - protein, 9 aa, Homo Sapiens
QAYGAGAYR

SEQ ID NO: 1139679 - protein, 9 aa, Homo Sapiens
PNSVLGHIW

SEQ ID NO: 1139680 - protein, 9 aa, Homo Sapiens
LWAFICELR

SEQ ID NO: 1139681 - protein, 9 aa, Homo Sapiens
RRTRGRAGA

SEQ ID NO: 1139682 - protein, 9 aa, Homo Sapiens
RKRRSHWMK

SEQ ID NO: 1139683 - protein, 9 aa, Homo Sapiens
LNIAMEQVN

SEQ ID NO: 1139684 - protein, 9 aa, Homo Sapiens
ASREDLIQI

SEQ ID NO: 1139685 - protein, 9 aa, Homo Sapiens
QQCPLNQQQ

SEQ ID NO: 1139686 - protein, 9 aa, Homo Sapiens
ATSPLLEDL

SEQ ID NO: 1139687 - protein, 9 aa, Homo Sapiens
HPLQMENAL

SEQ ID NO: 1139688 - protein, 9 aa, Homo Sapiens
GASGPVGPG

SEQ ID NO: 1139689 - protein, 9 aa, Homo Sapiens
PTSPKATAN

SEQ ID NO: 1139690 - protein, 9 aa, Homo Sapiens
KVRNHRIFE

SEQ ID NO: 1139691 - protein, 9 aa, Homo Sapiens
ISLSTVLSQ

SEQ ID NO: 1139692 - protein, 9 aa, Homo Sapiens
GPSGPSFAY

SEQ ID NO: 1139693 - protein, 8 aa, Homo Sapiens
KGTDSGSC

SEQ ID NO: 1139694 - protein, 9 aa, Homo Sapiens
HHQVLLFFI

SEQ ID NO: 1139695 - protein, 9 aa, Homo Sapiens
GGLGQVFAT

SEQ ID NO: 1139696 - protein, 9 aa, Homo Sapiens
RPSFIPHEV

SEQ ID NO: 1139697 - protein, 9 aa, Homo Sapiens
TRLTTVSGG

SEQ ID NO: 1139698 - protein, 9 aa, Homo Sapiens
SRALFTSLA

SEQ ID NO: 1139699 - protein, 9 aa, Homo Sapiens
PPSVTIHSF

SEQ ID NO: 1139700 - protein, 9 aa, Homo Sapiens
EMLRRTQAL

SEQ ID NO: 1139701 - protein, 9 aa, Homo Sapiens
LLIIDRDFD

SEQ ID NO: 1139702 - protein, 9 aa, Homo Sapiens
LPPEVPGLH

SEQ ID NO: 1139703 - protein, 9 aa, Homo Sapiens
AHRGNEQIS

SEQ ID NO: 1139704 - protein, 9 aa, Homo Sapiens
TDTITYRDS

SEQ ID NO: 1139705 - protein, 9 aa, Homo Sapiens
YVGVTSCLR

SEQ ID NO: 1139706 - protein, 9 aa, Homo Sapiens
MPSQLDSLV

SEQ ID NO: 1139707 - protein, 9 aa, Homo Sapiens
AAAVPKRMK

SEQ ID NO: 1139708 - protein, 9 aa, Homo Sapiens
LAKMAFCSA

SEQ ID NO: 1139709 - protein, 9 aa, Homo Sapiens
SVDMILISL

SEQ ID NO: 1139710 - protein, 9 aa, Homo Sapiens
DEVVSPLQS

SEQ ID NO: 1139711 - protein, 9 aa, Homo Sapiens
MDDSVSHQA

SEQ ID NO: 1139712 - protein, 9 aa, Homo Sapiens
PVLKENNAI

SEQ ID NO: 1139713 - protein, 9 aa, Homo Sapiens
THTVITTHT

SEQ ID NO: 1139714 - protein, 9 aa, Homo Sapiens
ARRPLLPGV

SEQ ID NO: 1139715 - protein, 9 aa, Homo Sapiens
SLYTEGSTN

SEQ ID NO: 1139716 - protein, 9 aa, Homo Sapiens
MPRTLEGCI

SEQ ID NO: 1139717 - protein, 9 aa, Homo Sapiens
TRFYFKEIL

SEQ ID NO: 1139718 - protein, 9 aa, Homo Sapiens
VRVPLQVVL

SEQ ID NO: 1139719 - protein, 9 aa, Homo Sapiens
RCVAGASRS

SEQ ID NO: 1139720 - protein, 9 aa, Homo Sapiens
PASSFSSLG

SEQ ID NO: 1139721 - protein, 9 aa, Homo Sapiens
IMSEHKKQS

SEQ ID NO: 1139722 - protein, 9 aa, Homo Sapiens
GSEASTRPI

SEQ ID NO: 1139723 - protein, 9 aa, Homo Sapiens
LQCNPRLDF

SEQ ID NO: 1139724 - protein, 9 aa, Homo Sapiens
HASGNLSRG

SEQ ID NO: 1139725 - protein, 9 aa, Homo Sapiens
LKRDIDDME

SEQ ID NO: 1139726 - protein, 9 aa, Homo Sapiens
NLIMFIVIH

SEQ ID NO: 1139727 - protein, 9 aa, Homo Sapiens
SRPWEKNRQ

SEQ ID NO: 1139728 - protein, 9 aa, Homo Sapiens
PENHADTIR

SEQ ID NO: 1139729 - protein, 9 aa, Homo Sapiens
AAVCSGRLL

SEQ ID NO: 1139730 - protein, 9 aa, Homo Sapiens
THAGSTMPS

SEQ ID NO: 1139731 - protein, 9 aa, Homo Sapiens
CISIRQLQL

SEQ ID NO: 1139732 - protein, 9 aa, Homo Sapiens
YTCAAENMV

SEQ ID NO: 1139733 - protein, 9 aa, Homo Sapiens
TLTLVYFSL

SEQ ID NO: 1139734 - protein, 9 aa, Homo Sapiens
QINVCLSKK

SEQ ID NO: 1139735 - protein, 9 aa, Homo Sapiens
LIKYKQKKH

SEQ ID NO: 1139736 - protein, 9 aa, Homo Sapiens
PSPPPHPQV

SEQ ID NO: 1139737 - protein, 9 aa, Homo Sapiens
LNEASVLLN

SEQ ID NO: 1139738 - protein, 9 aa, Homo Sapiens
ASRWLCRKL

SEQ ID NO: 1139739 - protein, 9 aa, Homo Sapiens
GHGRLVIVG

SEQ ID NO: 1139740 - protein, 9 aa, Homo Sapiens
CAGRHRLCR

SEQ ID NO: 1139741 - protein, 9 aa, Homo Sapiens
INPVREVKI

SEQ ID NO: 1139742 - protein, 9 aa, Homo Sapiens
IIELLDMGK

SEQ ID NO: 1139743 - protein, 9 aa, Homo Sapiens
CMAMYLMGL

SEQ ID NO: 1139744 - protein, 9 aa, Homo Sapiens
HMEKLTEVR

SEQ ID NO: 1139745 - protein, 9 aa, Homo Sapiens
ELGCACFKL

SEQ ID NO: 1139746 - protein, 9 aa, Homo Sapiens
DHRTSQNHS

SEQ ID NO: 1139747 - protein, 9 aa, Homo Sapiens
AAGLGPPAA

SEQ ID NO: 1139748 - protein, 9 aa, Homo Sapiens
LAHVLSLPI

SEQ ID NO: 1139749 - protein, 9 aa, Homo Sapiens
LNSEVVMEM

SEQ ID NO: 1139750 - protein, 9 aa, Homo Sapiens
VLGVATISC

SEQ ID NO: 1139751 - protein, 9 aa, Homo Sapiens
KLTHMCLAK

SEQ ID NO: 1139752 - protein, 9 aa, Homo Sapiens
WKYAELRDA

SEQ ID NO: 1139753 - protein, 9 aa, Homo Sapiens
ATKNAVLMY

SEQ ID NO: 1139754 - protein, 9 aa, Homo Sapiens
LGGNPVAVA

SEQ ID NO: 1139755 - protein, 9 aa, Homo Sapiens
VLFNFPPAQ

SEQ ID NO: 1139756 - protein, 9 aa, Homo Sapiens
AATSLATAA

SEQ ID NO: 1139757 - protein, 9 aa, Homo Sapiens
RPSATNPTW

SEQ ID NO: 1139758 - protein, 9 aa, Homo Sapiens
CGHPLLWGC

SEQ ID NO: 1139759 - protein, 9 aa, Homo Sapiens
PPTTRCTST

SEQ ID NO: 1139760 - protein, 9 aa, Homo Sapiens
PSCPRRPLR

SEQ ID NO: 1139761 - protein, 9 aa, Homo Sapiens
HIHNQTYRR

SEQ ID NO: 1139762 - protein, 9 aa, Homo Sapiens
CSGRLLGAS

SEQ ID NO: 1139763 - protein, 9 aa, Homo Sapiens
YGESSLAHI

SEQ ID NO: 1139764 - protein, 9 aa, Homo Sapiens
PVPLRPKAL

SEQ ID NO: 1139765 - protein, 9 aa, Homo Sapiens
DHRKIGSDQ

SEQ ID NO: 1139766 - protein, 9 aa, Homo Sapiens
IHIDEELRA

SEQ ID NO: 1139767 - protein, 9 aa, Homo Sapiens
KRLVQLLVS

SEQ ID NO: 1139768 - protein, 9 aa, Homo Sapiens
SPLQSALQG

SEQ ID NO: 1139769 - protein, 9 aa, Homo Sapiens
NVIRDVVTY

SEQ ID NO: 1139770 - protein, 9 aa, Homo Sapiens
QPQRNFCLL

SEQ ID NO: 1139771 - protein, 9 aa, Homo Sapiens
VVAAAVVVV

SEQ ID NO: 1139772 - protein, 9 aa, Homo Sapiens
GPAGTGRSS

SEQ ID NO: 1139773 - protein, 9 aa, Homo Sapiens
NTPHIIMHL

SEQ ID NO: 1139774 - protein, 9 aa, Homo Sapiens
DPEGLKNEE

SEQ ID NO: 1139775 - protein, 9 aa, Homo Sapiens
GIPDDRDNC

SEQ ID NO: 1139776 - protein, 9 aa, Homo Sapiens
PESPILVHR

SEQ ID NO: 1139777 - protein, 9 aa, Homo Sapiens
IKKHEEGCK

SEQ ID NO: 1139778 - protein, 9 aa, Homo Sapiens
AGLPVTGSP

SEQ ID NO: 1139779 - protein, 9 aa, Homo Sapiens
PPLRFNLIL

SEQ ID NO: 1139780 - protein, 9 aa, Homo Sapiens
TNIRLVYSN

SEQ ID NO: 1139781 - protein, 9 aa, Homo Sapiens
TFRMVLQKA

SEQ ID NO: 1139782 - protein, 9 aa, Homo Sapiens
PNEEDMFAS

SEQ ID NO: 1139783 - protein, 9 aa, Homo Sapiens
LKPIKRVLS

SEQ ID NO: 1139784 - protein, 9 aa, Homo Sapiens
ARATSGTAP

SEQ ID NO: 1139785 - protein, 9 aa, Homo Sapiens
AVSTPPASA

SEQ ID NO: 1139786 - protein, 9 aa, Homo Sapiens
IHGEKFEDE

SEQ ID NO: 1139787 - protein, 9 aa, Homo Sapiens
VNLDGSYWV

SEQ ID NO: 1139788 - protein, 9 aa, Homo Sapiens
SRSIYLGDS

SEQ ID NO: 1139789 - protein, 9 aa, Homo Sapiens
LMGRRRRGQ

SEQ ID NO: 1139790 - protein, 9 aa, Homo Sapiens
PGCTLWPHQ

SEQ ID NO: 1139791 - protein, 9 aa, Homo Sapiens
LRPRSMRSP

SEQ ID NO: 1139792 - protein, 9 aa, Homo Sapiens
LFPTSVQES

SEQ ID NO: 1139793 - protein, 9 aa, Homo Sapiens
YLHSNTGQD

SEQ ID NO: 1139794 - protein, 9 aa, Homo Sapiens
EKSTKSIVI

SEQ ID NO: 1139795 - protein, 9 aa, Homo Sapiens
YVACNAKDV

SEQ ID NO: 1139796 - protein, 9 aa, Homo Sapiens
TCRACRTSL

SEQ ID NO: 1139797 - protein, 9 aa, Homo Sapiens
GASIRRTKR

SEQ ID NO: 1139798 - protein, 9 aa, Homo Sapiens
FSVRNVFKK

SEQ ID NO: 1139799 - protein, 9 aa, Homo Sapiens
IMAQEDTAK

SEQ ID NO: 1139800 - protein, 9 aa, Homo Sapiens
THPAHQPLG

SEQ ID NO: 1139801 - protein, 9 aa, Homo Sapiens
ATRYCHGCG

SEQ ID NO: 1139802 - protein, 9 aa, Homo Sapiens
TAPDMKSYL

SEQ ID NO: 1139803 - protein, 9 aa, Homo Sapiens
PKRSRAQRP

SEQ ID NO: 1139804 - protein, 9 aa, Homo Sapiens
DGSHQDMAH

SEQ ID NO: 1139805 - protein, 9 aa, Homo Sapiens
WTEEEMEIA

SEQ ID NO: 1139806 - protein, 9 aa, Homo Sapiens
ESKIVFSVC

SEQ ID NO: 1139807 - protein, 9 aa, Homo Sapiens
ISQQKPSPV

SEQ ID NO: 1139808 - protein, 9 aa, Homo Sapiens
LLGLTIGLW

SEQ ID NO: 1139809 - protein, 9 aa, Homo Sapiens
RRRPRAGCP

SEQ ID NO: 1139810 - protein, 9 aa, Homo Sapiens
REMCASLYV

SEQ ID NO: 1139811 - protein, 9 aa, Homo Sapiens
PAMETRGCG

SEQ ID NO: 1139812 - protein, 9 aa, Homo Sapiens
WGQKANELY

SEQ ID NO: 1139813 - protein, 9 aa, Homo Sapiens
SDLFRHQRT

SEQ ID NO: 1139814 - protein, 9 aa, Homo Sapiens
DASRCLIGS

SEQ ID NO: 1139815 - protein, 9 aa, Homo Sapiens
GLPSTMQRK

SEQ ID NO: 1139816 - protein, 9 aa, Homo Sapiens
TDGGGGAAV

SEQ ID NO: 1139817 - protein, 9 aa, Homo Sapiens
LGPPLPPAT

SEQ ID NO: 1139818 - protein, 9 aa, Homo Sapiens
PNNNERYYG

SEQ ID NO: 1139819 - protein, 9 aa, Homo Sapiens
SHVGAADGL

SEQ ID NO: 1139820 - protein, 9 aa, Homo Sapiens
MKTGLSWSL

SEQ ID NO: 1139821 - protein, 9 aa, Homo Sapiens
ALLLRSSMY

SEQ ID NO: 1139822 - protein, 9 aa, Homo Sapiens
TPVWLHARL

SEQ ID NO: 1139823 - protein, 9 aa, Homo Sapiens
KRIEHSIDL

SEQ ID NO: 1139824 - protein, 9 aa, Homo Sapiens
GGQCCCCCG

SEQ ID NO: 1139825 - protein, 9 aa, Homo Sapiens
RTWWRTRAC

SEQ ID NO: 1139826 - protein, 9 aa, Homo Sapiens
ASCGPTSGS

SEQ ID NO: 1139827 - protein, 9 aa, Homo Sapiens
SSSSVNQSD

SEQ ID NO: 1139828 - protein, 9 aa, Homo Sapiens
TLTMESAKP

SEQ ID NO: 1139829 - protein, 9 aa, Homo Sapiens
MSGDQAKAA

SEQ ID NO: 1139830 - protein, 9 aa, Homo Sapiens
PNTWTSPSS

SEQ ID NO: 1139831 - protein, 9 aa, Homo Sapiens
LEFCTRLLW

SEQ ID NO: 1139832 - protein, 9 aa, Homo Sapiens
PCSKSHPKG

SEQ ID NO: 1139833 - protein, 9 aa, Homo Sapiens
TVITTHTQM

SEQ ID NO: 1139834 - protein, 9 aa, Homo Sapiens
NEFVGSMWR

SEQ ID NO: 1139835 - protein, 9 aa, Homo Sapiens
GTYIRTGDG

SEQ ID NO: 1139836 - protein, 9 aa, Homo Sapiens
DHYTAICHP

SEQ ID NO: 1139837 - protein, 9 aa, Homo Sapiens
SKQNLLLWR

SEQ ID NO: 1139838 - protein, 9 aa, Homo Sapiens
DSSDAGSSG

SEQ ID NO: 1139839 - protein, 9 aa, Homo Sapiens
SVGLQGKLG

SEQ ID NO: 1139840 - protein, 9 aa, Homo Sapiens
DKNHPKNLL

SEQ ID NO: 1139841 - protein, 9 aa, Homo Sapiens
QTKVLWPLR

SEQ ID NO: 1139842 - protein, 9 aa, Homo Sapiens
VNVVYAPWS

SEQ ID NO: 1139843 - protein, 9 aa, Homo Sapiens
GHSVYGPLW

SEQ ID NO: 1139844 - protein, 9 aa, Homo Sapiens
ILARLVATP

SEQ ID NO: 1139845 - protein, 9 aa, Homo Sapiens
AEVLVQSFS

SEQ ID NO: 1139846 - protein, 9 aa, Homo Sapiens
LTEMGKRKR

SEQ ID NO: 1139847 - protein, 9 aa, Homo Sapiens
VPPRGKDGH

SEQ ID NO: 1139848 - protein, 9 aa, Homo Sapiens
NRHSNEWKT

SEQ ID NO: 1139849 - protein, 9 aa, Homo Sapiens
EEGGNVEKD

SEQ ID NO: 1139850 - protein, 9 aa, Homo Sapiens
TSVPSLVFT

SEQ ID NO: 1139851 - protein, 9 aa, Homo Sapiens
RTRGAPAPP

SEQ ID NO: 1139852 - protein, 9 aa, Homo Sapiens
RDKKMVGDV

SEQ ID NO: 1139853 - protein, 9 aa, Homo Sapiens
GFRRKAQIP

SEQ ID NO: 1139854 - protein, 9 aa, Homo Sapiens
WPQKYSTWE

SEQ ID NO: 1139855 - protein, 9 aa, Homo Sapiens
SALETKATT

SEQ ID NO: 1139856 - protein, 9 aa, Homo Sapiens
YPTLKFFLN

SEQ ID NO: 1139857 - protein, 9 aa, Homo Sapiens
HVLSDDHHG

SEQ ID NO: 1139858 - protein, 9 aa, Homo Sapiens
GRGLRQRRG

SEQ ID NO: 1139859 - protein, 9 aa, Homo Sapiens
RTFLDRVYS

SEQ ID NO: 1139860 - protein, 9 aa, Homo Sapiens
SNPLNCTHL

SEQ ID NO: 1139861 - protein, 9 aa, Homo Sapiens
SVCVFRERA

SEQ ID NO: 1139862 - protein, 9 aa, Homo Sapiens
LVATKLYKG

SEQ ID NO: 1139863 - protein, 9 aa, Homo Sapiens
AFSFSQPRN

SEQ ID NO: 1139864 - protein, 9 aa, Homo Sapiens
TEEPEPEAE

SEQ ID NO: 1139865 - protein, 9 aa, Homo Sapiens
RCGWGGPRV

SEQ ID NO: 1139866 - protein, 9 aa, Homo Sapiens
IIITRDRGY

SEQ ID NO: 1139867 - protein, 9 aa, Homo Sapiens
SVKDHRTSQ

SEQ ID NO: 1139868 - protein, 9 aa, Homo Sapiens
RSPALRARG

SEQ ID NO: 1139869 - protein, 9 aa, Homo Sapiens
TPQIHASPR

SEQ ID NO: 1139870 - protein, 9 aa, Homo Sapiens
PPPGTGVCG

SEQ ID NO: 1139871 - protein, 9 aa, Homo Sapiens
RSVSPYPSH

SEQ ID NO: 1139872 - protein, 9 aa, Homo Sapiens
SSHGGLRLS

SEQ ID NO: 1139873 - protein, 9 aa, Homo Sapiens
REVADKGDA

SEQ ID NO: 1139874 - protein, 9 aa, Homo Sapiens
SSLTSEPGS

SEQ ID NO: 1139875 - protein, 9 aa, Homo Sapiens
DTEARKTGP

SEQ ID NO: 1139876 - protein, 9 aa, Homo Sapiens
LVDLAGSDR

SEQ ID NO: 1139877 - protein, 9 aa, Homo Sapiens
GGAPLDNST

SEQ ID NO: 1139878 - protein, 9 aa, Homo Sapiens
GPLWSIPEE

SEQ ID NO: 1139879 - protein, 9 aa, Homo Sapiens
HGFDKTQSE

SEQ ID NO: 1139880 - protein, 9 aa, Homo Sapiens
PPRPLTGRP

SEQ ID NO: 1139881 - protein, 9 aa, Homo Sapiens
GERQSPDPE

SEQ ID NO: 1139882 - protein, 9 aa, Homo Sapiens
VMESSVLLT

SEQ ID NO: 1139883 - protein, 9 aa, Homo Sapiens
PSLPHSRSS

SEQ ID NO: 1139884 - protein, 9 aa, Homo Sapiens
PFLWPGVKG

SEQ ID NO: 1139885 - protein, 9 aa, Homo Sapiens
SAGRTSARR

SEQ ID NO: 1139886 - protein, 9 aa, Homo Sapiens
ITGHDHEVV

SEQ ID NO: 1139887 - protein, 9 aa, Homo Sapiens
RPPLAPLLP

SEQ ID NO: 1139888 - protein, 9 aa, Homo Sapiens
ALECAGPKP

SEQ ID NO: 1139889 - protein, 9 aa, Homo Sapiens
LAARPPGEQ

SEQ ID NO: 1139890 - protein, 9 aa, Homo Sapiens
SGKGFVASP

SEQ ID NO: 1139891 - protein, 9 aa, Homo Sapiens
MGDNVIESK

SEQ ID NO: 1139892 - protein, 9 aa, Homo Sapiens
ECMVRGKHF

SEQ ID NO: 1139893 - protein, 9 aa, Homo Sapiens
QRPQTGSSS

SEQ ID NO: 1139894 - protein, 9 aa, Homo Sapiens
TNGQLVSQK

SEQ ID NO: 1139895 - protein, 9 aa, Homo Sapiens
RKADVDQDG

SEQ ID NO: 1139896 - protein, 9 aa, Homo Sapiens
DLIEGPAFS

SEQ ID NO: 1139897 - protein, 9 aa, Homo Sapiens
SQPSWNPKE

SEQ ID NO: 1139898 - protein, 9 aa, Homo Sapiens
WEVMPRTLE

SEQ ID NO: 1139899 - protein, 9 aa, Homo Sapiens
PPTPGRPAR

SEQ ID NO: 1139900 - protein, 9 aa, Homo Sapiens
SSQLITCHT

SEQ ID NO: 1139901 - protein, 9 aa, Homo Sapiens
MAPPAVGGR

SEQ ID NO: 1139902 - protein, 9 aa, Homo Sapiens
AARGLCSAA

SEQ ID NO: 1139903 - protein, 9 aa, Homo Sapiens
RPARPGTSG

SEQ ID NO: 1139904 - protein, 9 aa, Homo Sapiens
PDDDNDGIP

SEQ ID NO: 1139905 - protein, 9 aa, Homo Sapiens
DSGGSQPSM

SEQ ID NO: 1139906 - protein, 9 aa, Homo Sapiens
FVTVRLCRR

SEQ ID NO: 1139907 - protein, 9 aa, Homo Sapiens
QRFQSIICK

SEQ ID NO: 1139908 - protein, 9 aa, Homo Sapiens
ETGTALAAV

SEQ ID NO: 1139909 - protein, 9 aa, Homo Sapiens
AEDDDDDDD

SEQ ID NO: 1139910 - protein, 9 aa, Homo Sapiens
TVAYCYYLL

SEQ ID NO: 1139911 - protein, 9 aa, Homo Sapiens
YDHFSEDVY

SEQ ID NO: 1139912 - protein, 9 aa, Homo Sapiens
GGNWGAADQ

SEQ ID NO: 1139913 - protein, 9 aa, Homo Sapiens
YCLHEQYPL

SEQ ID NO: 1139914 - protein, 9 aa, Homo Sapiens
LSLPIRIYY

SEQ ID NO: 1139915 - protein, 9 aa, Homo Sapiens
TSASTARAG

SEQ ID NO: 1139916 - protein, 9 aa, Homo Sapiens
ASGTSRPGG

SEQ ID NO: 1139917 - protein, 9 aa, Homo Sapiens
LNSLQNYTL

SEQ ID NO: 1139918 - protein, 9 aa, Homo Sapiens
GRRRRTDSM

SEQ ID NO: 1139919 - protein, 9 aa, Homo Sapiens
FHKSCLEEN

SEQ ID NO: 1139920 - protein, 9 aa, Homo Sapiens
LSALGHTAV

SEQ ID NO: 1139921 - protein, 9 aa, Homo Sapiens
PSTAATTAA

SEQ ID NO: 1139922 - protein, 9 aa, Homo Sapiens
TLLGRCITS

SEQ ID NO: 1139923 - protein, 9 aa, Homo Sapiens
RTQRIPIPP

SEQ ID NO: 1139924 - protein, 9 aa, Homo Sapiens
MKAFKLFDD

SEQ ID NO: 1139925 - protein, 9 aa, Homo Sapiens
PGANICLLL

SEQ ID NO: 1139926 - protein, 9 aa, Homo Sapiens
LAVSTRGAS

SEQ ID NO: 1139927 - protein, 9 aa, Homo Sapiens
EQWEEEWTL

SEQ ID NO: 1139928 - protein, 9 aa, Homo Sapiens
PPPGLAPER

SEQ ID NO: 1139929 - protein, 9 aa, Homo Sapiens
CRFINIKKG

SEQ ID NO: 1139930 - protein, 9 aa, Homo Sapiens
YSTQVSMLT

SEQ ID NO: 1139931 - protein, 9 aa, Homo Sapiens
LQTRQADLH

SEQ ID NO: 1139932 - protein, 9 aa, Homo Sapiens
GGWVRRPGR

SEQ ID NO: 1139933 - protein, 9 aa, Homo Sapiens
GSPRLCATT

SEQ ID NO: 1139934 - protein, 9 aa, Homo Sapiens
YSSEDYTDQ

SEQ ID NO: 1139935 - protein, 9 aa, Homo Sapiens
FPETHLGRL

SEQ ID NO: 1139936 - protein, 9 aa, Homo Sapiens
KPFGPRSKM

SEQ ID NO: 1139937 - protein, 9 aa, Homo Sapiens
FCSFCIDLW

SEQ ID NO: 1139938 - protein, 9 aa, Homo Sapiens
AHTNRNHNS

SEQ ID NO: 1139939 - protein, 9 aa, Homo Sapiens
VISVAIPSV

SEQ ID NO: 1139940 - protein, 9 aa, Homo Sapiens
GAPPMAAAS

SEQ ID NO: 1139941 - protein, 9 aa, Homo Sapiens
PPRTPLFPL

SEQ ID NO: 1139942 - protein, 9 aa, Homo Sapiens
INNYRFQMK

SEQ ID NO: 1139943 - protein, 9 aa, Homo Sapiens
LKDPEELRS

SEQ ID NO: 1139944 - protein, 9 aa, Homo Sapiens
PPGQVGFGP

SEQ ID NO: 1139945 - protein, 9 aa, Homo Sapiens
KRWEETIFA

SEQ ID NO: 1139946 - protein, 9 aa, Homo Sapiens
SVTKVFKVL

SEQ ID NO: 1139947 - protein, 9 aa, Homo Sapiens
LLRQPLIMQ

SEQ ID NO: 1139948 - protein, 9 aa, Homo Sapiens
LGPVLFMVY

SEQ ID NO: 1139949 - protein, 9 aa, Homo Sapiens
GRVVEAGGS

SEQ ID NO: 1139950 - protein, 9 aa, Homo Sapiens
QQSLYCRSG

SEQ ID NO: 1139951 - protein, 9 aa, Homo Sapiens
TTRLMAPVG

SEQ ID NO: 1139952 - protein, 9 aa, Homo Sapiens
AELAILLPK

SEQ ID NO: 1139953 - protein, 9 aa, Homo Sapiens
GTAPMWTHG

SEQ ID NO: 1139954 - protein, 9 aa, Homo Sapiens
KRVHSKHSS

SEQ ID NO: 1139955 - protein, 9 aa, Homo Sapiens
LVGLFRAGK

SEQ ID NO: 1139956 - protein, 9 aa, Homo Sapiens
LKSRKLTKA

SEQ ID NO: 1139957 - protein, 9 aa, Homo Sapiens
QDGCNDGSV

SEQ ID NO: 1139958 - protein, 9 aa, Homo Sapiens
PGEIACRQR

SEQ ID NO: 1139959 - protein, 9 aa, Homo Sapiens
LTLMAEVSE

SEQ ID NO: 1139960 - protein, 9 aa, Homo Sapiens
EYVVPCMIH

SEQ ID NO: 1139961 - protein, 9 aa, Homo Sapiens
CSGSSTLAC

SEQ ID NO: 1139962 - protein, 9 aa, Homo Sapiens
GQDTIRGHL

SEQ ID NO: 1139963 - protein, 9 aa, Homo Sapiens
QHALAQAIA

SEQ ID NO: 1139964 - protein, 9 aa, Homo Sapiens
NCYDLVRTE

SEQ ID NO: 1139965 - protein, 9 aa, Homo Sapiens
WTAATLRCP

SEQ ID NO: 1139966 - protein, 9 aa, Homo Sapiens
DHETVDKIV

SEQ ID NO: 1139967 - protein, 9 aa, Homo Sapiens
ASSRPLSSW

SEQ ID NO: 1139968 - protein, 9 aa, Homo Sapiens
WMPLTILWV

SEQ ID NO: 1139969 - protein, 9 aa, Homo Sapiens
YTQKDQLEY

SEQ ID NO: 1139970 - protein, 9 aa, Homo Sapiens
CLSLDCGLW

SEQ ID NO: 1139971 - protein, 9 aa, Homo Sapiens
NLCQIVMAA

SEQ ID NO: 1139972 - protein, 9 aa, Homo Sapiens
QFLVYRRSA

SEQ ID NO: 1139973 - protein, 9 aa, Homo Sapiens
KVMILELLT

SEQ ID NO: 1139974 - protein, 9 aa, Homo Sapiens
PHTARPPLR

SEQ ID NO: 1139975 - protein, 9 aa, Homo Sapiens
LEGCISVKD

SEQ ID NO: 1139976 - protein, 9 aa, Homo Sapiens
IRAATLAPA

SEQ ID NO: 1139977 - protein, 9 aa, Homo Sapiens
WVLLHDGIK

SEQ ID NO: 1139978 - protein, 9 aa, Homo Sapiens
PVLLQGHSV

SEQ ID NO: 1139979 - protein, 9 aa, Homo Sapiens
LGIILGHFV

SEQ ID NO: 1139980 - protein, 9 aa, Homo Sapiens
RTSHISALI

SEQ ID NO: 1139981 - protein, 9 aa, Homo Sapiens
KGAGRARRA

SEQ ID NO: 1139982 - protein, 9 aa, Homo Sapiens
THQSSMSQT

SEQ ID NO: 1139983 - protein, 9 aa, Homo Sapiens
LPPPVLPGP

SEQ ID NO: 1139984 - protein, 9 aa, Homo Sapiens
LNFLSEGVN

SEQ ID NO: 1139985 - protein, 9 aa, Homo Sapiens
YRTSFYSQD

SEQ ID NO: 1139986 - protein, 9 aa, Homo Sapiens
LWGTWCSSS

SEQ ID NO: 1139987 - protein, 9 aa, Homo Sapiens
SRSHPETLA

SEQ ID NO: 1139988 - protein, 9 aa, Homo Sapiens
PTRCLDENN

SEQ ID NO: 1139989 - protein, 9 aa, Homo Sapiens
ACQNPTIFE

SEQ ID NO: 1139990 - protein, 9 aa, Homo Sapiens
VTIPDVHGR

SEQ ID NO: 1139991 - protein, 9 aa, Homo Sapiens
RNLTYMMTR

SEQ ID NO: 1139992 - protein, 9 aa, Homo Sapiens
GDGHGRLVI

SEQ ID NO: 1139993 - protein, 9 aa, Homo Sapiens
VISCFWSIP

SEQ ID NO: 1139994 - protein, 9 aa, Homo Sapiens
CSDESKPFP

SEQ ID NO: 1139995 - protein, 9 aa, Homo Sapiens
SNGATYSTQ

SEQ ID NO: 1139996 - protein, 9 aa, Homo Sapiens
PDGSHLGQP

SEQ ID NO: 1139997 - protein, 9 aa, Homo Sapiens
KASLSTSSS

SEQ ID NO: 1139998 - protein, 9 aa, Homo Sapiens
FNDVQSIKK

SEQ ID NO: 1139999 - protein, 9 aa, Homo Sapiens
PTEQPLELR

SEQ ID NO: 1140000 - protein, 9 aa, Homo Sapiens
AKTIKTVQA

SEQ ID NO: 1140001 - protein, 9 aa, Homo Sapiens
CRALELEQE

SEQ ID NO: 1140002 - protein, 9 aa, Homo Sapiens
QPESYLPIG

SEQ ID NO: 1140003 - protein, 9 aa, Homo Sapiens
SRSPTRPPG

SEQ ID NO: 1140004 - protein, 9 aa, Homo Sapiens
TSASTQARS

SEQ ID NO: 1140005 - protein, 9 aa, Homo Sapiens
RLTLMAEVS

SEQ ID NO: 1140006 - protein, 9 aa, Homo Sapiens
SVMCKMNPM

SEQ ID NO: 1140007 - protein, 9 aa, Homo Sapiens
LTHLAALVY

SEQ ID NO: 1140008 - protein, 9 aa, Homo Sapiens
HMGRDKKRT

SEQ ID NO: 1140009 - protein, 9 aa, Homo Sapiens
SMPHDGSLH

SEQ ID NO: 1140010 - protein, 9 aa, Homo Sapiens
QRQLLGHLQ

SEQ ID NO: 1140011 - protein, 9 aa, Homo Sapiens
HTDVFRFPT

SEQ ID NO: 1140012 - protein, 9 aa, Homo Sapiens
QEELKRVRG

SEQ ID NO: 1140013 - protein, 9 aa, Homo Sapiens
PLRTLPFTI

SEQ ID NO: 1140014 - protein, 9 aa, Homo Sapiens
HVLIEYFHL

SEQ ID NO: 1140015 - protein, 9 aa, Homo Sapiens
PEKDVTGAD

SEQ ID NO: 1140016 - protein, 9 aa, Homo Sapiens
HVAAMQMSS

SEQ ID NO: 1140017 - protein, 9 aa, Homo Sapiens
NDVAAIHCK

SEQ ID NO: 1140018 - protein, 9 aa, Homo Sapiens
STSLDDVLH

SEQ ID NO: 1140019 - protein, 9 aa, Homo Sapiens
RPGEIACRQ

SEQ ID NO: 1140020 - protein, 9 aa, Homo Sapiens
QSETVYEEM

SEQ ID NO: 1140021 - protein, 9 aa, Homo Sapiens
VLLFVTVRL

SEQ ID NO: 1140022 - protein, 9 aa, Homo Sapiens
HSDLGNSRF

SEQ ID NO: 1140023 - protein, 9 aa, Homo Sapiens
EFEEEEEEG

SEQ ID NO: 1140024 - protein, 9 aa, Homo Sapiens
PDRLKWHLL

SEQ ID NO: 1140025 - protein, 9 aa, Homo Sapiens
KSWTKLWCM

SEQ ID NO: 1140026 - protein, 9 aa, Homo Sapiens
LSTLSQPPP

SEQ ID NO: 1140027 - protein, 9 aa, Homo Sapiens
IHPQLLTSV

SEQ ID NO: 1140028 - protein, 9 aa, Homo Sapiens
PVVPQNMVP

SEQ ID NO: 1140029 - protein, 9 aa, Homo Sapiens
TRQQRSSGH

SEQ ID NO: 1140030 - protein, 9 aa, Homo Sapiens
PAPLPGRCR

SEQ ID NO: 1140031 - protein, 9 aa, Homo Sapiens
AAPSPTSER

SEQ ID NO: 1140032 - protein, 9 aa, Homo Sapiens
HWSPLTAAS

SEQ ID NO: 1140033 - protein, 9 aa, Homo Sapiens
LSALAVAVA

SEQ ID NO: 1140034 - protein, 9 aa, Homo Sapiens
PTATAASAR

SEQ ID NO: 1140035 - protein, 9 aa, Homo Sapiens
ECPVCFDFV

SEQ ID NO: 1140036 - protein, 9 aa, Homo Sapiens
LALLFEHMQ

SEQ ID NO: 1140037 - protein, 9 aa, Homo Sapiens
DKQVLEMVG

SEQ ID NO: 1140038 - protein, 9 aa, Homo Sapiens
RQLVGIGPR

SEQ ID NO: 1140039 - protein, 9 aa, Homo Sapiens
DAPAACLDR

SEQ ID NO: 1140040 - protein, 9 aa, Homo Sapiens
DVGLNSLQN

SEQ ID NO: 1140041 - protein, 9 aa, Homo Sapiens
AAENMVGKA

SEQ ID NO: 1140042 - protein, 9 aa, Homo Sapiens
GPRGVLSLL

SEQ ID NO: 1140043 - protein, 9 aa, Homo Sapiens
SPHLNQIMK

SEQ ID NO: 1140044 - protein, 9 aa, Homo Sapiens
RNGLHSVMD

SEQ ID NO: 1140045 - protein, 9 aa, Homo Sapiens
VACNMMKKK

SEQ ID NO: 1140046 - protein, 9 aa, Homo Sapiens
TRACTPASG

SEQ ID NO: 1140047 - protein, 9 aa, Homo Sapiens
ALTSIRCLH

SEQ ID NO: 1140048 - protein, 9 aa, Homo Sapiens
LRQLLVSLQ

SEQ ID NO: 1140049 - protein, 9 aa, Homo Sapiens
VVACFHFKW

SEQ ID NO: 1140050 - protein, 9 aa, Homo Sapiens
YPLPEHHST

SEQ ID NO: 1140051 - protein, 9 aa, Homo Sapiens
SLIDRPGPR

SEQ ID NO: 1140052 - protein, 9 aa, Homo Sapiens
RIKCRVHPN

SEQ ID NO: 1140053 - protein, 9 aa, Homo Sapiens
LQQYQRLTC

SEQ ID NO: 1140054 - protein, 9 aa, Homo Sapiens
IYDSQPNFN

SEQ ID NO: 1140055 - protein, 9 aa, Homo Sapiens
TLVFKRSPF

SEQ ID NO: 1140056 - protein, 9 aa, Homo Sapiens
LLAPGRGAA

SEQ ID NO: 1140057 - protein, 9 aa, Homo Sapiens
SLRPGARGE

SEQ ID NO: 1140058 - protein, 9 aa, Homo Sapiens
RKLLHVLTL

SEQ ID NO: 1140059 - protein, 9 aa, Homo Sapiens
KGMAGDWKI

SEQ ID NO: 1140060 - protein, 9 aa, Homo Sapiens
AQDPYDLMG

SEQ ID NO: 1140061 - protein, 9 aa, Homo Sapiens
TSLPPTGMT

SEQ ID NO: 1140062 - protein, 9 aa, Homo Sapiens
CRESGLRTH

SEQ ID NO: 1140063 - protein, 9 aa, Homo Sapiens
CCDAPHSFF

SEQ ID NO: 1140064 - protein, 9 aa, Homo Sapiens
SEGISFGLL

SEQ ID NO: 1140065 - protein, 9 aa, Homo Sapiens
AEGLLMEEE

SEQ ID NO: 1140066 - protein, 9 aa, Homo Sapiens
GEVQWRRVL

SEQ ID NO: 1140067 - protein, 9 aa, Homo Sapiens
AHSQYYVAQ

SEQ ID NO: 1140068 - protein, 9 aa, Homo Sapiens
LYSGTMSTT

SEQ ID NO: 1140069 - protein, 9 aa, Homo Sapiens
FDAKEEHAL

SEQ ID NO: 1140070 - protein, 9 aa, Homo Sapiens
NESDLCISI

SEQ ID NO: 1140071 - protein, 9 aa, Homo Sapiens
KYAFSLRNS

SEQ ID NO: 1140072 - protein, 9 aa, Homo Sapiens
GPSRREPSR

SEQ ID NO: 1140073 - protein, 9 aa, Homo Sapiens
GLLKVPIIR

SEQ ID NO: 1140074 - protein, 9 aa, Homo Sapiens
GGEAQENGI

SEQ ID NO: 1140075 - protein, 9 aa, Homo Sapiens
VPQQVQCIQ

SEQ ID NO: 1140076 - protein, 9 aa, Homo Sapiens
HSCDPPSSM

SEQ ID NO: 1140077 - protein, 9 aa, Homo Sapiens
GKNKQTIFN

SEQ ID NO: 1140078 - protein, 9 aa, Homo Sapiens
SVKKPFGPR

SEQ ID NO: 1140079 - protein, 9 aa, Homo Sapiens
FLWPGVKGP

SEQ ID NO: 1140080 - protein, 9 aa, Homo Sapiens
LAECCAQGR

SEQ ID NO: 1140081 - protein, 9 aa, Homo Sapiens
YNQTELGSR

SEQ ID NO: 1140082 - protein, 9 aa, Homo Sapiens
VALGPGRRS

SEQ ID NO: 1140083 - protein, 9 aa, Homo Sapiens
CGFCHEIAV

SEQ ID NO: 1140084 - protein, 9 aa, Homo Sapiens
FVKQRKIGD

SEQ ID NO: 1140085 - protein, 9 aa, Homo Sapiens
QQVTIDAIH

SEQ ID NO: 1140086 - protein, 9 aa, Homo Sapiens
CSWTCSQTR

SEQ ID NO: 1140087 - protein, 9 aa, Homo Sapiens
GQKREMCAS

SEQ ID NO: 1140088 - protein, 9 aa, Homo Sapiens
STGTTRQQR

SEQ ID NO: 1140089 - protein, 9 aa, Homo Sapiens
ELRPQHSEP

SEQ ID NO: 1140090 - protein, 9 aa, Homo Sapiens
RRERAGQTS

SEQ ID NO: 1140091 - protein, 9 aa, Homo Sapiens
PTLPVSRCE

SEQ ID NO: 1140092 - protein, 9 aa, Homo Sapiens
SHPDAILQA

SEQ ID NO: 1140093 - protein, 9 aa, Homo Sapiens
SAASACATS

SEQ ID NO: 1140094 - protein, 9 aa, Homo Sapiens
MSAPDGPSD

SEQ ID NO: 1140095 - protein, 9 aa, Homo Sapiens
TGDPPLLPP

SEQ ID NO: 1140096 - protein, 9 aa, Homo Sapiens
TLVGKGHFA

SEQ ID NO: 1140097 - protein, 9 aa, Homo Sapiens
CPGANICLL

SEQ ID NO: 1140098 - protein, 9 aa, Homo Sapiens
HCVQRALEI

SEQ ID NO: 1140099 - protein, 9 aa, Homo Sapiens
VLLKEVVKD

SEQ ID NO: 1140100 - protein, 9 aa, Homo Sapiens
HPHSHSHST

SEQ ID NO: 1140101 - protein, 9 aa, Homo Sapiens
HWNARIYYA

SEQ ID NO: 1140102 - protein, 9 aa, Homo Sapiens
LATWEQVGV

SEQ ID NO: 1140103 - protein, 9 aa, Homo Sapiens
IESLTGYRI

SEQ ID NO: 1140104 - protein, 9 aa, Homo Sapiens
NARERAHMR

SEQ ID NO: 1140105 - protein, 9 aa, Homo Sapiens
YIRKSPKGP

SEQ ID NO: 1140106 - protein, 9 aa, Homo Sapiens
LAPLLPLPP

SEQ ID NO: 1140107 - protein, 9 aa, Homo Sapiens
PAAARGAST

SEQ ID NO: 1140108 - protein, 9 aa, Homo Sapiens
SACHLIYSP

SEQ ID NO: 1140109 - protein, 9 aa, Homo Sapiens
RARRVRDSD

SEQ ID NO: 1140110 - protein, 9 aa, Homo Sapiens
LQDLAPPLL

SEQ ID NO: 1140111 - protein, 9 aa, Homo Sapiens
SPTSAPTAA

SEQ ID NO: 1140112 - protein, 9 aa, Homo Sapiens
VKKLMNARD

SEQ ID NO: 1140113 - protein, 9 aa, Homo Sapiens
QTSGETTHR

SEQ ID NO: 1140114 - protein, 9 aa, Homo Sapiens
TRGRRTGQL

SEQ ID NO: 1140115 - protein, 9 aa, Homo Sapiens
EALLISQLL

SEQ ID NO: 1140116 - protein, 9 aa, Homo Sapiens
SLCYGFVLD

SEQ ID NO: 1140117 - protein, 9 aa, Homo Sapiens
GGPRHHPRL

SEQ ID NO: 1140118 - protein, 9 aa, Homo Sapiens
LYEFCTCIP

SEQ ID NO: 1140119 - protein, 9 aa, Homo Sapiens
RSISTGCPL

SEQ ID NO: 1140120 - protein, 9 aa, Homo Sapiens
ADDAMCRCA

SEQ ID NO: 1140121 - protein, 9 aa, Homo Sapiens
SEGVEAFFM

SEQ ID NO: 1140122 - protein, 9 aa, Homo Sapiens
GESQEGKQQ

SEQ ID NO: 1140123 - protein, 9 aa, Homo Sapiens
LKEHLRKGG

SEQ ID NO: 1140124 - protein, 9 aa, Homo Sapiens
KSQLGSLKR

SEQ ID NO: 1140125 - protein, 9 aa, Homo Sapiens
TSWGEGFAQ

SEQ ID NO: 1140126 - protein, 9 aa, Homo Sapiens
VDLAGSESI

SEQ ID NO: 1140127 - protein, 9 aa, Homo Sapiens
HTQGSRPAA

SEQ ID NO: 1140128 - protein, 9 aa, Homo Sapiens
PDSTVDQQK

SEQ ID NO: 1140129 - protein, 9 aa, Homo Sapiens
LSGGFFVAA

SEQ ID NO: 1140130 - protein, 9 aa, Homo Sapiens
QLNGEATFG

SEQ ID NO: 1140131 - protein, 9 aa, Homo Sapiens
KQKRQRGSL

SEQ ID NO: 1140132 - protein, 9 aa, Homo Sapiens
QASQWPRVN

SEQ ID NO: 1140133 - protein, 9 aa, Homo Sapiens
TFLRHPRWS

SEQ ID NO: 1140134 - protein, 9 aa, Homo Sapiens
TQPPKQTIH

SEQ ID NO: 1140135 - protein, 9 aa, Homo Sapiens
EHCFRKIKH

SEQ ID NO: 1140136 - protein, 9 aa, Homo Sapiens
TEWRSLARD

SEQ ID NO: 1140137 - protein, 9 aa, Homo Sapiens
YQQIVQTYL

SEQ ID NO: 1140138 - protein, 9 aa, Homo Sapiens
KISQADSPC

SEQ ID NO: 1140139 - protein, 9 aa, Homo Sapiens
VWCPWCRGV

SEQ ID NO: 1140140 - protein, 9 aa, Homo Sapiens
GLTSGGECL

SEQ ID NO: 1140141 - protein, 9 aa, Homo Sapiens
GRQHSPNVC

SEQ ID NO: 1140142 - protein, 9 aa, Homo Sapiens
ISHRSEFEH

SEQ ID NO: 1140143 - protein, 9 aa, Homo Sapiens
APNDFSEQR

SEQ ID NO: 1140144 - protein, 9 aa, Homo Sapiens
VSSQPTSEL

SEQ ID NO: 1140145 - protein, 9 aa, Homo Sapiens
VPAHRSIPN

SEQ ID NO: 1140146 - protein, 9 aa, Homo Sapiens
DARKNSMIG

SEQ ID NO: 1140147 - protein, 9 aa, Homo Sapiens
IGKKGQHIE

SEQ ID NO: 1140148 - protein, 9 aa, Homo Sapiens
PAAARSSLG

SEQ ID NO: 1140149 - protein, 9 aa, Homo Sapiens
PVLTATATV

SEQ ID NO: 1140150 - protein, 9 aa, Homo Sapiens
TIDAIHEVE

SEQ ID NO: 1140151 - protein, 9 aa, Homo Sapiens
RKDKDGAAL

SEQ ID NO: 1140152 - protein, 9 aa, Homo Sapiens
WRWKPATPS

SEQ ID NO: 1140153 - protein, 9 aa, Homo Sapiens
VKKPIKKNP

SEQ ID NO: 1140154 - protein, 9 aa, Homo Sapiens
TCQQSAPWR

SEQ ID NO: 1140155 - protein, 9 aa, Homo Sapiens
WTSFGYVIL

SEQ ID NO: 1140156 - protein, 9 aa, Homo Sapiens
TIHHLKKTF

SEQ ID NO: 1140157 - protein, 9 aa, Homo Sapiens
PGLQMQESV

SEQ ID NO: 1140158 - protein, 9 aa, Homo Sapiens
YLGSDDVVK

SEQ ID NO: 1140159 - protein, 9 aa, Homo Sapiens
IQQPRYPRR

SEQ ID NO: 1140160 - protein, 9 aa, Homo Sapiens
RSTRRCPSP

SEQ ID NO: 1140161 - protein, 9 aa, Homo Sapiens
ASRDKQVLE

SEQ ID NO: 1140162 - protein, 9 aa, Homo Sapiens
QTRTAQSPA

SEQ ID NO: 1140163 - protein, 9 aa, Homo Sapiens
PTPHRRYFK

SEQ ID NO: 1140164 - protein, 9 aa, Homo Sapiens
ALSNKNLLI

SEQ ID NO: 1140165 - protein, 9 aa, Homo Sapiens
SPRCARSPS

SEQ ID NO: 1140166 - protein, 9 aa, Homo Sapiens
VLELTQKAT

SEQ ID NO: 1140167 - protein, 9 aa, Homo Sapiens
LWGKMLINL

SEQ ID NO: 1140168 - protein, 9 aa, Homo Sapiens
AISHRSEFE

SEQ ID NO: 1140169 - protein, 9 aa, Homo Sapiens
FPLLSRPRS

SEQ ID NO: 1140170 - protein, 9 aa, Homo Sapiens
KEQEKDRSK

SEQ ID NO: 1140171 - protein, 9 aa, Homo Sapiens
RAWLTALAV

SEQ ID NO: 1140172 - protein, 9 aa, Homo Sapiens
TYLRPRSMR

SEQ ID NO: 1140173 - protein, 9 aa, Homo Sapiens
IYLCRFCSY

SEQ ID NO: 1140174 - protein, 9 aa, Homo Sapiens
GSKTAGPHV

SEQ ID NO: 1140175 - protein, 9 aa, Homo Sapiens
PRTCGASIR

SEQ ID NO: 1140176 - protein, 9 aa, Homo Sapiens
VATISCRNE

SEQ ID NO: 1140177 - protein, 9 aa, Homo Sapiens
CSACHLIYS

SEQ ID NO: 1140178 - protein, 9 aa, Homo Sapiens
GQSHSKPCG

SEQ ID NO: 1140179 - protein, 9 aa, Homo Sapiens
GWPQKYSTW

SEQ ID NO: 1140180 - protein, 9 aa, Homo Sapiens
PRMKSQPSQ

SEQ ID NO: 1140181 - protein, 9 aa, Homo Sapiens
KSHDNVQLV

SEQ ID NO: 1140182 - protein, 9 aa, Homo Sapiens
FSAPCCWRL

SEQ ID NO: 1140183 - protein, 9 aa, Homo Sapiens
NAPEEKDLK

SEQ ID NO: 1140184 - protein, 9 aa, Homo Sapiens
PSLSPGLPG

SEQ ID NO: 1140185 - protein, 9 aa, Homo Sapiens
GIAGSVVQL

SEQ ID NO: 1140186 - protein, 9 aa, Homo Sapiens
EEERRAVIV

SEQ ID NO: 1140187 - protein, 9 aa, Homo Sapiens
VPRRKRCNR

SEQ ID NO: 1140188 - protein, 9 aa, Homo Sapiens
VTRHAAHTI

SEQ ID NO: 1140189 - protein, 9 aa, Homo Sapiens
PNPGCTLWP

SEQ ID NO: 1140190 - protein, 9 aa, Homo Sapiens
RTNGASQTT

SEQ ID NO: 1140191 - protein, 9 aa, Homo Sapiens
LFIYGTSII

SEQ ID NO: 1140192 - protein, 9 aa, Homo Sapiens
RGNMGIRPF

SEQ ID NO: 1140193 - protein, 9 aa, Homo Sapiens
RAWAPQTKG

SEQ ID NO: 1140194 - protein, 9 aa, Homo Sapiens
LYRPPLAPL

SEQ ID NO: 1140195 - protein, 9 aa, Homo Sapiens
LWTLSIWNQ

SEQ ID NO: 1140196 - protein, 9 aa, Homo Sapiens
THPLRMAKN

SEQ ID NO: 1140197 - protein, 9 aa, Homo Sapiens
TFYRLADLF

SEQ ID NO: 1140198 - protein, 9 aa, Homo Sapiens
HRIFEKDSK

SEQ ID NO: 1140199 - protein, 9 aa, Homo Sapiens
ISLSGIEII

SEQ ID NO: 1140200 - protein, 9 aa, Homo Sapiens
QRLQSPHTP

SEQ ID NO: 1140201 - protein, 9 aa, Homo Sapiens
GSSTDSEAL

SEQ ID NO: 1140202 - protein, 9 aa, Homo Sapiens
YTFSLAPGY

SEQ ID NO: 1140203 - protein, 9 aa, Homo Sapiens
GCFLQDFEK

SEQ ID NO: 1140204 - protein, 9 aa, Homo Sapiens
IDEAKRLHA

SEQ ID NO: 1140205 - protein, 9 aa, Homo Sapiens
IAMEQVNKR

SEQ ID NO: 1140206 - protein, 9 aa, Homo Sapiens
PWSPEDPWS

SEQ ID NO: 1140207 - protein, 9 aa, Homo Sapiens
KAYTLYWPE

SEQ ID NO: 1140208 - protein, 9 aa, Homo Sapiens
RCIIEVISN

SEQ ID NO: 1140209 - protein, 9 aa, Homo Sapiens
GERPYKGEE

SEQ ID NO: 1140210 - protein, 9 aa, Homo Sapiens
SASTQARSP

SEQ ID NO: 1140211 - protein, 9 aa, Homo Sapiens
WVDVDLLIG

SEQ ID NO: 1140212 - protein, 9 aa, Homo Sapiens
KCKPRFHFL

SEQ ID NO: 1140213 - protein, 9 aa, Homo Sapiens
LRRSYNEFG

SEQ ID NO: 1140214 - protein, 9 aa, Homo Sapiens
DDKKGCCRL

SEQ ID NO: 1140215 - protein, 9 aa, Homo Sapiens
STGDQAAKD

SEQ ID NO: 1140216 - protein, 9 aa, Homo Sapiens
VPGGPGTAE

SEQ ID NO: 1140217 - protein, 9 aa, Homo Sapiens
GEAVCAAIS

SEQ ID NO: 1140218 - protein, 9 aa, Homo Sapiens
GSGSPRRRP

SEQ ID NO: 1140219 - protein, 9 aa, Homo Sapiens
FKQHTIRAK

SEQ ID NO: 1140220 - protein, 9 aa, Homo Sapiens
CGILWLLWT

SEQ ID NO: 1140221 - protein, 9 aa, Homo Sapiens
EYAAVNCLT

SEQ ID NO: 1140222 - protein, 9 aa, Homo Sapiens
STFHILCKT

SEQ ID NO: 1140223 - protein, 9 aa, Homo Sapiens
YPEGFVYKH

SEQ ID NO: 1140224 - protein, 9 aa, Homo Sapiens
AIPEAMFSD

SEQ ID NO: 1140225 - protein, 9 aa, Homo Sapiens
PTPTPLSAS

SEQ ID NO: 1140226 - protein, 9 aa, Homo Sapiens
NVPVEAVSV

SEQ ID NO: 1140227 - protein, 9 aa, Homo Sapiens
PANRDTPPS

SEQ ID NO: 1140228 - protein, 9 aa, Homo Sapiens
EFIIKVQDN

SEQ ID NO: 1140229 - protein, 9 aa, Homo Sapiens
KLIASNSTI

SEQ ID NO: 1140230 - protein, 9 aa, Homo Sapiens
ATFEEGLGH

SEQ ID NO: 1140231 - protein, 9 aa, Homo Sapiens
GILTLFSLK

SEQ ID NO: 1140232 - protein, 9 aa, Homo Sapiens
SKALKPQLS

SEQ ID NO: 1140233 - protein, 9 aa, Homo Sapiens
PAIHQSLKA

SEQ ID NO: 1140234 - protein, 9 aa, Homo Sapiens
LQSPHTPLV

SEQ ID NO: 1140235 - protein, 9 aa, Homo Sapiens
PCGGKMATQ

SEQ ID NO: 1140236 - protein, 9 aa, Homo Sapiens
RWYTNINAT

SEQ ID NO: 1140237 - protein, 9 aa, Homo Sapiens
VTHARVLGS

SEQ ID NO: 1140238 - protein, 9 aa, Homo Sapiens
LGPTSAVVA

SEQ ID NO: 1140239 - protein, 9 aa, Homo Sapiens
MVAVALQPP

SEQ ID NO: 1140240 - protein, 9 aa, Homo Sapiens
SSPWPSALA

SEQ ID NO: 1140241 - protein, 9 aa, Homo Sapiens
PAHPTRGPR

SEQ ID NO: 1140242 - protein, 9 aa, Homo Sapiens
LSASHFTTL

SEQ ID NO: 1140243 - protein, 9 aa, Homo Sapiens
ESPPNPGCT

SEQ ID NO: 1140244 - protein, 9 aa, Homo Sapiens
KIMEHGGPP

SEQ ID NO: 1140245 - protein, 9 aa, Homo Sapiens
LQEFTPPSG

SEQ ID NO: 1140246 - protein, 9 aa, Homo Sapiens
GMTRASDRP

SEQ ID NO: 1140247 - protein, 9 aa, Homo Sapiens
QVQTIQILT

SEQ ID NO: 1140248 - protein, 9 aa, Homo Sapiens
RPERLLAPL

SEQ ID NO: 1140249 - protein, 9 aa, Homo Sapiens
AGFCAAGCH

SEQ ID NO: 1140250 - protein, 9 aa, Homo Sapiens
FMPYEIKVQ

SEQ ID NO: 1140251 - protein, 9 aa, Homo Sapiens
ARPSATNPT

SEQ ID NO: 1140252 - protein, 9 aa, Homo Sapiens
GGMMVRGPL

SEQ ID NO: 1140253 - protein, 9 aa, Homo Sapiens
IWVLFGSDD

SEQ ID NO: 1140254 - protein, 9 aa, Homo Sapiens
HLRKFSSSQ

SEQ ID NO: 1140255 - protein, 9 aa, Homo Sapiens
KAFFQKSGA

SEQ ID NO: 1140256 - protein, 9 aa, Homo Sapiens
WNPDGIDPT

SEQ ID NO: 1140257 - protein, 9 aa, Homo Sapiens
VRSRSPRCP

SEQ ID NO: 1140258 - protein, 9 aa, Homo Sapiens
GGPGTAEGP

SEQ ID NO: 1140259 - protein, 9 aa, Homo Sapiens
ETSLASCSR

SEQ ID NO: 1140260 - protein, 9 aa, Homo Sapiens
LSDTEQSLE

SEQ ID NO: 1140261 - protein, 9 aa, Homo Sapiens
GVQGQMVPP

SEQ ID NO: 1140262 - protein, 9 aa, Homo Sapiens
MTGLPRKSV

SEQ ID NO: 1140263 - protein, 9 aa, Homo Sapiens
LGHGVHHGG

SEQ ID NO: 1140264 - protein, 9 aa, Homo Sapiens
GGFGFGSRT

SEQ ID NO: 1140265 - protein, 9 aa, Homo Sapiens
FLVLRGVLG

SEQ ID NO: 1140266 - protein, 9 aa, Homo Sapiens
KLNQIAMTI

SEQ ID NO: 1140267 - protein, 9 aa, Homo Sapiens
SRFFVKIFF

SEQ ID NO: 1140268 - protein, 9 aa, Homo Sapiens
NLYYLRQQK

SEQ ID NO: 1140269 - protein, 9 aa, Homo Sapiens
QHQQNQNRM

SEQ ID NO: 1140270 - protein, 9 aa, Homo Sapiens
EIYDDCIGT

SEQ ID NO: 1140271 - protein, 9 aa, Homo Sapiens
VVGRVVEAG

SEQ ID NO: 1140272 - protein, 9 aa, Homo Sapiens
PQCLRRRSQ

SEQ ID NO: 1140273 - protein, 9 aa, Homo Sapiens
GERALPLPS

SEQ ID NO: 1140274 - protein, 9 aa, Homo Sapiens
GYRHPVLLL

SEQ ID NO: 1140275 - protein, 9 aa, Homo Sapiens
GSHLGQPRQ

SEQ ID NO: 1140276 - protein, 9 aa, Homo Sapiens
GAAKQGFSN

SEQ ID NO: 1140277 - protein, 9 aa, Homo Sapiens
VLTYGQTGS

SEQ ID NO: 1140278 - protein, 9 aa, Homo Sapiens
EKSQAVESA

SEQ ID NO: 1140279 - protein, 9 aa, Homo Sapiens
HWRIGGGTP

SEQ ID NO: 1140280 - protein, 9 aa, Homo Sapiens
FWHEHTKPD

SEQ ID NO: 1140281 - protein, 9 aa, Homo Sapiens
EEAKKLYPK

SEQ ID NO: 1140282 - protein, 9 aa, Homo Sapiens
AEQLKEYLF

SEQ ID NO: 1140283 - protein, 9 aa, Homo Sapiens
AATLGILSL

SEQ ID NO: 1140284 - protein, 9 aa, Homo Sapiens
DTGCRHIDG

SEQ ID NO: 1140285 - protein, 9 aa, Homo Sapiens
VGEDVSSLA

SEQ ID NO: 1140286 - protein, 9 aa, Homo Sapiens
GIVIEPSER

SEQ ID NO: 1140287 - protein, 9 aa, Homo Sapiens
KKWHRFGAS

SEQ ID NO: 1140288 - protein, 9 aa, Homo Sapiens
KAGLAPIFE

SEQ ID NO: 1140289 - protein, 9 aa, Homo Sapiens
RSLQNAVRV

SEQ ID NO: 1140290 - protein, 9 aa, Homo Sapiens
LIRSRVCGA

SEQ ID NO: 1140291 - protein, 9 aa, Homo Sapiens
QTRLRNSCE

SEQ ID NO: 1140292 - protein, 9 aa, Homo Sapiens
RLCATTTCP

SEQ ID NO: 1140293 - protein, 9 aa, Homo Sapiens
DSATTSGLS

SEQ ID NO: 1140294 - protein, 9 aa, Homo Sapiens
EASVLLNLR

SEQ ID NO: 1140295 - protein, 9 aa, Homo Sapiens
DTAYTKLVL

SEQ ID NO: 1140296 - protein, 9 aa, Homo Sapiens
KFEHLQTVT

SEQ ID NO: 1140297 - protein, 9 aa, Homo Sapiens
RPCPGICQL

SEQ ID NO: 1140298 - protein, 9 aa, Homo Sapiens
SQVDGSSQP

SEQ ID NO: 1140299 - protein, 9 aa, Homo Sapiens
TSQFPDEEK

SEQ ID NO: 1140300 - protein, 9 aa, Homo Sapiens
SLEGNSFLT

SEQ ID NO: 1140301 - protein, 9 aa, Homo Sapiens
SIVRAAHGP

SEQ ID NO: 1140302 - protein, 9 aa, Homo Sapiens
FPGMSEIYR

SEQ ID NO: 1140303 - protein, 9 aa, Homo Sapiens
VGVLTSKPY

SEQ ID NO: 1140304 - protein, 9 aa, Homo Sapiens
PTTPNGNLA

SEQ ID NO: 1140305 - protein, 9 aa, Homo Sapiens
GLICMAMYL

SEQ ID NO: 1140306 - protein, 9 aa, Homo Sapiens
RLLLQERLG

SEQ ID NO: 1140307 - protein, 9 aa, Homo Sapiens
ILELLTVAV

SEQ ID NO: 1140308 - protein, 9 aa, Homo Sapiens
ASCASTGSS

SEQ ID NO: 1140309 - protein, 9 aa, Homo Sapiens
CVSKILARH

SEQ ID NO: 1140310 - protein, 9 aa, Homo Sapiens
LLTSTIEFY

SEQ ID NO: 1140311 - protein, 9 aa, Homo Sapiens
LHLGPNVGC

SEQ ID NO: 1140312 - protein, 9 aa, Homo Sapiens
GNCHRCDHA

SEQ ID NO: 1140313 - protein, 9 aa, Homo Sapiens
RFPPEASDY

SEQ ID NO: 1140314 - protein, 9 aa, Homo Sapiens
AEQGRVHAV

SEQ ID NO: 1140315 - protein, 9 aa, Homo Sapiens
LSLEGNSFL

SEQ ID NO: 1140316 - protein, 9 aa, Homo Sapiens
SPGIPPALG

SEQ ID NO: 1140317 - protein, 9 aa, Homo Sapiens
ATGASGPVG

SEQ ID NO: 1140318 - protein, 9 aa, Homo Sapiens
PELRIGRLM

SEQ ID NO: 1140319 - protein, 9 aa, Homo Sapiens
ALTGRSPCP

SEQ ID NO: 1140320 - protein, 9 aa, Homo Sapiens
EGFDAKEEH

SEQ ID NO: 1140321 - protein, 9 aa, Homo Sapiens
SLASSSSCG

SEQ ID NO: 1140322 - protein, 9 aa, Homo Sapiens
WPLSTLQIN

SEQ ID NO: 1140323 - protein, 9 aa, Homo Sapiens
MASAPWSER

SEQ ID NO: 1140324 - protein, 9 aa, Homo Sapiens
PACIGWVAT

SEQ ID NO: 1140325 - protein, 9 aa, Homo Sapiens
DDRMVKSAL

SEQ ID NO: 1140326 - protein, 9 aa, Homo Sapiens
ACTCISMTT

SEQ ID NO: 1140327 - protein, 9 aa, Homo Sapiens
VKKKFMADL

SEQ ID NO: 1140328 - protein, 9 aa, Homo Sapiens
VYRTSFYSQ

SEQ ID NO: 1140329 - protein, 9 aa, Homo Sapiens
EKKAAVWAP

SEQ ID NO: 1140330 - protein, 9 aa, Homo Sapiens
DHVLFLIDP

SEQ ID NO: 1140331 - protein, 9 aa, Homo Sapiens
TLRGLAVGI

SEQ ID NO: 1140332 - protein, 9 aa, Homo Sapiens
GLQGKLGPK

SEQ ID NO: 1140333 - protein, 9 aa, Homo Sapiens
HSVMDDDLD

SEQ ID NO: 1140334 - protein, 9 aa, Homo Sapiens
NHFMVAQSE

SEQ ID NO: 1140335 - protein, 9 aa, Homo Sapiens
GDEPAGWKE

SEQ ID NO: 1140336 - protein, 9 aa, Homo Sapiens
VRGKHFTGR

SEQ ID NO: 1140337 - protein, 9 aa, Homo Sapiens
KMGKNRMER

SEQ ID NO: 1140338 - protein, 9 aa, Homo Sapiens
LSNLTPGAF

SEQ ID NO: 1140339 - protein, 9 aa, Homo Sapiens
LRVITSHAG

SEQ ID NO: 1140340 - protein, 9 aa, Homo Sapiens
LVHQLHGKV

SEQ ID NO: 1140341 - protein, 9 aa, Homo Sapiens
DALVFFFDA

SEQ ID NO: 1140342 - protein, 9 aa, Homo Sapiens
TTGQLTQEN

SEQ ID NO: 1140343 - protein, 9 aa, Homo Sapiens
NSSGASTDA

SEQ ID NO: 1140344 - protein, 9 aa, Homo Sapiens
QAVISLYAT

SEQ ID NO: 1140345 - protein, 9 aa, Homo Sapiens
RDVDECLQD

SEQ ID NO: 1140346 - protein, 9 aa, Homo Sapiens
WGAGRGRPQ

SEQ ID NO: 1140347 - protein, 9 aa, Homo Sapiens
VVLQGLFPP

SEQ ID NO: 1140348 - protein, 9 aa, Homo Sapiens
PSTSTRCRW

SEQ ID NO: 1140349 - protein, 9 aa, Homo Sapiens
CAMASSTWR

SEQ ID NO: 1140350 - protein, 9 aa, Homo Sapiens
IANRLAVDS

SEQ ID NO: 1140351 - protein, 9 aa, Homo Sapiens
PPISHDGSH

SEQ ID NO: 1140352 - protein, 9 aa, Homo Sapiens
LGSSEADQV

SEQ ID NO: 1140353 - protein, 9 aa, Homo Sapiens
KMKVLEFWP

SEQ ID NO: 1140354 - protein, 9 aa, Homo Sapiens
VACPDLRRQ

SEQ ID NO: 1140355 - protein, 9 aa, Homo Sapiens
SEALLDQRL

SEQ ID NO: 1140356 - protein, 9 aa, Homo Sapiens
VPPLPACSG

SEQ ID NO: 1140357 - protein, 9 aa, Homo Sapiens
KGPPNPGVG

SEQ ID NO: 1140358 - protein, 9 aa, Homo Sapiens
TRGRAGAPA

SEQ ID NO: 1140359 - protein, 9 aa, Homo Sapiens
SPRHGRSRS

SEQ ID NO: 1140360 - protein, 9 aa, Homo Sapiens
YHNVYSRDS

SEQ ID NO: 1140361 - protein, 9 aa, Homo Sapiens
PSDYVLLKE

SEQ ID NO: 1140362 - protein, 9 aa, Homo Sapiens
KVIIITRDR

SEQ ID NO: 1140363 - protein, 9 aa, Homo Sapiens
PGSLRLSCC

SEQ ID NO: 1140364 - protein, 9 aa, Homo Sapiens
VLLPGHLWK

SEQ ID NO: 1140365 - protein, 9 aa, Homo Sapiens
RLVIVGHGH

SEQ ID NO: 1140366 - protein, 9 aa, Homo Sapiens
DRYYTTLYR

SEQ ID NO: 1140367 - protein, 9 aa, Homo Sapiens
RTQQRPPWR

SEQ ID NO: 1140368 - protein, 9 aa, Homo Sapiens
RCITSQLGA

SEQ ID NO: 1140369 - protein, 9 aa, Homo Sapiens
LHSVMDDDL

SEQ ID NO: 1140370 - protein, 9 aa, Homo Sapiens
EKSSLGVEI

SEQ ID NO: 1140371 - protein, 9 aa, Homo Sapiens
GGGDRVPGL

SEQ ID NO: 1140372 - protein, 9 aa, Homo Sapiens
LLSVLDSTL

SEQ ID NO: 1140373 - protein, 9 aa, Homo Sapiens
DVTNLPTPQ

SEQ ID NO: 1140374 - protein, 9 aa, Homo Sapiens
LKPVEAVKY

SEQ ID NO: 1140375 - protein, 9 aa, Homo Sapiens
VIAKVIVIP

SEQ ID NO: 1140376 - protein, 9 aa, Homo Sapiens
PPQENKAVQ

SEQ ID NO: 1140377 - protein, 9 aa, Homo Sapiens
EEVSFFIAN

SEQ ID NO: 1140378 - protein, 9 aa, Homo Sapiens
YGGPSPQGQ

SEQ ID NO: 1140379 - protein, 9 aa, Homo Sapiens
TAEVLVQSF

SEQ ID NO: 1140380 - protein, 9 aa, Homo Sapiens
KGFVASPGR

SEQ ID NO: 1140381 - protein, 9 aa, Homo Sapiens
PHLGPPLPP

SEQ ID NO: 1140382 - protein, 9 aa, Homo Sapiens
IATNVEKHY

SEQ ID NO: 1140383 - protein, 9 aa, Homo Sapiens
TSSPASCCK

SEQ ID NO: 1140384 - protein, 9 aa, Homo Sapiens
GLCILVNTL

SEQ ID NO: 1140385 - protein, 9 aa, Homo Sapiens
CSERRYHQI

SEQ ID NO: 1140386 - protein, 9 aa, Homo Sapiens
DDGGLERKF

SEQ ID NO: 1140387 - protein, 9 aa, Homo Sapiens
NGRLGHGLV

SEQ ID NO: 1140388 - protein, 9 aa, Homo Sapiens
RSNIQVTVT

SEQ ID NO: 1140389 - protein, 9 aa, Homo Sapiens
PASSSPAPR

SEQ ID NO: 1140390 - protein, 9 aa, Homo Sapiens
GIGSSRRCL

SEQ ID NO: 1140391 - protein, 9 aa, Homo Sapiens
LSTKSPAAL

SEQ ID NO: 1140392 - protein, 9 aa, Homo Sapiens
VHGRSLQNA

SEQ ID NO: 1140393 - protein, 9 aa, Homo Sapiens
DLEPPLLVL

SEQ ID NO: 1140394 - protein, 9 aa, Homo Sapiens
PPLPPATPP

SEQ ID NO: 1140395 - protein, 9 aa, Homo Sapiens
LRCPKPTLQ

SEQ ID NO: 1140396 - protein, 9 aa, Homo Sapiens
AEGAGQREE

SEQ ID NO: 1140397 - protein, 9 aa, Homo Sapiens
DSAQLLTDR

SEQ ID NO: 1140398 - protein, 9 aa, Homo Sapiens
TCPFCPTLN

SEQ ID NO: 1140399 - protein, 9 aa, Homo Sapiens
KSPSPATSV

SEQ ID NO: 1140400 - protein, 9 aa, Homo Sapiens
KMDLDGMLT

SEQ ID NO: 1140401 - protein, 9 aa, Homo Sapiens
SRYSQPLHK

SEQ ID NO: 1140402 - protein, 9 aa, Homo Sapiens
WNARIYYAI

SEQ ID NO: 1140403 - protein, 9 aa, Homo Sapiens
RNVTVQIAN

SEQ ID NO: 1140404 - protein, 9 aa, Homo Sapiens
LADSLIGNA

SEQ ID NO: 1140405 - protein, 9 aa, Homo Sapiens
PLIPAPVLL

SEQ ID NO: 1140406 - protein, 9 aa, Homo Sapiens
EDAFHGPYG

SEQ ID NO: 1140407 - protein, 9 aa, Homo Sapiens
GFHVSKISQ

SEQ ID NO: 1140408 - protein, 9 aa, Homo Sapiens
SALTAYEDV

SEQ ID NO: 1140409 - protein, 9 aa, Homo Sapiens
PPRGRSQDC

SEQ ID NO: 1140410 - protein, 9 aa, Homo Sapiens
GLKEGIPAP

SEQ ID NO: 1140411 - protein, 9 aa, Homo Sapiens
CMGPNRELV

SEQ ID NO: 1140412 - protein, 9 aa, Homo Sapiens
SSSVRHRGA

SEQ ID NO: 1140413 - protein, 9 aa, Homo Sapiens
ELRHKHPVP

SEQ ID NO: 1140414 - protein, 9 aa, Homo Sapiens
TSITLSTIV

SEQ ID NO: 1140415 - protein, 9 aa, Homo Sapiens
SSKAEKRPQ

SEQ ID NO: 1140416 - protein, 9 aa, Homo Sapiens
SDPIMLNVG

SEQ ID NO: 1140417 - protein, 9 aa, Homo Sapiens
SFCFSPLWL

SEQ ID NO: 1140418 - protein, 9 aa, Homo Sapiens
LFTMFSSGT

SEQ ID NO: 1140419 - protein, 9 aa, Homo Sapiens
WEFTSWVSL

SEQ ID NO: 1140420 - protein, 9 aa, Homo Sapiens
IEFYTKGMT

SEQ ID NO: 1140421 - protein, 9 aa, Homo Sapiens
ALRARGGTT

SEQ ID NO: 1140422 - protein, 9 aa, Homo Sapiens
HRVLRYVNS

SEQ ID NO: 1140423 - protein, 9 aa, Homo Sapiens
LTSLGLSPD

SEQ ID NO: 1140424 - protein, 9 aa, Homo Sapiens
RQLPRDRRP

SEQ ID NO: 1140425 - protein, 9 aa, Homo Sapiens
VLDLICEGL

SEQ ID NO: 1140426 - protein, 9 aa, Homo Sapiens
WQGPQVSQQ

SEQ ID NO: 1140427 - protein, 9 aa, Homo Sapiens
VFMLHIQVQ

SEQ ID NO: 1140428 - protein, 9 aa, Homo Sapiens
SHSIPKFKI

SEQ ID NO: 1140429 - protein, 9 aa, Homo Sapiens
VTFDDHETV

SEQ ID NO: 1140430 - protein, 9 aa, Homo Sapiens
GENLTSVIS

SEQ ID NO: 1140431 - protein, 9 aa, Homo Sapiens
RLMSVDMIL

SEQ ID NO: 1140432 - protein, 9 aa, Homo Sapiens
VQALRNHYR

SEQ ID NO: 1140433 - protein, 9 aa, Homo Sapiens
SPCCLQALS

SEQ ID NO: 1140434 - protein, 9 aa, Homo Sapiens
YLTEFVELG

SEQ ID NO: 1140435 - protein, 9 aa, Homo Sapiens
SINFNEDNP

SEQ ID NO: 1140436 - protein, 9 aa, Homo Sapiens
ACWERQLKT

SEQ ID NO: 1140437 - protein, 9 aa, Homo Sapiens
TSWGAGFVN

SEQ ID NO: 1140438 - protein, 9 aa, Homo Sapiens
HHSQNYCYQ

SEQ ID NO: 1140439 - protein, 9 aa, Homo Sapiens
TLEKHGLSD

SEQ ID NO: 1140440 - protein, 9 aa, Homo Sapiens
GPTHASGNL

SEQ ID NO: 1140441 - protein, 9 aa, Homo Sapiens
MSHQNTFWY

SEQ ID NO: 1140442 - protein, 9 aa, Homo Sapiens
DETYPLSLW

SEQ ID NO: 1140443 - protein, 9 aa, Homo Sapiens
NKMNMDHQA

SEQ ID NO: 1140444 - protein, 9 aa, Homo Sapiens
LPGGGCCAK

SEQ ID NO: 1140445 - protein, 9 aa, Homo Sapiens
DSSVTKMHR

SEQ ID NO: 1140446 - protein, 9 aa, Homo Sapiens
KDSPGIPPA

SEQ ID NO: 1140447 - protein, 9 aa, Homo Sapiens
LAPPITDLF

SEQ ID NO: 1140448 - protein, 9 aa, Homo Sapiens
RFQMKFYFR

SEQ ID NO: 1140449 - protein, 9 aa, Homo Sapiens
CIRGKKQSP

SEQ ID NO: 1140450 - protein, 9 aa, Homo Sapiens
LQQLHQLPM

SEQ ID NO: 1140451 - protein, 9 aa, Homo Sapiens
ARGASTSSV

SEQ ID NO: 1140452 - protein, 9 aa, Homo Sapiens
IHHLETRPT

SEQ ID NO: 1140453 - protein, 9 aa, Homo Sapiens
VDILSTSGT

SEQ ID NO: 1140454 - protein, 9 aa, Homo Sapiens
IEQAHRGNE

SEQ ID NO: 1140455 - protein, 9 aa, Homo Sapiens
QDTDDEAAD

SEQ ID NO: 1140456 - protein, 9 aa, Homo Sapiens
IFIMLNYNT

SEQ ID NO: 1140457 - protein, 9 aa, Homo Sapiens
EVLAETCTD

SEQ ID NO: 1140458 - protein, 9 aa, Homo Sapiens
NTLLAAAAA

SEQ ID NO: 1140459 - protein, 9 aa, Homo Sapiens
EPEPAGVTP

SEQ ID NO: 1140460 - protein, 9 aa, Homo Sapiens
SLRPWARPA

SEQ ID NO: 1140461 - protein, 9 aa, Homo Sapiens
LMTVTGNVL

SEQ ID NO: 1140462 - protein, 9 aa, Homo Sapiens
GGDRVPGLG

SEQ ID NO: 1140463 - protein, 9 aa, Homo Sapiens
IKEVYFEKH

SEQ ID NO: 1140464 - protein, 9 aa, Homo Sapiens
IATTCNHRK

SEQ ID NO: 1140465 - protein, 9 aa, Homo Sapiens
MEYCFEVFD

SEQ ID NO: 1140466 - protein, 9 aa, Homo Sapiens
QLTPYSWVR

SEQ ID NO: 1140467 - protein, 9 aa, Homo Sapiens
DQRLRLQET

SEQ ID NO: 1140468 - protein, 9 aa, Homo Sapiens
PSPWLPAVP

SEQ ID NO: 1140469 - protein, 9 aa, Homo Sapiens
LPISQQKPS

SEQ ID NO: 1140470 - protein, 9 aa, Homo Sapiens
PRRRPYALL

SEQ ID NO: 1140471 - protein, 9 aa, Homo Sapiens
ERYSSSSGG

SEQ ID NO: 1140472 - protein, 9 aa, Homo Sapiens
AMENQHRSH

SEQ ID NO: 1140473 - protein, 9 aa, Homo Sapiens
ARWLDREER

SEQ ID NO: 1140474 - protein, 9 aa, Homo Sapiens
GWARVTLVT

SEQ ID NO: 1140475 - protein, 9 aa, Homo Sapiens
QGQHKLLCR

SEQ ID NO: 1140476 - protein, 9 aa, Homo Sapiens
GGSPAAVCS

SEQ ID NO: 1140477 - protein, 9 aa, Homo Sapiens
GQLPVSPSC

SEQ ID NO: 1140478 - protein, 9 aa, Homo Sapiens
LKEPGKNKQ

SEQ ID NO: 1140479 - protein, 9 aa, Homo Sapiens
VTFGIFCYG

SEQ ID NO: 1140480 - protein, 9 aa, Homo Sapiens
PKCCFFGAS

SEQ ID NO: 1140481 - protein, 9 aa, Homo Sapiens
DADQCCEVK

SEQ ID NO: 1140482 - protein, 9 aa, Homo Sapiens
LRRTQALPF

SEQ ID NO: 1140483 - protein, 9 aa, Homo Sapiens
TTILPYWRR

SEQ ID NO: 1140484 - protein, 9 aa, Homo Sapiens
YCILMEFCT

SEQ ID NO: 1140485 - protein, 9 aa, Homo Sapiens
LIERVKDCV

SEQ ID NO: 1140486 - protein, 9 aa, Homo Sapiens
KRKHTIEEA

SEQ ID NO: 1140487 - protein, 9 aa, Homo Sapiens
QESGVEVLS

SEQ ID NO: 1140488 - protein, 9 aa, Homo Sapiens
QLPSAPTCQ

SEQ ID NO: 1140489 - protein, 9 aa, Homo Sapiens
TPATPGNLV

SEQ ID NO: 1140490 - protein, 9 aa, Homo Sapiens
GECFPQAFF

SEQ ID NO: 1140491 - protein, 9 aa, Homo Sapiens
KDTKEEIMK

SEQ ID NO: 1140492 - protein, 9 aa, Homo Sapiens
RELLAGFCA

SEQ ID NO: 1140493 - protein, 9 aa, Homo Sapiens
DSGFTGTCC

SEQ ID NO: 1140494 - protein, 9 aa, Homo Sapiens
RRTRKQTKV

SEQ ID NO: 1140495 - protein, 9 aa, Homo Sapiens
GPRRRPYAL

SEQ ID NO: 1140496 - protein, 9 aa, Homo Sapiens
PSPAPLRLC

SEQ ID NO: 1140497 - protein, 9 aa, Homo Sapiens
LKITTNTEG

SEQ ID NO: 1140498 - protein, 9 aa, Homo Sapiens
ETMDIWLSL

SEQ ID NO: 1140499 - protein, 9 aa, Homo Sapiens
CKPRFHFLP

SEQ ID NO: 1140500 - protein, 9 aa, Homo Sapiens
GCGTSQLAE

SEQ ID NO: 1140501 - protein, 9 aa, Homo Sapiens
WEPVPGKVH

SEQ ID NO: 1140502 - protein, 9 aa, Homo Sapiens
PRPRLHQLP

SEQ ID NO: 1140503 - protein, 9 aa, Homo Sapiens
MINVVTLNN

SEQ ID NO: 1140504 - protein, 9 aa, Homo Sapiens
GWPMSSPWP

SEQ ID NO: 1140505 - protein, 9 aa, Homo Sapiens
TTPGILPSL

SEQ ID NO: 1140506 - protein, 9 aa, Homo Sapiens
LRSEEQKKN

SEQ ID NO: 1140507 - protein, 9 aa, Homo Sapiens
SSIKWSPSC

SEQ ID NO: 1140508 - protein, 9 aa, Homo Sapiens
ASIALATSK

SEQ ID NO: 1140509 - protein, 9 aa, Homo Sapiens
HMQRARNGG

SEQ ID NO: 1140510 - protein, 9 aa, Homo Sapiens
AQDSWWLPM

SEQ ID NO: 1140511 - protein, 9 aa, Homo Sapiens
SSDLEAQLD

SEQ ID NO: 1140512 - protein, 9 aa, Homo Sapiens
EIAKKGLVE

SEQ ID NO: 1140513 - protein, 9 aa, Homo Sapiens
REATMKMAA

SEQ ID NO: 1140514 - protein, 9 aa, Homo Sapiens
LRSPDQPHP

SEQ ID NO: 1140515 - protein, 9 aa, Homo Sapiens
RWAGARGRW

SEQ ID NO: 1140516 - protein, 9 aa, Homo Sapiens
LRVLSFNIE

SEQ ID NO: 1140517 - protein, 9 aa, Homo Sapiens
GRPPPQPAA

SEQ ID NO: 1140518 - protein, 9 aa, Homo Sapiens
TPTKLEPKP

SEQ ID NO: 1140519 - protein, 9 aa, Homo Sapiens
QEADQRDFR

SEQ ID NO: 1140520 - protein, 9 aa, Homo Sapiens
GRGTTRFYF

SEQ ID NO: 1140521 - protein, 9 aa, Homo Sapiens
NGVSTGRCI

SEQ ID NO: 1140522 - protein, 9 aa, Homo Sapiens
DNGWAGGGP

SEQ ID NO: 1140523 - protein, 9 aa, Homo Sapiens
EGEGERLVE

SEQ ID NO: 1140524 - protein, 9 aa, Homo Sapiens
IAQRLRICH

SEQ ID NO: 1140525 - protein, 9 aa, Homo Sapiens
SATFPRAMD

SEQ ID NO: 1140526 - protein, 9 aa, Homo Sapiens
KTSVAVHCS

SEQ ID NO: 1140527 - protein, 9 aa, Homo Sapiens
LKSTFHILC

SEQ ID NO: 1140528 - protein, 9 aa, Homo Sapiens
LAVQAQAGM

SEQ ID NO: 1140529 - protein, 9 aa, Homo Sapiens
TAIKAKQLE

SEQ ID NO: 1140530 - protein, 9 aa, Homo Sapiens
EGRGTESCE

SEQ ID NO: 1140531 - protein, 9 aa, Homo Sapiens
SEADQVGLA

SEQ ID NO: 1140532 - protein, 9 aa, Homo Sapiens
QVFSFCWFV

SEQ ID NO: 1140533 - protein, 9 aa, Homo Sapiens
LDGSMDERK

SEQ ID NO: 1140534 - protein, 9 aa, Homo Sapiens
GLMSLGNSR

SEQ ID NO: 1140535 - protein, 9 aa, Homo Sapiens
YLDDGGLER

SEQ ID NO: 1140536 - protein, 9 aa, Homo Sapiens
IHSKYVRAM

SEQ ID NO: 1140537 - protein, 9 aa, Homo Sapiens
RRLVSYWAQ

SEQ ID NO: 1140538 - protein, 9 aa, Homo Sapiens
DSIHRGAER

SEQ ID NO: 1140539 - protein, 9 aa, Homo Sapiens
RLYVMYTIG

SEQ ID NO: 1140540 - protein, 9 aa, Homo Sapiens
SAWCSSAAP

SEQ ID NO: 1140541 - protein, 9 aa, Homo Sapiens
TRNYAWVPI

SEQ ID NO: 1140542 - protein, 9 aa, Homo Sapiens
LPEAPPPPP

SEQ ID NO: 1140543 - protein, 9 aa, Homo Sapiens
PSPATSVEE

SEQ ID NO: 1140544 - protein, 9 aa, Homo Sapiens
QPRQLPRDR

SEQ ID NO: 1140545 - protein, 9 aa, Homo Sapiens
MSAGYHLGS

SEQ ID NO: 1140546 - protein, 9 aa, Homo Sapiens
IAWDPSPSH

SEQ ID NO: 1140547 - protein, 9 aa, Homo Sapiens
LQKKCKEYE

SEQ ID NO: 1140548 - protein, 9 aa, Homo Sapiens
LYNNREHIF

SEQ ID NO: 1140549 - protein, 9 aa, Homo Sapiens
EERRGRRGH

SEQ ID NO: 1140550 - protein, 9 aa, Homo Sapiens
GRLLAPGRG

SEQ ID NO: 1140551 - protein, 9 aa, Homo Sapiens
IGGGTPLSI

SEQ ID NO: 1140552 - protein, 9 aa, Homo Sapiens
GVSSALRFG

SEQ ID NO: 1140553 - protein, 9 aa, Homo Sapiens
PDWLRSCLE

SEQ ID NO: 1140554 - protein, 9 aa, Homo Sapiens
SWCPPGTTA

SEQ ID NO: 1140555 - protein, 9 aa, Homo Sapiens
GGLWHVQRS

SEQ ID NO: 1140556 - protein, 9 aa, Homo Sapiens
FWLMLCEFF

SEQ ID NO: 1140557 - protein, 9 aa, Homo Sapiens
QARRRAALS

SEQ ID NO: 1140558 - protein, 9 aa, Homo Sapiens
RKTSAVQRM

SEQ ID NO: 1140559 - protein, 9 aa, Homo Sapiens
VSPVLKENN

SEQ ID NO: 1140560 - protein, 9 aa, Homo Sapiens
IVHYSFLSH

SEQ ID NO: 1140561 - protein, 9 aa, Homo Sapiens
EYSALIVGH

SEQ ID NO: 1140562 - protein, 9 aa, Homo Sapiens
ASTRASGPT

SEQ ID NO: 1140563 - protein, 9 aa, Homo Sapiens
DENATYTQL

SEQ ID NO: 1140564 - protein, 9 aa, Homo Sapiens
RPWTAAARH

SEQ ID NO: 1140565 - protein, 9 aa, Homo Sapiens
EEPPTAPRH

SEQ ID NO: 1140566 - protein, 9 aa, Homo Sapiens
PRKSHDNVQ

SEQ ID NO: 1140567 - protein, 9 aa, Homo Sapiens
VHFKKDHSL

SEQ ID NO: 1140568 - protein, 9 aa, Homo Sapiens
QERMTQAEE

SEQ ID NO: 1140569 - protein, 9 aa, Homo Sapiens
IMGAVVTWV

SEQ ID NO: 1140570 - protein, 9 aa, Homo Sapiens
LHPPGTQEV

SEQ ID NO: 1140571 - protein, 9 aa, Homo Sapiens
LGVHIILIC

SEQ ID NO: 1140572 - protein, 9 aa, Homo Sapiens
LRPSFIPHE

SEQ ID NO: 1140573 - protein, 9 aa, Homo Sapiens
CLLTAFAQM

SEQ ID NO: 1140574 - protein, 9 aa, Homo Sapiens
LETYPDWFF

SEQ ID NO: 1140575 - protein, 9 aa, Homo Sapiens
AATTSPPTS

SEQ ID NO: 1140576 - protein, 9 aa, Homo Sapiens
SEGGPPRPT

SEQ ID NO: 1140577 - protein, 9 aa, Homo Sapiens
HLKEYEQCI

SEQ ID NO: 1140578 - protein, 9 aa, Homo Sapiens
AVLSVRPME

SEQ ID NO: 1140579 - protein, 9 aa, Homo Sapiens
DQPHPCPQF

SEQ ID NO: 1140580 - protein, 9 aa, Homo Sapiens
TLSKNFFDF

SEQ ID NO: 1140581 - protein, 9 aa, Homo Sapiens
ERVWRLEGN

SEQ ID NO: 1140582 - protein, 9 aa, Homo Sapiens
AAIKVMVVT

SEQ ID NO: 1140583 - protein, 9 aa, Homo Sapiens
RHLPPAAGL

SEQ ID NO: 1140584 - protein, 9 aa, Homo Sapiens
TKPESKYVP

SEQ ID NO: 1140585 - protein, 9 aa, Homo Sapiens
ATKGRKFYG

SEQ ID NO: 1140586 - protein, 9 aa, Homo Sapiens
CKHDLLMRA

SEQ ID NO: 1140587 - protein, 9 aa, Homo Sapiens
HDTDNAYVQ

SEQ ID NO: 1140588 - protein, 9 aa, Homo Sapiens
PALRAWPRQ

SEQ ID NO: 1140589 - protein, 9 aa, Homo Sapiens
KGLEILFSN

SEQ ID NO: 1140590 - protein, 9 aa, Homo Sapiens
KRPSLSEEE

SEQ ID NO: 1140591 - protein, 9 aa, Homo Sapiens
TSIAFSTSI

SEQ ID NO: 1140592 - protein, 9 aa, Homo Sapiens
AALSLSRTR

SEQ ID NO: 1140593 - protein, 9 aa, Homo Sapiens
ADEAKKHSN

SEQ ID NO: 1140594 - protein, 9 aa, Homo Sapiens
GTATMESLP

SEQ ID NO: 1140595 - protein, 9 aa, Homo Sapiens
TNALTLAQW

SEQ ID NO: 1140596 - protein, 9 aa, Homo Sapiens
YIDKDLEYA

SEQ ID NO: 1140597 - protein, 9 aa, Homo Sapiens
SRDSRSFFT

SEQ ID NO: 1140598 - protein, 9 aa, Homo Sapiens
TRRKRRRSG

SEQ ID NO: 1140599 - protein, 9 aa, Homo Sapiens
RRRKKKRRR

SEQ ID NO: 1140600 - protein, 9 aa, Homo Sapiens
PKKHCFDPD

SEQ ID NO: 1140601 - protein, 9 aa, Homo Sapiens
QMGPKKNQL

SEQ ID NO: 1140602 - protein, 9 aa, Homo Sapiens
LAHVPGRVT

SEQ ID NO: 1140603 - protein, 9 aa, Homo Sapiens
DRQLPGRLG

SEQ ID NO: 1140604 - protein, 9 aa, Homo Sapiens
DPVKKSCGV

SEQ ID NO: 1140605 - protein, 9 aa, Homo Sapiens
RLLPATSRP

SEQ ID NO: 1140606 - protein, 9 aa, Homo Sapiens
LLVKKPLVR

SEQ ID NO: 1140607 - protein, 9 aa, Homo Sapiens
QTRTSAPRI

SEQ ID NO: 1140608 - protein, 9 aa, Homo Sapiens
KMNKNRQRV

SEQ ID NO: 1140609 - protein, 9 aa, Homo Sapiens
NLTIEQSSQ

SEQ ID NO: 1140610 - protein, 9 aa, Homo Sapiens
DRPKVQADV

SEQ ID NO: 1140611 - protein, 9 aa, Homo Sapiens
GAWCRYGKR

SEQ ID NO: 1140612 - protein, 9 aa, Homo Sapiens
LRELCYGCG

SEQ ID NO: 1140613 - protein, 9 aa, Homo Sapiens
HSAGLSPGA

SEQ ID NO: 1140614 - protein, 9 aa, Homo Sapiens
HLMGRRRRG

SEQ ID NO: 1140615 - protein, 9 aa, Homo Sapiens
EKGSVTLKC

SEQ ID NO: 1140616 - protein, 9 aa, Homo Sapiens
AGACSKVKS

SEQ ID NO: 1140617 - protein, 9 aa, Homo Sapiens
EGIPAPDNF

SEQ ID NO: 1140618 - protein, 9 aa, Homo Sapiens
YSHLAKRLL

SEQ ID NO: 1140619 - protein, 9 aa, Homo Sapiens
HRAISIPDS

SEQ ID NO: 1140620 - protein, 9 aa, Homo Sapiens
ISSSLTSEP

SEQ ID NO: 1140621 - protein, 9 aa, Homo Sapiens
NKGPRTGCR

SEQ ID NO: 1140622 - protein, 9 aa, Homo Sapiens
FACLVIIHQ

SEQ ID NO: 1140623 - protein, 9 aa, Homo Sapiens
LRRILHRAV

SEQ ID NO: 1140624 - protein, 9 aa, Homo Sapiens
HTGSNIDCE

SEQ ID NO: 1140625 - protein, 9 aa, Homo Sapiens
AWASRWLCR

SEQ ID NO: 1140626 - protein, 9 aa, Homo Sapiens
PTACPVKQT

SEQ ID NO: 1140627 - protein, 9 aa, Homo Sapiens
LQSILDDFY

SEQ ID NO: 1140628 - protein, 9 aa, Homo Sapiens
FRNPLASAV

SEQ ID NO: 1140629 - protein, 9 aa, Homo Sapiens
FIIKVQDNN

SEQ ID NO: 1140630 - protein, 9 aa, Homo Sapiens
STRSYNWNI

SEQ ID NO: 1140631 - protein, 9 aa, Homo Sapiens
IFGVEEMAT

SEQ ID NO: 1140632 - protein, 9 aa, Homo Sapiens
VYKCLAPEE

SEQ ID NO: 1140633 - protein, 9 aa, Homo Sapiens
SRCENNSPS

SEQ ID NO: 1140634 - protein, 9 aa, Homo Sapiens
LQMTAVTMG

SEQ ID NO: 1140635 - protein, 9 aa, Homo Sapiens
RWCIHALLG

SEQ ID NO: 1140636 - protein, 9 aa, Homo Sapiens
LLHAPSLSP

SEQ ID NO: 1140637 - protein, 9 aa, Homo Sapiens
MQAVISLYA

SEQ ID NO: 1140638 - protein, 9 aa, Homo Sapiens
HRGEGEHKD

SEQ ID NO: 1140639 - protein, 9 aa, Homo Sapiens
SARRRTWWR

SEQ ID NO: 1140640 - protein, 9 aa, Homo Sapiens
CRTGSWWPR

SEQ ID NO: 1140641 - protein, 9 aa, Homo Sapiens
PHSHSHSTT

SEQ ID NO: 1140642 - protein, 9 aa, Homo Sapiens
NKSLTAHIV

SEQ ID NO: 1140643 - protein, 9 aa, Homo Sapiens
AEPGCLVTK

SEQ ID NO: 1140644 - protein, 9 aa, Homo Sapiens
RRHLPPAAG

SEQ ID NO: 1140645 - protein, 9 aa, Homo Sapiens
TPTWAGTST

SEQ ID NO: 1140646 - protein, 9 aa, Homo Sapiens
LGLSPDVQR

SEQ ID NO: 1140647 - protein, 9 aa, Homo Sapiens
RPSRKNHSS

SEQ ID NO: 1140648 - protein, 9 aa, Homo Sapiens
ALGPISCSG

SEQ ID NO: 1140649 - protein, 9 aa, Homo Sapiens
SDAPTRCLD

SEQ ID NO: 1140650 - protein, 9 aa, Homo Sapiens
PPLPACSGT

SEQ ID NO: 1140651 - protein, 9 aa, Homo Sapiens
KCDMSVLQR

SEQ ID NO: 1140652 - protein, 9 aa, Homo Sapiens
LTHPSMETT

SEQ ID NO: 1140653 - protein, 9 aa, Homo Sapiens
FYMINVVTL

SEQ ID NO: 1140654 - protein, 9 aa, Homo Sapiens
ENTLMRDLK

SEQ ID NO: 1140655 - protein, 9 aa, Homo Sapiens
YFKKFMEKD

SEQ ID NO: 1140656 - protein, 9 aa, Homo Sapiens
QAFARHGRS

SEQ ID NO: 1140657 - protein, 9 aa, Homo Sapiens
TPGAFHGLQ

SEQ ID NO: 1140658 - protein, 9 aa, Homo Sapiens
DHDLNGLLS

SEQ ID NO: 1140659 - protein, 9 aa, Homo Sapiens
HRSAGVGRT

SEQ ID NO: 1140660 - protein, 9 aa, Homo Sapiens
CYEGEADLR

SEQ ID NO: 1140661 - protein, 9 aa, Homo Sapiens
CTLKNRGYA

SEQ ID NO: 1140662 - protein, 9 aa, Homo Sapiens
QQLSLELNT

SEQ ID NO: 1140663 - protein, 9 aa, Homo Sapiens
HNYFMLVKN

SEQ ID NO: 1140664 - protein, 9 aa, Homo Sapiens
RKFPCGPWG

SEQ ID NO: 1140665 - protein, 9 aa, Homo Sapiens
MLHIGIMHW

SEQ ID NO: 1140666 - protein, 9 aa, Homo Sapiens
GLYVFLNVI

SEQ ID NO: 1140667 - protein, 9 aa, Homo Sapiens
AFRNVTVQI

SEQ ID NO: 1140668 - protein, 9 aa, Homo Sapiens
FSMDDMFLS

SEQ ID NO: 1140669 - protein, 9 aa, Homo Sapiens
ETWTLLRSF

SEQ ID NO: 1140670 - protein, 9 aa, Homo Sapiens
EARSTVVST

SEQ ID NO: 1140671 - protein, 9 aa, Homo Sapiens
CRAEGGPVG

SEQ ID NO: 1140672 - protein, 9 aa, Homo Sapiens
LLEDQVRKQ

SEQ ID NO: 1140673 - protein, 9 aa, Homo Sapiens
AGLGPPAAL

SEQ ID NO: 1140674 - protein, 9 aa, Homo Sapiens
TSARRRTWW

SEQ ID NO: 1140675 - protein, 9 aa, Homo Sapiens
WGIVEAMVA

SEQ ID NO: 1140676 - protein, 9 aa, Homo Sapiens
GPTAAGPAA

SEQ ID NO: 1140677 - protein, 9 aa, Homo Sapiens
IGLGVIING

SEQ ID NO: 1140678 - protein, 9 aa, Homo Sapiens
CRLVNWPEH

SEQ ID NO: 1140679 - protein, 9 aa, Homo Sapiens
GPRGRGCTG

SEQ ID NO: 1140680 - protein, 9 aa, Homo Sapiens
PSTLMRRLW

SEQ ID NO: 1140681 - protein, 9 aa, Homo Sapiens
SLEGALSSQ

SEQ ID NO: 1140682 - protein, 9 aa, Homo Sapiens
EDKKIKTES

SEQ ID NO: 1140683 - protein, 9 aa, Homo Sapiens
KIFYDSISK

SEQ ID NO: 1140684 - protein, 9 aa, Homo Sapiens
FCTADILHA

SEQ ID NO: 1140685 - protein, 9 aa, Homo Sapiens
TLPAPTACS

SEQ ID NO: 1140686 - protein, 9 aa, Homo Sapiens
HHPFQGSYS

SEQ ID NO: 1140687 - protein, 9 aa, Homo Sapiens
DQAAAFLPL

SEQ ID NO: 1140688 - protein, 9 aa, Homo Sapiens
GVPTLGSNV

SEQ ID NO: 1140689 - protein, 9 aa, Homo Sapiens
VIRTLDTPS

SEQ ID NO: 1140690 - protein, 9 aa, Homo Sapiens
HSLAHNLSV

SEQ ID NO: 1140691 - protein, 9 aa, Homo Sapiens
ENLTSVISV

SEQ ID NO: 1140692 - protein, 9 aa, Homo Sapiens
KEEIMKAFK

SEQ ID NO: 1140693 - protein, 9 aa, Homo Sapiens
LIMQPPLDL

SEQ ID NO: 1140694 - protein, 9 aa, Homo Sapiens
SSLVVKFVD

SEQ ID NO: 1140695 - protein, 9 aa, Homo Sapiens
AGWGTSAST

SEQ ID NO: 1140696 - protein, 9 aa, Homo Sapiens
ITRDRGYNQ

SEQ ID NO: 1140697 - protein, 9 aa, Homo Sapiens
FLALLTSVT

SEQ ID NO: 1140698 - protein, 9 aa, Homo Sapiens
TRPSTSTRC

SEQ ID NO: 1140699 - protein, 9 aa, Homo Sapiens
MIQKAVIQA

SEQ ID NO: 1140700 - protein, 9 aa, Homo Sapiens
AMKQGFKFN

SEQ ID NO: 1140701 - protein, 9 aa, Homo Sapiens
ELAESGLVP

SEQ ID NO: 1140702 - protein, 9 aa, Homo Sapiens
RRPCASCPG

SEQ ID NO: 1140703 - protein, 9 aa, Homo Sapiens
KHCPMARYI

SEQ ID NO: 1140704 - protein, 9 aa, Homo Sapiens
ITIDNICRC

SEQ ID NO: 1140705 - protein, 9 aa, Homo Sapiens
LGLGTHRIK

SEQ ID NO: 1140706 - protein, 9 aa, Homo Sapiens
ASMEFLQQE

SEQ ID NO: 1140707 - protein, 9 aa, Homo Sapiens
LLVTYHINN

SEQ ID NO: 1140708 - protein, 9 aa, Homo Sapiens
WVGAQEAVQ

SEQ ID NO: 1140709 - protein, 9 aa, Homo Sapiens
IQRPIQVQT

SEQ ID NO: 1140710 - protein, 9 aa, Homo Sapiens
MEFVCMKGP

SEQ ID NO: 1140711 - protein, 9 aa, Homo Sapiens
EQDLLHKMA

SEQ ID NO: 1140712 - protein, 9 aa, Homo Sapiens
PTKKSLILF

SEQ ID NO: 1140713 - protein, 9 aa, Homo Sapiens
VISVHGTEK

SEQ ID NO: 1140714 - protein, 9 aa, Homo Sapiens
EIQPTWKLL

SEQ ID NO: 1140715 - protein, 9 aa, Homo Sapiens
DAEKLEQAG

SEQ ID NO: 1140716 - protein, 9 aa, Homo Sapiens
YYTTLYRKM

SEQ ID NO: 1140717 - protein, 9 aa, Homo Sapiens
SVPGAALQD

SEQ ID NO: 1140718 - protein, 9 aa, Homo Sapiens
LQHKRLVRL

SEQ ID NO: 1140719 - protein, 9 aa, Homo Sapiens
STLACSRNS

SEQ ID NO: 1140720 - protein, 9 aa, Homo Sapiens
GASSSTSRD

SEQ ID NO: 1140721 - protein, 9 aa, Homo Sapiens
PRHRVVQST

SEQ ID NO: 1140722 - protein, 9 aa, Homo Sapiens
AVWAPRRGP

SEQ ID NO: 1140723 - protein, 9 aa, Homo Sapiens
NERFDTHEY

SEQ ID NO: 1140724 - protein, 9 aa, Homo Sapiens
PCEELAESG

SEQ ID NO: 1140725 - protein, 9 aa, Homo Sapiens
MLLSGIMGA

SEQ ID NO: 1140726 - protein, 9 aa, Homo Sapiens
APPGCILPF

SEQ ID NO: 1140727 - protein, 9 aa, Homo Sapiens
LASPTSSVA

SEQ ID NO: 1140728 - protein, 9 aa, Homo Sapiens
QGSRPAAGR

SEQ ID NO: 1140729 - protein, 9 aa, Homo Sapiens
SVCHCTHLT

SEQ ID NO: 1140730 - protein, 9 aa, Homo Sapiens
KPLTSLGLS

SEQ ID NO: 1140731 - protein, 9 aa, Homo Sapiens
QPTNRRSKN

SEQ ID NO: 1140732 - protein, 9 aa, Homo Sapiens
PSIDEAWWL

SEQ ID NO: 1140733 - protein, 9 aa, Homo Sapiens
GRYGDALKN

SEQ ID NO: 1140734 - protein, 9 aa, Homo Sapiens
VKPTNTRPQ

SEQ ID NO: 1140735 - protein, 9 aa, Homo Sapiens
SRSRCAYAS

SEQ ID NO: 1140736 - protein, 9 aa, Homo Sapiens
AKKGGNHIP

SEQ ID NO: 1140737 - protein, 9 aa, Homo Sapiens
ETDEDKFFS

SEQ ID NO: 1140738 - protein, 9 aa, Homo Sapiens
EHTNAKKIL

SEQ ID NO: 1140739 - protein, 9 aa, Homo Sapiens
QLLTGCHLS

SEQ ID NO: 1140740 - protein, 9 aa, Homo Sapiens
EKNKWMNKK

SEQ ID NO: 1140741 - protein, 9 aa, Homo Sapiens
GFKFNIMVV

SEQ ID NO: 1140742 - protein, 9 aa, Homo Sapiens
LQNIMDFGK

SEQ ID NO: 1140743 - protein, 9 aa, Homo Sapiens
CPLCSVTDY

SEQ ID NO: 1140744 - protein, 9 aa, Homo Sapiens
DDGTNQIND

SEQ ID NO: 1140745 - protein, 9 aa, Homo Sapiens
PATPGPGAG

SEQ ID NO: 1140746 - protein, 9 aa, Homo Sapiens
PTAFSEYPS

SEQ ID NO: 1140747 - protein, 9 aa, Homo Sapiens
PPTPMDSHR

SEQ ID NO: 1140748 - protein, 9 aa, Homo Sapiens
VKYFPFGQQ

SEQ ID NO: 1140749 - protein, 9 aa, Homo Sapiens
SRSRACWER

SEQ ID NO: 1140750 - protein, 9 aa, Homo Sapiens
QDDAYSQCV

SEQ ID NO: 1140751 - protein, 9 aa, Homo Sapiens
GQRPARQPT

SEQ ID NO: 1140752 - protein, 9 aa, Homo Sapiens
RGRTGVLLS

SEQ ID NO: 1140753 - protein, 9 aa, Homo Sapiens
SGGPRAKKP

SEQ ID NO: 1140754 - protein, 9 aa, Homo Sapiens
STTAKKPAV

SEQ ID NO: 1140755 - protein, 9 aa, Homo Sapiens
PGENLNISC

SEQ ID NO: 1140756 - protein, 9 aa, Homo Sapiens
SPALRARGG

SEQ ID NO: 1140757 - protein, 9 aa, Homo Sapiens
TASSPECGF

SEQ ID NO: 1140758 - protein, 9 aa, Homo Sapiens
KEGSWIQEI

SEQ ID NO: 1140759 - protein, 9 aa, Homo Sapiens
SAVLATYVF

SEQ ID NO: 1140760 - protein, 9 aa, Homo Sapiens
RAVITGHDH

SEQ ID NO: 1140761 - protein, 9 aa, Homo Sapiens
SVTASCAST

SEQ ID NO: 1140762 - protein, 9 aa, Homo Sapiens
NSRLSVVHM

SEQ ID NO: 1140763 - protein, 9 aa, Homo Sapiens
PNMTPRRRQ

SEQ ID NO: 1140764 - protein, 9 aa, Homo Sapiens
EKPFFCSEC

SEQ ID NO: 1140765 - protein, 9 aa, Homo Sapiens
ESQASICQL

SEQ ID NO: 1140766 - protein, 9 aa, Homo Sapiens
DAPQHAHQL

SEQ ID NO: 1140767 - protein, 9 aa, Homo Sapiens
RPAPYGITP

SEQ ID NO: 1140768 - protein, 9 aa, Homo Sapiens
LHLGLQPPV

SEQ ID NO: 1140769 - protein, 9 aa, Homo Sapiens
RNNMSAPDG

SEQ ID NO: 1140770 - protein, 9 aa, Homo Sapiens
PGDQRAGKD

SEQ ID NO: 1140771 - protein, 9 aa, Homo Sapiens
LAIPEAMFS

SEQ ID NO: 1140772 - protein, 9 aa, Homo Sapiens
GLAPIFEAQ

SEQ ID NO: 1140773 - protein, 9 aa, Homo Sapiens
TLSQVAMCT

SEQ ID NO: 1140774 - protein, 9 aa, Homo Sapiens
LDHEVKTLH

SEQ ID NO: 1140775 - protein, 9 aa, Homo Sapiens
GEVVKQTDV

SEQ ID NO: 1140776 - protein, 9 aa, Homo Sapiens
ILGMIPGLG

SEQ ID NO: 1140777 - protein, 9 aa, Homo Sapiens
RQCLSGHPP

SEQ ID NO: 1140778 - protein, 9 aa, Homo Sapiens
QRTTCHSIL

SEQ ID NO: 1140779 - protein, 9 aa, Homo Sapiens
VFEGVSTTA

SEQ ID NO: 1140780 - protein, 9 aa, Homo Sapiens
EADDAMCRC

SEQ ID NO: 1140781 - protein, 9 aa, Homo Sapiens
VNCFSCSTC

SEQ ID NO: 1140782 - protein, 9 aa, Homo Sapiens
RRRSVRPST

SEQ ID NO: 1140783 - protein, 9 aa, Homo Sapiens
CRQRRRGGP

SEQ ID NO: 1140784 - protein, 9 aa, Homo Sapiens
RRDTPGGRS

SEQ ID NO: 1140785 - protein, 9 aa, Homo Sapiens
DDTLLIQKA

SEQ ID NO: 1140786 - protein, 9 aa, Homo Sapiens
LEDSALRDL

SEQ ID NO: 1140787 - protein, 9 aa, Homo Sapiens
INTTTITTT

SEQ ID NO: 1140788 - protein, 9 aa, Homo Sapiens
VSGQVQALR

SEQ ID NO: 1140789 - protein, 9 aa, Homo Sapiens
HRCLLEGYD

SEQ ID NO: 1140790 - protein, 9 aa, Homo Sapiens
RFWEFVYQE

SEQ ID NO: 1140791 - protein, 9 aa, Homo Sapiens
AFPAKKKLQ

SEQ ID NO: 1140792 - protein, 9 aa, Homo Sapiens
GAGAKGPHS

SEQ ID NO: 1140793 - protein, 9 aa, Homo Sapiens
CPQYIRKSP

SEQ ID NO: 1140794 - protein, 9 aa, Homo Sapiens
MEVDVQALR

SEQ ID NO: 1140795 - protein, 9 aa, Homo Sapiens
WLSKGLATY

SEQ ID NO: 1140796 - protein, 9 aa, Homo Sapiens
APDNFLDKL

SEQ ID NO: 1140797 - protein, 9 aa, Homo Sapiens
WAGAVDNLR

SEQ ID NO: 1140798 - protein, 9 aa, Homo Sapiens
DDYEELTDE

SEQ ID NO: 1140799 - protein, 9 aa, Homo Sapiens
YFSLVHGLT

SEQ ID NO: 1140800 - protein, 9 aa, Homo Sapiens
AAKVKKERP

SEQ ID NO: 1140801 - protein, 9 aa, Homo Sapiens
ISVLVPGFP

SEQ ID NO: 1140802 - protein, 9 aa, Homo Sapiens
RQMVEATRY

SEQ ID NO: 1140803 - protein, 9 aa, Homo Sapiens
AGCCCRCKG

SEQ ID NO: 1140804 - protein, 9 aa, Homo Sapiens
GENHGELWV

SEQ ID NO: 1140805 - protein, 9 aa, Homo Sapiens
KLCQQLLDE

SEQ ID NO: 1140806 - protein, 9 aa, Homo Sapiens
NALSAMLAC

SEQ ID NO: 1140807 - protein, 9 aa, Homo Sapiens
LDTEREVKT

SEQ ID NO: 1140808 - protein, 9 aa, Homo Sapiens
AAIRTVIIG

SEQ ID NO: 1140809 - protein, 9 aa, Homo Sapiens
TRDRGYNQV

SEQ ID NO: 1140810 - protein, 9 aa, Homo Sapiens
DAFLHIDMY

SEQ ID NO: 1140811 - protein, 9 aa, Homo Sapiens
FTEIGTTAA

SEQ ID NO: 1140812 - protein, 9 aa, Homo Sapiens
KAELAKKQK

SEQ ID NO: 1140813 - protein, 9 aa, Homo Sapiens
GRTVLVYPT

SEQ ID NO: 1140814 - protein, 9 aa, Homo Sapiens
GDHDLNGLL

SEQ ID NO: 1140815 - protein, 9 aa, Homo Sapiens
SPKEEISPS

SEQ ID NO: 1140816 - protein, 9 aa, Homo Sapiens
PGGDKEKAF

SEQ ID NO: 1140817 - protein, 9 aa, Homo Sapiens
RMKPASCRA

SEQ ID NO: 1140818 - protein, 9 aa, Homo Sapiens
AELAACSEY

SEQ ID NO: 1140819 - protein, 9 aa, Homo Sapiens
ECKIAELLS

SEQ ID NO: 1140820 - protein, 9 aa, Homo Sapiens
GWGGPRVLD

SEQ ID NO: 1140821 - protein, 9 aa, Homo Sapiens
WKLKNGRKF

SEQ ID NO: 1140822 - protein, 9 aa, Homo Sapiens
PQWTQTCPP

SEQ ID NO: 1140823 - protein, 9 aa, Homo Sapiens
RVYSPFRSD

SEQ ID NO: 1140824 - protein, 9 aa, Homo Sapiens
ASCSRGARG

SEQ ID NO: 1140825 - protein, 9 aa, Homo Sapiens
SLLPKEDPI

SEQ ID NO: 1140826 - protein, 9 aa, Homo Sapiens
MNMDHQANC

SEQ ID NO: 1140827 - protein, 9 aa, Homo Sapiens
PQTCSAHRG

SEQ ID NO: 1140828 - protein, 9 aa, Homo Sapiens
RPSSPPSLA

SEQ ID NO: 1140829 - protein, 9 aa, Homo Sapiens
PGSASHREL

SEQ ID NO: 1140830 - protein, 9 aa, Homo Sapiens
TCMDEAGRN

SEQ ID NO: 1140831 - protein, 9 aa, Homo Sapiens
VVGWIITIS

SEQ ID NO: 1140832 - protein, 9 aa, Homo Sapiens
IAKYNIITF

SEQ ID NO: 1140833 - protein, 9 aa, Homo Sapiens
SGPGVESMA

SEQ ID NO: 1140834 - protein, 9 aa, Homo Sapiens
KLEYMEEEV

SEQ ID NO: 1140835 - protein, 9 aa, Homo Sapiens
FSDPGVWGP

SEQ ID NO: 1140836 - protein, 9 aa, Homo Sapiens
IAQDPYDLM

SEQ ID NO: 1140837 - protein, 9 aa, Homo Sapiens
HQPESYLPI

SEQ ID NO: 1140838 - protein, 9 aa, Homo Sapiens
HLLDLPGKD

SEQ ID NO: 1140839 - protein, 9 aa, Homo Sapiens
GCHPYCDVL

SEQ ID NO: 1140840 - protein, 9 aa, Homo Sapiens
PLPACSGTW

SEQ ID NO: 1140841 - protein, 9 aa, Homo Sapiens
GAADQSGPL

SEQ ID NO: 1140842 - protein, 9 aa, Homo Sapiens
AEQRRGRNS

SEQ ID NO: 1140843 - protein, 9 aa, Homo Sapiens
RLQTIDLLD

SEQ ID NO: 1140844 - protein, 9 aa, Homo Sapiens
TEDKKNGIW

SEQ ID NO: 1140845 - protein, 9 aa, Homo Sapiens
NRMERVKKL

SEQ ID NO: 1140846 - protein, 9 aa, Homo Sapiens
GACESGPCC

SEQ ID NO: 1140847 - protein, 9 aa, Homo Sapiens
VRGSTWMRR

SEQ ID NO: 1140848 - protein, 9 aa, Homo Sapiens
ALTSFPEVV

SEQ ID NO: 1140849 - protein, 9 aa, Homo Sapiens
WKLPGPRRP

SEQ ID NO: 1140850 - protein, 9 aa, Homo Sapiens
SPRNNPVPL

SEQ ID NO: 1140851 - protein, 9 aa, Homo Sapiens
LSGAQVDMV

SEQ ID NO: 1140852 - protein, 9 aa, Homo Sapiens
HETCFICHS

SEQ ID NO: 1140853 - protein, 9 aa, Homo Sapiens
GKGRGDVAL

SEQ ID NO: 1140854 - protein, 9 aa, Homo Sapiens
GRPEGQYLH

SEQ ID NO: 1140855 - protein, 9 aa, Homo Sapiens
RPWKTSCTT

SEQ ID NO: 1140856 - protein, 9 aa, Homo Sapiens
QATDDILRG

SEQ ID NO: 1140857 - protein, 9 aa, Homo Sapiens
STGPPHPTR

SEQ ID NO: 1140858 - protein, 9 aa, Homo Sapiens
RVSSEKLHF

SEQ ID NO: 1140859 - protein, 9 aa, Homo Sapiens
EGSFQRRGR

SEQ ID NO: 1140860 - protein, 9 aa, Homo Sapiens
KRPQWMLKA

SEQ ID NO: 1140861 - protein, 9 aa, Homo Sapiens
HHSFVSSVF

SEQ ID NO: 1140862 - protein, 9 aa, Homo Sapiens
ALAQGVLGH

SEQ ID NO: 1140863 - protein, 9 aa, Homo Sapiens
MIHPQLLTS

SEQ ID NO: 1140864 - protein, 9 aa, Homo Sapiens
NLTFDAITT

SEQ ID NO: 1140865 - protein, 9 aa, Homo Sapiens
AAATTAAAG

SEQ ID NO: 1140866 - protein, 9 aa, Homo Sapiens
ELTAAVLDL

SEQ ID NO: 1140867 - protein, 9 aa, Homo Sapiens
AVDGWVEEW

SEQ ID NO: 1140868 - protein, 9 aa, Homo Sapiens
RGRTRVHSE

SEQ ID NO: 1140869 - protein, 9 aa, Homo Sapiens
IYWLPLTDI

SEQ ID NO: 1140870 - protein, 9 aa, Homo Sapiens
VISLKQGKK

SEQ ID NO: 1140871 - protein, 9 aa, Homo Sapiens
FCTRLLWKR

SEQ ID NO: 1140872 - protein, 9 aa, Homo Sapiens
PEELRSYME

SEQ ID NO: 1140873 - protein, 9 aa, Homo Sapiens
LRLPNIRHS

SEQ ID NO: 1140874 - protein, 9 aa, Homo Sapiens
QSPAGPAGT

SEQ ID NO: 1140875 - protein, 9 aa, Homo Sapiens
PPHVERNLQ

SEQ ID NO: 1140876 - protein, 9 aa, Homo Sapiens
GTALAAVMG

SEQ ID NO: 1140877 - protein, 9 aa, Homo Sapiens
PCASLLSTL

SEQ ID NO: 1140878 - protein, 9 aa, Homo Sapiens
TPRGPLVLP

SEQ ID NO: 1140879 - protein, 9 aa, Homo Sapiens
IHLKLRNRT

SEQ ID NO: 1140880 - protein, 9 aa, Homo Sapiens
FTLLEDQVR

SEQ ID NO: 1140881 - protein, 9 aa, Homo Sapiens
YRVGTFGFL

SEQ ID NO: 1140882 - protein, 9 aa, Homo Sapiens
TGACLNDSN

SEQ ID NO: 1140883 - protein, 9 aa, Homo Sapiens
IREEKAPWK

SEQ ID NO: 1140884 - protein, 9 aa, Homo Sapiens
KKDPVVPQN

SEQ ID NO: 1140885 - protein, 9 aa, Homo Sapiens
SNPFIRTVK

SEQ ID NO: 1140886 - protein, 9 aa, Homo Sapiens
GAVENATES

SEQ ID NO: 1140887 - protein, 9 aa, Homo Sapiens
YAELRDAIN

SEQ ID NO: 1140888 - protein, 9 aa, Homo Sapiens
TVLWEDQIP

SEQ ID NO: 1140889 - protein, 9 aa, Homo Sapiens
FSHKSNLLY

SEQ ID NO: 1140890 - protein, 9 aa, Homo Sapiens
GVPGKTSLK

SEQ ID NO: 1140891 - protein, 9 aa, Homo Sapiens
DAYSQCVTT

SEQ ID NO: 1140892 - protein, 9 aa, Homo Sapiens
EARKTGPFC

SEQ ID NO: 1140893 - protein, 9 aa, Homo Sapiens
NKKTHPCTM

SEQ ID NO: 1140894 - protein, 9 aa, Homo Sapiens
RTFTTTSRL

SEQ ID NO: 1140895 - protein, 9 aa, Homo Sapiens
MLPPPSSPM

SEQ ID NO: 1140896 - protein, 9 aa, Homo Sapiens
TLMRRLWGT

SEQ ID NO: 1140897 - protein, 9 aa, Homo Sapiens
KLTPGLSKD

SEQ ID NO: 1140898 - protein, 9 aa, Homo Sapiens
LPAGRIRSG

SEQ ID NO: 1140899 - protein, 9 aa, Homo Sapiens
RKSSTRNKP

SEQ ID NO: 1140900 - protein, 9 aa, Homo Sapiens
FICELRPHG

SEQ ID NO: 1140901 - protein, 9 aa, Homo Sapiens
TGSSRGTSI

SEQ ID NO: 1140902 - protein, 9 aa, Homo Sapiens
KRPEQLPQH

SEQ ID NO: 1140903 - protein, 9 aa, Homo Sapiens
HLLAIAGNA

SEQ ID NO: 1140904 - protein, 9 aa, Homo Sapiens
GMKELLEGP

SEQ ID NO: 1140905 - protein, 9 aa, Homo Sapiens
LLAVTSLSV

SEQ ID NO: 1140906 - protein, 9 aa, Homo Sapiens
ARDAGVPTL

SEQ ID NO: 1140907 - protein, 9 aa, Homo Sapiens
DTAKILENE

SEQ ID NO: 1140908 - protein, 9 aa, Homo Sapiens
TGGDEPAGW

SEQ ID NO: 1140909 - protein, 9 aa, Homo Sapiens
ELVPHWQDH

SEQ ID NO: 1140910 - protein, 9 aa, Homo Sapiens
PSPLPAPRP

SEQ ID NO: 1140911 - protein, 9 aa, Homo Sapiens
DNVNKLNVS

SEQ ID NO: 1140912 - protein, 9 aa, Homo Sapiens
LRKTIMELK

SEQ ID NO: 1140913 - protein, 9 aa, Homo Sapiens
PHWASSPSP

SEQ ID NO: 1140914 - protein, 9 aa, Homo Sapiens
TVDAAIRTV

SEQ ID NO: 1140915 - protein, 9 aa, Homo Sapiens
HNENQHLVS

SEQ ID NO: 1140916 - protein, 9 aa, Homo Sapiens
QPAGLCPVL

SEQ ID NO: 1140917 - protein, 9 aa, Homo Sapiens
RPTGRTPTT

SEQ ID NO: 1140918 - protein, 9 aa, Homo Sapiens
LLLFVGLTY

SEQ ID NO: 1140919 - protein, 9 aa, Homo Sapiens
CGWGGPRVL

SEQ ID NO: 1140920 - protein, 9 aa, Homo Sapiens
REKEHEMNI

SEQ ID NO: 1140921 - protein, 9 aa, Homo Sapiens
TSVEESLPG

SEQ ID NO: 1140922 - protein, 9 aa, Homo Sapiens
QPGSEASTR

SEQ ID NO: 1140923 - protein, 9 aa, Homo Sapiens
SALDVDCMT

SEQ ID NO: 1140924 - protein, 9 aa, Homo Sapiens
RPRAGCPHT

SEQ ID NO: 1140925 - protein, 9 aa, Homo Sapiens
ANICLLLDA

SEQ ID NO: 1140926 - protein, 9 aa, Homo Sapiens
IRSRVCGAD

SEQ ID NO: 1140927 - protein, 9 aa, Homo Sapiens
TSLVGQGFI

SEQ ID NO: 1140928 - protein, 9 aa, Homo Sapiens
FGMYREKDI

SEQ ID NO: 1140929 - protein, 9 aa, Homo Sapiens
RQPTPAVGG

SEQ ID NO: 1140930 - protein, 9 aa, Homo Sapiens
LSCCLFSPF

SEQ ID NO: 1140931 - protein, 9 aa, Homo Sapiens
DLDPQLRLP

SEQ ID NO: 1140932 - protein, 9 aa, Homo Sapiens
NENQHLVSP

SEQ ID NO: 1140933 - protein, 9 aa, Homo Sapiens
SERKKRQRE

SEQ ID NO: 1140934 - protein, 9 aa, Homo Sapiens
PHPTMTTRT

SEQ ID NO: 1140935 - protein, 9 aa, Homo Sapiens
LLPPRPPAL

SEQ ID NO: 1140936 - protein, 9 aa, Homo Sapiens
KSNPFIRTV

SEQ ID NO: 1140937 - protein, 9 aa, Homo Sapiens
QKSYKCHKC

SEQ ID NO: 1140938 - protein, 9 aa, Homo Sapiens
DGQIGERPE

SEQ ID NO: 1140939 - protein, 9 aa, Homo Sapiens
SGRGGRGAH

SEQ ID NO: 1140940 - protein, 9 aa, Homo Sapiens
QWLVHSCWT

SEQ ID NO: 1140941 - protein, 9 aa, Homo Sapiens
DGILSTFPA

SEQ ID NO: 1140942 - protein, 9 aa, Homo Sapiens
ATTKLSMLE

SEQ ID NO: 1140943 - protein, 9 aa, Homo Sapiens
LYHSEEEEE

SEQ ID NO: 1140944 - protein, 9 aa, Homo Sapiens
PTGMTRASD

SEQ ID NO: 1140945 - protein, 9 aa, Homo Sapiens
YLAQAGLAH

SEQ ID NO: 1140946 - protein, 9 aa, Homo Sapiens
APMAEEEAS

SEQ ID NO: 1140947 - protein, 9 aa, Homo Sapiens
LLLCGQPQA

SEQ ID NO: 1140948 - protein, 9 aa, Homo Sapiens
PPVGLLVVS

SEQ ID NO: 1140949 - protein, 9 aa, Homo Sapiens
VLGVRSQRK

SEQ ID NO: 1140950 - protein, 9 aa, Homo Sapiens
VKKPLVRSL

SEQ ID NO: 1140951 - protein, 9 aa, Homo Sapiens
RPGENLNIS

SEQ ID NO: 1140952 - protein, 9 aa, Homo Sapiens
PVLSLACTH

SEQ ID NO: 1140953 - protein, 9 aa, Homo Sapiens
TITTPSKKN

SEQ ID NO: 1140954 - protein, 9 aa, Homo Sapiens
SSAVLATYV

SEQ ID NO: 1140955 - protein, 9 aa, Homo Sapiens
LSPTPSAPP

SEQ ID NO: 1140956 - protein, 9 aa, Homo Sapiens
LLEAQKRTC

SEQ ID NO: 1140957 - protein, 9 aa, Homo Sapiens
QPGVSETEV

SEQ ID NO: 1140958 - protein, 9 aa, Homo Sapiens
KRRRKSQLG

SEQ ID NO: 1140959 - protein, 9 aa, Homo Sapiens
DIKHISTKE

SEQ ID NO: 1140960 - protein, 9 aa, Homo Sapiens
KLGSPAPRE

SEQ ID NO: 1140961 - protein, 9 aa, Homo Sapiens
KDHGEPVLT

SEQ ID NO: 1140962 - protein, 9 aa, Homo Sapiens
PPENQVSVG

SEQ ID NO: 1140963 - protein, 9 aa, Homo Sapiens
KDAVLGCRK

SEQ ID NO: 1140964 - protein, 9 aa, Homo Sapiens
KKAICTGPN

SEQ ID NO: 1140965 - protein, 9 aa, Homo Sapiens
PGQQQQVFE

SEQ ID NO: 1140966 - protein, 9 aa, Homo Sapiens
PTSLCRGRC

SEQ ID NO: 1140967 - protein, 9 aa, Homo Sapiens
RFRQDGDEA

SEQ ID NO: 1140968 - protein, 9 aa, Homo Sapiens
LSKGLATYA

SEQ ID NO: 1140969 - protein, 9 aa, Homo Sapiens
TKAVIFCLS

SEQ ID NO: 1140970 - protein, 9 aa, Homo Sapiens
LNSIGFLLD

SEQ ID NO: 1140971 - protein, 9 aa, Homo Sapiens
CIEKTCEKP

SEQ ID NO: 1140972 - protein, 9 aa, Homo Sapiens
PSLRTRRPW

SEQ ID NO: 1140973 - protein, 9 aa, Homo Sapiens
SMDDDFQFN

SEQ ID NO: 1140974 - protein, 9 aa, Homo Sapiens
HRTPRNKVA

SEQ ID NO: 1140975 - protein, 9 aa, Homo Sapiens
QRPARQPTP

SEQ ID NO: 1140976 - protein, 9 aa, Homo Sapiens
APPPSTAAT

SEQ ID NO: 1140977 - protein, 9 aa, Homo Sapiens
CRALWEDVA

SEQ ID NO: 1140978 - protein, 9 aa, Homo Sapiens
PRLCVKATV

SEQ ID NO: 1140979 - protein, 9 aa, Homo Sapiens
SAMMQALKY

SEQ ID NO: 1140980 - protein, 9 aa, Homo Sapiens
DDVNFPINN

SEQ ID NO: 1140981 - protein, 9 aa, Homo Sapiens
AVESPTATE

SEQ ID NO: 1140982 - protein, 9 aa, Homo Sapiens
TMRPGTMRL

SEQ ID NO: 1140983 - protein, 9 aa, Homo Sapiens
AQAAPSTCL

SEQ ID NO: 1140984 - protein, 9 aa, Homo Sapiens
CQERDIFLP

SEQ ID NO: 1140985 - protein, 9 aa, Homo Sapiens
AAVLDLICE

SEQ ID NO: 1140986 - protein, 9 aa, Homo Sapiens
RARISRSIY

SEQ ID NO: 1140987 - protein, 9 aa, Homo Sapiens
HAQAHQKKA

SEQ ID NO: 1140988 - protein, 9 aa, Homo Sapiens
ARARRTLGT

SEQ ID NO: 1140989 - protein, 9 aa, Homo Sapiens
PGGLQLKAD

SEQ ID NO: 1140990 - protein, 9 aa, Homo Sapiens
NIAMGFPAE

SEQ ID NO: 1140991 - protein, 9 aa, Homo Sapiens
NVTQQINEC

SEQ ID NO: 1140992 - protein, 9 aa, Homo Sapiens
FDGHGCVDA

SEQ ID NO: 1140993 - protein, 9 aa, Homo Sapiens
YYAKKNLYY

SEQ ID NO: 1140994 - protein, 9 aa, Homo Sapiens
GTSLACLNA

SEQ ID NO: 1140995 - protein, 9 aa, Homo Sapiens
SLTHLFLVF

SEQ ID NO: 1140996 - protein, 9 aa, Homo Sapiens
QYLLNVSVA

SEQ ID NO: 1140997 - protein, 9 aa, Homo Sapiens
TIMELKDEC

SEQ ID NO: 1140998 - protein, 9 aa, Homo Sapiens
SSAWRPPRY

SEQ ID NO: 1140999 - protein, 9 aa, Homo Sapiens
TWAGTSTLS

SEQ ID NO: 1141000 - protein, 9 aa, Homo Sapiens
ANPFAADIG

SEQ ID NO: 1141001 - protein, 9 aa, Homo Sapiens
KNLYYLRQQ

SEQ ID NO: 1141002 - protein, 9 aa, Homo Sapiens
AVGLRNGIK

SEQ ID NO: 1141003 - protein, 9 aa, Homo Sapiens
SRWLCRKLR

SEQ ID NO: 1141004 - protein, 9 aa, Homo Sapiens
QGPGPNQHN

SEQ ID NO: 1141005 - protein, 9 aa, Homo Sapiens
HTHPLCPPP

SEQ ID NO: 1141006 - protein, 9 aa, Homo Sapiens
SSPSAKGHS

SEQ ID NO: 1141007 - protein, 9 aa, Homo Sapiens
FLIKYQQEV

SEQ ID NO: 1141008 - protein, 9 aa, Homo Sapiens
DNYITGYDV

SEQ ID NO: 1141009 - protein, 9 aa, Homo Sapiens
SVVKEARGR

SEQ ID NO: 1141010 - protein, 9 aa, Homo Sapiens
LVLNSPQGN

SEQ ID NO: 1141011 - protein, 9 aa, Homo Sapiens
QHLQNIMDF

SEQ ID NO: 1141012 - protein, 9 aa, Homo Sapiens
SYAEVKPLS

SEQ ID NO: 1141013 - protein, 9 aa, Homo Sapiens
TEFRYLDDG

SEQ ID NO: 1141014 - protein, 9 aa, Homo Sapiens
IAFNGSVKT

SEQ ID NO: 1141015 - protein, 9 aa, Homo Sapiens
YGFVLDHSR

SEQ ID NO: 1141016 - protein, 9 aa, Homo Sapiens
TGSSTASAA

SEQ ID NO: 1141017 - protein, 9 aa, Homo Sapiens
DNKTKELTL

SEQ ID NO: 1141018 - protein, 9 aa, Homo Sapiens
LFYMINVVT

SEQ ID NO: 1141019 - protein, 9 aa, Homo Sapiens
HHEKIFHPN

SEQ ID NO: 1141020 - protein, 9 aa, Homo Sapiens
SQALPAPPA

SEQ ID NO: 1141021 - protein, 9 aa, Homo Sapiens
GPGFVNVSQ

SEQ ID NO: 1141022 - protein, 9 aa, Homo Sapiens
QSNAGVAQP

SEQ ID NO: 1141023 - protein, 9 aa, Homo Sapiens
LGKNKMNMD

SEQ ID NO: 1141024 - protein, 9 aa, Homo Sapiens
PGPLRVPEG

SEQ ID NO: 1141025 - protein, 9 aa, Homo Sapiens
SSSLRMTPT

SEQ ID NO: 1141026 - protein, 9 aa, Homo Sapiens
QDIETVHGS

SEQ ID NO: 1141027 - protein, 9 aa, Homo Sapiens
YVIRTCVNT

SEQ ID NO: 1141028 - protein, 9 aa, Homo Sapiens
LDPSLASTD

SEQ ID NO: 1141029 - protein, 9 aa, Homo Sapiens
FALEVSGLR

SEQ ID NO: 1141030 - protein, 9 aa, Homo Sapiens
PDRPPGPPR

SEQ ID NO: 1141031 - protein, 9 aa, Homo Sapiens
GDTPQPSLP

SEQ ID NO: 1141032 - protein, 9 aa, Homo Sapiens
VNKLNVSLQ

SEQ ID NO: 1141033 - protein, 9 aa, Homo Sapiens
LQERKYAIG

SEQ ID NO: 1141034 - protein, 9 aa, Homo Sapiens
AAPMGHPPT

SEQ ID NO: 1141035 - protein, 9 aa, Homo Sapiens
YIISFTVPN

SEQ ID NO: 1141036 - protein, 9 aa, Homo Sapiens
PFLACDWLG

SEQ ID NO: 1141037 - protein, 9 aa, Homo Sapiens
SNSTQTFSA

SEQ ID NO: 1141038 - protein, 9 aa, Homo Sapiens
SSEKLHFSV

SEQ ID NO: 1141039 - protein, 9 aa, Homo Sapiens
EFITAVKAV

SEQ ID NO: 1141040 - protein, 9 aa, Homo Sapiens
TQSETIVSA

SEQ ID NO: 1141041 - protein, 9 aa, Homo Sapiens
FSMPHDGSL

SEQ ID NO: 1141042 - protein, 9 aa, Homo Sapiens
ATPGPGAGQ

SEQ ID NO: 1141043 - protein, 9 aa, Homo Sapiens
TGDGRIFAV

SEQ ID NO: 1141044 - protein, 9 aa, Homo Sapiens
GRSSRCASR

SEQ ID NO: 1141045 - protein, 9 aa, Homo Sapiens
GGPQGAFSE

SEQ ID NO: 1141046 - protein, 9 aa, Homo Sapiens
TMSTTLCTG

SEQ ID NO: 1141047 - protein, 9 aa, Homo Sapiens
LFRHQRTHT

SEQ ID NO: 1141048 - protein, 9 aa, Homo Sapiens
RRDSWPTRR

SEQ ID NO: 1141049 - protein, 9 aa, Homo Sapiens
SFKAFSPDL

SEQ ID NO: 1141050 - protein, 9 aa, Homo Sapiens
LDIEKIHRE

SEQ ID NO: 1141051 - protein, 9 aa, Homo Sapiens
HYNTLLAAA

SEQ ID NO: 1141052 - protein, 9 aa, Homo Sapiens
IPFCIGNAK

SEQ ID NO: 1141053 - protein, 9 aa, Homo Sapiens
SCPRRPLRR

SEQ ID NO: 1141054 - protein, 9 aa, Homo Sapiens
KEHLRKGGN

SEQ ID NO: 1141055 - protein, 9 aa, Homo Sapiens
CFIGSSDVG

SEQ ID NO: 1141056 - protein, 9 aa, Homo Sapiens
PQVSQQGRG

SEQ ID NO: 1141057 - protein, 9 aa, Homo Sapiens
QSETIVSAL

SEQ ID NO: 1141058 - protein, 9 aa, Homo Sapiens
HESPTGIDT

SEQ ID NO: 1141059 - protein, 9 aa, Homo Sapiens
VPIKHKKEL

SEQ ID NO: 1141060 - protein, 9 aa, Homo Sapiens
MLSLTHLFL

SEQ ID NO: 1141061 - protein, 9 aa, Homo Sapiens
HFKAHKAEL

SEQ ID NO: 1141062 - protein, 9 aa, Homo Sapiens
AQHSNLVTH

SEQ ID NO: 1141063 - protein, 9 aa, Homo Sapiens
LPMGRLDLA

SEQ ID NO: 1141064 - protein, 9 aa, Homo Sapiens
PPRGKDGHI

SEQ ID NO: 1141065 - protein, 9 aa, Homo Sapiens
DKQGMSVLS

SEQ ID NO: 1141066 - protein, 9 aa, Homo Sapiens
LPVVEPPPS

SEQ ID NO: 1141067 - protein, 9 aa, Homo Sapiens
SSPTWLTSA

SEQ ID NO: 1141068 - protein, 9 aa, Homo Sapiens
IVSDSGAHA

SEQ ID NO: 1141069 - protein, 9 aa, Homo Sapiens
SVISCFWSI

SEQ ID NO: 1141070 - protein, 9 aa, Homo Sapiens
YSLLPEVGG

SEQ ID NO: 1141071 - protein, 9 aa, Homo Sapiens
LVCLGTQTF

SEQ ID NO: 1141072 - protein, 9 aa, Homo Sapiens
VGLRRFPRV

SEQ ID NO: 1141073 - protein, 9 aa, Homo Sapiens
SGRRRCGSR

SEQ ID NO: 1141074 - protein, 9 aa, Homo Sapiens
TVVQLRQLL

SEQ ID NO: 1141075 - protein, 9 aa, Homo Sapiens
ETLVLNNNA

SEQ ID NO: 1141076 - protein, 9 aa, Homo Sapiens
PLPLLRQPL

SEQ ID NO: 1141077 - protein, 9 aa, Homo Sapiens
RRSLPAVAC

SEQ ID NO: 1141078 - protein, 9 aa, Homo Sapiens
SLDCGLWGP

SEQ ID NO: 1141079 - protein, 9 aa, Homo Sapiens
DSYQMTQER

SEQ ID NO: 1141080 - protein, 9 aa, Homo Sapiens
DISNARVFK

SEQ ID NO: 1141081 - protein, 9 aa, Homo Sapiens
EHRQESLEE

SEQ ID NO: 1141082 - protein, 9 aa, Homo Sapiens
YMMTRREKI

SEQ ID NO: 1141083 - protein, 9 aa, Homo Sapiens
ICSLYTEGS

SEQ ID NO: 1141084 - protein, 9 aa, Homo Sapiens
DFFREVKES

SEQ ID NO: 1141085 - protein, 9 aa, Homo Sapiens
GLAHRGLGG

SEQ ID NO: 1141086 - protein, 9 aa, Homo Sapiens
ALTCARAWM

SEQ ID NO: 1141087 - protein, 9 aa, Homo Sapiens
NTSYDGVFI

SEQ ID NO: 1141088 - protein, 9 aa, Homo Sapiens
CFQPRTRLL

SEQ ID NO: 1141089 - protein, 9 aa, Homo Sapiens
CPMGSCVCG

SEQ ID NO: 1141090 - protein, 9 aa, Homo Sapiens
NSPQGAFYS

SEQ ID NO: 1141091 - protein, 9 aa, Homo Sapiens
SMMPGVAGA

SEQ ID NO: 1141092 - protein, 9 aa, Homo Sapiens
AHTYVSEDL

SEQ ID NO: 1141093 - protein, 9 aa, Homo Sapiens
ILWGVRHPH

SEQ ID NO: 1141094 - protein, 9 aa, Homo Sapiens
NPTWRRTGA

SEQ ID NO: 1141095 - protein, 9 aa, Homo Sapiens
EPGKNKQTI

SEQ ID NO: 1141096 - protein, 9 aa, Homo Sapiens
RFALEVSGL

SEQ ID NO: 1141097 - protein, 9 aa, Homo Sapiens
TDCASRGMA

SEQ ID NO: 1141098 - protein, 9 aa, Homo Sapiens
CNSSNKSYT

SEQ ID NO: 1141099 - protein, 9 aa, Homo Sapiens
EHSERKKRQ

SEQ ID NO: 1141100 - protein, 9 aa, Homo Sapiens
PSPTDPKCC

SEQ ID NO: 1141101 - protein, 9 aa, Homo Sapiens
EPIPVLPTM

SEQ ID NO: 1141102 - protein, 9 aa, Homo Sapiens
CTAVSVPDS

SEQ ID NO: 1141103 - protein, 9 aa, Homo Sapiens
LVLAMQRTV

SEQ ID NO: 1141104 - protein, 9 aa, Homo Sapiens
QEGFQFVKG

SEQ ID NO: 1141105 - protein, 9 aa, Homo Sapiens
VDSPPHQKQ

SEQ ID NO: 1141106 - protein, 9 aa, Homo Sapiens
LTEFVELGN

SEQ ID NO: 1141107 - protein, 9 aa, Homo Sapiens
RARWDLRRP

SEQ ID NO: 1141108 - protein, 9 aa, Homo Sapiens
PHTPLVFSF

SEQ ID NO: 1141109 - protein, 9 aa, Homo Sapiens
DIFLPGHHC

SEQ ID NO: 1141110 - protein, 9 aa, Homo Sapiens
IPAPDNFLD

SEQ ID NO: 1141111 - protein, 9 aa, Homo Sapiens
GEKLEFCTR

SEQ ID NO: 1141112 - protein, 9 aa, Homo Sapiens
LIVRLQVQL

SEQ ID NO: 1141113 - protein, 9 aa, Homo Sapiens
NHMGRDKKR

SEQ ID NO: 1141114 - protein, 9 aa, Homo Sapiens
LTAAVLDLI

SEQ ID NO: 1141115 - protein, 9 aa, Homo Sapiens
HNYLALRDA

SEQ ID NO: 1141116 - protein, 9 aa, Homo Sapiens
MASSWKGSS

SEQ ID NO: 1141117 - protein, 9 aa, Homo Sapiens
KSESSALLS

SEQ ID NO: 1141118 - protein, 9 aa, Homo Sapiens
PSQAKLQRE

SEQ ID NO: 1141119 - protein, 9 aa, Homo Sapiens
SSPPCEVQV

SEQ ID NO: 1141120 - protein, 9 aa, Homo Sapiens
GSNGATYST

SEQ ID NO: 1141121 - protein, 9 aa, Homo Sapiens
FPRVNPAST

SEQ ID NO: 1141122 - protein, 9 aa, Homo Sapiens
LYYTVKLRR

SEQ ID NO: 1141123 - protein, 9 aa, Homo Sapiens
HSKSPKRSK

SEQ ID NO: 1141124 - protein, 9 aa, Homo Sapiens
LLNKKERRC

SEQ ID NO: 1141125 - protein, 9 aa, Homo Sapiens
LSLYRPPLA

SEQ ID NO: 1141126 - protein, 9 aa, Homo Sapiens
HTGKVRTAR

SEQ ID NO: 1141127 - protein, 9 aa, Homo Sapiens
SQASICQLT

SEQ ID NO: 1141128 - protein, 9 aa, Homo Sapiens
LSETSCLRA

SEQ ID NO: 1141129 - protein, 9 aa, Homo Sapiens
SSELRPVDT

SEQ ID NO: 1141130 - protein, 9 aa, Homo Sapiens
GAGRARRAR

SEQ ID NO: 1141131 - protein, 9 aa, Homo Sapiens
EDEEETTSH

SEQ ID NO: 1141132 - protein, 9 aa, Homo Sapiens
SANAAVASS

SEQ ID NO: 1141133 - protein, 9 aa, Homo Sapiens
TSLATAADS

SEQ ID NO: 1141134 - protein, 9 aa, Homo Sapiens
SLDGSMDER

SEQ ID NO: 1141135 - protein, 9 aa, Homo Sapiens
NKAQASHSE

SEQ ID NO: 1141136 - protein, 9 aa, Homo Sapiens
ELQSQHDEQ

SEQ ID NO: 1141137 - protein, 9 aa, Homo Sapiens
LEITALCPF

SEQ ID NO: 1141138 - protein, 9 aa, Homo Sapiens
RPLARILTA

SEQ ID NO: 1141139 - protein, 9 aa, Homo Sapiens
PPSPSVSPA

SEQ ID NO: 1141140 - protein, 9 aa, Homo Sapiens
TYRGLLCAV

SEQ ID NO: 1141141 - protein, 9 aa, Homo Sapiens
SWYCLTSPP

SEQ ID NO: 1141142 - protein, 9 aa, Homo Sapiens
CPRPCPGIC

SEQ ID NO: 1141143 - protein, 9 aa, Homo Sapiens
RCCPCSSPA

SEQ ID NO: 1141144 - protein, 9 aa, Homo Sapiens
ELSLQPMAF

SEQ ID NO: 1141145 - protein, 9 aa, Homo Sapiens
LIAVMFGDV

SEQ ID NO: 1141146 - protein, 9 aa, Homo Sapiens
KKHSNPYVK

SEQ ID NO: 1141147 - protein, 9 aa, Homo Sapiens
SWVSLVSRI

SEQ ID NO: 1141148 - protein, 9 aa, Homo Sapiens
RHHGHKHRK

SEQ ID NO: 1141149 - protein, 9 aa, Homo Sapiens
AYDAPSPSA

SEQ ID NO: 1141150 - protein, 9 aa, Homo Sapiens
DDCIGTVVD

SEQ ID NO: 1141151 - protein, 9 aa, Homo Sapiens
PMTYSYSNL

SEQ ID NO: 1141152 - protein, 9 aa, Homo Sapiens
SSVSHIRTT

SEQ ID NO: 1141153 - protein, 9 aa, Homo Sapiens
GVIVDLTVE

SEQ ID NO: 1141154 - protein, 9 aa, Homo Sapiens
GPSTCSGWG

SEQ ID NO: 1141155 - protein, 9 aa, Homo Sapiens
CSLVRGTTP

SEQ ID NO: 1141156 - protein, 9 aa, Homo Sapiens
RSFFTSAHP

SEQ ID NO: 1141157 - protein, 9 aa, Homo Sapiens
ELWSPPGQV

SEQ ID NO: 1141158 - protein, 9 aa, Homo Sapiens
NSLSNLTPG

SEQ ID NO: 1141159 - protein, 9 aa, Homo Sapiens
IQRGNVCGD

SEQ ID NO: 1141160 - protein, 9 aa, Homo Sapiens
YCVECRAGW

SEQ ID NO: 1141161 - protein, 9 aa, Homo Sapiens
ECLGDLRSG

SEQ ID NO: 1141162 - protein, 9 aa, Homo Sapiens
NYMLPCLSP

SEQ ID NO: 1141163 - protein, 9 aa, Homo Sapiens
ITTILPYWR

SEQ ID NO: 1141164 - protein, 9 aa, Homo Sapiens
IYLVCVARW

SEQ ID NO: 1141165 - protein, 9 aa, Homo Sapiens
AVAVRSDHV

SEQ ID NO: 1141166 - protein, 9 aa, Homo Sapiens
SRMSTASHS

SEQ ID NO: 1141167 - protein, 9 aa, Homo Sapiens
HIRTTMLSL

SEQ ID NO: 1141168 - protein, 9 aa, Homo Sapiens
RRKRRRSGR

SEQ ID NO: 1141169 - protein, 9 aa, Homo Sapiens
DYLQSILDD

SEQ ID NO: 1141170 - protein, 9 aa, Homo Sapiens
TRGASSSPH

SEQ ID NO: 1141171 - protein, 9 aa, Homo Sapiens
YCIHLVEGY

SEQ ID NO: 1141172 - protein, 9 aa, Homo Sapiens
SVDYCIHLV

SEQ ID NO: 1141173 - protein, 9 aa, Homo Sapiens
SGNTTHRCL

SEQ ID NO: 1141174 - protein, 9 aa, Homo Sapiens
NDAGSAACL

SEQ ID NO: 1141175 - protein, 9 aa, Homo Sapiens
GKMATQARG

SEQ ID NO: 1141176 - protein, 9 aa, Homo Sapiens
EGAQYPPPA

SEQ ID NO: 1141177 - protein, 9 aa, Homo Sapiens
RAGQSHSKP

SEQ ID NO: 1141178 - protein, 9 aa, Homo Sapiens
LQVRRLMSV

SEQ ID NO: 1141179 - protein, 9 aa, Homo Sapiens
GQAWLALAA

SEQ ID NO: 1141180 - protein, 9 aa, Homo Sapiens
EELNISESL

SEQ ID NO: 1141181 - protein, 9 aa, Homo Sapiens
EQQQQQEEV

SEQ ID NO: 1141182 - protein, 9 aa, Homo Sapiens
VDGWVEEWY

SEQ ID NO: 1141183 - protein, 9 aa, Homo Sapiens
STFPAERGA

SEQ ID NO: 1141184 - protein, 9 aa, Homo Sapiens
RTTRATLIN

SEQ ID NO: 1141185 - protein, 9 aa, Homo Sapiens
AAVQQLEGR

SEQ ID NO: 1141186 - protein, 9 aa, Homo Sapiens
LGVATISCR

SEQ ID NO: 1141187 - protein, 9 aa, Homo Sapiens
SGPPFPLLQ

SEQ ID NO: 1141188 - protein, 9 aa, Homo Sapiens
IKKGEIPSE

SEQ ID NO: 1141189 - protein, 9 aa, Homo Sapiens
TFQKILDMR

SEQ ID NO: 1141190 - protein, 9 aa, Homo Sapiens
WPDFLRGTP

SEQ ID NO: 1141191 - protein, 9 aa, Homo Sapiens
TTENSVYKS

SEQ ID NO: 1141192 - protein, 9 aa, Homo Sapiens
GLCHPSSVS

SEQ ID NO: 1141193 - protein, 9 aa, Homo Sapiens
EQNRRDVEA

SEQ ID NO: 1141194 - protein, 9 aa, Homo Sapiens
APVLLLLLL

SEQ ID NO: 1141195 - protein, 9 aa, Homo Sapiens
SGTPNAPHP

SEQ ID NO: 1141196 - protein, 9 aa, Homo Sapiens
SPRRRPCAS

SEQ ID NO: 1141197 - protein, 9 aa, Homo Sapiens
NIEENKGRM

SEQ ID NO: 1141198 - protein, 9 aa, Homo Sapiens
LGTHRIKCR

SEQ ID NO: 1141199 - protein, 9 aa, Homo Sapiens
TGLPRKSVT

SEQ ID NO: 1141200 - protein, 9 aa, Homo Sapiens
DRESLSSCQ

SEQ ID NO: 1141201 - protein, 9 aa, Homo Sapiens
TGLGKQVLA

SEQ ID NO: 1141202 - protein, 9 aa, Homo Sapiens
NPDWLRSCL

SEQ ID NO: 1141203 - protein, 9 aa, Homo Sapiens
HHVTHTVQK

SEQ ID NO: 1141204 - protein, 9 aa, Homo Sapiens
GVQEGVDEY

SEQ ID NO: 1141205 - protein, 9 aa, Homo Sapiens
ISALIAARG

SEQ ID NO: 1141206 - protein, 9 aa, Homo Sapiens
AAHLRQELQ

SEQ ID NO: 1141207 - protein, 9 aa, Homo Sapiens
TSLPDCRLA

SEQ ID NO: 1141208 - protein, 9 aa, Homo Sapiens
TCSMMVVHN

SEQ ID NO: 1141209 - protein, 9 aa, Homo Sapiens
AQEYLWGMD

SEQ ID NO: 1141210 - protein, 9 aa, Homo Sapiens
SLDEGSILA

SEQ ID NO: 1141211 - protein, 9 aa, Homo Sapiens
GIQTRFSQE

SEQ ID NO: 1141212 - protein, 9 aa, Homo Sapiens
DALRLRLEK

SEQ ID NO: 1141213 - protein, 9 aa, Homo Sapiens
HSSTFRDHK

SEQ ID NO: 1141214 - protein, 9 aa, Homo Sapiens
YNISSEVYR

SEQ ID NO: 1141215 - protein, 9 aa, Homo Sapiens
LPQHALVCL

SEQ ID NO: 1141216 - protein, 9 aa, Homo Sapiens
GGLRLRPPW

SEQ ID NO: 1141217 - protein, 9 aa, Homo Sapiens
KDKDGAALR

SEQ ID NO: 1141218 - protein, 9 aa, Homo Sapiens
RVWVHEKRV

SEQ ID NO: 1141219 - protein, 9 aa, Homo Sapiens
PEDFIWVGQ

SEQ ID NO: 1141220 - protein, 9 aa, Homo Sapiens
GDGPPTTRC

SEQ ID NO: 1141221 - protein, 9 aa, Homo Sapiens
STGRCIAFN

SEQ ID NO: 1141222 - protein, 9 aa, Homo Sapiens
KTGQKDLMS

SEQ ID NO: 1141223 - protein, 9 aa, Homo Sapiens
RGTLEKMQK

SEQ ID NO: 1141224 - protein, 9 aa, Homo Sapiens
EKKESFLNK

SEQ ID NO: 1141225 - protein, 9 aa, Homo Sapiens
ATRPGLQMQ

SEQ ID NO: 1141226 - protein, 9 aa, Homo Sapiens
RPLSLQCQS

SEQ ID NO: 1141227 - protein, 9 aa, Homo Sapiens
LLLQERLGS

SEQ ID NO: 1141228 - protein, 9 aa, Homo Sapiens
DGIPDDRDN

SEQ ID NO: 1141229 - protein, 9 aa, Homo Sapiens
ETFLKKNLY

SEQ ID NO: 1141230 - protein, 9 aa, Homo Sapiens
IMKRKPMNT

SEQ ID NO: 1141231 - protein, 9 aa, Homo Sapiens
VTAHAVRVH

SEQ ID NO: 1141232 - protein, 9 aa, Homo Sapiens
VLAGHGASL

SEQ ID NO: 1141233 - protein, 9 aa, Homo Sapiens
ITIAVKYKR

SEQ ID NO: 1141234 - protein, 9 aa, Homo Sapiens
HEVKLSIEG

SEQ ID NO: 1141235 - protein, 9 aa, Homo Sapiens
ASGPAGLPR

SEQ ID NO: 1141236 - protein, 9 aa, Homo Sapiens
SKACLPLGA

SEQ ID NO: 1141237 - protein, 9 aa, Homo Sapiens
PVNTYGPDF

SEQ ID NO: 1141238 - protein, 9 aa, Homo Sapiens
ELDHEDDFC

SEQ ID NO: 1141239 - protein, 9 aa, Homo Sapiens
KEKESEALN

SEQ ID NO: 1141240 - protein, 9 aa, Homo Sapiens
YRSIRWDDR

SEQ ID NO: 1141241 - protein, 9 aa, Homo Sapiens
AGPPPGGRA

SEQ ID NO: 1141242 - protein, 9 aa, Homo Sapiens
QPSWNPKEH

SEQ ID NO: 1141243 - protein, 9 aa, Homo Sapiens
AAAIMATPV

SEQ ID NO: 1141244 - protein, 9 aa, Homo Sapiens
HETVDKIVV

SEQ ID NO: 1141245 - protein, 9 aa, Homo Sapiens
KSLVSKGAL

SEQ ID NO: 1141246 - protein, 9 aa, Homo Sapiens
AQAHQKKAV

SEQ ID NO: 1141247 - protein, 9 aa, Homo Sapiens
RAAIWRRIG

SEQ ID NO: 1141248 - protein, 9 aa, Homo Sapiens
KLYKGVPLP

SEQ ID NO: 1141249 - protein, 9 aa, Homo Sapiens
QLENMSAGY

SEQ ID NO: 1141250 - protein, 9 aa, Homo Sapiens
PASTSSPQG

SEQ ID NO: 1141251 - protein, 9 aa, Homo Sapiens
LLTDRAFQG

SEQ ID NO: 1141252 - protein, 9 aa, Homo Sapiens
CKTFPFHIM

SEQ ID NO: 1141253 - protein, 9 aa, Homo Sapiens
ALLYKCDLF

SEQ ID NO: 1141254 - protein, 9 aa, Homo Sapiens
TETPTWAGT

SEQ ID NO: 1141255 - protein, 9 aa, Homo Sapiens
SRRRRCLAL

SEQ ID NO: 1141256 - protein, 9 aa, Homo Sapiens
SEHKKQSQQ

SEQ ID NO: 1141257 - protein, 9 aa, Homo Sapiens
EEQNQEHSE

SEQ ID NO: 1141258 - protein, 9 aa, Homo Sapiens
ALAQCMGPN

SEQ ID NO: 1141259 - protein, 9 aa, Homo Sapiens
LKLMEEFVR

SEQ ID NO: 1141260 - protein, 9 aa, Homo Sapiens
PGTQEVDAH

SEQ ID NO: 1141261 - protein, 9 aa, Homo Sapiens
EQGGLWHVQ

SEQ ID NO: 1141262 - protein, 9 aa, Homo Sapiens
ASDRVGPLA

SEQ ID NO: 1141263 - protein, 9 aa, Homo Sapiens
WGWQQSWEI

SEQ ID NO: 1141264 - protein, 9 aa, Homo Sapiens
VCHLSTKGF

SEQ ID NO: 1141265 - protein, 9 aa, Homo Sapiens
ARGEELTGL

SEQ ID NO: 1141266 - protein, 9 aa, Homo Sapiens
TGSSSLPTQ

SEQ ID NO: 1141267 - protein, 9 aa, Homo Sapiens
MEVVSHRAT

SEQ ID NO: 1141268 - protein, 9 aa, Homo Sapiens
CTSTATRAP

SEQ ID NO: 1141269 - protein, 9 aa, Homo Sapiens
GKFTNGQLV

SEQ ID NO: 1141270 - protein, 9 aa, Homo Sapiens
QNRMWWQIL

SEQ ID NO: 1141271 - protein, 9 aa, Homo Sapiens
QEGVDEYVK

SEQ ID NO: 1141272 - protein, 9 aa, Homo Sapiens
MSVLQRVLY

SEQ ID NO: 1141273 - protein, 9 aa, Homo Sapiens
ISMQAVISL

SEQ ID NO: 1141274 - protein, 9 aa, Homo Sapiens
ICPLLYADL

SEQ ID NO: 1141275 - protein, 9 aa, Homo Sapiens
VRGERLPDV

SEQ ID NO: 1141276 - protein, 9 aa, Homo Sapiens
AMIFKRGVF

SEQ ID NO: 1141277 - protein, 9 aa, Homo Sapiens
HRLITAYQR

SEQ ID NO: 1141278 - protein, 9 aa, Homo Sapiens
KRIAFQLTP

SEQ ID NO: 1141279 - protein, 9 aa, Homo Sapiens
PRTLEGCIS

SEQ ID NO: 1141280 - protein, 9 aa, Homo Sapiens
GLGPEAGHW

SEQ ID NO: 1141281 - protein, 9 aa, Homo Sapiens
LQLQMRLGC

SEQ ID NO: 1141282 - protein, 9 aa, Homo Sapiens
SAEGRKKGL

SEQ ID NO: 1141283 - protein, 9 aa, Homo Sapiens
GGEITDDLD

SEQ ID NO: 1141284 - protein, 9 aa, Homo Sapiens
APVLLGCWD

SEQ ID NO: 1141285 - protein, 9 aa, Homo Sapiens
ETSQFPDEE

SEQ ID NO: 1141286 - protein, 9 aa, Homo Sapiens
VDAHRERPL

SEQ ID NO: 1141287 - protein, 9 aa, Homo Sapiens
RIRGSRQRV

SEQ ID NO: 1141288 - protein, 9 aa, Homo Sapiens
CVKATVCPA

SEQ ID NO: 1141289 - protein, 9 aa, Homo Sapiens
PTPLSSHGS

SEQ ID NO: 1141290 - protein, 9 aa, Homo Sapiens
HGMSPALHR

SEQ ID NO: 1141291 - protein, 9 aa, Homo Sapiens
FCGLNHVNH

SEQ ID NO: 1141292 - protein, 9 aa, Homo Sapiens
AMAEALTNL

SEQ ID NO: 1141293 - protein, 9 aa, Homo Sapiens
ERVDGEKGT

SEQ ID NO: 1141294 - protein, 9 aa, Homo Sapiens
INTTISDAT

SEQ ID NO: 1141295 - protein, 9 aa, Homo Sapiens
RVKMVSQSF

SEQ ID NO: 1141296 - protein, 9 aa, Homo Sapiens
SQWDVDDNE

SEQ ID NO: 1141297 - protein, 9 aa, Homo Sapiens
LLVLGWPAF

SEQ ID NO: 1141298 - protein, 9 aa, Homo Sapiens
PGTCLKPTA

SEQ ID NO: 1141299 - protein, 9 aa, Homo Sapiens
PSSAGPLVV

SEQ ID NO: 1141300 - protein, 9 aa, Homo Sapiens
WCVIERRGP

SEQ ID NO: 1141301 - protein, 9 aa, Homo Sapiens
NKTKELTLE

SEQ ID NO: 1141302 - protein, 9 aa, Homo Sapiens
KTISPLRPE

SEQ ID NO: 1141303 - protein, 9 aa, Homo Sapiens
RRAWLTALA

SEQ ID NO: 1141304 - protein, 9 aa, Homo Sapiens
FSHPLFTMF

SEQ ID NO: 1141305 - protein, 9 aa, Homo Sapiens
CVDAARYAA

SEQ ID NO: 1141306 - protein, 9 aa, Homo Sapiens
EMNILYGIA

SEQ ID NO: 1141307 - protein, 9 aa, Homo Sapiens
ASGPVGPGG

SEQ ID NO: 1141308 - protein, 9 aa, Homo Sapiens
MAVYIAVIA

SEQ ID NO: 1141309 - protein, 9 aa, Homo Sapiens
SLVGLAKMA

SEQ ID NO: 1141310 - protein, 9 aa, Homo Sapiens
PRRAWRALL

SEQ ID NO: 1141311 - protein, 9 aa, Homo Sapiens
TRHSLKARG

SEQ ID NO: 1141312 - protein, 9 aa, Homo Sapiens
YTLNLLFWL

SEQ ID NO: 1141313 - protein, 9 aa, Homo Sapiens
MMYRTHCQC

SEQ ID NO: 1141314 - protein, 9 aa, Homo Sapiens
GHLHPPGTQ

SEQ ID NO: 1141315 - protein, 9 aa, Homo Sapiens
HWKEFVRRL

SEQ ID NO: 1141316 - protein, 9 aa, Homo Sapiens
SVTLRPWKT

SEQ ID NO: 1141317 - protein, 9 aa, Homo Sapiens
ALAVAVRSD

SEQ ID NO: 1141318 - protein, 9 aa, Homo Sapiens
LTILKKYML

SEQ ID NO: 1141319 - protein, 9 aa, Homo Sapiens
SLAFLTAAS

SEQ ID NO: 1141320 - protein, 9 aa, Homo Sapiens
GGQRGQEPL

SEQ ID NO: 1141321 - protein, 9 aa, Homo Sapiens
NLTSVISVA

SEQ ID NO: 1141322 - protein, 9 aa, Homo Sapiens
FTMFSSGTT

SEQ ID NO: 1141323 - protein, 9 aa, Homo Sapiens
THEMESLTA

SEQ ID NO: 1141324 - protein, 9 aa, Homo Sapiens
DNVFSPQAS

SEQ ID NO: 1141325 - protein, 9 aa, Homo Sapiens
VENATESVS

SEQ ID NO: 1141326 - protein, 9 aa, Homo Sapiens
CMLKPGVLL

SEQ ID NO: 1141327 - protein, 9 aa, Homo Sapiens
APATGPAPH

SEQ ID NO: 1141328 - protein, 9 aa, Homo Sapiens
DSSSSWKNR

SEQ ID NO: 1141329 - protein, 9 aa, Homo Sapiens
KYVQEDAGI

SEQ ID NO: 1141330 - protein, 9 aa, Homo Sapiens
LVKKPLVRS

SEQ ID NO: 1141331 - protein, 9 aa, Homo Sapiens
KQRQLLGHL

SEQ ID NO: 1141332 - protein, 9 aa, Homo Sapiens
HIQLDASIH

SEQ ID NO: 1141333 - protein, 9 aa, Homo Sapiens
VQRALEIWK

SEQ ID NO: 1141334 - protein, 9 aa, Homo Sapiens
GKSCDFYHT

SEQ ID NO: 1141335 - protein, 9 aa, Homo Sapiens
TYASIALAT

SEQ ID NO: 1141336 - protein, 9 aa, Homo Sapiens
QNGIVVADA

SEQ ID NO: 1141337 - protein, 9 aa, Homo Sapiens
YQEKLQVTL

SEQ ID NO: 1141338 - protein, 9 aa, Homo Sapiens
SPFAGCVYW

SEQ ID NO: 1141339 - protein, 9 aa, Homo Sapiens
GAGGFLLRV

SEQ ID NO: 1141340 - protein, 9 aa, Homo Sapiens
LDQHNGEKS

SEQ ID NO: 1141341 - protein, 9 aa, Homo Sapiens
QERVNLSAS

SEQ ID NO: 1141342 - protein, 9 aa, Homo Sapiens
EVEIQPTWK

SEQ ID NO: 1141343 - protein, 9 aa, Homo Sapiens
YGHLGALEC

SEQ ID NO: 1141344 - protein, 9 aa, Homo Sapiens
IAVMFGDVG

SEQ ID NO: 1141345 - protein, 9 aa, Homo Sapiens
KGPRTGCRP

SEQ ID NO: 1141346 - protein, 9 aa, Homo Sapiens
HLGLQPPVV

SEQ ID NO: 1141347 - protein, 9 aa, Homo Sapiens
LKRCRRRPR

SEQ ID NO: 1141348 - protein, 9 aa, Homo Sapiens
RKTYPICKQ

SEQ ID NO: 1141349 - protein, 9 aa, Homo Sapiens
GHVYMRNIV

SEQ ID NO: 1141350 - protein, 9 aa, Homo Sapiens
RLQIWWKKA

SEQ ID NO: 1141351 - protein, 9 aa, Homo Sapiens
RPLGPGRSI

SEQ ID NO: 1141352 - protein, 9 aa, Homo Sapiens
PPHAEVTFE

SEQ ID NO: 1141353 - protein, 9 aa, Homo Sapiens
VPHRSLQAA

SEQ ID NO: 1141354 - protein, 9 aa, Homo Sapiens
PRQQRETRR

SEQ ID NO: 1141355 - protein, 9 aa, Homo Sapiens
SDSPNPARG

SEQ ID NO: 1141356 - protein, 9 aa, Homo Sapiens
KTVAALWSG

SEQ ID NO: 1141357 - protein, 9 aa, Homo Sapiens
PKNVPKRVQ

SEQ ID NO: 1141358 - protein, 9 aa, Homo Sapiens
SCCLFSPFA

SEQ ID NO: 1141359 - protein, 9 aa, Homo Sapiens
EERFFERVT

SEQ ID NO: 1141360 - protein, 9 aa, Homo Sapiens
PTQRTTRAT

SEQ ID NO: 1141361 - protein, 9 aa, Homo Sapiens
HVLCRTHLK

SEQ ID NO: 1141362 - protein, 9 aa, Homo Sapiens
VCHCTHLTN

SEQ ID NO: 1141363 - protein, 9 aa, Homo Sapiens
VVFALVLYG

SEQ ID NO: 1141364 - protein, 9 aa, Homo Sapiens
FKAHKAELA

SEQ ID NO: 1141365 - protein, 9 aa, Homo Sapiens
ALASSKGRK

SEQ ID NO: 1141366 - protein, 9 aa, Homo Sapiens
KALQHKRLV

SEQ ID NO: 1141367 - protein, 9 aa, Homo Sapiens
SHPVSQMQH

SEQ ID NO: 1141368 - protein, 9 aa, Homo Sapiens
LSGDIVPAP

SEQ ID NO: 1141369 - protein, 9 aa, Homo Sapiens
MGRDPSPRA

SEQ ID NO: 1141370 - protein, 9 aa, Homo Sapiens
PRLDFHPRS

SEQ ID NO: 1141371 - protein, 9 aa, Homo Sapiens
HIWKLSDVD

SEQ ID NO: 1141372 - protein, 9 aa, Homo Sapiens
LLPHKSGSL

SEQ ID NO: 1141373 - protein, 9 aa, Homo Sapiens
PAVHAGILS

SEQ ID NO: 1141374 - protein, 9 aa, Homo Sapiens
KNGIWEVMP

SEQ ID NO: 1141375 - protein, 9 aa, Homo Sapiens
GKKRFEVKR

SEQ ID NO: 1141376 - protein, 9 aa, Homo Sapiens
KAQKTGLGI

SEQ ID NO: 1141377 - protein, 9 aa, Homo Sapiens
IPVLPTMHY

SEQ ID NO: 1141378 - protein, 9 aa, Homo Sapiens
FCGNNFEDE

SEQ ID NO: 1141379 - protein, 9 aa, Homo Sapiens
MEQVNKRDA

SEQ ID NO: 1141380 - protein, 9 aa, Homo Sapiens
IVNSFLIKY

SEQ ID NO: 1141381 - protein, 9 aa, Homo Sapiens
HNFKQWPDL

SEQ ID NO: 1141382 - protein, 9 aa, Homo Sapiens
YVPDAPDAT

SEQ ID NO: 1141383 - protein, 9 aa, Homo Sapiens
EIYRKDLLA

SEQ ID NO: 1141384 - protein, 9 aa, Homo Sapiens
AEPKARPGT

SEQ ID NO: 1141385 - protein, 9 aa, Homo Sapiens
AKVKKERPT

SEQ ID NO: 1141386 - protein, 9 aa, Homo Sapiens
GPKEAISAS

SEQ ID NO: 1141387 - protein, 9 aa, Homo Sapiens
LGGSERSHG

SEQ ID NO: 1141388 - protein, 9 aa, Homo Sapiens
LWQYDNEKK

SEQ ID NO: 1141389 - protein, 9 aa, Homo Sapiens
SPPGAPPSR

SEQ ID NO: 1141390 - protein, 9 aa, Homo Sapiens
PSIGQLETV

SEQ ID NO: 1141391 - protein, 9 aa, Homo Sapiens
EFVTRFGGI

SEQ ID NO: 1141392 - protein, 9 aa, Homo Sapiens
KRSLIDRPG

SEQ ID NO: 1141393 - protein, 9 aa, Homo Sapiens
TGTALAAVM

SEQ ID NO: 1141394 - protein, 9 aa, Homo Sapiens
DFPVYNANI

SEQ ID NO: 1141395 - protein, 9 aa, Homo Sapiens
HIANRLAVD

SEQ ID NO: 1141396 - protein, 9 aa, Homo Sapiens
LQGSKASKE

SEQ ID NO: 1141397 - protein, 9 aa, Homo Sapiens
QCHLLAIAG

SEQ ID NO: 1141398 - protein, 9 aa, Homo Sapiens
RSRVCGADV

SEQ ID NO: 1141399 - protein, 9 aa, Homo Sapiens
EVLSEEKSC

SEQ ID NO: 1141400 - protein, 9 aa, Homo Sapiens
CSRQIYFMA

SEQ ID NO: 1141401 - protein, 9 aa, Homo Sapiens
ILLSETSCL

SEQ ID NO: 1141402 - protein, 9 aa, Homo Sapiens
PAESHLLNR

SEQ ID NO: 1141403 - protein, 9 aa, Homo Sapiens
CTRLHGNIL

SEQ ID NO: 1141404 - protein, 9 aa, Homo Sapiens
PKRPPKLQA

SEQ ID NO: 1141405 - protein, 9 aa, Homo Sapiens
ISNALSKSS

SEQ ID NO: 1141406 - protein, 9 aa, Homo Sapiens
PMHTISDGI

SEQ ID NO: 1141407 - protein, 9 aa, Homo Sapiens
PDSYQRFGQ

SEQ ID NO: 1141408 - protein, 9 aa, Homo Sapiens
TSPHQAVCL

SEQ ID NO: 1141409 - protein, 9 aa, Homo Sapiens
PAPASRAAV

SEQ ID NO: 1141410 - protein, 9 aa, Homo Sapiens
PQGAFYSLQ

SEQ ID NO: 1141411 - protein, 9 aa, Homo Sapiens
EHQTRLRNS

SEQ ID NO: 1141412 - protein, 9 aa, Homo Sapiens
KTEETGKSH

SEQ ID NO: 1141413 - protein, 9 aa, Homo Sapiens
LDHTSLEED

SEQ ID NO: 1141414 - protein, 9 aa, Homo Sapiens
PTSSQTRTS

SEQ ID NO: 1141415 - protein, 9 aa, Homo Sapiens
FGSTVAYCY

SEQ ID NO: 1141416 - protein, 9 aa, Homo Sapiens
LAYTFETKA

SEQ ID NO: 1141417 - protein, 9 aa, Homo Sapiens
DAPSPTQER

SEQ ID NO: 1141418 - protein, 9 aa, Homo Sapiens
FFTSAHPSR

SEQ ID NO: 1141419 - protein, 9 aa, Homo Sapiens
VDEVFCSSP

SEQ ID NO: 1141420 - protein, 9 aa, Homo Sapiens
VSELERRFK

SEQ ID NO: 1141421 - protein, 9 aa, Homo Sapiens
PCSLVGIWN

SEQ ID NO: 1141422 - protein, 9 aa, Homo Sapiens
TRASDRPSS

SEQ ID NO: 1141423 - protein, 9 aa, Homo Sapiens
WSGASPHCE

SEQ ID NO: 1141424 - protein, 9 aa, Homo Sapiens
RAFRCSLYN

SEQ ID NO: 1141425 - protein, 9 aa, Homo Sapiens
LSQNDDICI

SEQ ID NO: 1141426 - protein, 9 aa, Homo Sapiens
AARTGLHIC

SEQ ID NO: 1141427 - protein, 9 aa, Homo Sapiens
TDALVWAGT

SEQ ID NO: 1141428 - protein, 9 aa, Homo Sapiens
IEEVLPHWL

SEQ ID NO: 1141429 - protein, 9 aa, Homo Sapiens
SKNTAALSL

SEQ ID NO: 1141430 - protein, 9 aa, Homo Sapiens
ISGGSGHCP

SEQ ID NO: 1141431 - protein, 9 aa, Homo Sapiens
DKFTLLEDQ

SEQ ID NO: 1141432 - protein, 9 aa, Homo Sapiens
FPPLIIQRL

SEQ ID NO: 1141433 - protein, 9 aa, Homo Sapiens
MEEEVLEME

SEQ ID NO: 1141434 - protein, 9 aa, Homo Sapiens
ETLREEEEK

SEQ ID NO: 1141435 - protein, 9 aa, Homo Sapiens
TPEPRPLAQ

SEQ ID NO: 1141436 - protein, 9 aa, Homo Sapiens
ITRSQEEFS

SEQ ID NO: 1141437 - protein, 9 aa, Homo Sapiens
VLVSKPEKV

SEQ ID NO: 1141438 - protein, 9 aa, Homo Sapiens
EDVAGSQVT

SEQ ID NO: 1141439 - protein, 9 aa, Homo Sapiens
KQKRREGVK

SEQ ID NO: 1141440 - protein, 9 aa, Homo Sapiens
LSSWTHPLR

SEQ ID NO: 1141441 - protein, 9 aa, Homo Sapiens
LVLLHELQA

SEQ ID NO: 1141442 - protein, 9 aa, Homo Sapiens
QVVLEHLRP

SEQ ID NO: 1141443 - protein, 9 aa, Homo Sapiens
CHKTKLKAF

SEQ ID NO: 1141444 - protein, 9 aa, Homo Sapiens
CKPVPPWDC

SEQ ID NO: 1141445 - protein, 9 aa, Homo Sapiens
TMVCCLKTS

SEQ ID NO: 1141446 - protein, 9 aa, Homo Sapiens
ETKPFSPKI

SEQ ID NO: 1141447 - protein, 9 aa, Homo Sapiens
EVNKNQSAL

SEQ ID NO: 1141448 - protein, 9 aa, Homo Sapiens
SGPVEGRVA

SEQ ID NO: 1141449 - protein, 9 aa, Homo Sapiens
HLPATQEVV

SEQ ID NO: 1141450 - protein, 9 aa, Homo Sapiens
ALRATLFQT

SEQ ID NO: 1141451 - protein, 9 aa, Homo Sapiens
QDITVYHEL

SEQ ID NO: 1141452 - protein, 9 aa, Homo Sapiens
PPLVLNSPQ

SEQ ID NO: 1141453 - protein, 9 aa, Homo Sapiens
SRANNTMGR

SEQ ID NO: 1141454 - protein, 9 aa, Homo Sapiens
GTSASTARA

SEQ ID NO: 1141455 - protein, 9 aa, Homo Sapiens
DTERNLRPL

SEQ ID NO: 1141456 - protein, 9 aa, Homo Sapiens
AKGQRMLVG

SEQ ID NO: 1141457 - protein, 9 aa, Homo Sapiens
AFSEKVSAT

SEQ ID NO: 1141458 - protein, 9 aa, Homo Sapiens
GASTRASGP

SEQ ID NO: 1141459 - protein, 9 aa, Homo Sapiens
WKGPRRTRP

SEQ ID NO: 1141460 - protein, 9 aa, Homo Sapiens
EHEMNILYG

SEQ ID NO: 1141461 - protein, 9 aa, Homo Sapiens
SALAVAVAL

SEQ ID NO: 1141462 - protein, 9 aa, Homo Sapiens
DLFGRVCTL

SEQ ID NO: 1141463 - protein, 9 aa, Homo Sapiens
FVGLTYLGS

SEQ ID NO: 1141464 - protein, 9 aa, Homo Sapiens
MRRLWGTTQ

SEQ ID NO: 1141465 - protein, 9 aa, Homo Sapiens
NPHCGLRGQ

SEQ ID NO: 1141466 - protein, 9 aa, Homo Sapiens
VVTSMVTHA

SEQ ID NO: 1141467 - protein, 9 aa, Homo Sapiens
LLASQWGTG

SEQ ID NO: 1141468 - protein, 9 aa, Homo Sapiens
PPLLPPPVL

SEQ ID NO: 1141469 - protein, 9 aa, Homo Sapiens
LCDCYDMAA

SEQ ID NO: 1141470 - protein, 9 aa, Homo Sapiens
SELGMEERP

SEQ ID NO: 1141471 - protein, 9 aa, Homo Sapiens
ELAVRALHN

SEQ ID NO: 1141472 - protein, 9 aa, Homo Sapiens
VFPFNILDS

SEQ ID NO: 1141473 - protein, 9 aa, Homo Sapiens
QVLITEHSD

SEQ ID NO: 1141474 - protein, 9 aa, Homo Sapiens
YADVVFWWT

SEQ ID NO: 1141475 - protein, 9 aa, Homo Sapiens
EDMMKKEKE

SEQ ID NO: 1141476 - protein, 9 aa, Homo Sapiens
STRLTVLWE

SEQ ID NO: 1141477 - protein, 9 aa, Homo Sapiens
SSEVYRQLE

SEQ ID NO: 1141478 - protein, 9 aa, Homo Sapiens
KKCVSKNTF

SEQ ID NO: 1141479 - protein, 9 aa, Homo Sapiens
SPTASSCLS

SEQ ID NO: 1141480 - protein, 9 aa, Homo Sapiens
CQHLRPAGT

SEQ ID NO: 1141481 - protein, 9 aa, Homo Sapiens
HLGPPLPPA

SEQ ID NO: 1141482 - protein, 9 aa, Homo Sapiens
VLIDVLHLV

SEQ ID NO: 1141483 - protein, 9 aa, Homo Sapiens
MKFYFRFTS

SEQ ID NO: 1141484 - protein, 9 aa, Homo Sapiens
IKVDLCADQ

SEQ ID NO: 1141485 - protein, 9 aa, Homo Sapiens
KSKSPSSAG

SEQ ID NO: 1141486 - protein, 9 aa, Homo Sapiens
SFCLRDETL

SEQ ID NO: 1141487 - protein, 9 aa, Homo Sapiens
EKLEFCTRL

SEQ ID NO: 1141488 - protein, 9 aa, Homo Sapiens
AKPSARSPT

SEQ ID NO: 1141489 - protein, 9 aa, Homo Sapiens
AVHLVSQAY

SEQ ID NO: 1141490 - protein, 9 aa, Homo Sapiens
KQVLAGHGA

SEQ ID NO: 1141491 - protein, 9 aa, Homo Sapiens
VITGHDHEV

SEQ ID NO: 1141492 - protein, 9 aa, Homo Sapiens
FEFIRVEDN

SEQ ID NO: 1141493 - protein, 9 aa, Homo Sapiens
LLQIEPEKT

SEQ ID NO: 1141494 - protein, 9 aa, Homo Sapiens
MKSYLWERY

SEQ ID NO: 1141495 - protein, 9 aa, Homo Sapiens
NNNHTEAYN

SEQ ID NO: 1141496 - protein, 9 aa, Homo Sapiens
FSNKKAKRV

SEQ ID NO: 1141497 - protein, 9 aa, Homo Sapiens
QHNRQLLCG

SEQ ID NO: 1141498 - protein, 9 aa, Homo Sapiens
SPTFPKGIA

SEQ ID NO: 1141499 - protein, 9 aa, Homo Sapiens
LVSYWAQPQ

SEQ ID NO: 1141500 - protein, 9 aa, Homo Sapiens
LFRLNHDQL

SEQ ID NO: 1141501 - protein, 9 aa, Homo Sapiens
YPVYSAPNV

SEQ ID NO: 1141502 - protein, 9 aa, Homo Sapiens
SHWSPLTAA

SEQ ID NO: 1141503 - protein, 9 aa, Homo Sapiens
VTFNKELDP

SEQ ID NO: 1141504 - protein, 9 aa, Homo Sapiens
WRSECRLLY

SEQ ID NO: 1141505 - protein, 9 aa, Homo Sapiens
FRDDGDWQA

SEQ ID NO: 1141506 - protein, 9 aa, Homo Sapiens
IPPVGLLVV

SEQ ID NO: 1141507 - protein, 9 aa, Homo Sapiens
GPVAVATDL

SEQ ID NO: 1141508 - protein, 9 aa, Homo Sapiens
GTTGGTAPM

SEQ ID NO: 1141509 - protein, 9 aa, Homo Sapiens
SLYRPPLAP

SEQ ID NO: 1141510 - protein, 9 aa, Homo Sapiens
KPESKYVPL

SEQ ID NO: 1141511 - protein, 9 aa, Homo Sapiens
ASTRPIAGT

SEQ ID NO: 1141512 - protein, 9 aa, Homo Sapiens
PSPQEISKV

SEQ ID NO: 1141513 - protein, 9 aa, Homo Sapiens
GNAKTTHND

SEQ ID NO: 1141514 - protein, 9 aa, Homo Sapiens
GRSEVPPSR

SEQ ID NO: 1141515 - protein, 9 aa, Homo Sapiens
PAGGVVLHS

SEQ ID NO: 1141516 - protein, 9 aa, Homo Sapiens
KTTHNDNSS

SEQ ID NO: 1141517 - protein, 9 aa, Homo Sapiens
AYAKQKLDS

SEQ ID NO: 1141518 - protein, 9 aa, Homo Sapiens
KGFYCVECR

SEQ ID NO: 1141519 - protein, 9 aa, Homo Sapiens
RKRDADQCC

SEQ ID NO: 1141520 - protein, 9 aa, Homo Sapiens
ISTVEWGAG

SEQ ID NO: 1141521 - protein, 9 aa, Homo Sapiens
PARQPTPAV

SEQ ID NO: 1141522 - protein, 9 aa, Homo Sapiens
PSPQGQHKL

SEQ ID NO: 1141523 - protein, 9 aa, Homo Sapiens
STSLWVVTS

SEQ ID NO: 1141524 - protein, 9 aa, Homo Sapiens
GIKECLGDL

SEQ ID NO: 1141525 - protein, 9 aa, Homo Sapiens
EVPRCAMAP

SEQ ID NO: 1141526 - protein, 9 aa, Homo Sapiens
AKGPHSYPV

SEQ ID NO: 1141527 - protein, 9 aa, Homo Sapiens
FMNLTREPS

SEQ ID NO: 1141528 - protein, 9 aa, Homo Sapiens
LELSRSPRR

SEQ ID NO: 1141529 - protein, 9 aa, Homo Sapiens
HKMDRKALT

SEQ ID NO: 1141530 - protein, 9 aa, Homo Sapiens
EVSGLRSVV

SEQ ID NO: 1141531 - protein, 9 aa, Homo Sapiens
DGILRKRLK

SEQ ID NO: 1141532 - protein, 9 aa, Homo Sapiens
QASMTLPAP

SEQ ID NO: 1141533 - protein, 9 aa, Homo Sapiens
DITIDNICR

SEQ ID NO: 1141534 - protein, 9 aa, Homo Sapiens
AWHHHGGAG

SEQ ID NO: 1141535 - protein, 9 aa, Homo Sapiens
PSPALPGGR

SEQ ID NO: 1141536 - protein, 9 aa, Homo Sapiens
VRPSTRAWR

SEQ ID NO: 1141537 - protein, 9 aa, Homo Sapiens
ALKPQLSGK

SEQ ID NO: 1141538 - protein, 9 aa, Homo Sapiens
TSVISVAIP

SEQ ID NO: 1141539 - protein, 9 aa, Homo Sapiens
DICPVGVLT

SEQ ID NO: 1141540 - protein, 9 aa, Homo Sapiens
ACSPPRLCV

SEQ ID NO: 1141541 - protein, 9 aa, Homo Sapiens
HIFSLPITN

SEQ ID NO: 1141542 - protein, 9 aa, Homo Sapiens
ERDLELEHY

SEQ ID NO: 1141543 - protein, 9 aa, Homo Sapiens
TTMLSLCLE

SEQ ID NO: 1141544 - protein, 9 aa, Homo Sapiens
QDANKGEPL

SEQ ID NO: 1141545 - protein, 9 aa, Homo Sapiens
HLSVSAQNS

SEQ ID NO: 1141546 - protein, 9 aa, Homo Sapiens
PNYIRCINP

SEQ ID NO: 1141547 - protein, 9 aa, Homo Sapiens
FINNLRALS

SEQ ID NO: 1141548 - protein, 9 aa, Homo Sapiens
CSLPENPLF

SEQ ID NO: 1141549 - protein, 9 aa, Homo Sapiens
SPQRPPLRA

SEQ ID NO: 1141550 - protein, 9 aa, Homo Sapiens
QNPEKNQRL

SEQ ID NO: 1141551 - protein, 9 aa, Homo Sapiens
PAFSLRNFE

SEQ ID NO: 1141552 - protein, 9 aa, Homo Sapiens
YCKASLSTS

SEQ ID NO: 1141553 - protein, 9 aa, Homo Sapiens
RRPGRHICE

SEQ ID NO: 1141554 - protein, 9 aa, Homo Sapiens
NSHLSPEEK

SEQ ID NO: 1141555 - protein, 9 aa, Homo Sapiens
PSALATQCS

SEQ ID NO: 1141556 - protein, 9 aa, Homo Sapiens
AILKDSTSS

SEQ ID NO: 1141557 - protein, 9 aa, Homo Sapiens
VAGATAQIQ

SEQ ID NO: 1141558 - protein, 9 aa, Homo Sapiens
FAEGRRRTV

SEQ ID NO: 1141559 - protein, 9 aa, Homo Sapiens
GSVRMFVWT

SEQ ID NO: 1141560 - protein, 9 aa, Homo Sapiens
LRPSWCPPG

SEQ ID NO: 1141561 - protein, 9 aa, Homo Sapiens
LPGQVAGAD

SEQ ID NO: 1141562 - protein, 9 aa, Homo Sapiens
KNDGGQPHK

SEQ ID NO: 1141563 - protein, 9 aa, Homo Sapiens
ARHPLGSQC

SEQ ID NO: 1141564 - protein, 9 aa, Homo Sapiens
KPLHIIGDP

SEQ ID NO: 1141565 - protein, 9 aa, Homo Sapiens
SFHQSINKN

SEQ ID NO: 1141566 - protein, 9 aa, Homo Sapiens
RACTPASGP

SEQ ID NO: 1141567 - protein, 9 aa, Homo Sapiens
LVHEKLGSD

SEQ ID NO: 1141568 - protein, 9 aa, Homo Sapiens
MLVENEGPQ

SEQ ID NO: 1141569 - protein, 9 aa, Homo Sapiens
LRAPELVLV

SEQ ID NO: 1141570 - protein, 9 aa, Homo Sapiens
SYRGTLLND

SEQ ID NO: 1141571 - protein, 9 aa, Homo Sapiens
FHELVQCFL

SEQ ID NO: 1141572 - protein, 9 aa, Homo Sapiens
ETVTLEDGQ

SEQ ID NO: 1141573 - protein, 9 aa, Homo Sapiens
VLLIVHYSF

SEQ ID NO: 1141574 - protein, 9 aa, Homo Sapiens
RTCGASIRR

SEQ ID NO: 1141575 - protein, 9 aa, Homo Sapiens
LGAGLGPGL

SEQ ID NO: 1141576 - protein, 9 aa, Homo Sapiens
KRRRSGRRR

SEQ ID NO: 1141577 - protein, 9 aa, Homo Sapiens
WGSAMPVDG

SEQ ID NO: 1141578 - protein, 9 aa, Homo Sapiens
LASPPWRAL

SEQ ID NO: 1141579 - protein, 9 aa, Homo Sapiens
CTDCASRGM

SEQ ID NO: 1141580 - protein, 9 aa, Homo Sapiens
RDYSGKKPP

SEQ ID NO: 1141581 - protein, 9 aa, Homo Sapiens
GRKKCSGSM

SEQ ID NO: 1141582 - protein, 9 aa, Homo Sapiens
EQDIETVHG

SEQ ID NO: 1141583 - protein, 9 aa, Homo Sapiens
RARRTLGTT

SEQ ID NO: 1141584 - protein, 9 aa, Homo Sapiens
HQSINKNLV

SEQ ID NO: 1141585 - protein, 9 aa, Homo Sapiens
MPAFSFSQP

SEQ ID NO: 1141586 - protein, 9 aa, Homo Sapiens
DPGVWGPRP

SEQ ID NO: 1141587 - protein, 9 aa, Homo Sapiens
FVVVAVDFG

SEQ ID NO: 1141588 - protein, 9 aa, Homo Sapiens
TLLESELYP

SEQ ID NO: 1141589 - protein, 9 aa, Homo Sapiens
WQQSWEIVM

SEQ ID NO: 1141590 - protein, 9 aa, Homo Sapiens
SDPGVVDKA

SEQ ID NO: 1141591 - protein, 9 aa, Homo Sapiens
RALCIHTGC

SEQ ID NO: 1141592 - protein, 9 aa, Homo Sapiens
DYMKHKSRE

SEQ ID NO: 1141593 - protein, 9 aa, Homo Sapiens
FMYLQPTNR

SEQ ID NO: 1141594 - protein, 9 aa, Homo Sapiens
KRKLRKEDE

SEQ ID NO: 1141595 - protein, 9 aa, Homo Sapiens
THHNGTGDK

SEQ ID NO: 1141596 - protein, 9 aa, Homo Sapiens
REPDTSNSL

SEQ ID NO: 1141597 - protein, 9 aa, Homo Sapiens
EVSLRNDAE

SEQ ID NO: 1141598 - protein, 9 aa, Homo Sapiens
MYSIMDELV

SEQ ID NO: 1141599 - protein, 9 aa, Homo Sapiens
EEEKKKQLS

SEQ ID NO: 1141600 - protein, 9 aa, Homo Sapiens
ILILLNTIC

SEQ ID NO: 1141601 - protein, 9 aa, Homo Sapiens
IKRVLSSTS

SEQ ID NO: 1141602 - protein, 9 aa, Homo Sapiens
IYLGDSEGP

SEQ ID NO: 1141603 - protein, 9 aa, Homo Sapiens
GLSPGACRP

SEQ ID NO: 1141604 - protein, 9 aa, Homo Sapiens
VAAVSSSEE

SEQ ID NO: 1141605 - protein, 9 aa, Homo Sapiens
KEIATDPEE

SEQ ID NO: 1141606 - protein, 9 aa, Homo Sapiens
TGASTRASG

SEQ ID NO: 1141607 - protein, 9 aa, Homo Sapiens
TSFFSSKQV

SEQ ID NO: 1141608 - protein, 9 aa, Homo Sapiens
GGPRPPGAP

SEQ ID NO: 1141609 - protein, 9 aa, Homo Sapiens
RRRCLALFL

SEQ ID NO: 1141610 - protein, 9 aa, Homo Sapiens
DQETGTALA

SEQ ID NO: 1141611 - protein, 9 aa, Homo Sapiens
PSRGSRGGA

SEQ ID NO: 1141612 - protein, 9 aa, Homo Sapiens
GPPTAASGR

SEQ ID NO: 1141613 - protein, 9 aa, Homo Sapiens
PSAAPAAPP

SEQ ID NO: 1141614 - protein, 9 aa, Homo Sapiens
INGPRDLGI

SEQ ID NO: 1141615 - protein, 9 aa, Homo Sapiens
EIFTEIGTT

SEQ ID NO: 1141616 - protein, 9 aa, Homo Sapiens
GQAAAGGSQ

SEQ ID NO: 1141617 - protein, 9 aa, Homo Sapiens
QGQMAWRLQ

SEQ ID NO: 1141618 - protein, 9 aa, Homo Sapiens
HKSTVQVCN

SEQ ID NO: 1141619 - protein, 9 aa, Homo Sapiens
GGVSLRPGA

SEQ ID NO: 1141620 - protein, 9 aa, Homo Sapiens
DAETKKVLG

SEQ ID NO: 1141621 - protein, 9 aa, Homo Sapiens
IRVEDNKSL

SEQ ID NO: 1141622 - protein, 9 aa, Homo Sapiens
VLTATATVL

SEQ ID NO: 1141623 - protein, 9 aa, Homo Sapiens
DRFKTNRIA

SEQ ID NO: 1141624 - protein, 9 aa, Homo Sapiens
TISDATTGD

SEQ ID NO: 1141625 - protein, 9 aa, Homo Sapiens
TDATMCCSF

SEQ ID NO: 1141626 - protein, 9 aa, Homo Sapiens
WIPLARKWH

SEQ ID NO: 1141627 - protein, 9 aa, Homo Sapiens
KTVIRVLEQ

SEQ ID NO: 1141628 - protein, 9 aa, Homo Sapiens
HPHDVHHLI

SEQ ID NO: 1141629 - protein, 9 aa, Homo Sapiens
IEGQLQDAE

SEQ ID NO: 1141630 - protein, 9 aa, Homo Sapiens
DQQVPFMAP

SEQ ID NO: 1141631 - protein, 9 aa, Homo Sapiens
KQNQIVDRV

SEQ ID NO: 1141632 - protein, 9 aa, Homo Sapiens
TDLDSFLKS

SEQ ID NO: 1141633 - protein, 9 aa, Homo Sapiens
LTRGASSSP

SEQ ID NO: 1141634 - protein, 9 aa, Homo Sapiens
ENKCVPNNN

SEQ ID NO: 1141635 - protein, 9 aa, Homo Sapiens
RPHSRGPQP

SEQ ID NO: 1141636 - protein, 9 aa, Homo Sapiens
KSGCKHDLL

SEQ ID NO: 1141637 - protein, 9 aa, Homo Sapiens
TFHILCKTS

SEQ ID NO: 1141638 - protein, 9 aa, Homo Sapiens
CEIGVTLKD

SEQ ID NO: 1141639 - protein, 9 aa, Homo Sapiens
RQVEEMKTQ

SEQ ID NO: 1141640 - protein, 9 aa, Homo Sapiens
RDMHLELKD

SEQ ID NO: 1141641 - protein, 9 aa, Homo Sapiens
SDPYTKVSI

SEQ ID NO: 1141642 - protein, 9 aa, Homo Sapiens
IMRHTQLQR

SEQ ID NO: 1141643 - protein, 9 aa, Homo Sapiens
QPTVDKIHE

SEQ ID NO: 1141644 - protein, 9 aa, Homo Sapiens
PRDRQLPGR

SEQ ID NO: 1141645 - protein, 9 aa, Homo Sapiens
PCCNCKATD

SEQ ID NO: 1141646 - protein, 9 aa, Homo Sapiens
WALSHLTDG

SEQ ID NO: 1141647 - protein, 9 aa, Homo Sapiens
SGASPHCEA

SEQ ID NO: 1141648 - protein, 9 aa, Homo Sapiens
IEVEIQPTW

SEQ ID NO: 1141649 - protein, 9 aa, Homo Sapiens
SPSAWCSSA

SEQ ID NO: 1141650 - protein, 9 aa, Homo Sapiens
LSSCQSMMH

SEQ ID NO: 1141651 - protein, 9 aa, Homo Sapiens
HVRGLCLYY

SEQ ID NO: 1141652 - protein, 9 aa, Homo Sapiens
SLKAHQPES

SEQ ID NO: 1141653 - protein, 9 aa, Homo Sapiens
VIEYSTEAA

SEQ ID NO: 1141654 - protein, 9 aa, Homo Sapiens
HAIQNSFQY

SEQ ID NO: 1141655 - protein, 9 aa, Homo Sapiens
NPFSLWEDL

SEQ ID NO: 1141656 - protein, 9 aa, Homo Sapiens
SETVSMKKT

SEQ ID NO: 1141657 - protein, 9 aa, Homo Sapiens
VMAVNMLTH

SEQ ID NO: 1141658 - protein, 9 aa, Homo Sapiens
TYQNPNMTV

SEQ ID NO: 1141659 - protein, 9 aa, Homo Sapiens
GRTAGQLLT

SEQ ID NO: 1141660 - protein, 9 aa, Homo Sapiens
IRAKFEEYG

SEQ ID NO: 1141661 - protein, 9 aa, Homo Sapiens
EEALGEAEH

SEQ ID NO: 1141662 - protein, 9 aa, Homo Sapiens
GQGQNYPRS

SEQ ID NO: 1141663 - protein, 9 aa, Homo Sapiens
MGMLPPDRC

SEQ ID NO: 1141664 - protein, 9 aa, Homo Sapiens
SPELEILCS

SEQ ID NO: 1141665 - protein, 9 aa, Homo Sapiens
VCTLSTAGQ

SEQ ID NO: 1141666 - protein, 9 aa, Homo Sapiens
PLTYSTCMS

SEQ ID NO: 1141667 - protein, 9 aa, Homo Sapiens
VVILPLLGL

SEQ ID NO: 1141668 - protein, 9 aa, Homo Sapiens
RILHQPEMA

SEQ ID NO: 1141669 - protein, 9 aa, Homo Sapiens
SLSRTRALM

SEQ ID NO: 1141670 - protein, 9 aa, Homo Sapiens
LAFLTAAST

SEQ ID NO: 1141671 - protein, 9 aa, Homo Sapiens
TEKDEWTMA

SEQ ID NO: 1141672 - protein, 9 aa, Homo Sapiens
ERELDLLDS

SEQ ID NO: 1141673 - protein, 9 aa, Homo Sapiens
EKIAGSLGI

SEQ ID NO: 1141674 - protein, 9 aa, Homo Sapiens
KFVDTDKER

SEQ ID NO: 1141675 - protein, 9 aa, Homo Sapiens
VCENIITYD

SEQ ID NO: 1141676 - protein, 9 aa, Homo Sapiens
VCGADVAAA

SEQ ID NO: 1141677 - protein, 9 aa, Homo Sapiens
PLGPGRSIS

SEQ ID NO: 1141678 - protein, 9 aa, Homo Sapiens
AGVQPPLPS

SEQ ID NO: 1141679 - protein, 9 aa, Homo Sapiens
ASILFMIVL

SEQ ID NO: 1141680 - protein, 9 aa, Homo Sapiens
SAMNLMTVT

SEQ ID NO: 1141681 - protein, 9 aa, Homo Sapiens
LKMNGDGTV

SEQ ID NO: 1141682 - protein, 9 aa, Homo Sapiens
QKHTSSGSI

SEQ ID NO: 1141683 - protein, 9 aa, Homo Sapiens
VAALWSGDK

SEQ ID NO: 1141684 - protein, 9 aa, Homo Sapiens
RELKPVEAV

SEQ ID NO: 1141685 - protein, 9 aa, Homo Sapiens
CSAGKRGGF

SEQ ID NO: 1141686 - protein, 9 aa, Homo Sapiens
PGQAAGRGG

SEQ ID NO: 1141687 - protein, 9 aa, Homo Sapiens
DLCISIRQL

SEQ ID NO: 1141688 - protein, 9 aa, Homo Sapiens
MTLPAPTAC

SEQ ID NO: 1141689 - protein, 9 aa, Homo Sapiens
LTQKDLTTK

SEQ ID NO: 1141690 - protein, 9 aa, Homo Sapiens
GKKGQHIEQ

SEQ ID NO: 1141691 - protein, 9 aa, Homo Sapiens
WPTGTQDSP

SEQ ID NO: 1141692 - protein, 9 aa, Homo Sapiens
MGTGIRTRP

SEQ ID NO: 1141693 - protein, 9 aa, Homo Sapiens
SAVMSANAA

SEQ ID NO: 1141694 - protein, 9 aa, Homo Sapiens
ANELRHKHP

SEQ ID NO: 1141695 - protein, 9 aa, Homo Sapiens
AIMAITSIV

SEQ ID NO: 1141696 - protein, 9 aa, Homo Sapiens
DFSLQFILH

SEQ ID NO: 1141697 - protein, 9 aa, Homo Sapiens
CCLDPSMTE

SEQ ID NO: 1141698 - protein, 9 aa, Homo Sapiens
GLLFRHILN

SEQ ID NO: 1141699 - protein, 9 aa, Homo Sapiens
NEEGSEDEE

SEQ ID NO: 1141700 - protein, 9 aa, Homo Sapiens
KQKLMNTSE

SEQ ID NO: 1141701 - protein, 9 aa, Homo Sapiens
VYPTDANAD

SEQ ID NO: 1141702 - protein, 9 aa, Homo Sapiens
ADKKLSRPF

SEQ ID NO: 1141703 - protein, 9 aa, Homo Sapiens
SFMGFAAPS

SEQ ID NO: 1141704 - protein, 9 aa, Homo Sapiens
NHRWHWSSG

SEQ ID NO: 1141705 - protein, 9 aa, Homo Sapiens
HTLSEVELL

SEQ ID NO: 1141706 - protein, 9 aa, Homo Sapiens
DLIKVSDDL

SEQ ID NO: 1141707 - protein, 9 aa, Homo Sapiens
KQLVQKAIL

SEQ ID NO: 1141708 - protein, 9 aa, Homo Sapiens
RLAHQQGLQ

SEQ ID NO: 1141709 - protein, 9 aa, Homo Sapiens
GNLVNKPDE

SEQ ID NO: 1141710 - protein, 9 aa, Homo Sapiens
VEIEFISVK

SEQ ID NO: 1141711 - protein, 9 aa, Homo Sapiens
LHRCQQEGQ

SEQ ID NO: 1141712 - protein, 9 aa, Homo Sapiens
TLQDMEKKP

SEQ ID NO: 1141713 - protein, 9 aa, Homo Sapiens
GISAMNLMT

SEQ ID NO: 1141714 - protein, 9 aa, Homo Sapiens
TTQLLHILE

SEQ ID NO: 1141715 - protein, 9 aa, Homo Sapiens
KYRPRAACG

SEQ ID NO: 1141716 - protein, 9 aa, Homo Sapiens
PKGGEGAEC

SEQ ID NO: 1141717 - protein, 9 aa, Homo Sapiens
TLGRSHWSP

SEQ ID NO: 1141718 - protein, 9 aa, Homo Sapiens
QKKNRKKLS

SEQ ID NO: 1141719 - protein, 9 aa, Homo Sapiens
PSSCWPVLL

SEQ ID NO: 1141720 - protein, 9 aa, Homo Sapiens
DGGITAIVE

SEQ ID NO: 1141721 - protein, 9 aa, Homo Sapiens
SKLPVHVYR

SEQ ID NO: 1141722 - protein, 9 aa, Homo Sapiens
CCAMASSTW

SEQ ID NO: 1141723 - protein, 9 aa, Homo Sapiens
LHQPPPPAL

SEQ ID NO: 1141724 - protein, 9 aa, Homo Sapiens
VAAAATEEE

SEQ ID NO: 1141725 - protein, 9 aa, Homo Sapiens
WVGMRRLCR

SEQ ID NO: 1141726 - protein, 9 aa, Homo Sapiens
INLMVLDSP

SEQ ID NO: 1141727 - protein, 9 aa, Homo Sapiens
AASPAPTSS

SEQ ID NO: 1141728 - protein, 9 aa, Homo Sapiens
YNMANGTVI

SEQ ID NO: 1141729 - protein, 9 aa, Homo Sapiens
TLATSYSSE

SEQ ID NO: 1141730 - protein, 9 aa, Homo Sapiens
ARHGRSLPR

SEQ ID NO: 1141731 - protein, 9 aa, Homo Sapiens
MLMSKMNKN

SEQ ID NO: 1141732 - protein, 9 aa, Homo Sapiens
GEVWRGCRG

SEQ ID NO: 1141733 - protein, 9 aa, Homo Sapiens
SLAPGYSAQ

SEQ ID NO: 1141734 - protein, 9 aa, Homo Sapiens
VLVAMRKAA

SEQ ID NO: 1141735 - protein, 9 aa, Homo Sapiens
LNISESLHI

SEQ ID NO: 1141736 - protein, 9 aa, Homo Sapiens
PGRRPPKGA

SEQ ID NO: 1141737 - protein, 9 aa, Homo Sapiens
SLGNMYHLP

SEQ ID NO: 1141738 - protein, 9 aa, Homo Sapiens
SGRLLGASS

SEQ ID NO: 1141739 - protein, 9 aa, Homo Sapiens
PLRPEAPCS

SEQ ID NO: 1141740 - protein, 9 aa, Homo Sapiens
RPTVAFLPP

SEQ ID NO: 1141741 - protein, 9 aa, Homo Sapiens
TPTKPFRLH

SEQ ID NO: 1141742 - protein, 9 aa, Homo Sapiens
PSRARGPAP

SEQ ID NO: 1141743 - protein, 9 aa, Homo Sapiens
GLDEVVSEL

SEQ ID NO: 1141744 - protein, 9 aa, Homo Sapiens
QVAMCTPPL

SEQ ID NO: 1141745 - protein, 9 aa, Homo Sapiens
TAAQKVVTS

SEQ ID NO: 1141746 - protein, 9 aa, Homo Sapiens
VPPQLPQAG

SEQ ID NO: 1141747 - protein, 9 aa, Homo Sapiens
KSHPKGTAS

SEQ ID NO: 1141748 - protein, 9 aa, Homo Sapiens
AGPLALASG

SEQ ID NO: 1141749 - protein, 9 aa, Homo Sapiens
QGSFFTGIP

SEQ ID NO: 1141750 - protein, 9 aa, Homo Sapiens
GRPRPCGGK

SEQ ID NO: 1141751 - protein, 9 aa, Homo Sapiens
AALSPAVPI

SEQ ID NO: 1141752 - protein, 9 aa, Homo Sapiens
LPPPTLLGR

SEQ ID NO: 1141753 - protein, 9 aa, Homo Sapiens
KREPVVVVA

SEQ ID NO: 1141754 - protein, 9 aa, Homo Sapiens
CQYECKNTF

SEQ ID NO: 1141755 - protein, 9 aa, Homo Sapiens
ERDFFREVK

SEQ ID NO: 1141756 - protein, 9 aa, Homo Sapiens
IPEPGLRSM

SEQ ID NO: 1141757 - protein, 9 aa, Homo Sapiens
RKRRRSGRR

SEQ ID NO: 1141758 - protein, 9 aa, Homo Sapiens
ISHDGSHQD

SEQ ID NO: 1141759 - protein, 9 aa, Homo Sapiens
LQEAYCQHL

SEQ ID NO: 1141760 - protein, 9 aa, Homo Sapiens
TTSTLVFYI

SEQ ID NO: 1141761 - protein, 9 aa, Homo Sapiens
KYAELDHED

SEQ ID NO: 1141762 - protein, 9 aa, Homo Sapiens
RLTVLWEDQ

SEQ ID NO: 1141763 - protein, 9 aa, Homo Sapiens
LEDTSHRMT

SEQ ID NO: 1141764 - protein, 9 aa, Homo Sapiens
NHTVQLQLH

SEQ ID NO: 1141765 - protein, 9 aa, Homo Sapiens
ARGRVNNIT

SEQ ID NO: 1141766 - protein, 9 aa, Homo Sapiens
INKSGELLV

SEQ ID NO: 1141767 - protein, 9 aa, Homo Sapiens
VCPVCQVPI

SEQ ID NO: 1141768 - protein, 9 aa, Homo Sapiens
RKVTELRQA

SEQ ID NO: 1141769 - protein, 9 aa, Homo Sapiens
RPSHKDAVL

SEQ ID NO: 1141770 - protein, 9 aa, Homo Sapiens
SYPPARQPS

SEQ ID NO: 1141771 - protein, 9 aa, Homo Sapiens
LVKETGLFR

SEQ ID NO: 1141772 - protein, 9 aa, Homo Sapiens
GLNSLQNYT

SEQ ID NO: 1141773 - protein, 9 aa, Homo Sapiens
GGNLVNKPD

SEQ ID NO: 1141774 - protein, 9 aa, Homo Sapiens
TYDEEEEEG

SEQ ID NO: 1141775 - protein, 9 aa, Homo Sapiens
ELAKKQKFR

SEQ ID NO: 1141776 - protein, 9 aa, Homo Sapiens
TDRAFQGAT

SEQ ID NO: 1141777 - protein, 9 aa, Homo Sapiens
CPRRPLRRL

SEQ ID NO: 1141778 - protein, 9 aa, Homo Sapiens
LYACQNPTI

SEQ ID NO: 1141779 - protein, 9 aa, Homo Sapiens
CPFRDVPSH

SEQ ID NO: 1141780 - protein, 9 aa, Homo Sapiens
CKTHTCQVI

SEQ ID NO: 1141781 - protein, 9 aa, Homo Sapiens
TPVILAVSL

SEQ ID NO: 1141782 - protein, 9 aa, Homo Sapiens
GTSTSFGSG

SEQ ID NO: 1141783 - protein, 9 aa, Homo Sapiens
INDHFYNHK

SEQ ID NO: 1141784 - protein, 9 aa, Homo Sapiens
HPLGDTPQP

SEQ ID NO: 1141785 - protein, 9 aa, Homo Sapiens
RDPPRPTSG

SEQ ID NO: 1141786 - protein, 9 aa, Homo Sapiens
NELTMDDVT

SEQ ID NO: 1141787 - protein, 9 aa, Homo Sapiens
EEHYAEQLK

SEQ ID NO: 1141788 - protein, 9 aa, Homo Sapiens
QLHSSLISG

SEQ ID NO: 1141789 - protein, 9 aa, Homo Sapiens
SATVQDSIA

SEQ ID NO: 1141790 - protein, 9 aa, Homo Sapiens
MNARDAKEK

SEQ ID NO: 1141791 - protein, 9 aa, Homo Sapiens
GPQGAFSEK

SEQ ID NO: 1141792 - protein, 9 aa, Homo Sapiens
SHRPCLSGP

SEQ ID NO: 1141793 - protein, 9 aa, Homo Sapiens
EPAGVTPIS

SEQ ID NO: 1141794 - protein, 9 aa, Homo Sapiens
APTQAKSPS

SEQ ID NO: 1141795 - protein, 9 aa, Homo Sapiens
HHGGNEAWK

SEQ ID NO: 1141796 - protein, 9 aa, Homo Sapiens
ANRDTPPSK

SEQ ID NO: 1141797 - protein, 9 aa, Homo Sapiens
GAAGALVYD

SEQ ID NO: 1141798 - protein, 9 aa, Homo Sapiens
QDPIEAPPP

SEQ ID NO: 1141799 - protein, 9 aa, Homo Sapiens
TLMMSNGCW

SEQ ID NO: 1141800 - protein, 9 aa, Homo Sapiens
VMLENINHL

SEQ ID NO: 1141801 - protein, 9 aa, Homo Sapiens
VFEEEDVCE

SEQ ID NO: 1141802 - protein, 9 aa, Homo Sapiens
KENRSSEGT

SEQ ID NO: 1141803 - protein, 9 aa, Homo Sapiens
SPPSMRCVH

SEQ ID NO: 1141804 - protein, 9 aa, Homo Sapiens
SANSLRVCR

SEQ ID NO: 1141805 - protein, 9 aa, Homo Sapiens
PLAAVVYSL

SEQ ID NO: 1141806 - protein, 9 aa, Homo Sapiens
LGERRRRTP

SEQ ID NO: 1141807 - protein, 9 aa, Homo Sapiens
VHSCWTKAL

SEQ ID NO: 1141808 - protein, 9 aa, Homo Sapiens
HWNGKKMLS

SEQ ID NO: 1141809 - protein, 9 aa, Homo Sapiens
SSGNSLTER

SEQ ID NO: 1141810 - protein, 9 aa, Homo Sapiens
DPLFPSTDD

SEQ ID NO: 1141811 - protein, 9 aa, Homo Sapiens
FSRKSSTRN

SEQ ID NO: 1141812 - protein, 9 aa, Homo Sapiens
ASPGRRDPQ

SEQ ID NO: 1141813 - protein, 9 aa, Homo Sapiens
VALLEVSLR

SEQ ID NO: 1141814 - protein, 9 aa, Homo Sapiens
HILLLHQQA

SEQ ID NO: 1141815 - protein, 9 aa, Homo Sapiens
KLYTGLYHI

SEQ ID NO: 1141816 - protein, 9 aa, Homo Sapiens
TNCMTVVQA

SEQ ID NO: 1141817 - protein, 9 aa, Homo Sapiens
LAAVECLGR

SEQ ID NO: 1141818 - protein, 9 aa, Homo Sapiens
GSGHCPHEG

SEQ ID NO: 1141819 - protein, 9 aa, Homo Sapiens
AVPMPWGPL

SEQ ID NO: 1141820 - protein, 9 aa, Homo Sapiens
RAKLEYMEE

SEQ ID NO: 1141821 - protein, 9 aa, Homo Sapiens
DEEEEEAED

SEQ ID NO: 1141822 - protein, 9 aa, Homo Sapiens
KLGSDLPGL

SEQ ID NO: 1141823 - protein, 9 aa, Homo Sapiens
RCARSPSLC

SEQ ID NO: 1141824 - protein, 9 aa, Homo Sapiens
LFEVELVSQ

SEQ ID NO: 1141825 - protein, 9 aa, Homo Sapiens
WLYQRMYSI

SEQ ID NO: 1141826 - protein, 9 aa, Homo Sapiens
FYTPATPGN

SEQ ID NO: 1141827 - protein, 9 aa, Homo Sapiens
SGLVHQGDV

SEQ ID NO: 1141828 - protein, 9 aa, Homo Sapiens
RMWWQILLF

SEQ ID NO: 1141829 - protein, 9 aa, Homo Sapiens
LLLLPPPTL

SEQ ID NO: 1141830 - protein, 9 aa, Homo Sapiens
AKKPCRTST

SEQ ID NO: 1141831 - protein, 9 aa, Homo Sapiens
ARSDELTRY

SEQ ID NO: 1141832 - protein, 9 aa, Homo Sapiens
FYTNVYIDP

SEQ ID NO: 1141833 - protein, 9 aa, Homo Sapiens
CLLYTLNLL

SEQ ID NO: 1141834 - protein, 9 aa, Homo Sapiens
CGGPRILLL

SEQ ID NO: 1141835 - protein, 9 aa, Homo Sapiens
SSSGTSRAA

SEQ ID NO: 1141836 - protein, 9 aa, Homo Sapiens
EKLILSEKL

SEQ ID NO: 1141837 - protein, 9 aa, Homo Sapiens
CQIVMAAYP

SEQ ID NO: 1141838 - protein, 9 aa, Homo Sapiens
ASDDEFIIK

SEQ ID NO: 1141839 - protein, 9 aa, Homo Sapiens
QPLWESVDL

SEQ ID NO: 1141840 - protein, 9 aa, Homo Sapiens
HSEDDEDVG

SEQ ID NO: 1141841 - protein, 9 aa, Homo Sapiens
RTTCHSILS

SEQ ID NO: 1141842 - protein, 9 aa, Homo Sapiens
GPSEYVANS

SEQ ID NO: 1141843 - protein, 9 aa, Homo Sapiens
PKGAGRARR

SEQ ID NO: 1141844 - protein, 9 aa, Homo Sapiens
FPSLSRSPA

SEQ ID NO: 1141845 - protein, 9 aa, Homo Sapiens
IVSKRHHEI

SEQ ID NO: 1141846 - protein, 9 aa, Homo Sapiens
RLLEETLAL

SEQ ID NO: 1141847 - protein, 9 aa, Homo Sapiens
RFHVTLDSA

SEQ ID NO: 1141848 - protein, 9 aa, Homo Sapiens
LVVIGVWQM

SEQ ID NO: 1141849 - protein, 9 aa, Homo Sapiens
HITQNLFII

SEQ ID NO: 1141850 - protein, 9 aa, Homo Sapiens
SWEWQRQAS

SEQ ID NO: 1141851 - protein, 9 aa, Homo Sapiens
ATDTTILSG

SEQ ID NO: 1141852 - protein, 9 aa, Homo Sapiens
HTARPPLRP

SEQ ID NO: 1141853 - protein, 9 aa, Homo Sapiens
PLITSYQPF

SEQ ID NO: 1141854 - protein, 9 aa, Homo Sapiens
EPAATPVVT

SEQ ID NO: 1141855 - protein, 9 aa, Homo Sapiens
ANVIKNPQF

SEQ ID NO: 1141856 - protein, 9 aa, Homo Sapiens
YFCRYCNEL

SEQ ID NO: 1141857 - protein, 9 aa, Homo Sapiens
EMEIAKKGL

SEQ ID NO: 1141858 - protein, 9 aa, Homo Sapiens
NGPRGSGGE

SEQ ID NO: 1141859 - protein, 9 aa, Homo Sapiens
RKSETPRGP

SEQ ID NO: 1141860 - protein, 9 aa, Homo Sapiens
CILCLKQYV

SEQ ID NO: 1141861 - protein, 9 aa, Homo Sapiens
AVLDPSLAS

SEQ ID NO: 1141862 - protein, 9 aa, Homo Sapiens
VSPASEKSM

SEQ ID NO: 1141863 - protein, 9 aa, Homo Sapiens
SFIRSSDYI

SEQ ID NO: 1141864 - protein, 9 aa, Homo Sapiens
RLPRHCLHP

SEQ ID NO: 1141865 - protein, 9 aa, Homo Sapiens
VTAQGEKNS

SEQ ID NO: 1141866 - protein, 9 aa, Homo Sapiens
MSLGNSRHG

SEQ ID NO: 1141867 - protein, 9 aa, Homo Sapiens
FSFLIFLIV

SEQ ID NO: 1141868 - protein, 9 aa, Homo Sapiens
DVHHLIHLG

SEQ ID NO: 1141869 - protein, 9 aa, Homo Sapiens
AGAAGAGGQ

SEQ ID NO: 1141870 - protein, 9 aa, Homo Sapiens
GTACLLAEC

SEQ ID NO: 1141871 - protein, 9 aa, Homo Sapiens
GGLRLSRTS

SEQ ID NO: 1141872 - protein, 9 aa, Homo Sapiens
AGVLEGGLG

SEQ ID NO: 1141873 - protein, 9 aa, Homo Sapiens
HPQGSFFTG

SEQ ID NO: 1141874 - protein, 9 aa, Homo Sapiens
IIQRLTIHH

SEQ ID NO: 1141875 - protein, 9 aa, Homo Sapiens
YLMFILILL

SEQ ID NO: 1141876 - protein, 9 aa, Homo Sapiens
LILVVIGVW

SEQ ID NO: 1141877 - protein, 9 aa, Homo Sapiens
VLLLLLLVL

SEQ ID NO: 1141878 - protein, 9 aa, Homo Sapiens
PPFPSHLAS

SEQ ID NO: 1141879 - protein, 9 aa, Homo Sapiens
TGEKPFFCS

SEQ ID NO: 1141880 - protein, 9 aa, Homo Sapiens
LLGIHWQCG

SEQ ID NO: 1141881 - protein, 9 aa, Homo Sapiens
AGGGGAFID

SEQ ID NO: 1141882 - protein, 9 aa, Homo Sapiens
ELKSWIKHT

SEQ ID NO: 1141883 - protein, 9 aa, Homo Sapiens
TLAPLGNAH

SEQ ID NO: 1141884 - protein, 9 aa, Homo Sapiens
WSTVRYMIG

SEQ ID NO: 1141885 - protein, 9 aa, Homo Sapiens
GKMANFSFG

SEQ ID NO: 1141886 - protein, 9 aa, Homo Sapiens
SLSVISCFW

SEQ ID NO: 1141887 - protein, 9 aa, Homo Sapiens
AQVSELERR

SEQ ID NO: 1141888 - protein, 9 aa, Homo Sapiens
AVWLLDVGI

SEQ ID NO: 1141889 - protein, 9 aa, Homo Sapiens
TVCDLAPRA

SEQ ID NO: 1141890 - protein, 9 aa, Homo Sapiens
NQTKKRKKW

SEQ ID NO: 1141891 - protein, 9 aa, Homo Sapiens
YLLKNQWFA

SEQ ID NO: 1141892 - protein, 9 aa, Homo Sapiens
EAAYALLLY

SEQ ID NO: 1141893 - protein, 9 aa, Homo Sapiens
DREVQWALG

SEQ ID NO: 1141894 - protein, 9 aa, Homo Sapiens
EGHIKAFST

SEQ ID NO: 1141895 - protein, 9 aa, Homo Sapiens
KSCDFYHTC

SEQ ID NO: 1141896 - protein, 9 aa, Homo Sapiens
LAGRGLPSP

SEQ ID NO: 1141897 - protein, 9 aa, Homo Sapiens
CSHGAGPAH

SEQ ID NO: 1141898 - protein, 9 aa, Homo Sapiens
CELCTEDFD

SEQ ID NO: 1141899 - protein, 9 aa, Homo Sapiens
GACSKVKSS

SEQ ID NO: 1141900 - protein, 9 aa, Homo Sapiens
SQDDHHLEV

SEQ ID NO: 1141901 - protein, 9 aa, Homo Sapiens
HRWQGHHSL

SEQ ID NO: 1141902 - protein, 9 aa, Homo Sapiens
LLILQHITQ

SEQ ID NO: 1141903 - protein, 9 aa, Homo Sapiens
RVHHTVPEP

SEQ ID NO: 1141904 - protein, 9 aa, Homo Sapiens
SVSPASEKS

SEQ ID NO: 1141905 - protein, 9 aa, Homo Sapiens
ALRRLRGGQ

SEQ ID NO: 1141906 - protein, 9 aa, Homo Sapiens
WCRTGASTR

SEQ ID NO: 1141907 - protein, 9 aa, Homo Sapiens
KRARTRHQK

SEQ ID NO: 1141908 - protein, 9 aa, Homo Sapiens
QLLTSVPSL

SEQ ID NO: 1141909 - protein, 9 aa, Homo Sapiens
CSTITLCLH

SEQ ID NO: 1141910 - protein, 9 aa, Homo Sapiens
TEFCNGTSS

SEQ ID NO: 1141911 - protein, 9 aa, Homo Sapiens
LVYLAGLLS

SEQ ID NO: 1141912 - protein, 9 aa, Homo Sapiens
DGCHDPRDD

SEQ ID NO: 1141913 - protein, 9 aa, Homo Sapiens
GSEVGRRRR

SEQ ID NO: 1141914 - protein, 9 aa, Homo Sapiens
YRIYRCAHP

SEQ ID NO: 1141915 - protein, 9 aa, Homo Sapiens
LRFVSSKHW

SEQ ID NO: 1141916 - protein, 9 aa, Homo Sapiens
DEDTAQIVP

SEQ ID NO: 1141917 - protein, 9 aa, Homo Sapiens
GSFQRRGRR

SEQ ID NO: 1141918 - protein, 9 aa, Homo Sapiens
LHTLLSALA

SEQ ID NO: 1141919 - protein, 9 aa, Homo Sapiens
CLSMSGLTS

SEQ ID NO: 1141920 - protein, 9 aa, Homo Sapiens
FINVPVEAV

SEQ ID NO: 1141921 - protein, 9 aa, Homo Sapiens
MWALSDMAV

SEQ ID NO: 1141922 - protein, 9 aa, Homo Sapiens
KRSCSASVS

SEQ ID NO: 1141923 - protein, 9 aa, Homo Sapiens
EAGHFKTWE

SEQ ID NO: 1141924 - protein, 9 aa, Homo Sapiens
LVTFGIFCY

SEQ ID NO: 1141925 - protein, 9 aa, Homo Sapiens
VCVNHWITT

SEQ ID NO: 1141926 - protein, 9 aa, Homo Sapiens
PGWWALQAS

SEQ ID NO: 1141927 - protein, 9 aa, Homo Sapiens
MDSETVKMA

SEQ ID NO: 1141928 - protein, 9 aa, Homo Sapiens
TVHLPFIEI

SEQ ID NO: 1141929 - protein, 9 aa, Homo Sapiens
PLLNRPCKA

SEQ ID NO: 1141930 - protein, 9 aa, Homo Sapiens
LEDLEEEDE

SEQ ID NO: 1141931 - protein, 9 aa, Homo Sapiens
VLATYVFLV

SEQ ID NO: 1141932 - protein, 9 aa, Homo Sapiens
TPGRPARPG

SEQ ID NO: 1141933 - protein, 9 aa, Homo Sapiens
KDLEYAHTF

SEQ ID NO: 1141934 - protein, 9 aa, Homo Sapiens
IVTELYFAG

SEQ ID NO: 1141935 - protein, 9 aa, Homo Sapiens
VGTSSPSLP

SEQ ID NO: 1141936 - protein, 9 aa, Homo Sapiens
TATWAPRRT

SEQ ID NO: 1141937 - protein, 9 aa, Homo Sapiens
LNTPHIIMH

SEQ ID NO: 1141938 - protein, 9 aa, Homo Sapiens
KMEYCFEVF

SEQ ID NO: 1141939 - protein, 9 aa, Homo Sapiens
AMVGEDVSS

SEQ ID NO: 1141940 - protein, 9 aa, Homo Sapiens
SFCTADILH

SEQ ID NO: 1141941 - protein, 9 aa, Homo Sapiens
VSRNTLFTR

SEQ ID NO: 1141942 - protein, 9 aa, Homo Sapiens
DTVLNRPPR

SEQ ID NO: 1141943 - protein, 9 aa, Homo Sapiens
KVNGTHVNV

SEQ ID NO: 1141944 - protein, 9 aa, Homo Sapiens
QDLKTKSII

SEQ ID NO: 1141945 - protein, 9 aa, Homo Sapiens
VPRATTKTL

SEQ ID NO: 1141946 - protein, 9 aa, Homo Sapiens
LPIFPQLGV

SEQ ID NO: 1141947 - protein, 9 aa, Homo Sapiens
CIFGVEEMA

SEQ ID NO: 1141948 - protein, 9 aa, Homo Sapiens
ALPGWIYTL

SEQ ID NO: 1141949 - protein, 9 aa, Homo Sapiens
AISSRHQTD

SEQ ID NO: 1141950 - protein, 9 aa, Homo Sapiens
AEEWPVPWA

SEQ ID NO: 1141951 - protein, 9 aa, Homo Sapiens
RTAQSPAGP

SEQ ID NO: 1141952 - protein, 9 aa, Homo Sapiens
SQRPISFVD

SEQ ID NO: 1141953 - protein, 9 aa, Homo Sapiens
GILSTFPAE

SEQ ID NO: 1141954 - protein, 9 aa, Homo Sapiens
WLRSCLERW

SEQ ID NO: 1141955 - protein, 9 aa, Homo Sapiens
NDDSPDLDL

SEQ ID NO: 1141956 - protein, 9 aa, Homo Sapiens
MGKTKPEIL

SEQ ID NO: 1141957 - protein, 9 aa, Homo Sapiens
TLTILKKYM

SEQ ID NO: 1141958 - protein, 9 aa, Homo Sapiens
NSIHVIQQG

SEQ ID NO: 1141959 - protein, 9 aa, Homo Sapiens
AATPPRAAA

SEQ ID NO: 1141960 - protein, 9 aa, Homo Sapiens
SWTPAPRYP

SEQ ID NO: 1141961 - protein, 9 aa, Homo Sapiens
VWTAATLRC

SEQ ID NO: 1141962 - protein, 9 aa, Homo Sapiens
SWRTLLRTN

SEQ ID NO: 1141963 - protein, 9 aa, Homo Sapiens
SSRPLSSWT

SEQ ID NO: 1141964 - protein, 9 aa, Homo Sapiens
IYIFCLHYG

SEQ ID NO: 1141965 - protein, 9 aa, Homo Sapiens
SWAESPEKD

SEQ ID NO: 1141966 - protein, 9 aa, Homo Sapiens
SRGSRGGAV

SEQ ID NO: 1141967 - protein, 9 aa, Homo Sapiens
DLERSLKDV

SEQ ID NO: 1141968 - protein, 9 aa, Homo Sapiens
PMAEEEASA

SEQ ID NO: 1141969 - protein, 9 aa, Homo Sapiens
LQATDDILR

SEQ ID NO: 1141970 - protein, 9 aa, Homo Sapiens
HSGERPYKG

SEQ ID NO: 1141971 - protein, 9 aa, Homo Sapiens
SSPSLPHSR

SEQ ID NO: 1141972 - protein, 9 aa, Homo Sapiens
ILGNEETKE

SEQ ID NO: 1141973 - protein, 9 aa, Homo Sapiens
SIPKKSYAL

SEQ ID NO: 1141974 - protein, 9 aa, Homo Sapiens
ELDETDEDK

SEQ ID NO: 1141975 - protein, 9 aa, Homo Sapiens
PETNKNITW

SEQ ID NO: 1141976 - protein, 9 aa, Homo Sapiens
SNRYSIDRS

SEQ ID NO: 1141977 - protein, 9 aa, Homo Sapiens
DGKKLKCGI

SEQ ID NO: 1141978 - protein, 9 aa, Homo Sapiens
LIIQRLTIH

SEQ ID NO: 1141979 - protein, 9 aa, Homo Sapiens
SCQQIASTT

SEQ ID NO: 1141980 - protein, 9 aa, Homo Sapiens
MSAAAMGGG

SEQ ID NO: 1141981 - protein, 9 aa, Homo Sapiens
STSSPEELH

SEQ ID NO: 1141982 - protein, 9 aa, Homo Sapiens
TPGLCPECS

SEQ ID NO: 1141983 - protein, 9 aa, Homo Sapiens
ILDMRGLKR

SEQ ID NO: 1141984 - protein, 9 aa, Homo Sapiens
INGKVFDAT

SEQ ID NO: 1141985 - protein, 9 aa, Homo Sapiens
NAAVASSSM

SEQ ID NO: 1141986 - protein, 9 aa, Homo Sapiens
FVHNENQHL

SEQ ID NO: 1141987 - protein, 9 aa, Homo Sapiens
ACHFPAILS

SEQ ID NO: 1141988 - protein, 9 aa, Homo Sapiens
RVCTLSTAG

SEQ ID NO: 1141989 - protein, 9 aa, Homo Sapiens
TTNCMTVVQ

SEQ ID NO: 1141990 - protein, 9 aa, Homo Sapiens
DQSGPLAAN

SEQ ID NO: 1141991 - protein, 9 aa, Homo Sapiens
WSPPGQVGF

SEQ ID NO: 1141992 - protein, 9 aa, Homo Sapiens
QAAPLLLRI

SEQ ID NO: 1141993 - protein, 9 aa, Homo Sapiens
GRHRGTGPA

SEQ ID NO: 1141994 - protein, 9 aa, Homo Sapiens
NRQRVRYDS

SEQ ID NO: 1141995 - protein, 9 aa, Homo Sapiens
AERIETIKA

SEQ ID NO: 1141996 - protein, 9 aa, Homo Sapiens
NPQVVPAAL

SEQ ID NO: 1141997 - protein, 9 aa, Homo Sapiens
KEGIPAPDN

SEQ ID NO: 1141998 - protein, 9 aa, Homo Sapiens
SQAQVSELE

SEQ ID NO: 1141999 - protein, 9 aa, Homo Sapiens
LSESVNAKE

SEQ ID NO: 1142000 - protein, 9 aa, Homo Sapiens
ASVSAAATT

SEQ ID NO: 1142001 - protein, 9 aa, Homo Sapiens
IIKKTSDIT

SEQ ID NO: 1142002 - protein, 9 aa, Homo Sapiens
NGSSAWRPP

SEQ ID NO: 1142003 - protein, 9 aa, Homo Sapiens
LQVQGKFQK

SEQ ID NO: 1142004 - protein, 9 aa, Homo Sapiens
RGISTCGPT

SEQ ID NO: 1142005 - protein, 9 aa, Homo Sapiens
NDISVDDQW

SEQ ID NO: 1142006 - protein, 9 aa, Homo Sapiens
LSTVHQVWV

SEQ ID NO: 1142007 - protein, 9 aa, Homo Sapiens
SCGVAHAGW

SEQ ID NO: 1142008 - protein, 9 aa, Homo Sapiens
NAGKERAAV

SEQ ID NO: 1142009 - protein, 9 aa, Homo Sapiens
YLLLTGETV

SEQ ID NO: 1142010 - protein, 9 aa, Homo Sapiens
VEAGPAGEL

SEQ ID NO: 1142011 - protein, 9 aa, Homo Sapiens
RANTVFSPD

SEQ ID NO: 1142012 - protein, 9 aa, Homo Sapiens
QDDTLLIQK

SEQ ID NO: 1142013 - protein, 9 aa, Homo Sapiens
PCRRGAPSG

SEQ ID NO: 1142014 - protein, 9 aa, Homo Sapiens
ILGVFSKVR

SEQ ID NO: 1142015 - protein, 9 aa, Homo Sapiens
SLKRDIDDM

SEQ ID NO: 1142016 - protein, 9 aa, Homo Sapiens
PSCSAWTVS

SEQ ID NO: 1142017 - protein, 9 aa, Homo Sapiens
CSLYTEGST

SEQ ID NO: 1142018 - protein, 9 aa, Homo Sapiens
ASEDAQQPA

SEQ ID NO: 1142019 - protein, 9 aa, Homo Sapiens
SKGALVQTK

SEQ ID NO: 1142020 - protein, 9 aa, Homo Sapiens
TSFPVALPL

SEQ ID NO: 1142021 - protein, 9 aa, Homo Sapiens
RKLQRCDLS

SEQ ID NO: 1142022 - protein, 9 aa, Homo Sapiens
GALVYDITS

SEQ ID NO: 1142023 - protein, 9 aa, Homo Sapiens
ERQITVTGT

SEQ ID NO: 1142024 - protein, 9 aa, Homo Sapiens
FQCHLLAIA

SEQ ID NO: 1142025 - protein, 9 aa, Homo Sapiens
PASPQPFCG

SEQ ID NO: 1142026 - protein, 9 aa, Homo Sapiens
HSCFQTKVV

SEQ ID NO: 1142027 - protein, 9 aa, Homo Sapiens
LQGPVGPLG

SEQ ID NO: 1142028 - protein, 9 aa, Homo Sapiens
GSTPGSGPS

SEQ ID NO: 1142029 - protein, 9 aa, Homo Sapiens
VDLFGRVCT

SEQ ID NO: 1142030 - protein, 9 aa, Homo Sapiens
NVEDDAETK

SEQ ID NO: 1142031 - protein, 9 aa, Homo Sapiens
AGRRPLPRP

SEQ ID NO: 1142032 - protein, 9 aa, Homo Sapiens
LRGQGGKQT

SEQ ID NO: 1142033 - protein, 9 aa, Homo Sapiens
PPPPIPQRP

SEQ ID NO: 1142034 - protein, 9 aa, Homo Sapiens
SDVGYGRSV

SEQ ID NO: 1142035 - protein, 9 aa, Homo Sapiens
RSPQKRVRS

SEQ ID NO: 1142036 - protein, 9 aa, Homo Sapiens
APWSERVPR

SEQ ID NO: 1142037 - protein, 9 aa, Homo Sapiens
GPGRRSQHR

SEQ ID NO: 1142038 - protein, 9 aa, Homo Sapiens
SPSAPTSRR

SEQ ID NO: 1142039 - protein, 9 aa, Homo Sapiens
GGRRNKHQG

SEQ ID NO: 1142040 - protein, 9 aa, Homo Sapiens
PKAAPPPLP

SEQ ID NO: 1142041 - protein, 9 aa, Homo Sapiens
LLQPPQALP

SEQ ID NO: 1142042 - protein, 9 aa, Homo Sapiens
PPTPLSSHG

SEQ ID NO: 1142043 - protein, 9 aa, Homo Sapiens
TPGNLVPVC

SEQ ID NO: 1142044 - protein, 9 aa, Homo Sapiens
HEKTLRGLA

SEQ ID NO: 1142045 - protein, 9 aa, Homo Sapiens
ELLALDSEA

SEQ ID NO: 1142046 - protein, 9 aa, Homo Sapiens
KRRRGQPPK

SEQ ID NO: 1142047 - protein, 9 aa, Homo Sapiens
EKSKRALER

SEQ ID NO: 1142048 - protein, 9 aa, Homo Sapiens
VQQISLEGA

SEQ ID NO: 1142049 - protein, 9 aa, Homo Sapiens
VEVLSCRSP

SEQ ID NO: 1142050 - protein, 9 aa, Homo Sapiens
PLPPWPASS

SEQ ID NO: 1142051 - protein, 9 aa, Homo Sapiens
EDTAQIVPK

SEQ ID NO: 1142052 - protein, 9 aa, Homo Sapiens
YQAARKDSD

SEQ ID NO: 1142053 - protein, 9 aa, Homo Sapiens
FQLQRIVST

SEQ ID NO: 1142054 - protein, 9 aa, Homo Sapiens
NSEVVMEMA

SEQ ID NO: 1142055 - protein, 9 aa, Homo Sapiens
VLHLVHQLH

SEQ ID NO: 1142056 - protein, 9 aa, Homo Sapiens
WQVYFTEEP

SEQ ID NO: 1142057 - protein, 9 aa, Homo Sapiens
PPERDWPQG

SEQ ID NO: 1142058 - protein, 9 aa, Homo Sapiens
TYVECTSAM

SEQ ID NO: 1142059 - protein, 9 aa, Homo Sapiens
PLVRSLALK

SEQ ID NO: 1142060 - protein, 9 aa, Homo Sapiens
LLSAERLQL

SEQ ID NO: 1142061 - protein, 9 aa, Homo Sapiens
AGKERAAVQ

SEQ ID NO: 1142062 - protein, 9 aa, Homo Sapiens
AVTFNKELD

SEQ ID NO: 1142063 - protein, 9 aa, Homo Sapiens
LPRRPPGPS

SEQ ID NO: 1142064 - protein, 9 aa, Homo Sapiens
TSAMMQALK

SEQ ID NO: 1142065 - protein, 9 aa, Homo Sapiens
IDFPVYNAN

SEQ ID NO: 1142066 - protein, 9 aa, Homo Sapiens
GYVGIGCEQ

SEQ ID NO: 1142067 - protein, 9 aa, Homo Sapiens
DTLLIQKAQ

SEQ ID NO: 1142068 - protein, 9 aa, Homo Sapiens
PVYSAPNVV

SEQ ID NO: 1142069 - protein, 9 aa, Homo Sapiens
IVFQLQRIV

SEQ ID NO: 1142070 - protein, 9 aa, Homo Sapiens
VSQMQHASG

SEQ ID NO: 1142071 - protein, 9 aa, Homo Sapiens
YFRFTSHGS

SEQ ID NO: 1142072 - protein, 9 aa, Homo Sapiens
PEHLLQPWL

SEQ ID NO: 1142073 - protein, 9 aa, Homo Sapiens
AAAPASVAT

SEQ ID NO: 1142074 - protein, 9 aa, Homo Sapiens
ALGEAEHIN

SEQ ID NO: 1142075 - protein, 9 aa, Homo Sapiens
VHQGDVGGQ

SEQ ID NO: 1142076 - protein, 9 aa, Homo Sapiens
WYALHGEVS

SEQ ID NO: 1142077 - protein, 9 aa, Homo Sapiens
VIKVDLCAD

SEQ ID NO: 1142078 - protein, 9 aa, Homo Sapiens
LQDFEKSKK

SEQ ID NO: 1142079 - protein, 9 aa, Homo Sapiens
EPGLRSMVS

SEQ ID NO: 1142080 - protein, 9 aa, Homo Sapiens
EPRLERLYC

SEQ ID NO: 1142081 - protein, 9 aa, Homo Sapiens
APRYPLKYL

SEQ ID NO: 1142082 - protein, 9 aa, Homo Sapiens
TDKAQEGTE

SEQ ID NO: 1142083 - protein, 9 aa, Homo Sapiens
SDAGRDGQE

SEQ ID NO: 1142084 - protein, 9 aa, Homo Sapiens
PQSASREDL

SEQ ID NO: 1142085 - protein, 9 aa, Homo Sapiens
GPVLLGFPV

SEQ ID NO: 1142086 - protein, 9 aa, Homo Sapiens
GPAPQGPVM

SEQ ID NO: 1142087 - protein, 9 aa, Homo Sapiens
HRVVQSTLE

SEQ ID NO: 1142088 - protein, 9 aa, Homo Sapiens
RKAMKQGFK

SEQ ID NO: 1142089 - protein, 9 aa, Homo Sapiens
VGHGVWVGA

SEQ ID NO: 1142090 - protein, 9 aa, Homo Sapiens
FTPFNESDF

SEQ ID NO: 1142091 - protein, 9 aa, Homo Sapiens
AHVLSLPIR

SEQ ID NO: 1142092 - protein, 9 aa, Homo Sapiens
RGEGEHKDI

SEQ ID NO: 1142093 - protein, 9 aa, Homo Sapiens
RERVRARVR

SEQ ID NO: 1142094 - protein, 9 aa, Homo Sapiens
KCITECVRT

SEQ ID NO: 1142095 - protein, 9 aa, Homo Sapiens
GPARIRSTR

SEQ ID NO: 1142096 - protein, 9 aa, Homo Sapiens
EELRSYMER

SEQ ID NO: 1142097 - protein, 9 aa, Homo Sapiens
AWLTILEAL

SEQ ID NO: 1142098 - protein, 9 aa, Homo Sapiens
RKDSDSPNP

SEQ ID NO: 1142099 - protein, 9 aa, Homo Sapiens
MDEAGRNIT

SEQ ID NO: 1142100 - protein, 9 aa, Homo Sapiens
LPAAPNMNS

SEQ ID NO: 1142101 - protein, 9 aa, Homo Sapiens
VCKLLVAGN

SEQ ID NO: 1142102 - protein, 9 aa, Homo Sapiens
KRVLSSTSE

SEQ ID NO: 1142103 - protein, 9 aa, Homo Sapiens
TEVRIYVAN

SEQ ID NO: 1142104 - protein, 9 aa, Homo Sapiens
KSENKQRKK

SEQ ID NO: 1142105 - protein, 9 aa, Homo Sapiens
DMMKKEKES

SEQ ID NO: 1142106 - protein, 9 aa, Homo Sapiens
AKYDVISVH

SEQ ID NO: 1142107 - protein, 9 aa, Homo Sapiens
HRKIGSDQE

SEQ ID NO: 1142108 - protein, 9 aa, Homo Sapiens
VQQKCLMKT

SEQ ID NO: 1142109 - protein, 9 aa, Homo Sapiens
CLNEASVLL

SEQ ID NO: 1142110 - protein, 9 aa, Homo Sapiens
AGATAQIQR

SEQ ID NO: 1142111 - protein, 9 aa, Homo Sapiens
LKKTSRILN

SEQ ID NO: 1142112 - protein, 9 aa, Homo Sapiens
GLPGNLRSL

SEQ ID NO: 1142113 - protein, 9 aa, Homo Sapiens
ARGWAQGGP

SEQ ID NO: 1142114 - protein, 9 aa, Homo Sapiens
KFPCGPWGA

SEQ ID NO: 1142115 - protein, 9 aa, Homo Sapiens
QVFLVVFLY

SEQ ID NO: 1142116 - protein, 9 aa, Homo Sapiens
DTLVGKGHF

SEQ ID NO: 1142117 - protein, 9 aa, Homo Sapiens
ESPTATEIQ

SEQ ID NO: 1142118 - protein, 9 aa, Homo Sapiens
SVSPYPSHS

SEQ ID NO: 1142119 - protein, 9 aa, Homo Sapiens
MMNWTHTAA

SEQ ID NO: 1142120 - protein, 9 aa, Homo Sapiens
QLALKHQLR

SEQ ID NO: 1142121 - protein, 9 aa, Homo Sapiens
YGKIEDMAM

SEQ ID NO: 1142122 - protein, 9 aa, Homo Sapiens
EKDTKEEIM

SEQ ID NO: 1142123 - protein, 9 aa, Homo Sapiens
QFNKGPRTG

SEQ ID NO: 1142124 - protein, 9 aa, Homo Sapiens
FSVCNTGSR

SEQ ID NO: 1142125 - protein, 9 aa, Homo Sapiens
SLAFSMDDM

SEQ ID NO: 1142126 - protein, 9 aa, Homo Sapiens
KLKNGRKFP

SEQ ID NO: 1142127 - protein, 9 aa, Homo Sapiens
TSERLTRSV

SEQ ID NO: 1142128 - protein, 9 aa, Homo Sapiens
IRSSDYIRH

SEQ ID NO: 1142129 - protein, 9 aa, Homo Sapiens
VLQQVSTAL

SEQ ID NO: 1142130 - protein, 9 aa, Homo Sapiens
QRTVLPGLD

SEQ ID NO: 1142131 - protein, 9 aa, Homo Sapiens
DHHLEVFPP

SEQ ID NO: 1142132 - protein, 9 aa, Homo Sapiens
GWRSPAAVV

SEQ ID NO: 1142133 - protein, 9 aa, Homo Sapiens
ITSFSCACA

SEQ ID NO: 1142134 - protein, 9 aa, Homo Sapiens
LNICRNSIH

SEQ ID NO: 1142135 - protein, 9 aa, Homo Sapiens
LTYIYPNIA

SEQ ID NO: 1142136 - protein, 9 aa, Homo Sapiens
PVGGAEGID

SEQ ID NO: 1142137 - protein, 9 aa, Homo Sapiens
LGPASVAPA

SEQ ID NO: 1142138 - protein, 9 aa, Homo Sapiens
LGCLYADLN

SEQ ID NO: 1142139 - protein, 9 aa, Homo Sapiens
SRILNLQVL

SEQ ID NO: 1142140 - protein, 9 aa, Homo Sapiens
QSPSWRSEC

SEQ ID NO: 1142141 - protein, 9 aa, Homo Sapiens
MYITTVLGN

SEQ ID NO: 1142142 - protein, 9 aa, Homo Sapiens
NAIRIGMYM

SEQ ID NO: 1142143 - protein, 9 aa, Homo Sapiens
WHVGADAEA

SEQ ID NO: 1142144 - protein, 9 aa, Homo Sapiens
GTPGTCLKP

SEQ ID NO: 1142145 - protein, 9 aa, Homo Sapiens
HGAGPAHPT

SEQ ID NO: 1142146 - protein, 9 aa, Homo Sapiens
WAPQTKGKG

SEQ ID NO: 1142147 - protein, 9 aa, Homo Sapiens
RRVPHPTMT

SEQ ID NO: 1142148 - protein, 9 aa, Homo Sapiens
SLDWQVYFT

SEQ ID NO: 1142149 - protein, 9 aa, Homo Sapiens
GGFGSHHHS

SEQ ID NO: 1142150 - protein, 9 aa, Homo Sapiens
TKPDRDNHV

SEQ ID NO: 1142151 - protein, 9 aa, Homo Sapiens
LPIRIYYYI

SEQ ID NO: 1142152 - protein, 9 aa, Homo Sapiens
QKKCKEYEK

SEQ ID NO: 1142153 - protein, 9 aa, Homo Sapiens
KAIPAVARM

SEQ ID NO: 1142154 - protein, 9 aa, Homo Sapiens
IEFISVKEA

SEQ ID NO: 1142155 - protein, 9 aa, Homo Sapiens
IPAARGGEN

SEQ ID NO: 1142156 - protein, 9 aa, Homo Sapiens
ELEQVHQKL

SEQ ID NO: 1142157 - protein, 9 aa, Homo Sapiens
SKAQKTGLG

SEQ ID NO: 1142158 - protein, 9 aa, Homo Sapiens
GPGPGPTVD

SEQ ID NO: 1142159 - protein, 9 aa, Homo Sapiens
GQAQDTSGH

SEQ ID NO: 1142160 - protein, 9 aa, Homo Sapiens
QVGLLPTLS

SEQ ID NO: 1142161 - protein, 9 aa, Homo Sapiens
ARLETYPDW

SEQ ID NO: 1142162 - protein, 9 aa, Homo Sapiens
LIGRLGEYS

SEQ ID NO: 1142163 - protein, 9 aa, Homo Sapiens
ATPLGYGAA

SEQ ID NO: 1142164 - protein, 9 aa, Homo Sapiens
LEMVKAVQL

SEQ ID NO: 1142165 - protein, 9 aa, Homo Sapiens
NLIGNNCNF

SEQ ID NO: 1142166 - protein, 9 aa, Homo Sapiens
LRFWANVIK

SEQ ID NO: 1142167 - protein, 9 aa, Homo Sapiens
RGSSFSRSR

SEQ ID NO: 1142168 - protein, 9 aa, Homo Sapiens
LVSKPEKVQ

SEQ ID NO: 1142169 - protein, 9 aa, Homo Sapiens
CMMSSHLHK

SEQ ID NO: 1142170 - protein, 9 aa, Homo Sapiens
SGSTPGSGP

SEQ ID NO: 1142171 - protein, 9 aa, Homo Sapiens
RKEALLLMS

SEQ ID NO: 1142172 - protein, 9 aa, Homo Sapiens
DCSLPENPL

SEQ ID NO: 1142173 - protein, 9 aa, Homo Sapiens
RTTPIEVLC

SEQ ID NO: 1142174 - protein, 9 aa, Homo Sapiens
DMAVLSVRP

SEQ ID NO: 1142175 - protein, 9 aa, Homo Sapiens
ELEEEERRA

SEQ ID NO: 1142176 - protein, 9 aa, Homo Sapiens
PERYSSSSG

SEQ ID NO: 1142177 - protein, 9 aa, Homo Sapiens
QIQRPIQVQ

SEQ ID NO: 1142178 - protein, 9 aa, Homo Sapiens
LEEQTCRAL

SEQ ID NO: 1142179 - protein, 9 aa, Homo Sapiens
LFQAGTSLV

SEQ ID NO: 1142180 - protein, 9 aa, Homo Sapiens
GFILERIPI

SEQ ID NO: 1142181 - protein, 9 aa, Homo Sapiens
VDGEKGTYS

SEQ ID NO: 1142182 - protein, 9 aa, Homo Sapiens
CPYHPGHHG

SEQ ID NO: 1142183 - protein, 9 aa, Homo Sapiens
LRSFRITTR

SEQ ID NO: 1142184 - protein, 9 aa, Homo Sapiens
NQSIRYPHN

SEQ ID NO: 1142185 - protein, 9 aa, Homo Sapiens
TVSGGTTSS

SEQ ID NO: 1142186 - protein, 9 aa, Homo Sapiens
QWCPDGSHL

SEQ ID NO: 1142187 - protein, 9 aa, Homo Sapiens
TLRLPCLLR

SEQ ID NO: 1142188 - protein, 9 aa, Homo Sapiens
LYSKVTPPE

SEQ ID NO: 1142189 - protein, 9 aa, Homo Sapiens
DVEASLQSD

SEQ ID NO: 1142190 - protein, 9 aa, Homo Sapiens
NHVNHFYCD

SEQ ID NO: 1142191 - protein, 9 aa, Homo Sapiens
QAILKDSTS

SEQ ID NO: 1142192 - protein, 9 aa, Homo Sapiens
PDTDLDSFL

SEQ ID NO: 1142193 - protein, 9 aa, Homo Sapiens
HCNLHLPCF

SEQ ID NO: 1142194 - protein, 9 aa, Homo Sapiens
AGHVHGIAP

SEQ ID NO: 1142195 - protein, 9 aa, Homo Sapiens
MCCTNATGL

SEQ ID NO: 1142196 - protein, 9 aa, Homo Sapiens
ISLPRSMDF

SEQ ID NO: 1142197 - protein, 9 aa, Homo Sapiens
TDAIFARRA

SEQ ID NO: 1142198 - protein, 9 aa, Homo Sapiens
LKICEEFKE

SEQ ID NO: 1142199 - protein, 9 aa, Homo Sapiens
FIQLHHSFV

SEQ ID NO: 1142200 - protein, 9 aa, Homo Sapiens
IAILSQGPR

SEQ ID NO: 1142201 - protein, 9 aa, Homo Sapiens
AVLDLICEG

SEQ ID NO: 1142202 - protein, 9 aa, Homo Sapiens
AGPAPQGPV

SEQ ID NO: 1142203 - protein, 9 aa, Homo Sapiens
PVKLGGHPL

SEQ ID NO: 1142204 - protein, 9 aa, Homo Sapiens
IFLSFLSFF

SEQ ID NO: 1142205 - protein, 9 aa, Homo Sapiens
LMRDLKPFR

SEQ ID NO: 1142206 - protein, 9 aa, Homo Sapiens
TRLLWKRSL

SEQ ID NO: 1142207 - protein, 9 aa, Homo Sapiens
GQERVPEII

SEQ ID NO: 1142208 - protein, 9 aa, Homo Sapiens
PSSVSGARG

SEQ ID NO: 1142209 - protein, 9 aa, Homo Sapiens
HHQAWIGAG

SEQ ID NO: 1142210 - protein, 9 aa, Homo Sapiens
AKKVQELQR

SEQ ID NO: 1142211 - protein, 9 aa, Homo Sapiens
IFRRGFRQL

SEQ ID NO: 1142212 - protein, 9 aa, Homo Sapiens
RDQERERER

SEQ ID NO: 1142213 - protein, 9 aa, Homo Sapiens
IYLYLFHND

SEQ ID NO: 1142214 - protein, 9 aa, Homo Sapiens
GPASSTSGP

SEQ ID NO: 1142215 - protein, 9 aa, Homo Sapiens
KEEGKPKKT

SEQ ID NO: 1142216 - protein, 9 aa, Homo Sapiens
TGMGRPPPQ

SEQ ID NO: 1142217 - protein, 9 aa, Homo Sapiens
SIFDGSALT

SEQ ID NO: 1142218 - protein, 9 aa, Homo Sapiens
TDDDRMVKS

SEQ ID NO: 1142219 - protein, 9 aa, Homo Sapiens
CGCVDDFGF

SEQ ID NO: 1142220 - protein, 9 aa, Homo Sapiens
GINTALCDC

SEQ ID NO: 1142221 - protein, 9 aa, Homo Sapiens
GASGPVEGR

SEQ ID NO: 1142222 - protein, 9 aa, Homo Sapiens
KVRQYLQER

SEQ ID NO: 1142223 - protein, 9 aa, Homo Sapiens
LMLCEFFGV

SEQ ID NO: 1142224 - protein, 9 aa, Homo Sapiens
GRLLLGLTI

SEQ ID NO: 1142225 - protein, 9 aa, Homo Sapiens
KVCVNHWIT

SEQ ID NO: 1142226 - protein, 9 aa, Homo Sapiens
IERQAMYTR

SEQ ID NO: 1142227 - protein, 9 aa, Homo Sapiens
SLSVDDAAI

SEQ ID NO: 1142228 - protein, 9 aa, Homo Sapiens
HQLVEQAWP

SEQ ID NO: 1142229 - protein, 9 aa, Homo Sapiens
KYGKSMYYY

SEQ ID NO: 1142230 - protein, 9 aa, Homo Sapiens
LHIGSTHNR

SEQ ID NO: 1142231 - protein, 9 aa, Homo Sapiens
VLVSQNYML

SEQ ID NO: 1142232 - protein, 9 aa, Homo Sapiens
ILMEFCTQG

SEQ ID NO: 1142233 - protein, 9 aa, Homo Sapiens
ASRRPLRRP

SEQ ID NO: 1142234 - protein, 9 aa, Homo Sapiens
EDSRQGSPG

SEQ ID NO: 1142235 - protein, 9 aa, Homo Sapiens
LLGPSMEIM

SEQ ID NO: 1142236 - protein, 9 aa, Homo Sapiens
PGCWTGTAG

SEQ ID NO: 1142237 - protein, 9 aa, Homo Sapiens
VPQLLIILT

SEQ ID NO: 1142238 - protein, 9 aa, Homo Sapiens
RIVRSSPTW

SEQ ID NO: 1142239 - protein, 9 aa, Homo Sapiens
GNHDKNHPK

SEQ ID NO: 1142240 - protein, 9 aa, Homo Sapiens
VQGAQGLVQ

SEQ ID NO: 1142241 - protein, 9 aa, Homo Sapiens
DYQATPEAR

SEQ ID NO: 1142242 - protein, 9 aa, Homo Sapiens
RSFKFPLQE

SEQ ID NO: 1142243 - protein, 9 aa, Homo Sapiens
DICSLYTEG

SEQ ID NO: 1142244 - protein, 9 aa, Homo Sapiens
CFRKIKHQK

SEQ ID NO: 1142245 - protein, 9 aa, Homo Sapiens
LTLVYFSLV

SEQ ID NO: 1142246 - protein, 9 aa, Homo Sapiens
SYPIWQKMF

SEQ ID NO: 1142247 - protein, 9 aa, Homo Sapiens
GSSVPGAAL

SEQ ID NO: 1142248 - protein, 9 aa, Homo Sapiens
QKMGKNRME

SEQ ID NO: 1142249 - protein, 9 aa, Homo Sapiens
WVRAKGPVL

SEQ ID NO: 1142250 - protein, 9 aa, Homo Sapiens
PPPGCWTGT

SEQ ID NO: 1142251 - protein, 9 aa, Homo Sapiens
PLLWGCHLH

SEQ ID NO: 1142252 - protein, 9 aa, Homo Sapiens
TSLSDCFIG

SEQ ID NO: 1142253 - protein, 9 aa, Homo Sapiens
LFLKRNNMS

SEQ ID NO: 1142254 - protein, 9 aa, Homo Sapiens
LTCQQSAPW

SEQ ID NO: 1142255 - protein, 9 aa, Homo Sapiens
EQRARHREG

SEQ ID NO: 1142256 - protein, 9 aa, Homo Sapiens
GGPRVLDPP

SEQ ID NO: 1142257 - protein, 9 aa, Homo Sapiens
CSECGKIFN

SEQ ID NO: 1142258 - protein, 9 aa, Homo Sapiens
EEWHTAFVN

SEQ ID NO: 1142259 - protein, 9 aa, Homo Sapiens
QRMLVGDGM

SEQ ID NO: 1142260 - protein, 9 aa, Homo Sapiens
WTHGWPMSS

SEQ ID NO: 1142261 - protein, 9 aa, Homo Sapiens
YTNVYIDPL

SEQ ID NO: 1142262 - protein, 9 aa, Homo Sapiens
PLALASGQW

SEQ ID NO: 1142263 - protein, 9 aa, Homo Sapiens
SMVTHARVL

SEQ ID NO: 1142264 - protein, 9 aa, Homo Sapiens
WRMSPTDAL

SEQ ID NO: 1142265 - protein, 9 aa, Homo Sapiens
GDAFPGGSR

SEQ ID NO: 1142266 - protein, 9 aa, Homo Sapiens
VHSKHSSSL

SEQ ID NO: 1142267 - protein, 9 aa, Homo Sapiens
PSKKCKPRF

SEQ ID NO: 1142268 - protein, 9 aa, Homo Sapiens
HRSLQAADP

SEQ ID NO: 1142269 - protein, 9 aa, Homo Sapiens
VHYSFLSHT

SEQ ID NO: 1142270 - protein, 9 aa, Homo Sapiens
QHITQNLFI

SEQ ID NO: 1142271 - protein, 9 aa, Homo Sapiens
AAATPPRAA

SEQ ID NO: 1142272 - protein, 9 aa, Homo Sapiens
GPPLPPATP

SEQ ID NO: 1142273 - protein, 9 aa, Homo Sapiens
QEASAARET

SEQ ID NO: 1142274 - protein, 9 aa, Homo Sapiens
FLSKACLPL

SEQ ID NO: 1142275 - protein, 9 aa, Homo Sapiens
ATKKDMLPQ

SEQ ID NO: 1142276 - protein, 9 aa, Homo Sapiens
YNILTVNRP

SEQ ID NO: 1142277 - protein, 9 aa, Homo Sapiens
TIEEAKAQA

SEQ ID NO: 1142278 - protein, 9 aa, Homo Sapiens
ASATRAGWG

SEQ ID NO: 1142279 - protein, 9 aa, Homo Sapiens
SSPPSLARR

SEQ ID NO: 1142280 - protein, 9 aa, Homo Sapiens
LSRNIPEDN

SEQ ID NO: 1142281 - protein, 9 aa, Homo Sapiens
NQLLPVLWE

SEQ ID NO: 1142282 - protein, 9 aa, Homo Sapiens
EWLFAVFER

SEQ ID NO: 1142283 - protein, 9 aa, Homo Sapiens
ISFGYNLQV

SEQ ID NO: 1142284 - protein, 9 aa, Homo Sapiens
IILVILRAP

SEQ ID NO: 1142285 - protein, 9 aa, Homo Sapiens
IRDVVTYTE

SEQ ID NO: 1142286 - protein, 9 aa, Homo Sapiens
CRGKMATQA

SEQ ID NO: 1142287 - protein, 9 aa, Homo Sapiens
RAGPAPQGP

SEQ ID NO: 1142288 - protein, 9 aa, Homo Sapiens
TLRRSYNEF

SEQ ID NO: 1142289 - protein, 9 aa, Homo Sapiens
PPGGPRHHP

SEQ ID NO: 1142290 - protein, 9 aa, Homo Sapiens
CHVRSCQVP

SEQ ID NO: 1142291 - protein, 9 aa, Homo Sapiens
ILLFSFLIF

SEQ ID NO: 1142292 - protein, 9 aa, Homo Sapiens
NSCKGEKLP

SEQ ID NO: 1142293 - protein, 9 aa, Homo Sapiens
LGVQWRITS

SEQ ID NO: 1142294 - protein, 9 aa, Homo Sapiens
FIPDGDQVL

SEQ ID NO: 1142295 - protein, 9 aa, Homo Sapiens
SIKRSCSAS

SEQ ID NO: 1142296 - protein, 9 aa, Homo Sapiens
VNMLTHQEV

SEQ ID NO: 1142297 - protein, 9 aa, Homo Sapiens
LAHQQGLQH

SEQ ID NO: 1142298 - protein, 9 aa, Homo Sapiens
LVFLGEQSG

SEQ ID NO: 1142299 - protein, 9 aa, Homo Sapiens
LGCACFKLG

SEQ ID NO: 1142300 - protein, 9 aa, Homo Sapiens
HVQLLSRAA

SEQ ID NO: 1142301 - protein, 9 aa, Homo Sapiens
GPGLGGGGR

SEQ ID NO: 1142302 - protein, 9 aa, Homo Sapiens
TIDASLRKY

SEQ ID NO: 1142303 - protein, 9 aa, Homo Sapiens
CPLLASQWG

SEQ ID NO: 1142304 - protein, 9 aa, Homo Sapiens
QMCEHLRRC

SEQ ID NO: 1142305 - protein, 9 aa, Homo Sapiens
LASSRPLSS

SEQ ID NO: 1142306 - protein, 9 aa, Homo Sapiens
RRRPYALLH

SEQ ID NO: 1142307 - protein, 9 aa, Homo Sapiens
TTHPTCILG

SEQ ID NO: 1142308 - protein, 9 aa, Homo Sapiens
LPSERLAHQ

SEQ ID NO: 1142309 - protein, 9 aa, Homo Sapiens
KLGGHPLQM

SEQ ID NO: 1142310 - protein, 9 aa, Homo Sapiens
YQNPEKNQR

SEQ ID NO: 1142311 - protein, 9 aa, Homo Sapiens
GKDLTQVEA

SEQ ID NO: 1142312 - protein, 9 aa, Homo Sapiens
PGRTVLVYP

SEQ ID NO: 1142313 - protein, 9 aa, Homo Sapiens
LPAPQGALT

SEQ ID NO: 1142314 - protein, 9 aa, Homo Sapiens
RDFFREVKE

SEQ ID NO: 1142315 - protein, 9 aa, Homo Sapiens
LPTQWGKSH

SEQ ID NO: 1142316 - protein, 9 aa, Homo Sapiens
DGASPCCLQ

SEQ ID NO: 1142317 - protein, 9 aa, Homo Sapiens
WPPRTPLFP

SEQ ID NO: 1142318 - protein, 9 aa, Homo Sapiens
LEKGSVTLK

SEQ ID NO: 1142319 - protein, 9 aa, Homo Sapiens
QQQRREDED

SEQ ID NO: 1142320 - protein, 9 aa, Homo Sapiens
LQREKEAGH

SEQ ID NO: 1142321 - protein, 9 aa, Homo Sapiens
RSQGVSSCP

SEQ ID NO: 1142322 - protein, 9 aa, Homo Sapiens
TDSHEELPC

SEQ ID NO: 1142323 - protein, 9 aa, Homo Sapiens
WGFRHDRSP

SEQ ID NO: 1142324 - protein, 9 aa, Homo Sapiens
YAKIYKPLH

SEQ ID NO: 1142325 - protein, 9 aa, Homo Sapiens
ADNLPTFDL

SEQ ID NO: 1142326 - protein, 9 aa, Homo Sapiens
SHPEWSSGC

SEQ ID NO: 1142327 - protein, 9 aa, Homo Sapiens
KCVPNNNER

SEQ ID NO: 1142328 - protein, 9 aa, Homo Sapiens
RPVLQQVST

SEQ ID NO: 1142329 - protein, 9 aa, Homo Sapiens
PAKILIIGG

SEQ ID NO: 1142330 - protein, 9 aa, Homo Sapiens
LGEQSGGKT

SEQ ID NO: 1142331 - protein, 9 aa, Homo Sapiens
MLSQNDDIC

SEQ ID NO: 1142332 - protein, 9 aa, Homo Sapiens
SANITTFNI

SEQ ID NO: 1142333 - protein, 9 aa, Homo Sapiens
LDVKKPIKK

SEQ ID NO: 1142334 - protein, 9 aa, Homo Sapiens
AQCLFLMSE

SEQ ID NO: 1142335 - protein, 9 aa, Homo Sapiens
TACPVKQTC

SEQ ID NO: 1142336 - protein, 9 aa, Homo Sapiens
QEKAKWLGV

SEQ ID NO: 1142337 - protein, 9 aa, Homo Sapiens
LSGIMGAVV

SEQ ID NO: 1142338 - protein, 9 aa, Homo Sapiens
NIECAGRKG

SEQ ID NO: 1142339 - protein, 9 aa, Homo Sapiens
RPGQGQNYP

SEQ ID NO: 1142340 - protein, 9 aa, Homo Sapiens
FVLDHSRLV

SEQ ID NO: 1142341 - protein, 9 aa, Homo Sapiens
GVSASEGCK

SEQ ID NO: 1142342 - protein, 9 aa, Homo Sapiens
RTRESPPNP

SEQ ID NO: 1142343 - protein, 9 aa, Homo Sapiens
AAGAGGQAG

SEQ ID NO: 1142344 - protein, 9 aa, Homo Sapiens
AWWLSNVDG

SEQ ID NO: 1142345 - protein, 9 aa, Homo Sapiens
RPKPPRPLT

SEQ ID NO: 1142346 - protein, 9 aa, Homo Sapiens
HGYGSRCCY

SEQ ID NO: 1142347 - protein, 9 aa, Homo Sapiens
PSHTMMLKD

SEQ ID NO: 1142348 - protein, 9 aa, Homo Sapiens
TTFNIQGLV

SEQ ID NO: 1142349 - protein, 9 aa, Homo Sapiens
VSYTLEKSY

SEQ ID NO: 1142350 - protein, 9 aa, Homo Sapiens
NGGSDLIKH

SEQ ID NO: 1142351 - protein, 9 aa, Homo Sapiens
ADSPCCSDF

SEQ ID NO: 1142352 - protein, 9 aa, Homo Sapiens
PWSYSKQNR

SEQ ID NO: 1142353 - protein, 9 aa, Homo Sapiens
AAASRTAST

SEQ ID NO: 1142354 - protein, 9 aa, Homo Sapiens
SCPESVKNG

SEQ ID NO: 1142355 - protein, 9 aa, Homo Sapiens
SWGRKSAIL

SEQ ID NO: 1142356 - protein, 9 aa, Homo Sapiens
AMQSLYIEE

SEQ ID NO: 1142357 - protein, 9 aa, Homo Sapiens
PSDKQGMSV

SEQ ID NO: 1142358 - protein, 9 aa, Homo Sapiens
ALVYKCLAP

SEQ ID NO: 1142359 - protein, 9 aa, Homo Sapiens
RPCRCCRCL

SEQ ID NO: 1142360 - protein, 9 aa, Homo Sapiens
SDYIRHQRI

SEQ ID NO: 1142361 - protein, 9 aa, Homo Sapiens
SDLIYLCRF

SEQ ID NO: 1142362 - protein, 9 aa, Homo Sapiens
CITSQLGAT

SEQ ID NO: 1142363 - protein, 9 aa, Homo Sapiens
GLLQSPVTG

SEQ ID NO: 1142364 - protein, 9 aa, Homo Sapiens
SPGPPGSLR

SEQ ID NO: 1142365 - protein, 9 aa, Homo Sapiens
LPAPPAPSP

SEQ ID NO: 1142366 - protein, 9 aa, Homo Sapiens
PSSATTPPT

SEQ ID NO: 1142367 - protein, 9 aa, Homo Sapiens
WMRPCSEWP

SEQ ID NO: 1142368 - protein, 9 aa, Homo Sapiens
PRASRAPRT

SEQ ID NO: 1142369 - protein, 9 aa, Homo Sapiens
ASLTQMSAG

SEQ ID NO: 1142370 - protein, 9 aa, Homo Sapiens
KVPGGSRPG

SEQ ID NO: 1142371 - protein, 9 aa, Homo Sapiens
GNCLPPLPR

SEQ ID NO: 1142372 - protein, 9 aa, Homo Sapiens
KLEEKVKKE

SEQ ID NO: 1142373 - protein, 9 aa, Homo Sapiens
ENAPEEKDL

SEQ ID NO: 1142374 - protein, 9 aa, Homo Sapiens
AGATCWCRL

SEQ ID NO: 1142375 - protein, 9 aa, Homo Sapiens
EKCCQCQEQ

SEQ ID NO: 1142376 - protein, 9 aa, Homo Sapiens
GQGPEIQEV

SEQ ID NO: 1142377 - protein, 9 aa, Homo Sapiens
LCLWMALCP

SEQ ID NO: 1142378 - protein, 9 aa, Homo Sapiens
RRVRDSDGD

SEQ ID NO: 1142379 - protein, 9 aa, Homo Sapiens
WPVKAPTSQ

SEQ ID NO: 1142380 - protein, 9 aa, Homo Sapiens
QINDQASFA

SEQ ID NO: 1142381 - protein, 9 aa, Homo Sapiens
SGSRSEISM

SEQ ID NO: 1142382 - protein, 9 aa, Homo Sapiens
PGSGISAQP

SEQ ID NO: 1142383 - protein, 9 aa, Homo Sapiens
GPRLECICT

SEQ ID NO: 1142384 - protein, 9 aa, Homo Sapiens
RPPTPIYQV

SEQ ID NO: 1142385 - protein, 9 aa, Homo Sapiens
LSLAQVKIE

SEQ ID NO: 1142386 - protein, 9 aa, Homo Sapiens
SGLKGKKIF

SEQ ID NO: 1142387 - protein, 9 aa, Homo Sapiens
GGPRLECIC

SEQ ID NO: 1142388 - protein, 9 aa, Homo Sapiens
QRKDCKWSS

SEQ ID NO: 1142389 - protein, 9 aa, Homo Sapiens
TCGRRTRKQ

SEQ ID NO: 1142390 - protein, 9 aa, Homo Sapiens
HRRLAPNKD

SEQ ID NO: 1142391 - protein, 9 aa, Homo Sapiens
VPEIPPETV

SEQ ID NO: 1142392 - protein, 9 aa, Homo Sapiens
ACTHTSMIL

SEQ ID NO: 1142393 - protein, 9 aa, Homo Sapiens
PHQGPCQRP

SEQ ID NO: 1142394 - protein, 9 aa, Homo Sapiens
LAKYAELDH

SEQ ID NO: 1142395 - protein, 9 aa, Homo Sapiens
SACATSAAA

SEQ ID NO: 1142396 - protein, 9 aa, Homo Sapiens
RTGRFAFQL

SEQ ID NO: 1142397 - protein, 9 aa, Homo Sapiens
RPLRRLGSE

SEQ ID NO: 1142398 - protein, 9 aa, Homo Sapiens
PMTHFGDTF

SEQ ID NO: 1142399 - protein, 9 aa, Homo Sapiens
TFKCTQCGK

SEQ ID NO: 1142400 - protein, 9 aa, Homo Sapiens
EVVCLLFPA

SEQ ID NO: 1142401 - protein, 9 aa, Homo Sapiens
AKKLYPKGV

SEQ ID NO: 1142402 - protein, 9 aa, Homo Sapiens
TTRLHRLIT

SEQ ID NO: 1142403 - protein, 9 aa, Homo Sapiens
VNLLFLEAR

SEQ ID NO: 1142404 - protein, 9 aa, Homo Sapiens
TWLTSACPS

SEQ ID NO: 1142405 - protein, 9 aa, Homo Sapiens
RSGRAIPIK

SEQ ID NO: 1142406 - protein, 9 aa, Homo Sapiens
KRASSFDPS

SEQ ID NO: 1142407 - protein, 9 aa, Homo Sapiens
WPLRPPPLS

SEQ ID NO: 1142408 - protein, 9 aa, Homo Sapiens
CPTSRSIVS

SEQ ID NO: 1142409 - protein, 9 aa, Homo Sapiens
SLLKTLPQP

SEQ ID NO: 1142410 - protein, 9 aa, Homo Sapiens
LTVYKPEVV

SEQ ID NO: 1142411 - protein, 9 aa, Homo Sapiens
AMVNTTDYH

SEQ ID NO: 1142412 - protein, 9 aa, Homo Sapiens
DSTSSAERE

SEQ ID NO: 1142413 - protein, 9 aa, Homo Sapiens
ADYLTAGTS

SEQ ID NO: 1142414 - protein, 9 aa, Homo Sapiens
QQQQQQQSQ

SEQ ID NO: 1142415 - protein, 9 aa, Homo Sapiens
DNTTVTYNS

SEQ ID NO: 1142416 - protein, 9 aa, Homo Sapiens
AWFTRELAV

SEQ ID NO: 1142417 - protein, 9 aa, Homo Sapiens
SQFPDEEKP

SEQ ID NO: 1142418 - protein, 9 aa, Homo Sapiens
LGILSLRSE

SEQ ID NO: 1142419 - protein, 9 aa, Homo Sapiens
IMKRMCKQK

SEQ ID NO: 1142420 - protein, 9 aa, Homo Sapiens
HQSLKAQNA

SEQ ID NO: 1142421 - protein, 9 aa, Homo Sapiens
SAATSRGMW

SEQ ID NO: 1142422 - protein, 9 aa, Homo Sapiens
FAGSGNTTH

SEQ ID NO: 1142423 - protein, 9 aa, Homo Sapiens
SQPLHKEIA

SEQ ID NO: 1142424 - protein, 9 aa, Homo Sapiens
WMRTHAGST

SEQ ID NO: 1142425 - protein, 9 aa, Homo Sapiens
GWRDSEIAG

SEQ ID NO: 1142426 - protein, 9 aa, Homo Sapiens
MYTRHECRQ

SEQ ID NO: 1142427 - protein, 9 aa, Homo Sapiens
NQFSLVSDG

SEQ ID NO: 1142428 - protein, 9 aa, Homo Sapiens
LSILWGVRH

SEQ ID NO: 1142429 - protein, 9 aa, Homo Sapiens
AGTGRSSRC

SEQ ID NO: 1142430 - protein, 9 aa, Homo Sapiens
PTQWGKSHS

SEQ ID NO: 1142431 - protein, 9 aa, Homo Sapiens
DGQERVPEI

SEQ ID NO: 1142432 - protein, 9 aa, Homo Sapiens
VAVASSLST

SEQ ID NO: 1142433 - protein, 9 aa, Homo Sapiens
FSTLTGKIL

SEQ ID NO: 1142434 - protein, 9 aa, Homo Sapiens
ASVATAPVP

SEQ ID NO: 1142435 - protein, 9 aa, Homo Sapiens
PPQPPLHQP

SEQ ID NO: 1142436 - protein, 9 aa, Homo Sapiens
VVVRIQSSG

SEQ ID NO: 1142437 - protein, 9 aa, Homo Sapiens
HRLNIAMEQ

SEQ ID NO: 1142438 - protein, 9 aa, Homo Sapiens
PRLPRHCLH

SEQ ID NO: 1142439 - protein, 9 aa, Homo Sapiens
WSDMLAGFL

SEQ ID NO: 1142440 - protein, 9 aa, Homo Sapiens
TIDSAFGQS

SEQ ID NO: 1142441 - protein, 9 aa, Homo Sapiens
TTTITTTTM

SEQ ID NO: 1142442 - protein, 9 aa, Homo Sapiens
GTQEVDAHR

SEQ ID NO: 1142443 - protein, 9 aa, Homo Sapiens
TSRILNLQV

SEQ ID NO: 1142444 - protein, 9 aa, Homo Sapiens
PTRGLCPGQ

SEQ ID NO: 1142445 - protein, 9 aa, Homo Sapiens
FDTILYYYQ

SEQ ID NO: 1142446 - protein, 9 aa, Homo Sapiens
IFRNEMLKK

SEQ ID NO: 1142447 - protein, 9 aa, Homo Sapiens
GSHVGAADG

SEQ ID NO: 1142448 - protein, 9 aa, Homo Sapiens
AELSTVHQV

SEQ ID NO: 1142449 - protein, 9 aa, Homo Sapiens
HFQVCFGRH

SEQ ID NO: 1142450 - protein, 9 aa, Homo Sapiens
ESRQLVGIG

SEQ ID NO: 1142451 - protein, 9 aa, Homo Sapiens
GMLPPDRCL

SEQ ID NO: 1142452 - protein, 9 aa, Homo Sapiens
TMESAKPVT

SEQ ID NO: 1142453 - protein, 9 aa, Homo Sapiens
PCTRLHGNI

SEQ ID NO: 1142454 - protein, 9 aa, Homo Sapiens
KLLHLEDAV

SEQ ID NO: 1142455 - protein, 9 aa, Homo Sapiens
NFKDVGSKD

SEQ ID NO: 1142456 - protein, 9 aa, Homo Sapiens
TAKCGIHGM

SEQ ID NO: 1142457 - protein, 9 aa, Homo Sapiens
AAASPRAAI

SEQ ID NO: 1142458 - protein, 9 aa, Homo Sapiens
GLVFGDDAL

SEQ ID NO: 1142459 - protein, 9 aa, Homo Sapiens
DAANQCQIE

SEQ ID NO: 1142460 - protein, 9 aa, Homo Sapiens
PHTHPLCPP

SEQ ID NO: 1142461 - protein, 9 aa, Homo Sapiens
QLRHLESAS

SEQ ID NO: 1142462 - protein, 9 aa, Homo Sapiens
KALSALFIW

SEQ ID NO: 1142463 - protein, 9 aa, Homo Sapiens
TKSLGPLHA

SEQ ID NO: 1142464 - protein, 9 aa, Homo Sapiens
TFGKKWHRF

SEQ ID NO: 1142465 - protein, 9 aa, Homo Sapiens
LIYKLYEVQ

SEQ ID NO: 1142466 - protein, 9 aa, Homo Sapiens
TDGVPERTV

SEQ ID NO: 1142467 - protein, 9 aa, Homo Sapiens
AAVECLGRP

SEQ ID NO: 1142468 - protein, 9 aa, Homo Sapiens
CRCVLTFAH

SEQ ID NO: 1142469 - protein, 9 aa, Homo Sapiens
TPPPRHPWP

SEQ ID NO: 1142470 - protein, 9 aa, Homo Sapiens
TLKEQFQSV

SEQ ID NO: 1142471 - protein, 9 aa, Homo Sapiens
HEAIKKNYC

SEQ ID NO: 1142472 - protein, 9 aa, Homo Sapiens
LTSFTLQPG

SEQ ID NO: 1142473 - protein, 9 aa, Homo Sapiens
SFGLLNISA

SEQ ID NO: 1142474 - protein, 9 aa, Homo Sapiens
CQTLAITSW

SEQ ID NO: 1142475 - protein, 9 aa, Homo Sapiens
PHPCPQFMA

SEQ ID NO: 1142476 - protein, 9 aa, Homo Sapiens
RGTSITLST

SEQ ID NO: 1142477 - protein, 9 aa, Homo Sapiens
CPEDNKTKE

SEQ ID NO: 1142478 - protein, 9 aa, Homo Sapiens
QLVCSVPGE

SEQ ID NO: 1142479 - protein, 9 aa, Homo Sapiens
WCARLTSSF

SEQ ID NO: 1142480 - protein, 9 aa, Homo Sapiens
SRQLVGIGP

SEQ ID NO: 1142481 - protein, 9 aa, Homo Sapiens
SVLLNLRER

SEQ ID NO: 1142482 - protein, 9 aa, Homo Sapiens
SILARLVAT

SEQ ID NO: 1142483 - protein, 9 aa, Homo Sapiens
LCRKLRARR

SEQ ID NO: 1142484 - protein, 9 aa, Homo Sapiens
GEWTELRQH

SEQ ID NO: 1142485 - protein, 9 aa, Homo Sapiens
RSSEGTKES

SEQ ID NO: 1142486 - protein, 9 aa, Homo Sapiens
MENQHRSHE

SEQ ID NO: 1142487 - protein, 9 aa, Homo Sapiens
QGKGYHIHN

SEQ ID NO: 1142488 - protein, 9 aa, Homo Sapiens
IGPSCVPTA

SEQ ID NO: 1142489 - protein, 9 aa, Homo Sapiens
QDHITGEFQ

SEQ ID NO: 1142490 - protein, 9 aa, Homo Sapiens
DTPTCVSCW

SEQ ID NO: 1142491 - protein, 9 aa, Homo Sapiens
WRTSRGQAQ

SEQ ID NO: 1142492 - protein, 9 aa, Homo Sapiens
TILPYWRRT

SEQ ID NO: 1142493 - protein, 9 aa, Homo Sapiens
RALMECLAP

SEQ ID NO: 1142494 - protein, 9 aa, Homo Sapiens
GSVRRAGRR

SEQ ID NO: 1142495 - protein, 9 aa, Homo Sapiens
LCPPGFRIV

SEQ ID NO: 1142496 - protein, 9 aa, Homo Sapiens
LQDAEQQLE

SEQ ID NO: 1142497 - protein, 9 aa, Homo Sapiens
CDLSSAAND

SEQ ID NO: 1142498 - protein, 9 aa, Homo Sapiens
MKWSRKAEN

SEQ ID NO: 1142499 - protein, 9 aa, Homo Sapiens
DGNFLCVWG

SEQ ID NO: 1142500 - protein, 9 aa, Homo Sapiens
CSVTSGASG

SEQ ID NO: 1142501 - protein, 9 aa, Homo Sapiens
PGLPGNLRS

SEQ ID NO: 1142502 - protein, 9 aa, Homo Sapiens
QVTIDGRSY

SEQ ID NO: 1142503 - protein, 9 aa, Homo Sapiens
CPGTATMES

SEQ ID NO: 1142504 - protein, 9 aa, Homo Sapiens
HGKVGQCLD

SEQ ID NO: 1142505 - protein, 9 aa, Homo Sapiens
TRGRRCWRG

SEQ ID NO: 1142506 - protein, 9 aa, Homo Sapiens
SQGYHQRTL

SEQ ID NO: 1142507 - protein, 9 aa, Homo Sapiens
LNAKEEATK

SEQ ID NO: 1142508 - protein, 9 aa, Homo Sapiens
YSANMMVDG

SEQ ID NO: 1142509 - protein, 9 aa, Homo Sapiens
LLTRPRPAT

SEQ ID NO: 1142510 - protein, 9 aa, Homo Sapiens
LLGDQLVGG

SEQ ID NO: 1142511 - protein, 9 aa, Homo Sapiens
LPQPGAEQG

SEQ ID NO: 1142512 - protein, 9 aa, Homo Sapiens
KQYRGIIDC

SEQ ID NO: 1142513 - protein, 9 aa, Homo Sapiens
TCSPQQKLR

SEQ ID NO: 1142514 - protein, 9 aa, Homo Sapiens
SHRRHRHHG

SEQ ID NO: 1142515 - protein, 9 aa, Homo Sapiens
ARDPPRPTS

SEQ ID NO: 1142516 - protein, 9 aa, Homo Sapiens
LMTAMWLSA

SEQ ID NO: 1142517 - protein, 9 aa, Homo Sapiens
FYVFNHHGR

SEQ ID NO: 1142518 - protein, 9 aa, Homo Sapiens
LLTTAWAAL

SEQ ID NO: 1142519 - protein, 9 aa, Homo Sapiens
KKCKPRFHF

SEQ ID NO: 1142520 - protein, 9 aa, Homo Sapiens
LLPLIHPRP

SEQ ID NO: 1142521 - protein, 9 aa, Homo Sapiens
NLQVLKKIL

SEQ ID NO: 1142522 - protein, 9 aa, Homo Sapiens
KMRKEAEAR

SEQ ID NO: 1142523 - protein, 9 aa, Homo Sapiens
FRPTLPPGN

SEQ ID NO: 1142524 - protein, 9 aa, Homo Sapiens
SGEELNHRT

SEQ ID NO: 1142525 - protein, 9 aa, Homo Sapiens
GAERVWRLE

SEQ ID NO: 1142526 - protein, 9 aa, Homo Sapiens
PRCPWPSAL

SEQ ID NO: 1142527 - protein, 9 aa, Homo Sapiens
RGRWWLSSG

SEQ ID NO: 1142528 - protein, 9 aa, Homo Sapiens
KRLTLPPSK

SEQ ID NO: 1142529 - protein, 9 aa, Homo Sapiens
APRHHQAWI

SEQ ID NO: 1142530 - protein, 9 aa, Homo Sapiens
VPGLGKPLM

SEQ ID NO: 1142531 - protein, 9 aa, Homo Sapiens
QRNLYRDAM

SEQ ID NO: 1142532 - protein, 9 aa, Homo Sapiens
AVPHTARPP

SEQ ID NO: 1142533 - protein, 9 aa, Homo Sapiens
GIINPSTFY

SEQ ID NO: 1142534 - protein, 9 aa, Homo Sapiens
VIPKKANSL

SEQ ID NO: 1142535 - protein, 9 aa, Homo Sapiens
GVLIDVLHL

SEQ ID NO: 1142536 - protein, 9 aa, Homo Sapiens
QFPDEEKPQ

SEQ ID NO: 1142537 - protein, 9 aa, Homo Sapiens
LPGEPGTPS

SEQ ID NO: 1142538 - protein, 9 aa, Homo Sapiens
KPKKTEAPA

SEQ ID NO: 1142539 - protein, 9 aa, Homo Sapiens
KGGLGEVAQ

SEQ ID NO: 1142540 - protein, 9 aa, Homo Sapiens
YGLPRPGSH

SEQ ID NO: 1142541 - protein, 9 aa, Homo Sapiens
NTSTFMPYE

SEQ ID NO: 1142542 - protein, 9 aa, Homo Sapiens
TFGLFLHLD

SEQ ID NO: 1142543 - protein, 9 aa, Homo Sapiens
QELEKCDID

SEQ ID NO: 1142544 - protein, 9 aa, Homo Sapiens
LYLMQKHTS

SEQ ID NO: 1142545 - protein, 9 aa, Homo Sapiens
QSAPWRSRS

SEQ ID NO: 1142546 - protein, 9 aa, Homo Sapiens
SQDSSTWLT

SEQ ID NO: 1142547 - protein, 9 aa, Homo Sapiens
ESSVVWQDL

SEQ ID NO: 1142548 - protein, 9 aa, Homo Sapiens
TGSDPQHNF

SEQ ID NO: 1142549 - protein, 9 aa, Homo Sapiens
SVSDCSDDT

SEQ ID NO: 1142550 - protein, 9 aa, Homo Sapiens
EKNYPQIPD

SEQ ID NO: 1142551 - protein, 9 aa, Homo Sapiens
YTGLYHIGY

SEQ ID NO: 1142552 - protein, 9 aa, Homo Sapiens
SNINGHVYM

SEQ ID NO: 1142553 - protein, 9 aa, Homo Sapiens
PLTGRPSYP

SEQ ID NO: 1142554 - protein, 9 aa, Homo Sapiens
PTSELSLQP

SEQ ID NO: 1142555 - protein, 9 aa, Homo Sapiens
HLYHGLRAS

SEQ ID NO: 1142556 - protein, 9 aa, Homo Sapiens
PLCSVTDYH

SEQ ID NO: 1142557 - protein, 9 aa, Homo Sapiens
VAARLAMAE

SEQ ID NO: 1142558 - protein, 9 aa, Homo Sapiens
HVALATIVT

SEQ ID NO: 1142559 - protein, 9 aa, Homo Sapiens
KIKHQKSGR

SEQ ID NO: 1142560 - protein, 9 aa, Homo Sapiens
AGCSWTCSQ

SEQ ID NO: 1142561 - protein, 9 aa, Homo Sapiens
ADGKFTTVA

SEQ ID NO: 1142562 - protein, 9 aa, Homo Sapiens
DGTNQINDQ

SEQ ID NO: 1142563 - protein, 9 aa, Homo Sapiens
DISTVIMDK

SEQ ID NO: 1142564 - protein, 9 aa, Homo Sapiens
CPPACNCVF

SEQ ID NO: 1142565 - protein, 9 aa, Homo Sapiens
GKSQGGRIL

SEQ ID NO: 1142566 - protein, 9 aa, Homo Sapiens
FSFCWFVHD

SEQ ID NO: 1142567 - protein, 9 aa, Homo Sapiens
VHGPGPCIG

SEQ ID NO: 1142568 - protein, 9 aa, Homo Sapiens
SAQPSSGTK

SEQ ID NO: 1142569 - protein, 9 aa, Homo Sapiens
GHLLYRIRK

SEQ ID NO: 1142570 - protein, 9 aa, Homo Sapiens
PERDWPQGD

SEQ ID NO: 1142571 - protein, 9 aa, Homo Sapiens
GRKFPCGPW

SEQ ID NO: 1142572 - protein, 9 aa, Homo Sapiens
FCLRDETLA

SEQ ID NO: 1142573 - protein, 9 aa, Homo Sapiens
AKHLKTLRL

SEQ ID NO: 1142574 - protein, 9 aa, Homo Sapiens
FRYLDDGGL

SEQ ID NO: 1142575 - protein, 9 aa, Homo Sapiens
TSFGSGPGV

SEQ ID NO: 1142576 - protein, 9 aa, Homo Sapiens
QQKPSPVLG

SEQ ID NO: 1142577 - protein, 9 aa, Homo Sapiens
HPGPTAAGP

SEQ ID NO: 1142578 - protein, 9 aa, Homo Sapiens
AQASHSEEN

SEQ ID NO: 1142579 - protein, 9 aa, Homo Sapiens
DPQLRLPRS

SEQ ID NO: 1142580 - protein, 9 aa, Homo Sapiens
KAKYTTQGM

SEQ ID NO: 1142581 - protein, 9 aa, Homo Sapiens
HKEKRTQRI

SEQ ID NO: 1142582 - protein, 9 aa, Homo Sapiens
PTWAGTSTL

SEQ ID NO: 1142583 - protein, 9 aa, Homo Sapiens
HGKLQSPPE

SEQ ID NO: 1142584 - protein, 9 aa, Homo Sapiens
RSEGGPPRP

SEQ ID NO: 1142585 - protein, 9 aa, Homo Sapiens
ETPTKLEPK

SEQ ID NO: 1142586 - protein, 9 aa, Homo Sapiens
CWTGTAGCC

SEQ ID NO: 1142587 - protein, 9 aa, Homo Sapiens
GPLRSLPCP

SEQ ID NO: 1142588 - protein, 9 aa, Homo Sapiens
VCTDCASRG

SEQ ID NO: 1142589 - protein, 9 aa, Homo Sapiens
SPLHALGAL

SEQ ID NO: 1142590 - protein, 9 aa, Homo Sapiens
HYWLQLLYS

SEQ ID NO: 1142591 - protein, 9 aa, Homo Sapiens
LIAWDPSPS

SEQ ID NO: 1142592 - protein, 9 aa, Homo Sapiens
ELILQQNCM

SEQ ID NO: 1142593 - protein, 9 aa, Homo Sapiens
FSFIWPLST

SEQ ID NO: 1142594 - protein, 9 aa, Homo Sapiens
TKFEGDHES

SEQ ID NO: 1142595 - protein, 9 aa, Homo Sapiens
RAKAKVAFH

SEQ ID NO: 1142596 - protein, 9 aa, Homo Sapiens
QASTAVAPA

SEQ ID NO: 1142597 - protein, 9 aa, Homo Sapiens
WPSALATQC

SEQ ID NO: 1142598 - protein, 9 aa, Homo Sapiens
PNIAMGFPA

SEQ ID NO: 1142599 - protein, 9 aa, Homo Sapiens
SPEELHRTA

SEQ ID NO: 1142600 - protein, 9 aa, Homo Sapiens
LTMGAICPL

SEQ ID NO: 1142601 - protein, 9 aa, Homo Sapiens
WSPLLFTGL

SEQ ID NO: 1142602 - protein, 9 aa, Homo Sapiens
AAHGPRTDR

SEQ ID NO: 1142603 - protein, 9 aa, Homo Sapiens
RHSPSPLSM

SEQ ID NO: 1142604 - protein, 9 aa, Homo Sapiens
RDFLREAGI

SEQ ID NO: 1142605 - protein, 9 aa, Homo Sapiens
LSSAVMPCP

SEQ ID NO: 1142606 - protein, 9 aa, Homo Sapiens
EISTQLCKK

SEQ ID NO: 1142607 - protein, 9 aa, Homo Sapiens
QAGPVAAVL

SEQ ID NO: 1142608 - protein, 9 aa, Homo Sapiens
RLERLYCQF

SEQ ID NO: 1142609 - protein, 9 aa, Homo Sapiens
GEAEHINGP

SEQ ID NO: 1142610 - protein, 9 aa, Homo Sapiens
CDPETEENI

SEQ ID NO: 1142611 - protein, 9 aa, Homo Sapiens
NYVHRGLAA

SEQ ID NO: 1142612 - protein, 9 aa, Homo Sapiens
LARLTIHID

SEQ ID NO: 1142613 - protein, 9 aa, Homo Sapiens
RDAMLENYR

SEQ ID NO: 1142614 - protein, 9 aa, Homo Sapiens
SVAGRTTQS

SEQ ID NO: 1142615 - protein, 9 aa, Homo Sapiens
NQEHSEDDE

SEQ ID NO: 1142616 - protein, 9 aa, Homo Sapiens
TEPVVLLVI

SEQ ID NO: 1142617 - protein, 9 aa, Homo Sapiens
WIGVVILPL

SEQ ID NO: 1142618 - protein, 9 aa, Homo Sapiens
NSVKVMYRC

SEQ ID NO: 1142619 - protein, 9 aa, Homo Sapiens
PKEAISAST

SEQ ID NO: 1142620 - protein, 9 aa, Homo Sapiens
QSIICKKDA

SEQ ID NO: 1142621 - protein, 9 aa, Homo Sapiens
RTTMLSLCL

SEQ ID NO: 1142622 - protein, 9 aa, Homo Sapiens
FDNYEDTIR

SEQ ID NO: 1142623 - protein, 9 aa, Homo Sapiens
LLQSPVTGE

SEQ ID NO: 1142624 - protein, 9 aa, Homo Sapiens
KKIFLVAAT

SEQ ID NO: 1142625 - protein, 9 aa, Homo Sapiens
LGLIPCIMV

SEQ ID NO: 1142626 - protein, 9 aa, Homo Sapiens
STAVAPASS

SEQ ID NO: 1142627 - protein, 9 aa, Homo Sapiens
GDRVPGLGP

SEQ ID NO: 1142628 - protein, 9 aa, Homo Sapiens
SRSGRNASA

SEQ ID NO: 1142629 - protein, 9 aa, Homo Sapiens
LTSVISVAI

SEQ ID NO: 1142630 - protein, 9 aa, Homo Sapiens
HDLGPLPAS

SEQ ID NO: 1142631 - protein, 9 aa, Homo Sapiens
TSRDATRFP

SEQ ID NO: 1142632 - protein, 9 aa, Homo Sapiens
CCCCCGAGV

SEQ ID NO: 1142633 - protein, 9 aa, Homo Sapiens
PPKAAPPPL

SEQ ID NO: 1142634 - protein, 9 aa, Homo Sapiens
DLVEAKKLP

SEQ ID NO: 1142635 - protein, 9 aa, Homo Sapiens
LDKPGKSCD

SEQ ID NO: 1142636 - protein, 9 aa, Homo Sapiens
VSTAVNVFE

SEQ ID NO: 1142637 - protein, 9 aa, Homo Sapiens
SCSPSPRYS

SEQ ID NO: 1142638 - protein, 9 aa, Homo Sapiens
EGKPKKTEA

SEQ ID NO: 1142639 - protein, 9 aa, Homo Sapiens
RINSTDHIE

SEQ ID NO: 1142640 - protein, 9 aa, Homo Sapiens
RATCYFTMG

SEQ ID NO: 1142641 - protein, 9 aa, Homo Sapiens
RGGQSSLPT

SEQ ID NO: 1142642 - protein, 9 aa, Homo Sapiens
GRGAARDAP

SEQ ID NO: 1142643 - protein, 9 aa, Homo Sapiens
ACRTSLASS

SEQ ID NO: 1142644 - protein, 9 aa, Homo Sapiens
VGFHVSKIS

SEQ ID NO: 1142645 - protein, 9 aa, Homo Sapiens
LSRTRALME

SEQ ID NO: 1142646 - protein, 9 aa, Homo Sapiens
CLQALSLRI

SEQ ID NO: 1142647 - protein, 9 aa, Homo Sapiens
KYSMELDET

SEQ ID NO: 1142648 - protein, 9 aa, Homo Sapiens
AASRTASTR

SEQ ID NO: 1142649 - protein, 9 aa, Homo Sapiens
ASSFDPSRH

SEQ ID NO: 1142650 - protein, 9 aa, Homo Sapiens
LAEQNRRDV

SEQ ID NO: 1142651 - protein, 9 aa, Homo Sapiens
DEDSTWEPE

SEQ ID NO: 1142652 - protein, 9 aa, Homo Sapiens
GFAQHSNLV

SEQ ID NO: 1142653 - protein, 9 aa, Homo Sapiens
LLHQQAGRI

SEQ ID NO: 1142654 - protein, 9 aa, Homo Sapiens
QVWTAATLR

SEQ ID NO: 1142655 - protein, 9 aa, Homo Sapiens
APPVRDPTG

SEQ ID NO: 1142656 - protein, 9 aa, Homo Sapiens
AGPRAPPQT

SEQ ID NO: 1142657 - protein, 9 aa, Homo Sapiens
RRGHEEREA

SEQ ID NO: 1142658 - protein, 9 aa, Homo Sapiens
DLSRISDEF

SEQ ID NO: 1142659 - protein, 9 aa, Homo Sapiens
EQFIPPYVL

SEQ ID NO: 1142660 - protein, 9 aa, Homo Sapiens
HLQDLLLGP

SEQ ID NO: 1142661 - protein, 9 aa, Homo Sapiens
LIHPRPPPH

SEQ ID NO: 1142662 - protein, 9 aa, Homo Sapiens
PSGPPFPLL

SEQ ID NO: 1142663 - protein, 9 aa, Homo Sapiens
VLLPRLVCC

SEQ ID NO: 1142664 - protein, 9 aa, Homo Sapiens
KELLEGPDY

SEQ ID NO: 1142665 - protein, 9 aa, Homo Sapiens
WGPFEESPL

SEQ ID NO: 1142666 - protein, 9 aa, Homo Sapiens
AYYTLSYCA

SEQ ID NO: 1142667 - protein, 9 aa, Homo Sapiens
VQPPLPSER

SEQ ID NO: 1142668 - protein, 9 aa, Homo Sapiens
DVDECLQDR

SEQ ID NO: 1142669 - protein, 9 aa, Homo Sapiens
TSLACLNAM

SEQ ID NO: 1142670 - protein, 9 aa, Homo Sapiens
ALLTSVTLL

SEQ ID NO: 1142671 - protein, 9 aa, Homo Sapiens
SEEEKLKLA

SEQ ID NO: 1142672 - protein, 9 aa, Homo Sapiens
CYGFVLDHS

SEQ ID NO: 1142673 - protein, 9 aa, Homo Sapiens
PLTDIQIVQ

SEQ ID NO: 1142674 - protein, 9 aa, Homo Sapiens
SGHCPHWAS

SEQ ID NO: 1142675 - protein, 9 aa, Homo Sapiens
SSARFVPCY

SEQ ID NO: 1142676 - protein, 9 aa, Homo Sapiens
DMKRRIHLK

SEQ ID NO: 1142677 - protein, 9 aa, Homo Sapiens
ILYRSKLMP

SEQ ID NO: 1142678 - protein, 9 aa, Homo Sapiens
TPALQPPPQ

SEQ ID NO: 1142679 - protein, 9 aa, Homo Sapiens
VCFDFVLPP

SEQ ID NO: 1142680 - protein, 9 aa, Homo Sapiens
SGGEGGLRL

SEQ ID NO: 1142681 - protein, 9 aa, Homo Sapiens
GPRSKMGKW

SEQ ID NO: 1142682 - protein, 9 aa, Homo Sapiens
LPTYLLVTY

SEQ ID NO: 1142683 - protein, 9 aa, Homo Sapiens
TGKLFPVCH

SEQ ID NO: 1142684 - protein, 9 aa, Homo Sapiens
ATAPVPAGW

SEQ ID NO: 1142685 - protein, 9 aa, Homo Sapiens
DKIHERKCG

SEQ ID NO: 1142686 - protein, 9 aa, Homo Sapiens
ALPFGGPSQ

SEQ ID NO: 1142687 - protein, 9 aa, Homo Sapiens
PPNGHCIGT

SEQ ID NO: 1142688 - protein, 9 aa, Homo Sapiens
TNFLCLDHI

SEQ ID NO: 1142689 - protein, 9 aa, Homo Sapiens
FNYCLHEQY

SEQ ID NO: 1142690 - protein, 9 aa, Homo Sapiens
FPASGEMKD

SEQ ID NO: 1142691 - protein, 9 aa, Homo Sapiens
CPSPQEISK

SEQ ID NO: 1142692 - protein, 9 aa, Homo Sapiens
MEGLGHEET

SEQ ID NO: 1142693 - protein, 9 aa, Homo Sapiens
CVTTMTHGV

SEQ ID NO: 1142694 - protein, 9 aa, Homo Sapiens
THLGRLLLC

SEQ ID NO: 1142695 - protein, 9 aa, Homo Sapiens
DPTQWIVTF

SEQ ID NO: 1142696 - protein, 9 aa, Homo Sapiens
APTSQVLWC

SEQ ID NO: 1142697 - protein, 9 aa, Homo Sapiens
LRHPRWSHW

SEQ ID NO: 1142698 - protein, 9 aa, Homo Sapiens
NFFRNKYQL

SEQ ID NO: 1142699 - protein, 9 aa, Homo Sapiens
APIMSQWWH

SEQ ID NO: 1142700 - protein, 9 aa, Homo Sapiens
AVCAAISRE

SEQ ID NO: 1142701 - protein, 9 aa, Homo Sapiens
TTLWLGPAS

SEQ ID NO: 1142702 - protein, 9 aa, Homo Sapiens
KDVWCPWCR

SEQ ID NO: 1142703 - protein, 9 aa, Homo Sapiens
SSSLVVKFV

SEQ ID NO: 1142704 - protein, 9 aa, Homo Sapiens
VHFKAHKAE

SEQ ID NO: 1142705 - protein, 9 aa, Homo Sapiens
YSLGRVFWT

SEQ ID NO: 1142706 - protein, 9 aa, Homo Sapiens
VEAFFMNLT

SEQ ID NO: 1142707 - protein, 9 aa, Homo Sapiens
CYYNLGCLY

SEQ ID NO: 1142708 - protein, 9 aa, Homo Sapiens
AVVYSLGRV

SEQ ID NO: 1142709 - protein, 9 aa, Homo Sapiens
GLLRALGTR

SEQ ID NO: 1142710 - protein, 9 aa, Homo Sapiens
RTPRNKVAQ

SEQ ID NO: 1142711 - protein, 9 aa, Homo Sapiens
RTLLQTRQA

SEQ ID NO: 1142712 - protein, 9 aa, Homo Sapiens
FIEIRIVEC

SEQ ID NO: 1142713 - protein, 9 aa, Homo Sapiens
SVIARCLVQ

SEQ ID NO: 1142714 - protein, 9 aa, Homo Sapiens
TNSQKSIVG

SEQ ID NO: 1142715 - protein, 9 aa, Homo Sapiens
NCLSMSGLT

SEQ ID NO: 1142716 - protein, 9 aa, Homo Sapiens
NHVSRGDVH

SEQ ID NO: 1142717 - protein, 9 aa, Homo Sapiens
VMCCTLRSG

SEQ ID NO: 1142718 - protein, 9 aa, Homo Sapiens
VLSTKSPAA

SEQ ID NO: 1142719 - protein, 9 aa, Homo Sapiens
ERGSVCTRT

SEQ ID NO: 1142720 - protein, 9 aa, Homo Sapiens
LLLQSVDQL

SEQ ID NO: 1142721 - protein, 9 aa, Homo Sapiens
LQRNLLRLQ

SEQ ID NO: 1142722 - protein, 9 aa, Homo Sapiens
HAGAMLEGK

SEQ ID NO: 1142723 - protein, 9 aa, Homo Sapiens
SLELSRSPR

SEQ ID NO: 1142724 - protein, 9 aa, Homo Sapiens
RIDNTTVTY

SEQ ID NO: 1142725 - protein, 9 aa, Homo Sapiens
VLLASVLPP

SEQ ID NO: 1142726 - protein, 9 aa, Homo Sapiens
TAALSFTLE

SEQ ID NO: 1142727 - protein, 9 aa, Homo Sapiens
GATRPGLQM

SEQ ID NO: 1142728 - protein, 9 aa, Homo Sapiens
RAFISPSIL

SEQ ID NO: 1142729 - protein, 9 aa, Homo Sapiens
LSRSPRRSR

SEQ ID NO: 1142730 - protein, 9 aa, Homo Sapiens
CRNNLYLLL

SEQ ID NO: 1142731 - protein, 9 aa, Homo Sapiens
RNKVAQAKL

SEQ ID NO: 1142732 - protein, 9 aa, Homo Sapiens
TQDLKTKSI

SEQ ID NO: 1142733 - protein, 9 aa, Homo Sapiens
HVGLGRLLA

SEQ ID NO: 1142734 - protein, 9 aa, Homo Sapiens
STLESSSHT

SEQ ID NO: 1142735 - protein, 9 aa, Homo Sapiens
QMVEATRYC

SEQ ID NO: 1142736 - protein, 9 aa, Homo Sapiens
HKYCCDAPH

SEQ ID NO: 1142737 - protein, 9 aa, Homo Sapiens
RQFLAKQGQ

SEQ ID NO: 1142738 - protein, 9 aa, Homo Sapiens
LYNVPEESP

SEQ ID NO: 1142739 - protein, 9 aa, Homo Sapiens
CYNFTRGDL

SEQ ID NO: 1142740 - protein, 9 aa, Homo Sapiens
RDTQELLPP

SEQ ID NO: 1142741 - protein, 9 aa, Homo Sapiens
CEVLEILLS

SEQ ID NO: 1142742 - protein, 9 aa, Homo Sapiens
NGRKFPCGP

SEQ ID NO: 1142743 - protein, 9 aa, Homo Sapiens
PPEASDYLH

SEQ ID NO: 1142744 - protein, 9 aa, Homo Sapiens
ELSLEGNSF

SEQ ID NO: 1142745 - protein, 9 aa, Homo Sapiens
RPGPKEAIS

SEQ ID NO: 1142746 - protein, 9 aa, Homo Sapiens
SQRKDCKWS

SEQ ID NO: 1142747 - protein, 9 aa, Homo Sapiens
WCLPPTTAS

SEQ ID NO: 1142748 - protein, 9 aa, Homo Sapiens
KIGDWKVMS

SEQ ID NO: 1142749 - protein, 9 aa, Homo Sapiens
PLLPHKSGS

SEQ ID NO: 1142750 - protein, 9 aa, Homo Sapiens
VSPSCPRCP

SEQ ID NO: 1142751 - protein, 9 aa, Homo Sapiens
GGGRYYGGD

SEQ ID NO: 1142752 - protein, 9 aa, Homo Sapiens
DVTGYLRTA

SEQ ID NO: 1142753 - protein, 9 aa, Homo Sapiens
ELGWRDSEI

SEQ ID NO: 1142754 - protein, 9 aa, Homo Sapiens
EKKTMNLTI

SEQ ID NO: 1142755 - protein, 9 aa, Homo Sapiens
QGVPQVSLV

SEQ ID NO: 1142756 - protein, 9 aa, Homo Sapiens
APQPSAAPA

SEQ ID NO: 1142757 - protein, 9 aa, Homo Sapiens
TPTLVPDPC

SEQ ID NO: 1142758 - protein, 9 aa, Homo Sapiens
VMVTIWWSV

SEQ ID NO: 1142759 - protein, 9 aa, Homo Sapiens
GLTHPAHQP

SEQ ID NO: 1142760 - protein, 9 aa, Homo Sapiens
LVGMTPRDL

SEQ ID NO: 1142761 - protein, 9 aa, Homo Sapiens
FFSNQPERV

SEQ ID NO: 1142762 - protein, 9 aa, Homo Sapiens
ALGPGRRSQ

SEQ ID NO: 1142763 - protein, 9 aa, Homo Sapiens
DFVLPPILQ

SEQ ID NO: 1142764 - protein, 9 aa, Homo Sapiens
TGYILFLVA

SEQ ID NO: 1142765 - protein, 9 aa, Homo Sapiens
QQLHQLPMG

SEQ ID NO: 1142766 - protein, 9 aa, Homo Sapiens
PTKPFRLHC

SEQ ID NO: 1142767 - protein, 9 aa, Homo Sapiens
VKKLKRQSL

SEQ ID NO: 1142768 - protein, 9 aa, Homo Sapiens
ELENEFLVY

SEQ ID NO: 1142769 - protein, 9 aa, Homo Sapiens
FHHGEKPYE

SEQ ID NO: 1142770 - protein, 9 aa, Homo Sapiens
LREYMVEKN

SEQ ID NO: 1142771 - protein, 9 aa, Homo Sapiens
HPLCGLGFC

SEQ ID NO: 1142772 - protein, 9 aa, Homo Sapiens
RQAPRTTAF

SEQ ID NO: 1142773 - protein, 9 aa, Homo Sapiens
RIIIMCCTN

SEQ ID NO: 1142774 - protein, 9 aa, Homo Sapiens
TRCRWAGAR

SEQ ID NO: 1142775 - protein, 9 aa, Homo Sapiens
CTQGQLYEV

SEQ ID NO: 1142776 - protein, 9 aa, Homo Sapiens
ISTQLCKKQ

SEQ ID NO: 1142777 - protein, 9 aa, Homo Sapiens
EGKILVRKV

SEQ ID NO: 1142778 - protein, 9 aa, Homo Sapiens
HYDAAFAQA

SEQ ID NO: 1142779 - protein, 9 aa, Homo Sapiens
TGPPHPTRM

SEQ ID NO: 1142780 - protein, 9 aa, Homo Sapiens
DQRAGKDPP

SEQ ID NO: 1142781 - protein, 9 aa, Homo Sapiens
HFFLIEKNL

SEQ ID NO: 1142782 - protein, 9 aa, Homo Sapiens
GSLEEKMEY

SEQ ID NO: 1142783 - protein, 9 aa, Homo Sapiens
RVREVEAVP

SEQ ID NO: 1142784 - protein, 9 aa, Homo Sapiens
EEMKWSRKA

SEQ ID NO: 1142785 - protein, 9 aa, Homo Sapiens
LICLQVAVL

SEQ ID NO: 1142786 - protein, 9 aa, Homo Sapiens
FLCVWGGYV

SEQ ID NO: 1142787 - protein, 9 aa, Homo Sapiens
LSKELWQKY

SEQ ID NO: 1142788 - protein, 9 aa, Homo Sapiens
GLDSLAGRG

SEQ ID NO: 1142789 - protein, 9 aa, Homo Sapiens
RSSAASPPA

SEQ ID NO: 1142790 - protein, 9 aa, Homo Sapiens
KKLSINNYR

SEQ ID NO: 1142791 - protein, 9 aa, Homo Sapiens
RKTMRPSLA

SEQ ID NO: 1142792 - protein, 9 aa, Homo Sapiens
PSLARRPLL

SEQ ID NO: 1142793 - protein, 9 aa, Homo Sapiens
LWSPLLFTG

SEQ ID NO: 1142794 - protein, 9 aa, Homo Sapiens
GPAARAKVA

SEQ ID NO: 1142795 - protein, 9 aa, Homo Sapiens
LRIPRWLPR

SEQ ID NO: 1142796 - protein, 9 aa, Homo Sapiens
SIICKKDAP

SEQ ID NO: 1142797 - protein, 9 aa, Homo Sapiens
DDADVYWCV

SEQ ID NO: 1142798 - protein, 9 aa, Homo Sapiens
SSLEPQQHF

SEQ ID NO: 1142799 - protein, 9 aa, Homo Sapiens
VQLRKLLHV

SEQ ID NO: 1142800 - protein, 9 aa, Homo Sapiens
HAPQLLPHP

SEQ ID NO: 1142801 - protein, 9 aa, Homo Sapiens
KTSLKASRM

SEQ ID NO: 1142802 - protein, 9 aa, Homo Sapiens
ESLDSPPQP

SEQ ID NO: 1142803 - protein, 9 aa, Homo Sapiens
YFTEEPEPE

SEQ ID NO: 1142804 - protein, 9 aa, Homo Sapiens
FLACDWLGC

SEQ ID NO: 1142805 - protein, 9 aa, Homo Sapiens
LQEQLYMRR

SEQ ID NO: 1142806 - protein, 9 aa, Homo Sapiens
VIAEAYTTK

SEQ ID NO: 1142807 - protein, 9 aa, Homo Sapiens
LAMAPRPRA

SEQ ID NO: 1142808 - protein, 9 aa, Homo Sapiens
QGPPGTSPG

SEQ ID NO: 1142809 - protein, 9 aa, Homo Sapiens
SPKRSKKSH

SEQ ID NO: 1142810 - protein, 9 aa, Homo Sapiens
DLGFFGQNQ

SEQ ID NO: 1142811 - protein, 9 aa, Homo Sapiens
ALNSWTQED

SEQ ID NO: 1142812 - protein, 9 aa, Homo Sapiens
VESLVQLKI

SEQ ID NO: 1142813 - protein, 9 aa, Homo Sapiens
HDVSSVLER

SEQ ID NO: 1142814 - protein, 9 aa, Homo Sapiens
EFGLLILFL

SEQ ID NO: 1142815 - protein, 9 aa, Homo Sapiens
HPLFTMFSS

SEQ ID NO: 1142816 - protein, 9 aa, Homo Sapiens
RALLYPRPW

SEQ ID NO: 1142817 - protein, 9 aa, Homo Sapiens
VPILCLFWL

SEQ ID NO: 1142818 - protein, 9 aa, Homo Sapiens
STRKLYEKR

SEQ ID NO: 1142819 - protein, 9 aa, Homo Sapiens
SLPGAMNAR

SEQ ID NO: 1142820 - protein, 9 aa, Homo Sapiens
KIGSDQELY

SEQ ID NO: 1142821 - protein, 9 aa, Homo Sapiens
LEEKVKKEG

SEQ ID NO: 1142822 - protein, 9 aa, Homo Sapiens
TQLLHILEA

SEQ ID NO: 1142823 - protein, 9 aa, Homo Sapiens
KPRVCPTSR

SEQ ID NO: 1142824 - protein, 9 aa, Homo Sapiens
SLGLFLNST

SEQ ID NO: 1142825 - protein, 9 aa, Homo Sapiens
PHDVSSVLE

SEQ ID NO: 1142826 - protein, 9 aa, Homo Sapiens
STDSEALHY

SEQ ID NO: 1142827 - protein, 9 aa, Homo Sapiens
DHSDLIYLC

SEQ ID NO: 1142828 - protein, 9 aa, Homo Sapiens
VAWLGEFDQ

SEQ ID NO: 1142829 - protein, 9 aa, Homo Sapiens
TMYYQVVKA

SEQ ID NO: 1142830 - protein, 9 aa, Homo Sapiens
RSRCRPHAW

SEQ ID NO: 1142831 - protein, 9 aa, Homo Sapiens
SLGARARTE

SEQ ID NO: 1142832 - protein, 9 aa, Homo Sapiens
VGRVVEAGG

SEQ ID NO: 1142833 - protein, 9 aa, Homo Sapiens
NYDDDEDDG

SEQ ID NO: 1142834 - protein, 9 aa, Homo Sapiens
GSRPGWKRT

SEQ ID NO: 1142835 - protein, 9 aa, Homo Sapiens
ALGRAPVSL

SEQ ID NO: 1142836 - protein, 9 aa, Homo Sapiens
ANSLRVCRP

SEQ ID NO: 1142837 - protein, 9 aa, Homo Sapiens
GSTDEVKAG

SEQ ID NO: 1142838 - protein, 9 aa, Homo Sapiens
RGGENLIPC

SEQ ID NO: 1142839 - protein, 9 aa, Homo Sapiens
LLQGVPGKT

SEQ ID NO: 1142840 - protein, 9 aa, Homo Sapiens
AVASSLSTP

SEQ ID NO: 1142841 - protein, 9 aa, Homo Sapiens
ERNPKIGLQ

SEQ ID NO: 1142842 - protein, 9 aa, Homo Sapiens
HRGRTGVLL

SEQ ID NO: 1142843 - protein, 9 aa, Homo Sapiens
PDAQTPDMS

SEQ ID NO: 1142844 - protein, 9 aa, Homo Sapiens
HLLREEKFW

SEQ ID NO: 1142845 - protein, 9 aa, Homo Sapiens
GRKLQRCDL

SEQ ID NO: 1142846 - protein, 9 aa, Homo Sapiens
RPQASTAVA

SEQ ID NO: 1142847 - protein, 9 aa, Homo Sapiens
TSLEEDAEP

SEQ ID NO: 1142848 - protein, 9 aa, Homo Sapiens
VAYCYYLLP

SEQ ID NO: 1142849 - protein, 9 aa, Homo Sapiens
YSSCLKDIE

SEQ ID NO: 1142850 - protein, 9 aa, Homo Sapiens
APPMMGAGY

SEQ ID NO: 1142851 - protein, 9 aa, Homo Sapiens
FKTNRIAGK

SEQ ID NO: 1142852 - protein, 9 aa, Homo Sapiens
IDLLDWCTK

SEQ ID NO: 1142853 - protein, 9 aa, Homo Sapiens
PQAPSQVWT

SEQ ID NO: 1142854 - protein, 9 aa, Homo Sapiens
QPMKTVVWG

SEQ ID NO: 1142855 - protein, 9 aa, Homo Sapiens
YGAHRCRIP

SEQ ID NO: 1142856 - protein, 9 aa, Homo Sapiens
AASTSSPAS

SEQ ID NO: 1142857 - protein, 9 aa, Homo Sapiens
MHGNETVGR

SEQ ID NO: 1142858 - protein, 9 aa, Homo Sapiens
WNFCDIGYH

SEQ ID NO: 1142859 - protein, 9 aa, Homo Sapiens
LALDSEAGV

SEQ ID NO: 1142860 - protein, 9 aa, Homo Sapiens
ASLLSTLSQ

SEQ ID NO: 1142861 - protein, 9 aa, Homo Sapiens
PNIDNVTVL

SEQ ID NO: 1142862 - protein, 9 aa, Homo Sapiens
IITRDRGYN

SEQ ID NO: 1142863 - protein, 9 aa, Homo Sapiens
IVKAMYYLK

SEQ ID NO: 1142864 - protein, 9 aa, Homo Sapiens
CQSPAHAHQ

SEQ ID NO: 1142865 - protein, 9 aa, Homo Sapiens
EPPHVERNL

SEQ ID NO: 1142866 - protein, 9 aa, Homo Sapiens
GESMEGLGH

SEQ ID NO: 1142867 - protein, 9 aa, Homo Sapiens
GVSTTAAGT

SEQ ID NO: 1142868 - protein, 9 aa, Homo Sapiens
QLNEEKSSL

SEQ ID NO: 1142869 - protein, 9 aa, Homo Sapiens
LVVCKQNVD

SEQ ID NO: 1142870 - protein, 9 aa, Homo Sapiens
HVFDANEPA

SEQ ID NO: 1142871 - protein, 9 aa, Homo Sapiens
KMDDATISR

SEQ ID NO: 1142872 - protein, 9 aa, Homo Sapiens
TEQPLELRL

SEQ ID NO: 1142873 - protein, 9 aa, Homo Sapiens
VDSLYLMQK

SEQ ID NO: 1142874 - protein, 9 aa, Homo Sapiens
ARSPTSSPT

SEQ ID NO: 1142875 - protein, 9 aa, Homo Sapiens
SLHVVKRKP

SEQ ID NO: 1142876 - protein, 9 aa, Homo Sapiens
QVSVGLQGK

SEQ ID NO: 1142877 - protein, 9 aa, Homo Sapiens
YLSSWFEDA

SEQ ID NO: 1142878 - protein, 9 aa, Homo Sapiens
DATMCCSFS

SEQ ID NO: 1142879 - protein, 9 aa, Homo Sapiens
QPHLLDILS

SEQ ID NO: 1142880 - protein, 9 aa, Homo Sapiens
WRVRKIGDW

SEQ ID NO: 1142881 - protein, 9 aa, Homo Sapiens
RTTLSGQQD

SEQ ID NO: 1142882 - protein, 9 aa, Homo Sapiens
WGRWTPKAW

SEQ ID NO: 1142883 - protein, 9 aa, Homo Sapiens
KIPQCLQLQ

SEQ ID NO: 1142884 - protein, 9 aa, Homo Sapiens
STGIRDMHL

SEQ ID NO: 1142885 - protein, 9 aa, Homo Sapiens
FSPDLTEEM

SEQ ID NO: 1142886 - protein, 9 aa, Homo Sapiens
FCRPTTVRK

SEQ ID NO: 1142887 - protein, 9 aa, Homo Sapiens
PLLEGSAEM

SEQ ID NO: 1142888 - protein, 9 aa, Homo Sapiens
RERAHMRVL

SEQ ID NO: 1142889 - protein, 9 aa, Homo Sapiens
TKMHRFYHI

SEQ ID NO: 1142890 - protein, 9 aa, Homo Sapiens
QDKYPAAHL

SEQ ID NO: 1142891 - protein, 9 aa, Homo Sapiens
PRAPHPPPA

SEQ ID NO: 1142892 - protein, 9 aa, Homo Sapiens
LAPIFEAQL

SEQ ID NO: 1142893 - protein, 9 aa, Homo Sapiens
VKGPDSPDS

SEQ ID NO: 1142894 - protein, 9 aa, Homo Sapiens
FISMQAVIS

SEQ ID NO: 1142895 - protein, 9 aa, Homo Sapiens
PRCPGSAGR

SEQ ID NO: 1142896 - protein, 9 aa, Homo Sapiens
SISTGCPLL

SEQ ID NO: 1142897 - protein, 9 aa, Homo Sapiens
ERMDYMKHK

SEQ ID NO: 1142898 - protein, 9 aa, Homo Sapiens
RETPTKLEP

SEQ ID NO: 1142899 - protein, 9 aa, Homo Sapiens
CSLLNFLSE

SEQ ID NO: 1142900 - protein, 9 aa, Homo Sapiens
APRPHSRGP

SEQ ID NO: 1142901 - protein, 9 aa, Homo Sapiens
DECLQDRCE

SEQ ID NO: 1142902 - protein, 9 aa, Homo Sapiens
RHDRGNYAR

SEQ ID NO: 1142903 - protein, 9 aa, Homo Sapiens
SWGTQCRRC

SEQ ID NO: 1142904 - protein, 9 aa, Homo Sapiens
LTPRPATGK

SEQ ID NO: 1142905 - protein, 9 aa, Homo Sapiens
SARPTKLGS

SEQ ID NO: 1142906 - protein, 9 aa, Homo Sapiens
EYRKHLNSH

SEQ ID NO: 1142907 - protein, 9 aa, Homo Sapiens
GWKRTQQRP

SEQ ID NO: 1142908 - protein, 9 aa, Homo Sapiens
LSDDHHGLV

SEQ ID NO: 1142909 - protein, 9 aa, Homo Sapiens
PWDCGGSEA

SEQ ID NO: 1142910 - protein, 9 aa, Homo Sapiens
KEIALHKYL

SEQ ID NO: 1142911 - protein, 9 aa, Homo Sapiens
RTHLKEYEQ

SEQ ID NO: 1142912 - protein, 9 aa, Homo Sapiens
MCGFKGDRG

SEQ ID NO: 1142913 - protein, 9 aa, Homo Sapiens
LLMPPPGLR

SEQ ID NO: 1142914 - protein, 9 aa, Homo Sapiens
SQVWTAATL

SEQ ID NO: 1142915 - protein, 9 aa, Homo Sapiens
RNLYRDAML

SEQ ID NO: 1142916 - protein, 9 aa, Homo Sapiens
FNASEQLPR

SEQ ID NO: 1142917 - protein, 9 aa, Homo Sapiens
EKPYICSKC

SEQ ID NO: 1142918 - protein, 9 aa, Homo Sapiens
FRKECNFSD

SEQ ID NO: 1142919 - protein, 9 aa, Homo Sapiens
LGMIPGLGQ

SEQ ID NO: 1142920 - protein, 9 aa, Homo Sapiens
LQMENALVA

SEQ ID NO: 1142921 - protein, 9 aa, Homo Sapiens
KLGNEVGHS

SEQ ID NO: 1142922 - protein, 9 aa, Homo Sapiens
EFSRGKTRK

SEQ ID NO: 1142923 - protein, 9 aa, Homo Sapiens
VGSTDEVKA

SEQ ID NO: 1142924 - protein, 9 aa, Homo Sapiens
EDDEDVGTT

SEQ ID NO: 1142925 - protein, 9 aa, Homo Sapiens
QGDVGGQRC

SEQ ID NO: 1142926 - protein, 9 aa, Homo Sapiens
KTSLFLHHK

SEQ ID NO: 1142927 - protein, 9 aa, Homo Sapiens
VVLHSPGAM

SEQ ID NO: 1142928 - protein, 9 aa, Homo Sapiens
RSSSLLPPR

SEQ ID NO: 1142929 - protein, 9 aa, Homo Sapiens
SGSQRTSSA

SEQ ID NO: 1142930 - protein, 9 aa, Homo Sapiens
PVAAEAVTF

SEQ ID NO: 1142931 - protein, 9 aa, Homo Sapiens
HEDDFCEAA

SEQ ID NO: 1142932 - protein, 9 aa, Homo Sapiens
RKAKFCIFS

SEQ ID NO: 1142933 - protein, 9 aa, Homo Sapiens
PHACRECGK

SEQ ID NO: 1142934 - protein, 9 aa, Homo Sapiens
GSRAEVTLI

SEQ ID NO: 1142935 - protein, 9 aa, Homo Sapiens
TSVEEMFAS

SEQ ID NO: 1142936 - protein, 9 aa, Homo Sapiens
HGVPPLVLN

SEQ ID NO: 1142937 - protein, 9 aa, Homo Sapiens
LMQKHTSSG

SEQ ID NO: 1142938 - protein, 9 aa, Homo Sapiens
FLSKKGNFQ

SEQ ID NO: 1142939 - protein, 9 aa, Homo Sapiens
ASGLVISTW

SEQ ID NO: 1142940 - protein, 9 aa, Homo Sapiens
GKEARSTVV

SEQ ID NO: 1142941 - protein, 9 aa, Homo Sapiens
PGPRLAPTQ

SEQ ID NO: 1142942 - protein, 9 aa, Homo Sapiens
TQGMKHSSQ

SEQ ID NO: 1142943 - protein, 9 aa, Homo Sapiens
LVLYGQNKK

SEQ ID NO: 1142944 - protein, 9 aa, Homo Sapiens
NAIPQSPRS

SEQ ID NO: 1142945 - protein, 9 aa, Homo Sapiens
GIPAPDNFL

SEQ ID NO: 1142946 - protein, 9 aa, Homo Sapiens
WTLTLVYFS

SEQ ID NO: 1142947 - protein, 9 aa, Homo Sapiens
AILELSAIV

SEQ ID NO: 1142948 - protein, 9 aa, Homo Sapiens
IGAGRAPLH

SEQ ID NO: 1142949 - protein, 9 aa, Homo Sapiens
FSSPPSVTI

SEQ ID NO: 1142950 - protein, 9 aa, Homo Sapiens
LSLKAHQPE

SEQ ID NO: 1142951 - protein, 9 aa, Homo Sapiens
NHFHQSVQE

SEQ ID NO: 1142952 - protein, 9 aa, Homo Sapiens
SSVVWQDLI

SEQ ID NO: 1142953 - protein, 9 aa, Homo Sapiens
TGSVGALTG

SEQ ID NO: 1142954 - protein, 9 aa, Homo Sapiens
LDEMFSSEK

SEQ ID NO: 1142955 - protein, 9 aa, Homo Sapiens
TGRGLRQRR

SEQ ID NO: 1142956 - protein, 9 aa, Homo Sapiens
LATFYRLAD

SEQ ID NO: 1142957 - protein, 9 aa, Homo Sapiens
GFASRDKQV

SEQ ID NO: 1142958 - protein, 9 aa, Homo Sapiens
QERVPEIIS

SEQ ID NO: 1142959 - protein, 9 aa, Homo Sapiens
QAADPTPSH

SEQ ID NO: 1142960 - protein, 9 aa, Homo Sapiens
FMECLVDAH

SEQ ID NO: 1142961 - protein, 9 aa, Homo Sapiens
PSKPGHKTN

SEQ ID NO: 1142962 - protein, 9 aa, Homo Sapiens
LGWRDSEIA

SEQ ID NO: 1142963 - protein, 9 aa, Homo Sapiens
EVPGLHGSL

SEQ ID NO: 1142964 - protein, 9 aa, Homo Sapiens
GLTMVYAFC

SEQ ID NO: 1142965 - protein, 9 aa, Homo Sapiens
SWIGVVILP

SEQ ID NO: 1142966 - protein, 9 aa, Homo Sapiens
VVAPATGPA

SEQ ID NO: 1142967 - protein, 9 aa, Homo Sapiens
PMLRPLGPG

SEQ ID NO: 1142968 - protein, 9 aa, Homo Sapiens
PKEAVVLPM

SEQ ID NO: 1142969 - protein, 9 aa, Homo Sapiens
PWPSALPSQ

SEQ ID NO: 1142970 - protein, 9 aa, Homo Sapiens
SAPVPVATQ

SEQ ID NO: 1142971 - protein, 9 aa, Homo Sapiens
KFEGDHESS

SEQ ID NO: 1142972 - protein, 9 aa, Homo Sapiens
PVTRGRRTG

SEQ ID NO: 1142973 - protein, 9 aa, Homo Sapiens
AGVRMGCVR

SEQ ID NO: 1142974 - protein, 9 aa, Homo Sapiens
TAAGIPDLA

SEQ ID NO: 1142975 - protein, 9 aa, Homo Sapiens
HMLDHLTKK

SEQ ID NO: 1142976 - protein, 9 aa, Homo Sapiens
RRILHRAVR

SEQ ID NO: 1142977 - protein, 9 aa, Homo Sapiens
MMPGVAGAA

SEQ ID NO: 1142978 - protein, 9 aa, Homo Sapiens
DVIVFSYVK

SEQ ID NO: 1142979 - protein, 9 aa, Homo Sapiens
AMNLMTVTG

SEQ ID NO: 1142980 - protein, 9 aa, Homo Sapiens
GISFGLLNI

SEQ ID NO: 1142981 - protein, 9 aa, Homo Sapiens
HVGAADGLD

SEQ ID NO: 1142982 - protein, 9 aa, Homo Sapiens
DWIVAPRGI

SEQ ID NO: 1142983 - protein, 9 aa, Homo Sapiens
YETARVNGL

SEQ ID NO: 1142984 - protein, 9 aa, Homo Sapiens
GRTRTLKIT

SEQ ID NO: 1142985 - protein, 9 aa, Homo Sapiens
RQRGYHKKS

SEQ ID NO: 1142986 - protein, 9 aa, Homo Sapiens
SLPGSSATV

SEQ ID NO: 1142987 - protein, 9 aa, Homo Sapiens
IHLVEGYLL

SEQ ID NO: 1142988 - protein, 9 aa, Homo Sapiens
RLRGGQRGQ

SEQ ID NO: 1142989 - protein, 9 aa, Homo Sapiens
KSQDQDVIK

SEQ ID NO: 1142990 - protein, 9 aa, Homo Sapiens
IRNTSYDGV

SEQ ID NO: 1142991 - protein, 9 aa, Homo Sapiens
SHVTANMVD

SEQ ID NO: 1142992 - protein, 9 aa, Homo Sapiens
MGKNRMERV

SEQ ID NO: 1142993 - protein, 9 aa, Homo Sapiens
DSVEHRDNL

SEQ ID NO: 1142994 - protein, 9 aa, Homo Sapiens
AQDITVYHE

SEQ ID NO: 1142995 - protein, 9 aa, Homo Sapiens
ERRGRRGHE

SEQ ID NO: 1142996 - protein, 9 aa, Homo Sapiens
RHPLHPPHL

SEQ ID NO: 1142997 - protein, 9 aa, Homo Sapiens
TIGLWLTTA

SEQ ID NO: 1142998 - protein, 9 aa, Homo Sapiens
RCPSPSRAR

SEQ ID NO: 1142999 - protein, 9 aa, Homo Sapiens
QPLKPPDGQ

SEQ ID NO: 1143000 - protein, 9 aa, Homo Sapiens
EAETLALVG

SEQ ID NO: 1143001 - protein, 9 aa, Homo Sapiens
TYGPDFGPN

SEQ ID NO: 1143002 - protein, 9 aa, Homo Sapiens
YLPEDFIWV

SEQ ID NO: 1143003 - protein, 9 aa, Homo Sapiens
CPVGGAEGI

SEQ ID NO: 1143004 - protein, 9 aa, Homo Sapiens
CRRRPRAGC

SEQ ID NO: 1143005 - protein, 9 aa, Homo Sapiens
LAGSDRVAK

SEQ ID NO: 1143006 - protein, 9 aa, Homo Sapiens
TTMKSVMCK

SEQ ID NO: 1143007 - protein, 9 aa, Homo Sapiens
STDDADADG

SEQ ID NO: 1143008 - protein, 9 aa, Homo Sapiens
FNHHGRVLF

SEQ ID NO: 1143009 - protein, 9 aa, Homo Sapiens
VWMTHEMES

SEQ ID NO: 1143010 - protein, 9 aa, Homo Sapiens
DSNQNSPIR

SEQ ID NO: 1143011 - protein, 9 aa, Homo Sapiens
GPLGLLLPA

SEQ ID NO: 1143012 - protein, 9 aa, Homo Sapiens
ICLLSLRAQ

SEQ ID NO: 1143013 - protein, 9 aa, Homo Sapiens
ASPGPPCGP

SEQ ID NO: 1143014 - protein, 9 aa, Homo Sapiens
PYWRRTAHV

SEQ ID NO: 1143015 - protein, 9 aa, Homo Sapiens
RQCVDRVFH

SEQ ID NO: 1143016 - protein, 9 aa, Homo Sapiens
EGSWIQEIN

SEQ ID NO: 1143017 - protein, 9 aa, Homo Sapiens
DQRDSLKIV

SEQ ID NO: 1143018 - protein, 9 aa, Homo Sapiens
VDQQKSSLS

SEQ ID NO: 1143019 - protein, 9 aa, Homo Sapiens
AVTSLSVLW

SEQ ID NO: 1143020 - protein, 9 aa, Homo Sapiens
YVIKCDMSV

SEQ ID NO: 1143021 - protein, 9 aa, Homo Sapiens
TQQINECKR

SEQ ID NO: 1143022 - protein, 9 aa, Homo Sapiens
LNDFHMSEL

SEQ ID NO: 1143023 - protein, 9 aa, Homo Sapiens
RSDTAQIVA

SEQ ID NO: 1143024 - protein, 9 aa, Homo Sapiens
LRILTSQRP

SEQ ID NO: 1143025 - protein, 9 aa, Homo Sapiens
LVAVAGESM

SEQ ID NO: 1143026 - protein, 9 aa, Homo Sapiens
TQSYSERME

SEQ ID NO: 1143027 - protein, 9 aa, Homo Sapiens
TWEHLVSTR

SEQ ID NO: 1143028 - protein, 9 aa, Homo Sapiens
QDLVHVHPH

SEQ ID NO: 1143029 - protein, 9 aa, Homo Sapiens
NGHCIGTLS

SEQ ID NO: 1143030 - protein, 9 aa, Homo Sapiens
DVYKLIHKS

SEQ ID NO: 1143031 - protein, 9 aa, Homo Sapiens
SFPTFGATD

SEQ ID NO: 1143032 - protein, 9 aa, Homo Sapiens
RVRPGRPSL

SEQ ID NO: 1143033 - protein, 9 aa, Homo Sapiens
DSGLVHQGD

SEQ ID NO: 1143034 - protein, 9 aa, Homo Sapiens
APAAARSSL

SEQ ID NO: 1143035 - protein, 9 aa, Homo Sapiens
LHEHGQRQQ

SEQ ID NO: 1143036 - protein, 9 aa, Homo Sapiens
TAFVFVITA

SEQ ID NO: 1143037 - protein, 9 aa, Homo Sapiens
SRSSSSIQE

SEQ ID NO: 1143038 - protein, 9 aa, Homo Sapiens
RPWGTGTRR

SEQ ID NO: 1143039 - protein, 9 aa, Homo Sapiens
DNTVSKRAS

SEQ ID NO: 1143040 - protein, 9 aa, Homo Sapiens
LYATVIHNV

SEQ ID NO: 1143041 - protein, 9 aa, Homo Sapiens
SSSLPTQWG

SEQ ID NO: 1143042 - protein, 9 aa, Homo Sapiens
LGRGACESG

SEQ ID NO: 1143043 - protein, 9 aa, Homo Sapiens
QLPSLRRTV

SEQ ID NO: 1143044 - protein, 9 aa, Homo Sapiens
QCQEQEVCF

SEQ ID NO: 1143045 - protein, 9 aa, Homo Sapiens
GAMVNTTDY

SEQ ID NO: 1143046 - protein, 9 aa, Homo Sapiens
FLQYPHFLK

SEQ ID NO: 1143047 - protein, 9 aa, Homo Sapiens
SFLAAAHMS

SEQ ID NO: 1143048 - protein, 9 aa, Homo Sapiens
PPPPPIPQR

SEQ ID NO: 1143049 - protein, 9 aa, Homo Sapiens
RERGGLSPA

SEQ ID NO: 1143050 - protein, 9 aa, Homo Sapiens
AVLQATGGD

SEQ ID NO: 1143051 - protein, 9 aa, Homo Sapiens
ARETSLASC

SEQ ID NO: 1143052 - protein, 9 aa, Homo Sapiens
PQKFLDTSH

SEQ ID NO: 1143053 - protein, 9 aa, Homo Sapiens
GNLIGNNCN

SEQ ID NO: 1143054 - protein, 9 aa, Homo Sapiens
QLHQLPMGR

SEQ ID NO: 1143055 - protein, 9 aa, Homo Sapiens
EFISVKEAA

SEQ ID NO: 1143056 - protein, 9 aa, Homo Sapiens
YTKLVLDRH

SEQ ID NO: 1143057 - protein, 9 aa, Homo Sapiens
RLVSYWAQP

SEQ ID NO: 1143058 - protein, 9 aa, Homo Sapiens
GPRPPGAPP

SEQ ID NO: 1143059 - protein, 9 aa, Homo Sapiens
GFLTEDKKN

SEQ ID NO: 1143060 - protein, 9 aa, Homo Sapiens
VPGDAPSHS

SEQ ID NO: 1143061 - protein, 9 aa, Homo Sapiens
MCRTPLASV

SEQ ID NO: 1143062 - protein, 9 aa, Homo Sapiens
HFCPLRTLP

SEQ ID NO: 1143063 - protein, 9 aa, Homo Sapiens
LIQQPRYPR

SEQ ID NO: 1143064 - protein, 9 aa, Homo Sapiens
CGRRTRKQT

SEQ ID NO: 1143065 - protein, 9 aa, Homo Sapiens
QARPHAYYT

SEQ ID NO: 1143066 - protein, 9 aa, Homo Sapiens
ISDRYYTTL

SEQ ID NO: 1143067 - protein, 9 aa, Homo Sapiens
SDFAHQSWL

SEQ ID NO: 1143068 - protein, 9 aa, Homo Sapiens
SQGIQTRFS

SEQ ID NO: 1143069 - protein, 9 aa, Homo Sapiens
CFYTPATPG

SEQ ID NO: 1143070 - protein, 9 aa, Homo Sapiens
GCTLWPHQG

SEQ ID NO: 1143071 - protein, 9 aa, Homo Sapiens
FPEVVASAD

SEQ ID NO: 1143072 - protein, 9 aa, Homo Sapiens
DSRQGSPGH

SEQ ID NO: 1143073 - protein, 9 aa, Homo Sapiens
RAEPKARPG

SEQ ID NO: 1143074 - protein, 9 aa, Homo Sapiens
SAPGSRDSP

SEQ ID NO: 1143075 - protein, 9 aa, Homo Sapiens
PPSHCQLCS

SEQ ID NO: 1143076 - protein, 9 aa, Homo Sapiens
NSVLGHIWK

SEQ ID NO: 1143077 - protein, 9 aa, Homo Sapiens
GWPDFLRGT

SEQ ID NO: 1143078 - protein, 9 aa, Homo Sapiens
HGASLQVVL

SEQ ID NO: 1143079 - protein, 9 aa, Homo Sapiens
ATLWGKMLI

SEQ ID NO: 1143080 - protein, 9 aa, Homo Sapiens
LQPPPQPPL

SEQ ID NO: 1143081 - protein, 9 aa, Homo Sapiens
SRLSWLTDP

SEQ ID NO: 1143082 - protein, 9 aa, Homo Sapiens
ERLLGPSME

SEQ ID NO: 1143083 - protein, 9 aa, Homo Sapiens
EVHRVTIMC

SEQ ID NO: 1143084 - protein, 9 aa, Homo Sapiens
IDEVTRNYA

SEQ ID NO: 1143085 - protein, 9 aa, Homo Sapiens
ENLRQCVDR

SEQ ID NO: 1143086 - protein, 9 aa, Homo Sapiens
CNRFVKKNG

SEQ ID NO: 1143087 - protein, 9 aa, Homo Sapiens
SHWEENRNG

SEQ ID NO: 1143088 - protein, 9 aa, Homo Sapiens
KSDPYTKVS

SEQ ID NO: 1143089 - protein, 9 aa, Homo Sapiens
ATPTEQPLE

SEQ ID NO: 1143090 - protein, 9 aa, Homo Sapiens
LPFSHPLFT

SEQ ID NO: 1143091 - protein, 9 aa, Homo Sapiens
SPTTRRGTP

SEQ ID NO: 1143092 - protein, 9 aa, Homo Sapiens
EPFPPAAPC

SEQ ID NO: 1143093 - protein, 9 aa, Homo Sapiens
PHVSGLGWP

SEQ ID NO: 1143094 - protein, 9 aa, Homo Sapiens
ISPSTVELS

SEQ ID NO: 1143095 - protein, 9 aa, Homo Sapiens
PTRHIRQDG

SEQ ID NO: 1143096 - protein, 9 aa, Homo Sapiens
RRQQHKNRE

SEQ ID NO: 1143097 - protein, 9 aa, Homo Sapiens
VAIVKAMYY

SEQ ID NO: 1143098 - protein, 9 aa, Homo Sapiens
SPTARATSG

SEQ ID NO: 1143099 - protein, 9 aa, Homo Sapiens
KGEIPSELQ

SEQ ID NO: 1143100 - protein, 9 aa, Homo Sapiens
DYEELTDEY

SEQ ID NO: 1143101 - protein, 9 aa, Homo Sapiens
GAHGASGGE

SEQ ID NO: 1143102 - protein, 9 aa, Homo Sapiens
IRTTMLSLC

SEQ ID NO: 1143103 - protein, 9 aa, Homo Sapiens
GPSPPLFQA

SEQ ID NO: 1143104 - protein, 9 aa, Homo Sapiens
PNIYRTMLQ

SEQ ID NO: 1143105 - protein, 9 aa, Homo Sapiens
SSRSPTRPP

SEQ ID NO: 1143106 - protein, 9 aa, Homo Sapiens
REVIAYFLE

SEQ ID NO: 1143107 - protein, 9 aa, Homo Sapiens
VIHTDLQSK

SEQ ID NO: 1143108 - protein, 9 aa, Homo Sapiens
HKLCRVYLE

SEQ ID NO: 1143109 - protein, 9 aa, Homo Sapiens
LGHGHKHEH

SEQ ID NO: 1143110 - protein, 9 aa, Homo Sapiens
SGGCPAEDG

SEQ ID NO: 1143111 - protein, 9 aa, Homo Sapiens
AFTAEVLVQ

SEQ ID NO: 1143112 - protein, 9 aa, Homo Sapiens
QLLYGRGEN

SEQ ID NO: 1143113 - protein, 9 aa, Homo Sapiens
RPQHSEPAH

SEQ ID NO: 1143114 - protein, 9 aa, Homo Sapiens
AGDTPSGHL

SEQ ID NO: 1143115 - protein, 9 aa, Homo Sapiens
NVDKPLHII

SEQ ID NO: 1143116 - protein, 9 aa, Homo Sapiens
DFTVIPSKP

SEQ ID NO: 1143117 - protein, 9 aa, Homo Sapiens
FTTTEGTTV

SEQ ID NO: 1143118 - protein, 9 aa, Homo Sapiens
FGYNLQVQG

SEQ ID NO: 1143119 - protein, 9 aa, Homo Sapiens
PSPPQGLVA

SEQ ID NO: 1143120 - protein, 9 aa, Homo Sapiens
TTLPGLFVK

SEQ ID NO: 1143121 - protein, 9 aa, Homo Sapiens
ILADDLIKV

SEQ ID NO: 1143122 - protein, 9 aa, Homo Sapiens
MTSPFKQEV

SEQ ID NO: 1143123 - protein, 9 aa, Homo Sapiens
ERPERYSSS

SEQ ID NO: 1143124 - protein, 9 aa, Homo Sapiens
MPGGAPGAP

SEQ ID NO: 1143125 - protein, 9 aa, Homo Sapiens
SVAPATLPC

SEQ ID NO: 1143126 - protein, 9 aa, Homo Sapiens
CFWSIPLVP

SEQ ID NO: 1143127 - protein, 9 aa, Homo Sapiens
NSAGVNEKV

SEQ ID NO: 1143128 - protein, 9 aa, Homo Sapiens
IHIPEPGLR

SEQ ID NO: 1143129 - protein, 9 aa, Homo Sapiens
VRSLRQDHV

SEQ ID NO: 1143130 - protein, 9 aa, Homo Sapiens
FRQMVEATR

SEQ ID NO: 1143131 - protein, 9 aa, Homo Sapiens
CRPHAWAPS

SEQ ID NO: 1143132 - protein, 9 aa, Homo Sapiens
DSTNADALH

SEQ ID NO: 1143133 - protein, 9 aa, Homo Sapiens
RCVCDRDDS

SEQ ID NO: 1143134 - protein, 9 aa, Homo Sapiens
LSIQERRRP

SEQ ID NO: 1143135 - protein, 9 aa, Homo Sapiens
QLCKKQNDR

SEQ ID NO: 1143136 - protein, 9 aa, Homo Sapiens
SLPAGGSCM

SEQ ID NO: 1143137 - protein, 9 aa, Homo Sapiens
ISTPHHPFQ

SEQ ID NO: 1143138 - protein, 9 aa, Homo Sapiens
GRAPARAGE

SEQ ID NO: 1143139 - protein, 9 aa, Homo Sapiens
RTAIKAKQL

SEQ ID NO: 1143140 - protein, 9 aa, Homo Sapiens
WALQASWSP

SEQ ID NO: 1143141 - protein, 9 aa, Homo Sapiens
DWRGPSWRV

SEQ ID NO: 1143142 - protein, 9 aa, Homo Sapiens
GGTAPMWTH

SEQ ID NO: 1143143 - protein, 9 aa, Homo Sapiens
HVSQSPFFA

SEQ ID NO: 1143144 - protein, 9 aa, Homo Sapiens
MAAESQGLS

SEQ ID NO: 1143145 - protein, 9 aa, Homo Sapiens
GHKTNQLQY

SEQ ID NO: 1143146 - protein, 9 aa, Homo Sapiens
DEEFCELCT

SEQ ID NO: 1143147 - protein, 9 aa, Homo Sapiens
AADGLDLLQ

SEQ ID NO: 1143148 - protein, 9 aa, Homo Sapiens
ARERAHMRV

SEQ ID NO: 1143149 - protein, 9 aa, Homo Sapiens
HGPRTDRLL

SEQ ID NO: 1143150 - protein, 9 aa, Homo Sapiens
QINHALLNS

SEQ ID NO: 1143151 - protein, 9 aa, Homo Sapiens
GAPTQRTTR

SEQ ID NO: 1143152 - protein, 9 aa, Homo Sapiens
QDMEKARET

SEQ ID NO: 1143153 - protein, 9 aa, Homo Sapiens
SLCVSRGAI

SEQ ID NO: 1143154 - protein, 9 aa, Homo Sapiens
APRTTAFCR

SEQ ID NO: 1143155 - protein, 9 aa, Homo Sapiens
KEHRNLPLC

SEQ ID NO: 1143156 - protein, 9 aa, Homo Sapiens
DEILTLCAS

SEQ ID NO: 1143157 - protein, 9 aa, Homo Sapiens
FAAISSRHQ

SEQ ID NO: 1143158 - protein, 9 aa, Homo Sapiens
LVIKFTVFI

SEQ ID NO: 1143159 - protein, 9 aa, Homo Sapiens
PAFSFSQPR

SEQ ID NO: 1143160 - protein, 9 aa, Homo Sapiens
ERKTSAVQR

SEQ ID NO: 1143161 - protein, 9 aa, Homo Sapiens
GTRSLLSSP

SEQ ID NO: 1143162 - protein, 9 aa, Homo Sapiens
ESLSSCQSM

SEQ ID NO: 1143163 - protein, 9 aa, Homo Sapiens
DNAYVQIRR

SEQ ID NO: 1143164 - protein, 9 aa, Homo Sapiens
SKSPKRSKK

SEQ ID NO: 1143165 - protein, 9 aa, Homo Sapiens
PTCTNQEIR

SEQ ID NO: 1143166 - protein, 9 aa, Homo Sapiens
GEAFRSASH

SEQ ID NO: 1143167 - protein, 9 aa, Homo Sapiens
MVAQSEAFD

SEQ ID NO: 1143168 - protein, 9 aa, Homo Sapiens
YVIAKVIVI

SEQ ID NO: 1143169 - protein, 9 aa, Homo Sapiens
LGPGRSIST

SEQ ID NO: 1143170 - protein, 9 aa, Homo Sapiens
ETVDKIVVQ

SEQ ID NO: 1143171 - protein, 9 aa, Homo Sapiens
FNGVRKYPL

SEQ ID NO: 1143172 - protein, 9 aa, Homo Sapiens
KSSLGVEIK

SEQ ID NO: 1143173 - protein, 9 aa, Homo Sapiens
PLSSSLRMT

SEQ ID NO: 1143174 - protein, 9 aa, Homo Sapiens
IATEREYIQ

SEQ ID NO: 1143175 - protein, 9 aa, Homo Sapiens
TDTKVGSEL

SEQ ID NO: 1143176 - protein, 9 aa, Homo Sapiens
TGKKKFSCP

SEQ ID NO: 1143177 - protein, 9 aa, Homo Sapiens
SSQPTSELS

SEQ ID NO: 1143178 - protein, 9 aa, Homo Sapiens
SMYLATVMG

SEQ ID NO: 1143179 - protein, 9 aa, Homo Sapiens
SSWTHPLRM

SEQ ID NO: 1143180 - protein, 9 aa, Homo Sapiens
LLSAITNRS

SEQ ID NO: 1143181 - protein, 9 aa, Homo Sapiens
MEEVLKWGE

SEQ ID NO: 1143182 - protein, 9 aa, Homo Sapiens
ICLDYSHYY

SEQ ID NO: 1143183 - protein, 9 aa, Homo Sapiens
MFCTGYSDG

SEQ ID NO: 1143184 - protein, 9 aa, Homo Sapiens
CYQNPEKNQ

SEQ ID NO: 1143185 - protein, 9 aa, Homo Sapiens
YYTLSYCAL

SEQ ID NO: 1143186 - protein, 9 aa, Homo Sapiens
DMTVHLPFI

SEQ ID NO: 1143187 - protein, 9 aa, Homo Sapiens
SHLASPPPR

SEQ ID NO: 1143188 - protein, 9 aa, Homo Sapiens
DQVRKQENE

SEQ ID NO: 1143189 - protein, 9 aa, Homo Sapiens
LPSAPTCQE

SEQ ID NO: 1143190 - protein, 9 aa, Homo Sapiens
EWVNSPEEV

SEQ ID NO: 1143191 - protein, 9 aa, Homo Sapiens
VTTHFDEVF

SEQ ID NO: 1143192 - protein, 9 aa, Homo Sapiens
MFYTPWCPH

SEQ ID NO: 1143193 - protein, 9 aa, Homo Sapiens
SATESPLTD

SEQ ID NO: 1143194 - protein, 9 aa, Homo Sapiens
PTRPSSPPP

SEQ ID NO: 1143195 - protein, 9 aa, Homo Sapiens
TMFSSGTTG

SEQ ID NO: 1143196 - protein, 9 aa, Homo Sapiens
CNHRKKEVR

SEQ ID NO: 1143197 - protein, 9 aa, Homo Sapiens
AVREHLREL

SEQ ID NO: 1143198 - protein, 9 aa, Homo Sapiens
KAVSSQPTS

SEQ ID NO: 1143199 - protein, 9 aa, Homo Sapiens
RRRRPPALR

SEQ ID NO: 1143200 - protein, 9 aa, Homo Sapiens
GHPSPRCAR

SEQ ID NO: 1143201 - protein, 9 aa, Homo Sapiens
GSPFTSANF

SEQ ID NO: 1143202 - protein, 9 aa, Homo Sapiens
FGGTEIFLF

SEQ ID NO: 1143203 - protein, 9 aa, Homo Sapiens
HTAFVNITY

SEQ ID NO: 1143204 - protein, 9 aa, Homo Sapiens
IPSLGPDNS

SEQ ID NO: 1143205 - protein, 9 aa, Homo Sapiens
EGVDEYVKL

SEQ ID NO: 1143206 - protein, 9 aa, Homo Sapiens
IRQGLCWLR

SEQ ID NO: 1143207 - protein, 9 aa, Homo Sapiens
WQACGQGTA

SEQ ID NO: 1143208 - protein, 9 aa, Homo Sapiens
GFQTSLLRI

SEQ ID NO: 1143209 - protein, 9 aa, Homo Sapiens
AAQLENMSA

SEQ ID NO: 1143210 - protein, 9 aa, Homo Sapiens
VFWWTALIA

SEQ ID NO: 1143211 - protein, 9 aa, Homo Sapiens
VVQLRQLLV

SEQ ID NO: 1143212 - protein, 9 aa, Homo Sapiens
EGEEEEEGG

SEQ ID NO: 1143213 - protein, 9 aa, Homo Sapiens
RRKRCNRFV

SEQ ID NO: 1143214 - protein, 9 aa, Homo Sapiens
SQRNLYRDA

SEQ ID NO: 1143215 - protein, 9 aa, Homo Sapiens
GPGGHQEDQ

SEQ ID NO: 1143216 - protein, 9 aa, Homo Sapiens
KWRHRTIFT

SEQ ID NO: 1143217 - protein, 9 aa, Homo Sapiens
GAITFKTGK

SEQ ID NO: 1143218 - protein, 9 aa, Homo Sapiens
TLEKMQKDQ

SEQ ID NO: 1143219 - protein, 9 aa, Homo Sapiens
LERSLKDVE

SEQ ID NO: 1143220 - protein, 9 aa, Homo Sapiens
SPQEISKVM

SEQ ID NO: 1143221 - protein, 9 aa, Homo Sapiens
LVIIHQRQL

SEQ ID NO: 1143222 - protein, 9 aa, Homo Sapiens
LKTWLPGGG

SEQ ID NO: 1143223 - protein, 9 aa, Homo Sapiens
VQRERNPKI

SEQ ID NO: 1143224 - protein, 9 aa, Homo Sapiens
LILLHLGLQ

SEQ ID NO: 1143225 - protein, 9 aa, Homo Sapiens
TQNLFIIEG

SEQ ID NO: 1143226 - protein, 9 aa, Homo Sapiens
TSELHQVLT

SEQ ID NO: 1143227 - protein, 9 aa, Homo Sapiens
AGSTVGPSG

SEQ ID NO: 1143228 - protein, 9 aa, Homo Sapiens
PAPSPSRGT

SEQ ID NO: 1143229 - protein, 9 aa, Homo Sapiens
DHSYPEGFV

SEQ ID NO: 1143230 - protein, 9 aa, Homo Sapiens
RGFPEPPCL

SEQ ID NO: 1143231 - protein, 9 aa, Homo Sapiens
GTLKRPSLS

SEQ ID NO: 1143232 - protein, 9 aa, Homo Sapiens
NSLTERGST

SEQ ID NO: 1143233 - protein, 9 aa, Homo Sapiens
LLLKRSDLL

SEQ ID NO: 1143234 - protein, 9 aa, Homo Sapiens
TRKQTKVLW

SEQ ID NO: 1143235 - protein, 9 aa, Homo Sapiens
PHIRAENHD

SEQ ID NO: 1143236 - protein, 9 aa, Homo Sapiens
IITISLLVG

SEQ ID NO: 1143237 - protein, 9 aa, Homo Sapiens
SMNYRVGTF

SEQ ID NO: 1143238 - protein, 9 aa, Homo Sapiens
GQSGTGEVR

SEQ ID NO: 1143239 - protein, 9 aa, Homo Sapiens
AWMRTHAGS

SEQ ID NO: 1143240 - protein, 9 aa, Homo Sapiens
QHNFKQWPD

SEQ ID NO: 1143241 - protein, 9 aa, Homo Sapiens
NLRQCVDRV

SEQ ID NO: 1143242 - protein, 9 aa, Homo Sapiens
IVQAFPSKM

SEQ ID NO: 1143243 - protein, 9 aa, Homo Sapiens
ETTLWLGPA

SEQ ID NO: 1143244 - protein, 9 aa, Homo Sapiens
EINGVAKSD

SEQ ID NO: 1143245 - protein, 9 aa, Homo Sapiens
ERRRRTPTR

SEQ ID NO: 1143246 - protein, 9 aa, Homo Sapiens
LSHWPFLKL

SEQ ID NO: 1143247 - protein, 9 aa, Homo Sapiens
PSCVPTAAR

SEQ ID NO: 1143248 - protein, 9 aa, Homo Sapiens
NFLCLWMAL

SEQ ID NO: 1143249 - protein, 9 aa, Homo Sapiens
SGAQPFACW

SEQ ID NO: 1143250 - protein, 9 aa, Homo Sapiens
LAPPTTFKP

SEQ ID NO: 1143251 - protein, 9 aa, Homo Sapiens
REIDFAIGM

SEQ ID NO: 1143252 - protein, 9 aa, Homo Sapiens
APFPCVQYC

SEQ ID NO: 1143253 - protein, 9 aa, Homo Sapiens
SSESFPIKN

SEQ ID NO: 1143254 - protein, 9 aa, Homo Sapiens
PHHTALPLH

SEQ ID NO: 1143255 - protein, 9 aa, Homo Sapiens
SLVNIQKDT

SEQ ID NO: 1143256 - protein, 9 aa, Homo Sapiens
QEQQLSKKN

SEQ ID NO: 1143257 - protein, 9 aa, Homo Sapiens
YRLPRQYSQ

SEQ ID NO: 1143258 - protein, 9 aa, Homo Sapiens
GSFVSPPAP

SEQ ID NO: 1143259 - protein, 9 aa, Homo Sapiens
LPGHQRLLV

SEQ ID NO: 1143260 - protein, 9 aa, Homo Sapiens
DITVGSFVS

SEQ ID NO: 1143261 - protein, 9 aa, Homo Sapiens
DKNTAFPKK

SEQ ID NO: 1143262 - protein, 9 aa, Homo Sapiens
LVNIQKDTL

SEQ ID NO: 1143263 - protein, 9 aa, Homo Sapiens
SPIFPHHTA

SEQ ID NO: 1143264 - protein, 9 aa, Homo Sapiens
FPHHTALPL

SEQ ID NO: 1143265 - protein, 9 aa, Homo Sapiens
IQKDTLRLV

SEQ ID NO: 1143266 - protein, 9 aa, Homo Sapiens
LGVPSLARE

SEQ ID NO: 1143267 - protein, 9 aa, Homo Sapiens
DHGPHMGTF

SEQ ID NO: 1143268 - protein, 9 aa, Homo Sapiens
YVKMYTGGV

SEQ ID NO: 1143269 - protein, 9 aa, Homo Sapiens
DSLRQKYVK

SEQ ID NO: 1143270 - protein, 9 aa, Homo Sapiens
LPRSAELGY

SEQ ID NO: 1143271 - protein, 9 aa, Homo Sapiens
RKRETALEI

SEQ ID NO: 1143272 - protein, 9 aa, Homo Sapiens
ETRMTTWHI

SEQ ID NO: 1143273 - protein, 9 aa, Homo Sapiens
AAQGGLYFC

SEQ ID NO: 1143274 - protein, 9 aa, Homo Sapiens
SPYRLPRQY

SEQ ID NO: 1143275 - protein, 9 aa, Homo Sapiens
LMCLVCLED

SEQ ID NO: 1143276 - protein, 9 aa, Homo Sapiens
SSRKGKEST

SEQ ID NO: 1143277 - protein, 9 aa, Homo Sapiens
SRKGKESTE

SEQ ID NO: 1143278 - protein, 9 aa, Homo Sapiens
MLPGHQRLL

SEQ ID NO: 1143279 - protein, 9 aa, Homo Sapiens
IHATDGDPQ

SEQ ID NO: 1143280 - protein, 9 aa, Homo Sapiens
EELDEAIFL

SEQ ID NO: 1143281 - protein, 9 aa, Homo Sapiens
GITAIFGKP

SEQ ID NO: 1143282 - protein, 9 aa, Homo Sapiens
GSSTASHFL

SEQ ID NO: 1143283 - protein, 9 aa, Homo Sapiens
DGFGLEAET

SEQ ID NO: 1143284 - protein, 9 aa, Homo Sapiens
SALLFIPGV

SEQ ID NO: 1143285 - protein, 9 aa, Homo Sapiens
IDFAIGMPV

SEQ ID NO: 1143286 - protein, 9 aa, Homo Sapiens
LRSLVNIQK

SEQ ID NO: 1143287 - protein, 9 aa, Homo Sapiens
ELGYLLTRV

SEQ ID NO: 1143288 - protein, 9 aa, Homo Sapiens
CQNGKYAAI

SEQ ID NO: 1143289 - protein, 9 aa, Homo Sapiens
LGYLLTRVA

SEQ ID NO: 1143290 - protein, 9 aa, Homo Sapiens
REDECVSCS

SEQ ID NO: 1143291 - protein, 9 aa, Homo Sapiens
ITFEEHKVD

SEQ ID NO: 1143292 - protein, 9 aa, Homo Sapiens
HFADGLDIT

SEQ ID NO: 1143293 - protein, 9 aa, Homo Sapiens
ASHHRRRGL

SEQ ID NO: 1143294 - protein, 9 aa, Homo Sapiens
PGSGGQKNG

SEQ ID NO: 1143295 - protein, 9 aa, Homo Sapiens
FCRGQTCYR

SEQ ID NO: 1143296 - protein, 9 aa, Homo Sapiens
VLMCLVCLE

SEQ ID NO: 1143297 - protein, 9 aa, Homo Sapiens
QQLSKKNNG

SEQ ID NO: 1143298 - protein, 9 aa, Homo Sapiens
SAELGYLLT

SEQ ID NO: 1143299 - protein, 9 aa, Homo Sapiens
IQNPASLKI

SEQ ID NO: 1143300 - protein, 9 aa, Homo Sapiens
WWPHCSSRK

SEQ ID NO: 1143301 - protein, 9 aa, Homo Sapiens
VMTSSKLEE

SEQ ID NO: 1143302 - protein, 9 aa, Homo Sapiens
RRLEIPSSG

SEQ ID NO: 1143303 - protein, 9 aa, Homo Sapiens
QVQALEEMR

SEQ ID NO: 1143304 - protein, 9 aa, Homo Sapiens
LRFLPLIGI

SEQ ID NO: 1143305 - protein, 9 aa, Homo Sapiens
LYGLTEDPD

SEQ ID NO: 1143306 - protein, 9 aa, Homo Sapiens
KAGQTLKQR

SEQ ID NO: 1143307 - protein, 9 aa, Homo Sapiens
VGKIHATDG

SEQ ID NO: 1143308 - protein, 9 aa, Homo Sapiens
RWKTIGSLH

SEQ ID NO: 1143309 - protein, 9 aa, Homo Sapiens
NHRLPQPIL

SEQ ID NO: 1143310 - protein, 9 aa, Homo Sapiens
AHGESSLAS

SEQ ID NO: 1143311 - protein, 9 aa, Homo Sapiens
QSSESFPIK

SEQ ID NO: 1143312 - protein, 9 aa, Homo Sapiens
MIQNPASLK

SEQ ID NO: 1143313 - protein, 9 aa, Homo Sapiens
PKAGQTLKQ

SEQ ID NO: 1143314 - protein, 9 aa, Homo Sapiens
PIKNSGSGN

SEQ ID NO: 1143315 - protein, 9 aa, Homo Sapiens
EFRCMLDGR

SEQ ID NO: 1143316 - protein, 9 aa, Homo Sapiens
NLSQQAASA

SEQ ID NO: 1143317 - protein, 9 aa, Homo Sapiens
KMIQNPASL

SEQ ID NO: 1143318 - protein, 9 aa, Homo Sapiens
PYRLPRQYS

SEQ ID NO: 1143319 - protein, 9 aa, Homo Sapiens
TFEEHKVDS

SEQ ID NO: 1143320 - protein, 9 aa, Homo Sapiens
NGKYAAIGT

SEQ ID NO: 1143321 - protein, 9 aa, Homo Sapiens
DRKRETALE

SEQ ID NO: 1143322 - protein, 9 aa, Homo Sapiens
NLKDHGPHM

SEQ ID NO: 1143323 - protein, 9 aa, Homo Sapiens
HPMKQPAVY

SEQ ID NO: 1143324 - protein, 9 aa, Homo Sapiens
QSSTSPTNS

SEQ ID NO: 1143325 - protein, 9 aa, Homo Sapiens
FPIKNSGSG

SEQ ID NO: 1143326 - protein, 9 aa, Homo Sapiens
GIIYYVMTS

SEQ ID NO: 1143327 - protein, 9 aa, Homo Sapiens
AAYLKIRLS

SEQ ID NO: 1143328 - protein, 9 aa, Homo Sapiens
LKTVLELRG

SEQ ID NO: 1143329 - protein, 9 aa, Homo Sapiens
LEAETRMTT

SEQ ID NO: 1143330 - protein, 9 aa, Homo Sapiens
HFLAVEMRR

SEQ ID NO: 1143331 - protein, 9 aa, Homo Sapiens
QDRKRETAL

SEQ ID NO: 1143332 - protein, 9 aa, Homo Sapiens
SDGNLSQQA

SEQ ID NO: 1143333 - protein, 9 aa, Homo Sapiens
VFRQLGCPS

SEQ ID NO: 1143334 - protein, 9 aa, Homo Sapiens
LNTAAVVFR

SEQ ID NO: 1143335 - protein, 9 aa, Homo Sapiens
IFHFADGLD

SEQ ID NO: 1143336 - protein, 9 aa, Homo Sapiens
LMVLMCLVC

SEQ ID NO: 1143337 - protein, 9 aa, Homo Sapiens
TLISGMASG

SEQ ID NO: 1143338 - protein, 9 aa, Homo Sapiens
FDWGLAPPT

SEQ ID NO: 1143339 - protein, 9 aa, Homo Sapiens
GRFDWGLAP

SEQ ID NO: 1143340 - protein, 9 aa, Homo Sapiens
VGSFVSPPA

SEQ ID NO: 1143341 - protein, 9 aa, Homo Sapiens
SFPIKNSGS

SEQ ID NO: 1143342 - protein, 9 aa, Homo Sapiens
QWVKSMQGG

SEQ ID NO: 1143343 - protein, 9 aa, Homo Sapiens
KDHGPHMGT

SEQ ID NO: 1143344 - protein, 9 aa, Homo Sapiens
IEAQKDSSD

SEQ ID NO: 1143345 - protein, 9 aa, Homo Sapiens
GESSLASSQ

SEQ ID NO: 1143346 - protein, 9 aa, Homo Sapiens
NTAAVVFRQ

SEQ ID NO: 1143347 - protein, 9 aa, Homo Sapiens
SSMPELFAS

SEQ ID NO: 1143348 - protein, 9 aa, Homo Sapiens
KTKITFEEH

SEQ ID NO: 1143349 - protein, 9 aa, Homo Sapiens
ITAIFGKPG

SEQ ID NO: 1143350 - protein, 9 aa, Homo Sapiens
PVSSDGNLS

SEQ ID NO: 1143351 - protein, 9 aa, Homo Sapiens
GDNYARWEN

SEQ ID NO: 1143352 - protein, 9 aa, Homo Sapiens
DGVFPEHAL

SEQ ID NO: 1143353 - protein, 9 aa, Homo Sapiens
SLARERDTD

SEQ ID NO: 1143354 - protein, 9 aa, Homo Sapiens
PQRLLEVCG

SEQ ID NO: 1143355 - protein, 9 aa, Homo Sapiens
TESTKQEFQ

SEQ ID NO: 1143356 - protein, 9 aa, Homo Sapiens
PIFPHHTAL

SEQ ID NO: 1143357 - protein, 9 aa, Homo Sapiens
GLAPPTTFK

SEQ ID NO: 1143358 - protein, 9 aa, Homo Sapiens
YCVITCPSL

SEQ ID NO: 1143359 - protein, 9 aa, Homo Sapiens
RQKYVKMYT

SEQ ID NO: 1143360 - protein, 9 aa, Homo Sapiens
GIKCQVDCM

SEQ ID NO: 1143361 - protein, 9 aa, Homo Sapiens
LKIRLSSYG

SEQ ID NO: 1143362 - protein, 9 aa, Homo Sapiens
GQTLKQRVF

SEQ ID NO: 1143363 - protein, 9 aa, Homo Sapiens
RYPQSSPYR

SEQ ID NO: 1143364 - protein, 9 aa, Homo Sapiens
ALVFSVQCW

SEQ ID NO: 1143365 - protein, 9 aa, Homo Sapiens
DNNNNHRLP

SEQ ID NO: 1143366 - protein, 9 aa, Homo Sapiens
TVKVAGETY

SEQ ID NO: 1143367 - protein, 9 aa, Homo Sapiens
CQSFCDHMK

SEQ ID NO: 1143368 - protein, 9 aa, Homo Sapiens
AQWVKSMQG

SEQ ID NO: 1143369 - protein, 9 aa, Homo Sapiens
ISLGITFFG

SEQ ID NO: 1143370 - protein, 9 aa, Homo Sapiens
WDPGLLLHF

SEQ ID NO: 1143371 - protein, 9 aa, Homo Sapiens
EEHKVDSTL

SEQ ID NO: 1143372 - protein, 9 aa, Homo Sapiens
QNEDVNQHG

SEQ ID NO: 1143373 - protein, 9 aa, Homo Sapiens
IYYVMTSSK

SEQ ID NO: 1143374 - protein, 9 aa, Homo Sapiens
DGNLSQQAA

SEQ ID NO: 1143375 - protein, 9 aa, Homo Sapiens
HLAVVGLFY

SEQ ID NO: 1143376 - protein, 9 aa, Homo Sapiens
FMAAGSSMP

SEQ ID NO: 1143377 - protein, 9 aa, Homo Sapiens
GQKNGGMGT

SEQ ID NO: 1143378 - protein, 9 aa, Homo Sapiens
ILMQVQALE

SEQ ID NO: 1143379 - protein, 9 aa, Homo Sapiens
CMLDGRWTV

SEQ ID NO: 1143380 - protein, 9 aa, Homo Sapiens
PEDKSTPEK

SEQ ID NO: 1143381 - protein, 9 aa, Homo Sapiens
GSGGQKNGG

SEQ ID NO: 1143382 - protein, 9 aa, Homo Sapiens
CWAENDVGQ

SEQ ID NO: 1143383 - protein, 9 aa, Homo Sapiens
LAVVGLFYG

SEQ ID NO: 1143384 - protein, 9 aa, Homo Sapiens
LSQQAASAP

SEQ ID NO: 1143385 - protein, 9 aa, Homo Sapiens
GAHGESSLA

SEQ ID NO: 1143386 - protein, 9 aa, Homo Sapiens
SSTASHFLA

SEQ ID NO: 1143387 - protein, 9 aa, Homo Sapiens
ARWENMDKS

SEQ ID NO: 1143388 - protein, 9 aa, Homo Sapiens
LEGGDILEE

SEQ ID NO: 1143389 - protein, 9 aa, Homo Sapiens
GGQKNGGMG

SEQ ID NO: 1143390 - protein, 9 aa, Homo Sapiens
SVAGITAIF

SEQ ID NO: 1143391 - protein, 9 aa, Homo Sapiens
CQVDCMSFP

SEQ ID NO: 1143392 - protein, 9 aa, Homo Sapiens
DIKDKNTAF

SEQ ID NO: 1143393 - protein, 9 aa, Homo Sapiens
IKCQVDCMS

SEQ ID NO: 1143394 - protein, 9 aa, Homo Sapiens
TPQRLLEVC

SEQ ID NO: 1143395 - protein, 9 aa, Homo Sapiens
DKSTPEKRT

SEQ ID NO: 1143396 - protein, 9 aa, Homo Sapiens
DFAIGMPVC

SEQ ID NO: 1143397 - protein, 9 aa, Homo Sapiens
LKQRVFQIL

SEQ ID NO: 1143398 - protein, 9 aa, Homo Sapiens
SMQGGPEHA

SEQ ID NO: 1143399 - protein, 9 aa, Homo Sapiens
VAAYLKIRL

SEQ ID NO: 1143400 - protein, 9 aa, Homo Sapiens
LCGGDNKSC

SEQ ID NO: 1143401 - protein, 9 aa, Homo Sapiens
LLHFLAAMA

SEQ ID NO: 1143402 - protein, 9 aa, Homo Sapiens
GPHMGTFLW

SEQ ID NO: 1143403 - protein, 9 aa, Homo Sapiens
QCWARAHSL

SEQ ID NO: 1143404 - protein, 9 aa, Homo Sapiens
GSLHPMKQP

SEQ ID NO: 1143405 - protein, 9 aa, Homo Sapiens
LKDHGPHMG

SEQ ID NO: 1143406 - protein, 9 aa, Homo Sapiens
TFMAAGSSM

SEQ ID NO: 1143407 - protein, 9 aa, Homo Sapiens
KPGSGGQKN

SEQ ID NO: 1143408 - protein, 9 aa, Homo Sapiens
PRSAELGYL

SEQ ID NO: 1143409 - protein, 9 aa, Homo Sapiens
FGKPGDKKK

SEQ ID NO: 1143410 - protein, 9 aa, Homo Sapiens
ILEESSYKV

SEQ ID NO: 1143411 - protein, 9 aa, Homo Sapiens
MCLVCLEDK

SEQ ID NO: 1143412 - protein, 9 aa, Homo Sapiens
QGGLYFCRG

SEQ ID NO: 1143413 - protein, 9 aa, Homo Sapiens
HKVDSTLIG

SEQ ID NO: 1143414 - protein, 9 aa, Homo Sapiens
WPQGAHGES

SEQ ID NO: 1143415 - protein, 9 aa, Homo Sapiens
NYILMQVQA

SEQ ID NO: 1143416 - protein, 9 aa, Homo Sapiens
EGGDILEES

SEQ ID NO: 1143417 - protein, 9 aa, Homo Sapiens
SFVSPPAPA

SEQ ID NO: 1143418 - protein, 9 aa, Homo Sapiens
EATESTKQE

SEQ ID NO: 1143419 - protein, 9 aa, Homo Sapiens
SCLPSCNNR

SEQ ID NO: 1143420 - protein, 9 aa, Homo Sapiens
LELRGRGDR

SEQ ID NO: 1143421 - protein, 9 aa, Homo Sapiens
EVLPRSAEL

SEQ ID NO: 1143422 - protein, 9 aa, Homo Sapiens
SDSQNEDVN

SEQ ID NO: 1143423 - protein, 9 aa, Homo Sapiens
RSLVNIQKD

SEQ ID NO: 1143424 - protein, 9 aa, Homo Sapiens
AIFGKPGDK

SEQ ID NO: 1143425 - protein, 9 aa, Homo Sapiens
AVGSIEIFH

SEQ ID NO: 1143426 - protein, 9 aa, Homo Sapiens
QNGKYAAIG

SEQ ID NO: 1143427 - protein, 9 aa, Homo Sapiens
LVFSVQCWA

SEQ ID NO: 1143428 - protein, 9 aa, Homo Sapiens
VCGRLYELL

SEQ ID NO: 1143429 - protein, 9 aa, Homo Sapiens
VGQAEVSVQ

SEQ ID NO: 1143430 - protein, 9 aa, Homo Sapiens
LLLHFLAAM

SEQ ID NO: 1143431 - protein, 9 aa, Homo Sapiens
YDIKDKNTA

SEQ ID NO: 1143432 - protein, 9 aa, Homo Sapiens
TQHGEEFRC

SEQ ID NO: 1143433 - protein, 9 aa, Homo Sapiens
ENDVGQAEV

SEQ ID NO: 1143434 - protein, 9 aa, Homo Sapiens
EKILNREID

SEQ ID NO: 1143435 - protein, 9 aa, Homo Sapiens
AGIKCQVDC

SEQ ID NO: 1143436 - protein, 9 aa, Homo Sapiens
MVLMCLVCL

SEQ ID NO: 1143437 - protein, 9 aa, Homo Sapiens
EPPASDSQN

SEQ ID NO: 1143438 - protein, 9 aa, Homo Sapiens
LHPMKQPAV

SEQ ID NO: 1143439 - protein, 9 aa, Homo Sapiens
HHRRRGLGK

SEQ ID NO: 1143440 - protein, 9 aa, Homo Sapiens
LPSCNNRHF

SEQ ID NO: 1143441 - protein, 9 aa, Homo Sapiens
TSALLFIPG

SEQ ID NO: 1143442 - protein, 9 aa, Homo Sapiens
NLYGLTEDP

SEQ ID NO: 1143443 - protein, 9 aa, Homo Sapiens
SMPELFASV

SEQ ID NO: 1143444 - protein, 9 aa, Homo Sapiens
RKTHSGAQP

SEQ ID NO: 1143445 - protein, 9 aa, Homo Sapiens
KYAAIGTYD

SEQ ID NO: 1143446 - protein, 9 aa, Homo Sapiens
AELGYLLTR

SEQ ID NO: 1143447 - protein, 9 aa, Homo Sapiens
EIAQWVKSM

SEQ ID NO: 1143448 - protein, 9 aa, Homo Sapiens
PVSPDQLPC

SEQ ID NO: 1143449 - protein, 9 aa, Homo Sapiens
YPQSSPYRL

SEQ ID NO: 1143450 - protein, 9 aa, Homo Sapiens
CMQKSSPFS

SEQ ID NO: 1143451 - protein, 9 aa, Homo Sapiens
RLLEVCGRL

SEQ ID NO: 1143452 - protein, 9 aa, Homo Sapiens
EFYYDIKDK

SEQ ID NO: 1143453 - protein, 9 aa, Homo Sapiens
HFLAAMAAV

SEQ ID NO: 1143454 - protein, 9 aa, Homo Sapiens
ESSLASSQA

SEQ ID NO: 1143455 - protein, 9 aa, Homo Sapiens
HGESSLASS

SEQ ID NO: 1143456 - protein, 9 aa, Homo Sapiens
QHGEEFRCM

SEQ ID NO: 1143457 - protein, 9 aa, Homo Sapiens
KTVLELRGR

SEQ ID NO: 1143458 - protein, 9 aa, Homo Sapiens
SSLASSQAK

SEQ ID NO: 1143459 - protein, 9 aa, Homo Sapiens
SAEARHHVA

SEQ ID NO: 1143460 - protein, 9 aa, Homo Sapiens
YWVVFSATS

SEQ ID NO: 1143461 - protein, 9 aa, Homo Sapiens
SSPYRLPRQ

SEQ ID NO: 1143462 - protein, 9 aa, Homo Sapiens
EAIFLTSFE

SEQ ID NO: 1143463 - protein, 9 aa, Homo Sapiens
MKMPEDKST

SEQ ID NO: 1143464 - protein, 9 aa, Homo Sapiens
AGFFLREDE

SEQ ID NO: 1143465 - protein, 9 aa, Homo Sapiens
QKDTLRLVK

SEQ ID NO: 1143466 - protein, 9 aa, Homo Sapiens
LLIHLKTVL

SEQ ID NO: 1143467 - protein, 9 aa, Homo Sapiens
VSSDGNLSQ

SEQ ID NO: 1143468 - protein, 9 aa, Homo Sapiens
KNYILMQVQ

SEQ ID NO: 1143469 - protein, 9 aa, Homo Sapiens
MPELFASVI

SEQ ID NO: 1143470 - protein, 9 aa, Homo Sapiens
VQCWARAHS

SEQ ID NO: 1143471 - protein, 9 aa, Homo Sapiens
YLGSSTASH

SEQ ID NO: 1143472 - protein, 9 aa, Homo Sapiens
HLKTVLELR

SEQ ID NO: 1143473 - protein, 9 aa, Homo Sapiens
GVPSLARER

SEQ ID NO: 1143474 - protein, 9 aa, Homo Sapiens
QEATESTKQ

SEQ ID NO: 1143475 - protein, 9 aa, Homo Sapiens
HAGFFLRED

SEQ ID NO: 1143476 - protein, 9 aa, Homo Sapiens
AGSSMPELF

SEQ ID NO: 1143477 - protein, 9 aa, Homo Sapiens
ETQHRIAPG

SEQ ID NO: 1143478 - protein, 9 aa, Homo Sapiens
VGSIEIFHF

SEQ ID NO: 1143479 - protein, 9 aa, Homo Sapiens
GSIEIFHFA

SEQ ID NO: 1143480 - protein, 9 aa, Homo Sapiens
DSQNEDVNQ

SEQ ID NO: 1143481 - protein, 9 aa, Homo Sapiens
TAIFGKPGD

SEQ ID NO: 1143482 - protein, 9 aa, Homo Sapiens
HGEEFRCML

SEQ ID NO: 1143483 - protein, 9 aa, Homo Sapiens
SGGQKNGGM

SEQ ID NO: 1143484 - protein, 9 aa, Homo Sapiens
LLEVCGRLY

SEQ ID NO: 1143485 - protein, 9 aa, Homo Sapiens
TIGSLHPMK

SEQ ID NO: 1143486 - protein, 9 aa, Homo Sapiens
TDGDPQDTL

SEQ ID NO: 1143487 - protein, 9 aa, Homo Sapiens
KYVKMYTGG

SEQ ID NO: 1143488 - protein, 9 aa, Homo Sapiens
QASAEARHH

SEQ ID NO: 1143489 - protein, 9 aa, Homo Sapiens
MGDQDRKRE

SEQ ID NO: 1143490 - protein, 9 aa, Homo Sapiens
LNREIDFAI

SEQ ID NO: 1143491 - protein, 9 aa, Homo Sapiens
TVGSFVSPP

SEQ ID NO: 1143492 - protein, 9 aa, Homo Sapiens
NVTVKVAGE

SEQ ID NO: 1143493 - protein, 9 aa, Homo Sapiens
PHCSSRKGK

SEQ ID NO: 1143494 - protein, 9 aa, Homo Sapiens
NLNTAAVVF

SEQ ID NO: 1143495 - protein, 9 aa, Homo Sapiens
DKMIQNPAS

SEQ ID NO: 1143496 - protein, 9 aa, Homo Sapiens
LIHLKTVLE

SEQ ID NO: 1143497 - protein, 9 aa, Homo Sapiens
EIDFAIGMP

SEQ ID NO: 1143498 - protein, 9 aa, Homo Sapiens
IQSSESFPI

SEQ ID NO: 1143499 - protein, 9 aa, Homo Sapiens
LISGMASGS

SEQ ID NO: 1143500 - protein, 9 aa, Homo Sapiens
LLLALPIKL

SEQ ID NO: 1143501 - protein, 9 aa, Homo Sapiens
SHDQRTLIS

SEQ ID NO: 1143502 - protein, 9 aa, Homo Sapiens
HGPHMGTFL

SEQ ID NO: 1143503 - protein, 9 aa, Homo Sapiens
RWENMDKSI

SEQ ID NO: 1143504 - protein, 9 aa, Homo Sapiens
YNNISLGIT

SEQ ID NO: 1143505 - protein, 9 aa, Homo Sapiens
ASDSQNEDV

SEQ ID NO: 1143506 - protein, 9 aa, Homo Sapiens
EDECVSCSN

SEQ ID NO: 1143507 - protein, 9 aa, Homo Sapiens
SLRQKYVKM

SEQ ID NO: 1143508 - protein, 9 aa, Homo Sapiens
AAGSSMPEL

SEQ ID NO: 1143509 - protein, 9 aa, Homo Sapiens
TVALSLIAL

SEQ ID NO: 1143510 - protein, 9 aa, Homo Sapiens
DEAIFLTSF

SEQ ID NO: 1143511 - protein, 9 aa, Homo Sapiens
STASHFLAV

SEQ ID NO: 1143512 - protein, 9 aa, Homo Sapiens
KIRLSSYGR

SEQ ID NO: 1143513 - protein, 9 aa, Homo Sapiens
MQVQALEEM

SEQ ID NO: 1143514 - protein, 9 aa, Homo Sapiens
RKGKESTEM

SEQ ID NO: 1143515 - protein, 9 aa, Homo Sapiens
QYCVITCPS

SEQ ID NO: 1143516 - protein, 9 aa, Homo Sapiens
DNYARWENM

SEQ ID NO: 1143517 - protein, 9 aa, Homo Sapiens
YILMQVQAL

SEQ ID NO: 1143518 - protein, 9 aa, Homo Sapiens
DKCGLCGGD

SEQ ID NO: 1143519 - protein, 9 aa, Homo Sapiens
LLALPIKLD

SEQ ID NO: 1143520 - protein, 9 aa, Homo Sapiens
PGLLLHFLA

SEQ ID NO: 1143521 - protein, 9 aa, Homo Sapiens
RSAELGYLL

SEQ ID NO: 1143522 - protein, 9 aa, Homo Sapiens
IKNSGSGNA

SEQ ID NO: 1143523 - protein, 9 aa, Homo Sapiens
EVCGRLYEL

SEQ ID NO: 1143524 - protein, 9 aa, Homo Sapiens
VSPDQLPCG

SEQ ID NO: 1143525 - protein, 9 aa, Homo Sapiens
HDQRTLISG

SEQ ID NO: 1143526 - protein, 9 aa, Homo Sapiens
SVMKMPEDK

SEQ ID NO: 1143527 - protein, 9 aa, Homo Sapiens
TVLELRGRG

SEQ ID NO: 1143528 - protein, 9 aa, Homo Sapiens
IFGKPGDKK

SEQ ID NO: 1143529 - protein, 9 aa, Homo Sapiens
YDLNLYGLT

SEQ ID NO: 1143530 - protein, 9 aa, Homo Sapiens
YGLTEDPDL

SEQ ID NO: 1143531 - protein, 9 aa, Homo Sapiens
PGHQRLLVT

SEQ ID NO: 1143532 - protein, 9 aa, Homo Sapiens
RRRGLGKKE

SEQ ID NO: 1143533 - protein, 9 aa, Homo Sapiens
MPEDKSTPE

SEQ ID NO: 1143534 - protein, 9 aa, Homo Sapiens
LPQMGDQDR

SEQ ID NO: 1143535 - protein, 9 aa, Homo Sapiens
ATASRLAEQ

SEQ ID NO: 1143536 - protein, 9 aa, Homo Sapiens
HITLVSLET

SEQ ID NO: 1143537 - protein, 9 aa, Homo Sapiens
AQLGRAGAT

SEQ ID NO: 1143538 - protein, 9 aa, Homo Sapiens
DQDRKRETA

SEQ ID NO: 1143539 - protein, 9 aa, Homo Sapiens
PPASDSQNE

SEQ ID NO: 1143540 - protein, 9 aa, Homo Sapiens
LSSYGRLLD

SEQ ID NO: 1143541 - protein, 9 aa, Homo Sapiens
AGATASRLA

SEQ ID NO: 1143542 - protein, 9 aa, Homo Sapiens
FPCVQYCVI

SEQ ID NO: 1143543 - protein, 9 aa, Homo Sapiens
HRKTHSGAQ

SEQ ID NO: 1143544 - protein, 9 aa, Homo Sapiens
RAGATASRL

SEQ ID NO: 1143545 - protein, 9 aa, Homo Sapiens
FSATSALLF

SEQ ID NO: 1143546 - protein, 9 aa, Homo Sapiens
IALLLLALP

SEQ ID NO: 1143547 - protein, 9 aa, Homo Sapiens
QSSPYRLPR

SEQ ID NO: 1143548 - protein, 9 aa, Homo Sapiens
CRGQTCYRP

SEQ ID NO: 1143549 - protein, 9 aa, Homo Sapiens
LMQVQALEE

SEQ ID NO: 1143550 - protein, 9 aa, Homo Sapiens
HYMTLPVSP

SEQ ID NO: 1143551 - protein, 9 aa, Homo Sapiens
FSYDLNLYG

SEQ ID NO: 1143552 - protein, 9 aa, Homo Sapiens
AKNYILMQV

SEQ ID NO: 1143553 - protein, 9 aa, Homo Sapiens
DWGLAPPTT

SEQ ID NO: 1143554 - protein, 9 aa, Homo Sapiens
LIGIEAQKD

SEQ ID NO: 1143555 - protein, 9 aa, Homo Sapiens
RALMCVTVA

SEQ ID NO: 1143556 - protein, 9 aa, Homo Sapiens
CGLCGGDNK

SEQ ID NO: 1143557 - protein, 9 aa, Homo Sapiens
KITFEEHKV

SEQ ID NO: 1143558 - protein, 9 aa, Homo Sapiens
SHLAVVGLF

SEQ ID NO: 1143559 - protein, 9 aa, Homo Sapiens
QRTLISGMA

SEQ ID NO: 1143560 - protein, 9 aa, Homo Sapiens
AEELDEAIF

SEQ ID NO: 1143561 - protein, 9 aa, Homo Sapiens
NREIDFAIG

SEQ ID NO: 1143562 - protein, 9 aa, Homo Sapiens
GHQRLLVTS

SEQ ID NO: 1143563 - protein, 9 aa, Homo Sapiens
EHKVDSTLI

SEQ ID NO: 1143564 - protein, 9 aa, Homo Sapiens
GQEATESTK

SEQ ID NO: 1143565 - protein, 9 aa, Homo Sapiens
QSFCDHMKS

SEQ ID NO: 1143566 - protein, 9 aa, Homo Sapiens
AQPFACWEC

SEQ ID NO: 1143567 - protein, 9 aa, Homo Sapiens
LGRAGATAS

SEQ ID NO: 1143568 - protein, 9 aa, Homo Sapiens
WENMDKSII

SEQ ID NO: 1143569 - protein, 9 aa, Homo Sapiens
PASDSQNED

SEQ ID NO: 1143570 - protein, 9 aa, Homo Sapiens
EAEELDEAI

SEQ ID NO: 1143571 - protein, 9 aa, Homo Sapiens
LSKCMQKSS

SEQ ID NO: 1143572 - protein, 9 aa, Homo Sapiens
SQQAASAPS

SEQ ID NO: 1143573 - protein, 9 aa, Homo Sapiens
GAQPFACWE

SEQ ID NO: 1143574 - protein, 9 aa, Homo Sapiens
FFLREDECV

SEQ ID NO: 1143575 - protein, 9 aa, Homo Sapiens
RLLVTSLLV

SEQ ID NO: 1143576 - protein, 9 aa, Homo Sapiens
DIALLLLAL

SEQ ID NO: 1143577 - protein, 9 aa, Homo Sapiens
AVVFRQLGC

SEQ ID NO: 1143578 - protein, 9 aa, Homo Sapiens
QKNGGMGTK

SEQ ID NO: 1143579 - protein, 9 aa, Homo Sapiens
MCVTVALSL

SEQ ID NO: 1143580 - protein, 9 aa, Homo Sapiens
LVTSLLVCH

SEQ ID NO: 1143581 - protein, 9 aa, Homo Sapiens
VTVALSLIA

SEQ ID NO: 1143582 - protein, 9 aa, Homo Sapiens
GDPQDTLTY

SEQ ID NO: 1143583 - protein, 9 aa, Homo Sapiens
SESFPIKNS

SEQ ID NO: 1143584 - protein, 9 aa, Homo Sapiens
EATKCQSFC

SEQ ID NO: 1143585 - protein, 9 aa, Homo Sapiens
HTALPLHLM

SEQ ID NO: 1143586 - protein, 9 aa, Homo Sapiens
RNLKDHGPH

SEQ ID NO: 1143587 - protein, 9 aa, Homo Sapiens
LGITFFGNK

SEQ ID NO: 1143588 - protein, 9 aa, Homo Sapiens
VQALEEMRR

SEQ ID NO: 1143589 - protein, 9 aa, Homo Sapiens
IEIFHFADG

SEQ ID NO: 1143590 - protein, 9 aa, Homo Sapiens
KDKNTAFPK

SEQ ID NO: 1143591 - protein, 9 aa, Homo Sapiens
DDNNNNHRL

SEQ ID NO: 1143592 - protein, 9 aa, Homo Sapiens
SRYPQSSPY

SEQ ID NO: 1143593 - protein, 9 aa, Homo Sapiens
GLYFCRGQT

SEQ ID NO: 1143594 - protein, 9 aa, Homo Sapiens
SSDGNLSQQ

SEQ ID NO: 1143595 - protein, 9 aa, Homo Sapiens
IQASAEARH

SEQ ID NO: 1143596 - protein, 9 aa, Homo Sapiens
SSHLAVVGL

SEQ ID NO: 1143597 - protein, 9 aa, Homo Sapiens
SLETQHRIA

SEQ ID NO: 1143598 - protein, 9 aa, Homo Sapiens
TQHRIAPGY

SEQ ID NO: 1143599 - protein, 9 aa, Homo Sapiens
FGLEAETRM

SEQ ID NO: 1143600 - protein, 9 aa, Homo Sapiens
EELSKCMQK

SEQ ID NO: 1143601 - protein, 9 aa, Homo Sapiens
GNLSQQAAS

SEQ ID NO: 1143602 - protein, 9 aa, Homo Sapiens
AAVVFRQLG

SEQ ID NO: 1143603 - protein, 9 aa, Homo Sapiens
PSCNNRHFW

SEQ ID NO: 1143604 - protein, 9 aa, Homo Sapiens
YLKIRLSSY

SEQ ID NO: 1143605 - protein, 9 aa, Homo Sapiens
TLVSLETQH

SEQ ID NO: 1143606 - protein, 9 aa, Homo Sapiens
TAAVVFRQL

SEQ ID NO: 1143607 - protein, 9 aa, Homo Sapiens
NNNHRLPQP

SEQ ID NO: 1143608 - protein, 9 aa, Homo Sapiens
DLEDGVFPE

SEQ ID NO: 1143609 - protein, 9 aa, Homo Sapiens
KNVTVKVAG

SEQ ID NO: 1143610 - protein, 9 aa, Homo Sapiens
PCVQYCVIT

SEQ ID NO: 1143611 - protein, 9 aa, Homo Sapiens
GLGKKEWGP

SEQ ID NO: 1143612 - protein, 9 aa, Homo Sapiens
IKDKNTAFP

SEQ ID NO: 1143613 - protein, 9 aa, Homo Sapiens
LHFLAAMAA

SEQ ID NO: 1143614 - protein, 9 aa, Homo Sapiens
FVSPPAPAS

SEQ ID NO: 1143615 - protein, 9 aa, Homo Sapiens
KCMQKSSPF

SEQ ID NO: 1143616 - protein, 9 aa, Homo Sapiens
NLEGGDILE

SEQ ID NO: 1143617 - protein, 9 aa, Homo Sapiens
YARWENMDK

SEQ ID NO: 1143618 - protein, 9 aa, Homo Sapiens
QRLLVTSLL

SEQ ID NO: 1143619 - protein, 9 aa, Homo Sapiens
EEDLEDGVF

SEQ ID NO: 1143620 - protein, 9 aa, Homo Sapiens
DILEESSYK

SEQ ID NO: 1143621 - protein, 9 aa, Homo Sapiens
RLPQPILES

SEQ ID NO: 1143622 - protein, 9 aa, Homo Sapiens
TASHFLAVE

SEQ ID NO: 1143623 - protein, 9 aa, Homo Sapiens
TASRLAEQA

SEQ ID NO: 1143624 - protein, 9 aa, Homo Sapiens
EEFRCMLDG

SEQ ID NO: 1143625 - protein, 9 aa, Homo Sapiens
EARHHVAGA

SEQ ID NO: 1143626 - protein, 9 aa, Homo Sapiens
AEPPASDSQ

SEQ ID NO: 1143627 - protein, 9 aa, Homo Sapiens
AGITAIFGK

SEQ ID NO: 1143628 - protein, 9 aa, Homo Sapiens
FLREDECVS

SEQ ID NO: 1143629 - protein, 9 aa, Homo Sapiens
VSALDKMIQ

SEQ ID NO: 1143630 - protein, 9 aa, Homo Sapiens
TKITFEEHK

SEQ ID NO: 1143631 - protein, 9 aa, Homo Sapiens
CLVCLEDKP

SEQ ID NO: 1143632 - protein, 9 aa, Homo Sapiens
VAGITAIFG

SEQ ID NO: 1143633 - protein, 9 aa, Homo Sapiens
LDKMIQNPA

SEQ ID NO: 1143634 - protein, 9 aa, Homo Sapiens
KQRVFQILD

SEQ ID NO: 1143635 - protein, 9 aa, Homo Sapiens
LRQKYVKMY

SEQ ID NO: 1143636 - protein, 9 aa, Homo Sapiens
GITFFGNKI

SEQ ID NO: 1143637 - protein, 9 aa, Homo Sapiens
GRKPGSGGQ

SEQ ID NO: 1143638 - protein, 9 aa, Homo Sapiens
PQGAHGESS

SEQ ID NO: 1143639 - protein, 9 aa, Homo Sapiens
AEARHHVAG

SEQ ID NO: 1143640 - protein, 9 aa, Homo Sapiens
CSSRKGKES

SEQ ID NO: 1143641 - protein, 9 aa, Homo Sapiens
SIEIFHFAD

SEQ ID NO: 1143642 - protein, 9 aa, Homo Sapiens
MTSSKLEEW

SEQ ID NO: 1143643 - protein, 9 aa, Homo Sapiens
ARERDTDPP

SEQ ID NO: 1143644 - protein, 9 aa, Homo Sapiens
GEEFRCMLD

SEQ ID NO: 1143645 - protein, 9 aa, Homo Sapiens
VFSVQCWAR

SEQ ID NO: 1143646 - protein, 9 aa, Homo Sapiens
GQAEVSVQV

SEQ ID NO: 1143647 - protein, 9 aa, Homo Sapiens
WKTIGSLHP

SEQ ID NO: 1143648 - protein, 9 aa, Homo Sapiens
ATDGDPQDT

SEQ ID NO: 1143649 - protein, 9 aa, Homo Sapiens
MAAGSSMPE

SEQ ID NO: 1143650 - protein, 9 aa, Homo Sapiens
KKRFDKCGL

SEQ ID NO: 1143651 - protein, 9 aa, Homo Sapiens
FRCMLDGRW

SEQ ID NO: 1143652 - protein, 9 aa, Homo Sapiens
LYFCRGQTC

SEQ ID NO: 1143653 - protein, 9 aa, Homo Sapiens
DVGQAEVSV

SEQ ID NO: 1143654 - protein, 9 aa, Homo Sapiens
TKCQSFCDH

SEQ ID NO: 1143655 - protein, 9 aa, Homo Sapiens
KGIIYYVMT

SEQ ID NO: 1143656 - protein, 9 aa, Homo Sapiens
VTVKVAGET

SEQ ID NO: 1143657 - protein, 9 aa, Homo Sapiens
HCSSRKGKE

SEQ ID NO: 1143658 - protein, 9 aa, Homo Sapiens
GDQDRKRET

SEQ ID NO: 1143659 - protein, 9 aa, Homo Sapiens
EIFHFADGL

SEQ ID NO: 1143660 - protein, 9 aa, Homo Sapiens
VRALVFSVQ

SEQ ID NO: 1143661 - protein, 9 aa, Homo Sapiens
CVQYCVITC

SEQ ID NO: 1143662 - protein, 9 aa, Homo Sapiens
FDKCGLCGG

SEQ ID NO: 1143663 - protein, 9 aa, Homo Sapiens
LETQHRIAP

SEQ ID NO: 1143664 - protein, 9 aa, Homo Sapiens
DGHYMTLPV

SEQ ID NO: 1143665 - protein, 9 aa, Homo Sapiens
TLPVSPDQL

SEQ ID NO: 1143666 - protein, 9 aa, Homo Sapiens
EDKSTPEKR

SEQ ID NO: 1143667 - protein, 9 aa, Homo Sapiens
HMGTFLWQA

SEQ ID NO: 1143668 - protein, 9 aa, Homo Sapiens
KCGLCGGDN

SEQ ID NO: 1143669 - protein, 9 aa, Homo Sapiens
LPIKLDDLK

SEQ ID NO: 1143670 - protein, 9 aa, Homo Sapiens
ESFPIKNSG

SEQ ID NO: 1143671 - protein, 9 aa, Homo Sapiens
CLPSCNNRH

SEQ ID NO: 1143672 - protein, 9 aa, Homo Sapiens
QRRLEIPSS

SEQ ID NO: 1143673 - protein, 9 aa, Homo Sapiens
QVDCMSFPC

SEQ ID NO: 1143674 - protein, 9 aa, Homo Sapiens
IGRFDWGLA

SEQ ID NO: 1143675 - protein, 9 aa, Homo Sapiens
HRLPQPILE

SEQ ID NO: 1143676 - protein, 9 aa, Homo Sapiens
WKNVTVKVA

SEQ ID NO: 1143677 - protein, 9 aa, Homo Sapiens
SYDLNLYGL

SEQ ID NO: 1143678 - protein, 9 aa, Homo Sapiens
ARALMCVTV

SEQ ID NO: 1143679 - protein, 9 aa, Homo Sapiens
LDEAIFLTS

SEQ ID NO: 1143680 - protein, 9 aa, Homo Sapiens
GSSMPELFA

SEQ ID NO: 1143681 - protein, 9 aa, Homo Sapiens
FEEHKVDST

SEQ ID NO: 1143682 - protein, 9 aa, Homo Sapiens
YVMTSSKLE

SEQ ID NO: 1143683 - protein, 9 aa, Homo Sapiens
SFCDHMKSV

SEQ ID NO: 1143684 - protein, 9 aa, Homo Sapiens
VLELRGRGD

SEQ ID NO: 1143685 - protein, 9 aa, Homo Sapiens
ALMCVTVAL

SEQ ID NO: 1143686 - protein, 9 aa, Homo Sapiens
KGKESTEMK

SEQ ID NO: 1143687 - protein, 9 aa, Homo Sapiens
FCQNGKYAA

SEQ ID NO: 1143688 - protein, 9 aa, Homo Sapiens
PHMGTFLWQ

SEQ ID NO: 1143689 - protein, 9 aa, Homo Sapiens
ALDKMIQNP

SEQ ID NO: 1143690 - protein, 9 aa, Homo Sapiens
SDSLRQKYV

SEQ ID NO: 1143691 - protein, 9 aa, Homo Sapiens
LPVSPDQLP

SEQ ID NO: 1143692 - protein, 9 aa, Homo Sapiens
WVKSMQGGP

SEQ ID NO: 1143693 - protein, 9 aa, Homo Sapiens
TRMTTWHIM

SEQ ID NO: 1143694 - protein, 9 aa, Homo Sapiens
YMTLPVSPD

SEQ ID NO: 1143695 - protein, 9 aa, Homo Sapiens
SQWKNVTVK

SEQ ID NO: 1143696 - protein, 9 aa, Homo Sapiens
HQRLLVTSL

SEQ ID NO: 1143697 - protein, 9 aa, Homo Sapiens
GGDILEESS

SEQ ID NO: 1143698 - protein, 9 aa, Homo Sapiens
LPLIGIEAQ

SEQ ID NO: 1143699 - protein, 9 aa, Homo Sapiens
ITFFGNKIG

SEQ ID NO: 1143700 - protein, 9 aa, Homo Sapiens
EEEEDLEDG

SEQ ID NO: 1143701 - protein, 9 aa, Homo Sapiens
VNIQKDTLR

SEQ ID NO: 1143702 - protein, 9 aa, Homo Sapiens
KILNREIDF

SEQ ID NO: 1143703 - protein, 9 aa, Homo Sapiens
VKMYTGGVS

SEQ ID NO: 1143704 - protein, 9 aa, Homo Sapiens
SHHRRRGLG

SEQ ID NO: 1143705 - protein, 9 aa, Homo Sapiens
YFCRGQTCY

SEQ ID NO: 1143706 - protein, 9 aa, Homo Sapiens
LNLYGLTED

SEQ ID NO: 1143707 - protein, 9 aa, Homo Sapiens
GRAGATASR

SEQ ID NO: 1143708 - protein, 9 aa, Homo Sapiens
QKYVKMYTG

SEQ ID NO: 1143709 - protein, 9 aa, Homo Sapiens
LGDNYARWE

SEQ ID NO: 1143710 - protein, 9 aa, Homo Sapiens
ATKCQSFCD

SEQ ID NO: 1143711 - protein, 9 aa, Homo Sapiens
LREDECVSC

SEQ ID NO: 1143712 - protein, 9 aa, Homo Sapiens
DQRTLISGM

SEQ ID NO: 1143713 - protein, 9 aa, Homo Sapiens
GDILEESSY

SEQ ID NO: 1143714 - protein, 9 aa, Homo Sapiens
IGSLHPMKQ

SEQ ID NO: 1143715 - protein, 9 aa, Homo Sapiens
GATASRLAE

SEQ ID NO: 1143716 - protein, 9 aa, Homo Sapiens
FRQLGCPSS

SEQ ID NO: 1143717 - protein, 9 aa, Homo Sapiens
WGLAPPTTF

SEQ ID NO: 1143718 - protein, 9 aa, Homo Sapiens
VLPRSAELG

SEQ ID NO: 1143719 - protein, 9 aa, Homo Sapiens
QAEVSVQVN

SEQ ID NO: 1143720 - protein, 9 aa, Homo Sapiens
RFDKCGLCG

SEQ ID NO: 1143721 - protein, 9 aa, Homo Sapiens
QWKNVTVKV

SEQ ID NO: 1143722 - protein, 9 aa, Homo Sapiens
KSMQGGPEH

SEQ ID NO: 1143723 - protein, 9 aa, Homo Sapiens
QLGRAGATA

SEQ ID NO: 1143724 - protein, 9 aa, Homo Sapiens
EDGVFPEHA

SEQ ID NO: 1143725 - protein, 9 aa, Homo Sapiens
VFSATSALL

SEQ ID NO: 1143726 - protein, 9 aa, Homo Sapiens
NISLGITFF

SEQ ID NO: 1143727 - protein, 9 aa, Homo Sapiens
RTLISGMAS

SEQ ID NO: 1143728 - protein, 9 aa, Homo Sapiens
QPFACWECG

SEQ ID NO: 1143729 - protein, 9 aa, Homo Sapiens
KTIGSLHPM

SEQ ID NO: 1143730 - protein, 9 aa, Homo Sapiens
ILNREIDFA

SEQ ID NO: 1143731 - protein, 9 aa, Homo Sapiens
TLRSLVNIQ

SEQ ID NO: 1143732 - protein, 9 aa, Homo Sapiens
VMKMPEDKS

SEQ ID NO: 1143733 - protein, 9 aa, Homo Sapiens
FSVQCWARA

SEQ ID NO: 1143734 - protein, 9 aa, Homo Sapiens
SKCMQKSSP

SEQ ID NO: 1143735 - protein, 9 aa, Homo Sapiens
SSPIFPHHT

SEQ ID NO: 1143736 - protein, 9 aa, Homo Sapiens
HRRRGLGKK

SEQ ID NO: 1143737 - protein, 9 aa, Homo Sapiens
LEDGVFPEH

SEQ ID NO: 1143738 - protein, 9 aa, Homo Sapiens
LEIPSSGAD

SEQ ID NO: 1143739 - protein, 9 aa, Homo Sapiens
FLPLIGIEA

SEQ ID NO: 1143740 - protein, 9 aa, Homo Sapiens
GLEAETRMT

SEQ ID NO: 1143741 - protein, 9 aa, Homo Sapiens
ASAEARHHV

SEQ ID NO: 1143742 - protein, 9 aa, Homo Sapiens
VPLMVLMCL

SEQ ID NO: 1143743 - protein, 9 aa, Homo Sapiens
WPHCSSRKG

SEQ ID NO: 1143744 - protein, 9 aa, Homo Sapiens
VKSMQGGPE

SEQ ID NO: 1143745 - protein, 9 aa, Homo Sapiens
VKVAGETYS

SEQ ID NO: 1143746 - protein, 9 aa, Homo Sapiens
CVTVALSLI

SEQ ID NO: 1143747 - protein, 9 aa, Homo Sapiens
DLNLYGLTE

SEQ ID NO: 1143748 - protein, 9 aa, Homo Sapiens
AAIGTYDGR

SEQ ID NO: 1143749 - protein, 9 aa, Homo Sapiens
ENMDKSIIG

SEQ ID NO: 1143750 - protein, 9 aa, Homo Sapiens
GLCGGDNKS

SEQ ID NO: 1143751 - protein, 9 aa, Homo Sapiens
KTHSGAQPF

SEQ ID NO: 1143752 - protein, 9 aa, Homo Sapiens
MQGGPEHAS

SEQ ID NO: 1143753 - protein, 9 aa, Homo Sapiens
QTLKQRVFQ

SEQ ID NO: 1143754 - protein, 9 aa, Homo Sapiens
SQNEDVNQH

SEQ ID NO: 1143755 - protein, 9 aa, Homo Sapiens
IFPHHTALP

SEQ ID NO: 1143756 - protein, 9 aa, Homo Sapiens
QKSSPFSAA

SEQ ID NO: 1143757 - protein, 9 aa, Homo Sapiens
VVFRQLGCP

SEQ ID NO: 1143758 - protein, 9 aa, Homo Sapiens
EQQLSKKNN

SEQ ID NO: 1143759 - protein, 9 aa, Homo Sapiens
LPQPILESA

SEQ ID NO: 1143760 - protein, 9 aa, Homo Sapiens
FHFADGLDI

SEQ ID NO: 1143761 - protein, 9 aa, Homo Sapiens
SGQEATEST

SEQ ID NO: 1143762 - protein, 9 aa, Homo Sapiens
SATSALLFI

SEQ ID NO: 1143763 - protein, 9 aa, Homo Sapiens
CVITCPSLV

SEQ ID NO: 1143764 - protein, 9 aa, Homo Sapiens
EAETRMTTW

SEQ ID NO: 1143765 - protein, 9 aa, Homo Sapiens
AGQTLKQRV

SEQ ID NO: 1143766 - protein, 9 aa, Homo Sapiens
GGLYFCRGQ

SEQ ID NO: 1143767 - protein, 9 aa, Homo Sapiens
GKYAAIGTY

SEQ ID NO: 1143768 - protein, 9 aa, Homo Sapiens
RRGLGKKEW

SEQ ID NO: 1143769 - protein, 9 aa, Homo Sapiens
WAENDVGQA

SEQ ID NO: 1143770 - protein, 9 aa, Homo Sapiens
CMSFPCGCT

SEQ ID NO: 1143771 - protein, 9 aa, Homo Sapiens
VPSLARERD

SEQ ID NO: 1143772 - protein, 9 aa, Homo Sapiens
TLKQRVFQI

SEQ ID NO: 1143773 - protein, 9 aa, Homo Sapiens
SVQCWARAH

SEQ ID NO: 1143774 - protein, 9 aa, Homo Sapiens
GKIHATDGD

SEQ ID NO: 1143775 - protein, 9 aa, Homo Sapiens
PLIGIEAQK

SEQ ID NO: 1143776 - protein, 9 aa, Homo Sapiens
FATCSSHLA

SEQ ID NO: 1143777 - protein, 9 aa, Homo Sapiens
ALGVPSLAR

SEQ ID NO: 1143778 - protein, 9 aa, Homo Sapiens
KRFDKCGLC

SEQ ID NO: 1143779 - protein, 9 aa, Homo Sapiens
YAAIGTYDG

SEQ ID NO: 1143780 - protein, 9 aa, Homo Sapiens
IAQWVKSMQ

SEQ ID NO: 1143781 - protein, 9 aa, Homo Sapiens
LMCVTVALS

SEQ ID NO: 1143782 - protein, 9 aa, Homo Sapiens
PSSPIFPHH

SEQ ID NO: 1143783 - protein, 9 aa, Homo Sapiens
AENDVGQAE

SEQ ID NO: 1143784 - protein, 9 aa, Homo Sapiens
SLHPMKQPA

SEQ ID NO: 1143785 - protein, 9 aa, Homo Sapiens
ELDEAIFLT

SEQ ID NO: 1143786 - protein, 9 aa, Homo Sapiens
KNTAFPKKV

SEQ ID NO: 1143787 - protein, 9 aa, Homo Sapiens
LSKKNNGFF

SEQ ID NO: 1143788 - protein, 9 aa, Homo Sapiens
DCQEQQLSK

SEQ ID NO: 1143789 - protein, 9 aa, Homo Sapiens
ASHFLAVEM

SEQ ID NO: 1143790 - protein, 9 aa, Homo Sapiens
GVFPEHALC

SEQ ID NO: 1143791 - protein, 9 aa, Homo Sapiens
ELSKCMQKS

SEQ ID NO: 1143792 - protein, 9 aa, Homo Sapiens
QRLLEVCGR

SEQ ID NO: 1143793 - protein, 9 aa, Homo Sapiens
THSGAQPFA

SEQ ID NO: 1143794 - protein, 9 aa, Homo Sapiens
WVVFSATSA

SEQ ID NO: 1143795 - protein, 9 aa, Homo Sapiens
TARCQSSTS

SEQ ID NO: 1143796 - protein, 9 aa, Homo Sapiens
MQKSSPFSA

SEQ ID NO: 1143797 - protein, 9 aa, Homo Sapiens
SALDKMIQN

SEQ ID NO: 1143798 - protein, 9 aa, Homo Sapiens
GLLLHFLAA

SEQ ID NO: 1143799 - protein, 9 aa, Homo Sapiens
ITLVSLETQ

SEQ ID NO: 1143800 - protein, 9 aa, Homo Sapiens
TKQEFQHFS

SEQ ID NO: 1143801 - protein, 9 aa, Homo Sapiens
VVFSATSAL

SEQ ID NO: 1143802 - protein, 9 aa, Homo Sapiens
VSLETQHRI

SEQ ID NO: 1143803 - protein, 9 aa, Homo Sapiens
SLGITFFGN

SEQ ID NO: 1143804 - protein, 9 aa, Homo Sapiens
HHTALPLHL

SEQ ID NO: 1143805 - protein, 9 aa, Homo Sapiens
VQYCVITCP

SEQ ID NO: 1143806 - protein, 9 aa, Homo Sapiens
QGAHGESSL

SEQ ID NO: 1143807 - protein, 9 aa, Homo Sapiens
SKKNNGFFQ

SEQ ID NO: 1143808 - protein, 9 aa, Homo Sapiens
YYDIKDKNT

SEQ ID NO: 1143809 - protein, 9 aa, Homo Sapiens
LGSSTASHF

SEQ ID NO: 1143810 - protein, 9 aa, Homo Sapiens
KMPEDKSTP

SEQ ID NO: 1143811 - protein, 9 aa, Homo Sapiens
ITVGSFVSP

SEQ ID NO: 1143812 - protein, 9 aa, Homo Sapiens
NIQKDTLRL

SEQ ID NO: 1143813 - protein, 9 aa, Homo Sapiens
PLMVLMCLV

SEQ ID NO: 1143814 - protein, 9 aa, Homo Sapiens
RKPGSGGQK

SEQ ID NO: 1143815 - protein, 9 aa, Homo Sapiens
RGLGKKEWG

SEQ ID NO: 1143816 - protein, 9 aa, Homo Sapiens
AQGGLYFCR

SEQ ID NO: 1143817 - protein, 9 aa, Homo Sapiens
PIQASAEAR

SEQ ID NO: 1143818 - protein, 9 aa, Homo Sapiens
RERDTDPPL

SEQ ID NO: 1143819 - protein, 9 aa, Homo Sapiens
FCDHMKSVI

SEQ ID NO: 1143820 - protein, 9 aa, Homo Sapiens
LVSLETQHR

SEQ ID NO: 1143821 - protein, 9 aa, Homo Sapiens
SIGRFDWGL

SEQ ID NO: 1143822 - protein, 9 aa, Homo Sapiens
GIEAQKDSS

SEQ ID NO: 1143823 - protein, 9 aa, Homo Sapiens
IIYYVMTSS

SEQ ID NO: 1143824 - protein, 9 aa, Homo Sapiens
ATESTKQEF

SEQ ID NO: 1143825 - protein, 9 aa, Homo Sapiens
DFSYDLNLY

SEQ ID NO: 1143826 - protein, 9 aa, Homo Sapiens
MTLPVSPDQ

SEQ ID NO: 1143827 - protein, 9 aa, Homo Sapiens
QNPASLKIV

SEQ ID NO: 1143828 - protein, 9 aa, Homo Sapiens
CDHMKSVIP

SEQ ID NO: 1143829 - protein, 9 aa, Homo Sapiens
RLSSYGRLL

SEQ ID NO: 1143830 - protein, 9 aa, Homo Sapiens
RFLPLIGIE

SEQ ID NO: 1143831 - protein, 9 aa, Homo Sapiens
GFFLREDEC

SEQ ID NO: 1143832 - protein, 9 aa, Homo Sapiens
HSGAQPFAC

SEQ ID NO: 1143833 - protein, 9 aa, Homo Sapiens
RPKAGQTLK

SEQ ID NO: 1143834 - protein, 9 aa, Homo Sapiens
GPIQASAEA

SEQ ID NO: 1143835 - protein, 9 aa, Homo Sapiens
ALPIKLDDL

SEQ ID NO: 1143836 - protein, 9 aa, Homo Sapiens
IRLSSYGRL

SEQ ID NO: 1143837 - protein, 9 aa, Homo Sapiens
ESTKQEFQH

SEQ ID NO: 1143838 - protein, 9 aa, Homo Sapiens
LEESSYKVI

SEQ ID NO: 1143839 - protein, 9 aa, Homo Sapiens
ATSALLFIP

SEQ ID NO: 1143840 - protein, 9 aa, Homo Sapiens
PQSSPYRLP

SEQ ID NO: 1143841 - protein, 9 aa, Homo Sapiens
EEEDLEDGV

SEQ ID NO: 1143842 - protein, 9 aa, Homo Sapiens
IHLKTVLEL

SEQ ID NO: 1143843 - protein, 9 aa, Homo Sapiens
CGRLYELLT

SEQ ID NO: 1143844 - protein, 9 aa, Homo Sapiens
GFGLEAETR

SEQ ID NO: 1143845 - protein, 9 aa, Homo Sapiens
PSLARERDT

SEQ ID NO: 1143846 - protein, 9 aa, Homo Sapiens
DCMSFPCGC

SEQ ID NO: 1143847 - protein, 9 aa, Homo Sapiens
DPGLLLHFL

SEQ ID NO: 1143848 - protein, 9 aa, Homo Sapiens
HATDGDPQD

SEQ ID NO: 1143849 - protein, 9 aa, Homo Sapiens
NNHRLPQPI

SEQ ID NO: 1143850 - protein, 9 aa, Homo Sapiens
QMGDQDRKR

SEQ ID NO: 1143851 - protein, 9 aa, Homo Sapiens
AETRMTTWH

SEQ ID NO: 1143852 - protein, 9 aa, Homo Sapiens
ATCSSHLAV

SEQ ID NO: 1143853 - protein, 9 aa, Homo Sapiens
IGIEAQKDS

SEQ ID NO: 1143854 - protein, 9 aa, Homo Sapiens
LALPIKLDD

SEQ ID NO: 1143855 - protein, 9 aa, Homo Sapiens
RALVFSVQC

SEQ ID NO: 1143856 - protein, 9 aa, Homo Sapiens
QLSKKNNGF

SEQ ID NO: 1143857 - protein, 9 aa, Homo Sapiens
KSTPEKRTE

SEQ ID NO: 1143858 - protein, 9 aa, Homo Sapiens
ALLLLALPI

SEQ ID NO: 1143859 - protein, 9 aa, Homo Sapiens
MDCQEQQLS

SEQ ID NO: 1143860 - protein, 9 aa, Homo Sapiens
RCQSSTSPT

SEQ ID NO: 1143861 - protein, 8 aa, Homo Sapiens
YREWVVVN

SEQ ID NO: 1143862 - protein, 9 aa, Homo Sapiens
VKGIIYYVM

SEQ ID NO: 1143863 - protein, 9 aa, Homo Sapiens
RCMLDGRWT

SEQ ID NO: 1143864 - protein, 9 aa, Homo Sapiens
IFLTSFEEI

SEQ ID NO: 1143865 - protein, 9 aa, Homo Sapiens
LARERDTDP

SEQ ID NO: 1143866 - protein, 9 aa, Homo Sapiens
NNISLGITF

SEQ ID NO: 1143867 - protein, 9 aa, Homo Sapiens
LLLLALPIK

SEQ ID NO: 1143868 - protein, 9 aa, Homo Sapiens
AIFLTSFEE

SEQ ID NO: 1143869 - protein, 9 aa, Homo Sapiens
NDVGQAEVS

SEQ ID NO: 1143870 - protein, 9 aa, Homo Sapiens
KCQVDCMSF

SEQ ID NO: 1143871 - protein, 9 aa, Homo Sapiens
DECVSCSNC

SEQ ID NO: 1143872 - protein, 9 aa, Homo Sapiens
GHYMTLPVS

SEQ ID NO: 1143873 - protein, 9 aa, Homo Sapiens
RFDWGLAPP

SEQ ID NO: 1143874 - protein, 9 aa, Homo Sapiens
YYVMTSSKL

SEQ ID NO: 1143875 - protein, 9 aa, Homo Sapiens
PWDPGLLLH

SEQ ID NO: 1143876 - protein, 9 aa, Homo Sapiens
ETARCQSST

SEQ ID NO: 1143877 - protein, 9 aa, Homo Sapiens
FYYDIKDKN

SEQ ID NO: 1143878 - protein, 9 aa, Homo Sapiens
KIHATDGDP

SEQ ID NO: 1143879 - protein, 9 aa, Homo Sapiens
LGKKEWGPG

SEQ ID NO: 1143880 - protein, 9 aa, Homo Sapiens
VDCMSFPCG

SEQ ID NO: 1143881 - protein, 9 aa, Homo Sapiens
LLVTSLLVC

SEQ ID NO: 1143882 - protein, 9 aa, Homo Sapiens
NNNNHRLPQ

SEQ ID NO: 1143883 - protein, 9 aa, Homo Sapiens
ARCQSSTSP

SEQ ID NO: 1143884 - protein, 9 aa, Homo Sapiens
LEVCGRLYE

SEQ ID NO: 1143885 - protein, 9 aa, Homo Sapiens
RLEIPSSGA

SEQ ID NO: 1143886 - protein, 9 aa, Homo Sapiens
CQSSTSPTN

SEQ ID NO: 1143887 - protein, 9 aa, Homo Sapiens
KCQSFCDHM

SEQ ID NO: 1143888 - protein, 9 aa, Homo Sapiens
PQMGDQDRK

SEQ ID NO: 1143889 - protein, 9 aa, Homo Sapiens
AYLKIRLSS

SEQ ID NO: 1143890 - protein, 9 aa, Homo Sapiens
CSSHLAVVG

SEQ ID NO: 1143891 - protein, 9 aa, Homo Sapiens
INLEGGDIL

SEQ ID NO: 1143892 - protein, 9 aa, Homo Sapiens
KVAGETYSL

SEQ ID NO: 1143893 - protein, 9 aa, Homo Sapiens
LVCLEDKPI

SEQ ID NO: 1143894 - protein, 9 aa, Homo Sapiens
AIGTYDGRC

SEQ ID NO: 1143895 - protein, 9 aa, Homo Sapiens
DGDPQDTLT

SEQ ID NO: 1143896 - protein, 9 aa, Homo Sapiens
SHFLAVEMR

SEQ ID NO: 1143897 - protein, 9 aa, Homo Sapiens
NYARWENMD

SEQ ID NO: 1143898 - protein, 9 aa, Homo Sapiens
CQEQQLSKK

SEQ ID NO: 1143899 - protein, 9 aa, Homo Sapiens
EDLEDGVFP

SEQ ID NO: 1143900 - protein, 9 aa, Homo Sapiens
TFFGNKIGS

SEQ ID NO: 1143901 - protein, 9 aa, Homo Sapiens
STKQEFQHF

SEQ ID NO: 1143902 - protein, 9 aa, Homo Sapiens
TARALMCVT

SEQ ID NO: 1143903 - protein, 9 aa, Homo Sapiens
PFPCVQYCV

SEQ ID NO: 1143904 - protein, 9 aa, Homo Sapiens
SQGSTSQAT

SEQ ID NO: 1143905 - protein, 9 aa, Homo Sapiens
SASSAKKPH

SEQ ID NO: 1143906 - protein, 9 aa, Homo Sapiens
VELKKNIEY

SEQ ID NO: 1143907 - protein, 9 aa, Homo Sapiens
SLAGLHPLR

SEQ ID NO: 1143908 - protein, 9 aa, Homo Sapiens
PIEIQLISP

SEQ ID NO: 1143909 - protein, 9 aa, Homo Sapiens
VFFSTLLNC

SEQ ID NO: 1143910 - protein, 9 aa, Homo Sapiens
MVSHPNHTG

SEQ ID NO: 1143911 - protein, 9 aa, Homo Sapiens
PILLTLPMV

SEQ ID NO: 1143912 - protein, 9 aa, Homo Sapiens
QTLFYLFFC

SEQ ID NO: 1143913 - protein, 9 aa, Homo Sapiens
DLSHDHHHS

SEQ ID NO: 1143914 - protein, 9 aa, Homo Sapiens
AGLHPLRLL

SEQ ID NO: 1143915 - protein, 9 aa, Homo Sapiens
FPELMTTRN

SEQ ID NO: 1143916 - protein, 9 aa, Homo Sapiens
SLTYLQPKS

SEQ ID NO: 1143917 - protein, 9 aa, Homo Sapiens
GDPRDPAPE

SEQ ID NO: 1143918 - protein, 9 aa, Homo Sapiens
QDVLPRGDL

SEQ ID NO: 1143919 - protein, 9 aa, Homo Sapiens
SFKAHDSSL

SEQ ID NO: 1143920 - protein, 9 aa, Homo Sapiens
FIPVWGVSV

SEQ ID NO: 1143921 - protein, 9 aa, Homo Sapiens
VPGPAREAR

SEQ ID NO: 1143922 - protein, 9 aa, Homo Sapiens
YIATRKGFE

SEQ ID NO: 1143923 - protein, 9 aa, Homo Sapiens
VVATTKPKA

SEQ ID NO: 1143924 - protein, 9 aa, Homo Sapiens
LGDPRDPAP

SEQ ID NO: 1143925 - protein, 9 aa, Homo Sapiens
LLHLHCADS

SEQ ID NO: 1143926 - protein, 9 aa, Homo Sapiens
DFWRNGKQR

SEQ ID NO: 1143927 - protein, 9 aa, Homo Sapiens
ENPWLDKKM

SEQ ID NO: 1143928 - protein, 9 aa, Homo Sapiens
WRNGKQRED

SEQ ID NO: 1143929 - protein, 9 aa, Homo Sapiens
RGGLPTVTA

SEQ ID NO: 1143930 - protein, 9 aa, Homo Sapiens
ILLHLHCAD

SEQ ID NO: 1143931 - protein, 9 aa, Homo Sapiens
EFHERGIIR

SEQ ID NO: 1143932 - protein, 9 aa, Homo Sapiens
EGPNGPPGR

SEQ ID NO: 1143933 - protein, 9 aa, Homo Sapiens
KMWQKGSVR

SEQ ID NO: 1143934 - protein, 9 aa, Homo Sapiens
TLMRRILNR

SEQ ID NO: 1143935 - protein, 9 aa, Homo Sapiens
GDVNVVELK

SEQ ID NO: 1143936 - protein, 9 aa, Homo Sapiens
CLERGGGRS

SEQ ID NO: 1143937 - protein, 9 aa, Homo Sapiens
KKRKKLKKG

SEQ ID NO: 1143938 - protein, 9 aa, Homo Sapiens
EEKKDSAEQ

SEQ ID NO: 1143939 - protein, 9 aa, Homo Sapiens
AQGARMLPR

SEQ ID NO: 1143940 - protein, 9 aa, Homo Sapiens
RTPGMFFFD

SEQ ID NO: 1143941 - protein, 9 aa, Homo Sapiens
ERPWCYITD

SEQ ID NO: 1143942 - protein, 9 aa, Homo Sapiens
QEINKHSFI

SEQ ID NO: 1143943 - protein, 9 aa, Homo Sapiens
ERRSSLVAE

SEQ ID NO: 1143944 - protein, 9 aa, Homo Sapiens
TLRAAPTAL

SEQ ID NO: 1143945 - protein, 9 aa, Homo Sapiens
GRVQHVFPE

SEQ ID NO: 1143946 - protein, 9 aa, Homo Sapiens
LAMKKEVIQ

SEQ ID NO: 1143947 - protein, 9 aa, Homo Sapiens
LSTWFGERD

SEQ ID NO: 1143948 - protein, 9 aa, Homo Sapiens
HHCQPPLAT

SEQ ID NO: 1143949 - protein, 9 aa, Homo Sapiens
WIRQRKKKR

SEQ ID NO: 1143950 - protein, 9 aa, Homo Sapiens
NTATEESEN

SEQ ID NO: 1143951 - protein, 9 aa, Homo Sapiens
LCTNWYYGE

SEQ ID NO: 1143952 - protein, 9 aa, Homo Sapiens
LFIPNGDTS

SEQ ID NO: 1143953 - protein, 9 aa, Homo Sapiens
REDVMRLSC

SEQ ID NO: 1143954 - protein, 9 aa, Homo Sapiens
HLHCADSRA

SEQ ID NO: 1143955 - protein, 9 aa, Homo Sapiens
PQLMQNVIL

SEQ ID NO: 1143956 - protein, 9 aa, Homo Sapiens
EAAHKEVVR

SEQ ID NO: 1143957 - protein, 9 aa, Homo Sapiens
LTYLQPKSN

SEQ ID NO: 1143958 - protein, 9 aa, Homo Sapiens
FKCVIGFMM

SEQ ID NO: 1143959 - protein, 9 aa, Homo Sapiens
LRPVFSLFI

SEQ ID NO: 1143960 - protein, 9 aa, Homo Sapiens
ENPLGEDDF

SEQ ID NO: 1143961 - protein, 9 aa, Homo Sapiens
GPPGRNGGW

SEQ ID NO: 1143962 - protein, 9 aa, Homo Sapiens
KKKQPEFSP

SEQ ID NO: 1143963 - protein, 9 aa, Homo Sapiens
DPRDPAPEK

SEQ ID NO: 1143964 - protein, 9 aa, Homo Sapiens
VTCACHILL

SEQ ID NO: 1143965 - protein, 9 aa, Homo Sapiens
LIDNAFGDI

SEQ ID NO: 1143966 - protein, 9 aa, Homo Sapiens
RGRRLGDPR

SEQ ID NO: 1143967 - protein, 9 aa, Homo Sapiens
PLLVFFSTL

SEQ ID NO: 1143968 - protein, 9 aa, Homo Sapiens
EARSDHRAR

SEQ ID NO: 1143969 - protein, 9 aa, Homo Sapiens
LLCWTASAM

SEQ ID NO: 1143970 - protein, 9 aa, Homo Sapiens
PSHSKGQRS

SEQ ID NO: 1143971 - protein, 9 aa, Homo Sapiens
VSLAGLHPL

SEQ ID NO: 1143972 - protein, 9 aa, Homo Sapiens
APISDPIHL

SEQ ID NO: 1143973 - protein, 9 aa, Homo Sapiens
EEHGLGHGH

SEQ ID NO: 1143974 - protein, 9 aa, Homo Sapiens
GARMLPRGG

SEQ ID NO: 1143975 - protein, 9 aa, Homo Sapiens
PHILQLNAI

SEQ ID NO: 1143976 - protein, 9 aa, Homo Sapiens
RKGFEREVS

SEQ ID NO: 1143977 - protein, 9 aa, Homo Sapiens
VTCDAVCNK

SEQ ID NO: 1143978 - protein, 9 aa, Homo Sapiens
HSEQVPHIL

SEQ ID NO: 1143979 - protein, 9 aa, Homo Sapiens
AKWLEVKSK

SEQ ID NO: 1143980 - protein, 9 aa, Homo Sapiens
GDLVHGAEQ

SEQ ID NO: 1143981 - protein, 9 aa, Homo Sapiens
ASPFPELMT

SEQ ID NO: 1143982 - protein, 9 aa, Homo Sapiens
FFSTLLNCS

SEQ ID NO: 1143983 - protein, 9 aa, Homo Sapiens
PVTCDAVCN

SEQ ID NO: 1143984 - protein, 9 aa, Homo Sapiens
KEEKKDSAE

SEQ ID NO: 1143985 - protein, 9 aa, Homo Sapiens
RILNRNEKN

SEQ ID NO: 1143986 - protein, 9 aa, Homo Sapiens
DGRGVPGPA

SEQ ID NO: 1143987 - protein, 9 aa, Homo Sapiens
MKKEVIQTR

SEQ ID NO: 1143988 - protein, 9 aa, Homo Sapiens
LLSRLDHTE

SEQ ID NO: 1143989 - protein, 9 aa, Homo Sapiens
ISEICSENR

SEQ ID NO: 1143990 - protein, 9 aa, Homo Sapiens
QVRGHHGAV

SEQ ID NO: 1143991 - protein, 9 aa, Homo Sapiens
RPNVTVRRC

SEQ ID NO: 1143992 - protein, 9 aa, Homo Sapiens
VFSLFIPNG

SEQ ID NO: 1143993 - protein, 9 aa, Homo Sapiens
GLPTVTAGW

SEQ ID NO: 1143994 - protein, 9 aa, Homo Sapiens
EINKHSFIN

SEQ ID NO: 1143995 - protein, 9 aa, Homo Sapiens
RMLPRGGQD

SEQ ID NO: 1143996 - protein, 9 aa, Homo Sapiens
VYIEMLGHT

SEQ ID NO: 1143997 - protein, 9 aa, Homo Sapiens
FITSWTEPK

SEQ ID NO: 1143998 - protein, 9 aa, Homo Sapiens
IVIRPILLT

SEQ ID NO: 1143999 - protein, 9 aa, Homo Sapiens
FEREVSSFL

SEQ ID NO: 1144000 - protein, 9 aa, Homo Sapiens
DSAEQVRKS

SEQ ID NO: 1144001 - protein, 9 aa, Homo Sapiens
CQTRGAPIS

SEQ ID NO: 1144002 - protein, 9 aa, Homo Sapiens
LHPLRLLCW

SEQ ID NO: 1144003 - protein, 9 aa, Homo Sapiens
WGVSVDECV

SEQ ID NO: 1144004 - protein, 9 aa, Homo Sapiens
VMVSHPNHT

SEQ ID NO: 1144005 - protein, 9 aa, Homo Sapiens
KKKRHQRSL

SEQ ID NO: 1144006 - protein, 9 aa, Homo Sapiens
RCHFMQCQF

SEQ ID NO: 1144007 - protein, 9 aa, Homo Sapiens
EIQLISPLA

SEQ ID NO: 1144008 - protein, 9 aa, Homo Sapiens
LWGCVSLAG

SEQ ID NO: 1144009 - protein, 9 aa, Homo Sapiens
KEKKSKLML

SEQ ID NO: 1144010 - protein, 9 aa, Homo Sapiens
AMKKEVIQT

SEQ ID NO: 1144011 - protein, 9 aa, Homo Sapiens
GRNGGWTWT

SEQ ID NO: 1144012 - protein, 9 aa, Homo Sapiens
KCVRTILPV

SEQ ID NO: 1144013 - protein, 9 aa, Homo Sapiens
AQWLRENPW

SEQ ID NO: 1144014 - protein, 9 aa, Homo Sapiens
TVRRCDTCS

SEQ ID NO: 1144015 - protein, 9 aa, Homo Sapiens
VLGHHCQPP

SEQ ID NO: 1144016 - protein, 9 aa, Homo Sapiens
MGTPKEKHE

SEQ ID NO: 1144017 - protein, 9 aa, Homo Sapiens
ERGDVNVVE

SEQ ID NO: 1144018 - protein, 9 aa, Homo Sapiens
ISDLVGCVV

SEQ ID NO: 1144019 - protein, 9 aa, Homo Sapiens
PLMSYSNNF

SEQ ID NO: 1144020 - protein, 9 aa, Homo Sapiens
TSSSKGPSH

SEQ ID NO: 1144021 - protein, 9 aa, Homo Sapiens
ILRAEGRME

SEQ ID NO: 1144022 - protein, 9 aa, Homo Sapiens
VPHILQLNA

SEQ ID NO: 1144023 - protein, 9 aa, Homo Sapiens
QVEAKWLEV

SEQ ID NO: 1144024 - protein, 9 aa, Homo Sapiens
VGLVGTAVT

SEQ ID NO: 1144025 - protein, 9 aa, Homo Sapiens
ILLTLPMVY

SEQ ID NO: 1144026 - protein, 9 aa, Homo Sapiens
LGGCLERGG

SEQ ID NO: 1144027 - protein, 9 aa, Homo Sapiens
KYYVTCACH

SEQ ID NO: 1144028 - protein, 9 aa, Homo Sapiens
SLQTLFYLF

SEQ ID NO: 1144029 - protein, 9 aa, Homo Sapiens
RQAQGARML

SEQ ID NO: 1144030 - protein, 9 aa, Homo Sapiens
PFIPVWGVS

SEQ ID NO: 1144031 - protein, 9 aa, Homo Sapiens
DDKEEKKDS

SEQ ID NO: 1144032 - protein, 9 aa, Homo Sapiens
KQPEFSPTS

SEQ ID NO: 1144033 - protein, 9 aa, Homo Sapiens
QLTLSQCKG

SEQ ID NO: 1144034 - protein, 9 aa, Homo Sapiens
RHQRSLLQW

SEQ ID NO: 1144035 - protein, 9 aa, Homo Sapiens
HGAEQDEGD

SEQ ID NO: 1144036 - protein, 9 aa, Homo Sapiens
RVEEVRALP

SEQ ID NO: 1144037 - protein, 9 aa, Homo Sapiens
GCLERGGGR

SEQ ID NO: 1144038 - protein, 9 aa, Homo Sapiens
TASLTYLQP

SEQ ID NO: 1144039 - protein, 9 aa, Homo Sapiens
APKCSWGTP

SEQ ID NO: 1144040 - protein, 9 aa, Homo Sapiens
DFTASNDIT

SEQ ID NO: 1144041 - protein, 9 aa, Homo Sapiens
KKHSEQVPH

SEQ ID NO: 1144042 - protein, 9 aa, Homo Sapiens
TLFYLFFCF

SEQ ID NO: 1144043 - protein, 9 aa, Homo Sapiens
EERRSSLVA

SEQ ID NO: 1144044 - protein, 9 aa, Homo Sapiens
VGKCRWKQC

SEQ ID NO: 1144045 - protein, 9 aa, Homo Sapiens
MTTRNNTSF

SEQ ID NO: 1144046 - protein, 9 aa, Homo Sapiens
WCYITDPQI

SEQ ID NO: 1144047 - protein, 9 aa, Homo Sapiens
SSLVAEIDS

SEQ ID NO: 1144048 - protein, 9 aa, Homo Sapiens
FQFLWILRS

SEQ ID NO: 1144049 - protein, 9 aa, Homo Sapiens
PLPWQKCVR

SEQ ID NO: 1144050 - protein, 9 aa, Homo Sapiens
RCQTRGAPI

SEQ ID NO: 1144051 - protein, 9 aa, Homo Sapiens
SLSPAHVAF

SEQ ID NO: 1144052 - protein, 9 aa, Homo Sapiens
SGGAGRGGL

SEQ ID NO: 1144053 - protein, 9 aa, Homo Sapiens
FVGLEDHKY

SEQ ID NO: 1144054 - protein, 9 aa, Homo Sapiens
KKDSAEQVR

SEQ ID NO: 1144055 - protein, 9 aa, Homo Sapiens
CNKCREMLT

SEQ ID NO: 1144056 - protein, 9 aa, Homo Sapiens
VILAPYMRS

SEQ ID NO: 1144057 - protein, 9 aa, Homo Sapiens
HTARPDSPD

SEQ ID NO: 1144058 - protein, 9 aa, Homo Sapiens
CVSLAGLHP

SEQ ID NO: 1144059 - protein, 9 aa, Homo Sapiens
RALPNAPNS

SEQ ID NO: 1144060 - protein, 9 aa, Homo Sapiens
EPKLNSPMY

SEQ ID NO: 1144061 - protein, 9 aa, Homo Sapiens
WLRENPWLD

SEQ ID NO: 1144062 - protein, 9 aa, Homo Sapiens
AFGDIFDQF

SEQ ID NO: 1144063 - protein, 9 aa, Homo Sapiens
GGRLGGCLE

SEQ ID NO: 1144064 - protein, 9 aa, Homo Sapiens
DSSLRTENP

SEQ ID NO: 1144065 - protein, 9 aa, Homo Sapiens
EGDGRGVPG

SEQ ID NO: 1144066 - protein, 9 aa, Homo Sapiens
NVMVSHPNH

SEQ ID NO: 1144067 - protein, 9 aa, Homo Sapiens
CKGLNYRYH

SEQ ID NO: 1144068 - protein, 9 aa, Homo Sapiens
HCADSRAAK

SEQ ID NO: 1144069 - protein, 9 aa, Homo Sapiens
GLHPLRLLC

SEQ ID NO: 1144070 - protein, 9 aa, Homo Sapiens
QPKSNQSPE

SEQ ID NO: 1144071 - protein, 9 aa, Homo Sapiens
KDSAEQVRK

SEQ ID NO: 1144072 - protein, 9 aa, Homo Sapiens
NHFINVMVS

SEQ ID NO: 1144073 - protein, 9 aa, Homo Sapiens
ELKKNIEYA

SEQ ID NO: 1144074 - protein, 9 aa, Homo Sapiens
IPGSSSFSY

SEQ ID NO: 1144075 - protein, 9 aa, Homo Sapiens
KILRAEGRM

SEQ ID NO: 1144076 - protein, 9 aa, Homo Sapiens
HFVGLEDHK

SEQ ID NO: 1144077 - protein, 9 aa, Homo Sapiens
PNVTVRRCD

SEQ ID NO: 1144078 - protein, 9 aa, Homo Sapiens
LATDLSHDH

SEQ ID NO: 1144079 - protein, 9 aa, Homo Sapiens
KHSEQVPHI

SEQ ID NO: 1144080 - protein, 9 aa, Homo Sapiens
GNAKKKQPE

SEQ ID NO: 1144081 - protein, 9 aa, Homo Sapiens
QCKGLNYRY

SEQ ID NO: 1144082 - protein, 9 aa, Homo Sapiens
KRKKLKKGK

SEQ ID NO: 1144083 - protein, 9 aa, Homo Sapiens
HVGKCRWKQ

SEQ ID NO: 1144084 - protein, 9 aa, Homo Sapiens
SKLMLAKEE

SEQ ID NO: 1144085 - protein, 9 aa, Homo Sapiens
TLVLLSRLD

SEQ ID NO: 1144086 - protein, 9 aa, Homo Sapiens
YWAMFDGHG

SEQ ID NO: 1144087 - protein, 9 aa, Homo Sapiens
HKYEYLMTL

SEQ ID NO: 1144088 - protein, 9 aa, Homo Sapiens
LRTENPKHS

SEQ ID NO: 1144089 - protein, 9 aa, Homo Sapiens
TSWTEPKLN

SEQ ID NO: 1144090 - protein, 9 aa, Homo Sapiens
RGDLVHGAE

SEQ ID NO: 1144091 - protein, 9 aa, Homo Sapiens
KRHQRSLLQ

SEQ ID NO: 1144092 - protein, 9 aa, Homo Sapiens
GNHFINVMV

SEQ ID NO: 1144093 - protein, 9 aa, Homo Sapiens
LMQNVILAP

SEQ ID NO: 1144094 - protein, 9 aa, Homo Sapiens
LPRGGQDVL

SEQ ID NO: 1144095 - protein, 9 aa, Homo Sapiens
INVMVSHPN

SEQ ID NO: 1144096 - protein, 9 aa, Homo Sapiens
PDEEHGLGH

SEQ ID NO: 1144097 - protein, 9 aa, Homo Sapiens
GTSSSKGPS

SEQ ID NO: 1144098 - protein, 9 aa, Homo Sapiens
LSPAHVAFE

SEQ ID NO: 1144099 - protein, 9 aa, Homo Sapiens
IIFITSWTE

SEQ ID NO: 1144100 - protein, 9 aa, Homo Sapiens
VEAKWLEVK

SEQ ID NO: 1144101 - protein, 9 aa, Homo Sapiens
LMLAKEEFK

SEQ ID NO: 1144102 - protein, 9 aa, Homo Sapiens
SAEQVRKST

SEQ ID NO: 1144103 - protein, 9 aa, Homo Sapiens
QGACACSTL

SEQ ID NO: 1144104 - protein, 9 aa, Homo Sapiens
NLIDNAFGD

SEQ ID NO: 1144105 - protein, 9 aa, Homo Sapiens
SLRTENPKH

SEQ ID NO: 1144106 - protein, 9 aa, Homo Sapiens
WTASAMQQK

SEQ ID NO: 1144107 - protein, 9 aa, Homo Sapiens
TGHYWAMFD

SEQ ID NO: 1144108 - protein, 9 aa, Homo Sapiens
QKCVRTILP

SEQ ID NO: 1144109 - protein, 9 aa, Homo Sapiens
RLIGRQVRG

SEQ ID NO: 1144110 - protein, 9 aa, Homo Sapiens
YIEMLGHTA

SEQ ID NO: 1144111 - protein, 9 aa, Homo Sapiens
LLVFFSTLL

SEQ ID NO: 1144112 - protein, 9 aa, Homo Sapiens
LSQCKGLNY

SEQ ID NO: 1144113 - protein, 9 aa, Homo Sapiens
GGLPTVTAG

SEQ ID NO: 1144114 - protein, 9 aa, Homo Sapiens
VTIIRMDRH

SEQ ID NO: 1144115 - protein, 9 aa, Homo Sapiens
LEDHKYEYL

SEQ ID NO: 1144116 - protein, 9 aa, Homo Sapiens
RMLAPKCSW

SEQ ID NO: 1144117 - protein, 9 aa, Homo Sapiens
TASNDITPL

SEQ ID NO: 1144118 - protein, 9 aa, Homo Sapiens
LEERRSSLV

SEQ ID NO: 1144119 - protein, 9 aa, Homo Sapiens
MRRILNRNE

SEQ ID NO: 1144120 - protein, 9 aa, Homo Sapiens
IALKAGRTL

SEQ ID NO: 1144121 - protein, 9 aa, Homo Sapiens
LMTTRNNTS

SEQ ID NO: 1144122 - protein, 9 aa, Homo Sapiens
CHFMQCQFL

SEQ ID NO: 1144123 - protein, 9 aa, Homo Sapiens
HSHHINDGR

SEQ ID NO: 1144124 - protein, 9 aa, Homo Sapiens
RPVFSLFIP

SEQ ID NO: 1144125 - protein, 9 aa, Homo Sapiens
DVALDFWRN

SEQ ID NO: 1144126 - protein, 9 aa, Homo Sapiens
MKRLPLLVF

SEQ ID NO: 1144127 - protein, 9 aa, Homo Sapiens
QDEGDGRGV

SEQ ID NO: 1144128 - protein, 9 aa, Homo Sapiens
SEICSENRL

SEQ ID NO: 1144129 - protein, 9 aa, Homo Sapiens
ATDLSHDHH

SEQ ID NO: 1144130 - protein, 9 aa, Homo Sapiens
KTLVLLSRL

SEQ ID NO: 1144131 - protein, 9 aa, Homo Sapiens
TDLSHDHHH

SEQ ID NO: 1144132 - protein, 9 aa, Homo Sapiens
LTVDDVHKS

SEQ ID NO: 1144133 - protein, 9 aa, Homo Sapiens
TYLQPKSNQ

SEQ ID NO: 1144134 - protein, 9 aa, Homo Sapiens
GHTARPDSP

SEQ ID NO: 1144135 - protein, 9 aa, Homo Sapiens
EGRMEDWMT

SEQ ID NO: 1144136 - protein, 9 aa, Homo Sapiens
GTASLTYLQ

SEQ ID NO: 1144137 - protein, 9 aa, Homo Sapiens
RRILNRNEK

SEQ ID NO: 1144138 - protein, 9 aa, Homo Sapiens
LRLLCWTAS

SEQ ID NO: 1144139 - protein, 9 aa, Homo Sapiens
KIRSGSFGD

SEQ ID NO: 1144140 - protein, 9 aa, Homo Sapiens
GAVPLPWQK

SEQ ID NO: 1144141 - protein, 9 aa, Homo Sapiens
PRGDLVHGA

SEQ ID NO: 1144142 - protein, 9 aa, Homo Sapiens
ALDFWRNGK

SEQ ID NO: 1144143 - protein, 9 aa, Homo Sapiens
VCNKCREML

SEQ ID NO: 1144144 - protein, 9 aa, Homo Sapiens
ASLTYLQPK

SEQ ID NO: 1144145 - protein, 9 aa, Homo Sapiens
KRLIGRQVR

SEQ ID NO: 1144146 - protein, 9 aa, Homo Sapiens
ASNDITPLH

SEQ ID NO: 1144147 - protein, 9 aa, Homo Sapiens
PGPAREARS

SEQ ID NO: 1144148 - protein, 9 aa, Homo Sapiens
IDQVEAKWL

SEQ ID NO: 1144149 - protein, 9 aa, Homo Sapiens
SPFPELMTT

SEQ ID NO: 1144150 - protein, 9 aa, Homo Sapiens
IRMDRHLHT

SEQ ID NO: 1144151 - protein, 9 aa, Homo Sapiens
ACSTLRAAP

SEQ ID NO: 1144152 - protein, 9 aa, Homo Sapiens
EALALPGGE

SEQ ID NO: 1144153 - protein, 9 aa, Homo Sapiens
LGHHCQPPL

SEQ ID NO: 1144154 - protein, 9 aa, Homo Sapiens
RSGSFGDVY

SEQ ID NO: 1144155 - protein, 9 aa, Homo Sapiens
CPFIPVWGV

SEQ ID NO: 1144156 - protein, 9 aa, Homo Sapiens
LVFFSTLLN

SEQ ID NO: 1144157 - protein, 9 aa, Homo Sapiens
GSTSQATPS

SEQ ID NO: 1144158 - protein, 9 aa, Homo Sapiens
LVHGAEQDE

SEQ ID NO: 1144159 - protein, 9 aa, Homo Sapiens
ISDPIHLSV

SEQ ID NO: 1144160 - protein, 9 aa, Homo Sapiens
QKSLSPAHV

SEQ ID NO: 1144161 - protein, 9 aa, Homo Sapiens
VMRLSCLAL

SEQ ID NO: 1144162 - protein, 9 aa, Homo Sapiens
PNGPPGRNG

SEQ ID NO: 1144163 - protein, 9 aa, Homo Sapiens
AAKNVRPGH

SEQ ID NO: 1144164 - protein, 9 aa, Homo Sapiens
FLTGHYWAM

SEQ ID NO: 1144165 - protein, 9 aa, Homo Sapiens
QQKSLSPAH

SEQ ID NO: 1144166 - protein, 9 aa, Homo Sapiens
PTDRTDGSV

SEQ ID NO: 1144167 - protein, 9 aa, Homo Sapiens
YLSTWFGER

SEQ ID NO: 1144168 - protein, 9 aa, Homo Sapiens
CIVIRPILL

SEQ ID NO: 1144169 - protein, 9 aa, Homo Sapiens
AVDFTASND

SEQ ID NO: 1144170 - protein, 9 aa, Homo Sapiens
HINDGRVQH

SEQ ID NO: 1144171 - protein, 9 aa, Homo Sapiens
RKKLKKGKE

SEQ ID NO: 1144172 - protein, 9 aa, Homo Sapiens
AGRTLQIFN

SEQ ID NO: 1144173 - protein, 9 aa, Homo Sapiens
QNVILAPYM

SEQ ID NO: 1144174 - protein, 9 aa, Homo Sapiens
ALRPVFSLF

SEQ ID NO: 1144175 - protein, 9 aa, Homo Sapiens
LSLQTLFYL

SEQ ID NO: 1144176 - protein, 9 aa, Homo Sapiens
VFKCVIGFM

SEQ ID NO: 1144177 - protein, 9 aa, Homo Sapiens
KRHGELQGH

SEQ ID NO: 1144178 - protein, 9 aa, Homo Sapiens
VGCVVSGWL

SEQ ID NO: 1144179 - protein, 9 aa, Homo Sapiens
CQFLGGTMI

SEQ ID NO: 1144180 - protein, 9 aa, Homo Sapiens
RGHHGAVGH

SEQ ID NO: 1144181 - protein, 9 aa, Homo Sapiens
YKLVRKIRS

SEQ ID NO: 1144182 - protein, 9 aa, Homo Sapiens
VGLEDHKYE

SEQ ID NO: 1144183 - protein, 9 aa, Homo Sapiens
DHKYEYLMT

SEQ ID NO: 1144184 - protein, 9 aa, Homo Sapiens
DVCPFIPVW

SEQ ID NO: 1144185 - protein, 9 aa, Homo Sapiens
ESENPLGED

SEQ ID NO: 1144186 - protein, 9 aa, Homo Sapiens
KGQEYLRSS

SEQ ID NO: 1144187 - protein, 9 aa, Homo Sapiens
GRTLQIFNI

SEQ ID NO: 1144188 - protein, 9 aa, Homo Sapiens
RMEDWMTAV

SEQ ID NO: 1144189 - protein, 9 aa, Homo Sapiens
RPGHLLWGC

SEQ ID NO: 1144190 - protein, 9 aa, Homo Sapiens
SAMQQKSLS

SEQ ID NO: 1144191 - protein, 9 aa, Homo Sapiens
CTNWYYGEC

SEQ ID NO: 1144192 - protein, 9 aa, Homo Sapiens
RAYVGLVGT

SEQ ID NO: 1144193 - protein, 9 aa, Homo Sapiens
GRGVPGPAR

SEQ ID NO: 1144194 - protein, 9 aa, Homo Sapiens
TCACHILLH

SEQ ID NO: 1144195 - protein, 9 aa, Homo Sapiens
ADSRAAKNV

SEQ ID NO: 1144196 - protein, 9 aa, Homo Sapiens
KPHAANGPL

SEQ ID NO: 1144197 - protein, 9 aa, Homo Sapiens
LQPKSNQSP

SEQ ID NO: 1144198 - protein, 9 aa, Homo Sapiens
QRKKKRHQR

SEQ ID NO: 1144199 - protein, 9 aa, Homo Sapiens
YLQPKSNQS

SEQ ID NO: 1144200 - protein, 9 aa, Homo Sapiens
CSENRLNVD

SEQ ID NO: 1144201 - protein, 9 aa, Homo Sapiens
FKAHDSSLR

SEQ ID NO: 1144202 - protein, 9 aa, Homo Sapiens
FYIATRKGF

SEQ ID NO: 1144203 - protein, 9 aa, Homo Sapiens
VIGFMMEMA

SEQ ID NO: 1144204 - protein, 9 aa, Homo Sapiens
LMSYSNNFT

SEQ ID NO: 1144205 - protein, 9 aa, Homo Sapiens
LPMSKGQEY

SEQ ID NO: 1144206 - protein, 9 aa, Homo Sapiens
RLGGCLERG

SEQ ID NO: 1144207 - protein, 9 aa, Homo Sapiens
GHVGKCRWK

SEQ ID NO: 1144208 - protein, 9 aa, Homo Sapiens
VLLSRLDHT

SEQ ID NO: 1144209 - protein, 9 aa, Homo Sapiens
QIPGSSSFS

SEQ ID NO: 1144210 - protein, 9 aa, Homo Sapiens
NGTSSSKGP

SEQ ID NO: 1144211 - protein, 9 aa, Homo Sapiens
DVMRLSCLA

SEQ ID NO: 1144212 - protein, 9 aa, Homo Sapiens
NRNEKNRPR

SEQ ID NO: 1144213 - protein, 9 aa, Homo Sapiens
LVPVKGHVG

SEQ ID NO: 1144214 - protein, 9 aa, Homo Sapiens
ITLMRRILN

SEQ ID NO: 1144215 - protein, 9 aa, Homo Sapiens
SQATPSHRN

SEQ ID NO: 1144216 - protein, 9 aa, Homo Sapiens
VIRPILLTL

SEQ ID NO: 1144217 - protein, 9 aa, Homo Sapiens
PKEKHEAIS

SEQ ID NO: 1144218 - protein, 9 aa, Homo Sapiens
VAISDLVGC

SEQ ID NO: 1144219 - protein, 9 aa, Homo Sapiens
QNLIDNAFG

SEQ ID NO: 1144220 - protein, 9 aa, Homo Sapiens
PQGACACST

SEQ ID NO: 1144221 - protein, 9 aa, Homo Sapiens
NAFGDIFDQ

SEQ ID NO: 1144222 - protein, 9 aa, Homo Sapiens
CWTASAMQQ

SEQ ID NO: 1144223 - protein, 9 aa, Homo Sapiens
GLEDHKYEY

SEQ ID NO: 1144224 - protein, 9 aa, Homo Sapiens
GAGRGGLPT

SEQ ID NO: 1144225 - protein, 9 aa, Homo Sapiens
DLCTNWYYG

SEQ ID NO: 1144226 - protein, 9 aa, Homo Sapiens
LDFWRNGKQ

SEQ ID NO: 1144227 - protein, 9 aa, Homo Sapiens
KLMLAKEEF

SEQ ID NO: 1144228 - protein, 9 aa, Homo Sapiens
LVLLSRLDH

SEQ ID NO: 1144229 - protein, 9 aa, Homo Sapiens
AEGRMEDWM

SEQ ID NO: 1144230 - protein, 9 aa, Homo Sapiens
VRALPNAPN

SEQ ID NO: 1144231 - protein, 9 aa, Homo Sapiens
LPLLVFFST

SEQ ID NO: 1144232 - protein, 9 aa, Homo Sapiens
PVWGVSVDE

SEQ ID NO: 1144233 - protein, 9 aa, Homo Sapiens
DHHHSHHIN

SEQ ID NO: 1144234 - protein, 9 aa, Homo Sapiens
AVGHEALAL

SEQ ID NO: 1144235 - protein, 9 aa, Homo Sapiens
LPRGDLVHG

SEQ ID NO: 1144236 - protein, 9 aa, Homo Sapiens
AISDLVGCV

SEQ ID NO: 1144237 - protein, 9 aa, Homo Sapiens
MWQKGSVRL

SEQ ID NO: 1144238 - protein, 9 aa, Homo Sapiens
SSMKPTDRT

SEQ ID NO: 1144239 - protein, 9 aa, Homo Sapiens
LVGCVVSGW

SEQ ID NO: 1144240 - protein, 9 aa, Homo Sapiens
WLEVKSKRR

SEQ ID NO: 1144241 - protein, 9 aa, Homo Sapiens
VRGHHGAVG

SEQ ID NO: 1144242 - protein, 9 aa, Homo Sapiens
HHSHHINDG

SEQ ID NO: 1144243 - protein, 9 aa, Homo Sapiens
PPLATDLSH

SEQ ID NO: 1144244 - protein, 9 aa, Homo Sapiens
DQVEAKWLE

SEQ ID NO: 1144245 - protein, 9 aa, Homo Sapiens
ECPLMSYSN

SEQ ID NO: 1144246 - protein, 9 aa, Homo Sapiens
TEESENPLG

SEQ ID NO: 1144247 - protein, 9 aa, Homo Sapiens
YKEKKSKLM

SEQ ID NO: 1144248 - protein, 9 aa, Homo Sapiens
RNGKQREDI

SEQ ID NO: 1144249 - protein, 9 aa, Homo Sapiens
LLWGCVSLA

SEQ ID NO: 1144250 - protein, 9 aa, Homo Sapiens
KKSKLMLAK

SEQ ID NO: 1144251 - protein, 9 aa, Homo Sapiens
RLGDPRDPA

SEQ ID NO: 1144252 - protein, 9 aa, Homo Sapiens
GCVSLAGLH

SEQ ID NO: 1144253 - protein, 9 aa, Homo Sapiens
GGERGRQAQ

SEQ ID NO: 1144254 - protein, 9 aa, Homo Sapiens
QATPSHRNT

SEQ ID NO: 1144255 - protein, 9 aa, Homo Sapiens
RSSLVAEID

SEQ ID NO: 1144256 - protein, 9 aa, Homo Sapiens
HVAFEVLGH

SEQ ID NO: 1144257 - protein, 9 aa, Homo Sapiens
IRSGSFGDV

SEQ ID NO: 1144258 - protein, 9 aa, Homo Sapiens
PLATDLSHD

SEQ ID NO: 1144259 - protein, 9 aa, Homo Sapiens
HSFINFELR

SEQ ID NO: 1144260 - protein, 9 aa, Homo Sapiens
GRGGLPTVT

SEQ ID NO: 1144261 - protein, 9 aa, Homo Sapiens
WQKGSVRLN

SEQ ID NO: 1144262 - protein, 9 aa, Homo Sapiens
SMKPTDRTD

SEQ ID NO: 1144263 - protein, 9 aa, Homo Sapiens
MLAPKCSWG

SEQ ID NO: 1144264 - protein, 9 aa, Homo Sapiens
RLPLLVFFS

SEQ ID NO: 1144265 - protein, 9 aa, Homo Sapiens
PFPELMTTR

SEQ ID NO: 1144266 - protein, 9 aa, Homo Sapiens
KCRPNVTVR

SEQ ID NO: 1144267 - protein, 9 aa, Homo Sapiens
NPLGEDDFD

SEQ ID NO: 1144268 - protein, 9 aa, Homo Sapiens
GCVVSGWLG

SEQ ID NO: 1144269 - protein, 9 aa, Homo Sapiens
EEVRALPNA

SEQ ID NO: 1144270 - protein, 9 aa, Homo Sapiens
DKEEKKDSA

SEQ ID NO: 1144271 - protein, 9 aa, Homo Sapiens
HHINDGRVQ

SEQ ID NO: 1144272 - protein, 9 aa, Homo Sapiens
LVAEIDSLT

SEQ ID NO: 1144273 - protein, 9 aa, Homo Sapiens
SDLVGCVVS

SEQ ID NO: 1144274 - protein, 9 aa, Homo Sapiens
NVRPGHLLW

SEQ ID NO: 1144275 - protein, 9 aa, Homo Sapiens
SLTGNKKKS

SEQ ID NO: 1144276 - protein, 9 aa, Homo Sapiens
PVKGHVGKC

SEQ ID NO: 1144277 - protein, 9 aa, Homo Sapiens
TSQATPSHR

SEQ ID NO: 1144278 - protein, 9 aa, Homo Sapiens
AHVAFEVLG

SEQ ID NO: 1144279 - protein, 9 aa, Homo Sapiens
MFDGHGGPA

SEQ ID NO: 1144280 - protein, 9 aa, Homo Sapiens
TKKVVATTK

SEQ ID NO: 1144281 - protein, 9 aa, Homo Sapiens
TSVLEYLST

SEQ ID NO: 1144282 - protein, 9 aa, Homo Sapiens
TARPDSPDP

SEQ ID NO: 1144283 - protein, 9 aa, Homo Sapiens
ITSWTEPKL

SEQ ID NO: 1144284 - protein, 9 aa, Homo Sapiens
RLNVDFLML

SEQ ID NO: 1144285 - protein, 9 aa, Homo Sapiens
GSVRLNRKA

SEQ ID NO: 1144286 - protein, 9 aa, Homo Sapiens
CLALGSEAW

SEQ ID NO: 1144287 - protein, 9 aa, Homo Sapiens
IEIQLISPL

SEQ ID NO: 1144288 - protein, 9 aa, Homo Sapiens
GAEQDEGDG

SEQ ID NO: 1144289 - protein, 9 aa, Homo Sapiens
APKTLVLLS

SEQ ID NO: 1144290 - protein, 9 aa, Homo Sapiens
LRAEGRMED

SEQ ID NO: 1144291 - protein, 9 aa, Homo Sapiens
PELMTTRNN

SEQ ID NO: 1144292 - protein, 9 aa, Homo Sapiens
GGQDVLPRG

SEQ ID NO: 1144293 - protein, 9 aa, Homo Sapiens
VRKIRSGSF

SEQ ID NO: 1144294 - protein, 9 aa, Homo Sapiens
SKGQEYLRS

SEQ ID NO: 1144295 - protein, 9 aa, Homo Sapiens
NPWLDKKMI

SEQ ID NO: 1144296 - protein, 9 aa, Homo Sapiens
TEPKLNSPM

SEQ ID NO: 1144297 - protein, 9 aa, Homo Sapiens
AEQDEGDGR

SEQ ID NO: 1144298 - protein, 9 aa, Homo Sapiens
AGRGRRLGD

SEQ ID NO: 1144299 - protein, 9 aa, Homo Sapiens
QLISPLASP

SEQ ID NO: 1144300 - protein, 9 aa, Homo Sapiens
ELMTTRNNT

SEQ ID NO: 1144301 - protein, 9 aa, Homo Sapiens
RQNLIDNAF

SEQ ID NO: 1144302 - protein, 9 aa, Homo Sapiens
AGAGNAKKK

SEQ ID NO: 1144303 - protein, 9 aa, Homo Sapiens
RQRKKKRHQ

SEQ ID NO: 1144304 - protein, 9 aa, Homo Sapiens
TDRTDGSVQ

SEQ ID NO: 1144305 - protein, 9 aa, Homo Sapiens
RRLGDPRDP

SEQ ID NO: 1144306 - protein, 9 aa, Homo Sapiens
RRSSLVAEI

SEQ ID NO: 1144307 - protein, 9 aa, Homo Sapiens
RTLQIFNIE

SEQ ID NO: 1144308 - protein, 9 aa, Homo Sapiens
PKCSWGTPQ

SEQ ID NO: 1144309 - protein, 9 aa, Homo Sapiens
TATEESENP

SEQ ID NO: 1144310 - protein, 9 aa, Homo Sapiens
KKEVIQTRK

SEQ ID NO: 1144311 - protein, 9 aa, Homo Sapiens
PPPIEIQLI

SEQ ID NO: 1144312 - protein, 9 aa, Homo Sapiens
RPWCYITDP

SEQ ID NO: 1144313 - protein, 9 aa, Homo Sapiens
GPAREARSD

SEQ ID NO: 1144314 - protein, 9 aa, Homo Sapiens
ICSENRLNV

SEQ ID NO: 1144315 - protein, 9 aa, Homo Sapiens
KPTDRTDGS

SEQ ID NO: 1144316 - protein, 9 aa, Homo Sapiens
KSKLMLAKE

SEQ ID NO: 1144317 - protein, 9 aa, Homo Sapiens
STSQATPSH

SEQ ID NO: 1144318 - protein, 9 aa, Homo Sapiens
IPVWGVSVD

SEQ ID NO: 1144319 - protein, 9 aa, Homo Sapiens
ITDPQIERE

SEQ ID NO: 1144320 - protein, 9 aa, Homo Sapiens
ERGIIRKMW

SEQ ID NO: 1144321 - protein, 9 aa, Homo Sapiens
IRQRKKKRH

SEQ ID NO: 1144322 - protein, 9 aa, Homo Sapiens
GAPISDPIH

SEQ ID NO: 1144323 - protein, 9 aa, Homo Sapiens
AELVFKCVI

SEQ ID NO: 1144324 - protein, 9 aa, Homo Sapiens
DNAFGDIFD

SEQ ID NO: 1144325 - protein, 9 aa, Homo Sapiens
PLQIPGSSS

SEQ ID NO: 1144326 - protein, 9 aa, Homo Sapiens
RLSCLALGS

SEQ ID NO: 1144327 - protein, 9 aa, Homo Sapiens
YSNNFTTIA

SEQ ID NO: 1144328 - protein, 9 aa, Homo Sapiens
GVPGPAREA

SEQ ID NO: 1144329 - protein, 9 aa, Homo Sapiens
PGRNGGWTW

SEQ ID NO: 1144330 - protein, 9 aa, Homo Sapiens
EESENPLGE

SEQ ID NO: 1144331 - protein, 9 aa, Homo Sapiens
SFINFELRI

SEQ ID NO: 1144332 - protein, 9 aa, Homo Sapiens
IIRKMWQKG

SEQ ID NO: 1144333 - protein, 9 aa, Homo Sapiens
LRAYVGLVG

SEQ ID NO: 1144334 - protein, 9 aa, Homo Sapiens
QRSLLQWRQ

SEQ ID NO: 1144335 - protein, 9 aa, Homo Sapiens
AGNAKKKQP

SEQ ID NO: 1144336 - protein, 9 aa, Homo Sapiens
RCLRAYVGL

SEQ ID NO: 1144337 - protein, 9 aa, Homo Sapiens
CACHILLHL

SEQ ID NO: 1144338 - protein, 9 aa, Homo Sapiens
AVPLPWQKC

SEQ ID NO: 1144339 - protein, 9 aa, Homo Sapiens
SSAKKPHAA

SEQ ID NO: 1144340 - protein, 9 aa, Homo Sapiens
KHSFINFEL

SEQ ID NO: 1144341 - protein, 9 aa, Homo Sapiens
CSTLRAAPT

SEQ ID NO: 1144342 - protein, 9 aa, Homo Sapiens
VDDVHKSTG

SEQ ID NO: 1144343 - protein, 9 aa, Homo Sapiens
QLMQNVILA

SEQ ID NO: 1144344 - protein, 9 aa, Homo Sapiens
NVILAPYMR

SEQ ID NO: 1144345 - protein, 9 aa, Homo Sapiens
MQCQFLGGT

SEQ ID NO: 1144346 - protein, 9 aa, Homo Sapiens
PAREARSDH

SEQ ID NO: 1144347 - protein, 9 aa, Homo Sapiens
DQLTLSQCK

SEQ ID NO: 1144348 - protein, 9 aa, Homo Sapiens
SVRLNRKAW

SEQ ID NO: 1144349 - protein, 9 aa, Homo Sapiens
LPDEEHGLG

SEQ ID NO: 1144350 - protein, 9 aa, Homo Sapiens
MQNVILAPY

SEQ ID NO: 1144351 - protein, 9 aa, Homo Sapiens
GAGNAKKKQ

SEQ ID NO: 1144352 - protein, 9 aa, Homo Sapiens
EQDEGDGRG

SEQ ID NO: 1144353 - protein, 9 aa, Homo Sapiens
VRRCDTCSP

SEQ ID NO: 1144354 - protein, 9 aa, Homo Sapiens
VHKSTGCDF

SEQ ID NO: 1144355 - protein, 9 aa, Homo Sapiens
ATPSHRNTI

SEQ ID NO: 1144356 - protein, 9 aa, Homo Sapiens
CLRAYVGLV

SEQ ID NO: 1144357 - protein, 9 aa, Homo Sapiens
RGGQDVLPR

SEQ ID NO: 1144358 - protein, 9 aa, Homo Sapiens
SAKKPHAAN

SEQ ID NO: 1144359 - protein, 9 aa, Homo Sapiens
WAMFDGHGG

SEQ ID NO: 1144360 - protein, 9 aa, Homo Sapiens
NLSLQTLFY

SEQ ID NO: 1144361 - protein, 9 aa, Homo Sapiens
EHGLGHGHV

SEQ ID NO: 1144362 - protein, 9 aa, Homo Sapiens
AAVDFTASN

SEQ ID NO: 1144363 - protein, 9 aa, Homo Sapiens
HHHSHHIND

SEQ ID NO: 1144364 - protein, 9 aa, Homo Sapiens
EVRALPNAP

SEQ ID NO: 1144365 - protein, 9 aa, Homo Sapiens
ARSDHRARL

SEQ ID NO: 1144366 - protein, 9 aa, Homo Sapiens
MLGHTARPD

SEQ ID NO: 1144367 - protein, 9 aa, Homo Sapiens
RENPWLDKK

SEQ ID NO: 1144368 - protein, 9 aa, Homo Sapiens
IATRKGFER

SEQ ID NO: 1144369 - protein, 9 aa, Homo Sapiens
VCPFIPVWG

SEQ ID NO: 1144370 - protein, 9 aa, Homo Sapiens
EEKTKKVVA

SEQ ID NO: 1144371 - protein, 9 aa, Homo Sapiens
AREARSDHR

SEQ ID NO: 1144372 - protein, 9 aa, Homo Sapiens
VRTLLLQEG

SEQ ID NO: 1144373 - protein, 9 aa, Homo Sapiens
ERGRQAQGA

SEQ ID NO: 1144374 - protein, 9 aa, Homo Sapiens
LRENPWLDK

SEQ ID NO: 1144375 - protein, 9 aa, Homo Sapiens
GHLLWGCVS

SEQ ID NO: 1144376 - protein, 9 aa, Homo Sapiens
TASAMQQKS

SEQ ID NO: 1144377 - protein, 9 aa, Homo Sapiens
CKCRPNVTV

SEQ ID NO: 1144378 - protein, 9 aa, Homo Sapiens
RHLHTPMYF

SEQ ID NO: 1144379 - protein, 9 aa, Homo Sapiens
VAEIDSLTS

SEQ ID NO: 1144380 - protein, 9 aa, Homo Sapiens
NAKKKQPEF

SEQ ID NO: 1144381 - protein, 9 aa, Homo Sapiens
LMRRILNRN

SEQ ID NO: 1144382 - protein, 9 aa, Homo Sapiens
NDGRVQHVF

SEQ ID NO: 1144383 - protein, 9 aa, Homo Sapiens
MLAKEEFKK

SEQ ID NO: 1144384 - protein, 9 aa, Homo Sapiens
YGECVGITE

SEQ ID NO: 1144385 - protein, 9 aa, Homo Sapiens
DSSMKPTDR

SEQ ID NO: 1144386 - protein, 9 aa, Homo Sapiens
TRGAPISDP

SEQ ID NO: 1144387 - protein, 9 aa, Homo Sapiens
AAAVDFTAS

SEQ ID NO: 1144388 - protein, 9 aa, Homo Sapiens
LPWQKCVRT

SEQ ID NO: 1144389 - protein, 9 aa, Homo Sapiens
WQKCVRTIL

SEQ ID NO: 1144390 - protein, 9 aa, Homo Sapiens
VVELKKNIE

SEQ ID NO: 1144391 - protein, 9 aa, Homo Sapiens
GRMEDWMTA

SEQ ID NO: 1144392 - protein, 9 aa, Homo Sapiens
LQIPGSSSF

SEQ ID NO: 1144393 - protein, 9 aa, Homo Sapiens
ALKAGRTLQ

SEQ ID NO: 1144394 - protein, 9 aa, Homo Sapiens
SLLQWRQLP

SEQ ID NO: 1144395 - protein, 9 aa, Homo Sapiens
TWFGERDFT

SEQ ID NO: 1144396 - protein, 9 aa, Homo Sapiens
QGSTSQATP

SEQ ID NO: 1144397 - protein, 9 aa, Homo Sapiens
PGHLLWGCV

SEQ ID NO: 1144398 - protein, 9 aa, Homo Sapiens
HGLGHGHVP

SEQ ID NO: 1144399 - protein, 9 aa, Homo Sapiens
KGFEREVSS

SEQ ID NO: 1144400 - protein, 9 aa, Homo Sapiens
QVPHILQLN

SEQ ID NO: 1144401 - protein, 9 aa, Homo Sapiens
PWCYITDPQ

SEQ ID NO: 1144402 - protein, 9 aa, Homo Sapiens
IFITSWTEP

SEQ ID NO: 1144403 - protein, 9 aa, Homo Sapiens
ALALPGGER

SEQ ID NO: 1144404 - protein, 9 aa, Homo Sapiens
TRKGFEREV

SEQ ID NO: 1144405 - protein, 9 aa, Homo Sapiens
KMGTPKEKH

SEQ ID NO: 1144406 - protein, 9 aa, Homo Sapiens
GIIRKMWQK

SEQ ID NO: 1144407 - protein, 9 aa, Homo Sapiens
TNWYYGECV

SEQ ID NO: 1144408 - protein, 9 aa, Homo Sapiens
DEGDGRGVP

SEQ ID NO: 1144409 - protein, 9 aa, Homo Sapiens
VIALKAGRT

SEQ ID NO: 1144410 - protein, 9 aa, Homo Sapiens
LKKGKEKAE

SEQ ID NO: 1144411 - protein, 9 aa, Homo Sapiens
LCWTASAMQ

SEQ ID NO: 1144412 - protein, 9 aa, Homo Sapiens
CHILLHLHC

SEQ ID NO: 1144413 - protein, 9 aa, Homo Sapiens
KNVRPGHLL

SEQ ID NO: 1144414 - protein, 9 aa, Homo Sapiens
RHGELQGHE

SEQ ID NO: 1144415 - protein, 9 aa, Homo Sapiens
QRMLAPKCS

SEQ ID NO: 1144416 - protein, 9 aa, Homo Sapiens
KAHDSSLRT

SEQ ID NO: 1144417 - protein, 9 aa, Homo Sapiens
YLFFCFLMA

SEQ ID NO: 1144418 - protein, 9 aa, Homo Sapiens
HEALALPGG

SEQ ID NO: 1144419 - protein, 9 aa, Homo Sapiens
EAKWLEVKS

SEQ ID NO: 1144420 - protein, 9 aa, Homo Sapiens
AMQQKSLSP

SEQ ID NO: 1144421 - protein, 9 aa, Homo Sapiens
TLSQCKGLN

SEQ ID NO: 1144422 - protein, 9 aa, Homo Sapiens
LHCADSRAA

SEQ ID NO: 1144423 - protein, 9 aa, Homo Sapiens
AHDSSLRTE

SEQ ID NO: 1144424 - protein, 9 aa, Homo Sapiens
LNRNEKNRP

SEQ ID NO: 1144425 - protein, 9 aa, Homo Sapiens
DVNVVELKK

SEQ ID NO: 1144426 - protein, 9 aa, Homo Sapiens
TPSHRNTIG

SEQ ID NO: 1144427 - protein, 9 aa, Homo Sapiens
AKNVRPGHL

SEQ ID NO: 1144428 - protein, 9 aa, Homo Sapiens
GGGRLGGCL

SEQ ID NO: 1144429 - protein, 9 aa, Homo Sapiens
LHLHCADSR

SEQ ID NO: 1144430 - protein, 9 aa, Homo Sapiens
ASAMQQKSL

SEQ ID NO: 1144431 - protein, 9 aa, Homo Sapiens
KWLEVKSKR

SEQ ID NO: 1144432 - protein, 9 aa, Homo Sapiens
HPLRLLCWT

SEQ ID NO: 1144433 - protein, 9 aa, Homo Sapiens
AWIRQRKKK

SEQ ID NO: 1144434 - protein, 9 aa, Homo Sapiens
RKAWIRQRK

SEQ ID NO: 1144435 - protein, 9 aa, Homo Sapiens
DVLPRGDLV

SEQ ID NO: 1144436 - protein, 9 aa, Homo Sapiens
LAPYMRSMM

SEQ ID NO: 1144437 - protein, 9 aa, Homo Sapiens
RAEGRMEDW

SEQ ID NO: 1144438 - protein, 9 aa, Homo Sapiens
KAGRTLQIF

SEQ ID NO: 1144439 - protein, 9 aa, Homo Sapiens
QWLRENPWL

SEQ ID NO: 1144440 - protein, 9 aa, Homo Sapiens
GPNGPPGRN

SEQ ID NO: 1144441 - protein, 9 aa, Homo Sapiens
LEYLSTWFG

SEQ ID NO: 1144442 - protein, 9 aa, Homo Sapiens
QGARMLPRG

SEQ ID NO: 1144443 - protein, 9 aa, Homo Sapiens
SNDITPLHV

SEQ ID NO: 1144444 - protein, 9 aa, Homo Sapiens
DSRAAKNVR

SEQ ID NO: 1144445 - protein, 9 aa, Homo Sapiens
KGHVGKCRW

SEQ ID NO: 1144446 - protein, 9 aa, Homo Sapiens
LSRLDHTEV

SEQ ID NO: 1144447 - protein, 9 aa, Homo Sapiens
KKRHQRSLL

SEQ ID NO: 1144448 - protein, 9 aa, Homo Sapiens
GRRLGDPRD

SEQ ID NO: 1144449 - protein, 9 aa, Homo Sapiens
DAVCNKCRE

SEQ ID NO: 1144450 - protein, 9 aa, Homo Sapiens
WLDKKMIGE

SEQ ID NO: 1144451 - protein, 9 aa, Homo Sapiens
LFYLFFCFL

SEQ ID NO: 1144452 - protein, 9 aa, Homo Sapiens
PAHVAFEVL

SEQ ID NO: 1144453 - protein, 9 aa, Homo Sapiens
HGAVGHEAL

SEQ ID NO: 1144454 - protein, 9 aa, Homo Sapiens
MLPRGGQDV

SEQ ID NO: 1144455 - protein, 9 aa, Homo Sapiens
FHERGIIRK

SEQ ID NO: 1144456 - protein, 9 aa, Homo Sapiens
RGVPGPARE

SEQ ID NO: 1144457 - protein, 9 aa, Homo Sapiens
SSYTSGECG

SEQ ID NO: 1144458 - protein, 9 aa, Homo Sapiens
NWYYGECVG

SEQ ID NO: 1144459 - protein, 9 aa, Homo Sapiens
IGFMMEMAS

SEQ ID NO: 1144460 - protein, 9 aa, Homo Sapiens
LQTLFYLFF

SEQ ID NO: 1144461 - protein, 9 aa, Homo Sapiens
VEEVRALPN

SEQ ID NO: 1144462 - protein, 9 aa, Homo Sapiens
KVVATTKPK

SEQ ID NO: 1144463 - protein, 9 aa, Homo Sapiens
INFELRIGI

SEQ ID NO: 1144464 - protein, 9 aa, Homo Sapiens
EGLTVDDVH

SEQ ID NO: 1144465 - protein, 9 aa, Homo Sapiens
ILNRNEKNR

SEQ ID NO: 1144466 - protein, 9 aa, Homo Sapiens
MRLSCLALG

SEQ ID NO: 1144467 - protein, 9 aa, Homo Sapiens
FWRNGKQRE

SEQ ID NO: 1144468 - protein, 9 aa, Homo Sapiens
VIQTRKRKP

SEQ ID NO: 1144469 - protein, 9 aa, Homo Sapiens
GHEALALPG

SEQ ID NO: 1144470 - protein, 9 aa, Homo Sapiens
INKHSFINF

SEQ ID NO: 1144471 - protein, 9 aa, Homo Sapiens
RPILLTLPM

SEQ ID NO: 1144472 - protein, 9 aa, Homo Sapiens
ENRLNVDFL

SEQ ID NO: 1144473 - protein, 9 aa, Homo Sapiens
WTEPKLNSP

SEQ ID NO: 1144474 - protein, 9 aa, Homo Sapiens
LGHTARPDS

SEQ ID NO: 1144475 - protein, 9 aa, Homo Sapiens
SPPPIEIQL

SEQ ID NO: 1144476 - protein, 9 aa, Homo Sapiens
DLVGCVVSG

SEQ ID NO: 1144477 - protein, 9 aa, Homo Sapiens
QKGSVRLNR

SEQ ID NO: 1144478 - protein, 9 aa, Homo Sapiens
DGRVQHVFP

SEQ ID NO: 1144479 - protein, 9 aa, Homo Sapiens
PRGGQDVLP

SEQ ID NO: 1144480 - protein, 9 aa, Homo Sapiens
EQVPHILQL

SEQ ID NO: 1144481 - protein, 9 aa, Homo Sapiens
ILAPYMRSM

SEQ ID NO: 1144482 - protein, 9 aa, Homo Sapiens
HFINVMVSH

SEQ ID NO: 1144483 - protein, 9 aa, Homo Sapiens
GPSHSKGQR

SEQ ID NO: 1144484 - protein, 9 aa, Homo Sapiens
CVIGFMMEM

SEQ ID NO: 1144485 - protein, 9 aa, Homo Sapiens
KEKHEAISK

SEQ ID NO: 1144486 - protein, 9 aa, Homo Sapiens
STLRAAPTA

SEQ ID NO: 1144487 - protein, 9 aa, Homo Sapiens
GDWDSSYTS

SEQ ID NO: 1144488 - protein, 9 aa, Homo Sapiens
HILLHLHCA

SEQ ID NO: 1144489 - protein, 9 aa, Homo Sapiens
WYYGECVGI

SEQ ID NO: 1144490 - protein, 9 aa, Homo Sapiens
YITDPQIER

SEQ ID NO: 1144491 - protein, 9 aa, Homo Sapiens
CACSTLRAA

SEQ ID NO: 1144492 - protein, 9 aa, Homo Sapiens
IEMLGHTAR

SEQ ID NO: 1144493 - protein, 9 aa, Homo Sapiens
SLFIPNGDT

SEQ ID NO: 1144494 - protein, 9 aa, Homo Sapiens
IQLISPLAS

SEQ ID NO: 1144495 - protein, 9 aa, Homo Sapiens
KAWIRQRKK

SEQ ID NO: 1144496 - protein, 9 aa, Homo Sapiens
GHYWAMFDG

SEQ ID NO: 1144497 - protein, 9 aa, Homo Sapiens
VVRTLLLQE

SEQ ID NO: 1144498 - protein, 9 aa, Homo Sapiens
KLKKGKEKA

SEQ ID NO: 1144499 - protein, 9 aa, Homo Sapiens
GFEREVSSF

SEQ ID NO: 1144500 - protein, 9 aa, Homo Sapiens
ARMLPRGGQ

SEQ ID NO: 1144501 - protein, 9 aa, Homo Sapiens
LALPGGERG

SEQ ID NO: 1144502 - protein, 9 aa, Homo Sapiens
CQPPLATDL

SEQ ID NO: 1144503 - protein, 9 aa, Homo Sapiens
SRAAKNVRP

SEQ ID NO: 1144504 - protein, 9 aa, Homo Sapiens
IDNAFGDIF

SEQ ID NO: 1144505 - protein, 9 aa, Homo Sapiens
SLVAEIDSL

SEQ ID NO: 1144506 - protein, 9 aa, Homo Sapiens
SVEFHERGI

SEQ ID NO: 1144507 - protein, 9 aa, Homo Sapiens
LPGGERGRQ

SEQ ID NO: 1144508 - protein, 9 aa, Homo Sapiens
PPGRNGGWT

SEQ ID NO: 1144509 - protein, 9 aa, Homo Sapiens
DSSYTSGEC

SEQ ID NO: 1144510 - protein, 9 aa, Homo Sapiens
SGDWDSSYT

SEQ ID NO: 1144511 - protein, 9 aa, Homo Sapiens
FTASNDITP

SEQ ID NO: 1144512 - protein, 9 aa, Homo Sapiens
QDSSMKPTD

SEQ ID NO: 1144513 - protein, 9 aa, Homo Sapiens
KEVVRTLLL

SEQ ID NO: 1144514 - protein, 9 aa, Homo Sapiens
RGDVNVVEL

SEQ ID NO: 1144515 - protein, 9 aa, Homo Sapiens
PECPLMSYS

SEQ ID NO: 1144516 - protein, 9 aa, Homo Sapiens
GAVGHEALA

SEQ ID NO: 1144517 - protein, 9 aa, Homo Sapiens
RKKKRHQRS

SEQ ID NO: 1144518 - protein, 9 aa, Homo Sapiens
QAQGARMLP

SEQ ID NO: 1144519 - protein, 9 aa, Homo Sapiens
SHHINDGRV

SEQ ID NO: 1144520 - protein, 9 aa, Homo Sapiens
VKGHVGKCR

SEQ ID NO: 1144521 - protein, 9 aa, Homo Sapiens
HEAISKKIP

SEQ ID NO: 1144522 - protein, 9 aa, Homo Sapiens
VLEYLSTWF

SEQ ID NO: 1144523 - protein, 9 aa, Homo Sapiens
AKKKQPEFS

SEQ ID NO: 1144524 - protein, 9 aa, Homo Sapiens
VYLPMSKGQ

SEQ ID NO: 1144525 - protein, 9 aa, Homo Sapiens
SHDHHHSHH

SEQ ID NO: 1144526 - protein, 9 aa, Homo Sapiens
KSLSPAHVA

SEQ ID NO: 1144527 - protein, 9 aa, Homo Sapiens
INDGRVQHV

SEQ ID NO: 1144528 - protein, 9 aa, Homo Sapiens
HDHHHSHHI

SEQ ID NO: 1144529 - protein, 9 aa, Homo Sapiens
CPLMSYSNN

SEQ ID NO: 1144530 - protein, 9 aa, Homo Sapiens
AFEVLGHHC

SEQ ID NO: 1144531 - protein, 9 aa, Homo Sapiens
VFYFQFLWI

SEQ ID NO: 1144532 - protein, 9 aa, Homo Sapiens
NRLNVDFLM

SEQ ID NO: 1144533 - protein, 9 aa, Homo Sapiens
FINFELRIG

SEQ ID NO: 1144534 - protein, 9 aa, Homo Sapiens
MKRHGELQG

SEQ ID NO: 1144535 - protein, 9 aa, Homo Sapiens
FIPNGDTSP

SEQ ID NO: 1144536 - protein, 9 aa, Homo Sapiens
EMLGHTARP

SEQ ID NO: 1144537 - protein, 9 aa, Homo Sapiens
RPLAMKKEV

SEQ ID NO: 1144538 - protein, 9 aa, Homo Sapiens
MDRHLHTPM

SEQ ID NO: 1144539 - protein, 9 aa, Homo Sapiens
ATEESENPL

SEQ ID NO: 1144540 - protein, 9 aa, Homo Sapiens
SCLALGSEA

SEQ ID NO: 1144541 - protein, 9 aa, Homo Sapiens
YVGLVGTAV

SEQ ID NO: 1144542 - protein, 9 aa, Homo Sapiens
GSSSFSYTL

SEQ ID NO: 1144543 - protein, 9 aa, Homo Sapiens
AGRGGLPTV

SEQ ID NO: 1144544 - protein, 9 aa, Homo Sapiens
NGPPGRNGG

SEQ ID NO: 1144545 - protein, 9 aa, Homo Sapiens
NVTVRRCDT

SEQ ID NO: 1144546 - protein, 9 aa, Homo Sapiens
SKGPSHSKG

SEQ ID NO: 1144547 - protein, 9 aa, Homo Sapiens
FLVPVKGHV

SEQ ID NO: 1144548 - protein, 9 aa, Homo Sapiens
ELVFKCVIG

SEQ ID NO: 1144549 - protein, 9 aa, Homo Sapiens
WDSSYTSGE

SEQ ID NO: 1144550 - protein, 9 aa, Homo Sapiens
RSDHRARLF

SEQ ID NO: 1144551 - protein, 9 aa, Homo Sapiens
SSKGPSHSK

SEQ ID NO: 1144552 - protein, 9 aa, Homo Sapiens
DEEHGLGHG

SEQ ID NO: 1144553 - protein, 9 aa, Homo Sapiens
PLAMKKEVI

SEQ ID NO: 1144554 - protein, 9 aa, Homo Sapiens
VPVTCDAVC

SEQ ID NO: 1144555 - protein, 9 aa, Homo Sapiens
DVHKSTGCD

SEQ ID NO: 1144556 - protein, 9 aa, Homo Sapiens
KKQPEFSPT

SEQ ID NO: 1144557 - protein, 9 aa, Homo Sapiens
HYWAMFDGH

SEQ ID NO: 1144558 - protein, 9 aa, Homo Sapiens
FYFQFLWIL

SEQ ID NO: 1144559 - protein, 9 aa, Homo Sapiens
PLRLLCWTA

SEQ ID NO: 1144560 - protein, 9 aa, Homo Sapiens
GRLGGCLER

SEQ ID NO: 1144561 - protein, 9 aa, Homo Sapiens
KVIALKAGR

SEQ ID NO: 1144562 - protein, 9 aa, Homo Sapiens
SVLEYLSTW

SEQ ID NO: 1144563 - protein, 9 aa, Homo Sapiens
RQVRGHHGA

SEQ ID NO: 1144564 - protein, 9 aa, Homo Sapiens
TPKEKHEAI

SEQ ID NO: 1144565 - protein, 9 aa, Homo Sapiens
IIRMDRHLH

SEQ ID NO: 1144566 - protein, 9 aa, Homo Sapiens
SYTSGECGI

SEQ ID NO: 1144567 - protein, 9 aa, Homo Sapiens
CYITDPQIE

SEQ ID NO: 1144568 - protein, 9 aa, Homo Sapiens
CDAVCNKCR

SEQ ID NO: 1144569 - protein, 9 aa, Homo Sapiens
NRKAWIRQR

SEQ ID NO: 1144570 - protein, 9 aa, Homo Sapiens
VLPRGDLVH

SEQ ID NO: 1144571 - protein, 9 aa, Homo Sapiens
FSLFIPNGD

SEQ ID NO: 1144572 - protein, 9 aa, Homo Sapiens
PPIEIQLIS

SEQ ID NO: 1144573 - protein, 9 aa, Homo Sapiens
CVVSGWLGD

SEQ ID NO: 1144574 - protein, 9 aa, Homo Sapiens
KGPSHSKGQ

SEQ ID NO: 1144575 - protein, 9 aa, Homo Sapiens
QFLWILRSK

SEQ ID NO: 1144576 - protein, 9 aa, Homo Sapiens
AQRMLAPKC

SEQ ID NO: 1144577 - protein, 9 aa, Homo Sapiens
LPECPLMSY

SEQ ID NO: 1144578 - protein, 9 aa, Homo Sapiens
EEEKTKKVV

SEQ ID NO: 1144579 - protein, 9 aa, Homo Sapiens
QASASSAKK

SEQ ID NO: 1144580 - protein, 9 aa, Homo Sapiens
YFQFLWILR

SEQ ID NO: 1144581 - protein, 9 aa, Homo Sapiens
LVRKIRSGS

SEQ ID NO: 1144582 - protein, 9 aa, Homo Sapiens
VPVKGHVGK

SEQ ID NO: 1144583 - protein, 9 aa, Homo Sapiens
GQDVLPRGD

SEQ ID NO: 1144584 - protein, 9 aa, Homo Sapiens
HLLWGCVSL

SEQ ID NO: 1144585 - protein, 9 aa, Homo Sapiens
QTRGAPISD

SEQ ID NO: 1144586 - protein, 9 aa, Homo Sapiens
AKRLIGRQV

SEQ ID NO: 1144587 - protein, 9 aa, Homo Sapiens
IGRQVRGHH

SEQ ID NO: 1144588 - protein, 9 aa, Homo Sapiens
HDSSLRTEN

SEQ ID NO: 1144589 - protein, 9 aa, Homo Sapiens
WSPPPIEIQ

SEQ ID NO: 1144590 - protein, 9 aa, Homo Sapiens
FINVMVSHP

SEQ ID NO: 1144591 - protein, 9 aa, Homo Sapiens
RGIIRKMWQ

SEQ ID NO: 1144592 - protein, 9 aa, Homo Sapiens
RNGGWTWTS

SEQ ID NO: 1144593 - protein, 9 aa, Homo Sapiens
LNRKAWIRQ

SEQ ID NO: 1144594 - protein, 9 aa, Homo Sapiens
IRKMWQKGS

SEQ ID NO: 1144595 - protein, 9 aa, Homo Sapiens
GSERPWCYI

SEQ ID NO: 1144596 - protein, 9 aa, Homo Sapiens
HERGIIRKM

SEQ ID NO: 1144597 - protein, 9 aa, Homo Sapiens
SPLQIPGSS

SEQ ID NO: 1144598 - protein, 9 aa, Homo Sapiens
KGSVRLNRK

SEQ ID NO: 1144599 - protein, 9 aa, Homo Sapiens
GLLLPDEEH

SEQ ID NO: 1144600 - protein, 9 aa, Homo Sapiens
NHFVGLEDH

SEQ ID NO: 1144601 - protein, 9 aa, Homo Sapiens
SERPWCYIT

SEQ ID NO: 1144602 - protein, 9 aa, Homo Sapiens
VEFHERGII

SEQ ID NO: 1144603 - protein, 9 aa, Homo Sapiens
VWGVSVDEC

SEQ ID NO: 1144604 - protein, 9 aa, Homo Sapiens
EKHEAISKK

SEQ ID NO: 1144605 - protein, 9 aa, Homo Sapiens
EDHKYEYLM

SEQ ID NO: 1144606 - protein, 9 aa, Homo Sapiens
LLPDEEHGL

SEQ ID NO: 1144607 - protein, 9 aa, Homo Sapiens
MSYSNNFTT

SEQ ID NO: 1144608 - protein, 9 aa, Homo Sapiens
ACACSTLRA

SEQ ID NO: 1144609 - protein, 9 aa, Homo Sapiens
QPPLATDLS

SEQ ID NO: 1144610 - protein, 9 aa, Homo Sapiens
PGSSSFSYT

SEQ ID NO: 1144611 - protein, 9 aa, Homo Sapiens
ACHILLHLH

SEQ ID NO: 1144612 - protein, 9 aa, Homo Sapiens
IRPILLTLP

SEQ ID NO: 1144613 - protein, 9 aa, Homo Sapiens
SWTEPKLNS

SEQ ID NO: 1144614 - protein, 9 aa, Homo Sapiens
EICSENRLN

SEQ ID NO: 1144615 - protein, 9 aa, Homo Sapiens
HILQLNAIF

SEQ ID NO: 1144616 - protein, 9 aa, Homo Sapiens
FYLFFCFLM

SEQ ID NO: 1144617 - protein, 9 aa, Homo Sapiens
QASPFPELM

SEQ ID NO: 1144618 - protein, 9 aa, Homo Sapiens
PWLDKKMIG

SEQ ID NO: 1144619 - protein, 9 aa, Homo Sapiens
VNVVELKKN

SEQ ID NO: 1144620 - protein, 9 aa, Homo Sapiens
HFMQCQFLG

SEQ ID NO: 1144621 - protein, 9 aa, Homo Sapiens
VDFTASNDI

SEQ ID NO: 1144622 - protein, 9 aa, Homo Sapiens
VAFEVLGHH

SEQ ID NO: 1144623 - protein, 9 aa, Homo Sapiens
SEQVPHILQ

SEQ ID NO: 1144624 - protein, 9 aa, Homo Sapiens
LKAGRTLQI

SEQ ID NO: 1144625 - protein, 9 aa, Homo Sapiens
KRLPLLVFF

SEQ ID NO: 1144626 - protein, 9 aa, Homo Sapiens
HQRSLLQWR

SEQ ID NO: 1144627 - protein, 9 aa, Homo Sapiens
RLLCWTASA

SEQ ID NO: 1144628 - protein, 9 aa, Homo Sapiens
YYVTCACHI

SEQ ID NO: 1144629 - protein, 9 aa, Homo Sapiens
KLVRKIRSG

SEQ ID NO: 1144630 - protein, 9 aa, Homo Sapiens
DDVHKSTGC

SEQ ID NO: 1144631 - protein, 9 aa, Homo Sapiens
LSHDHHHSH

SEQ ID NO: 1144632 - protein, 9 aa, Homo Sapiens
VRCHFMQCQ

SEQ ID NO: 1144633 - protein, 9 aa, Homo Sapiens
SDHRARLFQ

SEQ ID NO: 1144634 - protein, 9 aa, Homo Sapiens
QCQFLGGTM

SEQ ID NO: 1144635 - protein, 9 aa, Homo Sapiens
YYGECVGIT

SEQ ID NO: 1144636 - protein, 9 aa, Homo Sapiens
ASASSAKKP

SEQ ID NO: 1144637 - protein, 9 aa, Homo Sapiens
MCIVIRPIL

SEQ ID NO: 1144638 - protein, 9 aa, Homo Sapiens
SSLRTENPK

SEQ ID NO: 1144639 - protein, 9 aa, Homo Sapiens
EKTKKVVAT

SEQ ID NO: 1144640 - protein, 9 aa, Homo Sapiens
LSCLALGSE

SEQ ID NO: 1144641 - protein, 9 aa, Homo Sapiens
PISDPIHLS

SEQ ID NO: 1144642 - protein, 9 aa, Homo Sapiens
FEVLGHHCQ

SEQ ID NO: 1144643 - protein, 9 aa, Homo Sapiens
YLPMSKGQE

SEQ ID NO: 1144644 - protein, 9 aa, Homo Sapiens
SPAHVAFEV

SEQ ID NO: 1144645 - protein, 9 aa, Homo Sapiens
DAKRLIGRQ

SEQ ID NO: 1144646 - protein, 9 aa, Homo Sapiens
GACACSTLR

SEQ ID NO: 1144647 - protein, 9 aa, Homo Sapiens
DLVHGAEQD

SEQ ID NO: 1144648 - protein, 9 aa, Homo Sapiens
KCSWGTPQL

SEQ ID NO: 1144649 - protein, 9 aa, Homo Sapiens
VPLPWQKCV

SEQ ID NO: 1144650 - protein, 9 aa, Homo Sapiens
LAGLHPLRL

SEQ ID NO: 1144651 - protein, 9 aa, Homo Sapiens
AYVGLVGTA

SEQ ID NO: 1144652 - protein, 9 aa, Homo Sapiens
NLVFYFQFL

SEQ ID NO: 1144653 - protein, 9 aa, Homo Sapiens
WDQLTLSQC

SEQ ID NO: 1144654 - protein, 9 aa, Homo Sapiens
RGAPISDPI

SEQ ID NO: 1144655 - protein, 9 aa, Homo Sapiens
SYSNNFTTI

SEQ ID NO: 1144656 - protein, 9 aa, Homo Sapiens
KKVVATTKP

SEQ ID NO: 1144657 - protein, 9 aa, Homo Sapiens
YTSGECGIS

SEQ ID NO: 1144658 - protein, 9 aa, Homo Sapiens
AHKEVVRTL

SEQ ID NO: 1144659 - protein, 9 aa, Homo Sapiens
SENPLGEDD

SEQ ID NO: 1144660 - protein, 9 aa, Homo Sapiens
LLLPDEEHG

SEQ ID NO: 1144661 - protein, 9 aa, Homo Sapiens
KHEAISKKI

SEQ ID NO: 1144662 - protein, 9 aa, Homo Sapiens
PKTLVLLSR

SEQ ID NO: 1144663 - protein, 9 aa, Homo Sapiens
GHHGAVGHE

SEQ ID NO: 1144664 - protein, 9 aa, Homo Sapiens
CADSRAAKN

SEQ ID NO: 1144665 - protein, 9 aa, Homo Sapiens
SEEEKTKKV

SEQ ID NO: 1144666 - protein, 9 aa, Homo Sapiens
EKKDSAEQV

SEQ ID NO: 1144667 - protein, 9 aa, Homo Sapiens
YVTCACHIL

SEQ ID NO: 1144668 - protein, 9 aa, Homo Sapiens
RLNRKAWIR

SEQ ID NO: 1144669 - protein, 9 aa, Homo Sapiens
PWQKCVRTI

SEQ ID NO: 1144670 - protein, 9 aa, Homo Sapiens
VTVRRCDTC

SEQ ID NO: 1144671 - protein, 9 aa, Homo Sapiens
AMFDGHGGP

SEQ ID NO: 1144672 - protein, 9 aa, Homo Sapiens
PMSKGQEYL

SEQ ID NO: 1144673 - protein, 9 aa, Homo Sapiens
GHHCQPPLA

SEQ ID NO: 1144674 - protein, 9 aa, Homo Sapiens
ALPGGERGR

SEQ ID NO: 1144675 - protein, 9 aa, Homo Sapiens
ATRKGFERE

SEQ ID NO: 1144676 - protein, 9 aa, Homo Sapiens
CRPNVTVRR

SEQ ID NO: 1144677 - protein, 9 aa, Homo Sapiens
REARSDHRA

SEQ ID NO: 1144678 - protein, 9 aa, Homo Sapiens
GRQAQGARM

SEQ ID NO: 1144679 - protein, 9 aa, Homo Sapiens
MSKGQEYLR

SEQ ID NO: 1144680 - protein, 9 aa, Homo Sapiens
NGKQREDIK

SEQ ID NO: 1144681 - protein, 9 aa, Homo Sapiens
VALDFWRNG

SEQ ID NO: 1144682 - protein, 9 aa, Homo Sapiens
SQCKGLNYR

SEQ ID NO: 1144683 - protein, 9 aa, Homo Sapiens
YVRCHFMQC

SEQ ID NO: 1144684 - protein, 9 aa, Homo Sapiens
STWFGERDF

SEQ ID NO: 1144685 - protein, 9 aa, Homo Sapiens
HCQPPLATD

SEQ ID NO: 1144686 - protein, 9 aa, Homo Sapiens
SSSKGPSHS

SEQ ID NO: 1144687 - protein, 9 aa, Homo Sapiens
RKMWQKGSV

SEQ ID NO: 1144688 - protein, 9 aa, Homo Sapiens
GLTVDDVHK

SEQ ID NO: 1144689 - protein, 9 aa, Homo Sapiens
EDVMRLSCL

SEQ ID NO: 1144690 - protein, 9 aa, Homo Sapiens
KKLKKGKEK

SEQ ID NO: 1144691 - protein, 9 aa, Homo Sapiens
ASSAKKPHA

SEQ ID NO: 1144692 - protein, 9 aa, Homo Sapiens
KCVIGFMME

SEQ ID NO: 1144693 - protein, 9 aa, Homo Sapiens
LAPKCSWGT

SEQ ID NO: 1144694 - protein, 9 aa, Homo Sapiens
VRPGHLLWG

SEQ ID NO: 1144695 - protein, 9 aa, Homo Sapiens
VGHEALALP

SEQ ID NO: 1144696 - protein, 9 aa, Homo Sapiens
AKKPHAANG

SEQ ID NO: 1144697 - protein, 9 aa, Homo Sapiens
MQQKSLSPA

SEQ ID NO: 1144698 - protein, 9 aa, Homo Sapiens
EVLGHHCQP

SEQ ID NO: 1144699 - protein, 9 aa, Homo Sapiens
EKKSKLMLA

SEQ ID NO: 1144700 - protein, 9 aa, Homo Sapiens
INLVFYFQF

SEQ ID NO: 1144701 - protein, 9 aa, Homo Sapiens
SENRLNVDF

SEQ ID NO: 1144702 - protein, 9 aa, Homo Sapiens
KKPHAANGP

SEQ ID NO: 1144703 - protein, 9 aa, Homo Sapiens
RKIRSGSFG

SEQ ID NO: 1144704 - protein, 9 aa, Homo Sapiens
IQDSSMKPT

SEQ ID NO: 1144705 - protein, 9 aa, Homo Sapiens
RMDRHLHTP

SEQ ID NO: 1144706 - protein, 9 aa, Homo Sapiens
DRHLHTPMY

SEQ ID NO: 1144707 - protein, 9 aa, Homo Sapiens
FLWILRSKL

SEQ ID NO: 1144708 - protein, 9 aa, Homo Sapiens
GTPKEKHEA

SEQ ID NO: 1144709 - protein, 9 aa, Homo Sapiens
LTLSQCKGL

SEQ ID NO: 1144710 - protein, 9 aa, Homo Sapiens
TVDDVHKST

SEQ ID NO: 1144711 - protein, 9 aa, Homo Sapiens
HKSTGCDFA

SEQ ID NO: 1144712 - protein, 9 aa, Homo Sapiens
SMCIVIRPI

SEQ ID NO: 1144713 - protein, 9 aa, Homo Sapiens
GARCLRAYV

SEQ ID NO: 1144714 - protein, 9 aa, Homo Sapiens
RAAKNVRPG

SEQ ID NO: 1144715 - protein, 9 aa, Homo Sapiens
LVFKCVIGF

SEQ ID NO: 1144716 - protein, 9 aa, Homo Sapiens
AAHKEVVRT

SEQ ID NO: 1144717 - protein, 9 aa, Homo Sapiens
PGGERGRQA

SEQ ID NO: 1144718 - protein, 9 aa, Homo Sapiens
RGRQAQGAR

SEQ ID NO: 1144719 - protein, 9 aa, Homo Sapiens
GQEYLRSSG

SEQ ID NO: 1144720 - protein, 9 aa, Homo Sapiens
KTKKVVATT

SEQ ID NO: 1144721 - protein, 9 aa, Homo Sapiens
GDGRGVPGP

SEQ ID NO: 1144722 - protein, 9 aa, Homo Sapiens
NVVELKKNI

SEQ ID NO: 1144723 - protein, 9 aa, Homo Sapiens
GGAGRGGLP

SEQ ID NO: 1144724 - protein, 9 aa, Homo Sapiens
KEVIQTRKR

SEQ ID NO: 1144725 - protein, 9 aa, Homo Sapiens
RTLLLQEGR

SEQ ID NO: 1144726 - protein, 9 aa, Homo Sapiens
DWDSSYTSG

SEQ ID NO: 1144727 - protein, 9 aa, Homo Sapiens
CDLCTNWYY

SEQ ID NO: 1144728 - protein, 9 aa, Homo Sapiens
FMQCQFLGG

SEQ ID NO: 1144729 - protein, 9 aa, Homo Sapiens
TIIRMDRHL

SEQ ID NO: 1144730 - protein, 9 aa, Homo Sapiens
MEDWMTAVL

SEQ ID NO: 1144731 - protein, 9 aa, Homo Sapiens
GERGRQAQG

SEQ ID NO: 1144732 - protein, 9 aa, Homo Sapiens
VSHPNHTGN

SEQ ID NO: 1144733 - protein, 9 aa, Homo Sapiens
GGCLERGGG

SEQ ID NO: 1144734 - protein, 9 aa, Homo Sapiens
NKHSFINFE

SEQ ID NO: 1144735 - protein, 9 aa, Homo Sapiens
TSGECGIST

SEQ ID NO: 1144736 - protein, 9 aa, Homo Sapiens
RSLLQWRQL

SEQ ID NO: 1144737 - protein, 9 aa, Homo Sapiens
ARCLRAYVG

SEQ ID NO: 1144738 - protein, 9 aa, Homo Sapiens
EYLSTWFGE

SEQ ID NO: 1144739 - protein, 9 aa, Homo Sapiens
VHGAEQDEG

SEQ ID NO: 1144740 - protein, 9 aa, Homo Sapiens
GRGRRLGDP

SEQ ID NO: 1144741 - protein, 9 aa, Homo Sapiens
EVVRTLLLQ

SEQ ID NO: 1144742 - protein, 9 aa, Homo Sapiens
HHGAVGHEA

SEQ ID NO: 1144743 - protein, 9 aa, Homo Sapiens
GRQVRGHHG

SEQ ID NO: 1144744 - protein, 9 aa, Homo Sapiens
KYKLVRKIR

SEQ ID NO: 1144745 - protein, 9 aa, Homo Sapiens
PVFSLFIPN

SEQ ID NO: 1144746 - protein, 9 aa, Homo Sapiens
LIGRQVRGH

SEQ ID NO: 1144747 - protein, 9 aa, Homo Sapiens
WGCVSLAGL

SEQ ID NO: 1144748 - protein, 9 aa, Homo Sapiens
CSWGTPQLR

SEQ ID NO: 1144749 - protein, 9 aa, Homo Sapiens
AVCNKCREM

SEQ ID NO: 1144750 - protein, 9 aa, Homo Sapiens
TCDAVCNKC

SEQ ID NO: 1144751 - protein, 9 aa, Homo Sapiens
VRLNRKAWI

SEQ ID NO: 1144752 - protein, 9 aa, Homo Sapiens
HKEVVRTLL

SEQ ID NO: 1144753 - protein, 9 aa, Homo Sapiens
MKPTDRTDG

SEQ ID NO: 1144754 - protein, 9 aa, Homo Sapiens
LVFYFQFLW

SEQ ID NO: 1144755 - protein, 9 aa, Homo Sapiens
FAPKTLVLL

SEQ ID NO: 1144756 - protein, 9 aa, Homo Sapiens
RVYLPMSKG

SEQ ID NO: 1144757 - protein, 9 aa, Homo Sapiens
LTGHYWAMF

SEQ ID NO: 1144758 - protein, 9 aa, Homo Sapiens
FGDIFDQFY

SEQ ID NO: 1144759 - protein, 9 aa, Homo Sapiens
RGGGRLGGC

SEQ ID NO: 1144760 - protein, 9 aa, Homo Sapiens
IVTIIRMDR

SEQ ID NO: 1144761 - protein, 9 aa, Homo Sapiens
LEVKSKRRD

SEQ ID NO: 1144762 - protein, 9 aa, Homo Sapiens
EVIQTRKRK

SEQ ID NO: 1144763 - protein, 9 aa, Homo Sapiens
STDSVVPFD

SEQ ID NO: 1144764 - protein, 9 aa, Homo Sapiens
KHAEEVRQL

SEQ ID NO: 1144765 - protein, 9 aa, Homo Sapiens
QCAICRGFT

SEQ ID NO: 1144766 - protein, 9 aa, Homo Sapiens
FDKNKFSMT

SEQ ID NO: 1144767 - protein, 9 aa, Homo Sapiens
LFLLFFSSV

SEQ ID NO: 1144768 - protein, 9 aa, Homo Sapiens
HPILHVSSK

SEQ ID NO: 1144769 - protein, 9 aa, Homo Sapiens
RTFRHHETK

SEQ ID NO: 1144770 - protein, 9 aa, Homo Sapiens
KGWTGACTP

SEQ ID NO: 1144771 - protein, 9 aa, Homo Sapiens
STTLIPSHP

SEQ ID NO: 1144772 - protein, 9 aa, Homo Sapiens
TVAEKWTYE

SEQ ID NO: 1144773 - protein, 9 aa, Homo Sapiens
LVTGSVVVS

SEQ ID NO: 1144774 - protein, 9 aa, Homo Sapiens
TGSRATPGV

SEQ ID NO: 1144775 - protein, 9 aa, Homo Sapiens
CPLASLAPA

SEQ ID NO: 1144776 - protein, 9 aa, Homo Sapiens
LSLQRLSRP

SEQ ID NO: 1144777 - protein, 9 aa, Homo Sapiens
TGRDASPAA

SEQ ID NO: 1144778 - protein, 9 aa, Homo Sapiens
PGAGLGQDH

SEQ ID NO: 1144779 - protein, 9 aa, Homo Sapiens
WGVSGSSTR

SEQ ID NO: 1144780 - protein, 9 aa, Homo Sapiens
RERNQGSNM

SEQ ID NO: 1144781 - protein, 9 aa, Homo Sapiens
RYRLRAVLG

SEQ ID NO: 1144782 - protein, 9 aa, Homo Sapiens
HGLEGNHKK

SEQ ID NO: 1144783 - protein, 9 aa, Homo Sapiens
SPPDASPGP

SEQ ID NO: 1144784 - protein, 9 aa, Homo Sapiens
MVITVDAKA

SEQ ID NO: 1144785 - protein, 9 aa, Homo Sapiens
GLDLRVCGE

SEQ ID NO: 1144786 - protein, 9 aa, Homo Sapiens
SYCGPLRTV

SEQ ID NO: 1144787 - protein, 9 aa, Homo Sapiens
LSLWKRLKV

SEQ ID NO: 1144788 - protein, 9 aa, Homo Sapiens
AEKPTAALG

SEQ ID NO: 1144789 - protein, 9 aa, Homo Sapiens
LRPRYAGML

SEQ ID NO: 1144790 - protein, 9 aa, Homo Sapiens
DPAAFSARW

SEQ ID NO: 1144791 - protein, 9 aa, Homo Sapiens
RRARWDLRR

SEQ ID NO: 1144792 - protein, 9 aa, Homo Sapiens
TCCSMGQTW

SEQ ID NO: 1144793 - protein, 9 aa, Homo Sapiens
GYGDESDVF

SEQ ID NO: 1144794 - protein, 9 aa, Homo Sapiens
SGEQIPGLL

SEQ ID NO: 1144795 - protein, 9 aa, Homo Sapiens
KRSAFPSRS

SEQ ID NO: 1144796 - protein, 9 aa, Homo Sapiens
DTISSSELS

SEQ ID NO: 1144797 - protein, 9 aa, Homo Sapiens
SIKNNIKIT

SEQ ID NO: 1144798 - protein, 9 aa, Homo Sapiens
INLNLRAGP

SEQ ID NO: 1144799 - protein, 9 aa, Homo Sapiens
KENSKPQQF

SEQ ID NO: 1144800 - protein, 9 aa, Homo Sapiens
SLEETLPPD

SEQ ID NO: 1144801 - protein, 9 aa, Homo Sapiens
PIVKKGEEG

SEQ ID NO: 1144802 - protein, 9 aa, Homo Sapiens
DLAGEEASA

SEQ ID NO: 1144803 - protein, 9 aa, Homo Sapiens
RTGNGKTAC

SEQ ID NO: 1144804 - protein, 9 aa, Homo Sapiens
SLVFTFIVS

SEQ ID NO: 1144805 - protein, 9 aa, Homo Sapiens
QLFFFFLLF

SEQ ID NO: 1144806 - protein, 9 aa, Homo Sapiens
VAISIFVKH

SEQ ID NO: 1144807 - protein, 9 aa, Homo Sapiens
GTSAPWRHQ

SEQ ID NO: 1144808 - protein, 9 aa, Homo Sapiens
ELIFSALLS

SEQ ID NO: 1144809 - protein, 9 aa, Homo Sapiens
KINIDDLVK

SEQ ID NO: 1144810 - protein, 9 aa, Homo Sapiens
YHSGKPPAM

SEQ ID NO: 1144811 - protein, 9 aa, Homo Sapiens
RVPFLFVVQ

SEQ ID NO: 1144812 - protein, 9 aa, Homo Sapiens
TFYLQLWAP

SEQ ID NO: 1144813 - protein, 9 aa, Homo Sapiens
ARVTVTDTW

SEQ ID NO: 1144814 - protein, 9 aa, Homo Sapiens
PPRQTPRHP

SEQ ID NO: 1144815 - protein, 9 aa, Homo Sapiens
RRSTRPAAL

SEQ ID NO: 1144816 - protein, 9 aa, Homo Sapiens
STGSRATPG

SEQ ID NO: 1144817 - protein, 9 aa, Homo Sapiens
GQYLAPLPP

SEQ ID NO: 1144818 - protein, 9 aa, Homo Sapiens
PPCPGPKRM

SEQ ID NO: 1144819 - protein, 9 aa, Homo Sapiens
CPHILDRLQ

SEQ ID NO: 1144820 - protein, 9 aa, Homo Sapiens
ILIMGEAFA

SEQ ID NO: 1144821 - protein, 9 aa, Homo Sapiens
ECCRLLSAI

SEQ ID NO: 1144822 - protein, 9 aa, Homo Sapiens
IADDLIEKL

SEQ ID NO: 1144823 - protein, 9 aa, Homo Sapiens
GEIKGSTGI

SEQ ID NO: 1144824 - protein, 9 aa, Homo Sapiens
SLFSNALPE

SEQ ID NO: 1144825 - protein, 9 aa, Homo Sapiens
ILNTNSISV

SEQ ID NO: 1144826 - protein, 9 aa, Homo Sapiens
EEKGPLAWK

SEQ ID NO: 1144827 - protein, 9 aa, Homo Sapiens
SLGGCPLSL

SEQ ID NO: 1144828 - protein, 9 aa, Homo Sapiens
PQDSRQVLA

SEQ ID NO: 1144829 - protein, 9 aa, Homo Sapiens
EAEWQTRQT

SEQ ID NO: 1144830 - protein, 9 aa, Homo Sapiens
EQSDCPVIV

SEQ ID NO: 1144831 - protein, 9 aa, Homo Sapiens
PSPPHPPRP

SEQ ID NO: 1144832 - protein, 9 aa, Homo Sapiens
GRLRSRPPG

SEQ ID NO: 1144833 - protein, 9 aa, Homo Sapiens
TDEAVHKKA

SEQ ID NO: 1144834 - protein, 9 aa, Homo Sapiens
QSRKGQKKI

SEQ ID NO: 1144835 - protein, 9 aa, Homo Sapiens
SSSMAPKMN

SEQ ID NO: 1144836 - protein, 9 aa, Homo Sapiens
SARDKRLCP

SEQ ID NO: 1144837 - protein, 9 aa, Homo Sapiens
LAYCSLSFP

SEQ ID NO: 1144838 - protein, 9 aa, Homo Sapiens
PSPQGPLFL

SEQ ID NO: 1144839 - protein, 9 aa, Homo Sapiens
APGVAESPD

SEQ ID NO: 1144840 - protein, 9 aa, Homo Sapiens
PAVPAAACP

SEQ ID NO: 1144841 - protein, 9 aa, Homo Sapiens
AFPSRSLSS

SEQ ID NO: 1144842 - protein, 9 aa, Homo Sapiens
ECFDVMTDY

SEQ ID NO: 1144843 - protein, 9 aa, Homo Sapiens
AAGAAATPL

SEQ ID NO: 1144844 - protein, 9 aa, Homo Sapiens
PTRWAAATC

SEQ ID NO: 1144845 - protein, 9 aa, Homo Sapiens
PSKGVKFFD

SEQ ID NO: 1144846 - protein, 9 aa, Homo Sapiens
ATSGPSGPD

SEQ ID NO: 1144847 - protein, 9 aa, Homo Sapiens
SAFSRVSVI

SEQ ID NO: 1144848 - protein, 9 aa, Homo Sapiens
RPPGRGAEP

SEQ ID NO: 1144849 - protein, 9 aa, Homo Sapiens
ELYHGLEGN

SEQ ID NO: 1144850 - protein, 9 aa, Homo Sapiens
SLPGPCASL

SEQ ID NO: 1144851 - protein, 9 aa, Homo Sapiens
QFKIPEGGD

SEQ ID NO: 1144852 - protein, 9 aa, Homo Sapiens
TGPLAELVV

SEQ ID NO: 1144853 - protein, 9 aa, Homo Sapiens
SFSSSLGSH

SEQ ID NO: 1144854 - protein, 9 aa, Homo Sapiens
LGTAEIEDT

SEQ ID NO: 1144855 - protein, 9 aa, Homo Sapiens
AWKSTMAQL

SEQ ID NO: 1144856 - protein, 9 aa, Homo Sapiens
RASAPTSGL

SEQ ID NO: 1144857 - protein, 9 aa, Homo Sapiens
GDATASPSS

SEQ ID NO: 1144858 - protein, 9 aa, Homo Sapiens
SLPVATACC

SEQ ID NO: 1144859 - protein, 9 aa, Homo Sapiens
DKKRRSKIE

SEQ ID NO: 1144860 - protein, 9 aa, Homo Sapiens
KSYSPGMTM

SEQ ID NO: 1144861 - protein, 9 aa, Homo Sapiens
CWPALPKPA

SEQ ID NO: 1144862 - protein, 9 aa, Homo Sapiens
SHVCLPGSC

SEQ ID NO: 1144863 - protein, 9 aa, Homo Sapiens
THRAVRPLR

SEQ ID NO: 1144864 - protein, 9 aa, Homo Sapiens
GGAEESSAV

SEQ ID NO: 1144865 - protein, 9 aa, Homo Sapiens
FLRESGQWL

SEQ ID NO: 1144866 - protein, 9 aa, Homo Sapiens
FIGSLLRGQ

SEQ ID NO: 1144867 - protein, 9 aa, Homo Sapiens
GAAARPAGS

SEQ ID NO: 1144868 - protein, 9 aa, Homo Sapiens
SNEDTEEFP

SEQ ID NO: 1144869 - protein, 9 aa, Homo Sapiens
RRESRFWLA

SEQ ID NO: 1144870 - protein, 9 aa, Homo Sapiens
SRPHSGSGS

SEQ ID NO: 1144871 - protein, 9 aa, Homo Sapiens
SQLVCIGES

SEQ ID NO: 1144872 - protein, 9 aa, Homo Sapiens
LECCRLLSA

SEQ ID NO: 1144873 - protein, 9 aa, Homo Sapiens
AKKGRCYQL

SEQ ID NO: 1144874 - protein, 9 aa, Homo Sapiens
EGIIFIGHP

SEQ ID NO: 1144875 - protein, 9 aa, Homo Sapiens
ANKVQSDSS

SEQ ID NO: 1144876 - protein, 9 aa, Homo Sapiens
SGDFNLPLN

SEQ ID NO: 1144877 - protein, 9 aa, Homo Sapiens
ARAGEIKGS

SEQ ID NO: 1144878 - protein, 9 aa, Homo Sapiens
LQCRQYKCK

SEQ ID NO: 1144879 - protein, 9 aa, Homo Sapiens
VHYDPKKDV

SEQ ID NO: 1144880 - protein, 9 aa, Homo Sapiens
TMEAIGELY

SEQ ID NO: 1144881 - protein, 9 aa, Homo Sapiens
PLQGSAALL

SEQ ID NO: 1144882 - protein, 9 aa, Homo Sapiens
DRETSKPLE

SEQ ID NO: 1144883 - protein, 9 aa, Homo Sapiens
VGKDGECDL

SEQ ID NO: 1144884 - protein, 9 aa, Homo Sapiens
LTTPRPSGL

SEQ ID NO: 1144885 - protein, 9 aa, Homo Sapiens
GVFQRGKVE

SEQ ID NO: 1144886 - protein, 9 aa, Homo Sapiens
PSLLLLVFA

SEQ ID NO: 1144887 - protein, 9 aa, Homo Sapiens
VWVGAQEAV

SEQ ID NO: 1144888 - protein, 9 aa, Homo Sapiens
KFVIKKKAN

SEQ ID NO: 1144889 - protein, 9 aa, Homo Sapiens
DNMSYSMEV

SEQ ID NO: 1144890 - protein, 9 aa, Homo Sapiens
VRHHTAGLV

SEQ ID NO: 1144891 - protein, 9 aa, Homo Sapiens
AMARTGNGK

SEQ ID NO: 1144892 - protein, 9 aa, Homo Sapiens
RRGPCTTIK

SEQ ID NO: 1144893 - protein, 9 aa, Homo Sapiens
GAARLAGRK

SEQ ID NO: 1144894 - protein, 9 aa, Homo Sapiens
GDGKKMDLD

SEQ ID NO: 1144895 - protein, 9 aa, Homo Sapiens
RRKRSSQSR

SEQ ID NO: 1144896 - protein, 9 aa, Homo Sapiens
EDPAGSPPG

SEQ ID NO: 1144897 - protein, 9 aa, Homo Sapiens
ATTCAPGTA

SEQ ID NO: 1144898 - protein, 9 aa, Homo Sapiens
MPGSCRSPR

SEQ ID NO: 1144899 - protein, 9 aa, Homo Sapiens
VHYSLLKWN

SEQ ID NO: 1144900 - protein, 9 aa, Homo Sapiens
LIMGEAFAS

SEQ ID NO: 1144901 - protein, 9 aa, Homo Sapiens
CVPGWCRWK

SEQ ID NO: 1144902 - protein, 9 aa, Homo Sapiens
SDCPVIVSV

SEQ ID NO: 1144903 - protein, 9 aa, Homo Sapiens
NLLHGKTIE

SEQ ID NO: 1144904 - protein, 9 aa, Homo Sapiens
PADSCPGGA

SEQ ID NO: 1144905 - protein, 9 aa, Homo Sapiens
NNKREKHSA

SEQ ID NO: 1144906 - protein, 9 aa, Homo Sapiens
EPARAARAF

SEQ ID NO: 1144907 - protein, 9 aa, Homo Sapiens
PRRRPAAVS

SEQ ID NO: 1144908 - protein, 9 aa, Homo Sapiens
SRAPCRPPP

SEQ ID NO: 1144909 - protein, 9 aa, Homo Sapiens
KDLHMMISM

SEQ ID NO: 1144910 - protein, 9 aa, Homo Sapiens
LPLGRPRIP

SEQ ID NO: 1144911 - protein, 9 aa, Homo Sapiens
KGSTGIDSE

SEQ ID NO: 1144912 - protein, 9 aa, Homo Sapiens
LGLIADSSA

SEQ ID NO: 1144913 - protein, 9 aa, Homo Sapiens
VLAPGELLT

SEQ ID NO: 1144914 - protein, 9 aa, Homo Sapiens
SNWKPLTVL

SEQ ID NO: 1144915 - protein, 9 aa, Homo Sapiens
KKDVHIYEA

SEQ ID NO: 1144916 - protein, 9 aa, Homo Sapiens
PHPSPSWAW

SEQ ID NO: 1144917 - protein, 9 aa, Homo Sapiens
NNSQFVITP

SEQ ID NO: 1144918 - protein, 9 aa, Homo Sapiens
SAHVSTSFP

SEQ ID NO: 1144919 - protein, 9 aa, Homo Sapiens
RILCTKPVE

SEQ ID NO: 1144920 - protein, 9 aa, Homo Sapiens
IVKGVLDRE

SEQ ID NO: 1144921 - protein, 9 aa, Homo Sapiens
VVFVDPCKD

SEQ ID NO: 1144922 - protein, 9 aa, Homo Sapiens
EIGSGESSS

SEQ ID NO: 1144923 - protein, 9 aa, Homo Sapiens
EPAGARLAE

SEQ ID NO: 1144924 - protein, 9 aa, Homo Sapiens
LICIMKNQI

SEQ ID NO: 1144925 - protein, 9 aa, Homo Sapiens
WMAGGLVAH

SEQ ID NO: 1144926 - protein, 9 aa, Homo Sapiens
HQCSPRGDC

SEQ ID NO: 1144927 - protein, 9 aa, Homo Sapiens
AFLVLKREF

SEQ ID NO: 1144928 - protein, 9 aa, Homo Sapiens
SGSDGGTEY

SEQ ID NO: 1144929 - protein, 9 aa, Homo Sapiens
LEARAPHVC

SEQ ID NO: 1144930 - protein, 9 aa, Homo Sapiens
AMVTTWQGA

SEQ ID NO: 1144931 - protein, 9 aa, Homo Sapiens
ISEKEDETE

SEQ ID NO: 1144932 - protein, 9 aa, Homo Sapiens
WEGLWMPPY

SEQ ID NO: 1144933 - protein, 9 aa, Homo Sapiens
RAFSREQCR

SEQ ID NO: 1144934 - protein, 9 aa, Homo Sapiens
LHHPDLYLE

SEQ ID NO: 1144935 - protein, 9 aa, Homo Sapiens
MEPITLPGG

SEQ ID NO: 1144936 - protein, 9 aa, Homo Sapiens
GCESVMGMV

SEQ ID NO: 1144937 - protein, 9 aa, Homo Sapiens
LINDRHGSV

SEQ ID NO: 1144938 - protein, 9 aa, Homo Sapiens
SAALLPRSP

SEQ ID NO: 1144939 - protein, 9 aa, Homo Sapiens
YNSTMSSKS

SEQ ID NO: 1144940 - protein, 9 aa, Homo Sapiens
ILPSSRGMG

SEQ ID NO: 1144941 - protein, 9 aa, Homo Sapiens
GSPLLSGAR

SEQ ID NO: 1144942 - protein, 9 aa, Homo Sapiens
KSKGGPGGW

SEQ ID NO: 1144943 - protein, 9 aa, Homo Sapiens
INQLFSSKN

SEQ ID NO: 1144944 - protein, 9 aa, Homo Sapiens
PGWSAMPGG

SEQ ID NO: 1144945 - protein, 9 aa, Homo Sapiens
HGEVDVDGH

SEQ ID NO: 1144946 - protein, 9 aa, Homo Sapiens
HHTDHPRAQ

SEQ ID NO: 1144947 - protein, 9 aa, Homo Sapiens
VLYCYYPDT

SEQ ID NO: 1144948 - protein, 9 aa, Homo Sapiens
PPLPTASGL

SEQ ID NO: 1144949 - protein, 9 aa, Homo Sapiens
PLYHSALGV

SEQ ID NO: 1144950 - protein, 9 aa, Homo Sapiens
SVAEKVITP

SEQ ID NO: 1144951 - protein, 9 aa, Homo Sapiens
RLLRRPPGG

SEQ ID NO: 1144952 - protein, 9 aa, Homo Sapiens
ATPLEVARG

SEQ ID NO: 1144953 - protein, 9 aa, Homo Sapiens
LTKYLKRDH

SEQ ID NO: 1144954 - protein, 9 aa, Homo Sapiens
CARSASSCS

SEQ ID NO: 1144955 - protein, 9 aa, Homo Sapiens
WTGACTPPT

SEQ ID NO: 1144956 - protein, 9 aa, Homo Sapiens
AEASTGAWT

SEQ ID NO: 1144957 - protein, 9 aa, Homo Sapiens
MPYAGGVGA

SEQ ID NO: 1144958 - protein, 9 aa, Homo Sapiens
AGAYILVRY

SEQ ID NO: 1144959 - protein, 9 aa, Homo Sapiens
PTGSEADGL

SEQ ID NO: 1144960 - protein, 9 aa, Homo Sapiens
PTRRLSRAS

SEQ ID NO: 1144961 - protein, 9 aa, Homo Sapiens
QTCLEEGTA

SEQ ID NO: 1144962 - protein, 9 aa, Homo Sapiens
NRTHTCEKP

SEQ ID NO: 1144963 - protein, 9 aa, Homo Sapiens
DQLVGGQVG

SEQ ID NO: 1144964 - protein, 9 aa, Homo Sapiens
PLTGRDASP

SEQ ID NO: 1144965 - protein, 9 aa, Homo Sapiens
SKVQNEFKA

SEQ ID NO: 1144966 - protein, 9 aa, Homo Sapiens
GNQGLLYDW

SEQ ID NO: 1144967 - protein, 9 aa, Homo Sapiens
GRAARSSAQ

SEQ ID NO: 1144968 - protein, 9 aa, Homo Sapiens
GLYCGVAPL

SEQ ID NO: 1144969 - protein, 9 aa, Homo Sapiens
VFPPLIPLL

SEQ ID NO: 1144970 - protein, 9 aa, Homo Sapiens
ELLYDLLEL

SEQ ID NO: 1144971 - protein, 9 aa, Homo Sapiens
TNEAKKGRC

SEQ ID NO: 1144972 - protein, 9 aa, Homo Sapiens
CCHASCHSH

SEQ ID NO: 1144973 - protein, 9 aa, Homo Sapiens
RTVLLLPSA

SEQ ID NO: 1144974 - protein, 9 aa, Homo Sapiens
KKLHPILHV

SEQ ID NO: 1144975 - protein, 9 aa, Homo Sapiens
TISSSELSI

SEQ ID NO: 1144976 - protein, 9 aa, Homo Sapiens
ASQTPMAAL

SEQ ID NO: 1144977 - protein, 9 aa, Homo Sapiens
YHSLVMCLR

SEQ ID NO: 1144978 - protein, 9 aa, Homo Sapiens
LLSGARGRT

SEQ ID NO: 1144979 - protein, 9 aa, Homo Sapiens
PRKQAQQEP

SEQ ID NO: 1144980 - protein, 9 aa, Homo Sapiens
LPTHKIRTS

SEQ ID NO: 1144981 - protein, 9 aa, Homo Sapiens
HSDFRNRDV

SEQ ID NO: 1144982 - protein, 9 aa, Homo Sapiens
RVRFTNDDR

SEQ ID NO: 1144983 - protein, 9 aa, Homo Sapiens
SYGSHVCLP

SEQ ID NO: 1144984 - protein, 9 aa, Homo Sapiens
YRLLLLFQT

SEQ ID NO: 1144985 - protein, 9 aa, Homo Sapiens
TREEAEWIR

SEQ ID NO: 1144986 - protein, 9 aa, Homo Sapiens
GRRLGPRGH

SEQ ID NO: 1144987 - protein, 9 aa, Homo Sapiens
GHPAALWGQ

SEQ ID NO: 1144988 - protein, 9 aa, Homo Sapiens
VHMQPIPAY

SEQ ID NO: 1144989 - protein, 9 aa, Homo Sapiens
PRRTARLQT

SEQ ID NO: 1144990 - protein, 9 aa, Homo Sapiens
CPGQRVFLC

SEQ ID NO: 1144991 - protein, 9 aa, Homo Sapiens
PTGSSRLAA

SEQ ID NO: 1144992 - protein, 9 aa, Homo Sapiens
RKQPVSIWP

SEQ ID NO: 1144993 - protein, 9 aa, Homo Sapiens
VQEQHVGLF

SEQ ID NO: 1144994 - protein, 9 aa, Homo Sapiens
RDGLSEDQV

SEQ ID NO: 1144995 - protein, 9 aa, Homo Sapiens
ALVTGSVVV

SEQ ID NO: 1144996 - protein, 9 aa, Homo Sapiens
LCTHPGLLQ

SEQ ID NO: 1144997 - protein, 9 aa, Homo Sapiens
LLELPSQQR

SEQ ID NO: 1144998 - protein, 9 aa, Homo Sapiens
KRRGPCTTI

SEQ ID NO: 1144999 - protein, 9 aa, Homo Sapiens
NSLPQGAGS

SEQ ID NO: 1145000 - protein, 9 aa, Homo Sapiens
KPKLMLLTR

SEQ ID NO: 1145001 - protein, 9 aa, Homo Sapiens
DMVILKALV

SEQ ID NO: 1145002 - protein, 9 aa, Homo Sapiens
DMAVATRRY

SEQ ID NO: 1145003 - protein, 9 aa, Homo Sapiens
LTLRRKWWP

SEQ ID NO: 1145004 - protein, 9 aa, Homo Sapiens
RVAEEGFLE

SEQ ID NO: 1145005 - protein, 9 aa, Homo Sapiens
PQQPRMACS

SEQ ID NO: 1145006 - protein, 9 aa, Homo Sapiens
QEGSEELDM

SEQ ID NO: 1145007 - protein, 9 aa, Homo Sapiens
QAVDRETSK

SEQ ID NO: 1145008 - protein, 9 aa, Homo Sapiens
GSHVCLPGS

SEQ ID NO: 1145009 - protein, 9 aa, Homo Sapiens
YLEEQRIVH

SEQ ID NO: 1145010 - protein, 9 aa, Homo Sapiens
VHEDGDSPV

SEQ ID NO: 1145011 - protein, 9 aa, Homo Sapiens
RRKNKKPGE

SEQ ID NO: 1145012 - protein, 9 aa, Homo Sapiens
EPPLPTASG

SEQ ID NO: 1145013 - protein, 9 aa, Homo Sapiens
PLQRSGSLL

SEQ ID NO: 1145014 - protein, 9 aa, Homo Sapiens
DMLGDDGSL

SEQ ID NO: 1145015 - protein, 9 aa, Homo Sapiens
ALKKPLRKV

SEQ ID NO: 1145016 - protein, 9 aa, Homo Sapiens
PKPAVAWLQ

SEQ ID NO: 1145017 - protein, 9 aa, Homo Sapiens
GTQCAICRG

SEQ ID NO: 1145018 - protein, 9 aa, Homo Sapiens
HLPTLASRV

SEQ ID NO: 1145019 - protein, 9 aa, Homo Sapiens
AYVKDAWMQ

SEQ ID NO: 1145020 - protein, 9 aa, Homo Sapiens
AFPSPQGPL

SEQ ID NO: 1145021 - protein, 9 aa, Homo Sapiens
AHNRTHTCE

SEQ ID NO: 1145022 - protein, 9 aa, Homo Sapiens
GPVRHHTAG

SEQ ID NO: 1145023 - protein, 9 aa, Homo Sapiens
FNLLGEDWG

SEQ ID NO: 1145024 - protein, 9 aa, Homo Sapiens
LVPLVILGL

SEQ ID NO: 1145025 - protein, 9 aa, Homo Sapiens
VLPTYDSTH

SEQ ID NO: 1145026 - protein, 9 aa, Homo Sapiens
DEQVMQNQP

SEQ ID NO: 1145027 - protein, 9 aa, Homo Sapiens
CRPPPVPAP

SEQ ID NO: 1145028 - protein, 9 aa, Homo Sapiens
STTTLSWGS

SEQ ID NO: 1145029 - protein, 9 aa, Homo Sapiens
TYRLSIILP

SEQ ID NO: 1145030 - protein, 9 aa, Homo Sapiens
PEECVYPDY

SEQ ID NO: 1145031 - protein, 9 aa, Homo Sapiens
SPTLGRVPH

SEQ ID NO: 1145032 - protein, 9 aa, Homo Sapiens
QPLEEEYEH

SEQ ID NO: 1145033 - protein, 9 aa, Homo Sapiens
KITETIGII

SEQ ID NO: 1145034 - protein, 9 aa, Homo Sapiens
VAAYVTVPP

SEQ ID NO: 1145035 - protein, 9 aa, Homo Sapiens
PTASGLKNI

SEQ ID NO: 1145036 - protein, 9 aa, Homo Sapiens
SSAKRNNFS

SEQ ID NO: 1145037 - protein, 9 aa, Homo Sapiens
LRPAPRVSP

SEQ ID NO: 1145038 - protein, 9 aa, Homo Sapiens
LSALDKTDA

SEQ ID NO: 1145039 - protein, 9 aa, Homo Sapiens
PVMAWTSRM

SEQ ID NO: 1145040 - protein, 9 aa, Homo Sapiens
APHVDGERS

SEQ ID NO: 1145041 - protein, 9 aa, Homo Sapiens
TCTCRPPQF

SEQ ID NO: 1145042 - protein, 9 aa, Homo Sapiens
DLAELVSQQ

SEQ ID NO: 1145043 - protein, 9 aa, Homo Sapiens
PPQPSLPGP

SEQ ID NO: 1145044 - protein, 9 aa, Homo Sapiens
TGPRDSALN

SEQ ID NO: 1145045 - protein, 9 aa, Homo Sapiens
PRRLLRRPP

SEQ ID NO: 1145046 - protein, 9 aa, Homo Sapiens
TEIIIVVNQ

SEQ ID NO: 1145047 - protein, 9 aa, Homo Sapiens
QRRVPQPAQ

SEQ ID NO: 1145048 - protein, 9 aa, Homo Sapiens
NAASLGTRK

SEQ ID NO: 1145049 - protein, 9 aa, Homo Sapiens
PSRWPSSQG

SEQ ID NO: 1145050 - protein, 9 aa, Homo Sapiens
SWFMSVNEG

SEQ ID NO: 1145051 - protein, 9 aa, Homo Sapiens
PPPKMPPPR

SEQ ID NO: 1145052 - protein, 9 aa, Homo Sapiens
LTCQDHVSM

SEQ ID NO: 1145053 - protein, 9 aa, Homo Sapiens
AQVFAFLKG

SEQ ID NO: 1145054 - protein, 9 aa, Homo Sapiens
CGSLFEEEL

SEQ ID NO: 1145055 - protein, 9 aa, Homo Sapiens
RKGHNMLKK

SEQ ID NO: 1145056 - protein, 9 aa, Homo Sapiens
SSREVCSSP

SEQ ID NO: 1145057 - protein, 9 aa, Homo Sapiens
ALQAGPPGT

SEQ ID NO: 1145058 - protein, 9 aa, Homo Sapiens
KKRKAFDTN

SEQ ID NO: 1145059 - protein, 9 aa, Homo Sapiens
PKKRILNFL

SEQ ID NO: 1145060 - protein, 9 aa, Homo Sapiens
STMSCLSRP

SEQ ID NO: 1145061 - protein, 9 aa, Homo Sapiens
NKHSFSDQP

SEQ ID NO: 1145062 - protein, 9 aa, Homo Sapiens
PSQLPASSP

SEQ ID NO: 1145063 - protein, 9 aa, Homo Sapiens
SGPGRRLCT

SEQ ID NO: 1145064 - protein, 9 aa, Homo Sapiens
SVPTSQRGV

SEQ ID NO: 1145065 - protein, 9 aa, Homo Sapiens
TCLWAPGWR

SEQ ID NO: 1145066 - protein, 9 aa, Homo Sapiens
TPWMEGADP

SEQ ID NO: 1145067 - protein, 9 aa, Homo Sapiens
GKDGECDLG

SEQ ID NO: 1145068 - protein, 9 aa, Homo Sapiens
PVGESPWQV

SEQ ID NO: 1145069 - protein, 9 aa, Homo Sapiens
KKSRWDNET

SEQ ID NO: 1145070 - protein, 9 aa, Homo Sapiens
RRPAGARRL

SEQ ID NO: 1145071 - protein, 9 aa, Homo Sapiens
SDNRFEAHA

SEQ ID NO: 1145072 - protein, 9 aa, Homo Sapiens
LAPTRFTLE

SEQ ID NO: 1145073 - protein, 9 aa, Homo Sapiens
GPTPTEPPL

SEQ ID NO: 1145074 - protein, 9 aa, Homo Sapiens
SPAQLSQIK

SEQ ID NO: 1145075 - protein, 9 aa, Homo Sapiens
APVRSEAED

SEQ ID NO: 1145076 - protein, 9 aa, Homo Sapiens
VVARKLDLT

SEQ ID NO: 1145077 - protein, 9 aa, Homo Sapiens
SELSTDSVV

SEQ ID NO: 1145078 - protein, 9 aa, Homo Sapiens
PLWGRLRSR

SEQ ID NO: 1145079 - protein, 9 aa, Homo Sapiens
QCRKMQNMF

SEQ ID NO: 1145080 - protein, 9 aa, Homo Sapiens
RVAGTAGAR

SEQ ID NO: 1145081 - protein, 9 aa, Homo Sapiens
PTGVFSRMG

SEQ ID NO: 1145082 - protein, 9 aa, Homo Sapiens
DPKKMAPPK

SEQ ID NO: 1145083 - protein, 9 aa, Homo Sapiens
PRAPVRAWR

SEQ ID NO: 1145084 - protein, 9 aa, Homo Sapiens
RKDRWSVRP

SEQ ID NO: 1145085 - protein, 9 aa, Homo Sapiens
FLHCRGKKF

SEQ ID NO: 1145086 - protein, 9 aa, Homo Sapiens
TTLWVIPPQ

SEQ ID NO: 1145087 - protein, 9 aa, Homo Sapiens
WAIVNLCRN

SEQ ID NO: 1145088 - protein, 9 aa, Homo Sapiens
GPSGSFDFL

SEQ ID NO: 1145089 - protein, 9 aa, Homo Sapiens
QEEASGVAI

SEQ ID NO: 1145090 - protein, 9 aa, Homo Sapiens
HEVCAQTGE

SEQ ID NO: 1145091 - protein, 9 aa, Homo Sapiens
GKVTNEGAT

SEQ ID NO: 1145092 - protein, 9 aa, Homo Sapiens
TPGVALGRL

SEQ ID NO: 1145093 - protein, 9 aa, Homo Sapiens
PRLCSYTGA

SEQ ID NO: 1145094 - protein, 9 aa, Homo Sapiens
EPGAKSGRH

SEQ ID NO: 1145095 - protein, 9 aa, Homo Sapiens
EGCHKKTSQ

SEQ ID NO: 1145096 - protein, 9 aa, Homo Sapiens
TSIEVSVNG

SEQ ID NO: 1145097 - protein, 9 aa, Homo Sapiens
YPVLAPGEL

SEQ ID NO: 1145098 - protein, 9 aa, Homo Sapiens
GASQYPKKL

SEQ ID NO: 1145099 - protein, 9 aa, Homo Sapiens
HSQYPQYYG

SEQ ID NO: 1145100 - protein, 9 aa, Homo Sapiens
KGSMRDKKR

SEQ ID NO: 1145101 - protein, 9 aa, Homo Sapiens
RRLARARVP

SEQ ID NO: 1145102 - protein, 9 aa, Homo Sapiens
AFGKVVETS

SEQ ID NO: 1145103 - protein, 9 aa, Homo Sapiens
RCLPSNEDT

SEQ ID NO: 1145104 - protein, 9 aa, Homo Sapiens
ITVHNICHW

SEQ ID NO: 1145105 - protein, 9 aa, Homo Sapiens
LLLLVFASS

SEQ ID NO: 1145106 - protein, 9 aa, Homo Sapiens
SSMSSLGDP

SEQ ID NO: 1145107 - protein, 9 aa, Homo Sapiens
LQGSPGLAT

SEQ ID NO: 1145108 - protein, 9 aa, Homo Sapiens
TCLMRPPWL

SEQ ID NO: 1145109 - protein, 9 aa, Homo Sapiens
LPRNMALEV

SEQ ID NO: 1145110 - protein, 9 aa, Homo Sapiens
QIIARYVPL

SEQ ID NO: 1145111 - protein, 9 aa, Homo Sapiens
YWIYGCGGM

SEQ ID NO: 1145112 - protein, 9 aa, Homo Sapiens
FLLAGILIC

SEQ ID NO: 1145113 - protein, 9 aa, Homo Sapiens
PGPGAVGGC

SEQ ID NO: 1145114 - protein, 9 aa, Homo Sapiens
IRCPLQIIL

SEQ ID NO: 1145115 - protein, 9 aa, Homo Sapiens
ILEEGGSAH

SEQ ID NO: 1145116 - protein, 9 aa, Homo Sapiens
LRLCPHILD

SEQ ID NO: 1145117 - protein, 9 aa, Homo Sapiens
HLPLPQAPT

SEQ ID NO: 1145118 - protein, 9 aa, Homo Sapiens
EDCLRSFRP

SEQ ID NO: 1145119 - protein, 9 aa, Homo Sapiens
LLTRMKEKH

SEQ ID NO: 1145120 - protein, 9 aa, Homo Sapiens
LLSITNVIN

SEQ ID NO: 1145121 - protein, 9 aa, Homo Sapiens
FTNDDRHRL

SEQ ID NO: 1145122 - protein, 9 aa, Homo Sapiens
TQHEIWWGQ

SEQ ID NO: 1145123 - protein, 9 aa, Homo Sapiens
LDLTKAEKH

SEQ ID NO: 1145124 - protein, 9 aa, Homo Sapiens
KSTMAQLTT

SEQ ID NO: 1145125 - protein, 9 aa, Homo Sapiens
AGDEELMHL

SEQ ID NO: 1145126 - protein, 9 aa, Homo Sapiens
FRAGTLAQL

SEQ ID NO: 1145127 - protein, 9 aa, Homo Sapiens
SPPGTRPKP

SEQ ID NO: 1145128 - protein, 9 aa, Homo Sapiens
TFLRNVTWA

SEQ ID NO: 1145129 - protein, 9 aa, Homo Sapiens
NQVSVGLQG

SEQ ID NO: 1145130 - protein, 9 aa, Homo Sapiens
PGGATAARR

SEQ ID NO: 1145131 - protein, 9 aa, Homo Sapiens
QMEQDYHGL

SEQ ID NO: 1145132 - protein, 9 aa, Homo Sapiens
LEGEFSVIM

SEQ ID NO: 1145133 - protein, 9 aa, Homo Sapiens
VYFKINPWS

SEQ ID NO: 1145134 - protein, 9 aa, Homo Sapiens
FGLVCMGRV

SEQ ID NO: 1145135 - protein, 9 aa, Homo Sapiens
GGEGGGVML

SEQ ID NO: 1145136 - protein, 9 aa, Homo Sapiens
AHLLETLLP

SEQ ID NO: 1145137 - protein, 9 aa, Homo Sapiens
ARQLTRMYP

SEQ ID NO: 1145138 - protein, 9 aa, Homo Sapiens
CDKKRGASS

SEQ ID NO: 1145139 - protein, 9 aa, Homo Sapiens
LLAPTRFTL

SEQ ID NO: 1145140 - protein, 9 aa, Homo Sapiens
TTVGPELNE

SEQ ID NO: 1145141 - protein, 9 aa, Homo Sapiens
RSCSGLVRD

SEQ ID NO: 1145142 - protein, 9 aa, Homo Sapiens
TVNMSKVET

SEQ ID NO: 1145143 - protein, 9 aa, Homo Sapiens
KDGKINIDD

SEQ ID NO: 1145144 - protein, 9 aa, Homo Sapiens
TTSATTRRP

SEQ ID NO: 1145145 - protein, 9 aa, Homo Sapiens
STSSPKSTT

SEQ ID NO: 1145146 - protein, 9 aa, Homo Sapiens
PASRVRYGV

SEQ ID NO: 1145147 - protein, 9 aa, Homo Sapiens
ERPCARGQR

SEQ ID NO: 1145148 - protein, 9 aa, Homo Sapiens
EGRKRAFTT

SEQ ID NO: 1145149 - protein, 9 aa, Homo Sapiens
IQNISNNKR

SEQ ID NO: 1145150 - protein, 9 aa, Homo Sapiens
HVSMHRSPH

SEQ ID NO: 1145151 - protein, 9 aa, Homo Sapiens
TQPPECVDQ

SEQ ID NO: 1145152 - protein, 9 aa, Homo Sapiens
RIQIGQEMV

SEQ ID NO: 1145153 - protein, 9 aa, Homo Sapiens
IYEHLFCWI

SEQ ID NO: 1145154 - protein, 9 aa, Homo Sapiens
RSHILEHHP

SEQ ID NO: 1145155 - protein, 9 aa, Homo Sapiens
RIHTGGKTI

SEQ ID NO: 1145156 - protein, 9 aa, Homo Sapiens
FGNFNLLHG

SEQ ID NO: 1145157 - protein, 9 aa, Homo Sapiens
CLRLRTKLE

SEQ ID NO: 1145158 - protein, 9 aa, Homo Sapiens
PRKDEKKQE

SEQ ID NO: 1145159 - protein, 9 aa, Homo Sapiens
QHTTSIQSR

SEQ ID NO: 1145160 - protein, 9 aa, Homo Sapiens
PERITPELN

SEQ ID NO: 1145161 - protein, 9 aa, Homo Sapiens
YLKKTRTSL

SEQ ID NO: 1145162 - protein, 9 aa, Homo Sapiens
SYMRNLPHS

SEQ ID NO: 1145163 - protein, 9 aa, Homo Sapiens
NAHLGECVN

SEQ ID NO: 1145164 - protein, 9 aa, Homo Sapiens
LLAGERVGS

SEQ ID NO: 1145165 - protein, 9 aa, Homo Sapiens
ALLDEKRCL

SEQ ID NO: 1145166 - protein, 9 aa, Homo Sapiens
CVVLEARAP

SEQ ID NO: 1145167 - protein, 9 aa, Homo Sapiens
YYVTREGSC

SEQ ID NO: 1145168 - protein, 9 aa, Homo Sapiens
LFFFLFPLG

SEQ ID NO: 1145169 - protein, 9 aa, Homo Sapiens
RGKVEIIAN

SEQ ID NO: 1145170 - protein, 9 aa, Homo Sapiens
IGDEVKCWV

SEQ ID NO: 1145171 - protein, 9 aa, Homo Sapiens
NFLLNLAIS

SEQ ID NO: 1145172 - protein, 9 aa, Homo Sapiens
LRNCVSAVD

SEQ ID NO: 1145173 - protein, 9 aa, Homo Sapiens
LVRYALNHP

SEQ ID NO: 1145174 - protein, 9 aa, Homo Sapiens
SGSQTVNLA

SEQ ID NO: 1145175 - protein, 9 aa, Homo Sapiens
PCRGPMPGS

SEQ ID NO: 1145176 - protein, 9 aa, Homo Sapiens
VPVVREPEV

SEQ ID NO: 1145177 - protein, 9 aa, Homo Sapiens
HSPPLTPDV

SEQ ID NO: 1145178 - protein, 9 aa, Homo Sapiens
RWVPFAAAA

SEQ ID NO: 1145179 - protein, 9 aa, Homo Sapiens
PHRRAASMD

SEQ ID NO: 1145180 - protein, 9 aa, Homo Sapiens
LIPPMLHNL

SEQ ID NO: 1145181 - protein, 9 aa, Homo Sapiens
GPTIPAGTP

SEQ ID NO: 1145182 - protein, 9 aa, Homo Sapiens
IIIDGADLT

SEQ ID NO: 1145183 - protein, 9 aa, Homo Sapiens
VLLLPVITG

SEQ ID NO: 1145184 - protein, 9 aa, Homo Sapiens
GTPWMEGAD

SEQ ID NO: 1145185 - protein, 9 aa, Homo Sapiens
PMNFAATRP

SEQ ID NO: 1145186 - protein, 9 aa, Homo Sapiens
RVSSIDRRG

SEQ ID NO: 1145187 - protein, 9 aa, Homo Sapiens
CCLDSLDQD

SEQ ID NO: 1145188 - protein, 9 aa, Homo Sapiens
TRFTLEMFN

SEQ ID NO: 1145189 - protein, 9 aa, Homo Sapiens
MQFGYVVLF

SEQ ID NO: 1145190 - protein, 9 aa, Homo Sapiens
APRTVLLLP

SEQ ID NO: 1145191 - protein, 9 aa, Homo Sapiens
RNSQFGFGP

SEQ ID NO: 1145192 - protein, 9 aa, Homo Sapiens
PGQVHRGRR

SEQ ID NO: 1145193 - protein, 9 aa, Homo Sapiens
MQLFFFFLL

SEQ ID NO: 1145194 - protein, 9 aa, Homo Sapiens
TVFDNFFYQ

SEQ ID NO: 1145195 - protein, 9 aa, Homo Sapiens
VLPQQSRLP

SEQ ID NO: 1145196 - protein, 9 aa, Homo Sapiens
SLLSTLSQP

SEQ ID NO: 1145197 - protein, 9 aa, Homo Sapiens
VRVRIPLHS

SEQ ID NO: 1145198 - protein, 9 aa, Homo Sapiens
KIRKTSQVL

SEQ ID NO: 1145199 - protein, 9 aa, Homo Sapiens
LLVFASSGR

SEQ ID NO: 1145200 - protein, 9 aa, Homo Sapiens
HTDHPRAQC

SEQ ID NO: 1145201 - protein, 9 aa, Homo Sapiens
RSPIALHVK

SEQ ID NO: 1145202 - protein, 9 aa, Homo Sapiens
DTHLHGYAL

SEQ ID NO: 1145203 - protein, 9 aa, Homo Sapiens
GEFSVIMWS

SEQ ID NO: 1145204 - protein, 9 aa, Homo Sapiens
QDFEQRESV

SEQ ID NO: 1145205 - protein, 9 aa, Homo Sapiens
WIYGCGGMF

SEQ ID NO: 1145206 - protein, 9 aa, Homo Sapiens
ERNQGSNMF

SEQ ID NO: 1145207 - protein, 9 aa, Homo Sapiens
EDQQKINTF

SEQ ID NO: 1145208 - protein, 9 aa, Homo Sapiens
PAALGTCSI

SEQ ID NO: 1145209 - protein, 9 aa, Homo Sapiens
TSRLSLSQA

SEQ ID NO: 1145210 - protein, 9 aa, Homo Sapiens
VTTDKKVWL

SEQ ID NO: 1145211 - protein, 9 aa, Homo Sapiens
WWWWCCSGW

SEQ ID NO: 1145212 - protein, 9 aa, Homo Sapiens
FLSPGEGLA

SEQ ID NO: 1145213 - protein, 9 aa, Homo Sapiens
PSVESSYSK

SEQ ID NO: 1145214 - protein, 9 aa, Homo Sapiens
PFSSDLGSR

SEQ ID NO: 1145215 - protein, 9 aa, Homo Sapiens
YSYVNILLL

SEQ ID NO: 1145216 - protein, 9 aa, Homo Sapiens
REGSCGFVR

SEQ ID NO: 1145217 - protein, 9 aa, Homo Sapiens
AGGVGAQLM

SEQ ID NO: 1145218 - protein, 9 aa, Homo Sapiens
LWKKAFLVL

SEQ ID NO: 1145219 - protein, 9 aa, Homo Sapiens
SHAASTTYP

SEQ ID NO: 1145220 - protein, 9 aa, Homo Sapiens
DRHGSVSEA

SEQ ID NO: 1145221 - protein, 9 aa, Homo Sapiens
GGVGAQLMA

SEQ ID NO: 1145222 - protein, 9 aa, Homo Sapiens
AGARHHTRE

SEQ ID NO: 1145223 - protein, 9 aa, Homo Sapiens
QVVKFVIKK

SEQ ID NO: 1145224 - protein, 9 aa, Homo Sapiens
HSHKKKIRT

SEQ ID NO: 1145225 - protein, 9 aa, Homo Sapiens
PSSRGMGRR

SEQ ID NO: 1145226 - protein, 9 aa, Homo Sapiens
ASGLKNIPG

SEQ ID NO: 1145227 - protein, 9 aa, Homo Sapiens
RAVIPLKHP

SEQ ID NO: 1145228 - protein, 9 aa, Homo Sapiens
TSPMSDLHL

SEQ ID NO: 1145229 - protein, 9 aa, Homo Sapiens
GVLELSYLG

SEQ ID NO: 1145230 - protein, 9 aa, Homo Sapiens
VKDAKIQDF

SEQ ID NO: 1145231 - protein, 9 aa, Homo Sapiens
QSKRTNGMK

SEQ ID NO: 1145232 - protein, 9 aa, Homo Sapiens
QHMPVSPIS

SEQ ID NO: 1145233 - protein, 9 aa, Homo Sapiens
IRKLKSILP

SEQ ID NO: 1145234 - protein, 9 aa, Homo Sapiens
GLQECRGPR

SEQ ID NO: 1145235 - protein, 9 aa, Homo Sapiens
RDCGAWPPP

SEQ ID NO: 1145236 - protein, 9 aa, Homo Sapiens
SIASAHVST

SEQ ID NO: 1145237 - protein, 9 aa, Homo Sapiens
ASSSKESSW

SEQ ID NO: 1145238 - protein, 9 aa, Homo Sapiens
PLDVPDVPA

SEQ ID NO: 1145239 - protein, 9 aa, Homo Sapiens
SSASVRMVA

SEQ ID NO: 1145240 - protein, 9 aa, Homo Sapiens
IAQGIAGPG

SEQ ID NO: 1145241 - protein, 9 aa, Homo Sapiens
DQQKINTFA

SEQ ID NO: 1145242 - protein, 9 aa, Homo Sapiens
VYIFYRIFA

SEQ ID NO: 1145243 - protein, 9 aa, Homo Sapiens
HVLAAGNAE

SEQ ID NO: 1145244 - protein, 9 aa, Homo Sapiens
RALSFSCSC

SEQ ID NO: 1145245 - protein, 9 aa, Homo Sapiens
HPDLYLESD

SEQ ID NO: 1145246 - protein, 9 aa, Homo Sapiens
AKKRKKSYT

SEQ ID NO: 1145247 - protein, 9 aa, Homo Sapiens
KAAAPSTPK

SEQ ID NO: 1145248 - protein, 9 aa, Homo Sapiens
VMHRVAHHA

SEQ ID NO: 1145249 - protein, 9 aa, Homo Sapiens
AHERPHPIH

SEQ ID NO: 1145250 - protein, 9 aa, Homo Sapiens
LKELSKVQN

SEQ ID NO: 1145251 - protein, 9 aa, Homo Sapiens
HLYSSPYTH

SEQ ID NO: 1145252 - protein, 9 aa, Homo Sapiens
WEMQKEEKN

SEQ ID NO: 1145253 - protein, 9 aa, Homo Sapiens
RYRKPLELF

SEQ ID NO: 1145254 - protein, 9 aa, Homo Sapiens
TRCWACCGT

SEQ ID NO: 1145255 - protein, 9 aa, Homo Sapiens
CIGYGDESD

SEQ ID NO: 1145256 - protein, 9 aa, Homo Sapiens
SAVSCFSTT

SEQ ID NO: 1145257 - protein, 9 aa, Homo Sapiens
AATQEEPEQ

SEQ ID NO: 1145258 - protein, 9 aa, Homo Sapiens
KRKTIDCKD

SEQ ID NO: 1145259 - protein, 9 aa, Homo Sapiens
PACSSREVC

SEQ ID NO: 1145260 - protein, 9 aa, Homo Sapiens
GVFSRMGAT

SEQ ID NO: 1145261 - protein, 9 aa, Homo Sapiens
EMRGPQEIQ

SEQ ID NO: 1145262 - protein, 9 aa, Homo Sapiens
GPLTPLQWN

SEQ ID NO: 1145263 - protein, 9 aa, Homo Sapiens
HNMLKKKEE

SEQ ID NO: 1145264 - protein, 9 aa, Homo Sapiens
NKVSRFPEL

SEQ ID NO: 1145265 - protein, 9 aa, Homo Sapiens
RRRRKRSSQ

SEQ ID NO: 1145266 - protein, 9 aa, Homo Sapiens
YACHHCFTT

SEQ ID NO: 1145267 - protein, 9 aa, Homo Sapiens
LYNEMVDYS

SEQ ID NO: 1145268 - protein, 9 aa, Homo Sapiens
TARQPSRWP

SEQ ID NO: 1145269 - protein, 9 aa, Homo Sapiens
PAQLSQIKQ

SEQ ID NO: 1145270 - protein, 9 aa, Homo Sapiens
GQVGHGVWV

SEQ ID NO: 1145271 - protein, 9 aa, Homo Sapiens
AAMWNPREV

SEQ ID NO: 1145272 - protein, 9 aa, Homo Sapiens
AGATAQIQR

SEQ ID NO: 1145273 - protein, 9 aa, Homo Sapiens
SSSLGSHPG

SEQ ID NO: 1145274 - protein, 9 aa, Homo Sapiens
GPRAGGSRR

SEQ ID NO: 1145275 - protein, 9 aa, Homo Sapiens
SYCKGPRRS

SEQ ID NO: 1145276 - protein, 9 aa, Homo Sapiens
WNPREVQAG

SEQ ID NO: 1145277 - protein, 9 aa, Homo Sapiens
SDCTEIIIV

SEQ ID NO: 1145278 - protein, 9 aa, Homo Sapiens
TQGGRRARR

SEQ ID NO: 1145279 - protein, 9 aa, Homo Sapiens
CPGEPGAKS

SEQ ID NO: 1145280 - protein, 9 aa, Homo Sapiens
DTITESSLD

SEQ ID NO: 1145281 - protein, 9 aa, Homo Sapiens
PNEEVVRFY

SEQ ID NO: 1145282 - protein, 9 aa, Homo Sapiens
RRPRPRRAW

SEQ ID NO: 1145283 - protein, 9 aa, Homo Sapiens
AALKRHFTV

SEQ ID NO: 1145284 - protein, 9 aa, Homo Sapiens
LLRPRGGAW

SEQ ID NO: 1145285 - protein, 9 aa, Homo Sapiens
LVLQGDPRE

SEQ ID NO: 1145286 - protein, 9 aa, Homo Sapiens
YTHACCHAS

SEQ ID NO: 1145287 - protein, 9 aa, Homo Sapiens
ENQHTTSIQ

SEQ ID NO: 1145288 - protein, 9 aa, Homo Sapiens
SRQEKPPTA

SEQ ID NO: 1145289 - protein, 9 aa, Homo Sapiens
CEPARAARA

SEQ ID NO: 1145290 - protein, 9 aa, Homo Sapiens
HSHLCTHPG

SEQ ID NO: 1145291 - protein, 9 aa, Homo Sapiens
APSMPACAR

SEQ ID NO: 1145292 - protein, 9 aa, Homo Sapiens
TRMAGRRST

SEQ ID NO: 1145293 - protein, 9 aa, Homo Sapiens
SQYPKKLNH

SEQ ID NO: 1145294 - protein, 9 aa, Homo Sapiens
SACSAGGDA

SEQ ID NO: 1145295 - protein, 9 aa, Homo Sapiens
LSITNVINL

SEQ ID NO: 1145296 - protein, 9 aa, Homo Sapiens
LSPGATLTS

SEQ ID NO: 1145297 - protein, 9 aa, Homo Sapiens
PACRRRPAG

SEQ ID NO: 1145298 - protein, 9 aa, Homo Sapiens
WFLGQYLAP

SEQ ID NO: 1145299 - protein, 9 aa, Homo Sapiens
SPVNEEAKS

SEQ ID NO: 1145300 - protein, 9 aa, Homo Sapiens
TLRCPAVPA

SEQ ID NO: 1145301 - protein, 9 aa, Homo Sapiens
VRYALNHPD

SEQ ID NO: 1145302 - protein, 9 aa, Homo Sapiens
STPEKTDMM

SEQ ID NO: 1145303 - protein, 9 aa, Homo Sapiens
FLFTDARVA

SEQ ID NO: 1145304 - protein, 9 aa, Homo Sapiens
RSTRPAALG

SEQ ID NO: 1145305 - protein, 9 aa, Homo Sapiens
GRKDRWSVR

SEQ ID NO: 1145306 - protein, 9 aa, Homo Sapiens
DQVLHRLTV

SEQ ID NO: 1145307 - protein, 9 aa, Homo Sapiens
TPLTPVTQG

SEQ ID NO: 1145308 - protein, 9 aa, Homo Sapiens
TPRPSGLSC

SEQ ID NO: 1145309 - protein, 9 aa, Homo Sapiens
SHPNPTQPS

SEQ ID NO: 1145310 - protein, 9 aa, Homo Sapiens
EGHEYYRVH

SEQ ID NO: 1145311 - protein, 9 aa, Homo Sapiens
LKADMLGDD

SEQ ID NO: 1145312 - protein, 9 aa, Homo Sapiens
LNIIKHLNG

SEQ ID NO: 1145313 - protein, 9 aa, Homo Sapiens
QAPGRSPGG

SEQ ID NO: 1145314 - protein, 9 aa, Homo Sapiens
RPAERAVLG

SEQ ID NO: 1145315 - protein, 9 aa, Homo Sapiens
ARARVPCAG

SEQ ID NO: 1145316 - protein, 9 aa, Homo Sapiens
GLLWWWWWC

SEQ ID NO: 1145317 - protein, 9 aa, Homo Sapiens
AARSSAQAY

SEQ ID NO: 1145318 - protein, 9 aa, Homo Sapiens
CAHAHSNPI

SEQ ID NO: 1145319 - protein, 9 aa, Homo Sapiens
HVLGAQVFA

SEQ ID NO: 1145320 - protein, 9 aa, Homo Sapiens
HTREIFVLF

SEQ ID NO: 1145321 - protein, 9 aa, Homo Sapiens
ASEVGGGGR

SEQ ID NO: 1145322 - protein, 9 aa, Homo Sapiens
TFHLDEDVS

SEQ ID NO: 1145323 - protein, 9 aa, Homo Sapiens
ADAAILSAQ

SEQ ID NO: 1145324 - protein, 9 aa, Homo Sapiens
VITPKKAEH

SEQ ID NO: 1145325 - protein, 9 aa, Homo Sapiens
AFYEFTFRK

SEQ ID NO: 1145326 - protein, 9 aa, Homo Sapiens
SCHSHLCTH

SEQ ID NO: 1145327 - protein, 9 aa, Homo Sapiens
EPEQLPELE

SEQ ID NO: 1145328 - protein, 9 aa, Homo Sapiens
AHNGAGWGP

SEQ ID NO: 1145329 - protein, 9 aa, Homo Sapiens
SRGDNPTPQ

SEQ ID NO: 1145330 - protein, 9 aa, Homo Sapiens
STGAWTAEG

SEQ ID NO: 1145331 - protein, 9 aa, Homo Sapiens
SRVSSAKRN

SEQ ID NO: 1145332 - protein, 9 aa, Homo Sapiens
VTDRVTDNM

SEQ ID NO: 1145333 - protein, 9 aa, Homo Sapiens
RVTVTDTWV

SEQ ID NO: 1145334 - protein, 9 aa, Homo Sapiens
LDEKRCLEA

SEQ ID NO: 1145335 - protein, 9 aa, Homo Sapiens
NQIRKLKSI

SEQ ID NO: 1145336 - protein, 9 aa, Homo Sapiens
TNTKLSLDV

SEQ ID NO: 1145337 - protein, 9 aa, Homo Sapiens
GFRGYGYRS

SEQ ID NO: 1145338 - protein, 9 aa, Homo Sapiens
SGASASTSL

SEQ ID NO: 1145339 - protein, 9 aa, Homo Sapiens
PKKRERMML

SEQ ID NO: 1145340 - protein, 9 aa, Homo Sapiens
RRRKRSSQS

SEQ ID NO: 1145341 - protein, 9 aa, Homo Sapiens
VLSPRVTSD

SEQ ID NO: 1145342 - protein, 9 aa, Homo Sapiens
TLIPSHPNP

SEQ ID NO: 1145343 - protein, 9 aa, Homo Sapiens
ALLPRSPAL

SEQ ID NO: 1145344 - protein, 9 aa, Homo Sapiens
IVPAQRIPR

SEQ ID NO: 1145345 - protein, 9 aa, Homo Sapiens
MYVTVKWNY

SEQ ID NO: 1145346 - protein, 9 aa, Homo Sapiens
ERIGGPPSA

SEQ ID NO: 1145347 - protein, 9 aa, Homo Sapiens
NHLDGFDSR

SEQ ID NO: 1145348 - protein, 9 aa, Homo Sapiens
PGNSATTTC

SEQ ID NO: 1145349 - protein, 9 aa, Homo Sapiens
YSCVGVFQR

SEQ ID NO: 1145350 - protein, 9 aa, Homo Sapiens
NGIYPPMNF

SEQ ID NO: 1145351 - protein, 9 aa, Homo Sapiens
DHSRKVDVQ

SEQ ID NO: 1145352 - protein, 9 aa, Homo Sapiens
GRRSAAGDG

SEQ ID NO: 1145353 - protein, 9 aa, Homo Sapiens
VAVVARKLD

SEQ ID NO: 1145354 - protein, 9 aa, Homo Sapiens
PIPHLSPWD

SEQ ID NO: 1145355 - protein, 9 aa, Homo Sapiens
PLKLCPAAK

SEQ ID NO: 1145356 - protein, 9 aa, Homo Sapiens
LRALALRLG

SEQ ID NO: 1145357 - protein, 9 aa, Homo Sapiens
LTVGKSHLL

SEQ ID NO: 1145358 - protein, 9 aa, Homo Sapiens
YCTQYRGEV

SEQ ID NO: 1145359 - protein, 9 aa, Homo Sapiens
FKINPWSGL

SEQ ID NO: 1145360 - protein, 9 aa, Homo Sapiens
QCRQRECSS

SEQ ID NO: 1145361 - protein, 9 aa, Homo Sapiens
TWDPTYLST

SEQ ID NO: 1145362 - protein, 9 aa, Homo Sapiens
GRGGGALLC

SEQ ID NO: 1145363 - protein, 9 aa, Homo Sapiens
EIQLTMNDS

SEQ ID NO: 1145364 - protein, 9 aa, Homo Sapiens
MKGRKDRWS

SEQ ID NO: 1145365 - protein, 9 aa, Homo Sapiens
AVASRAATK

SEQ ID NO: 1145366 - protein, 9 aa, Homo Sapiens
AILIMGEAF

SEQ ID NO: 1145367 - protein, 9 aa, Homo Sapiens
WVVFNEKIK

SEQ ID NO: 1145368 - protein, 9 aa, Homo Sapiens
EALRLLCQP

SEQ ID NO: 1145369 - protein, 9 aa, Homo Sapiens
WIRSVAEKG

SEQ ID NO: 1145370 - protein, 9 aa, Homo Sapiens
DTCRAPSQT

SEQ ID NO: 1145371 - protein, 9 aa, Homo Sapiens
HVTLQVPRG

SEQ ID NO: 1145372 - protein, 9 aa, Homo Sapiens
YSTPLWQTS

SEQ ID NO: 1145373 - protein, 9 aa, Homo Sapiens
TTTARQPSR

SEQ ID NO: 1145374 - protein, 9 aa, Homo Sapiens
VGVVEDGEL

SEQ ID NO: 1145375 - protein, 9 aa, Homo Sapiens
RPRGGAWKS

SEQ ID NO: 1145376 - protein, 9 aa, Homo Sapiens
DNKGYCTQY

SEQ ID NO: 1145377 - protein, 9 aa, Homo Sapiens
TKLINDRHG

SEQ ID NO: 1145378 - protein, 9 aa, Homo Sapiens
WISLPRYWT

SEQ ID NO: 1145379 - protein, 9 aa, Homo Sapiens
AAAPSTPKE

SEQ ID NO: 1145380 - protein, 9 aa, Homo Sapiens
PMHFFLSQL

SEQ ID NO: 1145381 - protein, 9 aa, Homo Sapiens
RVCGEPLQV

SEQ ID NO: 1145382 - protein, 9 aa, Homo Sapiens
AKIIHHPKY

SEQ ID NO: 1145383 - protein, 9 aa, Homo Sapiens
CSTPCPLLP

SEQ ID NO: 1145384 - protein, 9 aa, Homo Sapiens
DVAALLMEG

SEQ ID NO: 1145385 - protein, 9 aa, Homo Sapiens
KEPAGARLA

SEQ ID NO: 1145386 - protein, 9 aa, Homo Sapiens
QEMVITVDA

SEQ ID NO: 1145387 - protein, 9 aa, Homo Sapiens
DPLTHLSMM

SEQ ID NO: 1145388 - protein, 9 aa, Homo Sapiens
SAPTSGLQE

SEQ ID NO: 1145389 - protein, 9 aa, Homo Sapiens
SCRILLGVM

SEQ ID NO: 1145390 - protein, 9 aa, Homo Sapiens
QGNPNEEVV

SEQ ID NO: 1145391 - protein, 9 aa, Homo Sapiens
VVGAGDVGK

SEQ ID NO: 1145392 - protein, 9 aa, Homo Sapiens
QGPLFLLFF

SEQ ID NO: 1145393 - protein, 9 aa, Homo Sapiens
RPGWAALQR

SEQ ID NO: 1145394 - protein, 9 aa, Homo Sapiens
IGQGLVGMT

SEQ ID NO: 1145395 - protein, 9 aa, Homo Sapiens
VPDDKSDDL

SEQ ID NO: 1145396 - protein, 9 aa, Homo Sapiens
WRRWTSSGS

SEQ ID NO: 1145397 - protein, 9 aa, Homo Sapiens
AMRKGHNML

SEQ ID NO: 1145398 - protein, 9 aa, Homo Sapiens
AGVTANRFQ

SEQ ID NO: 1145399 - protein, 9 aa, Homo Sapiens
ELRHVEEEK

SEQ ID NO: 1145400 - protein, 9 aa, Homo Sapiens
SALFIWPQH

SEQ ID NO: 1145401 - protein, 9 aa, Homo Sapiens
PLEVARGKR

SEQ ID NO: 1145402 - protein, 9 aa, Homo Sapiens
QTPRHPLQS

SEQ ID NO: 1145403 - protein, 9 aa, Homo Sapiens
RLQRGLPGN

SEQ ID NO: 1145404 - protein, 9 aa, Homo Sapiens
LGFPKRFIN

SEQ ID NO: 1145405 - protein, 9 aa, Homo Sapiens
GCGGMFFFV

SEQ ID NO: 1145406 - protein, 9 aa, Homo Sapiens
LGADAAILS

SEQ ID NO: 1145407 - protein, 9 aa, Homo Sapiens
QNMFAWQIK

SEQ ID NO: 1145408 - protein, 9 aa, Homo Sapiens
DWSWMVVNH

SEQ ID NO: 1145409 - protein, 9 aa, Homo Sapiens
YGSGFRGYG

SEQ ID NO: 1145410 - protein, 9 aa, Homo Sapiens
EYAEFLHCR

SEQ ID NO: 1145411 - protein, 9 aa, Homo Sapiens
TPFLVHKMF

SEQ ID NO: 1145412 - protein, 9 aa, Homo Sapiens
AQLQCNKHS

SEQ ID NO: 1145413 - protein, 9 aa, Homo Sapiens
RMGATPETD

SEQ ID NO: 1145414 - protein, 9 aa, Homo Sapiens
SGGDWLAPV

SEQ ID NO: 1145415 - protein, 9 aa, Homo Sapiens
QPIVKKGEE

SEQ ID NO: 1145416 - protein, 9 aa, Homo Sapiens
GKSHLLEFQ

SEQ ID NO: 1145417 - protein, 9 aa, Homo Sapiens
GPQPCNVAD

SEQ ID NO: 1145418 - protein, 9 aa, Homo Sapiens
LEEPAGPKS

SEQ ID NO: 1145419 - protein, 9 aa, Homo Sapiens
GRVRRSRRC

SEQ ID NO: 1145420 - protein, 9 aa, Homo Sapiens
RLAPRPAGT

SEQ ID NO: 1145421 - protein, 9 aa, Homo Sapiens
SFFLNVGRR

SEQ ID NO: 1145422 - protein, 9 aa, Homo Sapiens
SGVRAGGAE

SEQ ID NO: 1145423 - protein, 9 aa, Homo Sapiens
PNQVISLES

SEQ ID NO: 1145424 - protein, 9 aa, Homo Sapiens
YNKVVKVQL

SEQ ID NO: 1145425 - protein, 9 aa, Homo Sapiens
AVLVHLIDH

SEQ ID NO: 1145426 - protein, 9 aa, Homo Sapiens
RLLSLWFLD

SEQ ID NO: 1145427 - protein, 9 aa, Homo Sapiens
GWSAMPGGS

SEQ ID NO: 1145428 - protein, 9 aa, Homo Sapiens
HTPTTPTTP

SEQ ID NO: 1145429 - protein, 9 aa, Homo Sapiens
PSKSYSPGM

SEQ ID NO: 1145430 - protein, 9 aa, Homo Sapiens
PEKAKSPVN

SEQ ID NO: 1145431 - protein, 9 aa, Homo Sapiens
SPESQLVCI

SEQ ID NO: 1145432 - protein, 9 aa, Homo Sapiens
RAPVRAWRT

SEQ ID NO: 1145433 - protein, 9 aa, Homo Sapiens
ELLWPPLPG

SEQ ID NO: 1145434 - protein, 9 aa, Homo Sapiens
GIRCVIANQ

SEQ ID NO: 1145435 - protein, 9 aa, Homo Sapiens
RYWLHYLRP

SEQ ID NO: 1145436 - protein, 9 aa, Homo Sapiens
RLRSSGKKI

SEQ ID NO: 1145437 - protein, 9 aa, Homo Sapiens
QGFRGSFAT

SEQ ID NO: 1145438 - protein, 9 aa, Homo Sapiens
RGGRPSAPV

SEQ ID NO: 1145439 - protein, 9 aa, Homo Sapiens
AFAKAIYEH

SEQ ID NO: 1145440 - protein, 9 aa, Homo Sapiens
ADTADISQR

SEQ ID NO: 1145441 - protein, 9 aa, Homo Sapiens
PRTPRGTQP

SEQ ID NO: 1145442 - protein, 9 aa, Homo Sapiens
LQGKLGPKE

SEQ ID NO: 1145443 - protein, 9 aa, Homo Sapiens
VTTYNRDSF

SEQ ID NO: 1145444 - protein, 9 aa, Homo Sapiens
IGESRAVEE

SEQ ID NO: 1145445 - protein, 9 aa, Homo Sapiens
KRHFTVNMS

SEQ ID NO: 1145446 - protein, 9 aa, Homo Sapiens
KDAVPFVPP

SEQ ID NO: 1145447 - protein, 9 aa, Homo Sapiens
PGSSHLPTL

SEQ ID NO: 1145448 - protein, 9 aa, Homo Sapiens
PLEEKGPLA

SEQ ID NO: 1145449 - protein, 9 aa, Homo Sapiens
QEGSNPQGP

SEQ ID NO: 1145450 - protein, 9 aa, Homo Sapiens
ICLAVLWVA

SEQ ID NO: 1145451 - protein, 9 aa, Homo Sapiens
LKVFSRDGL

SEQ ID NO: 1145452 - protein, 9 aa, Homo Sapiens
TSSGSTTRA

SEQ ID NO: 1145453 - protein, 9 aa, Homo Sapiens
SECEKDQRL

SEQ ID NO: 1145454 - protein, 9 aa, Homo Sapiens
MAAAASGLS

SEQ ID NO: 1145455 - protein, 9 aa, Homo Sapiens
RILQLSLST

SEQ ID NO: 1145456 - protein, 9 aa, Homo Sapiens
HPTGPQISV

SEQ ID NO: 1145457 - protein, 9 aa, Homo Sapiens
MQKPKLMLL

SEQ ID NO: 1145458 - protein, 9 aa, Homo Sapiens
PLLSGARGR

SEQ ID NO: 1145459 - protein, 9 aa, Homo Sapiens
YRYGPASVQ

SEQ ID NO: 1145460 - protein, 9 aa, Homo Sapiens
AISIFVKHA

SEQ ID NO: 1145461 - protein, 9 aa, Homo Sapiens
VSGLCRYGG

SEQ ID NO: 1145462 - protein, 9 aa, Homo Sapiens
RPRKDEKKQ

SEQ ID NO: 1145463 - protein, 9 aa, Homo Sapiens
LQAYIARCQ

SEQ ID NO: 1145464 - protein, 9 aa, Homo Sapiens
LQLLRGGVL

SEQ ID NO: 1145465 - protein, 9 aa, Homo Sapiens
GAMLLSITN

SEQ ID NO: 1145466 - protein, 9 aa, Homo Sapiens
PSLWGRAWQ

SEQ ID NO: 1145467 - protein, 9 aa, Homo Sapiens
STPNTGPAA

SEQ ID NO: 1145468 - protein, 9 aa, Homo Sapiens
LVSGGDEVS

SEQ ID NO: 1145469 - protein, 9 aa, Homo Sapiens
PKNTLMQLN

SEQ ID NO: 1145470 - protein, 9 aa, Homo Sapiens
HKDFFILAL

SEQ ID NO: 1145471 - protein, 9 aa, Homo Sapiens
MLTVIGQGL

SEQ ID NO: 1145472 - protein, 9 aa, Homo Sapiens
TECDHAQPL

SEQ ID NO: 1145473 - protein, 9 aa, Homo Sapiens
GCLLHIARL

SEQ ID NO: 1145474 - protein, 9 aa, Homo Sapiens
AGPVRHHTA

SEQ ID NO: 1145475 - protein, 9 aa, Homo Sapiens
WVISELQEA

SEQ ID NO: 1145476 - protein, 9 aa, Homo Sapiens
CPPARPDQS

SEQ ID NO: 1145477 - protein, 9 aa, Homo Sapiens
SAKHPQMVF

SEQ ID NO: 1145478 - protein, 9 aa, Homo Sapiens
ASPPTQQPQ

SEQ ID NO: 1145479 - protein, 9 aa, Homo Sapiens
SCPGGATAA

SEQ ID NO: 1145480 - protein, 9 aa, Homo Sapiens
LGGMECTVR

SEQ ID NO: 1145481 - protein, 9 aa, Homo Sapiens
AKEGCESVM

SEQ ID NO: 1145482 - protein, 9 aa, Homo Sapiens
SATTRRPLP

SEQ ID NO: 1145483 - protein, 9 aa, Homo Sapiens
DTVHMQPIP

SEQ ID NO: 1145484 - protein, 9 aa, Homo Sapiens
EKAKSPVNE

SEQ ID NO: 1145485 - protein, 9 aa, Homo Sapiens
PPVGAGTGG

SEQ ID NO: 1145486 - protein, 9 aa, Homo Sapiens
ALLLLCYPN

SEQ ID NO: 1145487 - protein, 9 aa, Homo Sapiens
LLASARDKR

SEQ ID NO: 1145488 - protein, 9 aa, Homo Sapiens
RHFTVNMSK

SEQ ID NO: 1145489 - protein, 9 aa, Homo Sapiens
LLVLQLRAP

SEQ ID NO: 1145490 - protein, 9 aa, Homo Sapiens
GPWNTGLVA

SEQ ID NO: 1145491 - protein, 9 aa, Homo Sapiens
KGRKDRWSV

SEQ ID NO: 1145492 - protein, 9 aa, Homo Sapiens
PCPPLEVHL

SEQ ID NO: 1145493 - protein, 9 aa, Homo Sapiens
EETAPSLLL

SEQ ID NO: 1145494 - protein, 9 aa, Homo Sapiens
AQRESGSGP

SEQ ID NO: 1145495 - protein, 9 aa, Homo Sapiens
CPAAKQVSP

SEQ ID NO: 1145496 - protein, 9 aa, Homo Sapiens
GLWMPPYTP

SEQ ID NO: 1145497 - protein, 9 aa, Homo Sapiens
QSLETKLRD

SEQ ID NO: 1145498 - protein, 9 aa, Homo Sapiens
LQVLKKILR

SEQ ID NO: 1145499 - protein, 9 aa, Homo Sapiens
SFPGSSHLP

SEQ ID NO: 1145500 - protein, 9 aa, Homo Sapiens
KGRTCEMVV

SEQ ID NO: 1145501 - protein, 9 aa, Homo Sapiens
KNVRRKKMR

SEQ ID NO: 1145502 - protein, 9 aa, Homo Sapiens
RFPARAPLL

SEQ ID NO: 1145503 - protein, 9 aa, Homo Sapiens
MAPERITPE

SEQ ID NO: 1145504 - protein, 9 aa, Homo Sapiens
HIGCTQTMV

SEQ ID NO: 1145505 - protein, 9 aa, Homo Sapiens
QATRKHIII

SEQ ID NO: 1145506 - protein, 9 aa, Homo Sapiens
LCYPNVVPS

SEQ ID NO: 1145507 - protein, 9 aa, Homo Sapiens
VVGGASNAG

SEQ ID NO: 1145508 - protein, 9 aa, Homo Sapiens
LLACGVVQG

SEQ ID NO: 1145509 - protein, 9 aa, Homo Sapiens
SKELPGKPW

SEQ ID NO: 1145510 - protein, 9 aa, Homo Sapiens
ERTAKKSRW

SEQ ID NO: 1145511 - protein, 9 aa, Homo Sapiens
SGPQKGDPR

SEQ ID NO: 1145512 - protein, 9 aa, Homo Sapiens
GQDHQVPLW

SEQ ID NO: 1145513 - protein, 9 aa, Homo Sapiens
DAMLKRLVS

SEQ ID NO: 1145514 - protein, 9 aa, Homo Sapiens
TTCPTRWAA

SEQ ID NO: 1145515 - protein, 9 aa, Homo Sapiens
WSPCDRSWL

SEQ ID NO: 1145516 - protein, 9 aa, Homo Sapiens
KGERQNRAA

SEQ ID NO: 1145517 - protein, 9 aa, Homo Sapiens
LKKYYLLNP

SEQ ID NO: 1145518 - protein, 9 aa, Homo Sapiens
EDRNAHLGE

SEQ ID NO: 1145519 - protein, 9 aa, Homo Sapiens
NKGYCTQYR

SEQ ID NO: 1145520 - protein, 9 aa, Homo Sapiens
FGEQPTGDP

SEQ ID NO: 1145521 - protein, 9 aa, Homo Sapiens
FLRNVTWAI

SEQ ID NO: 1145522 - protein, 9 aa, Homo Sapiens
TTLSWGSPT

SEQ ID NO: 1145523 - protein, 9 aa, Homo Sapiens
TFEKKRGKN

SEQ ID NO: 1145524 - protein, 9 aa, Homo Sapiens
ADMLGDDGS

SEQ ID NO: 1145525 - protein, 9 aa, Homo Sapiens
GITWAGAGP

SEQ ID NO: 1145526 - protein, 9 aa, Homo Sapiens
LARPGAVES

SEQ ID NO: 1145527 - protein, 9 aa, Homo Sapiens
ECSSLCPYP

SEQ ID NO: 1145528 - protein, 9 aa, Homo Sapiens
PEGARCLCV

SEQ ID NO: 1145529 - protein, 9 aa, Homo Sapiens
AGDMSKKSP

SEQ ID NO: 1145530 - protein, 9 aa, Homo Sapiens
ASCHSHLCT

SEQ ID NO: 1145531 - protein, 9 aa, Homo Sapiens
GKYNFTSSF

SEQ ID NO: 1145532 - protein, 9 aa, Homo Sapiens
ATRKHIIIP

SEQ ID NO: 1145533 - protein, 9 aa, Homo Sapiens
RGPQEIQGM

SEQ ID NO: 1145534 - protein, 9 aa, Homo Sapiens
LYLESDEVA

SEQ ID NO: 1145535 - protein, 9 aa, Homo Sapiens
GSAPSMPAC

SEQ ID NO: 1145536 - protein, 9 aa, Homo Sapiens
TGCSVEFEE

SEQ ID NO: 1145537 - protein, 9 aa, Homo Sapiens
GVQGSLAYA

SEQ ID NO: 1145538 - protein, 9 aa, Homo Sapiens
SKAPEETPQ

SEQ ID NO: 1145539 - protein, 9 aa, Homo Sapiens
FSREQCRKM

SEQ ID NO: 1145540 - protein, 9 aa, Homo Sapiens
SSMSLATSS

SEQ ID NO: 1145541 - protein, 9 aa, Homo Sapiens
GTRPKPPHH

SEQ ID NO: 1145542 - protein, 9 aa, Homo Sapiens
LGTQAGPWN

SEQ ID NO: 1145543 - protein, 9 aa, Homo Sapiens
GRLTDGKRK

SEQ ID NO: 1145544 - protein, 9 aa, Homo Sapiens
HQATRKHII

SEQ ID NO: 1145545 - protein, 9 aa, Homo Sapiens
YKVSTRSSI

SEQ ID NO: 1145546 - protein, 9 aa, Homo Sapiens
LELSYLGSA

SEQ ID NO: 1145547 - protein, 9 aa, Homo Sapiens
TEEKKYSSL

SEQ ID NO: 1145548 - protein, 9 aa, Homo Sapiens
GSRSGGRSR

SEQ ID NO: 1145549 - protein, 9 aa, Homo Sapiens
HLDEYASIV

SEQ ID NO: 1145550 - protein, 9 aa, Homo Sapiens
VFFFMCCTS

SEQ ID NO: 1145551 - protein, 9 aa, Homo Sapiens
ESRTQSPGT

SEQ ID NO: 1145552 - protein, 9 aa, Homo Sapiens
SHPGSCAPF

SEQ ID NO: 1145553 - protein, 9 aa, Homo Sapiens
DELYHGLEG

SEQ ID NO: 1145554 - protein, 9 aa, Homo Sapiens
RDANLPKTS

SEQ ID NO: 1145555 - protein, 9 aa, Homo Sapiens
DYHGLMERY

SEQ ID NO: 1145556 - protein, 9 aa, Homo Sapiens
KNFTDTSHV

SEQ ID NO: 1145557 - protein, 9 aa, Homo Sapiens
AQLPGQVHR

SEQ ID NO: 1145558 - protein, 9 aa, Homo Sapiens
ADYNTLVDK

SEQ ID NO: 1145559 - protein, 9 aa, Homo Sapiens
FTVNMSKVE

SEQ ID NO: 1145560 - protein, 9 aa, Homo Sapiens
YIDNLEKNS

SEQ ID NO: 1145561 - protein, 9 aa, Homo Sapiens
FYLQLWAPL

SEQ ID NO: 1145562 - protein, 9 aa, Homo Sapiens
FGKDAASLL

SEQ ID NO: 1145563 - protein, 9 aa, Homo Sapiens
TYDSTHSML

SEQ ID NO: 1145564 - protein, 9 aa, Homo Sapiens
FMKLYHSLV

SEQ ID NO: 1145565 - protein, 9 aa, Homo Sapiens
CRGFTFQCA

SEQ ID NO: 1145566 - protein, 9 aa, Homo Sapiens
SQTPMAALV

SEQ ID NO: 1145567 - protein, 9 aa, Homo Sapiens
FTLIPLLLI

SEQ ID NO: 1145568 - protein, 9 aa, Homo Sapiens
KVQSDSSPS

SEQ ID NO: 1145569 - protein, 9 aa, Homo Sapiens
TGADGRPPR

SEQ ID NO: 1145570 - protein, 9 aa, Homo Sapiens
RQRECSSLC

SEQ ID NO: 1145571 - protein, 9 aa, Homo Sapiens
SLHQATRKH

SEQ ID NO: 1145572 - protein, 9 aa, Homo Sapiens
FFFILVPRL

SEQ ID NO: 1145573 - protein, 9 aa, Homo Sapiens
ALKQVSPAS

SEQ ID NO: 1145574 - protein, 9 aa, Homo Sapiens
SRKGQKKIR

SEQ ID NO: 1145575 - protein, 9 aa, Homo Sapiens
QTMSCTMAS

SEQ ID NO: 1145576 - protein, 9 aa, Homo Sapiens
LWAPLKTRD

SEQ ID NO: 1145577 - protein, 9 aa, Homo Sapiens
WACCGTRRS

SEQ ID NO: 1145578 - protein, 9 aa, Homo Sapiens
MELQASAAF

SEQ ID NO: 1145579 - protein, 9 aa, Homo Sapiens
IPPQPSLPG

SEQ ID NO: 1145580 - protein, 9 aa, Homo Sapiens
MSYLEEQRI

SEQ ID NO: 1145581 - protein, 9 aa, Homo Sapiens
ELDALKKPL

SEQ ID NO: 1145582 - protein, 9 aa, Homo Sapiens
IISSDVIST

SEQ ID NO: 1145583 - protein, 9 aa, Homo Sapiens
SPGAHLPLP

SEQ ID NO: 1145584 - protein, 9 aa, Homo Sapiens
APGRPGGGQ

SEQ ID NO: 1145585 - protein, 9 aa, Homo Sapiens
EQVHKDESV

SEQ ID NO: 1145586 - protein, 9 aa, Homo Sapiens
ALITSNIRE

SEQ ID NO: 1145587 - protein, 9 aa, Homo Sapiens
NLPHSNDAC

SEQ ID NO: 1145588 - protein, 9 aa, Homo Sapiens
QALGSRSGG

SEQ ID NO: 1145589 - protein, 9 aa, Homo Sapiens
QVHGIYFNI

SEQ ID NO: 1145590 - protein, 9 aa, Homo Sapiens
KIAFHIKSI

SEQ ID NO: 1145591 - protein, 9 aa, Homo Sapiens
AASGGPESR

SEQ ID NO: 1145592 - protein, 9 aa, Homo Sapiens
SVMGMVNYS

SEQ ID NO: 1145593 - protein, 9 aa, Homo Sapiens
FPHSQYPQY

SEQ ID NO: 1145594 - protein, 9 aa, Homo Sapiens
QSLVLVIED

SEQ ID NO: 1145595 - protein, 9 aa, Homo Sapiens
PGKMKGRKD

SEQ ID NO: 1145596 - protein, 9 aa, Homo Sapiens
NLLQVWEPP

SEQ ID NO: 1145597 - protein, 9 aa, Homo Sapiens
LESGHYTRF

SEQ ID NO: 1145598 - protein, 9 aa, Homo Sapiens
IHHPKYNRD

SEQ ID NO: 1145599 - protein, 9 aa, Homo Sapiens
RPARPAATT

SEQ ID NO: 1145600 - protein, 9 aa, Homo Sapiens
EPITLPGGL

SEQ ID NO: 1145601 - protein, 9 aa, Homo Sapiens
SELPATTAF

SEQ ID NO: 1145602 - protein, 9 aa, Homo Sapiens
QKKIRKTSQ

SEQ ID NO: 1145603 - protein, 9 aa, Homo Sapiens
TDMMPSTTS

SEQ ID NO: 1145604 - protein, 9 aa, Homo Sapiens
LSQIKQTSL

SEQ ID NO: 1145605 - protein, 9 aa, Homo Sapiens
CTGSPQTPP

SEQ ID NO: 1145606 - protein, 9 aa, Homo Sapiens
LLTSITFLG

SEQ ID NO: 1145607 - protein, 9 aa, Homo Sapiens
RSFRGSGPG

SEQ ID NO: 1145608 - protein, 9 aa, Homo Sapiens
GKLGPKEEV

SEQ ID NO: 1145609 - protein, 9 aa, Homo Sapiens
RYVPLTPWF

SEQ ID NO: 1145610 - protein, 9 aa, Homo Sapiens
GPLAELVVG

SEQ ID NO: 1145611 - protein, 9 aa, Homo Sapiens
GSGKTESTH

SEQ ID NO: 1145612 - protein, 9 aa, Homo Sapiens
QMLHKVDKA

SEQ ID NO: 1145613 - protein, 9 aa, Homo Sapiens
TTTCPTRWA

SEQ ID NO: 1145614 - protein, 9 aa, Homo Sapiens
HCGSRLKIL

SEQ ID NO: 1145615 - protein, 9 aa, Homo Sapiens
TLASAHVGV

SEQ ID NO: 1145616 - protein, 9 aa, Homo Sapiens
PGIRGALTT

SEQ ID NO: 1145617 - protein, 9 aa, Homo Sapiens
TYERVEERF

SEQ ID NO: 1145618 - protein, 9 aa, Homo Sapiens
YNTLVDKLN

SEQ ID NO: 1145619 - protein, 9 aa, Homo Sapiens
SLSAATQAI

SEQ ID NO: 1145620 - protein, 9 aa, Homo Sapiens
RKLDLTKAE

SEQ ID NO: 1145621 - protein, 9 aa, Homo Sapiens
EGLATEGGG

SEQ ID NO: 1145622 - protein, 9 aa, Homo Sapiens
KLQADGNGD

SEQ ID NO: 1145623 - protein, 9 aa, Homo Sapiens
PDEESVVIY

SEQ ID NO: 1145624 - protein, 9 aa, Homo Sapiens
KFLSLVLQG

SEQ ID NO: 1145625 - protein, 9 aa, Homo Sapiens
DTSHVPRGH

SEQ ID NO: 1145626 - protein, 9 aa, Homo Sapiens
TKTRMLYHS

SEQ ID NO: 1145627 - protein, 9 aa, Homo Sapiens
LDENKDGKI

SEQ ID NO: 1145628 - protein, 9 aa, Homo Sapiens
QQEPLPRGS

SEQ ID NO: 1145629 - protein, 9 aa, Homo Sapiens
RMGRRCSSW

SEQ ID NO: 1145630 - protein, 9 aa, Homo Sapiens
HTCEKPYHC

SEQ ID NO: 1145631 - protein, 9 aa, Homo Sapiens
SAPWRHQSH

SEQ ID NO: 1145632 - protein, 9 aa, Homo Sapiens
RAARAFSRE

SEQ ID NO: 1145633 - protein, 9 aa, Homo Sapiens
KAHNGAGWG

SEQ ID NO: 1145634 - protein, 9 aa, Homo Sapiens
KTETVEEQL

SEQ ID NO: 1145635 - protein, 9 aa, Homo Sapiens
QLMAPLSPG

SEQ ID NO: 1145636 - protein, 9 aa, Homo Sapiens
VPLTPWFLM

SEQ ID NO: 1145637 - protein, 9 aa, Homo Sapiens
SPRRSPALR

SEQ ID NO: 1145638 - protein, 9 aa, Homo Sapiens
TSGPSGPDN

SEQ ID NO: 1145639 - protein, 9 aa, Homo Sapiens
VPAQRIPRQ

SEQ ID NO: 1145640 - protein, 9 aa, Homo Sapiens
SPLLRPRGG

SEQ ID NO: 1145641 - protein, 9 aa, Homo Sapiens
SLVLQGDPR

SEQ ID NO: 1145642 - protein, 9 aa, Homo Sapiens
EPGDPVELV

SEQ ID NO: 1145643 - protein, 9 aa, Homo Sapiens
AHSRQRQDP

SEQ ID NO: 1145644 - protein, 9 aa, Homo Sapiens
PSAVSCFST

SEQ ID NO: 1145645 - protein, 9 aa, Homo Sapiens
LWGRAWQYL

SEQ ID NO: 1145646 - protein, 9 aa, Homo Sapiens
KLGPKEEVV

SEQ ID NO: 1145647 - protein, 9 aa, Homo Sapiens
PNRTTYVKA

SEQ ID NO: 1145648 - protein, 9 aa, Homo Sapiens
YLQLIQVDV

SEQ ID NO: 1145649 - protein, 9 aa, Homo Sapiens
PSLGGCPLS

SEQ ID NO: 1145650 - protein, 9 aa, Homo Sapiens
QKFIILRWY

SEQ ID NO: 1145651 - protein, 9 aa, Homo Sapiens
HPQLGQRAQ

SEQ ID NO: 1145652 - protein, 9 aa, Homo Sapiens
HPLGLCSAQ

SEQ ID NO: 1145653 - protein, 9 aa, Homo Sapiens
GMLLPRALP

SEQ ID NO: 1145654 - protein, 9 aa, Homo Sapiens
RVPEGPTIP

SEQ ID NO: 1145655 - protein, 9 aa, Homo Sapiens
EKDKKRTDS

SEQ ID NO: 1145656 - protein, 9 aa, Homo Sapiens
DHFDKNKFS

SEQ ID NO: 1145657 - protein, 9 aa, Homo Sapiens
CSLSFPGSS

SEQ ID NO: 1145658 - protein, 9 aa, Homo Sapiens
MWNPREVQA

SEQ ID NO: 1145659 - protein, 9 aa, Homo Sapiens
GMLTVIGQG

SEQ ID NO: 1145660 - protein, 9 aa, Homo Sapiens
QSDSSPSTS

SEQ ID NO: 1145661 - protein, 9 aa, Homo Sapiens
EFLSGKFAL

SEQ ID NO: 1145662 - protein, 9 aa, Homo Sapiens
PACARSASS

SEQ ID NO: 1145663 - protein, 9 aa, Homo Sapiens
LCVPCPGGG

SEQ ID NO: 1145664 - protein, 9 aa, Homo Sapiens
LATQRRPAT

SEQ ID NO: 1145665 - protein, 9 aa, Homo Sapiens
QEAPHNMVH

SEQ ID NO: 1145666 - protein, 9 aa, Homo Sapiens
DRAGPAPQG

SEQ ID NO: 1145667 - protein, 9 aa, Homo Sapiens
LMEDRNAHL

SEQ ID NO: 1145668 - protein, 9 aa, Homo Sapiens
RHPRLRSYC

SEQ ID NO: 1145669 - protein, 9 aa, Homo Sapiens
LPGPCASLL

SEQ ID NO: 1145670 - protein, 9 aa, Homo Sapiens
EVSPGGAGP

SEQ ID NO: 1145671 - protein, 9 aa, Homo Sapiens
AGRANDPCD

SEQ ID NO: 1145672 - protein, 9 aa, Homo Sapiens
LQMEQDYHG

SEQ ID NO: 1145673 - protein, 9 aa, Homo Sapiens
MSATTTARQ

SEQ ID NO: 1145674 - protein, 9 aa, Homo Sapiens
LTLASAHVG

SEQ ID NO: 1145675 - protein, 9 aa, Homo Sapiens
GAQVFAFLK

SEQ ID NO: 1145676 - protein, 9 aa, Homo Sapiens
SLLSLKADM

SEQ ID NO: 1145677 - protein, 9 aa, Homo Sapiens
DAHLCPQQH

SEQ ID NO: 1145678 - protein, 9 aa, Homo Sapiens
QAPSQVWTA

SEQ ID NO: 1145679 - protein, 9 aa, Homo Sapiens
GVMLFSTGS

SEQ ID NO: 1145680 - protein, 9 aa, Homo Sapiens
TLIPLLLIV

SEQ ID NO: 1145681 - protein, 9 aa, Homo Sapiens
KMQNMFAWQ

SEQ ID NO: 1145682 - protein, 9 aa, Homo Sapiens
PITVHNICH

SEQ ID NO: 1145683 - protein, 9 aa, Homo Sapiens
RSSPPWQAT

SEQ ID NO: 1145684 - protein, 9 aa, Homo Sapiens
TTAFSAFGR

SEQ ID NO: 1145685 - protein, 9 aa, Homo Sapiens
ADSCPGGAT

SEQ ID NO: 1145686 - protein, 9 aa, Homo Sapiens
QSSGGGMMS

SEQ ID NO: 1145687 - protein, 9 aa, Homo Sapiens
RPAATTSAT

SEQ ID NO: 1145688 - protein, 9 aa, Homo Sapiens
QTPMAALVD

SEQ ID NO: 1145689 - protein, 9 aa, Homo Sapiens
TWCTTCASA

SEQ ID NO: 1145690 - protein, 9 aa, Homo Sapiens
AKMPVDNPG

SEQ ID NO: 1145691 - protein, 9 aa, Homo Sapiens
DTSLAEEAS

SEQ ID NO: 1145692 - protein, 9 aa, Homo Sapiens
SFATSPGPT

SEQ ID NO: 1145693 - protein, 9 aa, Homo Sapiens
SATGASESR

SEQ ID NO: 1145694 - protein, 9 aa, Homo Sapiens
LSLVLQGDP

SEQ ID NO: 1145695 - protein, 9 aa, Homo Sapiens
PMPPFYYVT

SEQ ID NO: 1145696 - protein, 9 aa, Homo Sapiens
VSQEHQCSP

SEQ ID NO: 1145697 - protein, 9 aa, Homo Sapiens
KEGCHKKTS

SEQ ID NO: 1145698 - protein, 9 aa, Homo Sapiens
SDVFRSNFK

SEQ ID NO: 1145699 - protein, 9 aa, Homo Sapiens
VPIDTIIFG

SEQ ID NO: 1145700 - protein, 9 aa, Homo Sapiens
SPQAHKLWM

SEQ ID NO: 1145701 - protein, 9 aa, Homo Sapiens
FFLNVGRRH

SEQ ID NO: 1145702 - protein, 9 aa, Homo Sapiens
DAREREHIH

SEQ ID NO: 1145703 - protein, 9 aa, Homo Sapiens
QLYNEMVDY

SEQ ID NO: 1145704 - protein, 9 aa, Homo Sapiens
MEDRNAHLG

SEQ ID NO: 1145705 - protein, 9 aa, Homo Sapiens
VPARYRKPL

SEQ ID NO: 1145706 - protein, 9 aa, Homo Sapiens
ATSPGPTFD

SEQ ID NO: 1145707 - protein, 9 aa, Homo Sapiens
SVVGRNGIL

SEQ ID NO: 1145708 - protein, 9 aa, Homo Sapiens
LQECRGPRG

SEQ ID NO: 1145709 - protein, 9 aa, Homo Sapiens
ENQVHGIYF

SEQ ID NO: 1145710 - protein, 9 aa, Homo Sapiens
LGVMGSPGP

SEQ ID NO: 1145711 - protein, 9 aa, Homo Sapiens
LIDHLLQLL

SEQ ID NO: 1145712 - protein, 9 aa, Homo Sapiens
GPNQVISLE

SEQ ID NO: 1145713 - protein, 9 aa, Homo Sapiens
TGMSATTTA

SEQ ID NO: 1145714 - protein, 9 aa, Homo Sapiens
PRDSALNVL

SEQ ID NO: 1145715 - protein, 9 aa, Homo Sapiens
SSSGSDGGT

SEQ ID NO: 1145716 - protein, 9 aa, Homo Sapiens
DVVYYLHRM

SEQ ID NO: 1145717 - protein, 9 aa, Homo Sapiens
VLIPPLRPS

SEQ ID NO: 1145718 - protein, 9 aa, Homo Sapiens
RAREQSHSD

SEQ ID NO: 1145719 - protein, 9 aa, Homo Sapiens
DGECVCPLA

SEQ ID NO: 1145720 - protein, 9 aa, Homo Sapiens
VVLEARAPH

SEQ ID NO: 1145721 - protein, 9 aa, Homo Sapiens
DLLALNQKN

SEQ ID NO: 1145722 - protein, 9 aa, Homo Sapiens
ITYSTPLWQ

SEQ ID NO: 1145723 - protein, 9 aa, Homo Sapiens
TGAKGEEQS

SEQ ID NO: 1145724 - protein, 9 aa, Homo Sapiens
ILLGVMGSP

SEQ ID NO: 1145725 - protein, 9 aa, Homo Sapiens
VPHPSSMSL

SEQ ID NO: 1145726 - protein, 9 aa, Homo Sapiens
SGSHASIHA

SEQ ID NO: 1145727 - protein, 9 aa, Homo Sapiens
HNICHWNQK

SEQ ID NO: 1145728 - protein, 9 aa, Homo Sapiens
RVLHSLNPS

SEQ ID NO: 1145729 - protein, 9 aa, Homo Sapiens
PGMSGRGGG

SEQ ID NO: 1145730 - protein, 9 aa, Homo Sapiens
ATQEEPEQL

SEQ ID NO: 1145731 - protein, 9 aa, Homo Sapiens
LPRPACWAR

SEQ ID NO: 1145732 - protein, 9 aa, Homo Sapiens
DLYLESDEV

SEQ ID NO: 1145733 - protein, 9 aa, Homo Sapiens
ILFFFLFPL

SEQ ID NO: 1145734 - protein, 9 aa, Homo Sapiens
PACWARVPA

SEQ ID NO: 1145735 - protein, 9 aa, Homo Sapiens
SHTLSRAQT

SEQ ID NO: 1145736 - protein, 9 aa, Homo Sapiens
NCGHICNTC

SEQ ID NO: 1145737 - protein, 9 aa, Homo Sapiens
WCRWKTKFY

SEQ ID NO: 1145738 - protein, 9 aa, Homo Sapiens
MEATNVEKA

SEQ ID NO: 1145739 - protein, 9 aa, Homo Sapiens
LQADGNGDP

SEQ ID NO: 1145740 - protein, 9 aa, Homo Sapiens
GQRRLQEFL

SEQ ID NO: 1145741 - protein, 9 aa, Homo Sapiens
LRMPPMPPF

SEQ ID NO: 1145742 - protein, 9 aa, Homo Sapiens
DTIADHPAV

SEQ ID NO: 1145743 - protein, 9 aa, Homo Sapiens
DEKRCLEAR

SEQ ID NO: 1145744 - protein, 9 aa, Homo Sapiens
LIAQKPTGS

SEQ ID NO: 1145745 - protein, 9 aa, Homo Sapiens
SGSGQPAAA

SEQ ID NO: 1145746 - protein, 9 aa, Homo Sapiens
TVGKSHLLE

SEQ ID NO: 1145747 - protein, 9 aa, Homo Sapiens
DRWSVRPSD

SEQ ID NO: 1145748 - protein, 9 aa, Homo Sapiens
GGRSRAEKP

SEQ ID NO: 1145749 - protein, 9 aa, Homo Sapiens
SSPRRSPAL

SEQ ID NO: 1145750 - protein, 9 aa, Homo Sapiens
SAPMPSTSQ

SEQ ID NO: 1145751 - protein, 9 aa, Homo Sapiens
PLQWNEDQQ

SEQ ID NO: 1145752 - protein, 9 aa, Homo Sapiens
IFCSSSMAP

SEQ ID NO: 1145753 - protein, 9 aa, Homo Sapiens
EECVYPDYR

SEQ ID NO: 1145754 - protein, 9 aa, Homo Sapiens
ALQPHCLGQ

SEQ ID NO: 1145755 - protein, 9 aa, Homo Sapiens
DEESVVIYY

SEQ ID NO: 1145756 - protein, 9 aa, Homo Sapiens
LYNKVSRFP

SEQ ID NO: 1145757 - protein, 9 aa, Homo Sapiens
FPVAFGFLC

SEQ ID NO: 1145758 - protein, 9 aa, Homo Sapiens
LLNIIKHLN

SEQ ID NO: 1145759 - protein, 9 aa, Homo Sapiens
WLTEVQDMA

SEQ ID NO: 1145760 - protein, 9 aa, Homo Sapiens
VSSRPRKDE

SEQ ID NO: 1145761 - protein, 9 aa, Homo Sapiens
GEPHHAHQL

SEQ ID NO: 1145762 - protein, 9 aa, Homo Sapiens
RAPCRPPPV

SEQ ID NO: 1145763 - protein, 9 aa, Homo Sapiens
QQRQAVASR

SEQ ID NO: 1145764 - protein, 9 aa, Homo Sapiens
VMQLLCLLT

SEQ ID NO: 1145765 - protein, 9 aa, Homo Sapiens
RGGAARLAG

SEQ ID NO: 1145766 - protein, 9 aa, Homo Sapiens
GEALRLLCQ

SEQ ID NO: 1145767 - protein, 9 aa, Homo Sapiens
TPLEVARGK

SEQ ID NO: 1145768 - protein, 9 aa, Homo Sapiens
GRPRWPSRL

SEQ ID NO: 1145769 - protein, 9 aa, Homo Sapiens
ALGTQAGPW

SEQ ID NO: 1145770 - protein, 9 aa, Homo Sapiens
YSRAVLVER

SEQ ID NO: 1145771 - protein, 9 aa, Homo Sapiens
GSQGSHPWF

SEQ ID NO: 1145772 - protein, 9 aa, Homo Sapiens
PGEGLATEG

SEQ ID NO: 1145773 - protein, 9 aa, Homo Sapiens
TCSIWSTCC

SEQ ID NO: 1145774 - protein, 9 aa, Homo Sapiens
PAGTPWMEG

SEQ ID NO: 1145775 - protein, 9 aa, Homo Sapiens
LSQPPPQAP

SEQ ID NO: 1145776 - protein, 9 aa, Homo Sapiens
RKVHYDPKK

SEQ ID NO: 1145777 - protein, 9 aa, Homo Sapiens
RKMLPRSTV

SEQ ID NO: 1145778 - protein, 9 aa, Homo Sapiens
DLLSLVFTF

SEQ ID NO: 1145779 - protein, 9 aa, Homo Sapiens
LNSVSRAFR

SEQ ID NO: 1145780 - protein, 9 aa, Homo Sapiens
RWAHSRQRQ

SEQ ID NO: 1145781 - protein, 9 aa, Homo Sapiens
HDKNIWPSK

SEQ ID NO: 1145782 - protein, 9 aa, Homo Sapiens
QLTMNDSKH

SEQ ID NO: 1145783 - protein, 9 aa, Homo Sapiens
RRGLVEGYS

SEQ ID NO: 1145784 - protein, 9 aa, Homo Sapiens
DPTQTYGVI

SEQ ID NO: 1145785 - protein, 9 aa, Homo Sapiens
NITPLSVAM

SEQ ID NO: 1145786 - protein, 9 aa, Homo Sapiens
VIGRELRPR

SEQ ID NO: 1145787 - protein, 9 aa, Homo Sapiens
KIFWLIPPM

SEQ ID NO: 1145788 - protein, 9 aa, Homo Sapiens
YLKRDHREL

SEQ ID NO: 1145789 - protein, 9 aa, Homo Sapiens
EYKRLRAFQ

SEQ ID NO: 1145790 - protein, 9 aa, Homo Sapiens
AHHAAPRVH

SEQ ID NO: 1145791 - protein, 9 aa, Homo Sapiens
KYLLLDNAE

SEQ ID NO: 1145792 - protein, 9 aa, Homo Sapiens
WSGLIVTAR

SEQ ID NO: 1145793 - protein, 9 aa, Homo Sapiens
GSVPPLAFS

SEQ ID NO: 1145794 - protein, 9 aa, Homo Sapiens
FEDQQKINT

SEQ ID NO: 1145795 - protein, 9 aa, Homo Sapiens
MVTTWQGAP

SEQ ID NO: 1145796 - protein, 9 aa, Homo Sapiens
THIEFPRRV

SEQ ID NO: 1145797 - protein, 9 aa, Homo Sapiens
GVRAGGAEE

SEQ ID NO: 1145798 - protein, 9 aa, Homo Sapiens
LQRNSQFGF

SEQ ID NO: 1145799 - protein, 9 aa, Homo Sapiens
SLPQGAGSP

SEQ ID NO: 1145800 - protein, 9 aa, Homo Sapiens
PTAEGLVSG

SEQ ID NO: 1145801 - protein, 9 aa, Homo Sapiens
CQCDKKRGA

SEQ ID NO: 1145802 - protein, 9 aa, Homo Sapiens
FTDTSHVPR

SEQ ID NO: 1145803 - protein, 9 aa, Homo Sapiens
RGALTTRPS

SEQ ID NO: 1145804 - protein, 9 aa, Homo Sapiens
MVTRHPDTD

SEQ ID NO: 1145805 - protein, 9 aa, Homo Sapiens
PAGSPPGTR

SEQ ID NO: 1145806 - protein, 9 aa, Homo Sapiens
HARLAPRPA

SEQ ID NO: 1145807 - protein, 9 aa, Homo Sapiens
SGHPAALWG

SEQ ID NO: 1145808 - protein, 9 aa, Homo Sapiens
APTVPCSAL

SEQ ID NO: 1145809 - protein, 9 aa, Homo Sapiens
AAVVVLVSV

SEQ ID NO: 1145810 - protein, 9 aa, Homo Sapiens
KMREHAENL

SEQ ID NO: 1145811 - protein, 9 aa, Homo Sapiens
YPEQMDCSP

SEQ ID NO: 1145812 - protein, 9 aa, Homo Sapiens
FRHHETKFA

SEQ ID NO: 1145813 - protein, 9 aa, Homo Sapiens
DYIDAQSEA

SEQ ID NO: 1145814 - protein, 9 aa, Homo Sapiens
IHKLPLSLQ

SEQ ID NO: 1145815 - protein, 9 aa, Homo Sapiens
DSGADTGLV

SEQ ID NO: 1145816 - protein, 9 aa, Homo Sapiens
DTLKQQEIM

SEQ ID NO: 1145817 - protein, 9 aa, Homo Sapiens
AQTGQLGPR

SEQ ID NO: 1145818 - protein, 9 aa, Homo Sapiens
HGFGNCMEL

SEQ ID NO: 1145819 - protein, 9 aa, Homo Sapiens
LWGNDSSVP

SEQ ID NO: 1145820 - protein, 9 aa, Homo Sapiens
HHPDLYLES

SEQ ID NO: 1145821 - protein, 9 aa, Homo Sapiens
EGAAGTRCR

SEQ ID NO: 1145822 - protein, 9 aa, Homo Sapiens
DRPTRRPSR

SEQ ID NO: 1145823 - protein, 9 aa, Homo Sapiens
ATTSATTRR

SEQ ID NO: 1145824 - protein, 9 aa, Homo Sapiens
MGSPGPWPS

SEQ ID NO: 1145825 - protein, 9 aa, Homo Sapiens
GPRRSAAQT

SEQ ID NO: 1145826 - protein, 9 aa, Homo Sapiens
EHHPHTLDL

SEQ ID NO: 1145827 - protein, 9 aa, Homo Sapiens
VATWIKTTL

SEQ ID NO: 1145828 - protein, 9 aa, Homo Sapiens
RMIGINHCC

SEQ ID NO: 1145829 - protein, 9 aa, Homo Sapiens
EQHVGLFVC

SEQ ID NO: 1145830 - protein, 9 aa, Homo Sapiens
YCKGPRRSA

SEQ ID NO: 1145831 - protein, 9 aa, Homo Sapiens
ARVPACRRR

SEQ ID NO: 1145832 - protein, 9 aa, Homo Sapiens
SWGQCQSVC

SEQ ID NO: 1145833 - protein, 9 aa, Homo Sapiens
PLGGMECTV

SEQ ID NO: 1145834 - protein, 9 aa, Homo Sapiens
SPIADDLIE

SEQ ID NO: 1145835 - protein, 9 aa, Homo Sapiens
SLITIGEIA

SEQ ID NO: 1145836 - protein, 9 aa, Homo Sapiens
SRPRRTARL

SEQ ID NO: 1145837 - protein, 9 aa, Homo Sapiens
LLHGKTIEI

SEQ ID NO: 1145838 - protein, 9 aa, Homo Sapiens
EAELRHVEE

SEQ ID NO: 1145839 - protein, 9 aa, Homo Sapiens
QAYIARCQD

SEQ ID NO: 1145840 - protein, 9 aa, Homo Sapiens
PGVAESPDL

SEQ ID NO: 1145841 - protein, 9 aa, Homo Sapiens
TPCPLLPLP

SEQ ID NO: 1145842 - protein, 9 aa, Homo Sapiens
LLGVMGSPG

SEQ ID NO: 1145843 - protein, 9 aa, Homo Sapiens
HPRAQCVVL

SEQ ID NO: 1145844 - protein, 9 aa, Homo Sapiens
LHASPRRLL

SEQ ID NO: 1145845 - protein, 9 aa, Homo Sapiens
TRSEPSELE

SEQ ID NO: 1145846 - protein, 9 aa, Homo Sapiens
DGLDSGADT

SEQ ID NO: 1145847 - protein, 9 aa, Homo Sapiens
IPSHPNPTQ

SEQ ID NO: 1145848 - protein, 9 aa, Homo Sapiens
NPNEEVVRF

SEQ ID NO: 1145849 - protein, 9 aa, Homo Sapiens
LCPQQHVLG

SEQ ID NO: 1145850 - protein, 9 aa, Homo Sapiens
LKWNSEGFF

SEQ ID NO: 1145851 - protein, 9 aa, Homo Sapiens
QNMENQEMF

SEQ ID NO: 1145852 - protein, 9 aa, Homo Sapiens
NQVHGIYFN

SEQ ID NO: 1145853 - protein, 9 aa, Homo Sapiens
HPRLRSYCK

SEQ ID NO: 1145854 - protein, 9 aa, Homo Sapiens
ESWFMSVNE

SEQ ID NO: 1145855 - protein, 9 aa, Homo Sapiens
GADAAILSA

SEQ ID NO: 1145856 - protein, 9 aa, Homo Sapiens
AGPPAHARL

SEQ ID NO: 1145857 - protein, 9 aa, Homo Sapiens
LHGKTIEIG

SEQ ID NO: 1145858 - protein, 9 aa, Homo Sapiens
GSPRSSTWP

SEQ ID NO: 1145859 - protein, 9 aa, Homo Sapiens
IFRRLQSSG

SEQ ID NO: 1145860 - protein, 9 aa, Homo Sapiens
GVWVGAQEA

SEQ ID NO: 1145861 - protein, 9 aa, Homo Sapiens
RSLGPDTQP

SEQ ID NO: 1145862 - protein, 9 aa, Homo Sapiens
DDQHTFRDV

SEQ ID NO: 1145863 - protein, 9 aa, Homo Sapiens
SPGWSAMPG

SEQ ID NO: 1145864 - protein, 9 aa, Homo Sapiens
DGPIQNTLW

SEQ ID NO: 1145865 - protein, 9 aa, Homo Sapiens
GARRLARAR

SEQ ID NO: 1145866 - protein, 9 aa, Homo Sapiens
LKRARAPGV

SEQ ID NO: 1145867 - protein, 9 aa, Homo Sapiens
APGCHPTSG

SEQ ID NO: 1145868 - protein, 9 aa, Homo Sapiens
AKGEEQSRL

SEQ ID NO: 1145869 - protein, 9 aa, Homo Sapiens
QVGVLELSY

SEQ ID NO: 1145870 - protein, 9 aa, Homo Sapiens
EPVTCLNIQ

SEQ ID NO: 1145871 - protein, 9 aa, Homo Sapiens
DVRNGIYPP

SEQ ID NO: 1145872 - protein, 9 aa, Homo Sapiens
LISLFWKAH

SEQ ID NO: 1145873 - protein, 9 aa, Homo Sapiens
AGVARRDGD

SEQ ID NO: 1145874 - protein, 9 aa, Homo Sapiens
NWAYVKDAW

SEQ ID NO: 1145875 - protein, 9 aa, Homo Sapiens
GSGDFNLPL

SEQ ID NO: 1145876 - protein, 9 aa, Homo Sapiens
PLPRSACRW

SEQ ID NO: 1145877 - protein, 9 aa, Homo Sapiens
QELTNTKLS

SEQ ID NO: 1145878 - protein, 9 aa, Homo Sapiens
ALQWMVKSW

SEQ ID NO: 1145879 - protein, 9 aa, Homo Sapiens
NAEETLEAW

SEQ ID NO: 1145880 - protein, 9 aa, Homo Sapiens
HPSPHLYSS

SEQ ID NO: 1145881 - protein, 9 aa, Homo Sapiens
KECGKTFSE

SEQ ID NO: 1145882 - protein, 9 aa, Homo Sapiens
KKSPWEQKG

SEQ ID NO: 1145883 - protein, 9 aa, Homo Sapiens
PVFPPLIPL

SEQ ID NO: 1145884 - protein, 9 aa, Homo Sapiens
PRGVGVGDM

SEQ ID NO: 1145885 - protein, 9 aa, Homo Sapiens
SPDSGSSPA

SEQ ID NO: 1145886 - protein, 9 aa, Homo Sapiens
ADLTISNVT

SEQ ID NO: 1145887 - protein, 9 aa, Homo Sapiens
RKHIIIPLE

SEQ ID NO: 1145888 - protein, 9 aa, Homo Sapiens
SRAEKPTAA

SEQ ID NO: 1145889 - protein, 9 aa, Homo Sapiens
FYPHPHPRL

SEQ ID NO: 1145890 - protein, 9 aa, Homo Sapiens
CDSLFSNAL

SEQ ID NO: 1145891 - protein, 9 aa, Homo Sapiens
SSPSTSVDS

SEQ ID NO: 1145892 - protein, 9 aa, Homo Sapiens
NTNSISVFQ

SEQ ID NO: 1145893 - protein, 9 aa, Homo Sapiens
EKNPPLRFN

SEQ ID NO: 1145894 - protein, 9 aa, Homo Sapiens
LNGESPTLR

SEQ ID NO: 1145895 - protein, 9 aa, Homo Sapiens
ALGTSWPRL

SEQ ID NO: 1145896 - protein, 9 aa, Homo Sapiens
SRPGWAALQ

SEQ ID NO: 1145897 - protein, 9 aa, Homo Sapiens
LAENDSSSD

SEQ ID NO: 1145898 - protein, 9 aa, Homo Sapiens
HLGECVNLS

SEQ ID NO: 1145899 - protein, 9 aa, Homo Sapiens
WCTTCASAA

SEQ ID NO: 1145900 - protein, 9 aa, Homo Sapiens
HEFCSHKSK

SEQ ID NO: 1145901 - protein, 9 aa, Homo Sapiens
GTKTRLTQC

SEQ ID NO: 1145902 - protein, 9 aa, Homo Sapiens
ARGPRAPVR

SEQ ID NO: 1145903 - protein, 9 aa, Homo Sapiens
TNEDSDGDV

SEQ ID NO: 1145904 - protein, 9 aa, Homo Sapiens
LETGVYNVD

SEQ ID NO: 1145905 - protein, 9 aa, Homo Sapiens
PDTCRAPSQ

SEQ ID NO: 1145906 - protein, 9 aa, Homo Sapiens
YAEFLHCRG

SEQ ID NO: 1145907 - protein, 9 aa, Homo Sapiens
PASSPTKCE

SEQ ID NO: 1145908 - protein, 9 aa, Homo Sapiens
VFDNFFYQE

SEQ ID NO: 1145909 - protein, 9 aa, Homo Sapiens
EPPEECVYP

SEQ ID NO: 1145910 - protein, 9 aa, Homo Sapiens
QHPHPLLPF

SEQ ID NO: 1145911 - protein, 9 aa, Homo Sapiens
TNDILVIKN

SEQ ID NO: 1145912 - protein, 9 aa, Homo Sapiens
RGPVRLLLG

SEQ ID NO: 1145913 - protein, 9 aa, Homo Sapiens
GTYLLLHHQ

SEQ ID NO: 1145914 - protein, 9 aa, Homo Sapiens
AGTAARLPP

SEQ ID NO: 1145915 - protein, 9 aa, Homo Sapiens
GVMGSPGPW

SEQ ID NO: 1145916 - protein, 9 aa, Homo Sapiens
GLQVIEVTT

SEQ ID NO: 1145917 - protein, 9 aa, Homo Sapiens
HEKMGIDIS

SEQ ID NO: 1145918 - protein, 9 aa, Homo Sapiens
LGLFYQMLH

SEQ ID NO: 1145919 - protein, 9 aa, Homo Sapiens
EDTIADHPA

SEQ ID NO: 1145920 - protein, 9 aa, Homo Sapiens
ERRVKLPIT

SEQ ID NO: 1145921 - protein, 9 aa, Homo Sapiens
ATNVEKASA

SEQ ID NO: 1145922 - protein, 9 aa, Homo Sapiens
FFGDIHFGN

SEQ ID NO: 1145923 - protein, 9 aa, Homo Sapiens
HNYNSLFIY

SEQ ID NO: 1145924 - protein, 9 aa, Homo Sapiens
SPGEGLATE

SEQ ID NO: 1145925 - protein, 9 aa, Homo Sapiens
RVHHTDHPR

SEQ ID NO: 1145926 - protein, 9 aa, Homo Sapiens
CLTHLAVVL

SEQ ID NO: 1145927 - protein, 9 aa, Homo Sapiens
DHHDCMSLA

SEQ ID NO: 1145928 - protein, 9 aa, Homo Sapiens
TGSPQTPPR

SEQ ID NO: 1145929 - protein, 9 aa, Homo Sapiens
YPNVVPSLG

SEQ ID NO: 1145930 - protein, 9 aa, Homo Sapiens
KRSGVRAGG

SEQ ID NO: 1145931 - protein, 9 aa, Homo Sapiens
FPGSSHLPT

SEQ ID NO: 1145932 - protein, 9 aa, Homo Sapiens
GKTIEIGNS

SEQ ID NO: 1145933 - protein, 9 aa, Homo Sapiens
RYYQEAVRL

SEQ ID NO: 1145934 - protein, 9 aa, Homo Sapiens
EVKCWVLLC

SEQ ID NO: 1145935 - protein, 9 aa, Homo Sapiens
DSSPITDRE

SEQ ID NO: 1145936 - protein, 9 aa, Homo Sapiens
DILVIKNII

SEQ ID NO: 1145937 - protein, 9 aa, Homo Sapiens
AAAANCVNI

SEQ ID NO: 1145938 - protein, 9 aa, Homo Sapiens
AATTSATTR

SEQ ID NO: 1145939 - protein, 9 aa, Homo Sapiens
CPADVCGSL

SEQ ID NO: 1145940 - protein, 9 aa, Homo Sapiens
LRSSGKKIA

SEQ ID NO: 1145941 - protein, 9 aa, Homo Sapiens
AALGWSPCD

SEQ ID NO: 1145942 - protein, 9 aa, Homo Sapiens
SASACKDTA

SEQ ID NO: 1145943 - protein, 9 aa, Homo Sapiens
ARCLCVPCP

SEQ ID NO: 1145944 - protein, 9 aa, Homo Sapiens
NSHPPTTTT

SEQ ID NO: 1145945 - protein, 9 aa, Homo Sapiens
LTGSTPMHV

SEQ ID NO: 1145946 - protein, 9 aa, Homo Sapiens
GPPENQVSV

SEQ ID NO: 1145947 - protein, 9 aa, Homo Sapiens
LLDWKMVNQ

SEQ ID NO: 1145948 - protein, 9 aa, Homo Sapiens
DSALNVLRD

SEQ ID NO: 1145949 - protein, 9 aa, Homo Sapiens
RPRYAGMLL

SEQ ID NO: 1145950 - protein, 9 aa, Homo Sapiens
TTCASAATT

SEQ ID NO: 1145951 - protein, 9 aa, Homo Sapiens
RPCRMRLYQ

SEQ ID NO: 1145952 - protein, 9 aa, Homo Sapiens
QCSPRGDCL

SEQ ID NO: 1145953 - protein, 9 aa, Homo Sapiens
IRYYQEAVR

SEQ ID NO: 1145954 - protein, 9 aa, Homo Sapiens
GECVCPLAS

SEQ ID NO: 1145955 - protein, 9 aa, Homo Sapiens
DASPGPPAA

SEQ ID NO: 1145956 - protein, 9 aa, Homo Sapiens
TGRGEQSDC

SEQ ID NO: 1145957 - protein, 9 aa, Homo Sapiens
VIEVTTYNR

SEQ ID NO: 1145958 - protein, 9 aa, Homo Sapiens
LKVHERFHT

SEQ ID NO: 1145959 - protein, 9 aa, Homo Sapiens
LNVGRRHKI

SEQ ID NO: 1145960 - protein, 9 aa, Homo Sapiens
CIGESRAVE

SEQ ID NO: 1145961 - protein, 9 aa, Homo Sapiens
SRRCTGSPQ

SEQ ID NO: 1145962 - protein, 9 aa, Homo Sapiens
SWLPCRGPM

SEQ ID NO: 1145963 - protein, 9 aa, Homo Sapiens
EELDALKKP

SEQ ID NO: 1145964 - protein, 9 aa, Homo Sapiens
MSLATSSHA

SEQ ID NO: 1145965 - protein, 9 aa, Homo Sapiens
ARKLDLTKA

SEQ ID NO: 1145966 - protein, 9 aa, Homo Sapiens
TDHPRAQCV

SEQ ID NO: 1145967 - protein, 9 aa, Homo Sapiens
RITPELNQK

SEQ ID NO: 1145968 - protein, 9 aa, Homo Sapiens
SAFGDQVPC

SEQ ID NO: 1145969 - protein, 9 aa, Homo Sapiens
RPLPRSACR

SEQ ID NO: 1145970 - protein, 9 aa, Homo Sapiens
SDSKSSSEI

SEQ ID NO: 1145971 - protein, 9 aa, Homo Sapiens
PQGAGSPTL

SEQ ID NO: 1145972 - protein, 9 aa, Homo Sapiens
KVPDVLPSA

SEQ ID NO: 1145973 - protein, 9 aa, Homo Sapiens
KVHYDPKKD

SEQ ID NO: 1145974 - protein, 9 aa, Homo Sapiens
HKLESPALK

SEQ ID NO: 1145975 - protein, 9 aa, Homo Sapiens
TPPTFCTWT

SEQ ID NO: 1145976 - protein, 9 aa, Homo Sapiens
HQVDRLCGA

SEQ ID NO: 1145977 - protein, 9 aa, Homo Sapiens
SWNHKTMNL

SEQ ID NO: 1145978 - protein, 9 aa, Homo Sapiens
VDNPGLGPS

SEQ ID NO: 1145979 - protein, 9 aa, Homo Sapiens
PPRAARPPR

SEQ ID NO: 1145980 - protein, 9 aa, Homo Sapiens
AALLPRSPA

SEQ ID NO: 1145981 - protein, 9 aa, Homo Sapiens
RPRIPLPAQ

SEQ ID NO: 1145982 - protein, 9 aa, Homo Sapiens
PPQQEGSNP

SEQ ID NO: 1145983 - protein, 9 aa, Homo Sapiens
LVTDRVTDN

SEQ ID NO: 1145984 - protein, 9 aa, Homo Sapiens
SRWSRVPDH

SEQ ID NO: 1145985 - protein, 9 aa, Homo Sapiens
CSGLVRDCG

SEQ ID NO: 1145986 - protein, 9 aa, Homo Sapiens
PKPPHHEFC

SEQ ID NO: 1145987 - protein, 9 aa, Homo Sapiens
PDASPGPPA

SEQ ID NO: 1145988 - protein, 9 aa, Homo Sapiens
VATILFTLI

SEQ ID NO: 1145989 - protein, 9 aa, Homo Sapiens
PADTADISQ

SEQ ID NO: 1145990 - protein, 9 aa, Homo Sapiens
RPTVVQGMN

SEQ ID NO: 1145991 - protein, 9 aa, Homo Sapiens
GRRPRPRRA

SEQ ID NO: 1145992 - protein, 9 aa, Homo Sapiens
AQLTTPRPS

SEQ ID NO: 1145993 - protein, 9 aa, Homo Sapiens
LLQVWEPPW

SEQ ID NO: 1145994 - protein, 9 aa, Homo Sapiens
AIGEAPDHS

SEQ ID NO: 1145995 - protein, 9 aa, Homo Sapiens
ELRPRLSDR

SEQ ID NO: 1145996 - protein, 9 aa, Homo Sapiens
LCSYTGACT

SEQ ID NO: 1145997 - protein, 9 aa, Homo Sapiens
YGGRCVNTH

SEQ ID NO: 1145998 - protein, 9 aa, Homo Sapiens
SATTTARQP

SEQ ID NO: 1145999 - protein, 9 aa, Homo Sapiens
KYLKRDHRE

SEQ ID NO: 1146000 - protein, 9 aa, Homo Sapiens
SWPRLEGPS

SEQ ID NO: 1146001 - protein, 9 aa, Homo Sapiens
LSEDQVLHR

SEQ ID NO: 1146002 - protein, 9 aa, Homo Sapiens
MEFLSGKFA

SEQ ID NO: 1146003 - protein, 9 aa, Homo Sapiens
ESMLERSAI

SEQ ID NO: 1146004 - protein, 9 aa, Homo Sapiens
RLLLGVCGH

SEQ ID NO: 1146005 - protein, 9 aa, Homo Sapiens
VVSAPLGGM

SEQ ID NO: 1146006 - protein, 9 aa, Homo Sapiens
FIKIATHCK

SEQ ID NO: 1146007 - protein, 9 aa, Homo Sapiens
SRWPSSQGT

SEQ ID NO: 1146008 - protein, 9 aa, Homo Sapiens
ITTQHEIWW

SEQ ID NO: 1146009 - protein, 9 aa, Homo Sapiens
TVEEQLLCL

SEQ ID NO: 1146010 - protein, 9 aa, Homo Sapiens
TQVKEIHAQ

SEQ ID NO: 1146011 - protein, 9 aa, Homo Sapiens
ALPTRRLSR

SEQ ID NO: 1146012 - protein, 9 aa, Homo Sapiens
WTVRMGRRC

SEQ ID NO: 1146013 - protein, 9 aa, Homo Sapiens
LGLVVIVPA

SEQ ID NO: 1146014 - protein, 9 aa, Homo Sapiens
APGWRRWTS

SEQ ID NO: 1146015 - protein, 9 aa, Homo Sapiens
EGGGVMLFS

SEQ ID NO: 1146016 - protein, 9 aa, Homo Sapiens
RDASPAADN

SEQ ID NO: 1146017 - protein, 9 aa, Homo Sapiens
SLFIYVISI

SEQ ID NO: 1146018 - protein, 9 aa, Homo Sapiens
NMSYSMEVS

SEQ ID NO: 1146019 - protein, 9 aa, Homo Sapiens
HYLTVMNPQ

SEQ ID NO: 1146020 - protein, 9 aa, Homo Sapiens
GQGLVGMTP

SEQ ID NO: 1146021 - protein, 9 aa, Homo Sapiens
EQPVHQVDR

SEQ ID NO: 1146022 - protein, 9 aa, Homo Sapiens
VDVQTTRKI

SEQ ID NO: 1146023 - protein, 9 aa, Homo Sapiens
AALGQMCIA

SEQ ID NO: 1146024 - protein, 9 aa, Homo Sapiens
GAGLGQDHQ

SEQ ID NO: 1146025 - protein, 9 aa, Homo Sapiens
RLQEAELRH

SEQ ID NO: 1146026 - protein, 9 aa, Homo Sapiens
FHNPRTSTN

SEQ ID NO: 1146027 - protein, 9 aa, Homo Sapiens
VKPGGAGAR

SEQ ID NO: 1146028 - protein, 9 aa, Homo Sapiens
CAKQRTVKK

SEQ ID NO: 1146029 - protein, 9 aa, Homo Sapiens
PRPSGLSCH

SEQ ID NO: 1146030 - protein, 9 aa, Homo Sapiens
EEGTAISGN

SEQ ID NO: 1146031 - protein, 9 aa, Homo Sapiens
VGLFVCLAT

SEQ ID NO: 1146032 - protein, 9 aa, Homo Sapiens
VPGEFGSEI

SEQ ID NO: 1146033 - protein, 9 aa, Homo Sapiens
TSAGVTANR

SEQ ID NO: 1146034 - protein, 9 aa, Homo Sapiens
ESVMGMVNY

SEQ ID NO: 1146035 - protein, 9 aa, Homo Sapiens
WYHPSTHDK

SEQ ID NO: 1146036 - protein, 9 aa, Homo Sapiens
AVVARKLDL

SEQ ID NO: 1146037 - protein, 9 aa, Homo Sapiens
EKLSISEKE

SEQ ID NO: 1146038 - protein, 9 aa, Homo Sapiens
GECRVSSID

SEQ ID NO: 1146039 - protein, 9 aa, Homo Sapiens
NQFFRGGDN

SEQ ID NO: 1146040 - protein, 9 aa, Homo Sapiens
TRGIWMWCV

SEQ ID NO: 1146041 - protein, 9 aa, Homo Sapiens
HIEFPRRVL

SEQ ID NO: 1146042 - protein, 9 aa, Homo Sapiens
PGRTDYEMD

SEQ ID NO: 1146043 - protein, 9 aa, Homo Sapiens
CGATIQELN

SEQ ID NO: 1146044 - protein, 9 aa, Homo Sapiens
SGHPTGPQI

SEQ ID NO: 1146045 - protein, 9 aa, Homo Sapiens
TVEEGQMLT

SEQ ID NO: 1146046 - protein, 9 aa, Homo Sapiens
REPEVTSIV

SEQ ID NO: 1146047 - protein, 9 aa, Homo Sapiens
DDKSDDLEV

SEQ ID NO: 1146048 - protein, 9 aa, Homo Sapiens
RRPLPRSAC

SEQ ID NO: 1146049 - protein, 9 aa, Homo Sapiens
VSGSLPEGY

SEQ ID NO: 1146050 - protein, 9 aa, Homo Sapiens
HDPPFDFSL

SEQ ID NO: 1146051 - protein, 9 aa, Homo Sapiens
VFASSGRVR

SEQ ID NO: 1146052 - protein, 9 aa, Homo Sapiens
AMWNPREVQ

SEQ ID NO: 1146053 - protein, 9 aa, Homo Sapiens
IKLEEGWGV

SEQ ID NO: 1146054 - protein, 9 aa, Homo Sapiens
LSISEKEDE

SEQ ID NO: 1146055 - protein, 9 aa, Homo Sapiens
MRSGGDWLA

SEQ ID NO: 1146056 - protein, 9 aa, Homo Sapiens
DLGTVAGAT

SEQ ID NO: 1146057 - protein, 9 aa, Homo Sapiens
AARAFSREQ

SEQ ID NO: 1146058 - protein, 9 aa, Homo Sapiens
PPNKETSGL

SEQ ID NO: 1146059 - protein, 9 aa, Homo Sapiens
LMLLTRHMT

SEQ ID NO: 1146060 - protein, 9 aa, Homo Sapiens
IGAPITTSR

SEQ ID NO: 1146061 - protein, 9 aa, Homo Sapiens
SGPQGPATP

SEQ ID NO: 1146062 - protein, 9 aa, Homo Sapiens
RNNQFFRGG

SEQ ID NO: 1146063 - protein, 9 aa, Homo Sapiens
QQQQGRWAM

SEQ ID NO: 1146064 - protein, 9 aa, Homo Sapiens
ARLAGRKMK

SEQ ID NO: 1146065 - protein, 9 aa, Homo Sapiens
LFLRESGQW

SEQ ID NO: 1146066 - protein, 9 aa, Homo Sapiens
TKPAVPHPS

SEQ ID NO: 1146067 - protein, 9 aa, Homo Sapiens
LVLVIEDKM

SEQ ID NO: 1146068 - protein, 9 aa, Homo Sapiens
VAEKWTYER

SEQ ID NO: 1146069 - protein, 9 aa, Homo Sapiens
SWGTREPQA

SEQ ID NO: 1146070 - protein, 9 aa, Homo Sapiens
SWGSPTRMA

SEQ ID NO: 1146071 - protein, 9 aa, Homo Sapiens
KTDMMPSTT

SEQ ID NO: 1146072 - protein, 9 aa, Homo Sapiens
KHHFQGKEN

SEQ ID NO: 1146073 - protein, 9 aa, Homo Sapiens
RAPGRPGGG

SEQ ID NO: 1146074 - protein, 9 aa, Homo Sapiens
AVQEVADGG

SEQ ID NO: 1146075 - protein, 9 aa, Homo Sapiens
LRRKWWPTQ

SEQ ID NO: 1146076 - protein, 9 aa, Homo Sapiens
HTLFHCILG

SEQ ID NO: 1146077 - protein, 9 aa, Homo Sapiens
EHTDICPSE

SEQ ID NO: 1146078 - protein, 9 aa, Homo Sapiens
WLALQAGPP

SEQ ID NO: 1146079 - protein, 9 aa, Homo Sapiens
PKLHTPMHF

SEQ ID NO: 1146080 - protein, 9 aa, Homo Sapiens
RSFSPDSGS

SEQ ID NO: 1146081 - protein, 9 aa, Homo Sapiens
MAPPKEVEE

SEQ ID NO: 1146082 - protein, 9 aa, Homo Sapiens
KNKFSMTSW

SEQ ID NO: 1146083 - protein, 9 aa, Homo Sapiens
EEVVRFYAA

SEQ ID NO: 1146084 - protein, 9 aa, Homo Sapiens
PVRSEAEDS

SEQ ID NO: 1146085 - protein, 9 aa, Homo Sapiens
LGPRGHPLS

SEQ ID NO: 1146086 - protein, 9 aa, Homo Sapiens
WKKAFLVLK

SEQ ID NO: 1146087 - protein, 9 aa, Homo Sapiens
GGGMMSCRI

SEQ ID NO: 1146088 - protein, 9 aa, Homo Sapiens
KGQKKIRKT

SEQ ID NO: 1146089 - protein, 9 aa, Homo Sapiens
RFIRQHKDQ

SEQ ID NO: 1146090 - protein, 9 aa, Homo Sapiens
EESSASLLT

SEQ ID NO: 1146091 - protein, 9 aa, Homo Sapiens
ARDLLSLRA

SEQ ID NO: 1146092 - protein, 9 aa, Homo Sapiens
PTVPCSALG

SEQ ID NO: 1146093 - protein, 9 aa, Homo Sapiens
GAWTAEGAA

SEQ ID NO: 1146094 - protein, 9 aa, Homo Sapiens
LPQAPTPTS

SEQ ID NO: 1146095 - protein, 9 aa, Homo Sapiens
TSTSIFRRL

SEQ ID NO: 1146096 - protein, 9 aa, Homo Sapiens
PQPPRRPST

SEQ ID NO: 1146097 - protein, 9 aa, Homo Sapiens
RVSPSNAAS

SEQ ID NO: 1146098 - protein, 9 aa, Homo Sapiens
EVQDVRPYI

SEQ ID NO: 1146099 - protein, 9 aa, Homo Sapiens
EFCSHKSKG

SEQ ID NO: 1146100 - protein, 9 aa, Homo Sapiens
LVGGQVGHG

SEQ ID NO: 1146101 - protein, 9 aa, Homo Sapiens
CSSSATGGD

SEQ ID NO: 1146102 - protein, 9 aa, Homo Sapiens
PPYTPPRLL

SEQ ID NO: 1146103 - protein, 9 aa, Homo Sapiens
TTTSSPRRS

SEQ ID NO: 1146104 - protein, 9 aa, Homo Sapiens
SGGGMMSCR

SEQ ID NO: 1146105 - protein, 9 aa, Homo Sapiens
FLNVGRRHK

SEQ ID NO: 1146106 - protein, 9 aa, Homo Sapiens
PTLGRVPHQ

SEQ ID NO: 1146107 - protein, 9 aa, Homo Sapiens
AAARPAGSG

SEQ ID NO: 1146108 - protein, 9 aa, Homo Sapiens
DIFCSSSMA

SEQ ID NO: 1146109 - protein, 9 aa, Homo Sapiens
QYNKIVIPD

SEQ ID NO: 1146110 - protein, 9 aa, Homo Sapiens
EVYNYYTKA

SEQ ID NO: 1146111 - protein, 9 aa, Homo Sapiens
WMALRNCVS

SEQ ID NO: 1146112 - protein, 9 aa, Homo Sapiens
SLLSRMPAR

SEQ ID NO: 1146113 - protein, 9 aa, Homo Sapiens
TEVQDMANK

SEQ ID NO: 1146114 - protein, 9 aa, Homo Sapiens
AGAQDYDRR

SEQ ID NO: 1146115 - protein, 9 aa, Homo Sapiens
IKNTVYIIL

SEQ ID NO: 1146116 - protein, 9 aa, Homo Sapiens
CGEPLQVER

SEQ ID NO: 1146117 - protein, 9 aa, Homo Sapiens
KKYSSLKGN

SEQ ID NO: 1146118 - protein, 9 aa, Homo Sapiens
VSPEVQDVR

SEQ ID NO: 1146119 - protein, 9 aa, Homo Sapiens
ELTGMSATT

SEQ ID NO: 1146120 - protein, 9 aa, Homo Sapiens
AGTGGGPAC

SEQ ID NO: 1146121 - protein, 9 aa, Homo Sapiens
IGGPPSAPM

SEQ ID NO: 1146122 - protein, 9 aa, Homo Sapiens
QCDKKRGAS

SEQ ID NO: 1146123 - protein, 9 aa, Homo Sapiens
SCTMASQGL

SEQ ID NO: 1146124 - protein, 9 aa, Homo Sapiens
KHVTDFATE

SEQ ID NO: 1146125 - protein, 9 aa, Homo Sapiens
EEAHQEKHL

SEQ ID NO: 1146126 - protein, 9 aa, Homo Sapiens
PGWCRWKTK

SEQ ID NO: 1146127 - protein, 9 aa, Homo Sapiens
VIVSVQYFL

SEQ ID NO: 1146128 - protein, 9 aa, Homo Sapiens
PVRSYPVLA

SEQ ID NO: 1146129 - protein, 9 aa, Homo Sapiens
SKRTNGMKM

SEQ ID NO: 1146130 - protein, 9 aa, Homo Sapiens
ALFIWPQHS

SEQ ID NO: 1146131 - protein, 9 aa, Homo Sapiens
TILFTLIPL

SEQ ID NO: 1146132 - protein, 9 aa, Homo Sapiens
YDPKKDVHI

SEQ ID NO: 1146133 - protein, 9 aa, Homo Sapiens
GTQPCTSVP

SEQ ID NO: 1146134 - protein, 9 aa, Homo Sapiens
ARPHVPHDL

SEQ ID NO: 1146135 - protein, 9 aa, Homo Sapiens
GTYVKLSTA

SEQ ID NO: 1146136 - protein, 9 aa, Homo Sapiens
PSSLDPSNW

SEQ ID NO: 1146137 - protein, 9 aa, Homo Sapiens
ELLAPTRFT

SEQ ID NO: 1146138 - protein, 9 aa, Homo Sapiens
IIVDAAVVV

SEQ ID NO: 1146139 - protein, 9 aa, Homo Sapiens
KLCPAAKQV

SEQ ID NO: 1146140 - protein, 9 aa, Homo Sapiens
GNTNFKQKF

SEQ ID NO: 1146141 - protein, 9 aa, Homo Sapiens
GIGPLTRDA

SEQ ID NO: 1146142 - protein, 9 aa, Homo Sapiens
TYYSTSAPR

SEQ ID NO: 1146143 - protein, 9 aa, Homo Sapiens
YVTREGSCG

SEQ ID NO: 1146144 - protein, 9 aa, Homo Sapiens
RVPQPAQTW

SEQ ID NO: 1146145 - protein, 9 aa, Homo Sapiens
EIPTGSEAD

SEQ ID NO: 1146146 - protein, 9 aa, Homo Sapiens
PHPPRPARP

SEQ ID NO: 1146147 - protein, 9 aa, Homo Sapiens
HLQVEKDRL

SEQ ID NO: 1146148 - protein, 9 aa, Homo Sapiens
WWPTQSSRP

SEQ ID NO: 1146149 - protein, 9 aa, Homo Sapiens
TKFAQALPS

SEQ ID NO: 1146150 - protein, 9 aa, Homo Sapiens
MNLNKPLES

SEQ ID NO: 1146151 - protein, 9 aa, Homo Sapiens
SGGDEVSPG

SEQ ID NO: 1146152 - protein, 9 aa, Homo Sapiens
LQALGSRSG

SEQ ID NO: 1146153 - protein, 9 aa, Homo Sapiens
IILFFFLFP

SEQ ID NO: 1146154 - protein, 9 aa, Homo Sapiens
RKRAFTTIS

SEQ ID NO: 1146155 - protein, 9 aa, Homo Sapiens
LKDALQKRE

SEQ ID NO: 1146156 - protein, 9 aa, Homo Sapiens
TTCAPGTAR

SEQ ID NO: 1146157 - protein, 9 aa, Homo Sapiens
LPVRARTAR

SEQ ID NO: 1146158 - protein, 9 aa, Homo Sapiens
ASPSASQTP

SEQ ID NO: 1146159 - protein, 9 aa, Homo Sapiens
THACCHASC

SEQ ID NO: 1146160 - protein, 9 aa, Homo Sapiens
GVGDMASAG

SEQ ID NO: 1146161 - protein, 9 aa, Homo Sapiens
GAWPPPWLS

SEQ ID NO: 1146162 - protein, 9 aa, Homo Sapiens
LKMKFLSLV

SEQ ID NO: 1146163 - protein, 9 aa, Homo Sapiens
RSALPQGRA

SEQ ID NO: 1146164 - protein, 9 aa, Homo Sapiens
LFTDARVAE

SEQ ID NO: 1146165 - protein, 9 aa, Homo Sapiens
AFQGERMNH

SEQ ID NO: 1146166 - protein, 9 aa, Homo Sapiens
PWTSTSIFR

SEQ ID NO: 1146167 - protein, 9 aa, Homo Sapiens
CSSHRPVRP

SEQ ID NO: 1146168 - protein, 9 aa, Homo Sapiens
RLRTKLEKA

SEQ ID NO: 1146169 - protein, 9 aa, Homo Sapiens
IGLALSALW

SEQ ID NO: 1146170 - protein, 9 aa, Homo Sapiens
IHRLPAPGC

SEQ ID NO: 1146171 - protein, 9 aa, Homo Sapiens
NGKHSEGCS

SEQ ID NO: 1146172 - protein, 9 aa, Homo Sapiens
KDSAKHPQM

SEQ ID NO: 1146173 - protein, 9 aa, Homo Sapiens
RQEKPPTAE

SEQ ID NO: 1146174 - protein, 9 aa, Homo Sapiens
GPALPTRRL

SEQ ID NO: 1146175 - protein, 9 aa, Homo Sapiens
SALPQGRAP

SEQ ID NO: 1146176 - protein, 9 aa, Homo Sapiens
AYLKRVLIG

SEQ ID NO: 1146177 - protein, 9 aa, Homo Sapiens
MTPRDLGTV

SEQ ID NO: 1146178 - protein, 9 aa, Homo Sapiens
HLLQLLRGG

SEQ ID NO: 1146179 - protein, 9 aa, Homo Sapiens
ATLRCPAVP

SEQ ID NO: 1146180 - protein, 9 aa, Homo Sapiens
SGSLLCTPP

SEQ ID NO: 1146181 - protein, 9 aa, Homo Sapiens
TREIFVLFL

SEQ ID NO: 1146182 - protein, 9 aa, Homo Sapiens
TLTPSTTLW

SEQ ID NO: 1146183 - protein, 9 aa, Homo Sapiens
TSLTKYLKR

SEQ ID NO: 1146184 - protein, 9 aa, Homo Sapiens
VHQVDRLCG

SEQ ID NO: 1146185 - protein, 9 aa, Homo Sapiens
INDNVPVFP

SEQ ID NO: 1146186 - protein, 9 aa, Homo Sapiens
NRASSYMRN

SEQ ID NO: 1146187 - protein, 9 aa, Homo Sapiens
AQKPTGSSR

SEQ ID NO: 1146188 - protein, 9 aa, Homo Sapiens
LLFQTLLNI

SEQ ID NO: 1146189 - protein, 9 aa, Homo Sapiens
EQRIVHRDL

SEQ ID NO: 1146190 - protein, 9 aa, Homo Sapiens
REVQAGAAP

SEQ ID NO: 1146191 - protein, 9 aa, Homo Sapiens
PSRRPLGVS

SEQ ID NO: 1146192 - protein, 9 aa, Homo Sapiens
REKDKKRTD

SEQ ID NO: 1146193 - protein, 9 aa, Homo Sapiens
NPSTSSPKS

SEQ ID NO: 1146194 - protein, 9 aa, Homo Sapiens
ERQNRAALF

SEQ ID NO: 1146195 - protein, 9 aa, Homo Sapiens
QEAVRLNPK

SEQ ID NO: 1146196 - protein, 9 aa, Homo Sapiens
GSTPMHVVT

SEQ ID NO: 1146197 - protein, 9 aa, Homo Sapiens
VSVNGVLET

SEQ ID NO: 1146198 - protein, 9 aa, Homo Sapiens
MPPYTPPRL

SEQ ID NO: 1146199 - protein, 9 aa, Homo Sapiens
LQAGPPGTV

SEQ ID NO: 1146200 - protein, 9 aa, Homo Sapiens
SKIEASPIG

SEQ ID NO: 1146201 - protein, 9 aa, Homo Sapiens
NLPKTSRLS

SEQ ID NO: 1146202 - protein, 9 aa, Homo Sapiens
EDKKHGGGT

SEQ ID NO: 1146203 - protein, 9 aa, Homo Sapiens
GTREPQASR

SEQ ID NO: 1146204 - protein, 9 aa, Homo Sapiens
DVGKSALTI

SEQ ID NO: 1146205 - protein, 9 aa, Homo Sapiens
IGNSLPQGA

SEQ ID NO: 1146206 - protein, 9 aa, Homo Sapiens
HVGLFVCLA

SEQ ID NO: 1146207 - protein, 9 aa, Homo Sapiens
ESRGDNPTP

SEQ ID NO: 1146208 - protein, 9 aa, Homo Sapiens
IDIKNTVYI

SEQ ID NO: 1146209 - protein, 9 aa, Homo Sapiens
GTDEDDYRC

SEQ ID NO: 1146210 - protein, 9 aa, Homo Sapiens
TRCSFILRD

SEQ ID NO: 1146211 - protein, 9 aa, Homo Sapiens
PRMACSPTN

SEQ ID NO: 1146212 - protein, 9 aa, Homo Sapiens
RSGVRAGGA

SEQ ID NO: 1146213 - protein, 9 aa, Homo Sapiens
RAQCVVLEA

SEQ ID NO: 1146214 - protein, 9 aa, Homo Sapiens
DGHVQQRQA

SEQ ID NO: 1146215 - protein, 9 aa, Homo Sapiens
GQLEVTWSS

SEQ ID NO: 1146216 - protein, 9 aa, Homo Sapiens
SYLDKVPKK

SEQ ID NO: 1146217 - protein, 9 aa, Homo Sapiens
PWMEGADPG

SEQ ID NO: 1146218 - protein, 9 aa, Homo Sapiens
QVHRGRRPS

SEQ ID NO: 1146219 - protein, 9 aa, Homo Sapiens
VNKCFLSTS

SEQ ID NO: 1146220 - protein, 9 aa, Homo Sapiens
FASSGRVRR

SEQ ID NO: 1146221 - protein, 9 aa, Homo Sapiens
LLLVLQLRA

SEQ ID NO: 1146222 - protein, 9 aa, Homo Sapiens
RSKIEASPI

SEQ ID NO: 1146223 - protein, 9 aa, Homo Sapiens
AVVLHAPNH

SEQ ID NO: 1146224 - protein, 9 aa, Homo Sapiens
VSQQYFVDY

SEQ ID NO: 1146225 - protein, 9 aa, Homo Sapiens
SNALPEVAA

SEQ ID NO: 1146226 - protein, 9 aa, Homo Sapiens
HGAKRVCCP

SEQ ID NO: 1146227 - protein, 9 aa, Homo Sapiens
SHLCTHPGL

SEQ ID NO: 1146228 - protein, 9 aa, Homo Sapiens
RPPPVPAPS

SEQ ID NO: 1146229 - protein, 9 aa, Homo Sapiens
PVVREPEVT

SEQ ID NO: 1146230 - protein, 9 aa, Homo Sapiens
VSPASPPTQ

SEQ ID NO: 1146231 - protein, 9 aa, Homo Sapiens
PDCQSLLGG

SEQ ID NO: 1146232 - protein, 9 aa, Homo Sapiens
FAQALPSPW

SEQ ID NO: 1146233 - protein, 9 aa, Homo Sapiens
HQLQKLDFD

SEQ ID NO: 1146234 - protein, 9 aa, Homo Sapiens
HTFYNELCV

SEQ ID NO: 1146235 - protein, 9 aa, Homo Sapiens
RCPAVPAAA

SEQ ID NO: 1146236 - protein, 9 aa, Homo Sapiens
MEESEHFVK

SEQ ID NO: 1146237 - protein, 9 aa, Homo Sapiens
LPPSRSRWS

SEQ ID NO: 1146238 - protein, 9 aa, Homo Sapiens
QKLDFDTLK

SEQ ID NO: 1146239 - protein, 9 aa, Homo Sapiens
FMPSLVPVK

SEQ ID NO: 1146240 - protein, 9 aa, Homo Sapiens
SFMKLYHSL

SEQ ID NO: 1146241 - protein, 9 aa, Homo Sapiens
IPLLGDQLV

SEQ ID NO: 1146242 - protein, 9 aa, Homo Sapiens
CVIANQQQV

SEQ ID NO: 1146243 - protein, 9 aa, Homo Sapiens
YKSKVTITL

SEQ ID NO: 1146244 - protein, 9 aa, Homo Sapiens
LKKILRSFM

SEQ ID NO: 1146245 - protein, 9 aa, Homo Sapiens
PGSAPSMPA

SEQ ID NO: 1146246 - protein, 9 aa, Homo Sapiens
FLSGKFALK

SEQ ID NO: 1146247 - protein, 9 aa, Homo Sapiens
SHSDFRNRD

SEQ ID NO: 1146248 - protein, 9 aa, Homo Sapiens
GDRSTYRLS

SEQ ID NO: 1146249 - protein, 9 aa, Homo Sapiens
PPWLSPLQR

SEQ ID NO: 1146250 - protein, 9 aa, Homo Sapiens
GHPGTHGPS

SEQ ID NO: 1146251 - protein, 9 aa, Homo Sapiens
GYGYGSGFR

SEQ ID NO: 1146252 - protein, 9 aa, Homo Sapiens
FSSSLGSHP

SEQ ID NO: 1146253 - protein, 9 aa, Homo Sapiens
EASTGAWTA

SEQ ID NO: 1146254 - protein, 9 aa, Homo Sapiens
GTRCRASRA

SEQ ID NO: 1146255 - protein, 9 aa, Homo Sapiens
ASSHITHID

SEQ ID NO: 1146256 - protein, 9 aa, Homo Sapiens
HVSSFPSST

SEQ ID NO: 1146257 - protein, 9 aa, Homo Sapiens
ESDEVAWLK

SEQ ID NO: 1146258 - protein, 9 aa, Homo Sapiens
REREHIHAK

SEQ ID NO: 1146259 - protein, 9 aa, Homo Sapiens
PIVLLLPVI

SEQ ID NO: 1146260 - protein, 9 aa, Homo Sapiens
ILCTKPVES

SEQ ID NO: 1146261 - protein, 9 aa, Homo Sapiens
IIPLERRSP

SEQ ID NO: 1146262 - protein, 9 aa, Homo Sapiens
PPGNSATTT

SEQ ID NO: 1146263 - protein, 9 aa, Homo Sapiens
HPAALWGQG

SEQ ID NO: 1146264 - protein, 9 aa, Homo Sapiens
CAGPVFTPA

SEQ ID NO: 1146265 - protein, 9 aa, Homo Sapiens
ANQVGSEAG

SEQ ID NO: 1146266 - protein, 9 aa, Homo Sapiens
ASRPPLPRP

SEQ ID NO: 1146267 - protein, 9 aa, Homo Sapiens
LRFPFAVVL

SEQ ID NO: 1146268 - protein, 9 aa, Homo Sapiens
LPRYWTYGI

SEQ ID NO: 1146269 - protein, 9 aa, Homo Sapiens
FPLDVPDVP

SEQ ID NO: 1146270 - protein, 9 aa, Homo Sapiens
PFVPPLASS

SEQ ID NO: 1146271 - protein, 9 aa, Homo Sapiens
VPDHPSGQG

SEQ ID NO: 1146272 - protein, 9 aa, Homo Sapiens
HLSGGVPPY

SEQ ID NO: 1146273 - protein, 9 aa, Homo Sapiens
FCSHKSKGE

SEQ ID NO: 1146274 - protein, 9 aa, Homo Sapiens
LDVVLRDGL

SEQ ID NO: 1146275 - protein, 9 aa, Homo Sapiens
KHLNGSLWN

SEQ ID NO: 1146276 - protein, 9 aa, Homo Sapiens
CRWAHSRQR

SEQ ID NO: 1146277 - protein, 9 aa, Homo Sapiens
NSKKPPQSK

SEQ ID NO: 1146278 - protein, 9 aa, Homo Sapiens
LIQIFFFHL

SEQ ID NO: 1146279 - protein, 9 aa, Homo Sapiens
DVCGSLFEE

SEQ ID NO: 1146280 - protein, 9 aa, Homo Sapiens
TAQIQRPIQ

SEQ ID NO: 1146281 - protein, 9 aa, Homo Sapiens
PIADDLIEK

SEQ ID NO: 1146282 - protein, 9 aa, Homo Sapiens
KLRKNVRRK

SEQ ID NO: 1146283 - protein, 9 aa, Homo Sapiens
CLSALDKTD

SEQ ID NO: 1146284 - protein, 9 aa, Homo Sapiens
RCSQGACRR

SEQ ID NO: 1146285 - protein, 9 aa, Homo Sapiens
IILSVKILN

SEQ ID NO: 1146286 - protein, 9 aa, Homo Sapiens
QAEGSLKKT

SEQ ID NO: 1146287 - protein, 9 aa, Homo Sapiens
LSLVFTFIV

SEQ ID NO: 1146288 - protein, 9 aa, Homo Sapiens
SGSGKTEST

SEQ ID NO: 1146289 - protein, 9 aa, Homo Sapiens
WSVHGQRRL

SEQ ID NO: 1146290 - protein, 9 aa, Homo Sapiens
RAARCTRSA

SEQ ID NO: 1146291 - protein, 9 aa, Homo Sapiens
ACCHASCHS

SEQ ID NO: 1146292 - protein, 9 aa, Homo Sapiens
RCLCVPCPG

SEQ ID NO: 1146293 - protein, 9 aa, Homo Sapiens
APPKEVEED

SEQ ID NO: 1146294 - protein, 9 aa, Homo Sapiens
GEQSDCPVI

SEQ ID NO: 1146295 - protein, 9 aa, Homo Sapiens
QGKLGPKEE

SEQ ID NO: 1146296 - protein, 9 aa, Homo Sapiens
FLFPLGYLL

SEQ ID NO: 1146297 - protein, 9 aa, Homo Sapiens
FFLMLPEMV

SEQ ID NO: 1146298 - protein, 9 aa, Homo Sapiens
HVAIHEAME

SEQ ID NO: 1146299 - protein, 9 aa, Homo Sapiens
WLSPLQRSG

SEQ ID NO: 1146300 - protein, 9 aa, Homo Sapiens
HLQFPLDVP

SEQ ID NO: 1146301 - protein, 9 aa, Homo Sapiens
RETSKPLEP

SEQ ID NO: 1146302 - protein, 9 aa, Homo Sapiens
DNFFYQERA

SEQ ID NO: 1146303 - protein, 9 aa, Homo Sapiens
DIFLMKRFL

SEQ ID NO: 1146304 - protein, 9 aa, Homo Sapiens
RWPRGRPRW

SEQ ID NO: 1146305 - protein, 9 aa, Homo Sapiens
KKKEVRCSG

SEQ ID NO: 1146306 - protein, 9 aa, Homo Sapiens
TSLAEEASS

SEQ ID NO: 1146307 - protein, 9 aa, Homo Sapiens
RVTDNMATV

SEQ ID NO: 1146308 - protein, 9 aa, Homo Sapiens
LPAPGCHPT

SEQ ID NO: 1146309 - protein, 9 aa, Homo Sapiens
SLWGRAWQY

SEQ ID NO: 1146310 - protein, 9 aa, Homo Sapiens
LELYRKMLP

SEQ ID NO: 1146311 - protein, 9 aa, Homo Sapiens
KTVFDNFFY

SEQ ID NO: 1146312 - protein, 9 aa, Homo Sapiens
PSLGLTVPT

SEQ ID NO: 1146313 - protein, 9 aa, Homo Sapiens
KRRRRRKRS

SEQ ID NO: 1146314 - protein, 9 aa, Homo Sapiens
STTRRAVLV

SEQ ID NO: 1146315 - protein, 9 aa, Homo Sapiens
PHLSPWDLG

SEQ ID NO: 1146316 - protein, 9 aa, Homo Sapiens
VVNQQPIPT

SEQ ID NO: 1146317 - protein, 9 aa, Homo Sapiens
KQAQQEPLP

SEQ ID NO: 1146318 - protein, 9 aa, Homo Sapiens
SRRPLGVSP

SEQ ID NO: 1146319 - protein, 9 aa, Homo Sapiens
QKGDPREPT

SEQ ID NO: 1146320 - protein, 9 aa, Homo Sapiens
RLPAPGCHP

SEQ ID NO: 1146321 - protein, 9 aa, Homo Sapiens
PHVCQDIPA

SEQ ID NO: 1146322 - protein, 9 aa, Homo Sapiens
GSLAYAPQQ

SEQ ID NO: 1146323 - protein, 9 aa, Homo Sapiens
PKSPGPPAG

SEQ ID NO: 1146324 - protein, 9 aa, Homo Sapiens
REAEWQTRQ

SEQ ID NO: 1146325 - protein, 9 aa, Homo Sapiens
YFFPFFFIL

SEQ ID NO: 1146326 - protein, 9 aa, Homo Sapiens
ARTAIPLHL

SEQ ID NO: 1146327 - protein, 9 aa, Homo Sapiens
AKKSRWDNE

SEQ ID NO: 1146328 - protein, 9 aa, Homo Sapiens
DDLEYLECF

SEQ ID NO: 1146329 - protein, 9 aa, Homo Sapiens
DTVIGRELR

SEQ ID NO: 1146330 - protein, 9 aa, Homo Sapiens
PTFYPHPHP

SEQ ID NO: 1146331 - protein, 9 aa, Homo Sapiens
GSMRDKKRR

SEQ ID NO: 1146332 - protein, 9 aa, Homo Sapiens
TRWAAATCS

SEQ ID NO: 1146333 - protein, 9 aa, Homo Sapiens
IDKKRKAFD

SEQ ID NO: 1146334 - protein, 9 aa, Homo Sapiens
PHDLVLQGP

SEQ ID NO: 1146335 - protein, 9 aa, Homo Sapiens
PKMLWGNDS

SEQ ID NO: 1146336 - protein, 9 aa, Homo Sapiens
LLLYNSTMS

SEQ ID NO: 1146337 - protein, 9 aa, Homo Sapiens
SASEHTDIC

SEQ ID NO: 1146338 - protein, 9 aa, Homo Sapiens
PSYPGFPHS

SEQ ID NO: 1146339 - protein, 9 aa, Homo Sapiens
QGSAALLPR

SEQ ID NO: 1146340 - protein, 9 aa, Homo Sapiens
HPPTTTTSS

SEQ ID NO: 1146341 - protein, 9 aa, Homo Sapiens
QGSNMFNHL

SEQ ID NO: 1146342 - protein, 9 aa, Homo Sapiens
SNPIFRPTF

SEQ ID NO: 1146343 - protein, 9 aa, Homo Sapiens
GLGGGGKAT

SEQ ID NO: 1146344 - protein, 9 aa, Homo Sapiens
QCNKHSFSD

SEQ ID NO: 1146345 - protein, 9 aa, Homo Sapiens
EGSAEIPTG

SEQ ID NO: 1146346 - protein, 9 aa, Homo Sapiens
FLMLPEMVK

SEQ ID NO: 1146347 - protein, 9 aa, Homo Sapiens
KVVKVQLWI

SEQ ID NO: 1146348 - protein, 9 aa, Homo Sapiens
PERPCARGQ

SEQ ID NO: 1146349 - protein, 9 aa, Homo Sapiens
QEKHLPRRI

SEQ ID NO: 1146350 - protein, 9 aa, Homo Sapiens
IIQGSEAVG

SEQ ID NO: 1146351 - protein, 9 aa, Homo Sapiens
HTPMHFFLS

SEQ ID NO: 1146352 - protein, 9 aa, Homo Sapiens
RSQTGSPRS

SEQ ID NO: 1146353 - protein, 9 aa, Homo Sapiens
MSKKSPWEQ

SEQ ID NO: 1146354 - protein, 9 aa, Homo Sapiens
GSPIADDLI

SEQ ID NO: 1146355 - protein, 9 aa, Homo Sapiens
RRCTGSPQT

SEQ ID NO: 1146356 - protein, 9 aa, Homo Sapiens
PFDNMHDDP

SEQ ID NO: 1146357 - protein, 9 aa, Homo Sapiens
SMLERSAIA

SEQ ID NO: 1146358 - protein, 9 aa, Homo Sapiens
KSEQFKIPE

SEQ ID NO: 1146359 - protein, 9 aa, Homo Sapiens
SAPTVPCSA

SEQ ID NO: 1146360 - protein, 9 aa, Homo Sapiens
RSAFPSRSL

SEQ ID NO: 1146361 - protein, 9 aa, Homo Sapiens
PKKAEHLDF

SEQ ID NO: 1146362 - protein, 9 aa, Homo Sapiens
GPACVPVAE

SEQ ID NO: 1146363 - protein, 9 aa, Homo Sapiens
SKHHPLDER

SEQ ID NO: 1146364 - protein, 9 aa, Homo Sapiens
REDDHVAIH

SEQ ID NO: 1146365 - protein, 9 aa, Homo Sapiens
DHVAIHEAM

SEQ ID NO: 1146366 - protein, 9 aa, Homo Sapiens
VLHELLDVV

SEQ ID NO: 1146367 - protein, 9 aa, Homo Sapiens
FPSPQGPLF

SEQ ID NO: 1146368 - protein, 9 aa, Homo Sapiens
GGTEYYPHL

SEQ ID NO: 1146369 - protein, 9 aa, Homo Sapiens
GSGQPAAAN

SEQ ID NO: 1146370 - protein, 9 aa, Homo Sapiens
STYRLSIIL

SEQ ID NO: 1146371 - protein, 9 aa, Homo Sapiens
SKKWRLPTH

SEQ ID NO: 1146372 - protein, 9 aa, Homo Sapiens
GIEECMSMV

SEQ ID NO: 1146373 - protein, 9 aa, Homo Sapiens
RAPSQTLEA

SEQ ID NO: 1146374 - protein, 9 aa, Homo Sapiens
PSTTRRAVL

SEQ ID NO: 1146375 - protein, 9 aa, Homo Sapiens
GVDDVQFPY

SEQ ID NO: 1146376 - protein, 9 aa, Homo Sapiens
EVGGGGRWD

SEQ ID NO: 1146377 - protein, 9 aa, Homo Sapiens
WDNETPEER

SEQ ID NO: 1146378 - protein, 9 aa, Homo Sapiens
TTEPPPVGA

SEQ ID NO: 1146379 - protein, 9 aa, Homo Sapiens
TAATLRCPA

SEQ ID NO: 1146380 - protein, 9 aa, Homo Sapiens
VLDREQRDS

SEQ ID NO: 1146381 - protein, 9 aa, Homo Sapiens
LRPRGGAWK

SEQ ID NO: 1146382 - protein, 9 aa, Homo Sapiens
LIPSHPNPT

SEQ ID NO: 1146383 - protein, 9 aa, Homo Sapiens
MLLSITNVI

SEQ ID NO: 1146384 - protein, 9 aa, Homo Sapiens
KMAPPKEVE

SEQ ID NO: 1146385 - protein, 9 aa, Homo Sapiens
HPPSAIRDM

SEQ ID NO: 1146386 - protein, 9 aa, Homo Sapiens
GAKGEEQSR

SEQ ID NO: 1146387 - protein, 9 aa, Homo Sapiens
INIDDLVKV

SEQ ID NO: 1146388 - protein, 9 aa, Homo Sapiens
VWEPPWTGR

SEQ ID NO: 1146389 - protein, 9 aa, Homo Sapiens
APEETPQPP

SEQ ID NO: 1146390 - protein, 9 aa, Homo Sapiens
ACCGTRRSC

SEQ ID NO: 1146391 - protein, 9 aa, Homo Sapiens
DQRLREIAG

SEQ ID NO: 1146392 - protein, 9 aa, Homo Sapiens
YKRLRAFQR

SEQ ID NO: 1146393 - protein, 9 aa, Homo Sapiens
GQWLGRVGW

SEQ ID NO: 1146394 - protein, 9 aa, Homo Sapiens
GKFALKSPP

SEQ ID NO: 1146395 - protein, 9 aa, Homo Sapiens
FFRGGDNPN

SEQ ID NO: 1146396 - protein, 9 aa, Homo Sapiens
LCQCDKKRG

SEQ ID NO: 1146397 - protein, 9 aa, Homo Sapiens
IADPFKLAE

SEQ ID NO: 1146398 - protein, 9 aa, Homo Sapiens
WAFQGERMN

SEQ ID NO: 1146399 - protein, 9 aa, Homo Sapiens
AFEKVATSE

SEQ ID NO: 1146400 - protein, 9 aa, Homo Sapiens
GQTWGPRTP

SEQ ID NO: 1146401 - protein, 9 aa, Homo Sapiens
VQVENQVHG

SEQ ID NO: 1146402 - protein, 9 aa, Homo Sapiens
DEVAWLKML

SEQ ID NO: 1146403 - protein, 9 aa, Homo Sapiens
RKNKKPGEG

SEQ ID NO: 1146404 - protein, 9 aa, Homo Sapiens
DDLAELVSQ

SEQ ID NO: 1146405 - protein, 9 aa, Homo Sapiens
VIIKDIFLM

SEQ ID NO: 1146406 - protein, 9 aa, Homo Sapiens
LEHHPHTLD

SEQ ID NO: 1146407 - protein, 9 aa, Homo Sapiens
RHPDTDEAV

SEQ ID NO: 1146408 - protein, 9 aa, Homo Sapiens
AERAVLGRA

SEQ ID NO: 1146409 - protein, 9 aa, Homo Sapiens
LPGNWELKL

SEQ ID NO: 1146410 - protein, 9 aa, Homo Sapiens
SHILEHHPH

SEQ ID NO: 1146411 - protein, 9 aa, Homo Sapiens
EIIIVVNQE

SEQ ID NO: 1146412 - protein, 9 aa, Homo Sapiens
SNIRENVLW

SEQ ID NO: 1146413 - protein, 9 aa, Homo Sapiens
IGEKTEIQL

SEQ ID NO: 1146414 - protein, 9 aa, Homo Sapiens
EHLQVEKDR

SEQ ID NO: 1146415 - protein, 9 aa, Homo Sapiens
LLPSAALAL

SEQ ID NO: 1146416 - protein, 9 aa, Homo Sapiens
NRPAERAVL

SEQ ID NO: 1146417 - protein, 9 aa, Homo Sapiens
PPGSAPSMP

SEQ ID NO: 1146418 - protein, 9 aa, Homo Sapiens
NWLTEVQDM

SEQ ID NO: 1146419 - protein, 9 aa, Homo Sapiens
KTRMLYHSG

SEQ ID NO: 1146420 - protein, 9 aa, Homo Sapiens
QHVGLFVCL

SEQ ID NO: 1146421 - protein, 9 aa, Homo Sapiens
MNHNSAPTV

SEQ ID NO: 1146422 - protein, 9 aa, Homo Sapiens
TMQLFFFFL

SEQ ID NO: 1146423 - protein, 9 aa, Homo Sapiens
TGSSRLAAL

SEQ ID NO: 1146424 - protein, 9 aa, Homo Sapiens
GHQGPADPP

SEQ ID NO: 1146425 - protein, 9 aa, Homo Sapiens
QRLTWVCRR

SEQ ID NO: 1146426 - protein, 9 aa, Homo Sapiens
RAGPAPQGP

SEQ ID NO: 1146427 - protein, 9 aa, Homo Sapiens
SRGQNIRNR

SEQ ID NO: 1146428 - protein, 9 aa, Homo Sapiens
GGELLLGGV

SEQ ID NO: 1146429 - protein, 9 aa, Homo Sapiens
KKRTDSVAN

SEQ ID NO: 1146430 - protein, 9 aa, Homo Sapiens
SAATTCAPG

SEQ ID NO: 1146431 - protein, 9 aa, Homo Sapiens
CGFVRRPTV

SEQ ID NO: 1146432 - protein, 9 aa, Homo Sapiens
DSRVSSAKR

SEQ ID NO: 1146433 - protein, 9 aa, Homo Sapiens
FSPAQLSQI

SEQ ID NO: 1146434 - protein, 9 aa, Homo Sapiens
TGVSGLNGE

SEQ ID NO: 1146435 - protein, 9 aa, Homo Sapiens
TTRASTPNT

SEQ ID NO: 1146436 - protein, 9 aa, Homo Sapiens
VAGTAGARH

SEQ ID NO: 1146437 - protein, 9 aa, Homo Sapiens
VDAAVVVLV

SEQ ID NO: 1146438 - protein, 9 aa, Homo Sapiens
HAASTTYPE

SEQ ID NO: 1146439 - protein, 9 aa, Homo Sapiens
YIARCQDSP

SEQ ID NO: 1146440 - protein, 9 aa, Homo Sapiens
CLPSNEDTE

SEQ ID NO: 1146441 - protein, 9 aa, Homo Sapiens
GAGSPTLGR

SEQ ID NO: 1146442 - protein, 9 aa, Homo Sapiens
IQIFFFHLN

SEQ ID NO: 1146443 - protein, 9 aa, Homo Sapiens
SSTSRDSRS

SEQ ID NO: 1146444 - protein, 9 aa, Homo Sapiens
SRSRWSRVP

SEQ ID NO: 1146445 - protein, 9 aa, Homo Sapiens
VGVGDMASA

SEQ ID NO: 1146446 - protein, 9 aa, Homo Sapiens
GRRAPGRPG

SEQ ID NO: 1146447 - protein, 9 aa, Homo Sapiens
LWKRLKVFS

SEQ ID NO: 1146448 - protein, 9 aa, Homo Sapiens
SSATGGDRP

SEQ ID NO: 1146449 - protein, 9 aa, Homo Sapiens
WMQGLPRNM

SEQ ID NO: 1146450 - protein, 9 aa, Homo Sapiens
ATAQIQRPI

SEQ ID NO: 1146451 - protein, 9 aa, Homo Sapiens
SPWEQKGGS

SEQ ID NO: 1146452 - protein, 9 aa, Homo Sapiens
GAQDYDRRA

SEQ ID NO: 1146453 - protein, 9 aa, Homo Sapiens
SHPWFLGQY

SEQ ID NO: 1146454 - protein, 9 aa, Homo Sapiens
STMAQLTTP

SEQ ID NO: 1146455 - protein, 9 aa, Homo Sapiens
QVIRCPLQI

SEQ ID NO: 1146456 - protein, 9 aa, Homo Sapiens
LLRFPFAVV

SEQ ID NO: 1146457 - protein, 9 aa, Homo Sapiens
IHTGGKTIQ

SEQ ID NO: 1146458 - protein, 9 aa, Homo Sapiens
HRGRRPSGH

SEQ ID NO: 1146459 - protein, 9 aa, Homo Sapiens
LALITSNIR

SEQ ID NO: 1146460 - protein, 9 aa, Homo Sapiens
VEEGQMLTL

SEQ ID NO: 1146461 - protein, 9 aa, Homo Sapiens
FYEFTFRKF

SEQ ID NO: 1146462 - protein, 9 aa, Homo Sapiens
VPFLFVVQV

SEQ ID NO: 1146463 - protein, 9 aa, Homo Sapiens
AAAAAANCV

SEQ ID NO: 1146464 - protein, 9 aa, Homo Sapiens
CHTTGWMFA

SEQ ID NO: 1146465 - protein, 9 aa, Homo Sapiens
EDHLQFPLD

SEQ ID NO: 1146466 - protein, 9 aa, Homo Sapiens
KETSGLSSS

SEQ ID NO: 1146467 - protein, 9 aa, Homo Sapiens
AHGAGVPHL

SEQ ID NO: 1146468 - protein, 9 aa, Homo Sapiens
RFVDGLAFK

SEQ ID NO: 1146469 - protein, 9 aa, Homo Sapiens
VVNQEILNT

SEQ ID NO: 1146470 - protein, 9 aa, Homo Sapiens
MTSWNHKTM

SEQ ID NO: 1146471 - protein, 9 aa, Homo Sapiens
DKDDQHTFR

SEQ ID NO: 1146472 - protein, 9 aa, Homo Sapiens
DPHRGTPSL

SEQ ID NO: 1146473 - protein, 9 aa, Homo Sapiens
QVENQVHGI

SEQ ID NO: 1146474 - protein, 9 aa, Homo Sapiens
GQEMVITVD

SEQ ID NO: 1146475 - protein, 9 aa, Homo Sapiens
APGTARTCL

SEQ ID NO: 1146476 - protein, 9 aa, Homo Sapiens
GAEPGANSV

SEQ ID NO: 1146477 - protein, 9 aa, Homo Sapiens
YRLRAVLGL

SEQ ID NO: 1146478 - protein, 9 aa, Homo Sapiens
ILLSPVSRY

SEQ ID NO: 1146479 - protein, 9 aa, Homo Sapiens
CRGKKFTDF

SEQ ID NO: 1146480 - protein, 9 aa, Homo Sapiens
QSEAYLQEE

SEQ ID NO: 1146481 - protein, 9 aa, Homo Sapiens
VGPELNELD

SEQ ID NO: 1146482 - protein, 9 aa, Homo Sapiens
DGGTEYYPH

SEQ ID NO: 1146483 - protein, 9 aa, Homo Sapiens
CAPFSSDLG

SEQ ID NO: 1146484 - protein, 9 aa, Homo Sapiens
REFTTLNQL

SEQ ID NO: 1146485 - protein, 9 aa, Homo Sapiens
DGKRKTIDC

SEQ ID NO: 1146486 - protein, 9 aa, Homo Sapiens
GSQTVNLAG

SEQ ID NO: 1146487 - protein, 9 aa, Homo Sapiens
CHSHLCTHP

SEQ ID NO: 1146488 - protein, 9 aa, Homo Sapiens
TGSTPMHVV

SEQ ID NO: 1146489 - protein, 9 aa, Homo Sapiens
SVSRAFRDG

SEQ ID NO: 1146490 - protein, 9 aa, Homo Sapiens
DPEDGDATA

SEQ ID NO: 1146491 - protein, 9 aa, Homo Sapiens
AFIILEKNP

SEQ ID NO: 1146492 - protein, 9 aa, Homo Sapiens
HLNLLITLL

SEQ ID NO: 1146493 - protein, 9 aa, Homo Sapiens
LLPVITGSS

SEQ ID NO: 1146494 - protein, 9 aa, Homo Sapiens
LPSSRGMGR

SEQ ID NO: 1146495 - protein, 9 aa, Homo Sapiens
KPLCKTVKY

SEQ ID NO: 1146496 - protein, 9 aa, Homo Sapiens
FDTWQMLFY

SEQ ID NO: 1146497 - protein, 9 aa, Homo Sapiens
PPVLSPRVT

SEQ ID NO: 1146498 - protein, 9 aa, Homo Sapiens
ESIFRNTLS

SEQ ID NO: 1146499 - protein, 9 aa, Homo Sapiens
PAAPRGLGE

SEQ ID NO: 1146500 - protein, 9 aa, Homo Sapiens
HMPVSPISQ

SEQ ID NO: 1146501 - protein, 9 aa, Homo Sapiens
HLFDLSRHF

SEQ ID NO: 1146502 - protein, 9 aa, Homo Sapiens
TQPCTSVPS

SEQ ID NO: 1146503 - protein, 9 aa, Homo Sapiens
SAHPSRPCR

SEQ ID NO: 1146504 - protein, 9 aa, Homo Sapiens
DPDEPIHDP

SEQ ID NO: 1146505 - protein, 9 aa, Homo Sapiens
PGGAGARPP

SEQ ID NO: 1146506 - protein, 9 aa, Homo Sapiens
AFSYCGPLR

SEQ ID NO: 1146507 - protein, 9 aa, Homo Sapiens
DHLLQLLRG

SEQ ID NO: 1146508 - protein, 9 aa, Homo Sapiens
GEKTEIQLT

SEQ ID NO: 1146509 - protein, 9 aa, Homo Sapiens
HRGTPSLIM

SEQ ID NO: 1146510 - protein, 9 aa, Homo Sapiens
QTWGPRTPR

SEQ ID NO: 1146511 - protein, 9 aa, Homo Sapiens
ESLAQAAAL

SEQ ID NO: 1146512 - protein, 9 aa, Homo Sapiens
KMTMLLLYN

SEQ ID NO: 1146513 - protein, 9 aa, Homo Sapiens
DHLFDLSRH

SEQ ID NO: 1146514 - protein, 9 aa, Homo Sapiens
GSGKYNFTS

SEQ ID NO: 1146515 - protein, 9 aa, Homo Sapiens
IEVTTYNRD

SEQ ID NO: 1146516 - protein, 9 aa, Homo Sapiens
TSAHPSRPC

SEQ ID NO: 1146517 - protein, 9 aa, Homo Sapiens
LGVCGHLKP

SEQ ID NO: 1146518 - protein, 9 aa, Homo Sapiens
MPPFYYVTR

SEQ ID NO: 1146519 - protein, 9 aa, Homo Sapiens
RPSGHPAAL

SEQ ID NO: 1146520 - protein, 9 aa, Homo Sapiens
KVATSEALC

SEQ ID NO: 1146521 - protein, 9 aa, Homo Sapiens
LPRSACRWE

SEQ ID NO: 1146522 - protein, 9 aa, Homo Sapiens
VQGRGIGPL

SEQ ID NO: 1146523 - protein, 9 aa, Homo Sapiens
MHLDVSQRN

SEQ ID NO: 1146524 - protein, 9 aa, Homo Sapiens
TGSVVVSAP

SEQ ID NO: 1146525 - protein, 9 aa, Homo Sapiens
ESCNHEVCA

SEQ ID NO: 1146526 - protein, 9 aa, Homo Sapiens
IARYVPLTP

SEQ ID NO: 1146527 - protein, 9 aa, Homo Sapiens
TFRERNQGS

SEQ ID NO: 1146528 - protein, 9 aa, Homo Sapiens
AVNRPAERA

SEQ ID NO: 1146529 - protein, 9 aa, Homo Sapiens
SCSSSATGG

SEQ ID NO: 1146530 - protein, 9 aa, Homo Sapiens
SEAYLQEEL

SEQ ID NO: 1146531 - protein, 9 aa, Homo Sapiens
LLPRALPSL

SEQ ID NO: 1146532 - protein, 9 aa, Homo Sapiens
SIHDKHLNR

SEQ ID NO: 1146533 - protein, 9 aa, Homo Sapiens
NGIEECMSM

SEQ ID NO: 1146534 - protein, 9 aa, Homo Sapiens
SFSPDSGSS

SEQ ID NO: 1146535 - protein, 9 aa, Homo Sapiens
PRGLGEPHH

SEQ ID NO: 1146536 - protein, 9 aa, Homo Sapiens
LPITSSLWT

SEQ ID NO: 1146537 - protein, 9 aa, Homo Sapiens
GQGAAARPA

SEQ ID NO: 1146538 - protein, 9 aa, Homo Sapiens
GQPTLDVFW

SEQ ID NO: 1146539 - protein, 9 aa, Homo Sapiens
NLLLTMMAY

SEQ ID NO: 1146540 - protein, 9 aa, Homo Sapiens
HGPLTGRDA

SEQ ID NO: 1146541 - protein, 9 aa, Homo Sapiens
ACVEEPNDT

SEQ ID NO: 1146542 - protein, 9 aa, Homo Sapiens
CGLLWWWWW

SEQ ID NO: 1146543 - protein, 9 aa, Homo Sapiens
GVGWAQRCS

SEQ ID NO: 1146544 - protein, 9 aa, Homo Sapiens
KPPAMRSGG

SEQ ID NO: 1146545 - protein, 9 aa, Homo Sapiens
VVKKDHVTL

SEQ ID NO: 1146546 - protein, 9 aa, Homo Sapiens
TFARNTSRI

SEQ ID NO: 1146547 - protein, 9 aa, Homo Sapiens
LPEHKKHVT

SEQ ID NO: 1146548 - protein, 9 aa, Homo Sapiens
AFSTCLTHL

SEQ ID NO: 1146549 - protein, 9 aa, Homo Sapiens
LQVIEVTTY

SEQ ID NO: 1146550 - protein, 9 aa, Homo Sapiens
KSPGPPAGS

SEQ ID NO: 1146551 - protein, 9 aa, Homo Sapiens
MSCRILLGV

SEQ ID NO: 1146552 - protein, 9 aa, Homo Sapiens
RTYSLITIG

SEQ ID NO: 1146553 - protein, 9 aa, Homo Sapiens
GDVHQDTKD

SEQ ID NO: 1146554 - protein, 9 aa, Homo Sapiens
QLIQIFFFH

SEQ ID NO: 1146555 - protein, 9 aa, Homo Sapiens
RHHTAGLVE

SEQ ID NO: 1146556 - protein, 9 aa, Homo Sapiens
YTRFIRQHK

SEQ ID NO: 1146557 - protein, 9 aa, Homo Sapiens
QDLTHMIHI

SEQ ID NO: 1146558 - protein, 9 aa, Homo Sapiens
PRRRRRFPA

SEQ ID NO: 1146559 - protein, 9 aa, Homo Sapiens
ALWGQGPRR

SEQ ID NO: 1146560 - protein, 9 aa, Homo Sapiens
RKPLELFGK

SEQ ID NO: 1146561 - protein, 9 aa, Homo Sapiens
CCGEYTYFI

SEQ ID NO: 1146562 - protein, 9 aa, Homo Sapiens
TSAFGIHKG

SEQ ID NO: 1146563 - protein, 9 aa, Homo Sapiens
EFLHCRGKK

SEQ ID NO: 1146564 - protein, 9 aa, Homo Sapiens
MQNMFAWQI

SEQ ID NO: 1146565 - protein, 9 aa, Homo Sapiens
NKETRMSCT

SEQ ID NO: 1146566 - protein, 9 aa, Homo Sapiens
SALLDEKRC

SEQ ID NO: 1146567 - protein, 9 aa, Homo Sapiens
LSQLRELCG

SEQ ID NO: 1146568 - protein, 9 aa, Homo Sapiens
LISDIIHEK

SEQ ID NO: 1146569 - protein, 9 aa, Homo Sapiens
WVVGTYLLL

SEQ ID NO: 1146570 - protein, 9 aa, Homo Sapiens
DITWRWNSM

SEQ ID NO: 1146571 - protein, 9 aa, Homo Sapiens
LVSQQYFVD

SEQ ID NO: 1146572 - protein, 9 aa, Homo Sapiens
AVPRVRFTN

SEQ ID NO: 1146573 - protein, 9 aa, Homo Sapiens
MFAWQIKTA

SEQ ID NO: 1146574 - protein, 9 aa, Homo Sapiens
GTAEIEDTI

SEQ ID NO: 1146575 - protein, 9 aa, Homo Sapiens
LQAELEELC

SEQ ID NO: 1146576 - protein, 9 aa, Homo Sapiens
GSCDTSLAE

SEQ ID NO: 1146577 - protein, 9 aa, Homo Sapiens
MRGPQEIQG

SEQ ID NO: 1146578 - protein, 9 aa, Homo Sapiens
TENVYVLAN

SEQ ID NO: 1146579 - protein, 9 aa, Homo Sapiens
YLSHHPKPE

SEQ ID NO: 1146580 - protein, 9 aa, Homo Sapiens
IIKHLNGSL

SEQ ID NO: 1146581 - protein, 9 aa, Homo Sapiens
GPLFLLFFS

SEQ ID NO: 1146582 - protein, 9 aa, Homo Sapiens
PSWSVVNWS

SEQ ID NO: 1146583 - protein, 9 aa, Homo Sapiens
LRITFQQHR

SEQ ID NO: 1146584 - protein, 9 aa, Homo Sapiens
APCPPLEVH

SEQ ID NO: 1146585 - protein, 9 aa, Homo Sapiens
PTSGGSCDT

SEQ ID NO: 1146586 - protein, 9 aa, Homo Sapiens
PWTGRGEQS

SEQ ID NO: 1146587 - protein, 9 aa, Homo Sapiens
CVSQEHQCS

SEQ ID NO: 1146588 - protein, 9 aa, Homo Sapiens
LLTRSNDPK

SEQ ID NO: 1146589 - protein, 9 aa, Homo Sapiens
SWREGRERR

SEQ ID NO: 1146590 - protein, 9 aa, Homo Sapiens
EICVKRRRR

SEQ ID NO: 1146591 - protein, 9 aa, Homo Sapiens
GVAIGEAPD

SEQ ID NO: 1146592 - protein, 9 aa, Homo Sapiens
GEQIPGLLG

SEQ ID NO: 1146593 - protein, 9 aa, Homo Sapiens
NDIVGSEAF

SEQ ID NO: 1146594 - protein, 9 aa, Homo Sapiens
IAFHIKSIA

SEQ ID NO: 1146595 - protein, 9 aa, Homo Sapiens
GDVGKSALT

SEQ ID NO: 1146596 - protein, 9 aa, Homo Sapiens
EETGCLECC

SEQ ID NO: 1146597 - protein, 9 aa, Homo Sapiens
SNKLGFPKR

SEQ ID NO: 1146598 - protein, 9 aa, Homo Sapiens
ENSHPPTTT

SEQ ID NO: 1146599 - protein, 9 aa, Homo Sapiens
GSEADGLDS

SEQ ID NO: 1146600 - protein, 9 aa, Homo Sapiens
TGGGPACVP

SEQ ID NO: 1146601 - protein, 9 aa, Homo Sapiens
GARGRTGAV

SEQ ID NO: 1146602 - protein, 9 aa, Homo Sapiens
ADNGCLRQE

SEQ ID NO: 1146603 - protein, 9 aa, Homo Sapiens
SLESIFRNT

SEQ ID NO: 1146604 - protein, 9 aa, Homo Sapiens
CPSVESSYS

SEQ ID NO: 1146605 - protein, 9 aa, Homo Sapiens
LEEQRIVHR

SEQ ID NO: 1146606 - protein, 9 aa, Homo Sapiens
HETILQKRM

SEQ ID NO: 1146607 - protein, 9 aa, Homo Sapiens
KLWGLETKE

SEQ ID NO: 1146608 - protein, 9 aa, Homo Sapiens
LLRGGVLAQ

SEQ ID NO: 1146609 - protein, 9 aa, Homo Sapiens
LITIGEIAQ

SEQ ID NO: 1146610 - protein, 9 aa, Homo Sapiens
YQERANKKQ

SEQ ID NO: 1146611 - protein, 9 aa, Homo Sapiens
EKVITPYTL

SEQ ID NO: 1146612 - protein, 9 aa, Homo Sapiens
LAKKTETVE

SEQ ID NO: 1146613 - protein, 9 aa, Homo Sapiens
ETSGLSSSP

SEQ ID NO: 1146614 - protein, 9 aa, Homo Sapiens
FWLALQAGP

SEQ ID NO: 1146615 - protein, 9 aa, Homo Sapiens
GRKRAFTTI

SEQ ID NO: 1146616 - protein, 9 aa, Homo Sapiens
QPLRRSLPI

SEQ ID NO: 1146617 - protein, 9 aa, Homo Sapiens
FFRAGTLAQ

SEQ ID NO: 1146618 - protein, 9 aa, Homo Sapiens
DHPRAQCVV

SEQ ID NO: 1146619 - protein, 9 aa, Homo Sapiens
AQLEEQRDE

SEQ ID NO: 1146620 - protein, 9 aa, Homo Sapiens
LPLSYCNSE

SEQ ID NO: 1146621 - protein, 9 aa, Homo Sapiens
SRPCRMRLY

SEQ ID NO: 1146622 - protein, 9 aa, Homo Sapiens
PLYLSHHPK

SEQ ID NO: 1146623 - protein, 9 aa, Homo Sapiens
AQRCSQGAC

SEQ ID NO: 1146624 - protein, 9 aa, Homo Sapiens
AQPQNTFLT

SEQ ID NO: 1146625 - protein, 9 aa, Homo Sapiens
CMSLACLIL

SEQ ID NO: 1146626 - protein, 9 aa, Homo Sapiens
SLDPSNWKP

SEQ ID NO: 1146627 - protein, 9 aa, Homo Sapiens
SCWLSCRKQ

SEQ ID NO: 1146628 - protein, 9 aa, Homo Sapiens
KDINDNVPV

SEQ ID NO: 1146629 - protein, 9 aa, Homo Sapiens
QVVPDPNRT

SEQ ID NO: 1146630 - protein, 9 aa, Homo Sapiens
NTLNYASRG

SEQ ID NO: 1146631 - protein, 9 aa, Homo Sapiens
HSALGVGMP

SEQ ID NO: 1146632 - protein, 9 aa, Homo Sapiens
DAKIQDFEQ

SEQ ID NO: 1146633 - protein, 9 aa, Homo Sapiens
ETPKKKRSA

SEQ ID NO: 1146634 - protein, 9 aa, Homo Sapiens
TAEGLVSGG

SEQ ID NO: 1146635 - protein, 9 aa, Homo Sapiens
RLLLLFQTL

SEQ ID NO: 1146636 - protein, 9 aa, Homo Sapiens
GGQVGHGVW

SEQ ID NO: 1146637 - protein, 9 aa, Homo Sapiens
RLNSVSRAF

SEQ ID NO: 1146638 - protein, 9 aa, Homo Sapiens
MEGADPGER

SEQ ID NO: 1146639 - protein, 9 aa, Homo Sapiens
RRLPLRAIN

SEQ ID NO: 1146640 - protein, 9 aa, Homo Sapiens
TATMPTYCY

SEQ ID NO: 1146641 - protein, 9 aa, Homo Sapiens
PWQATRSRT

SEQ ID NO: 1146642 - protein, 9 aa, Homo Sapiens
SGRSRLPAD

SEQ ID NO: 1146643 - protein, 9 aa, Homo Sapiens
NLKVHERFH

SEQ ID NO: 1146644 - protein, 9 aa, Homo Sapiens
DPSNWKPLT

SEQ ID NO: 1146645 - protein, 9 aa, Homo Sapiens
STTRASTPN

SEQ ID NO: 1146646 - protein, 9 aa, Homo Sapiens
AVLYLKKTR

SEQ ID NO: 1146647 - protein, 9 aa, Homo Sapiens
AQPLARPGA

SEQ ID NO: 1146648 - protein, 9 aa, Homo Sapiens
QRSGSLLCT

SEQ ID NO: 1146649 - protein, 9 aa, Homo Sapiens
LLSLWFLDR

SEQ ID NO: 1146650 - protein, 9 aa, Homo Sapiens
KTNTEEKKY

SEQ ID NO: 1146651 - protein, 9 aa, Homo Sapiens
QHPGEALRL

SEQ ID NO: 1146652 - protein, 9 aa, Homo Sapiens
SQAFLTLRR

SEQ ID NO: 1146653 - protein, 9 aa, Homo Sapiens
SVISDCTEI

SEQ ID NO: 1146654 - protein, 9 aa, Homo Sapiens
WAHSRQRQD

SEQ ID NO: 1146655 - protein, 9 aa, Homo Sapiens
ERAFSYCGP

SEQ ID NO: 1146656 - protein, 9 aa, Homo Sapiens
STCLMRPPW

SEQ ID NO: 1146657 - protein, 9 aa, Homo Sapiens
PLQSHVSSF

SEQ ID NO: 1146658 - protein, 9 aa, Homo Sapiens
IMDAMLKRL

SEQ ID NO: 1146659 - protein, 9 aa, Homo Sapiens
SLQRTSAAL

SEQ ID NO: 1146660 - protein, 9 aa, Homo Sapiens
ELTNTKLSL

SEQ ID NO: 1146661 - protein, 9 aa, Homo Sapiens
PQGHQGPAD

SEQ ID NO: 1146662 - protein, 9 aa, Homo Sapiens
TIADHPAVP

SEQ ID NO: 1146663 - protein, 9 aa, Homo Sapiens
ELFGKVFGN

SEQ ID NO: 1146664 - protein, 9 aa, Homo Sapiens
LTVIGQGLV

SEQ ID NO: 1146665 - protein, 9 aa, Homo Sapiens
YDSTHSMLE

SEQ ID NO: 1146666 - protein, 9 aa, Homo Sapiens
TAPPLAPLP

SEQ ID NO: 1146667 - protein, 9 aa, Homo Sapiens
MASQGLLLS

SEQ ID NO: 1146668 - protein, 9 aa, Homo Sapiens
LQRLTWVCR

SEQ ID NO: 1146669 - protein, 9 aa, Homo Sapiens
AALWGQGPR

SEQ ID NO: 1146670 - protein, 9 aa, Homo Sapiens
LTMGIYFDE

SEQ ID NO: 1146671 - protein, 9 aa, Homo Sapiens
NDSKHKLES

SEQ ID NO: 1146672 - protein, 9 aa, Homo Sapiens
GTAARLPPS

SEQ ID NO: 1146673 - protein, 9 aa, Homo Sapiens
QPDPDVPEK

SEQ ID NO: 1146674 - protein, 9 aa, Homo Sapiens
PAHARLAPR

SEQ ID NO: 1146675 - protein, 9 aa, Homo Sapiens
FPWQSLETK

SEQ ID NO: 1146676 - protein, 9 aa, Homo Sapiens
PIDTIIFGG

SEQ ID NO: 1146677 - protein, 9 aa, Homo Sapiens
RAATKRPDR

SEQ ID NO: 1146678 - protein, 9 aa, Homo Sapiens
APQGPVMAW

SEQ ID NO: 1146679 - protein, 9 aa, Homo Sapiens
PVMEGLVEV

SEQ ID NO: 1146680 - protein, 9 aa, Homo Sapiens
THARTAIPL

SEQ ID NO: 1146681 - protein, 9 aa, Homo Sapiens
TRRLSRASR

SEQ ID NO: 1146682 - protein, 9 aa, Homo Sapiens
ATGASESRN

SEQ ID NO: 1146683 - protein, 9 aa, Homo Sapiens
ELLAWDPPR

SEQ ID NO: 1146684 - protein, 9 aa, Homo Sapiens
NDECRSAME

SEQ ID NO: 1146685 - protein, 9 aa, Homo Sapiens
WHPLGLCSA

SEQ ID NO: 1146686 - protein, 9 aa, Homo Sapiens
VLGAQVFAF

SEQ ID NO: 1146687 - protein, 9 aa, Homo Sapiens
ELSKVQNEF

SEQ ID NO: 1146688 - protein, 9 aa, Homo Sapiens
WGPRTPRGT

SEQ ID NO: 1146689 - protein, 9 aa, Homo Sapiens
VCWRGCNKI

SEQ ID NO: 1146690 - protein, 9 aa, Homo Sapiens
PAGSSTQAH

SEQ ID NO: 1146691 - protein, 9 aa, Homo Sapiens
VLAAGNAEE

SEQ ID NO: 1146692 - protein, 9 aa, Homo Sapiens
PVTCLNIQD

SEQ ID NO: 1146693 - protein, 9 aa, Homo Sapiens
NVYVLANEP

SEQ ID NO: 1146694 - protein, 9 aa, Homo Sapiens
PWENPAGHG

SEQ ID NO: 1146695 - protein, 9 aa, Homo Sapiens
KLSISEKED

SEQ ID NO: 1146696 - protein, 9 aa, Homo Sapiens
TVLLLPSAA

SEQ ID NO: 1146697 - protein, 9 aa, Homo Sapiens
RQAVASRAA

SEQ ID NO: 1146698 - protein, 9 aa, Homo Sapiens
QGSQRERGA

SEQ ID NO: 1146699 - protein, 9 aa, Homo Sapiens
SGGVPPYTE

SEQ ID NO: 1146700 - protein, 9 aa, Homo Sapiens
MHRVAHHAA

SEQ ID NO: 1146701 - protein, 9 aa, Homo Sapiens
RERGADGEV

SEQ ID NO: 1146702 - protein, 9 aa, Homo Sapiens
GQLGPRAGG

SEQ ID NO: 1146703 - protein, 9 aa, Homo Sapiens
PAPQGPVMA

SEQ ID NO: 1146704 - protein, 9 aa, Homo Sapiens
GLNGESPTL

SEQ ID NO: 1146705 - protein, 9 aa, Homo Sapiens
LLSPVSRYN

SEQ ID NO: 1146706 - protein, 9 aa, Homo Sapiens
AKSTPASLA

SEQ ID NO: 1146707 - protein, 9 aa, Homo Sapiens
HTTSIQSRI

SEQ ID NO: 1146708 - protein, 9 aa, Homo Sapiens
SAATQAIPP

SEQ ID NO: 1146709 - protein, 9 aa, Homo Sapiens
PGLLGSPLL

SEQ ID NO: 1146710 - protein, 9 aa, Homo Sapiens
APEGVPIDT

SEQ ID NO: 1146711 - protein, 9 aa, Homo Sapiens
DALQKREVT

SEQ ID NO: 1146712 - protein, 9 aa, Homo Sapiens
PTSGLQECR

SEQ ID NO: 1146713 - protein, 9 aa, Homo Sapiens
PTLRGLLGA

SEQ ID NO: 1146714 - protein, 9 aa, Homo Sapiens
CRGPMPGSC

SEQ ID NO: 1146715 - protein, 9 aa, Homo Sapiens
QQVGGRGGR

SEQ ID NO: 1146716 - protein, 9 aa, Homo Sapiens
HAQLTEQMK

SEQ ID NO: 1146717 - protein, 9 aa, Homo Sapiens
SRLKILQNL

SEQ ID NO: 1146718 - protein, 9 aa, Homo Sapiens
KPGGAGARP

SEQ ID NO: 1146719 - protein, 9 aa, Homo Sapiens
LFFVLVNLE

SEQ ID NO: 1146720 - protein, 9 aa, Homo Sapiens
KYWIYGCGG

SEQ ID NO: 1146721 - protein, 9 aa, Homo Sapiens
DTWQMLFYV

SEQ ID NO: 1146722 - protein, 9 aa, Homo Sapiens
PRTSTNKEL

SEQ ID NO: 1146723 - protein, 9 aa, Homo Sapiens
DPFKRLISA

SEQ ID NO: 1146724 - protein, 9 aa, Homo Sapiens
TAISGNCGP

SEQ ID NO: 1146725 - protein, 9 aa, Homo Sapiens
HSNPIFRPT

SEQ ID NO: 1146726 - protein, 9 aa, Homo Sapiens
GPVLGCLLH

SEQ ID NO: 1146727 - protein, 9 aa, Homo Sapiens
SVLHELLDV

SEQ ID NO: 1146728 - protein, 9 aa, Homo Sapiens
ALPQGRAPL

SEQ ID NO: 1146729 - protein, 9 aa, Homo Sapiens
SRVVCTMIN

SEQ ID NO: 1146730 - protein, 9 aa, Homo Sapiens
GGLDLRVCG

SEQ ID NO: 1146731 - protein, 9 aa, Homo Sapiens
CTGAKGEEQ

SEQ ID NO: 1146732 - protein, 9 aa, Homo Sapiens
RPSRQWPAG

SEQ ID NO: 1146733 - protein, 9 aa, Homo Sapiens
HTEQINEIG

SEQ ID NO: 1146734 - protein, 9 aa, Homo Sapiens
GSQRERGAD

SEQ ID NO: 1146735 - protein, 9 aa, Homo Sapiens
PREVQAGAA

SEQ ID NO: 1146736 - protein, 9 aa, Homo Sapiens
TFQQHRRPL

SEQ ID NO: 1146737 - protein, 9 aa, Homo Sapiens
LFIYVISIN

SEQ ID NO: 1146738 - protein, 9 aa, Homo Sapiens
HPRHPRLRS

SEQ ID NO: 1146739 - protein, 9 aa, Homo Sapiens
GAHLPLPQA

SEQ ID NO: 1146740 - protein, 9 aa, Homo Sapiens
GLLEGSAEI

SEQ ID NO: 1146741 - protein, 9 aa, Homo Sapiens
DANLPKTSR

SEQ ID NO: 1146742 - protein, 9 aa, Homo Sapiens
AHGEVDVDG

SEQ ID NO: 1146743 - protein, 9 aa, Homo Sapiens
VARKLDLTK

SEQ ID NO: 1146744 - protein, 9 aa, Homo Sapiens
TFLHPFPSK

SEQ ID NO: 1146745 - protein, 9 aa, Homo Sapiens
GERQNRAAL

SEQ ID NO: 1146746 - protein, 9 aa, Homo Sapiens
ALQPGEKKS

SEQ ID NO: 1146747 - protein, 9 aa, Homo Sapiens
DCGAWPPPW

SEQ ID NO: 1146748 - protein, 9 aa, Homo Sapiens
SGPCPSVCA

SEQ ID NO: 1146749 - protein, 9 aa, Homo Sapiens
ALPSPWENP

SEQ ID NO: 1146750 - protein, 9 aa, Homo Sapiens
HEDGDSPVF

SEQ ID NO: 1146751 - protein, 9 aa, Homo Sapiens
SPKSTTLIP

SEQ ID NO: 1146752 - protein, 9 aa, Homo Sapiens
PMLHNLALY

SEQ ID NO: 1146753 - protein, 9 aa, Homo Sapiens
SRATPGVAL

SEQ ID NO: 1146754 - protein, 9 aa, Homo Sapiens
GLFYQMLHK

SEQ ID NO: 1146755 - protein, 9 aa, Homo Sapiens
SLGDPAAFS

SEQ ID NO: 1146756 - protein, 9 aa, Homo Sapiens
KVTDKFTEN

SEQ ID NO: 1146757 - protein, 9 aa, Homo Sapiens
TWAGAGPGA

SEQ ID NO: 1146758 - protein, 9 aa, Homo Sapiens
RFEAHASFY

SEQ ID NO: 1146759 - protein, 9 aa, Homo Sapiens
TSLTMGIYF

SEQ ID NO: 1146760 - protein, 9 aa, Homo Sapiens
KPSPPHPPR

SEQ ID NO: 1146761 - protein, 9 aa, Homo Sapiens
GQASSPSHA

SEQ ID NO: 1146762 - protein, 9 aa, Homo Sapiens
VPHLVSGGD

SEQ ID NO: 1146763 - protein, 9 aa, Homo Sapiens
PGPCASLLS

SEQ ID NO: 1146764 - protein, 9 aa, Homo Sapiens
AEWIRSVAE

SEQ ID NO: 1146765 - protein, 9 aa, Homo Sapiens
DMSKKSPWE

SEQ ID NO: 1146766 - protein, 9 aa, Homo Sapiens
RKKSYTTPK

SEQ ID NO: 1146767 - protein, 9 aa, Homo Sapiens
FWRVYIFYR

SEQ ID NO: 1146768 - protein, 9 aa, Homo Sapiens
NLSVAEKVI

SEQ ID NO: 1146769 - protein, 9 aa, Homo Sapiens
RPPGGGALP

SEQ ID NO: 1146770 - protein, 9 aa, Homo Sapiens
IVVNQEILN

SEQ ID NO: 1146771 - protein, 9 aa, Homo Sapiens
AAATPLEVA

SEQ ID NO: 1146772 - protein, 9 aa, Homo Sapiens
KVITPYTLT

SEQ ID NO: 1146773 - protein, 9 aa, Homo Sapiens
CGPDCEVDS

SEQ ID NO: 1146774 - protein, 9 aa, Homo Sapiens
IKADNGCLR

SEQ ID NO: 1146775 - protein, 9 aa, Homo Sapiens
FSRMGATPE

SEQ ID NO: 1146776 - protein, 9 aa, Homo Sapiens
KSRWDNETP

SEQ ID NO: 1146777 - protein, 9 aa, Homo Sapiens
YFTSLTKYL

SEQ ID NO: 1146778 - protein, 9 aa, Homo Sapiens
AHQEKHLPR

SEQ ID NO: 1146779 - protein, 9 aa, Homo Sapiens
INHSQSLVL

SEQ ID NO: 1146780 - protein, 9 aa, Homo Sapiens
QWMVKSWVI

SEQ ID NO: 1146781 - protein, 9 aa, Homo Sapiens
RTMLELLNH

SEQ ID NO: 1146782 - protein, 9 aa, Homo Sapiens
GLKNIPGIR

SEQ ID NO: 1146783 - protein, 9 aa, Homo Sapiens
AMNHNSAPT

SEQ ID NO: 1146784 - protein, 9 aa, Homo Sapiens
LQWMVKSWV

SEQ ID NO: 1146785 - protein, 9 aa, Homo Sapiens
GQRAQLPGQ

SEQ ID NO: 1146786 - protein, 9 aa, Homo Sapiens
AAAVLVHLI

SEQ ID NO: 1146787 - protein, 9 aa, Homo Sapiens
NKCFLSTSC

SEQ ID NO: 1146788 - protein, 9 aa, Homo Sapiens
RPPLPRPAC

SEQ ID NO: 1146789 - protein, 9 aa, Homo Sapiens
ELSYLGSAV

SEQ ID NO: 1146790 - protein, 9 aa, Homo Sapiens
GPPRPTPAR

SEQ ID NO: 1146791 - protein, 9 aa, Homo Sapiens
LPSNEDTEE

SEQ ID NO: 1146792 - protein, 9 aa, Homo Sapiens
PLELFGKVF

SEQ ID NO: 1146793 - protein, 9 aa, Homo Sapiens
VKGVLDREQ

SEQ ID NO: 1146794 - protein, 9 aa, Homo Sapiens
TLFHPMPVL

SEQ ID NO: 1146795 - protein, 9 aa, Homo Sapiens
KVFGNFNLL

SEQ ID NO: 1146796 - protein, 9 aa, Homo Sapiens
VIKKKANLN

SEQ ID NO: 1146797 - protein, 9 aa, Homo Sapiens
LRTKLEKAL

SEQ ID NO: 1146798 - protein, 9 aa, Homo Sapiens
SKSYSPGMT

SEQ ID NO: 1146799 - protein, 9 aa, Homo Sapiens
PHPHPRLCS

SEQ ID NO: 1146800 - protein, 9 aa, Homo Sapiens
CARGQRQNI

SEQ ID NO: 1146801 - protein, 9 aa, Homo Sapiens
HASPRRLLR

SEQ ID NO: 1146802 - protein, 9 aa, Homo Sapiens
ERPHPIHIG

SEQ ID NO: 1146803 - protein, 9 aa, Homo Sapiens
KTVAEKWTY

SEQ ID NO: 1146804 - protein, 9 aa, Homo Sapiens
GLRYATADA

SEQ ID NO: 1146805 - protein, 9 aa, Homo Sapiens
VLWVAKSTP

SEQ ID NO: 1146806 - protein, 9 aa, Homo Sapiens
DFDIRVPFL

SEQ ID NO: 1146807 - protein, 9 aa, Homo Sapiens
WMFASDSYI

SEQ ID NO: 1146808 - protein, 9 aa, Homo Sapiens
QQGRWAMVT

SEQ ID NO: 1146809 - protein, 9 aa, Homo Sapiens
LGPDTQPPE

SEQ ID NO: 1146810 - protein, 9 aa, Homo Sapiens
ILRWYHPST

SEQ ID NO: 1146811 - protein, 9 aa, Homo Sapiens
SSGGGMMSC

SEQ ID NO: 1146812 - protein, 9 aa, Homo Sapiens
TLAQLEEQR

SEQ ID NO: 1146813 - protein, 9 aa, Homo Sapiens
GMMSCRILL

SEQ ID NO: 1146814 - protein, 9 aa, Homo Sapiens
AMETRSEPS

SEQ ID NO: 1146815 - protein, 9 aa, Homo Sapiens
VQGSLAYAP

SEQ ID NO: 1146816 - protein, 9 aa, Homo Sapiens
PEDGDATAS

SEQ ID NO: 1146817 - protein, 9 aa, Homo Sapiens
LPTLASRVA

SEQ ID NO: 1146818 - protein, 9 aa, Homo Sapiens
LTNTKLSLD

SEQ ID NO: 1146819 - protein, 9 aa, Homo Sapiens
WFLDRTFRH

SEQ ID NO: 1146820 - protein, 9 aa, Homo Sapiens
RKMQNMFAW

SEQ ID NO: 1146821 - protein, 9 aa, Homo Sapiens
APSLLLLVF

SEQ ID NO: 1146822 - protein, 9 aa, Homo Sapiens
CLRQELLLL

SEQ ID NO: 1146823 - protein, 9 aa, Homo Sapiens
GPGRRLCTG

SEQ ID NO: 1146824 - protein, 9 aa, Homo Sapiens
KVTTDKKVW

SEQ ID NO: 1146825 - protein, 9 aa, Homo Sapiens
AGPVSHSAE

SEQ ID NO: 1146826 - protein, 9 aa, Homo Sapiens
ITTSRPEGA

SEQ ID NO: 1146827 - protein, 9 aa, Homo Sapiens
LWNSSPRTK

SEQ ID NO: 1146828 - protein, 9 aa, Homo Sapiens
SLVLVIEDK

SEQ ID NO: 1146829 - protein, 9 aa, Homo Sapiens
VKHAEEVRQ

SEQ ID NO: 1146830 - protein, 9 aa, Homo Sapiens
CVYPDYRGK

SEQ ID NO: 1146831 - protein, 9 aa, Homo Sapiens
QGLVGMTPR

SEQ ID NO: 1146832 - protein, 9 aa, Homo Sapiens
EGEFSVIMW

SEQ ID NO: 1146833 - protein, 9 aa, Homo Sapiens
ITVSPEGSG

SEQ ID NO: 1146834 - protein, 9 aa, Homo Sapiens
TNPICDMRF

SEQ ID NO: 1146835 - protein, 9 aa, Homo Sapiens
TDEPVTCLN

SEQ ID NO: 1146836 - protein, 9 aa, Homo Sapiens
PSRPCRMRL

SEQ ID NO: 1146837 - protein, 9 aa, Homo Sapiens
ELSTDSVVP

SEQ ID NO: 1146838 - protein, 9 aa, Homo Sapiens
RNNFSRLEP

SEQ ID NO: 1146839 - protein, 9 aa, Homo Sapiens
CTMASQGLL

SEQ ID NO: 1146840 - protein, 9 aa, Homo Sapiens
DNLLLTMMA

SEQ ID NO: 1146841 - protein, 9 aa, Homo Sapiens
CLWAPGWRR

SEQ ID NO: 1146842 - protein, 9 aa, Homo Sapiens
SFPWQSLET

SEQ ID NO: 1146843 - protein, 9 aa, Homo Sapiens
SLGPPRPTP

SEQ ID NO: 1146844 - protein, 9 aa, Homo Sapiens
TCLEEGTAI

SEQ ID NO: 1146845 - protein, 9 aa, Homo Sapiens
STHDKNIWP

SEQ ID NO: 1146846 - protein, 9 aa, Homo Sapiens
KKMAPPKEV

SEQ ID NO: 1146847 - protein, 9 aa, Homo Sapiens
TSSLWTQQT

SEQ ID NO: 1146848 - protein, 9 aa, Homo Sapiens
LATSSHAER

SEQ ID NO: 1146849 - protein, 9 aa, Homo Sapiens
VFWRVYIFY

SEQ ID NO: 1146850 - protein, 9 aa, Homo Sapiens
WGQGPRRRP

SEQ ID NO: 1146851 - protein, 9 aa, Homo Sapiens
RDPFKRLIS

SEQ ID NO: 1146852 - protein, 9 aa, Homo Sapiens
MHVVTCLTR

SEQ ID NO: 1146853 - protein, 9 aa, Homo Sapiens
PQGPATPHT

SEQ ID NO: 1146854 - protein, 9 aa, Homo Sapiens
HYLQLIQVD

SEQ ID NO: 1146855 - protein, 9 aa, Homo Sapiens
LWQTSTLAL

SEQ ID NO: 1146856 - protein, 9 aa, Homo Sapiens
ALGQMCIAY

SEQ ID NO: 1146857 - protein, 9 aa, Homo Sapiens
REKHSASEH

SEQ ID NO: 1146858 - protein, 9 aa, Homo Sapiens
QKFLGSFLL

SEQ ID NO: 1146859 - protein, 9 aa, Homo Sapiens
ESSASLLTG

SEQ ID NO: 1146860 - protein, 9 aa, Homo Sapiens
VQNEFKAEY

SEQ ID NO: 1146861 - protein, 9 aa, Homo Sapiens
ASGDSLELR

SEQ ID NO: 1146862 - protein, 9 aa, Homo Sapiens
QPPECVDQK

SEQ ID NO: 1146863 - protein, 9 aa, Homo Sapiens
TTLILVYLI

SEQ ID NO: 1146864 - protein, 9 aa, Homo Sapiens
RASSYMRNL

SEQ ID NO: 1146865 - protein, 9 aa, Homo Sapiens
VAPLQSAFG

SEQ ID NO: 1146866 - protein, 9 aa, Homo Sapiens
IEWMAGGLV

SEQ ID NO: 1146867 - protein, 9 aa, Homo Sapiens
LFPLGYLLV

SEQ ID NO: 1146868 - protein, 9 aa, Homo Sapiens
HHPLDERAL

SEQ ID NO: 1146869 - protein, 9 aa, Homo Sapiens
LLYDLLELP

SEQ ID NO: 1146870 - protein, 9 aa, Homo Sapiens
GDQVPCQQT

SEQ ID NO: 1146871 - protein, 9 aa, Homo Sapiens
GWKLHIGNF

SEQ ID NO: 1146872 - protein, 9 aa, Homo Sapiens
VSVLHELLD

SEQ ID NO: 1146873 - protein, 9 aa, Homo Sapiens
TEASVPATS

SEQ ID NO: 1146874 - protein, 9 aa, Homo Sapiens
ATCTHRHYE

SEQ ID NO: 1146875 - protein, 9 aa, Homo Sapiens
ELKPEEIQH

SEQ ID NO: 1146876 - protein, 9 aa, Homo Sapiens
FHVVFVDPC

SEQ ID NO: 1146877 - protein, 9 aa, Homo Sapiens
PRPGGFFTR

SEQ ID NO: 1146878 - protein, 9 aa, Homo Sapiens
QKMKELASI

SEQ ID NO: 1146879 - protein, 9 aa, Homo Sapiens
VFLDHWKDW

SEQ ID NO: 1146880 - protein, 9 aa, Homo Sapiens
ATALAITVS

SEQ ID NO: 1146881 - protein, 9 aa, Homo Sapiens
CRGPRGALL

SEQ ID NO: 1146882 - protein, 9 aa, Homo Sapiens
MAPLSPGAT

SEQ ID NO: 1146883 - protein, 9 aa, Homo Sapiens
NRIFFGDIH

SEQ ID NO: 1146884 - protein, 9 aa, Homo Sapiens
PGRGAEPAA

SEQ ID NO: 1146885 - protein, 9 aa, Homo Sapiens
FRVLYCYYP

SEQ ID NO: 1146886 - protein, 9 aa, Homo Sapiens
LNKHISLND

SEQ ID NO: 1146887 - protein, 9 aa, Homo Sapiens
IKHEAVSDQ

SEQ ID NO: 1146888 - protein, 9 aa, Homo Sapiens
QELLWPPLP

SEQ ID NO: 1146889 - protein, 9 aa, Homo Sapiens
IALHVKQEP

SEQ ID NO: 1146890 - protein, 9 aa, Homo Sapiens
IHEKMGIDI

SEQ ID NO: 1146891 - protein, 9 aa, Homo Sapiens
AGTLAQLEE

SEQ ID NO: 1146892 - protein, 9 aa, Homo Sapiens
EEPEQLPEL

SEQ ID NO: 1146893 - protein, 9 aa, Homo Sapiens
HHTAGLVEK

SEQ ID NO: 1146894 - protein, 9 aa, Homo Sapiens
DIKNTVYII

SEQ ID NO: 1146895 - protein, 9 aa, Homo Sapiens
TSAALEKNF

SEQ ID NO: 1146896 - protein, 9 aa, Homo Sapiens
LLGGMIEVE

SEQ ID NO: 1146897 - protein, 9 aa, Homo Sapiens
IKSIAAALK

SEQ ID NO: 1146898 - protein, 9 aa, Homo Sapiens
ASAARRCHQ

SEQ ID NO: 1146899 - protein, 9 aa, Homo Sapiens
GMKMNMKGP

SEQ ID NO: 1146900 - protein, 9 aa, Homo Sapiens
VQDVRPYIV

SEQ ID NO: 1146901 - protein, 9 aa, Homo Sapiens
LFYQMLHKV

SEQ ID NO: 1146902 - protein, 9 aa, Homo Sapiens
ISIFVKHAE

SEQ ID NO: 1146903 - protein, 9 aa, Homo Sapiens
ADDLIEKLV

SEQ ID NO: 1146904 - protein, 9 aa, Homo Sapiens
ASGRKNSNM

SEQ ID NO: 1146905 - protein, 9 aa, Homo Sapiens
HKLPLSLQD

SEQ ID NO: 1146906 - protein, 9 aa, Homo Sapiens
VRHGVESML

SEQ ID NO: 1146907 - protein, 9 aa, Homo Sapiens
FKQKFIILR

SEQ ID NO: 1146908 - protein, 9 aa, Homo Sapiens
VIAKMPVDN

SEQ ID NO: 1146909 - protein, 9 aa, Homo Sapiens
RTSTNKELY

SEQ ID NO: 1146910 - protein, 9 aa, Homo Sapiens
WQTSTLALI

SEQ ID NO: 1146911 - protein, 9 aa, Homo Sapiens
HLCTHPGLL

SEQ ID NO: 1146912 - protein, 9 aa, Homo Sapiens
SRSVLSVPA

SEQ ID NO: 1146913 - protein, 9 aa, Homo Sapiens
PNTGPAAAA

SEQ ID NO: 1146914 - protein, 9 aa, Homo Sapiens
SDSSPSTSV

SEQ ID NO: 1146915 - protein, 9 aa, Homo Sapiens
GDTSIDTFL

SEQ ID NO: 1146916 - protein, 9 aa, Homo Sapiens
SCSGLVRDC

SEQ ID NO: 1146917 - protein, 9 aa, Homo Sapiens
KKEEDKKHG

SEQ ID NO: 1146918 - protein, 9 aa, Homo Sapiens
GMGRRPRPR

SEQ ID NO: 1146919 - protein, 9 aa, Homo Sapiens
GAQLMAPLS

SEQ ID NO: 1146920 - protein, 9 aa, Homo Sapiens
IDALQPHCL

SEQ ID NO: 1146921 - protein, 9 aa, Homo Sapiens
ATILFTLIP

SEQ ID NO: 1146922 - protein, 9 aa, Homo Sapiens
WPSSQGTLS

SEQ ID NO: 1146923 - protein, 9 aa, Homo Sapiens
SLQHYLQLI

SEQ ID NO: 1146924 - protein, 9 aa, Homo Sapiens
ALWNQLSLL

SEQ ID NO: 1146925 - protein, 9 aa, Homo Sapiens
NLLHHLKHH

SEQ ID NO: 1146926 - protein, 9 aa, Homo Sapiens
ARSASSCSS

SEQ ID NO: 1146927 - protein, 9 aa, Homo Sapiens
CDLGPAGTP

SEQ ID NO: 1146928 - protein, 9 aa, Homo Sapiens
QQQQQQQGR

SEQ ID NO: 1146929 - protein, 9 aa, Homo Sapiens
HVVNQQPIP

SEQ ID NO: 1146930 - protein, 9 aa, Homo Sapiens
CPVIVSVQY

SEQ ID NO: 1146931 - protein, 9 aa, Homo Sapiens
ALSALFIWP

SEQ ID NO: 1146932 - protein, 9 aa, Homo Sapiens
SEYCWHINF

SEQ ID NO: 1146933 - protein, 9 aa, Homo Sapiens
DIYEKDLHM

SEQ ID NO: 1146934 - protein, 9 aa, Homo Sapiens
HVLRALALR

SEQ ID NO: 1146935 - protein, 9 aa, Homo Sapiens
RRPTVVQGM

SEQ ID NO: 1146936 - protein, 9 aa, Homo Sapiens
TTNTTGSTL

SEQ ID NO: 1146937 - protein, 9 aa, Homo Sapiens
RALLPFDNM

SEQ ID NO: 1146938 - protein, 9 aa, Homo Sapiens
GATLTSTSC

SEQ ID NO: 1146939 - protein, 9 aa, Homo Sapiens
GKAPHRRAA

SEQ ID NO: 1146940 - protein, 9 aa, Homo Sapiens
GIIFIGHPP

SEQ ID NO: 1146941 - protein, 9 aa, Homo Sapiens
ACARSASSC

SEQ ID NO: 1146942 - protein, 9 aa, Homo Sapiens
TLTSTSCST

SEQ ID NO: 1146943 - protein, 9 aa, Homo Sapiens
HNSAPTVPC

SEQ ID NO: 1146944 - protein, 9 aa, Homo Sapiens
RHGSVSEAS

SEQ ID NO: 1146945 - protein, 9 aa, Homo Sapiens
PRGGAWKSI

SEQ ID NO: 1146946 - protein, 9 aa, Homo Sapiens
SNFYSVVGR

SEQ ID NO: 1146947 - protein, 9 aa, Homo Sapiens
GVVQGALRS

SEQ ID NO: 1146948 - protein, 9 aa, Homo Sapiens
CHPTSGIPR

SEQ ID NO: 1146949 - protein, 9 aa, Homo Sapiens
IFPMYVTVK

SEQ ID NO: 1146950 - protein, 9 aa, Homo Sapiens
GKVVETSAF

SEQ ID NO: 1146951 - protein, 9 aa, Homo Sapiens
EFTTLNQLR

SEQ ID NO: 1146952 - protein, 9 aa, Homo Sapiens
GGLPVGESP

SEQ ID NO: 1146953 - protein, 9 aa, Homo Sapiens
WRWNSMTLD

SEQ ID NO: 1146954 - protein, 9 aa, Homo Sapiens
DGKKMDLDG

SEQ ID NO: 1146955 - protein, 9 aa, Homo Sapiens
KDGECDLGP

SEQ ID NO: 1146956 - protein, 9 aa, Homo Sapiens
DFSNSVSTC

SEQ ID NO: 1146957 - protein, 9 aa, Homo Sapiens
PRGSPGPSG

SEQ ID NO: 1146958 - protein, 9 aa, Homo Sapiens
YICPRLGAS

SEQ ID NO: 1146959 - protein, 9 aa, Homo Sapiens
GLRPPHLPS

SEQ ID NO: 1146960 - protein, 9 aa, Homo Sapiens
RERMMLPVR

SEQ ID NO: 1146961 - protein, 9 aa, Homo Sapiens
SEDRRTMRL

SEQ ID NO: 1146962 - protein, 9 aa, Homo Sapiens
ELDMVILKA

SEQ ID NO: 1146963 - protein, 9 aa, Homo Sapiens
GSLWNSSPR

SEQ ID NO: 1146964 - protein, 9 aa, Homo Sapiens
FALRPAPRV

SEQ ID NO: 1146965 - protein, 9 aa, Homo Sapiens
LYSSPYTHA

SEQ ID NO: 1146966 - protein, 9 aa, Homo Sapiens
PTYLSTAAM

SEQ ID NO: 1146967 - protein, 9 aa, Homo Sapiens
TNSISVFQV

SEQ ID NO: 1146968 - protein, 9 aa, Homo Sapiens
ARVAEEGFL

SEQ ID NO: 1146969 - protein, 9 aa, Homo Sapiens
GSRSGSGQP

SEQ ID NO: 1146970 - protein, 9 aa, Homo Sapiens
RRGRLNSVS

SEQ ID NO: 1146971 - protein, 9 aa, Homo Sapiens
SISVFQVIR

SEQ ID NO: 1146972 - protein, 9 aa, Homo Sapiens
ASSGPCPSV

SEQ ID NO: 1146973 - protein, 9 aa, Homo Sapiens
QGERMNHGN

SEQ ID NO: 1146974 - protein, 9 aa, Homo Sapiens
IGELYGVSH

SEQ ID NO: 1146975 - protein, 9 aa, Homo Sapiens
LMLPEMVKN

SEQ ID NO: 1146976 - protein, 9 aa, Homo Sapiens
FGKVVETSA

SEQ ID NO: 1146977 - protein, 9 aa, Homo Sapiens
LGSPLLSGA

SEQ ID NO: 1146978 - protein, 9 aa, Homo Sapiens
ILYIDITWR

SEQ ID NO: 1146979 - protein, 9 aa, Homo Sapiens
RMAGRRSTR

SEQ ID NO: 1146980 - protein, 9 aa, Homo Sapiens
PKKKRSAFP

SEQ ID NO: 1146981 - protein, 9 aa, Homo Sapiens
TAAIRYYQE

SEQ ID NO: 1146982 - protein, 9 aa, Homo Sapiens
RCCLDSLDQ

SEQ ID NO: 1146983 - protein, 9 aa, Homo Sapiens
VSCSSVELT

SEQ ID NO: 1146984 - protein, 9 aa, Homo Sapiens
PALPKPAVA

SEQ ID NO: 1146985 - protein, 9 aa, Homo Sapiens
TWVVFNEKI

SEQ ID NO: 1146986 - protein, 9 aa, Homo Sapiens
QLFSSKNPE

SEQ ID NO: 1146987 - protein, 9 aa, Homo Sapiens
LRDGLACSL

SEQ ID NO: 1146988 - protein, 9 aa, Homo Sapiens
CKGPRRSAA

SEQ ID NO: 1146989 - protein, 9 aa, Homo Sapiens
TVIGQGLVG

SEQ ID NO: 1146990 - protein, 9 aa, Homo Sapiens
QPQNTFLTQ

SEQ ID NO: 1146991 - protein, 9 aa, Homo Sapiens
QYDTLQAYV

SEQ ID NO: 1146992 - protein, 9 aa, Homo Sapiens
MFLSPGEGL

SEQ ID NO: 1146993 - protein, 9 aa, Homo Sapiens
LTIGEKTEI

SEQ ID NO: 1146994 - protein, 9 aa, Homo Sapiens
RAGGSRRHP

SEQ ID NO: 1146995 - protein, 9 aa, Homo Sapiens
AMRSGGDWL

SEQ ID NO: 1146996 - protein, 9 aa, Homo Sapiens
LKHPRVAVT

SEQ ID NO: 1146997 - protein, 9 aa, Homo Sapiens
PARPAATTS

SEQ ID NO: 1146998 - protein, 9 aa, Homo Sapiens
PCPGPKRMS

SEQ ID NO: 1146999 - protein, 9 aa, Homo Sapiens
SGLKNIPGI

SEQ ID NO: 1147000 - protein, 9 aa, Homo Sapiens
NFVNGIRCV

SEQ ID NO: 1147001 - protein, 9 aa, Homo Sapiens
YSTNEAKKG

SEQ ID NO: 1147002 - protein, 9 aa, Homo Sapiens
PHHLAQLLG

SEQ ID NO: 1147003 - protein, 9 aa, Homo Sapiens
VAQSAGPPA

SEQ ID NO: 1147004 - protein, 9 aa, Homo Sapiens
QELIKVHRA

SEQ ID NO: 1147005 - protein, 9 aa, Homo Sapiens
HHCFTTTSK

SEQ ID NO: 1147006 - protein, 9 aa, Homo Sapiens
ETKLRDSSD

SEQ ID NO: 1147007 - protein, 9 aa, Homo Sapiens
IPLLLIVIS

SEQ ID NO: 1147008 - protein, 9 aa, Homo Sapiens
RDEYKRLRA

SEQ ID NO: 1147009 - protein, 9 aa, Homo Sapiens
HVKQEPPQI

SEQ ID NO: 1147010 - protein, 9 aa, Homo Sapiens
GWVSRWVIR

SEQ ID NO: 1147011 - protein, 9 aa, Homo Sapiens
ICRGFTFQC

SEQ ID NO: 1147012 - protein, 9 aa, Homo Sapiens
AGPKSRAAP

SEQ ID NO: 1147013 - protein, 9 aa, Homo Sapiens
PRGTQPCTS

SEQ ID NO: 1147014 - protein, 9 aa, Homo Sapiens
HPLDERALQ

SEQ ID NO: 1147015 - protein, 9 aa, Homo Sapiens
MGIIFMCLR

SEQ ID NO: 1147016 - protein, 9 aa, Homo Sapiens
SHTRGIWMW

SEQ ID NO: 1147017 - protein, 9 aa, Homo Sapiens
YQAAGASPS

SEQ ID NO: 1147018 - protein, 9 aa, Homo Sapiens
SGQPAAANA

SEQ ID NO: 1147019 - protein, 9 aa, Homo Sapiens
RGIWMWCVP

SEQ ID NO: 1147020 - protein, 9 aa, Homo Sapiens
SLSQAFLTL

SEQ ID NO: 1147021 - protein, 9 aa, Homo Sapiens
LDSGADTGL

SEQ ID NO: 1147022 - protein, 9 aa, Homo Sapiens
VALCSSHRP

SEQ ID NO: 1147023 - protein, 9 aa, Homo Sapiens
SPGPSGSFD

SEQ ID NO: 1147024 - protein, 9 aa, Homo Sapiens
LVCWRGCNK

SEQ ID NO: 1147025 - protein, 9 aa, Homo Sapiens
PKSEQFKIP

SEQ ID NO: 1147026 - protein, 9 aa, Homo Sapiens
GHICNTCSS

SEQ ID NO: 1147027 - protein, 9 aa, Homo Sapiens
ECVCPLASL

SEQ ID NO: 1147028 - protein, 9 aa, Homo Sapiens
GANSVSAHN

SEQ ID NO: 1147029 - protein, 9 aa, Homo Sapiens
VPDVLPSAL

SEQ ID NO: 1147030 - protein, 9 aa, Homo Sapiens
RMSCKQALG

SEQ ID NO: 1147031 - protein, 9 aa, Homo Sapiens
IPGGPISLS

SEQ ID NO: 1147032 - protein, 9 aa, Homo Sapiens
RKFFDDNGY

SEQ ID NO: 1147033 - protein, 9 aa, Homo Sapiens
AAKIIHHPK

SEQ ID NO: 1147034 - protein, 9 aa, Homo Sapiens
QSGQLEVTW

SEQ ID NO: 1147035 - protein, 9 aa, Homo Sapiens
LRPPHLPSC

SEQ ID NO: 1147036 - protein, 9 aa, Homo Sapiens
PDTDEAVHK

SEQ ID NO: 1147037 - protein, 9 aa, Homo Sapiens
RVFKGLRYA

SEQ ID NO: 1147038 - protein, 9 aa, Homo Sapiens
ESPWQVMAS

SEQ ID NO: 1147039 - protein, 9 aa, Homo Sapiens
QTPQDSRQV

SEQ ID NO: 1147040 - protein, 9 aa, Homo Sapiens
VFVTSCNGY

SEQ ID NO: 1147041 - protein, 9 aa, Homo Sapiens
ISSDVISTN

SEQ ID NO: 1147042 - protein, 9 aa, Homo Sapiens
GDPAAFSAR

SEQ ID NO: 1147043 - protein, 9 aa, Homo Sapiens
TCLTHLAVV

SEQ ID NO: 1147044 - protein, 9 aa, Homo Sapiens
ASATGASES

SEQ ID NO: 1147045 - protein, 9 aa, Homo Sapiens
GSCRSPRST

SEQ ID NO: 1147046 - protein, 9 aa, Homo Sapiens
SAGVTANRF

SEQ ID NO: 1147047 - protein, 9 aa, Homo Sapiens
NPPLRFNLI

SEQ ID NO: 1147048 - protein, 9 aa, Homo Sapiens
FLVPRGTFH

SEQ ID NO: 1147049 - protein, 9 aa, Homo Sapiens
KRLKVFSRD

SEQ ID NO: 1147050 - protein, 9 aa, Homo Sapiens
TTSSPRRSP

SEQ ID NO: 1147051 - protein, 9 aa, Homo Sapiens
LGPPRPTPA

SEQ ID NO: 1147052 - protein, 9 aa, Homo Sapiens
TPRDLGTVA

SEQ ID NO: 1147053 - protein, 9 aa, Homo Sapiens
SSYSKSGPA

SEQ ID NO: 1147054 - protein, 9 aa, Homo Sapiens
TKRPDRVVL

SEQ ID NO: 1147055 - protein, 9 aa, Homo Sapiens
ELYRKMLPR

SEQ ID NO: 1147056 - protein, 9 aa, Homo Sapiens
LRTQNNFLL

SEQ ID NO: 1147057 - protein, 9 aa, Homo Sapiens
FEKVATSEA

SEQ ID NO: 1147058 - protein, 9 aa, Homo Sapiens
GWCRWKTKF

SEQ ID NO: 1147059 - protein, 9 aa, Homo Sapiens
TCSCPDSHK

SEQ ID NO: 1147060 - protein, 9 aa, Homo Sapiens
VHNICHWNQ

SEQ ID NO: 1147061 - protein, 9 aa, Homo Sapiens
LSTAAMNHN

SEQ ID NO: 1147062 - protein, 9 aa, Homo Sapiens
PPLRFNLIL

SEQ ID NO: 1147063 - protein, 9 aa, Homo Sapiens
MLLLYNSTM

SEQ ID NO: 1147064 - protein, 9 aa, Homo Sapiens
IVSVQYFLI

SEQ ID NO: 1147065 - protein, 9 aa, Homo Sapiens
AATCTHRHY

SEQ ID NO: 1147066 - protein, 9 aa, Homo Sapiens
IFRPTFYPH

SEQ ID NO: 1147067 - protein, 9 aa, Homo Sapiens
LTSTSCSTM

SEQ ID NO: 1147068 - protein, 9 aa, Homo Sapiens
LIADSSASV

SEQ ID NO: 1147069 - protein, 9 aa, Homo Sapiens
LVPRGTFHL

SEQ ID NO: 1147070 - protein, 9 aa, Homo Sapiens
RAEKPTAAL

SEQ ID NO: 1147071 - protein, 9 aa, Homo Sapiens
GFSRSFSPD

SEQ ID NO: 1147072 - protein, 9 aa, Homo Sapiens
SQVVPDPNR

SEQ ID NO: 1147073 - protein, 9 aa, Homo Sapiens
TSCSTMSCL

SEQ ID NO: 1147074 - protein, 9 aa, Homo Sapiens
TTWQGAPVR

SEQ ID NO: 1147075 - protein, 9 aa, Homo Sapiens
SGARSRSPC

SEQ ID NO: 1147076 - protein, 9 aa, Homo Sapiens
SPLAPCPPL

SEQ ID NO: 1147077 - protein, 9 aa, Homo Sapiens
QLPQLQGFL

SEQ ID NO: 1147078 - protein, 9 aa, Homo Sapiens
EPRELPIIQ

SEQ ID NO: 1147079 - protein, 9 aa, Homo Sapiens
RHQIQLPDL

SEQ ID NO: 1147080 - protein, 9 aa, Homo Sapiens
GAASNFYSV

SEQ ID NO: 1147081 - protein, 9 aa, Homo Sapiens
LLRDSSPIT

SEQ ID NO: 1147082 - protein, 9 aa, Homo Sapiens
AKSPVNEEA

SEQ ID NO: 1147083 - protein, 9 aa, Homo Sapiens
GPRASLSQL

SEQ ID NO: 1147084 - protein, 9 aa, Homo Sapiens
NSSSGGSGH

SEQ ID NO: 1147085 - protein, 9 aa, Homo Sapiens
WTYERVEER

SEQ ID NO: 1147086 - protein, 9 aa, Homo Sapiens
RAGGAEESS

SEQ ID NO: 1147087 - protein, 9 aa, Homo Sapiens
DLSYGSHVC

SEQ ID NO: 1147088 - protein, 9 aa, Homo Sapiens
NKPLESKLI

SEQ ID NO: 1147089 - protein, 9 aa, Homo Sapiens
DSKHKLESP

SEQ ID NO: 1147090 - protein, 9 aa, Homo Sapiens
DTSIDTFLM

SEQ ID NO: 1147091 - protein, 9 aa, Homo Sapiens
ESEFNLLGE

SEQ ID NO: 1147092 - protein, 9 aa, Homo Sapiens
PLERRSPQA

SEQ ID NO: 1147093 - protein, 9 aa, Homo Sapiens
TFQRQELLW

SEQ ID NO: 1147094 - protein, 9 aa, Homo Sapiens
KMKELASIH

SEQ ID NO: 1147095 - protein, 9 aa, Homo Sapiens
PLAELVVGG

SEQ ID NO: 1147096 - protein, 9 aa, Homo Sapiens
ASRAATKRP

SEQ ID NO: 1147097 - protein, 9 aa, Homo Sapiens
PPTQQPQTP

SEQ ID NO: 1147098 - protein, 9 aa, Homo Sapiens
IQSKHHPLD

SEQ ID NO: 1147099 - protein, 9 aa, Homo Sapiens
VQTTRKILM

SEQ ID NO: 1147100 - protein, 9 aa, Homo Sapiens
KNLLHHLKH

SEQ ID NO: 1147101 - protein, 9 aa, Homo Sapiens
PMYVTVKWN

SEQ ID NO: 1147102 - protein, 9 aa, Homo Sapiens
RPASSWGTR

SEQ ID NO: 1147103 - protein, 9 aa, Homo Sapiens
LTRHMTTCQ

SEQ ID NO: 1147104 - protein, 9 aa, Homo Sapiens
QLLLLVLQL

SEQ ID NO: 1147105 - protein, 9 aa, Homo Sapiens
YKYLLSATT

SEQ ID NO: 1147106 - protein, 9 aa, Homo Sapiens
WNTGLVAIQ

SEQ ID NO: 1147107 - protein, 9 aa, Homo Sapiens
FSTCLTHLA

SEQ ID NO: 1147108 - protein, 9 aa, Homo Sapiens
LQLRAPGVD

SEQ ID NO: 1147109 - protein, 9 aa, Homo Sapiens
AILIGQTLS

SEQ ID NO: 1147110 - protein, 9 aa, Homo Sapiens
KVFSRDGLS

SEQ ID NO: 1147111 - protein, 9 aa, Homo Sapiens
HSESWFMSV

SEQ ID NO: 1147112 - protein, 9 aa, Homo Sapiens
TRKGWTGAC

SEQ ID NO: 1147113 - protein, 9 aa, Homo Sapiens
PLGDELYHG

SEQ ID NO: 1147114 - protein, 9 aa, Homo Sapiens
REQSHSDFR

SEQ ID NO: 1147115 - protein, 9 aa, Homo Sapiens
VSHSAEEQP

SEQ ID NO: 1147116 - protein, 9 aa, Homo Sapiens
LVPARYRKP

SEQ ID NO: 1147117 - protein, 9 aa, Homo Sapiens
DVALCSSHR

SEQ ID NO: 1147118 - protein, 9 aa, Homo Sapiens
SGLVRDCGA

SEQ ID NO: 1147119 - protein, 9 aa, Homo Sapiens
TRHPDTDEA

SEQ ID NO: 1147120 - protein, 9 aa, Homo Sapiens
RAAAVLVHL

SEQ ID NO: 1147121 - protein, 9 aa, Homo Sapiens
PGTMEPITL

SEQ ID NO: 1147122 - protein, 9 aa, Homo Sapiens
SAGGDASCA

SEQ ID NO: 1147123 - protein, 9 aa, Homo Sapiens
CDTSLAEEA

SEQ ID NO: 1147124 - protein, 9 aa, Homo Sapiens
LVATNPICD

SEQ ID NO: 1147125 - protein, 9 aa, Homo Sapiens
VFQVIRCPL

SEQ ID NO: 1147126 - protein, 9 aa, Homo Sapiens
GTLAQLEEQ

SEQ ID NO: 1147127 - protein, 9 aa, Homo Sapiens
RHHETKFAQ

SEQ ID NO: 1147128 - protein, 9 aa, Homo Sapiens
PGALFLEGI

SEQ ID NO: 1147129 - protein, 9 aa, Homo Sapiens
IKIATHCKA

SEQ ID NO: 1147130 - protein, 9 aa, Homo Sapiens
ILLIAVLVC

SEQ ID NO: 1147131 - protein, 9 aa, Homo Sapiens
ATGVAQSAG

SEQ ID NO: 1147132 - protein, 9 aa, Homo Sapiens
LLGAHVQAP

SEQ ID NO: 1147133 - protein, 9 aa, Homo Sapiens
TKPSVMQSF

SEQ ID NO: 1147134 - protein, 9 aa, Homo Sapiens
RGRVKPGGA

SEQ ID NO: 1147135 - protein, 9 aa, Homo Sapiens
RHHTREIFV

SEQ ID NO: 1147136 - protein, 9 aa, Homo Sapiens
AASNFYSVV

SEQ ID NO: 1147137 - protein, 9 aa, Homo Sapiens
MEGLVEVRL

SEQ ID NO: 1147138 - protein, 9 aa, Homo Sapiens
HNARQLTRM

SEQ ID NO: 1147139 - protein, 9 aa, Homo Sapiens
RGGVLAQHP

SEQ ID NO: 1147140 - protein, 9 aa, Homo Sapiens
RTVKKAGRE

SEQ ID NO: 1147141 - protein, 9 aa, Homo Sapiens
LREAEWQTR

SEQ ID NO: 1147142 - protein, 9 aa, Homo Sapiens
PDPDVPEKR

SEQ ID NO: 1147143 - protein, 9 aa, Homo Sapiens
KKPPQSKRT

SEQ ID NO: 1147144 - protein, 9 aa, Homo Sapiens
ARTARSALP

SEQ ID NO: 1147145 - protein, 9 aa, Homo Sapiens
SLLGGMIEV

SEQ ID NO: 1147146 - protein, 9 aa, Homo Sapiens
LFGKVFGNF

SEQ ID NO: 1147147 - protein, 9 aa, Homo Sapiens
GSTGIDSEY

SEQ ID NO: 1147148 - protein, 9 aa, Homo Sapiens
CYEEDESIL

SEQ ID NO: 1147149 - protein, 9 aa, Homo Sapiens
QQPRMACSP

SEQ ID NO: 1147150 - protein, 9 aa, Homo Sapiens
KRGASSSTS

SEQ ID NO: 1147151 - protein, 9 aa, Homo Sapiens
PGPKRMSCK

SEQ ID NO: 1147152 - protein, 9 aa, Homo Sapiens
SSVPPLSHT

SEQ ID NO: 1147153 - protein, 9 aa, Homo Sapiens
LWVIPPQPS

SEQ ID NO: 1147154 - protein, 9 aa, Homo Sapiens
VVFNEKIKS

SEQ ID NO: 1147155 - protein, 9 aa, Homo Sapiens
DQHTFRDVV

SEQ ID NO: 1147156 - protein, 9 aa, Homo Sapiens
SMSSLGDPA

SEQ ID NO: 1147157 - protein, 9 aa, Homo Sapiens
LLMEGFLAF

SEQ ID NO: 1147158 - protein, 9 aa, Homo Sapiens
EVVKKDHVT

SEQ ID NO: 1147159 - protein, 9 aa, Homo Sapiens
AWRTSSACS

SEQ ID NO: 1147160 - protein, 9 aa, Homo Sapiens
TLQVPRGKE

SEQ ID NO: 1147161 - protein, 9 aa, Homo Sapiens
IIKDIFLMK

SEQ ID NO: 1147162 - protein, 9 aa, Homo Sapiens
YRIFACSRG

SEQ ID NO: 1147163 - protein, 9 aa, Homo Sapiens
MEQPLEEEY

SEQ ID NO: 1147164 - protein, 9 aa, Homo Sapiens
LRAINLNLR

SEQ ID NO: 1147165 - protein, 9 aa, Homo Sapiens
RTCTCRPPQ

SEQ ID NO: 1147166 - protein, 9 aa, Homo Sapiens
SLGLTVPTA

SEQ ID NO: 1147167 - protein, 9 aa, Homo Sapiens
FACSRGLCC

SEQ ID NO: 1147168 - protein, 9 aa, Homo Sapiens
CPPSWSVVN

SEQ ID NO: 1147169 - protein, 9 aa, Homo Sapiens
FKIPEGGDR

SEQ ID NO: 1147170 - protein, 9 aa, Homo Sapiens
EDDYRCSVY

SEQ ID NO: 1147171 - protein, 9 aa, Homo Sapiens
CPTRWAAAT

SEQ ID NO: 1147172 - protein, 9 aa, Homo Sapiens
ASLAPAVNR

SEQ ID NO: 1147173 - protein, 9 aa, Homo Sapiens
SESRGDNPT

SEQ ID NO: 1147174 - protein, 9 aa, Homo Sapiens
ACTPPTFCT

SEQ ID NO: 1147175 - protein, 9 aa, Homo Sapiens
GLVAHLLSK

SEQ ID NO: 1147176 - protein, 9 aa, Homo Sapiens
HSGSGSHAS

SEQ ID NO: 1147177 - protein, 9 aa, Homo Sapiens
SCVGVFQRG

SEQ ID NO: 1147178 - protein, 9 aa, Homo Sapiens
AAIRYYQEA

SEQ ID NO: 1147179 - protein, 9 aa, Homo Sapiens
HLAQLLGAD

SEQ ID NO: 1147180 - protein, 9 aa, Homo Sapiens
RRARRARWD

SEQ ID NO: 1147181 - protein, 9 aa, Homo Sapiens
YASRGQNIR

SEQ ID NO: 1147182 - protein, 9 aa, Homo Sapiens
QQQQQGRWA

SEQ ID NO: 1147183 - protein, 9 aa, Homo Sapiens
HCCGEYTYF

SEQ ID NO: 1147184 - protein, 9 aa, Homo Sapiens
RRTARLQTG

SEQ ID NO: 1147185 - protein, 9 aa, Homo Sapiens
ITWRWNSMT

SEQ ID NO: 1147186 - protein, 9 aa, Homo Sapiens
ENIDIKNTV

SEQ ID NO: 1147187 - protein, 9 aa, Homo Sapiens
QYNKVVKVQ

SEQ ID NO: 1147188 - protein, 9 aa, Homo Sapiens
QNQPTLFIS

SEQ ID NO: 1147189 - protein, 9 aa, Homo Sapiens
IIDGADLTI

SEQ ID NO: 1147190 - protein, 9 aa, Homo Sapiens
PDIYEKDLH

SEQ ID NO: 1147191 - protein, 9 aa, Homo Sapiens
QDVRPYIVG

SEQ ID NO: 1147192 - protein, 9 aa, Homo Sapiens
LSAQHEDVE

SEQ ID NO: 1147193 - protein, 9 aa, Homo Sapiens
PVRSPELRG

SEQ ID NO: 1147194 - protein, 9 aa, Homo Sapiens
PCNVADTNL

SEQ ID NO: 1147195 - protein, 9 aa, Homo Sapiens
GGGQPARPH

SEQ ID NO: 1147196 - protein, 9 aa, Homo Sapiens
EDQYLLRDS

SEQ ID NO: 1147197 - protein, 9 aa, Homo Sapiens
IRHPSLGGC

SEQ ID NO: 1147198 - protein, 9 aa, Homo Sapiens
KAFSTCLTH

SEQ ID NO: 1147199 - protein, 9 aa, Homo Sapiens
TAEPTVSFT

SEQ ID NO: 1147200 - protein, 9 aa, Homo Sapiens
IGSGESSSE

SEQ ID NO: 1147201 - protein, 9 aa, Homo Sapiens
AVLVCWRGC

SEQ ID NO: 1147202 - protein, 9 aa, Homo Sapiens
VRARTARSA

SEQ ID NO: 1147203 - protein, 9 aa, Homo Sapiens
CSMGQTWGP

SEQ ID NO: 1147204 - protein, 9 aa, Homo Sapiens
PEGWDKRCC

SEQ ID NO: 1147205 - protein, 9 aa, Homo Sapiens
LLDEKRCLE

SEQ ID NO: 1147206 - protein, 9 aa, Homo Sapiens
VDGERSFRG

SEQ ID NO: 1147207 - protein, 9 aa, Homo Sapiens
EVKDSAKHP

SEQ ID NO: 1147208 - protein, 9 aa, Homo Sapiens
ESPLMEKKE

SEQ ID NO: 1147209 - protein, 9 aa, Homo Sapiens
EEWGIIHRL

SEQ ID NO: 1147210 - protein, 9 aa, Homo Sapiens
SKHKLESPA

SEQ ID NO: 1147211 - protein, 9 aa, Homo Sapiens
HQRRVPQPA

SEQ ID NO: 1147212 - protein, 9 aa, Homo Sapiens
FHLLFMNLT

SEQ ID NO: 1147213 - protein, 9 aa, Homo Sapiens
CASAATTCA

SEQ ID NO: 1147214 - protein, 9 aa, Homo Sapiens
TSAPWRHQS

SEQ ID NO: 1147215 - protein, 9 aa, Homo Sapiens
TRIHKLPLS

SEQ ID NO: 1147216 - protein, 9 aa, Homo Sapiens
PPLAFSVGH

SEQ ID NO: 1147217 - protein, 9 aa, Homo Sapiens
LVVLPQQSR

SEQ ID NO: 1147218 - protein, 9 aa, Homo Sapiens
GVKFFDEFR

SEQ ID NO: 1147219 - protein, 9 aa, Homo Sapiens
AEIASREAQ

SEQ ID NO: 1147220 - protein, 9 aa, Homo Sapiens
ALDKTDARR

SEQ ID NO: 1147221 - protein, 9 aa, Homo Sapiens
SLACLILLS

SEQ ID NO: 1147222 - protein, 9 aa, Homo Sapiens
ASTGAWTAE

SEQ ID NO: 1147223 - protein, 9 aa, Homo Sapiens
ERITPELNQ

SEQ ID NO: 1147224 - protein, 9 aa, Homo Sapiens
QASSPSHAT

SEQ ID NO: 1147225 - protein, 9 aa, Homo Sapiens
EDGELEGQP

SEQ ID NO: 1147226 - protein, 9 aa, Homo Sapiens
CRYKSKVTI

SEQ ID NO: 1147227 - protein, 9 aa, Homo Sapiens
LIFSALLSA

SEQ ID NO: 1147228 - protein, 9 aa, Homo Sapiens
RSPALRARG

SEQ ID NO: 1147229 - protein, 9 aa, Homo Sapiens
GPRGHPLSA

SEQ ID NO: 1147230 - protein, 9 aa, Homo Sapiens
PSHPNPTQP

SEQ ID NO: 1147231 - protein, 9 aa, Homo Sapiens
SCSTMSCLS

SEQ ID NO: 1147232 - protein, 9 aa, Homo Sapiens
SKVETGLHV

SEQ ID NO: 1147233 - protein, 9 aa, Homo Sapiens
IEIGNSLPQ

SEQ ID NO: 1147234 - protein, 9 aa, Homo Sapiens
SEADGLDSG

SEQ ID NO: 1147235 - protein, 9 aa, Homo Sapiens
LSGARGRTG

SEQ ID NO: 1147236 - protein, 9 aa, Homo Sapiens
FLSLVLQGD

SEQ ID NO: 1147237 - protein, 9 aa, Homo Sapiens
SPEGSGKYN

SEQ ID NO: 1147238 - protein, 9 aa, Homo Sapiens
EGSNPQGPP

SEQ ID NO: 1147239 - protein, 9 aa, Homo Sapiens
VCGVRAHGA

SEQ ID NO: 1147240 - protein, 9 aa, Homo Sapiens
EPPWTGRGE

SEQ ID NO: 1147241 - protein, 9 aa, Homo Sapiens
LDPSNWKPL

SEQ ID NO: 1147242 - protein, 9 aa, Homo Sapiens
PRRAWKHSP

SEQ ID NO: 1147243 - protein, 9 aa, Homo Sapiens
RYGPASVQA

SEQ ID NO: 1147244 - protein, 9 aa, Homo Sapiens
PWDLGTARR

SEQ ID NO: 1147245 - protein, 9 aa, Homo Sapiens
AVPFVPPLA

SEQ ID NO: 1147246 - protein, 9 aa, Homo Sapiens
SLLCTPPGS

SEQ ID NO: 1147247 - protein, 9 aa, Homo Sapiens
PTTVPPKMQ

SEQ ID NO: 1147248 - protein, 9 aa, Homo Sapiens
EARAPHVCQ

SEQ ID NO: 1147249 - protein, 9 aa, Homo Sapiens
DCQSLLGGM

SEQ ID NO: 1147250 - protein, 9 aa, Homo Sapiens
NTTVVFHLL

SEQ ID NO: 1147251 - protein, 9 aa, Homo Sapiens
VEIDLRHQI

SEQ ID NO: 1147252 - protein, 9 aa, Homo Sapiens
KEGRKRAFT

SEQ ID NO: 1147253 - protein, 9 aa, Homo Sapiens
LSTSCGTDF

SEQ ID NO: 1147254 - protein, 9 aa, Homo Sapiens
YSNLLQVWE

SEQ ID NO: 1147255 - protein, 9 aa, Homo Sapiens
GSLPEGYHG

SEQ ID NO: 1147256 - protein, 9 aa, Homo Sapiens
STLSPPDAS

SEQ ID NO: 1147257 - protein, 9 aa, Homo Sapiens
ERMMLPVRA

SEQ ID NO: 1147258 - protein, 9 aa, Homo Sapiens
ATKRPDRVV

SEQ ID NO: 1147259 - protein, 9 aa, Homo Sapiens
RAARPPRLR

SEQ ID NO: 1147260 - protein, 9 aa, Homo Sapiens
GHEYYRVHE

SEQ ID NO: 1147261 - protein, 9 aa, Homo Sapiens
PQPCNVADT

SEQ ID NO: 1147262 - protein, 9 aa, Homo Sapiens
RSYCKGPRR

SEQ ID NO: 1147263 - protein, 9 aa, Homo Sapiens
KRKAFDTNG

SEQ ID NO: 1147264 - protein, 9 aa, Homo Sapiens
GCPLSLWKR

SEQ ID NO: 1147265 - protein, 9 aa, Homo Sapiens
EEASGVAIG

SEQ ID NO: 1147266 - protein, 9 aa, Homo Sapiens
MLELLNHLD

SEQ ID NO: 1147267 - protein, 9 aa, Homo Sapiens
QLQCNKHSF

SEQ ID NO: 1147268 - protein, 9 aa, Homo Sapiens
SGCGHGAKR

SEQ ID NO: 1147269 - protein, 9 aa, Homo Sapiens
GTPNRIFFG

SEQ ID NO: 1147270 - protein, 9 aa, Homo Sapiens
DLLELPSQQ

SEQ ID NO: 1147271 - protein, 9 aa, Homo Sapiens
VKKFIKIAT

SEQ ID NO: 1147272 - protein, 9 aa, Homo Sapiens
APGLPLTPA

SEQ ID NO: 1147273 - protein, 9 aa, Homo Sapiens
ARNVSSRPR

SEQ ID NO: 1147274 - protein, 9 aa, Homo Sapiens
TNKELYRVL

SEQ ID NO: 1147275 - protein, 9 aa, Homo Sapiens
RRRPAGARR

SEQ ID NO: 1147276 - protein, 9 aa, Homo Sapiens
ITPELNQKG

SEQ ID NO: 1147277 - protein, 9 aa, Homo Sapiens
LDVPDVPAS

SEQ ID NO: 1147278 - protein, 9 aa, Homo Sapiens
PASSWGTRE

SEQ ID NO: 1147279 - protein, 9 aa, Homo Sapiens
YRTYSLITI

SEQ ID NO: 1147280 - protein, 9 aa, Homo Sapiens
DEVKCWVLL

SEQ ID NO: 1147281 - protein, 9 aa, Homo Sapiens
QAFLTLRRK

SEQ ID NO: 1147282 - protein, 9 aa, Homo Sapiens
SLGSHPGSC

SEQ ID NO: 1147283 - protein, 9 aa, Homo Sapiens
DRLCGACPG

SEQ ID NO: 1147284 - protein, 9 aa, Homo Sapiens
GAALGQMCI

SEQ ID NO: 1147285 - protein, 9 aa, Homo Sapiens
MLLGCAWGQ

SEQ ID NO: 1147286 - protein, 9 aa, Homo Sapiens
GLLGSPLLS

SEQ ID NO: 1147287 - protein, 9 aa, Homo Sapiens
RRSPALRAR

SEQ ID NO: 1147288 - protein, 9 aa, Homo Sapiens
LAAGNAEET

SEQ ID NO: 1147289 - protein, 9 aa, Homo Sapiens
QQQLDLEHE

SEQ ID NO: 1147290 - protein, 9 aa, Homo Sapiens
NCVSAVDEL

SEQ ID NO: 1147291 - protein, 9 aa, Homo Sapiens
QVDVAISIF

SEQ ID NO: 1147292 - protein, 9 aa, Homo Sapiens
YAMHSRILC

SEQ ID NO: 1147293 - protein, 9 aa, Homo Sapiens
AQEAVQEVA

SEQ ID NO: 1147294 - protein, 9 aa, Homo Sapiens
TKEAATQEE

SEQ ID NO: 1147295 - protein, 9 aa, Homo Sapiens
VPPTTLFHP

SEQ ID NO: 1147296 - protein, 9 aa, Homo Sapiens
SWTSHTVKN

SEQ ID NO: 1147297 - protein, 9 aa, Homo Sapiens
RWGTGVEDP

SEQ ID NO: 1147298 - protein, 9 aa, Homo Sapiens
LHVFPHVCG

SEQ ID NO: 1147299 - protein, 9 aa, Homo Sapiens
LSFYVIDIS

SEQ ID NO: 1147300 - protein, 9 aa, Homo Sapiens
QFLLTRSND

SEQ ID NO: 1147301 - protein, 9 aa, Homo Sapiens
KNPPLRFNL

SEQ ID NO: 1147302 - protein, 9 aa, Homo Sapiens
HNMVHPNVI

SEQ ID NO: 1147303 - protein, 9 aa, Homo Sapiens
LFSNALPEV

SEQ ID NO: 1147304 - protein, 9 aa, Homo Sapiens
NVPVFPMAV

SEQ ID NO: 1147305 - protein, 9 aa, Homo Sapiens
RRLCTGEDV

SEQ ID NO: 1147306 - protein, 9 aa, Homo Sapiens
RLCPSESML

SEQ ID NO: 1147307 - protein, 9 aa, Homo Sapiens
LASARDKRL

SEQ ID NO: 1147308 - protein, 9 aa, Homo Sapiens
RAWRTSSAC

SEQ ID NO: 1147309 - protein, 9 aa, Homo Sapiens
VCRWAHSRQ

SEQ ID NO: 1147310 - protein, 9 aa, Homo Sapiens
DTQPPECVD

SEQ ID NO: 1147311 - protein, 9 aa, Homo Sapiens
RVCCPTSPK

SEQ ID NO: 1147312 - protein, 9 aa, Homo Sapiens
EIQGMQGPP

SEQ ID NO: 1147313 - protein, 9 aa, Homo Sapiens
KDAASLLTR

SEQ ID NO: 1147314 - protein, 9 aa, Homo Sapiens
SWVISELQE

SEQ ID NO: 1147315 - protein, 9 aa, Homo Sapiens
LWGQGPRRR

SEQ ID NO: 1147316 - protein, 9 aa, Homo Sapiens
NETPKKKRS

SEQ ID NO: 1147317 - protein, 9 aa, Homo Sapiens
LAPLPPVTI

SEQ ID NO: 1147318 - protein, 9 aa, Homo Sapiens
PSVGKAMHT

SEQ ID NO: 1147319 - protein, 9 aa, Homo Sapiens
APHNMVHPN

SEQ ID NO: 1147320 - protein, 9 aa, Homo Sapiens
FERAPRPGG

SEQ ID NO: 1147321 - protein, 8 aa, Homo Sapiens
RPGCDLLL

SEQ ID NO: 1147322 - protein, 9 aa, Homo Sapiens
VRQAPCSTP

SEQ ID NO: 1147323 - protein, 9 aa, Homo Sapiens
PKMQKPKLM

SEQ ID NO: 1147324 - protein, 9 aa, Homo Sapiens
FTTLNQLRM

SEQ ID NO: 1147325 - protein, 9 aa, Homo Sapiens
AREQSHSDF

SEQ ID NO: 1147326 - protein, 9 aa, Homo Sapiens
RPLGVSPLA

SEQ ID NO: 1147327 - protein, 9 aa, Homo Sapiens
GTRRSCSGL

SEQ ID NO: 1147328 - protein, 9 aa, Homo Sapiens
IKLWGLETK

SEQ ID NO: 1147329 - protein, 9 aa, Homo Sapiens
KDWYLPDTL

SEQ ID NO: 1147330 - protein, 9 aa, Homo Sapiens
MECTVRSQT

SEQ ID NO: 1147331 - protein, 9 aa, Homo Sapiens
RQTPRHPLQ

SEQ ID NO: 1147332 - protein, 9 aa, Homo Sapiens
QGSEAVGYR

SEQ ID NO: 1147333 - protein, 9 aa, Homo Sapiens
LYHGLEGNH

SEQ ID NO: 1147334 - protein, 9 aa, Homo Sapiens
LRHQIQLPD

SEQ ID NO: 1147335 - protein, 9 aa, Homo Sapiens
TNFKQKFII

SEQ ID NO: 1147336 - protein, 9 aa, Homo Sapiens
LPSAALALT

SEQ ID NO: 1147337 - protein, 9 aa, Homo Sapiens
PYTHACCHA

SEQ ID NO: 1147338 - protein, 9 aa, Homo Sapiens
SPSNAASLG

SEQ ID NO: 1147339 - protein, 9 aa, Homo Sapiens
GIYFDENMK

SEQ ID NO: 1147340 - protein, 9 aa, Homo Sapiens
LWAPGWRRW

SEQ ID NO: 1147341 - protein, 9 aa, Homo Sapiens
FDTLKQQEI

SEQ ID NO: 1147342 - protein, 9 aa, Homo Sapiens
SGARGRTGA

SEQ ID NO: 1147343 - protein, 9 aa, Homo Sapiens
VSPLAPCPP

SEQ ID NO: 1147344 - protein, 9 aa, Homo Sapiens
KVDVQTTRK

SEQ ID NO: 1147345 - protein, 9 aa, Homo Sapiens
CLGLLSILS

SEQ ID NO: 1147346 - protein, 9 aa, Homo Sapiens
DQDLTHMIH

SEQ ID NO: 1147347 - protein, 9 aa, Homo Sapiens
PEGVPIDTI

SEQ ID NO: 1147348 - protein, 9 aa, Homo Sapiens
IMKNQIRKL

SEQ ID NO: 1147349 - protein, 9 aa, Homo Sapiens
ERASAPTSG

SEQ ID NO: 1147350 - protein, 9 aa, Homo Sapiens
EVKDINDNV

SEQ ID NO: 1147351 - protein, 9 aa, Homo Sapiens
GSELPATTA

SEQ ID NO: 1147352 - protein, 9 aa, Homo Sapiens
EIKGSTGID

SEQ ID NO: 1147353 - protein, 9 aa, Homo Sapiens
RSAAQTGQL

SEQ ID NO: 1147354 - protein, 9 aa, Homo Sapiens
SISHTLSRA

SEQ ID NO: 1147355 - protein, 9 aa, Homo Sapiens
TTGWMFASD

SEQ ID NO: 1147356 - protein, 9 aa, Homo Sapiens
CRWKTKFYR

SEQ ID NO: 1147357 - protein, 9 aa, Homo Sapiens
VVCLLFPAS

SEQ ID NO: 1147358 - protein, 9 aa, Homo Sapiens
HCRNCGHIC

SEQ ID NO: 1147359 - protein, 9 aa, Homo Sapiens
RPRWPSRLS

SEQ ID NO: 1147360 - protein, 9 aa, Homo Sapiens
FQDNLQPFM

SEQ ID NO: 1147361 - protein, 9 aa, Homo Sapiens
DEVDGRGSW

SEQ ID NO: 1147362 - protein, 9 aa, Homo Sapiens
SEPGDPVEL

SEQ ID NO: 1147363 - protein, 9 aa, Homo Sapiens
LVSVLHELL

SEQ ID NO: 1147364 - protein, 9 aa, Homo Sapiens
LQPGEKKSQ

SEQ ID NO: 1147365 - protein, 9 aa, Homo Sapiens
QEAELRHVE

SEQ ID NO: 1147366 - protein, 9 aa, Homo Sapiens
VRAGGAEES

SEQ ID NO: 1147367 - protein, 9 aa, Homo Sapiens
EQPTGDPPI

SEQ ID NO: 1147368 - protein, 9 aa, Homo Sapiens
FTSAHPSRP

SEQ ID NO: 1147369 - protein, 9 aa, Homo Sapiens
WWWWWCCSG

SEQ ID NO: 1147370 - protein, 9 aa, Homo Sapiens
LQSLHHPPC

SEQ ID NO: 1147371 - protein, 9 aa, Homo Sapiens
GADLTISNV

SEQ ID NO: 1147372 - protein, 9 aa, Homo Sapiens
PCSLSAATQ

SEQ ID NO: 1147373 - protein, 9 aa, Homo Sapiens
CPSVCAHAH

SEQ ID NO: 1147374 - protein, 9 aa, Homo Sapiens
RSPELRGGP

SEQ ID NO: 1147375 - protein, 9 aa, Homo Sapiens
SCGFTQDRG

SEQ ID NO: 1147376 - protein, 9 aa, Homo Sapiens
DGRVIDPKR

SEQ ID NO: 1147377 - protein, 9 aa, Homo Sapiens
WAQRCSQGA

SEQ ID NO: 1147378 - protein, 9 aa, Homo Sapiens
GPPPPHQAP

SEQ ID NO: 1147379 - protein, 9 aa, Homo Sapiens
WPAHLLETL

SEQ ID NO: 1147380 - protein, 9 aa, Homo Sapiens
ASVPATSGP

SEQ ID NO: 1147381 - protein, 9 aa, Homo Sapiens
KFAQALPSP

SEQ ID NO: 1147382 - protein, 9 aa, Homo Sapiens
EVWTATMPT

SEQ ID NO: 1147383 - protein, 9 aa, Homo Sapiens
VQAPGRSPG

SEQ ID NO: 1147384 - protein, 9 aa, Homo Sapiens
GAGDVGKSA

SEQ ID NO: 1147385 - protein, 9 aa, Homo Sapiens
GRRSTRPAA

SEQ ID NO: 1147386 - protein, 9 aa, Homo Sapiens
SNAASLGTR

SEQ ID NO: 1147387 - protein, 9 aa, Homo Sapiens
TQNNFLLNL

SEQ ID NO: 1147388 - protein, 9 aa, Homo Sapiens
VKRRRRRKR

SEQ ID NO: 1147389 - protein, 9 aa, Homo Sapiens
HLFCWIVTR

SEQ ID NO: 1147390 - protein, 9 aa, Homo Sapiens
SFLQEHWDV

SEQ ID NO: 1147391 - protein, 9 aa, Homo Sapiens
PAVPHPSSM

SEQ ID NO: 1147392 - protein, 9 aa, Homo Sapiens
TWLESLRIT

SEQ ID NO: 1147393 - protein, 9 aa, Homo Sapiens
NFTKLAKKT

SEQ ID NO: 1147394 - protein, 9 aa, Homo Sapiens
ETLPPDTCR

SEQ ID NO: 1147395 - protein, 9 aa, Homo Sapiens
GLGQDHQVP

SEQ ID NO: 1147396 - protein, 9 aa, Homo Sapiens
TLCAGPVFT

SEQ ID NO: 1147397 - protein, 9 aa, Homo Sapiens
SLSSFLIFF

SEQ ID NO: 1147398 - protein, 9 aa, Homo Sapiens
SNPQGPPPP

SEQ ID NO: 1147399 - protein, 9 aa, Homo Sapiens
SIDKKRKAF

SEQ ID NO: 1147400 - protein, 9 aa, Homo Sapiens
GYLLVPARY

SEQ ID NO: 1147401 - protein, 9 aa, Homo Sapiens
MTMLLLYNS

SEQ ID NO: 1147402 - protein, 9 aa, Homo Sapiens
SYSKSGPAL

SEQ ID NO: 1147403 - protein, 9 aa, Homo Sapiens
DRVVLRRYR

SEQ ID NO: 1147404 - protein, 9 aa, Homo Sapiens
QYFLIDALQ

SEQ ID NO: 1147405 - protein, 9 aa, Homo Sapiens
KEKLSISEK

SEQ ID NO: 1147406 - protein, 9 aa, Homo Sapiens
SVQTHIKAL

SEQ ID NO: 1147407 - protein, 9 aa, Homo Sapiens
GWLELSSLE

SEQ ID NO: 1147408 - protein, 9 aa, Homo Sapiens
AGTRCRASR

SEQ ID NO: 1147409 - protein, 9 aa, Homo Sapiens
LLSLKADML

SEQ ID NO: 1147410 - protein, 9 aa, Homo Sapiens
IFACSRGLC

SEQ ID NO: 1147411 - protein, 9 aa, Homo Sapiens
EPAAPRGLG

SEQ ID NO: 1147412 - protein, 9 aa, Homo Sapiens
SVVNWSACS

SEQ ID NO: 1147413 - protein, 9 aa, Homo Sapiens
AAAAANCVN

SEQ ID NO: 1147414 - protein, 9 aa, Homo Sapiens
VHHTDHPRA

SEQ ID NO: 1147415 - protein, 9 aa, Homo Sapiens
VLKREFTTL

SEQ ID NO: 1147416 - protein, 9 aa, Homo Sapiens
AYIARCQDS

SEQ ID NO: 1147417 - protein, 9 aa, Homo Sapiens
RTARSALPQ

SEQ ID NO: 1147418 - protein, 9 aa, Homo Sapiens
LDGMLTVIG

SEQ ID NO: 1147419 - protein, 9 aa, Homo Sapiens
QRVHHTDHP

SEQ ID NO: 1147420 - protein, 9 aa, Homo Sapiens
DEKSGPCSN

SEQ ID NO: 1147421 - protein, 9 aa, Homo Sapiens
LTGMSATTT

SEQ ID NO: 1147422 - protein, 9 aa, Homo Sapiens
PQSKRTNGM

SEQ ID NO: 1147423 - protein, 9 aa, Homo Sapiens
PRSACRWEP

SEQ ID NO: 1147424 - protein, 9 aa, Homo Sapiens
VEVLKRESH

SEQ ID NO: 1147425 - protein, 9 aa, Homo Sapiens
PLQIILFFF

SEQ ID NO: 1147426 - protein, 9 aa, Homo Sapiens
TGCLECCRL

SEQ ID NO: 1147427 - protein, 9 aa, Homo Sapiens
GLVVLPQQS

SEQ ID NO: 1147428 - protein, 9 aa, Homo Sapiens
NHCCGEYTY

SEQ ID NO: 1147429 - protein, 9 aa, Homo Sapiens
HLSPWDLGT

SEQ ID NO: 1147430 - protein, 9 aa, Homo Sapiens
IAQKPTGSS

SEQ ID NO: 1147431 - protein, 9 aa, Homo Sapiens
EKTEIQLTM

SEQ ID NO: 1147432 - protein, 9 aa, Homo Sapiens
NHEVCAQTG

SEQ ID NO: 1147433 - protein, 9 aa, Homo Sapiens
NSDGMYRYG

SEQ ID NO: 1147434 - protein, 9 aa, Homo Sapiens
HHAHQLHAS

SEQ ID NO: 1147435 - protein, 9 aa, Homo Sapiens
GSCAPFSSD

SEQ ID NO: 1147436 - protein, 9 aa, Homo Sapiens
GDELYHGLE

SEQ ID NO: 1147437 - protein, 9 aa, Homo Sapiens
FYQERANKK

SEQ ID NO: 1147438 - protein, 9 aa, Homo Sapiens
TMNLNKPLE

SEQ ID NO: 1147439 - protein, 9 aa, Homo Sapiens
DTSLTMGIY

SEQ ID NO: 1147440 - protein, 9 aa, Homo Sapiens
AQTWPACAR

SEQ ID NO: 1147441 - protein, 9 aa, Homo Sapiens
WATGVAQSA

SEQ ID NO: 1147442 - protein, 9 aa, Homo Sapiens
FPSKSYSPG

SEQ ID NO: 1147443 - protein, 9 aa, Homo Sapiens
CQQTMSCTM

SEQ ID NO: 1147444 - protein, 9 aa, Homo Sapiens
GARSRSPCS

SEQ ID NO: 1147445 - protein, 9 aa, Homo Sapiens
TMGIYFDEN

SEQ ID NO: 1147446 - protein, 9 aa, Homo Sapiens
RLPADTADI

SEQ ID NO: 1147447 - protein, 9 aa, Homo Sapiens
ASTTACEPA

SEQ ID NO: 1147448 - protein, 9 aa, Homo Sapiens
PNGKHSEGC

SEQ ID NO: 1147449 - protein, 9 aa, Homo Sapiens
LLHHLKHHF

SEQ ID NO: 1147450 - protein, 9 aa, Homo Sapiens
PLHYLTVMN

SEQ ID NO: 1147451 - protein, 9 aa, Homo Sapiens
GSEAVGYRT

SEQ ID NO: 1147452 - protein, 9 aa, Homo Sapiens
KEECCPPAR

SEQ ID NO: 1147453 - protein, 9 aa, Homo Sapiens
KRSSQSRSP

SEQ ID NO: 1147454 - protein, 9 aa, Homo Sapiens
TGEDVAALL

SEQ ID NO: 1147455 - protein, 9 aa, Homo Sapiens
FFFHLNLLI

SEQ ID NO: 1147456 - protein, 9 aa, Homo Sapiens
GRVIDPKRP

SEQ ID NO: 1147457 - protein, 9 aa, Homo Sapiens
LLKKKEVRC

SEQ ID NO: 1147458 - protein, 9 aa, Homo Sapiens
MLFSTGSRA

SEQ ID NO: 1147459 - protein, 9 aa, Homo Sapiens
GSDGGTEYY

SEQ ID NO: 1147460 - protein, 9 aa, Homo Sapiens
AEWQTRQTK

SEQ ID NO: 1147461 - protein, 9 aa, Homo Sapiens
AAQLQCNKH

SEQ ID NO: 1147462 - protein, 9 aa, Homo Sapiens
CGCGPDCEV

SEQ ID NO: 1147463 - protein, 9 aa, Homo Sapiens
SPVQLYNEM

SEQ ID NO: 1147464 - protein, 9 aa, Homo Sapiens
VKLPITSSL

SEQ ID NO: 1147465 - protein, 9 aa, Homo Sapiens
EEASAKKLV

SEQ ID NO: 1147466 - protein, 9 aa, Homo Sapiens
VIPPQPSLP

SEQ ID NO: 1147467 - protein, 9 aa, Homo Sapiens
SILGVVGGT

SEQ ID NO: 1147468 - protein, 9 aa, Homo Sapiens
DVAGLHGPR

SEQ ID NO: 1147469 - protein, 9 aa, Homo Sapiens
RTKYIGNTN

SEQ ID NO: 1147470 - protein, 9 aa, Homo Sapiens
CEVSGLCRY

SEQ ID NO: 1147471 - protein, 9 aa, Homo Sapiens
QRCSQGACR

SEQ ID NO: 1147472 - protein, 9 aa, Homo Sapiens
TTPRPSGLS

SEQ ID NO: 1147473 - protein, 9 aa, Homo Sapiens
PQPPRAARP

SEQ ID NO: 1147474 - protein, 9 aa, Homo Sapiens
LSVSPSFSS

SEQ ID NO: 1147475 - protein, 9 aa, Homo Sapiens
STGIDSEYE

SEQ ID NO: 1147476 - protein, 9 aa, Homo Sapiens
RVKPGGAGA

SEQ ID NO: 1147477 - protein, 9 aa, Homo Sapiens
AELVSQQYF

SEQ ID NO: 1147478 - protein, 9 aa, Homo Sapiens
MLLTRHMTT

SEQ ID NO: 1147479 - protein, 9 aa, Homo Sapiens
MCIAYFSIV

SEQ ID NO: 1147480 - protein, 9 aa, Homo Sapiens
STVTEDCLR

SEQ ID NO: 1147481 - protein, 9 aa, Homo Sapiens
TGACTPPTF

SEQ ID NO: 1147482 - protein, 9 aa, Homo Sapiens
SSASLLTGA

SEQ ID NO: 1147483 - protein, 9 aa, Homo Sapiens
KNTVYIILR

SEQ ID NO: 1147484 - protein, 9 aa, Homo Sapiens
YSSVPPLSH

SEQ ID NO: 1147485 - protein, 9 aa, Homo Sapiens
FLELYRKML

SEQ ID NO: 1147486 - protein, 9 aa, Homo Sapiens
TTPTTPLTP

SEQ ID NO: 1147487 - protein, 9 aa, Homo Sapiens
SASRPPLPR

SEQ ID NO: 1147488 - protein, 9 aa, Homo Sapiens
DEVSPGGAG

SEQ ID NO: 1147489 - protein, 9 aa, Homo Sapiens
GGDRPTRRP

SEQ ID NO: 1147490 - protein, 9 aa, Homo Sapiens
KHKLESPAL

SEQ ID NO: 1147491 - protein, 9 aa, Homo Sapiens
LLLKKKEVR

SEQ ID NO: 1147492 - protein, 9 aa, Homo Sapiens
FLDHWKDWY

SEQ ID NO: 1147493 - protein, 9 aa, Homo Sapiens
HPHPLLPFQ

SEQ ID NO: 1147494 - protein, 9 aa, Homo Sapiens
DKMREDDHV

SEQ ID NO: 1147495 - protein, 9 aa, Homo Sapiens
GRRARRARW

SEQ ID NO: 1147496 - protein, 9 aa, Homo Sapiens
AVLKQNSSP

SEQ ID NO: 1147497 - protein, 9 aa, Homo Sapiens
DGLAFKVNF

SEQ ID NO: 1147498 - protein, 9 aa, Homo Sapiens
GARVTVTDT

SEQ ID NO: 1147499 - protein, 9 aa, Homo Sapiens
LPSPWENPA

SEQ ID NO: 1147500 - protein, 9 aa, Homo Sapiens
LIKVHRAAA

SEQ ID NO: 1147501 - protein, 9 aa, Homo Sapiens
PRYAGMLLG

SEQ ID NO: 1147502 - protein, 9 aa, Homo Sapiens
PPGTRPKPP

SEQ ID NO: 1147503 - protein, 9 aa, Homo Sapiens
PDVAGLHGP

SEQ ID NO: 1147504 - protein, 9 aa, Homo Sapiens
YEEDESILG

SEQ ID NO: 1147505 - protein, 9 aa, Homo Sapiens
ATSEALCGV

SEQ ID NO: 1147506 - protein, 9 aa, Homo Sapiens
RAARSSAQA

SEQ ID NO: 1147507 - protein, 9 aa, Homo Sapiens
ADPPGPPGP

SEQ ID NO: 1147508 - protein, 9 aa, Homo Sapiens
LYGVSHEPV

SEQ ID NO: 1147509 - protein, 9 aa, Homo Sapiens
EGQPTLDVF

SEQ ID NO: 1147510 - protein, 9 aa, Homo Sapiens
SRTFYLQLW

SEQ ID NO: 1147511 - protein, 9 aa, Homo Sapiens
QMCIAYFSI

SEQ ID NO: 1147512 - protein, 9 aa, Homo Sapiens
KFTENVYVL

SEQ ID NO: 1147513 - protein, 9 aa, Homo Sapiens
PPLASSASA

SEQ ID NO: 1147514 - protein, 9 aa, Homo Sapiens
GPVSHSAEE

SEQ ID NO: 1147515 - protein, 9 aa, Homo Sapiens
YRQRTLVLK

SEQ ID NO: 1147516 - protein, 9 aa, Homo Sapiens
YQELTNTKL

SEQ ID NO: 1147517 - protein, 9 aa, Homo Sapiens
SPALKQVSP

SEQ ID NO: 1147518 - protein, 9 aa, Homo Sapiens
TVEIDLRHQ

SEQ ID NO: 1147519 - protein, 9 aa, Homo Sapiens
MAGRRSTRP

SEQ ID NO: 1147520 - protein, 9 aa, Homo Sapiens
RNVTWAIVN

SEQ ID NO: 1147521 - protein, 9 aa, Homo Sapiens
VVREPEVTS

SEQ ID NO: 1147522 - protein, 9 aa, Homo Sapiens
QTSTLALIT

SEQ ID NO: 1147523 - protein, 9 aa, Homo Sapiens
DLLTSITFL

SEQ ID NO: 1147524 - protein, 9 aa, Homo Sapiens
HLGDGKKMD

SEQ ID NO: 1147525 - protein, 9 aa, Homo Sapiens
SSKKWRLPT

SEQ ID NO: 1147526 - protein, 9 aa, Homo Sapiens
DEPIHDPPF

SEQ ID NO: 1147527 - protein, 9 aa, Homo Sapiens
RCIGYGDES

SEQ ID NO: 1147528 - protein, 9 aa, Homo Sapiens
MTGPMEQPL

SEQ ID NO: 1147529 - protein, 9 aa, Homo Sapiens
NIRENVLWD

SEQ ID NO: 1147530 - protein, 9 aa, Homo Sapiens
CSSLCPYPA

SEQ ID NO: 1147531 - protein, 9 aa, Homo Sapiens
KFYRQRTLV

SEQ ID NO: 1147532 - protein, 9 aa, Homo Sapiens
RSGGRSRAE

SEQ ID NO: 1147533 - protein, 9 aa, Homo Sapiens
GPRDSALNV

SEQ ID NO: 1147534 - protein, 9 aa, Homo Sapiens
QGPPQQEGS

SEQ ID NO: 1147535 - protein, 9 aa, Homo Sapiens
PDASDFEAP

SEQ ID NO: 1147536 - protein, 9 aa, Homo Sapiens
TSIDTFLME

SEQ ID NO: 1147537 - protein, 9 aa, Homo Sapiens
QKPTGSSRL

SEQ ID NO: 1147538 - protein, 9 aa, Homo Sapiens
IFSALLSAA

SEQ ID NO: 1147539 - protein, 9 aa, Homo Sapiens
GGPPSAPMP

SEQ ID NO: 1147540 - protein, 9 aa, Homo Sapiens
RQQNELKNI

SEQ ID NO: 1147541 - protein, 9 aa, Homo Sapiens
LQSSGGGMM

SEQ ID NO: 1147542 - protein, 9 aa, Homo Sapiens
APHVCQDIP

SEQ ID NO: 1147543 - protein, 9 aa, Homo Sapiens
LAGRKMKRV

SEQ ID NO: 1147544 - protein, 9 aa, Homo Sapiens
GPQGPATPH

SEQ ID NO: 1147545 - protein, 9 aa, Homo Sapiens
GNGKTACFL

SEQ ID NO: 1147546 - protein, 9 aa, Homo Sapiens
PFKRLISAF

SEQ ID NO: 1147547 - protein, 9 aa, Homo Sapiens
YQLPQLQGF

SEQ ID NO: 1147548 - protein, 9 aa, Homo Sapiens
DLPLSYCNS

SEQ ID NO: 1147549 - protein, 9 aa, Homo Sapiens
SQDGWKLHI

SEQ ID NO: 1147550 - protein, 9 aa, Homo Sapiens
AENLLGKNI

SEQ ID NO: 1147551 - protein, 9 aa, Homo Sapiens
RFWLALQAG

SEQ ID NO: 1147552 - protein, 9 aa, Homo Sapiens
KQRTVKKAG

SEQ ID NO: 1147553 - protein, 9 aa, Homo Sapiens
ATTNTTGST

SEQ ID NO: 1147554 - protein, 9 aa, Homo Sapiens
DGELEGQPT

SEQ ID NO: 1147555 - protein, 9 aa, Homo Sapiens
PPSRSRWSR

SEQ ID NO: 1147556 - protein, 9 aa, Homo Sapiens
GKEECCPPA

SEQ ID NO: 1147557 - protein, 9 aa, Homo Sapiens
FRERNQGSN

SEQ ID NO: 1147558 - protein, 9 aa, Homo Sapiens
YAPQQAWIV

SEQ ID NO: 1147559 - protein, 9 aa, Homo Sapiens
EEVVCLLFP

SEQ ID NO: 1147560 - protein, 9 aa, Homo Sapiens
VLGCLLHIA

SEQ ID NO: 1147561 - protein, 9 aa, Homo Sapiens
LASRVAGTA

SEQ ID NO: 1147562 - protein, 9 aa, Homo Sapiens
QRSPIALHV

SEQ ID NO: 1147563 - protein, 9 aa, Homo Sapiens
TKLRDSSDS

SEQ ID NO: 1147564 - protein, 9 aa, Homo Sapiens
DVLPSALEQ

SEQ ID NO: 1147565 - protein, 9 aa, Homo Sapiens
AGARRLARA

SEQ ID NO: 1147566 - protein, 9 aa, Homo Sapiens
CWRGCNKIK

SEQ ID NO: 1147567 - protein, 9 aa, Homo Sapiens
GPVFPPLIP

SEQ ID NO: 1147568 - protein, 9 aa, Homo Sapiens
DVAISIFVK

SEQ ID NO: 1147569 - protein, 9 aa, Homo Sapiens
YQEMFMQFG

SEQ ID NO: 1147570 - protein, 9 aa, Homo Sapiens
ETAVHEGNR

SEQ ID NO: 1147571 - protein, 9 aa, Homo Sapiens
DSAKHPQMV

SEQ ID NO: 1147572 - protein, 9 aa, Homo Sapiens
KLISDIIHE

SEQ ID NO: 1147573 - protein, 9 aa, Homo Sapiens
KMVNQKMPW

SEQ ID NO: 1147574 - protein, 9 aa, Homo Sapiens
KRLISAFKD

SEQ ID NO: 1147575 - protein, 9 aa, Homo Sapiens
DTADISQRF

SEQ ID NO: 1147576 - protein, 9 aa, Homo Sapiens
TRASTPNTG

SEQ ID NO: 1147577 - protein, 9 aa, Homo Sapiens
PTAALGWSP

SEQ ID NO: 1147578 - protein, 9 aa, Homo Sapiens
GRCYQLPQL

SEQ ID NO: 1147579 - protein, 9 aa, Homo Sapiens
NVTWAIVNL

SEQ ID NO: 1147580 - protein, 9 aa, Homo Sapiens
VGMTPRDLG

SEQ ID NO: 1147581 - protein, 9 aa, Homo Sapiens
ANLPKTSRL

SEQ ID NO: 1147582 - protein, 9 aa, Homo Sapiens
VQSDSSPST

SEQ ID NO: 1147583 - protein, 9 aa, Homo Sapiens
HWNQKIRFK

SEQ ID NO: 1147584 - protein, 9 aa, Homo Sapiens
QASRQEKPP

SEQ ID NO: 1147585 - protein, 9 aa, Homo Sapiens
GKTFSESSK

SEQ ID NO: 1147586 - protein, 9 aa, Homo Sapiens
TLPGGLTLP

SEQ ID NO: 1147587 - protein, 9 aa, Homo Sapiens
ACTHPSPHL

SEQ ID NO: 1147588 - protein, 9 aa, Homo Sapiens
DLTISNVTL

SEQ ID NO: 1147589 - protein, 9 aa, Homo Sapiens
WSEPGDPVE

SEQ ID NO: 1147590 - protein, 9 aa, Homo Sapiens
LESLRITFQ

SEQ ID NO: 1147591 - protein, 9 aa, Homo Sapiens
SLLKWNSEG

SEQ ID NO: 1147592 - protein, 9 aa, Homo Sapiens
GCDKVMTKT

SEQ ID NO: 1147593 - protein, 9 aa, Homo Sapiens
GLVCMGRVG

SEQ ID NO: 1147594 - protein, 9 aa, Homo Sapiens
NGKTACFLL

SEQ ID NO: 1147595 - protein, 9 aa, Homo Sapiens
WLSCRKQPV

SEQ ID NO: 1147596 - protein, 9 aa, Homo Sapiens
AGASPSASQ

SEQ ID NO: 1147597 - protein, 9 aa, Homo Sapiens
SPPWQATRS

SEQ ID NO: 1147598 - protein, 9 aa, Homo Sapiens
VGMPSAVSC

SEQ ID NO: 1147599 - protein, 9 aa, Homo Sapiens
QGSLAYAPQ

SEQ ID NO: 1147600 - protein, 9 aa, Homo Sapiens
TWCPGMVSV

SEQ ID NO: 1147601 - protein, 9 aa, Homo Sapiens
PSTSSPKST

SEQ ID NO: 1147602 - protein, 9 aa, Homo Sapiens
CKMLLARHS

SEQ ID NO: 1147603 - protein, 9 aa, Homo Sapiens
PAGTAARLP

SEQ ID NO: 1147604 - protein, 9 aa, Homo Sapiens
RVQELTGCS

SEQ ID NO: 1147605 - protein, 9 aa, Homo Sapiens
DPPFDFSLE

SEQ ID NO: 1147606 - protein, 9 aa, Homo Sapiens
TPIPHLSPW

SEQ ID NO: 1147607 - protein, 9 aa, Homo Sapiens
KIRTSWLET

SEQ ID NO: 1147608 - protein, 9 aa, Homo Sapiens
PLASLAPAV

SEQ ID NO: 1147609 - protein, 9 aa, Homo Sapiens
VGTYLLLHH

SEQ ID NO: 1147610 - protein, 9 aa, Homo Sapiens
YTLTPSTTL

SEQ ID NO: 1147611 - protein, 9 aa, Homo Sapiens
IRALSFSCS

SEQ ID NO: 1147612 - protein, 9 aa, Homo Sapiens
IRTSWLETA

SEQ ID NO: 1147613 - protein, 9 aa, Homo Sapiens
LAYAPQQAW

SEQ ID NO: 1147614 - protein, 9 aa, Homo Sapiens
MQGLPRNMA

SEQ ID NO: 1147615 - protein, 9 aa, Homo Sapiens
PTSSQEKMA

SEQ ID NO: 1147616 - protein, 9 aa, Homo Sapiens
FRDRTCTCR

SEQ ID NO: 1147617 - protein, 9 aa, Homo Sapiens
TLEAWEGLW

SEQ ID NO: 1147618 - protein, 9 aa, Homo Sapiens
SSGSDGGTE

SEQ ID NO: 1147619 - protein, 9 aa, Homo Sapiens
LSRPGWAAL

SEQ ID NO: 1147620 - protein, 9 aa, Homo Sapiens
VPKKRERMM

SEQ ID NO: 1147621 - protein, 9 aa, Homo Sapiens
IALVATNPI

SEQ ID NO: 1147622 - protein, 9 aa, Homo Sapiens
PPLPAGLRV

SEQ ID NO: 1147623 - protein, 9 aa, Homo Sapiens
HASIHASSG

SEQ ID NO: 1147624 - protein, 9 aa, Homo Sapiens
IILRWYHPS

SEQ ID NO: 1147625 - protein, 9 aa, Homo Sapiens
TSPGPTFDA

SEQ ID NO: 1147626 - protein, 9 aa, Homo Sapiens
PIALHVKQE

SEQ ID NO: 1147627 - protein, 9 aa, Homo Sapiens
EGCDKVMTK

SEQ ID NO: 1147628 - protein, 9 aa, Homo Sapiens
IPASHSDVG

SEQ ID NO: 1147629 - protein, 9 aa, Homo Sapiens
QRQAVASRA

SEQ ID NO: 1147630 - protein, 9 aa, Homo Sapiens
DTSCKKRLP

SEQ ID NO: 1147631 - protein, 9 aa, Homo Sapiens
SSPGWSAMP

SEQ ID NO: 1147632 - protein, 9 aa, Homo Sapiens
SRVPDHPSG

SEQ ID NO: 1147633 - protein, 9 aa, Homo Sapiens
QLRMPPMPP

SEQ ID NO: 1147634 - protein, 9 aa, Homo Sapiens
LPVGESPWQ

SEQ ID NO: 1147635 - protein, 9 aa, Homo Sapiens
GDEELMHLD

SEQ ID NO: 1147636 - protein, 9 aa, Homo Sapiens
WTSHTVKNL

SEQ ID NO: 1147637 - protein, 9 aa, Homo Sapiens
TACCPSRNT

SEQ ID NO: 1147638 - protein, 9 aa, Homo Sapiens
TKLEKALSA

SEQ ID NO: 1147639 - protein, 9 aa, Homo Sapiens
RIIIDGADL

SEQ ID NO: 1147640 - protein, 9 aa, Homo Sapiens
FFFPFDTWQ

SEQ ID NO: 1147641 - protein, 9 aa, Homo Sapiens
DYNTLVDKL

SEQ ID NO: 1147642 - protein, 9 aa, Homo Sapiens
NILLLQPQP

SEQ ID NO: 1147643 - protein, 9 aa, Homo Sapiens
QGLLLSSMS

SEQ ID NO: 1147644 - protein, 9 aa, Homo Sapiens
QPARPHVPH

SEQ ID NO: 1147645 - protein, 9 aa, Homo Sapiens
CMGRVGHDP

SEQ ID NO: 1147646 - protein, 9 aa, Homo Sapiens
DQYLLRDSS

SEQ ID NO: 1147647 - protein, 9 aa, Homo Sapiens
TARSALPQG

SEQ ID NO: 1147648 - protein, 9 aa, Homo Sapiens
LAFPSPQGP

SEQ ID NO: 1147649 - protein, 9 aa, Homo Sapiens
SRSFSPDSG

SEQ ID NO: 1147650 - protein, 9 aa, Homo Sapiens
VNEEAKSPA

SEQ ID NO: 1147651 - protein, 9 aa, Homo Sapiens
SPTLRGLLG

SEQ ID NO: 1147652 - protein, 9 aa, Homo Sapiens
STLSQPPPQ

SEQ ID NO: 1147653 - protein, 9 aa, Homo Sapiens
RSAFSRVSV

SEQ ID NO: 1147654 - protein, 9 aa, Homo Sapiens
MVILKALVK

SEQ ID NO: 1147655 - protein, 9 aa, Homo Sapiens
CPLSLWKRL

SEQ ID NO: 1147656 - protein, 9 aa, Homo Sapiens
QGKENSKPQ

SEQ ID NO: 1147657 - protein, 9 aa, Homo Sapiens
RLQSSGGGM

SEQ ID NO: 1147658 - protein, 9 aa, Homo Sapiens
VIRCPLQII

SEQ ID NO: 1147659 - protein, 9 aa, Homo Sapiens
NDTISSSEL

SEQ ID NO: 1147660 - protein, 9 aa, Homo Sapiens
RKLKSILPI

SEQ ID NO: 1147661 - protein, 9 aa, Homo Sapiens
EQIPGLLGS

SEQ ID NO: 1147662 - protein, 9 aa, Homo Sapiens
NEDVAQIVE

SEQ ID NO: 1147663 - protein, 9 aa, Homo Sapiens
HQIQLPDLE

SEQ ID NO: 1147664 - protein, 9 aa, Homo Sapiens
QQLDLEHEL

SEQ ID NO: 1147665 - protein, 9 aa, Homo Sapiens
EVHYSLLKW

SEQ ID NO: 1147666 - protein, 9 aa, Homo Sapiens
KGPLAWKST

SEQ ID NO: 1147667 - protein, 9 aa, Homo Sapiens
KTSRILNLQ

SEQ ID NO: 1147668 - protein, 9 aa, Homo Sapiens
CRILLGVMG

SEQ ID NO: 1147669 - protein, 9 aa, Homo Sapiens
PNVVPSLGR

SEQ ID NO: 1147670 - protein, 9 aa, Homo Sapiens
GQVHRGRRP

SEQ ID NO: 1147671 - protein, 9 aa, Homo Sapiens
TNDDRHRLA

SEQ ID NO: 1147672 - protein, 9 aa, Homo Sapiens
VLQGDPRES

SEQ ID NO: 1147673 - protein, 9 aa, Homo Sapiens
PRQTPRHPL

SEQ ID NO: 1147674 - protein, 9 aa, Homo Sapiens
PPDCQSLLG

SEQ ID NO: 1147675 - protein, 9 aa, Homo Sapiens
TPTTPTTPL

SEQ ID NO: 1147676 - protein, 9 aa, Homo Sapiens
QWLGRVGWL

SEQ ID NO: 1147677 - protein, 9 aa, Homo Sapiens
SSINRPNQS

SEQ ID NO: 1147678 - protein, 9 aa, Homo Sapiens
PVSIWPNLS

SEQ ID NO: 1147679 - protein, 9 aa, Homo Sapiens
FCSSSMAPK

SEQ ID NO: 1147680 - protein, 9 aa, Homo Sapiens
SDLGSRSRP

SEQ ID NO: 1147681 - protein, 9 aa, Homo Sapiens
DWHVVNQQP

SEQ ID NO: 1147682 - protein, 9 aa, Homo Sapiens
GHLGDGKKM

SEQ ID NO: 1147683 - protein, 9 aa, Homo Sapiens
KGDPREPTR

SEQ ID NO: 1147684 - protein, 9 aa, Homo Sapiens
STAAMNHNS

SEQ ID NO: 1147685 - protein, 9 aa, Homo Sapiens
LEGSAEIPT

SEQ ID NO: 1147686 - protein, 9 aa, Homo Sapiens
LCTGEDVAA

SEQ ID NO: 1147687 - protein, 9 aa, Homo Sapiens
TAFTTCCTP

SEQ ID NO: 1147688 - protein, 9 aa, Homo Sapiens
KYIDNLEKN

SEQ ID NO: 1147689 - protein, 9 aa, Homo Sapiens
ILHVSSKST

SEQ ID NO: 1147690 - protein, 9 aa, Homo Sapiens
PADVCGSLF

SEQ ID NO: 1147691 - protein, 9 aa, Homo Sapiens
AFGFLCNVC

SEQ ID NO: 1147692 - protein, 9 aa, Homo Sapiens
TQCAICRGF

SEQ ID NO: 1147693 - protein, 9 aa, Homo Sapiens
SRILCTKPV

SEQ ID NO: 1147694 - protein, 9 aa, Homo Sapiens
MAPTWCPGM

SEQ ID NO: 1147695 - protein, 9 aa, Homo Sapiens
GLLYDWSWM

SEQ ID NO: 1147696 - protein, 9 aa, Homo Sapiens
PARRGLVEG

SEQ ID NO: 1147697 - protein, 9 aa, Homo Sapiens
CSLSAATQA

SEQ ID NO: 1147698 - protein, 9 aa, Homo Sapiens
PFDTWQMLF

SEQ ID NO: 1147699 - protein, 9 aa, Homo Sapiens
RKNVRRKKM

SEQ ID NO: 1147700 - protein, 9 aa, Homo Sapiens
AGMLLGCAW

SEQ ID NO: 1147701 - protein, 9 aa, Homo Sapiens
AFKVNFTFN

SEQ ID NO: 1147702 - protein, 9 aa, Homo Sapiens
PVRLLLGVC

SEQ ID NO: 1147703 - protein, 9 aa, Homo Sapiens
TAARRAARC

SEQ ID NO: 1147704 - protein, 9 aa, Homo Sapiens
CCGTRRSCS

SEQ ID NO: 1147705 - protein, 9 aa, Homo Sapiens
EQQLWKKAF

SEQ ID NO: 1147706 - protein, 9 aa, Homo Sapiens
LHGAPWKGR

SEQ ID NO: 1147707 - protein, 9 aa, Homo Sapiens
DKFTENVYV

SEQ ID NO: 1147708 - protein, 9 aa, Homo Sapiens
CWARVPACR

SEQ ID NO: 1147709 - protein, 9 aa, Homo Sapiens
NQVLRSGTK

SEQ ID NO: 1147710 - protein, 9 aa, Homo Sapiens
RQLLLRFPF

SEQ ID NO: 1147711 - protein, 9 aa, Homo Sapiens
FIWPQHSYK

SEQ ID NO: 1147712 - protein, 9 aa, Homo Sapiens
VRRSRRCTG

SEQ ID NO: 1147713 - protein, 9 aa, Homo Sapiens
FYQMLHKVD

SEQ ID NO: 1147714 - protein, 9 aa, Homo Sapiens
RLPTHKIRT

SEQ ID NO: 1147715 - protein, 9 aa, Homo Sapiens
LEAWEGLWM

SEQ ID NO: 1147716 - protein, 9 aa, Homo Sapiens
PAATTSATT

SEQ ID NO: 1147717 - protein, 9 aa, Homo Sapiens
DFRAREQSH

SEQ ID NO: 1147718 - protein, 9 aa, Homo Sapiens
LVCIGESRA

SEQ ID NO: 1147719 - protein, 9 aa, Homo Sapiens
PGRRAPGRP

SEQ ID NO: 1147720 - protein, 9 aa, Homo Sapiens
FYYVTREGS

SEQ ID NO: 1147721 - protein, 9 aa, Homo Sapiens
LSQAFLTLR

SEQ ID NO: 1147722 - protein, 9 aa, Homo Sapiens
AGVPHLVSG

SEQ ID NO: 1147723 - protein, 9 aa, Homo Sapiens
ISPVQLYNE

SEQ ID NO: 1147724 - protein, 9 aa, Homo Sapiens
TCSRPTWCT

SEQ ID NO: 1147725 - protein, 9 aa, Homo Sapiens
RLSIILPQT

SEQ ID NO: 1147726 - protein, 9 aa, Homo Sapiens
FAVVLHAPN

SEQ ID NO: 1147727 - protein, 9 aa, Homo Sapiens
PRAGGSRRH

SEQ ID NO: 1147728 - protein, 9 aa, Homo Sapiens
NDNMSYSME

SEQ ID NO: 1147729 - protein, 9 aa, Homo Sapiens
LRCPAVPAA

SEQ ID NO: 1147730 - protein, 9 aa, Homo Sapiens
AGVGWATGV

SEQ ID NO: 1147731 - protein, 9 aa, Homo Sapiens
PTPTTPIPH

SEQ ID NO: 1147732 - protein, 9 aa, Homo Sapiens
VVLPQQSRL

SEQ ID NO: 1147733 - protein, 9 aa, Homo Sapiens
VAFIILEKN

SEQ ID NO: 1147734 - protein, 9 aa, Homo Sapiens
HVDLPLSYC

SEQ ID NO: 1147735 - protein, 9 aa, Homo Sapiens
EWGIIHRLP

SEQ ID NO: 1147736 - protein, 9 aa, Homo Sapiens
PWLSPLQRS

SEQ ID NO: 1147737 - protein, 9 aa, Homo Sapiens
CWLSCRKQP

SEQ ID NO: 1147738 - protein, 9 aa, Homo Sapiens
TYLSTAAMN

SEQ ID NO: 1147739 - protein, 9 aa, Homo Sapiens
LFSLWRTFD

SEQ ID NO: 1147740 - protein, 9 aa, Homo Sapiens
EPQASRQEK

SEQ ID NO: 1147741 - protein, 9 aa, Homo Sapiens
MQKEEKNSK

SEQ ID NO: 1147742 - protein, 9 aa, Homo Sapiens
QQRVHHTDH

SEQ ID NO: 1147743 - protein, 9 aa, Homo Sapiens
LSCRKQPVS

SEQ ID NO: 1147744 - protein, 9 aa, Homo Sapiens
SPGATLTST

SEQ ID NO: 1147745 - protein, 9 aa, Homo Sapiens
QSRLPLQWV

SEQ ID NO: 1147746 - protein, 9 aa, Homo Sapiens
ILSVKILNS

SEQ ID NO: 1147747 - protein, 9 aa, Homo Sapiens
VKSHTRGIW

SEQ ID NO: 1147748 - protein, 9 aa, Homo Sapiens
LLLLCYPNV

SEQ ID NO: 1147749 - protein, 9 aa, Homo Sapiens
SQFLLTRSN

SEQ ID NO: 1147750 - protein, 9 aa, Homo Sapiens
ELIKHEAVS

SEQ ID NO: 1147751 - protein, 9 aa, Homo Sapiens
KLMLLTRHM

SEQ ID NO: 1147752 - protein, 9 aa, Homo Sapiens
GRDASPAAD

SEQ ID NO: 1147753 - protein, 9 aa, Homo Sapiens
VCMGRVGHD

SEQ ID NO: 1147754 - protein, 9 aa, Homo Sapiens
ETAPSLLLL

SEQ ID NO: 1147755 - protein, 9 aa, Homo Sapiens
TGVFSRMGA

SEQ ID NO: 1147756 - protein, 9 aa, Homo Sapiens
MVALVTGSV

SEQ ID NO: 1147757 - protein, 9 aa, Homo Sapiens
IASAHVSTS

SEQ ID NO: 1147758 - protein, 9 aa, Homo Sapiens
QELLRHRER

SEQ ID NO: 1147759 - protein, 9 aa, Homo Sapiens
TVPTAPPLA

SEQ ID NO: 1147760 - protein, 9 aa, Homo Sapiens
QFRVLYCYY

SEQ ID NO: 1147761 - protein, 9 aa, Homo Sapiens
RRKLRKNVR

SEQ ID NO: 1147762 - protein, 9 aa, Homo Sapiens
IRVPFLFVV

SEQ ID NO: 1147763 - protein, 9 aa, Homo Sapiens
EEKNSKKPP

SEQ ID NO: 1147764 - protein, 9 aa, Homo Sapiens
DEELMHLDV

SEQ ID NO: 1147765 - protein, 9 aa, Homo Sapiens
TKLAKKTET

SEQ ID NO: 1147766 - protein, 9 aa, Homo Sapiens
VTDFATENL

SEQ ID NO: 1147767 - protein, 9 aa, Homo Sapiens
GHPPSAIRD

SEQ ID NO: 1147768 - protein, 9 aa, Homo Sapiens
QTVNLAGRA

SEQ ID NO: 1147769 - protein, 9 aa, Homo Sapiens
PLGVSPLAP

SEQ ID NO: 1147770 - protein, 9 aa, Homo Sapiens
SEVVDVSVP

SEQ ID NO: 1147771 - protein, 9 aa, Homo Sapiens
HVTDFATEN

SEQ ID NO: 1147772 - protein, 9 aa, Homo Sapiens
SSEIGSGES

SEQ ID NO: 1147773 - protein, 9 aa, Homo Sapiens
GGASGRKNS

SEQ ID NO: 1147774 - protein, 9 aa, Homo Sapiens
GLRVPEGPT

SEQ ID NO: 1147775 - protein, 9 aa, Homo Sapiens
FPMYVTVKW

SEQ ID NO: 1147776 - protein, 9 aa, Homo Sapiens
CESVMGMVN

SEQ ID NO: 1147777 - protein, 9 aa, Homo Sapiens
GSPGPWPSP

SEQ ID NO: 1147778 - protein, 9 aa, Homo Sapiens
GLEGNHKKQ

SEQ ID NO: 1147779 - protein, 9 aa, Homo Sapiens
CVSAVDELA

SEQ ID NO: 1147780 - protein, 9 aa, Homo Sapiens
CRKMQNMFA

SEQ ID NO: 1147781 - protein, 9 aa, Homo Sapiens
FAWQIKTAQ

SEQ ID NO: 1147782 - protein, 9 aa, Homo Sapiens
INDRHGSVS

SEQ ID NO: 1147783 - protein, 9 aa, Homo Sapiens
HAHSNPIFR

SEQ ID NO: 1147784 - protein, 9 aa, Homo Sapiens
SDSIASAHV

SEQ ID NO: 1147785 - protein, 9 aa, Homo Sapiens
QSHSDFRNR

SEQ ID NO: 1147786 - protein, 9 aa, Homo Sapiens
QEKMAAELQ

SEQ ID NO: 1147787 - protein, 9 aa, Homo Sapiens
PTPLQPLRR

SEQ ID NO: 1147788 - protein, 9 aa, Homo Sapiens
AEKWTYERV

SEQ ID NO: 1147789 - protein, 9 aa, Homo Sapiens
TTSRPEGAR

SEQ ID NO: 1147790 - protein, 9 aa, Homo Sapiens
LPQPCRCHP

SEQ ID NO: 1147791 - protein, 9 aa, Homo Sapiens
TPARTPTQP

SEQ ID NO: 1147792 - protein, 9 aa, Homo Sapiens
VGVLELSYL

SEQ ID NO: 1147793 - protein, 9 aa, Homo Sapiens
DLSRHFDLR

SEQ ID NO: 1147794 - protein, 9 aa, Homo Sapiens
LHYLRPILR

SEQ ID NO: 1147795 - protein, 9 aa, Homo Sapiens
QWTQTCPPK

SEQ ID NO: 1147796 - protein, 9 aa, Homo Sapiens
CWACCGTRR

SEQ ID NO: 1147797 - protein, 9 aa, Homo Sapiens
GPMEQPLEE

SEQ ID NO: 1147798 - protein, 9 aa, Homo Sapiens
TIIFGGRRP

SEQ ID NO: 1147799 - protein, 9 aa, Homo Sapiens
ECRGPRGAL

SEQ ID NO: 1147800 - protein, 9 aa, Homo Sapiens
MNHGNPSGV

SEQ ID NO: 1147801 - protein, 9 aa, Homo Sapiens
QLLGADAAI

SEQ ID NO: 1147802 - protein, 9 aa, Homo Sapiens
EPTVDTVHM

SEQ ID NO: 1147803 - protein, 9 aa, Homo Sapiens
PHHEFCSHK

SEQ ID NO: 1147804 - protein, 9 aa, Homo Sapiens
TSIQSRICS

SEQ ID NO: 1147805 - protein, 9 aa, Homo Sapiens
GASGRKNSN

SEQ ID NO: 1147806 - protein, 9 aa, Homo Sapiens
GSGHPTGPQ

SEQ ID NO: 1147807 - protein, 9 aa, Homo Sapiens
FMQFGYVVL

SEQ ID NO: 1147808 - protein, 9 aa, Homo Sapiens
SAALEKNFM

SEQ ID NO: 1147809 - protein, 9 aa, Homo Sapiens
ASCARWRTR

SEQ ID NO: 1147810 - protein, 9 aa, Homo Sapiens
THIKALLAL

SEQ ID NO: 1147811 - protein, 9 aa, Homo Sapiens
NSISVFQVI

SEQ ID NO: 1147812 - protein, 9 aa, Homo Sapiens
NGWVSRWVI

SEQ ID NO: 1147813 - protein, 9 aa, Homo Sapiens
ALIAQKPTG

SEQ ID NO: 1147814 - protein, 9 aa, Homo Sapiens
IWPNLSCKY

SEQ ID NO: 1147815 - protein, 9 aa, Homo Sapiens
PGAPAHGEV

SEQ ID NO: 1147816 - protein, 9 aa, Homo Sapiens
LLGPPPPHQ

SEQ ID NO: 1147817 - protein, 9 aa, Homo Sapiens
LDLRVCGEP

SEQ ID NO: 1147818 - protein, 9 aa, Homo Sapiens
LLPFQYQAL

SEQ ID NO: 1147819 - protein, 9 aa, Homo Sapiens
GGGGSGDFN

SEQ ID NO: 1147820 - protein, 9 aa, Homo Sapiens
RDSALNVLR

SEQ ID NO: 1147821 - protein, 9 aa, Homo Sapiens
LLSAALPQP

SEQ ID NO: 1147822 - protein, 9 aa, Homo Sapiens
LGRVPHQVQ

SEQ ID NO: 1147823 - protein, 9 aa, Homo Sapiens
NHNSAPTVP

SEQ ID NO: 1147824 - protein, 9 aa, Homo Sapiens
SSGCHASGD

SEQ ID NO: 1147825 - protein, 9 aa, Homo Sapiens
KQQVVKFVI

SEQ ID NO: 1147826 - protein, 9 aa, Homo Sapiens
ISRLAQSKE

SEQ ID NO: 1147827 - protein, 9 aa, Homo Sapiens
VIDPKRPWL

SEQ ID NO: 1147828 - protein, 9 aa, Homo Sapiens
LNTNSISVF

SEQ ID NO: 1147829 - protein, 9 aa, Homo Sapiens
CQFRVLYCY

SEQ ID NO: 1147830 - protein, 9 aa, Homo Sapiens
KMNMKGPEG

SEQ ID NO: 1147831 - protein, 9 aa, Homo Sapiens
MKFLSLVLQ

SEQ ID NO: 1147832 - protein, 9 aa, Homo Sapiens
PGAHLPLPQ

SEQ ID NO: 1147833 - protein, 9 aa, Homo Sapiens
TQQPQTPQD

SEQ ID NO: 1147834 - protein, 9 aa, Homo Sapiens
AALQRLTWV

SEQ ID NO: 1147835 - protein, 9 aa, Homo Sapiens
VPACRRRPA

SEQ ID NO: 1147836 - protein, 9 aa, Homo Sapiens
TARSHILEH

SEQ ID NO: 1147837 - protein, 9 aa, Homo Sapiens
QEIERERES

SEQ ID NO: 1147838 - protein, 9 aa, Homo Sapiens
ILQKRMNFL

SEQ ID NO: 1147839 - protein, 9 aa, Homo Sapiens
DKNKFSMTS

SEQ ID NO: 1147840 - protein, 9 aa, Homo Sapiens
CTQYRGEVC

SEQ ID NO: 1147841 - protein, 9 aa, Homo Sapiens
HYDPKKDVH

SEQ ID NO: 1147842 - protein, 9 aa, Homo Sapiens
ARPASSWGT

SEQ ID NO: 1147843 - protein, 9 aa, Homo Sapiens
HIHAKGSYE

SEQ ID NO: 1147844 - protein, 9 aa, Homo Sapiens
LAQAAALGT

SEQ ID NO: 1147845 - protein, 9 aa, Homo Sapiens
NMSKVETGL

SEQ ID NO: 1147846 - protein, 9 aa, Homo Sapiens
CGVAPLQSA

SEQ ID NO: 1147847 - protein, 9 aa, Homo Sapiens
GGGVMLFST

SEQ ID NO: 1147848 - protein, 9 aa, Homo Sapiens
IGLHVFPHV

SEQ ID NO: 1147849 - protein, 9 aa, Homo Sapiens
DHPSGQGAA

SEQ ID NO: 1147850 - protein, 9 aa, Homo Sapiens
LHKDFFILA

SEQ ID NO: 1147851 - protein, 9 aa, Homo Sapiens
QRLSRPTKT

SEQ ID NO: 1147852 - protein, 9 aa, Homo Sapiens
SSSATGGDR

SEQ ID NO: 1147853 - protein, 9 aa, Homo Sapiens
NFTDTSHVP

SEQ ID NO: 1147854 - protein, 9 aa, Homo Sapiens
VLLNDGSVP

SEQ ID NO: 1147855 - protein, 9 aa, Homo Sapiens
GPLAWKSTM

SEQ ID NO: 1147856 - protein, 9 aa, Homo Sapiens
LPADTADIS

SEQ ID NO: 1147857 - protein, 9 aa, Homo Sapiens
MRNLPHSND

SEQ ID NO: 1147858 - protein, 9 aa, Homo Sapiens
GAGVPHLVS

SEQ ID NO: 1147859 - protein, 9 aa, Homo Sapiens
TDLEEDAVL

SEQ ID NO: 1147860 - protein, 9 aa, Homo Sapiens
SPASPPTQQ

SEQ ID NO: 1147861 - protein, 9 aa, Homo Sapiens
AGPEEDEEW

SEQ ID NO: 1147862 - protein, 9 aa, Homo Sapiens
TVVFHLLFM

SEQ ID NO: 1147863 - protein, 9 aa, Homo Sapiens
WFMSVNEGS

SEQ ID NO: 1147864 - protein, 9 aa, Homo Sapiens
VVPDPNRTT

SEQ ID NO: 1147865 - protein, 9 aa, Homo Sapiens
TIGEKTEIQ

SEQ ID NO: 1147866 - protein, 9 aa, Homo Sapiens
SSTWPQNWS

SEQ ID NO: 1147867 - protein, 9 aa, Homo Sapiens
WGIIHRLPA

SEQ ID NO: 1147868 - protein, 9 aa, Homo Sapiens
LLLLKKKEV

SEQ ID NO: 1147869 - protein, 9 aa, Homo Sapiens
REPQASRQE

SEQ ID NO: 1147870 - protein, 9 aa, Homo Sapiens
KDVAILIGQ

SEQ ID NO: 1147871 - protein, 9 aa, Homo Sapiens
YWMALRNCV

SEQ ID NO: 1147872 - protein, 9 aa, Homo Sapiens
IKGSTGIDS

SEQ ID NO: 1147873 - protein, 9 aa, Homo Sapiens
PEVQDVRPY

SEQ ID NO: 1147874 - protein, 9 aa, Homo Sapiens
FSRDGLSED

SEQ ID NO: 1147875 - protein, 9 aa, Homo Sapiens
GGPISLSCW

SEQ ID NO: 1147876 - protein, 9 aa, Homo Sapiens
VGKAMHTPK

SEQ ID NO: 1147877 - protein, 9 aa, Homo Sapiens
PTKPAVPHP

SEQ ID NO: 1147878 - protein, 9 aa, Homo Sapiens
WAPGWRRWT

SEQ ID NO: 1147879 - protein, 9 aa, Homo Sapiens
PIPTIDTSC

SEQ ID NO: 1147880 - protein, 9 aa, Homo Sapiens
MVMGIIFMC

SEQ ID NO: 1147881 - protein, 9 aa, Homo Sapiens
VTVTDTWVM

SEQ ID NO: 1147882 - protein, 9 aa, Homo Sapiens
NKLGFPKRF

SEQ ID NO: 1147883 - protein, 9 aa, Homo Sapiens
DGERSFRGS

SEQ ID NO: 1147884 - protein, 9 aa, Homo Sapiens
SGRGGGALL

SEQ ID NO: 1147885 - protein, 9 aa, Homo Sapiens
PACVPVAEA

SEQ ID NO: 1147886 - protein, 9 aa, Homo Sapiens
SACRWEPQP

SEQ ID NO: 1147887 - protein, 9 aa, Homo Sapiens
ARRARWDLR

SEQ ID NO: 1147888 - protein, 9 aa, Homo Sapiens
LRGLLGAHV

SEQ ID NO: 1147889 - protein, 9 aa, Homo Sapiens
QPTSDHSPT

SEQ ID NO: 1147890 - protein, 9 aa, Homo Sapiens
KVIELNKHI

SEQ ID NO: 1147891 - protein, 9 aa, Homo Sapiens
SVQYFLIDA

SEQ ID NO: 1147892 - protein, 9 aa, Homo Sapiens
ARRLARARV

SEQ ID NO: 1147893 - protein, 9 aa, Homo Sapiens
RWAAATCSR

SEQ ID NO: 1147894 - protein, 9 aa, Homo Sapiens
LTGPLAELV

SEQ ID NO: 1147895 - protein, 9 aa, Homo Sapiens
LQLWAPLKT

SEQ ID NO: 1147896 - protein, 9 aa, Homo Sapiens
SDVISTNGI

SEQ ID NO: 1147897 - protein, 9 aa, Homo Sapiens
GRVPHQVQG

SEQ ID NO: 1147898 - protein, 9 aa, Homo Sapiens
WTSSGSTTR

SEQ ID NO: 1147899 - protein, 9 aa, Homo Sapiens
TPTTPIPHL

SEQ ID NO: 1147900 - protein, 9 aa, Homo Sapiens
PSAPVRSEA

SEQ ID NO: 1147901 - protein, 9 aa, Homo Sapiens
SRPPLPRPA

SEQ ID NO: 1147902 - protein, 9 aa, Homo Sapiens
EAGDEELMH

SEQ ID NO: 1147903 - protein, 9 aa, Homo Sapiens
MTPSGECRV

SEQ ID NO: 1147904 - protein, 9 aa, Homo Sapiens
RLRSYCKGP

SEQ ID NO: 1147905 - protein, 9 aa, Homo Sapiens
ISLPRYWTY

SEQ ID NO: 1147906 - protein, 9 aa, Homo Sapiens
YIGNTNFKQ

SEQ ID NO: 1147907 - protein, 9 aa, Homo Sapiens
GKVFGNFNL

SEQ ID NO: 1147908 - protein, 9 aa, Homo Sapiens
ASREAQNFS

SEQ ID NO: 1147909 - protein, 9 aa, Homo Sapiens
IPGLLGSPL

SEQ ID NO: 1147910 - protein, 9 aa, Homo Sapiens
AQEAPHNMV

SEQ ID NO: 1147911 - protein, 9 aa, Homo Sapiens
TPPGSAPSM

SEQ ID NO: 1147912 - protein, 9 aa, Homo Sapiens
CALLLLCYP

SEQ ID NO: 1147913 - protein, 9 aa, Homo Sapiens
GVPPTTLFH

SEQ ID NO: 1147914 - protein, 9 aa, Homo Sapiens
VPEGPTIPA

SEQ ID NO: 1147915 - protein, 9 aa, Homo Sapiens
RQRSPIALH

SEQ ID NO: 1147916 - protein, 9 aa, Homo Sapiens
HGKEECCPP

SEQ ID NO: 1147917 - protein, 9 aa, Homo Sapiens
EWIRSVAEK

SEQ ID NO: 1147918 - protein, 9 aa, Homo Sapiens
LGTRKGWTG

SEQ ID NO: 1147919 - protein, 9 aa, Homo Sapiens
AALPQPCRC

SEQ ID NO: 1147920 - protein, 9 aa, Homo Sapiens
GARCLCVPC

SEQ ID NO: 1147921 - protein, 9 aa, Homo Sapiens
SSPSHATRN

SEQ ID NO: 1147922 - protein, 9 aa, Homo Sapiens
PPPVGAGTG

SEQ ID NO: 1147923 - protein, 9 aa, Homo Sapiens
RAPHVCQDI

SEQ ID NO: 1147924 - protein, 9 aa, Homo Sapiens
TDTSHVPRG

SEQ ID NO: 1147925 - protein, 9 aa, Homo Sapiens
GGDPRGVGV

SEQ ID NO: 1147926 - protein, 9 aa, Homo Sapiens
KGNYPAGER

SEQ ID NO: 1147927 - protein, 9 aa, Homo Sapiens
PSTTLWVIP

SEQ ID NO: 1147928 - protein, 9 aa, Homo Sapiens
FLGSFLLAG

SEQ ID NO: 1147929 - protein, 9 aa, Homo Sapiens
EKWTYERVE

SEQ ID NO: 1147930 - protein, 9 aa, Homo Sapiens
PYTPPRLLS

SEQ ID NO: 1147931 - protein, 9 aa, Homo Sapiens
AGARLAEND

SEQ ID NO: 1147932 - protein, 9 aa, Homo Sapiens
KKGRCYQLP

SEQ ID NO: 1147933 - protein, 9 aa, Homo Sapiens
GAMETRSEP

SEQ ID NO: 1147934 - protein, 9 aa, Homo Sapiens
QPPRRPSTA

SEQ ID NO: 1147935 - protein, 9 aa, Homo Sapiens
RLCSYTGAC

SEQ ID NO: 1147936 - protein, 9 aa, Homo Sapiens
FHIKSIAAA

SEQ ID NO: 1147937 - protein, 9 aa, Homo Sapiens
HGEQAEEEE

SEQ ID NO: 1147938 - protein, 9 aa, Homo Sapiens
NPEKLQRNS

SEQ ID NO: 1147939 - protein, 9 aa, Homo Sapiens
TTCCTPSEE

SEQ ID NO: 1147940 - protein, 9 aa, Homo Sapiens
VQEANIHRF

SEQ ID NO: 1147941 - protein, 9 aa, Homo Sapiens
CTHRHYERL

SEQ ID NO: 1147942 - protein, 9 aa, Homo Sapiens
ALGSRSGGR

SEQ ID NO: 1147943 - protein, 9 aa, Homo Sapiens
ICYEEDESI

SEQ ID NO: 1147944 - protein, 9 aa, Homo Sapiens
HHETKFAQA

SEQ ID NO: 1147945 - protein, 9 aa, Homo Sapiens
DALQPHCLG

SEQ ID NO: 1147946 - protein, 9 aa, Homo Sapiens
KNSGSQSGT

SEQ ID NO: 1147947 - protein, 9 aa, Homo Sapiens
QSHCFYRGT

SEQ ID NO: 1147948 - protein, 9 aa, Homo Sapiens
SSVELTGMS

SEQ ID NO: 1147949 - protein, 9 aa, Homo Sapiens
RTHTCEKPY

SEQ ID NO: 1147950 - protein, 9 aa, Homo Sapiens
DNHGFGNCM

SEQ ID NO: 1147951 - protein, 9 aa, Homo Sapiens
TGVYNVDHQ

SEQ ID NO: 1147952 - protein, 9 aa, Homo Sapiens
LQELLRHRE

SEQ ID NO: 1147953 - protein, 9 aa, Homo Sapiens
FDMFLKLND

SEQ ID NO: 1147954 - protein, 9 aa, Homo Sapiens
VNQEILNTN

SEQ ID NO: 1147955 - protein, 9 aa, Homo Sapiens
QLLLRFPFA

SEQ ID NO: 1147956 - protein, 9 aa, Homo Sapiens
HEGNRLETM

SEQ ID NO: 1147957 - protein, 9 aa, Homo Sapiens
SAQAYQAAG

SEQ ID NO: 1147958 - protein, 9 aa, Homo Sapiens
KDAWMQKYE

SEQ ID NO: 1147959 - protein, 9 aa, Homo Sapiens
YSMEVSYME

SEQ ID NO: 1147960 - protein, 9 aa, Homo Sapiens
LAELVSQQY

SEQ ID NO: 1147961 - protein, 9 aa, Homo Sapiens
IEGQYDTLQ

SEQ ID NO: 1147962 - protein, 9 aa, Homo Sapiens
TELIKHEAV

SEQ ID NO: 1147963 - protein, 9 aa, Homo Sapiens
SSLWTQQTC

SEQ ID NO: 1147964 - protein, 9 aa, Homo Sapiens
CSRPTWCTT

SEQ ID NO: 1147965 - protein, 9 aa, Homo Sapiens
LSEKTTPSP

SEQ ID NO: 1147966 - protein, 9 aa, Homo Sapiens
SHRPVRPGR

SEQ ID NO: 1147967 - protein, 9 aa, Homo Sapiens
EFSEATAEP

SEQ ID NO: 1147968 - protein, 9 aa, Homo Sapiens
EKLQELLRH

SEQ ID NO: 1147969 - protein, 9 aa, Homo Sapiens
AVAWLQGSP

SEQ ID NO: 1147970 - protein, 9 aa, Homo Sapiens
THPGLLQFE

SEQ ID NO: 1147971 - protein, 9 aa, Homo Sapiens
ALLPFDNMH

SEQ ID NO: 1147972 - protein, 9 aa, Homo Sapiens
FGFGPNQVI

SEQ ID NO: 1147973 - protein, 9 aa, Homo Sapiens
KINTFARNT

SEQ ID NO: 1147974 - protein, 9 aa, Homo Sapiens
TDGKRKTID

SEQ ID NO: 1147975 - protein, 9 aa, Homo Sapiens
LSLTSSLGW

SEQ ID NO: 1147976 - protein, 9 aa, Homo Sapiens
VREPEVTSI

SEQ ID NO: 1147977 - protein, 9 aa, Homo Sapiens
ERRSPQAHK

SEQ ID NO: 1147978 - protein, 9 aa, Homo Sapiens
LCRYGGRCV

SEQ ID NO: 1147979 - protein, 9 aa, Homo Sapiens
QLHASPRRL

SEQ ID NO: 1147980 - protein, 9 aa, Homo Sapiens
LGWSPCDRS

SEQ ID NO: 1147981 - protein, 9 aa, Homo Sapiens
DMANKALLA

SEQ ID NO: 1147982 - protein, 9 aa, Homo Sapiens
LRSRPPGRG

SEQ ID NO: 1147983 - protein, 9 aa, Homo Sapiens
SKEPAGARL

SEQ ID NO: 1147984 - protein, 9 aa, Homo Sapiens
PGTVGPLGL

SEQ ID NO: 1147985 - protein, 9 aa, Homo Sapiens
AHARLAPRP

SEQ ID NO: 1147986 - protein, 9 aa, Homo Sapiens
HKLWMIVII

SEQ ID NO: 1147987 - protein, 9 aa, Homo Sapiens
ELKGYACHH

SEQ ID NO: 1147988 - protein, 9 aa, Homo Sapiens
HVQAPGRSP

SEQ ID NO: 1147989 - protein, 9 aa, Homo Sapiens
YRLSIILPQ

SEQ ID NO: 1147990 - protein, 9 aa, Homo Sapiens
PQASRQEKP

SEQ ID NO: 1147991 - protein, 9 aa, Homo Sapiens
RSSINRPNQ

SEQ ID NO: 1147992 - protein, 9 aa, Homo Sapiens
MPACARGPR

SEQ ID NO: 1147993 - protein, 9 aa, Homo Sapiens
SKDGMLSPG

SEQ ID NO: 1147994 - protein, 9 aa, Homo Sapiens
ATPHTLLPH

SEQ ID NO: 1147995 - protein, 9 aa, Homo Sapiens
DLRHQIQLP

SEQ ID NO: 1147996 - protein, 9 aa, Homo Sapiens
VRKVHYDPK

SEQ ID NO: 1147997 - protein, 9 aa, Homo Sapiens
IAPPCPGPK

SEQ ID NO: 1147998 - protein, 9 aa, Homo Sapiens
NKVVKVQLW

SEQ ID NO: 1147999 - protein, 9 aa, Homo Sapiens
GRGFRDRTC

SEQ ID NO: 1148000 - protein, 9 aa, Homo Sapiens
LLTRHMTTC

SEQ ID NO: 1148001 - protein, 9 aa, Homo Sapiens
VKCVLQDPI

SEQ ID NO: 1148002 - protein, 9 aa, Homo Sapiens
LRRPQWTQT

SEQ ID NO: 1148003 - protein, 9 aa, Homo Sapiens
IWSTCCSMG

SEQ ID NO: 1148004 - protein, 9 aa, Homo Sapiens
TYPEQMDCS

SEQ ID NO: 1148005 - protein, 9 aa, Homo Sapiens
VLELSYLGS

SEQ ID NO: 1148006 - protein, 9 aa, Homo Sapiens
HYAGPVRHH

SEQ ID NO: 1148007 - protein, 9 aa, Homo Sapiens
GATAARRAA

SEQ ID NO: 1148008 - protein, 9 aa, Homo Sapiens
AHVSTSFPA

SEQ ID NO: 1148009 - protein, 9 aa, Homo Sapiens
QVIEVTTYN

SEQ ID NO: 1148010 - protein, 9 aa, Homo Sapiens
GNYPAGERV

SEQ ID NO: 1148011 - protein, 9 aa, Homo Sapiens
ETGCLECCR

SEQ ID NO: 1148012 - protein, 9 aa, Homo Sapiens
PTKTRMLYH

SEQ ID NO: 1148013 - protein, 9 aa, Homo Sapiens
LKPDPLTHL

SEQ ID NO: 1148014 - protein, 9 aa, Homo Sapiens
LSWGSPTRM

SEQ ID NO: 1148015 - protein, 9 aa, Homo Sapiens
AWLQGSPGL

SEQ ID NO: 1148016 - protein, 9 aa, Homo Sapiens
DESDVFRSN

SEQ ID NO: 1148017 - protein, 9 aa, Homo Sapiens
RGRLNSVSR

SEQ ID NO: 1148018 - protein, 9 aa, Homo Sapiens
VATNPICDM

SEQ ID NO: 1148019 - protein, 9 aa, Homo Sapiens
AQTGETVQP

SEQ ID NO: 1148020 - protein, 9 aa, Homo Sapiens
ARPAATTSA

SEQ ID NO: 1148021 - protein, 9 aa, Homo Sapiens
SHPPTTTTS

SEQ ID NO: 1148022 - protein, 9 aa, Homo Sapiens
KRERMMLPV

SEQ ID NO: 1148023 - protein, 9 aa, Homo Sapiens
VCTGAKGEE

SEQ ID NO: 1148024 - protein, 9 aa, Homo Sapiens
LTDGKRKTI

SEQ ID NO: 1148025 - protein, 9 aa, Homo Sapiens
VVVLVSVLH

SEQ ID NO: 1148026 - protein, 9 aa, Homo Sapiens
FVDPCKDSE

SEQ ID NO: 1148027 - protein, 9 aa, Homo Sapiens
AGCQFRVLY

SEQ ID NO: 1148028 - protein, 9 aa, Homo Sapiens
SSQEKMAAE

SEQ ID NO: 1148029 - protein, 9 aa, Homo Sapiens
WTGRGEQSD

SEQ ID NO: 1148030 - protein, 9 aa, Homo Sapiens
HISLNDLQQ

SEQ ID NO: 1148031 - protein, 9 aa, Homo Sapiens
PIFRPTFYP

SEQ ID NO: 1148032 - protein, 9 aa, Homo Sapiens
RVYIFYRIF

SEQ ID NO: 1148033 - protein, 9 aa, Homo Sapiens
GCHPTSGIP

SEQ ID NO: 1148034 - protein, 9 aa, Homo Sapiens
PEGPTIPAG

SEQ ID NO: 1148035 - protein, 9 aa, Homo Sapiens
PAPGCHPTS

SEQ ID NO: 1148036 - protein, 9 aa, Homo Sapiens
LHHLKHHFQ

SEQ ID NO: 1148037 - protein, 9 aa, Homo Sapiens
AGARPPGNS

SEQ ID NO: 1148038 - protein, 9 aa, Homo Sapiens
GGMMSCRIL

SEQ ID NO: 1148039 - protein, 9 aa, Homo Sapiens
GTSWPRLEG

SEQ ID NO: 1148040 - protein, 9 aa, Homo Sapiens
SAQHEDVEG

SEQ ID NO: 1148041 - protein, 9 aa, Homo Sapiens
VVYYLHRMG

SEQ ID NO: 1148042 - protein, 9 aa, Homo Sapiens
SVPPLSHTP

SEQ ID NO: 1148043 - protein, 9 aa, Homo Sapiens
YPSYPGFPH

SEQ ID NO: 1148044 - protein, 9 aa, Homo Sapiens
RGAEPAAPR

SEQ ID NO: 1148045 - protein, 9 aa, Homo Sapiens
VKDSAKHPQ

SEQ ID NO: 1148046 - protein, 9 aa, Homo Sapiens
ARRESRFWL

SEQ ID NO: 1148047 - protein, 9 aa, Homo Sapiens
APWRHQSHC

SEQ ID NO: 1148048 - protein, 9 aa, Homo Sapiens
AIKADNGCL

SEQ ID NO: 1148049 - protein, 9 aa, Homo Sapiens
PGPWPSPGA

SEQ ID NO: 1148050 - protein, 9 aa, Homo Sapiens
HMIHILDTE

SEQ ID NO: 1148051 - protein, 9 aa, Homo Sapiens
PEPPEECVY

SEQ ID NO: 1148052 - protein, 9 aa, Homo Sapiens
DSCPGGATA

SEQ ID NO: 1148053 - protein, 9 aa, Homo Sapiens
SLWRTFDSV

SEQ ID NO: 1148054 - protein, 9 aa, Homo Sapiens
TLDVFWRVY

SEQ ID NO: 1148055 - protein, 9 aa, Homo Sapiens
RRPSRQWPA

SEQ ID NO: 1148056 - protein, 9 aa, Homo Sapiens
TLSLQRLSR

SEQ ID NO: 1148057 - protein, 9 aa, Homo Sapiens
LEGPSRTWR

SEQ ID NO: 1148058 - protein, 9 aa, Homo Sapiens
DEYASIVSS

SEQ ID NO: 1148059 - protein, 9 aa, Homo Sapiens
MKLVTKHVP

SEQ ID NO: 1148060 - protein, 9 aa, Homo Sapiens
AISGNCGPT

SEQ ID NO: 1148061 - protein, 9 aa, Homo Sapiens
KESSWISDG

SEQ ID NO: 1148062 - protein, 9 aa, Homo Sapiens
QDWSHVAAY

SEQ ID NO: 1148063 - protein, 9 aa, Homo Sapiens
GCQFRVLYC

SEQ ID NO: 1148064 - protein, 9 aa, Homo Sapiens
HSDVGLLEG

SEQ ID NO: 1148065 - protein, 9 aa, Homo Sapiens
QAPTPTSLF

SEQ ID NO: 1148066 - protein, 9 aa, Homo Sapiens
EFYKHCGSR

SEQ ID NO: 1148067 - protein, 9 aa, Homo Sapiens
SSVMHRVAH

SEQ ID NO: 1148068 - protein, 9 aa, Homo Sapiens
VTVKWNYTN

SEQ ID NO: 1148069 - protein, 9 aa, Homo Sapiens
EELKPEEIQ

SEQ ID NO: 1148070 - protein, 9 aa, Homo Sapiens
PGERVLHSL

SEQ ID NO: 1148071 - protein, 9 aa, Homo Sapiens
WRVYIFYRI

SEQ ID NO: 1148072 - protein, 9 aa, Homo Sapiens
QIQLPDLEN

SEQ ID NO: 1148073 - protein, 9 aa, Homo Sapiens
SVPPLAFSV

SEQ ID NO: 1148074 - protein, 9 aa, Homo Sapiens
LSYLGSAVS

SEQ ID NO: 1148075 - protein, 9 aa, Homo Sapiens
DVHQDTKDN

SEQ ID NO: 1148076 - protein, 9 aa, Homo Sapiens
DNMHDDPCL

SEQ ID NO: 1148077 - protein, 9 aa, Homo Sapiens
PQGPLFLLF

SEQ ID NO: 1148078 - protein, 9 aa, Homo Sapiens
GMECTVRSQ

SEQ ID NO: 1148079 - protein, 9 aa, Homo Sapiens
KYLLSATTS

SEQ ID NO: 1148080 - protein, 9 aa, Homo Sapiens
APAHGEVDV

SEQ ID NO: 1148081 - protein, 9 aa, Homo Sapiens
RLPLRAINL

SEQ ID NO: 1148082 - protein, 9 aa, Homo Sapiens
MFLKLNDIV

SEQ ID NO: 1148083 - protein, 9 aa, Homo Sapiens
LLGSEFTHI

SEQ ID NO: 1148084 - protein, 9 aa, Homo Sapiens
SPGHGEQAE

SEQ ID NO: 1148085 - protein, 9 aa, Homo Sapiens
GYSNLLQVW

SEQ ID NO: 1148086 - protein, 9 aa, Homo Sapiens
PSVQTHIKA

SEQ ID NO: 1148087 - protein, 9 aa, Homo Sapiens
VGYRTYSLI

SEQ ID NO: 1148088 - protein, 9 aa, Homo Sapiens
GALIAQKPT

SEQ ID NO: 1148089 - protein, 9 aa, Homo Sapiens
EKRCLEARI

SEQ ID NO: 1148090 - protein, 9 aa, Homo Sapiens
DINDNVPVF

SEQ ID NO: 1148091 - protein, 9 aa, Homo Sapiens
SSQSRSPVP

SEQ ID NO: 1148092 - protein, 9 aa, Homo Sapiens
DGNGDPGRN

SEQ ID NO: 1148093 - protein, 9 aa, Homo Sapiens
RLRAFQRIR

SEQ ID NO: 1148094 - protein, 9 aa, Homo Sapiens
FTFRKFFDD

SEQ ID NO: 1148095 - protein, 9 aa, Homo Sapiens
CQDHVSMHR

SEQ ID NO: 1148096 - protein, 9 aa, Homo Sapiens
WWWCCSGWY

SEQ ID NO: 1148097 - protein, 9 aa, Homo Sapiens
RCQDSPTSG

SEQ ID NO: 1148098 - protein, 9 aa, Homo Sapiens
CVPCPGGGE

SEQ ID NO: 1148099 - protein, 9 aa, Homo Sapiens
EAPTPLQPL

SEQ ID NO: 1148100 - protein, 9 aa, Homo Sapiens
ASIHDKHLN

SEQ ID NO: 1148101 - protein, 9 aa, Homo Sapiens
GDQLVGGQV

SEQ ID NO: 1148102 - protein, 9 aa, Homo Sapiens
ETSPMSDLH

SEQ ID NO: 1148103 - protein, 9 aa, Homo Sapiens
GRWAMVTTW

SEQ ID NO: 1148104 - protein, 9 aa, Homo Sapiens
ELLNHLDGF

SEQ ID NO: 1148105 - protein, 9 aa, Homo Sapiens
LSFFLNVGR

SEQ ID NO: 1148106 - protein, 9 aa, Homo Sapiens
RTPRGTQPC

SEQ ID NO: 1148107 - protein, 9 aa, Homo Sapiens
QPSRWPSSQ

SEQ ID NO: 1148108 - protein, 9 aa, Homo Sapiens
FRNTLSFYV

SEQ ID NO: 1148109 - protein, 9 aa, Homo Sapiens
MHSKEGRKR

SEQ ID NO: 1148110 - protein, 9 aa, Homo Sapiens
SLVMCLRLR

SEQ ID NO: 1148111 - protein, 9 aa, Homo Sapiens
ARLPPSRSR

SEQ ID NO: 1148112 - protein, 9 aa, Homo Sapiens
SKSKLISLF

SEQ ID NO: 1148113 - protein, 9 aa, Homo Sapiens
SLSFPGSSH

SEQ ID NO: 1148114 - protein, 9 aa, Homo Sapiens
FSPDSGSSP

SEQ ID NO: 1148115 - protein, 9 aa, Homo Sapiens
RPPRLRATR

SEQ ID NO: 1148116 - protein, 9 aa, Homo Sapiens
GQLADYNTL

SEQ ID NO: 1148117 - protein, 9 aa, Homo Sapiens
GELYGVSHE

SEQ ID NO: 1148118 - protein, 9 aa, Homo Sapiens
IKHLNGSLW

SEQ ID NO: 1148119 - protein, 9 aa, Homo Sapiens
VSTRSSINR

SEQ ID NO: 1148120 - protein, 9 aa, Homo Sapiens
TNSVPTSQR

SEQ ID NO: 1148121 - protein, 9 aa, Homo Sapiens
FRAREQSHS

SEQ ID NO: 1148122 - protein, 9 aa, Homo Sapiens
NRLETMRHI

SEQ ID NO: 1148123 - protein, 9 aa, Homo Sapiens
MDAMLKRLV

SEQ ID NO: 1148124 - protein, 9 aa, Homo Sapiens
VSKDGMLSP

SEQ ID NO: 1148125 - protein, 9 aa, Homo Sapiens
MLKKKEEKL

SEQ ID NO: 1148126 - protein, 9 aa, Homo Sapiens
KHSASEHTD

SEQ ID NO: 1148127 - protein, 9 aa, Homo Sapiens
LHAPNHHDQ

SEQ ID NO: 1148128 - protein, 9 aa, Homo Sapiens
IDAQSEAYL

SEQ ID NO: 1148129 - protein, 9 aa, Homo Sapiens
LIDALQPHC

SEQ ID NO: 1148130 - protein, 9 aa, Homo Sapiens
DEESGASQY

SEQ ID NO: 1148131 - protein, 9 aa, Homo Sapiens
IRKTSQVLT

SEQ ID NO: 1148132 - protein, 9 aa, Homo Sapiens
VLGRAARSS

SEQ ID NO: 1148133 - protein, 9 aa, Homo Sapiens
QAIKADNGC

SEQ ID NO: 1148134 - protein, 9 aa, Homo Sapiens
SRFVDGLAF

SEQ ID NO: 1148135 - protein, 9 aa, Homo Sapiens
TARTCLWAP

SEQ ID NO: 1148136 - protein, 9 aa, Homo Sapiens
SMTSWNHKT

SEQ ID NO: 1148137 - protein, 9 aa, Homo Sapiens
KSHTRGIWM

SEQ ID NO: 1148138 - protein, 9 aa, Homo Sapiens
EEKKKAPTP

SEQ ID NO: 1148139 - protein, 9 aa, Homo Sapiens
YRYTVKAHN

SEQ ID NO: 1148140 - protein, 9 aa, Homo Sapiens
GEEATELIK

SEQ ID NO: 1148141 - protein, 9 aa, Homo Sapiens
GFIQTATAL

SEQ ID NO: 1148142 - protein, 9 aa, Homo Sapiens
SHLPTLASR

SEQ ID NO: 1148143 - protein, 9 aa, Homo Sapiens
AEIPTGSEA

SEQ ID NO: 1148144 - protein, 9 aa, Homo Sapiens
PRHPLQSLH

SEQ ID NO: 1148145 - protein, 9 aa, Homo Sapiens
QAAALGTQR

SEQ ID NO: 1148146 - protein, 9 aa, Homo Sapiens
RGGAWKSIF

SEQ ID NO: 1148147 - protein, 9 aa, Homo Sapiens
YNEVYNYYT

SEQ ID NO: 1148148 - protein, 9 aa, Homo Sapiens
QARPASSWG

SEQ ID NO: 1148149 - protein, 9 aa, Homo Sapiens
VLHRLTVGK

SEQ ID NO: 1148150 - protein, 9 aa, Homo Sapiens
PPVPAPSQL

SEQ ID NO: 1148151 - protein, 9 aa, Homo Sapiens
PGDPVELVV

SEQ ID NO: 1148152 - protein, 9 aa, Homo Sapiens
GKAFTAHEV

SEQ ID NO: 1148153 - protein, 9 aa, Homo Sapiens
GPQGSQRER

SEQ ID NO: 1148154 - protein, 9 aa, Homo Sapiens
DQDGAEPGA

SEQ ID NO: 1148155 - protein, 9 aa, Homo Sapiens
ALPKPAVAW

SEQ ID NO: 1148156 - protein, 9 aa, Homo Sapiens
GKPWTSTSI

SEQ ID NO: 1148157 - protein, 9 aa, Homo Sapiens
RCSSWREGR

SEQ ID NO: 1148158 - protein, 9 aa, Homo Sapiens
GLIADSSAS

SEQ ID NO: 1148159 - protein, 9 aa, Homo Sapiens
RKITETIGI

SEQ ID NO: 1148160 - protein, 9 aa, Homo Sapiens
LEKNPPLRF

SEQ ID NO: 1148161 - protein, 9 aa, Homo Sapiens
SMGQTWGPR

SEQ ID NO: 1148162 - protein, 9 aa, Homo Sapiens
RPLPVMEGL

SEQ ID NO: 1148163 - protein, 9 aa, Homo Sapiens
HKKHVTDFA

SEQ ID NO: 1148164 - protein, 9 aa, Homo Sapiens
TSGGSCDTS

SEQ ID NO: 1148165 - protein, 9 aa, Homo Sapiens
SLPRYWTYG

SEQ ID NO: 1148166 - protein, 9 aa, Homo Sapiens
KVSTRSSIN

SEQ ID NO: 1148167 - protein, 9 aa, Homo Sapiens
IRCVIANQQ

SEQ ID NO: 1148168 - protein, 9 aa, Homo Sapiens
GPVLPKNTL

SEQ ID NO: 1148169 - protein, 9 aa, Homo Sapiens
QTLLNIIKH

SEQ ID NO: 1148170 - protein, 9 aa, Homo Sapiens
PATLASAAR

SEQ ID NO: 1148171 - protein, 9 aa, Homo Sapiens
RHQSHCFYR

SEQ ID NO: 1148172 - protein, 9 aa, Homo Sapiens
VGIGAFHTE

SEQ ID NO: 1148173 - protein, 9 aa, Homo Sapiens
IVMGVFPIC

SEQ ID NO: 1148174 - protein, 9 aa, Homo Sapiens
QKPKLMLLT

SEQ ID NO: 1148175 - protein, 9 aa, Homo Sapiens
VVLRDGLAC

SEQ ID NO: 1148176 - protein, 9 aa, Homo Sapiens
KNPEKLQRN

SEQ ID NO: 1148177 - protein, 9 aa, Homo Sapiens
KDNKGYCTQ

SEQ ID NO: 1148178 - protein, 9 aa, Homo Sapiens
EIDLRHQIQ

SEQ ID NO: 1148179 - protein, 9 aa, Homo Sapiens
FTTCCTPSE

SEQ ID NO: 1148180 - protein, 9 aa, Homo Sapiens
VTREGSCGF

SEQ ID NO: 1148181 - protein, 9 aa, Homo Sapiens
ENGWVSRWV

SEQ ID NO: 1148182 - protein, 9 aa, Homo Sapiens
RMNFLHHPD

SEQ ID NO: 1148183 - protein, 9 aa, Homo Sapiens
QRRLPLRAI

SEQ ID NO: 1148184 - protein, 9 aa, Homo Sapiens
PSPIRTHRA

SEQ ID NO: 1148185 - protein, 9 aa, Homo Sapiens
NKELYRVLP

SEQ ID NO: 1148186 - protein, 9 aa, Homo Sapiens
CTTIKAKQL

SEQ ID NO: 1148187 - protein, 9 aa, Homo Sapiens
PPGSCGFTQ

SEQ ID NO: 1148188 - protein, 9 aa, Homo Sapiens
AKKDYNEVY

SEQ ID NO: 1148189 - protein, 9 aa, Homo Sapiens
CPDSHKGRT

SEQ ID NO: 1148190 - protein, 9 aa, Homo Sapiens
PEKTDMMPS

SEQ ID NO: 1148191 - protein, 9 aa, Homo Sapiens
YFKINPWSG

SEQ ID NO: 1148192 - protein, 9 aa, Homo Sapiens
TKTRLTQCN

SEQ ID NO: 1148193 - protein, 9 aa, Homo Sapiens
ISVFQVIRC

SEQ ID NO: 1148194 - protein, 9 aa, Homo Sapiens
KGLRYATAD

SEQ ID NO: 1148195 - protein, 9 aa, Homo Sapiens
NPREVQAGA

SEQ ID NO: 1148196 - protein, 9 aa, Homo Sapiens
ARSSAQAYQ

SEQ ID NO: 1148197 - protein, 9 aa, Homo Sapiens
RLENGEPRE

SEQ ID NO: 1148198 - protein, 9 aa, Homo Sapiens
AAGNAEETL

SEQ ID NO: 1148199 - protein, 9 aa, Homo Sapiens
GASPSASQT

SEQ ID NO: 1148200 - protein, 9 aa, Homo Sapiens
WGTGVEDPL

SEQ ID NO: 1148201 - protein, 9 aa, Homo Sapiens
LQPHCLGQL

SEQ ID NO: 1148202 - protein, 9 aa, Homo Sapiens
FFLFPLGYL

SEQ ID NO: 1148203 - protein, 9 aa, Homo Sapiens
PGCHPTSGI

SEQ ID NO: 1148204 - protein, 9 aa, Homo Sapiens
NEVYNYYTK

SEQ ID NO: 1148205 - protein, 9 aa, Homo Sapiens
TNGMKMNMK

SEQ ID NO: 1148206 - protein, 9 aa, Homo Sapiens
GTVPVVREP

SEQ ID NO: 1148207 - protein, 9 aa, Homo Sapiens
LYLKKTRTS

SEQ ID NO: 1148208 - protein, 9 aa, Homo Sapiens
HYLRPILRR

SEQ ID NO: 1148209 - protein, 9 aa, Homo Sapiens
HSGKPPAMR

SEQ ID NO: 1148210 - protein, 9 aa, Homo Sapiens
YFLIDALQP

SEQ ID NO: 1148211 - protein, 9 aa, Homo Sapiens
CRKQPVSIW

SEQ ID NO: 1148212 - protein, 9 aa, Homo Sapiens
VRMVALVTG

SEQ ID NO: 1148213 - protein, 9 aa, Homo Sapiens
GGSCDTSLA

SEQ ID NO: 1148214 - protein, 9 aa, Homo Sapiens
HPFPSKSYS

SEQ ID NO: 1148215 - protein, 9 aa, Homo Sapiens
WDLRRPQWT

SEQ ID NO: 1148216 - protein, 9 aa, Homo Sapiens
GFREPSVQT

SEQ ID NO: 1148217 - protein, 9 aa, Homo Sapiens
FYVIDISPG

SEQ ID NO: 1148218 - protein, 9 aa, Homo Sapiens
FLMKRFLTL

SEQ ID NO: 1148219 - protein, 9 aa, Homo Sapiens
WLESLRITF

SEQ ID NO: 1148220 - protein, 9 aa, Homo Sapiens
TNEGATSTL

SEQ ID NO: 1148221 - protein, 9 aa, Homo Sapiens
HGVESMLER

SEQ ID NO: 1148222 - protein, 9 aa, Homo Sapiens
RTENIDIKN

SEQ ID NO: 1148223 - protein, 9 aa, Homo Sapiens
VPHDLVLQG

SEQ ID NO: 1148224 - protein, 9 aa, Homo Sapiens
SSQGTLSLQ

SEQ ID NO: 1148225 - protein, 9 aa, Homo Sapiens
EANIHRFMA

SEQ ID NO: 1148226 - protein, 9 aa, Homo Sapiens
PQQSRLPLQ

SEQ ID NO: 1148227 - protein, 9 aa, Homo Sapiens
EGPTIPAGT

SEQ ID NO: 1148228 - protein, 9 aa, Homo Sapiens
VDAREREHI

SEQ ID NO: 1148229 - protein, 9 aa, Homo Sapiens
PPRRPSTAN

SEQ ID NO: 1148230 - protein, 9 aa, Homo Sapiens
LATEGGGLG

SEQ ID NO: 1148231 - protein, 9 aa, Homo Sapiens
QPPRAARPP

SEQ ID NO: 1148232 - protein, 9 aa, Homo Sapiens
PHLYSSPYT

SEQ ID NO: 1148233 - protein, 9 aa, Homo Sapiens
EGVPIDTII

SEQ ID NO: 1148234 - protein, 9 aa, Homo Sapiens
EVDVDGHVQ

SEQ ID NO: 1148235 - protein, 9 aa, Homo Sapiens
ERGGAARLA

SEQ ID NO: 1148236 - protein, 9 aa, Homo Sapiens
PLTRDAHLC

SEQ ID NO: 1148237 - protein, 9 aa, Homo Sapiens
IQYNKVVKV

SEQ ID NO: 1148238 - protein, 9 aa, Homo Sapiens
FLVRVRIPL

SEQ ID NO: 1148239 - protein, 9 aa, Homo Sapiens
QSAFGDQVP

SEQ ID NO: 1148240 - protein, 9 aa, Homo Sapiens
TPSEEFACV

SEQ ID NO: 1148241 - protein, 9 aa, Homo Sapiens
KRFINQLFS

SEQ ID NO: 1148242 - protein, 9 aa, Homo Sapiens
DSDGDVHQD

SEQ ID NO: 1148243 - protein, 9 aa, Homo Sapiens
GNAEETLEA

SEQ ID NO: 1148244 - protein, 9 aa, Homo Sapiens
NPWSGLIVT

SEQ ID NO: 1148245 - protein, 9 aa, Homo Sapiens
KKTSRILNL

SEQ ID NO: 1148246 - protein, 9 aa, Homo Sapiens
ECRVSSIDR

SEQ ID NO: 1148247 - protein, 9 aa, Homo Sapiens
DVSVPFVET

SEQ ID NO: 1148248 - protein, 9 aa, Homo Sapiens
EDVAALLME

SEQ ID NO: 1148249 - protein, 9 aa, Homo Sapiens
ELDSKLLLD

SEQ ID NO: 1148250 - protein, 9 aa, Homo Sapiens
ATAEPTVSF

SEQ ID NO: 1148251 - protein, 9 aa, Homo Sapiens
GASSHITHI

SEQ ID NO: 1148252 - protein, 9 aa, Homo Sapiens
PYMAPERIT

SEQ ID NO: 1148253 - protein, 9 aa, Homo Sapiens
MGRRCSSWR

SEQ ID NO: 1148254 - protein, 9 aa, Homo Sapiens
DLLSLRAGS

SEQ ID NO: 1148255 - protein, 9 aa, Homo Sapiens
TSYRVHSIF

SEQ ID NO: 1148256 - protein, 9 aa, Homo Sapiens
EKKKAPTPQ

SEQ ID NO: 1148257 - protein, 9 aa, Homo Sapiens
AIRYYQEAV

SEQ ID NO: 1148258 - protein, 9 aa, Homo Sapiens
VGWAQRCSQ

SEQ ID NO: 1148259 - protein, 9 aa, Homo Sapiens
APAPLSVSP

SEQ ID NO: 1148260 - protein, 9 aa, Homo Sapiens
QAWDTKPSV

SEQ ID NO: 1148261 - protein, 9 aa, Homo Sapiens
LYCGVAPLQ

SEQ ID NO: 1148262 - protein, 9 aa, Homo Sapiens
NRTTYVKAS

SEQ ID NO: 1148263 - protein, 9 aa, Homo Sapiens
RMYPLGLRM

SEQ ID NO: 1148264 - protein, 9 aa, Homo Sapiens
SSGPFLQLS

SEQ ID NO: 1148265 - protein, 9 aa, Homo Sapiens
MVKNRSKKS

SEQ ID NO: 1148266 - protein, 9 aa, Homo Sapiens
TAARLPPSR

SEQ ID NO: 1148267 - protein, 9 aa, Homo Sapiens
NKFSMTSWN

SEQ ID NO: 1148268 - protein, 9 aa, Homo Sapiens
TCGCGPDCE

SEQ ID NO: 1148269 - protein, 9 aa, Homo Sapiens
KHSPLLRPR

SEQ ID NO: 1148270 - protein, 9 aa, Homo Sapiens
LRSFMKLYH

SEQ ID NO: 1148271 - protein, 9 aa, Homo Sapiens
PHPRLCSYT

SEQ ID NO: 1148272 - protein, 9 aa, Homo Sapiens
ATGDEQVMQ

SEQ ID NO: 1148273 - protein, 9 aa, Homo Sapiens
GPCASLLST

SEQ ID NO: 1148274 - protein, 9 aa, Homo Sapiens
LEVTWSSKF

SEQ ID NO: 1148275 - protein, 9 aa, Homo Sapiens
VEVAGAQDY

SEQ ID NO: 1148276 - protein, 9 aa, Homo Sapiens
PEGCDKVMT

SEQ ID NO: 1148277 - protein, 9 aa, Homo Sapiens
ARTGNGKTA

SEQ ID NO: 1148278 - protein, 9 aa, Homo Sapiens
CGHLKPSGE

SEQ ID NO: 1148279 - protein, 9 aa, Homo Sapiens
GASASTSLS

SEQ ID NO: 1148280 - protein, 9 aa, Homo Sapiens
ALPSLLSRM

SEQ ID NO: 1148281 - protein, 9 aa, Homo Sapiens
LSRHFDLRF

SEQ ID NO: 1148282 - protein, 9 aa, Homo Sapiens
QPPPQAPSQ

SEQ ID NO: 1148283 - protein, 9 aa, Homo Sapiens
GPEEDEEWG

SEQ ID NO: 1148284 - protein, 9 aa, Homo Sapiens
QFGFGPNQV

SEQ ID NO: 1148285 - protein, 9 aa, Homo Sapiens
RDPTQTYGV

SEQ ID NO: 1148286 - protein, 9 aa, Homo Sapiens
ESGCGHGAK

SEQ ID NO: 1148287 - protein, 9 aa, Homo Sapiens
NGSQGSHPW

SEQ ID NO: 1148288 - protein, 9 aa, Homo Sapiens
NGDRSTYRL

SEQ ID NO: 1148289 - protein, 9 aa, Homo Sapiens
GILICIMKN

SEQ ID NO: 1148290 - protein, 9 aa, Homo Sapiens
EGWDKRCCL

SEQ ID NO: 1148291 - protein, 9 aa, Homo Sapiens
VVFHLLFMN

SEQ ID NO: 1148292 - protein, 9 aa, Homo Sapiens
AILSAQHED

SEQ ID NO: 1148293 - protein, 9 aa, Homo Sapiens
VHHGANQVG

SEQ ID NO: 1148294 - protein, 9 aa, Homo Sapiens
CPGGATAAR

SEQ ID NO: 1148295 - protein, 9 aa, Homo Sapiens
NGKVTNEGA

SEQ ID NO: 1148296 - protein, 9 aa, Homo Sapiens
LGTCSIWST

SEQ ID NO: 1148297 - protein, 9 aa, Homo Sapiens
LASIHDKHL

SEQ ID NO: 1148298 - protein, 9 aa, Homo Sapiens
RGHPLSASQ

SEQ ID NO: 1148299 - protein, 9 aa, Homo Sapiens
PCSALGTSW

SEQ ID NO: 1148300 - protein, 9 aa, Homo Sapiens
EFALRPAPR

SEQ ID NO: 1148301 - protein, 9 aa, Homo Sapiens
QGAAARPAG

SEQ ID NO: 1148302 - protein, 9 aa, Homo Sapiens
SAGPPAHAR

SEQ ID NO: 1148303 - protein, 9 aa, Homo Sapiens
ASIVSSSKG

SEQ ID NO: 1148304 - protein, 9 aa, Homo Sapiens
QFVITPKKA

SEQ ID NO: 1148305 - protein, 9 aa, Homo Sapiens
VLWDFWDHG

SEQ ID NO: 1148306 - protein, 9 aa, Homo Sapiens
SGSTTRAST

SEQ ID NO: 1148307 - protein, 9 aa, Homo Sapiens
SSLEETLPP

SEQ ID NO: 1148308 - protein, 9 aa, Homo Sapiens
PSRTWRCWV

SEQ ID NO: 1148309 - protein, 9 aa, Homo Sapiens
EQPLEEEYE

SEQ ID NO: 1148310 - protein, 9 aa, Homo Sapiens
ACEPARAAR

SEQ ID NO: 1148311 - protein, 9 aa, Homo Sapiens
IKSCVPGWC

SEQ ID NO: 1148312 - protein, 9 aa, Homo Sapiens
TREGSCGFV

SEQ ID NO: 1148313 - protein, 9 aa, Homo Sapiens
RAVLGRAAR

SEQ ID NO: 1148314 - protein, 9 aa, Homo Sapiens
DGSVPPLAF

SEQ ID NO: 1148315 - protein, 9 aa, Homo Sapiens
DEEWGIIHR

SEQ ID NO: 1148316 - protein, 9 aa, Homo Sapiens
LTRLLAACG

SEQ ID NO: 1148317 - protein, 9 aa, Homo Sapiens
TPRGTQPCT

SEQ ID NO: 1148318 - protein, 9 aa, Homo Sapiens
PMPGSCRSP

SEQ ID NO: 1148319 - protein, 9 aa, Homo Sapiens
KPAVPHPSS

SEQ ID NO: 1148320 - protein, 9 aa, Homo Sapiens
FRGGDNPNV

SEQ ID NO: 1148321 - protein, 9 aa, Homo Sapiens
LQSHVSSFP

SEQ ID NO: 1148322 - protein, 9 aa, Homo Sapiens
QIPGLLGSP

SEQ ID NO: 1148323 - protein, 9 aa, Homo Sapiens
ATTSSSGWL

SEQ ID NO: 1148324 - protein, 9 aa, Homo Sapiens
GRPSAPVRS

SEQ ID NO: 1148325 - protein, 9 aa, Homo Sapiens
SGCHASGDS

SEQ ID NO: 1148326 - protein, 9 aa, Homo Sapiens
HETKFAQAL

SEQ ID NO: 1148327 - protein, 9 aa, Homo Sapiens
FSSKNPEKL

SEQ ID NO: 1148328 - protein, 9 aa, Homo Sapiens
FIILEKNPP

SEQ ID NO: 1148329 - protein, 9 aa, Homo Sapiens
EEDAVLKQN

SEQ ID NO: 1148330 - protein, 9 aa, Homo Sapiens
LFSTGSRAT

SEQ ID NO: 1148331 - protein, 9 aa, Homo Sapiens
ISGRRSAAG

SEQ ID NO: 1148332 - protein, 9 aa, Homo Sapiens
MHFFLSQLS

SEQ ID NO: 1148333 - protein, 9 aa, Homo Sapiens
SQSLVLVIE

SEQ ID NO: 1148334 - protein, 9 aa, Homo Sapiens
VLLLPSAAL

SEQ ID NO: 1148335 - protein, 9 aa, Homo Sapiens
PGQRVFLCP

SEQ ID NO: 1148336 - protein, 9 aa, Homo Sapiens
TRHMTTCQS

SEQ ID NO: 1148337 - protein, 9 aa, Homo Sapiens
TYNRDSFDT

SEQ ID NO: 1148338 - protein, 9 aa, Homo Sapiens
MGMVNYSWP

SEQ ID NO: 1148339 - protein, 9 aa, Homo Sapiens
TRTGCRWPR

SEQ ID NO: 1148340 - protein, 9 aa, Homo Sapiens
SGSIKNNIK

SEQ ID NO: 1148341 - protein, 9 aa, Homo Sapiens
LVLKREFTT

SEQ ID NO: 1148342 - protein, 9 aa, Homo Sapiens
ESVTASFEK

SEQ ID NO: 1148343 - protein, 9 aa, Homo Sapiens
GHVQQRQAV

SEQ ID NO: 1148344 - protein, 9 aa, Homo Sapiens
WPPPWLSPL

SEQ ID NO: 1148345 - protein, 9 aa, Homo Sapiens
RLRLSQDGW

SEQ ID NO: 1148346 - protein, 9 aa, Homo Sapiens
KLHPILHVS

SEQ ID NO: 1148347 - protein, 9 aa, Homo Sapiens
RMACSPTNS

SEQ ID NO: 1148348 - protein, 9 aa, Homo Sapiens
SIHASSGPC

SEQ ID NO: 1148349 - protein, 9 aa, Homo Sapiens
GNFNLLHGK

SEQ ID NO: 1148350 - protein, 9 aa, Homo Sapiens
KKHVTDFAT

SEQ ID NO: 1148351 - protein, 9 aa, Homo Sapiens
VLHSLNPST

SEQ ID NO: 1148352 - protein, 9 aa, Homo Sapiens
LLPFDNMHD

SEQ ID NO: 1148353 - protein, 9 aa, Homo Sapiens
LPIQPPLPA

SEQ ID NO: 1148354 - protein, 9 aa, Homo Sapiens
HSQSLVLVI

SEQ ID NO: 1148355 - protein, 9 aa, Homo Sapiens
HLIDHLLQL

SEQ ID NO: 1148356 - protein, 9 aa, Homo Sapiens
RPTFYPHPH

SEQ ID NO: 1148357 - protein, 9 aa, Homo Sapiens
LDMVILKAL

SEQ ID NO: 1148358 - protein, 9 aa, Homo Sapiens
CPLQIILFF

SEQ ID NO: 1148359 - protein, 9 aa, Homo Sapiens
LMKRFLTLA

SEQ ID NO: 1148360 - protein, 9 aa, Homo Sapiens
VSCFSTTTL

SEQ ID NO: 1148361 - protein, 9 aa, Homo Sapiens
LRYATADAS

SEQ ID NO: 1148362 - protein, 9 aa, Homo Sapiens
EQVMQNQPT

SEQ ID NO: 1148363 - protein, 9 aa, Homo Sapiens
WVLLCDPEA

SEQ ID NO: 1148364 - protein, 9 aa, Homo Sapiens
PWIAPPCPG

SEQ ID NO: 1148365 - protein, 9 aa, Homo Sapiens
GVPPYTECD

SEQ ID NO: 1148366 - protein, 9 aa, Homo Sapiens
GPLTGRDAS

SEQ ID NO: 1148367 - protein, 9 aa, Homo Sapiens
SLPIQPPLP

SEQ ID NO: 1148368 - protein, 9 aa, Homo Sapiens
CTPSEEFAC

SEQ ID NO: 1148369 - protein, 9 aa, Homo Sapiens
CGPLRTVWI

SEQ ID NO: 1148370 - protein, 9 aa, Homo Sapiens
TGDEQVMQN

SEQ ID NO: 1148371 - protein, 9 aa, Homo Sapiens
ECVSQEHQC

SEQ ID NO: 1148372 - protein, 9 aa, Homo Sapiens
WKHSPLLRP

SEQ ID NO: 1148373 - protein, 9 aa, Homo Sapiens
CTPPTFCTW

SEQ ID NO: 1148374 - protein, 9 aa, Homo Sapiens
RRFPARAPL

SEQ ID NO: 1148375 - protein, 9 aa, Homo Sapiens
APPCPGPKR

SEQ ID NO: 1148376 - protein, 9 aa, Homo Sapiens
IVSGPVLGC

SEQ ID NO: 1148377 - protein, 9 aa, Homo Sapiens
KITYSTPLW

SEQ ID NO: 1148378 - protein, 9 aa, Homo Sapiens
LVFTFIVSA

SEQ ID NO: 1148379 - protein, 9 aa, Homo Sapiens
PSCHPLPQL

SEQ ID NO: 1148380 - protein, 9 aa, Homo Sapiens
PVPAPSQLP

SEQ ID NO: 1148381 - protein, 9 aa, Homo Sapiens
EDAVLKQNS

SEQ ID NO: 1148382 - protein, 9 aa, Homo Sapiens
ITREEAEWI

SEQ ID NO: 1148383 - protein, 9 aa, Homo Sapiens
ALQKREVTD

SEQ ID NO: 1148384 - protein, 9 aa, Homo Sapiens
LWMPPYTPP

SEQ ID NO: 1148385 - protein, 9 aa, Homo Sapiens
ASSPSHATR

SEQ ID NO: 1148386 - protein, 9 aa, Homo Sapiens
LRVCGEPLQ

SEQ ID NO: 1148387 - protein, 9 aa, Homo Sapiens
AICNPLHYL

SEQ ID NO: 1148388 - protein, 9 aa, Homo Sapiens
GDNPNVESM

SEQ ID NO: 1148389 - protein, 9 aa, Homo Sapiens
EDEEWGIIH

SEQ ID NO: 1148390 - protein, 9 aa, Homo Sapiens
HSLVMCLRL

SEQ ID NO: 1148391 - protein, 9 aa, Homo Sapiens
SINRPNQSR

SEQ ID NO: 1148392 - protein, 9 aa, Homo Sapiens
AGPALPTRR

SEQ ID NO: 1148393 - protein, 9 aa, Homo Sapiens
ILAYCSLSF

SEQ ID NO: 1148394 - protein, 9 aa, Homo Sapiens
EDVEGCLEL

SEQ ID NO: 1148395 - protein, 9 aa, Homo Sapiens
FVNGIRCVI

SEQ ID NO: 1148396 - protein, 9 aa, Homo Sapiens
GAPITTSRP

SEQ ID NO: 1148397 - protein, 9 aa, Homo Sapiens
FSNALPEVA

SEQ ID NO: 1148398 - protein, 9 aa, Homo Sapiens
TGGDRPTRR

SEQ ID NO: 1148399 - protein, 9 aa, Homo Sapiens
SFDLLSLVF

SEQ ID NO: 1148400 - protein, 9 aa, Homo Sapiens
SEGCSRSSP

SEQ ID NO: 1148401 - protein, 9 aa, Homo Sapiens
ELTNDILVI

SEQ ID NO: 1148402 - protein, 9 aa, Homo Sapiens
QEILNTNSI

SEQ ID NO: 1148403 - protein, 9 aa, Homo Sapiens
VSECEKDQR

SEQ ID NO: 1148404 - protein, 9 aa, Homo Sapiens
GCHKKTSQL

SEQ ID NO: 1148405 - protein, 9 aa, Homo Sapiens
GHGVWVGAQ

SEQ ID NO: 1148406 - protein, 9 aa, Homo Sapiens
DTLQAYVTP

SEQ ID NO: 1148407 - protein, 9 aa, Homo Sapiens
LPPDTCRAP

SEQ ID NO: 1148408 - protein, 9 aa, Homo Sapiens
FTQDRGLQA

SEQ ID NO: 1148409 - protein, 9 aa, Homo Sapiens
YAGGVGAQL

SEQ ID NO: 1148410 - protein, 9 aa, Homo Sapiens
QNISNNKRE

SEQ ID NO: 1148411 - protein, 9 aa, Homo Sapiens
GISGRRSAA

SEQ ID NO: 1148412 - protein, 9 aa, Homo Sapiens
HRLTVGKSH

SEQ ID NO: 1148413 - protein, 9 aa, Homo Sapiens
TLPALGEKR

SEQ ID NO: 1148414 - protein, 9 aa, Homo Sapiens
LRHRERSAQ

SEQ ID NO: 1148415 - protein, 9 aa, Homo Sapiens
ASLSQLREL

SEQ ID NO: 1148416 - protein, 9 aa, Homo Sapiens
TGASESRNM

SEQ ID NO: 1148417 - protein, 9 aa, Homo Sapiens
ASQYPKKLN

SEQ ID NO: 1148418 - protein, 9 aa, Homo Sapiens
SGRHLSGGV

SEQ ID NO: 1148419 - protein, 9 aa, Homo Sapiens
WYLPDTLLL

SEQ ID NO: 1148420 - protein, 9 aa, Homo Sapiens
PTQQPQTPQ

SEQ ID NO: 1148421 - protein, 9 aa, Homo Sapiens
SSLCPYPAR

SEQ ID NO: 1148422 - protein, 9 aa, Homo Sapiens
KEEEEKKKA

SEQ ID NO: 1148423 - protein, 9 aa, Homo Sapiens
ETILQKRMN

SEQ ID NO: 1148424 - protein, 9 aa, Homo Sapiens
YVIDISPGA

SEQ ID NO: 1148425 - protein, 9 aa, Homo Sapiens
VAEKVITPY

SEQ ID NO: 1148426 - protein, 9 aa, Homo Sapiens
RVPHQVQGR

SEQ ID NO: 1148427 - protein, 9 aa, Homo Sapiens
WLETAVHEG

SEQ ID NO: 1148428 - protein, 9 aa, Homo Sapiens
LFFSSVISD

SEQ ID NO: 1148429 - protein, 9 aa, Homo Sapiens
DGKINIDDL

SEQ ID NO: 1148430 - protein, 9 aa, Homo Sapiens
TAGARHHTR

SEQ ID NO: 1148431 - protein, 9 aa, Homo Sapiens
THRHYERLV

SEQ ID NO: 1148432 - protein, 9 aa, Homo Sapiens
GIEIPGRTD

SEQ ID NO: 1148433 - protein, 9 aa, Homo Sapiens
GAEPAAPRG

SEQ ID NO: 1148434 - protein, 9 aa, Homo Sapiens
EIASREAQN

SEQ ID NO: 1148435 - protein, 9 aa, Homo Sapiens
KYYLLNPAS

SEQ ID NO: 1148436 - protein, 9 aa, Homo Sapiens
SVPSTTRRA

SEQ ID NO: 1148437 - protein, 9 aa, Homo Sapiens
KLYGEIADP

SEQ ID NO: 1148438 - protein, 9 aa, Homo Sapiens
EAANFDMAV

SEQ ID NO: 1148439 - protein, 9 aa, Homo Sapiens
FHLDEDVSY

SEQ ID NO: 1148440 - protein, 9 aa, Homo Sapiens
SRVRYGVDD

SEQ ID NO: 1148441 - protein, 9 aa, Homo Sapiens
VSSGPFLQL

SEQ ID NO: 1148442 - protein, 9 aa, Homo Sapiens
TRVGIGAFH

SEQ ID NO: 1148443 - protein, 9 aa, Homo Sapiens
RCYQLPQLQ

SEQ ID NO: 1148444 - protein, 9 aa, Homo Sapiens
DRLQRGLPG

SEQ ID NO: 1148445 - protein, 9 aa, Homo Sapiens
WPPLPGGSC

SEQ ID NO: 1148446 - protein, 9 aa, Homo Sapiens
DESVTASFE

SEQ ID NO: 1148447 - protein, 9 aa, Homo Sapiens
SRKVDVQTT

SEQ ID NO: 1148448 - protein, 9 aa, Homo Sapiens
DGDVHQDTK

SEQ ID NO: 1148449 - protein, 9 aa, Homo Sapiens
KKTETVEEQ

SEQ ID NO: 1148450 - protein, 9 aa, Homo Sapiens
APLSPGATL

SEQ ID NO: 1148451 - protein, 9 aa, Homo Sapiens
GAPGARVTV

SEQ ID NO: 1148452 - protein, 9 aa, Homo Sapiens
KRMSCKQAL

SEQ ID NO: 1148453 - protein, 9 aa, Homo Sapiens
LGRAARSSA

SEQ ID NO: 1148454 - protein, 9 aa, Homo Sapiens
LYHSLVMCL

SEQ ID NO: 1148455 - protein, 9 aa, Homo Sapiens
KRNNFSRLE

SEQ ID NO: 1148456 - protein, 9 aa, Homo Sapiens
SLFWKAHMN

SEQ ID NO: 1148457 - protein, 9 aa, Homo Sapiens
HAQPLARPG

SEQ ID NO: 1148458 - protein, 9 aa, Homo Sapiens
RAPGVAESP

SEQ ID NO: 1148459 - protein, 9 aa, Homo Sapiens
LTGADGRPP

SEQ ID NO: 1148460 - protein, 9 aa, Homo Sapiens
RALPSLLSR

SEQ ID NO: 1148461 - protein, 9 aa, Homo Sapiens
GKKMDLDGM

SEQ ID NO: 1148462 - protein, 9 aa, Homo Sapiens
DPKKDVHIY

SEQ ID NO: 1148463 - protein, 9 aa, Homo Sapiens
KEETRRKLR

SEQ ID NO: 1148464 - protein, 9 aa, Homo Sapiens
RWDNETPEE

SEQ ID NO: 1148465 - protein, 9 aa, Homo Sapiens
CLELIFSAL

SEQ ID NO: 1148466 - protein, 9 aa, Homo Sapiens
FFVLVNLEV

SEQ ID NO: 1148467 - protein, 9 aa, Homo Sapiens
KKYLLLDNA

SEQ ID NO: 1148468 - protein, 9 aa, Homo Sapiens
VPDPNRTTY

SEQ ID NO: 1148469 - protein, 9 aa, Homo Sapiens
ELNELDSKL

SEQ ID NO: 1148470 - protein, 9 aa, Homo Sapiens
LSTDSVVPF

SEQ ID NO: 1148471 - protein, 9 aa, Homo Sapiens
YEFTFRKFF

SEQ ID NO: 1148472 - protein, 9 aa, Homo Sapiens
PPHLPSCHP

SEQ ID NO: 1148473 - protein, 9 aa, Homo Sapiens
DVFWRVYIF

SEQ ID NO: 1148474 - protein, 9 aa, Homo Sapiens
AERASAPTS

SEQ ID NO: 1148475 - protein, 9 aa, Homo Sapiens
LHYLTVMNP

SEQ ID NO: 1148476 - protein, 9 aa, Homo Sapiens
APTWCPGMV

SEQ ID NO: 1148477 - protein, 9 aa, Homo Sapiens
KVQVENQVH

SEQ ID NO: 1148478 - protein, 9 aa, Homo Sapiens
VFQRGKVEI

SEQ ID NO: 1148479 - protein, 9 aa, Homo Sapiens
TNVEKASAD

SEQ ID NO: 1148480 - protein, 9 aa, Homo Sapiens
EAQNFSFIS

SEQ ID NO: 1148481 - protein, 9 aa, Homo Sapiens
FQGKENSKP

SEQ ID NO: 1148482 - protein, 9 aa, Homo Sapiens
VFVDPCKDS

SEQ ID NO: 1148483 - protein, 9 aa, Homo Sapiens
EPIHDPPFD

SEQ ID NO: 1148484 - protein, 9 aa, Homo Sapiens
LAQLLGADA

SEQ ID NO: 1148485 - protein, 9 aa, Homo Sapiens
YHQDWSHVA

SEQ ID NO: 1148486 - protein, 9 aa, Homo Sapiens
APCSTPCPL

SEQ ID NO: 1148487 - protein, 9 aa, Homo Sapiens
VASHVDLPL

SEQ ID NO: 1148488 - protein, 9 aa, Homo Sapiens
RRRRRKRSS

SEQ ID NO: 1148489 - protein, 9 aa, Homo Sapiens
APSTPKEPA

SEQ ID NO: 1148490 - protein, 9 aa, Homo Sapiens
RPTSSQEKM

SEQ ID NO: 1148491 - protein, 9 aa, Homo Sapiens
LAELVVGGA

SEQ ID NO: 1148492 - protein, 9 aa, Homo Sapiens
HQSHCFYRG

SEQ ID NO: 1148493 - protein, 9 aa, Homo Sapiens
RKAFDTNGW

SEQ ID NO: 1148494 - protein, 9 aa, Homo Sapiens
AEGAAGTRC

SEQ ID NO: 1148495 - protein, 9 aa, Homo Sapiens
TPTTVPPKM

SEQ ID NO: 1148496 - protein, 9 aa, Homo Sapiens
TKYLKRDHR

SEQ ID NO: 1148497 - protein, 9 aa, Homo Sapiens
PVIVSVQYF

SEQ ID NO: 1148498 - protein, 9 aa, Homo Sapiens
AYQAAGASP

SEQ ID NO: 1148499 - protein, 9 aa, Homo Sapiens
RPILLSPVS

SEQ ID NO: 1148500 - protein, 9 aa, Homo Sapiens
APSQVWTAA

SEQ ID NO: 1148501 - protein, 9 aa, Homo Sapiens
FKRLISAFK

SEQ ID NO: 1148502 - protein, 9 aa, Homo Sapiens
GAEESSAVC

SEQ ID NO: 1148503 - protein, 9 aa, Homo Sapiens
GRPGGGQPA

SEQ ID NO: 1148504 - protein, 9 aa, Homo Sapiens
RYATADASA

SEQ ID NO: 1148505 - protein, 9 aa, Homo Sapiens
MAPKMNFDL

SEQ ID NO: 1148506 - protein, 9 aa, Homo Sapiens
PPPQAPSQV

SEQ ID NO: 1148507 - protein, 9 aa, Homo Sapiens
SSYMRNLPH

SEQ ID NO: 1148508 - protein, 9 aa, Homo Sapiens
DAQRESGSG

SEQ ID NO: 1148509 - protein, 9 aa, Homo Sapiens
HGYALWPEQ

SEQ ID NO: 1148510 - protein, 9 aa, Homo Sapiens
RDRTCTCRP

SEQ ID NO: 1148511 - protein, 9 aa, Homo Sapiens
PTFCTWTVR

SEQ ID NO: 1148512 - protein, 9 aa, Homo Sapiens
PVRARTARS

SEQ ID NO: 1148513 - protein, 9 aa, Homo Sapiens
RRLGPRGHP

SEQ ID NO: 1148514 - protein, 9 aa, Homo Sapiens
DGMYRYGPA

SEQ ID NO: 1148515 - protein, 9 aa, Homo Sapiens
NKHISLNDL

SEQ ID NO: 1148516 - protein, 9 aa, Homo Sapiens
SEVGGGGRW

SEQ ID NO: 1148517 - protein, 9 aa, Homo Sapiens
PCTSVPSTT

SEQ ID NO: 1148518 - protein, 9 aa, Homo Sapiens
GNEDSPGHG

SEQ ID NO: 1148519 - protein, 9 aa, Homo Sapiens
RPRRAWKHS

SEQ ID NO: 1148520 - protein, 9 aa, Homo Sapiens
IYEKDLHMM

SEQ ID NO: 1148521 - protein, 9 aa, Homo Sapiens
QELKGYACH

SEQ ID NO: 1148522 - protein, 9 aa, Homo Sapiens
NKREKHSAS

SEQ ID NO: 1148523 - protein, 9 aa, Homo Sapiens
GQMCIAYFS

SEQ ID NO: 1148524 - protein, 9 aa, Homo Sapiens
LVIKNIIPT

SEQ ID NO: 1148525 - protein, 9 aa, Homo Sapiens
TSLHQATRK

SEQ ID NO: 1148526 - protein, 9 aa, Homo Sapiens
EPGANSVSA

SEQ ID NO: 1148527 - protein, 9 aa, Homo Sapiens
PRRSPALRA

SEQ ID NO: 1148528 - protein, 9 aa, Homo Sapiens
PSFSSSLGS

SEQ ID NO: 1148529 - protein, 9 aa, Homo Sapiens
EEPAGPKSR

SEQ ID NO: 1148530 - protein, 9 aa, Homo Sapiens
VAESPDLAA

SEQ ID NO: 1148531 - protein, 9 aa, Homo Sapiens
TQNMENQEM

SEQ ID NO: 1148532 - protein, 9 aa, Homo Sapiens
SVSPSFSSS

SEQ ID NO: 1148533 - protein, 9 aa, Homo Sapiens
SGRWGTGVE

SEQ ID NO: 1148534 - protein, 9 aa, Homo Sapiens
GDMSKKSPW

SEQ ID NO: 1148535 - protein, 9 aa, Homo Sapiens
DFEQRESVL

SEQ ID NO: 1148536 - protein, 9 aa, Homo Sapiens
SSIPGGPIS

SEQ ID NO: 1148537 - protein, 9 aa, Homo Sapiens
NEDSPGHGE

SEQ ID NO: 1148538 - protein, 9 aa, Homo Sapiens
AVHLSYGRV

SEQ ID NO: 1148539 - protein, 9 aa, Homo Sapiens
VHRGRRPSG

SEQ ID NO: 1148540 - protein, 9 aa, Homo Sapiens
EGQMLTLKC

SEQ ID NO: 1148541 - protein, 9 aa, Homo Sapiens
KVQEANIHR

SEQ ID NO: 1148542 - protein, 9 aa, Homo Sapiens
RGLPGNWEL

SEQ ID NO: 1148543 - protein, 9 aa, Homo Sapiens
QTLPALGEK

SEQ ID NO: 1148544 - protein, 9 aa, Homo Sapiens
LKQVSPASP

SEQ ID NO: 1148545 - protein, 9 aa, Homo Sapiens
RVPDHPSGQ

SEQ ID NO: 1148546 - protein, 9 aa, Homo Sapiens
VSMHRSPHF

SEQ ID NO: 1148547 - protein, 9 aa, Homo Sapiens
QPQTPQDSR

SEQ ID NO: 1148548 - protein, 9 aa, Homo Sapiens
QIILFFFLF

SEQ ID NO: 1148549 - protein, 9 aa, Homo Sapiens
PRAQCVVLE

SEQ ID NO: 1148550 - protein, 9 aa, Homo Sapiens
NFLHHPDLY

SEQ ID NO: 1148551 - protein, 9 aa, Homo Sapiens
GSCGFVRRP

SEQ ID NO: 1148552 - protein, 9 aa, Homo Sapiens
VQDMANKAL

SEQ ID NO: 1148553 - protein, 9 aa, Homo Sapiens
EDPGTLETG

SEQ ID NO: 1148554 - protein, 9 aa, Homo Sapiens
GGMIEVEPE

SEQ ID NO: 1148555 - protein, 9 aa, Homo Sapiens
RLPPSRSRW

SEQ ID NO: 1148556 - protein, 9 aa, Homo Sapiens
FSAYKRETR

SEQ ID NO: 1148557 - protein, 9 aa, Homo Sapiens
EGRERRVKL

SEQ ID NO: 1148558 - protein, 9 aa, Homo Sapiens
QYKCKMLLA

SEQ ID NO: 1148559 - protein, 9 aa, Homo Sapiens
NFNLLHGKT

SEQ ID NO: 1148560 - protein, 9 aa, Homo Sapiens
GPSRTWRCW

SEQ ID NO: 1148561 - protein, 9 aa, Homo Sapiens
ELQMEQDYH

SEQ ID NO: 1148562 - protein, 9 aa, Homo Sapiens
SGPCSNSSD

SEQ ID NO: 1148563 - protein, 9 aa, Homo Sapiens
LPLPQAPTP

SEQ ID NO: 1148564 - protein, 9 aa, Homo Sapiens
EGTAISGNC

SEQ ID NO: 1148565 - protein, 9 aa, Homo Sapiens
PFAAAAAAN

SEQ ID NO: 1148566 - protein, 9 aa, Homo Sapiens
QQQQQQGRW

SEQ ID NO: 1148567 - protein, 9 aa, Homo Sapiens
SNLLQVWEP

SEQ ID NO: 1148568 - protein, 9 aa, Homo Sapiens
IIHEKMGID

SEQ ID NO: 1148569 - protein, 9 aa, Homo Sapiens
LLLDNAEDS

SEQ ID NO: 1148570 - protein, 9 aa, Homo Sapiens
SIFRNTLSF

SEQ ID NO: 1148571 - protein, 9 aa, Homo Sapiens
LHPILHVSS

SEQ ID NO: 1148572 - protein, 9 aa, Homo Sapiens
SLHHPPCSL

SEQ ID NO: 1148573 - protein, 9 aa, Homo Sapiens
REQCRKMQN

SEQ ID NO: 1148574 - protein, 9 aa, Homo Sapiens
PNGGKQHPH

SEQ ID NO: 1148575 - protein, 9 aa, Homo Sapiens
PREIPLYLS

SEQ ID NO: 1148576 - protein, 9 aa, Homo Sapiens
IVDAAVVVL

SEQ ID NO: 1148577 - protein, 9 aa, Homo Sapiens
QRVFLCPGE

SEQ ID NO: 1148578 - protein, 9 aa, Homo Sapiens
VQPWIAPPC

SEQ ID NO: 1148579 - protein, 9 aa, Homo Sapiens
LPTRRLSRA

SEQ ID NO: 1148580 - protein, 9 aa, Homo Sapiens
GSTTRASTP

SEQ ID NO: 1148581 - protein, 9 aa, Homo Sapiens
QIFFFHLNL

SEQ ID NO: 1148582 - protein, 9 aa, Homo Sapiens
HLDGFDSRG

SEQ ID NO: 1148583 - protein, 9 aa, Homo Sapiens
SAPSMPACA

SEQ ID NO: 1148584 - protein, 9 aa, Homo Sapiens
ASHSDVGLL

SEQ ID NO: 1148585 - protein, 9 aa, Homo Sapiens
RLRAVLGLG

SEQ ID NO: 1148586 - protein, 9 aa, Homo Sapiens
EVVDVSVPF

SEQ ID NO: 1148587 - protein, 9 aa, Homo Sapiens
LYRKMLPRS

SEQ ID NO: 1148588 - protein, 9 aa, Homo Sapiens
IGEIAQGIA

SEQ ID NO: 1148589 - protein, 9 aa, Homo Sapiens
HFQGKENSK

SEQ ID NO: 1148590 - protein, 9 aa, Homo Sapiens
TVNLAGRAN

SEQ ID NO: 1148591 - protein, 9 aa, Homo Sapiens
QLTTPRPSG

SEQ ID NO: 1148592 - protein, 9 aa, Homo Sapiens
PAGHGKEEC

SEQ ID NO: 1148593 - protein, 9 aa, Homo Sapiens
RLSQDGWKL

SEQ ID NO: 1148594 - protein, 9 aa, Homo Sapiens
LQLIQVDVA

SEQ ID NO: 1148595 - protein, 9 aa, Homo Sapiens
RVKLPITSS

SEQ ID NO: 1148596 - protein, 9 aa, Homo Sapiens
TFLTQNMEN

SEQ ID NO: 1148597 - protein, 9 aa, Homo Sapiens
GDPVELVVT

SEQ ID NO: 1148598 - protein, 9 aa, Homo Sapiens
TLATRIHKL

SEQ ID NO: 1148599 - protein, 9 aa, Homo Sapiens
SPWDLGTAR

SEQ ID NO: 1148600 - protein, 9 aa, Homo Sapiens
GGGGGSGDF

SEQ ID NO: 1148601 - protein, 9 aa, Homo Sapiens
HLNGSLWNS

SEQ ID NO: 1148602 - protein, 9 aa, Homo Sapiens
QNNFLLNLA

SEQ ID NO: 1148603 - protein, 9 aa, Homo Sapiens
PSRQWPAGP

SEQ ID NO: 1148604 - protein, 9 aa, Homo Sapiens
WTAEGAAGT

SEQ ID NO: 1148605 - protein, 9 aa, Homo Sapiens
ECDLGPAGT

SEQ ID NO: 1148606 - protein, 9 aa, Homo Sapiens
QGHQGPADP

SEQ ID NO: 1148607 - protein, 9 aa, Homo Sapiens
KKILRSFMK

SEQ ID NO: 1148608 - protein, 9 aa, Homo Sapiens
AMHSRILCT

SEQ ID NO: 1148609 - protein, 9 aa, Homo Sapiens
STTLWVIPP

SEQ ID NO: 1148610 - protein, 9 aa, Homo Sapiens
VILEEGGSA

SEQ ID NO: 1148611 - protein, 9 aa, Homo Sapiens
YSLITIGEI

SEQ ID NO: 1148612 - protein, 9 aa, Homo Sapiens
TDSVANKLG

SEQ ID NO: 1148613 - protein, 9 aa, Homo Sapiens
HHGANQVGS

SEQ ID NO: 1148614 - protein, 9 aa, Homo Sapiens
ETMRHIIQG

SEQ ID NO: 1148615 - protein, 9 aa, Homo Sapiens
VEEPNDTIT

SEQ ID NO: 1148616 - protein, 9 aa, Homo Sapiens
VRYGVDDVQ

SEQ ID NO: 1148617 - protein, 9 aa, Homo Sapiens
PQLLGPPPP

SEQ ID NO: 1148618 - protein, 9 aa, Homo Sapiens
EGTNGIEEC

SEQ ID NO: 1148619 - protein, 9 aa, Homo Sapiens
VAWLQGSPG

SEQ ID NO: 1148620 - protein, 9 aa, Homo Sapiens
HHPHTLDLS

SEQ ID NO: 1148621 - protein, 9 aa, Homo Sapiens
IKVHRAAAV

SEQ ID NO: 1148622 - protein, 9 aa, Homo Sapiens
VGLLEGSAE

SEQ ID NO: 1148623 - protein, 9 aa, Homo Sapiens
SPTKCEICV

SEQ ID NO: 1148624 - protein, 9 aa, Homo Sapiens
CSPTNSLLK

SEQ ID NO: 1148625 - protein, 9 aa, Homo Sapiens
TGAWTAEGA

SEQ ID NO: 1148626 - protein, 9 aa, Homo Sapiens
KLRRKNKKP

SEQ ID NO: 1148627 - protein, 9 aa, Homo Sapiens
EFLELYRKM

SEQ ID NO: 1148628 - protein, 9 aa, Homo Sapiens
EVSVNGVLE

SEQ ID NO: 1148629 - protein, 9 aa, Homo Sapiens
AAKQVSPAG

SEQ ID NO: 1148630 - protein, 9 aa, Homo Sapiens
YSSLKGNYP

SEQ ID NO: 1148631 - protein, 9 aa, Homo Sapiens
IIFPMYVTV

SEQ ID NO: 1148632 - protein, 9 aa, Homo Sapiens
AKDDLCLSA

SEQ ID NO: 1148633 - protein, 9 aa, Homo Sapiens
DVAILIGQT

SEQ ID NO: 1148634 - protein, 9 aa, Homo Sapiens
WSVVNWSAC

SEQ ID NO: 1148635 - protein, 9 aa, Homo Sapiens
VRNGIYPPM

SEQ ID NO: 1148636 - protein, 9 aa, Homo Sapiens
KTKFYRQRT

SEQ ID NO: 1148637 - protein, 9 aa, Homo Sapiens
VGPLGLRPP

SEQ ID NO: 1148638 - protein, 9 aa, Homo Sapiens
TACEPARAA

SEQ ID NO: 1148639 - protein, 9 aa, Homo Sapiens
PRTVLLLPS

SEQ ID NO: 1148640 - protein, 9 aa, Homo Sapiens
GNRLETMRH

SEQ ID NO: 1148641 - protein, 9 aa, Homo Sapiens
TTVPPKMQK

SEQ ID NO: 1148642 - protein, 9 aa, Homo Sapiens
WKDVAILIG

SEQ ID NO: 1148643 - protein, 9 aa, Homo Sapiens
PPARPDQSR

SEQ ID NO: 1148644 - protein, 9 aa, Homo Sapiens
ASTPNTGPA

SEQ ID NO: 1148645 - protein, 9 aa, Homo Sapiens
AYAPQQAWI

SEQ ID NO: 1148646 - protein, 9 aa, Homo Sapiens
TRPKPPHHE

SEQ ID NO: 1148647 - protein, 9 aa, Homo Sapiens
PDVRPPVLS

SEQ ID NO: 1148648 - protein, 9 aa, Homo Sapiens
VLDVVYYLH

SEQ ID NO: 1148649 - protein, 9 aa, Homo Sapiens
IMHDENKET

SEQ ID NO: 1148650 - protein, 9 aa, Homo Sapiens
QATRSRTLH

SEQ ID NO: 1148651 - protein, 9 aa, Homo Sapiens
PTWCPGMVS

SEQ ID NO: 1148652 - protein, 9 aa, Homo Sapiens
GPCSNSSDS

SEQ ID NO: 1148653 - protein, 9 aa, Homo Sapiens
TCLNIQDVR

SEQ ID NO: 1148654 - protein, 9 aa, Homo Sapiens
ALLMEGFLA

SEQ ID NO: 1148655 - protein, 9 aa, Homo Sapiens
EGLWMPPYT

SEQ ID NO: 1148656 - protein, 9 aa, Homo Sapiens
SAYKRETRC

SEQ ID NO: 1148657 - protein, 9 aa, Homo Sapiens
HFTVNMSKV

SEQ ID NO: 1148658 - protein, 9 aa, Homo Sapiens
WNSEGFFNI

SEQ ID NO: 1148659 - protein, 9 aa, Homo Sapiens
REPSVQTHI

SEQ ID NO: 1148660 - protein, 9 aa, Homo Sapiens
KKKAPTPQE

SEQ ID NO: 1148661 - protein, 9 aa, Homo Sapiens
PTGDPPIGP

SEQ ID NO: 1148662 - protein, 9 aa, Homo Sapiens
LQWVVGTYL

SEQ ID NO: 1148663 - protein, 9 aa, Homo Sapiens
LSRPTKTRM

SEQ ID NO: 1148664 - protein, 9 aa, Homo Sapiens
STNEAKKGR

SEQ ID NO: 1148665 - protein, 9 aa, Homo Sapiens
HCRGKKFTD

SEQ ID NO: 1148666 - protein, 9 aa, Homo Sapiens
VKFVIKKKA

SEQ ID NO: 1148667 - protein, 9 aa, Homo Sapiens
YLLNPASLL

SEQ ID NO: 1148668 - protein, 9 aa, Homo Sapiens
VPVAEASTG

SEQ ID NO: 1148669 - protein, 9 aa, Homo Sapiens
RPKPPHHEF

SEQ ID NO: 1148670 - protein, 9 aa, Homo Sapiens
SYVNILLLQ

SEQ ID NO: 1148671 - protein, 9 aa, Homo Sapiens
FIGHPPSAI

SEQ ID NO: 1148672 - protein, 9 aa, Homo Sapiens
VGRRHKIGW

SEQ ID NO: 1148673 - protein, 9 aa, Homo Sapiens
IQSRICSVQ

SEQ ID NO: 1148674 - protein, 9 aa, Homo Sapiens
CSALGTSWP

SEQ ID NO: 1148675 - protein, 9 aa, Homo Sapiens
RGGTTIGEV

SEQ ID NO: 1148676 - protein, 9 aa, Homo Sapiens
QAGPPGTVG

SEQ ID NO: 1148677 - protein, 9 aa, Homo Sapiens
SQGPYSSVP

SEQ ID NO: 1148678 - protein, 9 aa, Homo Sapiens
AQCVVLEAR

SEQ ID NO: 1148679 - protein, 9 aa, Homo Sapiens
CRYGGRCVN

SEQ ID NO: 1148680 - protein, 9 aa, Homo Sapiens
RPHVPHDLV

SEQ ID NO: 1148681 - protein, 9 aa, Homo Sapiens
GECDLGPAG

SEQ ID NO: 1148682 - protein, 9 aa, Homo Sapiens
LTGRDASPA

SEQ ID NO: 1148683 - protein, 9 aa, Homo Sapiens
TEDCLRSFR

SEQ ID NO: 1148684 - protein, 9 aa, Homo Sapiens
IHRFMAQFH

SEQ ID NO: 1148685 - protein, 9 aa, Homo Sapiens
DLVLIGAPI

SEQ ID NO: 1148686 - protein, 9 aa, Homo Sapiens
IQVQTGGRL

SEQ ID NO: 1148687 - protein, 9 aa, Homo Sapiens
PSSQGTLSL

SEQ ID NO: 1148688 - protein, 9 aa, Homo Sapiens
PCPGGGEGG

SEQ ID NO: 1148689 - protein, 9 aa, Homo Sapiens
SPRKQAQQE

SEQ ID NO: 1148690 - protein, 9 aa, Homo Sapiens
AWLKMLCVN

SEQ ID NO: 1148691 - protein, 9 aa, Homo Sapiens
TLMQLNEIK

SEQ ID NO: 1148692 - protein, 9 aa, Homo Sapiens
SEDQVLHRL

SEQ ID NO: 1148693 - protein, 9 aa, Homo Sapiens
HGIEIPGRT

SEQ ID NO: 1148694 - protein, 9 aa, Homo Sapiens
LKDAVPFVP

SEQ ID NO: 1148695 - protein, 9 aa, Homo Sapiens
CQSVCQPRC

SEQ ID NO: 1148696 - protein, 9 aa, Homo Sapiens
PPSAPMPST

SEQ ID NO: 1148697 - protein, 9 aa, Homo Sapiens
ENKDGKINI

SEQ ID NO: 1148698 - protein, 9 aa, Homo Sapiens
VEDGELEGQ

SEQ ID NO: 1148699 - protein, 9 aa, Homo Sapiens
NLVTDRVTD

SEQ ID NO: 1148700 - protein, 9 aa, Homo Sapiens
RRCHQRRVP

SEQ ID NO: 1148701 - protein, 9 aa, Homo Sapiens
ARPDQSRPT

SEQ ID NO: 1148702 - protein, 9 aa, Homo Sapiens
KVTITLYGK

SEQ ID NO: 1148703 - protein, 9 aa, Homo Sapiens
VEKFGLVCM

SEQ ID NO: 1148704 - protein, 9 aa, Homo Sapiens
ARSRSPCSG

SEQ ID NO: 1148705 - protein, 9 aa, Homo Sapiens
KPTGVFSRM

SEQ ID NO: 1148706 - protein, 9 aa, Homo Sapiens
ITFQQHRRP

SEQ ID NO: 1148707 - protein, 9 aa, Homo Sapiens
SCGFVRRPT

SEQ ID NO: 1148708 - protein, 9 aa, Homo Sapiens
SKKSPWEQK

SEQ ID NO: 1148709 - protein, 9 aa, Homo Sapiens
AEEQPVHQV

SEQ ID NO: 1148710 - protein, 9 aa, Homo Sapiens
HKIRTSWLE

SEQ ID NO: 1148711 - protein, 9 aa, Homo Sapiens
VIGQGLVGM

SEQ ID NO: 1148712 - protein, 9 aa, Homo Sapiens
GLVGMTPRD

SEQ ID NO: 1148713 - protein, 9 aa, Homo Sapiens
YTPPRLLSL

SEQ ID NO: 1148714 - protein, 9 aa, Homo Sapiens
GKITRHDDP

SEQ ID NO: 1148715 - protein, 9 aa, Homo Sapiens
LVHLIDHLL

SEQ ID NO: 1148716 - protein, 9 aa, Homo Sapiens
FTPFLVHKM

SEQ ID NO: 1148717 - protein, 9 aa, Homo Sapiens
KENMFTPFL

SEQ ID NO: 1148718 - protein, 9 aa, Homo Sapiens
PKITYSTPL

SEQ ID NO: 1148719 - protein, 9 aa, Homo Sapiens
ISPGALFLE

SEQ ID NO: 1148720 - protein, 9 aa, Homo Sapiens
ATMPTYCYE

SEQ ID NO: 1148721 - protein, 9 aa, Homo Sapiens
THLAVVLLF

SEQ ID NO: 1148722 - protein, 9 aa, Homo Sapiens
RRPLGVSPL

SEQ ID NO: 1148723 - protein, 9 aa, Homo Sapiens
VLVSCSSVE

SEQ ID NO: 1148724 - protein, 9 aa, Homo Sapiens
SHKSKGEEL

SEQ ID NO: 1148725 - protein, 9 aa, Homo Sapiens
KLVVVGAGD

SEQ ID NO: 1148726 - protein, 9 aa, Homo Sapiens
WMPPYTPPR

SEQ ID NO: 1148727 - protein, 9 aa, Homo Sapiens
ASSSTSRDS

SEQ ID NO: 1148728 - protein, 9 aa, Homo Sapiens
FSRVSVIQA

SEQ ID NO: 1148729 - protein, 9 aa, Homo Sapiens
SRVAGTAGA

SEQ ID NO: 1148730 - protein, 9 aa, Homo Sapiens
DHVTLQVPR

SEQ ID NO: 1148731 - protein, 9 aa, Homo Sapiens
CGKTFSESS

SEQ ID NO: 1148732 - protein, 9 aa, Homo Sapiens
EDSPGHGEQ

SEQ ID NO: 1148733 - protein, 9 aa, Homo Sapiens
HILDRLQRG

SEQ ID NO: 1148734 - protein, 9 aa, Homo Sapiens
GNGDPGRNG

SEQ ID NO: 1148735 - protein, 9 aa, Homo Sapiens
AHAHSNPIF

SEQ ID NO: 1148736 - protein, 9 aa, Homo Sapiens
QLWKKAFLV

SEQ ID NO: 1148737 - protein, 9 aa, Homo Sapiens
PSQTLEAWE

SEQ ID NO: 1148738 - protein, 9 aa, Homo Sapiens
ALRVLHGAP

SEQ ID NO: 1148739 - protein, 9 aa, Homo Sapiens
AKNFTDTSH

SEQ ID NO: 1148740 - protein, 9 aa, Homo Sapiens
RIFACSRGL

SEQ ID NO: 1148741 - protein, 9 aa, Homo Sapiens
AVLGLGGGG

SEQ ID NO: 1148742 - protein, 9 aa, Homo Sapiens
PLTIGEKTE

SEQ ID NO: 1148743 - protein, 9 aa, Homo Sapiens
CKKLHPILH

SEQ ID NO: 1148744 - protein, 9 aa, Homo Sapiens
PKEEVVCLL

SEQ ID NO: 1148745 - protein, 9 aa, Homo Sapiens
SSGKKIAFH

SEQ ID NO: 1148746 - protein, 9 aa, Homo Sapiens
AHLCPQQHV

SEQ ID NO: 1148747 - protein, 9 aa, Homo Sapiens
IYSLQRTSA

SEQ ID NO: 1148748 - protein, 9 aa, Homo Sapiens
EAATQEEPE

SEQ ID NO: 1148749 - protein, 9 aa, Homo Sapiens
QPVSIWPNL

SEQ ID NO: 1148750 - protein, 9 aa, Homo Sapiens
FVITPKKAE

SEQ ID NO: 1148751 - protein, 9 aa, Homo Sapiens
SRCHTTGWM

SEQ ID NO: 1148752 - protein, 9 aa, Homo Sapiens
KQVSPAGAP

SEQ ID NO: 1148753 - protein, 9 aa, Homo Sapiens
LDNAEDSPD

SEQ ID NO: 1148754 - protein, 9 aa, Homo Sapiens
QPVHQVDRL

SEQ ID NO: 1148755 - protein, 9 aa, Homo Sapiens
RKGQKKIRK

SEQ ID NO: 1148756 - protein, 9 aa, Homo Sapiens
PKLMLLTRH

SEQ ID NO: 1148757 - protein, 9 aa, Homo Sapiens
VGGCGPEAG

SEQ ID NO: 1148758 - protein, 9 aa, Homo Sapiens
LTHLAVVLL

SEQ ID NO: 1148759 - protein, 9 aa, Homo Sapiens
EGVPPTTLF

SEQ ID NO: 1148760 - protein, 9 aa, Homo Sapiens
YLECFDVMT

SEQ ID NO: 1148761 - protein, 9 aa, Homo Sapiens
QVMQNQPTL

SEQ ID NO: 1148762 - protein, 9 aa, Homo Sapiens
PTSQRGVSY

SEQ ID NO: 1148763 - protein, 9 aa, Homo Sapiens
RSRPPGRGA

SEQ ID NO: 1148764 - protein, 9 aa, Homo Sapiens
SARGPVRLL

SEQ ID NO: 1148765 - protein, 9 aa, Homo Sapiens
HLDVSQRNH

SEQ ID NO: 1148766 - protein, 9 aa, Homo Sapiens
SIPGGPISL

SEQ ID NO: 1148767 - protein, 9 aa, Homo Sapiens
MSGRGGGAL

SEQ ID NO: 1148768 - protein, 9 aa, Homo Sapiens
LSALWNQLS

SEQ ID NO: 1148769 - protein, 9 aa, Homo Sapiens
KLEEGWGVS

SEQ ID NO: 1148770 - protein, 9 aa, Homo Sapiens
RSYPVLAPG

SEQ ID NO: 1148771 - protein, 9 aa, Homo Sapiens
GQMLTLKCV

SEQ ID NO: 1148772 - protein, 9 aa, Homo Sapiens
LESPALKQV

SEQ ID NO: 1148773 - protein, 9 aa, Homo Sapiens
QVISLESIF

SEQ ID NO: 1148774 - protein, 9 aa, Homo Sapiens
PELSLAGVA

SEQ ID NO: 1148775 - protein, 9 aa, Homo Sapiens
DYNEVYNYY

SEQ ID NO: 1148776 - protein, 9 aa, Homo Sapiens
LPTASGLKN

SEQ ID NO: 1148777 - protein, 9 aa, Homo Sapiens
IFYRIFACS

SEQ ID NO: 1148778 - protein, 9 aa, Homo Sapiens
VLGPHPSPS

SEQ ID NO: 1148779 - protein, 9 aa, Homo Sapiens
RPAALGTCS

SEQ ID NO: 1148780 - protein, 9 aa, Homo Sapiens
WIKTTLILV

SEQ ID NO: 1148781 - protein, 9 aa, Homo Sapiens
GDESDVFRS

SEQ ID NO: 1148782 - protein, 9 aa, Homo Sapiens
PWPSPGAHL

SEQ ID NO: 1148783 - protein, 9 aa, Homo Sapiens
GSDHHDCMS

SEQ ID NO: 1148784 - protein, 9 aa, Homo Sapiens
RQTPPGSAP

SEQ ID NO: 1148785 - protein, 9 aa, Homo Sapiens
RTKLEKALS

SEQ ID NO: 1148786 - protein, 9 aa, Homo Sapiens
FINQLFSSK

SEQ ID NO: 1148787 - protein, 9 aa, Homo Sapiens
DNPGLGPSC

SEQ ID NO: 1148788 - protein, 9 aa, Homo Sapiens
HCPADVCGS

SEQ ID NO: 1148789 - protein, 9 aa, Homo Sapiens
ELERAFSYC

SEQ ID NO: 1148790 - protein, 9 aa, Homo Sapiens
LEGGLPVGE

SEQ ID NO: 1148791 - protein, 9 aa, Homo Sapiens
YVPLTPWFL

SEQ ID NO: 1148792 - protein, 9 aa, Homo Sapiens
SGFRGYGYR

SEQ ID NO: 1148793 - protein, 9 aa, Homo Sapiens
QPSGPQGPA

SEQ ID NO: 1148794 - protein, 9 aa, Homo Sapiens
VPCAGTTPP

SEQ ID NO: 1148795 - protein, 9 aa, Homo Sapiens
LITSNIREN

SEQ ID NO: 1148796 - protein, 9 aa, Homo Sapiens
RGLQALGSR

SEQ ID NO: 1148797 - protein, 9 aa, Homo Sapiens
RAPTGPPRH

SEQ ID NO: 1148798 - protein, 9 aa, Homo Sapiens
PKRFINQLF

SEQ ID NO: 1148799 - protein, 9 aa, Homo Sapiens
IQDFEQRES

SEQ ID NO: 1148800 - protein, 9 aa, Homo Sapiens
SGTDEDDYR

SEQ ID NO: 1148801 - protein, 9 aa, Homo Sapiens
GAPAHGEVD

SEQ ID NO: 1148802 - protein, 9 aa, Homo Sapiens
SSLKGNYPA

SEQ ID NO: 1148803 - protein, 9 aa, Homo Sapiens
EMVITVDAK

SEQ ID NO: 1148804 - protein, 9 aa, Homo Sapiens
SISEKEDET

SEQ ID NO: 1148805 - protein, 9 aa, Homo Sapiens
GMPSAVSCF

SEQ ID NO: 1148806 - protein, 9 aa, Homo Sapiens
GPISLSCWL

SEQ ID NO: 1148807 - protein, 9 aa, Homo Sapiens
SASEYCWHI

SEQ ID NO: 1148808 - protein, 9 aa, Homo Sapiens
LLAACGATI

SEQ ID NO: 1148809 - protein, 9 aa, Homo Sapiens
HQDWSHVAA

SEQ ID NO: 1148810 - protein, 9 aa, Homo Sapiens
ANDECRSAM

SEQ ID NO: 1148811 - protein, 9 aa, Homo Sapiens
EEQPVHQVD

SEQ ID NO: 1148812 - protein, 9 aa, Homo Sapiens
DKKRGASSS

SEQ ID NO: 1148813 - protein, 9 aa, Homo Sapiens
TQYRGEVCN

SEQ ID NO: 1148814 - protein, 9 aa, Homo Sapiens
IFRLYSRAV

SEQ ID NO: 1148815 - protein, 9 aa, Homo Sapiens
PSSMSLATS

SEQ ID NO: 1148816 - protein, 9 aa, Homo Sapiens
PPRLLSLWF

SEQ ID NO: 1148817 - protein, 9 aa, Homo Sapiens
ILVRYALNH

SEQ ID NO: 1148818 - protein, 9 aa, Homo Sapiens
SCDTSLAEE

SEQ ID NO: 1148819 - protein, 9 aa, Homo Sapiens
NGIRCVIAN

SEQ ID NO: 1148820 - protein, 9 aa, Homo Sapiens
VAQIVEILH

SEQ ID NO: 1148821 - protein, 9 aa, Homo Sapiens
RTFYLQLWA

SEQ ID NO: 1148822 - protein, 9 aa, Homo Sapiens
GPLTRDAHL

SEQ ID NO: 1148823 - protein, 9 aa, Homo Sapiens
VELTGMSAT

SEQ ID NO: 1148824 - protein, 9 aa, Homo Sapiens
WDPPRSCRQ

SEQ ID NO: 1148825 - protein, 9 aa, Homo Sapiens
SPLQSHVSS

SEQ ID NO: 1148826 - protein, 9 aa, Homo Sapiens
CPGMVSVVG

SEQ ID NO: 1148827 - protein, 9 aa, Homo Sapiens
LKLISDIIH

SEQ ID NO: 1148828 - protein, 9 aa, Homo Sapiens
QTGQLGPRA

SEQ ID NO: 1148829 - protein, 9 aa, Homo Sapiens
FLGQYLAPL

SEQ ID NO: 1148830 - protein, 9 aa, Homo Sapiens
LTQNMENQE

SEQ ID NO: 1148831 - protein, 9 aa, Homo Sapiens
DLEYLECFD

SEQ ID NO: 1148832 - protein, 9 aa, Homo Sapiens
HPRVAVTTT

SEQ ID NO: 1148833 - protein, 9 aa, Homo Sapiens
YWLHYLRPI

SEQ ID NO: 1148834 - protein, 9 aa, Homo Sapiens
QWNEDQQLG

SEQ ID NO: 1148835 - protein, 9 aa, Homo Sapiens
IILEKNPPL

SEQ ID NO: 1148836 - protein, 9 aa, Homo Sapiens
GGQPARPHV

SEQ ID NO: 1148837 - protein, 9 aa, Homo Sapiens
CGSRLKILQ

SEQ ID NO: 1148838 - protein, 9 aa, Homo Sapiens
SQEHQCSPR

SEQ ID NO: 1148839 - protein, 9 aa, Homo Sapiens
PGGFFTRYP

SEQ ID NO: 1148840 - protein, 9 aa, Homo Sapiens
TMAAAASGL

SEQ ID NO: 1148841 - protein, 9 aa, Homo Sapiens
AGPQPCNVA

SEQ ID NO: 1148842 - protein, 9 aa, Homo Sapiens
GLDSGADTG

SEQ ID NO: 1148843 - protein, 9 aa, Homo Sapiens
MHETILQKR

SEQ ID NO: 1148844 - protein, 9 aa, Homo Sapiens
CRWEPQPPR

SEQ ID NO: 1148845 - protein, 9 aa, Homo Sapiens
RGVGVGDMA

SEQ ID NO: 1148846 - protein, 9 aa, Homo Sapiens
GSAEIPTGS

SEQ ID NO: 1148847 - protein, 9 aa, Homo Sapiens
RGGDNPNVE

SEQ ID NO: 1148848 - protein, 9 aa, Homo Sapiens
KKLVPLVIL

SEQ ID NO: 1148849 - protein, 9 aa, Homo Sapiens
KGASSHITH

SEQ ID NO: 1148850 - protein, 9 aa, Homo Sapiens
PDSGSSPAS

SEQ ID NO: 1148851 - protein, 9 aa, Homo Sapiens
HAPNHHDQE

SEQ ID NO: 1148852 - protein, 9 aa, Homo Sapiens
GLATQRRPA

SEQ ID NO: 1148853 - protein, 9 aa, Homo Sapiens
QHEDVEGCL

SEQ ID NO: 1148854 - protein, 9 aa, Homo Sapiens
ADGNGDPGR

SEQ ID NO: 1148855 - protein, 9 aa, Homo Sapiens
LAGPALPTR

SEQ ID NO: 1148856 - protein, 9 aa, Homo Sapiens
RTSWLETAV

SEQ ID NO: 1148857 - protein, 9 aa, Homo Sapiens
AREREHIHA

SEQ ID NO: 1148858 - protein, 9 aa, Homo Sapiens
ETVEEQLLC

SEQ ID NO: 1148859 - protein, 9 aa, Homo Sapiens
KKHGGGTAV

SEQ ID NO: 1148860 - protein, 9 aa, Homo Sapiens
KMLPRSTVS

SEQ ID NO: 1148861 - protein, 9 aa, Homo Sapiens
SMAPKMNFD

SEQ ID NO: 1148862 - protein, 9 aa, Homo Sapiens
GPKRMSCKQ

SEQ ID NO: 1148863 - protein, 9 aa, Homo Sapiens
GCSVEFEEM

SEQ ID NO: 1148864 - protein, 9 aa, Homo Sapiens
RFINQLFSS

SEQ ID NO: 1148865 - protein, 9 aa, Homo Sapiens
GESPTLRGL

SEQ ID NO: 1148866 - protein, 9 aa, Homo Sapiens
LLKWNSEGF

SEQ ID NO: 1148867 - protein, 9 aa, Homo Sapiens
EVTWSSKFN

SEQ ID NO: 1148868 - protein, 9 aa, Homo Sapiens
RPACWARVP

SEQ ID NO: 1148869 - protein, 9 aa, Homo Sapiens
QEQHVGLFV

SEQ ID NO: 1148870 - protein, 9 aa, Homo Sapiens
INTFARNTS

SEQ ID NO: 1148871 - protein, 9 aa, Homo Sapiens
APPLWGRLR

SEQ ID NO: 1148872 - protein, 9 aa, Homo Sapiens
DGDATASPS

SEQ ID NO: 1148873 - protein, 9 aa, Homo Sapiens
KGHNMLKKK

SEQ ID NO: 1148874 - protein, 9 aa, Homo Sapiens
RPATLASAA

SEQ ID NO: 1148875 - protein, 9 aa, Homo Sapiens
RSLPIQPPL

SEQ ID NO: 1148876 - protein, 9 aa, Homo Sapiens
LLNPASLLP

SEQ ID NO: 1148877 - protein, 9 aa, Homo Sapiens
VMGVFPICW

SEQ ID NO: 1148878 - protein, 9 aa, Homo Sapiens
TPYTLTPST

SEQ ID NO: 1148879 - protein, 9 aa, Homo Sapiens
LALDCMRRE

SEQ ID NO: 1148880 - protein, 9 aa, Homo Sapiens
SIQSRICSV

SEQ ID NO: 1148881 - protein, 9 aa, Homo Sapiens
GGAAGVGWA

SEQ ID NO: 1148882 - protein, 9 aa, Homo Sapiens
AATLRCPAV

SEQ ID NO: 1148883 - protein, 9 aa, Homo Sapiens
NHGFGNCME

SEQ ID NO: 1148884 - protein, 9 aa, Homo Sapiens
AGGLVAHLL

SEQ ID NO: 1148885 - protein, 9 aa, Homo Sapiens
SHVDLPLSY

SEQ ID NO: 1148886 - protein, 9 aa, Homo Sapiens
RNGIYPPMN

SEQ ID NO: 1148887 - protein, 9 aa, Homo Sapiens
TVRMGRRCS

SEQ ID NO: 1148888 - protein, 9 aa, Homo Sapiens
EEAEWIRSV

SEQ ID NO: 1148889 - protein, 9 aa, Homo Sapiens
GKHSEGCSR

SEQ ID NO: 1148890 - protein, 9 aa, Homo Sapiens
TSSSGWLEL

SEQ ID NO: 1148891 - protein, 9 aa, Homo Sapiens
TRDAHLCPQ

SEQ ID NO: 1148892 - protein, 9 aa, Homo Sapiens
LIKHEAVSD

SEQ ID NO: 1148893 - protein, 9 aa, Homo Sapiens
QGPYSSVPP

SEQ ID NO: 1148894 - protein, 9 aa, Homo Sapiens
SAPVRSEAE

SEQ ID NO: 1148895 - protein, 9 aa, Homo Sapiens
MALRNCVSA

SEQ ID NO: 1148896 - protein, 9 aa, Homo Sapiens
TTYNRDSFD

SEQ ID NO: 1148897 - protein, 9 aa, Homo Sapiens
LDHWKDWYL

SEQ ID NO: 1148898 - protein, 9 aa, Homo Sapiens
KVQLWIYLR

SEQ ID NO: 1148899 - protein, 9 aa, Homo Sapiens
TLSQPPPQA

SEQ ID NO: 1148900 - protein, 9 aa, Homo Sapiens
SVMQSFNDP

SEQ ID NO: 1148901 - protein, 9 aa, Homo Sapiens
PGANSVSAH

SEQ ID NO: 1148902 - protein, 9 aa, Homo Sapiens
AHLGECVNL

SEQ ID NO: 1148903 - protein, 9 aa, Homo Sapiens
YYHQDWSHV

SEQ ID NO: 1148904 - protein, 9 aa, Homo Sapiens
KHPQMVFTV

SEQ ID NO: 1148905 - protein, 9 aa, Homo Sapiens
VAALLMEGF

SEQ ID NO: 1148906 - protein, 9 aa, Homo Sapiens
RGSGPGRRL

SEQ ID NO: 1148907 - protein, 9 aa, Homo Sapiens
SKESSWISD

SEQ ID NO: 1148908 - protein, 9 aa, Homo Sapiens
HSEGCSRSS

SEQ ID NO: 1148909 - protein, 9 aa, Homo Sapiens
KIPEGGDRQ

SEQ ID NO: 1148910 - protein, 9 aa, Homo Sapiens
EVAGAQDYD

SEQ ID NO: 1148911 - protein, 9 aa, Homo Sapiens
HTTGWMFAS

SEQ ID NO: 1148912 - protein, 9 aa, Homo Sapiens
STPCPLLPL

SEQ ID NO: 1148913 - protein, 9 aa, Homo Sapiens
EEDEEWGII

SEQ ID NO: 1148914 - protein, 9 aa, Homo Sapiens
KIIHHPKYN

SEQ ID NO: 1148915 - protein, 9 aa, Homo Sapiens
DEDDYRCSV

SEQ ID NO: 1148916 - protein, 9 aa, Homo Sapiens
AANFDMAVA

SEQ ID NO: 1148917 - protein, 9 aa, Homo Sapiens
TLIRQVLDV

SEQ ID NO: 1148918 - protein, 9 aa, Homo Sapiens
PAGARRLAR

SEQ ID NO: 1148919 - protein, 9 aa, Homo Sapiens
MLYHSGKPP

SEQ ID NO: 1148920 - protein, 9 aa, Homo Sapiens
VKLSTAQSN

SEQ ID NO: 1148921 - protein, 9 aa, Homo Sapiens
RLGPRGHPL

SEQ ID NO: 1148922 - protein, 9 aa, Homo Sapiens
GRSRLPADT

SEQ ID NO: 1148923 - protein, 9 aa, Homo Sapiens
KLYHSLVMC

SEQ ID NO: 1148924 - protein, 9 aa, Homo Sapiens
SPRSSTWPQ

SEQ ID NO: 1148925 - protein, 9 aa, Homo Sapiens
IAGPQGSQR

SEQ ID NO: 1148926 - protein, 9 aa, Homo Sapiens
VTNEGATST

SEQ ID NO: 1148927 - protein, 9 aa, Homo Sapiens
KKDHVTLQV

SEQ ID NO: 1148928 - protein, 9 aa, Homo Sapiens
ECEKDQRLR

SEQ ID NO: 1148929 - protein, 9 aa, Homo Sapiens
LRARGGTTI

SEQ ID NO: 1148930 - protein, 9 aa, Homo Sapiens
LHSLNPSTS

SEQ ID NO: 1148931 - protein, 9 aa, Homo Sapiens
TPTTPLTPV

SEQ ID NO: 1148932 - protein, 9 aa, Homo Sapiens
VNRPAERAV

SEQ ID NO: 1148933 - protein, 9 aa, Homo Sapiens
PAGERVCSN

SEQ ID NO: 1148934 - protein, 9 aa, Homo Sapiens
FDNFFYQER

SEQ ID NO: 1148935 - protein, 9 aa, Homo Sapiens
SYSMEVSYM

SEQ ID NO: 1148936 - protein, 9 aa, Homo Sapiens
MGPQGPPEN

SEQ ID NO: 1148937 - protein, 9 aa, Homo Sapiens
DCPVIVSVQ

SEQ ID NO: 1148938 - protein, 9 aa, Homo Sapiens
EGGLPVGES

SEQ ID NO: 1148939 - protein, 9 aa, Homo Sapiens
YAGMLLGCA

SEQ ID NO: 1148940 - protein, 9 aa, Homo Sapiens
CRRRPAGAR

SEQ ID NO: 1148941 - protein, 9 aa, Homo Sapiens
NSLFIYVIS

SEQ ID NO: 1148942 - protein, 9 aa, Homo Sapiens
WYKYLLSAT

SEQ ID NO: 1148943 - protein, 9 aa, Homo Sapiens
QEEPEQLPE

SEQ ID NO: 1148944 - protein, 9 aa, Homo Sapiens
SPRTKYIGN

SEQ ID NO: 1148945 - protein, 9 aa, Homo Sapiens
RMPARRESR

SEQ ID NO: 1148946 - protein, 9 aa, Homo Sapiens
GAPVRSPEL

SEQ ID NO: 1148947 - protein, 9 aa, Homo Sapiens
ESIDKKRKA

SEQ ID NO: 1148948 - protein, 9 aa, Homo Sapiens
TLGRVPHQV

SEQ ID NO: 1148949 - protein, 9 aa, Homo Sapiens
RDLGTVAGA

SEQ ID NO: 1148950 - protein, 9 aa, Homo Sapiens
EGMLLPRAL

SEQ ID NO: 1148951 - protein, 9 aa, Homo Sapiens
AVYFKINPW

SEQ ID NO: 1148952 - protein, 9 aa, Homo Sapiens
LNELDSKLL

SEQ ID NO: 1148953 - protein, 9 aa, Homo Sapiens
EPPPVGAGT

SEQ ID NO: 1148954 - protein, 9 aa, Homo Sapiens
EGRLTDGKR

SEQ ID NO: 1148955 - protein, 9 aa, Homo Sapiens
KIISSDVIS

SEQ ID NO: 1148956 - protein, 9 aa, Homo Sapiens
ISSGCHASG

SEQ ID NO: 1148957 - protein, 9 aa, Homo Sapiens
HDSENFTDS

SEQ ID NO: 1148958 - protein, 9 aa, Homo Sapiens
QGMQGPPPQ

SEQ ID NO: 1148959 - protein, 9 aa, Homo Sapiens
TDIMDAMLK

SEQ ID NO: 1148960 - protein, 9 aa, Homo Sapiens
VPPLSHTPS

SEQ ID NO: 1148961 - protein, 9 aa, Homo Sapiens
PPRSCRQTP

SEQ ID NO: 1148962 - protein, 9 aa, Homo Sapiens
TLPPDTCRA

SEQ ID NO: 1148963 - protein, 9 aa, Homo Sapiens
WPACARSAS

SEQ ID NO: 1148964 - protein, 9 aa, Homo Sapiens
DSLFSNALP

SEQ ID NO: 1148965 - protein, 9 aa, Homo Sapiens
KPPHHEFCS

SEQ ID NO: 1148966 - protein, 9 aa, Homo Sapiens
CRASRAPCR

SEQ ID NO: 1148967 - protein, 9 aa, Homo Sapiens
EKNSGSQSG

SEQ ID NO: 1148968 - protein, 9 aa, Homo Sapiens
GCLELIFSA

SEQ ID NO: 1148969 - protein, 9 aa, Homo Sapiens
TTRRPLPRS

SEQ ID NO: 1148970 - protein, 9 aa, Homo Sapiens
PPQAPSQVW

SEQ ID NO: 1148971 - protein, 9 aa, Homo Sapiens
AGPWNTGLV

SEQ ID NO: 1148972 - protein, 9 aa, Homo Sapiens
SFFTSAHPS

SEQ ID NO: 1148973 - protein, 9 aa, Homo Sapiens
SAIQTSAGV

SEQ ID NO: 1148974 - protein, 9 aa, Homo Sapiens
ASPSPIRTH

SEQ ID NO: 1148975 - protein, 9 aa, Homo Sapiens
GTMEPITLP

SEQ ID NO: 1148976 - protein, 9 aa, Homo Sapiens
SRMPARRES

SEQ ID NO: 1148977 - protein, 9 aa, Homo Sapiens
YGSELPATT

SEQ ID NO: 1148978 - protein, 9 aa, Homo Sapiens
GEEASAKKL

SEQ ID NO: 1148979 - protein, 9 aa, Homo Sapiens
EDVAQIVEI

SEQ ID NO: 1148980 - protein, 9 aa, Homo Sapiens
RMVALVTGS

SEQ ID NO: 1148981 - protein, 9 aa, Homo Sapiens
DRTFRHHET

SEQ ID NO: 1148982 - protein, 9 aa, Homo Sapiens
HPDTDEAVH

SEQ ID NO: 1148983 - protein, 9 aa, Homo Sapiens
WLIPPMLHN

SEQ ID NO: 1148984 - protein, 9 aa, Homo Sapiens
CKKRLPSKE

SEQ ID NO: 1148985 - protein, 9 aa, Homo Sapiens
WLELSSLES

SEQ ID NO: 1148986 - protein, 9 aa, Homo Sapiens
QPPLPAGLR

SEQ ID NO: 1148987 - protein, 9 aa, Homo Sapiens
MEGFLAFPS

SEQ ID NO: 1148988 - protein, 9 aa, Homo Sapiens
HEDHLQFPL

SEQ ID NO: 1148989 - protein, 9 aa, Homo Sapiens
EVQAGAAPK

SEQ ID NO: 1148990 - protein, 9 aa, Homo Sapiens
AKQVSPAGA

SEQ ID NO: 1148991 - protein, 9 aa, Homo Sapiens
HDCMSLACL

SEQ ID NO: 1148992 - protein, 9 aa, Homo Sapiens
SSSGGSGHP

SEQ ID NO: 1148993 - protein, 9 aa, Homo Sapiens
SIEVSVNGV

SEQ ID NO: 1148994 - protein, 9 aa, Homo Sapiens
EQCRKMQNM

SEQ ID NO: 1148995 - protein, 9 aa, Homo Sapiens
ATELIKHEA

SEQ ID NO: 1148996 - protein, 9 aa, Homo Sapiens
LGQLGLVVI

SEQ ID NO: 1148997 - protein, 9 aa, Homo Sapiens
GGGPACVPV

SEQ ID NO: 1148998 - protein, 9 aa, Homo Sapiens
DNRFEAHAS

SEQ ID NO: 1148999 - protein, 9 aa, Homo Sapiens
VGAQLMAPL

SEQ ID NO: 1149000 - protein, 9 aa, Homo Sapiens
TSCGTDFYM

SEQ ID NO: 1149001 - protein, 9 aa, Homo Sapiens
NGESPTLRG

SEQ ID NO: 1149002 - protein, 9 aa, Homo Sapiens
SIWSEPGDP

SEQ ID NO: 1149003 - protein, 9 aa, Homo Sapiens
QVSPASPPT

SEQ ID NO: 1149004 - protein, 9 aa, Homo Sapiens
SLDKDDQHT

SEQ ID NO: 1149005 - protein, 9 aa, Homo Sapiens
GYACHHCFT

SEQ ID NO: 1149006 - protein, 9 aa, Homo Sapiens
LCAKQRTVK

SEQ ID NO: 1149007 - protein, 9 aa, Homo Sapiens
GPRRRPAAV

SEQ ID NO: 1149008 - protein, 9 aa, Homo Sapiens
DRVTDNMAT

SEQ ID NO: 1149009 - protein, 9 aa, Homo Sapiens
RFTLEMFNR

SEQ ID NO: 1149010 - protein, 9 aa, Homo Sapiens
CEKDQRLRE

SEQ ID NO: 1149011 - protein, 9 aa, Homo Sapiens
GLETKEVYR

SEQ ID NO: 1149012 - protein, 9 aa, Homo Sapiens
THKIRTSWL

SEQ ID NO: 1149013 - protein, 9 aa, Homo Sapiens
GRPRIPLPA

SEQ ID NO: 1149014 - protein, 9 aa, Homo Sapiens
HQVQGRGIG

SEQ ID NO: 1149015 - protein, 9 aa, Homo Sapiens
NMLKKKEEK

SEQ ID NO: 1149016 - protein, 9 aa, Homo Sapiens
LPCRGPMPG

SEQ ID NO: 1149017 - protein, 9 aa, Homo Sapiens
QPHCLGQLG

SEQ ID NO: 1149018 - protein, 9 aa, Homo Sapiens
SRLSASRPP

SEQ ID NO: 1149019 - protein, 9 aa, Homo Sapiens
SKLISLFWK

SEQ ID NO: 1149020 - protein, 9 aa, Homo Sapiens
PHLPSCHPL

SEQ ID NO: 1149021 - protein, 9 aa, Homo Sapiens
LTMNDSKHK

SEQ ID NO: 1149022 - protein, 9 aa, Homo Sapiens
PWEQKGGSK

SEQ ID NO: 1149023 - protein, 9 aa, Homo Sapiens
SPVPKKRER

SEQ ID NO: 1149024 - protein, 9 aa, Homo Sapiens
TPPRLLSLW

SEQ ID NO: 1149025 - protein, 9 aa, Homo Sapiens
CFDVMTDYS

SEQ ID NO: 1149026 - protein, 9 aa, Homo Sapiens
VMCLRLRTK

SEQ ID NO: 1149027 - protein, 9 aa, Homo Sapiens
LGVGMPSAV

SEQ ID NO: 1149028 - protein, 9 aa, Homo Sapiens
TEFYKHCGS

SEQ ID NO: 1149029 - protein, 9 aa, Homo Sapiens
VRAHGAGVP

SEQ ID NO: 1149030 - protein, 9 aa, Homo Sapiens
RSGSLLCTP

SEQ ID NO: 1149031 - protein, 9 aa, Homo Sapiens
GRTDYEMDR

SEQ ID NO: 1149032 - protein, 9 aa, Homo Sapiens
YVNILLLQP

SEQ ID NO: 1149033 - protein, 9 aa, Homo Sapiens
GQNIRNRAT

SEQ ID NO: 1149034 - protein, 9 aa, Homo Sapiens
AQSAGPPAH

SEQ ID NO: 1149035 - protein, 9 aa, Homo Sapiens
VSVPFVETG

SEQ ID NO: 1149036 - protein, 9 aa, Homo Sapiens
RYTVKAHNG

SEQ ID NO: 1149037 - protein, 9 aa, Homo Sapiens
PSEETAPSL

SEQ ID NO: 1149038 - protein, 9 aa, Homo Sapiens
VEQHMPVSP

SEQ ID NO: 1149039 - protein, 9 aa, Homo Sapiens
ADPGERVLH

SEQ ID NO: 1149040 - protein, 9 aa, Homo Sapiens
PPSTVTEDC

SEQ ID NO: 1149041 - protein, 9 aa, Homo Sapiens
LQKRMNFLH

SEQ ID NO: 1149042 - protein, 9 aa, Homo Sapiens
VQQRQAVAS

SEQ ID NO: 1149043 - protein, 9 aa, Homo Sapiens
LRLRTKLEK

SEQ ID NO: 1149044 - protein, 9 aa, Homo Sapiens
IRSIEGQYD

SEQ ID NO: 1149045 - protein, 9 aa, Homo Sapiens
SEHTDICPS

SEQ ID NO: 1149046 - protein, 9 aa, Homo Sapiens
LLLPSAALA

SEQ ID NO: 1149047 - protein, 9 aa, Homo Sapiens
IEFPRRVLP

SEQ ID NO: 1149048 - protein, 9 aa, Homo Sapiens
TENIDIKNT

SEQ ID NO: 1149049 - protein, 9 aa, Homo Sapiens
HIILSVKIL

SEQ ID NO: 1149050 - protein, 9 aa, Homo Sapiens
SVCQPRCKH

SEQ ID NO: 1149051 - protein, 9 aa, Homo Sapiens
SVNEGSFPD

SEQ ID NO: 1149052 - protein, 9 aa, Homo Sapiens
QPTLDVFWR

SEQ ID NO: 1149053 - protein, 9 aa, Homo Sapiens
RHPLQSLHH

SEQ ID NO: 1149054 - protein, 9 aa, Homo Sapiens
SPWENPAGH

SEQ ID NO: 1149055 - protein, 9 aa, Homo Sapiens
LGQRAQLPG

SEQ ID NO: 1149056 - protein, 9 aa, Homo Sapiens
PMAALVDLA

SEQ ID NO: 1149057 - protein, 9 aa, Homo Sapiens
QHPHHLAQL

SEQ ID NO: 1149058 - protein, 9 aa, Homo Sapiens
PTQSSRPRR

SEQ ID NO: 1149059 - protein, 9 aa, Homo Sapiens
SGGPESRTQ

SEQ ID NO: 1149060 - protein, 9 aa, Homo Sapiens
MRHIIQGSE

SEQ ID NO: 1149061 - protein, 9 aa, Homo Sapiens
GGFFTRYPR

SEQ ID NO: 1149062 - protein, 9 aa, Homo Sapiens
VTSCNGYFV

SEQ ID NO: 1149063 - protein, 9 aa, Homo Sapiens
DFGKDAASL

SEQ ID NO: 1149064 - protein, 9 aa, Homo Sapiens
TTTLSWGSP

SEQ ID NO: 1149065 - protein, 9 aa, Homo Sapiens
QSKHHPLDE

SEQ ID NO: 1149066 - protein, 9 aa, Homo Sapiens
VAWHPLGLC

SEQ ID NO: 1149067 - protein, 9 aa, Homo Sapiens
ARWRTRCWA

SEQ ID NO: 1149068 - protein, 9 aa, Homo Sapiens
APAVNRPAE

SEQ ID NO: 1149069 - protein, 9 aa, Homo Sapiens
HSAEEQPVH

SEQ ID NO: 1149070 - protein, 9 aa, Homo Sapiens
GHIGVVISS

SEQ ID NO: 1149071 - protein, 9 aa, Homo Sapiens
GAVESCNHE

SEQ ID NO: 1149072 - protein, 9 aa, Homo Sapiens
TMRHIIQGS

SEQ ID NO: 1149073 - protein, 9 aa, Homo Sapiens
PQGPVMAWT

SEQ ID NO: 1149074 - protein, 9 aa, Homo Sapiens
GGMECTVRS

SEQ ID NO: 1149075 - protein, 9 aa, Homo Sapiens
SLKPDPLTH

SEQ ID NO: 1149076 - protein, 9 aa, Homo Sapiens
ESPALKQVS

SEQ ID NO: 1149077 - protein, 9 aa, Homo Sapiens
RPGGGQPAR

SEQ ID NO: 1149078 - protein, 9 aa, Homo Sapiens
RPTRRPSRQ

SEQ ID NO: 1149079 - protein, 9 aa, Homo Sapiens
PAALWGQGP

SEQ ID NO: 1149080 - protein, 9 aa, Homo Sapiens
LPVMEGLVE

SEQ ID NO: 1149081 - protein, 9 aa, Homo Sapiens
KKWRLPTHK

SEQ ID NO: 1149082 - protein, 9 aa, Homo Sapiens
VSSSKGGRI

SEQ ID NO: 1149083 - protein, 9 aa, Homo Sapiens
SGQWLGRVG

SEQ ID NO: 1149084 - protein, 9 aa, Homo Sapiens
TDSVVPFDA

SEQ ID NO: 1149085 - protein, 9 aa, Homo Sapiens
LHQATRKHI

SEQ ID NO: 1149086 - protein, 9 aa, Homo Sapiens
PGWRRWTSS

SEQ ID NO: 1149087 - protein, 9 aa, Homo Sapiens
LEELCAVVE

SEQ ID NO: 1149088 - protein, 9 aa, Homo Sapiens
IQNTLWQAR

SEQ ID NO: 1149089 - protein, 9 aa, Homo Sapiens
FNEKIKSCV

SEQ ID NO: 1149090 - protein, 9 aa, Homo Sapiens
LCSAQPAIS

SEQ ID NO: 1149091 - protein, 9 aa, Homo Sapiens
KWRLPTHKI

SEQ ID NO: 1149092 - protein, 9 aa, Homo Sapiens
ATVSSGPFL

SEQ ID NO: 1149093 - protein, 9 aa, Homo Sapiens
APTSGLQEC

SEQ ID NO: 1149094 - protein, 9 aa, Homo Sapiens
ALHVKQEPP

SEQ ID NO: 1149095 - protein, 9 aa, Homo Sapiens
NQGLLYDWS

SEQ ID NO: 1149096 - protein, 9 aa, Homo Sapiens
SVSARGPVR

SEQ ID NO: 1149097 - protein, 9 aa, Homo Sapiens
ASSYMRNLP

SEQ ID NO: 1149098 - protein, 9 aa, Homo Sapiens
LPSCHPLPQ

SEQ ID NO: 1149099 - protein, 9 aa, Homo Sapiens
VDPCKDSER

SEQ ID NO: 1149100 - protein, 9 aa, Homo Sapiens
MAALVDLAG

SEQ ID NO: 1149101 - protein, 9 aa, Homo Sapiens
ALPGRRAPG

SEQ ID NO: 1149102 - protein, 9 aa, Homo Sapiens
TRSRTLHGA

SEQ ID NO: 1149103 - protein, 9 aa, Homo Sapiens
VCAQTGETV

SEQ ID NO: 1149104 - protein, 9 aa, Homo Sapiens
RRAPTGPPR

SEQ ID NO: 1149105 - protein, 9 aa, Homo Sapiens
QRTSAALEK

SEQ ID NO: 1149106 - protein, 9 aa, Homo Sapiens
IFRNTLSFY

SEQ ID NO: 1149107 - protein, 9 aa, Homo Sapiens
ADGLDSGAD

SEQ ID NO: 1149108 - protein, 9 aa, Homo Sapiens
THDKNIWPS

SEQ ID NO: 1149109 - protein, 9 aa, Homo Sapiens
EREHIHAKG

SEQ ID NO: 1149110 - protein, 9 aa, Homo Sapiens
LTPLQWNED

SEQ ID NO: 1149111 - protein, 9 aa, Homo Sapiens
PFYYVTREG

SEQ ID NO: 1149112 - protein, 9 aa, Homo Sapiens
PRHPRHPRL

SEQ ID NO: 1149113 - protein, 9 aa, Homo Sapiens
SQPPPQAPS

SEQ ID NO: 1149114 - protein, 9 aa, Homo Sapiens
GMSGRGGGA

SEQ ID NO: 1149115 - protein, 9 aa, Homo Sapiens
CGVVQGALR

SEQ ID NO: 1149116 - protein, 9 aa, Homo Sapiens
KNSKKPPQS

SEQ ID NO: 1149117 - protein, 9 aa, Homo Sapiens
RWSRVPDHP

SEQ ID NO: 1149118 - protein, 9 aa, Homo Sapiens
TNDNMSYSM

SEQ ID NO: 1149119 - protein, 9 aa, Homo Sapiens
IHDKHLNRP

SEQ ID NO: 1149120 - protein, 9 aa, Homo Sapiens
RPCARGQRQ

SEQ ID NO: 1149121 - protein, 9 aa, Homo Sapiens
HQGPADPPG

SEQ ID NO: 1149122 - protein, 9 aa, Homo Sapiens
LLEGSAEIP

SEQ ID NO: 1149123 - protein, 9 aa, Homo Sapiens
EPEDPGTLE

SEQ ID NO: 1149124 - protein, 9 aa, Homo Sapiens
HHLKHHFQG

SEQ ID NO: 1149125 - protein, 9 aa, Homo Sapiens
PTPEPPEEC

SEQ ID NO: 1149126 - protein, 9 aa, Homo Sapiens
WSSLDAQRE

SEQ ID NO: 1149127 - protein, 9 aa, Homo Sapiens
FQVIRCPLQ

SEQ ID NO: 1149128 - protein, 9 aa, Homo Sapiens
VVETSAFGI

SEQ ID NO: 1149129 - protein, 9 aa, Homo Sapiens
KHPRVAVTT

SEQ ID NO: 1149130 - protein, 9 aa, Homo Sapiens
WKSIFRLYS

SEQ ID NO: 1149131 - protein, 9 aa, Homo Sapiens
HDENKETRM

SEQ ID NO: 1149132 - protein, 9 aa, Homo Sapiens
NMFTPFLVH

SEQ ID NO: 1149133 - protein, 9 aa, Homo Sapiens
KMQKPKLML

SEQ ID NO: 1149134 - protein, 9 aa, Homo Sapiens
TKFYRQRTL

SEQ ID NO: 1149135 - protein, 9 aa, Homo Sapiens
ISHTLSRAQ

SEQ ID NO: 1149136 - protein, 9 aa, Homo Sapiens
RSACRWEPQ

SEQ ID NO: 1149137 - protein, 9 aa, Homo Sapiens
KSGPCSNSS

SEQ ID NO: 1149138 - protein, 9 aa, Homo Sapiens
RRRRFPARA

SEQ ID NO: 1149139 - protein, 9 aa, Homo Sapiens
RARVPCAGT

SEQ ID NO: 1149140 - protein, 9 aa, Homo Sapiens
MMKLRRKNK

SEQ ID NO: 1149141 - protein, 9 aa, Homo Sapiens
VINHSQSLV

SEQ ID NO: 1149142 - protein, 9 aa, Homo Sapiens
MKLYHSLVM

SEQ ID NO: 1149143 - protein, 9 aa, Homo Sapiens
HASGDSLEL

SEQ ID NO: 1149144 - protein, 9 aa, Homo Sapiens
VVGRNGILP

SEQ ID NO: 1149145 - protein, 9 aa, Homo Sapiens
PVAEASTGA

SEQ ID NO: 1149146 - protein, 9 aa, Homo Sapiens
DGNEDSPGH

SEQ ID NO: 1149147 - protein, 9 aa, Homo Sapiens
AKIPDTHLH

SEQ ID NO: 1149148 - protein, 9 aa, Homo Sapiens
TITESSLDV

SEQ ID NO: 1149149 - protein, 9 aa, Homo Sapiens
SEKEDETEV

SEQ ID NO: 1149150 - protein, 9 aa, Homo Sapiens
DLPNITPLS

SEQ ID NO: 1149151 - protein, 9 aa, Homo Sapiens
DFSIWSEPG

SEQ ID NO: 1149152 - protein, 9 aa, Homo Sapiens
WNSSPRTKY

SEQ ID NO: 1149153 - protein, 9 aa, Homo Sapiens
RMNHGNPSG

SEQ ID NO: 1149154 - protein, 9 aa, Homo Sapiens
QALPSPWEN

SEQ ID NO: 1149155 - protein, 9 aa, Homo Sapiens
MVNQKMPWN

SEQ ID NO: 1149156 - protein, 9 aa, Homo Sapiens
FFILALDCM

SEQ ID NO: 1149157 - protein, 9 aa, Homo Sapiens
ASARDKRLC

SEQ ID NO: 1149158 - protein, 9 aa, Homo Sapiens
KMKFLSLVL

SEQ ID NO: 1149159 - protein, 9 aa, Homo Sapiens
SPQTPPRDA

SEQ ID NO: 1149160 - protein, 9 aa, Homo Sapiens
FDKMREDDH

SEQ ID NO: 1149161 - protein, 9 aa, Homo Sapiens
TMLLLYNST

SEQ ID NO: 1149162 - protein, 9 aa, Homo Sapiens
GVRAHGAGV

SEQ ID NO: 1149163 - protein, 9 aa, Homo Sapiens
TVKKAGREF

SEQ ID NO: 1149164 - protein, 9 aa, Homo Sapiens
RRKWWPTQS

SEQ ID NO: 1149165 - protein, 9 aa, Homo Sapiens
AEPAAPRGL

SEQ ID NO: 1149166 - protein, 9 aa, Homo Sapiens
GFLCNVCNI

SEQ ID NO: 1149167 - protein, 9 aa, Homo Sapiens
DVISTNGIV

SEQ ID NO: 1149168 - protein, 9 aa, Homo Sapiens
MPSTTSPPS

SEQ ID NO: 1149169 - protein, 9 aa, Homo Sapiens
HIIIPLERR

SEQ ID NO: 1149170 - protein, 9 aa, Homo Sapiens
QAFEKVATS

SEQ ID NO: 1149171 - protein, 9 aa, Homo Sapiens
MSSLGDPAA

SEQ ID NO: 1149172 - protein, 9 aa, Homo Sapiens
PRRSAAQTG

SEQ ID NO: 1149173 - protein, 9 aa, Homo Sapiens
DHSGSIKNN

SEQ ID NO: 1149174 - protein, 9 aa, Homo Sapiens
FLQWRDPTQ

SEQ ID NO: 1149175 - protein, 9 aa, Homo Sapiens
ETPQPPRRP

SEQ ID NO: 1149176 - protein, 9 aa, Homo Sapiens
KKEVRCSGC

SEQ ID NO: 1149177 - protein, 9 aa, Homo Sapiens
QDGAEPGAN

SEQ ID NO: 1149178 - protein, 9 aa, Homo Sapiens
ACSSKKWRL

SEQ ID NO: 1149179 - protein, 9 aa, Homo Sapiens
KQAFEKVAT

SEQ ID NO: 1149180 - protein, 9 aa, Homo Sapiens
NTTGSTLLQ

SEQ ID NO: 1149181 - protein, 9 aa, Homo Sapiens
IFVKHAEEV

SEQ ID NO: 1149182 - protein, 9 aa, Homo Sapiens
SATTTCPTR

SEQ ID NO: 1149183 - protein, 9 aa, Homo Sapiens
GVVEDGELE

SEQ ID NO: 1149184 - protein, 9 aa, Homo Sapiens
PALKQVSPA

SEQ ID NO: 1149185 - protein, 9 aa, Homo Sapiens
AGERVCSNI

SEQ ID NO: 1149186 - protein, 9 aa, Homo Sapiens
RKQAQQEPL

SEQ ID NO: 1149187 - protein, 9 aa, Homo Sapiens
CPPLEVHLH

SEQ ID NO: 1149188 - protein, 9 aa, Homo Sapiens
FDLSRHFDL

SEQ ID NO: 1149189 - protein, 9 aa, Homo Sapiens
ANIHRFMAQ

SEQ ID NO: 1149190 - protein, 9 aa, Homo Sapiens
QVEQHMPVS

SEQ ID NO: 1149191 - protein, 9 aa, Homo Sapiens
KTIEIGNSL

SEQ ID NO: 1149192 - protein, 9 aa, Homo Sapiens
SRTWRCWVA

SEQ ID NO: 1149193 - protein, 9 aa, Homo Sapiens
LVVIVPAQR

SEQ ID NO: 1149194 - protein, 9 aa, Homo Sapiens
ACSSREVCS

SEQ ID NO: 1149195 - protein, 9 aa, Homo Sapiens
MFIKYWIYG

SEQ ID NO: 1149196 - protein, 9 aa, Homo Sapiens
RLRSRPPGR

SEQ ID NO: 1149197 - protein, 9 aa, Homo Sapiens
PIRTHRAVR

SEQ ID NO: 1149198 - protein, 9 aa, Homo Sapiens
HVCLPGSCD

SEQ ID NO: 1149199 - protein, 9 aa, Homo Sapiens
RHRIQSKHH

SEQ ID NO: 1149200 - protein, 9 aa, Homo Sapiens
PRASLSQLR

SEQ ID NO: 1149201 - protein, 9 aa, Homo Sapiens
KRCCLDSLD

SEQ ID NO: 1149202 - protein, 9 aa, Homo Sapiens
VQELTGCSV

SEQ ID NO: 1149203 - protein, 9 aa, Homo Sapiens
FVKCVLQDP

SEQ ID NO: 1149204 - protein, 9 aa, Homo Sapiens
VTRHPDTDE

SEQ ID NO: 1149205 - protein, 9 aa, Homo Sapiens
ACPGQRVFL

SEQ ID NO: 1149206 - protein, 9 aa, Homo Sapiens
RAPLEGMLL

SEQ ID NO: 1149207 - protein, 9 aa, Homo Sapiens
ELIKVHRAA

SEQ ID NO: 1149208 - protein, 9 aa, Homo Sapiens
KGVLDREQR

SEQ ID NO: 1149209 - protein, 9 aa, Homo Sapiens
SSVISDCTE

SEQ ID NO: 1149210 - protein, 9 aa, Homo Sapiens
VSPSFSSSL

SEQ ID NO: 1149211 - protein, 9 aa, Homo Sapiens
MKMNMKGPE

SEQ ID NO: 1149212 - protein, 9 aa, Homo Sapiens
CLLFPASGE

SEQ ID NO: 1149213 - protein, 9 aa, Homo Sapiens
ASRQEKPPT

SEQ ID NO: 1149214 - protein, 9 aa, Homo Sapiens
PEKREKQAG

SEQ ID NO: 1149215 - protein, 9 aa, Homo Sapiens
SRHFDLRFV

SEQ ID NO: 1149216 - protein, 9 aa, Homo Sapiens
CDHAQPLAR

SEQ ID NO: 1149217 - protein, 9 aa, Homo Sapiens
PYAGGVGAQ

SEQ ID NO: 1149218 - protein, 9 aa, Homo Sapiens
RLGASASPA

SEQ ID NO: 1149219 - protein, 9 aa, Homo Sapiens
SGSLPEGYH

SEQ ID NO: 1149220 - protein, 9 aa, Homo Sapiens
PASGEMKDP

SEQ ID NO: 1149221 - protein, 9 aa, Homo Sapiens
DASCARWRT

SEQ ID NO: 1149222 - protein, 9 aa, Homo Sapiens
EDSDGDVHQ

SEQ ID NO: 1149223 - protein, 9 aa, Homo Sapiens
IGNTNFKQK

SEQ ID NO: 1149224 - protein, 9 aa, Homo Sapiens
QPAAANAAR

SEQ ID NO: 1149225 - protein, 9 aa, Homo Sapiens
FLHPFPSKS

SEQ ID NO: 1149226 - protein, 9 aa, Homo Sapiens
SGRVRRSRR

SEQ ID NO: 1149227 - protein, 9 aa, Homo Sapiens
WRTSSACSA

SEQ ID NO: 1149228 - protein, 9 aa, Homo Sapiens
NEDSDGDVH

SEQ ID NO: 1149229 - protein, 9 aa, Homo Sapiens
TSGPQKGDP

SEQ ID NO: 1149230 - protein, 9 aa, Homo Sapiens
PTRFTLEMF

SEQ ID NO: 1149231 - protein, 9 aa, Homo Sapiens
AIYEHLFCW

SEQ ID NO: 1149232 - protein, 9 aa, Homo Sapiens
QPCTSVPST

SEQ ID NO: 1149233 - protein, 9 aa, Homo Sapiens
CYPNVVPSL

SEQ ID NO: 1149234 - protein, 9 aa, Homo Sapiens
MQKFLGSFL

SEQ ID NO: 1149235 - protein, 9 aa, Homo Sapiens
YGVSHEPVP

SEQ ID NO: 1149236 - protein, 9 aa, Homo Sapiens
GAKRRGPCT

SEQ ID NO: 1149237 - protein, 9 aa, Homo Sapiens
TVGPLGLRP

SEQ ID NO: 1149238 - protein, 9 aa, Homo Sapiens
EDESILGVV

SEQ ID NO: 1149239 - protein, 9 aa, Homo Sapiens
PEALERWPA

SEQ ID NO: 1149240 - protein, 9 aa, Homo Sapiens
DTDEAVHKK

SEQ ID NO: 1149241 - protein, 9 aa, Homo Sapiens
GRHLSGGVP

SEQ ID NO: 1149242 - protein, 9 aa, Homo Sapiens
GALERIGGP

SEQ ID NO: 1149243 - protein, 9 aa, Homo Sapiens
QALGLVVLP

SEQ ID NO: 1149244 - protein, 9 aa, Homo Sapiens
YCWHINFTT

SEQ ID NO: 1149245 - protein, 9 aa, Homo Sapiens
GEGGGVMLF

SEQ ID NO: 1149246 - protein, 9 aa, Homo Sapiens
QSWGQCQSV

SEQ ID NO: 1149247 - protein, 9 aa, Homo Sapiens
RAINLNLRA

SEQ ID NO: 1149248 - protein, 9 aa, Homo Sapiens
NPKLHTPMH

SEQ ID NO: 1149249 - protein, 9 aa, Homo Sapiens
LPASSPTKC

SEQ ID NO: 1149250 - protein, 9 aa, Homo Sapiens
RSSAQAYQA

SEQ ID NO: 1149251 - protein, 9 aa, Homo Sapiens
FFILVPRLE

SEQ ID NO: 1149252 - protein, 9 aa, Homo Sapiens
TRRAVLVSC

SEQ ID NO: 1149253 - protein, 9 aa, Homo Sapiens
MLLPRALPS

SEQ ID NO: 1149254 - protein, 9 aa, Homo Sapiens
TDTLCAGPV

SEQ ID NO: 1149255 - protein, 9 aa, Homo Sapiens
LSSFLIFFI

SEQ ID NO: 1149256 - protein, 9 aa, Homo Sapiens
PWSGLIVTA

SEQ ID NO: 1149257 - protein, 9 aa, Homo Sapiens
LNDIVGSEA

SEQ ID NO: 1149258 - protein, 9 aa, Homo Sapiens
TPSTTLWVI

SEQ ID NO: 1149259 - protein, 9 aa, Homo Sapiens
KEEKNSKKP

SEQ ID NO: 1149260 - protein, 9 aa, Homo Sapiens
PPAGSSTQA

SEQ ID NO: 1149261 - protein, 9 aa, Homo Sapiens
RRRGRLNSV

SEQ ID NO: 1149262 - protein, 9 aa, Homo Sapiens
KLDLTKAEK

SEQ ID NO: 1149263 - protein, 9 aa, Homo Sapiens
EGAPPLWGR

SEQ ID NO: 1149264 - protein, 9 aa, Homo Sapiens
EEDESILGV

SEQ ID NO: 1149265 - protein, 9 aa, Homo Sapiens
CQSLLGGMI

SEQ ID NO: 1149266 - protein, 9 aa, Homo Sapiens
SVFQVIRCP

SEQ ID NO: 1149267 - protein, 9 aa, Homo Sapiens
FLLTRSNDP

SEQ ID NO: 1149268 - protein, 9 aa, Homo Sapiens
LLDVVLRDG

SEQ ID NO: 1149269 - protein, 9 aa, Homo Sapiens
SNETPKKKR

SEQ ID NO: 1149270 - protein, 9 aa, Homo Sapiens
HGQRRLQEF

SEQ ID NO: 1149271 - protein, 9 aa, Homo Sapiens
LACSLQHYL

SEQ ID NO: 1149272 - protein, 9 aa, Homo Sapiens
MRDKKRRSK

SEQ ID NO: 1149273 - protein, 9 aa, Homo Sapiens
IPTGSEADG

SEQ ID NO: 1149274 - protein, 9 aa, Homo Sapiens
PGGAGPVSH

SEQ ID NO: 1149275 - protein, 9 aa, Homo Sapiens
LAPVAWHPL

SEQ ID NO: 1149276 - protein, 9 aa, Homo Sapiens
QVDRLCGAC

SEQ ID NO: 1149277 - protein, 9 aa, Homo Sapiens
LKPSGEQIP

SEQ ID NO: 1149278 - protein, 9 aa, Homo Sapiens
QVQGRGIGP

SEQ ID NO: 1149279 - protein, 9 aa, Homo Sapiens
VDPDEPIHD

SEQ ID NO: 1149280 - protein, 9 aa, Homo Sapiens
MAGGLVAHL

SEQ ID NO: 1149281 - protein, 9 aa, Homo Sapiens
LLLVFASSG

SEQ ID NO: 1149282 - protein, 9 aa, Homo Sapiens
KRLCPSESM

SEQ ID NO: 1149283 - protein, 9 aa, Homo Sapiens
CIMKNQIRK

SEQ ID NO: 1149284 - protein, 9 aa, Homo Sapiens
KGHIGVVIS

SEQ ID NO: 1149285 - protein, 9 aa, Homo Sapiens
GKQHPHPLL

SEQ ID NO: 1149286 - protein, 9 aa, Homo Sapiens
TLSFYVIDI

SEQ ID NO: 1149287 - protein, 9 aa, Homo Sapiens
SPGLATQRR

SEQ ID NO: 1149288 - protein, 9 aa, Homo Sapiens
FSRSFSPDS

SEQ ID NO: 1149289 - protein, 9 aa, Homo Sapiens
DNGCLRQEL

SEQ ID NO: 1149290 - protein, 9 aa, Homo Sapiens
YNSLFIYVI

SEQ ID NO: 1149291 - protein, 9 aa, Homo Sapiens
PLRRSLPIQ

SEQ ID NO: 1149292 - protein, 9 aa, Homo Sapiens
SWSSLDAQR

SEQ ID NO: 1149293 - protein, 9 aa, Homo Sapiens
GPHPSPSWA

SEQ ID NO: 1149294 - protein, 9 aa, Homo Sapiens
QAQQEPLPR

SEQ ID NO: 1149295 - protein, 9 aa, Homo Sapiens
ENKETRMSC

SEQ ID NO: 1149296 - protein, 9 aa, Homo Sapiens
NYPAGERVC

SEQ ID NO: 1149297 - protein, 9 aa, Homo Sapiens
SGHYTRFIR

SEQ ID NO: 1149298 - protein, 9 aa, Homo Sapiens
LCNVCNIPF

SEQ ID NO: 1149299 - protein, 9 aa, Homo Sapiens
MYPLGLRMN

SEQ ID NO: 1149300 - protein, 9 aa, Homo Sapiens
KKKRSAFPS

SEQ ID NO: 1149301 - protein, 9 aa, Homo Sapiens
PQQEGSNPQ

SEQ ID NO: 1149302 - protein, 9 aa, Homo Sapiens
THRSAFSRV

SEQ ID NO: 1149303 - protein, 9 aa, Homo Sapiens
DFRYKTQAG

SEQ ID NO: 1149304 - protein, 9 aa, Homo Sapiens
LRGGVLAQH

SEQ ID NO: 1149305 - protein, 9 aa, Homo Sapiens
LAQSKETLS

SEQ ID NO: 1149306 - protein, 9 aa, Homo Sapiens
LIPLLGDQL

SEQ ID NO: 1149307 - protein, 9 aa, Homo Sapiens
PPGTVGPLG

SEQ ID NO: 1149308 - protein, 9 aa, Homo Sapiens
RVLHGAPWK

SEQ ID NO: 1149309 - protein, 9 aa, Homo Sapiens
SFLLAGILI

SEQ ID NO: 1149310 - protein, 9 aa, Homo Sapiens
LPATTAFSA

SEQ ID NO: 1149311 - protein, 9 aa, Homo Sapiens
CQRLVELHM

SEQ ID NO: 1149312 - protein, 9 aa, Homo Sapiens
TVDTVHMQP

SEQ ID NO: 1149313 - protein, 9 aa, Homo Sapiens
RLKVFSRDG

SEQ ID NO: 1149314 - protein, 9 aa, Homo Sapiens
LHGIEIPGR

SEQ ID NO: 1149315 - protein, 9 aa, Homo Sapiens
DSHKGRTCE

SEQ ID NO: 1149316 - protein, 9 aa, Homo Sapiens
TSAATCTHR

SEQ ID NO: 1149317 - protein, 9 aa, Homo Sapiens
IPLYLSHHP

SEQ ID NO: 1149318 - protein, 9 aa, Homo Sapiens
HKTMNLNKP

SEQ ID NO: 1149319 - protein, 9 aa, Homo Sapiens
QEAVQEVAD

SEQ ID NO: 1149320 - protein, 9 aa, Homo Sapiens
WGQCQSVCQ

SEQ ID NO: 1149321 - protein, 9 aa, Homo Sapiens
DTDLEEDAV

SEQ ID NO: 1149322 - protein, 9 aa, Homo Sapiens
TREPQASRQ

SEQ ID NO: 1149323 - protein, 9 aa, Homo Sapiens
ITPLSVAMN

SEQ ID NO: 1149324 - protein, 9 aa, Homo Sapiens
SMRDKKRRS

SEQ ID NO: 1149325 - protein, 9 aa, Homo Sapiens
KSCVPGWCR

SEQ ID NO: 1149326 - protein, 9 aa, Homo Sapiens
SLGTRKGWT

SEQ ID NO: 1149327 - protein, 9 aa, Homo Sapiens
PRNMALEVF

SEQ ID NO: 1149328 - protein, 9 aa, Homo Sapiens
GEDVAALLM

SEQ ID NO: 1149329 - protein, 9 aa, Homo Sapiens
SEELDMVIL

SEQ ID NO: 1149330 - protein, 9 aa, Homo Sapiens
WTQTCPPKR

SEQ ID NO: 1149331 - protein, 9 aa, Homo Sapiens
PEEDEEWGI

SEQ ID NO: 1149332 - protein, 9 aa, Homo Sapiens
SYTGACTHP

SEQ ID NO: 1149333 - protein, 9 aa, Homo Sapiens
EKPTAALGW

SEQ ID NO: 1149334 - protein, 9 aa, Homo Sapiens
SYPGFPHSQ

SEQ ID NO: 1149335 - protein, 9 aa, Homo Sapiens
PSAALALTE

SEQ ID NO: 1149336 - protein, 9 aa, Homo Sapiens
MREHAENLL

SEQ ID NO: 1149337 - protein, 9 aa, Homo Sapiens
LDNLLLTMM

SEQ ID NO: 1149338 - protein, 9 aa, Homo Sapiens
SLAQAAALG

SEQ ID NO: 1149339 - protein, 9 aa, Homo Sapiens
GRAPLEGML

SEQ ID NO: 1149340 - protein, 9 aa, Homo Sapiens
GGALLCLSA

SEQ ID NO: 1149341 - protein, 9 aa, Homo Sapiens
PPQSKRTNG

SEQ ID NO: 1149342 - protein, 9 aa, Homo Sapiens
LSAATQAIP

SEQ ID NO: 1149343 - protein, 9 aa, Homo Sapiens
ERAVLGRAA

SEQ ID NO: 1149344 - protein, 9 aa, Homo Sapiens
AHPSRPCRM

SEQ ID NO: 1149345 - protein, 9 aa, Homo Sapiens
GIVMGVFPI

SEQ ID NO: 1149346 - protein, 9 aa, Homo Sapiens
ETRCSFILR

SEQ ID NO: 1149347 - protein, 9 aa, Homo Sapiens
YWTYGITRG

SEQ ID NO: 1149348 - protein, 9 aa, Homo Sapiens
RQAPGPGAV

SEQ ID NO: 1149349 - protein, 9 aa, Homo Sapiens
ELSSLESGC

SEQ ID NO: 1149350 - protein, 9 aa, Homo Sapiens
NFEVWTATM

SEQ ID NO: 1149351 - protein, 9 aa, Homo Sapiens
HIFIGSLLR

SEQ ID NO: 1149352 - protein, 9 aa, Homo Sapiens
PQKGDPREP

SEQ ID NO: 1149353 - protein, 9 aa, Homo Sapiens
SGSQSGTKM

SEQ ID NO: 1149354 - protein, 9 aa, Homo Sapiens
PQPAQTWPA

SEQ ID NO: 1149355 - protein, 9 aa, Homo Sapiens
GGGGPERPC

SEQ ID NO: 1149356 - protein, 9 aa, Homo Sapiens
FYSSVFGVM

SEQ ID NO: 1149357 - protein, 9 aa, Homo Sapiens
EIAQGIAGP

SEQ ID NO: 1149358 - protein, 9 aa, Homo Sapiens
RVFLCPGEP

SEQ ID NO: 1149359 - protein, 9 aa, Homo Sapiens
NVGRRHKIG

SEQ ID NO: 1149360 - protein, 9 aa, Homo Sapiens
LPGRRAPGR

SEQ ID NO: 1149361 - protein, 9 aa, Homo Sapiens
QGLPRNMAL

SEQ ID NO: 1149362 - protein, 9 aa, Homo Sapiens
FREPSVQTH

SEQ ID NO: 1149363 - protein, 9 aa, Homo Sapiens
ATQRRPATL

SEQ ID NO: 1149364 - protein, 9 aa, Homo Sapiens
TEPPPVGAG

SEQ ID NO: 1149365 - protein, 9 aa, Homo Sapiens
GPIQNTLWQ

SEQ ID NO: 1149366 - protein, 9 aa, Homo Sapiens
VIPLKHPRV

SEQ ID NO: 1149367 - protein, 9 aa, Homo Sapiens
AFSREQCRK

SEQ ID NO: 1149368 - protein, 9 aa, Homo Sapiens
KEGCESVMG

SEQ ID NO: 1149369 - protein, 9 aa, Homo Sapiens
LVRDCGAWP

SEQ ID NO: 1149370 - protein, 9 aa, Homo Sapiens
TFYPHPHPR

SEQ ID NO: 1149371 - protein, 9 aa, Homo Sapiens
PLQWVVGTY

SEQ ID NO: 1149372 - protein, 9 aa, Homo Sapiens
HIKSIAAAL

SEQ ID NO: 1149373 - protein, 9 aa, Homo Sapiens
VKVQLWIYL

SEQ ID NO: 1149374 - protein, 9 aa, Homo Sapiens
SKVTITLYG

SEQ ID NO: 1149375 - protein, 9 aa, Homo Sapiens
QRQELLWPP

SEQ ID NO: 1149376 - protein, 9 aa, Homo Sapiens
QCQSVCQPR

SEQ ID NO: 1149377 - protein, 9 aa, Homo Sapiens
HIIQGSEAV

SEQ ID NO: 1149378 - protein, 9 aa, Homo Sapiens
AIVNLCRNK

SEQ ID NO: 1149379 - protein, 9 aa, Homo Sapiens
NQVISLESI

SEQ ID NO: 1149380 - protein, 9 aa, Homo Sapiens
SDGGTEYYP

SEQ ID NO: 1149381 - protein, 9 aa, Homo Sapiens
GLLACGVVQ

SEQ ID NO: 1149382 - protein, 9 aa, Homo Sapiens
DSTHSMLEA

SEQ ID NO: 1149383 - protein, 9 aa, Homo Sapiens
HQEKHLPRR

SEQ ID NO: 1149384 - protein, 9 aa, Homo Sapiens
EKIFLQWRD

SEQ ID NO: 1149385 - protein, 9 aa, Homo Sapiens
FSIWSEPGD

SEQ ID NO: 1149386 - protein, 9 aa, Homo Sapiens
GAVGGCGPE

SEQ ID NO: 1149387 - protein, 9 aa, Homo Sapiens
VSVGLQGKL

SEQ ID NO: 1149388 - protein, 9 aa, Homo Sapiens
AAILSAQHE

SEQ ID NO: 1149389 - protein, 9 aa, Homo Sapiens
KFSMTSWNH

SEQ ID NO: 1149390 - protein, 9 aa, Homo Sapiens
SIFVKHAEE

SEQ ID NO: 1149391 - protein, 9 aa, Homo Sapiens
KHGGGTAVG

SEQ ID NO: 1149392 - protein, 9 aa, Homo Sapiens
PTVDTVHMQ

SEQ ID NO: 1149393 - protein, 9 aa, Homo Sapiens
NSQFGFGPN

SEQ ID NO: 1149394 - protein, 9 aa, Homo Sapiens
YRVHEDGDS

SEQ ID NO: 1149395 - protein, 9 aa, Homo Sapiens
IPGRTDYEM

SEQ ID NO: 1149396 - protein, 9 aa, Homo Sapiens
GFPKRFINQ

SEQ ID NO: 1149397 - protein, 9 aa, Homo Sapiens
HPNPTQPSG

SEQ ID NO: 1149398 - protein, 9 aa, Homo Sapiens
LLSRMPARR

SEQ ID NO: 1149399 - protein, 9 aa, Homo Sapiens
IRTHRAVRP

SEQ ID NO: 1149400 - protein, 9 aa, Homo Sapiens
THLSMMPPP

SEQ ID NO: 1149401 - protein, 9 aa, Homo Sapiens
ASESRNMIY

SEQ ID NO: 1149402 - protein, 9 aa, Homo Sapiens
PLQSAFGDQ

SEQ ID NO: 1149403 - protein, 9 aa, Homo Sapiens
EETPQPPRR

SEQ ID NO: 1149404 - protein, 9 aa, Homo Sapiens
VLAQHPHHL

SEQ ID NO: 1149405 - protein, 9 aa, Homo Sapiens
PHRGTPSLI

SEQ ID NO: 1149406 - protein, 9 aa, Homo Sapiens
MSDLHLTSE

SEQ ID NO: 1149407 - protein, 9 aa, Homo Sapiens
QVKEIHAQL

SEQ ID NO: 1149408 - protein, 9 aa, Homo Sapiens
PEMVKNRSK

SEQ ID NO: 1149409 - protein, 9 aa, Homo Sapiens
ICNTCSSNE

SEQ ID NO: 1149410 - protein, 9 aa, Homo Sapiens
RGASSSTSR

SEQ ID NO: 1149411 - protein, 9 aa, Homo Sapiens
VSGPVLGCL

SEQ ID NO: 1149412 - protein, 9 aa, Homo Sapiens
ALSALWNQL

SEQ ID NO: 1149413 - protein, 9 aa, Homo Sapiens
TPNTGPAAA

SEQ ID NO: 1149414 - protein, 9 aa, Homo Sapiens
NQHTTSIQS

SEQ ID NO: 1149415 - protein, 9 aa, Homo Sapiens
SATGGDRPT

SEQ ID NO: 1149416 - protein, 9 aa, Homo Sapiens
GWAALQRLT

SEQ ID NO: 1149417 - protein, 9 aa, Homo Sapiens
PPCAQEAPH

SEQ ID NO: 1149418 - protein, 9 aa, Homo Sapiens
KIKSCVPGW

SEQ ID NO: 1149419 - protein, 9 aa, Homo Sapiens
NFKQKFIIL

SEQ ID NO: 1149420 - protein, 9 aa, Homo Sapiens
QKDNKGYCT

SEQ ID NO: 1149421 - protein, 9 aa, Homo Sapiens
CRQTPPGSA

SEQ ID NO: 1149422 - protein, 9 aa, Homo Sapiens
EANEDVAQI

SEQ ID NO: 1149423 - protein, 9 aa, Homo Sapiens
QGPVMAWTS

SEQ ID NO: 1149424 - protein, 9 aa, Homo Sapiens
GRTIKLWGL

SEQ ID NO: 1149425 - protein, 9 aa, Homo Sapiens
LIRQVLDVV

SEQ ID NO: 1149426 - protein, 9 aa, Homo Sapiens
SRKITETIG

SEQ ID NO: 1149427 - protein, 9 aa, Homo Sapiens
TEPTVDTVH

SEQ ID NO: 1149428 - protein, 9 aa, Homo Sapiens
EERSEVVDV

SEQ ID NO: 1149429 - protein, 9 aa, Homo Sapiens
SRLPLQWVV

SEQ ID NO: 1149430 - protein, 9 aa, Homo Sapiens
PHQVQGRGI

SEQ ID NO: 1149431 - protein, 9 aa, Homo Sapiens
CNVCNIPFL

SEQ ID NO: 1149432 - protein, 9 aa, Homo Sapiens
STPMHVVTC

SEQ ID NO: 1149433 - protein, 9 aa, Homo Sapiens
SCKRKVGGA

SEQ ID NO: 1149434 - protein, 9 aa, Homo Sapiens
NEAANFDMA

SEQ ID NO: 1149435 - protein, 9 aa, Homo Sapiens
RASLSQLRE

SEQ ID NO: 1149436 - protein, 9 aa, Homo Sapiens
QRPPRQTPR

SEQ ID NO: 1149437 - protein, 9 aa, Homo Sapiens
KEAATQEEP

SEQ ID NO: 1149438 - protein, 9 aa, Homo Sapiens
SGPFLQLSS

SEQ ID NO: 1149439 - protein, 9 aa, Homo Sapiens
MEQDYHGLM

SEQ ID NO: 1149440 - protein, 9 aa, Homo Sapiens
FGNCMELQA

SEQ ID NO: 1149441 - protein, 9 aa, Homo Sapiens
KVQNEFKAE

SEQ ID NO: 1149442 - protein, 9 aa, Homo Sapiens
HRPVRPGRR

SEQ ID NO: 1149443 - protein, 9 aa, Homo Sapiens
RTGCRWPRG

SEQ ID NO: 1149444 - protein, 9 aa, Homo Sapiens
CILGPGGAA

SEQ ID NO: 1149445 - protein, 9 aa, Homo Sapiens
KKRGASSST

SEQ ID NO: 1149446 - protein, 9 aa, Homo Sapiens
YKCKMLLAR

SEQ ID NO: 1149447 - protein, 9 aa, Homo Sapiens
RGEQSDCPV

SEQ ID NO: 1149448 - protein, 9 aa, Homo Sapiens
HLHGYALWP

SEQ ID NO: 1149449 - protein, 9 aa, Homo Sapiens
STEASVPAT

SEQ ID NO: 1149450 - protein, 9 aa, Homo Sapiens
PTRMAGRRS

SEQ ID NO: 1149451 - protein, 9 aa, Homo Sapiens
FSRKITETI

SEQ ID NO: 1149452 - protein, 9 aa, Homo Sapiens
FLKLNDIVG

SEQ ID NO: 1149453 - protein, 9 aa, Homo Sapiens
GQYDTLQAY

SEQ ID NO: 1149454 - protein, 9 aa, Homo Sapiens
DWLAPVAWH

SEQ ID NO: 1149455 - protein, 9 aa, Homo Sapiens
CRWPRGRPR

SEQ ID NO: 1149456 - protein, 9 aa, Homo Sapiens
TVPPKMQKP

SEQ ID NO: 1149457 - protein, 9 aa, Homo Sapiens
SSLGDPAAF

SEQ ID NO: 1149458 - protein, 9 aa, Homo Sapiens
PPGRGAEPA

SEQ ID NO: 1149459 - protein, 9 aa, Homo Sapiens
VTTWQGAPV

SEQ ID NO: 1149460 - protein, 9 aa, Homo Sapiens
WAPLKTRDR

SEQ ID NO: 1149461 - protein, 9 aa, Homo Sapiens
WPRLEGPSR

SEQ ID NO: 1149462 - protein, 9 aa, Homo Sapiens
HKKKIRTSP

SEQ ID NO: 1149463 - protein, 9 aa, Homo Sapiens
PEHKKHVTD

SEQ ID NO: 1149464 - protein, 9 aa, Homo Sapiens
RTSSACSAG

SEQ ID NO: 1149465 - protein, 9 aa, Homo Sapiens
TRRSCSGLV

SEQ ID NO: 1149466 - protein, 9 aa, Homo Sapiens
EIHAQLTEQ

SEQ ID NO: 1149467 - protein, 9 aa, Homo Sapiens
ELCAVVEQT

SEQ ID NO: 1149468 - protein, 9 aa, Homo Sapiens
SPHLYSSPY

SEQ ID NO: 1149469 - protein, 9 aa, Homo Sapiens
DYVEVAGAQ

SEQ ID NO: 1149470 - protein, 9 aa, Homo Sapiens
FDPHRGTPS

SEQ ID NO: 1149471 - protein, 9 aa, Homo Sapiens
DDLCLSALD

SEQ ID NO: 1149472 - protein, 9 aa, Homo Sapiens
PGPSGSFDF

SEQ ID NO: 1149473 - protein, 9 aa, Homo Sapiens
HVVTCLTRD

SEQ ID NO: 1149474 - protein, 9 aa, Homo Sapiens
HACCHASCH

SEQ ID NO: 1149475 - protein, 9 aa, Homo Sapiens
STSRDSRSF

SEQ ID NO: 1149476 - protein, 9 aa, Homo Sapiens
VCSSPRAGW

SEQ ID NO: 1149477 - protein, 9 aa, Homo Sapiens
ASNFYSVVG

SEQ ID NO: 1149478 - protein, 9 aa, Homo Sapiens
DKSDDLEVP

SEQ ID NO: 1149479 - protein, 9 aa, Homo Sapiens
LRLLCQPCS

SEQ ID NO: 1149480 - protein, 9 aa, Homo Sapiens
YVSRVVCTM

SEQ ID NO: 1149481 - protein, 9 aa, Homo Sapiens
WISDGKKQE

SEQ ID NO: 1149482 - protein, 9 aa, Homo Sapiens
RRLQEFLAD

SEQ ID NO: 1149483 - protein, 9 aa, Homo Sapiens
LQKREVTDK

SEQ ID NO: 1149484 - protein, 9 aa, Homo Sapiens
WQATRSRTL

SEQ ID NO: 1149485 - protein, 9 aa, Homo Sapiens
RLARARVPC

SEQ ID NO: 1149486 - protein, 9 aa, Homo Sapiens
PLPQAPTPT

SEQ ID NO: 1149487 - protein, 9 aa, Homo Sapiens
VRDCGAWPP

SEQ ID NO: 1149488 - protein, 9 aa, Homo Sapiens
TTARQPSRW

SEQ ID NO: 1149489 - protein, 9 aa, Homo Sapiens
QATQGGRRA

SEQ ID NO: 1149490 - protein, 9 aa, Homo Sapiens
NNFLLNLAI

SEQ ID NO: 1149491 - protein, 9 aa, Homo Sapiens
PEKLQRNSQ

SEQ ID NO: 1149492 - protein, 9 aa, Homo Sapiens
RGGLDLRVC

SEQ ID NO: 1149493 - protein, 9 aa, Homo Sapiens
NGMKMNMKG

SEQ ID NO: 1149494 - protein, 9 aa, Homo Sapiens
RHPQLGQRA

SEQ ID NO: 1149495 - protein, 9 aa, Homo Sapiens
AVEVLKRES

SEQ ID NO: 1149496 - protein, 9 aa, Homo Sapiens
APEEAHQEK

SEQ ID NO: 1149497 - protein, 9 aa, Homo Sapiens
LGDQLVGGQ

SEQ ID NO: 1149498 - protein, 9 aa, Homo Sapiens
EANDECRSA

SEQ ID NO: 1149499 - protein, 9 aa, Homo Sapiens
GMLLGCAWG

SEQ ID NO: 1149500 - protein, 9 aa, Homo Sapiens
TCQARPASS

SEQ ID NO: 1149501 - protein, 9 aa, Homo Sapiens
CGVRAHGAG

SEQ ID NO: 1149502 - protein, 9 aa, Homo Sapiens
KGEELKPEE

SEQ ID NO: 1149503 - protein, 9 aa, Homo Sapiens
AASLLTRMK

SEQ ID NO: 1149504 - protein, 9 aa, Homo Sapiens
QQHVLGAQV

SEQ ID NO: 1149505 - protein, 9 aa, Homo Sapiens
GMEESEHFV

SEQ ID NO: 1149506 - protein, 9 aa, Homo Sapiens
PGTARTCLW

SEQ ID NO: 1149507 - protein, 9 aa, Homo Sapiens
VHERFHTGE

SEQ ID NO: 1149508 - protein, 9 aa, Homo Sapiens
ICPRLGASA

SEQ ID NO: 1149509 - protein, 9 aa, Homo Sapiens
DTQVKEIHA

SEQ ID NO: 1149510 - protein, 9 aa, Homo Sapiens
THLIVQHLT

SEQ ID NO: 1149511 - protein, 9 aa, Homo Sapiens
LEDPAGSPP

SEQ ID NO: 1149512 - protein, 9 aa, Homo Sapiens
WVSRWVIRP

SEQ ID NO: 1149513 - protein, 9 aa, Homo Sapiens
HAHQLHASP

SEQ ID NO: 1149514 - protein, 9 aa, Homo Sapiens
AGILPSSRG

SEQ ID NO: 1149515 - protein, 9 aa, Homo Sapiens
PMHVVTCLT

SEQ ID NO: 1149516 - protein, 9 aa, Homo Sapiens
EVLIPPLRP

SEQ ID NO: 1149517 - protein, 9 aa, Homo Sapiens
VSARGPVRL

SEQ ID NO: 1149518 - protein, 9 aa, Homo Sapiens
HSRKVDVQT

SEQ ID NO: 1149519 - protein, 9 aa, Homo Sapiens
QGSHPWFLG

SEQ ID NO: 1149520 - protein, 9 aa, Homo Sapiens
TMLELLNHL

SEQ ID NO: 1149521 - protein, 9 aa, Homo Sapiens
FALPLGRPR

SEQ ID NO: 1149522 - protein, 9 aa, Homo Sapiens
DIPASHSDV

SEQ ID NO: 1149523 - protein, 9 aa, Homo Sapiens
FLGADLPNI

SEQ ID NO: 1149524 - protein, 9 aa, Homo Sapiens
TIDTSCKKR

SEQ ID NO: 1149525 - protein, 9 aa, Homo Sapiens
PCPSVCAHA

SEQ ID NO: 1149526 - protein, 9 aa, Homo Sapiens
IFFGDIHFG

SEQ ID NO: 1149527 - protein, 9 aa, Homo Sapiens
NDTITESSL

SEQ ID NO: 1149528 - protein, 9 aa, Homo Sapiens
KISDNRFEA

SEQ ID NO: 1149529 - protein, 9 aa, Homo Sapiens
RFMAQFHEK

SEQ ID NO: 1149530 - protein, 9 aa, Homo Sapiens
SLLLLKKKE

SEQ ID NO: 1149531 - protein, 9 aa, Homo Sapiens
RAHERPHPI

SEQ ID NO: 1149532 - protein, 9 aa, Homo Sapiens
CAICRGFTF

SEQ ID NO: 1149533 - protein, 9 aa, Homo Sapiens
QRRLQEFLA

SEQ ID NO: 1149534 - protein, 9 aa, Homo Sapiens
VCQDIPASH

SEQ ID NO: 1149535 - protein, 9 aa, Homo Sapiens
WQARVETIS

SEQ ID NO: 1149536 - protein, 9 aa, Homo Sapiens
EPSVQTHIK

SEQ ID NO: 1149537 - protein, 9 aa, Homo Sapiens
PVLGPHPSP

SEQ ID NO: 1149538 - protein, 9 aa, Homo Sapiens
TETIGIISK

SEQ ID NO: 1149539 - protein, 9 aa, Homo Sapiens
DNPTPQLVM

SEQ ID NO: 1149540 - protein, 9 aa, Homo Sapiens
YPPMNFAAT

SEQ ID NO: 1149541 - protein, 9 aa, Homo Sapiens
PSVCAHAHS

SEQ ID NO: 1149542 - protein, 9 aa, Homo Sapiens
SQTGSPRSS

SEQ ID NO: 1149543 - protein, 9 aa, Homo Sapiens
LQRSGSLLC

SEQ ID NO: 1149544 - protein, 9 aa, Homo Sapiens
ITIGEIAQG

SEQ ID NO: 1149545 - protein, 9 aa, Homo Sapiens
ERVLHSLNP

SEQ ID NO: 1149546 - protein, 9 aa, Homo Sapiens
ILVIKNIIP

SEQ ID NO: 1149547 - protein, 9 aa, Homo Sapiens
PPTTTTSSP

SEQ ID NO: 1149548 - protein, 9 aa, Homo Sapiens
LQHYLQLIQ

SEQ ID NO: 1149549 - protein, 9 aa, Homo Sapiens
HERFHTGEK

SEQ ID NO: 1149550 - protein, 9 aa, Homo Sapiens
LERIGGPPS

SEQ ID NO: 1149551 - protein, 9 aa, Homo Sapiens
QIEKEHLQV

SEQ ID NO: 1149552 - protein, 9 aa, Homo Sapiens
PQGRAPLEG

SEQ ID NO: 1149553 - protein, 9 aa, Homo Sapiens
PLKHPRVAV

SEQ ID NO: 1149554 - protein, 9 aa, Homo Sapiens
PNHHDQELI

SEQ ID NO: 1149555 - protein, 9 aa, Homo Sapiens
VGGASGRKN

SEQ ID NO: 1149556 - protein, 9 aa, Homo Sapiens
LESGCGHGA

SEQ ID NO: 1149557 - protein, 9 aa, Homo Sapiens
PPLWGRLRS

SEQ ID NO: 1149558 - protein, 9 aa, Homo Sapiens
SCRSPRSTW

SEQ ID NO: 1149559 - protein, 9 aa, Homo Sapiens
DNAEDSPDQ

SEQ ID NO: 1149560 - protein, 9 aa, Homo Sapiens
DVGLLEGSA

SEQ ID NO: 1149561 - protein, 9 aa, Homo Sapiens
TLNQLRMPP

SEQ ID NO: 1149562 - protein, 9 aa, Homo Sapiens
PARYRKPLE

SEQ ID NO: 1149563 - protein, 9 aa, Homo Sapiens
ATSSHAERA

SEQ ID NO: 1149564 - protein, 9 aa, Homo Sapiens
RKWWPTQSS

SEQ ID NO: 1149565 - protein, 9 aa, Homo Sapiens
PKRMSCKQA

SEQ ID NO: 1149566 - protein, 9 aa, Homo Sapiens
GPPRHPRHP

SEQ ID NO: 1149567 - protein, 9 aa, Homo Sapiens
NPAGHGKEE

SEQ ID NO: 1149568 - protein, 9 aa, Homo Sapiens
AINLNLRAG

SEQ ID NO: 1149569 - protein, 9 aa, Homo Sapiens
ARAPGVAES

SEQ ID NO: 1149570 - protein, 9 aa, Homo Sapiens
VSGTVPVVR

SEQ ID NO: 1149571 - protein, 9 aa, Homo Sapiens
TLSPPDASP

SEQ ID NO: 1149572 - protein, 9 aa, Homo Sapiens
SSDLGSRSR

SEQ ID NO: 1149573 - protein, 9 aa, Homo Sapiens
QGTLSLQRL

SEQ ID NO: 1149574 - protein, 9 aa, Homo Sapiens
HFFLSQLSF

SEQ ID NO: 1149575 - protein, 9 aa, Homo Sapiens
GGSAHTSRS

SEQ ID NO: 1149576 - protein, 9 aa, Homo Sapiens
TWGPRTPRG

SEQ ID NO: 1149577 - protein, 9 aa, Homo Sapiens
HPQMVFTVR

SEQ ID NO: 1149578 - protein, 9 aa, Homo Sapiens
AVIPLKHPR

SEQ ID NO: 1149579 - protein, 9 aa, Homo Sapiens
TSRDSRSFF

SEQ ID NO: 1149580 - protein, 9 aa, Homo Sapiens
SRLPADTAD

SEQ ID NO: 1149581 - protein, 9 aa, Homo Sapiens
CLCVPCPGG

SEQ ID NO: 1149582 - protein, 9 aa, Homo Sapiens
DPEGCDKVM

SEQ ID NO: 1149583 - protein, 9 aa, Homo Sapiens
ARGRTGAVT

SEQ ID NO: 1149584 - protein, 9 aa, Homo Sapiens
RGLLREAEW

SEQ ID NO: 1149585 - protein, 9 aa, Homo Sapiens
EKEHLQVEK

SEQ ID NO: 1149586 - protein, 9 aa, Homo Sapiens
IFWLIPPML

SEQ ID NO: 1149587 - protein, 9 aa, Homo Sapiens
TFYNELCVA

SEQ ID NO: 1149588 - protein, 9 aa, Homo Sapiens
RNLPHSNDA

SEQ ID NO: 1149589 - protein, 9 aa, Homo Sapiens
IIFIGHPPS

SEQ ID NO: 1149590 - protein, 9 aa, Homo Sapiens
FRLYSRAVL

SEQ ID NO: 1149591 - protein, 9 aa, Homo Sapiens
PLAGPALPT

SEQ ID NO: 1149592 - protein, 9 aa, Homo Sapiens
GMLSPGAWN

SEQ ID NO: 1149593 - protein, 9 aa, Homo Sapiens
TLRRKWWPT

SEQ ID NO: 1149594 - protein, 9 aa, Homo Sapiens
ESGHYTRFI

SEQ ID NO: 1149595 - protein, 9 aa, Homo Sapiens
KAIYEHLFC

SEQ ID NO: 1149596 - protein, 9 aa, Homo Sapiens
PNTTVVFHL

SEQ ID NO: 1149597 - protein, 9 aa, Homo Sapiens
EELTNDILV

SEQ ID NO: 1149598 - protein, 9 aa, Homo Sapiens
GADPGERVL

SEQ ID NO: 1149599 - protein, 9 aa, Homo Sapiens
RRLLRRPPG

SEQ ID NO: 1149600 - protein, 9 aa, Homo Sapiens
NIWPSKGVK

SEQ ID NO: 1149601 - protein, 9 aa, Homo Sapiens
ITRHDDPES

SEQ ID NO: 1149602 - protein, 9 aa, Homo Sapiens
LCVAPEEHP

SEQ ID NO: 1149603 - protein, 9 aa, Homo Sapiens
HVSSKSTPE

SEQ ID NO: 1149604 - protein, 9 aa, Homo Sapiens
NHGNPSGVD

SEQ ID NO: 1149605 - protein, 9 aa, Homo Sapiens
FSSDLGSRS

SEQ ID NO: 1149606 - protein, 9 aa, Homo Sapiens
KRKVGGASG

SEQ ID NO: 1149607 - protein, 9 aa, Homo Sapiens
RSIEGQYDT

SEQ ID NO: 1149608 - protein, 9 aa, Homo Sapiens
APVRAWRTS

SEQ ID NO: 1149609 - protein, 9 aa, Homo Sapiens
AAVLVHLID

SEQ ID NO: 1149610 - protein, 9 aa, Homo Sapiens
THVLAAGNA

SEQ ID NO: 1149611 - protein, 9 aa, Homo Sapiens
SSAQAYQAA

SEQ ID NO: 1149612 - protein, 9 aa, Homo Sapiens
PPQQPRMAC

SEQ ID NO: 1149613 - protein, 9 aa, Homo Sapiens
ASAGPQPCN

SEQ ID NO: 1149614 - protein, 9 aa, Homo Sapiens
ALRNCVSAV

SEQ ID NO: 1149615 - protein, 9 aa, Homo Sapiens
LWSVHGQRR

SEQ ID NO: 1149616 - protein, 9 aa, Homo Sapiens
NGVLETHFL

SEQ ID NO: 1149617 - protein, 9 aa, Homo Sapiens
RVHEDGDSP

SEQ ID NO: 1149618 - protein, 9 aa, Homo Sapiens
SVPAGILPS

SEQ ID NO: 1149619 - protein, 9 aa, Homo Sapiens
FPEVALSLT

SEQ ID NO: 1149620 - protein, 9 aa, Homo Sapiens
SHSDVGLLE

SEQ ID NO: 1149621 - protein, 9 aa, Homo Sapiens
DLIEKLVAS

SEQ ID NO: 1149622 - protein, 9 aa, Homo Sapiens
TVPCSALGT

SEQ ID NO: 1149623 - protein, 9 aa, Homo Sapiens
LSATTSSSG

SEQ ID NO: 1149624 - protein, 9 aa, Homo Sapiens
ACARGPRAP

SEQ ID NO: 1149625 - protein, 9 aa, Homo Sapiens
PTTTTSSPR

SEQ ID NO: 1149626 - protein, 9 aa, Homo Sapiens
KSWVISELQ

SEQ ID NO: 1149627 - protein, 9 aa, Homo Sapiens
EGSGKYNFT

SEQ ID NO: 1149628 - protein, 9 aa, Homo Sapiens
VAGAQDYDR

SEQ ID NO: 1149629 - protein, 9 aa, Homo Sapiens
YVILEEGGS

SEQ ID NO: 1149630 - protein, 9 aa, Homo Sapiens
PPIGPPFEM

SEQ ID NO: 1149631 - protein, 9 aa, Homo Sapiens
YSSVFGVMQ

SEQ ID NO: 1149632 - protein, 9 aa, Homo Sapiens
QYPKKLNHT

SEQ ID NO: 1149633 - protein, 9 aa, Homo Sapiens
PCTTIKAKQ

SEQ ID NO: 1149634 - protein, 9 aa, Homo Sapiens
CTWTVRMGR

SEQ ID NO: 1149635 - protein, 9 aa, Homo Sapiens
ESPTLRGLL

SEQ ID NO: 1149636 - protein, 9 aa, Homo Sapiens
RPPRQTPRH

SEQ ID NO: 1149637 - protein, 9 aa, Homo Sapiens
ALCSSHRPV

SEQ ID NO: 1149638 - protein, 9 aa, Homo Sapiens
RERRVKLPI

SEQ ID NO: 1149639 - protein, 9 aa, Homo Sapiens
KWNSEGFFN

SEQ ID NO: 1149640 - protein, 9 aa, Homo Sapiens
SPLQRSGSL

SEQ ID NO: 1149641 - protein, 9 aa, Homo Sapiens
ESGQWLGRV

SEQ ID NO: 1149642 - protein, 9 aa, Homo Sapiens
ENQEMFADT

SEQ ID NO: 1149643 - protein, 9 aa, Homo Sapiens
RTNGMKMNM

SEQ ID NO: 1149644 - protein, 9 aa, Homo Sapiens
SRSRPHSGS

SEQ ID NO: 1149645 - protein, 9 aa, Homo Sapiens
TRPAALGTC

SEQ ID NO: 1149646 - protein, 9 aa, Homo Sapiens
LSSLESGCG

SEQ ID NO: 1149647 - protein, 9 aa, Homo Sapiens
GKMKGRKDR

SEQ ID NO: 1149648 - protein, 9 aa, Homo Sapiens
FVRRPTVVQ

SEQ ID NO: 1149649 - protein, 9 aa, Homo Sapiens
NIPGIRGAL

SEQ ID NO: 1149650 - protein, 9 aa, Homo Sapiens
CKLQADGNG

SEQ ID NO: 1149651 - protein, 9 aa, Homo Sapiens
RIHKLPLSL

SEQ ID NO: 1149652 - protein, 9 aa, Homo Sapiens
DNVPVFPMA

SEQ ID NO: 1149653 - protein, 9 aa, Homo Sapiens
IMGEAFASD

SEQ ID NO: 1149654 - protein, 9 aa, Homo Sapiens
NEKIKSCVP

SEQ ID NO: 1149655 - protein, 9 aa, Homo Sapiens
VVLRRYRLR

SEQ ID NO: 1149656 - protein, 9 aa, Homo Sapiens
PLSFFLNVG

SEQ ID NO: 1149657 - protein, 9 aa, Homo Sapiens
MLHNLALYE

SEQ ID NO: 1149658 - protein, 9 aa, Homo Sapiens
DVAQIVEIL

SEQ ID NO: 1149659 - protein, 9 aa, Homo Sapiens
GSPGLATQR

SEQ ID NO: 1149660 - protein, 9 aa, Homo Sapiens
GPKSRAAPS

SEQ ID NO: 1149661 - protein, 9 aa, Homo Sapiens
LSVPAGILP

SEQ ID NO: 1149662 - protein, 9 aa, Homo Sapiens
LLDNAEDSP

SEQ ID NO: 1149663 - protein, 9 aa, Homo Sapiens
NAAKIIHHP

SEQ ID NO: 1149664 - protein, 9 aa, Homo Sapiens
LPEMVKNRS

SEQ ID NO: 1149665 - protein, 9 aa, Homo Sapiens
VSSIDRRGS

SEQ ID NO: 1149666 - protein, 9 aa, Homo Sapiens
HEVGKVIGI

SEQ ID NO: 1149667 - protein, 9 aa, Homo Sapiens
STRPAALGT

SEQ ID NO: 1149668 - protein, 9 aa, Homo Sapiens
DVVLRDGLA

SEQ ID NO: 1149669 - protein, 9 aa, Homo Sapiens
IFFFHLNLL

SEQ ID NO: 1149670 - protein, 9 aa, Homo Sapiens
SVGLQGKLG

SEQ ID NO: 1149671 - protein, 9 aa, Homo Sapiens
LSPWDLGTA

SEQ ID NO: 1149672 - protein, 9 aa, Homo Sapiens
HGAGVPHLV

SEQ ID NO: 1149673 - protein, 9 aa, Homo Sapiens
CHASCHSHL

SEQ ID NO: 1149674 - protein, 9 aa, Homo Sapiens
AGRTIKLWG

SEQ ID NO: 1149675 - protein, 9 aa, Homo Sapiens
EGCESVMGM

SEQ ID NO: 1149676 - protein, 9 aa, Homo Sapiens
HHAAPRVHI

SEQ ID NO: 1149677 - protein, 9 aa, Homo Sapiens
RGFTFQCAI

SEQ ID NO: 1149678 - protein, 9 aa, Homo Sapiens
QTPPRDANL

SEQ ID NO: 1149679 - protein, 9 aa, Homo Sapiens
GGDNPNVES

SEQ ID NO: 1149680 - protein, 9 aa, Homo Sapiens
TLTRLLAAC

SEQ ID NO: 1149681 - protein, 9 aa, Homo Sapiens
FGVMQLLCL

SEQ ID NO: 1149682 - protein, 9 aa, Homo Sapiens
PPMNFAATR

SEQ ID NO: 1149683 - protein, 9 aa, Homo Sapiens
QDPEDGDAT

SEQ ID NO: 1149684 - protein, 9 aa, Homo Sapiens
PASLLPVLA

SEQ ID NO: 1149685 - protein, 9 aa, Homo Sapiens
CYQLPQLQG

SEQ ID NO: 1149686 - protein, 9 aa, Homo Sapiens
PLQSLHHPP

SEQ ID NO: 1149687 - protein, 9 aa, Homo Sapiens
ASKELPGKP

SEQ ID NO: 1149688 - protein, 9 aa, Homo Sapiens
LCLSALDKT

SEQ ID NO: 1149689 - protein, 9 aa, Homo Sapiens
ELPGKPWTS

SEQ ID NO: 1149690 - protein, 9 aa, Homo Sapiens
SKKPPQSKR

SEQ ID NO: 1149691 - protein, 9 aa, Homo Sapiens
PYTLTPSTT

SEQ ID NO: 1149692 - protein, 9 aa, Homo Sapiens
CCPPARPDQ

SEQ ID NO: 1149693 - protein, 9 aa, Homo Sapiens
HRAVRPLRR

SEQ ID NO: 1149694 - protein, 9 aa, Homo Sapiens
YYQEAVRLN

SEQ ID NO: 1149695 - protein, 9 aa, Homo Sapiens
LALQAGPPG

SEQ ID NO: 1149696 - protein, 9 aa, Homo Sapiens
TIPAGTPWM

SEQ ID NO: 1149697 - protein, 9 aa, Homo Sapiens
PPLTPDVAG

SEQ ID NO: 1149698 - protein, 9 aa, Homo Sapiens
LVSGGELLL

SEQ ID NO: 1149699 - protein, 9 aa, Homo Sapiens
PEDPGTLET

SEQ ID NO: 1149700 - protein, 9 aa, Homo Sapiens
GAGPGAPGG

SEQ ID NO: 1149701 - protein, 9 aa, Homo Sapiens
KLGFPKRFI

SEQ ID NO: 1149702 - protein, 9 aa, Homo Sapiens
YNVDHQNKA

SEQ ID NO: 1149703 - protein, 9 aa, Homo Sapiens
HPGTHGPSA

SEQ ID NO: 1149704 - protein, 9 aa, Homo Sapiens
ILNLQVLKK

SEQ ID NO: 1149705 - protein, 9 aa, Homo Sapiens
GVGWATGVA

SEQ ID NO: 1149706 - protein, 9 aa, Homo Sapiens
PLARPGAVE

SEQ ID NO: 1149707 - protein, 9 aa, Homo Sapiens
CISSGCHAS

SEQ ID NO: 1149708 - protein, 9 aa, Homo Sapiens
GKENSKPQQ

SEQ ID NO: 1149709 - protein, 9 aa, Homo Sapiens
VSRFPELTS

SEQ ID NO: 1149710 - protein, 9 aa, Homo Sapiens
GGAGPVSHS

SEQ ID NO: 1149711 - protein, 9 aa, Homo Sapiens
VFTFIVSAV

SEQ ID NO: 1149712 - protein, 9 aa, Homo Sapiens
RELRPRLSD

SEQ ID NO: 1149713 - protein, 9 aa, Homo Sapiens
VIKNIIPTK

SEQ ID NO: 1149714 - protein, 9 aa, Homo Sapiens
CGACPGQRV

SEQ ID NO: 1149715 - protein, 9 aa, Homo Sapiens
SCAPFSSDL

SEQ ID NO: 1149716 - protein, 9 aa, Homo Sapiens
STVKSHTRG

SEQ ID NO: 1149717 - protein, 9 aa, Homo Sapiens
GLAFKVNFT

SEQ ID NO: 1149718 - protein, 9 aa, Homo Sapiens
RGGGALLCL

SEQ ID NO: 1149719 - protein, 9 aa, Homo Sapiens
LQCNKHSFS

SEQ ID NO: 1149720 - protein, 9 aa, Homo Sapiens
APTPLQPLR

SEQ ID NO: 1149721 - protein, 9 aa, Homo Sapiens
TPKAAAPST

SEQ ID NO: 1149722 - protein, 9 aa, Homo Sapiens
LVLQLRAPG

SEQ ID NO: 1149723 - protein, 9 aa, Homo Sapiens
ACSAGGDAS

SEQ ID NO: 1149724 - protein, 9 aa, Homo Sapiens
HSKEGRKRA

SEQ ID NO: 1149725 - protein, 9 aa, Homo Sapiens
TAEIEDTIA

SEQ ID NO: 1149726 - protein, 9 aa, Homo Sapiens
GPCPSVCAH

SEQ ID NO: 1149727 - protein, 9 aa, Homo Sapiens
THCKAQRNL

SEQ ID NO: 1149728 - protein, 9 aa, Homo Sapiens
RITFQQHRR

SEQ ID NO: 1149729 - protein, 9 aa, Homo Sapiens
ELLDVVLRD

SEQ ID NO: 1149730 - protein, 9 aa, Homo Sapiens
RTLATRIHK

SEQ ID NO: 1149731 - protein, 9 aa, Homo Sapiens
GDPRGVGVG

SEQ ID NO: 1149732 - protein, 9 aa, Homo Sapiens
EAHQEKHLP

SEQ ID NO: 1149733 - protein, 9 aa, Homo Sapiens
LGEPHHAHQ

SEQ ID NO: 1149734 - protein, 9 aa, Homo Sapiens
GEPRELPII

SEQ ID NO: 1149735 - protein, 9 aa, Homo Sapiens
PPKMPPPRS

SEQ ID NO: 1149736 - protein, 9 aa, Homo Sapiens
GCTQTMVMG

SEQ ID NO: 1149737 - protein, 9 aa, Homo Sapiens
PRIQIGQEM

SEQ ID NO: 1149738 - protein, 9 aa, Homo Sapiens
LERRSPQAH

SEQ ID NO: 1149739 - protein, 9 aa, Homo Sapiens
DKRCCLDSL

SEQ ID NO: 1149740 - protein, 9 aa, Homo Sapiens
NLNKPLESK

SEQ ID NO: 1149741 - protein, 9 aa, Homo Sapiens
KTMNLNKPL

SEQ ID NO: 1149742 - protein, 9 aa, Homo Sapiens
QSDCPVIVS

SEQ ID NO: 1149743 - protein, 9 aa, Homo Sapiens
LPNITPLSV

SEQ ID NO: 1149744 - protein, 9 aa, Homo Sapiens
HMQPIPAYW

SEQ ID NO: 1149745 - protein, 9 aa, Homo Sapiens
PVDNPGLGP

SEQ ID NO: 1149746 - protein, 9 aa, Homo Sapiens
ITLPGGLTL

SEQ ID NO: 1149747 - protein, 9 aa, Homo Sapiens
VPGWCRWKT

SEQ ID NO: 1149748 - protein, 9 aa, Homo Sapiens
VRFYAAAMH

SEQ ID NO: 1149749 - protein, 9 aa, Homo Sapiens
PRTKYIGNT

SEQ ID NO: 1149750 - protein, 9 aa, Homo Sapiens
VPCQQTMSC

SEQ ID NO: 1149751 - protein, 9 aa, Homo Sapiens
RGLVEGYSN

SEQ ID NO: 1149752 - protein, 9 aa, Homo Sapiens
VKKAGREFP

SEQ ID NO: 1149753 - protein, 9 aa, Homo Sapiens
SPSRRPLGV

SEQ ID NO: 1149754 - protein, 9 aa, Homo Sapiens
LGRPRIPLP

SEQ ID NO: 1149755 - protein, 9 aa, Homo Sapiens
ESRFWLALQ

SEQ ID NO: 1149756 - protein, 9 aa, Homo Sapiens
QHSISHTLS

SEQ ID NO: 1149757 - protein, 9 aa, Homo Sapiens
GAHVQAPGR

SEQ ID NO: 1149758 - protein, 9 aa, Homo Sapiens
KKGEEGGRM

SEQ ID NO: 1149759 - protein, 9 aa, Homo Sapiens
SGLEANDEC

SEQ ID NO: 1149760 - protein, 9 aa, Homo Sapiens
GSLKKTSRI

SEQ ID NO: 1149761 - protein, 9 aa, Homo Sapiens
AVPAAACPP

SEQ ID NO: 1149762 - protein, 9 aa, Homo Sapiens
GPPQQEGSN

SEQ ID NO: 1149763 - protein, 9 aa, Homo Sapiens
EFSVIMWSP

SEQ ID NO: 1149764 - protein, 9 aa, Homo Sapiens
LGVSPLAPC

SEQ ID NO: 1149765 - protein, 9 aa, Homo Sapiens
PHPIHIGCT

SEQ ID NO: 1149766 - protein, 9 aa, Homo Sapiens
SALGVGMPS

SEQ ID NO: 1149767 - protein, 9 aa, Homo Sapiens
LDHSRKVDV

SEQ ID NO: 1149768 - protein, 9 aa, Homo Sapiens
TPMAALVDL

SEQ ID NO: 1149769 - protein, 9 aa, Homo Sapiens
LKREFTTLN

SEQ ID NO: 1149770 - protein, 9 aa, Homo Sapiens
EWMAGGLVA

SEQ ID NO: 1149771 - protein, 9 aa, Homo Sapiens
AAAGAAATP

SEQ ID NO: 1149772 - protein, 9 aa, Homo Sapiens
GPDCEVDSC

SEQ ID NO: 1149773 - protein, 9 aa, Homo Sapiens
WMEGADPGE

SEQ ID NO: 1149774 - protein, 9 aa, Homo Sapiens
RTHRAVRPL

SEQ ID NO: 1149775 - protein, 9 aa, Homo Sapiens
FSDYVEVAG

SEQ ID NO: 1149776 - protein, 9 aa, Homo Sapiens
DEPVTCLNI

SEQ ID NO: 1149777 - protein, 9 aa, Homo Sapiens
SKEGRKRAF

SEQ ID NO: 1149778 - protein, 9 aa, Homo Sapiens
GEEQSRLAA

SEQ ID NO: 1149779 - protein, 9 aa, Homo Sapiens
LEANDECRS

SEQ ID NO: 1149780 - protein, 9 aa, Homo Sapiens
IDNLEKNSG

SEQ ID NO: 1149781 - protein, 9 aa, Homo Sapiens
GEELKPEEI

SEQ ID NO: 1149782 - protein, 9 aa, Homo Sapiens
CPSRNTRSC

SEQ ID NO: 1149783 - protein, 9 aa, Homo Sapiens
SGTVPVVRE

SEQ ID NO: 1149784 - protein, 9 aa, Homo Sapiens
DIVSGPVLG

SEQ ID NO: 1149785 - protein, 9 aa, Homo Sapiens
DVQTTRKIL

SEQ ID NO: 1149786 - protein, 9 aa, Homo Sapiens
SGKYNFTSS

SEQ ID NO: 1149787 - protein, 9 aa, Homo Sapiens
LCPAAKQVS

SEQ ID NO: 1149788 - protein, 9 aa, Homo Sapiens
QRAQLPGQV

SEQ ID NO: 1149789 - protein, 9 aa, Homo Sapiens
LYIDITWRW

SEQ ID NO: 1149790 - protein, 9 aa, Homo Sapiens
KPDPLTHLS

SEQ ID NO: 1149791 - protein, 9 aa, Homo Sapiens
LDRTFRHHE

SEQ ID NO: 1149792 - protein, 9 aa, Homo Sapiens
RSPQAHKLW

SEQ ID NO: 1149793 - protein, 9 aa, Homo Sapiens
TPLQPLRRS

SEQ ID NO: 1149794 - protein, 9 aa, Homo Sapiens
QPGEKKSQA

SEQ ID NO: 1149795 - protein, 9 aa, Homo Sapiens
KLNDIVGSE

SEQ ID NO: 1149796 - protein, 9 aa, Homo Sapiens
IGSLLRGQV

SEQ ID NO: 1149797 - protein, 9 aa, Homo Sapiens
GASAGPQPC

SEQ ID NO: 1149798 - protein, 9 aa, Homo Sapiens
FSVIMWSPN

SEQ ID NO: 1149799 - protein, 9 aa, Homo Sapiens
RGRPRWPSR

SEQ ID NO: 1149800 - protein, 9 aa, Homo Sapiens
RLAGRKMKR

SEQ ID NO: 1149801 - protein, 9 aa, Homo Sapiens
NPTQPSGPQ

SEQ ID NO: 1149802 - protein, 9 aa, Homo Sapiens
AWPPPWLSP

SEQ ID NO: 1149803 - protein, 9 aa, Homo Sapiens
KLVTKHVPG

SEQ ID NO: 1149804 - protein, 9 aa, Homo Sapiens
GKATGVSGL

SEQ ID NO: 1149805 - protein, 9 aa, Homo Sapiens
MANKALLAL

SEQ ID NO: 1149806 - protein, 9 aa, Homo Sapiens
QLDLEHELL

SEQ ID NO: 1149807 - protein, 9 aa, Homo Sapiens
ISDNRFEAH

SEQ ID NO: 1149808 - protein, 9 aa, Homo Sapiens
LAGEEASAK

SEQ ID NO: 1149809 - protein, 9 aa, Homo Sapiens
TTLFHPMPV

SEQ ID NO: 1149810 - protein, 9 aa, Homo Sapiens
GTTPPASTT

SEQ ID NO: 1149811 - protein, 9 aa, Homo Sapiens
EECMSMVWE

SEQ ID NO: 1149812 - protein, 9 aa, Homo Sapiens
SGVAIGEAP

SEQ ID NO: 1149813 - protein, 9 aa, Homo Sapiens
TSRPEGARC

SEQ ID NO: 1149814 - protein, 9 aa, Homo Sapiens
IGQEMVITV

SEQ ID NO: 1149815 - protein, 9 aa, Homo Sapiens
NGGKQHPHP

SEQ ID NO: 1149816 - protein, 9 aa, Homo Sapiens
TSLSEKTTP

SEQ ID NO: 1149817 - protein, 9 aa, Homo Sapiens
SQGACRRED

SEQ ID NO: 1149818 - protein, 9 aa, Homo Sapiens
AQALPSPWE

SEQ ID NO: 1149819 - protein, 9 aa, Homo Sapiens
IFLFTDARV

SEQ ID NO: 1149820 - protein, 9 aa, Homo Sapiens
QSRPTCQAR

SEQ ID NO: 1149821 - protein, 9 aa, Homo Sapiens
CTSVPSTTR

SEQ ID NO: 1149822 - protein, 9 aa, Homo Sapiens
EMVKNRSKK

SEQ ID NO: 1149823 - protein, 9 aa, Homo Sapiens
WTAATLRCP

SEQ ID NO: 1149824 - protein, 9 aa, Homo Sapiens
PVSHSAEEQ

SEQ ID NO: 1149825 - protein, 9 aa, Homo Sapiens
ETKFAQALP

SEQ ID NO: 1149826 - protein, 9 aa, Homo Sapiens
AIQTSAGVT

SEQ ID NO: 1149827 - protein, 9 aa, Homo Sapiens
ASASTSLSE

SEQ ID NO: 1149828 - protein, 9 aa, Homo Sapiens
QEGIIFIGH

SEQ ID NO: 1149829 - protein, 9 aa, Homo Sapiens
THSPPLTPD

SEQ ID NO: 1149830 - protein, 9 aa, Homo Sapiens
GANQVGSEA

SEQ ID NO: 1149831 - protein, 9 aa, Homo Sapiens
ELMHLDVSQ

SEQ ID NO: 1149832 - protein, 9 aa, Homo Sapiens
CGFTQDRGL

SEQ ID NO: 1149833 - protein, 9 aa, Homo Sapiens
ATHCKAQRN

SEQ ID NO: 1149834 - protein, 9 aa, Homo Sapiens
MSVNEGSFP

SEQ ID NO: 1149835 - protein, 9 aa, Homo Sapiens
WTSTSIFRR

SEQ ID NO: 1149836 - protein, 9 aa, Homo Sapiens
VDVDGHVQQ

SEQ ID NO: 1149837 - protein, 9 aa, Homo Sapiens
SIVSSSKGG

SEQ ID NO: 1149838 - protein, 9 aa, Homo Sapiens
YASIVSSSK

SEQ ID NO: 1149839 - protein, 9 aa, Homo Sapiens
CLSRPGWAA

SEQ ID NO: 1149840 - protein, 9 aa, Homo Sapiens
ILFTLIPLL

SEQ ID NO: 1149841 - protein, 9 aa, Homo Sapiens
YMAPERITP

SEQ ID NO: 1149842 - protein, 9 aa, Homo Sapiens
PDEPIHDPP

SEQ ID NO: 1149843 - protein, 9 aa, Homo Sapiens
VLHAPNHHD

SEQ ID NO: 1149844 - protein, 9 aa, Homo Sapiens
GLQALGSRS

SEQ ID NO: 1149845 - protein, 9 aa, Homo Sapiens
QNTLWQARV

SEQ ID NO: 1149846 - protein, 9 aa, Homo Sapiens
LHRLTVGKS

SEQ ID NO: 1149847 - protein, 9 aa, Homo Sapiens
GLTVPTAPP

SEQ ID NO: 1149848 - protein, 9 aa, Homo Sapiens
IATHCKAQR

SEQ ID NO: 1149849 - protein, 9 aa, Homo Sapiens
SDHHDCMSL

SEQ ID NO: 1149850 - protein, 9 aa, Homo Sapiens
RTDSVANKL

SEQ ID NO: 1149851 - protein, 9 aa, Homo Sapiens
PPTFCTWTV

SEQ ID NO: 1149852 - protein, 9 aa, Homo Sapiens
KIVIPDEES

SEQ ID NO: 1149853 - protein, 9 aa, Homo Sapiens
SQLPASSPT

SEQ ID NO: 1149854 - protein, 9 aa, Homo Sapiens
TETVEEQLL

SEQ ID NO: 1149855 - protein, 9 aa, Homo Sapiens
QRTVKKAGR

SEQ ID NO: 1149856 - protein, 9 aa, Homo Sapiens
HASSGPCPS

SEQ ID NO: 1149857 - protein, 9 aa, Homo Sapiens
GEIADPFKL

SEQ ID NO: 1149858 - protein, 9 aa, Homo Sapiens
SWISDGKKQ

SEQ ID NO: 1149859 - protein, 9 aa, Homo Sapiens
LNYASRGQN

SEQ ID NO: 1149860 - protein, 9 aa, Homo Sapiens
DPPRSCRQT

SEQ ID NO: 1149861 - protein, 9 aa, Homo Sapiens
PPLIPLLGD

SEQ ID NO: 1149862 - protein, 9 aa, Homo Sapiens
ATTRRPLPR

SEQ ID NO: 1149863 - protein, 9 aa, Homo Sapiens
TLWQARVET

SEQ ID NO: 1149864 - protein, 9 aa, Homo Sapiens
LGGCPLSLW

SEQ ID NO: 1149865 - protein, 9 aa, Homo Sapiens
LRVPEGPTI

SEQ ID NO: 1149866 - protein, 9 aa, Homo Sapiens
GNLKVHERF

SEQ ID NO: 1149867 - protein, 9 aa, Homo Sapiens
YPAGERVCS

SEQ ID NO: 1149868 - protein, 9 aa, Homo Sapiens
TPQDSRQVL

SEQ ID NO: 1149869 - protein, 9 aa, Homo Sapiens
AGTTPPAST

SEQ ID NO: 1149870 - protein, 9 aa, Homo Sapiens
VSPSNAASL

SEQ ID NO: 1149871 - protein, 9 aa, Homo Sapiens
KPSVMQSFN

SEQ ID NO: 1149872 - protein, 9 aa, Homo Sapiens
HNPRTSTNK

SEQ ID NO: 1149873 - protein, 9 aa, Homo Sapiens
SDLSYGSHV

SEQ ID NO: 1149874 - protein, 9 aa, Homo Sapiens
NGSLWNSSP

SEQ ID NO: 1149875 - protein, 9 aa, Homo Sapiens
KKRSAFPSR

SEQ ID NO: 1149876 - protein, 9 aa, Homo Sapiens
GSRLKILQN

SEQ ID NO: 1149877 - protein, 9 aa, Homo Sapiens
TILAYCSLS

SEQ ID NO: 1149878 - protein, 9 aa, Homo Sapiens
IGEAPDHSY

SEQ ID NO: 1149879 - protein, 9 aa, Homo Sapiens
LGSRSGGRS

SEQ ID NO: 1149880 - protein, 9 aa, Homo Sapiens
EDRRTMRLR

SEQ ID NO: 1149881 - protein, 9 aa, Homo Sapiens
CKQALGTQA

SEQ ID NO: 1149882 - protein, 9 aa, Homo Sapiens
KKIRKTSQV

SEQ ID NO: 1149883 - protein, 9 aa, Homo Sapiens
IGQTLSLEE

SEQ ID NO: 1149884 - protein, 9 aa, Homo Sapiens
RSASSCSSS

SEQ ID NO: 1149885 - protein, 9 aa, Homo Sapiens
STCLTHLAV

SEQ ID NO: 1149886 - protein, 9 aa, Homo Sapiens
YGPASVQAI

SEQ ID NO: 1149887 - protein, 9 aa, Homo Sapiens
ELVSQQYFV

SEQ ID NO: 1149888 - protein, 9 aa, Homo Sapiens
SEELDWHVV

SEQ ID NO: 1149889 - protein, 9 aa, Homo Sapiens
ALGVGMPSA

SEQ ID NO: 1149890 - protein, 9 aa, Homo Sapiens
IGNVQEQHV

SEQ ID NO: 1149891 - protein, 9 aa, Homo Sapiens
HTSRSVLSV

SEQ ID NO: 1149892 - protein, 9 aa, Homo Sapiens
LPAGLRVPE

SEQ ID NO: 1149893 - protein, 9 aa, Homo Sapiens
FPFFFILVP

SEQ ID NO: 1149894 - protein, 9 aa, Homo Sapiens
SSPRTKYIG

SEQ ID NO: 1149895 - protein, 9 aa, Homo Sapiens
ARSHILEHH

SEQ ID NO: 1149896 - protein, 9 aa, Homo Sapiens
EDGDATASP

SEQ ID NO: 1149897 - protein, 9 aa, Homo Sapiens
SRVSVIQAF

SEQ ID NO: 1149898 - protein, 9 aa, Homo Sapiens
VRDPFKRLI

SEQ ID NO: 1149899 - protein, 9 aa, Homo Sapiens
FQTLLNIIK

SEQ ID NO: 1149900 - protein, 9 aa, Homo Sapiens
VRLLLGVCG

SEQ ID NO: 1149901 - protein, 9 aa, Homo Sapiens
VNGIRCVIA

SEQ ID NO: 1149902 - protein, 9 aa, Homo Sapiens
SEFTHIEFP

SEQ ID NO: 1149903 - protein, 9 aa, Homo Sapiens
MGAALGQMC

SEQ ID NO: 1149904 - protein, 9 aa, Homo Sapiens
VTGSVVVSA

SEQ ID NO: 1149905 - protein, 9 aa, Homo Sapiens
YFDPKMLWG

SEQ ID NO: 1149906 - protein, 9 aa, Homo Sapiens
VHEGNRLET

SEQ ID NO: 1149907 - protein, 9 aa, Homo Sapiens
HSDSIASAH

SEQ ID NO: 1149908 - protein, 9 aa, Homo Sapiens
IPEGGDRQP

SEQ ID NO: 1149909 - protein, 9 aa, Homo Sapiens
LQKLDFDTL

SEQ ID NO: 1149910 - protein, 9 aa, Homo Sapiens
FRGSGPGRR

SEQ ID NO: 1149911 - protein, 9 aa, Homo Sapiens
DGWKLHIGN

SEQ ID NO: 1149912 - protein, 9 aa, Homo Sapiens
HRLPAPGCH

SEQ ID NO: 1149913 - protein, 9 aa, Homo Sapiens
RLMEDRNAH

SEQ ID NO: 1149914 - protein, 9 aa, Homo Sapiens
ELPATTAFS

SEQ ID NO: 1149915 - protein, 9 aa, Homo Sapiens
LRATRTGCR

SEQ ID NO: 1149916 - protein, 9 aa, Homo Sapiens
PGRRLCTGE

SEQ ID NO: 1149917 - protein, 9 aa, Homo Sapiens
GRLNSVSRA

SEQ ID NO: 1149918 - protein, 9 aa, Homo Sapiens
LIGQTLSLE

SEQ ID NO: 1149919 - protein, 9 aa, Homo Sapiens
RRSCSGLVR

SEQ ID NO: 1149920 - protein, 9 aa, Homo Sapiens
RPRPRRAWK

SEQ ID NO: 1149921 - protein, 9 aa, Homo Sapiens
SSFLIFFIP

SEQ ID NO: 1149922 - protein, 9 aa, Homo Sapiens
PATTAFSAF

SEQ ID NO: 1149923 - protein, 9 aa, Homo Sapiens
YTGACTHPS

SEQ ID NO: 1149924 - protein, 9 aa, Homo Sapiens
GHGAKRVCC

SEQ ID NO: 1149925 - protein, 9 aa, Homo Sapiens
YSVVGRNGI

SEQ ID NO: 1149926 - protein, 9 aa, Homo Sapiens
VCGEPLQVE

SEQ ID NO: 1149927 - protein, 9 aa, Homo Sapiens
LEATVSSGP

SEQ ID NO: 1149928 - protein, 9 aa, Homo Sapiens
PGFPHSQYP

SEQ ID NO: 1149929 - protein, 9 aa, Homo Sapiens
TNGIEECMS

SEQ ID NO: 1149930 - protein, 9 aa, Homo Sapiens
RLSASRPPL

SEQ ID NO: 1149931 - protein, 9 aa, Homo Sapiens
VSFDLLSLV

SEQ ID NO: 1149932 - protein, 9 aa, Homo Sapiens
LGYLLVPAR

SEQ ID NO: 1149933 - protein, 9 aa, Homo Sapiens
PSGPQGPAT

SEQ ID NO: 1149934 - protein, 9 aa, Homo Sapiens
ASTSLSEKT

SEQ ID NO: 1149935 - protein, 9 aa, Homo Sapiens
EKIKSCVPG

SEQ ID NO: 1149936 - protein, 9 aa, Homo Sapiens
HNGAGWGPE

SEQ ID NO: 1149937 - protein, 9 aa, Homo Sapiens
DRNAHLGEC

SEQ ID NO: 1149938 - protein, 9 aa, Homo Sapiens
LIAVLVCWR

SEQ ID NO: 1149939 - protein, 9 aa, Homo Sapiens
LSQDGWKLH

SEQ ID NO: 1149940 - protein, 9 aa, Homo Sapiens
LGSHPGSCA

SEQ ID NO: 1149941 - protein, 9 aa, Homo Sapiens
ASIHASSGP

SEQ ID NO: 1149942 - protein, 9 aa, Homo Sapiens
IIHHPKYNR

SEQ ID NO: 1149943 - protein, 9 aa, Homo Sapiens
LHELLDVVL

SEQ ID NO: 1149944 - protein, 9 aa, Homo Sapiens
ETIGIISKM

SEQ ID NO: 1149945 - protein, 9 aa, Homo Sapiens
FFYQERANK

SEQ ID NO: 1149946 - protein, 9 aa, Homo Sapiens
QSVHIILSV

SEQ ID NO: 1149947 - protein, 9 aa, Homo Sapiens
SVFPVFVTS

SEQ ID NO: 1149948 - protein, 9 aa, Homo Sapiens
VQYFLIDAL

SEQ ID NO: 1149949 - protein, 9 aa, Homo Sapiens
GGRRARRAR

SEQ ID NO: 1149950 - protein, 9 aa, Homo Sapiens
TAPSLLLLV

SEQ ID NO: 1149951 - protein, 9 aa, Homo Sapiens
SCSSVELTG

SEQ ID NO: 1149952 - protein, 9 aa, Homo Sapiens
MGIYFDENM

SEQ ID NO: 1149953 - protein, 9 aa, Homo Sapiens
YDLLELPSQ

SEQ ID NO: 1149954 - protein, 9 aa, Homo Sapiens
VYNVDHQNK

SEQ ID NO: 1149955 - protein, 9 aa, Homo Sapiens
LWQARVETI

SEQ ID NO: 1149956 - protein, 9 aa, Homo Sapiens
RVSVIQAFL

SEQ ID NO: 1149957 - protein, 9 aa, Homo Sapiens
LGCLLHIAR

SEQ ID NO: 1149958 - protein, 9 aa, Homo Sapiens
TMNDSKHKL

SEQ ID NO: 1149959 - protein, 9 aa, Homo Sapiens
PGGGEGGGV

SEQ ID NO: 1149960 - protein, 9 aa, Homo Sapiens
ASPRRLLRR

SEQ ID NO: 1149961 - protein, 9 aa, Homo Sapiens
TDKFTENVY

SEQ ID NO: 1149962 - protein, 9 aa, Homo Sapiens
DGADLTISN

SEQ ID NO: 1149963 - protein, 9 aa, Homo Sapiens
VSTCLMRPP

SEQ ID NO: 1149964 - protein, 9 aa, Homo Sapiens
HLDAILIMG

SEQ ID NO: 1149965 - protein, 9 aa, Homo Sapiens
PDLYLESDE

SEQ ID NO: 1149966 - protein, 9 aa, Homo Sapiens
GAKSGRHLS

SEQ ID NO: 1149967 - protein, 9 aa, Homo Sapiens
KSHLLEFQT

SEQ ID NO: 1149968 - protein, 9 aa, Homo Sapiens
DEYKRLRAF

SEQ ID NO: 1149969 - protein, 9 aa, Homo Sapiens
GVPIDTIIF

SEQ ID NO: 1149970 - protein, 9 aa, Homo Sapiens
FFHLNLLIT

SEQ ID NO: 1149971 - protein, 9 aa, Homo Sapiens
CSSREVCSS

SEQ ID NO: 1149972 - protein, 9 aa, Homo Sapiens
FLLFFSSVI

SEQ ID NO: 1149973 - protein, 9 aa, Homo Sapiens
SRPTWCTTC

SEQ ID NO: 1149974 - protein, 9 aa, Homo Sapiens
QLIQVDVAI

SEQ ID NO: 1149975 - protein, 9 aa, Homo Sapiens
ASLGTRKGW

SEQ ID NO: 1149976 - protein, 9 aa, Homo Sapiens
PNLEATVSS

SEQ ID NO: 1149977 - protein, 9 aa, Homo Sapiens
GSRATPGVA

SEQ ID NO: 1149978 - protein, 9 aa, Homo Sapiens
LTGCSVEFE

SEQ ID NO: 1149979 - protein, 9 aa, Homo Sapiens
YLAPLPPVT

SEQ ID NO: 1149980 - protein, 9 aa, Homo Sapiens
DAVLKQNSS

SEQ ID NO: 1149981 - protein, 9 aa, Homo Sapiens
GPKEEVVCL

SEQ ID NO: 1149982 - protein, 9 aa, Homo Sapiens
LWWMQGLPR

SEQ ID NO: 1149983 - protein, 9 aa, Homo Sapiens
PNITPLSVA

SEQ ID NO: 1149984 - protein, 9 aa, Homo Sapiens
CLEARIAQL

SEQ ID NO: 1149985 - protein, 9 aa, Homo Sapiens
KLWMIVIIK

SEQ ID NO: 1149986 - protein, 9 aa, Homo Sapiens
TCPTRWAAA

SEQ ID NO: 1149987 - protein, 9 aa, Homo Sapiens
GAPWKGRPL

SEQ ID NO: 1149988 - protein, 9 aa, Homo Sapiens
RRSPQAHKL

SEQ ID NO: 1149989 - protein, 9 aa, Homo Sapiens
PFFFILVPR

SEQ ID NO: 1149990 - protein, 9 aa, Homo Sapiens
AGILICIMK

SEQ ID NO: 1149991 - protein, 9 aa, Homo Sapiens
QKQQVVKFV

SEQ ID NO: 1149992 - protein, 9 aa, Homo Sapiens
PPRLRATRT

SEQ ID NO: 1149993 - protein, 9 aa, Homo Sapiens
VMGSPGPWP

SEQ ID NO: 1149994 - protein, 9 aa, Homo Sapiens
LDTVIGREL

SEQ ID NO: 1149995 - protein, 9 aa, Homo Sapiens
HLVSGGDEV

SEQ ID NO: 1149996 - protein, 9 aa, Homo Sapiens
MSLACLILL

SEQ ID NO: 1149997 - protein, 9 aa, Homo Sapiens
TPTEPPLPT

SEQ ID NO: 1149998 - protein, 9 aa, Homo Sapiens
ESQLVCIGE

SEQ ID NO: 1149999 - protein, 9 aa, Homo Sapiens
ALAITVSYG

SEQ ID NO: 1150000 - protein, 9 aa, Homo Sapiens
SLLLLVFAS

SEQ ID NO: 1150001 - protein, 9 aa, Homo Sapiens
SPMSDLHLT

SEQ ID NO: 1150002 - protein, 9 aa, Homo Sapiens
LVVVGAGDV

SEQ ID NO: 1150003 - protein, 9 aa, Homo Sapiens
PPRPTPART

SEQ ID NO: 1150004 - protein, 9 aa, Homo Sapiens
KKTRTSLHQ

SEQ ID NO: 1150005 - protein, 9 aa, Homo Sapiens
APRPGGFFT

SEQ ID NO: 1150006 - protein, 9 aa, Homo Sapiens
SHSAEEQPV

SEQ ID NO: 1150007 - protein, 9 aa, Homo Sapiens
PADPPGPPG

SEQ ID NO: 1150008 - protein, 9 aa, Homo Sapiens
TPSVGKAMH

SEQ ID NO: 1150009 - protein, 9 aa, Homo Sapiens
TVKSHTRGI

SEQ ID NO: 1150010 - protein, 9 aa, Homo Sapiens
WGRLRSRPP

SEQ ID NO: 1150011 - protein, 9 aa, Homo Sapiens
CVKRRRRRK

SEQ ID NO: 1150012 - protein, 9 aa, Homo Sapiens
TKPGPPVLL

SEQ ID NO: 1150013 - protein, 9 aa, Homo Sapiens
SLNPSTSSP

SEQ ID NO: 1150014 - protein, 9 aa, Homo Sapiens
QDRGLQALG

SEQ ID NO: 1150015 - protein, 9 aa, Homo Sapiens
HAEEVRQLL

SEQ ID NO: 1150016 - protein, 9 aa, Homo Sapiens
SGSFDFLLL

SEQ ID NO: 1150017 - protein, 9 aa, Homo Sapiens
KDDQHTFRD

SEQ ID NO: 1150018 - protein, 9 aa, Homo Sapiens
TTDKKVWLM

SEQ ID NO: 1150019 - protein, 9 aa, Homo Sapiens
VTANRFQSG

SEQ ID NO: 1150020 - protein, 9 aa, Homo Sapiens
GEPGAKSGR

SEQ ID NO: 1150021 - protein, 9 aa, Homo Sapiens
SSLDAQRES

SEQ ID NO: 1150022 - protein, 9 aa, Homo Sapiens
SPQGPLFLL

SEQ ID NO: 1150023 - protein, 9 aa, Homo Sapiens
PPRPARPAA

SEQ ID NO: 1150024 - protein, 9 aa, Homo Sapiens
VSQGPYSSV

SEQ ID NO: 1150025 - protein, 9 aa, Homo Sapiens
TTACEPARA

SEQ ID NO: 1150026 - protein, 9 aa, Homo Sapiens
VHLSYGRVN

SEQ ID NO: 1150027 - protein, 9 aa, Homo Sapiens
NSVSTCLMR

SEQ ID NO: 1150028 - protein, 9 aa, Homo Sapiens
PTRRPSRQW

SEQ ID NO: 1150029 - protein, 9 aa, Homo Sapiens
NSATTTCPT

SEQ ID NO: 1150030 - protein, 9 aa, Homo Sapiens
FQYQALGLV

SEQ ID NO: 1150031 - protein, 9 aa, Homo Sapiens
KEPEDPGTL

SEQ ID NO: 1150032 - protein, 9 aa, Homo Sapiens
VATACCPSR

SEQ ID NO: 1150033 - protein, 9 aa, Homo Sapiens
DENKDGKIN

SEQ ID NO: 1150034 - protein, 9 aa, Homo Sapiens
CCRLLSAIY

SEQ ID NO: 1150035 - protein, 9 aa, Homo Sapiens
NTLMQLNEI

SEQ ID NO: 1150036 - protein, 9 aa, Homo Sapiens
ARYVPLTPW

SEQ ID NO: 1150037 - protein, 9 aa, Homo Sapiens
DPAGSPPGT

SEQ ID NO: 1150038 - protein, 9 aa, Homo Sapiens
ALQRLTWVC

SEQ ID NO: 1150039 - protein, 9 aa, Homo Sapiens
STPLWQTST

SEQ ID NO: 1150040 - protein, 9 aa, Homo Sapiens
LGLVVLPQQ

SEQ ID NO: 1150041 - protein, 9 aa, Homo Sapiens
PAMRSGGDW

SEQ ID NO: 1150042 - protein, 9 aa, Homo Sapiens
TGSPRSSTW

SEQ ID NO: 1150043 - protein, 9 aa, Homo Sapiens
SSCSSSATG

SEQ ID NO: 1150044 - protein, 9 aa, Homo Sapiens
MSCTMASQG

SEQ ID NO: 1150045 - protein, 9 aa, Homo Sapiens
NTGPAAAAT

SEQ ID NO: 1150046 - protein, 9 aa, Homo Sapiens
TQEEPEQLP

SEQ ID NO: 1150047 - protein, 9 aa, Homo Sapiens
LEEGWGVSG

SEQ ID NO: 1150048 - protein, 9 aa, Homo Sapiens
SGKPPAMRS

SEQ ID NO: 1150049 - protein, 9 aa, Homo Sapiens
VGKSHLLEF

SEQ ID NO: 1150050 - protein, 9 aa, Homo Sapiens
EVSGLCRYG

SEQ ID NO: 1150051 - protein, 9 aa, Homo Sapiens
DRSWLPCRG

SEQ ID NO: 1150052 - protein, 9 aa, Homo Sapiens
QTFRERNQG

SEQ ID NO: 1150053 - protein, 9 aa, Homo Sapiens
FFPFFFILV

SEQ ID NO: 1150054 - protein, 9 aa, Homo Sapiens
PTQPSGPQG

SEQ ID NO: 1150055 - protein, 9 aa, Homo Sapiens
AAMNHNSAP

SEQ ID NO: 1150056 - protein, 9 aa, Homo Sapiens
SYPVLAPGE

SEQ ID NO: 1150057 - protein, 9 aa, Homo Sapiens
NLEATVSSG

SEQ ID NO: 1150058 - protein, 9 aa, Homo Sapiens
VPEKREKQA

SEQ ID NO: 1150059 - protein, 9 aa, Homo Sapiens
ASAHVSTSF

SEQ ID NO: 1150060 - protein, 9 aa, Homo Sapiens
GSRRHPQLG

SEQ ID NO: 1150061 - protein, 9 aa, Homo Sapiens
VCGHLKPSG

SEQ ID NO: 1150062 - protein, 9 aa, Homo Sapiens
HHDQELIKV

SEQ ID NO: 1150063 - protein, 9 aa, Homo Sapiens
YLLVPARYR

SEQ ID NO: 1150064 - protein, 9 aa, Homo Sapiens
EETLPPDTC

SEQ ID NO: 1150065 - protein, 9 aa, Homo Sapiens
IQTSAGVTA

SEQ ID NO: 1150066 - protein, 9 aa, Homo Sapiens
SLRAGSLDT

SEQ ID NO: 1150067 - protein, 9 aa, Homo Sapiens
LSEDRRTMR

SEQ ID NO: 1150068 - protein, 9 aa, Homo Sapiens
VSPGGAGPV

SEQ ID NO: 1150069 - protein, 9 aa, Homo Sapiens
CSAQPAIST

SEQ ID NO: 1150070 - protein, 9 aa, Homo Sapiens
ATNPICDMR

SEQ ID NO: 1150071 - protein, 9 aa, Homo Sapiens
GAQEAVQEV

SEQ ID NO: 1150072 - protein, 9 aa, Homo Sapiens
TPPRDANLP

SEQ ID NO: 1150073 - protein, 9 aa, Homo Sapiens
RCTGSPQTP

SEQ ID NO: 1150074 - protein, 9 aa, Homo Sapiens
RPEGARCLC

SEQ ID NO: 1150075 - protein, 9 aa, Homo Sapiens
EAVQEVADG

SEQ ID NO: 1150076 - protein, 9 aa, Homo Sapiens
FYKHCGSRL

SEQ ID NO: 1150077 - protein, 9 aa, Homo Sapiens
VKKGERQNR

SEQ ID NO: 1150078 - protein, 9 aa, Homo Sapiens
HFDKNKFSM

SEQ ID NO: 1150079 - protein, 9 aa, Homo Sapiens
DAAILSAQH

SEQ ID NO: 1150080 - protein, 9 aa, Homo Sapiens
LLFPASGEM

SEQ ID NO: 1150081 - protein, 9 aa, Homo Sapiens
SYLGSAVSL

SEQ ID NO: 1150082 - protein, 9 aa, Homo Sapiens
IFLQWRDPT

SEQ ID NO: 1150083 - protein, 9 aa, Homo Sapiens
HTHARTAIP

SEQ ID NO: 1150084 - protein, 9 aa, Homo Sapiens
EGCSRSSPP

SEQ ID NO: 1150085 - protein, 9 aa, Homo Sapiens
LDSQIQDAP

SEQ ID NO: 1150086 - protein, 9 aa, Homo Sapiens
VGLQGKLGP

SEQ ID NO: 1150087 - protein, 9 aa, Homo Sapiens
CGHGAKRVC

SEQ ID NO: 1150088 - protein, 9 aa, Homo Sapiens
ETRMSCTVN

SEQ ID NO: 1150089 - protein, 9 aa, Homo Sapiens
EDQVLHRLT

SEQ ID NO: 1150090 - protein, 9 aa, Homo Sapiens
SCRQTPPGS

SEQ ID NO: 1150091 - protein, 9 aa, Homo Sapiens
RNQGSNMFN

SEQ ID NO: 1150092 - protein, 9 aa, Homo Sapiens
RGLGEPHHA

SEQ ID NO: 1150093 - protein, 9 aa, Homo Sapiens
TPKKAEHLD

SEQ ID NO: 1150094 - protein, 9 aa, Homo Sapiens
LWVAKSTPA

SEQ ID NO: 1150095 - protein, 9 aa, Homo Sapiens
STNKELYRV

SEQ ID NO: 1150096 - protein, 9 aa, Homo Sapiens
LLHHQPTSP

SEQ ID NO: 1150097 - protein, 9 aa, Homo Sapiens
CTHPGLLQF

SEQ ID NO: 1150098 - protein, 9 aa, Homo Sapiens
MFGLFSLWR

SEQ ID NO: 1150099 - protein, 9 aa, Homo Sapiens
AQIQRPIQV

SEQ ID NO: 1150100 - protein, 9 aa, Homo Sapiens
TCASAATTC

SEQ ID NO: 1150101 - protein, 9 aa, Homo Sapiens
RFLTLASAH

SEQ ID NO: 1150102 - protein, 9 aa, Homo Sapiens
LIPLLLIVI

SEQ ID NO: 1150103 - protein, 9 aa, Homo Sapiens
RHFDLRFVV

SEQ ID NO: 1150104 - protein, 9 aa, Homo Sapiens
DRSTYRLSI

SEQ ID NO: 1150105 - protein, 9 aa, Homo Sapiens
FVFFFMCCT

SEQ ID NO: 1150106 - protein, 9 aa, Homo Sapiens
GFRDRTCTC

SEQ ID NO: 1150107 - protein, 9 aa, Homo Sapiens
SGISGRRSA

SEQ ID NO: 1150108 - protein, 9 aa, Homo Sapiens
DETTEPPPV

SEQ ID NO: 1150109 - protein, 9 aa, Homo Sapiens
STSCSTMSC

SEQ ID NO: 1150110 - protein, 9 aa, Homo Sapiens
KTRTSLHQA

SEQ ID NO: 1150111 - protein, 9 aa, Homo Sapiens
QIRKLKSIL

SEQ ID NO: 1150112 - protein, 9 aa, Homo Sapiens
RVSPEVQDV

SEQ ID NO: 1150113 - protein, 9 aa, Homo Sapiens
PTCQARPAS

SEQ ID NO: 1150114 - protein, 9 aa, Homo Sapiens
EKVATSEAL

SEQ ID NO: 1150115 - protein, 9 aa, Homo Sapiens
RIVHRDLAA

SEQ ID NO: 1150116 - protein, 9 aa, Homo Sapiens
KDESVTASF

SEQ ID NO: 1150117 - protein, 9 aa, Homo Sapiens
RRSLPIQPP

SEQ ID NO: 1150118 - protein, 9 aa, Homo Sapiens
CFSAYKRET

SEQ ID NO: 1150119 - protein, 9 aa, Homo Sapiens
HPGEALRLL

SEQ ID NO: 1150120 - protein, 9 aa, Homo Sapiens
FLSTSCGTD

SEQ ID NO: 1150121 - protein, 9 aa, Homo Sapiens
FPFDTWQML

SEQ ID NO: 1150122 - protein, 9 aa, Homo Sapiens
ASRVRYGVD

SEQ ID NO: 1150123 - protein, 9 aa, Homo Sapiens
FMSVNEGSF

SEQ ID NO: 1150124 - protein, 9 aa, Homo Sapiens
KLQIEKEHL

SEQ ID NO: 1150125 - protein, 9 aa, Homo Sapiens
ESQSGRWGT

SEQ ID NO: 1150126 - protein, 9 aa, Homo Sapiens
PCQQTMSCT

SEQ ID NO: 1150127 - protein, 9 aa, Homo Sapiens
PPPWLSPLQ

SEQ ID NO: 1150128 - protein, 9 aa, Homo Sapiens
FPHVCGVRA

SEQ ID NO: 1150129 - protein, 9 aa, Homo Sapiens
LRLSQDGWK

SEQ ID NO: 1150130 - protein, 9 aa, Homo Sapiens
WMQKYEDIK

SEQ ID NO: 1150131 - protein, 9 aa, Homo Sapiens
EGGSAHTSR

SEQ ID NO: 1150132 - protein, 9 aa, Homo Sapiens
FSMTSWNHK

SEQ ID NO: 1150133 - protein, 9 aa, Homo Sapiens
LVFASSGRV

SEQ ID NO: 1150134 - protein, 9 aa, Homo Sapiens
GSSTQAHAS

SEQ ID NO: 1150135 - protein, 9 aa, Homo Sapiens
QRGVSYLAA

SEQ ID NO: 1150136 - protein, 9 aa, Homo Sapiens
PVQLYNEMV

SEQ ID NO: 1150137 - protein, 9 aa, Homo Sapiens
PVITGSSQD

SEQ ID NO: 1150138 - protein, 9 aa, Homo Sapiens
HLLEFQTPL

SEQ ID NO: 1150139 - protein, 9 aa, Homo Sapiens
SPSPIRTHR

SEQ ID NO: 1150140 - protein, 9 aa, Homo Sapiens
ESEHFVKCV

SEQ ID NO: 1150141 - protein, 9 aa, Homo Sapiens
RPTWCTTCA

SEQ ID NO: 1150142 - protein, 9 aa, Homo Sapiens
QHGPLTGRD

SEQ ID NO: 1150143 - protein, 9 aa, Homo Sapiens
SRPPGRGAE

SEQ ID NO: 1150144 - protein, 9 aa, Homo Sapiens
KMLWGNDSS

SEQ ID NO: 1150145 - protein, 9 aa, Homo Sapiens
STAQSNYLP

SEQ ID NO: 1150146 - protein, 9 aa, Homo Sapiens
GVFSPAQLS

SEQ ID NO: 1150147 - protein, 9 aa, Homo Sapiens
PPFYYVTRE

SEQ ID NO: 1150148 - protein, 9 aa, Homo Sapiens
VLIGAPITT

SEQ ID NO: 1150149 - protein, 9 aa, Homo Sapiens
AQIVEILHS

SEQ ID NO: 1150150 - protein, 9 aa, Homo Sapiens
FDLLSLVFT

SEQ ID NO: 1150151 - protein, 9 aa, Homo Sapiens
VPRLECSGT

SEQ ID NO: 1150152 - protein, 9 aa, Homo Sapiens
FWLIPPMLH

SEQ ID NO: 1150153 - protein, 9 aa, Homo Sapiens
EVAWLKMLC

SEQ ID NO: 1150154 - protein, 9 aa, Homo Sapiens
VPRGTFHLD

SEQ ID NO: 1150155 - protein, 9 aa, Homo Sapiens
REEAEWIRS

SEQ ID NO: 1150156 - protein, 9 aa, Homo Sapiens
HFVKCVLQD

SEQ ID NO: 1150157 - protein, 9 aa, Homo Sapiens
NHHDQELIK

SEQ ID NO: 1150158 - protein, 9 aa, Homo Sapiens
TGDPPIGPP

SEQ ID NO: 1150159 - protein, 9 aa, Homo Sapiens
DPRGVGVGD

SEQ ID NO: 1150160 - protein, 9 aa, Homo Sapiens
CLRLCPHIL

SEQ ID NO: 1150161 - protein, 9 aa, Homo Sapiens
HKSKGEELK

SEQ ID NO: 1150162 - protein, 9 aa, Homo Sapiens
IQPTSDHSP

SEQ ID NO: 1150163 - protein, 9 aa, Homo Sapiens
LPLQWVVGT

SEQ ID NO: 1150164 - protein, 9 aa, Homo Sapiens
QLTRMYPLG

SEQ ID NO: 1150165 - protein, 9 aa, Homo Sapiens
ECSGTILAY

SEQ ID NO: 1150166 - protein, 9 aa, Homo Sapiens
LFPASGEMK

SEQ ID NO: 1150167 - protein, 9 aa, Homo Sapiens
QTGRPILLS

SEQ ID NO: 1150168 - protein, 9 aa, Homo Sapiens
PLVILGLIA

SEQ ID NO: 1150169 - protein, 9 aa, Homo Sapiens
VSSAKRNNF

SEQ ID NO: 1150170 - protein, 9 aa, Homo Sapiens
IRDHFDKNK

SEQ ID NO: 1150171 - protein, 9 aa, Homo Sapiens
PGGGQPARP

SEQ ID NO: 1150172 - protein, 9 aa, Homo Sapiens
LWFLDRTFR

SEQ ID NO: 1150173 - protein, 9 aa, Homo Sapiens
DTDTSLTMG

SEQ ID NO: 1150174 - protein, 9 aa, Homo Sapiens
FYRIFACSR

SEQ ID NO: 1150175 - protein, 9 aa, Homo Sapiens
QLEVTWSSK

SEQ ID NO: 1150176 - protein, 9 aa, Homo Sapiens
RAGTLAQLE

SEQ ID NO: 1150177 - protein, 9 aa, Homo Sapiens
DYSASEYCW

SEQ ID NO: 1150178 - protein, 9 aa, Homo Sapiens
ILICIMKNQ

SEQ ID NO: 1150179 - protein, 9 aa, Homo Sapiens
PAQSPLQSH

SEQ ID NO: 1150180 - protein, 9 aa, Homo Sapiens
PAGARLAEN

SEQ ID NO: 1150181 - protein, 9 aa, Homo Sapiens
SSGPCPSVC

SEQ ID NO: 1150182 - protein, 9 aa, Homo Sapiens
TGENPYECR

SEQ ID NO: 1150183 - protein, 9 aa, Homo Sapiens
QGGRRARRA

SEQ ID NO: 1150184 - protein, 9 aa, Homo Sapiens
PQAPTPTSL

SEQ ID NO: 1150185 - protein, 9 aa, Homo Sapiens
GRSRAEKPT

SEQ ID NO: 1150186 - protein, 9 aa, Homo Sapiens
RDHFDKNKF

SEQ ID NO: 1150187 - protein, 9 aa, Homo Sapiens
TRRKLRKNV

SEQ ID NO: 1150188 - protein, 9 aa, Homo Sapiens
PSPGAHLPL

SEQ ID NO: 1150189 - protein, 9 aa, Homo Sapiens
ALRLLCQPC

SEQ ID NO: 1150190 - protein, 9 aa, Homo Sapiens
DWKMVNQKM

SEQ ID NO: 1150191 - protein, 9 aa, Homo Sapiens
VTWSSKFNI

SEQ ID NO: 1150192 - protein, 9 aa, Homo Sapiens
SRQRQDPSH

SEQ ID NO: 1150193 - protein, 9 aa, Homo Sapiens
KKRERMMLP

SEQ ID NO: 1150194 - protein, 9 aa, Homo Sapiens
RVRRSRRCT

SEQ ID NO: 1150195 - protein, 9 aa, Homo Sapiens
RGKKFTDFE

SEQ ID NO: 1150196 - protein, 9 aa, Homo Sapiens
PLCKTVKYA

SEQ ID NO: 1150197 - protein, 9 aa, Homo Sapiens
FFKLIGDTS

SEQ ID NO: 1150198 - protein, 9 aa, Homo Sapiens
SLKKTSRIL

SEQ ID NO: 1150199 - protein, 9 aa, Homo Sapiens
YVTVKWNYT

SEQ ID NO: 1150200 - protein, 9 aa, Homo Sapiens
DREGVPPTT

SEQ ID NO: 1150201 - protein, 9 aa, Homo Sapiens
SGGSGHPTG

SEQ ID NO: 1150202 - protein, 9 aa, Homo Sapiens
LKKYLLLDN

SEQ ID NO: 1150203 - protein, 9 aa, Homo Sapiens
QRNSQFGFG

SEQ ID NO: 1150204 - protein, 9 aa, Homo Sapiens
CTKPVESML

SEQ ID NO: 1150205 - protein, 9 aa, Homo Sapiens
AFDTNGWQL

SEQ ID NO: 1150206 - protein, 9 aa, Homo Sapiens
KSRAAPSPE

SEQ ID NO: 1150207 - protein, 9 aa, Homo Sapiens
FSALLSAAL

SEQ ID NO: 1150208 - protein, 9 aa, Homo Sapiens
HPSGQGAAA

SEQ ID NO: 1150209 - protein, 9 aa, Homo Sapiens
TVKAHNGAG

SEQ ID NO: 1150210 - protein, 9 aa, Homo Sapiens
RPSAPVRSE

SEQ ID NO: 1150211 - protein, 9 aa, Homo Sapiens
LKHHFQGKE

SEQ ID NO: 1150212 - protein, 9 aa, Homo Sapiens
KRVCCPTSP

SEQ ID NO: 1150213 - protein, 9 aa, Homo Sapiens
WLAPVAWHP

SEQ ID NO: 1150214 - protein, 9 aa, Homo Sapiens
MRKGHNMLK

SEQ ID NO: 1150215 - protein, 9 aa, Homo Sapiens
GVAQSAGPP

SEQ ID NO: 1150216 - protein, 9 aa, Homo Sapiens
APGARVTVT

SEQ ID NO: 1150217 - protein, 9 aa, Homo Sapiens
VPPKMQKPK

SEQ ID NO: 1150218 - protein, 9 aa, Homo Sapiens
GTAGARHHT

SEQ ID NO: 1150219 - protein, 9 aa, Homo Sapiens
CARWRTRCW

SEQ ID NO: 1150220 - protein, 9 aa, Homo Sapiens
FYRQRTLVL

SEQ ID NO: 1150221 - protein, 9 aa, Homo Sapiens
AKRVCCPTS

SEQ ID NO: 1150222 - protein, 9 aa, Homo Sapiens
PQAHKLWMI

SEQ ID NO: 1150223 - protein, 9 aa, Homo Sapiens
YYSTSAPRR

SEQ ID NO: 1150224 - protein, 9 aa, Homo Sapiens
IVLLLPVIT

SEQ ID NO: 1150225 - protein, 9 aa, Homo Sapiens
RGSPGPSGS

SEQ ID NO: 1150226 - protein, 9 aa, Homo Sapiens
LHVKQEPPQ

SEQ ID NO: 1150227 - protein, 9 aa, Homo Sapiens
LEETLPPDT

SEQ ID NO: 1150228 - protein, 9 aa, Homo Sapiens
TQQTCLEEG

SEQ ID NO: 1150229 - protein, 9 aa, Homo Sapiens
NEDQQLGDL

SEQ ID NO: 1150230 - protein, 9 aa, Homo Sapiens
SFSRKITET

SEQ ID NO: 1150231 - protein, 9 aa, Homo Sapiens
SILSFLQEH

SEQ ID NO: 1150232 - protein, 9 aa, Homo Sapiens
DFDTLKQQE

SEQ ID NO: 1150233 - protein, 9 aa, Homo Sapiens
AGHGKEECC

SEQ ID NO: 1150234 - protein, 9 aa, Homo Sapiens
PVRAWRTSS

SEQ ID NO: 1150235 - protein, 9 aa, Homo Sapiens
QVLHRLTVG

SEQ ID NO: 1150236 - protein, 9 aa, Homo Sapiens
AHLPLPQAP

SEQ ID NO: 1150237 - protein, 9 aa, Homo Sapiens
RKRSSQSRS

SEQ ID NO: 1150238 - protein, 9 aa, Homo Sapiens
MPGGSPPGW

SEQ ID NO: 1150239 - protein, 9 aa, Homo Sapiens
TAALGWSPC

SEQ ID NO: 1150240 - protein, 9 aa, Homo Sapiens
PIHDPPFDF

SEQ ID NO: 1150241 - protein, 9 aa, Homo Sapiens
LIEKLVASR

SEQ ID NO: 1150242 - protein, 9 aa, Homo Sapiens
GRRLCTGED

SEQ ID NO: 1150243 - protein, 9 aa, Homo Sapiens
ICNPLHYLT

SEQ ID NO: 1150244 - protein, 9 aa, Homo Sapiens
LLCQCDKKR

SEQ ID NO: 1150245 - protein, 9 aa, Homo Sapiens
HRRAASMDS

SEQ ID NO: 1150246 - protein, 9 aa, Homo Sapiens
GLQGKLGPK

SEQ ID NO: 1150247 - protein, 9 aa, Homo Sapiens
RAPRPGGFF

SEQ ID NO: 1150248 - protein, 9 aa, Homo Sapiens
ENFTDSLQS

SEQ ID NO: 1150249 - protein, 9 aa, Homo Sapiens
RPTCQARPA

SEQ ID NO: 1150250 - protein, 9 aa, Homo Sapiens
LCGACPGQR

SEQ ID NO: 1150251 - protein, 9 aa, Homo Sapiens
DCTEIIIVV

SEQ ID NO: 1150252 - protein, 9 aa, Homo Sapiens
SRRHPQLGQ

SEQ ID NO: 1150253 - protein, 9 aa, Homo Sapiens
WPSRLSASR

SEQ ID NO: 1150254 - protein, 9 aa, Homo Sapiens
VVIVPAQRI

SEQ ID NO: 1150255 - protein, 9 aa, Homo Sapiens
FVLVNLEVT

SEQ ID NO: 1150256 - protein, 9 aa, Homo Sapiens
VQLWIYLRP

SEQ ID NO: 1150257 - protein, 9 aa, Homo Sapiens
CAGTTPPAS

SEQ ID NO: 1150258 - protein, 9 aa, Homo Sapiens
HLCPQQHVL

SEQ ID NO: 1150259 - protein, 9 aa, Homo Sapiens
SPGALFLEG

SEQ ID NO: 1150260 - protein, 9 aa, Homo Sapiens
RPDQSRPTC

SEQ ID NO: 1150261 - protein, 9 aa, Homo Sapiens
RRAARCTRS

SEQ ID NO: 1150262 - protein, 9 aa, Homo Sapiens
RDKKRRSKI

SEQ ID NO: 1150263 - protein, 9 aa, Homo Sapiens
GHYTRFIRQ

SEQ ID NO: 1150264 - protein, 9 aa, Homo Sapiens
QAGPWNTGL

SEQ ID NO: 1150265 - protein, 9 aa, Homo Sapiens
PLFLLFFSS

SEQ ID NO: 1150266 - protein, 9 aa, Homo Sapiens
FPFAVVLHA

SEQ ID NO: 1150267 - protein, 9 aa, Homo Sapiens
ALRPAPRVS

SEQ ID NO: 1150268 - protein, 9 aa, Homo Sapiens
NTLVDKLNT

SEQ ID NO: 1150269 - protein, 9 aa, Homo Sapiens
SVNGVLETH

SEQ ID NO: 1150270 - protein, 9 aa, Homo Sapiens
AAPSTPKEP

SEQ ID NO: 1150271 - protein, 9 aa, Homo Sapiens
PPVLLAGER

SEQ ID NO: 1150272 - protein, 9 aa, Homo Sapiens
SGLESLAQA

SEQ ID NO: 1150273 - protein, 9 aa, Homo Sapiens
AAALKRHFT

SEQ ID NO: 1150274 - protein, 9 aa, Homo Sapiens
GTFHLDEDV

SEQ ID NO: 1150275 - protein, 9 aa, Homo Sapiens
RSSTWPQNW

SEQ ID NO: 1150276 - protein, 9 aa, Homo Sapiens
ICKGASSHI

SEQ ID NO: 1150277 - protein, 9 aa, Homo Sapiens
GGGPERPCA

SEQ ID NO: 1150278 - protein, 9 aa, Homo Sapiens
TSNIRENVL

SEQ ID NO: 1150279 - protein, 9 aa, Homo Sapiens
SIGLALSAL

SEQ ID NO: 1150280 - protein, 9 aa, Homo Sapiens
GPVMAWTSR

SEQ ID NO: 1150281 - protein, 9 aa, Homo Sapiens
WREGRERRV

SEQ ID NO: 1150282 - protein, 9 aa, Homo Sapiens
PIHIGCTQT

SEQ ID NO: 1150283 - protein, 9 aa, Homo Sapiens
VFSPAQLSQ

SEQ ID NO: 1150284 - protein, 9 aa, Homo Sapiens
TVKNLLHHL

SEQ ID NO: 1150285 - protein, 9 aa, Homo Sapiens
NTGLVAIQL

SEQ ID NO: 1150286 - protein, 9 aa, Homo Sapiens
PLPVMEGLV

SEQ ID NO: 1150287 - protein, 9 aa, Homo Sapiens
GGAARLAGR

SEQ ID NO: 1150288 - protein, 9 aa, Homo Sapiens
VIDISPGAL

SEQ ID NO: 1150289 - protein, 9 aa, Homo Sapiens
RQPDPDVPE

SEQ ID NO: 1150290 - protein, 9 aa, Homo Sapiens
RCWACCGTR

SEQ ID NO: 1150291 - protein, 9 aa, Homo Sapiens
ERMNHGNPS

SEQ ID NO: 1150292 - protein, 9 aa, Homo Sapiens
QDYHGLMER

SEQ ID NO: 1150293 - protein, 9 aa, Homo Sapiens
AVSCFSTTT

SEQ ID NO: 1150294 - protein, 9 aa, Homo Sapiens
PVNEEAKSP

SEQ ID NO: 1150295 - protein, 9 aa, Homo Sapiens
GPSEETAPS

SEQ ID NO: 1150296 - protein, 9 aa, Homo Sapiens
LLPRRRRRF

SEQ ID NO: 1150297 - protein, 9 aa, Homo Sapiens
IVHRDLAAR

SEQ ID NO: 1150298 - protein, 9 aa, Homo Sapiens
SRGMGRRPR

SEQ ID NO: 1150299 - protein, 9 aa, Homo Sapiens
KPPTAEGLV

SEQ ID NO: 1150300 - protein, 9 aa, Homo Sapiens
DSQIQDAPD

SEQ ID NO: 1150301 - protein, 9 aa, Homo Sapiens
ALSEDRRTM

SEQ ID NO: 1150302 - protein, 9 aa, Homo Sapiens
PGITWAGAG

SEQ ID NO: 1150303 - protein, 9 aa, Homo Sapiens
RQNRAALFQ

SEQ ID NO: 1150304 - protein, 9 aa, Homo Sapiens
PGTRPKPPH

SEQ ID NO: 1150305 - protein, 9 aa, Homo Sapiens
ILDRLQRGL

SEQ ID NO: 1150306 - protein, 9 aa, Homo Sapiens
LSSMSSLGD

SEQ ID NO: 1150307 - protein, 9 aa, Homo Sapiens
GGRPSAPVR

SEQ ID NO: 1150308 - protein, 9 aa, Homo Sapiens
QLPEHKKHV

SEQ ID NO: 1150309 - protein, 9 aa, Homo Sapiens
LLLCYPNVV

SEQ ID NO: 1150310 - protein, 9 aa, Homo Sapiens
TEIQLTMND

SEQ ID NO: 1150311 - protein, 9 aa, Homo Sapiens
ARCQDSPTS

SEQ ID NO: 1150312 - protein, 9 aa, Homo Sapiens
NMHDDPCLL

SEQ ID NO: 1150313 - protein, 9 aa, Homo Sapiens
FLCNVCNIP

SEQ ID NO: 1150314 - protein, 9 aa, Homo Sapiens
CQARPASSW

SEQ ID NO: 1150315 - protein, 9 aa, Homo Sapiens
PVGAGTGGG

SEQ ID NO: 1150316 - protein, 9 aa, Homo Sapiens
SRSFFTSAH

SEQ ID NO: 1150317 - protein, 9 aa, Homo Sapiens
KRRSKIEAS

SEQ ID NO: 1150318 - protein, 9 aa, Homo Sapiens
TSGLQECRG

SEQ ID NO: 1150319 - protein, 9 aa, Homo Sapiens
EKTDMMPST

SEQ ID NO: 1150320 - protein, 9 aa, Homo Sapiens
PLLPFQYQA

SEQ ID NO: 1150321 - protein, 9 aa, Homo Sapiens
SCLSRPGWA

SEQ ID NO: 1150322 - protein, 9 aa, Homo Sapiens
EKGPLAWKS

SEQ ID NO: 1150323 - protein, 9 aa, Homo Sapiens
RSEPSELEL

SEQ ID NO: 1150324 - protein, 9 aa, Homo Sapiens
RSGGDWLAP

SEQ ID NO: 1150325 - protein, 9 aa, Homo Sapiens
MLPEMVKNR

SEQ ID NO: 1150326 - protein, 9 aa, Homo Sapiens
GSEFTHIEF

SEQ ID NO: 1150327 - protein, 9 aa, Homo Sapiens
VHKDESVTA

SEQ ID NO: 1150328 - protein, 9 aa, Homo Sapiens
IHDPPFDFS

SEQ ID NO: 1150329 - protein, 9 aa, Homo Sapiens
KMDLDGMLT

SEQ ID NO: 1150330 - protein, 9 aa, Homo Sapiens
TFRKFFDDN

SEQ ID NO: 1150331 - protein, 9 aa, Homo Sapiens
CPRLGASAS

SEQ ID NO: 1150332 - protein, 9 aa, Homo Sapiens
YNEMVDYSN

SEQ ID NO: 1150333 - protein, 9 aa, Homo Sapiens
GVSGSSTRP

SEQ ID NO: 1150334 - protein, 9 aa, Homo Sapiens
CTEIIIVVN

SEQ ID NO: 1150335 - protein, 9 aa, Homo Sapiens
GLCRYGGRC

SEQ ID NO: 1150336 - protein, 9 aa, Homo Sapiens
VNLAGRAND

SEQ ID NO: 1150337 - protein, 9 aa, Homo Sapiens
ARYRKPLEL

SEQ ID NO: 1150338 - protein, 9 aa, Homo Sapiens
SLTKYLKRD

SEQ ID NO: 1150339 - protein, 9 aa, Homo Sapiens
GSPTLGRVP

SEQ ID NO: 1150340 - protein, 9 aa, Homo Sapiens
RHMTTCQSV

SEQ ID NO: 1150341 - protein, 9 aa, Homo Sapiens
FVRHGVESM

SEQ ID NO: 1150342 - protein, 9 aa, Homo Sapiens
ELEGQPTLD

SEQ ID NO: 1150343 - protein, 9 aa, Homo Sapiens
LRFNLILMM

SEQ ID NO: 1150344 - protein, 9 aa, Homo Sapiens
PGPVLPKNT

SEQ ID NO: 1150345 - protein, 9 aa, Homo Sapiens
RILNLQVLK

SEQ ID NO: 1150346 - protein, 9 aa, Homo Sapiens
WKPLTVLNK

SEQ ID NO: 1150347 - protein, 9 aa, Homo Sapiens
GSGPGRRLC

SEQ ID NO: 1150348 - protein, 9 aa, Homo Sapiens
RYKTQAGDA

SEQ ID NO: 1150349 - protein, 9 aa, Homo Sapiens
VGAGAYILV

SEQ ID NO: 1150350 - protein, 9 aa, Homo Sapiens
ASSGRVRRS

SEQ ID NO: 1150351 - protein, 9 aa, Homo Sapiens
AARPPRLRA

SEQ ID NO: 1150352 - protein, 9 aa, Homo Sapiens
ALRARGGTT

SEQ ID NO: 1150353 - protein, 9 aa, Homo Sapiens
ATGGDRPTR

SEQ ID NO: 1150354 - protein, 9 aa, Homo Sapiens
PRALPSLLS

SEQ ID NO: 1150355 - protein, 9 aa, Homo Sapiens
CLRSFRPYH

SEQ ID NO: 1150356 - protein, 9 aa, Homo Sapiens
CMELQASAA

SEQ ID NO: 1150357 - protein, 9 aa, Homo Sapiens
SDDQDLTHM

SEQ ID NO: 1150358 - protein, 9 aa, Homo Sapiens
GTRKGWTGA

SEQ ID NO: 1150359 - protein, 9 aa, Homo Sapiens
DILYIDITW

SEQ ID NO: 1150360 - protein, 9 aa, Homo Sapiens
PVLPKNTLM

SEQ ID NO: 1150361 - protein, 9 aa, Homo Sapiens
DTIIFGGRR

SEQ ID NO: 1150362 - protein, 9 aa, Homo Sapiens
KCFLSTSCG

SEQ ID NO: 1150363 - protein, 9 aa, Homo Sapiens
SPSTSVDSL

SEQ ID NO: 1150364 - protein, 9 aa, Homo Sapiens
TKLYGEIAD

SEQ ID NO: 1150365 - protein, 9 aa, Homo Sapiens
RMMLPVRAR

SEQ ID NO: 1150366 - protein, 9 aa, Homo Sapiens
PDVLPSALE

SEQ ID NO: 1150367 - protein, 9 aa, Homo Sapiens
KLINDRHGS

SEQ ID NO: 1150368 - protein, 9 aa, Homo Sapiens
GYRTYSLIT

SEQ ID NO: 1150369 - protein, 9 aa, Homo Sapiens
RSSGKKIAF

SEQ ID NO: 1150370 - protein, 9 aa, Homo Sapiens
ENVYVLANE

SEQ ID NO: 1150371 - protein, 9 aa, Homo Sapiens
AYKRETRCS

SEQ ID NO: 1150372 - protein, 9 aa, Homo Sapiens
EATAEPTVS

SEQ ID NO: 1150373 - protein, 9 aa, Homo Sapiens
VPCPGGGEG

SEQ ID NO: 1150374 - protein, 9 aa, Homo Sapiens
VTDKFTENV

SEQ ID NO: 1150375 - protein, 9 aa, Homo Sapiens
PSGEQIPGL

SEQ ID NO: 1150376 - protein, 9 aa, Homo Sapiens
WVIPPQPSL

SEQ ID NO: 1150377 - protein, 9 aa, Homo Sapiens
YLSTAAMNH

SEQ ID NO: 1150378 - protein, 9 aa, Homo Sapiens
TTTTSSPRR

SEQ ID NO: 1150379 - protein, 9 aa, Homo Sapiens
DCKLQADGN

SEQ ID NO: 1150380 - protein, 9 aa, Homo Sapiens
GSPQTPPRD

SEQ ID NO: 1150381 - protein, 9 aa, Homo Sapiens
PGSCAPFSS

SEQ ID NO: 1150382 - protein, 9 aa, Homo Sapiens
TAQAVDRET

SEQ ID NO: 1150383 - protein, 9 aa, Homo Sapiens
SLLTGADGR

SEQ ID NO: 1150384 - protein, 9 aa, Homo Sapiens
EADGLDSGA

SEQ ID NO: 1150385 - protein, 9 aa, Homo Sapiens
CTGEDVAAL

SEQ ID NO: 1150386 - protein, 9 aa, Homo Sapiens
PVLGCLLHI

SEQ ID NO: 1150387 - protein, 9 aa, Homo Sapiens
EGLVSGGEL

SEQ ID NO: 1150388 - protein, 9 aa, Homo Sapiens
FSLWRTFDS

SEQ ID NO: 1150389 - protein, 9 aa, Homo Sapiens
SGTILAYCS

SEQ ID NO: 1150390 - protein, 9 aa, Homo Sapiens
HPLSASQPS

SEQ ID NO: 1150391 - protein, 9 aa, Homo Sapiens
VATSEALCG

SEQ ID NO: 1150392 - protein, 9 aa, Homo Sapiens
QEKPPTAEG

SEQ ID NO: 1150393 - protein, 9 aa, Homo Sapiens
GHPTGPQIS

SEQ ID NO: 1150394 - protein, 9 aa, Homo Sapiens
IEGAPPLWG

SEQ ID NO: 1150395 - protein, 9 aa, Homo Sapiens
YPKKLNHTP

SEQ ID NO: 1150396 - protein, 9 aa, Homo Sapiens
SPTRMAGRR

SEQ ID NO: 1150397 - protein, 9 aa, Homo Sapiens
IPDEESVVI

SEQ ID NO: 1150398 - protein, 9 aa, Homo Sapiens
KEEDKKHGG

SEQ ID NO: 1150399 - protein, 9 aa, Homo Sapiens
TFSESSKLT

SEQ ID NO: 1150400 - protein, 9 aa, Homo Sapiens
YPLSFFLNV

SEQ ID NO: 1150401 - protein, 9 aa, Homo Sapiens
HLDEDVSYK

SEQ ID NO: 1150402 - protein, 9 aa, Homo Sapiens
RAVLGLGGG

SEQ ID NO: 1150403 - protein, 9 aa, Homo Sapiens
GLATEGGGL

SEQ ID NO: 1150404 - protein, 9 aa, Homo Sapiens
SKSSSEIGS

SEQ ID NO: 1150405 - protein, 9 aa, Homo Sapiens
LLGVCGHLK

SEQ ID NO: 1150406 - protein, 9 aa, Homo Sapiens
GARLAENDS

SEQ ID NO: 1150407 - protein, 9 aa, Homo Sapiens
RALALRLGI

SEQ ID NO: 1150408 - protein, 9 aa, Homo Sapiens
AFHTEQINE

SEQ ID NO: 1150409 - protein, 9 aa, Homo Sapiens
LDAILIMGE

SEQ ID NO: 1150410 - protein, 9 aa, Homo Sapiens
SLTMGIYFD

SEQ ID NO: 1150411 - protein, 9 aa, Homo Sapiens
CVAPEEHPV

SEQ ID NO: 1150412 - protein, 9 aa, Homo Sapiens
GWATGVAQS

SEQ ID NO: 1150413 - protein, 9 aa, Homo Sapiens
ARAPHVCQD

SEQ ID NO: 1150414 - protein, 9 aa, Homo Sapiens
AEEVRQLLL

SEQ ID NO: 1150415 - protein, 9 aa, Homo Sapiens
PPEECVYPD

SEQ ID NO: 1150416 - protein, 9 aa, Homo Sapiens
RWEPQPPRA

SEQ ID NO: 1150417 - protein, 9 aa, Homo Sapiens
GEIAQGIAG

SEQ ID NO: 1150418 - protein, 9 aa, Homo Sapiens
KICYEEDES

SEQ ID NO: 1150419 - protein, 9 aa, Homo Sapiens
KPTAALGWS

SEQ ID NO: 1150420 - protein, 9 aa, Homo Sapiens
GLVVIVPAQ

SEQ ID NO: 1150421 - protein, 9 aa, Homo Sapiens
VCPLASLAP

SEQ ID NO: 1150422 - protein, 9 aa, Homo Sapiens
GVARRDGDL

SEQ ID NO: 1150423 - protein, 9 aa, Homo Sapiens
TSATTRRPL

SEQ ID NO: 1150424 - protein, 9 aa, Homo Sapiens
MKNQIRKLK

SEQ ID NO: 1150425 - protein, 9 aa, Homo Sapiens
SQTLEAWEG

SEQ ID NO: 1150426 - protein, 9 aa, Homo Sapiens
NEEAKSPAE

SEQ ID NO: 1150427 - protein, 9 aa, Homo Sapiens
VCLLFPASG

SEQ ID NO: 1150428 - protein, 9 aa, Homo Sapiens
KGPRRSAAQ

SEQ ID NO: 1150429 - protein, 9 aa, Homo Sapiens
TSSPKSTTL

SEQ ID NO: 1150430 - protein, 9 aa, Homo Sapiens
CDRSWLPCR

SEQ ID NO: 1150431 - protein, 9 aa, Homo Sapiens
RWYHPSTHD

SEQ ID NO: 1150432 - protein, 9 aa, Homo Sapiens
LSYGSHVCL

SEQ ID NO: 1150433 - protein, 9 aa, Homo Sapiens
RHTLFHCIL

SEQ ID NO: 1150434 - protein, 9 aa, Homo Sapiens
AKTVAEKWT

SEQ ID NO: 1150435 - protein, 9 aa, Homo Sapiens
EKDQRLREI

SEQ ID NO: 1150436 - protein, 9 aa, Homo Sapiens
EWQTRQTKL

SEQ ID NO: 1150437 - protein, 9 aa, Homo Sapiens
LSAPTRQTL

SEQ ID NO: 1150438 - protein, 9 aa, Homo Sapiens
QGRAPLEGM

SEQ ID NO: 1150439 - protein, 9 aa, Homo Sapiens
DVEGCLELI

SEQ ID NO: 1150440 - protein, 9 aa, Homo Sapiens
MAVHLSYGR

SEQ ID NO: 1150441 - protein, 9 aa, Homo Sapiens
FSYCGPLRT

SEQ ID NO: 1150442 - protein, 9 aa, Homo Sapiens
PKKMAPPKE

SEQ ID NO: 1150443 - protein, 9 aa, Homo Sapiens
SLAYAPQQA

SEQ ID NO: 1150444 - protein, 9 aa, Homo Sapiens
EHQCSPRGD

SEQ ID NO: 1150445 - protein, 9 aa, Homo Sapiens
QVGHGVWVG

SEQ ID NO: 1150446 - protein, 9 aa, Homo Sapiens
PPTTLFHPM

SEQ ID NO: 1150447 - protein, 9 aa, Homo Sapiens
YGDESDVFR

SEQ ID NO: 1150448 - protein, 9 aa, Homo Sapiens
RAFSYCGPL

SEQ ID NO: 1150449 - protein, 9 aa, Homo Sapiens
RLRATRTGC

SEQ ID NO: 1150450 - protein, 9 aa, Homo Sapiens
RSFMKLYHS

SEQ ID NO: 1150451 - protein, 9 aa, Homo Sapiens
RYWTYGITR

SEQ ID NO: 1150452 - protein, 9 aa, Homo Sapiens
RKGWTGACT

SEQ ID NO: 1150453 - protein, 9 aa, Homo Sapiens
TMPPNKETS

SEQ ID NO: 1150454 - protein, 9 aa, Homo Sapiens
AKHPQMVFT

SEQ ID NO: 1150455 - protein, 9 aa, Homo Sapiens
VMQSFNDPL

SEQ ID NO: 1150456 - protein, 9 aa, Homo Sapiens
QSSRPRRTA

SEQ ID NO: 1150457 - protein, 9 aa, Homo Sapiens
PLGLCSAQP

SEQ ID NO: 1150458 - protein, 9 aa, Homo Sapiens
GRWVPFAAA

SEQ ID NO: 1150459 - protein, 9 aa, Homo Sapiens
QLHKDFFIL

SEQ ID NO: 1150460 - protein, 9 aa, Homo Sapiens
AQQEPLPRG

SEQ ID NO: 1150461 - protein, 9 aa, Homo Sapiens
NTFLTQNME

SEQ ID NO: 1150462 - protein, 9 aa, Homo Sapiens
AMLLSITNV

SEQ ID NO: 1150463 - protein, 9 aa, Homo Sapiens
HTVKNLLHH

SEQ ID NO: 1150464 - protein, 9 aa, Homo Sapiens
TLWVIPPQP

SEQ ID NO: 1150465 - protein, 9 aa, Homo Sapiens
LSRFVDGLA

SEQ ID NO: 1150466 - protein, 9 aa, Homo Sapiens
IAAALKRHF

SEQ ID NO: 1150467 - protein, 9 aa, Homo Sapiens
NNQFFRGGD

SEQ ID NO: 1150468 - protein, 9 aa, Homo Sapiens
TKEGCHKKT

SEQ ID NO: 1150469 - protein, 9 aa, Homo Sapiens
NHKTMNLNK

SEQ ID NO: 1150470 - protein, 9 aa, Homo Sapiens
KHISLNDLQ

SEQ ID NO: 1150471 - protein, 9 aa, Homo Sapiens
QPQLIVKGV

SEQ ID NO: 1150472 - protein, 9 aa, Homo Sapiens
PGHGEQAEE

SEQ ID NO: 1150473 - protein, 9 aa, Homo Sapiens
KNIWPSKGV

SEQ ID NO: 1150474 - protein, 9 aa, Homo Sapiens
IARCQDSPT

SEQ ID NO: 1150475 - protein, 9 aa, Homo Sapiens
AKKTETVEE

SEQ ID NO: 1150476 - protein, 9 aa, Homo Sapiens
FTKLAKKTE

SEQ ID NO: 1150477 - protein, 9 aa, Homo Sapiens
FLAFPSPQG

SEQ ID NO: 1150478 - protein, 9 aa, Homo Sapiens
LSGGVPPYT

SEQ ID NO: 1150479 - protein, 9 aa, Homo Sapiens
QQQGRWAMV

SEQ ID NO: 1150480 - protein, 9 aa, Homo Sapiens
PVRQAPCST

SEQ ID NO: 1150481 - protein, 9 aa, Homo Sapiens
SDGMYRYGP

SEQ ID NO: 1150482 - protein, 9 aa, Homo Sapiens
HPLLPFQYQ

SEQ ID NO: 1150483 - protein, 9 aa, Homo Sapiens
ASRAPCRPP

SEQ ID NO: 1150484 - protein, 9 aa, Homo Sapiens
ELQAYIARC

SEQ ID NO: 1150485 - protein, 9 aa, Homo Sapiens
LLCTPPGSC

SEQ ID NO: 1150486 - protein, 9 aa, Homo Sapiens
APNHHDQEL

SEQ ID NO: 1150487 - protein, 9 aa, Homo Sapiens
EGFLAFPSP

SEQ ID NO: 1150488 - protein, 9 aa, Homo Sapiens
NSVASHVDL

SEQ ID NO: 1150489 - protein, 9 aa, Homo Sapiens
ARTCLWAPG

SEQ ID NO: 1150490 - protein, 9 aa, Homo Sapiens
SPGGAGPVS

SEQ ID NO: 1150491 - protein, 9 aa, Homo Sapiens
LFQTLLNII

SEQ ID NO: 1150492 - protein, 9 aa, Homo Sapiens
LPKSEQFKI

SEQ ID NO: 1150493 - protein, 9 aa, Homo Sapiens
YLRPILRRQ

SEQ ID NO: 1150494 - protein, 9 aa, Homo Sapiens
LTPSTTLWV

SEQ ID NO: 1150495 - protein, 9 aa, Homo Sapiens
RGQVPARRG

SEQ ID NO: 1150496 - protein, 9 aa, Homo Sapiens
AVGYRTYSL

SEQ ID NO: 1150497 - protein, 9 aa, Homo Sapiens
GFFTRYPRH

SEQ ID NO: 1150498 - protein, 9 aa, Homo Sapiens
HITHIDWDS

SEQ ID NO: 1150499 - protein, 9 aa, Homo Sapiens
IRQVLDVVY

SEQ ID NO: 1150500 - protein, 9 aa, Homo Sapiens
RLPLQWVVG

SEQ ID NO: 1150501 - protein, 9 aa, Homo Sapiens
PAQTWPACA

SEQ ID NO: 1150502 - protein, 9 aa, Homo Sapiens
HVQQRQAVA

SEQ ID NO: 1150503 - protein, 9 aa, Homo Sapiens
DVVLPTYDS

SEQ ID NO: 1150504 - protein, 9 aa, Homo Sapiens
GGVPPYTEC

SEQ ID NO: 1150505 - protein, 9 aa, Homo Sapiens
SAKKLVPLV

SEQ ID NO: 1150506 - protein, 9 aa, Homo Sapiens
HDQELIKVH

SEQ ID NO: 1150507 - protein, 9 aa, Homo Sapiens
PRHPRLRSY

SEQ ID NO: 1150508 - protein, 9 aa, Homo Sapiens
APRVSPSNA

SEQ ID NO: 1150509 - protein, 9 aa, Homo Sapiens
LVAHLLSKY

SEQ ID NO: 1150510 - protein, 9 aa, Homo Sapiens
QIQDAPDAS

SEQ ID NO: 1150511 - protein, 9 aa, Homo Sapiens
HGLYNKVSR

SEQ ID NO: 1150512 - protein, 9 aa, Homo Sapiens
GLVRDCGAW

SEQ ID NO: 1150513 - protein, 9 aa, Homo Sapiens
SPCDRSWLP

SEQ ID NO: 1150514 - protein, 9 aa, Homo Sapiens
LVRVRIPLH

SEQ ID NO: 1150515 - protein, 9 aa, Homo Sapiens
YAGPVRHHT

SEQ ID NO: 1150516 - protein, 9 aa, Homo Sapiens
RELPIIQDV

SEQ ID NO: 1150517 - protein, 9 aa, Homo Sapiens
SDGDVHQDT

SEQ ID NO: 1150518 - protein, 9 aa, Homo Sapiens
GDEVSPGGA

SEQ ID NO: 1150519 - protein, 9 aa, Homo Sapiens
LEEEYEHME

SEQ ID NO: 1150520 - protein, 9 aa, Homo Sapiens
IPGIRGALT

SEQ ID NO: 1150521 - protein, 9 aa, Homo Sapiens
QHTFRDVVR

SEQ ID NO: 1150522 - protein, 9 aa, Homo Sapiens
VVVGAGDVG

SEQ ID NO: 1150523 - protein, 9 aa, Homo Sapiens
TSHVPRGHL

SEQ ID NO: 1150524 - protein, 9 aa, Homo Sapiens
APLSVSPSF

SEQ ID NO: 1150525 - protein, 9 aa, Homo Sapiens
LRKNVRRKK

SEQ ID NO: 1150526 - protein, 9 aa, Homo Sapiens
PTPARTPTQ

SEQ ID NO: 1150527 - protein, 9 aa, Homo Sapiens
PICDMRFCG

SEQ ID NO: 1150528 - protein, 9 aa, Homo Sapiens
AGRKMKRVL

SEQ ID NO: 1150529 - protein, 9 aa, Homo Sapiens
IIIVVNQEI

SEQ ID NO: 1150530 - protein, 9 aa, Homo Sapiens
PFAVVLHAP

SEQ ID NO: 1150531 - protein, 9 aa, Homo Sapiens
PGSCGFTQD

SEQ ID NO: 1150532 - protein, 9 aa, Homo Sapiens
CWYKYLLSA

SEQ ID NO: 1150533 - protein, 9 aa, Homo Sapiens
VVLPTYDST

SEQ ID NO: 1150534 - protein, 9 aa, Homo Sapiens
RSGSGQPAA

SEQ ID NO: 1150535 - protein, 9 aa, Homo Sapiens
RPIQVQTGG

SEQ ID NO: 1150536 - protein, 9 aa, Homo Sapiens
EYASIVSSS

SEQ ID NO: 1150537 - protein, 9 aa, Homo Sapiens
SKQAFEKVA

SEQ ID NO: 1150538 - protein, 9 aa, Homo Sapiens
MVKSWVISE

SEQ ID NO: 1150539 - protein, 9 aa, Homo Sapiens
GACTPPTFC

SEQ ID NO: 1150540 - protein, 9 aa, Homo Sapiens
FFDMFLKLN

SEQ ID NO: 1150541 - protein, 9 aa, Homo Sapiens
VAFGFLCNV

SEQ ID NO: 1150542 - protein, 9 aa, Homo Sapiens
LWPPLPGGS

SEQ ID NO: 1150543 - protein, 9 aa, Homo Sapiens
MSCKQALGT

SEQ ID NO: 1150544 - protein, 9 aa, Homo Sapiens
ARGGTTIGE

SEQ ID NO: 1150545 - protein, 9 aa, Homo Sapiens
SSSSSGSDG

SEQ ID NO: 1150546 - protein, 9 aa, Homo Sapiens
LADYNTLVD

SEQ ID NO: 1150547 - protein, 9 aa, Homo Sapiens
LGTVAGATA

SEQ ID NO: 1150548 - protein, 9 aa, Homo Sapiens
VHGQRRLQE

SEQ ID NO: 1150549 - protein, 9 aa, Homo Sapiens
PAVAWLQGS

SEQ ID NO: 1150550 - protein, 9 aa, Homo Sapiens
KKRKKSYTT

SEQ ID NO: 1150551 - protein, 9 aa, Homo Sapiens
RPAPRVSPS

SEQ ID NO: 1150552 - protein, 9 aa, Homo Sapiens
ENPAGHGKE

SEQ ID NO: 1150553 - protein, 9 aa, Homo Sapiens
EAWFPEVAL

SEQ ID NO: 1150554 - protein, 9 aa, Homo Sapiens
DNLQPFMPS

SEQ ID NO: 1150555 - protein, 9 aa, Homo Sapiens
GWAQRCSQG

SEQ ID NO: 1150556 - protein, 9 aa, Homo Sapiens
CLGTKTRLT

SEQ ID NO: 1150557 - protein, 9 aa, Homo Sapiens
YSLLKWNSE

SEQ ID NO: 1150558 - protein, 9 aa, Homo Sapiens
FGDQVPCQQ

SEQ ID NO: 1150559 - protein, 9 aa, Homo Sapiens
MMLPVRART

SEQ ID NO: 1150560 - protein, 9 aa, Homo Sapiens
LAPRPAGTA

SEQ ID NO: 1150561 - protein, 9 aa, Homo Sapiens
SAALPQPCR

SEQ ID NO: 1150562 - protein, 9 aa, Homo Sapiens
LCAVVEQTE

SEQ ID NO: 1150563 - protein, 9 aa, Homo Sapiens
ILGLIADSS

SEQ ID NO: 1150564 - protein, 9 aa, Homo Sapiens
RPILRRQRL

SEQ ID NO: 1150565 - protein, 9 aa, Homo Sapiens
AARLAGRKM

SEQ ID NO: 1150566 - protein, 9 aa, Homo Sapiens
LLGSPLLSG

SEQ ID NO: 1150567 - protein, 9 aa, Homo Sapiens
SSRPRKDEK

SEQ ID NO: 1150568 - protein, 9 aa, Homo Sapiens
CRSPRSTWP

SEQ ID NO: 1150569 - protein, 9 aa, Homo Sapiens
LSCWLSCRK

SEQ ID NO: 1150570 - protein, 9 aa, Homo Sapiens
EIEDTIADH

SEQ ID NO: 1150571 - protein, 9 aa, Homo Sapiens
SRDSRSFFT

SEQ ID NO: 1150572 - protein, 9 aa, Homo Sapiens
RRAPGRPGG

SEQ ID NO: 1150573 - protein, 9 aa, Homo Sapiens
PCSNSSDSD

SEQ ID NO: 1150574 - protein, 9 aa, Homo Sapiens
DARVAEEGF

SEQ ID NO: 1150575 - protein, 9 aa, Homo Sapiens
ERFHTGEKP

SEQ ID NO: 1150576 - protein, 9 aa, Homo Sapiens
EITTGPRDS

SEQ ID NO: 1150577 - protein, 9 aa, Homo Sapiens
RLLAACGAT

SEQ ID NO: 1150578 - protein, 9 aa, Homo Sapiens
LPQLLGPPP

SEQ ID NO: 1150579 - protein, 9 aa, Homo Sapiens
HLTSETSSV

SEQ ID NO: 1150580 - protein, 9 aa, Homo Sapiens
GPERPCARG

SEQ ID NO: 1150581 - protein, 9 aa, Homo Sapiens
QLPASSPTK

SEQ ID NO: 1150582 - protein, 9 aa, Homo Sapiens
KVPKKRILN

SEQ ID NO: 1150583 - protein, 9 aa, Homo Sapiens
PLGLRPPHL

SEQ ID NO: 1150584 - protein, 9 aa, Homo Sapiens
VLRDGLACS

SEQ ID NO: 1150585 - protein, 9 aa, Homo Sapiens
HAERASAPT

SEQ ID NO: 1150586 - protein, 9 aa, Homo Sapiens
RPHPIHIGC

SEQ ID NO: 1150587 - protein, 9 aa, Homo Sapiens
GLPVGESPW

SEQ ID NO: 1150588 - protein, 9 aa, Homo Sapiens
CSVEFEEMD

SEQ ID NO: 1150589 - protein, 9 aa, Homo Sapiens
RSRAEKPTA

SEQ ID NO: 1150590 - protein, 9 aa, Homo Sapiens
YEMPYAGGV

SEQ ID NO: 1150591 - protein, 9 aa, Homo Sapiens
KNQIRKLKS

SEQ ID NO: 1150592 - protein, 9 aa, Homo Sapiens
AATTCAPGT

SEQ ID NO: 1150593 - protein, 9 aa, Homo Sapiens
VPPYTECDH

SEQ ID NO: 1150594 - protein, 9 aa, Homo Sapiens
KLQELLRHR

SEQ ID NO: 1150595 - protein, 9 aa, Homo Sapiens
AGPPGTVGP

SEQ ID NO: 1150596 - protein, 9 aa, Homo Sapiens
HPSRPCRMR

SEQ ID NO: 1150597 - protein, 9 aa, Homo Sapiens
DIIHEKMGI

SEQ ID NO: 1150598 - protein, 9 aa, Homo Sapiens
AATPLEVAR

SEQ ID NO: 1150599 - protein, 9 aa, Homo Sapiens
PWNTGLVAI

SEQ ID NO: 1150600 - protein, 9 aa, Homo Sapiens
IVRDPFKRL

SEQ ID NO: 1150601 - protein, 9 aa, Homo Sapiens
WIAPPCPGP

SEQ ID NO: 1150602 - protein, 9 aa, Homo Sapiens
GVPHLVSGG

SEQ ID NO: 1150603 - protein, 9 aa, Homo Sapiens
VAWLKMLCV

SEQ ID NO: 1150604 - protein, 9 aa, Homo Sapiens
QDHVSMHRS

SEQ ID NO: 1150605 - protein, 9 aa, Homo Sapiens
SPPTQQPQT

SEQ ID NO: 1150606 - protein, 9 aa, Homo Sapiens
KPTGSSRLA

SEQ ID NO: 1150607 - protein, 9 aa, Homo Sapiens
TGVAQSAGP

SEQ ID NO: 1150608 - protein, 9 aa, Homo Sapiens
ECVYPDYRG

SEQ ID NO: 1150609 - protein, 9 aa, Homo Sapiens
SHHPKPEWA

SEQ ID NO: 1150610 - protein, 9 aa, Homo Sapiens
LLSLRAGSL

SEQ ID NO: 1150611 - protein, 9 aa, Homo Sapiens
LGQMCIAYF

SEQ ID NO: 1150612 - protein, 9 aa, Homo Sapiens
GRGAEPAAP

SEQ ID NO: 1150613 - protein, 9 aa, Homo Sapiens
IGCTQTMVM

SEQ ID NO: 1150614 - protein, 9 aa, Homo Sapiens
QVKDAKIQD

SEQ ID NO: 1150615 - protein, 9 aa, Homo Sapiens
QEMFMQFGY

SEQ ID NO: 1150616 - protein, 9 aa, Homo Sapiens
DDFRYKTQA

SEQ ID NO: 1150617 - protein, 9 aa, Homo Sapiens
EARDLLSLR

SEQ ID NO: 1150618 - protein, 9 aa, Homo Sapiens
PRGRPRWPS

SEQ ID NO: 1150619 - protein, 9 aa, Homo Sapiens
LRWYHPSTH

SEQ ID NO: 1150620 - protein, 9 aa, Homo Sapiens
LESIFRNTL

SEQ ID NO: 1150621 - protein, 9 aa, Homo Sapiens
SLESGCGHG

SEQ ID NO: 1150622 - protein, 9 aa, Homo Sapiens
SQLRELCGH

SEQ ID NO: 1150623 - protein, 9 aa, Homo Sapiens
ARHHTREIF

SEQ ID NO: 1150624 - protein, 9 aa, Homo Sapiens
GGLVAHLLS

SEQ ID NO: 1150625 - protein, 9 aa, Homo Sapiens
QRLVELHMC

SEQ ID NO: 1150626 - protein, 9 aa, Homo Sapiens
CLALSEDRR

SEQ ID NO: 1150627 - protein, 9 aa, Homo Sapiens
PDVPEKREK

SEQ ID NO: 1150628 - protein, 9 aa, Homo Sapiens
QVGGRGGRL

SEQ ID NO: 1150629 - protein, 9 aa, Homo Sapiens
IDTSCKKRL

SEQ ID NO: 1150630 - protein, 9 aa, Homo Sapiens
SALDKTDAR

SEQ ID NO: 1150631 - protein, 9 aa, Homo Sapiens
ALALRLGIS

SEQ ID NO: 1150632 - protein, 9 aa, Homo Sapiens
TVHMQPIPA

SEQ ID NO: 1150633 - protein, 9 aa, Homo Sapiens
VIMWSPNDN

SEQ ID NO: 1150634 - protein, 9 aa, Homo Sapiens
KAPHRRAAS

SEQ ID NO: 1150635 - protein, 9 aa, Homo Sapiens
FSEATAEPT

SEQ ID NO: 1150636 - protein, 9 aa, Homo Sapiens
VKKGEEGGR

SEQ ID NO: 1150637 - protein, 9 aa, Homo Sapiens
GRRCSSWRE

SEQ ID NO: 1150638 - protein, 9 aa, Homo Sapiens
RTWRCWVAL

SEQ ID NO: 1150639 - protein, 9 aa, Homo Sapiens
TWKDVAILI

SEQ ID NO: 1150640 - protein, 9 aa, Homo Sapiens
SSLDPSNWK

SEQ ID NO: 1150641 - protein, 9 aa, Homo Sapiens
HPSLGGCPL

SEQ ID NO: 1150642 - protein, 9 aa, Homo Sapiens
VGAQEAVQE

SEQ ID NO: 1150643 - protein, 9 aa, Homo Sapiens
MFMQFGYVV

SEQ ID NO: 1150644 - protein, 9 aa, Homo Sapiens
PGAVGGCGP

SEQ ID NO: 1150645 - protein, 9 aa, Homo Sapiens
NKVQSDSSP

SEQ ID NO: 1150646 - protein, 9 aa, Homo Sapiens
DHQVPLWGQ

SEQ ID NO: 1150647 - protein, 9 aa, Homo Sapiens
REVCSSPRA

SEQ ID NO: 1150648 - protein, 9 aa, Homo Sapiens
PRGTFHLDE

SEQ ID NO: 1150649 - protein, 9 aa, Homo Sapiens
SSHITHIDW

SEQ ID NO: 1150650 - protein, 9 aa, Homo Sapiens
TLASAARRC

SEQ ID NO: 1150651 - protein, 9 aa, Homo Sapiens
QAYQAAGAS

SEQ ID NO: 1150652 - protein, 9 aa, Homo Sapiens
TWPQNWSST

SEQ ID NO: 1150653 - protein, 9 aa, Homo Sapiens
KSIFRLYSR

SEQ ID NO: 1150654 - protein, 9 aa, Homo Sapiens
MDLDGMLTV

SEQ ID NO: 1150655 - protein, 9 aa, Homo Sapiens
YCGPLRTVW

SEQ ID NO: 1150656 - protein, 9 aa, Homo Sapiens
PLEGMLLPR

SEQ ID NO: 1150657 - protein, 9 aa, Homo Sapiens
LGSEFTHIE

SEQ ID NO: 1150658 - protein, 9 aa, Homo Sapiens
PQGPPENQV

SEQ ID NO: 1150659 - protein, 9 aa, Homo Sapiens
QQKINTFAR

SEQ ID NO: 1150660 - protein, 9 aa, Homo Sapiens
NRFEAHASF

SEQ ID NO: 1150661 - protein, 9 aa, Homo Sapiens
ENSKPQQFL

SEQ ID NO: 1150662 - protein, 9 aa, Homo Sapiens
LLFFSSVIS

SEQ ID NO: 1150663 - protein, 9 aa, Homo Sapiens
QQTCLEEGT

SEQ ID NO: 1150664 - protein, 9 aa, Homo Sapiens
TQRRPATLA

SEQ ID NO: 1150665 - protein, 9 aa, Homo Sapiens
RRSKIEASP

SEQ ID NO: 1150666 - protein, 9 aa, Homo Sapiens
RRHPQLGQR

SEQ ID NO: 1150667 - protein, 9 aa, Homo Sapiens
TPQPPRRPS

SEQ ID NO: 1150668 - protein, 9 aa, Homo Sapiens
GGTTIGEVT

SEQ ID NO: 1150669 - protein, 9 aa, Homo Sapiens
PQTPQDSRQ

SEQ ID NO: 1150670 - protein, 9 aa, Homo Sapiens
IADSSASVR

SEQ ID NO: 1150671 - protein, 9 aa, Homo Sapiens
PAPLSVSPS

SEQ ID NO: 1150672 - protein, 9 aa, Homo Sapiens
RSRLPADTA

SEQ ID NO: 1150673 - protein, 9 aa, Homo Sapiens
ECMSMVWEK

SEQ ID NO: 1150674 - protein, 9 aa, Homo Sapiens
CNHEVCAQT

SEQ ID NO: 1150675 - protein, 9 aa, Homo Sapiens
HMTTCQSVH

SEQ ID NO: 1150676 - protein, 9 aa, Homo Sapiens
AEIEDTIAD

SEQ ID NO: 1150677 - protein, 9 aa, Homo Sapiens
ASSPTKCEI

SEQ ID NO: 1150678 - protein, 9 aa, Homo Sapiens
GFLAFPSPQ

SEQ ID NO: 1150679 - protein, 9 aa, Homo Sapiens
CLECCRLLS

SEQ ID NO: 1150680 - protein, 9 aa, Homo Sapiens
EEKKYSSLK

SEQ ID NO: 1150681 - protein, 9 aa, Homo Sapiens
VVQGALRSN

SEQ ID NO: 1150682 - protein, 9 aa, Homo Sapiens
TVTEDCLRS

SEQ ID NO: 1150683 - protein, 9 aa, Homo Sapiens
DLTKAEKHV

SEQ ID NO: 1150684 - protein, 9 aa, Homo Sapiens
VRSPELRGG

SEQ ID NO: 1150685 - protein, 9 aa, Homo Sapiens
YNKIVIPDE

SEQ ID NO: 1150686 - protein, 9 aa, Homo Sapiens
FFSSVISDC

SEQ ID NO: 1150687 - protein, 9 aa, Homo Sapiens
FINAAKIIH

SEQ ID NO: 1150688 - protein, 9 aa, Homo Sapiens
SEATAEPTV

SEQ ID NO: 1150689 - protein, 9 aa, Homo Sapiens
NEGATSTLT

SEQ ID NO: 1150690 - protein, 9 aa, Homo Sapiens
TSGLSSSPA

SEQ ID NO: 1150691 - protein, 9 aa, Homo Sapiens
KSKLISLFW

SEQ ID NO: 1150692 - protein, 9 aa, Homo Sapiens
PASTTACEP

SEQ ID NO: 1150693 - protein, 9 aa, Homo Sapiens
SLLTRMKEK

SEQ ID NO: 1150694 - protein, 9 aa, Homo Sapiens
NLAGRANDP

SEQ ID NO: 1150695 - protein, 9 aa, Homo Sapiens
FAKAIYEHL

SEQ ID NO: 1150696 - protein, 9 aa, Homo Sapiens
IYFFPFFFI

SEQ ID NO: 1150697 - protein, 9 aa, Homo Sapiens
RSDDQDLTH

SEQ ID NO: 1150698 - protein, 9 aa, Homo Sapiens
CSCPDSHKG

SEQ ID NO: 1150699 - protein, 9 aa, Homo Sapiens
FIKYWIYGC

SEQ ID NO: 1150700 - protein, 9 aa, Homo Sapiens
THTHARTAI

SEQ ID NO: 1150701 - protein, 9 aa, Homo Sapiens
RHPSLGGCP

SEQ ID NO: 1150702 - protein, 9 aa, Homo Sapiens
GRIIIDGAD

SEQ ID NO: 1150703 - protein, 9 aa, Homo Sapiens
CVEEPNDTI

SEQ ID NO: 1150704 - protein, 9 aa, Homo Sapiens
IQRPIQVQT

SEQ ID NO: 1150705 - protein, 9 aa, Homo Sapiens
AELEELCAV

SEQ ID NO: 1150706 - protein, 9 aa, Homo Sapiens
GTGVEDPLG

SEQ ID NO: 1150707 - protein, 9 aa, Homo Sapiens
KGVKFFDEF

SEQ ID NO: 1150708 - protein, 9 aa, Homo Sapiens
HPGSCAPFS

SEQ ID NO: 1150709 - protein, 9 aa, Homo Sapiens
IDHDDFRYK

SEQ ID NO: 1150710 - protein, 9 aa, Homo Sapiens
GASSSTSRD

SEQ ID NO: 1150711 - protein, 9 aa, Homo Sapiens
SGKAPHRRA

SEQ ID NO: 1150712 - protein, 9 aa, Homo Sapiens
EEATELIKH

SEQ ID NO: 1150713 - protein, 9 aa, Homo Sapiens
GPGAVGGCG

SEQ ID NO: 1150714 - protein, 9 aa, Homo Sapiens
PTYDSTHSM

SEQ ID NO: 1150715 - protein, 9 aa, Homo Sapiens
IEKLVASRL

SEQ ID NO: 1150716 - protein, 9 aa, Homo Sapiens
RPPVLSPRV

SEQ ID NO: 1150717 - protein, 9 aa, Homo Sapiens
SRDGLSEDQ

SEQ ID NO: 1150718 - protein, 9 aa, Homo Sapiens
TKHVPGEFG

SEQ ID NO: 1150719 - protein, 9 aa, Homo Sapiens
RPGVSKDGM

SEQ ID NO: 1150720 - protein, 9 aa, Homo Sapiens
QGLLYDWSW

SEQ ID NO: 1150721 - protein, 9 aa, Homo Sapiens
VPAGILPSS

SEQ ID NO: 1150722 - protein, 9 aa, Homo Sapiens
KELASIHDK

SEQ ID NO: 1150723 - protein, 9 aa, Homo Sapiens
STHLIVQHL

SEQ ID NO: 1150724 - protein, 9 aa, Homo Sapiens
RDKRLCPSE

SEQ ID NO: 1150725 - protein, 9 aa, Homo Sapiens
TCQDHVSMH

SEQ ID NO: 1150726 - protein, 9 aa, Homo Sapiens
LVDLAGEEA

SEQ ID NO: 1150727 - protein, 9 aa, Homo Sapiens
PGGGALPGR

SEQ ID NO: 1150728 - protein, 9 aa, Homo Sapiens
FLDRTFRHH

SEQ ID NO: 1150729 - protein, 9 aa, Homo Sapiens
GSQSGTKMK

SEQ ID NO: 1150730 - protein, 9 aa, Homo Sapiens
DAASLLTRM

SEQ ID NO: 1150731 - protein, 9 aa, Homo Sapiens
WCPGMVSVV

SEQ ID NO: 1150732 - protein, 9 aa, Homo Sapiens
AVGGCGPEA

SEQ ID NO: 1150733 - protein, 9 aa, Homo Sapiens
LVCMGRVGH

SEQ ID NO: 1150734 - protein, 9 aa, Homo Sapiens
PIQPPLPAG

SEQ ID NO: 1150735 - protein, 9 aa, Homo Sapiens
SAATCTHRH

SEQ ID NO: 1150736 - protein, 9 aa, Homo Sapiens
QALGTQAGP

SEQ ID NO: 1150737 - protein, 9 aa, Homo Sapiens
KREKHSASE

SEQ ID NO: 1150738 - protein, 9 aa, Homo Sapiens
STTACEPAR

SEQ ID NO: 1150739 - protein, 9 aa, Homo Sapiens
AGAGPGAPG

SEQ ID NO: 1150740 - protein, 9 aa, Homo Sapiens
QLGQRAQLP

SEQ ID NO: 1150741 - protein, 9 aa, Homo Sapiens
KDYNEVYNY

SEQ ID NO: 1150742 - protein, 9 aa, Homo Sapiens
IHAQLTEQM

SEQ ID NO: 1150743 - protein, 9 aa, Homo Sapiens
EASVPATSG

SEQ ID NO: 1150744 - protein, 9 aa, Homo Sapiens
PPDTCRAPS

SEQ ID NO: 1150745 - protein, 9 aa, Homo Sapiens
EDVALCSSH

SEQ ID NO: 1150746 - protein, 9 aa, Homo Sapiens
FFFLFPLGY

SEQ ID NO: 1150747 - protein, 9 aa, Homo Sapiens
LLWWWWWCC

SEQ ID NO: 1150748 - protein, 9 aa, Homo Sapiens
LLLLVLQLR

SEQ ID NO: 1150749 - protein, 9 aa, Homo Sapiens
VQAGAAPKT

SEQ ID NO: 1150750 - protein, 9 aa, Homo Sapiens
CPGPKRMSC

SEQ ID NO: 1150751 - protein, 9 aa, Homo Sapiens
LCPHILDRL

SEQ ID NO: 1150752 - protein, 9 aa, Homo Sapiens
TTQHEIWWG

SEQ ID NO: 1150753 - protein, 9 aa, Homo Sapiens
PDCEVDSCT

SEQ ID NO: 1150754 - protein, 9 aa, Homo Sapiens
SPALRARGG

SEQ ID NO: 1150755 - protein, 9 aa, Homo Sapiens
YRKPLELFG

SEQ ID NO: 1150756 - protein, 9 aa, Homo Sapiens
LRDSSPITD

SEQ ID NO: 1150757 - protein, 9 aa, Homo Sapiens
GEVDVDGHV

SEQ ID NO: 1150758 - protein, 9 aa, Homo Sapiens
IDITWRWNS

SEQ ID NO: 1150759 - protein, 9 aa, Homo Sapiens
DRQPDPDVP

SEQ ID NO: 1150760 - protein, 9 aa, Homo Sapiens
EFTFRKFFD

SEQ ID NO: 1150761 - protein, 9 aa, Homo Sapiens
FDNMHDDPC

SEQ ID NO: 1150762 - protein, 9 aa, Homo Sapiens
LNPSTSSPK

SEQ ID NO: 1150763 - protein, 9 aa, Homo Sapiens
AEKVITPYT

SEQ ID NO: 1150764 - protein, 9 aa, Homo Sapiens
SRPTSSQEK

SEQ ID NO: 1150765 - protein, 9 aa, Homo Sapiens
APHRRAASM

SEQ ID NO: 1150766 - protein, 9 aa, Homo Sapiens
APITTSRPE

SEQ ID NO: 1150767 - protein, 9 aa, Homo Sapiens
YVEVAGAQD

SEQ ID NO: 1150768 - protein, 9 aa, Homo Sapiens
SLFEEELAF

SEQ ID NO: 1150769 - protein, 9 aa, Homo Sapiens
ARPGAVESC

SEQ ID NO: 1150770 - protein, 9 aa, Homo Sapiens
GTCSIWSTC

SEQ ID NO: 1150771 - protein, 9 aa, Homo Sapiens
LDRLQRGLP

SEQ ID NO: 1150772 - protein, 9 aa, Homo Sapiens
PSTMAAAAS

SEQ ID NO: 1150773 - protein, 9 aa, Homo Sapiens
GATAQIQRP

SEQ ID NO: 1150774 - protein, 9 aa, Homo Sapiens
QVHKDESVT

SEQ ID NO: 1150775 - protein, 9 aa, Homo Sapiens
LKRHFTVNM

SEQ ID NO: 1150776 - protein, 9 aa, Homo Sapiens
QLLRGGVLA

SEQ ID NO: 1150777 - protein, 9 aa, Homo Sapiens
EVVRFYAAA

SEQ ID NO: 1150778 - protein, 9 aa, Homo Sapiens
EECCPPARP

SEQ ID NO: 1150779 - protein, 9 aa, Homo Sapiens
TQTCPPKRG

SEQ ID NO: 1150780 - protein, 9 aa, Homo Sapiens
ATLTSTSCS

SEQ ID NO: 1150781 - protein, 9 aa, Homo Sapiens
FVDAREREH

SEQ ID NO: 1150782 - protein, 9 aa, Homo Sapiens
EVCAQTGET

SEQ ID NO: 1150783 - protein, 9 aa, Homo Sapiens
IPLERRSPQ

SEQ ID NO: 1150784 - protein, 9 aa, Homo Sapiens
PRSCRQTPP

SEQ ID NO: 1150785 - protein, 9 aa, Homo Sapiens
MARTGNGKT

SEQ ID NO: 1150786 - protein, 9 aa, Homo Sapiens
HTRGIWMWC

SEQ ID NO: 1150787 - protein, 9 aa, Homo Sapiens
SSSKESSWI

SEQ ID NO: 1150788 - protein, 9 aa, Homo Sapiens
THPSPHLYS

SEQ ID NO: 1150789 - protein, 9 aa, Homo Sapiens
PWKGRPLSV

SEQ ID NO: 1150790 - protein, 9 aa, Homo Sapiens
RSRSPCSGG

SEQ ID NO: 1150791 - protein, 9 aa, Homo Sapiens
EDTEEFPLC

SEQ ID NO: 1150792 - protein, 9 aa, Homo Sapiens
GPRGSPGPS

SEQ ID NO: 1150793 - protein, 9 aa, Homo Sapiens
QPFMPSLVP

SEQ ID NO: 1150794 - protein, 9 aa, Homo Sapiens
GAGAYILVR

SEQ ID NO: 1150795 - protein, 9 aa, Homo Sapiens
YVKDAWMQK

SEQ ID NO: 1150796 - protein, 9 aa, Homo Sapiens
PNDTITESS

SEQ ID NO: 1150797 - protein, 9 aa, Homo Sapiens
SGRRSAAGD

SEQ ID NO: 1150798 - protein, 9 aa, Homo Sapiens
SESWFMSVN

SEQ ID NO: 1150799 - protein, 9 aa, Homo Sapiens
GTTIGEVTS

SEQ ID NO: 1150800 - protein, 9 aa, Homo Sapiens
QTCPPKRGP

SEQ ID NO: 1150801 - protein, 9 aa, Homo Sapiens
CGFIQTATA

SEQ ID NO: 1150802 - protein, 9 aa, Homo Sapiens
QVFAFLKGL

SEQ ID NO: 1150803 - protein, 9 aa, Homo Sapiens
LSAALPQPC

SEQ ID NO: 1150804 - protein, 9 aa, Homo Sapiens
VTLQVPRGK

SEQ ID NO: 1150805 - protein, 9 aa, Homo Sapiens
THTCEKPYH

SEQ ID NO: 1150806 - protein, 9 aa, Homo Sapiens
ESGASQYPK

SEQ ID NO: 1150807 - protein, 9 aa, Homo Sapiens
KCWVLLCDP

SEQ ID NO: 1150808 - protein, 9 aa, Homo Sapiens
PLPQLLGPP

SEQ ID NO: 1150809 - protein, 9 aa, Homo Sapiens
PLGLLDWKM

SEQ ID NO: 1150810 - protein, 9 aa, Homo Sapiens
TRMYPLGLR

SEQ ID NO: 1150811 - protein, 9 aa, Homo Sapiens
DITKLYGEI

SEQ ID NO: 1150812 - protein, 9 aa, Homo Sapiens
VAIGEAPDH

SEQ ID NO: 1150813 - protein, 9 aa, Homo Sapiens
GNSLPQGAG

SEQ ID NO: 1150814 - protein, 9 aa, Homo Sapiens
NSVSRAFRD

SEQ ID NO: 1150815 - protein, 9 aa, Homo Sapiens
SQIQDAPDA

SEQ ID NO: 1150816 - protein, 9 aa, Homo Sapiens
ECDHAQPLA

SEQ ID NO: 1150817 - protein, 9 aa, Homo Sapiens
DAQSEAYLQ

SEQ ID NO: 1150818 - protein, 9 aa, Homo Sapiens
GPELNELDS

SEQ ID NO: 1150819 - protein, 9 aa, Homo Sapiens
IPAGTPWME

SEQ ID NO: 1150820 - protein, 9 aa, Homo Sapiens
PVAFGFLCN

SEQ ID NO: 1150821 - protein, 9 aa, Homo Sapiens
LRESGQWLG

SEQ ID NO: 1150822 - protein, 9 aa, Homo Sapiens
SHASIHASS

SEQ ID NO: 1150823 - protein, 9 aa, Homo Sapiens
ACVPVAEAS

SEQ ID NO: 1150824 - protein, 9 aa, Homo Sapiens
IAVLVCWRG

SEQ ID NO: 1150825 - protein, 9 aa, Homo Sapiens
LALRLGISL

SEQ ID NO: 1150826 - protein, 9 aa, Homo Sapiens
QGQLADYNT

SEQ ID NO: 1150827 - protein, 9 aa, Homo Sapiens
NLEKNSGSQ

SEQ ID NO: 1150828 - protein, 9 aa, Homo Sapiens
LCKTVKYAL

SEQ ID NO: 1150829 - protein, 9 aa, Homo Sapiens
PQWTQTCPP

SEQ ID NO: 1150830 - protein, 9 aa, Homo Sapiens
GLESLAQAA

SEQ ID NO: 1150831 - protein, 9 aa, Homo Sapiens
PILHVSSKS

SEQ ID NO: 1150832 - protein, 9 aa, Homo Sapiens
IHCRGGKGH

SEQ ID NO: 1150833 - protein, 9 aa, Homo Sapiens
QMLTLKCVT

SEQ ID NO: 1150834 - protein, 9 aa, Homo Sapiens
SQRERGADG

SEQ ID NO: 1150835 - protein, 9 aa, Homo Sapiens
GSLFEEELA

SEQ ID NO: 1150836 - protein, 9 aa, Homo Sapiens
LSHHPKPEW

SEQ ID NO: 1150837 - protein, 9 aa, Homo Sapiens
PLLGDQLVG

SEQ ID NO: 1150838 - protein, 9 aa, Homo Sapiens
SSLESGCGH

SEQ ID NO: 1150839 - protein, 9 aa, Homo Sapiens
TIGEIAQGI

SEQ ID NO: 1150840 - protein, 9 aa, Homo Sapiens
SPIALHVKQ

SEQ ID NO: 1150841 - protein, 9 aa, Homo Sapiens
QGAPVRSPE

SEQ ID NO: 1150842 - protein, 9 aa, Homo Sapiens
VPRVRFTND

SEQ ID NO: 1150843 - protein, 9 aa, Homo Sapiens
GRGEQSDCP

SEQ ID NO: 1150844 - protein, 9 aa, Homo Sapiens
RGDNPTPQL

SEQ ID NO: 1150845 - protein, 9 aa, Homo Sapiens
LGGMIEVEP

SEQ ID NO: 1150846 - protein, 9 aa, Homo Sapiens
LWTQQTCLE

SEQ ID NO: 1150847 - protein, 9 aa, Homo Sapiens
RTSAALEKN

SEQ ID NO: 1150848 - protein, 9 aa, Homo Sapiens
FTAHEVGKV

SEQ ID NO: 1150849 - protein, 9 aa, Homo Sapiens
MLSPGAWNG

SEQ ID NO: 1150850 - protein, 9 aa, Homo Sapiens
HSGSIKNNI

SEQ ID NO: 1150851 - protein, 9 aa, Homo Sapiens
ALERIGGPP

SEQ ID NO: 1150852 - protein, 9 aa, Homo Sapiens
LDKVPKKRI

SEQ ID NO: 1150853 - protein, 9 aa, Homo Sapiens
SLQRLSRPT

SEQ ID NO: 1150854 - protein, 9 aa, Homo Sapiens
VRSEAEDSS

SEQ ID NO: 1150855 - protein, 9 aa, Homo Sapiens
RQLTRMYPL

SEQ ID NO: 1150856 - protein, 9 aa, Homo Sapiens
LIIVDAAVV

SEQ ID NO: 1150857 - protein, 9 aa, Homo Sapiens
PAGILPSSR

SEQ ID NO: 1150858 - protein, 9 aa, Homo Sapiens
LAWKSTMAQ

SEQ ID NO: 1150859 - protein, 9 aa, Homo Sapiens
DRRTMRLRH

SEQ ID NO: 1150860 - protein, 9 aa, Homo Sapiens
QAPCSTPCP

SEQ ID NO: 1150861 - protein, 9 aa, Homo Sapiens
PVPKKRERM

SEQ ID NO: 1150862 - protein, 9 aa, Homo Sapiens
LTNDILVIK

SEQ ID NO: 1150863 - protein, 9 aa, Homo Sapiens
AHVQAPGRS

SEQ ID NO: 1150864 - protein, 9 aa, Homo Sapiens
KAKSPVNEE

SEQ ID NO: 1150865 - protein, 9 aa, Homo Sapiens
GATSTLTMN

SEQ ID NO: 1150866 - protein, 9 aa, Homo Sapiens
TQSSRPRRT

SEQ ID NO: 1150867 - protein, 9 aa, Homo Sapiens
WKDWYLPDT

SEQ ID NO: 1150868 - protein, 9 aa, Homo Sapiens
GGAWKSIFR

SEQ ID NO: 1150869 - protein, 9 aa, Homo Sapiens
GCHASGDSL

SEQ ID NO: 1150870 - protein, 9 aa, Homo Sapiens
RSSQSRSPV

SEQ ID NO: 1150871 - protein, 9 aa, Homo Sapiens
WQVMASLTG

SEQ ID NO: 1150872 - protein, 9 aa, Homo Sapiens
TVIGRELRP

SEQ ID NO: 1150873 - protein, 9 aa, Homo Sapiens
VAKSTPASL

SEQ ID NO: 1150874 - protein, 9 aa, Homo Sapiens
NSTMSSKSP

SEQ ID NO: 1150875 - protein, 9 aa, Homo Sapiens
PSGQGAAAR

SEQ ID NO: 1150876 - protein, 9 aa, Homo Sapiens
GRVFKGLRY

SEQ ID NO: 1150877 - protein, 9 aa, Homo Sapiens
PSRLSASRP

SEQ ID NO: 1150878 - protein, 9 aa, Homo Sapiens
TLFHCILGP

SEQ ID NO: 1150879 - protein, 9 aa, Homo Sapiens
LGLGGGGKA

SEQ ID NO: 1150880 - protein, 9 aa, Homo Sapiens
KCKMLLARH

SEQ ID NO: 1150881 - protein, 9 aa, Homo Sapiens
PGKPWTSTS

SEQ ID NO: 1150882 - protein, 9 aa, Homo Sapiens
PAGPKSRAA

SEQ ID NO: 1150883 - protein, 9 aa, Homo Sapiens
MPTYCYECE

SEQ ID NO: 1150884 - protein, 9 aa, Homo Sapiens
SHAERASAP

SEQ ID NO: 1150885 - protein, 9 aa, Homo Sapiens
SAPLGGMEC

SEQ ID NO: 1150886 - protein, 9 aa, Homo Sapiens
FVKHAEEVR

SEQ ID NO: 1150887 - protein, 9 aa, Homo Sapiens
ACCPSRNTR

SEQ ID NO: 1150888 - protein, 9 aa, Homo Sapiens
TVTDTWVMK

SEQ ID NO: 1150889 - protein, 9 aa, Homo Sapiens
SQEKMAAEL

SEQ ID NO: 1150890 - protein, 9 aa, Homo Sapiens
FVDGLAFKV

SEQ ID NO: 1150891 - protein, 9 aa, Homo Sapiens
PCASLLSTL

SEQ ID NO: 1150892 - protein, 9 aa, Homo Sapiens
IGEANEDVA

SEQ ID NO: 1150893 - protein, 9 aa, Homo Sapiens
PQTPPRDAN

SEQ ID NO: 1150894 - protein, 9 aa, Homo Sapiens
TTPKAAAPS

SEQ ID NO: 1150895 - protein, 9 aa, Homo Sapiens
LRVLHGAPW

SEQ ID NO: 1150896 - protein, 9 aa, Homo Sapiens
VCTMINSND

SEQ ID NO: 1150897 - protein, 9 aa, Homo Sapiens
GSHPWFLGQ

SEQ ID NO: 1150898 - protein, 9 aa, Homo Sapiens
TEEFPLCAL

SEQ ID NO: 1150899 - protein, 9 aa, Homo Sapiens
YHGLEGNHK

SEQ ID NO: 1150900 - protein, 9 aa, Homo Sapiens
EILNTNSIS

SEQ ID NO: 1150901 - protein, 9 aa, Homo Sapiens
QNFSFISLA

SEQ ID NO: 1150902 - protein, 9 aa, Homo Sapiens
GEGLATEGG

SEQ ID NO: 1150903 - protein, 9 aa, Homo Sapiens
QDHQVPLWG

SEQ ID NO: 1150904 - protein, 9 aa, Homo Sapiens
DSSPSTSVD

SEQ ID NO: 1150905 - protein, 9 aa, Homo Sapiens
LTVPTAPPL

SEQ ID NO: 1150906 - protein, 9 aa, Homo Sapiens
MKRFLTLAS

SEQ ID NO: 1150907 - protein, 9 aa, Homo Sapiens
RRVQELTGC

SEQ ID NO: 1150908 - protein, 9 aa, Homo Sapiens
DYRCSVYTQ

SEQ ID NO: 1150909 - protein, 9 aa, Homo Sapiens
LYSRAVLVE

SEQ ID NO: 1150910 - protein, 9 aa, Homo Sapiens
NYASRGQNI

SEQ ID NO: 1150911 - protein, 9 aa, Homo Sapiens
RGVSYLAAA

SEQ ID NO: 1150912 - protein, 9 aa, Homo Sapiens
QHYLQLIQV

SEQ ID NO: 1150913 - protein, 9 aa, Homo Sapiens
LRAVLGLGG

SEQ ID NO: 1150914 - protein, 9 aa, Homo Sapiens
PPCSLSAAT

SEQ ID NO: 1150915 - protein, 9 aa, Homo Sapiens
KAPEETPQP

SEQ ID NO: 1150916 - protein, 9 aa, Homo Sapiens
WMVKSWVIS

SEQ ID NO: 1150917 - protein, 9 aa, Homo Sapiens
LKGYACHHC

SEQ ID NO: 1150918 - protein, 9 aa, Homo Sapiens
TRHDDPESE

SEQ ID NO: 1150919 - protein, 9 aa, Homo Sapiens
KCRYKSKVT

SEQ ID NO: 1150920 - protein, 9 aa, Homo Sapiens
LPVITGSSQ

SEQ ID NO: 1150921 - protein, 9 aa, Homo Sapiens
KEARDLLSL

SEQ ID NO: 1150922 - protein, 9 aa, Homo Sapiens
NELCVAPEE

SEQ ID NO: 1150923 - protein, 9 aa, Homo Sapiens
GWMFASDSY

SEQ ID NO: 1150924 - protein, 9 aa, Homo Sapiens
LHIFIGSLL

SEQ ID NO: 1150925 - protein, 9 aa, Homo Sapiens
CTVRSQTGS

SEQ ID NO: 1150926 - protein, 9 aa, Homo Sapiens
RRSAAGDGS

SEQ ID NO: 1150927 - protein, 9 aa, Homo Sapiens
SHITHIDWD

SEQ ID NO: 1150928 - protein, 9 aa, Homo Sapiens
TGNGKTACF

SEQ ID NO: 1150929 - protein, 9 aa, Homo Sapiens
DENKETRMS

SEQ ID NO: 1150930 - protein, 9 aa, Homo Sapiens
LPASRVRYG

SEQ ID NO: 1150931 - protein, 9 aa, Homo Sapiens
CRLLSAIYS

SEQ ID NO: 1150932 - protein, 9 aa, Homo Sapiens
QAVASRAAT

SEQ ID NO: 1150933 - protein, 9 aa, Homo Sapiens
PTLDVFWRV

SEQ ID NO: 1150934 - protein, 9 aa, Homo Sapiens
ASRVAGTAG

SEQ ID NO: 1150935 - protein, 9 aa, Homo Sapiens
CVPVAEAST

SEQ ID NO: 1150936 - protein, 9 aa, Homo Sapiens
LLLPVITGS

SEQ ID NO: 1150937 - protein, 9 aa, Homo Sapiens
YTVKAHNGA

SEQ ID NO: 1150938 - protein, 9 aa, Homo Sapiens
SLSCWLSCR

SEQ ID NO: 1150939 - protein, 9 aa, Homo Sapiens
WGNDSSVPR

SEQ ID NO: 1150940 - protein, 9 aa, Homo Sapiens
VITGSSQDT

SEQ ID NO: 1150941 - protein, 9 aa, Homo Sapiens
LLRGQVPAR

SEQ ID NO: 1150942 - protein, 9 aa, Homo Sapiens
CCSMGQTWG

SEQ ID NO: 1150943 - protein, 9 aa, Homo Sapiens
RLEEPAGPK

SEQ ID NO: 1150944 - protein, 9 aa, Homo Sapiens
AAQPQNTFL

SEQ ID NO: 1150945 - protein, 9 aa, Homo Sapiens
CHQRRVPQP

SEQ ID NO: 1150946 - protein, 9 aa, Homo Sapiens
QAAGASPSA

SEQ ID NO: 1150947 - protein, 9 aa, Homo Sapiens
LDAQRESGS

SEQ ID NO: 1150948 - protein, 9 aa, Homo Sapiens
PTRQTLPAL

SEQ ID NO: 1150949 - protein, 9 aa, Homo Sapiens
GDEQVMQNQ

SEQ ID NO: 1150950 - protein, 9 aa, Homo Sapiens
RSRWSRVPD

SEQ ID NO: 1150951 - protein, 9 aa, Homo Sapiens
CSSWREGRE

SEQ ID NO: 1150952 - protein, 9 aa, Homo Sapiens
LQEAELRHV

SEQ ID NO: 1150953 - protein, 9 aa, Homo Sapiens
PPYTECDHA

SEQ ID NO: 1150954 - protein, 9 aa, Homo Sapiens
ILLLQPQPQ

SEQ ID NO: 1150955 - protein, 9 aa, Homo Sapiens
RGPCTTIKA

SEQ ID NO: 1150956 - protein, 9 aa, Homo Sapiens
CNPLHYLTV

SEQ ID NO: 1150957 - protein, 9 aa, Homo Sapiens
LRRPPGGGA

SEQ ID NO: 1150958 - protein, 9 aa, Homo Sapiens
TSRSVLSVP

SEQ ID NO: 1150959 - protein, 9 aa, Homo Sapiens
ALGTCSIWS

SEQ ID NO: 1150960 - protein, 9 aa, Homo Sapiens
GSEELDMVI

SEQ ID NO: 1150961 - protein, 9 aa, Homo Sapiens
EGSCGFVRR

SEQ ID NO: 1150962 - protein, 9 aa, Homo Sapiens
RRCSSWREG

SEQ ID NO: 1150963 - protein, 9 aa, Homo Sapiens
GLPRNMALE

SEQ ID NO: 1150964 - protein, 9 aa, Homo Sapiens
VEGYSNLLQ

SEQ ID NO: 1150965 - protein, 9 aa, Homo Sapiens
WTATMPTYC

SEQ ID NO: 1150966 - protein, 9 aa, Homo Sapiens
KDRWSVRPS

SEQ ID NO: 1150967 - protein, 9 aa, Homo Sapiens
DPREPTRLH

SEQ ID NO: 1150968 - protein, 9 aa, Homo Sapiens
TYLLLHHQP

SEQ ID NO: 1150969 - protein, 9 aa, Homo Sapiens
FRRLQSSGG

SEQ ID NO: 1150970 - protein, 9 aa, Homo Sapiens
YNKVSRFPE

SEQ ID NO: 1150971 - protein, 9 aa, Homo Sapiens
VSRWVIRPY

SEQ ID NO: 1150972 - protein, 9 aa, Homo Sapiens
QRRPATLAS

SEQ ID NO: 1150973 - protein, 9 aa, Homo Sapiens
FSSVISDCT

SEQ ID NO: 1150974 - protein, 9 aa, Homo Sapiens
RPPHLPSCH

SEQ ID NO: 1150975 - protein, 9 aa, Homo Sapiens
RGTQCAICR

SEQ ID NO: 1150976 - protein, 9 aa, Homo Sapiens
ATTTARQPS

SEQ ID NO: 1150977 - protein, 9 aa, Homo Sapiens
EAWEGLWMP

SEQ ID NO: 1150978 - protein, 9 aa, Homo Sapiens
MFTPFLVHK

SEQ ID NO: 1150979 - protein, 9 aa, Homo Sapiens
TDTSLTMGI

SEQ ID NO: 1150980 - protein, 9 aa, Homo Sapiens
GSPPGTRPK

SEQ ID NO: 1150981 - protein, 9 aa, Homo Sapiens
TTYPEQMDC

SEQ ID NO: 1150982 - protein, 9 aa, Homo Sapiens
QVGSEAGKF

SEQ ID NO: 1150983 - protein, 9 aa, Homo Sapiens
DECVSQEHQ

SEQ ID NO: 1150984 - protein, 9 aa, Homo Sapiens
VFPHVCGVR

SEQ ID NO: 1150985 - protein, 9 aa, Homo Sapiens
DNLEKNSGS

SEQ ID NO: 1150986 - protein, 9 aa, Homo Sapiens
LPKNTLMQL

SEQ ID NO: 1150987 - protein, 9 aa, Homo Sapiens
RAWKHSPLL

SEQ ID NO: 1150988 - protein, 9 aa, Homo Sapiens
GPCTTIKAK

SEQ ID NO: 1150989 - protein, 9 aa, Homo Sapiens
KETRMSCTV

SEQ ID NO: 1150990 - protein, 9 aa, Homo Sapiens
FKLIGDTSI

SEQ ID NO: 1150991 - protein, 9 aa, Homo Sapiens
GLEANDECR

SEQ ID NO: 1150992 - protein, 9 aa, Homo Sapiens
NFYSVVGRN

SEQ ID NO: 1150993 - protein, 9 aa, Homo Sapiens
RSWLPCRGP

SEQ ID NO: 1150994 - protein, 9 aa, Homo Sapiens
SVELTGMSA

SEQ ID NO: 1150995 - protein, 9 aa, Homo Sapiens
QTATALAIT

SEQ ID NO: 1150996 - protein, 9 aa, Homo Sapiens
PPENQVSVG

SEQ ID NO: 1150997 - protein, 9 aa, Homo Sapiens
MATTNTTGS

SEQ ID NO: 1150998 - protein, 9 aa, Homo Sapiens
WWGQMSKPS

SEQ ID NO: 1150999 - protein, 9 aa, Homo Sapiens
PDRVVLRRY

SEQ ID NO: 1151000 - protein, 9 aa, Homo Sapiens
ENVLWDFWD

SEQ ID NO: 1151001 - protein, 9 aa, Homo Sapiens
AYCSLSFPG

SEQ ID NO: 1151002 - protein, 9 aa, Homo Sapiens
LAGILICIM

SEQ ID NO: 1151003 - protein, 9 aa, Homo Sapiens
QPAQTWPAC

SEQ ID NO: 1151004 - protein, 9 aa, Homo Sapiens
YSLQRTSAA

SEQ ID NO: 1151005 - protein, 9 aa, Homo Sapiens
PLTHLSMMP

SEQ ID NO: 1151006 - protein, 9 aa, Homo Sapiens
HLRKVPDVL

SEQ ID NO: 1151007 - protein, 9 aa, Homo Sapiens
GPPSAPMPS

SEQ ID NO: 1151008 - protein, 9 aa, Homo Sapiens
MSYSMEVSY

SEQ ID NO: 1151009 - protein, 9 aa, Homo Sapiens
QTGSPRSST

SEQ ID NO: 1151010 - protein, 9 aa, Homo Sapiens
KKFIKIATH

SEQ ID NO: 1151011 - protein, 9 aa, Homo Sapiens
PLTPDVAGL

SEQ ID NO: 1151012 - protein, 9 aa, Homo Sapiens
THGPSAGAP

SEQ ID NO: 1151013 - protein, 9 aa, Homo Sapiens
VPFAAAAAA

SEQ ID NO: 1151014 - protein, 9 aa, Homo Sapiens
KEIHAQLTE

SEQ ID NO: 1151015 - protein, 9 aa, Homo Sapiens
RPTKTRMLY

SEQ ID NO: 1151016 - protein, 9 aa, Homo Sapiens
LRYWLHYLR

SEQ ID NO: 1151017 - protein, 9 aa, Homo Sapiens
APQQAWIVS

SEQ ID NO: 1151018 - protein, 9 aa, Homo Sapiens
QKINTFARN

SEQ ID NO: 1151019 - protein, 9 aa, Homo Sapiens
RSPCSGGWC

SEQ ID NO: 1151020 - protein, 9 aa, Homo Sapiens
TWIKTTLIL

SEQ ID NO: 1151021 - protein, 9 aa, Homo Sapiens
EKLQRNSQF

SEQ ID NO: 1151022 - protein, 9 aa, Homo Sapiens
AYILVRYAL

SEQ ID NO: 1151023 - protein, 9 aa, Homo Sapiens
MPSAVSCFS

SEQ ID NO: 1151024 - protein, 9 aa, Homo Sapiens
LEKNSGSQS

SEQ ID NO: 1151025 - protein, 9 aa, Homo Sapiens
NTKLSLDVE

SEQ ID NO: 1151026 - protein, 9 aa, Homo Sapiens
QRSLGPDTQ

SEQ ID NO: 1151027 - protein, 9 aa, Homo Sapiens
GMYRYGPAS

SEQ ID NO: 1151028 - protein, 9 aa, Homo Sapiens
VDLPLSYCN

SEQ ID NO: 1151029 - protein, 9 aa, Homo Sapiens
DGEEATELI

SEQ ID NO: 1151030 - protein, 9 aa, Homo Sapiens
APCRPPPVP

SEQ ID NO: 1151031 - protein, 9 aa, Homo Sapiens
PSLLSRMPA

SEQ ID NO: 1151032 - protein, 9 aa, Homo Sapiens
RVRCLGTKT

SEQ ID NO: 1151033 - protein, 9 aa, Homo Sapiens
LAACGATIQ

SEQ ID NO: 1151034 - protein, 9 aa, Homo Sapiens
WKTKFYRQR

SEQ ID NO: 1151035 - protein, 9 aa, Homo Sapiens
PAPAPLSVS

SEQ ID NO: 1151036 - protein, 9 aa, Homo Sapiens
RGMGRRPRP

SEQ ID NO: 1151037 - protein, 9 aa, Homo Sapiens
TCEKPYHCL

SEQ ID NO: 1151038 - protein, 9 aa, Homo Sapiens
CKRKVGGAS

SEQ ID NO: 1151039 - protein, 9 aa, Homo Sapiens
RKLRKNVRR

SEQ ID NO: 1151040 - protein, 9 aa, Homo Sapiens
IQVDVAISI

SEQ ID NO: 1151041 - protein, 9 aa, Homo Sapiens
VALSLTSSL

SEQ ID NO: 1151042 - protein, 9 aa, Homo Sapiens
LTRSNDPKM

SEQ ID NO: 1151043 - protein, 9 aa, Homo Sapiens
MIFLFTDAR

SEQ ID NO: 1151044 - protein, 9 aa, Homo Sapiens
NPRTSTNKE

SEQ ID NO: 1151045 - protein, 9 aa, Homo Sapiens
RYFDPKMLW

SEQ ID NO: 1151046 - protein, 9 aa, Homo Sapiens
SHVSSFPSS

SEQ ID NO: 1151047 - protein, 9 aa, Homo Sapiens
PIQNTLWQA

SEQ ID NO: 1151048 - protein, 9 aa, Homo Sapiens
NDNVPVFPM

SEQ ID NO: 1151049 - protein, 9 aa, Homo Sapiens
SSPTKCEIC

SEQ ID NO: 1151050 - protein, 9 aa, Homo Sapiens
MHRSPHFLP

SEQ ID NO: 1151051 - protein, 9 aa, Homo Sapiens
QWVVGTYLL

SEQ ID NO: 1151052 - protein, 9 aa, Homo Sapiens
RAQLPGQVH

SEQ ID NO: 1151053 - protein, 9 aa, Homo Sapiens
SQFVITPKK

SEQ ID NO: 1151054 - protein, 9 aa, Homo Sapiens
QVWEPPWTG

SEQ ID NO: 1151055 - protein, 9 aa, Homo Sapiens
GDRPTRRPS

SEQ ID NO: 1151056 - protein, 9 aa, Homo Sapiens
WRHQSHCFY

SEQ ID NO: 1151057 - protein, 9 aa, Homo Sapiens
LVEGYSNLL

SEQ ID NO: 1151058 - protein, 9 aa, Homo Sapiens
CLAVLWVAK

SEQ ID NO: 1151059 - protein, 9 aa, Homo Sapiens
CSNSSDSDS

SEQ ID NO: 1151060 - protein, 9 aa, Homo Sapiens
YSASEYCWH

SEQ ID NO: 1151061 - protein, 9 aa, Homo Sapiens
KLEKALSAL

SEQ ID NO: 1151062 - protein, 9 aa, Homo Sapiens
VIELNKHIS

SEQ ID NO: 1151063 - protein, 9 aa, Homo Sapiens
DDLIEKLVA

SEQ ID NO: 1151064 - protein, 9 aa, Homo Sapiens
CPGTMEPIT

SEQ ID NO: 1151065 - protein, 9 aa, Homo Sapiens
VTCLNIQDV

SEQ ID NO: 1151066 - protein, 9 aa, Homo Sapiens
RPAGARRLA

SEQ ID NO: 1151067 - protein, 9 aa, Homo Sapiens
TPLWQTSTL

SEQ ID NO: 1151068 - protein, 9 aa, Homo Sapiens
STSAATCTH

SEQ ID NO: 1151069 - protein, 9 aa, Homo Sapiens
IVDYIDAQS

SEQ ID NO: 1151070 - protein, 9 aa, Homo Sapiens
PTTPIPHLS

SEQ ID NO: 1151071 - protein, 9 aa, Homo Sapiens
RHPRHPRLR

SEQ ID NO: 1151072 - protein, 9 aa, Homo Sapiens
MNMKGPEGR

SEQ ID NO: 1151073 - protein, 9 aa, Homo Sapiens
RGGKGHIGV

SEQ ID NO: 1151074 - protein, 9 aa, Homo Sapiens
NVSSRPRKD

SEQ ID NO: 1151075 - protein, 9 aa, Homo Sapiens
VFSRMGATP

SEQ ID NO: 1151076 - protein, 9 aa, Homo Sapiens
RNCVSAVDE

SEQ ID NO: 1151077 - protein, 9 aa, Homo Sapiens
LYHSGKPPA

SEQ ID NO: 1151078 - protein, 9 aa, Homo Sapiens
LLLGVCGHL

SEQ ID NO: 1151079 - protein, 9 aa, Homo Sapiens
KFGLVCMGR

SEQ ID NO: 1151080 - protein, 9 aa, Homo Sapiens
AMKLVTKHV

SEQ ID NO: 1151081 - protein, 9 aa, Homo Sapiens
TPPASTTAC

SEQ ID NO: 1151082 - protein, 9 aa, Homo Sapiens
LESDEVAWL

SEQ ID NO: 1151083 - protein, 9 aa, Homo Sapiens
NISNNKREK

SEQ ID NO: 1151084 - protein, 9 aa, Homo Sapiens
NVQEQHVGL

SEQ ID NO: 1151085 - protein, 9 aa, Homo Sapiens
PQLGQRAQL

SEQ ID NO: 1151086 - protein, 9 aa, Homo Sapiens
AWMQKYEDI

SEQ ID NO: 1151087 - protein, 9 aa, Homo Sapiens
NPASLLPVL

SEQ ID NO: 1151088 - protein, 9 aa, Homo Sapiens
VARRDGDLG

SEQ ID NO: 1151089 - protein, 9 aa, Homo Sapiens
SLGPDTQPP

SEQ ID NO: 1151090 - protein, 9 aa, Homo Sapiens
WGLETKEVY

SEQ ID NO: 1151091 - protein, 9 aa, Homo Sapiens
YDTLQAYVT

SEQ ID NO: 1151092 - protein, 9 aa, Homo Sapiens
PPTAEGLVS

SEQ ID NO: 1151093 - protein, 9 aa, Homo Sapiens
GARPPGNSA

SEQ ID NO: 1151094 - protein, 9 aa, Homo Sapiens
RRVPQPAQT

SEQ ID NO: 1151095 - protein, 9 aa, Homo Sapiens
NDRHGSVSE

SEQ ID NO: 1151096 - protein, 9 aa, Homo Sapiens
FIQTATALA

SEQ ID NO: 1151097 - protein, 9 aa, Homo Sapiens
RFPFAVVLH

SEQ ID NO: 1151098 - protein, 9 aa, Homo Sapiens
ARRAARCTR

SEQ ID NO: 1151099 - protein, 9 aa, Homo Sapiens
HSRQRQDPS

SEQ ID NO: 1151100 - protein, 9 aa, Homo Sapiens
LPSYLDKVP

SEQ ID NO: 1151101 - protein, 9 aa, Homo Sapiens
CWHINFTTF

SEQ ID NO: 1151102 - protein, 9 aa, Homo Sapiens
DATASPSSE

SEQ ID NO: 1151103 - protein, 9 aa, Homo Sapiens
SAPTRQTLP

SEQ ID NO: 1151104 - protein, 9 aa, Homo Sapiens
PARPHVPHD

SEQ ID NO: 1151105 - protein, 9 aa, Homo Sapiens
AMPGGSPPG

SEQ ID NO: 1151106 - protein, 9 aa, Homo Sapiens
VGGGGRWDV

SEQ ID NO: 1151107 - protein, 9 aa, Homo Sapiens
RVGIGAFHT

SEQ ID NO: 1151108 - protein, 9 aa, Homo Sapiens
VLVSVLHEL

SEQ ID NO: 1151109 - protein, 9 aa, Homo Sapiens
IDLRHQIQL

SEQ ID NO: 1151110 - protein, 9 aa, Homo Sapiens
PLGYLLVPA

SEQ ID NO: 1151111 - protein, 9 aa, Homo Sapiens
PTTLFHPMP

SEQ ID NO: 1151112 - protein, 9 aa, Homo Sapiens
AACGATIQE

SEQ ID NO: 1151113 - protein, 9 aa, Homo Sapiens
EVCSSPRAG

SEQ ID NO: 1151114 - protein, 9 aa, Homo Sapiens
LIGAMETRS

SEQ ID NO: 1151115 - protein, 9 aa, Homo Sapiens
GGGGKATGV

SEQ ID NO: 1151116 - protein, 9 aa, Homo Sapiens
EGNRLETMR

SEQ ID NO: 1151117 - protein, 9 aa, Homo Sapiens
PPAHARLAP

SEQ ID NO: 1151118 - protein, 9 aa, Homo Sapiens
PCARGQRQN

SEQ ID NO: 1151119 - protein, 9 aa, Homo Sapiens
IEASPIGSI

SEQ ID NO: 1151120 - protein, 9 aa, Homo Sapiens
DRTCTCRPP

SEQ ID NO: 1151121 - protein, 9 aa, Homo Sapiens
NSSDSDSGD

SEQ ID NO: 1151122 - protein, 9 aa, Homo Sapiens
LHHQPTSPM

SEQ ID NO: 1151123 - protein, 9 aa, Homo Sapiens
GPPGTVGPL

SEQ ID NO: 1151124 - protein, 9 aa, Homo Sapiens
LDEYASIVS

SEQ ID NO: 1151125 - protein, 9 aa, Homo Sapiens
VQTHIKALL

SEQ ID NO: 1151126 - protein, 9 aa, Homo Sapiens
CRNCGHICN

SEQ ID NO: 1151127 - protein, 9 aa, Homo Sapiens
SCNHEVCAQ

SEQ ID NO: 1151128 - protein, 9 aa, Homo Sapiens
QLLGPPPPH

SEQ ID NO: 1151129 - protein, 9 aa, Homo Sapiens
TFFLMLPEM

SEQ ID NO: 1151130 - protein, 9 aa, Homo Sapiens
DISPGALFL

SEQ ID NO: 1151131 - protein, 9 aa, Homo Sapiens
LEGQPTLDV

SEQ ID NO: 1151132 - protein, 9 aa, Homo Sapiens
ACSRGLCCV

SEQ ID NO: 1151133 - protein, 9 aa, Homo Sapiens
VVKVQLWIY

SEQ ID NO: 1151134 - protein, 9 aa, Homo Sapiens
KKAFLVLKR

SEQ ID NO: 1151135 - protein, 9 aa, Homo Sapiens
MEVSYMEIY

SEQ ID NO: 1151136 - protein, 9 aa, Homo Sapiens
EMPYAGGVG

SEQ ID NO: 1151137 - protein, 9 aa, Homo Sapiens
ESTHLIVQH

SEQ ID NO: 1151138 - protein, 9 aa, Homo Sapiens
HKELQMEQD

SEQ ID NO: 1151139 - protein, 9 aa, Homo Sapiens
DGMLSPGAW

SEQ ID NO: 1151140 - protein, 9 aa, Homo Sapiens
TSWLETAVH

SEQ ID NO: 1151141 - protein, 9 aa, Homo Sapiens
KRPDRVVLR

SEQ ID NO: 1151142 - protein, 9 aa, Homo Sapiens
GESPWQVMA

SEQ ID NO: 1151143 - protein, 9 aa, Homo Sapiens
RRPQWTQTC

SEQ ID NO: 1151144 - protein, 9 aa, Homo Sapiens
DVRPPVLSP

SEQ ID NO: 1151145 - protein, 9 aa, Homo Sapiens
KVVETSAFG

SEQ ID NO: 1151146 - protein, 9 aa, Homo Sapiens
LGAQVFAFL

SEQ ID NO: 1151147 - protein, 9 aa, Homo Sapiens
APDASDFEA

SEQ ID NO: 1151148 - protein, 9 aa, Homo Sapiens
NEDTEEFPL

SEQ ID NO: 1151149 - protein, 9 aa, Homo Sapiens
LEWISLPRY

SEQ ID NO: 1151150 - protein, 9 aa, Homo Sapiens
SMSLATSSH

SEQ ID NO: 1151151 - protein, 9 aa, Homo Sapiens
RWPSRLSAS

SEQ ID NO: 1151152 - protein, 9 aa, Homo Sapiens
HGVWVGAQE

SEQ ID NO: 1151153 - protein, 9 aa, Homo Sapiens
KPLELFGKV

SEQ ID NO: 1151154 - protein, 9 aa, Homo Sapiens
SALGTSWPR

SEQ ID NO: 1151155 - protein, 9 aa, Homo Sapiens
ELASIHDKH

SEQ ID NO: 1151156 - protein, 9 aa, Homo Sapiens
AHQLHASPR

SEQ ID NO: 1151157 - protein, 9 aa, Homo Sapiens
LYDWSWMVV

SEQ ID NO: 1151158 - protein, 9 aa, Homo Sapiens
SDYVEVAGA

SEQ ID NO: 1151159 - protein, 9 aa, Homo Sapiens
VHLIDHLLQ

SEQ ID NO: 1151160 - protein, 9 aa, Homo Sapiens
SSGGSGHPT

SEQ ID NO: 1151161 - protein, 9 aa, Homo Sapiens
HDDFRYKTQ

SEQ ID NO: 1151162 - protein, 9 aa, Homo Sapiens
GAAGVGWAT

SEQ ID NO: 1151163 - protein, 9 aa, Homo Sapiens
PTIPAGTPW

SEQ ID NO: 1151164 - protein, 9 aa, Homo Sapiens
DGLACSLQH

SEQ ID NO: 1151165 - protein, 9 aa, Homo Sapiens
YLLLHHQPT

SEQ ID NO: 1151166 - protein, 9 aa, Homo Sapiens
CQSVHIILS

SEQ ID NO: 1151167 - protein, 9 aa, Homo Sapiens
KPPQSKRTN

SEQ ID NO: 1151168 - protein, 9 aa, Homo Sapiens
SSTQAHASV

SEQ ID NO: 1151169 - protein, 9 aa, Homo Sapiens
RVVCTMINS

SEQ ID NO: 1151170 - protein, 9 aa, Homo Sapiens
FATSPGPTF

SEQ ID NO: 1151171 - protein, 9 aa, Homo Sapiens
WGQMSKPSQ

SEQ ID NO: 1151172 - protein, 9 aa, Homo Sapiens
WPALPKPAV

SEQ ID NO: 1151173 - protein, 9 aa, Homo Sapiens
RENVLWDFW

SEQ ID NO: 1151174 - protein, 9 aa, Homo Sapiens
LQIEKEHLQ

SEQ ID NO: 1151175 - protein, 9 aa, Homo Sapiens
LSPPDASPG

SEQ ID NO: 1151176 - protein, 9 aa, Homo Sapiens
SPSHATRNG

SEQ ID NO: 1151177 - protein, 9 aa, Homo Sapiens
KKMREHAEN

SEQ ID NO: 1151178 - protein, 9 aa, Homo Sapiens
LHCRGKKFT

SEQ ID NO: 1151179 - protein, 9 aa, Homo Sapiens
ATQGGRRAR

SEQ ID NO: 1151180 - protein, 9 aa, Homo Sapiens
TLESGHYTR

SEQ ID NO: 1151181 - protein, 9 aa, Homo Sapiens
GKSGKAPHR

SEQ ID NO: 1151182 - protein, 9 aa, Homo Sapiens
RTSGPQKGD

SEQ ID NO: 1151183 - protein, 9 aa, Homo Sapiens
PKAAAPSTP

SEQ ID NO: 1151184 - protein, 9 aa, Homo Sapiens
EESEHFVKC

SEQ ID NO: 1151185 - protein, 9 aa, Homo Sapiens
IVKKGEEGG

SEQ ID NO: 1151186 - protein, 9 aa, Homo Sapiens
TMPTYCYEC

SEQ ID NO: 1151187 - protein, 9 aa, Homo Sapiens
IWSEPGDPV

SEQ ID NO: 1151188 - protein, 9 aa, Homo Sapiens
RARWDLRRP

SEQ ID NO: 1151189 - protein, 9 aa, Homo Sapiens
NQEILNTNS

SEQ ID NO: 1151190 - protein, 9 aa, Homo Sapiens
DSEELDWHV

SEQ ID NO: 1151191 - protein, 9 aa, Homo Sapiens
DTDEPVTCL

SEQ ID NO: 1151192 - protein, 9 aa, Homo Sapiens
HVAAYVTVP

SEQ ID NO: 1151193 - protein, 9 aa, Homo Sapiens
RTRCWACCG

SEQ ID NO: 1151194 - protein, 9 aa, Homo Sapiens
TLALITSNI

SEQ ID NO: 1151195 - protein, 9 aa, Homo Sapiens
HKDESVTAS

SEQ ID NO: 1151196 - protein, 9 aa, Homo Sapiens
CKSTLSPPD

SEQ ID NO: 1151197 - protein, 9 aa, Homo Sapiens
NSQFVITPK

SEQ ID NO: 1151198 - protein, 9 aa, Homo Sapiens
GSGFRGYGY

SEQ ID NO: 1151199 - protein, 9 aa, Homo Sapiens
KDFFILALD

SEQ ID NO: 1151200 - protein, 9 aa, Homo Sapiens
TSCQGAMLL

SEQ ID NO: 1151201 - protein, 9 aa, Homo Sapiens
SSLGSHPGS

SEQ ID NO: 1151202 - protein, 9 aa, Homo Sapiens
HVFPHVCGV

SEQ ID NO: 1151203 - protein, 9 aa, Homo Sapiens
VAILIGQTL

SEQ ID NO: 1151204 - protein, 9 aa, Homo Sapiens
KQFLVRVRI

SEQ ID NO: 1151205 - protein, 9 aa, Homo Sapiens
EGCLELIFS

SEQ ID NO: 1151206 - protein, 9 aa, Homo Sapiens
APTGPPRHP

SEQ ID NO: 1151207 - protein, 9 aa, Homo Sapiens
SLAPAVNRP

SEQ ID NO: 1151208 - protein, 9 aa, Homo Sapiens
DDHVAIHEA

SEQ ID NO: 1151209 - protein, 9 aa, Homo Sapiens
LPKTSRLSL

SEQ ID NO: 1151210 - protein, 9 aa, Homo Sapiens
MLERSAIAR

SEQ ID NO: 1151211 - protein, 9 aa, Homo Sapiens
DLDGMLTVI

SEQ ID NO: 1151212 - protein, 9 aa, Homo Sapiens
KSTLSPPDA

SEQ ID NO: 1151213 - protein, 9 aa, Homo Sapiens
LHPFPSKSY

SEQ ID NO: 1151214 - protein, 9 aa, Homo Sapiens
RRSRRCTGS

SEQ ID NO: 1151215 - protein, 9 aa, Homo Sapiens
SHLLEFQTP

SEQ ID NO: 1151216 - protein, 9 aa, Homo Sapiens
ERSEVVDVS

SEQ ID NO: 1151217 - protein, 9 aa, Homo Sapiens
TPEPPEECV

SEQ ID NO: 1151218 - protein, 9 aa, Homo Sapiens
ACPPSWSVV

SEQ ID NO: 1151219 - protein, 9 aa, Homo Sapiens
SLATSSHAE

SEQ ID NO: 1151220 - protein, 9 aa, Homo Sapiens
MTTCQSVHI

SEQ ID NO: 1151221 - protein, 9 aa, Homo Sapiens
DLEEDAVLK

SEQ ID NO: 1151222 - protein, 9 aa, Homo Sapiens
EHKKHVTDF

SEQ ID NO: 1151223 - protein, 9 aa, Homo Sapiens
VFSRDGLSE

SEQ ID NO: 1151224 - protein, 9 aa, Homo Sapiens
FMCCTSYRV

SEQ ID NO: 1151225 - protein, 9 aa, Homo Sapiens
YDYSASEYC

SEQ ID NO: 1151226 - protein, 9 aa, Homo Sapiens
HICNTCSSN

SEQ ID NO: 1151227 - protein, 9 aa, Homo Sapiens
SPGPPAGSS

SEQ ID NO: 1151228 - protein, 9 aa, Homo Sapiens
FTCGCGPDC

SEQ ID NO: 1151229 - protein, 9 aa, Homo Sapiens
DPPGPPGPP

SEQ ID NO: 1151230 - protein, 9 aa, Homo Sapiens
PVLAPGELL

SEQ ID NO: 1151231 - protein, 9 aa, Homo Sapiens
NIDIKNTVY

SEQ ID NO: 1151232 - protein, 9 aa, Homo Sapiens
CSGTILAYC

SEQ ID NO: 1151233 - protein, 9 aa, Homo Sapiens
SSWREGRER

SEQ ID NO: 1151234 - protein, 9 aa, Homo Sapiens
HKGRTCEMV

SEQ ID NO: 1151235 - protein, 9 aa, Homo Sapiens
PFMPSLVPV

SEQ ID NO: 1151236 - protein, 9 aa, Homo Sapiens
RGTFHLDED

SEQ ID NO: 1151237 - protein, 9 aa, Homo Sapiens
GLFSLWRTF

SEQ ID NO: 1151238 - protein, 9 aa, Homo Sapiens
AQSKETLSV

SEQ ID NO: 1151239 - protein, 9 aa, Homo Sapiens
SLWFLDRTF

SEQ ID NO: 1151240 - protein, 9 aa, Homo Sapiens
YLKRVLIGP

SEQ ID NO: 1151241 - protein, 9 aa, Homo Sapiens
AVLGRAARS

SEQ ID NO: 1151242 - protein, 9 aa, Homo Sapiens
CSHKSKGEE

SEQ ID NO: 1151243 - protein, 9 aa, Homo Sapiens
VLQLRAPGV

SEQ ID NO: 1151244 - protein, 9 aa, Homo Sapiens
QSVCQPRCK

SEQ ID NO: 1151245 - protein, 9 aa, Homo Sapiens
KLPLSLQDL

SEQ ID NO: 1151246 - protein, 9 aa, Homo Sapiens
SGSSTRPKS

SEQ ID NO: 1151247 - protein, 9 aa, Homo Sapiens
LLSLVFTFI

SEQ ID NO: 1151248 - protein, 9 aa, Homo Sapiens
RSFFTSAHP

SEQ ID NO: 1151249 - protein, 9 aa, Homo Sapiens
ATRIHKLPL

SEQ ID NO: 1151250 - protein, 9 aa, Homo Sapiens
AGLGGAAGV

SEQ ID NO: 1151251 - protein, 9 aa, Homo Sapiens
QRERGADGE

SEQ ID NO: 1151252 - protein, 9 aa, Homo Sapiens
LQRLSRPTK

SEQ ID NO: 1151253 - protein, 9 aa, Homo Sapiens
NALPEVAAR

SEQ ID NO: 1151254 - protein, 9 aa, Homo Sapiens
LATRIHKLP

SEQ ID NO: 1151255 - protein, 9 aa, Homo Sapiens
TWTVRMGRR

SEQ ID NO: 1151256 - protein, 9 aa, Homo Sapiens
AQHPHHLAQ

SEQ ID NO: 1151257 - protein, 9 aa, Homo Sapiens
VVNWSACSR

SEQ ID NO: 1151258 - protein, 9 aa, Homo Sapiens
ELSLAGVAR

SEQ ID NO: 1151259 - protein, 9 aa, Homo Sapiens
SRSPVPKKR

SEQ ID NO: 1151260 - protein, 9 aa, Homo Sapiens
ALCAKQRTV

SEQ ID NO: 1151261 - protein, 9 aa, Homo Sapiens
QECRGPRGA

SEQ ID NO: 1151262 - protein, 9 aa, Homo Sapiens
REGVPPTTL

SEQ ID NO: 1151263 - protein, 9 aa, Homo Sapiens
GQPARPHVP

SEQ ID NO: 1151264 - protein, 9 aa, Homo Sapiens
EKFGLVCMG

SEQ ID NO: 1151265 - protein, 9 aa, Homo Sapiens
IPTKPAVPH

SEQ ID NO: 1151266 - protein, 9 aa, Homo Sapiens
CGAWPPPWL

SEQ ID NO: 1151267 - protein, 9 aa, Homo Sapiens
SSSGWLELS

SEQ ID NO: 1151268 - protein, 9 aa, Homo Sapiens
TASGLKNIP

SEQ ID NO: 1151269 - protein, 9 aa, Homo Sapiens
QQQQLDLEH

SEQ ID NO: 1151270 - protein, 9 aa, Homo Sapiens
SASLLTGAD

SEQ ID NO: 1151271 - protein, 9 aa, Homo Sapiens
VSGGDEVSP

SEQ ID NO: 1151272 - protein, 9 aa, Homo Sapiens
LAFKVNFTF

SEQ ID NO: 1151273 - protein, 9 aa, Homo Sapiens
AWHPLGLCS

SEQ ID NO: 1151274 - protein, 9 aa, Homo Sapiens
TQAGPWNTG

SEQ ID NO: 1151275 - protein, 9 aa, Homo Sapiens
GSSTRPKSP

SEQ ID NO: 1151276 - protein, 9 aa, Homo Sapiens
TVPVVREPE

SEQ ID NO: 1151277 - protein, 9 aa, Homo Sapiens
AEPGANSVS

SEQ ID NO: 1151278 - protein, 9 aa, Homo Sapiens
PASHSDVGL

SEQ ID NO: 1151279 - protein, 9 aa, Homo Sapiens
MGPRASLSQ

SEQ ID NO: 1151280 - protein, 9 aa, Homo Sapiens
PSTVTEDCL

SEQ ID NO: 1151281 - protein, 9 aa, Homo Sapiens
PEETPQPPR

SEQ ID NO: 1151282 - protein, 9 aa, Homo Sapiens
LPTYDSTHS

SEQ ID NO: 1151283 - protein, 9 aa, Homo Sapiens
ANQVLRSGT

SEQ ID NO: 1151284 - protein, 9 aa, Homo Sapiens
TCCTPSEEF

SEQ ID NO: 1151285 - protein, 9 aa, Homo Sapiens
LERAFSYCG

SEQ ID NO: 1151286 - protein, 9 aa, Homo Sapiens
VNILLLQPQ

SEQ ID NO: 1151287 - protein, 9 aa, Homo Sapiens
RAHGAGVPH

SEQ ID NO: 1151288 - protein, 9 aa, Homo Sapiens
EKMAAELQF

SEQ ID NO: 1151289 - protein, 9 aa, Homo Sapiens
STWPQNWSS

SEQ ID NO: 1151290 - protein, 9 aa, Homo Sapiens
QEHQCSPRG

SEQ ID NO: 1151291 - protein, 9 aa, Homo Sapiens
QSPLQSHVS

SEQ ID NO: 1151292 - protein, 9 aa, Homo Sapiens
HATRNGEVV

SEQ ID NO: 1151293 - protein, 9 aa, Homo Sapiens
GAKKRKKSY

SEQ ID NO: 1151294 - protein, 9 aa, Homo Sapiens
SVMHRVAHH

SEQ ID NO: 1151295 - protein, 9 aa, Homo Sapiens
MMSCRILLG

SEQ ID NO: 1151296 - protein, 9 aa, Homo Sapiens
RRLQSSGGG

SEQ ID NO: 1151297 - protein, 9 aa, Homo Sapiens
FNLLHGKTI

SEQ ID NO: 1151298 - protein, 9 aa, Homo Sapiens
GIGAFHTEQ

SEQ ID NO: 1151299 - protein, 9 aa, Homo Sapiens
QSRSPVPKK

SEQ ID NO: 1151300 - protein, 9 aa, Homo Sapiens
SRVRCLGTK

SEQ ID NO: 1151301 - protein, 9 aa, Homo Sapiens
RCSVYTQED

SEQ ID NO: 1151302 - protein, 9 aa, Homo Sapiens
SMHRSPHFL

SEQ ID NO: 1151303 - protein, 9 aa, Homo Sapiens
KIQDFEQRE

SEQ ID NO: 1151304 - protein, 9 aa, Homo Sapiens
RETRCSFIL

SEQ ID NO: 1151305 - protein, 9 aa, Homo Sapiens
KRARAPGVA

SEQ ID NO: 1151306 - protein, 9 aa, Homo Sapiens
HTGGKTIQM

SEQ ID NO: 1151307 - protein, 9 aa, Homo Sapiens
EQHMPVSPI

SEQ ID NO: 1151308 - protein, 9 aa, Homo Sapiens
RCPLQIILF

SEQ ID NO: 1151309 - protein, 9 aa, Homo Sapiens
EELCAVVEQ

SEQ ID NO: 1151310 - protein, 9 aa, Homo Sapiens
NTLSFYVID

SEQ ID NO: 1151311 - protein, 9 aa, Homo Sapiens
LPFQYQALG

SEQ ID NO: 1151312 - protein, 9 aa, Homo Sapiens
YLDKVPKKR

SEQ ID NO: 1151313 - protein, 9 aa, Homo Sapiens
PESQLVCIG

SEQ ID NO: 1151314 - protein, 9 aa, Homo Sapiens
HVPGEFGSE

SEQ ID NO: 1151315 - protein, 9 aa, Homo Sapiens
AQAAALGTQ

SEQ ID NO: 1151316 - protein, 9 aa, Homo Sapiens
KLVPLVILG

SEQ ID NO: 1151317 - protein, 9 aa, Homo Sapiens
PRVSPSNAA

SEQ ID NO: 1151318 - protein, 9 aa, Homo Sapiens
LYNSTMSSK

SEQ ID NO: 1151319 - protein, 9 aa, Homo Sapiens
CRAPSQTLE

SEQ ID NO: 1151320 - protein, 9 aa, Homo Sapiens
SRMGATPET

SEQ ID NO: 1151321 - protein, 9 aa, Homo Sapiens
KSKGEELKP

SEQ ID NO: 1151322 - protein, 9 aa, Homo Sapiens
SRSGGRSRA

SEQ ID NO: 1151323 - protein, 9 aa, Homo Sapiens
EHIHAKGSY

SEQ ID NO: 1151324 - protein, 9 aa, Homo Sapiens
SSHAERASA

SEQ ID NO: 1151325 - protein, 9 aa, Homo Sapiens
FPLGYLLVP

SEQ ID NO: 1151326 - protein, 9 aa, Homo Sapiens
ACGATIQEL

SEQ ID NO: 1151327 - protein, 9 aa, Homo Sapiens
SNSSDSDSG

SEQ ID NO: 1151328 - protein, 9 aa, Homo Sapiens
LPRALPSLL

SEQ ID NO: 1151329 - protein, 9 aa, Homo Sapiens
LNGSLWNSS

SEQ ID NO: 1151330 - protein, 9 aa, Homo Sapiens
AVVVLVSVL

SEQ ID NO: 1151331 - protein, 9 aa, Homo Sapiens
NVLWDFWDH

SEQ ID NO: 1151332 - protein, 9 aa, Homo Sapiens
CTHTHTHAR

SEQ ID NO: 1151333 - protein, 9 aa, Homo Sapiens
LETGRSGAT

SEQ ID NO: 1151334 - protein, 9 aa, Homo Sapiens
DHDDFRYKT

SEQ ID NO: 1151335 - protein, 9 aa, Homo Sapiens
RDEVDGRGS

SEQ ID NO: 1151336 - protein, 9 aa, Homo Sapiens
GSIKNNIKI

SEQ ID NO: 1151337 - protein, 9 aa, Homo Sapiens
EETRRKLRK

SEQ ID NO: 1151338 - protein, 9 aa, Homo Sapiens
DSIASAHVS

SEQ ID NO: 1151339 - protein, 9 aa, Homo Sapiens
AAGDGSSWR

SEQ ID NO: 1151340 - protein, 9 aa, Homo Sapiens
GNCMELQAS

SEQ ID NO: 1151341 - protein, 9 aa, Homo Sapiens
RLCGACPGQ

SEQ ID NO: 1151342 - protein, 9 aa, Homo Sapiens
ISLFWKAHM

SEQ ID NO: 1151343 - protein, 9 aa, Homo Sapiens
TPLQWNEDQ

SEQ ID NO: 1151344 - protein, 9 aa, Homo Sapiens
WEITDTLCA

SEQ ID NO: 1151345 - protein, 9 aa, Homo Sapiens
SQGTLSLQR

SEQ ID NO: 1151346 - protein, 9 aa, Homo Sapiens
ASVRMVALV

SEQ ID NO: 1151347 - protein, 9 aa, Homo Sapiens
PRDLGTVAG

SEQ ID NO: 1151348 - protein, 9 aa, Homo Sapiens
EAPHNMVHP

SEQ ID NO: 1151349 - protein, 9 aa, Homo Sapiens
SVHGQRRLQ

SEQ ID NO: 1151350 - protein, 9 aa, Homo Sapiens
KLLLETGVY

SEQ ID NO: 1151351 - protein, 9 aa, Homo Sapiens
FLTLASAHV

SEQ ID NO: 1151352 - protein, 9 aa, Homo Sapiens
RCVIANQQQ

SEQ ID NO: 1151353 - protein, 9 aa, Homo Sapiens
TSQRGVSYL

SEQ ID NO: 1151354 - protein, 9 aa, Homo Sapiens
LVMCLRLRT

SEQ ID NO: 1151355 - protein, 9 aa, Homo Sapiens
QVPCQQTMS

SEQ ID NO: 1151356 - protein, 9 aa, Homo Sapiens
GFPHSQYPQ

SEQ ID NO: 1151357 - protein, 9 aa, Homo Sapiens
GKTESTHLI

SEQ ID NO: 1151358 - protein, 9 aa, Homo Sapiens
YIQPTSDHS

SEQ ID NO: 1151359 - protein, 9 aa, Homo Sapiens
GPLGLRPPH

SEQ ID NO: 1151360 - protein, 9 aa, Homo Sapiens
PLWQTSTLA

SEQ ID NO: 1151361 - protein, 9 aa, Homo Sapiens
MHSRILCTK

SEQ ID NO: 1151362 - protein, 9 aa, Homo Sapiens
MKELASIHD

SEQ ID NO: 1151363 - protein, 9 aa, Homo Sapiens
AKIISSDVI

SEQ ID NO: 1151364 - protein, 9 aa, Homo Sapiens
LEEKGPLAW

SEQ ID NO: 1151365 - protein, 9 aa, Homo Sapiens
DPPIGPPFE

SEQ ID NO: 1151366 - protein, 9 aa, Homo Sapiens
PTIDTSCKK

SEQ ID NO: 1151367 - protein, 9 aa, Homo Sapiens
SLWNSSPRT

SEQ ID NO: 1151368 - protein, 9 aa, Homo Sapiens
TLEMFNRGR

SEQ ID NO: 1151369 - protein, 9 aa, Homo Sapiens
QQLWKKAFL

SEQ ID NO: 1151370 - protein, 9 aa, Homo Sapiens
LCSSHRPVR

SEQ ID NO: 1151371 - protein, 9 aa, Homo Sapiens
SVVVSAPLG

SEQ ID NO: 1151372 - protein, 9 aa, Homo Sapiens
PITSSLWTQ

SEQ ID NO: 1151373 - protein, 9 aa, Homo Sapiens
DCMSLACLI

SEQ ID NO: 1151374 - protein, 9 aa, Homo Sapiens
SGASQYPKK

SEQ ID NO: 1151375 - protein, 9 aa, Homo Sapiens
PTPTEPPLP

SEQ ID NO: 1151376 - protein, 9 aa, Homo Sapiens
PLRAINLNL

SEQ ID NO: 1151377 - protein, 9 aa, Homo Sapiens
PALRARGGT

SEQ ID NO: 1151378 - protein, 9 aa, Homo Sapiens
WNHKTMNLN

SEQ ID NO: 1151379 - protein, 9 aa, Homo Sapiens
VTEDCLRSF

SEQ ID NO: 1151380 - protein, 9 aa, Homo Sapiens
AQNFSFISL

SEQ ID NO: 1151381 - protein, 9 aa, Homo Sapiens
EKPVLGPHP

SEQ ID NO: 1151382 - protein, 9 aa, Homo Sapiens
QPLARPGAV

SEQ ID NO: 1151383 - protein, 9 aa, Homo Sapiens
MGEAFASDE

SEQ ID NO: 1151384 - protein, 9 aa, Homo Sapiens
SRFPELTSH

SEQ ID NO: 1151385 - protein, 9 aa, Homo Sapiens
DIRVPFLFV

SEQ ID NO: 1151386 - protein, 9 aa, Homo Sapiens
ETRRKLRKN

SEQ ID NO: 1151387 - protein, 9 aa, Homo Sapiens
VMGIIFMCL

SEQ ID NO: 1151388 - protein, 9 aa, Homo Sapiens
GPVRLLLGV

SEQ ID NO: 1151389 - protein, 9 aa, Homo Sapiens
SPWQVMASL

SEQ ID NO: 1151390 - protein, 9 aa, Homo Sapiens
FRPTFYPHP

SEQ ID NO: 1151391 - protein, 9 aa, Homo Sapiens
SQGSHPWFL

SEQ ID NO: 1151392 - protein, 9 aa, Homo Sapiens
ELSAPTRQT

SEQ ID NO: 1151393 - protein, 9 aa, Homo Sapiens
ELIIVDAAV

SEQ ID NO: 1151394 - protein, 9 aa, Homo Sapiens
DKRLCPSES

SEQ ID NO: 1151395 - protein, 9 aa, Homo Sapiens
QCRQYKCKM

SEQ ID NO: 1151396 - protein, 9 aa, Homo Sapiens
TVKWNYTNI

SEQ ID NO: 1151397 - protein, 9 aa, Homo Sapiens
SSDLSYGSH

SEQ ID NO: 1151398 - protein, 9 aa, Homo Sapiens
VDRLCGACP

SEQ ID NO: 1151399 - protein, 9 aa, Homo Sapiens
GSHASIHAS

SEQ ID NO: 1151400 - protein, 9 aa, Homo Sapiens
HQVPLWGQL

SEQ ID NO: 1151401 - protein, 9 aa, Homo Sapiens
EELMHLDVS

SEQ ID NO: 1151402 - protein, 9 aa, Homo Sapiens
TGRPILLSP

SEQ ID NO: 1151403 - protein, 9 aa, Homo Sapiens
RVLYCYYPD

SEQ ID NO: 1151404 - protein, 9 aa, Homo Sapiens
TLSWGSPTR

SEQ ID NO: 1151405 - protein, 9 aa, Homo Sapiens
PRLRSYCKG

SEQ ID NO: 1151406 - protein, 9 aa, Homo Sapiens
KKTNTEEKK

SEQ ID NO: 1151407 - protein, 9 aa, Homo Sapiens
AICRGFTFQ

SEQ ID NO: 1151408 - protein, 9 aa, Homo Sapiens
HPHHLAQLL

SEQ ID NO: 1151409 - protein, 9 aa, Homo Sapiens
WKMVNQKMP

SEQ ID NO: 1151410 - protein, 9 aa, Homo Sapiens
IKDIFLMKR

SEQ ID NO: 1151411 - protein, 9 aa, Homo Sapiens
AQSPLQSHV

SEQ ID NO: 1151412 - protein, 9 aa, Homo Sapiens
LCTKPVESM

SEQ ID NO: 1151413 - protein, 9 aa, Homo Sapiens
GVSGLNGES

SEQ ID NO: 1151414 - protein, 9 aa, Homo Sapiens
KRTNGMKMN

SEQ ID NO: 1151415 - protein, 9 aa, Homo Sapiens
GRRPLPVME

SEQ ID NO: 1151416 - protein, 9 aa, Homo Sapiens
PCLALSEDR

SEQ ID NO: 1151417 - protein, 9 aa, Homo Sapiens
DSSASVRMV

SEQ ID NO: 1151418 - protein, 9 aa, Homo Sapiens
RFPELTSHT

SEQ ID NO: 1151419 - protein, 9 aa, Homo Sapiens
WKKEEDKKH

SEQ ID NO: 1151420 - protein, 9 aa, Homo Sapiens
GPGITWAGA

SEQ ID NO: 1151421 - protein, 9 aa, Homo Sapiens
ATTTCPTRW

SEQ ID NO: 1151422 - protein, 9 aa, Homo Sapiens
PLLRPRGGA

SEQ ID NO: 1151423 - protein, 9 aa, Homo Sapiens
PGNWELKLE

SEQ ID NO: 1151424 - protein, 9 aa, Homo Sapiens
LDFDTLKQQ

SEQ ID NO: 1151425 - protein, 9 aa, Homo Sapiens
FGDIHFGNI

SEQ ID NO: 1151426 - protein, 9 aa, Homo Sapiens
SHVAAYVTV

SEQ ID NO: 1151427 - protein, 9 aa, Homo Sapiens
RLSLSQAFL

SEQ ID NO: 1151428 - protein, 9 aa, Homo Sapiens
ASLLTGADG

SEQ ID NO: 1151429 - protein, 9 aa, Homo Sapiens
AVDRETSKP

SEQ ID NO: 1151430 - protein, 9 aa, Homo Sapiens
LYHSALGVG

SEQ ID NO: 1151431 - protein, 9 aa, Homo Sapiens
IPPSLWGRA

SEQ ID NO: 1151432 - protein, 9 aa, Homo Sapiens
WLGRVGWLQ

SEQ ID NO: 1151433 - protein, 9 aa, Homo Sapiens
WSRVPDHPS

SEQ ID NO: 1151434 - protein, 9 aa, Homo Sapiens
GGSGDFNLP

SEQ ID NO: 1151435 - protein, 9 aa, Homo Sapiens
YQALGLVVL

SEQ ID NO: 1151436 - protein, 9 aa, Homo Sapiens
RRPAAVSVH

SEQ ID NO: 1151437 - protein, 9 aa, Homo Sapiens
VIPDEESVV

SEQ ID NO: 1151438 - protein, 9 aa, Homo Sapiens
VVVSAPLGG

SEQ ID NO: 1151439 - protein, 9 aa, Homo Sapiens
RGYGYRSCR

SEQ ID NO: 1151440 - protein, 9 aa, Homo Sapiens
GTPSLIMKP

SEQ ID NO: 1151441 - protein, 9 aa, Homo Sapiens
APSQLPASS

SEQ ID NO: 1151442 - protein, 9 aa, Homo Sapiens
HTFRDVVRF

SEQ ID NO: 1151443 - protein, 9 aa, Homo Sapiens
GGGALLCLS

SEQ ID NO: 1151444 - protein, 9 aa, Homo Sapiens
EKHSASEHT

SEQ ID NO: 1151445 - protein, 9 aa, Homo Sapiens
GSGSHASIH

SEQ ID NO: 1151446 - protein, 9 aa, Homo Sapiens
QGPPENQVS

SEQ ID NO: 1151447 - protein, 9 aa, Homo Sapiens
FQDYQEMFM

SEQ ID NO: 1151448 - protein, 9 aa, Homo Sapiens
EATNVEKAS

SEQ ID NO: 1151449 - protein, 9 aa, Homo Sapiens
TMVMGIIFM

SEQ ID NO: 1151450 - protein, 9 aa, Homo Sapiens
CHWNQKIRF

SEQ ID NO: 1151451 - protein, 9 aa, Homo Sapiens
LGDGKKMDL

SEQ ID NO: 1151452 - protein, 9 aa, Homo Sapiens
ASGVAIGEA

SEQ ID NO: 1151453 - protein, 9 aa, Homo Sapiens
LNDGSVPPL

SEQ ID NO: 1151454 - protein, 9 aa, Homo Sapiens
GIPPSLWGR

SEQ ID NO: 1151455 - protein, 9 aa, Homo Sapiens
LLETGVYNV

SEQ ID NO: 1151456 - protein, 9 aa, Homo Sapiens
PQEIQGMQG

SEQ ID NO: 1151457 - protein, 9 aa, Homo Sapiens
PPRHPRHPR

SEQ ID NO: 1151458 - protein, 9 aa, Homo Sapiens
ALNQKNSVI

SEQ ID NO: 1151459 - protein, 9 aa, Homo Sapiens
SREAQNFSF

SEQ ID NO: 1151460 - protein, 9 aa, Homo Sapiens
EEGGSAHTS

SEQ ID NO: 1151461 - protein, 9 aa, Homo Sapiens
QLGPRAGGS

SEQ ID NO: 1151462 - protein, 9 aa, Homo Sapiens
AQAYQAAGA

SEQ ID NO: 1151463 - protein, 9 aa, Homo Sapiens
RMPPMPPFY

SEQ ID NO: 1151464 - protein, 9 aa, Homo Sapiens
VTDNMATVS

SEQ ID NO: 1151465 - protein, 9 aa, Homo Sapiens
FSGLESLAQ

SEQ ID NO: 1151466 - protein, 9 aa, Homo Sapiens
IVIIKDIFL

SEQ ID NO: 1151467 - protein, 9 aa, Homo Sapiens
PDTHLHGYA

SEQ ID NO: 1151468 - protein, 9 aa, Homo Sapiens
RGSFATSPG

SEQ ID NO: 1151469 - protein, 9 aa, Homo Sapiens
WENPAGHGK

SEQ ID NO: 1151470 - protein, 9 aa, Homo Sapiens
TVAGATAQI

SEQ ID NO: 1151471 - protein, 9 aa, Homo Sapiens
HSRILCTKP

SEQ ID NO: 1151472 - protein, 9 aa, Homo Sapiens
TAAMNHNSA

SEQ ID NO: 1151473 - protein, 9 aa, Homo Sapiens
LPQGAGSPT

SEQ ID NO: 1151474 - protein, 9 aa, Homo Sapiens
SRSGSGQPA

SEQ ID NO: 1151475 - protein, 9 aa, Homo Sapiens
LHHPPCSLS

SEQ ID NO: 1151476 - protein, 9 aa, Homo Sapiens
PYRYTVKAH

SEQ ID NO: 1151477 - protein, 9 aa, Homo Sapiens
HPIHIGCTQ

SEQ ID NO: 1151478 - protein, 9 aa, Homo Sapiens
LGQDHQVPL

SEQ ID NO: 1151479 - protein, 9 aa, Homo Sapiens
SEAVGYRTY

SEQ ID NO: 1151480 - protein, 9 aa, Homo Sapiens
EGQYDTLQA

SEQ ID NO: 1151481 - protein, 9 aa, Homo Sapiens
FTSLTKYLK

SEQ ID NO: 1151482 - protein, 9 aa, Homo Sapiens
ARAARAFSR

SEQ ID NO: 1151483 - protein, 9 aa, Homo Sapiens
ASGGPESRT

SEQ ID NO: 1151484 - protein, 9 aa, Homo Sapiens
VSGGELLLG

SEQ ID NO: 1151485 - protein, 9 aa, Homo Sapiens
WSTCCSMGQ

SEQ ID NO: 1151486 - protein, 9 aa, Homo Sapiens
ACSLQHYLQ

SEQ ID NO: 1151487 - protein, 9 aa, Homo Sapiens
PSSPGWSAM

SEQ ID NO: 1151488 - protein, 9 aa, Homo Sapiens
GSTVKSHTR

SEQ ID NO: 1151489 - protein, 9 aa, Homo Sapiens
PARRESRFW

SEQ ID NO: 1151490 - protein, 9 aa, Homo Sapiens
GDFNLPLNR

SEQ ID NO: 1151491 - protein, 9 aa, Homo Sapiens
DAVPFVPPL

SEQ ID NO: 1151492 - protein, 9 aa, Homo Sapiens
LQWNEDQQL

SEQ ID NO: 1151493 - protein, 9 aa, Homo Sapiens
SAMPGGSPP

SEQ ID NO: 1151494 - protein, 9 aa, Homo Sapiens
TSTSCSTMS

SEQ ID NO: 1151495 - protein, 9 aa, Homo Sapiens
VFNEKIKSC

SEQ ID NO: 1151496 - protein, 9 aa, Homo Sapiens
YSTSAPRRS

SEQ ID NO: 1151497 - protein, 9 aa, Homo Sapiens
TTLNQLRMP

SEQ ID NO: 1151498 - protein, 9 aa, Homo Sapiens
APWKGRPLS

SEQ ID NO: 1151499 - protein, 9 aa, Homo Sapiens
KDGMLSPGA

SEQ ID NO: 1151500 - protein, 9 aa, Homo Sapiens
RLLCQPCSQ

SEQ ID NO: 1151501 - protein, 9 aa, Homo Sapiens
PGATLTSTS

SEQ ID NO: 1151502 - protein, 9 aa, Homo Sapiens
ACDSLFSNA

SEQ ID NO: 1151503 - protein, 9 aa, Homo Sapiens
DQHSISHTL

SEQ ID NO: 1151504 - protein, 9 aa, Homo Sapiens
PITLPGGLT

SEQ ID NO: 1151505 - protein, 9 aa, Homo Sapiens
RPGAVESCN

SEQ ID NO: 1151506 - protein, 9 aa, Homo Sapiens
PGARVTVTD

SEQ ID NO: 1151507 - protein, 9 aa, Homo Sapiens
KSGKAPHRR

SEQ ID NO: 1151508 - protein, 9 aa, Homo Sapiens
ACSPTNSLL

SEQ ID NO: 1151509 - protein, 9 aa, Homo Sapiens
WKRLKVFSR

SEQ ID NO: 1151510 - protein, 9 aa, Homo Sapiens
CRQRECSSL

SEQ ID NO: 1151511 - protein, 9 aa, Homo Sapiens
AELVVGGAS

SEQ ID NO: 1151512 - protein, 9 aa, Homo Sapiens
LSEAPHVDG

SEQ ID NO: 1151513 - protein, 9 aa, Homo Sapiens
EGARCLCVP

SEQ ID NO: 1151514 - protein, 9 aa, Homo Sapiens
SGLQECRGP

SEQ ID NO: 1151515 - protein, 9 aa, Homo Sapiens
TPDVAGLHG

SEQ ID NO: 1151516 - protein, 9 aa, Homo Sapiens
SSRPRRTAR

SEQ ID NO: 1151517 - protein, 9 aa, Homo Sapiens
VTWAIVNLC

SEQ ID NO: 1151518 - protein, 9 aa, Homo Sapiens
PPAGHPGTH

SEQ ID NO: 1151519 - protein, 9 aa, Homo Sapiens
LSRMPARRE

SEQ ID NO: 1151520 - protein, 9 aa, Homo Sapiens
DHLQFPLDV

SEQ ID NO: 1151521 - protein, 9 aa, Homo Sapiens
QLRELCGHW

SEQ ID NO: 1151522 - protein, 9 aa, Homo Sapiens
TGSEADGLD

SEQ ID NO: 1151523 - protein, 9 aa, Homo Sapiens
DPTYLSTAA

SEQ ID NO: 1151524 - protein, 9 aa, Homo Sapiens
SHSESWFMS

SEQ ID NO: 1151525 - protein, 9 aa, Homo Sapiens
QLVCIGESR

SEQ ID NO: 1151526 - protein, 9 aa, Homo Sapiens
YEHLFCWIV

SEQ ID NO: 1151527 - protein, 9 aa, Homo Sapiens
FCTWTVRMG

SEQ ID NO: 1151528 - protein, 9 aa, Homo Sapiens
ETRSEPSEL

SEQ ID NO: 1151529 - protein, 9 aa, Homo Sapiens
PPPVPAPSQ

SEQ ID NO: 1151530 - protein, 9 aa, Homo Sapiens
LALSALWNQ

SEQ ID NO: 1151531 - protein, 9 aa, Homo Sapiens
NVRRKKMRE

SEQ ID NO: 1151532 - protein, 9 aa, Homo Sapiens
RSVLSVPAG

SEQ ID NO: 1151533 - protein, 9 aa, Homo Sapiens
LLLRFPFAV

SEQ ID NO: 1151534 - protein, 9 aa, Homo Sapiens
SGKKIAFHI

SEQ ID NO: 1151535 - protein, 9 aa, Homo Sapiens
YRCSVYTQE

SEQ ID NO: 1151536 - protein, 9 aa, Homo Sapiens
ITTGPRDSA

SEQ ID NO: 1151537 - protein, 9 aa, Homo Sapiens
LWMIVIIKD

SEQ ID NO: 1151538 - protein, 9 aa, Homo Sapiens
GIIFMCLRL

SEQ ID NO: 1151539 - protein, 9 aa, Homo Sapiens
EENQHTTSI

SEQ ID NO: 1151540 - protein, 9 aa, Homo Sapiens
KDIFLMKRF

SEQ ID NO: 1151541 - protein, 9 aa, Homo Sapiens
VPSTTRRAV

SEQ ID NO: 1151542 - protein, 9 aa, Homo Sapiens
QPIVLLLPV

SEQ ID NO: 1151543 - protein, 9 aa, Homo Sapiens
SEHFVKCVL

SEQ ID NO: 1151544 - protein, 9 aa, Homo Sapiens
SCFSTTTLS

SEQ ID NO: 1151545 - protein, 9 aa, Homo Sapiens
PSGECRVSS

SEQ ID NO: 1151546 - protein, 9 aa, Homo Sapiens
VSGSSTRPK

SEQ ID NO: 1151547 - protein, 9 aa, Homo Sapiens
LCTPPGSCG

SEQ ID NO: 1151548 - protein, 9 aa, Homo Sapiens
PDSHKGRTC

SEQ ID NO: 1151549 - protein, 9 aa, Homo Sapiens
GPATPHTLL

SEQ ID NO: 1151550 - protein, 9 aa, Homo Sapiens
KLWSVHGQR

SEQ ID NO: 1151551 - protein, 9 aa, Homo Sapiens
TMEPITLPG

SEQ ID NO: 1151552 - protein, 9 aa, Homo Sapiens
DGAEPGANS

SEQ ID NO: 1151553 - protein, 9 aa, Homo Sapiens
LSLKPDPLT

SEQ ID NO: 1151554 - protein, 9 aa, Homo Sapiens
AEFLHCRGK

SEQ ID NO: 1151555 - protein, 9 aa, Homo Sapiens
PPSWSVVNW

SEQ ID NO: 1151556 - protein, 9 aa, Homo Sapiens
WRDPTQTYG

SEQ ID NO: 1151557 - protein, 9 aa, Homo Sapiens
DKKRTDSVA

SEQ ID NO: 1151558 - protein, 9 aa, Homo Sapiens
VGVFQRGKV

SEQ ID NO: 1151559 - protein, 9 aa, Homo Sapiens
GLGGAAGVG

SEQ ID NO: 1151560 - protein, 9 aa, Homo Sapiens
GLVEGYSNL

SEQ ID NO: 1151561 - protein, 9 aa, Homo Sapiens
VKEIHAQLT

SEQ ID NO: 1151562 - protein, 9 aa, Homo Sapiens
LLLQPQPQY

SEQ ID NO: 1151563 - protein, 9 aa, Homo Sapiens
GLGEPHHAH

SEQ ID NO: 1151564 - protein, 9 aa, Homo Sapiens
GQCQSVCQP

SEQ ID NO: 1151565 - protein, 9 aa, Homo Sapiens
EKNSKKPPQ

SEQ ID NO: 1151566 - protein, 9 aa, Homo Sapiens
HDGECVCPL

SEQ ID NO: 1151567 - protein, 9 aa, Homo Sapiens
VKNLLHHLK

SEQ ID NO: 1151568 - protein, 9 aa, Homo Sapiens
GPWPSPGAH

SEQ ID NO: 1151569 - protein, 9 aa, Homo Sapiens
GVESMLERS

SEQ ID NO: 1151570 - protein, 9 aa, Homo Sapiens
WCCSGWYCY

SEQ ID NO: 1151571 - protein, 9 aa, Homo Sapiens
LLSATTSSS

SEQ ID NO: 1151572 - protein, 9 aa, Homo Sapiens
PLIPLLGDQ

SEQ ID NO: 1151573 - protein, 9 aa, Homo Sapiens
GQDPEDGDA

SEQ ID NO: 1151574 - protein, 9 aa, Homo Sapiens
MPARRESRF

SEQ ID NO: 1151575 - protein, 9 aa, Homo Sapiens
LELSSLESG

SEQ ID NO: 1151576 - protein, 9 aa, Homo Sapiens
APTRQTLPA

SEQ ID NO: 1151577 - protein, 9 aa, Homo Sapiens
SCVPGWCRW

SEQ ID NO: 1151578 - protein, 9 aa, Homo Sapiens
WPNLSCKYP

SEQ ID NO: 1151579 - protein, 9 aa, Homo Sapiens
WGTREPQAS

SEQ ID NO: 1151580 - protein, 9 aa, Homo Sapiens
AAGASPSAS

SEQ ID NO: 1151581 - protein, 9 aa, Homo Sapiens
QTPPGSAPS

SEQ ID NO: 1151582 - protein, 9 aa, Homo Sapiens
LNQLRMPPM

SEQ ID NO: 1151583 - protein, 9 aa, Homo Sapiens
RLETMRHII

SEQ ID NO: 1151584 - protein, 9 aa, Homo Sapiens
HRAAAVLVH

SEQ ID NO: 1151585 - protein, 9 aa, Homo Sapiens
GLCSAQPAI

SEQ ID NO: 1151586 - protein, 9 aa, Homo Sapiens
GKRKTIDCK

SEQ ID NO: 1151587 - protein, 9 aa, Homo Sapiens
DLIGAMETR

SEQ ID NO: 1151588 - protein, 9 aa, Homo Sapiens
PDGTYVKLS

SEQ ID NO: 1151589 - protein, 9 aa, Homo Sapiens
EHLFCWIVT

SEQ ID NO: 1151590 - protein, 9 aa, Homo Sapiens
ASEYCWHIN

SEQ ID NO: 1151591 - protein, 9 aa, Homo Sapiens
RESGQWLGR

SEQ ID NO: 1151592 - protein, 9 aa, Homo Sapiens
LRRKNKKPG

SEQ ID NO: 1151593 - protein, 9 aa, Homo Sapiens
PAGHPGTHG

SEQ ID NO: 1151594 - protein, 9 aa, Homo Sapiens
PGSCRSPRS

SEQ ID NO: 1151595 - protein, 9 aa, Homo Sapiens
HGKTIEIGN

SEQ ID NO: 1151596 - protein, 9 aa, Homo Sapiens
KKIAFHIKS

SEQ ID NO: 1151597 - protein, 9 aa, Homo Sapiens
YPHPHPRLC

SEQ ID NO: 1151598 - protein, 9 aa, Homo Sapiens
MNFLHHPDL

SEQ ID NO: 1151599 - protein, 9 aa, Homo Sapiens
DCEVDSCTA

SEQ ID NO: 1151600 - protein, 9 aa, Homo Sapiens
PCAGTTPPA

SEQ ID NO: 1151601 - protein, 9 aa, Homo Sapiens
DIMDAMLKR

SEQ ID NO: 1151602 - protein, 9 aa, Homo Sapiens
RDSRSFFTS

SEQ ID NO: 1151603 - protein, 9 aa, Homo Sapiens
VRFTNDDRH

SEQ ID NO: 1151604 - protein, 9 aa, Homo Sapiens
RTHVLAAGN

SEQ ID NO: 1151605 - protein, 9 aa, Homo Sapiens
FFTSAHPSR

SEQ ID NO: 1151606 - protein, 9 aa, Homo Sapiens
PAHGEVDVD

SEQ ID NO: 1151607 - protein, 9 aa, Homo Sapiens
RASTPNTGP

SEQ ID NO: 1151608 - protein, 9 aa, Homo Sapiens
QYCPSVESS

SEQ ID NO: 1151609 - protein, 9 aa, Homo Sapiens
STRPKSPGP

SEQ ID NO: 1151610 - protein, 9 aa, Homo Sapiens
FTDSLQSPS

SEQ ID NO: 1151611 - protein, 9 aa, Homo Sapiens
ELDWHVVNQ

SEQ ID NO: 1151612 - protein, 9 aa, Homo Sapiens
LQGSAALLP

SEQ ID NO: 1151613 - protein, 9 aa, Homo Sapiens
RVAHHAAPR

SEQ ID NO: 1151614 - protein, 9 aa, Homo Sapiens
ARAFSREQC

SEQ ID NO: 1151615 - protein, 9 aa, Homo Sapiens
KYIGNTNFK

SEQ ID NO: 1151616 - protein, 9 aa, Homo Sapiens
SSWISDGKK

SEQ ID NO: 1151617 - protein, 9 aa, Homo Sapiens
KSKVTITLY

SEQ ID NO: 1151618 - protein, 9 aa, Homo Sapiens
NICHWNQKI

SEQ ID NO: 1151619 - protein, 9 aa, Homo Sapiens
RRVKLPITS

SEQ ID NO: 1151620 - protein, 9 aa, Homo Sapiens
TDRVTDNMA

SEQ ID NO: 1151621 - protein, 9 aa, Homo Sapiens
GACPGQRVF

SEQ ID NO: 1151622 - protein, 9 aa, Homo Sapiens
SLWTQQTCL

SEQ ID NO: 1151623 - protein, 9 aa, Homo Sapiens
AAGTRCRAS

SEQ ID NO: 1151624 - protein, 9 aa, Homo Sapiens
VDGLAFKVN

SEQ ID NO: 1151625 - protein, 9 aa, Homo Sapiens
PRAVIPLKH

SEQ ID NO: 1151626 - protein, 9 aa, Homo Sapiens
SHATRNGEV

SEQ ID NO: 1151627 - protein, 9 aa, Homo Sapiens
LETAVHEGN

SEQ ID NO: 1151628 - protein, 9 aa, Homo Sapiens
DNMATVSWD

SEQ ID NO: 1151629 - protein, 9 aa, Homo Sapiens
LEKALSALF

SEQ ID NO: 1151630 - protein, 9 aa, Homo Sapiens
AGLRVPEGP

SEQ ID NO: 1151631 - protein, 9 aa, Homo Sapiens
SGKTESTHL

SEQ ID NO: 1151632 - protein, 9 aa, Homo Sapiens
HHTFYNELC

SEQ ID NO: 1151633 - protein, 9 aa, Homo Sapiens
GGAGARPPG

SEQ ID NO: 1151634 - protein, 9 aa, Homo Sapiens
LEHELLELE

SEQ ID NO: 1151635 - protein, 9 aa, Homo Sapiens
VMEGLVEVR

SEQ ID NO: 1151636 - protein, 9 aa, Homo Sapiens
SPELRGGPL

SEQ ID NO: 1151637 - protein, 9 aa, Homo Sapiens
ATWIKTTLI

SEQ ID NO: 1151638 - protein, 9 aa, Homo Sapiens
HRIQSKHHP

SEQ ID NO: 1151639 - protein, 9 aa, Homo Sapiens
LSLRAGSLD

SEQ ID NO: 1151640 - protein, 9 aa, Homo Sapiens
CRGGKGHIG

SEQ ID NO: 1151641 - protein, 9 aa, Homo Sapiens
VPATSGPSG

SEQ ID NO: 1151642 - protein, 9 aa, Homo Sapiens
GKINIDDLV

SEQ ID NO: 1151643 - protein, 9 aa, Homo Sapiens
YYRVHEDGD

SEQ ID NO: 1151644 - protein, 9 aa, Homo Sapiens
KHCGSRLKI

SEQ ID NO: 1151645 - protein, 9 aa, Homo Sapiens
DTKPSVMQS

SEQ ID NO: 1151646 - protein, 9 aa, Homo Sapiens
MGATPETDE

SEQ ID NO: 1151647 - protein, 9 aa, Homo Sapiens
AVLVSCSSV

SEQ ID NO: 1151648 - protein, 9 aa, Homo Sapiens
SLLRGQVPA

SEQ ID NO: 1151649 - protein, 9 aa, Homo Sapiens
SQRGVSYLA

SEQ ID NO: 1151650 - protein, 9 aa, Homo Sapiens
PSNWKPLTV

SEQ ID NO: 1151651 - protein, 9 aa, Homo Sapiens
CSPRKQAQQ

SEQ ID NO: 1151652 - protein, 9 aa, Homo Sapiens
GEITTGPRD

SEQ ID NO: 1151653 - protein, 9 aa, Homo Sapiens
GAAATPLEV

SEQ ID NO: 1151654 - protein, 9 aa, Homo Sapiens
YHSALGVGM

SEQ ID NO: 1151655 - protein, 9 aa, Homo Sapiens
RVVLRRYRL

SEQ ID NO: 1151656 - protein, 9 aa, Homo Sapiens
KAFDTNGWQ

SEQ ID NO: 1151657 - protein, 9 aa, Homo Sapiens
GDPREPTRL

SEQ ID NO: 1151658 - protein, 9 aa, Homo Sapiens
LETKLRDSS

SEQ ID NO: 1151659 - protein, 9 aa, Homo Sapiens
YRKMLPRST

SEQ ID NO: 1151660 - protein, 9 aa, Homo Sapiens
PLAPCPPLE

SEQ ID NO: 1151661 - protein, 9 aa, Homo Sapiens
RTSIEVSVN

SEQ ID NO: 1151662 - protein, 9 aa, Homo Sapiens
QYQALGLVV

SEQ ID NO: 1151663 - protein, 9 aa, Homo Sapiens
LGGAAGVGW

SEQ ID NO: 1151664 - protein, 9 aa, Homo Sapiens
ATSTLTMNP

SEQ ID NO: 1151665 - protein, 9 aa, Homo Sapiens
CGHICNTCS

SEQ ID NO: 1151666 - protein, 9 aa, Homo Sapiens
SIDTFLMEM

SEQ ID NO: 1151667 - protein, 9 aa, Homo Sapiens
EEEEKKKAP

SEQ ID NO: 1151668 - protein, 9 aa, Homo Sapiens
KTRLTQCNV

SEQ ID NO: 1151669 - protein, 9 aa, Homo Sapiens
EVQDMANKA

SEQ ID NO: 1151670 - protein, 9 aa, Homo Sapiens
GPQGPPENQ

SEQ ID NO: 1151671 - protein, 9 aa, Homo Sapiens
IYGCGGMFF

SEQ ID NO: 1151672 - protein, 9 aa, Homo Sapiens
CLGQLGLVV

SEQ ID NO: 1151673 - protein, 9 aa, Homo Sapiens
VLGLGGGGK

SEQ ID NO: 1151674 - protein, 9 aa, Homo Sapiens
RARTARSAL

SEQ ID NO: 1151675 - protein, 9 aa, Homo Sapiens
DLRVCGEPL

SEQ ID NO: 1151676 - protein, 9 aa, Homo Sapiens
TRTSLHQAT

SEQ ID NO: 1151677 - protein, 9 aa, Homo Sapiens
IGKAFTAHE

SEQ ID NO: 1151678 - protein, 9 aa, Homo Sapiens
FARNVSSRP

SEQ ID NO: 1151679 - protein, 9 aa, Homo Sapiens
TITVEEGQM

SEQ ID NO: 1151680 - protein, 9 aa, Homo Sapiens
TEPPLPTAS

SEQ ID NO: 1151681 - protein, 9 aa, Homo Sapiens
LHVSSKSTP

SEQ ID NO: 1151682 - protein, 9 aa, Homo Sapiens
HIGVVISSY

SEQ ID NO: 1151683 - protein, 9 aa, Homo Sapiens
MSASACKDT

SEQ ID NO: 1151684 - protein, 9 aa, Homo Sapiens
GGPESRTQS

SEQ ID NO: 1151685 - protein, 9 aa, Homo Sapiens
PPDASPGPP

SEQ ID NO: 1151686 - protein, 9 aa, Homo Sapiens
ALVDLAGEE

SEQ ID NO: 1151687 - protein, 9 aa, Homo Sapiens
AFTAHEVGK

SEQ ID NO: 1151688 - protein, 9 aa, Homo Sapiens
WACDSLFSN

SEQ ID NO: 1151689 - protein, 9 aa, Homo Sapiens
GALPGRRAP

SEQ ID NO: 1151690 - protein, 9 aa, Homo Sapiens
PTGPPRHPR

SEQ ID NO: 1151691 - protein, 9 aa, Homo Sapiens
LGLLDWKMV

SEQ ID NO: 1151692 - protein, 9 aa, Homo Sapiens
LDTDEPVTC

SEQ ID NO: 1151693 - protein, 9 aa, Homo Sapiens
VPTAPPLAP

SEQ ID NO: 1151694 - protein, 9 aa, Homo Sapiens
RGTPSLIMK

SEQ ID NO: 1151695 - protein, 9 aa, Homo Sapiens
AWFPEVALS

SEQ ID NO: 1151696 - protein, 9 aa, Homo Sapiens
EWISLPRYW

SEQ ID NO: 1151697 - protein, 9 aa, Homo Sapiens
IRGALTTRP

SEQ ID NO: 1151698 - protein, 9 aa, Homo Sapiens
IDHLLQLLR

SEQ ID NO: 1151699 - protein, 9 aa, Homo Sapiens
RILLGVMGS

SEQ ID NO: 1151700 - protein, 9 aa, Homo Sapiens
IAHNRTHTC

SEQ ID NO: 1151701 - protein, 9 aa, Homo Sapiens
SLLLQVEQH

SEQ ID NO: 1151702 - protein, 9 aa, Homo Sapiens
CTQTMVMGI

SEQ ID NO: 1151703 - protein, 9 aa, Homo Sapiens
GGKQHPHPL

SEQ ID NO: 1151704 - protein, 9 aa, Homo Sapiens
GIIHRLPAP

SEQ ID NO: 1151705 - protein, 9 aa, Homo Sapiens
RYKSKVTIT

SEQ ID NO: 1151706 - protein, 9 aa, Homo Sapiens
KTQAGDAMR

SEQ ID NO: 1151707 - protein, 9 aa, Homo Sapiens
TKCEICVKR

SEQ ID NO: 1151708 - protein, 9 aa, Homo Sapiens
TGCRWPRGR

SEQ ID NO: 1151709 - protein, 9 aa, Homo Sapiens
SRWDNETPE

SEQ ID NO: 1151710 - protein, 9 aa, Homo Sapiens
WAYVKDAWM

SEQ ID NO: 1151711 - protein, 9 aa, Homo Sapiens
ARRGLVEGY

SEQ ID NO: 1151712 - protein, 9 aa, Homo Sapiens
ILRSFMKLY

SEQ ID NO: 1151713 - protein, 9 aa, Homo Sapiens
LGLRPPHLP

SEQ ID NO: 1151714 - protein, 9 aa, Homo Sapiens
TQPSGPQGP

SEQ ID NO: 1151715 - protein, 9 aa, Homo Sapiens
RQSWGQCQS

SEQ ID NO: 1151716 - protein, 9 aa, Homo Sapiens
DLWWMQGLP

SEQ ID NO: 1151717 - protein, 9 aa, Homo Sapiens
RPAGTAARL

SEQ ID NO: 1151718 - protein, 9 aa, Homo Sapiens
RWPSSQGTL

SEQ ID NO: 1151719 - protein, 9 aa, Homo Sapiens
SSGRVRRSR

SEQ ID NO: 1151720 - protein, 9 aa, Homo Sapiens
NMFAWQIKT

SEQ ID NO: 1151721 - protein, 9 aa, Homo Sapiens
PRGHPLSAS

SEQ ID NO: 1151722 - protein, 9 aa, Homo Sapiens
EELDMVILK

SEQ ID NO: 1151723 - protein, 9 aa, Homo Sapiens
LKISDNRFE

SEQ ID NO: 1151724 - protein, 9 aa, Homo Sapiens
LGPKEEVVC

SEQ ID NO: 1151725 - protein, 9 aa, Homo Sapiens
GVGMPSAVS

SEQ ID NO: 1151726 - protein, 9 aa, Homo Sapiens
LLLHHQPTS

SEQ ID NO: 1151727 - protein, 9 aa, Homo Sapiens
MHDDPCLLT

SEQ ID NO: 1151728 - protein, 9 aa, Homo Sapiens
LELLNHLDG

SEQ ID NO: 1151729 - protein, 9 aa, Homo Sapiens
DKEEEEKKK

SEQ ID NO: 1151730 - protein, 9 aa, Homo Sapiens
ALRLGISLQ

SEQ ID NO: 1151731 - protein, 9 aa, Homo Sapiens
TMSCTMASQ

SEQ ID NO: 1151732 - protein, 9 aa, Homo Sapiens
SSWGTREPQ

SEQ ID NO: 1151733 - protein, 9 aa, Homo Sapiens
CQDIPASHS

SEQ ID NO: 1151734 - protein, 9 aa, Homo Sapiens
GGGSGDFNL

SEQ ID NO: 1151735 - protein, 9 aa, Homo Sapiens
CAVVEQTER

SEQ ID NO: 1151736 - protein, 9 aa, Homo Sapiens
VGSEAGKFG

SEQ ID NO: 1151737 - protein, 9 aa, Homo Sapiens
PHVCGVRAH

SEQ ID NO: 1151738 - protein, 9 aa, Homo Sapiens
YIFYRIFAC

SEQ ID NO: 1151739 - protein, 9 aa, Homo Sapiens
HGIYFNITA

SEQ ID NO: 1151740 - protein, 9 aa, Homo Sapiens
SCKKRLPSK

SEQ ID NO: 1151741 - protein, 9 aa, Homo Sapiens
VPQPAQTWP

SEQ ID NO: 1151742 - protein, 9 aa, Homo Sapiens
YKTQAGDAM

SEQ ID NO: 1151743 - protein, 9 aa, Homo Sapiens
SVLSVPAGI

SEQ ID NO: 1151744 - protein, 9 aa, Homo Sapiens
CWVLLCDPE

SEQ ID NO: 1151745 - protein, 9 aa, Homo Sapiens
AKRNNFSRL

SEQ ID NO: 1151746 - protein, 9 aa, Homo Sapiens
MREDDHVAI

SEQ ID NO: 1151747 - protein, 9 aa, Homo Sapiens
ALSLTSSLG

SEQ ID NO: 1151748 - protein, 9 aa, Homo Sapiens
LIQVDVAIS

SEQ ID NO: 1151749 - protein, 9 aa, Homo Sapiens
TIEIGNSLP

SEQ ID NO: 1151750 - protein, 9 aa, Homo Sapiens
APGPGAVGG

SEQ ID NO: 1151751 - protein, 9 aa, Homo Sapiens
WAMVTTWQG

SEQ ID NO: 1151752 - protein, 9 aa, Homo Sapiens
MHDENKETR

SEQ ID NO: 1151753 - protein, 9 aa, Homo Sapiens
SSDVISTNG

SEQ ID NO: 1151754 - protein, 9 aa, Homo Sapiens
LKKPLRKVR

SEQ ID NO: 1151755 - protein, 9 aa, Homo Sapiens
GWSPCDRSW

SEQ ID NO: 1151756 - protein, 9 aa, Homo Sapiens
GPESRTQSP

SEQ ID NO: 1151757 - protein, 9 aa, Homo Sapiens
RCRASRAPC

SEQ ID NO: 1151758 - protein, 9 aa, Homo Sapiens
TMAQLTTPR

SEQ ID NO: 1151759 - protein, 9 aa, Homo Sapiens
AMAGLGGAA

SEQ ID NO: 1151760 - protein, 9 aa, Homo Sapiens
EDDHVAIHE

SEQ ID NO: 1151761 - protein, 9 aa, Homo Sapiens
HRLGLFYQM

SEQ ID NO: 1151762 - protein, 9 aa, Homo Sapiens
IEDTIADHP

SEQ ID NO: 1151763 - protein, 9 aa, Homo Sapiens
TGWMFASDS

SEQ ID NO: 1151764 - protein, 9 aa, Homo Sapiens
SKNPEKLQR

SEQ ID NO: 1151765 - protein, 9 aa, Homo Sapiens
LKKTRTSLH

SEQ ID NO: 1151766 - protein, 9 aa, Homo Sapiens
NKETSGLSS

SEQ ID NO: 1151767 - protein, 9 aa, Homo Sapiens
MIGINHCCG

SEQ ID NO: 1151768 - protein, 9 aa, Homo Sapiens
PATSGPSGP

SEQ ID NO: 1151769 - protein, 9 aa, Homo Sapiens
ENGEPRELP

SEQ ID NO: 1151770 - protein, 9 aa, Homo Sapiens
SPCSGGWCR

SEQ ID NO: 1151771 - protein, 9 aa, Homo Sapiens
MNDSKHKLE

SEQ ID NO: 1151772 - protein, 9 aa, Homo Sapiens
PLQPLRRSL

SEQ ID NO: 1151773 - protein, 9 aa, Homo Sapiens
LLREAEWQT

SEQ ID NO: 1151774 - protein, 9 aa, Homo Sapiens
PKSRAAPSP

SEQ ID NO: 1151775 - protein, 9 aa, Homo Sapiens
RGRRPSGHP

SEQ ID NO: 1151776 - protein, 9 aa, Homo Sapiens
HPSTHDKNI

SEQ ID NO: 1151777 - protein, 9 aa, Homo Sapiens
HVSTSFPAQ

SEQ ID NO: 1151778 - protein, 9 aa, Homo Sapiens
TPLTIGEKT

SEQ ID NO: 1151779 - protein, 9 aa, Homo Sapiens
GAGARPPGN

SEQ ID NO: 1151780 - protein, 9 aa, Homo Sapiens
GACTHPSPH

SEQ ID NO: 1151781 - protein, 9 aa, Homo Sapiens
QERANKKQW

SEQ ID NO: 1151782 - protein, 9 aa, Homo Sapiens
QQTMSCTMA

SEQ ID NO: 1151783 - protein, 9 aa, Homo Sapiens
GCLECCRLL

SEQ ID NO: 1151784 - protein, 9 aa, Homo Sapiens
SPRRLLRRP

SEQ ID NO: 1151785 - protein, 9 aa, Homo Sapiens
LAYLKRVLI

SEQ ID NO: 1151786 - protein, 9 aa, Homo Sapiens
STPKEPAPT

SEQ ID NO: 1151787 - protein, 9 aa, Homo Sapiens
TGPMEQPLE

SEQ ID NO: 1151788 - protein, 9 aa, Homo Sapiens
WAAATCSRP

SEQ ID NO: 1151789 - protein, 9 aa, Homo Sapiens
CEYQELTNT

SEQ ID NO: 1151790 - protein, 9 aa, Homo Sapiens
KDAKIQDFE

SEQ ID NO: 1151791 - protein, 9 aa, Homo Sapiens
TSHTVKNLL

SEQ ID NO: 1151792 - protein, 9 aa, Homo Sapiens
LQRTSAALE

SEQ ID NO: 1151793 - protein, 9 aa, Homo Sapiens
HERPHPIHI

SEQ ID NO: 1151794 - protein, 9 aa, Homo Sapiens
DDQDLTHMI

SEQ ID NO: 1151795 - protein, 9 aa, Homo Sapiens
KQVSPASPP

SEQ ID NO: 1151796 - protein, 9 aa, Homo Sapiens
GVLDREQRD

SEQ ID NO: 1151797 - protein, 9 aa, Homo Sapiens
VSPEGSGKY

SEQ ID NO: 1151798 - protein, 9 aa, Homo Sapiens
QTGETVQPL

SEQ ID NO: 1151799 - protein, 9 aa, Homo Sapiens
SPSFSSSLG

SEQ ID NO: 1151800 - protein, 9 aa, Homo Sapiens
EKHLPRRIY

SEQ ID NO: 1151801 - protein, 9 aa, Homo Sapiens
INAAKIIHH

SEQ ID NO: 1151802 - protein, 9 aa, Homo Sapiens
LLVPARYRK

SEQ ID NO: 1151803 - protein, 9 aa, Homo Sapiens
LIGDTSIDT

SEQ ID NO: 1151804 - protein, 9 aa, Homo Sapiens
RVSSAKRNN

SEQ ID NO: 1151805 - protein, 9 aa, Homo Sapiens
GEKPVLGPH

SEQ ID NO: 1151806 - protein, 9 aa, Homo Sapiens
CVCPLASLA

SEQ ID NO: 1151807 - protein, 9 aa, Homo Sapiens
MLPVRARTA

SEQ ID NO: 1151808 - protein, 9 aa, Homo Sapiens
MSCLSRPGW

SEQ ID NO: 1151809 - protein, 9 aa, Homo Sapiens
SSMAPKMNF

SEQ ID NO: 1151810 - protein, 9 aa, Homo Sapiens
LWDFWDHGG

SEQ ID NO: 1151811 - protein, 9 aa, Homo Sapiens
PDHPSGQGA

SEQ ID NO: 1151812 - protein, 9 aa, Homo Sapiens
GPMPGSCRS

SEQ ID NO: 1151813 - protein, 9 aa, Homo Sapiens
LDWKMVNQK

SEQ ID NO: 1151814 - protein, 9 aa, Homo Sapiens
SAGPQPCNV

SEQ ID NO: 1151815 - protein, 9 aa, Homo Sapiens
GFGNCMELQ

SEQ ID NO: 1151816 - protein, 9 aa, Homo Sapiens
TTPIPHLSP

SEQ ID NO: 1151817 - protein, 9 aa, Homo Sapiens
RPFALPLGR

SEQ ID NO: 1151818 - protein, 9 aa, Homo Sapiens
EIGNSLPQG

SEQ ID NO: 1151819 - protein, 9 aa, Homo Sapiens
AASLGTRKG

SEQ ID NO: 1151820 - protein, 9 aa, Homo Sapiens
ECGKTFSES

SEQ ID NO: 1151821 - protein, 9 aa, Homo Sapiens
TTCQSVHII

SEQ ID NO: 1151822 - protein, 9 aa, Homo Sapiens
ILVPRLECS

SEQ ID NO: 1151823 - protein, 9 aa, Homo Sapiens
PNPTQPSGP

SEQ ID NO: 1151824 - protein, 9 aa, Homo Sapiens
RNCGHICNT

SEQ ID NO: 1151825 - protein, 9 aa, Homo Sapiens
AGLGQDHQV

SEQ ID NO: 1151826 - protein, 9 aa, Homo Sapiens
EQDYHGLME

SEQ ID NO: 1151827 - protein, 9 aa, Homo Sapiens
PSTHDKNIW

SEQ ID NO: 1151828 - protein, 9 aa, Homo Sapiens
RDAGCQFRV

SEQ ID NO: 1151829 - protein, 9 aa, Homo Sapiens
LPRSPALPP

SEQ ID NO: 1151830 - protein, 9 aa, Homo Sapiens
KREFTTLNQ

SEQ ID NO: 1151831 - protein, 9 aa, Homo Sapiens
RLCPHILDR

SEQ ID NO: 1151832 - protein, 9 aa, Homo Sapiens
APTPTSLFQ

SEQ ID NO: 1151833 - protein, 9 aa, Homo Sapiens
LVLIGAPIT

SEQ ID NO: 1151834 - protein, 9 aa, Homo Sapiens
SALWNQLSL

SEQ ID NO: 1151835 - protein, 9 aa, Homo Sapiens
RCVGKDGEC

SEQ ID NO: 1151836 - protein, 9 aa, Homo Sapiens
PGEALRLLC

SEQ ID NO: 1151837 - protein, 9 aa, Homo Sapiens
SATTSSSGW

SEQ ID NO: 1151838 - protein, 9 aa, Homo Sapiens
VSRVVCTMI

SEQ ID NO: 1151839 - protein, 9 aa, Homo Sapiens
VLSVPAGIL

SEQ ID NO: 1151840 - protein, 9 aa, Homo Sapiens
HHTREIFVL

SEQ ID NO: 1151841 - protein, 9 aa, Homo Sapiens
RLTGSTPMH

SEQ ID NO: 1151842 - protein, 9 aa, Homo Sapiens
DGTYVKLST

SEQ ID NO: 1151843 - protein, 9 aa, Homo Sapiens
SPYTHACCH

SEQ ID NO: 1151844 - protein, 9 aa, Homo Sapiens
MPVDNPGLG

SEQ ID NO: 1151845 - protein, 9 aa, Homo Sapiens
DKKHGGGTA

SEQ ID NO: 1151846 - protein, 9 aa, Homo Sapiens
RWPAHLLET

SEQ ID NO: 1151847 - protein, 9 aa, Homo Sapiens
AFGDQVPCQ

SEQ ID NO: 1151848 - protein, 9 aa, Homo Sapiens
LLNHLDGFD

SEQ ID NO: 1151849 - protein, 9 aa, Homo Sapiens
LTAQAVDRE

SEQ ID NO: 1151850 - protein, 9 aa, Homo Sapiens
LAQLEEQRD

SEQ ID NO: 1151851 - protein, 9 aa, Homo Sapiens
QYLLRDSSP

SEQ ID NO: 1151852 - protein, 9 aa, Homo Sapiens
LWGLETKEV

SEQ ID NO: 1151853 - protein, 9 aa, Homo Sapiens
ETWDPTYLS

SEQ ID NO: 1151854 - protein, 9 aa, Homo Sapiens
PGPPAGSST

SEQ ID NO: 1151855 - protein, 9 aa, Homo Sapiens
WARVPACRR

SEQ ID NO: 1151856 - protein, 9 aa, Homo Sapiens
TRLLAACGA

SEQ ID NO: 1151857 - protein, 9 aa, Homo Sapiens
DSKSSSEIG

SEQ ID NO: 1151858 - protein, 9 aa, Homo Sapiens
ELNKHISLN

SEQ ID NO: 1151859 - protein, 9 aa, Homo Sapiens
ELTGCSVEF

SEQ ID NO: 1151860 - protein, 9 aa, Homo Sapiens
FILALDCMR

SEQ ID NO: 1151861 - protein, 9 aa, Homo Sapiens
PTKCEICVK

SEQ ID NO: 1151862 - protein, 9 aa, Homo Sapiens
RCHTTGWMF

SEQ ID NO: 1151863 - protein, 9 aa, Homo Sapiens
SKGEELKPE

SEQ ID NO: 1151864 - protein, 9 aa, Homo Sapiens
RRTMRLRHG

SEQ ID NO: 1151865 - protein, 9 aa, Homo Sapiens
SRFWLALQA

SEQ ID NO: 1151866 - protein, 9 aa, Homo Sapiens
LTRDAHLCP

SEQ ID NO: 1151867 - protein, 9 aa, Homo Sapiens
EYYRVHEDG

SEQ ID NO: 1151868 - protein, 9 aa, Homo Sapiens
RQYKCKMLL

SEQ ID NO: 1151869 - protein, 9 aa, Homo Sapiens
GIRGALTTR

SEQ ID NO: 1151870 - protein, 9 aa, Homo Sapiens
RRYRLRAVL

SEQ ID NO: 1151871 - protein, 9 aa, Homo Sapiens
TSSPRRSPA

SEQ ID NO: 1151872 - protein, 9 aa, Homo Sapiens
LTPDVAGLH

SEQ ID NO: 1151873 - protein, 9 aa, Homo Sapiens
QGRGIGPLT

SEQ ID NO: 1151874 - protein, 9 aa, Homo Sapiens
LLCYPNVVP

SEQ ID NO: 1151875 - protein, 9 aa, Homo Sapiens
SRPRKDEKK

SEQ ID NO: 1151876 - protein, 9 aa, Homo Sapiens
PVLSPRVTS

SEQ ID NO: 1151877 - protein, 9 aa, Homo Sapiens
KAFTAHEVG

SEQ ID NO: 1151878 - protein, 9 aa, Homo Sapiens
HWKDWYLPD

SEQ ID NO: 1151879 - protein, 9 aa, Homo Sapiens
DGMLTVIGQ

SEQ ID NO: 1151880 - protein, 9 aa, Homo Sapiens
LLPRSPALP

SEQ ID NO: 1151881 - protein, 9 aa, Homo Sapiens
KKYYLLNPA

SEQ ID NO: 1151882 - protein, 9 aa, Homo Sapiens
TTSSSGWLE

SEQ ID NO: 1151883 - protein, 9 aa, Homo Sapiens
GTLSLQRLS

SEQ ID NO: 1151884 - protein, 9 aa, Homo Sapiens
QHVLGAQVF

SEQ ID NO: 1151885 - protein, 9 aa, Homo Sapiens
GVHHGANQV

SEQ ID NO: 1151886 - protein, 9 aa, Homo Sapiens
SREVCSSPR

SEQ ID NO: 1151887 - protein, 9 aa, Homo Sapiens
FTDARVAEE

SEQ ID NO: 1151888 - protein, 9 aa, Homo Sapiens
IMWSPNDNN

SEQ ID NO: 1151889 - protein, 9 aa, Homo Sapiens
ITPYTLTPS

SEQ ID NO: 1151890 - protein, 9 aa, Homo Sapiens
PISLSCWLS

SEQ ID NO: 1151891 - protein, 9 aa, Homo Sapiens
RSCRQTPPG

SEQ ID NO: 1151892 - protein, 9 aa, Homo Sapiens
VGWATGVAQ

SEQ ID NO: 1151893 - protein, 9 aa, Homo Sapiens
PARAARAFS

SEQ ID NO: 1151894 - protein, 9 aa, Homo Sapiens
GWTGACTPP

SEQ ID NO: 1151895 - protein, 9 aa, Homo Sapiens
AFLTLRRKW

SEQ ID NO: 1151896 - protein, 9 aa, Homo Sapiens
QFPLDVPDV

SEQ ID NO: 1151897 - protein, 9 aa, Homo Sapiens
LSFLQEHWD

SEQ ID NO: 1151898 - protein, 9 aa, Homo Sapiens
GVYNVDHQN

SEQ ID NO: 1151899 - protein, 9 aa, Homo Sapiens
CTTCASAAT

SEQ ID NO: 1151900 - protein, 9 aa, Homo Sapiens
EFTHIEFPR

SEQ ID NO: 1151901 - protein, 9 aa, Homo Sapiens
TTPPASTTA

SEQ ID NO: 1151902 - protein, 9 aa, Homo Sapiens
WRLPTHKIR

SEQ ID NO: 1151903 - protein, 9 aa, Homo Sapiens
AGGAEESSA

SEQ ID NO: 1151904 - protein, 9 aa, Homo Sapiens
LEEGGSAHT

SEQ ID NO: 1151905 - protein, 9 aa, Homo Sapiens
RKVTTDKKV

SEQ ID NO: 1151906 - protein, 9 aa, Homo Sapiens
FDMAVATRR

SEQ ID NO: 1151907 - protein, 9 aa, Homo Sapiens
PKTSRLSLS

SEQ ID NO: 1151908 - protein, 9 aa, Homo Sapiens
IELNKHISL

SEQ ID NO: 1151909 - protein, 9 aa, Homo Sapiens
ICHWNQKIR

SEQ ID NO: 1151910 - protein, 9 aa, Homo Sapiens
RRPSGHPAA

SEQ ID NO: 1151911 - protein, 9 aa, Homo Sapiens
KRTDSVANK

SEQ ID NO: 1151912 - protein, 9 aa, Homo Sapiens
PDQSRPTCQ

SEQ ID NO: 1151913 - protein, 9 aa, Homo Sapiens
ARGPVRLLL

SEQ ID NO: 1151914 - protein, 9 aa, Homo Sapiens
IKTTLILVY

SEQ ID NO: 1151915 - protein, 9 aa, Homo Sapiens
GICKGASSH

SEQ ID NO: 1151916 - protein, 9 aa, Homo Sapiens
SPRVTSDPE

SEQ ID NO: 1151917 - protein, 9 aa, Homo Sapiens
HCLGQLGLV

SEQ ID NO: 1151918 - protein, 9 aa, Homo Sapiens
QLPGQVHRG

SEQ ID NO: 1151919 - protein, 9 aa, Homo Sapiens
SGLCRYGGR

SEQ ID NO: 1151920 - protein, 9 aa, Homo Sapiens
RCLGTKTRL

SEQ ID NO: 1151921 - protein, 9 aa, Homo Sapiens
FPICWCPFF

SEQ ID NO: 1151922 - protein, 9 aa, Homo Sapiens
PSTPKEPAP

SEQ ID NO: 1151923 - protein, 9 aa, Homo Sapiens
QTLEAWEGL

SEQ ID NO: 1151924 - protein, 9 aa, Homo Sapiens
SCKQALGTQ

SEQ ID NO: 1151925 - protein, 9 aa, Homo Sapiens
ERAPRPGGF

SEQ ID NO: 1151926 - protein, 9 aa, Homo Sapiens
VLKQNSSPP

SEQ ID NO: 1151927 - protein, 9 aa, Homo Sapiens
LLSILSFLQ

SEQ ID NO: 1151928 - protein, 9 aa, Homo Sapiens
GGGEGGGVM

SEQ ID NO: 1151929 - protein, 9 aa, Homo Sapiens
GAWKSIFRL

SEQ ID NO: 1151930 - protein, 9 aa, Homo Sapiens
KIPDTHLHG

SEQ ID NO: 1151931 - protein, 9 aa, Homo Sapiens
TATALAITV

SEQ ID NO: 1151932 - protein, 9 aa, Homo Sapiens
KPLESKLIS

SEQ ID NO: 1151933 - protein, 9 aa, Homo Sapiens
SLWKRLKVF

SEQ ID NO: 1151934 - protein, 9 aa, Homo Sapiens
ARPPRLRAT

SEQ ID NO: 1151935 - protein, 9 aa, Homo Sapiens
ESLRITFQQ

SEQ ID NO: 1151936 - protein, 9 aa, Homo Sapiens
SVCAHAHSN

SEQ ID NO: 1151937 - protein, 9 aa, Homo Sapiens
HHEFCSHKS

SEQ ID NO: 1151938 - protein, 9 aa, Homo Sapiens
LACGVVQGA

SEQ ID NO: 1151939 - protein, 9 aa, Homo Sapiens
GQGPRRRPA

SEQ ID NO: 1151940 - protein, 9 aa, Homo Sapiens
GALLCLSAL

SEQ ID NO: 1151941 - protein, 9 aa, Homo Sapiens
SRPTCQARP

SEQ ID NO: 1151942 - protein, 9 aa, Homo Sapiens
QGIAGPGHK

SEQ ID NO: 1151943 - protein, 9 aa, Homo Sapiens
FYNELCVAP

SEQ ID NO: 1151944 - protein, 9 aa, Homo Sapiens
LIVKGVLDR

SEQ ID NO: 1151945 - protein, 9 aa, Homo Sapiens
AKSGRHLSG

SEQ ID NO: 1151946 - protein, 9 aa, Homo Sapiens
DHAQPLARP

SEQ ID NO: 1151947 - protein, 9 aa, Homo Sapiens
LHGYALWPE

SEQ ID NO: 1151948 - protein, 9 aa, Homo Sapiens
LFIWPQHSY

SEQ ID NO: 1151949 - protein, 9 aa, Homo Sapiens
PTEPPLPTA

SEQ ID NO: 1151950 - protein, 9 aa, Homo Sapiens
DKVPKKRIL

SEQ ID NO: 1151951 - protein, 9 aa, Homo Sapiens
HWVKKGERQ

SEQ ID NO: 1151952 - protein, 9 aa, Homo Sapiens
CEICVKRRR

SEQ ID NO: 1151953 - protein, 9 aa, Homo Sapiens
PDPNRTTYV

SEQ ID NO: 1151954 - protein, 9 aa, Homo Sapiens
RQTLPALGE

SEQ ID NO: 1151955 - protein, 9 aa, Homo Sapiens
DDYRCSVYT

SEQ ID NO: 1151956 - protein, 9 aa, Homo Sapiens
RDGLACSLQ

SEQ ID NO: 1151957 - protein, 9 aa, Homo Sapiens
LGAKRRGPC

SEQ ID NO: 1151958 - protein, 9 aa, Homo Sapiens
HRSAFSRVS

SEQ ID NO: 1151959 - protein, 9 aa, Homo Sapiens
PYSSVPPLS

SEQ ID NO: 1151960 - protein, 9 aa, Homo Sapiens
ACRWEPQPP

SEQ ID NO: 1151961 - protein, 9 aa, Homo Sapiens
NPLHYLTVM

SEQ ID NO: 1151962 - protein, 9 aa, Homo Sapiens
CARGPRAPV

SEQ ID NO: 1151963 - protein, 9 aa, Homo Sapiens
VLVIEDKMK

SEQ ID NO: 1151964 - protein, 9 aa, Homo Sapiens
RRKKMREHA

SEQ ID NO: 1151965 - protein, 9 aa, Homo Sapiens
YLLSATTSS

SEQ ID NO: 1151966 - protein, 9 aa, Homo Sapiens
SAMRKGHNM

SEQ ID NO: 1151967 - protein, 9 aa, Homo Sapiens
WLHYLRPIL

SEQ ID NO: 1151968 - protein, 9 aa, Homo Sapiens
TWQMLFYVT

SEQ ID NO: 1151969 - protein, 9 aa, Homo Sapiens
CSQGACRRE

SEQ ID NO: 1151970 - protein, 9 aa, Homo Sapiens
KKEETRRKL

SEQ ID NO: 1151971 - protein, 9 aa, Homo Sapiens
QLQKLDFDT

SEQ ID NO: 1151972 - protein, 9 aa, Homo Sapiens
KGYCTQYRG

SEQ ID NO: 1151973 - protein, 9 aa, Homo Sapiens
CGTRRSCSG

SEQ ID NO: 1151974 - protein, 9 aa, Homo Sapiens
KHLPRRIYL

SEQ ID NO: 1151975 - protein, 9 aa, Homo Sapiens
YCPSVESSY

SEQ ID NO: 1151976 - protein, 9 aa, Homo Sapiens
PRWPSRLSA

SEQ ID NO: 1151977 - protein, 9 aa, Homo Sapiens
FMCLRLCPH

SEQ ID NO: 1151978 - protein, 9 aa, Homo Sapiens
PAGLRVPEG

SEQ ID NO: 1151979 - protein, 9 aa, Homo Sapiens
DEDQYLLRD

SEQ ID NO: 1151980 - protein, 9 aa, Homo Sapiens
RDSSPITDR

SEQ ID NO: 1151981 - protein, 9 aa, Homo Sapiens
RLEGPSRTW

SEQ ID NO: 1151982 - protein, 9 aa, Homo Sapiens
ECCPPARPD

SEQ ID NO: 1151983 - protein, 9 aa, Homo Sapiens
PSYLDKVPK

SEQ ID NO: 1151984 - protein, 9 aa, Homo Sapiens
QTHIKALLA

SEQ ID NO: 1151985 - protein, 9 aa, Homo Sapiens
WKLHIGNFS

SEQ ID NO: 1151986 - protein, 9 aa, Homo Sapiens
ISDIIHEKM

SEQ ID NO: 1151987 - protein, 9 aa, Homo Sapiens
PYTECDHAQ

SEQ ID NO: 1151988 - protein, 9 aa, Homo Sapiens
GAPPLWGRL

SEQ ID NO: 1151989 - protein, 9 aa, Homo Sapiens
PAPRVSPSN

SEQ ID NO: 1151990 - protein, 9 aa, Homo Sapiens
ACGVVQGAL

SEQ ID NO: 1151991 - protein, 9 aa, Homo Sapiens
MVCTGAKGE

SEQ ID NO: 1151992 - protein, 9 aa, Homo Sapiens
MKLRRKNKK

SEQ ID NO: 1151993 - protein, 9 aa, Homo Sapiens
GSNPQGPPP

SEQ ID NO: 1151994 - protein, 9 aa, Homo Sapiens
LYGEIADPF

SEQ ID NO: 1151995 - protein, 9 aa, Homo Sapiens
EPTVSFTNE

SEQ ID NO: 1151996 - protein, 9 aa, Homo Sapiens
TYVKLSTAQ

SEQ ID NO: 1151997 - protein, 9 aa, Homo Sapiens
PHLVSGGDE

SEQ ID NO: 1151998 - protein, 9 aa, Homo Sapiens
EGSLKKTSR

SEQ ID NO: 1151999 - protein, 9 aa, Homo Sapiens
ASAKKLVPL

SEQ ID NO: 1152000 - protein, 9 aa, Homo Sapiens
LQFPLDVPD

SEQ ID NO: 1152001 - protein, 9 aa, Homo Sapiens
AVHEGNRLE

SEQ ID NO: 1152002 - protein, 9 aa, Homo Sapiens
GPACSSREV

SEQ ID NO: 1152003 - protein, 9 aa, Homo Sapiens
EDDLAELVS

SEQ ID NO: 1152004 - protein, 9 aa, Homo Sapiens
TLETGRSGA

SEQ ID NO: 1152005 - protein, 9 aa, Homo Sapiens
EEEVLIPPL

SEQ ID NO: 1152006 - protein, 9 aa, Homo Sapiens
LHLTSETSS

SEQ ID NO: 1152007 - protein, 9 aa, Homo Sapiens
FGPNQVISL

SEQ ID NO: 1152008 - protein, 9 aa, Homo Sapiens
IGHPPSAIR

SEQ ID NO: 1152009 - protein, 9 aa, Homo Sapiens
IEKEHLQVE

SEQ ID NO: 1152010 - protein, 9 aa, Homo Sapiens
KPGPPVLLA

SEQ ID NO: 1152011 - protein, 9 aa, Homo Sapiens
SCRKQPVSI

SEQ ID NO: 1152012 - protein, 9 aa, Homo Sapiens
CVGVFQRGK

SEQ ID NO: 1152013 - protein, 9 aa, Homo Sapiens
YMRNLPHSN

SEQ ID NO: 1152014 - protein, 9 aa, Homo Sapiens
EGYSNLLQV

SEQ ID NO: 1152015 - protein, 9 aa, Homo Sapiens
PSAPMPSTS

SEQ ID NO: 1152016 - protein, 9 aa, Homo Sapiens
FFPFDTWQM

SEQ ID NO: 1152017 - protein, 9 aa, Homo Sapiens
LGTKTRLTQ

SEQ ID NO: 1152018 - protein, 9 aa, Homo Sapiens
HVDGERSFR

SEQ ID NO: 1152019 - protein, 9 aa, Homo Sapiens
LSPRVTSDP

SEQ ID NO: 1152020 - protein, 9 aa, Homo Sapiens
CSLQHYLQL

SEQ ID NO: 1152021 - protein, 9 aa, Homo Sapiens
KSGRHLSGG

SEQ ID NO: 1152022 - protein, 9 aa, Homo Sapiens
CHPLPQLLG

SEQ ID NO: 1152023 - protein, 9 aa, Homo Sapiens
QLWAPLKTR

SEQ ID NO: 1152024 - protein, 9 aa, Homo Sapiens
LAIRSKPLC

SEQ ID NO: 1152025 - protein, 9 aa, Homo Sapiens
LGDELYHGL

SEQ ID NO: 1152026 - protein, 9 aa, Homo Sapiens
RSRRCTGSP

SEQ ID NO: 1152027 - protein, 9 aa, Homo Sapiens
GQLGLVVIV

SEQ ID NO: 1152028 - protein, 9 aa, Homo Sapiens
LIPPLRPSK

SEQ ID NO: 1152029 - protein, 9 aa, Homo Sapiens
RCHQRRVPQ

SEQ ID NO: 1152030 - protein, 9 aa, Homo Sapiens
ISNNKREKH

SEQ ID NO: 1152031 - protein, 9 aa, Homo Sapiens
NCMELQASA

SEQ ID NO: 1152032 - protein, 9 aa, Homo Sapiens
VMVTRHPDT

SEQ ID NO: 1152033 - protein, 9 aa, Homo Sapiens
DWSHVAAYV

SEQ ID NO: 1152034 - protein, 9 aa, Homo Sapiens
GTHGPSAGA

SEQ ID NO: 1152035 - protein, 9 aa, Homo Sapiens
KVSRFPELT

SEQ ID NO: 1152036 - protein, 9 aa, Homo Sapiens
HLPSCHPLP

SEQ ID NO: 1152037 - protein, 9 aa, Homo Sapiens
AALGTCSIW

SEQ ID NO: 1152038 - protein, 9 aa, Homo Sapiens
STSAPRRSC

SEQ ID NO: 1152039 - protein, 9 aa, Homo Sapiens
DQTGRPILL

SEQ ID NO: 1152040 - protein, 9 aa, Homo Sapiens
RHRERSAQP

SEQ ID NO: 1152041 - protein, 9 aa, Homo Sapiens
VHQDTKDNC

SEQ ID NO: 1152042 - protein, 9 aa, Homo Sapiens
CHHCFTTTS

SEQ ID NO: 1152043 - protein, 9 aa, Homo Sapiens
GGDEVSPGG

SEQ ID NO: 1152044 - protein, 9 aa, Homo Sapiens
YAKKDYNEV

SEQ ID NO: 1152045 - protein, 9 aa, Homo Sapiens
HEYYRVHED

SEQ ID NO: 1152046 - protein, 9 aa, Homo Sapiens
LEEDAVLKQ

SEQ ID NO: 1152047 - protein, 9 aa, Homo Sapiens
RHVEEEKER

SEQ ID NO: 1152048 - protein, 9 aa, Homo Sapiens
RKKMREHAE

SEQ ID NO: 1152049 - protein, 9 aa, Homo Sapiens
IRENVLWDF

SEQ ID NO: 1152050 - protein, 9 aa, Homo Sapiens
RHGVESMLE

SEQ ID NO: 1152051 - protein, 9 aa, Homo Sapiens
TANHDSENF

SEQ ID NO: 1152052 - protein, 9 aa, Homo Sapiens
LRRSLPIQP

SEQ ID NO: 1152053 - protein, 9 aa, Homo Sapiens
LKLNDIVGS

SEQ ID NO: 1152054 - protein, 9 aa, Homo Sapiens
VIVPAQRIP

SEQ ID NO: 1152055 - protein, 9 aa, Homo Sapiens
MGRVGHDPK

SEQ ID NO: 1152056 - protein, 9 aa, Homo Sapiens
GLVSGGELL

SEQ ID NO: 1152057 - protein, 9 aa, Homo Sapiens
VPCSALGTS

SEQ ID NO: 1152058 - protein, 9 aa, Homo Sapiens
HVVFVDPCK

SEQ ID NO: 1152059 - protein, 9 aa, Homo Sapiens
GLPGNWELK

SEQ ID NO: 1152060 - protein, 9 aa, Homo Sapiens
PNLSVAEKV

SEQ ID NO: 1152061 - protein, 9 aa, Homo Sapiens
HGAPWKGRP

SEQ ID NO: 1152062 - protein, 9 aa, Homo Sapiens
IKYWIYGCG

SEQ ID NO: 1152063 - protein, 9 aa, Homo Sapiens
RNAHLGECV

SEQ ID NO: 1152064 - protein, 9 aa, Homo Sapiens
RTTYVKASG

SEQ ID NO: 1152065 - protein, 9 aa, Homo Sapiens
SGTKMKATH

SEQ ID NO: 1152066 - protein, 9 aa, Homo Sapiens
LKGNYPAGE

SEQ ID NO: 1152067 - protein, 9 aa, Homo Sapiens
AWKSIFRLY

SEQ ID NO: 1152068 - protein, 9 aa, Homo Sapiens
MGQTWGPRT

SEQ ID NO: 1152069 - protein, 9 aa, Homo Sapiens
GPAAAATST

SEQ ID NO: 1152070 - protein, 9 aa, Homo Sapiens
PQLIVKGVL

SEQ ID NO: 1152071 - protein, 9 aa, Homo Sapiens
TTLIPSHPN

SEQ ID NO: 1152072 - protein, 9 aa, Homo Sapiens
WDPTYLSTA

SEQ ID NO: 1152073 - protein, 9 aa, Homo Sapiens
RGFRDRTCT

SEQ ID NO: 1152074 - protein, 9 aa, Homo Sapiens
QNEFKAEYE

SEQ ID NO: 1152075 - protein, 9 aa, Homo Sapiens
ATAARRAAR

SEQ ID NO: 1152076 - protein, 9 aa, Homo Sapiens
GHGKEECCP

SEQ ID NO: 1152077 - protein, 9 aa, Homo Sapiens
EGPSRTWRC

SEQ ID NO: 1152078 - protein, 9 aa, Homo Sapiens
SQSGRWGTG

SEQ ID NO: 1152079 - protein, 9 aa, Homo Sapiens
LSRPTSSQE

SEQ ID NO: 1152080 - protein, 9 aa, Homo Sapiens
IGRELRPRL

SEQ ID NO: 1152081 - protein, 9 aa, Homo Sapiens
GSHPGSCAP

SEQ ID NO: 1152082 - protein, 9 aa, Homo Sapiens
GCLRQELLL

SEQ ID NO: 1152083 - protein, 9 aa, Homo Sapiens
LAGVARRDG

SEQ ID NO: 1152084 - protein, 9 aa, Homo Sapiens
QKRMNFLHH

SEQ ID NO: 1152085 - protein, 9 aa, Homo Sapiens
PMEQPLEEE

SEQ ID NO: 1152086 - protein, 9 aa, Homo Sapiens
QDIPASHSD

SEQ ID NO: 1152087 - protein, 9 aa, Homo Sapiens
SSRGMGRRP

SEQ ID NO: 1152088 - protein, 9 aa, Homo Sapiens
QYLAPLPPV

SEQ ID NO: 1152089 - protein, 9 aa, Homo Sapiens
FIILRWYHP

SEQ ID NO: 1152090 - protein, 9 aa, Homo Sapiens
RWKTKFYRQ

SEQ ID NO: 1152091 - protein, 9 aa, Homo Sapiens
AKRRGPCTT

SEQ ID NO: 1152092 - protein, 9 aa, Homo Sapiens
RLAQSKETL

SEQ ID NO: 1152093 - protein, 9 aa, Homo Sapiens
CSRGLCCVP

SEQ ID NO: 1152094 - protein, 9 aa, Homo Sapiens
RLTVGKSHL

SEQ ID NO: 1152095 - protein, 9 aa, Homo Sapiens
ESILGVVGG

SEQ ID NO: 1152096 - protein, 9 aa, Homo Sapiens
VHYAGPVRH

SEQ ID NO: 1152097 - protein, 9 aa, Homo Sapiens
ICVKRRRRR

SEQ ID NO: 1152098 - protein, 9 aa, Homo Sapiens
SNDPKMSET

SEQ ID NO: 1152099 - protein, 9 aa, Homo Sapiens
VRPPVLSPR

SEQ ID NO: 1152100 - protein, 9 aa, Homo Sapiens
TNTEEKKYS

SEQ ID NO: 1152101 - protein, 9 aa, Homo Sapiens
PDDKSDDLE

SEQ ID NO: 1152102 - protein, 9 aa, Homo Sapiens
EYWMALRNC

SEQ ID NO: 1152103 - protein, 9 aa, Homo Sapiens
PNRIFFGDI

SEQ ID NO: 1152104 - protein, 9 aa, Homo Sapiens
LLIAVLVCW

SEQ ID NO: 1152105 - protein, 9 aa, Homo Sapiens
PAMAGLGGA

SEQ ID NO: 1152106 - protein, 9 aa, Homo Sapiens
PSVMQSFND

SEQ ID NO: 1152107 - protein, 9 aa, Homo Sapiens
SVHIILSVK

SEQ ID NO: 1152108 - protein, 9 aa, Homo Sapiens
GSCGFTQDR

SEQ ID NO: 1152109 - protein, 9 aa, Homo Sapiens
LGTSWPRLE

SEQ ID NO: 1152110 - protein, 9 aa, Homo Sapiens
QRILQLSLS

SEQ ID NO: 1152111 - protein, 9 aa, Homo Sapiens
MLPRSTVSI

SEQ ID NO: 1152112 - protein, 9 aa, Homo Sapiens
SSWSSLDAQ

SEQ ID NO: 1152113 - protein, 9 aa, Homo Sapiens
LLALNQKNS

SEQ ID NO: 1152114 - protein, 9 aa, Homo Sapiens
GTVGPLGLR

SEQ ID NO: 1152115 - protein, 9 aa, Homo Sapiens
NSVPTSQRG

SEQ ID NO: 1152116 - protein, 9 aa, Homo Sapiens
KMPVDNPGL

SEQ ID NO: 1152117 - protein, 9 aa, Homo Sapiens
PSGSFDFLL

SEQ ID NO: 1152118 - protein, 9 aa, Homo Sapiens
GTLETGRSG

SEQ ID NO: 1152119 - protein, 9 aa, Homo Sapiens
SRAVLVERG

SEQ ID NO: 1152120 - protein, 9 aa, Homo Sapiens
SGRVFKGLR

SEQ ID NO: 1152121 - protein, 9 aa, Homo Sapiens
ETGVYNVDH

SEQ ID NO: 1152122 - protein, 9 aa, Homo Sapiens
IDISPGALF

SEQ ID NO: 1152123 - protein, 9 aa, Homo Sapiens
KTEIQLTMN

SEQ ID NO: 1152124 - protein, 9 aa, Homo Sapiens
LLLTMMAYD

SEQ ID NO: 1152125 - protein, 9 aa, Homo Sapiens
CCTSYRVHS

SEQ ID NO: 1152126 - protein, 9 aa, Homo Sapiens
GCRWPRGRP

SEQ ID NO: 1152127 - protein, 9 aa, Homo Sapiens
RRRRRFPAR

SEQ ID NO: 1152128 - protein, 9 aa, Homo Sapiens
VRRPTVVQG

SEQ ID NO: 1152129 - protein, 9 aa, Homo Sapiens
FILVPRLEC

SEQ ID NO: 1152130 - protein, 9 aa, Homo Sapiens
EAPHVDGER

SEQ ID NO: 1152131 - protein, 9 aa, Homo Sapiens
HASCHSHLC

SEQ ID NO: 1152132 - protein, 9 aa, Homo Sapiens
DPCKDSERY

SEQ ID NO: 1152133 - protein, 9 aa, Homo Sapiens
GDASCARWR

SEQ ID NO: 1152134 - protein, 9 aa, Homo Sapiens
YTECDHAQP

SEQ ID NO: 1152135 - protein, 9 aa, Homo Sapiens
GPQEIQGMQ

SEQ ID NO: 1152136 - protein, 9 aa, Homo Sapiens
HHDCMSLAC

SEQ ID NO: 1152137 - protein, 9 aa, Homo Sapiens
FLIDALQPH

SEQ ID NO: 1152138 - protein, 9 aa, Homo Sapiens
VISLESIFR

SEQ ID NO: 1152139 - protein, 9 aa, Homo Sapiens
LWGRLRSRP

SEQ ID NO: 1152140 - protein, 9 aa, Homo Sapiens
FEAHASFYY

SEQ ID NO: 1152141 - protein, 9 aa, Homo Sapiens
SMEVSYMEI

SEQ ID NO: 1152142 - protein, 9 aa, Homo Sapiens
QCVVLEARA

SEQ ID NO: 1152143 - protein, 9 aa, Homo Sapiens
VPKKRILNF

SEQ ID NO: 1152144 - protein, 9 aa, Homo Sapiens
LPSLLSRMP

SEQ ID NO: 1152145 - protein, 9 aa, Homo Sapiens
DALKKPLRK

SEQ ID NO: 1152146 - protein, 9 aa, Homo Sapiens
DPVRSYPVL

SEQ ID NO: 1152147 - protein, 9 aa, Homo Sapiens
TGACTHPSP

SEQ ID NO: 1152148 - protein, 9 aa, Homo Sapiens
MAQLTTPRP

SEQ ID NO: 1152149 - protein, 9 aa, Homo Sapiens
NCISSGCHA

SEQ ID NO: 1152150 - protein, 9 aa, Homo Sapiens
ADSSASVRM

SEQ ID NO: 1152151 - protein, 9 aa, Homo Sapiens
LEGMLLPRA

SEQ ID NO: 1152152 - protein, 9 aa, Homo Sapiens
GPADPPGPP

SEQ ID NO: 1152153 - protein, 9 aa, Homo Sapiens
YLESDEVAW

SEQ ID NO: 1152154 - protein, 9 aa, Homo Sapiens
EKPPTAEGL

SEQ ID NO: 1152155 - protein, 9 aa, Homo Sapiens
SYLEEQRIV

SEQ ID NO: 1152156 - protein, 9 aa, Homo Sapiens
GAYILVRYA

SEQ ID NO: 1152157 - protein, 9 aa, Homo Sapiens
CEKPYHCLD

SEQ ID NO: 1152158 - protein, 9 aa, Homo Sapiens
PHILDRLQR

SEQ ID NO: 1152159 - protein, 9 aa, Homo Sapiens
EYQELTNTK

SEQ ID NO: 1152160 - protein, 9 aa, Homo Sapiens
NWKPLTVLN

SEQ ID NO: 1152161 - protein, 9 aa, Homo Sapiens
EVALSLTSS

SEQ ID NO: 1152162 - protein, 9 aa, Homo Sapiens
GQPAAANAA

SEQ ID NO: 1152163 - protein, 9 aa, Homo Sapiens
EKSGPCSNS

SEQ ID NO: 1152164 - protein, 9 aa, Homo Sapiens
PRLEGPSRT

SEQ ID NO: 1152165 - protein, 9 aa, Homo Sapiens
INHCCGEYT

SEQ ID NO: 1152166 - protein, 9 aa, Homo Sapiens
LKNIPGIRG

SEQ ID NO: 1152167 - protein, 9 aa, Homo Sapiens
FLCPGEPGA

SEQ ID NO: 1152168 - protein, 9 aa, Homo Sapiens
IQGSEAVGY

SEQ ID NO: 1152169 - protein, 9 aa, Homo Sapiens
LSLKADMLG

SEQ ID NO: 1152170 - protein, 9 aa, Homo Sapiens
IDGADLTIS

SEQ ID NO: 1152171 - protein, 9 aa, Homo Sapiens
LLRRPPGGG

SEQ ID NO: 1152172 - protein, 9 aa, Homo Sapiens
RRRFPARAP

SEQ ID NO: 1152173 - protein, 9 aa, Homo Sapiens
TCRAPSQTL

SEQ ID NO: 1152174 - protein, 9 aa, Homo Sapiens
VFHLLFMNL

SEQ ID NO: 1152175 - protein, 9 aa, Homo Sapiens
LQWRDPTQT

SEQ ID NO: 1152176 - protein, 9 aa, Homo Sapiens
AGRRSTRPA

SEQ ID NO: 1152177 - protein, 9 aa, Homo Sapiens
PRAARPPRL

SEQ ID NO: 1152178 - protein, 9 aa, Homo Sapiens
SSPPWQATR

SEQ ID NO: 1152179 - protein, 9 aa, Homo Sapiens
AASTTYPEQ

SEQ ID NO: 1152180 - protein, 9 aa, Homo Sapiens
GNVQEQHVG

SEQ ID NO: 1152181 - protein, 9 aa, Homo Sapiens
PHHAHQLHA

SEQ ID NO: 1152182 - protein, 9 aa, Homo Sapiens
EAKKGRCYQ

SEQ ID NO: 1152183 - protein, 9 aa, Homo Sapiens
DGLSEDQVL

SEQ ID NO: 1152184 - protein, 9 aa, Homo Sapiens
DVDGHVQQR

SEQ ID NO: 1152185 - protein, 9 aa, Homo Sapiens
LASAARRCH

SEQ ID NO: 1152186 - protein, 9 aa, Homo Sapiens
WRTRCWACC

SEQ ID NO: 1152187 - protein, 9 aa, Homo Sapiens
RVIDPKRPW

SEQ ID NO: 1152188 - protein, 9 aa, Homo Sapiens
GIYPPMNFA

SEQ ID NO: 1152189 - protein, 9 aa, Homo Sapiens
SSKESSWIS

SEQ ID NO: 1152190 - protein, 9 aa, Homo Sapiens
WSHVAAYVT

SEQ ID NO: 1152191 - protein, 9 aa, Homo Sapiens
WPSPGAHLP

SEQ ID NO: 1152192 - protein, 9 aa, Homo Sapiens
EGADPGERV

SEQ ID NO: 1152193 - protein, 9 aa, Homo Sapiens
EAHASFYYP

SEQ ID NO: 1152194 - protein, 9 aa, Homo Sapiens
RKVGGASGR

SEQ ID NO: 1152195 - protein, 9 aa, Homo Sapiens
KHSEGCSRS

SEQ ID NO: 1152196 - protein, 9 aa, Homo Sapiens
RQELLWPPL

SEQ ID NO: 1152197 - protein, 9 aa, Homo Sapiens
GGPERPCAR

SEQ ID NO: 1152198 - protein, 9 aa, Homo Sapiens
TWAIVNLCR

SEQ ID NO: 1152199 - protein, 9 aa, Homo Sapiens
WNGDRSTYR

SEQ ID NO: 1152200 - protein, 9 aa, Homo Sapiens
DFFILALDC

SEQ ID NO: 1152201 - protein, 9 aa, Homo Sapiens
GARHHTREI

SEQ ID NO: 1152202 - protein, 9 aa, Homo Sapiens
YGSHVCLPG

SEQ ID NO: 1152203 - protein, 9 aa, Homo Sapiens
PSQVWTAAT

SEQ ID NO: 1152204 - protein, 9 aa, Homo Sapiens
SIWSTCCSM

SEQ ID NO: 1152205 - protein, 9 aa, Homo Sapiens
VWTAATLRC

SEQ ID NO: 1152206 - protein, 9 aa, Homo Sapiens
SCHPLPQLL

SEQ ID NO: 1152207 - protein, 9 aa, Homo Sapiens
TYSTPLWQT

SEQ ID NO: 1152208 - protein, 9 aa, Homo Sapiens
TPELNQKGY

SEQ ID NO: 1152209 - protein, 9 aa, Homo Sapiens
ELQCRQYKC

SEQ ID NO: 1152210 - protein, 9 aa, Homo Sapiens
METRSEPSE

SEQ ID NO: 1152211 - protein, 9 aa, Homo Sapiens
SGKFALKSP

SEQ ID NO: 1152212 - protein, 9 aa, Homo Sapiens
SCQGAMLLS

SEQ ID NO: 1152213 - protein, 9 aa, Homo Sapiens
PGWAALQRL

SEQ ID NO: 1152214 - protein, 9 aa, Homo Sapiens
CSRSSPPWQ

SEQ ID NO: 1152215 - protein, 9 aa, Homo Sapiens
YVKLSTAQS

SEQ ID NO: 1152216 - protein, 9 aa, Homo Sapiens
CDKVMTKTL

SEQ ID NO: 1152217 - protein, 9 aa, Homo Sapiens
HSFSDQPKV

SEQ ID NO: 1152218 - protein, 9 aa, Homo Sapiens
RYGGRCVNT

SEQ ID NO: 1152219 - protein, 9 aa, Homo Sapiens
TPMHFFLSQ

SEQ ID NO: 1152220 - protein, 9 aa, Homo Sapiens
AQLLGADAA

SEQ ID NO: 1152221 - protein, 9 aa, Homo Sapiens
WMIVIIKDI

SEQ ID NO: 1152222 - protein, 9 aa, Homo Sapiens
SIFRLYSRA

SEQ ID NO: 1152223 - protein, 9 aa, Homo Sapiens
YNELCVAPE

SEQ ID NO: 1152224 - protein, 9 aa, Homo Sapiens
DKNIWPSKG

SEQ ID NO: 1152225 - protein, 9 aa, Homo Sapiens
HPHPRLCSY

SEQ ID NO: 1152226 - protein, 9 aa, Homo Sapiens
SAFPSRSLS

SEQ ID NO: 1152227 - protein, 9 aa, Homo Sapiens
VVGTYLLLH

SEQ ID NO: 1152228 - protein, 9 aa, Homo Sapiens
ELVVGGASN

SEQ ID NO: 1152229 - protein, 9 aa, Homo Sapiens
VYNYYTKAI

SEQ ID NO: 1152230 - protein, 9 aa, Homo Sapiens
NSSPRTKYI

SEQ ID NO: 1152231 - protein, 9 aa, Homo Sapiens
MAGLGGAAG

SEQ ID NO: 1152232 - protein, 9 aa, Homo Sapiens
PAERAVLGR

SEQ ID NO: 1152233 - protein, 9 aa, Homo Sapiens
SEQFKIPEG

SEQ ID NO: 1152234 - protein, 9 aa, Homo Sapiens
PLKKYLLLD

SEQ ID NO: 1152235 - protein, 9 aa, Homo Sapiens
NILGKITRH

SEQ ID NO: 1152236 - protein, 9 aa, Homo Sapiens
LRLGISLQL

SEQ ID NO: 1152237 - protein, 9 aa, Homo Sapiens
TRRPLPRSA

SEQ ID NO: 1152238 - protein, 9 aa, Homo Sapiens
QRECSSLCP

SEQ ID NO: 1152239 - protein, 9 aa, Homo Sapiens
IGAFHTEQI

SEQ ID NO: 1152240 - protein, 9 aa, Homo Sapiens
KLPITSSLW

SEQ ID NO: 1152241 - protein, 9 aa, Homo Sapiens
VTKPGPPVL

SEQ ID NO: 1152242 - protein, 9 aa, Homo Sapiens
ERWPAHLLE

SEQ ID NO: 1152243 - protein, 9 aa, Homo Sapiens
TTPLTPVTQ

SEQ ID NO: 1152244 - protein, 9 aa, Homo Sapiens
LFSSKNPEK

SEQ ID NO: 1152245 - protein, 9 aa, Homo Sapiens
NARQLTRMY

SEQ ID NO: 1152246 - protein, 9 aa, Homo Sapiens
VKAHNGAGW

SEQ ID NO: 1152247 - protein, 9 aa, Homo Sapiens
SPLEEKGPL

SEQ ID NO: 1152248 - protein, 9 aa, Homo Sapiens
SKGVKFFDE

SEQ ID NO: 1152249 - protein, 9 aa, Homo Sapiens
ASSCSSSAT

SEQ ID NO: 1152250 - protein, 9 aa, Homo Sapiens
YIRDHFDKN

SEQ ID NO: 1152251 - protein, 9 aa, Homo Sapiens
VQGALRSNY

SEQ ID NO: 1152252 - protein, 9 aa, Homo Sapiens
SCPDSHKGR

SEQ ID NO: 1152253 - protein, 9 aa, Homo Sapiens
IFMCLRLCP

SEQ ID NO: 1152254 - protein, 9 aa, Homo Sapiens
NEEVVRFYA

SEQ ID NO: 1152255 - protein, 9 aa, Homo Sapiens
GFTQDRGLQ

SEQ ID NO: 1152256 - protein, 9 aa, Homo Sapiens
VCAHAHSNP

SEQ ID NO: 1152257 - protein, 9 aa, Homo Sapiens
AARRAARCT

SEQ ID NO: 1152258 - protein, 9 aa, Homo Sapiens
SRPEGARCL

SEQ ID NO: 1152259 - protein, 9 aa, Homo Sapiens
LSGKFALKS

SEQ ID NO: 1152260 - protein, 9 aa, Homo Sapiens
RYGVDDVQF

SEQ ID NO: 1152261 - protein, 9 aa, Homo Sapiens
TVSSGPFLQ

SEQ ID NO: 1152262 - protein, 9 aa, Homo Sapiens
PRELPIIQD

SEQ ID NO: 1152263 - protein, 9 aa, Homo Sapiens
HYICPRLGA

SEQ ID NO: 1152264 - protein, 9 aa, Homo Sapiens
PPMLHNLAL

SEQ ID NO: 1152265 - protein, 9 aa, Homo Sapiens
VFGVMQLLC

SEQ ID NO: 1152266 - protein, 9 aa, Homo Sapiens
PWQSLETKL

SEQ ID NO: 1152267 - protein, 9 aa, Homo Sapiens
AALEKNFMK

SEQ ID NO: 1152268 - protein, 9 aa, Homo Sapiens
YKRETRCSF

SEQ ID NO: 1152269 - protein, 9 aa, Homo Sapiens
APLQSAFGD

SEQ ID NO: 1152270 - protein, 9 aa, Homo Sapiens
GIAGPGHKI

SEQ ID NO: 1152271 - protein, 9 aa, Homo Sapiens
VPTSQRGVS

SEQ ID NO: 1152272 - protein, 9 aa, Homo Sapiens
AAQTGQLGP

SEQ ID NO: 1152273 - protein, 9 aa, Homo Sapiens
LLWPPLPGG

SEQ ID NO: 1152274 - protein, 9 aa, Homo Sapiens
RPRRTARLQ

SEQ ID NO: 1152275 - protein, 9 aa, Homo Sapiens
VGAGDVGKS

SEQ ID NO: 1152276 - protein, 9 aa, Homo Sapiens
LCAGPVFTP

SEQ ID NO: 1152277 - protein, 9 aa, Homo Sapiens
PSGHPAALW

SEQ ID NO: 1152278 - protein, 9 aa, Homo Sapiens
GHLKPSGEQ

SEQ ID NO: 1152279 - protein, 9 aa, Homo Sapiens
VEGCLELIF

SEQ ID NO: 1152280 - protein, 9 aa, Homo Sapiens
GGATAARRA

SEQ ID NO: 1152281 - protein, 9 aa, Homo Sapiens
LLSTLSQPP

SEQ ID NO: 1152282 - protein, 9 aa, Homo Sapiens
ACHHCFTTT

SEQ ID NO: 1152283 - protein, 9 aa, Homo Sapiens
FTENVYVLA

SEQ ID NO: 1152284 - protein, 9 aa, Homo Sapiens
QLVGGQVGH

SEQ ID NO: 1152285 - protein, 9 aa, Homo Sapiens
PFFFPFDTW

SEQ ID NO: 1152286 - protein, 9 aa, Homo Sapiens
TALAITVSY

SEQ ID NO: 1152287 - protein, 9 aa, Homo Sapiens
SSHLPTLAS

SEQ ID NO: 1152288 - protein, 9 aa, Homo Sapiens
EFNLLGEDW

SEQ ID NO: 1152289 - protein, 9 aa, Homo Sapiens
PRSSTWPQN

SEQ ID NO: 1152290 - protein, 9 aa, Homo Sapiens
HTLSRAQTV

SEQ ID NO: 1152291 - protein, 9 aa, Homo Sapiens
AGSPTLGRV

SEQ ID NO: 1152292 - protein, 9 aa, Homo Sapiens
FRQQNELKN

SEQ ID NO: 1152293 - protein, 9 aa, Homo Sapiens
GVLAQHPHH

SEQ ID NO: 1152294 - protein, 9 aa, Homo Sapiens
MGVFPICWC

SEQ ID NO: 1152295 - protein, 9 aa, Homo Sapiens
SPEVQDVRP

SEQ ID NO: 1152296 - protein, 9 aa, Homo Sapiens
TSSQEKMAA

SEQ ID NO: 1152297 - protein, 9 aa, Homo Sapiens
EMGPQGPPE

SEQ ID NO: 1152298 - protein, 9 aa, Homo Sapiens
GFGPNQVIS

SEQ ID NO: 1152299 - protein, 9 aa, Homo Sapiens
MPPMPPFYY

SEQ ID NO: 1152300 - protein, 9 aa, Homo Sapiens
CAPGTARTC

SEQ ID NO: 1152301 - protein, 9 aa, Homo Sapiens
SSSEIGSGE

SEQ ID NO: 1152302 - protein, 9 aa, Homo Sapiens
SDLHLTSET

SEQ ID NO: 1152303 - protein, 9 aa, Homo Sapiens
TSTNKELYR

SEQ ID NO: 1152304 - protein, 9 aa, Homo Sapiens
LIGAPITTS

SEQ ID NO: 1152305 - protein, 9 aa, Homo Sapiens
TAVHEGNRL

SEQ ID NO: 1152306 - protein, 9 aa, Homo Sapiens
PSNEDTEEF

SEQ ID NO: 1152307 - protein, 9 aa, Homo Sapiens
PFQYQALGL

SEQ ID NO: 1152308 - protein, 9 aa, Homo Sapiens
IIIPLERRS

SEQ ID NO: 1152309 - protein, 9 aa, Homo Sapiens
PTVSFTNEV

SEQ ID NO: 1152310 - protein, 9 aa, Homo Sapiens
HRERSAQPA

SEQ ID NO: 1152311 - protein, 9 aa, Homo Sapiens
PRPRRAWKH

SEQ ID NO: 1152312 - protein, 9 aa, Homo Sapiens
KLQRNSQFG

SEQ ID NO: 1152313 - protein, 9 aa, Homo Sapiens
SVSTCLMRP

SEQ ID NO: 1152314 - protein, 9 aa, Homo Sapiens
SMPACARGP

SEQ ID NO: 1152315 - protein, 9 aa, Homo Sapiens
NKIVIPDEE

SEQ ID NO: 1152316 - protein, 9 aa, Homo Sapiens
IVIPDEESV

SEQ ID NO: 1152317 - protein, 9 aa, Homo Sapiens
SSHRPVRPG

SEQ ID NO: 1152318 - protein, 9 aa, Homo Sapiens
PGEKKSQAS

SEQ ID NO: 1152319 - protein, 9 aa, Homo Sapiens
ALGLVVLPQ

SEQ ID NO: 1152320 - protein, 9 aa, Homo Sapiens
FLHHPDLYL

SEQ ID NO: 1152321 - protein, 9 aa, Homo Sapiens
ESSYSKSGP

SEQ ID NO: 1152322 - protein, 9 aa, Homo Sapiens
RRRPAAVSV

SEQ ID NO: 1152323 - protein, 9 aa, Homo Sapiens
IPTIDTSCK

SEQ ID NO: 1152324 - protein, 9 aa, Homo Sapiens
LTRMYPLGL

SEQ ID NO: 1152325 - protein, 9 aa, Homo Sapiens
RIQSKHHPL

SEQ ID NO: 1152326 - protein, 9 aa, Homo Sapiens
ANEDVAQIV

SEQ ID NO: 1152327 - protein, 9 aa, Homo Sapiens
TPNRIFFGD

SEQ ID NO: 1152328 - protein, 9 aa, Homo Sapiens
PCDRSWLPC

SEQ ID NO: 1152329 - protein, 9 aa, Homo Sapiens
CQGAMLLSI

SEQ ID NO: 1152330 - protein, 9 aa, Homo Sapiens
HSPLLRPRG

SEQ ID NO: 1152331 - protein, 9 aa, Homo Sapiens
CEQLLLLVL

SEQ ID NO: 1152332 - protein, 9 aa, Homo Sapiens
KDPEGCDKV

SEQ ID NO: 1152333 - protein, 9 aa, Homo Sapiens
LLLETGVYN

SEQ ID NO: 1152334 - protein, 9 aa, Homo Sapiens
QDNLQPFMP

SEQ ID NO: 1152335 - protein, 9 aa, Homo Sapiens
VDTVHMQPI

SEQ ID NO: 1152336 - protein, 9 aa, Homo Sapiens
YSSPYTHAC

SEQ ID NO: 1152337 - protein, 9 aa, Homo Sapiens
LECFDVMTD

SEQ ID NO: 1152338 - protein, 9 aa, Homo Sapiens
AQNSELSTD

SEQ ID NO: 1152339 - protein, 9 aa, Homo Sapiens
SCGTDFYMA

SEQ ID NO: 1152340 - protein, 9 aa, Homo Sapiens
AKVSECEKD

SEQ ID NO: 1152341 - protein, 9 aa, Homo Sapiens
SWSVVNWSA

SEQ ID NO: 1152342 - protein, 9 aa, Homo Sapiens
TTVVFHLLF

SEQ ID NO: 1152343 - protein, 9 aa, Homo Sapiens
RATRTGCRW

SEQ ID NO: 1152344 - protein, 9 aa, Homo Sapiens
GRWGTGVED

SEQ ID NO: 1152345 - protein, 9 aa, Homo Sapiens
PNLSCKYPR

SEQ ID NO: 1152346 - protein, 9 aa, Homo Sapiens
YCGVAPLQS

SEQ ID NO: 1152347 - protein, 9 aa, Homo Sapiens
DKVIELNKH

SEQ ID NO: 1152348 - protein, 9 aa, Homo Sapiens
VYVSRVVCT

SEQ ID NO: 1152349 - protein, 9 aa, Homo Sapiens
TCQSVHIIL

SEQ ID NO: 1152350 - protein, 9 aa, Homo Sapiens
THTHTHART

SEQ ID NO: 1152351 - protein, 9 aa, Homo Sapiens
GDNPTPQLV

SEQ ID NO: 1152352 - protein, 9 aa, Homo Sapiens
LLQVEQHMP

SEQ ID NO: 1152353 - protein, 9 aa, Homo Sapiens
KRMNFLHHP

SEQ ID NO: 1152354 - protein, 9 aa, Homo Sapiens
LGSRSRPHS

SEQ ID NO: 1152355 - protein, 9 aa, Homo Sapiens
VLHGAPWKG

SEQ ID NO: 1152356 - protein, 9 aa, Homo Sapiens
ARLAPRPAG

SEQ ID NO: 1152357 - protein, 9 aa, Homo Sapiens
DAAVVVLVS

SEQ ID NO: 1152358 - protein, 9 aa, Homo Sapiens
CNVADTNLE

SEQ ID NO: 1152359 - protein, 9 aa, Homo Sapiens
DASPAADNS

SEQ ID NO: 1152360 - protein, 9 aa, Homo Sapiens
AGAAATPLE

SEQ ID NO: 1152361 - protein, 9 aa, Homo Sapiens
LAWDPPRSC

SEQ ID NO: 1152362 - protein, 9 aa, Homo Sapiens
TSCNGYFVF

SEQ ID NO: 1152363 - protein, 9 aa, Homo Sapiens
GPAPQGPVM

SEQ ID NO: 1152364 - protein, 9 aa, Homo Sapiens
DPKMLWGND

SEQ ID NO: 1152365 - protein, 9 aa, Homo Sapiens
SAARRCHQR

SEQ ID NO: 1152366 - protein, 9 aa, Homo Sapiens
SFYVIDISP

SEQ ID NO: 1152367 - protein, 9 aa, Homo Sapiens
VGHGVWVGA

SEQ ID NO: 1152368 - protein, 9 aa, Homo Sapiens
QTWPACARS

SEQ ID NO: 1152369 - protein, 9 aa, Homo Sapiens
HPWFLGQYL

SEQ ID NO: 1152370 - protein, 9 aa, Homo Sapiens
KTTLILVYL

SEQ ID NO: 1152371 - protein, 9 aa, Homo Sapiens
NFDMAVATR

SEQ ID NO: 1152372 - protein, 9 aa, Homo Sapiens
MLWGNDSSV

SEQ ID NO: 1152373 - protein, 9 aa, Homo Sapiens
TRFIRQHKD

SEQ ID NO: 1152374 - protein, 9 aa, Homo Sapiens
VRVSPEVQD

SEQ ID NO: 1152375 - protein, 9 aa, Homo Sapiens
KQPVSIWPN

SEQ ID NO: 1152376 - protein, 9 aa, Homo Sapiens
IDTIIFGGR

SEQ ID NO: 1152377 - protein, 9 aa, Homo Sapiens
IPPMLHNLA

SEQ ID NO: 1152378 - protein, 9 aa, Homo Sapiens
VPPLASSAS

SEQ ID NO: 1152379 - protein, 9 aa, Homo Sapiens
QSLLGGMIE

SEQ ID NO: 1152380 - protein, 9 aa, Homo Sapiens
LDALKKPLR

SEQ ID NO: 1152381 - protein, 9 aa, Homo Sapiens
AGSSTQAHA

SEQ ID NO: 1152382 - protein, 9 aa, Homo Sapiens
QPRMACSPT

SEQ ID NO: 1152383 - protein, 9 aa, Homo Sapiens
STLALITSN

SEQ ID NO: 1152384 - protein, 9 aa, Homo Sapiens
LNPASLLPV

SEQ ID NO: 1152385 - protein, 9 aa, Homo Sapiens
FHTEQINEI

SEQ ID NO: 1152386 - protein, 9 aa, Homo Sapiens
SLETKLRDS

SEQ ID NO: 1152387 - protein, 9 aa, Homo Sapiens
ILSFLQEHW

SEQ ID NO: 1152388 - protein, 9 aa, Homo Sapiens
LKKTSRILN

SEQ ID NO: 1152389 - protein, 9 aa, Homo Sapiens
EYCWHINFT

SEQ ID NO: 1152390 - protein, 9 aa, Homo Sapiens
HCRGGKGHI

SEQ ID NO: 1152391 - protein, 9 aa, Homo Sapiens
LFDLSRHFD

SEQ ID NO: 1152392 - protein, 9 aa, Homo Sapiens
GGKSGKAPH

SEQ ID NO: 1152393 - protein, 9 aa, Homo Sapiens
TAHEVGKVI

SEQ ID NO: 1152394 - protein, 9 aa, Homo Sapiens
PTTPLTPVT

SEQ ID NO: 1152395 - protein, 9 aa, Homo Sapiens
PPKMQKPKL

SEQ ID NO: 1152396 - protein, 9 aa, Homo Sapiens
QHEIWWGQM

SEQ ID NO: 1152397 - protein, 9 aa, Homo Sapiens
WWMQGLPRN

SEQ ID NO: 1152398 - protein, 9 aa, Homo Sapiens
RLGLFYQML

SEQ ID NO: 1152399 - protein, 9 aa, Homo Sapiens
ARWDLRRPQ

SEQ ID NO: 1152400 - protein, 9 aa, Homo Sapiens
EKCRYKSKV

SEQ ID NO: 1152401 - protein, 9 aa, Homo Sapiens
TVGPELNEL

SEQ ID NO: 1152402 - protein, 9 aa, Homo Sapiens
RSPVPKKRE

SEQ ID NO: 1152403 - protein, 9 aa, Homo Sapiens
LERWPAHLL

SEQ ID NO: 1152404 - protein, 9 aa, Homo Sapiens
RIFFGDIHF

SEQ ID NO: 1152405 - protein, 9 aa, Homo Sapiens
EAEWIRSVA

SEQ ID NO: 1152406 - protein, 9 aa, Homo Sapiens
LPRRRRRFP

SEQ ID NO: 1152407 - protein, 9 aa, Homo Sapiens
VFGNFNLLH

SEQ ID NO: 1152408 - protein, 9 aa, Homo Sapiens
VNMSKVETG

SEQ ID NO: 1152409 - protein, 9 aa, Homo Sapiens
LSLAGVARR

SEQ ID NO: 1152410 - protein, 9 aa, Homo Sapiens
ITPKKAEHL

SEQ ID NO: 1152411 - protein, 9 aa, Homo Sapiens
PGEPGAKSG

SEQ ID NO: 1152412 - protein, 9 aa, Homo Sapiens
CSSSMAPKM

SEQ ID NO: 1152413 - protein, 9 aa, Homo Sapiens
KSIAAALKR

SEQ ID NO: 1152414 - protein, 9 aa, Homo Sapiens
EPHHAHQLH

SEQ ID NO: 1152415 - protein, 9 aa, Homo Sapiens
SGQGAAARP

SEQ ID NO: 1152416 - protein, 9 aa, Homo Sapiens
WKSTMAQLT

SEQ ID NO: 1152417 - protein, 9 aa, Homo Sapiens
ARSALPQGR

SEQ ID NO: 1152418 - protein, 9 aa, Homo Sapiens
GSPGPSGSF

SEQ ID NO: 1152419 - protein, 9 aa, Homo Sapiens
LPSQQRKRQ

SEQ ID NO: 1152420 - protein, 9 aa, Homo Sapiens
EAKEKLSIS

SEQ ID NO: 1152421 - protein, 9 aa, Homo Sapiens
SAAGDGSSW

SEQ ID NO: 1152422 - protein, 9 aa, Homo Sapiens
VISDCTEII

SEQ ID NO: 1152423 - protein, 9 aa, Homo Sapiens
IIVVNQEIL

SEQ ID NO: 1152424 - protein, 9 aa, Homo Sapiens
DQVPCQQTM

SEQ ID NO: 1152425 - protein, 9 aa, Homo Sapiens
VLEARAPHV

SEQ ID NO: 1152426 - protein, 9 aa, Homo Sapiens
EKALSALFI

SEQ ID NO: 1152427 - protein, 9 aa, Homo Sapiens
PELNELDSK

SEQ ID NO: 1152428 - protein, 9 aa, Homo Sapiens
WPRGRPRWP

SEQ ID NO: 1152429 - protein, 9 aa, Homo Sapiens
LTMMAYDRF

SEQ ID NO: 1152430 - protein, 9 aa, Homo Sapiens
LLTMMAYDR

SEQ ID NO: 1152431 - protein, 9 aa, Homo Sapiens
KHHPLDERA

SEQ ID NO: 1152432 - protein, 9 aa, Homo Sapiens
RARRARWDL

SEQ ID NO: 1152433 - protein, 9 aa, Homo Sapiens
HEDVEGCLE

SEQ ID NO: 1152434 - protein, 9 aa, Homo Sapiens
ADVCGSLFE

SEQ ID NO: 1152435 - protein, 9 aa, Homo Sapiens
LLLQVEQHM

SEQ ID NO: 1152436 - protein, 9 aa, Homo Sapiens
RTSLHQATR

SEQ ID NO: 1152437 - protein, 9 aa, Homo Sapiens
GNPNEEVVR

SEQ ID NO: 1152438 - protein, 9 aa, Homo Sapiens
RRHTLFHCI

SEQ ID NO: 1152439 - protein, 9 aa, Homo Sapiens
SRILNLQVL

SEQ ID NO: 1152440 - protein, 9 aa, Homo Sapiens
QSAGPPAHA

SEQ ID NO: 1152441 - protein, 9 aa, Homo Sapiens
QADGNGDPG

SEQ ID NO: 1152442 - protein, 9 aa, Homo Sapiens
YYLLNPASL

SEQ ID NO: 1152443 - protein, 9 aa, Homo Sapiens
IEECMSMVW

SEQ ID NO: 1152444 - protein, 9 aa, Homo Sapiens
RPPGNSATT

SEQ ID NO: 1152445 - protein, 9 aa, Homo Sapiens
LRPRLSDRP

SEQ ID NO: 1152446 - protein, 9 aa, Homo Sapiens
KDHVTLQVP

SEQ ID NO: 1152447 - protein, 9 aa, Homo Sapiens
FFFMCCTSY

SEQ ID NO: 1152448 - protein, 9 aa, Homo Sapiens
HYKVSTRSS

SEQ ID NO: 1152449 - protein, 9 aa, Homo Sapiens
PDPLTHLSM

SEQ ID NO: 1152450 - protein, 9 aa, Homo Sapiens
PGVSKDGML

SEQ ID NO: 1152451 - protein, 9 aa, Homo Sapiens
FLTQNMENQ

SEQ ID NO: 1152452 - protein, 9 aa, Homo Sapiens
ITWAGAGPG

SEQ ID NO: 1152453 - protein, 9 aa, Homo Sapiens
ITDTLCAGP

SEQ ID NO: 1152454 - protein, 9 aa, Homo Sapiens
YILVRYALN

SEQ ID NO: 1152455 - protein, 9 aa, Homo Sapiens
ASTTYPEQM

SEQ ID NO: 1152456 - protein, 9 aa, Homo Sapiens
VITPYTLTP

SEQ ID NO: 1152457 - protein, 9 aa, Homo Sapiens
CRQYKCKML

SEQ ID NO: 1152458 - protein, 9 aa, Homo Sapiens
WVKKGERQN

SEQ ID NO: 1152459 - protein, 9 aa, Homo Sapiens
YGEIADPFK

SEQ ID NO: 1152460 - protein, 9 aa, Homo Sapiens
RTCLWAPGW

SEQ ID NO: 1152461 - protein, 9 aa, Homo Sapiens
SAEIPTGSE

SEQ ID NO: 1152462 - protein, 9 aa, Homo Sapiens
HELLELEKI

SEQ ID NO: 1152463 - protein, 9 aa, Homo Sapiens
KSSSEIGSG

SEQ ID NO: 1152464 - protein, 9 aa, Homo Sapiens
KILRSFMKL

SEQ ID NO: 1152465 - protein, 9 aa, Homo Sapiens
ASAPTSGLQ

SEQ ID NO: 1152466 - protein, 9 aa, Homo Sapiens
LLAWDPPRS

SEQ ID NO: 1152467 - protein, 9 aa, Homo Sapiens
CVGKDGECD

SEQ ID NO: 1152468 - protein, 9 aa, Homo Sapiens
QFFRGGDNP

SEQ ID NO: 1152469 - protein, 9 aa, Homo Sapiens
PLEEEYEHM

SEQ ID NO: 1152470 - protein, 9 aa, Homo Sapiens
CHASGDSLE

SEQ ID NO: 1152471 - protein, 9 aa, Homo Sapiens
PQGSQRERG

SEQ ID NO: 1152472 - protein, 9 aa, Homo Sapiens
ARRCHQRRV

SEQ ID NO: 1152473 - protein, 9 aa, Homo Sapiens
EIADPFKLA

SEQ ID NO: 1152474 - protein, 9 aa, Homo Sapiens
GVFPICWCP

SEQ ID NO: 1152475 - protein, 9 aa, Homo Sapiens
MSKVETGLH

SEQ ID NO: 1152476 - protein, 9 aa, Homo Sapiens
AAATCSRPT

SEQ ID NO: 1152477 - protein, 9 aa, Homo Sapiens
KGRCYQLPQ

SEQ ID NO: 1152478 - protein, 9 aa, Homo Sapiens
FSTTTLSWG

SEQ ID NO: 1152479 - protein, 9 aa, Homo Sapiens
VLKKILRSF

SEQ ID NO: 1152480 - protein, 9 aa, Homo Sapiens
RGQNIRNRA

SEQ ID NO: 1152481 - protein, 9 aa, Homo Sapiens
GVAPLQSAF

SEQ ID NO: 1152482 - protein, 9 aa, Homo Sapiens
LENGEPREL

SEQ ID NO: 1152483 - protein, 9 aa, Homo Sapiens
KSDDLEVPV

SEQ ID NO: 1152484 - protein, 9 aa, Homo Sapiens
RRPATLASA

SEQ ID NO: 1152485 - protein, 9 aa, Homo Sapiens
KADMLGDDG

SEQ ID NO: 1152486 - protein, 9 aa, Homo Sapiens
VILGLIADS

SEQ ID NO: 1152487 - protein, 9 aa, Homo Sapiens
GEANEDVAQ

SEQ ID NO: 1152488 - protein, 9 aa, Homo Sapiens
HFDLRFVVI

SEQ ID NO: 1152489 - protein, 9 aa, Homo Sapiens
AQLSQIKQT

SEQ ID NO: 1152490 - protein, 9 aa, Homo Sapiens
GLACSLQHY

SEQ ID NO: 1152491 - protein, 9 aa, Homo Sapiens
TMMAYDRFV

SEQ ID NO: 1152492 - protein, 9 aa, Homo Sapiens
ASLLTRMKE

SEQ ID NO: 1152493 - protein, 9 aa, Homo Sapiens
PSNAASLGT

SEQ ID NO: 1152494 - protein, 9 aa, Homo Sapiens
QPSLPGPCA

SEQ ID NO: 1152495 - protein, 9 aa, Homo Sapiens
KSTTLIPSH

SEQ ID NO: 1152496 - protein, 9 aa, Homo Sapiens
KKRRSKIEA

SEQ ID NO: 1152497 - protein, 9 aa, Homo Sapiens
KHSFSDQPK

SEQ ID NO: 1152498 - protein, 9 aa, Homo Sapiens
RARGGTTIG

SEQ ID NO: 1152499 - protein, 9 aa, Homo Sapiens
GGSRSGSGQ

SEQ ID NO: 1152500 - protein, 9 aa, Homo Sapiens
LETWDPTYL

SEQ ID NO: 1152501 - protein, 9 aa, Homo Sapiens
EYLECFDVM

SEQ ID NO: 1152502 - protein, 9 aa, Homo Sapiens
PAAKQVSPA

SEQ ID NO: 1152503 - protein, 9 aa, Homo Sapiens
TSWNHKTMN

SEQ ID NO: 1152504 - protein, 9 aa, Homo Sapiens
FVPPLASSA

SEQ ID NO: 1152505 - protein, 9 aa, Homo Sapiens
SLRTQNNFL

SEQ ID NO: 1152506 - protein, 9 aa, Homo Sapiens
AGPAPQGPV

SEQ ID NO: 1152507 - protein, 9 aa, Homo Sapiens
QDYQEMFMQ

SEQ ID NO: 1152508 - protein, 9 aa, Homo Sapiens
PLTPWFLMP

SEQ ID NO: 1152509 - protein, 9 aa, Homo Sapiens
KTFSESSKL

SEQ ID NO: 1152510 - protein, 9 aa, Homo Sapiens
HPSSMSLAT

SEQ ID NO: 1152511 - protein, 9 aa, Homo Sapiens
LTPWFLMPI

SEQ ID NO: 1152512 - protein, 9 aa, Homo Sapiens
NQLRMPPMP

SEQ ID NO: 1152513 - protein, 9 aa, Homo Sapiens
LKKKEVRCS

SEQ ID NO: 1152514 - protein, 9 aa, Homo Sapiens
TPHTLLPHE

SEQ ID NO: 1152515 - protein, 9 aa, Homo Sapiens
PLAWKSTMA

SEQ ID NO: 1152516 - protein, 9 aa, Homo Sapiens
SGSGSHASI

SEQ ID NO: 1152517 - protein, 9 aa, Homo Sapiens
IIFMCLRLC

SEQ ID NO: 1152518 - protein, 9 aa, Homo Sapiens
RGPRAPVRA

SEQ ID NO: 1152519 - protein, 9 aa, Homo Sapiens
VAMARTGNG

SEQ ID NO: 1152520 - protein, 9 aa, Homo Sapiens
QQSRLPLQW

SEQ ID NO: 1152521 - protein, 9 aa, Homo Sapiens
HKQFLVRVR

SEQ ID NO: 1152522 - protein, 9 aa, Homo Sapiens
CESKSKLIS

SEQ ID NO: 1152523 - protein, 9 aa, Homo Sapiens
AFSRVSVIQ

SEQ ID NO: 1152524 - protein, 9 aa, Homo Sapiens
PVLLAGERV

SEQ ID NO: 1152525 - protein, 9 aa, Homo Sapiens
SRLAQSKET

SEQ ID NO: 1152526 - protein, 9 aa, Homo Sapiens
PHPSSMSLA

SEQ ID NO: 1152527 - protein, 9 aa, Homo Sapiens
VDYIDAQSE

SEQ ID NO: 1152528 - protein, 9 aa, Homo Sapiens
GKGHIGVVI

SEQ ID NO: 1152529 - protein, 9 aa, Homo Sapiens
WGRAWQYLS

SEQ ID NO: 1152530 - protein, 9 aa, Homo Sapiens
LGPHPSPSW

SEQ ID NO: 1152531 - protein, 9 aa, Homo Sapiens
LPGQVHRGR

SEQ ID NO: 1152532 - protein, 9 aa, Homo Sapiens
ASRGQNIRN

SEQ ID NO: 1152533 - protein, 9 aa, Homo Sapiens
ESSWISDGK

SEQ ID NO: 1152534 - protein, 9 aa, Homo Sapiens
SPIRTHRAV

SEQ ID NO: 1152535 - protein, 9 aa, Homo Sapiens
KWTYERVEE

SEQ ID NO: 1152536 - protein, 9 aa, Homo Sapiens
IGINHCCGE

SEQ ID NO: 1152537 - protein, 9 aa, Homo Sapiens
LLQPQPQYV

SEQ ID NO: 1152538 - protein, 9 aa, Homo Sapiens
TWQGAPVRS

SEQ ID NO: 1152539 - protein, 9 aa, Homo Sapiens
RVRYGVDDV

SEQ ID NO: 1152540 - protein, 9 aa, Homo Sapiens
PGLPLTPAP

SEQ ID NO: 1152541 - protein, 9 aa, Homo Sapiens
SSTRPKSPG

SEQ ID NO: 1152542 - protein, 9 aa, Homo Sapiens
HPLQSLHHP

SEQ ID NO: 1152543 - protein, 9 aa, Homo Sapiens
PRDANLPKT

SEQ ID NO: 1152544 - protein, 9 aa, Homo Sapiens
RGPMPGSCR

SEQ ID NO: 1152545 - protein, 9 aa, Homo Sapiens
SRSPCSGGW

SEQ ID NO: 1152546 - protein, 9 aa, Homo Sapiens
TIGKAFTAH

SEQ ID NO: 1152547 - protein, 9 aa, Homo Sapiens
KFLGSFLLA

SEQ ID NO: 1152548 - protein, 9 aa, Homo Sapiens
MCLRLCPHI

SEQ ID NO: 1152549 - protein, 9 aa, Homo Sapiens
HRVAHHAAP

SEQ ID NO: 1152550 - protein, 9 aa, Homo Sapiens
GMTPRDLGT

SEQ ID NO: 1152551 - protein, 9 aa, Homo Sapiens
GAAGTRCRA

SEQ ID NO: 1152552 - protein, 9 aa, Homo Sapiens
NSQFLLTRS

SEQ ID NO: 1152553 - protein, 9 aa, Homo Sapiens
KELSKVQNE

SEQ ID NO: 1152554 - protein, 9 aa, Homo Sapiens
AARRCHQRR

SEQ ID NO: 1152555 - protein, 9 aa, Homo Sapiens
SASQTPMAA

SEQ ID NO: 1152556 - protein, 9 aa, Homo Sapiens
TPPGSCGFT

SEQ ID NO: 1152557 - protein, 9 aa, Homo Sapiens
SAAQTGQLG

SEQ ID NO: 1152558 - protein, 9 aa, Homo Sapiens
GLYNKVSRF

SEQ ID NO: 1152559 - protein, 9 aa, Homo Sapiens
EHELLELEK

SEQ ID NO: 1152560 - protein, 9 aa, Homo Sapiens
RQVLDVVYY

SEQ ID NO: 1152561 - protein, 9 aa, Homo Sapiens
MENQEMFAD

SEQ ID NO: 1152562 - protein, 9 aa, Homo Sapiens
LPQQSRLPL

SEQ ID NO: 1152563 - protein, 9 aa, Homo Sapiens
ATRSRTLHG

SEQ ID NO: 1152564 - protein, 9 aa, Homo Sapiens
REGRERRVK

SEQ ID NO: 1152565 - protein, 9 aa, Homo Sapiens
KYSSLKGNY

SEQ ID NO: 1152566 - protein, 9 aa, Homo Sapiens
PPASTTACE

SEQ ID NO: 1152567 - protein, 9 aa, Homo Sapiens
ATPGVALGR

SEQ ID NO: 1152568 - protein, 9 aa, Homo Sapiens
STSIFRRLQ

SEQ ID NO: 1152569 - protein, 9 aa, Homo Sapiens
DTEEFPLCA

SEQ ID NO: 1152570 - protein, 9 aa, Homo Sapiens
QGRWAMVTT

SEQ ID NO: 1152571 - protein, 9 aa, Homo Sapiens
CMSMVWEKC

SEQ ID NO: 1152572 - protein, 9 aa, Homo Sapiens
VASRAATKR

SEQ ID NO: 1152573 - protein, 9 aa, Homo Sapiens
NSGSQSGTK

SEQ ID NO: 1152574 - protein, 9 aa, Homo Sapiens
PKKDVHIYE

SEQ ID NO: 1152575 - protein, 9 aa, Homo Sapiens
SHKKKIRTS

SEQ ID NO: 1152576 - protein, 9 aa, Homo Sapiens
GLLREAEWQ

SEQ ID NO: 1152577 - protein, 9 aa, Homo Sapiens
SAASGGPES

SEQ ID NO: 1152578 - protein, 9 aa, Homo Sapiens
ARDKRLCPS

SEQ ID NO: 1152579 - protein, 9 aa, Homo Sapiens
QAHKLWMIV

SEQ ID NO: 1152580 - protein, 9 aa, Homo Sapiens
DSRSFFTSA

SEQ ID NO: 1152581 - protein, 9 aa, Homo Sapiens
GGVMLFSTG

SEQ ID NO: 1152582 - protein, 9 aa, Homo Sapiens
KRLRAFQRI

SEQ ID NO: 1152583 - protein, 9 aa, Homo Sapiens
IGPLTRDAH

SEQ ID NO: 1152584 - protein, 9 aa, Homo Sapiens
RNVSSRPRK

SEQ ID NO: 1152585 - protein, 9 aa, Homo Sapiens
PENQVSVGL

SEQ ID NO: 1152586 - protein, 9 aa, Homo Sapiens
ILALDCMRR

SEQ ID NO: 1152587 - protein, 9 aa, Homo Sapiens
TILQKRMNF

SEQ ID NO: 1152588 - protein, 9 aa, Homo Sapiens
QRGLPGNWE

SEQ ID NO: 1152589 - protein, 9 aa, Homo Sapiens
VRSYPVLAP

SEQ ID NO: 1152590 - protein, 9 aa, Homo Sapiens
FEVWTATMP

SEQ ID NO: 1152591 - protein, 9 aa, Homo Sapiens
SCWYKYLLS

SEQ ID NO: 1152592 - protein, 9 aa, Homo Sapiens
PCSTPCPLL

SEQ ID NO: 1152593 - protein, 9 aa, Homo Sapiens
TRSSINRPN

SEQ ID NO: 1152594 - protein, 9 aa, Homo Sapiens
LMEGFLAFP

SEQ ID NO: 1152595 - protein, 9 aa, Homo Sapiens
VPAPSQLPA

SEQ ID NO: 1152596 - protein, 9 aa, Homo Sapiens
WQMLFYVTA

SEQ ID NO: 1152597 - protein, 9 aa, Homo Sapiens
DLTHMIHIL

SEQ ID NO: 1152598 - protein, 9 aa, Homo Sapiens
GAFHTEQIN

SEQ ID NO: 1152599 - protein, 9 aa, Homo Sapiens
SSACSAGGD

SEQ ID NO: 1152600 - protein, 9 aa, Homo Sapiens
DQSRPTCQA

SEQ ID NO: 1152601 - protein, 9 aa, Homo Sapiens
PASPPTQQP

SEQ ID NO: 1152602 - protein, 9 aa, Homo Sapiens
NATDIMDAM

SEQ ID NO: 1152603 - protein, 9 aa, Homo Sapiens
YGVDDVQFP

SEQ ID NO: 1152604 - protein, 9 aa, Homo Sapiens
VHGIYFNIT

SEQ ID NO: 1152605 - protein, 9 aa, Homo Sapiens
AWEGLWMPP

SEQ ID NO: 1152606 - protein, 9 aa, Homo Sapiens
QIGQEMVIT

SEQ ID NO: 1152607 - protein, 9 aa, Homo Sapiens
EDRAGPAPQ

SEQ ID NO: 1152608 - protein, 9 aa, Homo Sapiens
LSPGEGLAT

SEQ ID NO: 1152609 - protein, 9 aa, Homo Sapiens
TAFSAFGRA

SEQ ID NO: 1152610 - protein, 9 aa, Homo Sapiens
LSPLQRSGS

SEQ ID NO: 1152611 - protein, 9 aa, Homo Sapiens
VESSYSKSG

SEQ ID NO: 1152612 - protein, 9 aa, Homo Sapiens
GTMPPNKET

SEQ ID NO: 1152613 - protein, 9 aa, Homo Sapiens
TKYIGNTNF

SEQ ID NO: 1152614 - protein, 9 aa, Homo Sapiens
LTHLSMMPP

SEQ ID NO: 1152615 - protein, 9 aa, Homo Sapiens
RRAWKHSPL

SEQ ID NO: 1152616 - protein, 9 aa, Homo Sapiens
SLSEKTTPS

SEQ ID NO: 1152617 - protein, 9 aa, Homo Sapiens
GGSRRHPQL

SEQ ID NO: 1152618 - protein, 9 aa, Homo Sapiens
TSTLALITS

SEQ ID NO: 1152619 - protein, 9 aa, Homo Sapiens
AGTPWMEGA

SEQ ID NO: 1152620 - protein, 9 aa, Homo Sapiens
MMPSTTSPP

SEQ ID NO: 1152621 - protein, 9 aa, Homo Sapiens
LYLSHHPKP

SEQ ID NO: 1152622 - protein, 9 aa, Homo Sapiens
IAKMPVDNP

SEQ ID NO: 1152623 - protein, 9 aa, Homo Sapiens
KDDLCLSAL

SEQ ID NO: 1152624 - protein, 9 aa, Homo Sapiens
GVHSHKKKI

SEQ ID NO: 1152625 - protein, 9 aa, Homo Sapiens
FSNSVSTCL

SEQ ID NO: 1152626 - protein, 9 aa, Homo Sapiens
GAGPVSHSA

SEQ ID NO: 1152627 - protein, 9 aa, Homo Sapiens
TGQLGPRAG

SEQ ID NO: 1152628 - protein, 9 aa, Homo Sapiens
NQLFSSKNP

SEQ ID NO: 1152629 - protein, 9 aa, Homo Sapiens
CRPAPEEAH

SEQ ID NO: 1152630 - protein, 9 aa, Homo Sapiens
CPAVPAAAC

SEQ ID NO: 1152631 - protein, 9 aa, Homo Sapiens
KIFLQWRDP

SEQ ID NO: 1152632 - protein, 9 aa, Homo Sapiens
EVRQLLLRF

SEQ ID NO: 1152633 - protein, 9 aa, Homo Sapiens
KHVPGEFGS

SEQ ID NO: 1152634 - protein, 9 aa, Homo Sapiens
FAAAAAANC

SEQ ID NO: 1152635 - protein, 9 aa, Homo Sapiens
PSMPACARG

SEQ ID NO: 1152636 - protein, 9 aa, Homo Sapiens
GKDAASLLT

SEQ ID NO: 1152637 - protein, 9 aa, Homo Sapiens
HHLAQLLGA

SEQ ID NO: 1152638 - protein, 9 aa, Homo Sapiens
GSLLCTPPG

SEQ ID NO: 1152639 - protein, 9 aa, Homo Sapiens
SGQLEVTWS

SEQ ID NO: 1152640 - protein, 9 aa, Homo Sapiens
PTAPPLAPL

SEQ ID NO: 1152641 - protein, 9 aa, Homo Sapiens
QLEEQRDEQ

SEQ ID NO: 1152642 - protein, 9 aa, Homo Sapiens
GDPPIGPPF

SEQ ID NO: 1152643 - protein, 9 aa, Homo Sapiens
TDARVAEEG

SEQ ID NO: 1152644 - protein, 9 aa, Homo Sapiens
EQSHSDFRN

SEQ ID NO: 1152645 - protein, 9 aa, Homo Sapiens
SRTQSPGTD

SEQ ID NO: 1152646 - protein, 9 aa, Homo Sapiens
IQDAPDASD

SEQ ID NO: 1152647 - protein, 9 aa, Homo Sapiens
AVESCNHEV

SEQ ID NO: 1152648 - protein, 9 aa, Homo Sapiens
NTVYIILRM

SEQ ID NO: 1152649 - protein, 9 aa, Homo Sapiens
PESRTQSPG

SEQ ID NO: 1152650 - protein, 9 aa, Homo Sapiens
CPGGGEGGG

SEQ ID NO: 1152651 - protein, 9 aa, Homo Sapiens
TISPVQLYN

SEQ ID NO: 1152652 - protein, 9 aa, Homo Sapiens
NHLRKVPDV

SEQ ID NO: 1152653 - protein, 9 aa, Homo Sapiens
AARLPPSRS

SEQ ID NO: 1152654 - protein, 9 aa, Homo Sapiens
SDIIHEKMG

SEQ ID NO: 1152655 - protein, 9 aa, Homo Sapiens
RKVDVQTTR

SEQ ID NO: 1152656 - protein, 9 aa, Homo Sapiens
LDVVYYLHR

SEQ ID NO: 1152657 - protein, 9 aa, Homo Sapiens
KELQMEQDY

SEQ ID NO: 1152658 - protein, 9 aa, Homo Sapiens
TSCKKRLPS

SEQ ID NO: 1152659 - protein, 9 aa, Homo Sapiens
FQRQELLWP

SEQ ID NO: 1152660 - protein, 9 aa, Homo Sapiens
PPWQATRSR

SEQ ID NO: 1152661 - protein, 9 aa, Homo Sapiens
GPPAGSSTQ

SEQ ID NO: 1152662 - protein, 9 aa, Homo Sapiens
LGASASPAA

SEQ ID NO: 1152663 - protein, 9 aa, Homo Sapiens
KFIILRWYH

SEQ ID NO: 1152664 - protein, 9 aa, Homo Sapiens
EEVLIPPLR

SEQ ID NO: 1152665 - protein, 9 aa, Homo Sapiens
SPPHPPRPA

SEQ ID NO: 1152666 - protein, 9 aa, Homo Sapiens
IEIPGRTDY

SEQ ID NO: 1152667 - protein, 9 aa, Homo Sapiens
AATKRPDRV

SEQ ID NO: 1152668 - protein, 9 aa, Homo Sapiens
VVCTMINSN

SEQ ID NO: 1152669 - protein, 9 aa, Homo Sapiens
KLESPALKQ

SEQ ID NO: 1152670 - protein, 9 aa, Homo Sapiens
TYSLITIGE

SEQ ID NO: 1152671 - protein, 9 aa, Homo Sapiens
TLRGLLGAH

SEQ ID NO: 1152672 - protein, 9 aa, Homo Sapiens
AWDPPRSCR

SEQ ID NO: 1152673 - protein, 9 aa, Homo Sapiens
SGECRVSSI

SEQ ID NO: 1152674 - protein, 9 aa, Homo Sapiens
EASAKKLVP

SEQ ID NO: 1152675 - protein, 9 aa, Homo Sapiens
PLPRPACWA

SEQ ID NO: 1152676 - protein, 9 aa, Homo Sapiens
FKGLRYATA

SEQ ID NO: 1152677 - protein, 9 aa, Homo Sapiens
SPPLTPDVA

SEQ ID NO: 1152678 - protein, 9 aa, Homo Sapiens
WVPFAAAAA

SEQ ID NO: 1152679 - protein, 9 aa, Homo Sapiens
IQCRQRECS

SEQ ID NO: 1152680 - protein, 9 aa, Homo Sapiens
IFIGSLLRG

SEQ ID NO: 1152681 - protein, 9 aa, Homo Sapiens
ADLPNITPL

SEQ ID NO: 1152682 - protein, 9 aa, Homo Sapiens
IASREAQNF

SEQ ID NO: 1152683 - protein, 9 aa, Homo Sapiens
LPVATACCP

SEQ ID NO: 1152684 - protein, 9 aa, Homo Sapiens
KDQHSISHT

SEQ ID NO: 1152685 - protein, 9 aa, Homo Sapiens
EEGQMLTLK

SEQ ID NO: 1152686 - protein, 9 aa, Homo Sapiens
HAENLLGKN

SEQ ID NO: 1152687 - protein, 9 aa, Homo Sapiens
SRPTKTRML

SEQ ID NO: 1152688 - protein, 9 aa, Homo Sapiens
WPSKGVKFF

SEQ ID NO: 1152689 - protein, 9 aa, Homo Sapiens
TGPAAAATS

SEQ ID NO: 1152690 - protein, 9 aa, Homo Sapiens
ILGPGGAAA

SEQ ID NO: 1152691 - protein, 9 aa, Homo Sapiens
PSPHLYSSP

SEQ ID NO: 1152692 - protein, 9 aa, Homo Sapiens
RSNDPKMSE

SEQ ID NO: 1152693 - protein, 9 aa, Homo Sapiens
LRSYCKGPR

SEQ ID NO: 1152694 - protein, 9 aa, Homo Sapiens
LQRGLPGNW

SEQ ID NO: 1152695 - protein, 9 aa, Homo Sapiens
RAVLVERGP

SEQ ID NO: 1152696 - protein, 9 aa, Homo Sapiens
YDWSWMVVN

SEQ ID NO: 1152697 - protein, 9 aa, Homo Sapiens
TWRWNSMTL

SEQ ID NO: 1152698 - protein, 9 aa, Homo Sapiens
EIWWGQMSK

SEQ ID NO: 1152699 - protein, 9 aa, Homo Sapiens
GVAESPDLA

SEQ ID NO: 1152700 - protein, 9 aa, Homo Sapiens
VPVFPMAVK

SEQ ID NO: 1152701 - protein, 9 aa, Homo Sapiens
LPGKPWTST

SEQ ID NO: 1152702 - protein, 9 aa, Homo Sapiens
KPSGEQIPG

SEQ ID NO: 1152703 - protein, 9 aa, Homo Sapiens
LGLTVPTAP

SEQ ID NO: 1152704 - protein, 9 aa, Homo Sapiens
FTLEMFNRG

SEQ ID NO: 1152705 - protein, 9 aa, Homo Sapiens
LNHLDGFDS

SEQ ID NO: 1152706 - protein, 9 aa, Homo Sapiens
LLAGILICI

SEQ ID NO: 1152707 - protein, 9 aa, Homo Sapiens
PVHQVDRLC

SEQ ID NO: 1152708 - protein, 9 aa, Homo Sapiens
RDAHLCPQQ

SEQ ID NO: 1152709 - protein, 9 aa, Homo Sapiens
MCLRLRTKL

SEQ ID NO: 1152710 - protein, 9 aa, Homo Sapiens
ENMFTPFLV

SEQ ID NO: 1152711 - protein, 9 aa, Homo Sapiens
LLGADAAIL

SEQ ID NO: 1152712 - protein, 9 aa, Homo Sapiens
WVAKSTPAS

SEQ ID NO: 1152713 - protein, 9 aa, Homo Sapiens
RTAKKSRWD

SEQ ID NO: 1152714 - protein, 9 aa, Homo Sapiens
QAPGPGAVG

SEQ ID NO: 1152715 - protein, 9 aa, Homo Sapiens
VLVHLIDHL

SEQ ID NO: 1152716 - protein, 9 aa, Homo Sapiens
ELKELSKVQ

SEQ ID NO: 1152717 - protein, 9 aa, Homo Sapiens
KQALGTQAG

SEQ ID NO: 1152718 - protein, 9 aa, Homo Sapiens
RLCTGEDVA

SEQ ID NO: 1152719 - protein, 9 aa, Homo Sapiens
EKDLHMMIS

SEQ ID NO: 1152720 - protein, 9 aa, Homo Sapiens
RTIKLWGLE

SEQ ID NO: 1152721 - protein, 9 aa, Homo Sapiens
DGECDLGPA

SEQ ID NO: 1152722 - protein, 9 aa, Homo Sapiens
ANFDMAVAT

SEQ ID NO: 1152723 - protein, 9 aa, Homo Sapiens
EATVSSGPF

SEQ ID NO: 1152724 - protein, 9 aa, Homo Sapiens
KRAFTTIST

SEQ ID NO: 1152725 - protein, 9 aa, Homo Sapiens
QGAMLLSIT

SEQ ID NO: 1152726 - protein, 9 aa, Homo Sapiens
RASRAPCRP

SEQ ID NO: 1152727 - protein, 9 aa, Homo Sapiens
GVGAQLMAP

SEQ ID NO: 1152728 - protein, 9 aa, Homo Sapiens
SRGLCCVPL

SEQ ID NO: 1152729 - protein, 9 aa, Homo Sapiens
PLSVSPSFS

SEQ ID NO: 1152730 - protein, 9 aa, Homo Sapiens
RMLYHSGKP

SEQ ID NO: 1152731 - protein, 9 aa, Homo Sapiens
DSLGPPRPT

SEQ ID NO: 1152732 - protein, 9 aa, Homo Sapiens
STHSMLEAM

SEQ ID NO: 1152733 - protein, 9 aa, Homo Sapiens
TRMLYHSGK

SEQ ID NO: 1152734 - protein, 9 aa, Homo Sapiens
EVVCLLFPA

SEQ ID NO: 1152735 - protein, 9 aa, Homo Sapiens
RSHAASTTY

SEQ ID NO: 1152736 - protein, 9 aa, Homo Sapiens
HHPPCSLSA

SEQ ID NO: 1152737 - protein, 9 aa, Homo Sapiens
CCTPSEEFA

SEQ ID NO: 1152738 - protein, 9 aa, Homo Sapiens
ETTEPPPVG

SEQ ID NO: 1152739 - protein, 9 aa, Homo Sapiens
VGESPWQVM

SEQ ID NO: 1152740 - protein, 9 aa, Homo Sapiens
VMQNQPTLF

SEQ ID NO: 1152741 - protein, 9 aa, Homo Sapiens
KQNATDIMD

SEQ ID NO: 1152742 - protein, 9 aa, Homo Sapiens
PGTLETGRS

SEQ ID NO: 1152743 - protein, 9 aa, Homo Sapiens
TRKHIIIPL

SEQ ID NO: 1152744 - protein, 9 aa, Homo Sapiens
SIEGQYDTL

SEQ ID NO: 1152745 - protein, 9 aa, Homo Sapiens
GRELRPRLS

SEQ ID NO: 1152746 - protein, 9 aa, Homo Sapiens
SRNMIYMSR

SEQ ID NO: 1152747 - protein, 9 aa, Homo Sapiens
LKLCPAAKQ

SEQ ID NO: 1152748 - protein, 9 aa, Homo Sapiens
CCPSRNTRS

SEQ ID NO: 1152749 - protein, 9 aa, Homo Sapiens
QSHVSSFPS

SEQ ID NO: 1152750 - protein, 9 aa, Homo Sapiens
EHAENLLGK

SEQ ID NO: 1152751 - protein, 9 aa, Homo Sapiens
CIAYFSIVA

SEQ ID NO: 1152752 - protein, 9 aa, Homo Sapiens
SQSGTKMKA

SEQ ID NO: 1152753 - protein, 9 aa, Homo Sapiens
HTHTHARTA

SEQ ID NO: 1152754 - protein, 9 aa, Homo Sapiens
CFLSTSCGT

SEQ ID NO: 1152755 - protein, 9 aa, Homo Sapiens
HSISHTLSR

SEQ ID NO: 1152756 - protein, 9 aa, Homo Sapiens
NTEEKKYSS

SEQ ID NO: 1152757 - protein, 9 aa, Homo Sapiens
RRWTSSGST

SEQ ID NO: 1152758 - protein, 9 aa, Homo Sapiens
RLAENDSSS

SEQ ID NO: 1152759 - protein, 9 aa, Homo Sapiens
PMSDLHLTS

SEQ ID NO: 1152760 - protein, 9 aa, Homo Sapiens
GNFVNGIRC

SEQ ID NO: 1152761 - protein, 9 aa, Homo Sapiens
PGTHGPSAG

SEQ ID NO: 1152762 - protein, 9 aa, Homo Sapiens
EPAGPKSRA

SEQ ID NO: 1152763 - protein, 9 aa, Homo Sapiens
EITDTLCAG

SEQ ID NO: 1152764 - protein, 9 aa, Homo Sapiens
GHNMLKKKE

SEQ ID NO: 1152765 - protein, 9 aa, Homo Sapiens
HLKHHFQGK

SEQ ID NO: 1152766 - protein, 9 aa, Homo Sapiens
RFNLILMMY

SEQ ID NO: 1152767 - protein, 9 aa, Homo Sapiens
LDVFWRVYI

SEQ ID NO: 1152768 - protein, 9 aa, Homo Sapiens
ETSAFGIHK

SEQ ID NO: 1152769 - protein, 9 aa, Homo Sapiens
KTESTHLIV

SEQ ID NO: 1152770 - protein, 9 aa, Homo Sapiens
QSGRWGTGV

SEQ ID NO: 1152771 - protein, 9 aa, Homo Sapiens
LTEVQDMAN

SEQ ID NO: 1152772 - protein, 9 aa, Homo Sapiens
SAEEQPVHQ

SEQ ID NO: 1152773 - protein, 9 aa, Homo Sapiens
LASLAPAVN

SEQ ID NO: 1152774 - protein, 9 aa, Homo Sapiens
FGKVFGNFN

SEQ ID NO: 1152775 - protein, 9 aa, Homo Sapiens
KCEICVKRR

SEQ ID NO: 1152776 - protein, 9 aa, Homo Sapiens
KVSECEKDQ

SEQ ID NO: 1152777 - protein, 9 aa, Homo Sapiens
NELDSKLLL

SEQ ID NO: 1152778 - protein, 9 aa, Homo Sapiens
ENQVSVGLQ

SEQ ID NO: 1152779 - protein, 9 aa, Homo Sapiens
RSTYRLSII

SEQ ID NO: 1152780 - protein, 9 aa, Homo Sapiens
DWYLPDTLL

SEQ ID NO: 1152781 - protein, 9 aa, Homo Sapiens
RQRTLVLKK

SEQ ID NO: 1152782 - protein, 9 aa, Homo Sapiens
IIARYVPLT

SEQ ID NO: 1152783 - protein, 9 aa, Homo Sapiens
FQGERMNHG

SEQ ID NO: 1152784 - protein, 9 aa, Homo Sapiens
IPLKHPRVA

SEQ ID NO: 1152785 - protein, 9 aa, Homo Sapiens
DAGCQFRVL

SEQ ID NO: 1152786 - protein, 9 aa, Homo Sapiens
PILLSPVSR

SEQ ID NO: 1152787 - protein, 9 aa, Homo Sapiens
FPVFVTSCN

SEQ ID NO: 1152788 - protein, 9 aa, Homo Sapiens
GHWVKKGER

SEQ ID NO: 1152789 - protein, 9 aa, Homo Sapiens
TSRILNLQV

SEQ ID NO: 1152790 - protein, 9 aa, Homo Sapiens
RLKDALQKR

SEQ ID NO: 1152791 - protein, 9 aa, Homo Sapiens
SAKRNNFSR

SEQ ID NO: 1152792 - protein, 9 aa, Homo Sapiens
WFPEVALSL

SEQ ID NO: 1152793 - protein, 9 aa, Homo Sapiens
TRMSCTVNV

SEQ ID NO: 1152794 - protein, 9 aa, Homo Sapiens
HIGDEVKCW

SEQ ID NO: 1152795 - protein, 9 aa, Homo Sapiens
QPNTTVVFH

SEQ ID NO: 1152796 - protein, 9 aa, Homo Sapiens
ILEHHPHTL

SEQ ID NO: 1152797 - protein, 9 aa, Homo Sapiens
HRFMAQFHE

SEQ ID NO: 1152798 - protein, 9 aa, Homo Sapiens
FHLNLLITL

SEQ ID NO: 1152799 - protein, 9 aa, Homo Sapiens
PCAQEAPHN

SEQ ID NO: 1152800 - protein, 9 aa, Homo Sapiens
TFRHHETKF

SEQ ID NO: 1152801 - protein, 9 aa, Homo Sapiens
DHSPTQDKL

SEQ ID NO: 1152802 - protein, 9 aa, Homo Sapiens
LSFPGSSHL

SEQ ID NO: 1152803 - protein, 9 aa, Homo Sapiens
AEGLVSGGE

SEQ ID NO: 1152804 - protein, 9 aa, Homo Sapiens
VCIGESRAV

SEQ ID NO: 1152805 - protein, 9 aa, Homo Sapiens
NMENQEMFA

SEQ ID NO: 1152806 - protein, 9 aa, Homo Sapiens
KGYACHHCF

SEQ ID NO: 1152807 - protein, 9 aa, Homo Sapiens
NPGLGPSCW

SEQ ID NO: 1152808 - protein, 9 aa, Homo Sapiens
PPMPPFYYV

SEQ ID NO: 1152809 - protein, 9 aa, Homo Sapiens
GGVLAQHPH

SEQ ID NO: 1152810 - protein, 9 aa, Homo Sapiens
EEEKKKAPT

SEQ ID NO: 1152811 - protein, 9 aa, Homo Sapiens
VESMLERSA

SEQ ID NO: 1152812 - protein, 9 aa, Homo Sapiens
EASGVAIGE

SEQ ID NO: 1152813 - protein, 9 aa, Homo Sapiens
PGAKSGRHL

SEQ ID NO: 1152814 - protein, 9 aa, Homo Sapiens
LVVGGASNA

SEQ ID NO: 1152815 - protein, 9 aa, Homo Sapiens
QLSQIKQTS

SEQ ID NO: 1152816 - protein, 9 aa, Homo Sapiens
KALSALFIW

SEQ ID NO: 1152817 - protein, 9 aa, Homo Sapiens
VMGMVNYSW

SEQ ID NO: 1152818 - protein, 9 aa, Homo Sapiens
LDKDDQHTF

SEQ ID NO: 1152819 - protein, 9 aa, Homo Sapiens
ACWARVPAC

SEQ ID NO: 1152820 - protein, 9 aa, Homo Sapiens
FFIVRDPFK

SEQ ID NO: 1152821 - protein, 9 aa, Homo Sapiens
PALPTRRLS

SEQ ID NO: 1152822 - protein, 9 aa, Homo Sapiens
DPNRTTYVK

SEQ ID NO: 1152823 - protein, 9 aa, Homo Sapiens
PRPACWARV

SEQ ID NO: 1152824 - protein, 9 aa, Homo Sapiens
TMASQGLLL

SEQ ID NO: 1152825 - protein, 9 aa, Homo Sapiens
WLPCRGPMP

SEQ ID NO: 1152826 - protein, 9 aa, Homo Sapiens
VPLVILGLI

SEQ ID NO: 1152827 - protein, 9 aa, Homo Sapiens
KWWPTQSSR

SEQ ID NO: 1152828 - protein, 9 aa, Homo Sapiens
AWDTKPSVM

SEQ ID NO: 1152829 - protein, 9 aa, Homo Sapiens
TPEKTDMMP

SEQ ID NO: 1152830 - protein, 9 aa, Homo Sapiens
AWTAEGAAG

SEQ ID NO: 1152831 - protein, 9 aa, Homo Sapiens
HILEHHPHT

SEQ ID NO: 1152832 - protein, 9 aa, Homo Sapiens
MPSLVPVKS

SEQ ID NO: 1152833 - protein, 9 aa, Homo Sapiens
LPRRIYLRP

SEQ ID NO: 1152834 - protein, 9 aa, Homo Sapiens
VHRAAAVLV

SEQ ID NO: 1152835 - protein, 9 aa, Homo Sapiens
ESDVFRSNF

SEQ ID NO: 1152836 - protein, 9 aa, Homo Sapiens
YIDAQSEAY

SEQ ID NO: 1152837 - protein, 9 aa, Homo Sapiens
PHSGSGSHA

SEQ ID NO: 1152838 - protein, 9 aa, Homo Sapiens
SCARWRTRC

SEQ ID NO: 1152839 - protein, 9 aa, Homo Sapiens
VRIPLHSVK

SEQ ID NO: 1152840 - protein, 9 aa, Homo Sapiens
RLRPRYAGM

SEQ ID NO: 1152841 - protein, 9 aa, Homo Sapiens
AGEIKGSTG

SEQ ID NO: 1152842 - protein, 9 aa, Homo Sapiens
CKGASSHIT

SEQ ID NO: 1152843 - protein, 9 aa, Homo Sapiens
YPGFPHSQY

SEQ ID NO: 1152844 - protein, 9 aa, Homo Sapiens
SEETAPSLL

SEQ ID NO: 1152845 - protein, 9 aa, Homo Sapiens
CTSYRVHSI

SEQ ID NO: 1152846 - protein, 9 aa, Homo Sapiens
GERSFRGSG

SEQ ID NO: 1152847 - protein, 9 aa, Homo Sapiens
PAAAATSTW

SEQ ID NO: 1152848 - protein, 9 aa, Homo Sapiens
GKKIAFHIK

SEQ ID NO: 1152849 - protein, 9 aa, Homo Sapiens
WGRRPLPVM

SEQ ID NO: 1152850 - protein, 9 aa, Homo Sapiens
PTHKIRTSW

SEQ ID NO: 1152851 - protein, 9 aa, Homo Sapiens
VPFVPPLAS

SEQ ID NO: 1152852 - protein, 9 aa, Homo Sapiens
AQATQGGRR

SEQ ID NO: 1152853 - protein, 9 aa, Homo Sapiens
VNWSACSRT

SEQ ID NO: 1152854 - protein, 9 aa, Homo Sapiens
PWRHQSHCF

SEQ ID NO: 1152855 - protein, 9 aa, Homo Sapiens
QQVVKFVIK

SEQ ID NO: 1152856 - protein, 9 aa, Homo Sapiens
YKHCGSRLK

SEQ ID NO: 1152857 - protein, 9 aa, Homo Sapiens
AIGELYGVS

SEQ ID NO: 1152858 - protein, 9 aa, Homo Sapiens
QKEEKNSKK

SEQ ID NO: 1152859 - protein, 9 aa, Homo Sapiens
SQFGFGPNQ

SEQ ID NO: 1152860 - protein, 9 aa, Homo Sapiens
IQTFRERNQ

SEQ ID NO: 1152861 - protein, 9 aa, Homo Sapiens
FSVFPVFVT

SEQ ID NO: 1152862 - protein, 9 aa, Homo Sapiens
RNTLSFYVI

SEQ ID NO: 1152863 - protein, 9 aa, Homo Sapiens
RVRIPLHSV

SEQ ID NO: 1152864 - protein, 9 aa, Homo Sapiens
APRGLGEPH

SEQ ID NO: 1152865 - protein, 9 aa, Homo Sapiens
FIEWMAGGL

SEQ ID NO: 1152866 - protein, 9 aa, Homo Sapiens
GERMNHGNP

SEQ ID NO: 1152867 - protein, 9 aa, Homo Sapiens
GTNGIEECM

SEQ ID NO: 1152868 - protein, 9 aa, Homo Sapiens
LSVAEKVIT

SEQ ID NO: 1152869 - protein, 9 aa, Homo Sapiens
SLKADMLGD

SEQ ID NO: 1152870 - protein, 9 aa, Homo Sapiens
LLGDQLVGG

SEQ ID NO: 1152871 - protein, 9 aa, Homo Sapiens
RVPACRRRP

SEQ ID NO: 1152872 - protein, 9 aa, Homo Sapiens
HCILGPGGA

SEQ ID NO: 1152873 - protein, 9 aa, Homo Sapiens
EEVRQLLLR

SEQ ID NO: 1152874 - protein, 9 aa, Homo Sapiens
PRLGASASP

SEQ ID NO: 1152875 - protein, 9 aa, Homo Sapiens
HPPCSLSAA

SEQ ID NO: 1152876 - protein, 9 aa, Homo Sapiens
VDRETSKPL

SEQ ID NO: 1152877 - protein, 9 aa, Homo Sapiens
AGGSRRHPQ

SEQ ID NO: 1152878 - protein, 9 aa, Homo Sapiens
AHVLRALAL

SEQ ID NO: 1152879 - protein, 9 aa, Homo Sapiens
QNSELSTDS

SEQ ID NO: 1152880 - protein, 9 aa, Homo Sapiens
GAGTGGGPA

SEQ ID NO: 1152881 - protein, 9 aa, Homo Sapiens
RSRPHSGSG

SEQ ID NO: 1152882 - protein, 9 aa, Homo Sapiens
NLMPPGKNH

SEQ ID NO: 1152883 - protein, 9 aa, Homo Sapiens
YLLRDSSPI

SEQ ID NO: 1152884 - protein, 9 aa, Homo Sapiens
ALGWSPCDR

SEQ ID NO: 1152885 - protein, 9 aa, Homo Sapiens
NLQVLKKIL

SEQ ID NO: 1152886 - protein, 9 aa, Homo Sapiens
ECTVRSQTG

SEQ ID NO: 1152887 - protein, 9 aa, Homo Sapiens
FSTGSRATP

SEQ ID NO: 1152888 - protein, 9 aa, Homo Sapiens
ASEHTDICP

SEQ ID NO: 1152889 - protein, 9 aa, Homo Sapiens
GVCGHLKPS

SEQ ID NO: 1152890 - protein, 9 aa, Homo Sapiens
CRVSSIDRR

SEQ ID NO: 1152891 - protein, 9 aa, Homo Sapiens
PSRSRWSRV

SEQ ID NO: 1152892 - protein, 9 aa, Homo Sapiens
AGPVFTPAS

SEQ ID NO: 1152893 - protein, 9 aa, Homo Sapiens
YQEAVRLNP

SEQ ID NO: 1152894 - protein, 9 aa, Homo Sapiens
ESKSKLISL

SEQ ID NO: 1152895 - protein, 9 aa, Homo Sapiens
AEGSLKKTS

SEQ ID NO: 1152896 - protein, 9 aa, Homo Sapiens
SQGLLLSSM

SEQ ID NO: 1152897 - protein, 9 aa, Homo Sapiens
PKSTTLIPS

SEQ ID NO: 1152898 - protein, 9 aa, Homo Sapiens
QSGTKMKAT

SEQ ID NO: 1152899 - protein, 9 aa, Homo Sapiens
AAGVGWATG

SEQ ID NO: 1152900 - protein, 9 aa, Homo Sapiens
HGGGTAVGG

SEQ ID NO: 1152901 - protein, 9 aa, Homo Sapiens
GGGALPGRR

SEQ ID NO: 1152902 - protein, 9 aa, Homo Sapiens
EEQRIVHRD

SEQ ID NO: 1152903 - protein, 9 aa, Homo Sapiens
LDHSGSIKN

SEQ ID NO: 1152904 - protein, 9 aa, Homo Sapiens
NHDSENFTD

SEQ ID NO: 1152905 - protein, 9 aa, Homo Sapiens
KVHERFHTG

SEQ ID NO: 1152906 - protein, 9 aa, Homo Sapiens
AFTTCCTPS

SEQ ID NO: 1152907 - protein, 9 aa, Homo Sapiens
YGYGSGFRG

SEQ ID NO: 1152908 - protein, 9 aa, Homo Sapiens
EKKYSSLKG

SEQ ID NO: 1152909 - protein, 9 aa, Homo Sapiens
DPDVPEKRE

SEQ ID NO: 1152910 - protein, 9 aa, Homo Sapiens
NKDGKINID

SEQ ID NO: 1152911 - protein, 9 aa, Homo Sapiens
VLRALALRL

SEQ ID NO: 1152912 - protein, 9 aa, Homo Sapiens
QEANIHRFM

SEQ ID NO: 1152913 - protein, 9 aa, Homo Sapiens
LQSAFGDQV

SEQ ID NO: 1152914 - protein, 9 aa, Homo Sapiens
AKEKLSISE

SEQ ID NO: 1152915 - protein, 9 aa, Homo Sapiens
KFFDDNGYP

SEQ ID NO: 1152916 - protein, 9 aa, Homo Sapiens
AGHPGTHGP

SEQ ID NO: 1152917 - protein, 9 aa, Homo Sapiens
DAILIMGEA

SEQ ID NO: 1152918 - protein, 9 aa, Homo Sapiens
DREKDKKRT

SEQ ID NO: 1152919 - protein, 9 aa, Homo Sapiens
QKGIPPSLW

SEQ ID NO: 1152920 - protein, 9 aa, Homo Sapiens
NDGSVPPLA

SEQ ID NO: 1152921 - protein, 9 aa, Homo Sapiens
TLEGEFSVI

SEQ ID NO: 1152922 - protein, 9 aa, Homo Sapiens
ASQGLLLSS

SEQ ID NO: 1152923 - protein, 9 aa, Homo Sapiens
AGFSRSFSP

SEQ ID NO: 1152924 - protein, 9 aa, Homo Sapiens
KTSRLSLSQ

SEQ ID NO: 1152925 - protein, 9 aa, Homo Sapiens
LDPVRSYPV

SEQ ID NO: 1152926 - protein, 9 aa, Homo Sapiens
GGPACVPVA

SEQ ID NO: 1152927 - protein, 9 aa, Homo Sapiens
TVRSQTGSP

SEQ ID NO: 1152928 - protein, 9 aa, Homo Sapiens
YGCGGMFFF

SEQ ID NO: 1152929 - protein, 9 aa, Homo Sapiens
ITSSLWTQQ

SEQ ID NO: 1152930 - protein, 9 aa, Homo Sapiens
VETSAFGIH

SEQ ID NO: 1152931 - protein, 9 aa, Homo Sapiens
VPHQVQGRG

SEQ ID NO: 1152932 - protein, 9 aa, Homo Sapiens
ATCSRPTWC

SEQ ID NO: 1152933 - protein, 9 aa, Homo Sapiens
QLIVKGVLD

SEQ ID NO: 1152934 - protein, 9 aa, Homo Sapiens
KADNGCLRQ

SEQ ID NO: 1152935 - protein, 9 aa, Homo Sapiens
IIHRLPAPG

SEQ ID NO: 1152936 - protein, 9 aa, Homo Sapiens
WGSPTRMAG

SEQ ID NO: 1152937 - protein, 9 aa, Homo Sapiens
APVRSPELR

SEQ ID NO: 1152938 - protein, 9 aa, Homo Sapiens
SEFNLLGED

SEQ ID NO: 1152939 - protein, 9 aa, Homo Sapiens
VISTNGIVH

SEQ ID NO: 1152940 - protein, 9 aa, Homo Sapiens
SNNKREKHS

SEQ ID NO: 1152941 - protein, 9 aa, Homo Sapiens
TQDRGLQAL

SEQ ID NO: 1152942 - protein, 9 aa, Homo Sapiens
TLVDKLNTN

SEQ ID NO: 1152943 - protein, 9 aa, Homo Sapiens
ATRNGEVVE

SEQ ID NO: 1152944 - protein, 9 aa, Homo Sapiens
ACRRRPAGA

SEQ ID NO: 1152945 - protein, 9 aa, Homo Sapiens
PVFVTSCNG

SEQ ID NO: 1152946 - protein, 9 aa, Homo Sapiens
WLQGSPGLA

SEQ ID NO: 1152947 - protein, 9 aa, Homo Sapiens
KSPVNEEAK

SEQ ID NO: 1152948 - protein, 9 aa, Homo Sapiens
NLQPFMPSL

SEQ ID NO: 1152949 - protein, 9 aa, Homo Sapiens
TTGPRDSAL

SEQ ID NO: 1152950 - protein, 9 aa, Homo Sapiens
IEVSVNGVL

SEQ ID NO: 1152951 - protein, 9 aa, Homo Sapiens
LVPRLECSG

SEQ ID NO: 1152952 - protein, 9 aa, Homo Sapiens
RLVELHMCR

SEQ ID NO: 1152953 - protein, 9 aa, Homo Sapiens
ICIMKNQIR

SEQ ID NO: 1152954 - protein, 9 aa, Homo Sapiens
VQLYNEMVD

SEQ ID NO: 1152955 - protein, 9 aa, Homo Sapiens
ALLSAALPQ

SEQ ID NO: 1152956 - protein, 9 aa, Homo Sapiens
ASSWGTREP

SEQ ID NO: 1152957 - protein, 9 aa, Homo Sapiens
YLQLWAPLK

SEQ ID NO: 1152958 - protein, 9 aa, Homo Sapiens
TAKKSRWDN

SEQ ID NO: 1152959 - protein, 9 aa, Homo Sapiens
GDEVKCWVL

SEQ ID NO: 1152960 - protein, 9 aa, Homo Sapiens
TLASRVAGT

SEQ ID NO: 1152961 - protein, 9 aa, Homo Sapiens
RRPLPVMEG

SEQ ID NO: 1152962 - protein, 9 aa, Homo Sapiens
EMFMQFGYV

SEQ ID NO: 1152963 - protein, 9 aa, Homo Sapiens
KPWTSTSIF

SEQ ID NO: 1152964 - protein, 9 aa, Homo Sapiens
VKSWVISEL

SEQ ID NO: 1152965 - protein, 9 aa, Homo Sapiens
SLRITFQQH

SEQ ID NO: 1152966 - protein, 9 aa, Homo Sapiens
ALERWPAHL

SEQ ID NO: 1152967 - protein, 9 aa, Homo Sapiens
PITTSRPEG

SEQ ID NO: 1152968 - protein, 9 aa, Homo Sapiens
GSAHTSRSV

SEQ ID NO: 1152969 - protein, 9 aa, Homo Sapiens
RHDDPESEI

SEQ ID NO: 1152970 - protein, 9 aa, Homo Sapiens
AGTAGARHH

SEQ ID NO: 1152971 - protein, 9 aa, Homo Sapiens
CSTMSCLSR

SEQ ID NO: 1152972 - protein, 9 aa, Homo Sapiens
GSFATSPGP

SEQ ID NO: 1152973 - protein, 9 aa, Homo Sapiens
KQHPHPLLP

SEQ ID NO: 1152974 - protein, 9 aa, Homo Sapiens
ATTAFSAFG

SEQ ID NO: 1152975 - protein, 9 aa, Homo Sapiens
VDLAGEEAS

SEQ ID NO: 1152976 - protein, 9 aa, Homo Sapiens
GAKRVCCPT

SEQ ID NO: 1152977 - protein, 9 aa, Homo Sapiens
LNKPLESKL

SEQ ID NO: 1152978 - protein, 9 aa, Homo Sapiens
PTWCTTCAS

SEQ ID NO: 1152979 - protein, 9 aa, Homo Sapiens
VRAWRTSSA

SEQ ID NO: 1152980 - protein, 9 aa, Homo Sapiens
PPAMRSGGD

SEQ ID NO: 1152981 - protein, 9 aa, Homo Sapiens
TESTHLIVQ

SEQ ID NO: 1152982 - protein, 9 aa, Homo Sapiens
GERVCSNII

SEQ ID NO: 1152983 - protein, 9 aa, Homo Sapiens
HNRTHTCEK

SEQ ID NO: 1152984 - protein, 9 aa, Homo Sapiens
AHLDAILIM

SEQ ID NO: 1152985 - protein, 9 aa, Homo Sapiens
SALLSAALP

SEQ ID NO: 1152986 - protein, 9 aa, Homo Sapiens
TSWPRLEGP

SEQ ID NO: 1152987 - protein, 9 aa, Homo Sapiens
DPGERVLHS

SEQ ID NO: 1152988 - protein, 9 aa, Homo Sapiens
CLMRPPWLK

SEQ ID NO: 1152989 - protein, 9 aa, Homo Sapiens
GLLGAHVQA

SEQ ID NO: 1152990 - protein, 9 aa, Homo Sapiens
HQVGVLELS

SEQ ID NO: 1152991 - protein, 9 aa, Homo Sapiens
FDPKMLWGN

SEQ ID NO: 1152992 - protein, 9 aa, Homo Sapiens
EMQKEEKNS

SEQ ID NO: 1152993 - protein, 9 aa, Homo Sapiens
VFKGLRYAT

SEQ ID NO: 1152994 - protein, 9 aa, Homo Sapiens
LALSEDRRT

SEQ ID NO: 1152995 - protein, 9 aa, Homo Sapiens
RWTSSGSTT

SEQ ID NO: 1152996 - protein, 9 aa, Homo Sapiens
LQIILFFFL

SEQ ID NO: 1152997 - protein, 9 aa, Homo Sapiens
GYCTQYRGE

SEQ ID NO: 1152998 - protein, 9 aa, Homo Sapiens
ASGLEANDE

SEQ ID NO: 1152999 - protein, 9 aa, Homo Sapiens
INPWSGLIV

SEQ ID NO: 1153000 - protein, 9 aa, Homo Sapiens
LGADLPNIT

SEQ ID NO: 1153001 - protein, 9 aa, Homo Sapiens
LMHLDVSQR

SEQ ID NO: 1153002 - protein, 9 aa, Homo Sapiens
PCRPPPVPA

SEQ ID NO: 1153003 - protein, 9 aa, Homo Sapiens
LALNQKNSV

SEQ ID NO: 1153004 - protein, 9 aa, Homo Sapiens
AHEVGKVIG

SEQ ID NO: 1153005 - protein, 9 aa, Homo Sapiens
EEDKKHGGG

SEQ ID NO: 1153006 - protein, 9 aa, Homo Sapiens
PPHHEFCSH

SEQ ID NO: 1153007 - protein, 9 aa, Homo Sapiens
PLSLWKRLK

SEQ ID NO: 1153008 - protein, 9 aa, Homo Sapiens
LSTAQSNYL

SEQ ID NO: 1153009 - protein, 9 aa, Homo Sapiens
NQGSNMFNH

SEQ ID NO: 1153010 - protein, 9 aa, Homo Sapiens
QAELEELCA

SEQ ID NO: 1153011 - protein, 9 aa, Homo Sapiens
REIPLYLSH

SEQ ID NO: 1153012 - protein, 9 aa, Homo Sapiens
GCGPDCEVD

SEQ ID NO: 1153013 - protein, 9 aa, Homo Sapiens
ISDCTEIII

SEQ ID NO: 1153014 - protein, 9 aa, Homo Sapiens
TQTMVMGII

SEQ ID NO: 1153015 - protein, 9 aa, Homo Sapiens
LVILGLIAD

SEQ ID NO: 1153016 - protein, 9 aa, Homo Sapiens
QGAGSPTLG

SEQ ID NO: 1153017 - protein, 9 aa, Homo Sapiens
PLTPLQWNE

SEQ ID NO: 1153018 - protein, 9 aa, Homo Sapiens
VDVAISIFV

SEQ ID NO: 1153019 - protein, 9 aa, Homo Sapiens
ILEKNPPLR

SEQ ID NO: 1153020 - protein, 9 aa, Homo Sapiens
PVAWHPLGL

SEQ ID NO: 1153021 - protein, 9 aa, Homo Sapiens
IQGMQGPPP

SEQ ID NO: 1153022 - protein, 9 aa, Homo Sapiens
SVRMVALVT

SEQ ID NO: 1153023 - protein, 9 aa, Homo Sapiens
IAGPGHKIQ

SEQ ID NO: 1153024 - protein, 9 aa, Homo Sapiens
QEIQGMQGP

SEQ ID NO: 1153025 - protein, 9 aa, Homo Sapiens
PLGRPRIPL

SEQ ID NO: 1153026 - protein, 9 aa, Homo Sapiens
RLTWVCRRP

SEQ ID NO: 1153027 - protein, 9 aa, Homo Sapiens
IPDTHLHGY

SEQ ID NO: 1153028 - protein, 9 aa, Homo Sapiens
NSAPTVPCS

SEQ ID NO: 1153029 - protein, 9 aa, Homo Sapiens
GPRTPRGTQ

SEQ ID NO: 1153030 - protein, 9 aa, Homo Sapiens
LSLWFLDRT

SEQ ID NO: 1153031 - protein, 9 aa, Homo Sapiens
LLNDGSVPP

SEQ ID NO: 1153032 - protein, 9 aa, Homo Sapiens
NQVGSEAGK

SEQ ID NO: 1153033 - protein, 9 aa, Homo Sapiens
EEGWGVSGS

SEQ ID NO: 1153034 - protein, 9 aa, Homo Sapiens
QIQRPIQVQ

SEQ ID NO: 1153035 - protein, 9 aa, Homo Sapiens
SGGRSRAEK

SEQ ID NO: 1153036 - protein, 9 aa, Homo Sapiens
GPYSSVPPL

SEQ ID NO: 1153037 - protein, 9 aa, Homo Sapiens
GWRRWTSSG

SEQ ID NO: 1153038 - protein, 9 aa, Homo Sapiens
PDTQPPECV

SEQ ID NO: 1153039 - protein, 9 aa, Homo Sapiens
FPKRFINQL

SEQ ID NO: 1153040 - protein, 9 aa, Homo Sapiens
HSLNPSTSS

SEQ ID NO: 1153041 - protein, 9 aa, Homo Sapiens
NFFYQERAN

SEQ ID NO: 1153042 - protein, 9 aa, Homo Sapiens
TSSACSAGG

SEQ ID NO: 1153043 - protein, 9 aa, Homo Sapiens
GEQPTGDPP

SEQ ID NO: 1153044 - protein, 9 aa, Homo Sapiens
QTSAGVTAN

SEQ ID NO: 1153045 - protein, 9 aa, Homo Sapiens
MLTLKCVTS

SEQ ID NO: 1153046 - protein, 9 aa, Homo Sapiens
SVESSYSKS

SEQ ID NO: 1153047 - protein, 9 aa, Homo Sapiens
QVLKKILRS

SEQ ID NO: 1153048 - protein, 9 aa, Homo Sapiens
RFTNDDRHR

SEQ ID NO: 1153049 - protein, 9 aa, Homo Sapiens
TDNMATVSW

SEQ ID NO: 1153050 - protein, 9 aa, Homo Sapiens
PLSPGATLT

SEQ ID NO: 1153051 - protein, 9 aa, Homo Sapiens
TGPPRHPRH

SEQ ID NO: 1153052 - protein, 9 aa, Homo Sapiens
PPGGGALPG

SEQ ID NO: 1153053 - protein, 9 aa, Homo Sapiens
NFTDSLQSP

SEQ ID NO: 1153054 - protein, 9 aa, Homo Sapiens
QVWTAATLR

SEQ ID NO: 1153055 - protein, 9 aa, Homo Sapiens
IFIGHPPSA

SEQ ID NO: 1153056 - protein, 9 aa, Homo Sapiens
AKAIYEHLF

SEQ ID NO: 1153057 - protein, 9 aa, Homo Sapiens
PLRFNLILM

SEQ ID NO: 1153058 - protein, 9 aa, Homo Sapiens
GGDWLAPVA

SEQ ID NO: 1153059 - protein, 9 aa, Homo Sapiens
QLADYNTLV

SEQ ID NO: 1153060 - protein, 9 aa, Homo Sapiens
PVATACCPS

SEQ ID NO: 1153061 - protein, 9 aa, Homo Sapiens
TGAPGARVT

SEQ ID NO: 1153062 - protein, 9 aa, Homo Sapiens
VFLCPGEPG

SEQ ID NO: 1153063 - protein, 9 aa, Homo Sapiens
TTRRAVLVS

SEQ ID NO: 1153064 - protein, 9 aa, Homo Sapiens
TRSNDPKMS

SEQ ID NO: 1153065 - protein, 9 aa, Homo Sapiens
AGEEASAKK

SEQ ID NO: 1153066 - protein, 9 aa, Homo Sapiens
WTQQTCLEE

SEQ ID NO: 1153067 - protein, 9 aa, Homo Sapiens
EGATSTLTM

SEQ ID NO: 1153068 - protein, 9 aa, Homo Sapiens
NPIFRPTFY

SEQ ID NO: 1153069 - protein, 9 aa, Homo Sapiens
TDEDDYRCS

SEQ ID NO: 1153070 - protein, 9 aa, Homo Sapiens
SVTASFEKL

SEQ ID NO: 1153071 - protein, 9 aa, Homo Sapiens
QEPLPRGSS

SEQ ID NO: 1153072 - protein, 9 aa, Homo Sapiens
LEEGTAISG

SEQ ID NO: 1153073 - protein, 9 aa, Homo Sapiens
KMREDDHVA

SEQ ID NO: 1153074 - protein, 9 aa, Homo Sapiens
LMPPGKNHN

SEQ ID NO: 1153075 - protein, 9 aa, Homo Sapiens
VVLVSVLHE

SEQ ID NO: 1153076 - protein, 9 aa, Homo Sapiens
KLDFDTLKQ

SEQ ID NO: 1153077 - protein, 9 aa, Homo Sapiens
RYAGMLLGC

SEQ ID NO: 1153078 - protein, 9 aa, Homo Sapiens
TRRPSRQWP

SEQ ID NO: 1153079 - protein, 9 aa, Homo Sapiens
PWFLGQYLA

SEQ ID NO: 1153080 - protein, 9 aa, Homo Sapiens
KQKFIILRW

SEQ ID NO: 1153081 - protein, 9 aa, Homo Sapiens
KREVTDKRK

SEQ ID NO: 1153082 - protein, 9 aa, Homo Sapiens
SHTVKNLLH

SEQ ID NO: 1153083 - protein, 9 aa, Homo Sapiens
PEGSGKYNF

SEQ ID NO: 1153084 - protein, 9 aa, Homo Sapiens
GASESRNMI

SEQ ID NO: 1153085 - protein, 9 aa, Homo Sapiens
DNQPIVKKG

SEQ ID NO: 1153086 - protein, 9 aa, Homo Sapiens
LRHVEEEKE

SEQ ID NO: 1153087 - protein, 9 aa, Homo Sapiens
NEAKKGRCY

SEQ ID NO: 1153088 - protein, 9 aa, Homo Sapiens
LELFGKVFG

SEQ ID NO: 1153089 - protein, 9 aa, Homo Sapiens
PGPPVLLAG

SEQ ID NO: 1153090 - protein, 9 aa, Homo Sapiens
GTILAYCSL

SEQ ID NO: 1153091 - protein, 9 aa, Homo Sapiens
AVPHPSSMS

SEQ ID NO: 1153092 - protein, 9 aa, Homo Sapiens
AKQRTVKKA

SEQ ID NO: 1153093 - protein, 9 aa, Homo Sapiens
GTAISGNCG

SEQ ID NO: 1153094 - protein, 9 aa, Homo Sapiens
VKWNYTNIT

SEQ ID NO: 1153095 - protein, 9 aa, Homo Sapiens
RIGGPPSAP

SEQ ID NO: 1153096 - protein, 9 aa, Homo Sapiens
LSLSQAFLT

SEQ ID NO: 1153097 - protein, 9 aa, Homo Sapiens
RVPCAGTTP

SEQ ID NO: 1153098 - protein, 9 aa, Homo Sapiens
QDCKLQADG

SEQ ID NO: 1153099 - protein, 9 aa, Homo Sapiens
RKTIDCKDA

SEQ ID NO: 1153100 - protein, 9 aa, Homo Sapiens
ITETIGIIS

SEQ ID NO: 1153101 - protein, 9 aa, Homo Sapiens
IPHLSPWDL

SEQ ID NO: 1153102 - protein, 9 aa, Homo Sapiens
LYDLLELPS

SEQ ID NO: 1153103 - protein, 9 aa, Homo Sapiens
CSSVELTGM

SEQ ID NO: 1153104 - protein, 9 aa, Homo Sapiens
TNTTGSTLL

SEQ ID NO: 1153105 - protein, 9 aa, Homo Sapiens
VVDVSVPFV

SEQ ID NO: 1153106 - protein, 9 aa, Homo Sapiens
CLEEGTAIS

SEQ ID NO: 1153107 - protein, 9 aa, Homo Sapiens
SGGELLLGG

SEQ ID NO: 1153108 - protein, 9 aa, Homo Sapiens
GGDASCARW

SEQ ID NO: 1153109 - protein, 9 aa, Homo Sapiens
KRKKSYTTP

SEQ ID NO: 1153110 - protein, 9 aa, Homo Sapiens
FPASGEMKD

SEQ ID NO: 1153111 - protein, 9 aa, Homo Sapiens
ISLSCWLSC

SEQ ID NO: 1153112 - protein, 9 aa, Homo Sapiens
SRRAHERPH

SEQ ID NO: 1153113 - protein, 9 aa, Homo Sapiens
YHPSTHDKN

SEQ ID NO: 1153114 - protein, 9 aa, Homo Sapiens
RCLEARIAQ

SEQ ID NO: 1153115 - protein, 9 aa, Homo Sapiens
SPLLSGARG

SEQ ID NO: 1153116 - protein, 9 aa, Homo Sapiens
LSALFIWPQ

SEQ ID NO: 1153117 - protein, 9 aa, Homo Sapiens
PRVRFTNDD

SEQ ID NO: 1153118 - protein, 9 aa, Homo Sapiens
WHVVNQQPI

SEQ ID NO: 1153119 - protein, 9 aa, Homo Sapiens
SLAGVARRD

SEQ ID NO: 1153120 - protein, 9 aa, Homo Sapiens
HARTAIPLH

SEQ ID NO: 1153121 - protein, 9 aa, Homo Sapiens
VFPICWCPF

SEQ ID NO: 1153122 - protein, 9 aa, Homo Sapiens
PSASQTPMA

SEQ ID NO: 1153123 - protein, 9 aa, Homo Sapiens
IQTATALAI

SEQ ID NO: 1153124 - protein, 9 aa, Homo Sapiens
HVCQDIPAS

SEQ ID NO: 1153125 - protein, 9 aa, Homo Sapiens
ELLRHRERS

SEQ ID NO: 1153126 - protein, 9 aa, Homo Sapiens
GSRSRPHSG

SEQ ID NO: 1153127 - protein, 9 aa, Homo Sapiens
VMLFSTGSR

SEQ ID NO: 1153128 - protein, 9 aa, Homo Sapiens
FRKFFDDNG

SEQ ID NO: 1153129 - protein, 9 aa, Homo Sapiens
QPCNVADTN

SEQ ID NO: 1153130 - protein, 9 aa, Homo Sapiens
FVTSCNGYF

SEQ ID NO: 1153131 - protein, 9 aa, Homo Sapiens
MYRYGPASV

SEQ ID NO: 1153132 - protein, 9 aa, Homo Sapiens
RAVLVSCSS

SEQ ID NO: 1153133 - protein, 9 aa, Homo Sapiens
LNLQVLKKI

SEQ ID NO: 1153134 - protein, 9 aa, Homo Sapiens
PTTPTTPLT

SEQ ID NO: 1153135 - protein, 9 aa, Homo Sapiens
DYQEMFMQF

SEQ ID NO: 1153136 - protein, 9 aa, Homo Sapiens
TFCTWTVRM

SEQ ID NO: 1153137 - protein, 9 aa, Homo Sapiens
IYPPMNFAA

SEQ ID NO: 1153138 - protein, 9 aa, Homo Sapiens
KLHTPMHFF

SEQ ID NO: 1153139 - protein, 9 aa, Homo Sapiens
VALVTGSVV

SEQ ID NO: 1153140 - protein, 9 aa, Homo Sapiens
PPWTGRGEQ

SEQ ID NO: 1153141 - protein, 9 aa, Homo Sapiens
TCAPGTART

SEQ ID NO: 1153142 - protein, 9 aa, Homo Sapiens
KRETRCSFI

SEQ ID NO: 1153143 - protein, 9 aa, Homo Sapiens
VDVSVPFVE

SEQ ID NO: 1153144 - protein, 9 aa, Homo Sapiens
GSLLRGQVP

SEQ ID NO: 1153145 - protein, 9 aa, Homo Sapiens
GLHVFPHVC

SEQ ID NO: 1153146 - protein, 9 aa, Homo Sapiens
FLTLRRKWW

SEQ ID NO: 1153147 - protein, 9 aa, Homo Sapiens
EVATWIKTT

SEQ ID NO: 1153148 - protein, 9 aa, Homo Sapiens
ARQPSRWPS

SEQ ID NO: 1153149 - protein, 9 aa, Homo Sapiens
GGALPGRRA

SEQ ID NO: 1153150 - protein, 9 aa, Homo Sapiens
IWPSKGVKF

SEQ ID NO: 1153151 - protein, 9 aa, Homo Sapiens
LSTLSQPPP

SEQ ID NO: 1153152 - protein, 9 aa, Homo Sapiens
GVSPLAPCP

SEQ ID NO: 1153153 - protein, 9 aa, Homo Sapiens
WVGAQEAVQ

SEQ ID NO: 1153154 - protein, 9 aa, Homo Sapiens
SIGLHVFPH

SEQ ID NO: 1153155 - protein, 9 aa, Homo Sapiens
PFALPLGRP

SEQ ID NO: 1153156 - protein, 9 aa, Homo Sapiens
YEKDLHMMI

SEQ ID NO: 1153157 - protein, 9 aa, Homo Sapiens
NQPIVKKGE

SEQ ID NO: 1153158 - protein, 9 aa, Homo Sapiens
HDLVLQGPP

SEQ ID NO: 1153159 - protein, 9 aa, Homo Sapiens
AGDVGKSAL

SEQ ID NO: 1153160 - protein, 9 aa, Homo Sapiens
STSCGTDFY

SEQ ID NO: 1153161 - protein, 9 aa, Homo Sapiens
RPQWTQTCP

SEQ ID NO: 1153162 - protein, 9 aa, Homo Sapiens
CKTVKYALI

SEQ ID NO: 1153163 - protein, 9 aa, Homo Sapiens
SSGWLELSS

SEQ ID NO: 1153164 - protein, 9 aa, Homo Sapiens
VRQLLLRFP

SEQ ID NO: 1153165 - protein, 9 aa, Homo Sapiens
DLCLSALDK

SEQ ID NO: 1153166 - protein, 9 aa, Homo Sapiens
LKPEEIQHS

SEQ ID NO: 1153167 - protein, 9 aa, Homo Sapiens
TMINSNDDN

SEQ ID NO: 1153168 - protein, 9 aa, Homo Sapiens
WQTRQTKLD

SEQ ID NO: 1153169 - protein, 9 aa, Homo Sapiens
RQAPCSTPC

SEQ ID NO: 1153170 - protein, 9 aa, Homo Sapiens
AKKLVPLVI

SEQ ID NO: 1153171 - protein, 9 aa, Homo Sapiens
LRGQVPARR

SEQ ID NO: 1153172 - protein, 9 aa, Homo Sapiens
LVGMTPRDL

SEQ ID NO: 1153173 - protein, 9 aa, Homo Sapiens
LELIFSALL

SEQ ID NO: 1153174 - protein, 9 aa, Homo Sapiens
GAFGKVVET

SEQ ID NO: 1153175 - protein, 9 aa, Homo Sapiens
VSIWPNLSC

SEQ ID NO: 1153176 - protein, 9 aa, Homo Sapiens
KRCLEARIA

SEQ ID NO: 1153177 - protein, 9 aa, Homo Sapiens
PSHATRNGE

SEQ ID NO: 1153178 - protein, 9 aa, Homo Sapiens
RQPSRWPSS

SEQ ID NO: 1153179 - protein, 9 aa, Homo Sapiens
SLKGNYPAG

SEQ ID NO: 1153180 - protein, 9 aa, Homo Sapiens
ALKRHFTVN

SEQ ID NO: 1153181 - protein, 9 aa, Homo Sapiens
QVCRWAHSR

SEQ ID NO: 1153182 - protein, 9 aa, Homo Sapiens
ATLASAARR

SEQ ID NO: 1153183 - protein, 9 aa, Homo Sapiens
VFPVFVTSC

SEQ ID NO: 1153184 - protein, 9 aa, Homo Sapiens
LAPCPPLEV

SEQ ID NO: 1153185 - protein, 9 aa, Homo Sapiens
TVRVSPEVQ

SEQ ID NO: 1153186 - protein, 9 aa, Homo Sapiens
QDAPDASDF

SEQ ID NO: 1153187 - protein, 9 aa, Homo Sapiens
LGKITRHDD

SEQ ID NO: 1153188 - protein, 9 aa, Homo Sapiens
SSSSGSDGG

SEQ ID NO: 1153189 - protein, 9 aa, Homo Sapiens
VKEARDLLS

SEQ ID NO: 1153190 - protein, 9 aa, Homo Sapiens
ITVEEGQML

SEQ ID NO: 1153191 - protein, 9 aa, Homo Sapiens
CFTCGCGPD

SEQ ID NO: 1153192 - protein, 9 aa, Homo Sapiens
PEVALSLTS

SEQ ID NO: 1153193 - protein, 9 aa, Homo Sapiens
HSPTQDKLV

SEQ ID NO: 1153194 - protein, 9 aa, Homo Sapiens
WSWMVVNHN

SEQ ID NO: 1153195 - protein, 9 aa, Homo Sapiens
WEPPWTGRG

SEQ ID NO: 1153196 - protein, 9 aa, Homo Sapiens
VRMGRRCSS

SEQ ID NO: 1153197 - protein, 9 aa, Homo Sapiens
RQRQDPSHA

SEQ ID NO: 1153198 - protein, 9 aa, Homo Sapiens
GWDKRCCLD

SEQ ID NO: 1153199 - protein, 9 aa, Homo Sapiens
LLTGADGRP

SEQ ID NO: 1153200 - protein, 9 aa, Homo Sapiens
REAQNFSFI

SEQ ID NO: 1153201 - protein, 9 aa, Homo Sapiens
NTNFKQKFI

SEQ ID NO: 1153202 - protein, 9 aa, Homo Sapiens
GFRGSFATS

SEQ ID NO: 1153203 - protein, 9 aa, Homo Sapiens
NIIKHLNGS

SEQ ID NO: 1153204 - protein, 9 aa, Homo Sapiens
QNTFLTQNM

SEQ ID NO: 1153205 - protein, 9 aa, Homo Sapiens
CSAGGDASC

SEQ ID NO: 1153206 - protein, 9 aa, Homo Sapiens
EHFVKCVLQ

SEQ ID NO: 1153207 - protein, 9 aa, Homo Sapiens
VPARRGLVE

SEQ ID NO: 1153208 - protein, 9 aa, Homo Sapiens
RATPGVALG

SEQ ID NO: 1153209 - protein, 9 aa, Homo Sapiens
MLHKVDKAS

SEQ ID NO: 1153210 - protein, 9 aa, Homo Sapiens
SKPLCKTVK

SEQ ID NO: 1153211 - protein, 9 aa, Homo Sapiens
GTGGGPACV

SEQ ID NO: 1153212 - protein, 9 aa, Homo Sapiens
RWDLRRPQW

SEQ ID NO: 1153213 - protein, 9 aa, Homo Sapiens
SGLNGESPT

SEQ ID NO: 1153214 - protein, 9 aa, Homo Sapiens
IQPPLPAGL

SEQ ID NO: 1153215 - protein, 9 aa, Homo Sapiens
EPNDTITES

SEQ ID NO: 1153216 - protein, 9 aa, Homo Sapiens
GNSATTTCP

SEQ ID NO: 1153217 - protein, 9 aa, Homo Sapiens
VSGLNGESP

SEQ ID NO: 1153218 - protein, 9 aa, Homo Sapiens
GHGEQAEEE

SEQ ID NO: 1153219 - protein, 9 aa, Homo Sapiens
WSAMPGGSP

SEQ ID NO: 1153220 - protein, 9 aa, Homo Sapiens
HPRLCSYTG

SEQ ID NO: 1153221 - protein, 9 aa, Homo Sapiens
VCGSLFEEE

SEQ ID NO: 1153222 - protein, 9 aa, Homo Sapiens
TRCRASRAP

SEQ ID NO: 1153223 - protein, 9 aa, Homo Sapiens
TPKKKRSAF

SEQ ID NO: 1153224 - protein, 9 aa, Homo Sapiens
FRGYGYRSC

SEQ ID NO: 1153225 - protein, 9 aa, Homo Sapiens
GELEGQPTL

SEQ ID NO: 1153226 - protein, 9 aa, Homo Sapiens
NGEPRELPI

SEQ ID NO: 1153227 - protein, 9 aa, Homo Sapiens
LQPFMPSLV

SEQ ID NO: 1153228 - protein, 9 aa, Homo Sapiens
PGGPISLSC

SEQ ID NO: 1153229 - protein, 9 aa, Homo Sapiens
SEIGSGESS

SEQ ID NO: 1153230 - protein, 9 aa, Homo Sapiens
LELPSQQRK

SEQ ID NO: 1153231 - protein, 9 aa, Homo Sapiens
TPSGECRVS

SEQ ID NO: 1153232 - protein, 9 aa, Homo Sapiens
STRSSINRP

SEQ ID NO: 1153233 - protein, 9 aa, Homo Sapiens
AVLWVAKST

SEQ ID NO: 1153234 - protein, 9 aa, Homo Sapiens
PHVDGERSF

SEQ ID NO: 1153235 - protein, 9 aa, Homo Sapiens
QGPADPPGP

SEQ ID NO: 1153236 - protein, 9 aa, Homo Sapiens
KDQRLREIA

SEQ ID NO: 1153237 - protein, 9 aa, Homo Sapiens
AKIQDFEQR

SEQ ID NO: 1153238 - protein, 9 aa, Homo Sapiens
LRNVTWAIV

SEQ ID NO: 1153239 - protein, 9 aa, Homo Sapiens
WDKRCCLDS

SEQ ID NO: 1153240 - protein, 9 aa, Homo Sapiens
VVKFVIKKK

SEQ ID NO: 1153241 - protein, 9 aa, Homo Sapiens
KPAVAWLQG

SEQ ID NO: 1153242 - protein, 9 aa, Homo Sapiens
RDLLSLRAG

SEQ ID NO: 1153243 - protein, 9 aa, Homo Sapiens
GILPSSRGM

SEQ ID NO: 1153244 - protein, 9 aa, Homo Sapiens
TSVPSTTRR

SEQ ID NO: 1153245 - protein, 9 aa, Homo Sapiens
VVEDGELEG

SEQ ID NO: 1153246 - protein, 9 aa, Homo Sapiens
AQHEDVEGC

SEQ ID NO: 1153247 - protein, 9 aa, Homo Sapiens
IQLTMNDSK

SEQ ID NO: 1153248 - protein, 9 aa, Homo Sapiens
VRRKKMREH

SEQ ID NO: 1153249 - protein, 9 aa, Homo Sapiens
ILGKITRHD

SEQ ID NO: 1153250 - protein, 9 aa, Homo Sapiens
SVPATSGPS

SEQ ID NO: 1153251 - protein, 9 aa, Homo Sapiens
VKKDHVTLQ

SEQ ID NO: 1153252 - protein, 9 aa, Homo Sapiens
LSLDKDDQH

SEQ ID NO: 1153253 - protein, 9 aa, Homo Sapiens
FPPLIPLLG

SEQ ID NO: 1153254 - protein, 9 aa, Homo Sapiens
GKPPAMRSG

SEQ ID NO: 1153255 - protein, 9 aa, Homo Sapiens
TSSHAERAS

SEQ ID NO: 1153256 - protein, 9 aa, Homo Sapiens
QRESGSGPS

SEQ ID NO: 1153257 - protein, 9 aa, Homo Sapiens
GSVVVSAPL

SEQ ID NO: 1153258 - protein, 9 aa, Homo Sapiens
DLHLTSETS

SEQ ID NO: 1153259 - protein, 9 aa, Homo Sapiens
RSEVVDVSV

SEQ ID NO: 1153260 - protein, 9 aa, Homo Sapiens
IGYGDESDV

SEQ ID NO: 1153261 - protein, 9 aa, Homo Sapiens
HGANQVGSE

SEQ ID NO: 1153262 - protein, 9 aa, Homo Sapiens
VVAMARTGN

SEQ ID NO: 1153263 - protein, 9 aa, Homo Sapiens
GGPGITWAG

SEQ ID NO: 1153264 - protein, 9 aa, Homo Sapiens
MEAIGELYG

SEQ ID NO: 1153265 - protein, 9 aa, Homo Sapiens
LGIVMGVFP

SEQ ID NO: 1153266 - protein, 9 aa, Homo Sapiens
GWGVSGSST

SEQ ID NO: 1153267 - protein, 9 aa, Homo Sapiens
HVPHDLVLQ

SEQ ID NO: 1153268 - protein, 9 aa, Homo Sapiens
PQPSLPGPC

SEQ ID NO: 1153269 - protein, 9 aa, Homo Sapiens
VKDINDNVP

SEQ ID NO: 1153270 - protein, 9 aa, Homo Sapiens
PQNTFLTQN

SEQ ID NO: 1153271 - protein, 9 aa, Homo Sapiens
CKAFSTCLT

SEQ ID NO: 1153272 - protein, 9 aa, Homo Sapiens
HPLPQLLGP

SEQ ID NO: 1153273 - protein, 9 aa, Homo Sapiens
SREQCRKMQ

SEQ ID NO: 1153274 - protein, 9 aa, Homo Sapiens
WPTQSSRPR

SEQ ID NO: 1153275 - protein, 9 aa, Homo Sapiens
RPDRVVLRR

SEQ ID NO: 1153276 - protein, 9 aa, Homo Sapiens
FDVMTDYSN

SEQ ID NO: 1153277 - protein, 9 aa, Homo Sapiens
RSKPLCKTV

SEQ ID NO: 1153278 - protein, 9 aa, Homo Sapiens
CASLLSTLS

SEQ ID NO: 1153279 - protein, 9 aa, Homo Sapiens
SVFGVMQLL

SEQ ID NO: 1153280 - protein, 9 aa, Homo Sapiens
LCEYQELTN

SEQ ID NO: 1153281 - protein, 9 aa, Homo Sapiens
KIEASPIGS

SEQ ID NO: 1153282 - protein, 9 aa, Homo Sapiens
GINHCCGEY

SEQ ID NO: 1153283 - protein, 9 aa, Homo Sapiens
GVMQLLCLL

SEQ ID NO: 1153284 - protein, 9 aa, Homo Sapiens
PCSGGWCRK

SEQ ID NO: 1153285 - protein, 9 aa, Homo Sapiens
FTHIEFPRR

SEQ ID NO: 1153286 - protein, 9 aa, Homo Sapiens
QNATDIMDA

SEQ ID NO: 1153287 - protein, 9 aa, Homo Sapiens
QDMANKALL

SEQ ID NO: 1153288 - protein, 9 aa, Homo Sapiens
PACARGPRA

SEQ ID NO: 1153289 - protein, 9 aa, Homo Sapiens
IDIFCSSSM

SEQ ID NO: 1153290 - protein, 9 aa, Homo Sapiens
CSSKKWRLP

SEQ ID NO: 1153291 - protein, 9 aa, Homo Sapiens
LMAPLSPGA

SEQ ID NO: 1153292 - protein, 9 aa, Homo Sapiens
KMKGRKDRW

SEQ ID NO: 1153293 - protein, 9 aa, Homo Sapiens
PQAPSQVWT

SEQ ID NO: 1153294 - protein, 9 aa, Homo Sapiens
EPELSLAGV

SEQ ID NO: 1153295 - protein, 9 aa, Homo Sapiens
GTVAGATAQ

SEQ ID NO: 1153296 - protein, 9 aa, Homo Sapiens
ASLLSTLSQ

SEQ ID NO: 1153297 - protein, 9 aa, Homo Sapiens
MAVATRRYP

SEQ ID NO: 1153298 - protein, 9 aa, Homo Sapiens
VAGATAQIQ

SEQ ID NO: 1153299 - protein, 9 aa, Homo Sapiens
LLYNSTMSS

SEQ ID NO: 1153300 - protein, 9 aa, Homo Sapiens
QRGKVEIIA

SEQ ID NO: 1153301 - protein, 9 aa, Homo Sapiens
RARAPGVAE

SEQ ID NO: 1153302 - protein, 9 aa, Homo Sapiens
AATQAIPPR

SEQ ID NO: 1153303 - protein, 9 aa, Homo Sapiens
RRPPGGGAL

SEQ ID NO: 1153304 - protein, 9 aa, Homo Sapiens
GGKGHIGVV

SEQ ID NO: 1153305 - protein, 9 aa, Homo Sapiens
PPLPRPACW

SEQ ID NO: 1153306 - protein, 9 aa, Homo Sapiens
FGFLCNVCN

SEQ ID NO: 1153307 - protein, 9 aa, Homo Sapiens
FVIKKKANL

SEQ ID NO: 1153308 - protein, 9 aa, Homo Sapiens
VITREEAEW

SEQ ID NO: 1153309 - protein, 9 aa, Homo Sapiens
PQQHVLGAQ

SEQ ID NO: 1153310 - protein, 9 aa, Homo Sapiens
PSPWENPAG

SEQ ID NO: 1153311 - protein, 9 aa, Homo Sapiens
ATRTGCRWP

SEQ ID NO: 1153312 - protein, 9 aa, Homo Sapiens
KDALQKREV

SEQ ID NO: 1153313 - protein, 9 aa, Homo Sapiens
QVSVGLQGK

SEQ ID NO: 1153314 - protein, 9 aa, Homo Sapiens
AALLMEGFL

SEQ ID NO: 1153315 - protein, 9 aa, Homo Sapiens
KEEVVCLLF

SEQ ID NO: 1153316 - protein, 9 aa, Homo Sapiens
RPAPEEAHQ

SEQ ID NO: 1153317 - protein, 9 aa, Homo Sapiens
AHSNPIFRP

SEQ ID NO: 1153318 - protein, 9 aa, Homo Sapiens
KRFLTLASA

SEQ ID NO: 1153319 - protein, 9 aa, Homo Sapiens
ELPIIQDVM

SEQ ID NO: 1153320 - protein, 9 aa, Homo Sapiens
PHNMVHPNV

SEQ ID NO: 1153321 - protein, 9 aa, Homo Sapiens
GCGHGAKRV

SEQ ID NO: 1153322 - protein, 9 aa, Homo Sapiens
PAHLLETLL

SEQ ID NO: 1153323 - protein, 9 aa, Homo Sapiens
SQTVNLAGR

SEQ ID NO: 1153324 - protein, 9 aa, Homo Sapiens
AEPTVSFTN

SEQ ID NO: 1153325 - protein, 9 aa, Homo Sapiens
GFVRRPTVV

SEQ ID NO: 1153326 - protein, 9 aa, Homo Sapiens
PEEAHQEKH

SEQ ID NO: 1153327 - protein, 9 aa, Homo Sapiens
PRPTPARTP

SEQ ID NO: 1153328 - protein, 9 aa, Homo Sapiens
GGAKKRKKS

SEQ ID NO: 1153329 - protein, 9 aa, Homo Sapiens
YLLLDNAED

SEQ ID NO: 1153330 - protein, 9 aa, Homo Sapiens
GPPVLLAGE

SEQ ID NO: 1153331 - protein, 9 aa, Homo Sapiens
PATPHTLLP

SEQ ID NO: 1153332 - protein, 9 aa, Homo Sapiens
IAVLYLKKT

SEQ ID NO: 1153333 - protein, 9 aa, Homo Sapiens
QGPRRRPAA

SEQ ID NO: 1153334 - protein, 9 aa, Homo Sapiens
VKDAWMQKY

SEQ ID NO: 1153335 - protein, 9 aa, Homo Sapiens
SLSQLRELC

SEQ ID NO: 1153336 - protein, 9 aa, Homo Sapiens
NMKGPEGRR

SEQ ID NO: 1153337 - protein, 9 aa, Homo Sapiens
MYIQPTSDH

SEQ ID NO: 1153338 - protein, 9 aa, Homo Sapiens
CTPPGSCGF

SEQ ID NO: 1153339 - protein, 9 aa, Homo Sapiens
PAPEEAHQE

SEQ ID NO: 1153340 - protein, 9 aa, Homo Sapiens
NHSQSLVLV

SEQ ID NO: 1153341 - protein, 9 aa, Homo Sapiens
LLCQPCSQL

SEQ ID NO: 1153342 - protein, 9 aa, Homo Sapiens
KFIKIATHC

SEQ ID NO: 1153343 - protein, 9 aa, Homo Sapiens
GSPTRMAGR

SEQ ID NO: 1153344 - protein, 9 aa, Homo Sapiens
MQNQPTLFI

SEQ ID NO: 1153345 - protein, 9 aa, Homo Sapiens
HQLHASPRR

SEQ ID NO: 1153346 - protein, 9 aa, Homo Sapiens
PHVPHDLVL

SEQ ID NO: 1153347 - protein, 9 aa, Homo Sapiens
LSSIPGGPI

SEQ ID NO: 1153348 - protein, 9 aa, Homo Sapiens
RAGEIKGST

SEQ ID NO: 1153349 - protein, 9 aa, Homo Sapiens
ITSNIRENV

SEQ ID NO: 1153350 - protein, 9 aa, Homo Sapiens
GGGKATGVS

SEQ ID NO: 1153351 - protein, 9 aa, Homo Sapiens
LVSCSSVEL

SEQ ID NO: 1153352 - protein, 9 aa, Homo Sapiens
NGCLRQELL

SEQ ID NO: 1153353 - protein, 9 aa, Homo Sapiens
SSVFGVMQL

SEQ ID NO: 1153354 - protein, 9 aa, Homo Sapiens
LGQYLAPLP

SEQ ID NO: 1153355 - protein, 9 aa, Homo Sapiens
ALPQPCRCH

SEQ ID NO: 1153356 - protein, 9 aa, Homo Sapiens
MCCTSYRVH

SEQ ID NO: 1153357 - protein, 9 aa, Homo Sapiens
QKREVTDKR

SEQ ID NO: 1153358 - protein, 9 aa, Homo Sapiens
QFLVRVRIP

SEQ ID NO: 1153359 - protein, 9 aa, Homo Sapiens
KGIPPSLWG

SEQ ID NO: 1153360 - protein, 9 aa, Homo Sapiens
RSAAGDGSS

SEQ ID NO: 1153361 - protein, 9 aa, Homo Sapiens
DSENFTDSL

SEQ ID NO: 1153362 - protein, 9 aa, Homo Sapiens
SLASGLEAN

SEQ ID NO: 1153363 - protein, 9 aa, Homo Sapiens
FRGSFATSP

SEQ ID NO: 1153364 - protein, 9 aa, Homo Sapiens
LGSFLLAGI

SEQ ID NO: 1153365 - protein, 9 aa, Homo Sapiens
GLLDWKMVN

SEQ ID NO: 1153366 - protein, 9 aa, Homo Sapiens
GRERRVKLP

SEQ ID NO: 1153367 - protein, 9 aa, Homo Sapiens
PFPSKSYSP

SEQ ID NO: 1153368 - protein, 9 aa, Homo Sapiens
RPAAVSVHL

SEQ ID NO: 1153369 - protein, 9 aa, Homo Sapiens
VGAGTGGGP

SEQ ID NO: 1153370 - protein, 9 aa, Homo Sapiens
AGNAEETLE

SEQ ID NO: 1153371 - protein, 9 aa, Homo Sapiens
LHTPMHFFL

SEQ ID NO: 1153372 - protein, 9 aa, Homo Sapiens
VEVKDSAKH

SEQ ID NO: 1153373 - protein, 9 aa, Homo Sapiens
QRIVHRDLA

SEQ ID NO: 1153374 - protein, 9 aa, Homo Sapiens
SQVWTAATL

SEQ ID NO: 1153375 - protein, 9 aa, Homo Sapiens
QWRDPTQTY

SEQ ID NO: 1153376 - protein, 9 aa, Homo Sapiens
ELEELCAVV

SEQ ID NO: 1153377 - protein, 9 aa, Homo Sapiens
ERSFRGSGP

SEQ ID NO: 1153378 - protein, 9 aa, Homo Sapiens
ITKLYGEIA

SEQ ID NO: 1153379 - protein, 9 aa, Homo Sapiens
RAFTTISTH

SEQ ID NO: 1153380 - protein, 9 aa, Homo Sapiens
YIDITWRWN

SEQ ID NO: 1153381 - protein, 9 aa, Homo Sapiens
VKCWVLLCD

SEQ ID NO: 1153382 - protein, 9 aa, Homo Sapiens
EALERWPAH

SEQ ID NO: 1153383 - protein, 9 aa, Homo Sapiens
GVGVGDMAS

SEQ ID NO: 1153384 - protein, 9 aa, Homo Sapiens
SQIKQTSLA

SEQ ID NO: 1153385 - protein, 9 aa, Homo Sapiens
SLDAQRESG

SEQ ID NO: 1153386 - protein, 9 aa, Homo Sapiens
VAHHAAPRV

SEQ ID NO: 1153387 - protein, 9 aa, Homo Sapiens
EQLLLLVLQ

SEQ ID NO: 1153388 - protein, 9 aa, Homo Sapiens
NTLWQARVE

SEQ ID NO: 1153389 - protein, 9 aa, Homo Sapiens
SHKGRTCEM

SEQ ID NO: 1153390 - protein, 9 aa, Homo Sapiens
LQVEQHMPV

SEQ ID NO: 1153391 - protein, 9 aa, Homo Sapiens
AAPRGLGEP

SEQ ID NO: 1153392 - protein, 9 aa, Homo Sapiens
CTMINSNDD

SEQ ID NO: 1153393 - protein, 9 aa, Homo Sapiens
GDWLAPVAW

SEQ ID NO: 1153394 - protein, 9 aa, Homo Sapiens
GLLSILSFL

SEQ ID NO: 1153395 - protein, 9 aa, Homo Sapiens
SVGKAMHTP

SEQ ID NO: 1153396 - protein, 9 aa, Homo Sapiens
ASAATTCAP

SEQ ID NO: 1153397 - protein, 9 aa, Homo Sapiens
DRGLQALGS

SEQ ID NO: 1153398 - protein, 9 aa, Homo Sapiens
SIAAALKRH

SEQ ID NO: 1153399 - protein, 9 aa, Homo Sapiens
KKMDLDGML

SEQ ID NO: 1153400 - protein, 9 aa, Homo Sapiens
NKDQHSISH

SEQ ID NO: 1153401 - protein, 9 aa, Homo Sapiens
WAGAGPGAP

SEQ ID NO: 1153402 - protein, 9 aa, Homo Sapiens
RHLSGGVPP

SEQ ID NO: 1153403 - protein, 9 aa, Homo Sapiens
STCCSMGQT

SEQ ID NO: 1153404 - protein, 9 aa, Homo Sapiens
PICWCPFFI

SEQ ID NO: 1153405 - protein, 9 aa, Homo Sapiens
PHSQYPQYY

SEQ ID NO: 1153406 - protein, 9 aa, Homo Sapiens
VLLAGERVG

SEQ ID NO: 1153407 - protein, 9 aa, Homo Sapiens
EIPLYLSHH

SEQ ID NO: 1153408 - protein, 9 aa, Homo Sapiens
DLEHELLEL

SEQ ID NO: 1153409 - protein, 9 aa, Homo Sapiens
GRVKPGGAG

SEQ ID NO: 1153410 - protein, 9 aa, Homo Sapiens
HYSLLKWNS

SEQ ID NO: 1153411 - protein, 9 aa, Homo Sapiens
HEIWWGQMS

SEQ ID NO: 1153412 - protein, 9 aa, Homo Sapiens
GNEAANFDM

SEQ ID NO: 1153413 - protein, 9 aa, Homo Sapiens
KLHGIEIPG

SEQ ID NO: 1153414 - protein, 9 aa, Homo Sapiens
IQIGQEMVI

SEQ ID NO: 1153415 - protein, 9 aa, Homo Sapiens
HLPRRIYLR

SEQ ID NO: 1153416 - protein, 9 aa, Homo Sapiens
VENQVHGIY

SEQ ID NO: 1153417 - protein, 9 aa, Homo Sapiens
DMFLKLNDI

SEQ ID NO: 1153418 - protein, 9 aa, Homo Sapiens
GLSEDQVLH

SEQ ID NO: 1153419 - protein, 9 aa, Homo Sapiens
LTHMIHILD

SEQ ID NO: 1153420 - protein, 9 aa, Homo Sapiens
REHAENLLG

SEQ ID NO: 1153421 - protein, 9 aa, Homo Sapiens
ARPPGNSAT

SEQ ID NO: 1153422 - protein, 9 aa, Homo Sapiens
SASTSLSEK

SEQ ID NO: 1153423 - protein, 9 aa, Homo Sapiens
GVSKDGMLS

SEQ ID NO: 1153424 - protein, 9 aa, Homo Sapiens
IFLMKRFLT

SEQ ID NO: 1153425 - protein, 9 aa, Homo Sapiens
RGTQPCTSV

SEQ ID NO: 1153426 - protein, 9 aa, Homo Sapiens
VDGHVQQRQ

SEQ ID NO: 1153427 - protein, 9 aa, Homo Sapiens
AQAVDRETS

SEQ ID NO: 1153428 - protein, 9 aa, Homo Sapiens
RRAVLVSCS

SEQ ID NO: 1153429 - protein, 9 aa, Homo Sapiens
GSSHLPTLA

SEQ ID NO: 1153430 - protein, 9 aa, Homo Sapiens
HELLDVVLR

SEQ ID NO: 1153431 - protein, 9 aa, Homo Sapiens
VGGQVGHGV

SEQ ID NO: 1153432 - protein, 9 aa, Homo Sapiens
WDTKPSVMQ

SEQ ID NO: 1153433 - protein, 9 aa, Homo Sapiens
QTAAIRYYQ

SEQ ID NO: 1153434 - protein, 9 aa, Homo Sapiens
GPRAPVRAW

SEQ ID NO: 1153435 - protein, 9 aa, Homo Sapiens
LPLRAINLN

SEQ ID NO: 1153436 - protein, 9 aa, Homo Sapiens
AQGIAGPGH

SEQ ID NO: 1153437 - protein, 9 aa, Homo Sapiens
SIWPNLSCK

SEQ ID NO: 1153438 - protein, 9 aa, Homo Sapiens
KLISLFWKA

SEQ ID NO: 1153439 - protein, 9 aa, Homo Sapiens
CHKKTSQLD

SEQ ID NO: 1153440 - protein, 9 aa, Homo Sapiens
YCSLSFPGS

SEQ ID NO: 1153441 - protein, 9 aa, Homo Sapiens
GGGGGGSGD

SEQ ID NO: 1153442 - protein, 9 aa, Homo Sapiens
DLGSRSRPH

SEQ ID NO: 1153443 - protein, 9 aa, Homo Sapiens
IWWGQMSKP

SEQ ID NO: 1153444 - protein, 9 aa, Homo Sapiens
STMAAAASG

SEQ ID NO: 1153445 - protein, 9 aa, Homo Sapiens
CSYTGACTH

SEQ ID NO: 1153446 - protein, 9 aa, Homo Sapiens
LSKVQNEFK

SEQ ID NO: 1153447 - protein, 9 aa, Homo Sapiens
DQELIKVHR

SEQ ID NO: 1153448 - protein, 9 aa, Homo Sapiens
LVTKHVPGE

SEQ ID NO: 1153449 - protein, 9 aa, Homo Sapiens
REHIHAKGS

SEQ ID NO: 1153450 - protein, 9 aa, Homo Sapiens
KVGGASGRK

SEQ ID NO: 1153451 - protein, 9 aa, Homo Sapiens
RETKLINDR

SEQ ID NO: 1153452 - protein, 9 aa, Homo Sapiens
WQSLETKLR

SEQ ID NO: 1153453 - protein, 9 aa, Homo Sapiens
QSLHHPPCS

SEQ ID NO: 1153454 - protein, 9 aa, Homo Sapiens
IHIGCTQTM

SEQ ID NO: 1153455 - protein, 9 aa, Homo Sapiens
QELTGCSVE

SEQ ID NO: 1153456 - protein, 9 aa, Homo Sapiens
SFRGSGPGR

SEQ ID NO: 1153457 - protein, 9 aa, Homo Sapiens
PVRHHTAGL

SEQ ID NO: 1153458 - protein, 9 aa, Homo Sapiens
GGSGHPTGP

SEQ ID NO: 1153459 - protein, 9 aa, Homo Sapiens
IVSSSKGGR

SEQ ID NO: 1153460 - protein, 9 aa, Homo Sapiens
KDKKRTDSV

SEQ ID NO: 1153461 - protein, 9 aa, Homo Sapiens
CPQQHVLGA

SEQ ID NO: 1153462 - protein, 9 aa, Homo Sapiens
VLPSALEQL

SEQ ID NO: 1153463 - protein, 9 aa, Homo Sapiens
LAVLWVAKS

SEQ ID NO: 1153464 - protein, 9 aa, Homo Sapiens
GQRVFLCPG

SEQ ID NO: 1153465 - protein, 9 aa, Homo Sapiens
PHCLGQLGL

SEQ ID NO: 1153466 - protein, 9 aa, Homo Sapiens
DDQDGAEPG

SEQ ID NO: 1153467 - protein, 9 aa, Homo Sapiens
LARARVPCA

SEQ ID NO: 1153468 - protein, 9 aa, Homo Sapiens
PLPTASGLK

SEQ ID NO: 1153469 - protein, 9 aa, Homo Sapiens
SWLETAVHE

SEQ ID NO: 1153470 - protein, 9 aa, Homo Sapiens
STSLSEKTT

SEQ ID NO: 1153471 - protein, 9 aa, Homo Sapiens
AATCSRPTW

SEQ ID NO: 1153472 - protein, 9 aa, Homo Sapiens
LLLFQTLLN

SEQ ID NO: 1153473 - protein, 9 aa, Homo Sapiens
VRCLGTKTR

SEQ ID NO: 1153474 - protein, 9 aa, Homo Sapiens
TPMHVVTCL

SEQ ID NO: 1153475 - protein, 9 aa, Homo Sapiens
SRSSPPWQA

SEQ ID NO: 1153476 - protein, 9 aa, Homo Sapiens
CNKHSFSDQ

SEQ ID NO: 1153477 - protein, 9 aa, Homo Sapiens
WQGAPVRSP

SEQ ID NO: 1153478 - protein, 9 aa, Homo Sapiens
QVLDVVYYL

SEQ ID NO: 1153479 - protein, 9 aa, Homo Sapiens
EAIGELYGV

SEQ ID NO: 1153480 - protein, 9 aa, Homo Sapiens
VLPKNTLMQ

SEQ ID NO: 1153481 - protein, 9 aa, Homo Sapiens
TVSPEGSGK

SEQ ID NO: 1153482 - protein, 9 aa, Homo Sapiens
VHSHKKKIR

SEQ ID NO: 1153483 - protein, 9 aa, Homo Sapiens
ELPSQQRKR

SEQ ID NO: 1153484 - protein, 9 aa, Homo Sapiens
TSIFRRLQS

SEQ ID NO: 1153485 - protein, 9 aa, Homo Sapiens
RGIGPLTRD

SEQ ID NO: 1153486 - protein, 9 aa, Homo Sapiens
SPGPWPSPG

SEQ ID NO: 1153487 - protein, 9 aa, Homo Sapiens
ENSDGMYRY

SEQ ID NO: 1153488 - protein, 9 aa, Homo Sapiens
YQMLHKVDK

SEQ ID NO: 1153489 - protein, 9 aa, Homo Sapiens
QGLLACGVV

SEQ ID NO: 1153490 - protein, 9 aa, Homo Sapiens
SPSASQTPM

SEQ ID NO: 1153491 - protein, 9 aa, Homo Sapiens
APRPAGTAA

SEQ ID NO: 1153492 - protein, 9 aa, Homo Sapiens
SDEVAWLKM

SEQ ID NO: 1153493 - protein, 9 aa, Homo Sapiens
KVHRAAAVL

SEQ ID NO: 1153494 - protein, 9 aa, Homo Sapiens
AALVDLAGE

SEQ ID NO: 1153495 - protein, 9 aa, Homo Sapiens
VSRAFRDGE

SEQ ID NO: 1153496 - protein, 9 aa, Homo Sapiens
PAPSQLPAS

SEQ ID NO: 1153497 - protein, 9 aa, Homo Sapiens
WWCCSGWYC

SEQ ID NO: 1153498 - protein, 9 aa, Homo Sapiens
GPPAHARLA

SEQ ID NO: 1153499 - protein, 9 aa, Homo Sapiens
AFHIKSIAA

SEQ ID NO: 1153500 - protein, 9 aa, Homo Sapiens
TMSCLSRPG

SEQ ID NO: 1153501 - protein, 9 aa, Homo Sapiens
SASVRMVAL

SEQ ID NO: 1153502 - protein, 9 aa, Homo Sapiens
KATGVSGLN

SEQ ID NO: 1153503 - protein, 9 aa, Homo Sapiens
SSKNPEKLQ

SEQ ID NO: 1153504 - protein, 9 aa, Homo Sapiens
LASGLEAND

SEQ ID NO: 1153505 - protein, 9 aa, Homo Sapiens
KELPGKPWT

SEQ ID NO: 1153506 - protein, 9 aa, Homo Sapiens
IGAMETRSE

SEQ ID NO: 1153507 - protein, 9 aa, Homo Sapiens
LFTLIPLLL

SEQ ID NO: 1153508 - protein, 9 aa, Homo Sapiens
QLGLVVIVP

SEQ ID NO: 1153509 - protein, 9 aa, Homo Sapiens
GCSRSSPPW

SEQ ID NO: 1153510 - protein, 9 aa, Homo Sapiens
PRLLSLWFL

SEQ ID NO: 1153511 - protein, 9 aa, Homo Sapiens
IGDTSIDTF

SEQ ID NO: 1153512 - protein, 9 aa, Homo Sapiens
RPKSPGPPA

SEQ ID NO: 1153513 - protein, 9 aa, Homo Sapiens
VLVCWRGCN

SEQ ID NO: 1153514 - protein, 9 aa, Homo Sapiens
GSFLLAGIL

SEQ ID NO: 1153515 - protein, 9 aa, Homo Sapiens
PAVNRPAER

SEQ ID NO: 1153516 - protein, 9 aa, Homo Sapiens
NNLMPPGKN

SEQ ID NO: 1153517 - protein, 9 aa, Homo Sapiens
CAQTGETVQ

SEQ ID NO: 1153518 - protein, 9 aa, Homo Sapiens
LLRHRERSA

SEQ ID NO: 1153519 - protein, 9 aa, Homo Sapiens
DMMPSTTSP

SEQ ID NO: 1153520 - protein, 9 aa, Homo Sapiens
GRPILLSPV

SEQ ID NO: 1153521 - protein, 9 aa, Homo Sapiens
PPHPPRPAR

SEQ ID NO: 1153522 - protein, 9 aa, Homo Sapiens
SGGSCDTSL

SEQ ID NO: 1153523 - protein, 9 aa, Homo Sapiens
VAEASTGAW

SEQ ID NO: 1153524 - protein, 9 aa, Homo Sapiens
FYSVVGRNG

SEQ ID NO: 1153525 - protein, 9 aa, Homo Sapiens
MIVIIKDIF

SEQ ID NO: 1153526 - protein, 9 aa, Homo Sapiens
LFHCILGPG

SEQ ID NO: 1153527 - protein, 9 aa, Homo Sapiens
EVTTYNRDS

SEQ ID NO: 1153528 - protein, 9 aa, Homo Sapiens
DTLCAGPVF

SEQ ID NO: 1153529 - protein, 9 aa, Homo Sapiens
KNTLMQLNE

SEQ ID NO: 1153530 - protein, 9 aa, Homo Sapiens
RHIIQGSEA

SEQ ID NO: 1153531 - protein, 9 aa, Homo Sapiens
SGWLELSSL

SEQ ID NO: 1153532 - protein, 9 aa, Homo Sapiens
PSLPGPCAS

SEQ ID NO: 1153533 - protein, 9 aa, Homo Sapiens
AWKHSPLLR

SEQ ID NO: 1153534 - protein, 9 aa, Homo Sapiens
SGPVLGCLL

SEQ ID NO: 1153535 - protein, 9 aa, Homo Sapiens
AELRHVEEE

SEQ ID NO: 1153536 - protein, 9 aa, Homo Sapiens
LGGGGKATG

SEQ ID NO: 1153537 - protein, 9 aa, Homo Sapiens
THLHGYALW

SEQ ID NO: 1153538 - protein, 9 aa, Homo Sapiens
VTITLYGKS

SEQ ID NO: 1153539 - protein, 9 aa, Homo Sapiens
DESILGVVG

SEQ ID NO: 1153540 - protein, 9 aa, Homo Sapiens
DKKRKAFDT

SEQ ID NO: 1153541 - protein, 9 aa, Homo Sapiens
LAPAVNRPA

SEQ ID NO: 1153542 - protein, 9 aa, Homo Sapiens
CTHPSPHLY

SEQ ID NO: 1153543 - protein, 9 aa, Homo Sapiens
ELYGVSHEP

SEQ ID NO: 1153544 - protein, 9 aa, Homo Sapiens
VVLHAPNHH

SEQ ID NO: 1153545 - protein, 9 aa, Homo Sapiens
LAQHPHHLA

SEQ ID NO: 1153546 - protein, 9 aa, Homo Sapiens
LRRYRLRAV

SEQ ID NO: 1153547 - protein, 9 aa, Homo Sapiens
ASHVDLPLS

SEQ ID NO: 1153548 - protein, 9 aa, Homo Sapiens
EGSEELDMV

SEQ ID NO: 1153549 - protein, 9 aa, Homo Sapiens
FIALVATNP

SEQ ID NO: 1153550 - protein, 9 aa, Homo Sapiens
GPGAPAHGE

SEQ ID NO: 1153551 - protein, 9 aa, Homo Sapiens
KLAKKTETV

SEQ ID NO: 1153552 - protein, 9 aa, Homo Sapiens
VRSQTGSPR

SEQ ID NO: 1153553 - protein, 9 aa, Homo Sapiens
TCTHRHYER

SEQ ID NO: 1153554 - protein, 9 aa, Homo Sapiens
NIHRFMAQF

SEQ ID NO: 1153555 - protein, 9 aa, Homo Sapiens
RPGGFFTRY

SEQ ID NO: 1153556 - protein, 9 aa, Homo Sapiens
KPVLGPHPS

SEQ ID NO: 1153557 - protein, 9 aa, Homo Sapiens
RWAMVTTWQ

SEQ ID NO: 1153558 - protein, 9 aa, Homo Sapiens
EEPNDTITE

SEQ ID NO: 1153559 - protein, 9 aa, Homo Sapiens
TTSIQSRIC

SEQ ID NO: 1153560 - protein, 9 aa, Homo Sapiens
TLNYASRGQ

SEQ ID NO: 1153561 - protein, 9 aa, Homo Sapiens
DFNLPLNRG

SEQ ID NO: 1153562 - protein, 9 aa, Homo Sapiens
HRHYERLVL

SEQ ID NO: 1153563 - protein, 9 aa, Homo Sapiens
RLTDGKRKT

SEQ ID NO: 1153564 - protein, 9 aa, Homo Sapiens
KNIPGIRGA

SEQ ID NO: 1153565 - protein, 9 aa, Homo Sapiens
HSASEHTDI

SEQ ID NO: 1153566 - protein, 9 aa, Homo Sapiens
PRLRATRTG

SEQ ID NO: 1153567 - protein, 9 aa, Homo Sapiens
TIKLWGLET

SEQ ID NO: 1153568 - protein, 9 aa, Homo Sapiens
HHFQGKENS

SEQ ID NO: 1153569 - protein, 9 aa, Homo Sapiens
RECSSLCPY

SEQ ID NO: 1153570 - protein, 9 aa, Homo Sapiens
GDIHFGNIQ

SEQ ID NO: 1153571 - protein, 9 aa, Homo Sapiens
NYNSLFIYV

SEQ ID NO: 1153572 - protein, 9 aa, Homo Sapiens
LGLLSILSF

SEQ ID NO: 1153573 - protein, 9 aa, Homo Sapiens
EKLQIEKEH

SEQ ID NO: 1153574 - protein, 9 aa, Homo Sapiens
DHWKDWYLP

SEQ ID NO: 1153575 - protein, 9 aa, Homo Sapiens
DLRRPQWTQ

SEQ ID NO: 1153576 - protein, 9 aa, Homo Sapiens
LGPPPPHQA

SEQ ID NO: 1153577 - protein, 9 aa, Homo Sapiens
ISLESIFRN

SEQ ID NO: 1153578 - protein, 9 aa, Homo Sapiens
KEHLQVEKD

SEQ ID NO: 1153579 - protein, 9 aa, Homo Sapiens
CAQNSELST

SEQ ID NO: 1153580 - protein, 9 aa, Homo Sapiens
VVRFYAAAM

SEQ ID NO: 1153581 - protein, 9 aa, Homo Sapiens
HLKPSGEQI

SEQ ID NO: 1153582 - protein, 9 aa, Homo Sapiens
PRYWTYGIT

SEQ ID NO: 1153583 - protein, 9 aa, Homo Sapiens
EQFKIPEGG

SEQ ID NO: 1153584 - protein, 9 aa, Homo Sapiens
RPTPARTPT

SEQ ID NO: 1153585 - protein, 9 aa, Homo Sapiens
RWRTRCWAC

SEQ ID NO: 1153586 - protein, 9 aa, Homo Sapiens
SQSRSPVPK

SEQ ID NO: 1153587 - protein, 9 aa, Homo Sapiens
FDIRVPFLF

SEQ ID NO: 1153588 - protein, 9 aa, Homo Sapiens
VSVQYFLID

SEQ ID NO: 1153589 - protein, 9 aa, Homo Sapiens
CSIWSTCCS

SEQ ID NO: 1153590 - protein, 9 aa, Homo Sapiens
RPHSGSGSH

SEQ ID NO: 1153591 - protein, 9 aa, Homo Sapiens
NPICDMRFC

SEQ ID NO: 1153592 - protein, 9 aa, Homo Sapiens
VSVIQAFLG

SEQ ID NO: 1153593 - protein, 9 aa, Homo Sapiens
VGDMASAGP

SEQ ID NO: 1153594 - protein, 9 aa, Homo Sapiens
HPPRPARPA

SEQ ID NO: 1153595 - protein, 9 aa, Homo Sapiens
QPWIAPPCP

SEQ ID NO: 1153596 - protein, 9 aa, Homo Sapiens
QQEGSNPQG

SEQ ID NO: 1153597 - protein, 9 aa, Homo Sapiens
GPQKGDPRE

SEQ ID NO: 1153598 - protein, 9 aa, Homo Sapiens
APLEGMLLP

SEQ ID NO: 1153599 - protein, 9 aa, Homo Sapiens
GQVPARRGL

SEQ ID NO: 1153600 - protein, 9 aa, Homo Sapiens
GFYSSVFGV

SEQ ID NO: 1153601 - protein, 9 aa, Homo Sapiens
CKDSERYAQ

SEQ ID NO: 1153602 - protein, 9 aa, Homo Sapiens
GGCPLSLWK

SEQ ID NO: 1153603 - protein, 9 aa, Homo Sapiens
GERVLHSLN

SEQ ID NO: 1153604 - protein, 9 aa, Homo Sapiens
APERITPEL

SEQ ID NO: 1153605 - protein, 9 aa, Homo Sapiens
HHPKYNRDT

SEQ ID NO: 1153606 - protein, 9 aa, Homo Sapiens
SNSVSTCLM

SEQ ID NO: 1153607 - protein, 9 aa, Homo Sapiens
GLLPRRRRR

SEQ ID NO: 1153608 - protein, 9 aa, Homo Sapiens
DHVSMHRSP

SEQ ID NO: 1153609 - protein, 9 aa, Homo Sapiens
MGRRPRPRR

SEQ ID NO: 1153610 - protein, 9 aa, Homo Sapiens
ALVATNPIC

SEQ ID NO: 1153611 - protein, 9 aa, Homo Sapiens
RKVPDVLPS

SEQ ID NO: 1153612 - protein, 9 aa, Homo Sapiens
NQEMFADTS

SEQ ID NO: 1153613 - protein, 9 aa, Homo Sapiens
SRLSLSQAF

SEQ ID NO: 1153614 - protein, 9 aa, Homo Sapiens
RGLLGAHVQ

SEQ ID NO: 1153615 - protein, 9 aa, Homo Sapiens
WNEDQQLGD

SEQ ID NO: 1153616 - protein, 9 aa, Homo Sapiens
QDGWKLHIG

SEQ ID NO: 1153617 - protein, 9 aa, Homo Sapiens
FPEGWDKRC

SEQ ID NO: 1153618 - protein, 9 aa, Homo Sapiens
ATACCPSRN

SEQ ID NO: 1153619 - protein, 9 aa, Homo Sapiens
TGLVAIQLH

SEQ ID NO: 1153620 - protein, 9 aa, Homo Sapiens
HDDPESEIK

SEQ ID NO: 1153621 - protein, 9 aa, Homo Sapiens
AIRSKPLCK

SEQ ID NO: 1153622 - protein, 9 aa, Homo Sapiens
VTKHVPGEF

SEQ ID NO: 1153623 - protein, 9 aa, Homo Sapiens
EPQPPRAAR

SEQ ID NO: 1153624 - protein, 9 aa, Homo Sapiens
EATELIKHE

SEQ ID NO: 1153625 - protein, 9 aa, Homo Sapiens
LRPILRRQR

SEQ ID NO: 1153626 - protein, 9 aa, Homo Sapiens
NDILVIKNI

SEQ ID NO: 1153627 - protein, 9 aa, Homo Sapiens
DVPEKREKQ

SEQ ID NO: 1153628 - protein, 9 aa, Homo Sapiens
LPFDNMHDD

SEQ ID NO: 1153629 - protein, 9 aa, Homo Sapiens
KITRHDDPE

SEQ ID NO: 1153630 - protein, 9 aa, Homo Sapiens
QGPATPHTL

SEQ ID NO: 1153631 - protein, 9 aa, Homo Sapiens
CTCRPPQFG

SEQ ID NO: 1153632 - protein, 9 aa, Homo Sapiens
KLIGDTSID

SEQ ID NO: 1153633 - protein, 9 aa, Homo Sapiens
PRPAGTAAR

SEQ ID NO: 1153634 - protein, 9 aa, Homo Sapiens
THMIHILDT

SEQ ID NO: 1153635 - protein, 9 aa, Homo Sapiens
LPKPAVAWL

SEQ ID NO: 1153636 - protein, 9 aa, Homo Sapiens
KSPWEQKGG

SEQ ID NO: 1153637 - protein, 9 aa, Homo Sapiens
SDVGLLEGS

SEQ ID NO: 1153638 - protein, 9 aa, Homo Sapiens
RRSAAQTGQ

SEQ ID NO: 1153639 - protein, 9 aa, Homo Sapiens
AEQQLWKKA

SEQ ID NO: 1153640 - protein, 9 aa, Homo Sapiens
PPRDANLPK

SEQ ID NO: 1153641 - protein, 9 aa, Homo Sapiens
ESRNMIYMS

SEQ ID NO: 1153642 - protein, 9 aa, Homo Sapiens
FRYKTQAGD

SEQ ID NO: 1153643 - protein, 9 aa, Homo Sapiens
AGSPPGTRP

SEQ ID NO: 1153644 - protein, 9 aa, Homo Sapiens
HYTRFIRQH

SEQ ID NO: 1153645 - protein, 9 aa, Homo Sapiens
KKPLRKVRR

SEQ ID NO: 1153646 - protein, 9 aa, Homo Sapiens
NTFARNTSR

SEQ ID NO: 1153647 - protein, 9 aa, Homo Sapiens
LLLLFQTLL

SEQ ID NO: 1153648 - protein, 9 aa, Homo Sapiens
ALPLGRPRI

SEQ ID NO: 1153649 - protein, 9 aa, Homo Sapiens
MENSHPPTT

SEQ ID NO: 1153650 - protein, 9 aa, Homo Sapiens
PARPDQSRP

SEQ ID NO: 1153651 - protein, 9 aa, Homo Sapiens
APSQTLEAW

SEQ ID NO: 1153652 - protein, 9 aa, Homo Sapiens
LDWHVVNQQ

SEQ ID NO: 1153653 - protein, 9 aa, Homo Sapiens
EIPGRTDYE

SEQ ID NO: 1153654 - protein, 9 aa, Homo Sapiens
FFMCCTSYR

SEQ ID NO: 1153655 - protein, 9 aa, Homo Sapiens
LPQGRAPLE

SEQ ID NO: 1153656 - protein, 9 aa, Homo Sapiens
EYFTSLTKY

SEQ ID NO: 1153657 - protein, 9 aa, Homo Sapiens
IHASSGPCP

SEQ ID NO: 1153658 - protein, 9 aa, Homo Sapiens
MLGDDGSLL

SEQ ID NO: 1153659 - protein, 9 aa, Homo Sapiens
LGPRAGGSR

SEQ ID NO: 1153660 - protein, 9 aa, Homo Sapiens
LLYDWSWMV

SEQ ID NO: 1153661 - protein, 9 aa, Homo Sapiens
FLVLKREFT

SEQ ID NO: 1153662 - protein, 9 aa, Homo Sapiens
ARLAENDSS

SEQ ID NO: 1153663 - protein, 9 aa, Homo Sapiens
YDTQVKEIH

SEQ ID NO: 1153664 - protein, 9 aa, Homo Sapiens
PHPLLPFQY

SEQ ID NO: 1153665 - protein, 9 aa, Homo Sapiens
LQPLRRSLP

SEQ ID NO: 1153666 - protein, 9 aa, Homo Sapiens
YSIGLALSA

SEQ ID NO: 1153667 - protein, 9 aa, Homo Sapiens
AHTSRSVLS

SEQ ID NO: 1153668 - protein, 9 aa, Homo Sapiens
RRAHERPHP

SEQ ID NO: 1153669 - protein, 9 aa, Homo Sapiens
NEMVDYSNT

SEQ ID NO: 1153670 - protein, 9 aa, Homo Sapiens
KKDYNEVYN

SEQ ID NO: 1153671 - protein, 9 aa, Homo Sapiens
FSRCHTTGW

SEQ ID NO: 1153672 - protein, 9 aa, Homo Sapiens
PGLATQRRP

SEQ ID NO: 1153673 - protein, 9 aa, Homo Sapiens
VWTATMPTY

SEQ ID NO: 1153674 - protein, 9 aa, Homo Sapiens
SESRNMIYM

SEQ ID NO: 1153675 - protein, 9 aa, Homo Sapiens
EAVPRVRFT

SEQ ID NO: 1153676 - protein, 9 aa, Homo Sapiens
PGRPGGGQP

SEQ ID NO: 1153677 - protein, 9 aa, Homo Sapiens
KKGERQNRA

SEQ ID NO: 1153678 - protein, 9 aa, Homo Sapiens
VESCNHEVC

SEQ ID NO: 1153679 - protein, 9 aa, Homo Sapiens
RTQNNFLLN

SEQ ID NO: 1153680 - protein, 9 aa, Homo Sapiens
GGKATGVSG

SEQ ID NO: 1153681 - protein, 9 aa, Homo Sapiens
GYGSGFRGY

SEQ ID NO: 1153682 - protein, 9 aa, Homo Sapiens
VHIILSVKI

SEQ ID NO: 1153683 - protein, 9 aa, Homo Sapiens
SSPKSTTLI

SEQ ID NO: 1153684 - protein, 9 aa, Homo Sapiens
VLRRYRLRA

SEQ ID NO: 1153685 - protein, 9 aa, Homo Sapiens
QRPIQVQTG

SEQ ID NO: 1153686 - protein, 9 aa, Homo Sapiens
AHKLWMIVI

SEQ ID NO: 1153687 - protein, 9 aa, Homo Sapiens
SIFRRLQSS

SEQ ID NO: 1153688 - protein, 9 aa, Homo Sapiens
SELQAYIAR

SEQ ID NO: 1153689 - protein, 9 aa, Homo Sapiens
APTRFTLEM

SEQ ID NO: 1153690 - protein, 9 aa, Homo Sapiens
SENFTDSLQ

SEQ ID NO: 1153691 - protein, 9 aa, Homo Sapiens
FIVRDPFKR

SEQ ID NO: 1153692 - protein, 9 aa, Homo Sapiens
FHCILGPGG

SEQ ID NO: 1153693 - protein, 9 aa, Homo Sapiens
RESRFWLAL

SEQ ID NO: 1153694 - protein, 9 aa, Homo Sapiens
VPPLAFSVG

SEQ ID NO: 1153695 - protein, 9 aa, Homo Sapiens
DAWMQKYED

SEQ ID NO: 1153696 - protein, 9 aa, Homo Sapiens
LGDPAAFSA

SEQ ID NO: 1153697 - protein, 9 aa, Homo Sapiens
QGSPGLATQ

SEQ ID NO: 1153698 - protein, 9 aa, Homo Sapiens
MACSPTNSL

SEQ ID NO: 1153699 - protein, 9 aa, Homo Sapiens
ANHDSENFT

SEQ ID NO: 1153700 - protein, 9 aa, Homo Sapiens
SSGSTTRAS

SEQ ID NO: 1153701 - protein, 9 aa, Homo Sapiens
TAEGAAGTR

SEQ ID NO: 1153702 - protein, 9 aa, Homo Sapiens
GTQAGPWNT

SEQ ID NO: 1153703 - protein, 9 aa, Homo Sapiens
PHTPTTPTT

SEQ ID NO: 1153704 - protein, 9 aa, Homo Sapiens
RLYSRAVLV

SEQ ID NO: 1153705 - protein, 9 aa, Homo Sapiens
LQVWEPPWT

SEQ ID NO: 1153706 - protein, 9 aa, Homo Sapiens
GADLPNITP

SEQ ID NO: 1153707 - protein, 9 aa, Homo Sapiens
KPLRKVRRL

SEQ ID NO: 1153708 - protein, 9 aa, Homo Sapiens
VLYLKKTRT

SEQ ID NO: 1153709 - protein, 9 aa, Homo Sapiens
GHPLSASQP

SEQ ID NO: 1153710 - protein, 9 aa, Homo Sapiens
GQKKIRKTS

SEQ ID NO: 1153711 - protein, 9 aa, Homo Sapiens
TRPKSPGPP

SEQ ID NO: 1153712 - protein, 9 aa, Homo Sapiens
RIPLHSVKS

SEQ ID NO: 1153713 - protein, 9 aa, Homo Sapiens
APVAWHPLG

SEQ ID NO: 1153714 - protein, 9 aa, Homo Sapiens
QVPARRGLV

SEQ ID NO: 1153715 - protein, 9 aa, Homo Sapiens
DAPDASDFE

SEQ ID NO: 1153716 - protein, 9 aa, Homo Sapiens
TLLNIIKHL

SEQ ID NO: 1153717 - protein, 9 aa, Homo Sapiens
WAALQRLTW

SEQ ID NO: 1153718 - protein, 9 aa, Homo Sapiens
QTMVMGIIF

SEQ ID NO: 1153719 - protein, 9 aa, Homo Sapiens
CAQEAPHNM

SEQ ID NO: 1153720 - protein, 9 aa, Homo Sapiens
DSPGHGEQA

SEQ ID NO: 1153721 - protein, 9 aa, Homo Sapiens
APLGGMECT

SEQ ID NO: 1153722 - protein, 9 aa, Homo Sapiens
GSAALLPRS

SEQ ID NO: 1153723 - protein, 9 aa, Homo Sapiens
EDKEEEEKK

SEQ ID NO: 1153724 - protein, 9 aa, Homo Sapiens
GTARTCLWA

SEQ ID NO: 1153725 - protein, 9 aa, Homo Sapiens
ILIGQTLSL

SEQ ID NO: 1153726 - protein, 9 aa, Homo Sapiens
PPSLWGRAW

SEQ ID NO: 1153727 - protein, 9 aa, Homo Sapiens
KINPWSGLI

SEQ ID NO: 1153728 - protein, 9 aa, Homo Sapiens
TWPACARSA

SEQ ID NO: 1153729 - protein, 9 aa, Homo Sapiens
QPTGDPPIG

SEQ ID NO: 1153730 - protein, 9 aa, Homo Sapiens
SEAPHVDGE

SEQ ID NO: 1153731 - protein, 9 aa, Homo Sapiens
HVCGVRAHG

SEQ ID NO: 1153732 - protein, 9 aa, Homo Sapiens
LGLCSAQPA

SEQ ID NO: 1153733 - protein, 9 aa, Homo Sapiens
EELDWHVVN

SEQ ID NO: 1153734 - protein, 9 aa, Homo Sapiens
LAGRANDPC

SEQ ID NO: 1153735 - protein, 9 aa, Homo Sapiens
LSILSFLQE

SEQ ID NO: 1153736 - protein, 9 aa, Homo Sapiens
SRAATKRPD

SEQ ID NO: 1153737 - protein, 9 aa, Homo Sapiens
ELCVAPEEH

SEQ ID NO: 1153738 - protein, 9 aa, Homo Sapiens
HVEEEKERA

SEQ ID NO: 1153739 - protein, 9 aa, Homo Sapiens
GVTANRFQS

SEQ ID NO: 1153740 - protein, 9 aa, Homo Sapiens
NSELSTDSV

SEQ ID NO: 1153741 - protein, 9 aa, Homo Sapiens
PGAVESCNH

SEQ ID NO: 1153742 - protein, 9 aa, Homo Sapiens
TVHNICHWN

SEQ ID NO: 1153743 - protein, 9 aa, Homo Sapiens
KMVCTGAKG

SEQ ID NO: 1153744 - protein, 9 aa, Homo Sapiens
KVTNEGATS

SEQ ID NO: 1153745 - protein, 9 aa, Homo Sapiens
KEDDLAELV

SEQ ID NO: 1153746 - protein, 9 aa, Homo Sapiens
PCKDSERYA

SEQ ID NO: 1153747 - protein, 9 aa, Homo Sapiens
LETMRHIIQ

SEQ ID NO: 1153748 - protein, 9 aa, Homo Sapiens
PLPAGLRVP

SEQ ID NO: 1153749 - protein, 9 aa, Homo Sapiens
KAKIISSDV

SEQ ID NO: 1153750 - protein, 9 aa, Homo Sapiens
KHIIIPLER

SEQ ID NO: 1153751 - protein, 9 aa, Homo Sapiens
AGPQGSQRE

SEQ ID NO: 1153752 - protein, 9 aa, Homo Sapiens
SSSTSRDSR

SEQ ID NO: 1153753 - protein, 9 aa, Homo Sapiens
AGGDASCAR

SEQ ID NO: 1153754 - protein, 9 aa, Homo Sapiens
LGAHVQAPG

SEQ ID NO: 1153755 - protein, 9 aa, Homo Sapiens
RLSRPTKTR

SEQ ID NO: 1153756 - protein, 9 aa, Homo Sapiens
ATGVSGLNG

SEQ ID NO: 1153757 - protein, 9 aa, Homo Sapiens
LEYLECFDV

SEQ ID NO: 1153758 - protein, 9 aa, Homo Sapiens
AQSEAYLQE

SEQ ID NO: 1153759 - protein, 9 aa, Homo Sapiens
PRPARPAAT

SEQ ID NO: 1153760 - protein, 9 aa, Homo Sapiens
SAHTSRSVL

SEQ ID NO: 1153761 - protein, 9 aa, Homo Sapiens
VKFFDEFRN

SEQ ID NO: 1153762 - protein, 9 aa, Homo Sapiens
PNKETSGLS

SEQ ID NO: 1153763 - protein, 9 aa, Homo Sapiens
TPRHPLQSL

SEQ ID NO: 1153764 - protein, 9 aa, Homo Sapiens
AQLMAPLSP

SEQ ID NO: 1153765 - protein, 9 aa, Homo Sapiens
IRSKPLCKT

SEQ ID NO: 1153766 - protein, 9 aa, Homo Sapiens
PWQVMASLT

SEQ ID NO: 1153767 - protein, 9 aa, Homo Sapiens
CGEYTYFIE

SEQ ID NO: 1153768 - protein, 9 aa, Homo Sapiens
ARVPCAGTT

SEQ ID NO: 1153769 - protein, 9 aa, Homo Sapiens
LLQLLRGGV

SEQ ID NO: 1153770 - protein, 9 aa, Homo Sapiens
LDLEHELLE

SEQ ID NO: 1153771 - protein, 9 aa, Homo Sapiens
PSEEFACVD

SEQ ID NO: 1153772 - protein, 9 aa, Homo Sapiens
EESGASQYP

SEQ ID NO: 1153773 - protein, 9 aa, Homo Sapiens
KIATHCKAQ

SEQ ID NO: 1153774 - protein, 9 aa, Homo Sapiens
KAFLVLKRE

SEQ ID NO: 1153775 - protein, 9 aa, Homo Sapiens
VNGVLETHF

SEQ ID NO: 1153776 - protein, 9 aa, Homo Sapiens
PPPAGHPGT

SEQ ID NO: 1153777 - protein, 9 aa, Homo Sapiens
FEVATWIKT

SEQ ID NO: 1153778 - protein, 9 aa, Homo Sapiens
LQSGQLEVT

SEQ ID NO: 1153779 - protein, 9 aa, Homo Sapiens
TIGIISKMM

SEQ ID NO: 1153780 - protein, 9 aa, Homo Sapiens
PIQVQTGGR

SEQ ID NO: 1153781 - protein, 9 aa, Homo Sapiens
SVIMWSPND

SEQ ID NO: 1153782 - protein, 9 aa, Homo Sapiens
KGEEQSRLA

SEQ ID NO: 1153783 - protein, 9 aa, Homo Sapiens
TLTAQAVDR

SEQ ID NO: 1153784 - protein, 9 aa, Homo Sapiens
MPPNKETSG

SEQ ID NO: 1153785 - protein, 9 aa, Homo Sapiens
GLALSALWN

SEQ ID NO: 1153786 - protein, 9 aa, Homo Sapiens
CLNIQDVRE

SEQ ID NO: 1153787 - protein, 9 aa, Homo Sapiens
GPDTQPPEC

SEQ ID NO: 1153788 - protein, 9 aa, Homo Sapiens
GRGIGPLTR

SEQ ID NO: 1153789 - protein, 9 aa, Homo Sapiens
ETKLINDRH

SEQ ID NO: 1153790 - protein, 9 aa, Homo Sapiens
GRRPSGHPA

SEQ ID NO: 1153791 - protein, 9 aa, Homo Sapiens
GMSATTTAR

SEQ ID NO: 1153792 - protein, 9 aa, Homo Sapiens
WEPQPPRAA

SEQ ID NO: 1153793 - protein, 9 aa, Homo Sapiens
LCPGEPGAK

SEQ ID NO: 1153794 - protein, 9 aa, Homo Sapiens
LWWWWWCCS

SEQ ID NO: 1153795 - protein, 9 aa, Homo Sapiens
FQRGKVEII

SEQ ID NO: 1153796 - protein, 9 aa, Homo Sapiens
DPGTLETGR

SEQ ID NO: 1153797 - protein, 9 aa, Homo Sapiens
STTYPEQMD

SEQ ID NO: 1153798 - protein, 9 aa, Homo Sapiens
EGWGVSGSS

SEQ ID NO: 1153799 - protein, 9 aa, Homo Sapiens
LSPVSRYNE

SEQ ID NO: 1153800 - protein, 9 aa, Homo Sapiens
SSPYTHACC

SEQ ID NO: 1153801 - protein, 9 aa, Homo Sapiens
DCLRSFRPY

SEQ ID NO: 1153802 - protein, 9 aa, Homo Sapiens
SVASHVDLP

SEQ ID NO: 1153803 - protein, 9 aa, Homo Sapiens
VSAPLGGME

SEQ ID NO: 1153804 - protein, 9 aa, Homo Sapiens
EAVGYRTYS

SEQ ID NO: 1153805 - protein, 9 aa, Homo Sapiens
LESLAQAAA

SEQ ID NO: 1153806 - protein, 9 aa, Homo Sapiens
FGLFSLWRT

SEQ ID NO: 1153807 - protein, 9 aa, Homo Sapiens
TWSSKFNIS

SEQ ID NO: 1153808 - protein, 9 aa, Homo Sapiens
QQPQTPQDS

SEQ ID NO: 1153809 - protein, 9 aa, Homo Sapiens
VTASFEKLR

SEQ ID NO: 1153810 - protein, 9 aa, Homo Sapiens
TRQTLPALG

SEQ ID NO: 1153811 - protein, 9 aa, Homo Sapiens
KLSTAQSNY

SEQ ID NO: 1153812 - protein, 9 aa, Homo Sapiens
CFSTTTLSW

SEQ ID NO: 1153813 - protein, 9 aa, Homo Sapiens
ILSAQHEDV

SEQ ID NO: 1153814 - protein, 9 aa, Homo Sapiens
YAGCVPQMY

SEQ ID NO: 1153815 - protein, 9 aa, Homo Sapiens
VIEPEVLQD

SEQ ID NO: 1153816 - protein, 9 aa, Homo Sapiens
HFESKEKEE

SEQ ID NO: 1153817 - protein, 9 aa, Homo Sapiens
SSSVSMGAM

SEQ ID NO: 1153818 - protein, 9 aa, Homo Sapiens
ECSDSDQEE

SEQ ID NO: 1153819 - protein, 9 aa, Homo Sapiens
SEHFESKEK

SEQ ID NO: 1153820 - protein, 9 aa, Homo Sapiens
LCCMYRQQK

SEQ ID NO: 1153821 - protein, 9 aa, Homo Sapiens
LLKAGCQVR

SEQ ID NO: 1153822 - protein, 9 aa, Homo Sapiens
LVGFPPFES

SEQ ID NO: 1153823 - protein, 9 aa, Homo Sapiens
HICSEHFES

SEQ ID NO: 1153824 - protein, 9 aa, Homo Sapiens
REELSLLWL

SEQ ID NO: 1153825 - protein, 9 aa, Homo Sapiens
QNQSKLRAP

SEQ ID NO: 1153826 - protein, 9 aa, Homo Sapiens
VITTLKVTV

SEQ ID NO: 1153827 - protein, 9 aa, Homo Sapiens
VTLSLCCMY

SEQ ID NO: 1153828 - protein, 9 aa, Homo Sapiens
DDITRYYLC

SEQ ID NO: 1153829 - protein, 9 aa, Homo Sapiens
QSPERSRTL

SEQ ID NO: 1153830 - protein, 9 aa, Homo Sapiens
VLTPFLKPF

SEQ ID NO: 1153831 - protein, 9 aa, Homo Sapiens
KSKRHVISQ

SEQ ID NO: 1153832 - protein, 9 aa, Homo Sapiens
GRLLKAGCQ

SEQ ID NO: 1153833 - protein, 9 aa, Homo Sapiens
GGMNQRPIL

SEQ ID NO: 1153834 - protein, 9 aa, Homo Sapiens
ISPPNAILE

SEQ ID NO: 1153835 - protein, 9 aa, Homo Sapiens
EPVYRYCVL

SEQ ID NO: 1153836 - protein, 9 aa, Homo Sapiens
TVLTFTALS

SEQ ID NO: 1153837 - protein, 9 aa, Homo Sapiens
GGMGGGVDN

SEQ ID NO: 1153838 - protein, 9 aa, Homo Sapiens
WLAWQLKAT

SEQ ID NO: 1153839 - protein, 9 aa, Homo Sapiens
KAGCQVREP

SEQ ID NO: 1153840 - protein, 9 aa, Homo Sapiens
PRHSHPTRV

SEQ ID NO: 1153841 - protein, 9 aa, Homo Sapiens
NHMIRLHPD

SEQ ID NO: 1153842 - protein, 9 aa, Homo Sapiens
AKASEKRSN

SEQ ID NO: 1153843 - protein, 9 aa, Homo Sapiens
LKAGCQVRE

SEQ ID NO: 1153844 - protein, 9 aa, Homo Sapiens
PAQLSDDIT

SEQ ID NO: 1153845 - protein, 9 aa, Homo Sapiens
HSHPTRVRR

SEQ ID NO: 1153846 - protein, 9 aa, Homo Sapiens
PSGGDQLSN

SEQ ID NO: 1153847 - protein, 9 aa, Homo Sapiens
AQLQNQSKL

SEQ ID NO: 1153848 - protein, 9 aa, Homo Sapiens
LSDDITRYY

SEQ ID NO: 1153849 - protein, 9 aa, Homo Sapiens
REPVYRYCV

SEQ ID NO: 1153850 - protein, 9 aa, Homo Sapiens
SHPTRVRRC

SEQ ID NO: 1153851 - protein, 9 aa, Homo Sapiens
NPGHEGPTG

SEQ ID NO: 1153852 - protein, 9 aa, Homo Sapiens
QTHPGEEWV

SEQ ID NO: 1153853 - protein, 9 aa, Homo Sapiens
LCYELLVGF

SEQ ID NO: 1153854 - protein, 9 aa, Homo Sapiens
KNHMIRLHP

SEQ ID NO: 1153855 - protein, 9 aa, Homo Sapiens
WALRVFSSS

SEQ ID NO: 1153856 - protein, 9 aa, Homo Sapiens
PVYRYCVLQ

SEQ ID NO: 1153857 - protein, 9 aa, Homo Sapiens
SPAPGLCSI

SEQ ID NO: 1153858 - protein, 9 aa, Homo Sapiens
SKRHVISQP

SEQ ID NO: 1153859 - protein, 9 aa, Homo Sapiens
SIEELRREV

SEQ ID NO: 1153860 - protein, 9 aa, Homo Sapiens
TYMTGNELT

SEQ ID NO: 1153861 - protein, 9 aa, Homo Sapiens
ICSEHFESK

SEQ ID NO: 1153862 - protein, 9 aa, Homo Sapiens
PTRVRRCPG

SEQ ID NO: 1153863 - protein, 9 aa, Homo Sapiens
IQANGPQIS

SEQ ID NO: 1153864 - protein, 9 aa, Homo Sapiens
GVTVKNHMI

SEQ ID NO: 1153865 - protein, 9 aa, Homo Sapiens
KRKNTHGEE

SEQ ID NO: 1153866 - protein, 9 aa, Homo Sapiens
LLVGFPPFE

SEQ ID NO: 1153867 - protein, 9 aa, Homo Sapiens
VYRYCVLQC

SEQ ID NO: 1153868 - protein, 9 aa, Homo Sapiens
VTVKNHMIR

SEQ ID NO: 1153869 - protein, 9 aa, Homo Sapiens
NQRPILTII

SEQ ID NO: 1153870 - protein, 9 aa, Homo Sapiens
PERSRTLHF

SEQ ID NO: 1153871 - protein, 9 aa, Homo Sapiens
SQFSSRSRS

SEQ ID NO: 1153872 - protein, 9 aa, Homo Sapiens
YVDPSGGDQ

SEQ ID NO: 1153873 - protein, 9 aa, Homo Sapiens
QLLEKRKNT

SEQ ID NO: 1153874 - protein, 9 aa, Homo Sapiens
HVISQPHKS

SEQ ID NO: 1153875 - protein, 9 aa, Homo Sapiens
ELSLLWLAW

SEQ ID NO: 1153876 - protein, 9 aa, Homo Sapiens
TRVRRCPGG

SEQ ID NO: 1153877 - protein, 9 aa, Homo Sapiens
CLWALRVFS

SEQ ID NO: 1153878 - protein, 9 aa, Homo Sapiens
YELLVGFPP

SEQ ID NO: 1153879 - protein, 9 aa, Homo Sapiens
TPFLKPFIY

SEQ ID NO: 1153880 - protein, 9 aa, Homo Sapiens
SGRKSKRHV

SEQ ID NO: 1153881 - protein, 9 aa, Homo Sapiens
LKVTVADAP

SEQ ID NO: 1153882 - protein, 9 aa, Homo Sapiens
SSCMGGMNQ

SEQ ID NO: 1153883 - protein, 9 aa, Homo Sapiens
CQVREPGQD

SEQ ID NO: 1153884 - protein, 9 aa, Homo Sapiens
VRRCPGGLP

SEQ ID NO: 1153885 - protein, 9 aa, Homo Sapiens
VGFPPFESA

SEQ ID NO: 1153886 - protein, 9 aa, Homo Sapiens
THPGEEWVK

SEQ ID NO: 1153887 - protein, 9 aa, Homo Sapiens
GPLGNPGHE

SEQ ID NO: 1153888 - protein, 9 aa, Homo Sapiens
RVRRCPGGL

SEQ ID NO: 1153889 - protein, 9 aa, Homo Sapiens
DQLSNVHRT

SEQ ID NO: 1153890 - protein, 9 aa, Homo Sapiens
RSQFSSRSR

SEQ ID NO: 1153891 - protein, 9 aa, Homo Sapiens
LWLAWQLKA

SEQ ID NO: 1153892 - protein, 9 aa, Homo Sapiens
YCVLQCEEQ

SEQ ID NO: 1153893 - protein, 9 aa, Homo Sapiens
LWALRVFSS

SEQ ID NO: 1153894 - protein, 9 aa, Homo Sapiens
AMEGIMEVL

SEQ ID NO: 1153895 - protein, 9 aa, Homo Sapiens
FLKPFIYSL

SEQ ID NO: 1153896 - protein, 9 aa, Homo Sapiens
LTFTALSVE

SEQ ID NO: 1153897 - protein, 9 aa, Homo Sapiens
AGCVPQMYF

SEQ ID NO: 1153898 - protein, 9 aa, Homo Sapiens
CMYRQQKRH

SEQ ID NO: 1153899 - protein, 9 aa, Homo Sapiens
SPPNAILEK

SEQ ID NO: 1153900 - protein, 9 aa, Homo Sapiens
GLFGISGMV

SEQ ID NO: 1153901 - protein, 9 aa, Homo Sapiens
SKLRAPTAE

SEQ ID NO: 1153902 - protein, 9 aa, Homo Sapiens
KPFIYSLRN

SEQ ID NO: 1153903 - protein, 9 aa, Homo Sapiens
GAQLQNQSK

SEQ ID NO: 1153904 - protein, 9 aa, Homo Sapiens
EVCAATYMT

SEQ ID NO: 1153905 - protein, 9 aa, Homo Sapiens
RHSHPTRVR

SEQ ID NO: 1153906 - protein, 9 aa, Homo Sapiens
RSNAFDDIA

SEQ ID NO: 1153907 - protein, 9 aa, Homo Sapiens
SIYKPPETR

SEQ ID NO: 1153908 - protein, 9 aa, Homo Sapiens
VLSKSGGLF

SEQ ID NO: 1153909 - protein, 9 aa, Homo Sapiens
VLTFTALSV

SEQ ID NO: 1153910 - protein, 9 aa, Homo Sapiens
GLCSIYKPP

SEQ ID NO: 1153911 - protein, 9 aa, Homo Sapiens
MEVLSKSGG

SEQ ID NO: 1153912 - protein, 9 aa, Homo Sapiens
ASEKRSNAF

SEQ ID NO: 1153913 - protein, 9 aa, Homo Sapiens
GISGMVREG

SEQ ID NO: 1153914 - protein, 9 aa, Homo Sapiens
LGNPGHEGP

SEQ ID NO: 1153915 - protein, 9 aa, Homo Sapiens
TSIEELRRE

SEQ ID NO: 1153916 - protein, 9 aa, Homo Sapiens
RVFSSSVSM

SEQ ID NO: 1153917 - protein, 9 aa, Homo Sapiens
LLEKRKNTH

SEQ ID NO: 1153918 - protein, 9 aa, Homo Sapiens
TLKVTVADA

SEQ ID NO: 1153919 - protein, 9 aa, Homo Sapiens
GIMEVLSKS

SEQ ID NO: 1153920 - protein, 9 aa, Homo Sapiens
YRYCVLQCE

SEQ ID NO: 1153921 - protein, 9 aa, Homo Sapiens
RSPAPGLCS

SEQ ID NO: 1153922 - protein, 9 aa, Homo Sapiens
SGMVREGRR

SEQ ID NO: 1153923 - protein, 9 aa, Homo Sapiens
ELQKLFTSI

SEQ ID NO: 1153924 - protein, 9 aa, Homo Sapiens
EVLSKSGGL

SEQ ID NO: 1153925 - protein, 9 aa, Homo Sapiens
STQEQTHPG

SEQ ID NO: 1153926 - protein, 9 aa, Homo Sapiens
CAKAFNRSS

SEQ ID NO: 1153927 - protein, 9 aa, Homo Sapiens
KRSNAFDDI

SEQ ID NO: 1153928 - protein, 9 aa, Homo Sapiens
GDREPVYRY

SEQ ID NO: 1153929 - protein, 9 aa, Homo Sapiens
ETSTQEQTH

SEQ ID NO: 1153930 - protein, 9 aa, Homo Sapiens
ECAKAFNRS

SEQ ID NO: 1153931 - protein, 9 aa, Homo Sapiens
PLGNPGHEG

SEQ ID NO: 1153932 - protein, 9 aa, Homo Sapiens
QISPPNAIL

SEQ ID NO: 1153933 - protein, 9 aa, Homo Sapiens
ATYMTGNEL

SEQ ID NO: 1153934 - protein, 9 aa, Homo Sapiens
SRELLEVIE

SEQ ID NO: 1153935 - protein, 9 aa, Homo Sapiens
KVTVADAPN

SEQ ID NO: 1153936 - protein, 9 aa, Homo Sapiens
VQSPERSRT

SEQ ID NO: 1153937 - protein, 9 aa, Homo Sapiens
GDQLSNVHR

SEQ ID NO: 1153938 - protein, 9 aa, Homo Sapiens
SKNGGMGGG

SEQ ID NO: 1153939 - protein, 9 aa, Homo Sapiens
SVTLSLCCM

SEQ ID NO: 1153940 - protein, 9 aa, Homo Sapiens
NTHGEEKEN

SEQ ID NO: 1153941 - protein, 9 aa, Homo Sapiens
SDDITRYYL

SEQ ID NO: 1153942 - protein, 9 aa, Homo Sapiens
TQEQTHPGE

SEQ ID NO: 1153943 - protein, 9 aa, Homo Sapiens
ERSRTLHFR

SEQ ID NO: 1153944 - protein, 9 aa, Homo Sapiens
RKSKRHVIS

SEQ ID NO: 1153945 - protein, 9 aa, Homo Sapiens
ANGPQISPP

SEQ ID NO: 1153946 - protein, 9 aa, Homo Sapiens
KLRAPTAEK

SEQ ID NO: 1153947 - protein, 9 aa, Homo Sapiens
ILYAGCVPQ

SEQ ID NO: 1153948 - protein, 9 aa, Homo Sapiens
VKNHMIRLH

SEQ ID NO: 1153949 - protein, 9 aa, Homo Sapiens
VFSSSVSMG

SEQ ID NO: 1153950 - protein, 9 aa, Homo Sapiens
PPDPAQLSD

SEQ ID NO: 1153951 - protein, 9 aa, Homo Sapiens
CYELLVGFP

SEQ ID NO: 1153952 - protein, 9 aa, Homo Sapiens
EVIEPEVLQ

SEQ ID NO: 1153953 - protein, 9 aa, Homo Sapiens
QKLFTSIEE

SEQ ID NO: 1153954 - protein, 9 aa, Homo Sapiens
APGLCSIYK

SEQ ID NO: 1153955 - protein, 9 aa, Homo Sapiens
ESKEKEEDK

SEQ ID NO: 1153956 - protein, 9 aa, Homo Sapiens
ITTLKVTVA

SEQ ID NO: 1153957 - protein, 9 aa, Homo Sapiens
LRVFSSSVS

SEQ ID NO: 1153958 - protein, 9 aa, Homo Sapiens
TFTALSVER

SEQ ID NO: 1153959 - protein, 9 aa, Homo Sapiens
LFTSIEELR

SEQ ID NO: 1153960 - protein, 9 aa, Homo Sapiens
CEECAKAFN

SEQ ID NO: 1153961 - protein, 9 aa, Homo Sapiens
YATVLTFTA

SEQ ID NO: 1153962 - protein, 9 aa, Homo Sapiens
PGSDGPLGN

SEQ ID NO: 1153963 - protein, 9 aa, Homo Sapiens
MEGIMEVLS

SEQ ID NO: 1153964 - protein, 9 aa, Homo Sapiens
PQMYFFIFF

SEQ ID NO: 1153965 - protein, 9 aa, Homo Sapiens
KGRLLKAGC

SEQ ID NO: 1153966 - protein, 9 aa, Homo Sapiens
LTPFLKPFI

SEQ ID NO: 1153967 - protein, 9 aa, Homo Sapiens
CCMYRQQKR

SEQ ID NO: 1153968 - protein, 9 aa, Homo Sapiens
EETSTQEQT

SEQ ID NO: 1153969 - protein, 9 aa, Homo Sapiens
THFSKNGGM

SEQ ID NO: 1153970 - protein, 9 aa, Homo Sapiens
LKPFIYSLR

SEQ ID NO: 1153971 - protein, 9 aa, Homo Sapiens
QFSSRSRSR

SEQ ID NO: 1153972 - protein, 9 aa, Homo Sapiens
KASEKRSNA

SEQ ID NO: 1153973 - protein, 9 aa, Homo Sapiens
SGGDQLSNV

SEQ ID NO: 1153974 - protein, 9 aa, Homo Sapiens
EECAKAFNR

SEQ ID NO: 1153975 - protein, 9 aa, Homo Sapiens
EQTHPGEEW

SEQ ID NO: 1153976 - protein, 9 aa, Homo Sapiens
CTYATVLTF

SEQ ID NO: 1153977 - protein, 9 aa, Homo Sapiens
EGIMEVLSK

SEQ ID NO: 1153978 - protein, 9 aa, Homo Sapiens
TGNELTFLD

SEQ ID NO: 1153979 - protein, 9 aa, Homo Sapiens
EKRKNTHGE

SEQ ID NO: 1153980 - protein, 9 aa, Homo Sapiens
ATVLTFTAL

SEQ ID NO: 1153981 - protein, 9 aa, Homo Sapiens
RKNTHGEEK

SEQ ID NO: 1153982 - protein, 9 aa, Homo Sapiens
SRSKSRSQF

SEQ ID NO: 1153983 - protein, 9 aa, Homo Sapiens
SCMGGMNQR

SEQ ID NO: 1153984 - protein, 9 aa, Homo Sapiens
VPQMYFFIF

SEQ ID NO: 1153985 - protein, 9 aa, Homo Sapiens
MNQRPILTI

SEQ ID NO: 1153986 - protein, 9 aa, Homo Sapiens
CSIYKPPET

SEQ ID NO: 1153987 - protein, 9 aa, Homo Sapiens
ELLVGFPPF

SEQ ID NO: 1153988 - protein, 9 aa, Homo Sapiens
RSKSRSQFS

SEQ ID NO: 1153989 - protein, 9 aa, Homo Sapiens
LFGISGMVR

SEQ ID NO: 1153990 - protein, 9 aa, Homo Sapiens
HMIRLHPDG

SEQ ID NO: 1153991 - protein, 9 aa, Homo Sapiens
DPAQLSDDI

SEQ ID NO: 1153992 - protein, 9 aa, Homo Sapiens
KNTHGEEKE

SEQ ID NO: 1153993 - protein, 9 aa, Homo Sapiens
LEKRKNTHG

SEQ ID NO: 1153994 - protein, 9 aa, Homo Sapiens
GLSSECSDS

SEQ ID NO: 1153995 - protein, 9 aa, Homo Sapiens
QRPILTIIT

SEQ ID NO: 1153996 - protein, 9 aa, Homo Sapiens
TTLKVTVAD

SEQ ID NO: 1153997 - protein, 9 aa, Homo Sapiens
QANGPQISP

SEQ ID NO: 1153998 - protein, 9 aa, Homo Sapiens
AKAFNRSSH

SEQ ID NO: 1153999 - protein, 9 aa, Homo Sapiens
SPERSRTLH

SEQ ID NO: 1154000 - protein, 9 aa, Homo Sapiens
LSRELLEVI

SEQ ID NO: 1154001 - protein, 9 aa, Homo Sapiens
RHVISQPHK

SEQ ID NO: 1154002 - protein, 9 aa, Homo Sapiens
LSLCCMYRQ

SEQ ID NO: 1154003 - protein, 9 aa, Homo Sapiens
GGDQLSNVH

SEQ ID NO: 1154004 - protein, 9 aa, Homo Sapiens
GMVREGRRE

SEQ ID NO: 1154005 - protein, 9 aa, Homo Sapiens
GNPGHEGPT

SEQ ID NO: 1154006 - protein, 9 aa, Homo Sapiens
KNGGMGGGV

SEQ ID NO: 1154007 - protein, 9 aa, Homo Sapiens
KRHVISQPH

SEQ ID NO: 1154008 - protein, 9 aa, Homo Sapiens
GRKSKRHVI

SEQ ID NO: 1154009 - protein, 9 aa, Homo Sapiens
YMTGNELTF

SEQ ID NO: 1154010 - protein, 9 aa, Homo Sapiens
QSKLRAPTA

SEQ ID NO: 1154011 - protein, 9 aa, Homo Sapiens
EREELSLLW

SEQ ID NO: 1154012 - protein, 9 aa, Homo Sapiens
EELSLLWLA

SEQ ID NO: 1154013 - protein, 9 aa, Homo Sapiens
FGISGMVRE

SEQ ID NO: 1154014 - protein, 9 aa, Homo Sapiens
EKRSNAFDD

SEQ ID NO: 1154015 - protein, 9 aa, Homo Sapiens
QLSDDITRY

SEQ ID NO: 1154016 - protein, 9 aa, Homo Sapiens
SDGPLGNPG

SEQ ID NO: 1154017 - protein, 9 aa, Homo Sapiens
LQKLFTSIE

SEQ ID NO: 1154018 - protein, 9 aa, Homo Sapiens
FGLFGISGM

SEQ ID NO: 1154019 - protein, 9 aa, Homo Sapiens
IMEVLSKSG

SEQ ID NO: 1154020 - protein, 9 aa, Homo Sapiens
THGEEKENL

SEQ ID NO: 1154021 - protein, 9 aa, Homo Sapiens
QELQKLFTS

SEQ ID NO: 1154022 - protein, 9 aa, Homo Sapiens
DGPLGNPGH

SEQ ID NO: 1154023 - protein, 9 aa, Homo Sapiens
GMNQRPILT

SEQ ID NO: 1154024 - protein, 9 aa, Homo Sapiens
LYAGCVPQM

SEQ ID NO: 1154025 - protein, 9 aa, Homo Sapiens
EHFESKEKE

SEQ ID NO: 1154026 - protein, 9 aa, Homo Sapiens
GSDGPLGNP

SEQ ID NO: 1154027 - protein, 9 aa, Homo Sapiens
AQLSDDITR

SEQ ID NO: 1154028 - protein, 9 aa, Homo Sapiens
TLSLCCMYR

SEQ ID NO: 1154029 - protein, 9 aa, Homo Sapiens
QEQTHPGEE

SEQ ID NO: 1154030 - protein, 9 aa, Homo Sapiens
VADAPNTPA

SEQ ID NO: 1154031 - protein, 9 aa, Homo Sapiens
FSSSVSMGA

SEQ ID NO: 1154032 - protein, 9 aa, Homo Sapiens
MVREGRREN

SEQ ID NO: 1154033 - protein, 9 aa, Homo Sapiens
CVPQMYFFI

SEQ ID NO: 1154034 - protein, 9 aa, Homo Sapiens
LRNSSLQGR

SEQ ID NO: 1154035 - protein, 9 aa, Homo Sapiens
SKSRSQFSS

SEQ ID NO: 1154036 - protein, 9 aa, Homo Sapiens
RYCVLQCEE

SEQ ID NO: 1154037 - protein, 9 aa, Homo Sapiens
LLWLAWQLK

SEQ ID NO: 1154038 - protein, 9 aa, Homo Sapiens
DREPVYRYC

SEQ ID NO: 1154039 - protein, 9 aa, Homo Sapiens
NQSKLRAPT

SEQ ID NO: 1154040 - protein, 9 aa, Homo Sapiens
NAFDDIATY

SEQ ID NO: 1154041 - protein, 9 aa, Homo Sapiens
SRSQFSSRS

SEQ ID NO: 1154042 - protein, 9 aa, Homo Sapiens
CMGGMNQRP

SEQ ID NO: 1154043 - protein, 9 aa, Homo Sapiens
PDPAQLSDD

SEQ ID NO: 1154044 - protein, 9 aa, Homo Sapiens
FPPFESASH

SEQ ID NO: 1154045 - protein, 9 aa, Homo Sapiens
DPSGGDQLS

SEQ ID NO: 1154046 - protein, 9 aa, Homo Sapiens
PAPGLCSIY

SEQ ID NO: 1154047 - protein, 9 aa, Homo Sapiens
NGGMGGGVD

SEQ ID NO: 1154048 - protein, 9 aa, Homo Sapiens
GCVPQMYFF

SEQ ID NO: 1154049 - protein, 9 aa, Homo Sapiens
LSSECSDSD

SEQ ID NO: 1154050 - protein, 9 aa, Homo Sapiens
TVADAPNTP

SEQ ID NO: 1154051 - protein, 9 aa, Homo Sapiens
HGVTVKNHM

SEQ ID NO: 1154052 - protein, 9 aa, Homo Sapiens
SAMEGIMEV

SEQ ID NO: 1154053 - protein, 9 aa, Homo Sapiens
DSSGLSSEC

SEQ ID NO: 1154054 - protein, 9 aa, Homo Sapiens
TSTQEQTHP

SEQ ID NO: 1154055 - protein, 9 aa, Homo Sapiens
YSVLTPFLK

SEQ ID NO: 1154056 - protein, 9 aa, Homo Sapiens
HPTRVRRCP

SEQ ID NO: 1154057 - protein, 9 aa, Homo Sapiens
HFSKNGGMG

SEQ ID NO: 1154058 - protein, 9 aa, Homo Sapiens
SSLQGRVES

SEQ ID NO: 1154059 - protein, 9 aa, Homo Sapiens
LSGRKSKRH

SEQ ID NO: 1154060 - protein, 9 aa, Homo Sapiens
GMGGGVDNS

SEQ ID NO: 1154061 - protein, 9 aa, Homo Sapiens
GVQSPERSR

SEQ ID NO: 1154062 - protein, 9 aa, Homo Sapiens
SVLTPFLKP

SEQ ID NO: 1154063 - protein, 9 aa, Homo Sapiens
GCQVREPGQ

SEQ ID NO: 1154064 - protein, 9 aa, Homo Sapiens
TVKNHMIRL

SEQ ID NO: 1154065 - protein, 9 aa, Homo Sapiens
SSECSDSDQ

SEQ ID NO: 1154066 - protein, 9 aa, Homo Sapiens
FTSIEELRR

SEQ ID NO: 1154067 - protein, 9 aa, Homo Sapiens
RLLKAGCQV

SEQ ID NO: 1154068 - protein, 9 aa, Homo Sapiens
SNAFDDIAT

SEQ ID NO: 1154069 - protein, 9 aa, Homo Sapiens
MGGGVDNSE

SEQ ID NO: 1154070 - protein, 9 aa, Homo Sapiens
SLQGRVESF

SEQ ID NO: 1154071 - protein, 9 aa, Homo Sapiens
MTGNELTFL

SEQ ID NO: 1154072 - protein, 9 aa, Homo Sapiens
AGCQVREPG

SEQ ID NO: 1154073 - protein, 9 aa, Homo Sapiens
NSSLQGRVE

SEQ ID NO: 1154074 - protein, 9 aa, Homo Sapiens
LHICSEHFE

SEQ ID NO: 1154075 - protein, 9 aa, Homo Sapiens
KSRSQFSSR

SEQ ID NO: 1154076 - protein, 9 aa, Homo Sapiens
LQGRVESFF

SEQ ID NO: 1154077 - protein, 9 aa, Homo Sapiens
CSDSDQEEL

SEQ ID NO: 1154078 - protein, 9 aa, Homo Sapiens
IEPEVLQDS

SEQ ID NO: 1154079 - protein, 9 aa, Homo Sapiens
LSLLWLAWQ

SEQ ID NO: 1154080 - protein, 9 aa, Homo Sapiens
QLQNQSKLR

SEQ ID NO: 1154081 - protein, 9 aa, Homo Sapiens
GPQISPPNA

SEQ ID NO: 1154082 - protein, 9 aa, Homo Sapiens
SSGLSSECS

SEQ ID NO: 1154083 - protein, 9 aa, Homo Sapiens
RELLEVIEP

SEQ ID NO: 1154084 - protein, 9 aa, Homo Sapiens
LLRNSSLQG

SEQ ID NO: 1154085 - protein, 9 aa, Homo Sapiens
GRVESFFTY

SEQ ID NO: 1154086 - protein, 9 aa, Homo Sapiens
GFPPFESAS

SEQ ID NO: 1154087 - protein, 9 aa, Homo Sapiens
LQNQSKLRA

SEQ ID NO: 1154088 - protein, 9 aa, Homo Sapiens
VTVADAPNT

SEQ ID NO: 1154089 - protein, 9 aa, Homo Sapiens
FTALSVERY

SEQ ID NO: 1154090 - protein, 9 aa, Homo Sapiens
CAATYMTGN

SEQ ID NO: 1154091 - protein, 9 aa, Homo Sapiens
CSEHFESKE

SEQ ID NO: 1154092 - protein, 9 aa, Homo Sapiens
GSVTLSLCC

SEQ ID NO: 1154093 - protein, 9 aa, Homo Sapiens
VCAATYMTG

SEQ ID NO: 1154094 - protein, 9 aa, Homo Sapiens
ELLEVIEPE

SEQ ID NO: 1154095 - protein, 9 aa, Homo Sapiens
VDPSGGDQL

SEQ ID NO: 1154096 - protein, 9 aa, Homo Sapiens
SEKRSNAFD

SEQ ID NO: 1154097 - protein, 9 aa, Homo Sapiens
SILYAGCVP

SEQ ID NO: 1154098 - protein, 9 aa, Homo Sapiens
SECSDSDQE

SEQ ID NO: 1154099 - protein, 9 aa, Homo Sapiens
QGRVESFFT

SEQ ID NO: 1154100 - protein, 9 aa, Homo Sapiens
ISGMVREGR

SEQ ID NO: 1154101 - protein, 9 aa, Homo Sapiens
FSKNGGMGG

SEQ ID NO: 1154102 - protein, 9 aa, Homo Sapiens
PGLCSIYKP

SEQ ID NO: 1154103 - protein, 9 aa, Homo Sapiens
SGLSSECSD

SEQ ID NO: 1154104 - protein, 9 aa, Homo Sapiens
VHGVTVKNH

SEQ ID NO: 1154105 - protein, 9 aa, Homo Sapiens
LCSIYKPPE

SEQ ID NO: 1154106 - protein, 9 aa, Homo Sapiens
ALRVFSSSV

SEQ ID NO: 1154107 - protein, 9 aa, Homo Sapiens
FSSRSRSRS

SEQ ID NO: 1154108 - protein, 9 aa, Homo Sapiens
AATYMTGNE

SEQ ID NO: 1154109 - protein, 9 aa, Homo Sapiens
MGGMNQRPI

SEQ ID NO: 1154110 - protein, 9 aa, Homo Sapiens
TYATVLTFT

SEQ ID NO: 1154111 - protein, 9 aa, Homo Sapiens
PQISPPNAI

SEQ ID NO: 1154112 - protein, 9 aa, Homo Sapiens
FESKEKEED

SEQ ID NO: 1154113 - protein, 9 aa, Homo Sapiens
SLLWLAWQL

SEQ ID NO: 1154114 - protein, 9 aa, Homo Sapiens
NGPQISPPN

SEQ ID NO: 1154115 - protein, 9 aa, Homo Sapiens
RNSSLQGRV

SEQ ID NO: 1154116 - protein, 9 aa, Homo Sapiens
SLCCMYRQQ

SEQ ID NO: 1154117 - protein, 9 aa, Homo Sapiens
KLFTSIEEL

SEQ ID NO: 1154118 - protein, 9 aa, Homo Sapiens
PFLKPFIYS

SEQ ID NO: 1154119 - protein, 9 aa, Homo Sapiens
RPSHWFTAS

SEQ ID NO: 1154120 - protein, 9 aa, Homo Sapiens
WELYPDSED

SEQ ID NO: 1154121 - protein, 9 aa, Homo Sapiens
WWFLWQVLN

SEQ ID NO: 1154122 - protein, 9 aa, Homo Sapiens
RSLVISLLE

SEQ ID NO: 1154123 - protein, 9 aa, Homo Sapiens
PADRAPAQS

SEQ ID NO: 1154124 - protein, 9 aa, Homo Sapiens
CPNLLPAPS

SEQ ID NO: 1154125 - protein, 9 aa, Homo Sapiens
RRLWELYPD

SEQ ID NO: 1154126 - protein, 9 aa, Homo Sapiens
YCLQFQAQL

SEQ ID NO: 1154127 - protein, 9 aa, Homo Sapiens
FRKRPQHCP

SEQ ID NO: 1154128 - protein, 9 aa, Homo Sapiens
PRPTCRVGL

SEQ ID NO: 1154129 - protein, 9 aa, Homo Sapiens
PAQSCREAE

SEQ ID NO: 1154130 - protein, 9 aa, Homo Sapiens
LMGPWHLCM

SEQ ID NO: 1154131 - protein, 9 aa, Homo Sapiens
AIQDNVKVS

SEQ ID NO: 1154132 - protein, 9 aa, Homo Sapiens
KDYRDFSLR

SEQ ID NO: 1154133 - protein, 9 aa, Homo Sapiens
KQENIAWPC

SEQ ID NO: 1154134 - protein, 9 aa, Homo Sapiens
VSCQRDLGK

SEQ ID NO: 1154135 - protein, 9 aa, Homo Sapiens
EMSGSSKNS

SEQ ID NO: 1154136 - protein, 9 aa, Homo Sapiens
WHCESNRFH

SEQ ID NO: 1154137 - protein, 9 aa, Homo Sapiens
PSEKTPEDE

SEQ ID NO: 1154138 - protein, 9 aa, Homo Sapiens
DCQIHKVDD

SEQ ID NO: 1154139 - protein, 9 aa, Homo Sapiens
EDVSQITFV

SEQ ID NO: 1154140 - protein, 9 aa, Homo Sapiens
PVSITVSSH

SEQ ID NO: 1154141 - protein, 9 aa, Homo Sapiens
QTIALLTLA

SEQ ID NO: 1154142 - protein, 9 aa, Homo Sapiens
VCVEEDKIV

SEQ ID NO: 1154143 - protein, 9 aa, Homo Sapiens
GRPSHWFTA

SEQ ID NO: 1154144 - protein, 9 aa, Homo Sapiens
FSWQSVLLS

SEQ ID NO: 1154145 - protein, 9 aa, Homo Sapiens
TKQKTSSDD

SEQ ID NO: 1154146 - protein, 9 aa, Homo Sapiens
YKLCKQHQL

SEQ ID NO: 1154147 - protein, 9 aa, Homo Sapiens
WLLCAADSQ

SEQ ID NO: 1154148 - protein, 9 aa, Homo Sapiens
LKSWISVPC

SEQ ID NO: 1154149 - protein, 9 aa, Homo Sapiens
LVPLFIWTP

SEQ ID NO: 1154150 - protein, 9 aa, Homo Sapiens
KEMSGSSKN

SEQ ID NO: 1154151 - protein, 9 aa, Homo Sapiens
RDPLSKITE

SEQ ID NO: 1154152 - protein, 9 aa, Homo Sapiens
KITEQEKDF

SEQ ID NO: 1154153 - protein, 9 aa, Homo Sapiens
GPGSRVSCQ

SEQ ID NO: 1154154 - protein, 9 aa, Homo Sapiens
PHHLVPLFI

SEQ ID NO: 1154155 - protein, 9 aa, Homo Sapiens
GSRVSCQRD

SEQ ID NO: 1154156 - protein, 9 aa, Homo Sapiens
KSGSGSGLN

SEQ ID NO: 1154157 - protein, 9 aa, Homo Sapiens
TCRVGLFLD

SEQ ID NO: 1154158 - protein, 9 aa, Homo Sapiens
ALHLACASD

SEQ ID NO: 1154159 - protein, 9 aa, Homo Sapiens
ECKDLIKLM

SEQ ID NO: 1154160 - protein, 9 aa, Homo Sapiens
LRIFDHEDV

SEQ ID NO: 1154161 - protein, 9 aa, Homo Sapiens
RTVVTITHR

SEQ ID NO: 1154162 - protein, 9 aa, Homo Sapiens
GNAKSVTLF

SEQ ID NO: 1154163 - protein, 9 aa, Homo Sapiens
REVILVLIP

SEQ ID NO: 1154164 - protein, 9 aa, Homo Sapiens
KIVNYATNV

SEQ ID NO: 1154165 - protein, 9 aa, Homo Sapiens
IPRPTCRVG

SEQ ID NO: 1154166 - protein, 9 aa, Homo Sapiens
AAVVSLFNR

SEQ ID NO: 1154167 - protein, 9 aa, Homo Sapiens
SWQSVLLSH

SEQ ID NO: 1154168 - protein, 9 aa, Homo Sapiens
LGREVILVL

SEQ ID NO: 1154169 - protein, 9 aa, Homo Sapiens
LHLACASDH

SEQ ID NO: 1154170 - protein, 9 aa, Homo Sapiens
TPPFGLIPR

SEQ ID NO: 1154171 - protein, 9 aa, Homo Sapiens
PLFIWTPWR

SEQ ID NO: 1154172 - protein, 9 aa, Homo Sapiens
LWELYPDSE

SEQ ID NO: 1154173 - protein, 9 aa, Homo Sapiens
QLEERSGSN

SEQ ID NO: 1154174 - protein, 9 aa, Homo Sapiens
FLDCQIHKV

SEQ ID NO: 1154175 - protein, 9 aa, Homo Sapiens
EVILVLIPY

SEQ ID NO: 1154176 - protein, 9 aa, Homo Sapiens
KVDLKGSQI

SEQ ID NO: 1154177 - protein, 9 aa, Homo Sapiens
ESFPNLREI

SEQ ID NO: 1154178 - protein, 9 aa, Homo Sapiens
ISVPCPNLL

SEQ ID NO: 1154179 - protein, 9 aa, Homo Sapiens
FGGNAKSVT

SEQ ID NO: 1154180 - protein, 9 aa, Homo Sapiens
APSALVLLA

SEQ ID NO: 1154181 - protein, 9 aa, Homo Sapiens
PGSSNPRSQ

SEQ ID NO: 1154182 - protein, 9 aa, Homo Sapiens
VSITVSSHN

SEQ ID NO: 1154183 - protein, 9 aa, Homo Sapiens
RWDTTKKIA

SEQ ID NO: 1154184 - protein, 9 aa, Homo Sapiens
SFLDCQIHK

SEQ ID NO: 1154185 - protein, 9 aa, Homo Sapiens
HLTQHVRIH

SEQ ID NO: 1154186 - protein, 9 aa, Homo Sapiens
ERSGSNLEL

SEQ ID NO: 1154187 - protein, 9 aa, Homo Sapiens
RPVMIISRF

SEQ ID NO: 1154188 - protein, 9 aa, Homo Sapiens
DLFSLRVHS

SEQ ID NO: 1154189 - protein, 9 aa, Homo Sapiens
EDAVKDIRS

SEQ ID NO: 1154190 - protein, 9 aa, Homo Sapiens
PCPNLLPAP

SEQ ID NO: 1154191 - protein, 9 aa, Homo Sapiens
PQHCPPSFL

SEQ ID NO: 1154192 - protein, 9 aa, Homo Sapiens
KDQEAKQDK

SEQ ID NO: 1154193 - protein, 9 aa, Homo Sapiens
ITTPSKKKN

SEQ ID NO: 1154194 - protein, 9 aa, Homo Sapiens
WTPWRKSGS

SEQ ID NO: 1154195 - protein, 9 aa, Homo Sapiens
LFSLRVHSL

SEQ ID NO: 1154196 - protein, 9 aa, Homo Sapiens
NLDDIGVRL
